United States Patent 11,492,591 (UNIVERSAL DONOR STEM CELLS AND RELATED METHODS) - sequence listing, part 8

SEQ ID NO: 231909 - DNA, 20 bp, Artificial
  CRISPR gRNA sequence
ttattgtggtcccgcggggc

SEQ ID NO: 231910 - DNA, 20 bp, Artificial
  CRISPR gRNA sequence
attgtggtcccgcggggcag

SEQ ID NO: 231911 - DNA, 20 bp, Artificial
  CRISPR gRNA sequence
ttgtggtcccgcggggcagg

SEQ ID NO: 231912 - DNA, 20 bp, Artificial
  CRISPR gRNA sequence
cgcggggcaggaggtatgca

SEQ ID NO: 231913 - DNA, 20 bp, Artificial
  CRISPR gRNA sequence
gaggtatgcatggcatacgt

SEQ ID NO: 231914 - DNA, 20 bp, Artificial
  CRISPR gRNA sequence
gtatgcatggcatacgtaag

SEQ ID NO: 231915 - DNA, 20 bp, Artificial
  CRISPR gRNA sequence
atgcatggcatacgtaagca

SEQ ID NO: 231916 - DNA, 20 bp, Artificial
  CRISPR gRNA sequence
gcatggcatacgtaagcaga

SEQ ID NO: 231917 - DNA, 20 bp, Artificial
  CRISPR gRNA sequence
ggcatacgtaagcagagagc

SEQ ID NO: 231918 - DNA, 20 bp, Artificial
  CRISPR gRNA sequence
catacgtaagcagagagccg

SEQ ID NO: 231919 - DNA, 20 bp, Artificial
  CRISPR gRNA sequence
atacgtaagcagagagccgg

SEQ ID NO: 231920 - DNA, 20 bp, Artificial
  CRISPR gRNA sequence
cgtaagcagagagccggagg

SEQ ID NO: 231921 - DNA, 20 bp, Artificial
  CRISPR gRNA sequence
agagagccggaggcagccat

SEQ ID NO: 231922 - DNA, 20 bp, Artificial
  CRISPR gRNA sequence
cggaggcagccatcggcacc

SEQ ID NO: 231923 - DNA, 20 bp, Artificial
  CRISPR gRNA sequence
gcagccatcggcacctagaa

SEQ ID NO: 231924 - DNA, 20 bp, Artificial
  CRISPR gRNA sequence
catcggcacctagaacggtg

SEQ ID NO: 231925 - DNA, 20 bp, Artificial
  CRISPR gRNA sequence
tcggcacctagaacggtgca

SEQ ID NO: 231926 - DNA, 20 bp, Artificial
  CRISPR gRNA sequence
cacctagaacggtgcagagt

SEQ ID NO: 231927 - DNA, 20 bp, Artificial
  CRISPR gRNA sequence
agaacggtgcagagttggcc

SEQ ID NO: 231928 - DNA, 20 bp, Artificial
  CRISPR gRNA sequence
gaacggtgcagagttggccc

SEQ ID NO: 231929 - DNA, 20 bp, Artificial
  CRISPR gRNA sequence
acggtgcagagttggcccag

SEQ ID NO: 231930 - DNA, 20 bp, Artificial
  CRISPR gRNA sequence
gcagagttggcccaggagcg

SEQ ID NO: 231931 - DNA, 20 bp, Artificial
  CRISPR gRNA sequence
gagttggcccaggagcgtgg

SEQ ID NO: 231932 - DNA, 20 bp, Artificial
  CRISPR gRNA sequence
agttggcccaggagcgtggc

SEQ ID NO: 231933 - DNA, 20 bp, Artificial
  CRISPR gRNA sequence
gttggcccaggagcgtggcg

SEQ ID NO: 231934 - DNA, 20 bp, Artificial
  CRISPR gRNA sequence
ggcccaggagcgtggcgggg

SEQ ID NO: 231935 - DNA, 20 bp, Artificial
  CRISPR gRNA sequence
gcccaggagcgtggcggggc

SEQ ID NO: 231936 - DNA, 20 bp, Artificial
  CRISPR gRNA sequence
caggagcgtggcggggcagg

SEQ ID NO: 231937 - DNA, 20 bp, Artificial
  CRISPR gRNA sequence
ctgcacctgccctgctcgcc

SEQ ID NO: 231938 - DNA, 20 bp, Artificial
  CRISPR gRNA sequence
cacctgccctgctcgcccag

SEQ ID NO: 231939 - DNA, 20 bp, Artificial
  CRISPR gRNA sequence
tgctcgcccagcagaccctc

SEQ ID NO: 231940 - DNA, 20 bp, Artificial
  CRISPR gRNA sequence
gctcgcccagcagaccctcc

SEQ ID NO: 231941 - DNA, 20 bp, Artificial
  CRISPR gRNA sequence
ccagcagaccctccgggctc

SEQ ID NO: 231942 - DNA, 20 bp, Artificial
  CRISPR gRNA sequence
agaccctccgggctccagcc

SEQ ID NO: 231943 - DNA, 20 bp, Artificial
  CRISPR gRNA sequence
ccctccgggctccagcctgg

SEQ ID NO: 231944 - DNA, 20 bp, Artificial
  CRISPR gRNA sequence
cctccgggctccagcctggc

SEQ ID NO: 231945 - DNA, 20 bp, Artificial
  CRISPR gRNA sequence
ctccgggctccagcctggcg

SEQ ID NO: 231946 - DNA, 20 bp, Artificial
  CRISPR gRNA sequence
ggctccagcctggcggggcc

SEQ ID NO: 231947 - DNA, 20 bp, Artificial
  CRISPR gRNA sequence
gcggggcccagcgtccacct

SEQ ID NO: 231948 - DNA, 20 bp, Artificial
  CRISPR gRNA sequence
gggcccagcgtccaccttgg

SEQ ID NO: 231949 - DNA, 20 bp, Artificial
  CRISPR gRNA sequence
ggcccagcgtccaccttggt

SEQ ID NO: 231950 - DNA, 20 bp, Artificial
  CRISPR gRNA sequence
agcgtccaccttggtgggcc

SEQ ID NO: 231951 - DNA, 20 bp, Artificial
  CRISPR gRNA sequence
gcgtccaccttggtgggccc

SEQ ID NO: 231952 - DNA, 20 bp, Artificial
  CRISPR gRNA sequence
ccaccttggtgggcccaggt

SEQ ID NO: 231953 - DNA, 20 bp, Artificial
  CRISPR gRNA sequence
ggtgggcccaggtcagatct

SEQ ID NO: 231954 - DNA, 20 bp, Artificial
  CRISPR gRNA sequence
ggcccaggtcagatcttggc

SEQ ID NO: 231955 - DNA, 20 bp, Artificial
  CRISPR gRNA sequence
gcccaggtcagatcttggcc

SEQ ID NO: 231956 - DNA, 20 bp, Artificial
  CRISPR gRNA sequence
cccaggtcagatcttggcca

SEQ ID NO: 231957 - DNA, 20 bp, Artificial
  CRISPR gRNA sequence
aggtcagatcttggccaggg

SEQ ID NO: 231958 - DNA, 20 bp, Artificial
  CRISPR gRNA sequence
gtcagatcttggccagggtg

SEQ ID NO: 231959 - DNA, 20 bp, Artificial
  CRISPR gRNA sequence
agatcttggccagggtggag

SEQ ID NO: 231960 - DNA, 20 bp, Artificial
  CRISPR gRNA sequence
gatcttggccagggtggagt

SEQ ID NO: 231961 - DNA, 20 bp, Artificial
  CRISPR gRNA sequence
ggccagggtggagtgggcgt

SEQ ID NO: 231962 - DNA, 20 bp, Artificial
  CRISPR gRNA sequence
gggcgtcggcctgctcctct

SEQ ID NO: 231963 - DNA, 20 bp, Artificial
  CRISPR gRNA sequence
gtcggcctgctcctcttgga

SEQ ID NO: 231964 - DNA, 20 bp, Artificial
  CRISPR gRNA sequence
tcggcctgctcctcttggat

SEQ ID NO: 231965 - DNA, 20 bp, Artificial
  CRISPR gRNA sequence
cggcctgctcctcttggatg

SEQ ID NO: 231966 - DNA, 20 bp, Artificial
  CRISPR gRNA sequence
ggcctgctcctcttggatgg

SEQ ID NO: 231967 - DNA, 20 bp, Artificial
  CRISPR gRNA sequence
gctcctcttggatgggggtc

SEQ ID NO: 231968 - DNA, 20 bp, Artificial
  CRISPR gRNA sequence
gtccggaaactgcctccccc

SEQ ID NO: 231969 - DNA, 20 bp, Artificial
  CRISPR gRNA sequence
tccggaaactgcctccccct

SEQ ID NO: 231970 - DNA, 20 bp, Artificial
  CRISPR gRNA sequence
ccggaaactgcctccccctg

SEQ ID NO: 231971 - DNA, 20 bp, Artificial
  CRISPR gRNA sequence
ggaaactgcctccccctggg

SEQ ID NO: 231972 - DNA, 20 bp, Artificial
  CRISPR gRNA sequence
gaaactgcctccccctgggg

SEQ ID NO: 231973 - DNA, 20 bp, Artificial
  CRISPR gRNA sequence
cctccccctggggaggaaaa

SEQ ID NO: 231974 - DNA, 20 bp, Artificial
  CRISPR gRNA sequence
ctccccctggggaggaaaaa

SEQ ID NO: 231975 - DNA, 20 bp, Artificial
  CRISPR gRNA sequence
ccccctggggaggaaaaaag

SEQ ID NO: 231976 - DNA, 20 bp, Artificial
  CRISPR gRNA sequence
ccctggggaggaaaaaagga

SEQ ID NO: 231977 - DNA, 20 bp, Artificial
  CRISPR gRNA sequence
gggaggaaaaaaggagagat

SEQ ID NO: 231978 - DNA, 20 bp, Artificial
  CRISPR gRNA sequence
aggaaaaaaggagagattgg

SEQ ID NO: 231979 - DNA, 20 bp, Artificial
  CRISPR gRNA sequence
ggaaaaaaggagagattggt

SEQ ID NO: 231980 - DNA, 20 bp, Artificial
  CRISPR gRNA sequence
aaaaaggagagattggtggg

SEQ ID NO: 231981 - DNA, 20 bp, Artificial
  CRISPR gRNA sequence
aaaaggagagattggtgggt

SEQ ID NO: 231982 - DNA, 20 bp, Artificial
  CRISPR gRNA sequence
ggtgggtgggcctcacccgc

SEQ ID NO: 231983 - DNA, 20 bp, Artificial
  CRISPR gRNA sequence
gtgggtgggcctcacccgcc

SEQ ID NO: 231984 - DNA, 20 bp, Artificial
  CRISPR gRNA sequence
gggtgggcctcacccgccag

SEQ ID NO: 231985 - DNA, 20 bp, Artificial
  CRISPR gRNA sequence
tgggcctcacccgccaggag

SEQ ID NO: 231986 - DNA, 20 bp, Artificial
  CRISPR gRNA sequence
ctcacccgccaggagcagtg

SEQ ID NO: 231987 - DNA, 20 bp, Artificial
  CRISPR gRNA sequence
acccgccaggagcagtgcgg

SEQ ID NO: 231988 - DNA, 20 bp, Artificial
  CRISPR gRNA sequence
cccgccaggagcagtgcggc

SEQ ID NO: 231989 - DNA, 20 bp, Artificial
  CRISPR gRNA sequence
ccgccaggagcagtgcggca

SEQ ID NO: 231990 - DNA, 20 bp, Artificial
  CRISPR gRNA sequence
gagcagtgcggcagggccat

SEQ ID NO: 231991 - DNA, 20 bp, Artificial
  CRISPR gRNA sequence
agcagtgcggcagggccatg

SEQ ID NO: 231992 - DNA, 20 bp, Artificial
  CRISPR gRNA sequence
cagggccatgaggcactcac

SEQ ID NO: 231993 - DNA, 20 bp, Artificial
  CRISPR gRNA sequence
agggccatgaggcactcacc

SEQ ID NO: 231994 - DNA, 20 bp, Artificial
  CRISPR gRNA sequence
gggccatgaggcactcacca

SEQ ID NO: 231995 - DNA, 20 bp, Artificial
  CRISPR gRNA sequence
ggccatgaggcactcaccag

SEQ ID NO: 231996 - DNA, 20 bp, Artificial
  CRISPR gRNA sequence
gccatgaggcactcaccagg

SEQ ID NO: 231997 - DNA, 20 bp, Artificial
  CRISPR gRNA sequence
ggcactcaccagggggcttg

SEQ ID NO: 231998 - DNA, 20 bp, Artificial
  CRISPR gRNA sequence
gcactcaccagggggcttgt

SEQ ID NO: 231999 - DNA, 20 bp, Artificial
  CRISPR gRNA sequence
accagggggcttgtgggcat

SEQ ID NO: 232000 - DNA, 20 bp, Artificial
  CRISPR gRNA sequence
ccagggggcttgtgggcatc

SEQ ID NO: 232001 - DNA, 20 bp, Artificial
  CRISPR gRNA sequence
cagggggcttgtgggcatcg

SEQ ID NO: 232002 - DNA, 20 bp, Artificial
  CRISPR gRNA sequence
agggggcttgtgggcatcgg

SEQ ID NO: 232003 - DNA, 20 bp, Artificial
  CRISPR gRNA sequence
gggggcttgtgggcatcggg

SEQ ID NO: 232004 - DNA, 20 bp, Artificial
  CRISPR gRNA sequence
ggcttgtgggcatcgggggg

SEQ ID NO: 232005 - DNA, 20 bp, Artificial
  CRISPR gRNA sequence
gggcatcggggggcagcctc

SEQ ID NO: 232006 - DNA, 20 bp, Artificial
  CRISPR gRNA sequence
ggggcagcctctggtccctc

SEQ ID NO: 232007 - DNA, 20 bp, Artificial
  CRISPR gRNA sequence
ggcagcctctggtccctccg

SEQ ID NO: 232008 - DNA, 20 bp, Artificial
  CRISPR gRNA sequence
agcctctggtccctccggag

SEQ ID NO: 232009 - DNA, 20 bp, Artificial
  CRISPR gRNA sequence
gcctctggtccctccggagc

SEQ ID NO: 232010 - DNA, 20 bp, Artificial
  CRISPR gRNA sequence
tggtccctccggagcaggta

SEQ ID NO: 232011 - DNA, 20 bp, Artificial
  CRISPR gRNA sequence
ggtccctccggagcaggtac

SEQ ID NO: 232012 - DNA, 20 bp, Artificial
  CRISPR gRNA sequence
gtccctccggagcaggtaca

SEQ ID NO: 232013 - DNA, 20 bp, Artificial
  CRISPR gRNA sequence
ctccggagcaggtacagggc

SEQ ID NO: 232014 - DNA, 20 bp, Artificial
  CRISPR gRNA sequence
cggagcaggtacagggccag

SEQ ID NO: 232015 - DNA, 20 bp, Artificial
  CRISPR gRNA sequence
ggagcaggtacagggccagc

SEQ ID NO: 232016 - DNA, 20 bp, Artificial
  CRISPR gRNA sequence
caggtacagggccagcagga

SEQ ID NO: 232017 - DNA, 20 bp, Artificial
  CRISPR gRNA sequence
tacagggccagcaggatggc

SEQ ID NO: 232018 - DNA, 20 bp, Artificial
  CRISPR gRNA sequence
acagggccagcaggatggcc

SEQ ID NO: 232019 - DNA, 20 bp, Artificial
  CRISPR gRNA sequence
cagggccagcaggatggcca

SEQ ID NO: 232020 - DNA, 20 bp, Artificial
  CRISPR gRNA sequence
agggccagcaggatggccag

SEQ ID NO: 232021 - DNA, 20 bp, Artificial
  CRISPR gRNA sequence
gggccagcaggatggccagg

SEQ ID NO: 232022 - DNA, 20 bp, Artificial
  CRISPR gRNA sequence
agcaggatggccagggggcc

SEQ ID NO: 232023 - DNA, 20 bp, Artificial
  CRISPR gRNA sequence
aggatggccagggggcccag

SEQ ID NO: 232024 - DNA, 20 bp, Artificial
  CRISPR gRNA sequence
gccagggggcccagcagccc

SEQ ID NO: 232025 - DNA, 20 bp, Artificial
  CRISPR gRNA sequence
gggcccagcagccccagcac

SEQ ID NO: 232026 - DNA, 20 bp, Artificial
  CRISPR gRNA sequence
ggcccagcagccccagcacc

SEQ ID NO: 232027 - DNA, 20 bp, Artificial
  CRISPR gRNA sequence
agcagccccagcaccaggcc

SEQ ID NO: 232028 - DNA, 20 bp, Artificial
  CRISPR gRNA sequence
gcagccccagcaccaggccc

SEQ ID NO: 232029 - DNA, 20 bp, Artificial
  CRISPR gRNA sequence
cccagcaccaggcccaggcc

SEQ ID NO: 232030 - DNA, 20 bp, Artificial
  CRISPR gRNA sequence
ccagcaccaggcccaggccc

SEQ ID NO: 232031 - DNA, 20 bp, Artificial
  CRISPR gRNA sequence
caccaggcccaggcccagga

SEQ ID NO: 232032 - DNA, 20 bp, Artificial
  CRISPR gRNA sequence
caggcccaggcccaggatgg

SEQ ID NO: 232033 - DNA, 20 bp, Artificial
  CRISPR gRNA sequence
ccaggatggcggcaaccgca

SEQ ID NO: 232034 - DNA, 20 bp, Artificial
  CRISPR gRNA sequence
ggcggcaaccgcacggcctg

SEQ ID NO: 232035 - DNA, 20 bp, Artificial
  CRISPR gRNA sequence
gcggcaaccgcacggcctgc

SEQ ID NO: 232036 - DNA, 20 bp, Artificial
  CRISPR gRNA sequence
gcaaccgcacggcctgcagg

SEQ ID NO: 232037 - DNA, 20 bp, Artificial
  CRISPR gRNA sequence
caaccgcacggcctgcagga

SEQ ID NO: 232038 - DNA, 20 bp, Artificial
  CRISPR gRNA sequence
aaccgcacggcctgcaggaa

SEQ ID NO: 232039 - DNA, 20 bp, Artificial
  CRISPR gRNA sequence
accgcacggcctgcaggaag

SEQ ID NO: 232040 - DNA, 20 bp, Artificial
  CRISPR gRNA sequence
gcctgcaggaaggggtctgc

SEQ ID NO: 232041 - DNA, 20 bp, Artificial
  CRISPR gRNA sequence
cctgcaggaaggggtctgct

SEQ ID NO: 232042 - DNA, 20 bp, Artificial
  CRISPR gRNA sequence
gcaggaaggggtctgctggg

SEQ ID NO: 232043 - DNA, 20 bp, Artificial
  CRISPR gRNA sequence
caggaaggggtctgctgggt

SEQ ID NO: 232044 - DNA, 20 bp, Artificial
  CRISPR gRNA sequence
aggaaggggtctgctgggtg

SEQ ID NO: 232045 - DNA, 20 bp, Artificial
  CRISPR gRNA sequence
ggtctgctgggtggggtcca

SEQ ID NO: 232046 - DNA, 20 bp, Artificial
  CRISPR gRNA sequence
gtctgctgggtggggtccac

SEQ ID NO: 232047 - DNA, 20 bp, Artificial
  CRISPR gRNA sequence
ctgctgggtggggtccacag

SEQ ID NO: 232048 - DNA, 20 bp, Artificial
  CRISPR gRNA sequence
tgctgggtggggtccacagg

SEQ ID NO: 232049 - DNA, 20 bp, Artificial
  CRISPR gRNA sequence
gctgggtggggtccacagga

SEQ ID NO: 232050 - DNA, 20 bp, Artificial
  CRISPR gRNA sequence
ctgggtggggtccacaggag

SEQ ID NO: 232051 - DNA, 20 bp, Artificial
  CRISPR gRNA sequence
cgccctccccttctcctatt

SEQ ID NO: 232052 - DNA, 20 bp, Artificial
  CRISPR gRNA sequence
gccctccccttctcctattc

SEQ ID NO: 232053 - DNA, 20 bp, Artificial
  CRISPR gRNA sequence
tccccttctcctattcgggt

SEQ ID NO: 232054 - DNA, 20 bp, Artificial
  CRISPR gRNA sequence
ccccttctcctattcgggtt

SEQ ID NO: 232055 - DNA, 20 bp, Artificial
  CRISPR gRNA sequence
cccttctcctattcgggttg

SEQ ID NO: 232056 - DNA, 20 bp, Artificial
  CRISPR gRNA sequence
ccttctcctattcgggttgg

SEQ ID NO: 232057 - DNA, 20 bp, Artificial
  CRISPR gRNA sequence
attcgggttgggggccccgc

SEQ ID NO: 232058 - DNA, 20 bp, Artificial
  CRISPR gRNA sequence
ttcgggttgggggccccgct

SEQ ID NO: 232059 - DNA, 20 bp, Artificial
  CRISPR gRNA sequence
ggttgggggccccgctgggc

SEQ ID NO: 232060 - DNA, 20 bp, Artificial
  CRISPR gRNA sequence
gttgggggccccgctgggct

SEQ ID NO: 232061 - DNA, 20 bp, Artificial
  CRISPR gRNA sequence
ggggccccgctgggctgggc

SEQ ID NO: 232062 - DNA, 20 bp, Artificial
  CRISPR gRNA sequence
gggccccgctgggctgggcc

SEQ ID NO: 232063 - DNA, 20 bp, Artificial
  CRISPR gRNA sequence
gggccaggcgcccttacccc

SEQ ID NO: 232064 - DNA, 20 bp, Artificial
  CRISPR gRNA sequence
ggccaggcgcccttaccccc

SEQ ID NO: 232065 - DNA, 20 bp, Artificial
  CRISPR gRNA sequence
gccaggcgcccttacccccg

SEQ ID NO: 232066 - DNA, 20 bp, Artificial
  CRISPR gRNA sequence
cttacccccggggacctcca

SEQ ID NO: 232067 - DNA, 20 bp, Artificial
  CRISPR gRNA sequence
ttacccccggggacctccac

SEQ ID NO: 232068 - DNA, 20 bp, Artificial
  CRISPR gRNA sequence
ccccggggacctccacgggc

SEQ ID NO: 232069 - DNA, 20 bp, Artificial
  CRISPR gRNA sequence
cccggggacctccacgggcc

SEQ ID NO: 232070 - DNA, 20 bp, Artificial
  CRISPR gRNA sequence
ggggacctccacgggccggg

SEQ ID NO: 232071 - DNA, 20 bp, Artificial
  CRISPR gRNA sequence
ggacctccacgggccgggtg

SEQ ID NO: 232072 - DNA, 20 bp, Artificial
  CRISPR gRNA sequence
gacctccacgggccgggtgg

SEQ ID NO: 232073 - DNA, 20 bp, Artificial
  CRISPR gRNA sequence
acctccacgggccgggtgga

SEQ ID NO: 232074 - DNA, 20 bp, Artificial
  CRISPR gRNA sequence
gccgggtggagggtccctgt

SEQ ID NO: 232075 - DNA, 20 bp, Artificial
  CRISPR gRNA sequence
ccgggtggagggtccctgtg

SEQ ID NO: 232076 - DNA, 20 bp, Artificial
  CRISPR gRNA sequence
ggagggtccctgtgaggttc

SEQ ID NO: 232077 - DNA, 20 bp, Artificial
  CRISPR gRNA sequence
gagggtccctgtgaggttct

SEQ ID NO: 232078 - DNA, 20 bp, Artificial
  CRISPR gRNA sequence
gtccctgtgaggttctgggc

SEQ ID NO: 232079 - DNA, 20 bp, Artificial
  CRISPR gRNA sequence
tccctgtgaggttctgggcc

SEQ ID NO: 232080 - DNA, 20 bp, Artificial
  CRISPR gRNA sequence
tgaggttctgggccaggctt

SEQ ID NO: 232081 - DNA, 20 bp, Artificial
  CRISPR gRNA sequence
ggttctgggccaggcttcag

SEQ ID NO: 232082 - DNA, 20 bp, Artificial
  CRISPR gRNA sequence
gttctgggccaggcttcagt

SEQ ID NO: 232083 - DNA, 20 bp, Artificial
  CRISPR gRNA sequence
tgggccaggcttcagtgggc

SEQ ID NO: 232084 - DNA, 20 bp, Artificial
  CRISPR gRNA sequence
ccaggcttcagtgggctgga

SEQ ID NO: 232085 - DNA, 20 bp, Artificial
  CRISPR gRNA sequence
ttcagtgggctggacagtga

SEQ ID NO: 232086 - DNA, 20 bp, Artificial
  CRISPR gRNA sequence
tcagtgggctggacagtgat

SEQ ID NO: 232087 - DNA, 20 bp, Artificial
  CRISPR gRNA sequence
gggctggacagtgatgggcc

SEQ ID NO: 232088 - DNA, 20 bp, Artificial
  CRISPR gRNA sequence
tggacagtgatgggcctggc

SEQ ID NO: 232089 - DNA, 20 bp, Artificial
  CRISPR gRNA sequence
ggacagtgatgggcctggcc

SEQ ID NO: 232090 - DNA, 20 bp, Artificial
  CRISPR gRNA sequence
gacagtgatgggcctggccg

SEQ ID NO: 232091 - DNA, 20 bp, Artificial
  CRISPR gRNA sequence
acagtgatgggcctggccgg

SEQ ID NO: 232092 - DNA, 20 bp, Artificial
  CRISPR gRNA sequence
cagtgatgggcctggccggg

SEQ ID NO: 232093 - DNA, 20 bp, Artificial
  CRISPR gRNA sequence
tgggcctggccggggggccc

SEQ ID NO: 232094 - DNA, 20 bp, Artificial
  CRISPR gRNA sequence
gggcctggccggggggccct

SEQ ID NO: 232095 - DNA, 20 bp, Artificial
  CRISPR gRNA sequence
ccggggggccctgggtctcc

SEQ ID NO: 232096 - DNA, 20 bp, Artificial
  CRISPR gRNA sequence
cggggggccctgggtctcct

SEQ ID NO: 232097 - DNA, 20 bp, Artificial
  CRISPR gRNA sequence
ggggggccctgggtctcctg

SEQ ID NO: 232098 - DNA, 20 bp, Artificial
  CRISPR gRNA sequence
ctgggtctcctggggctgcg

SEQ ID NO: 232099 - DNA, 20 bp, Artificial
  CRISPR gRNA sequence
gtctcctggggctgcgtggc

SEQ ID NO: 232100 - DNA, 20 bp, Artificial
  CRISPR gRNA sequence
tctcctggggctgcgtggct

SEQ ID NO: 232101 - DNA, 20 bp, Artificial
  CRISPR gRNA sequence
ctcctggggctgcgtggctg

SEQ ID NO: 232102 - DNA, 20 bp, Artificial
  CRISPR gRNA sequence
tcctggggctgcgtggctgg

SEQ ID NO: 232103 - DNA, 20 bp, Artificial
  CRISPR gRNA sequence
cctggggctgcgtggctggg

SEQ ID NO: 232104 - DNA, 20 bp, Artificial
  CRISPR gRNA sequence
ctggggggtccctgtcctca

SEQ ID NO: 232105 - DNA, 20 bp, Artificial
  CRISPR gRNA sequence
tgtcctcacagattgcgtcc

SEQ ID NO: 232106 - DNA, 20 bp, Artificial
  CRISPR gRNA sequence
gattgcgtccgagctattgc

SEQ ID NO: 232107 - DNA, 20 bp, Artificial
  CRISPR gRNA sequence
gcgtccgagctattgctggc

SEQ ID NO: 232108 - DNA, 20 bp, Artificial
  CRISPR gRNA sequence
gagctattgctggccggctg

SEQ ID NO: 232109 - DNA, 20 bp, Artificial
  CRISPR gRNA sequence
agctattgctggccggctgc

SEQ ID NO: 232110 - DNA, 20 bp, Artificial
  CRISPR gRNA sequence
gctattgctggccggctgca

SEQ ID NO: 232111 - DNA, 20 bp, Artificial
  CRISPR gRNA sequence
cggctgcagggtgtgcttcc

SEQ ID NO: 232112 - DNA, 20 bp, Artificial
  CRISPR gRNA sequence
gcagggtgtgcttcccagcc

SEQ ID NO: 232113 - DNA, 20 bp, Artificial
  CRISPR gRNA sequence
cagggtgtgcttcccagcca

SEQ ID NO: 232114 - DNA, 20 bp, Artificial
  CRISPR gRNA sequence
tgtgcttcccagccaaggtg

SEQ ID NO: 232115 - DNA, 20 bp, Artificial
  CRISPR gRNA sequence
cccagccaaggtgcagctgt

SEQ ID NO: 232116 - DNA, 20 bp, Artificial
  CRISPR gRNA sequence
ccagccaaggtgcagctgtt

SEQ ID NO: 232117 - DNA, 20 bp, Artificial
  CRISPR gRNA sequence
cagccaaggtgcagctgttg

SEQ ID NO: 232118 - DNA, 20 bp, Artificial
  CRISPR gRNA sequence
aaggtgcagctgttggggaa

SEQ ID NO: 232119 - DNA, 20 bp, Artificial
  CRISPR gRNA sequence
aggtgcagctgttggggaac

SEQ ID NO: 232120 - DNA, 20 bp, Artificial
  CRISPR gRNA sequence
gtgcagctgttggggaacag

SEQ ID NO: 232121 - DNA, 20 bp, Artificial
  CRISPR gRNA sequence
tgcagctgttggggaacagg

SEQ ID NO: 232122 - DNA, 20 bp, Artificial
  CRISPR gRNA sequence
ggggaacaggaggtgttgct

SEQ ID NO: 232123 - DNA, 20 bp, Artificial
  CRISPR gRNA sequence
gggaacaggaggtgttgctc

SEQ ID NO: 232124 - DNA, 20 bp, Artificial
  CRISPR gRNA sequence
acaggaggtgttgctcaggc

SEQ ID NO: 232125 - DNA, 20 bp, Artificial
  CRISPR gRNA sequence
tgctcaggccagaaaccccc

SEQ ID NO: 232126 - DNA, 20 bp, Artificial
  CRISPR gRNA sequence
gctcaggccagaaaccccct

SEQ ID NO: 232127 - DNA, 20 bp, Artificial
  CRISPR gRNA sequence
gccagaaaccccctgggacc

SEQ ID NO: 232128 - DNA, 20 bp, Artificial
  CRISPR gRNA sequence
ccagaaaccccctgggaccc

SEQ ID NO: 232129 - DNA, 20 bp, Artificial
  CRISPR gRNA sequence
agaaaccccctgggacccgg

SEQ ID NO: 232130 - DNA, 20 bp, Artificial
  CRISPR gRNA sequence
cccctgggacccgggagatg

SEQ ID NO: 232131 - DNA, 20 bp, Artificial
  CRISPR gRNA sequence
ctgggacccgggagatgcgg

SEQ ID NO: 232132 - DNA, 20 bp, Artificial
  CRISPR gRNA sequence
tgggacccgggagatgcggt

SEQ ID NO: 232133 - DNA, 20 bp, Artificial
  CRISPR gRNA sequence
gggacccgggagatgcggtg

SEQ ID NO: 232134 - DNA, 20 bp, Artificial
  CRISPR gRNA sequence
gggagatgcggtggggataa

SEQ ID NO: 232135 - DNA, 20 bp, Artificial
  CRISPR gRNA sequence
ggagatgcggtggggataac

SEQ ID NO: 232136 - DNA, 20 bp, Artificial
  CRISPR gRNA sequence
gagatgcggtggggataaca

SEQ ID NO: 232137 - DNA, 20 bp, Artificial
  CRISPR gRNA sequence
ggggataacagggtccacgc

SEQ ID NO: 232138 - DNA, 20 bp, Artificial
  CRISPR gRNA sequence
ataacagggtccacgctggc

SEQ ID NO: 232139 - DNA, 20 bp, Artificial
  CRISPR gRNA sequence
gggtccacgctggccagcca

SEQ ID NO: 232140 - DNA, 20 bp, Artificial
  CRISPR gRNA sequence
ggtccacgctggccagccac

SEQ ID NO: 232141 - DNA, 20 bp, Artificial
  CRISPR gRNA sequence
ccacgctggccagccacagg

SEQ ID NO: 232142 - DNA, 20 bp, Artificial
  CRISPR gRNA sequence
gccacaggcagcatctacca

SEQ ID NO: 232143 - DNA, 20 bp, Artificial
  CRISPR gRNA sequence
gcagcatctaccacagacac

SEQ ID NO: 232144 - DNA, 20 bp, Artificial
  CRISPR gRNA sequence
cagcatctaccacagacacc

SEQ ID NO: 232145 - DNA, 20 bp, Artificial
  CRISPR gRNA sequence
atctaccacagacaccaggc

SEQ ID NO: 232146 - DNA, 20 bp, Artificial
  CRISPR gRNA sequence
cacagacaccaggccagtga

SEQ ID NO: 232147 - DNA, 20 bp, Artificial
  CRISPR gRNA sequence
acaccaggccagtgacagcc

SEQ ID NO: 232148 - DNA, 20 bp, Artificial
  CRISPR gRNA sequence
caccaggccagtgacagcca

SEQ ID NO: 232149 - DNA, 20 bp, Artificial
  CRISPR gRNA sequence
tgacagccaaggacgctgcc

SEQ ID NO: 232150 - DNA, 20 bp, Artificial
  CRISPR gRNA sequence
ccagccccacgtgcccccca

SEQ ID NO: 232151 - DNA, 20 bp, Artificial
  CRISPR gRNA sequence
cagccccacgtgccccccac

SEQ ID NO: 232152 - DNA, 20 bp, Artificial
  CRISPR gRNA sequence
agccccacgtgccccccaca

SEQ ID NO: 232153 - DNA, 20 bp, Artificial
  CRISPR gRNA sequence
gccccacgtgccccccacag

SEQ ID NO: 232154 - DNA, 20 bp, Artificial
  CRISPR gRNA sequence
tgccccccacaggggcctcc

SEQ ID NO: 232155 - DNA, 20 bp, Artificial
  CRISPR gRNA sequence
gccccccacaggggcctcca

SEQ ID NO: 232156 - DNA, 20 bp, Artificial
  CRISPR gRNA sequence
cccacatctacaccccccac

SEQ ID NO: 232157 - DNA, 20 bp, Artificial
  CRISPR gRNA sequence
acctccctgtcctgtgcccc

SEQ ID NO: 232158 - DNA, 20 bp, Artificial
  CRISPR gRNA sequence
cctccctgtcctgtgccccc

SEQ ID NO: 232159 - DNA, 20 bp, Artificial
  CRISPR gRNA sequence
ctccctgtcctgtgccccca

SEQ ID NO: 232160 - DNA, 20 bp, Artificial
  CRISPR gRNA sequence
cctgtgcccccagggcctcc

SEQ ID NO: 232161 - DNA, 20 bp, Artificial
  CRISPR gRNA sequence
cccccagggcctcccagctg

SEQ ID NO: 232162 - DNA, 20 bp, Artificial
  CRISPR gRNA sequence
cccagggcctcccagctgcg

SEQ ID NO: 232163 - DNA, 20 bp, Artificial
  CRISPR gRNA sequence
ccagggcctcccagctgcgg

SEQ ID NO: 232164 - DNA, 20 bp, Artificial
  CRISPR gRNA sequence
cagggcctcccagctgcgga

SEQ ID NO: 232165 - DNA, 20 bp, Artificial
  CRISPR gRNA sequence
gcctcccagctgcggagggt

SEQ ID NO: 232166 - DNA, 20 bp, Artificial
  CRISPR gRNA sequence
cctcccagctgcggagggtg

SEQ ID NO: 232167 - DNA, 20 bp, Artificial
  CRISPR gRNA sequence
ctcccagctgcggagggtga

SEQ ID NO: 232168 - DNA, 20 bp, Artificial
  CRISPR gRNA sequence
gggtgagggtcccacacacc

SEQ ID NO: 232169 - DNA, 20 bp, Artificial
  CRISPR gRNA sequence
cacacacccagctccaccca

SEQ ID NO: 232170 - DNA, 20 bp, Artificial
  CRISPR gRNA sequence
acacacccagctccacccac

SEQ ID NO: 232171 - DNA, 20 bp, Artificial
  CRISPR gRNA sequence
cacacccagctccacccaca

SEQ ID NO: 232172 - DNA, 20 bp, Artificial
  CRISPR gRNA sequence
cccagctccacccacaggga

SEQ ID NO: 232173 - DNA, 20 bp, Artificial
  CRISPR gRNA sequence
ccagctccacccacagggaa

SEQ ID NO: 232174 - DNA, 20 bp, Artificial
  CRISPR gRNA sequence
ccacagggaaaggctgcccc

SEQ ID NO: 232175 - DNA, 20 bp, Artificial
  CRISPR gRNA sequence
cacagggaaaggctgccccc

SEQ ID NO: 232176 - DNA, 20 bp, Artificial
  CRISPR gRNA sequence
agggaaaggctgcccccagg

SEQ ID NO: 232177 - DNA, 20 bp, Artificial
  CRISPR gRNA sequence
gaaaggctgcccccaggcag

SEQ ID NO: 232178 - DNA, 20 bp, Artificial
  CRISPR gRNA sequence
gcagcttcctgctccccaac

SEQ ID NO: 232179 - DNA, 20 bp, Artificial
  CRISPR gRNA sequence
cagcttcctgctccccaacc

SEQ ID NO: 232180 - DNA, 20 bp, Artificial
  CRISPR gRNA sequence
tcctgctccccaaccaggtc

SEQ ID NO: 232181 - DNA, 20 bp, Artificial
  CRISPR gRNA sequence
cccaaccaggtccagccaca

SEQ ID NO: 232182 - DNA, 20 bp, Artificial
  CRISPR gRNA sequence
accaggtccagccacatagc

SEQ ID NO: 232183 - DNA, 20 bp, Artificial
  CRISPR gRNA sequence
ccaggtccagccacatagcc

SEQ ID NO: 232184 - DNA, 20 bp, Artificial
  CRISPR gRNA sequence
cagccacatagccaggcccc

SEQ ID NO: 232185 - DNA, 20 bp, Artificial
  CRISPR gRNA sequence
agccacatagccaggccccc

SEQ ID NO: 232186 - DNA, 20 bp, Artificial
  CRISPR gRNA sequence
gccacatagccaggccccca

SEQ ID NO: 232187 - DNA, 20 bp, Artificial
  CRISPR gRNA sequence
agccaggcccccagggccac

SEQ ID NO: 232188 - DNA, 20 bp, Artificial
  CRISPR gRNA sequence
ccccaccccacctgcccccc

SEQ ID NO: 232189 - DNA, 20 bp, Artificial
  CRISPR gRNA sequence
cctgcccccccagcccctcc

SEQ ID NO: 232190 - DNA, 20 bp, Artificial
  CRISPR gRNA sequence
cccagcccctcccagctccc

SEQ ID NO: 232191 - DNA, 20 bp, Artificial
  CRISPR gRNA sequence
taaccaccccaacccccccc

SEQ ID NO: 232192 - DNA, 20 bp, Artificial
  CRISPR gRNA sequence
aacccccccccagcccctcc

SEQ ID NO: 232193 - DNA, 20 bp, Artificial
  CRISPR gRNA sequence
ccccagcccctcccagcccc

SEQ ID NO: 232194 - DNA, 20 bp, Artificial
  CRISPR gRNA sequence
agcccctcccagcccctggc

SEQ ID NO: 232195 - DNA, 20 bp, Artificial
  CRISPR gRNA sequence
gcccctcccagcccctggcc

SEQ ID NO: 232196 - DNA, 20 bp, Artificial
  CRISPR gRNA sequence
ccctggccaggcccctcact

SEQ ID NO: 232197 - DNA, 20 bp, Artificial
  CRISPR gRNA sequence
gccaggcccctcacttggtc

SEQ ID NO: 232198 - DNA, 20 bp, Artificial
  CRISPR gRNA sequence
ccaggcccctcacttggtcc

SEQ ID NO: 232199 - DNA, 20 bp, Artificial
  CRISPR gRNA sequence
caggcccctcacttggtcca

SEQ ID NO: 232200 - DNA, 20 bp, Artificial
  CRISPR gRNA sequence
ctcacttggtccagggcttg

SEQ ID NO: 232201 - DNA, 20 bp, Artificial
  CRISPR gRNA sequence
tcacttggtccagggcttgc

SEQ ID NO: 232202 - DNA, 20 bp, Artificial
  CRISPR gRNA sequence
tggtccagggcttgcaggcc

SEQ ID NO: 232203 - DNA, 20 bp, Artificial
  CRISPR gRNA sequence
ttgcaggcctggttgtcgcc

SEQ ID NO: 232204 - DNA, 20 bp, Artificial
  CRISPR gRNA sequence
tgcaggcctggttgtcgcct

SEQ ID NO: 232205 - DNA, 20 bp, Artificial
  CRISPR gRNA sequence
gcaggcctggttgtcgcctg

SEQ ID NO: 232206 - DNA, 20 bp, Artificial
  CRISPR gRNA sequence
aggcctggttgtcgcctggg

SEQ ID NO: 232207 - DNA, 20 bp, Artificial
  CRISPR gRNA sequence
cctggttgtcgcctggggag

SEQ ID NO: 232208 - DNA, 20 bp, Artificial
  CRISPR gRNA sequence
tcgcctggggagaagtgccc

SEQ ID NO: 232209 - DNA, 20 bp, Artificial
  CRISPR gRNA sequence
gcctggggagaagtgccctg

SEQ ID NO: 232210 - DNA, 20 bp, Artificial
  CRISPR gRNA sequence
cctggggagaagtgccctgg

SEQ ID NO: 232211 - DNA, 20 bp, Artificial
  CRISPR gRNA sequence
ctggggagaagtgccctgga

SEQ ID NO: 232212 - DNA, 20 bp, Artificial
  CRISPR gRNA sequence
gggagaagtgccctggaggg

SEQ ID NO: 232213 - DNA, 20 bp, Artificial
  CRISPR gRNA sequence
ggagaagtgccctggagggc

SEQ ID NO: 232214 - DNA, 20 bp, Artificial
  CRISPR gRNA sequence
gagaagtgccctggagggca

SEQ ID NO: 232215 - DNA, 20 bp, Artificial
  CRISPR gRNA sequence
agaagtgccctggagggcag

SEQ ID NO: 232216 - DNA, 20 bp, Artificial
  CRISPR gRNA sequence
gaagtgccctggagggcagg

SEQ ID NO: 232217 - DNA, 20 bp, Artificial
  CRISPR gRNA sequence
gccctggagggcagggggca

SEQ ID NO: 232218 - DNA, 20 bp, Artificial
  CRISPR gRNA sequence
agggggcacagtctgcaaca

SEQ ID NO: 232219 - DNA, 20 bp, Artificial
  CRISPR gRNA sequence
ggcacagtctgcaacaaaga

SEQ ID NO: 232220 - DNA, 20 bp, Artificial
  CRISPR gRNA sequence
gcacagtctgcaacaaagat

SEQ ID NO: 232221 - DNA, 20 bp, Artificial
  CRISPR gRNA sequence
cacagtctgcaacaaagata

SEQ ID NO: 232222 - DNA, 20 bp, Artificial
  CRISPR gRNA sequence
agtctgcaacaaagataggg

SEQ ID NO: 232223 - DNA, 20 bp, Artificial
  CRISPR gRNA sequence
tgcaacaaagatagggtggt

SEQ ID NO: 232224 - DNA, 20 bp, Artificial
  CRISPR gRNA sequence
gcaacaaagatagggtggtc

SEQ ID NO: 232225 - DNA, 20 bp, Artificial
  CRISPR gRNA sequence
caacaaagatagggtggtca

SEQ ID NO: 232226 - DNA, 20 bp, Artificial
  CRISPR gRNA sequence
aacaaagatagggtggtcag

SEQ ID NO: 232227 - DNA, 20 bp, Artificial
  CRISPR gRNA sequence
gggtggtcaggggctgccca

SEQ ID NO: 232228 - DNA, 20 bp, Artificial
  CRISPR gRNA sequence
ggtggtcaggggctgcccac

SEQ ID NO: 232229 - DNA, 20 bp, Artificial
  CRISPR gRNA sequence
caggggctgcccacaggccc

SEQ ID NO: 232230 - DNA, 20 bp, Artificial
  CRISPR gRNA sequence
aggggctgcccacaggcccc

SEQ ID NO: 232231 - DNA, 20 bp, Artificial
  CRISPR gRNA sequence
tgcccacaggccccgggtgc

SEQ ID NO: 232232 - DNA, 20 bp, Artificial
  CRISPR gRNA sequence
gcccacaggccccgggtgct

SEQ ID NO: 232233 - DNA, 20 bp, Artificial
  CRISPR gRNA sequence
cccacaggccccgggtgctg

SEQ ID NO: 232234 - DNA, 20 bp, Artificial
  CRISPR gRNA sequence
ggccccgggtgctggggaca

SEQ ID NO: 232235 - DNA, 20 bp, Artificial
  CRISPR gRNA sequence
gccccgggtgctggggacat

SEQ ID NO: 232236 - DNA, 20 bp, Artificial
  CRISPR gRNA sequence
ccccgggtgctggggacatg

SEQ ID NO: 232237 - DNA, 20 bp, Artificial
  CRISPR gRNA sequence
cgggtgctggggacatgggg

SEQ ID NO: 232238 - DNA, 20 bp, Artificial
  CRISPR gRNA sequence
ggtgctggggacatggggca

SEQ ID NO: 232239 - DNA, 20 bp, Artificial
  CRISPR gRNA sequence
gggacatggggcagagcctg

SEQ ID NO: 232240 - DNA, 20 bp, Artificial
  CRISPR gRNA sequence
ggacatggggcagagcctgt

SEQ ID NO: 232241 - DNA, 20 bp, Artificial
  CRISPR gRNA sequence
gacatggggcagagcctgtg

SEQ ID NO: 232242 - DNA, 20 bp, Artificial
  CRISPR gRNA sequence
atggggcagagcctgtgggg

SEQ ID NO: 232243 - DNA, 20 bp, Artificial
  CRISPR gRNA sequence
tggggcagagcctgtggggc

SEQ ID NO: 232244 - DNA, 20 bp, Artificial
  CRISPR gRNA sequence
gggcaggcacttgcccccca

SEQ ID NO: 232245 - DNA, 20 bp, Artificial
  CRISPR gRNA sequence
aggcacttgccccccatggc

SEQ ID NO: 232246 - DNA, 20 bp, Artificial
  CRISPR gRNA sequence
ggcacttgccccccatggct

SEQ ID NO: 232247 - DNA, 20 bp, Artificial
  CRISPR gRNA sequence
acttgccccccatggctggg

SEQ ID NO: 232248 - DNA, 20 bp, Artificial
  CRISPR gRNA sequence
tgccccccatggctgggtgg

SEQ ID NO: 232249 - DNA, 20 bp, Artificial
  CRISPR gRNA sequence
gccccccatggctgggtggt

SEQ ID NO: 232250 - DNA, 20 bp, Artificial
  CRISPR gRNA sequence
ccatggctgggtggtgggtt

SEQ ID NO: 232251 - DNA, 20 bp, Artificial
  CRISPR gRNA sequence
tgggtggtgggtttggcctc

SEQ ID NO: 232252 - DNA, 20 bp, Artificial
  CRISPR gRNA sequence
gtggtgggtttggcctctgg

SEQ ID NO: 232253 - DNA, 20 bp, Artificial
  CRISPR gRNA sequence
ccctgcccacatcccacccg

SEQ ID NO: 232254 - DNA, 20 bp, Artificial
  CRISPR gRNA sequence
cctgcccacatcccacccgt

SEQ ID NO: 232255 - DNA, 20 bp, Artificial
  CRISPR gRNA sequence
cccacccgtgggccctgacc

SEQ ID NO: 232256 - DNA, 20 bp, Artificial
  CRISPR gRNA sequence
ccacccgtgggccctgaccc

SEQ ID NO: 232257 - DNA, 20 bp, Artificial
  CRISPR gRNA sequence
acccgtgggccctgacccgg

SEQ ID NO: 232258 - DNA, 20 bp, Artificial
  CRISPR gRNA sequence
tgggccctgacccgggagct

SEQ ID NO: 232259 - DNA, 20 bp, Artificial
  CRISPR gRNA sequence
tgacccgggagctcggtctt

SEQ ID NO: 232260 - DNA, 20 bp, Artificial
  CRISPR gRNA sequence
gacccgggagctcggtcttg

SEQ ID NO: 232261 - DNA, 20 bp, Artificial
  CRISPR gRNA sequence
gagctcggtcttgaggatgc

SEQ ID NO: 232262 - DNA, 20 bp, Artificial
  CRISPR gRNA sequence
gctcggtcttgaggatgcca

SEQ ID NO: 232263 - DNA, 20 bp, Artificial
  CRISPR gRNA sequence
ctcggtcttgaggatgccag

SEQ ID NO: 232264 - DNA, 20 bp, Artificial
  CRISPR gRNA sequence
cggtcttgaggatgccagag

SEQ ID NO: 232265 - DNA, 20 bp, Artificial
  CRISPR gRNA sequence
ggtcttgaggatgccagagg

SEQ ID NO: 232266 - DNA, 20 bp, Artificial
  CRISPR gRNA sequence
gaggatgccagaggaggcac

SEQ ID NO: 232267 - DNA, 20 bp, Artificial
  CRISPR gRNA sequence
gatgccagaggaggcaccgg

SEQ ID NO: 232268 - DNA, 20 bp, Artificial
  CRISPR gRNA sequence
atgccagaggaggcaccggt

SEQ ID NO: 232269 - DNA, 20 bp, Artificial
  CRISPR gRNA sequence
tgccagaggaggcaccggtg

SEQ ID NO: 232270 - DNA, 20 bp, Artificial
  CRISPR gRNA sequence
agaggaggcaccggtggggc

SEQ ID NO: 232271 - DNA, 20 bp, Artificial
  CRISPR gRNA sequence
gaggaggcaccggtggggcc

SEQ ID NO: 232272 - DNA, 20 bp, Artificial
  CRISPR gRNA sequence
ccggtggggccaggtccctg

SEQ ID NO: 232273 - DNA, 20 bp, Artificial
  CRISPR gRNA sequence
ggccaggtccctgcggccca

SEQ ID NO: 232274 - DNA, 20 bp, Artificial
  CRISPR gRNA sequence
cccacggcccatctgcgtca

SEQ ID NO: 232275 - DNA, 20 bp, Artificial
  CRISPR gRNA sequence
cggcccatctgcgtcacaga

SEQ ID NO: 232276 - DNA, 20 bp, Artificial
  CRISPR gRNA sequence
ctatgcacacccccaaccgc

SEQ ID NO: 232277 - DNA, 20 bp, Artificial
  CRISPR gRNA sequence
acacccccaaccgccggccg

SEQ ID NO: 232278 - DNA, 20 bp, Artificial
  CRISPR gRNA sequence
aaccgccggccgcagccacc

SEQ ID NO: 232279 - DNA, 20 bp, Artificial
  CRISPR gRNA sequence
gccaccgagctcaccaactc

SEQ ID NO: 232280 - DNA, 20 bp, Artificial
  CRISPR gRNA sequence
ccaccgagctcaccaactcc

SEQ ID NO: 232281 - DNA, 20 bp, Artificial
  CRISPR gRNA sequence
gctcaccaactccaggcttg

SEQ ID NO: 232282 - DNA, 20 bp, Artificial
  CRISPR gRNA sequence
actccaggcttgtagctgtc

SEQ ID NO: 232283 - DNA, 20 bp, Artificial
  CRISPR gRNA sequence
ctccaggcttgtagctgtcc

SEQ ID NO: 232284 - DNA, 20 bp, Artificial
  CRISPR gRNA sequence
tccaggcttgtagctgtcca

SEQ ID NO: 232285 - DNA, 20 bp, Artificial
  CRISPR gRNA sequence
ccaggcttgtagctgtccag

SEQ ID NO: 232286 - DNA, 20 bp, Artificial
  CRISPR gRNA sequence
gcttgtagctgtccaggggc

SEQ ID NO: 232287 - DNA, 20 bp, Artificial
  CRISPR gRNA sequence
cttgtagctgtccaggggct

SEQ ID NO: 232288 - DNA, 20 bp, Artificial
  CRISPR gRNA sequence
ccaggggctgggtgcccgcc

SEQ ID NO: 232289 - DNA, 20 bp, Artificial
  CRISPR gRNA sequence
ggggctgggtgcccgcccgg

SEQ ID NO: 232290 - DNA, 20 bp, Artificial
  CRISPR gRNA sequence
gctgggtgcccgcccggcag

SEQ ID NO: 232291 - DNA, 20 bp, Artificial
  CRISPR gRNA sequence
gggtgcccgcccggcagcgg

SEQ ID NO: 232292 - DNA, 20 bp, Artificial
  CRISPR gRNA sequence
gcggcagactgtgtcctgtg

SEQ ID NO: 232293 - DNA, 20 bp, Artificial
  CRISPR gRNA sequence
gtgtcctgtgtggccgtgca

SEQ ID NO: 232294 - DNA, 20 bp, Artificial
  CRISPR gRNA sequence
tccgctcactcccacttcct

SEQ ID NO: 232295 - DNA, 20 bp, Artificial
  CRISPR gRNA sequence
gctcactcccacttcctgag

SEQ ID NO: 232296 - DNA, 20 bp, Artificial
  CRISPR gRNA sequence
ctcactcccacttcctgagc

SEQ ID NO: 232297 - DNA, 20 bp, Artificial
  CRISPR gRNA sequence
tcactcccacttcctgagca

SEQ ID NO: 232298 - DNA, 20 bp, Artificial
  CRISPR gRNA sequence
cactcccacttcctgagcag

SEQ ID NO: 232299 - DNA, 20 bp, Artificial
  CRISPR gRNA sequence
cccacttcctgagcaggggc

SEQ ID NO: 232300 - DNA, 20 bp, Artificial
  CRISPR gRNA sequence
cttcctgagcaggggccgga

SEQ ID NO: 232301 - DNA, 20 bp, Artificial
  CRISPR gRNA sequence
ttcctgagcaggggccggat

SEQ ID NO: 232302 - DNA, 20 bp, Artificial
  CRISPR gRNA sequence
tcctgagcaggggccggatg

SEQ ID NO: 232303 - DNA, 20 bp, Artificial
  CRISPR gRNA sequence
cctgagcaggggccggatgg

SEQ ID NO: 232304 - DNA, 20 bp, Artificial
  CRISPR gRNA sequence
ctgagcaggggccggatggg

SEQ ID NO: 232305 - DNA, 20 bp, Artificial
  CRISPR gRNA sequence
tgagcaggggccggatgggg

SEQ ID NO: 232306 - DNA, 20 bp, Artificial
  CRISPR gRNA sequence
gcaggggccggatggggggg

SEQ ID NO: 232307 - DNA, 20 bp, Artificial
  CRISPR gRNA sequence
gggccggatgggggggtggt

SEQ ID NO: 232308 - DNA, 20 bp, Artificial
  CRISPR gRNA sequence
ggccggatgggggggtggtc

SEQ ID NO: 232309 - DNA, 20 bp, Artificial
  CRISPR gRNA sequence
cggatgggggggtggtcagg

SEQ ID NO: 232310 - DNA, 20 bp, Artificial
  CRISPR gRNA sequence
ggatgggggggtggtcaggt

SEQ ID NO: 232311 - DNA, 20 bp, Artificial
  CRISPR gRNA sequence
gatgggggggtggtcaggtg

SEQ ID NO: 232312 - DNA, 20 bp, Artificial
  CRISPR gRNA sequence
atgggggggtggtcaggtgg

SEQ ID NO: 232313 - DNA, 20 bp, Artificial
  CRISPR gRNA sequence
gggtggtcaggtgggggctg

SEQ ID NO: 232314 - DNA, 20 bp, Artificial
  CRISPR gRNA sequence
ggtcaggtgggggctgtgga

SEQ ID NO: 232315 - DNA, 20 bp, Artificial
  CRISPR gRNA sequence
gtcaggtgggggctgtggac

SEQ ID NO: 232316 - DNA, 20 bp, Artificial
  CRISPR gRNA sequence
tcaggtgggggctgtggaca

SEQ ID NO: 232317 - DNA, 20 bp, Artificial
  CRISPR gRNA sequence
ggggctgtggacagggtcct

SEQ ID NO: 232318 - DNA, 20 bp, Artificial
  CRISPR gRNA sequence
gggctgtggacagggtcctc

SEQ ID NO: 232319 - DNA, 20 bp, Artificial
  CRISPR gRNA sequence
ctgtggacagggtcctcagg

SEQ ID NO: 232320 - DNA, 20 bp, Artificial
  CRISPR gRNA sequence
gacagggtcctcaggaagcg

SEQ ID NO: 232321 - DNA, 20 bp, Artificial
  CRISPR gRNA sequence
acagggtcctcaggaagcgt

SEQ ID NO: 232322 - DNA, 20 bp, Artificial
  CRISPR gRNA sequence
tcctcaggaagcgtgggcac

SEQ ID NO: 232323 - DNA, 20 bp, Artificial
  CRISPR gRNA sequence
ctcaggaagcgtgggcactg

SEQ ID NO: 232324 - DNA, 20 bp, Artificial
  CRISPR gRNA sequence
tcaggaagcgtgggcactgg

SEQ ID NO: 232325 - DNA, 20 bp, Artificial
  CRISPR gRNA sequence
gaagcgtgggcactggagga

SEQ ID NO: 232326 - DNA, 20 bp, Artificial
  CRISPR gRNA sequence
aagcgtgggcactggaggac

SEQ ID NO: 232327 - DNA, 20 bp, Artificial
  CRISPR gRNA sequence
gtgggcactggaggacaggt

SEQ ID NO: 232328 - DNA, 20 bp, Artificial
  CRISPR gRNA sequence
aggttggcctccccaccaca

SEQ ID NO: 232329 - DNA, 20 bp, Artificial
  CRISPR gRNA sequence
gttggcctccccaccacaca

SEQ ID NO: 232330 - DNA, 20 bp, Artificial
  CRISPR gRNA sequence
ttggcctccccaccacacag

SEQ ID NO: 232331 - DNA, 20 bp, Artificial
  CRISPR gRNA sequence
tggcctccccaccacacaga

SEQ ID NO: 232332 - DNA, 20 bp, Artificial
  CRISPR gRNA sequence
ccccaccacacagagggccg

SEQ ID NO: 232333 - DNA, 20 bp, Artificial
  CRISPR gRNA sequence
cccaccacacagagggccgt

SEQ ID NO: 232334 - DNA, 20 bp, Artificial
  CRISPR gRNA sequence
accacacagagggccgtggg

SEQ ID NO: 232335 - DNA, 20 bp, Artificial
  CRISPR gRNA sequence
ccacacagagggccgtgggc

SEQ ID NO: 232336 - DNA, 20 bp, Artificial
  CRISPR gRNA sequence
cacacagagggccgtgggca

SEQ ID NO: 232337 - DNA, 20 bp, Artificial
  CRISPR gRNA sequence
acacagagggccgtgggcag

SEQ ID NO: 232338 - DNA, 20 bp, Artificial
  CRISPR gRNA sequence
gggccgtgggcaggggtctg

SEQ ID NO: 232339 - DNA, 20 bp, Artificial
  CRISPR gRNA sequence
aggggtctgcggcctcccct

SEQ ID NO: 232340 - DNA, 20 bp, Artificial
  CRISPR gRNA sequence
ctgcggcctcccctgagact

SEQ ID NO: 232341 - DNA, 20 bp, Artificial
  CRISPR gRNA sequence
gcggcctcccctgagacttg

SEQ ID NO: 232342 - DNA, 20 bp, Artificial
  CRISPR gRNA sequence
cctgagacttggagcccctg

SEQ ID NO: 232343 - DNA, 20 bp, Artificial
  CRISPR gRNA sequence
ttggagcccctgcagccccc

SEQ ID NO: 232344 - DNA, 20 bp, Artificial
  CRISPR gRNA sequence
tggagcccctgcagcccccg

SEQ ID NO: 232345 - DNA, 20 bp, Artificial
  CRISPR gRNA sequence
cctgcagcccccgaggctcc

SEQ ID NO: 232346 - DNA, 20 bp, Artificial
  CRISPR gRNA sequence
ctgcagcccccgaggctcct

SEQ ID NO: 232347 - DNA, 20 bp, Artificial
  CRISPR gRNA sequence
gctcctgggccctcccttcc

SEQ ID NO: 232348 - DNA, 20 bp, Artificial
  CRISPR gRNA sequence
ctcccttcctggccacaacc

SEQ ID NO: 232349 - DNA, 20 bp, Artificial
  CRISPR gRNA sequence
tcccttcctggccacaacct

SEQ ID NO: 232350 - DNA, 20 bp, Artificial
  CRISPR gRNA sequence
cccttcctggccacaacctg

SEQ ID NO: 232351 - DNA, 20 bp, Artificial
  CRISPR gRNA sequence
tcctggccacaacctggggc

SEQ ID NO: 232352 - DNA, 20 bp, Artificial
  CRISPR gRNA sequence
acaacctggggctggttccg

SEQ ID NO: 232353 - DNA, 20 bp, Artificial
  CRISPR gRNA sequence
acctggggctggttccgtgg

SEQ ID NO: 232354 - DNA, 20 bp, Artificial
  CRISPR gRNA sequence
ggctggttccgtggcagccc

SEQ ID NO: 232355 - DNA, 20 bp, Artificial
  CRISPR gRNA sequence
ccctacccctccaccgcctc

SEQ ID NO: 232356 - DNA, 20 bp, Artificial
  CRISPR gRNA sequence
cctccaccgcctccagccgc

SEQ ID NO: 232357 - DNA, 20 bp, Artificial
  CRISPR gRNA sequence
ccagccgccagccccgcctg

SEQ ID NO: 232358 - DNA, 20 bp, Artificial
  CRISPR gRNA sequence
gccgccagccccgcctgcgg

SEQ ID NO: 232359 - DNA, 20 bp, Artificial
  CRISPR gRNA sequence
ccgccagccccgcctgcggc

SEQ ID NO: 232360 - DNA, 20 bp, Artificial
  CRISPR gRNA sequence
cgccagccccgcctgcggca

SEQ ID NO: 232361 - DNA, 20 bp, Artificial
  CRISPR gRNA sequence
cgcctgcggcagggtctcca

SEQ ID NO: 232362 - DNA, 20 bp, Artificial
  CRISPR gRNA sequence
gtctccatggcccaaccccc

SEQ ID NO: 232363 - DNA, 20 bp, Artificial
  CRISPR gRNA sequence
aaccccccagcctcactgct

SEQ ID NO: 232364 - DNA, 20 bp, Artificial
  CRISPR gRNA sequence
accccccagcctcactgctc

SEQ ID NO: 232365 - DNA, 20 bp, Artificial
  CRISPR gRNA sequence
cccagcctcactgctcaggc

SEQ ID NO: 232366 - DNA, 20 bp, Artificial
  CRISPR gRNA sequence
gcctcactgctcaggccagc

SEQ ID NO: 232367 - DNA, 20 bp, Artificial
  CRISPR gRNA sequence
cctcactgctcaggccagca

SEQ ID NO: 232368 - DNA, 20 bp, Artificial
  CRISPR gRNA sequence
actgctcaggccagcaaggc

SEQ ID NO: 232369 - DNA, 20 bp, Artificial
  CRISPR gRNA sequence
ctgctcaggccagcaaggcc

SEQ ID NO: 232370 - DNA, 20 bp, Artificial
  CRISPR gRNA sequence
gccagcaaggccaggccaca

SEQ ID NO: 232371 - DNA, 20 bp, Artificial
  CRISPR gRNA sequence
gcaaggccaggccacatggc

SEQ ID NO: 232372 - DNA, 20 bp, Artificial
  CRISPR gRNA sequence
gccaggccacatggccagcg

SEQ ID NO: 232373 - DNA, 20 bp, Artificial
  CRISPR gRNA sequence
gtggtctccccgactccacg

SEQ ID NO: 232374 - DNA, 20 bp, Artificial
  CRISPR gRNA sequence
ctccccgactccacgtggcc

SEQ ID NO: 232375 - DNA, 20 bp, Artificial
  CRISPR gRNA sequence
tccccgactccacgtggcct

SEQ ID NO: 232376 - DNA, 20 bp, Artificial
  CRISPR gRNA sequence
gactccacgtggcctgggcc

SEQ ID NO: 232377 - DNA, 20 bp, Artificial
  CRISPR gRNA sequence
cacgtggcctgggccgagtc

SEQ ID NO: 232378 - DNA, 20 bp, Artificial
  CRISPR gRNA sequence
acgtggcctgggccgagtct

SEQ ID NO: 232379 - DNA, 20 bp, Artificial
  CRISPR gRNA sequence
ctgggccgagtctgggcccc

SEQ ID NO: 232380 - DNA, 20 bp, Artificial
  CRISPR gRNA sequence
gggccgagtctgggcccccg

SEQ ID NO: 232381 - DNA, 20 bp, Artificial
  CRISPR gRNA sequence
ggccgagtctgggcccccgg

SEQ ID NO: 232382 - DNA, 20 bp, Artificial
  CRISPR gRNA sequence
gccgagtctgggcccccgga

SEQ ID NO: 232383 - DNA, 20 bp, Artificial
  CRISPR gRNA sequence
cgagtctgggcccccggagg

SEQ ID NO: 232384 - DNA, 20 bp, Artificial
  CRISPR gRNA sequence
agtctgggcccccggaggga

SEQ ID NO: 232385 - DNA, 20 bp, Artificial
  CRISPR gRNA sequence
gtctgggcccccggagggag

SEQ ID NO: 232386 - DNA, 20 bp, Artificial
  CRISPR gRNA sequence
tctgggcccccggagggaga

SEQ ID NO: 232387 - DNA, 20 bp, Artificial
  CRISPR gRNA sequence
ctgggcccccggagggagag

SEQ ID NO: 232388 - DNA, 20 bp, Artificial
  CRISPR gRNA sequence
tgggcccccggagggagagg

SEQ ID NO: 232389 - DNA, 20 bp, Artificial
  CRISPR gRNA sequence
ggagggagagggggtgcccc

SEQ ID NO: 232390 - DNA, 20 bp, Artificial
  CRISPR gRNA sequence
gagggagagggggtgcccct

SEQ ID NO: 232391 - DNA, 20 bp, Artificial
  CRISPR gRNA sequence
gggagagggggtgcccctgg

SEQ ID NO: 232392 - DNA, 20 bp, Artificial
  CRISPR gRNA sequence
ggtgcccctgggagacgcct

SEQ ID NO: 232393 - DNA, 20 bp, Artificial
  CRISPR gRNA sequence
ggagacgcctcagctcctcg

SEQ ID NO: 232394 - DNA, 20 bp, Artificial
  CRISPR gRNA sequence
gagacgcctcagctcctcga

SEQ ID NO: 232395 - DNA, 20 bp, Artificial
  CRISPR gRNA sequence
agctcctcgaaggacccctg

SEQ ID NO: 232396 - DNA, 20 bp, Artificial
  CRISPR gRNA sequence
tcctcgaaggacccctgtgg

SEQ ID NO: 232397 - DNA, 20 bp, Artificial
  CRISPR gRNA sequence
ctcgaaggacccctgtggcg

SEQ ID NO: 232398 - DNA, 20 bp, Artificial
  CRISPR gRNA sequence
gaaggacccctgtggcggag

SEQ ID NO: 232399 - DNA, 20 bp, Artificial
  CRISPR gRNA sequence
tggcggagcagaccccgctg

SEQ ID NO: 232400 - DNA, 20 bp, Artificial
  CRISPR gRNA sequence
agcagaccccgctgtggttt

SEQ ID NO: 232401 - DNA, 20 bp, Artificial
  CRISPR gRNA sequence
gcagaccccgctgtggtttg

SEQ ID NO: 232402 - DNA, 20 bp, Artificial
  CRISPR gRNA sequence
tggtttgaggttcgtttctg

SEQ ID NO: 232403 - DNA, 20 bp, Artificial
  CRISPR gRNA sequence
gaggttcgtttctgcggctg

SEQ ID NO: 232404 - DNA, 20 bp, Artificial
  CRISPR gRNA sequence
aggttcgtttctgcggctgt

SEQ ID NO: 232405 - DNA, 20 bp, Artificial
  CRISPR gRNA sequence
gttcgtttctgcggctgtgg

SEQ ID NO: 232406 - DNA, 20 bp, Artificial
  CRISPR gRNA sequence
gggagccccatgctgctgcg

SEQ ID NO: 232407 - DNA, 20 bp, Artificial
  CRISPR gRNA sequence
ggagccccatgctgctgcgt

SEQ ID NO: 232408 - DNA, 20 bp, Artificial
  CRISPR gRNA sequence
catgctgctgcgtgggaatg

SEQ ID NO: 232409 - DNA, 20 bp, Artificial
  CRISPR gRNA sequence
atgctgctgcgtgggaatgt

SEQ ID NO: 232410 - DNA, 20 bp, Artificial
  CRISPR gRNA sequence
ctgcgtgggaatgtgggtgc

SEQ ID NO: 232411 - DNA, 20 bp, Artificial
  CRISPR gRNA sequence
tgcgtgggaatgtgggtgcc

SEQ ID NO: 232412 - DNA, 20 bp, Artificial
  CRISPR gRNA sequence
caggctgccgccccctgtgc

SEQ ID NO: 232413 - DNA, 20 bp, Artificial
  CRISPR gRNA sequence
aggctgccgccccctgtgct

SEQ ID NO: 232414 - DNA, 20 bp, Artificial
  CRISPR gRNA sequence
ctgccgccccctgtgctggg

SEQ ID NO: 232415 - DNA, 20 bp, Artificial
  CRISPR gRNA sequence
tgccgccccctgtgctgggt

SEQ ID NO: 232416 - DNA, 20 bp, Artificial
  CRISPR gRNA sequence
gccgccccctgtgctgggtg

SEQ ID NO: 232417 - DNA, 20 bp, Artificial
  CRISPR gRNA sequence
ccctgtgctgggtggggctg

SEQ ID NO: 232418 - DNA, 20 bp, Artificial
  CRISPR gRNA sequence
cctgtgctgggtggggctgt

SEQ ID NO: 232419 - DNA, 20 bp, Artificial
  CRISPR gRNA sequence
ctgtgctgggtggggctgtg

SEQ ID NO: 232420 - DNA, 20 bp, Artificial
  CRISPR gRNA sequence
gctgggtggggctgtggggc

SEQ ID NO: 232421 - DNA, 20 bp, Artificial
  CRISPR gRNA sequence
ctgggtggggctgtggggcc

SEQ ID NO: 232422 - DNA, 20 bp, Artificial
  CRISPR gRNA sequence
ggtggggctgtggggccagg

SEQ ID NO: 232423 - DNA, 20 bp, Artificial
  CRISPR gRNA sequence
gtggggctgtggggccaggt

SEQ ID NO: 232424 - DNA, 20 bp, Artificial
  CRISPR gRNA sequence
ggggctgtggggccaggtgg

SEQ ID NO: 232425 - DNA, 20 bp, Artificial
  CRISPR gRNA sequence
gggccaggtgggagctcact

SEQ ID NO: 232426 - DNA, 20 bp, Artificial
  CRISPR gRNA sequence
ggccaggtgggagctcactg

SEQ ID NO: 232427 - DNA, 20 bp, Artificial
  CRISPR gRNA sequence
cactgaggttacaccacgtg

SEQ ID NO: 232428 - DNA, 20 bp, Artificial
  CRISPR gRNA sequence
actgaggttacaccacgtgc

SEQ ID NO: 232429 - DNA, 20 bp, Artificial
  CRISPR gRNA sequence
ctgaggttacaccacgtgca

SEQ ID NO: 232430 - DNA, 20 bp, Artificial
  CRISPR gRNA sequence
caccacgtgcagggcttgca

SEQ ID NO: 232431 - DNA, 20 bp, Artificial
  CRISPR gRNA sequence
cgtgcagggcttgcacggct

SEQ ID NO: 232432 - DNA, 20 bp, Artificial
  CRISPR gRNA sequence
tgcagggcttgcacggcttg

SEQ ID NO: 232433 - DNA, 20 bp, Artificial
  CRISPR gRNA sequence
tggagctgaccacgtcgttg

SEQ ID NO: 232434 - DNA, 20 bp, Artificial
  CRISPR gRNA sequence
agctgaccacgtcgttgtag

SEQ ID NO: 232435 - DNA, 20 bp, Artificial
  CRISPR gRNA sequence
accacgtcgttgtagaagcc

SEQ ID NO: 232436 - DNA, 20 bp, Artificial
  CRISPR gRNA sequence
ttgtagaagcccggcccgca

SEQ ID NO: 232437 - DNA, 20 bp, Artificial
  CRISPR gRNA sequence
agaagcccggcccgcacgga

SEQ ID NO: 232438 - DNA, 20 bp, Artificial
  CRISPR gRNA sequence
acggacggcacaccgtgttc

SEQ ID NO: 232439 - DNA, 20 bp, Artificial
  CRISPR gRNA sequence
cggacggcacaccgtgttct

SEQ ID NO: 232440 - DNA, 20 bp, Artificial
  CRISPR gRNA sequence
gacggcacaccgtgttctgg

SEQ ID NO: 232441 - DNA, 20 bp, Artificial
  CRISPR gRNA sequence
ggcacaccgtgttctgggag

SEQ ID NO: 232442 - DNA, 20 bp, Artificial
  CRISPR gRNA sequence
ccgtgttctgggagcggctg

SEQ ID NO: 232443 - DNA, 20 bp, Artificial
  CRISPR gRNA sequence
tgttctgggagcggctgcag

SEQ ID NO: 232444 - DNA, 20 bp, Artificial
  CRISPR gRNA sequence
gctcaccatcccgttgcctg

SEQ ID NO: 232445 - DNA, 20 bp, Artificial
  CRISPR gRNA sequence
caccatcccgttgcctgcag

SEQ ID NO: 232446 - DNA, 20 bp, Artificial
  CRISPR gRNA sequence
ccatcccgttgcctgcagca

SEQ ID NO: 232447 - DNA, 20 bp, Artificial
  CRISPR gRNA sequence
catcccgttgcctgcagcag

SEQ ID NO: 232448 - DNA, 20 bp, Artificial
  CRISPR gRNA sequence
ccgttgcctgcagcagaggc

SEQ ID NO: 232449 - DNA, 20 bp, Artificial
  CRISPR gRNA sequence
cctgcagcagaggccggcgt

SEQ ID NO: 232450 - DNA, 20 bp, Artificial
  CRISPR gRNA sequence
ctgcagcagaggccggcgtc

SEQ ID NO: 232451 - DNA, 20 bp, Artificial
  CRISPR gRNA sequence
cagcagaggccggcgtcagg

SEQ ID NO: 232452 - DNA, 20 bp, Artificial
  CRISPR gRNA sequence
cagaggccggcgtcaggcag

SEQ ID NO: 232453 - DNA, 20 bp, Artificial
  CRISPR gRNA sequence
ggccggcgtcaggcagcggt

SEQ ID NO: 232454 - DNA, 20 bp, Artificial
  CRISPR gRNA sequence
gccggcgtcaggcagcggtc

SEQ ID NO: 232455 - DNA, 20 bp, Artificial
  CRISPR gRNA sequence
gtcaggcagcggtcaggccc

SEQ ID NO: 232456 - DNA, 20 bp, Artificial
  CRISPR gRNA sequence
tcaggcagcggtcaggcccc

SEQ ID NO: 232457 - DNA, 20 bp, Artificial
  CRISPR gRNA sequence
aggccccaggcttgcgcccg

SEQ ID NO: 232458 - DNA, 20 bp, Artificial
  CRISPR gRNA sequence
cttgcgcccgtggacccccc

SEQ ID NO: 232459 - DNA, 20 bp, Artificial
  CRISPR gRNA sequence
ttgcgcccgtggaccccccc

SEQ ID NO: 232460 - DNA, 20 bp, Artificial
  CRISPR gRNA sequence
cgcccgtggacccccccagg

SEQ ID NO: 232461 - DNA, 20 bp, Artificial
  CRISPR gRNA sequence
cccccaggcggctcctctgc

SEQ ID NO: 232462 - DNA, 20 bp, Artificial
  CRISPR gRNA sequence
ccccaggcggctcctctgcc

SEQ ID NO: 232463 - DNA, 20 bp, Artificial
  CRISPR gRNA sequence
ggcggctcctctgccaggct

SEQ ID NO: 232464 - DNA, 20 bp, Artificial
  CRISPR gRNA sequence
gctcctctgccaggcttggc

SEQ ID NO: 232465 - DNA, 20 bp, Artificial
  CRISPR gRNA sequence
cccctcacccgccccctccc

SEQ ID NO: 232466 - DNA, 20 bp, Artificial
  CRISPR gRNA sequence
ccctcacccgccccctcccc

SEQ ID NO: 232467 - DNA, 20 bp, Artificial
  CRISPR gRNA sequence
acccgccccctccccaggac

SEQ ID NO: 232468 - DNA, 20 bp, Artificial
  CRISPR gRNA sequence
cctccccaggaccagcctcc

SEQ ID NO: 232469 - DNA, 20 bp, Artificial
  CRISPR gRNA sequence
cccaggaccagcctcctggc

SEQ ID NO: 232470 - DNA, 20 bp, Artificial
  CRISPR gRNA sequence
tggctggcccatccctgccc

SEQ ID NO: 232471 - DNA, 20 bp, Artificial
  CRISPR gRNA sequence
cccatccctgccccagcccc

SEQ ID NO: 232472 - DNA, 20 bp, Artificial
  CRISPR gRNA sequence
ctgccccagcccccagtccc

SEQ ID NO: 232473 - DNA, 20 bp, Artificial
  CRISPR gRNA sequence
gccccagcccccagtccctg

SEQ ID NO: 232474 - DNA, 20 bp, Artificial
  CRISPR gRNA sequence
gtccctggagtgcccgtgcg

SEQ ID NO: 232475 - DNA, 20 bp, Artificial
  CRISPR gRNA sequence
cgtgcgtggcgacccctcct

SEQ ID NO: 232476 - DNA, 20 bp, Artificial
  CRISPR gRNA sequence
gtgcgtggcgacccctcctg

SEQ ID NO: 232477 - DNA, 20 bp, Artificial
  CRISPR gRNA sequence
acccctcctgaggcctcacc

SEQ ID NO: 232478 - DNA, 20 bp, Artificial
  CRISPR gRNA sequence
cctcacctggcctgcactcg

SEQ ID NO: 232479 - DNA, 20 bp, Artificial
  CRISPR gRNA sequence
cacctggcctgcactcgtgg

SEQ ID NO: 232480 - DNA, 20 bp, Artificial
  CRISPR gRNA sequence
gcctgcactcgtggcagcac

SEQ ID NO: 232481 - DNA, 20 bp, Artificial
  CRISPR gRNA sequence
gtggcagcaccggtcgttgc

SEQ ID NO: 232482 - DNA, 20 bp, Artificial
  CRISPR gRNA sequence
tggcagcaccggtcgttgct

SEQ ID NO: 232483 - DNA, 20 bp, Artificial
  CRISPR gRNA sequence
ggcagcaccggtcgttgctg

SEQ ID NO: 232484 - DNA, 20 bp, Artificial
  CRISPR gRNA sequence
agcaccggtcgttgctgggg

SEQ ID NO: 232485 - DNA, 20 bp, Artificial
  CRISPR gRNA sequence
gcaccggtcgttgctggggt

SEQ ID NO: 232486 - DNA, 20 bp, Artificial
  CRISPR gRNA sequence
tggggtaggtgtccccgaca

SEQ ID NO: 232487 - DNA, 20 bp, Artificial
  CRISPR gRNA sequence
ggtaggtgtccccgacacag

SEQ ID NO: 232488 - DNA, 20 bp, Artificial
  CRISPR gRNA sequence
taggtgtccccgacacagtg

SEQ ID NO: 232489 - DNA, 20 bp, Artificial
  CRISPR gRNA sequence
gacacagtggagccccgtca

SEQ ID NO: 232490 - DNA, 20 bp, Artificial
  CRISPR gRNA sequence
tggagccccgtcacggtgct

SEQ ID NO: 232491 - DNA, 20 bp, Artificial
  CRISPR gRNA sequence
cccgtcacggtgctcagccc

SEQ ID NO: 232492 - DNA, 20 bp, Artificial
  CRISPR gRNA sequence
ccgtcacggtgctcagcccc

SEQ ID NO: 232493 - DNA, 20 bp, Artificial
  CRISPR gRNA sequence
acggtgctcagccccaggcc

SEQ ID NO: 232494 - DNA, 20 bp, Artificial
  CRISPR gRNA sequence
cggtgctcagccccaggccc

SEQ ID NO: 232495 - DNA, 20 bp, Artificial
  CRISPR gRNA sequence
gtgctcagccccaggcccag

SEQ ID NO: 232496 - DNA, 20 bp, Artificial
  CRISPR gRNA sequence
tgctcagccccaggcccagg

SEQ ID NO: 232497 - DNA, 20 bp, Artificial
  CRISPR gRNA sequence
ctcagccccaggcccaggag

SEQ ID NO: 232498 - DNA, 20 bp, Artificial
  CRISPR gRNA sequence
agccccaggcccaggaggag

SEQ ID NO: 232499 - DNA, 20 bp, Artificial
  CRISPR gRNA sequence
ccccaggcccaggaggagca

SEQ ID NO: 232500 - DNA, 20 bp, Artificial
  CRISPR gRNA sequence
aggaggagcagagccgcaca

SEQ ID NO: 232501 - DNA, 20 bp, Artificial
  CRISPR gRNA sequence
gcagagccgcacacggcccg

SEQ ID NO: 232502 - DNA, 20 bp, Artificial
  CRISPR gRNA sequence
gccgcacacggcccgcggcc

SEQ ID NO: 232503 - DNA, 20 bp, Artificial
  CRISPR gRNA sequence
cggcccgcggcccagccgcc

SEQ ID NO: 232504 - DNA, 20 bp, Artificial
  CRISPR gRNA sequence
atcctcgtctctgctgtcgc

SEQ ID NO: 232505 - DNA, 20 bp, Artificial
  CRISPR gRNA sequence
cctcgtctctgctgtcgcca

SEQ ID NO: 232506 - DNA, 20 bp, Artificial
  CRISPR gRNA sequence
tctctgctgtcgccagagtc

SEQ ID NO: 232507 - DNA, 20 bp, Artificial
  CRISPR gRNA sequence
ctctgctgtcgccagagtct

SEQ ID NO: 232508 - DNA, 20 bp, Artificial
  CRISPR gRNA sequence
cagagtctgggttttccttg

SEQ ID NO: 232509 - DNA, 20 bp, Artificial
  CRISPR gRNA sequence
agagtctgggttttccttgc

SEQ ID NO: 232510 - DNA, 20 bp, Artificial
  CRISPR gRNA sequence
gagtctgggttttccttgcg

SEQ ID NO: 232511 - DNA, 20 bp, Artificial
  CRISPR gRNA sequence
tgggttttccttgcggggtg

SEQ ID NO: 232512 - DNA, 20 bp, Artificial
  CRISPR gRNA sequence
tccttgcggggtgtggctat

SEQ ID NO: 232513 - DNA, 20 bp, Artificial
  CRISPR gRNA sequence
ccttgcggggtgtggctata

SEQ ID NO: 232514 - DNA, 20 bp, Artificial
  CRISPR gRNA sequence
gggtgtggctataaggactg

SEQ ID NO: 232515 - DNA, 20 bp, Artificial
  CRISPR gRNA sequence
gtgtggctataaggactgtg

SEQ ID NO: 232516 - DNA, 20 bp, Artificial
  CRISPR gRNA sequence
tgtggctataaggactgtgg

SEQ ID NO: 232517 - DNA, 20 bp, Artificial
  CRISPR gRNA sequence
tggctataaggactgtggag

SEQ ID NO: 232518 - DNA, 20 bp, Artificial
  CRISPR gRNA sequence
ggctataaggactgtggagg

SEQ ID NO: 232519 - DNA, 20 bp, Artificial
  CRISPR gRNA sequence
gctataaggactgtggagga

SEQ ID NO: 232520 - DNA, 20 bp, Artificial
  CRISPR gRNA sequence
ctataaggactgtggaggag

SEQ ID NO: 232521 - DNA, 20 bp, Artificial
  CRISPR gRNA sequence
ataaggactgtggaggaggg

SEQ ID NO: 232522 - DNA, 20 bp, Artificial
  CRISPR gRNA sequence
taaggactgtggaggagggg

SEQ ID NO: 232523 - DNA, 20 bp, Artificial
  CRISPR gRNA sequence
aaggactgtggaggagggga

SEQ ID NO: 232524 - DNA, 20 bp, Artificial
  CRISPR gRNA sequence
aggactgtggaggaggggag

SEQ ID NO: 232525 - DNA, 20 bp, Artificial
  CRISPR gRNA sequence
gactgtggaggaggggaggg

SEQ ID NO: 232526 - DNA, 20 bp, Artificial
  CRISPR gRNA sequence
ctgtggaggaggggagggga

SEQ ID NO: 232527 - DNA, 20 bp, Artificial
  CRISPR gRNA sequence
tgtggaggaggggaggggag

SEQ ID NO: 232528 - DNA, 20 bp, Artificial
  CRISPR gRNA sequence
gtggaggaggggaggggaga

SEQ ID NO: 232529 - DNA, 20 bp, Artificial
  CRISPR gRNA sequence
tggaggaggggaggggagag

SEQ ID NO: 232530 - DNA, 20 bp, Artificial
  CRISPR gRNA sequence
gaggaggggaggggagaggg

SEQ ID NO: 232531 - DNA, 20 bp, Artificial
  CRISPR gRNA sequence
aggaggggaggggagagggg

SEQ ID NO: 232532 - DNA, 20 bp, Artificial
  CRISPR gRNA sequence
gaggggaggggagaggggag

SEQ ID NO: 232533 - DNA, 20 bp, Artificial
  CRISPR gRNA sequence
aggggaggggagaggggagg

SEQ ID NO: 232534 - DNA, 20 bp, Artificial
  CRISPR gRNA sequence
ggggaggggagaggggagga

SEQ ID NO: 232535 - DNA, 20 bp, Artificial
  CRISPR gRNA sequence
gaggggagaggggaggaggg

SEQ ID NO: 232536 - DNA, 20 bp, Artificial
  CRISPR gRNA sequence
ggggagaggggaggagggca

SEQ ID NO: 232537 - DNA, 20 bp, Artificial
  CRISPR gRNA sequence
gggagaggggaggagggcag

SEQ ID NO: 232538 - DNA, 20 bp, Artificial
  CRISPR gRNA sequence
gagaggggaggagggcagag

SEQ ID NO: 232539 - DNA, 20 bp, Artificial
  CRISPR gRNA sequence
agaggggaggagggcagagg

SEQ ID NO: 232540 - DNA, 20 bp, Artificial
  CRISPR gRNA sequence
ggggaggagggcagaggagg

SEQ ID NO: 232541 - DNA, 20 bp, Artificial
  CRISPR gRNA sequence
gggaggagggcagaggaggc

SEQ ID NO: 232542 - DNA, 20 bp, Artificial
  CRISPR gRNA sequence
gaggagggcagaggaggcgg

SEQ ID NO: 232543 - DNA, 20 bp, Artificial
  CRISPR gRNA sequence
aggagggcagaggaggcggg

SEQ ID NO: 232544 - DNA, 20 bp, Artificial
  CRISPR gRNA sequence
gagggcagaggaggcgggag

SEQ ID NO: 232545 - DNA, 20 bp, Artificial
  CRISPR gRNA sequence
agggcagaggaggcgggagg

SEQ ID NO: 232546 - DNA, 20 bp, Artificial
  CRISPR gRNA sequence
gcagaggaggcgggaggagg

SEQ ID NO: 232547 - DNA, 20 bp, Artificial
  CRISPR gRNA sequence
cagaggaggcgggaggagga

SEQ ID NO: 232548 - DNA, 20 bp, Artificial
  CRISPR gRNA sequence
aggaggcgggaggaggaagg

SEQ ID NO: 232549 - DNA, 20 bp, Artificial
  CRISPR gRNA sequence
aggcgggaggaggaaggtgg

SEQ ID NO: 232550 - DNA, 20 bp, Artificial
  CRISPR gRNA sequence
ggcgggaggaggaaggtggc

SEQ ID NO: 232551 - DNA, 20 bp, Artificial
  CRISPR gRNA sequence
ggaggaggaaggtggcaggc

SEQ ID NO: 232552 - DNA, 20 bp, Artificial
  CRISPR gRNA sequence
gaggaggaaggtggcaggcc

SEQ ID NO: 232553 - DNA, 20 bp, Artificial
  CRISPR gRNA sequence
aggaggaaggtggcaggccg

SEQ ID NO: 232554 - DNA, 20 bp, Artificial
  CRISPR gRNA sequence
aggtggcaggccggggaccc

SEQ ID NO: 232555 - DNA, 20 bp, Artificial
  CRISPR gRNA sequence
caggccggggaccctggctg

SEQ ID NO: 232556 - DNA, 20 bp, Artificial
  CRISPR gRNA sequence
aggccggggaccctggctgt

SEQ ID NO: 232557 - DNA, 20 bp, Artificial
  CRISPR gRNA sequence
cggggaccctggctgtgggc

SEQ ID NO: 232558 - DNA, 20 bp, Artificial
  CRISPR gRNA sequence
ggggaccctggctgtgggct

SEQ ID NO: 232559 - DNA, 20 bp, Artificial
  CRISPR gRNA sequence
ctggctgtgggctgggcaca

SEQ ID NO: 232560 - DNA, 20 bp, Artificial
  CRISPR gRNA sequence
tggctgtgggctgggcacaa

SEQ ID NO: 232561 - DNA, 20 bp, Artificial
  CRISPR gRNA sequence
ctgtgggctgggcacaaagg

SEQ ID NO: 232562 - DNA, 20 bp, Artificial
  CRISPR gRNA sequence
tgtgggctgggcacaaaggc

SEQ ID NO: 232563 - DNA, 20 bp, Artificial
  CRISPR gRNA sequence
gtgggctgggcacaaaggcg

SEQ ID NO: 232564 - DNA, 20 bp, Artificial
  CRISPR gRNA sequence
ctgggcacaaaggcggggtc

SEQ ID NO: 232565 - DNA, 20 bp, Artificial
  CRISPR gRNA sequence
tgggcacaaaggcggggtct

SEQ ID NO: 232566 - DNA, 20 bp, Artificial
  CRISPR gRNA sequence
aggcggggtctgggcacccc

SEQ ID NO: 232567 - DNA, 20 bp, Artificial
  CRISPR gRNA sequence
ggtctgggcacccccagcat

SEQ ID NO: 232568 - DNA, 20 bp, Artificial
  CRISPR gRNA sequence
ccttctgacctcttctgccc

SEQ ID NO: 232569 - DNA, 20 bp, Artificial
  CRISPR gRNA sequence
ctgcccaagaccaccgtgtt

SEQ ID NO: 232570 - DNA, 20 bp, Artificial
  CRISPR gRNA sequence
agaccaccgtgttcagaccc

SEQ ID NO: 232571 - DNA, 20 bp, Artificial
  CRISPR gRNA sequence
gaccaccgtgttcagacccc

SEQ ID NO: 232572 - DNA, 20 bp, Artificial
  CRISPR gRNA sequence
accaccgtgttcagacccca

SEQ ID NO: 232573 - DNA, 20 bp, Artificial
  CRISPR gRNA sequence
cgtgttcagaccccagggca

SEQ ID NO: 232574 - DNA, 20 bp, Artificial
  CRISPR gRNA sequence
gttcagaccccagggcacag

SEQ ID NO: 232575 - DNA, 20 bp, Artificial
  CRISPR gRNA sequence
ttcagaccccagggcacagt

SEQ ID NO: 232576 - DNA, 20 bp, Artificial
  CRISPR gRNA sequence
tcagaccccagggcacagta

SEQ ID NO: 232577 - DNA, 20 bp, Artificial
  CRISPR gRNA sequence
ccccagggcacagtagggcc

SEQ ID NO: 232578 - DNA, 20 bp, Artificial
  CRISPR gRNA sequence
gcacagtagggcctggcctg

SEQ ID NO: 232579 - DNA, 20 bp, Artificial
  CRISPR gRNA sequence
ctggcctgcggctcgaccct

SEQ ID NO: 232580 - DNA, 20 bp, Artificial
  CRISPR gRNA sequence
gcggctcgaccctcagcaaa

SEQ ID NO: 232581 - DNA, 20 bp, Artificial
  CRISPR gRNA sequence
cggctcgaccctcagcaaaa

SEQ ID NO: 232582 - DNA, 20 bp, Artificial
  CRISPR gRNA sequence
accctcagcaaaaaggtcca

SEQ ID NO: 232583 - DNA, 20 bp, Artificial
  CRISPR gRNA sequence
cctcagcaaaaaggtccatg

SEQ ID NO: 232584 - DNA, 20 bp, Artificial
  CRISPR gRNA sequence
aaaaaggtccatggagcacg

SEQ ID NO: 232585 - DNA, 20 bp, Artificial
  CRISPR gRNA sequence
aaaaggtccatggagcacgt

SEQ ID NO: 232586 - DNA, 20 bp, Artificial
  CRISPR gRNA sequence
atggagcacgtgggtaaact

SEQ ID NO: 232587 - DNA, 20 bp, Artificial
  CRISPR gRNA sequence
tggagcacgtgggtaaactg

SEQ ID NO: 232588 - DNA, 20 bp, Artificial
  CRISPR gRNA sequence
agcacgtgggtaaactgagg

SEQ ID NO: 232589 - DNA, 20 bp, Artificial
  CRISPR gRNA sequence
gggtaaactgaggcagcact

SEQ ID NO: 232590 - DNA, 20 bp, Artificial
  CRISPR gRNA sequence
aaactgaggcagcactgagt

SEQ ID NO: 232591 - DNA, 20 bp, Artificial
  CRISPR gRNA sequence
aactgaggcagcactgagtc

SEQ ID NO: 232592 - DNA, 20 bp, Artificial
  CRISPR gRNA sequence
ctgaggcagcactgagtcag

SEQ ID NO: 232593 - DNA, 20 bp, Artificial
  CRISPR gRNA sequence
gaggcagcactgagtcagga

SEQ ID NO: 232594 - DNA, 20 bp, Artificial
  CRISPR gRNA sequence
aggcagcactgagtcaggag

SEQ ID NO: 232595 - DNA, 20 bp, Artificial
  CRISPR gRNA sequence
agtcaggagaggcaactcct

SEQ ID NO: 232596 - DNA, 20 bp, Artificial
  CRISPR gRNA sequence
ggagaggcaactcctcagtc

SEQ ID NO: 232597 - DNA, 20 bp, Artificial
  CRISPR gRNA sequence
aactcctcagtctggacctt

SEQ ID NO: 232598 - DNA, 20 bp, Artificial
  CRISPR gRNA sequence
actcctcagtctggaccttc

SEQ ID NO: 232599 - DNA, 20 bp, Artificial
  CRISPR gRNA sequence
ctcctcagtctggaccttca

SEQ ID NO: 232600 - DNA, 20 bp, Artificial
  CRISPR gRNA sequence
agtctggaccttcagggctg

SEQ ID NO: 232601 - DNA, 20 bp, Artificial
  CRISPR gRNA sequence
tcagggctgtggcactgctg

SEQ ID NO: 232602 - DNA, 20 bp, Artificial
  CRISPR gRNA sequence
gctgtggcactgctgaagca

SEQ ID NO: 232603 - DNA, 20 bp, Artificial
  CRISPR gRNA sequence
atggtcccccttgtatgccc

SEQ ID NO: 232604 - DNA, 20 bp, Artificial
  CRISPR gRNA sequence
cccccttgtatgcccaagac

SEQ ID NO: 232605 - DNA, 20 bp, Artificial
  CRISPR gRNA sequence
gtatgcccaagactagctct

SEQ ID NO: 232606 - DNA, 20 bp, Artificial
  CRISPR gRNA sequence
tgcccaagactagctctgag

SEQ ID NO: 232607 - DNA, 20 bp, Artificial
  CRISPR gRNA sequence
ccaagactagctctgagcag

SEQ ID NO: 232608 - DNA, 20 bp, Artificial
  CRISPR gRNA sequence
gctctgagcagcagtgacca

SEQ ID NO: 232609 - DNA, 20 bp, Artificial
  CRISPR gRNA sequence
agcagcagtgaccacagcca

SEQ ID NO: 232610 - DNA, 20 bp, Artificial
  CRISPR gRNA sequence
gcagtgaccacagccatggt

SEQ ID NO: 232611 - DNA, 20 bp, Artificial
  CRISPR gRNA sequence
tgaccacagccatggtaaga

SEQ ID NO: 232612 - DNA, 20 bp, Artificial
  CRISPR gRNA sequence
catggtaagacagacaccca

SEQ ID NO: 232613 - DNA, 20 bp, Artificial
  CRISPR gRNA sequence
gtaagacagacacccatggc

SEQ ID NO: 232614 - DNA, 20 bp, Artificial
  CRISPR gRNA sequence
taagacagacacccatggcc

SEQ ID NO: 232615 - DNA, 20 bp, Artificial
  CRISPR gRNA sequence
cagacacccatggccaggca

SEQ ID NO: 232616 - DNA, 20 bp, Artificial
  CRISPR gRNA sequence
acacccatggccaggcacgg

SEQ ID NO: 232617 - DNA, 20 bp, Artificial
  CRISPR gRNA sequence
gtggctcccgcctgtaatcc

SEQ ID NO: 232618 - DNA, 20 bp, Artificial
  CRISPR gRNA sequence
cgcctgtaatcccagcactt

SEQ ID NO: 232619 - DNA, 20 bp, Artificial
  CRISPR gRNA sequence
gcctgtaatcccagcacttt

SEQ ID NO: 232620 - DNA, 20 bp, Artificial
  CRISPR gRNA sequence
ctgtaatcccagcactttgg

SEQ ID NO: 232621 - DNA, 20 bp, Artificial
  CRISPR gRNA sequence
tgtaatcccagcactttggg

SEQ ID NO: 232622 - DNA, 20 bp, Artificial
  CRISPR gRNA sequence
tcccagcactttgggaggcc

SEQ ID NO: 232623 - DNA, 20 bp, Artificial
  CRISPR gRNA sequence
cccagcactttgggaggcca

SEQ ID NO: 232624 - DNA, 20 bp, Artificial
  CRISPR gRNA sequence
agcactttgggaggccaagg

SEQ ID NO: 232625 - DNA, 20 bp, Artificial
  CRISPR gRNA sequence
gcactttgggaggccaaggc

SEQ ID NO: 232626 - DNA, 20 bp, Artificial
  CRISPR gRNA sequence
ctttgggaggccaaggcggg

SEQ ID NO: 232627 - DNA, 20 bp, Artificial
  CRISPR gRNA sequence
ccaaggcgggtggatcacct

SEQ ID NO: 232628 - DNA, 20 bp, Artificial
  CRISPR gRNA sequence
caaggcgggtggatcacctg

SEQ ID NO: 232629 - DNA, 20 bp, Artificial
  CRISPR gRNA sequence
gcgggtggatcacctgaggt

SEQ ID NO: 232630 - DNA, 20 bp, Artificial
  CRISPR gRNA sequence
cgggtggatcacctgaggtc

SEQ ID NO: 232631 - DNA, 20 bp, Artificial
  CRISPR gRNA sequence
ggtggatcacctgaggtcag

SEQ ID NO: 232632 - DNA, 20 bp, Artificial
  CRISPR gRNA sequence
tcacctgaggtcaggagttc

SEQ ID NO: 232633 - DNA, 20 bp, Artificial
  CRISPR gRNA sequence
tgaggtcaggagttcaagac

SEQ ID NO: 232634 - DNA, 20 bp, Artificial
  CRISPR gRNA sequence
tcaggagttcaagaccagtc

SEQ ID NO: 232635 - DNA, 20 bp, Artificial
  CRISPR gRNA sequence
caagaccagtctggctaaca

SEQ ID NO: 232636 - DNA, 20 bp, Artificial
  CRISPR gRNA sequence
ctaaaactacaaaaattatt

SEQ ID NO: 232637 - DNA, 20 bp, Artificial
  CRISPR gRNA sequence
taaaactacaaaaattattc

SEQ ID NO: 232638 - DNA, 20 bp, Artificial
  CRISPR gRNA sequence
ctacaaaaattattcgggcg

SEQ ID NO: 232639 - DNA, 20 bp, Artificial
  CRISPR gRNA sequence
caaaaattattcgggcgtgg

SEQ ID NO: 232640 - DNA, 20 bp, Artificial
  CRISPR gRNA sequence
aaattattcgggcgtggtgg

SEQ ID NO: 232641 - DNA, 20 bp, Artificial
  CRISPR gRNA sequence
aattattcgggcgtggtggc

SEQ ID NO: 232642 - DNA, 20 bp, Artificial
  CRISPR gRNA sequence
tcgggcgtggtggcgggcgc

SEQ ID NO: 232643 - DNA, 20 bp, Artificial
  CRISPR gRNA sequence
gtggcgggcgccggtaatcc

SEQ ID NO: 232644 - DNA, 20 bp, Artificial
  CRISPR gRNA sequence
ccacgcccgaataatttttg

SEQ ID NO: 232645 - DNA, 20 bp, Artificial
  CRISPR gRNA sequence
ccgaataatttttgtagttt

SEQ ID NO: 232646 - DNA, 20 bp, Artificial
  CRISPR gRNA sequence
aataatttttgtagttttag

SEQ ID NO: 232647 - DNA, 20 bp, Artificial
  CRISPR gRNA sequence
taatttttgtagttttagta

SEQ ID NO: 232648 - DNA, 20 bp, Artificial
  CRISPR gRNA sequence
ttttgtagttttagtagaga

SEQ ID NO: 232649 - DNA, 20 bp, Artificial
  CRISPR gRNA sequence
tttgtagttttagtagagac

SEQ ID NO: 232650 - DNA, 20 bp, Artificial
  CRISPR gRNA sequence
gagacgggatttcgccatgt

SEQ ID NO: 232651 - DNA, 20 bp, Artificial
  CRISPR gRNA sequence
cgggatttcgccatgttagc

SEQ ID NO: 232652 - DNA, 20 bp, Artificial
  CRISPR gRNA sequence
tttcgccatgttagccagac

SEQ ID NO: 232653 - DNA, 20 bp, Artificial
  CRISPR gRNA sequence
tggtcttgaactcctgacct

SEQ ID NO: 232654 - DNA, 20 bp, Artificial
  CRISPR gRNA sequence
ggtcttgaactcctgacctc

SEQ ID NO: 232655 - DNA, 20 bp, Artificial
  CRISPR gRNA sequence
ctcaggtgatccacccgcct

SEQ ID NO: 232656 - DNA, 20 bp, Artificial
  CRISPR gRNA sequence
ccacccgccttggcctccca

SEQ ID NO: 232657 - DNA, 20 bp, Artificial
  CRISPR gRNA sequence
gccttggcctcccaaagtgc

SEQ ID NO: 232658 - DNA, 20 bp, Artificial
  CRISPR gRNA sequence
ccttggcctcccaaagtgct

SEQ ID NO: 232659 - DNA, 20 bp, Artificial
  CRISPR gRNA sequence
ctcccaaagtgctgggatta

SEQ ID NO: 232660 - DNA, 20 bp, Artificial
  CRISPR gRNA sequence
tcccaaagtgctgggattac

SEQ ID NO: 232661 - DNA, 20 bp, Artificial
  CRISPR gRNA sequence
caaagtgctgggattacagg

SEQ ID NO: 232662 - DNA, 20 bp, Artificial
  CRISPR gRNA sequence
aaagtgctgggattacaggc

SEQ ID NO: 232663 - DNA, 20 bp, Artificial
  CRISPR gRNA sequence
agtgctgggattacaggcgg

SEQ ID NO: 232664 - DNA, 20 bp, Artificial
  CRISPR gRNA sequence
caggcgggagccaccgtgcc

SEQ ID NO: 232665 - DNA, 20 bp, Artificial
  CRISPR gRNA sequence
ggagccaccgtgcctggcca

SEQ ID NO: 232666 - DNA, 20 bp, Artificial
  CRISPR gRNA sequence
gagccaccgtgcctggccat

SEQ ID NO: 232667 - DNA, 20 bp, Artificial
  CRISPR gRNA sequence
catgggtgtctgtcttacca

SEQ ID NO: 232668 - DNA, 20 bp, Artificial
  CRISPR gRNA sequence
tgtctgtcttaccatggctg

SEQ ID NO: 232669 - DNA, 20 bp, Artificial
  CRISPR gRNA sequence
tggctgtggtcactgctgct

SEQ ID NO: 232670 - DNA, 20 bp, Artificial
  CRISPR gRNA sequence
gctgtggtcactgctgctca

SEQ ID NO: 232671 - DNA, 20 bp, Artificial
  CRISPR gRNA sequence
tggtcactgctgctcagagc

SEQ ID NO: 232672 - DNA, 20 bp, Artificial
  CRISPR gRNA sequence
ctgctgctcagagctagtct

SEQ ID NO: 232673 - DNA, 20 bp, Artificial
  CRISPR gRNA sequence
tgctgctcagagctagtctt

SEQ ID NO: 232674 - DNA, 20 bp, Artificial
  CRISPR gRNA sequence
agagctagtcttgggcatac

SEQ ID NO: 232675 - DNA, 20 bp, Artificial
  CRISPR gRNA sequence
gagctagtcttgggcataca

SEQ ID NO: 232676 - DNA, 20 bp, Artificial
  CRISPR gRNA sequence
agctagtcttgggcatacaa

SEQ ID NO: 232677 - DNA, 20 bp, Artificial
  CRISPR gRNA sequence
gctagtcttgggcatacaag

SEQ ID NO: 232678 - DNA, 20 bp, Artificial
  CRISPR gRNA sequence
ctagtcttgggcatacaagg

SEQ ID NO: 232679 - DNA, 20 bp, Artificial
  CRISPR gRNA sequence
atacaagggggaccatgctt

SEQ ID NO: 232680 - DNA, 20 bp, Artificial
  CRISPR gRNA sequence
caagggggaccatgcttcag

SEQ ID NO: 232681 - DNA, 20 bp, Artificial
  CRISPR gRNA sequence
accatgcttcagcagtgcca

SEQ ID NO: 232682 - DNA, 20 bp, Artificial
  CRISPR gRNA sequence
tcagcagtgccacagccctg

SEQ ID NO: 232683 - DNA, 20 bp, Artificial
  CRISPR gRNA sequence
cagcagtgccacagccctga

SEQ ID NO: 232684 - DNA, 20 bp, Artificial
  CRISPR gRNA sequence
gtgccacagccctgaaggtc

SEQ ID NO: 232685 - DNA, 20 bp, Artificial
  CRISPR gRNA sequence
cagccctgaaggtccagact

SEQ ID NO: 232686 - DNA, 20 bp, Artificial
  CRISPR gRNA sequence
agccctgaaggtccagactg

SEQ ID NO: 232687 - DNA, 20 bp, Artificial
  CRISPR gRNA sequence
ccctgaaggtccagactgag

SEQ ID NO: 232688 - DNA, 20 bp, Artificial
  CRISPR gRNA sequence
aggagttgcctctcctgact

SEQ ID NO: 232689 - DNA, 20 bp, Artificial
  CRISPR gRNA sequence
ctcctgactcagtgctgcct

SEQ ID NO: 232690 - DNA, 20 bp, Artificial
  CRISPR gRNA sequence
cagtttacccacgtgctcca

SEQ ID NO: 232691 - DNA, 20 bp, Artificial
  CRISPR gRNA sequence
gctccatggacctttttgct

SEQ ID NO: 232692 - DNA, 20 bp, Artificial
  CRISPR gRNA sequence
ctccatggacctttttgctg

SEQ ID NO: 232693 - DNA, 20 bp, Artificial
  CRISPR gRNA sequence
tccatggacctttttgctga

SEQ ID NO: 232694 - DNA, 20 bp, Artificial
  CRISPR gRNA sequence
ggacctttttgctgagggtc

SEQ ID NO: 232695 - DNA, 20 bp, Artificial
  CRISPR gRNA sequence
ttttgctgagggtcgagccg

SEQ ID NO: 232696 - DNA, 20 bp, Artificial
  CRISPR gRNA sequence
tttgctgagggtcgagccgc

SEQ ID NO: 232697 - DNA, 20 bp, Artificial
  CRISPR gRNA sequence
ctgagggtcgagccgcaggc

SEQ ID NO: 232698 - DNA, 20 bp, Artificial
  CRISPR gRNA sequence
tgagggtcgagccgcaggcc

SEQ ID NO: 232699 - DNA, 20 bp, Artificial
  CRISPR gRNA sequence
ggccaggccctactgtgccc

SEQ ID NO: 232700 - DNA, 20 bp, Artificial
  CRISPR gRNA sequence
gccaggccctactgtgccct

SEQ ID NO: 232701 - DNA, 20 bp, Artificial
  CRISPR gRNA sequence
ccaggccctactgtgccctg

SEQ ID NO: 232702 - DNA, 20 bp, Artificial
  CRISPR gRNA sequence
tgtgccctggggtctgaaca

SEQ ID NO: 232703 - DNA, 20 bp, Artificial
  CRISPR gRNA sequence
gccctggggtctgaacacgg

SEQ ID NO: 232704 - DNA, 20 bp, Artificial
  CRISPR gRNA sequence
gggtctgaacacggtggtct

SEQ ID NO: 232705 - DNA, 20 bp, Artificial
  CRISPR gRNA sequence
ggtctgaacacggtggtctt

SEQ ID NO: 232706 - DNA, 20 bp, Artificial
  CRISPR gRNA sequence
ctgaacacggtggtcttggg

SEQ ID NO: 232707 - DNA, 20 bp, Artificial
  CRISPR gRNA sequence
aacacggtggtcttgggcag

SEQ ID NO: 232708 - DNA, 20 bp, Artificial
  CRISPR gRNA sequence
cacggtggtcttgggcagaa

SEQ ID NO: 232709 - DNA, 20 bp, Artificial
  CRISPR gRNA sequence
acggtggtcttgggcagaag

SEQ ID NO: 232710 - DNA, 20 bp, Artificial
  CRISPR gRNA sequence
tggtcttgggcagaagaggt

SEQ ID NO: 232711 - DNA, 20 bp, Artificial
  CRISPR gRNA sequence
tcttgggcagaagaggtcag

SEQ ID NO: 232712 - DNA, 20 bp, Artificial
  CRISPR gRNA sequence
cttgggcagaagaggtcaga

SEQ ID NO: 232713 - DNA, 20 bp, Artificial
  CRISPR gRNA sequence
gggcagaagaggtcagaagg

SEQ ID NO: 232714 - DNA, 20 bp, Artificial
  CRISPR gRNA sequence
aagaggtcagaaggcagaat

SEQ ID NO: 232715 - DNA, 20 bp, Artificial
  CRISPR gRNA sequence
aaggcagaataagccaatgc

SEQ ID NO: 232716 - DNA, 20 bp, Artificial
  CRISPR gRNA sequence
aggcagaataagccaatgct

SEQ ID NO: 232717 - DNA, 20 bp, Artificial
  CRISPR gRNA sequence
ggcagaataagccaatgctg

SEQ ID NO: 232718 - DNA, 20 bp, Artificial
  CRISPR gRNA sequence
gcagaataagccaatgctgg

SEQ ID NO: 232719 - DNA, 20 bp, Artificial
  CRISPR gRNA sequence
aagccaatgctgggggtgcc

SEQ ID NO: 232720 - DNA, 20 bp, Artificial
  CRISPR gRNA sequence
ccagaccccgcctttgtgcc

SEQ ID NO: 232721 - DNA, 20 bp, Artificial
  CRISPR gRNA sequence
ccgcctttgtgcccagccca

SEQ ID NO: 232722 - DNA, 20 bp, Artificial
  CRISPR gRNA sequence
ctttgtgcccagcccacagc

SEQ ID NO: 232723 - DNA, 20 bp, Artificial
  CRISPR gRNA sequence
tttgtgcccagcccacagcc

SEQ ID NO: 232724 - DNA, 20 bp, Artificial
  CRISPR gRNA sequence
ttgtgcccagcccacagcca

SEQ ID NO: 232725 - DNA, 20 bp, Artificial
  CRISPR gRNA sequence
cagcccacagccagggtccc

SEQ ID NO: 232726 - DNA, 20 bp, Artificial
  CRISPR gRNA sequence
ctctcccctcccctcctcca

SEQ ID NO: 232727 - DNA, 20 bp, Artificial
  CRISPR gRNA sequence
cccctcctccacagtcctta

SEQ ID NO: 232728 - DNA, 20 bp, Artificial
  CRISPR gRNA sequence
tccttatagccacaccccgc

SEQ ID NO: 232729 - DNA, 20 bp, Artificial
  CRISPR gRNA sequence
ccttatagccacaccccgca

SEQ ID NO: 232730 - DNA, 20 bp, Artificial
  CRISPR gRNA sequence
cacaccccgcaaggaaaacc

SEQ ID NO: 232731 - DNA, 20 bp, Artificial
  CRISPR gRNA sequence
cgcaaggaaaacccagactc

SEQ ID NO: 232732 - DNA, 20 bp, Artificial
  CRISPR gRNA sequence
gaaaacccagactctggcga

SEQ ID NO: 232733 - DNA, 20 bp, Artificial
  CRISPR gRNA sequence
aacccagactctggcgacag

SEQ ID NO: 232734 - DNA, 20 bp, Artificial
  CRISPR gRNA sequence
cccagactctggcgacagca

SEQ ID NO: 232735 - DNA, 20 bp, Artificial
  CRISPR gRNA sequence
actctggcgacagcagagac

SEQ ID NO: 232736 - DNA, 20 bp, Artificial
  CRISPR gRNA sequence
ctctggcgacagcagagacg

SEQ ID NO: 232737 - DNA, 20 bp, Artificial
  CRISPR gRNA sequence
agcagagacgaggatgtgcg

SEQ ID NO: 232738 - DNA, 20 bp, Artificial
  CRISPR gRNA sequence
gcagagacgaggatgtgcgt

SEQ ID NO: 232739 - DNA, 20 bp, Artificial
  CRISPR gRNA sequence
cagagacgaggatgtgcgtg

SEQ ID NO: 232740 - DNA, 20 bp, Artificial
  CRISPR gRNA sequence
agagacgaggatgtgcgtgg

SEQ ID NO: 232741 - DNA, 20 bp, Artificial
  CRISPR gRNA sequence
cgaggatgtgcgtgggggct

SEQ ID NO: 232742 - DNA, 20 bp, Artificial
  CRISPR gRNA sequence
ggatgtgcgtgggggctcgg

SEQ ID NO: 232743 - DNA, 20 bp, Artificial
  CRISPR gRNA sequence
gtgcgtgggggctcggcggc

SEQ ID NO: 232744 - DNA, 20 bp, Artificial
  CRISPR gRNA sequence
tgcgtgggggctcggcggct

SEQ ID NO: 232745 - DNA, 20 bp, Artificial
  CRISPR gRNA sequence
ggggctcggcggctgggccg

SEQ ID NO: 232746 - DNA, 20 bp, Artificial
  CRISPR gRNA sequence
gggctcggcggctgggccgc

SEQ ID NO: 232747 - DNA, 20 bp, Artificial
  CRISPR gRNA sequence
gctgggccgcgggccgtgtg

SEQ ID NO: 232748 - DNA, 20 bp, Artificial
  CRISPR gRNA sequence
gtgtgcggctctgctcctcc

SEQ ID NO: 232749 - DNA, 20 bp, Artificial
  CRISPR gRNA sequence
tgtgcggctctgctcctcct

SEQ ID NO: 232750 - DNA, 20 bp, Artificial
  CRISPR gRNA sequence
ggctctgctcctcctgggcc

SEQ ID NO: 232751 - DNA, 20 bp, Artificial
  CRISPR gRNA sequence
gctctgctcctcctgggcct

SEQ ID NO: 232752 - DNA, 20 bp, Artificial
  CRISPR gRNA sequence
ctctgctcctcctgggcctg

SEQ ID NO: 232753 - DNA, 20 bp, Artificial
  CRISPR gRNA sequence
ctcctcctgggcctggggct

SEQ ID NO: 232754 - DNA, 20 bp, Artificial
  CRISPR gRNA sequence
cctggggctgagcaccgtga

SEQ ID NO: 232755 - DNA, 20 bp, Artificial
  CRISPR gRNA sequence
ctggggctgagcaccgtgac

SEQ ID NO: 232756 - DNA, 20 bp, Artificial
  CRISPR gRNA sequence
tggggctgagcaccgtgacg

SEQ ID NO: 232757 - DNA, 20 bp, Artificial
  CRISPR gRNA sequence
gtgacggggctccactgtgt

SEQ ID NO: 232758 - DNA, 20 bp, Artificial
  CRISPR gRNA sequence
tgacggggctccactgtgtc

SEQ ID NO: 232759 - DNA, 20 bp, Artificial
  CRISPR gRNA sequence
gacggggctccactgtgtcg

SEQ ID NO: 232760 - DNA, 20 bp, Artificial
  CRISPR gRNA sequence
tgtgtcggggacacctaccc

SEQ ID NO: 232761 - DNA, 20 bp, Artificial
  CRISPR gRNA sequence
acacctaccccagcaacgac

SEQ ID NO: 232762 - DNA, 20 bp, Artificial
  CRISPR gRNA sequence
gcaacgaccggtgctgccac

SEQ ID NO: 232763 - DNA, 20 bp, Artificial
  CRISPR gRNA sequence
gaccggtgctgccacgagtg

SEQ ID NO: 232764 - DNA, 20 bp, Artificial
  CRISPR gRNA sequence
accggtgctgccacgagtgc

SEQ ID NO: 232765 - DNA, 20 bp, Artificial
  CRISPR gRNA sequence
gtgctgccacgagtgcaggc

SEQ ID NO: 232766 - DNA, 20 bp, Artificial
  CRISPR gRNA sequence
tgctgccacgagtgcaggcc

SEQ ID NO: 232767 - DNA, 20 bp, Artificial
  CRISPR gRNA sequence
gccacgagtgcaggccaggt

SEQ ID NO: 232768 - DNA, 20 bp, Artificial
  CRISPR gRNA sequence
ccacgagtgcaggccaggtg

SEQ ID NO: 232769 - DNA, 20 bp, Artificial
  CRISPR gRNA sequence
gtgcaggccaggtgaggcct

SEQ ID NO: 232770 - DNA, 20 bp, Artificial
  CRISPR gRNA sequence
tgcaggccaggtgaggcctc

SEQ ID NO: 232771 - DNA, 20 bp, Artificial
  CRISPR gRNA sequence
caggccaggtgaggcctcag

SEQ ID NO: 232772 - DNA, 20 bp, Artificial
  CRISPR gRNA sequence
aggccaggtgaggcctcagg

SEQ ID NO: 232773 - DNA, 20 bp, Artificial
  CRISPR gRNA sequence
ggccaggtgaggcctcagga

SEQ ID NO: 232774 - DNA, 20 bp, Artificial
  CRISPR gRNA sequence
gccaggtgaggcctcaggag

SEQ ID NO: 232775 - DNA, 20 bp, Artificial
  CRISPR gRNA sequence
tcaggaggggtcgccacgca

SEQ ID NO: 232776 - DNA, 20 bp, Artificial
  CRISPR gRNA sequence
caggaggggtcgccacgcac

SEQ ID NO: 232777 - DNA, 20 bp, Artificial
  CRISPR gRNA sequence
gtcgccacgcacgggcactc

SEQ ID NO: 232778 - DNA, 20 bp, Artificial
  CRISPR gRNA sequence
tcgccacgcacgggcactcc

SEQ ID NO: 232779 - DNA, 20 bp, Artificial
  CRISPR gRNA sequence
cgccacgcacgggcactcca

SEQ ID NO: 232780 - DNA, 20 bp, Artificial
  CRISPR gRNA sequence
cgcacgggcactccagggac

SEQ ID NO: 232781 - DNA, 20 bp, Artificial
  CRISPR gRNA sequence
gcacgggcactccagggact

SEQ ID NO: 232782 - DNA, 20 bp, Artificial
  CRISPR gRNA sequence
cacgggcactccagggactg

SEQ ID NO: 232783 - DNA, 20 bp, Artificial
  CRISPR gRNA sequence
acgggcactccagggactgg

SEQ ID NO: 232784 - DNA, 20 bp, Artificial
  CRISPR gRNA sequence
gcactccagggactgggggc

SEQ ID NO: 232785 - DNA, 20 bp, Artificial
  CRISPR gRNA sequence
cactccagggactgggggct

SEQ ID NO: 232786 - DNA, 20 bp, Artificial
  CRISPR gRNA sequence
actccagggactgggggctg

SEQ ID NO: 232787 - DNA, 20 bp, Artificial
  CRISPR gRNA sequence
ccagggactgggggctgggg

SEQ ID NO: 232788 - DNA, 20 bp, Artificial
  CRISPR gRNA sequence
cagggactgggggctggggc

SEQ ID NO: 232789 - DNA, 20 bp, Artificial
  CRISPR gRNA sequence
agggactgggggctggggca

SEQ ID NO: 232790 - DNA, 20 bp, Artificial
  CRISPR gRNA sequence
actgggggctggggcaggga

SEQ ID NO: 232791 - DNA, 20 bp, Artificial
  CRISPR gRNA sequence
ctgggggctggggcagggat

SEQ ID NO: 232792 - DNA, 20 bp, Artificial
  CRISPR gRNA sequence
gggctggggcagggatgggc

SEQ ID NO: 232793 - DNA, 20 bp, Artificial
  CRISPR gRNA sequence
tggggcagggatgggccagc

SEQ ID NO: 232794 - DNA, 20 bp, Artificial
  CRISPR gRNA sequence
ggggcagggatgggccagcc

SEQ ID NO: 232795 - DNA, 20 bp, Artificial
  CRISPR gRNA sequence
ggcagggatgggccagccag

SEQ ID NO: 232796 - DNA, 20 bp, Artificial
  CRISPR gRNA sequence
gcagggatgggccagccagg

SEQ ID NO: 232797 - DNA, 20 bp, Artificial
  CRISPR gRNA sequence
ggatgggccagccaggaggc

SEQ ID NO: 232798 - DNA, 20 bp, Artificial
  CRISPR gRNA sequence
gccagccaggaggctggtcc

SEQ ID NO: 232799 - DNA, 20 bp, Artificial
  CRISPR gRNA sequence
ccagccaggaggctggtcct

SEQ ID NO: 232800 - DNA, 20 bp, Artificial
  CRISPR gRNA sequence
cagccaggaggctggtcctg

SEQ ID NO: 232801 - DNA, 20 bp, Artificial
  CRISPR gRNA sequence
gccaggaggctggtcctggg

SEQ ID NO: 232802 - DNA, 20 bp, Artificial
  CRISPR gRNA sequence
ccaggaggctggtcctgggg

SEQ ID NO: 232803 - DNA, 20 bp, Artificial
  CRISPR gRNA sequence
caggaggctggtcctgggga

SEQ ID NO: 232804 - DNA, 20 bp, Artificial
  CRISPR gRNA sequence
aggaggctggtcctggggag

SEQ ID NO: 232805 - DNA, 20 bp, Artificial
  CRISPR gRNA sequence
ggaggctggtcctggggagg

SEQ ID NO: 232806 - DNA, 20 bp, Artificial
  CRISPR gRNA sequence
ggctggtcctggggaggggg

SEQ ID NO: 232807 - DNA, 20 bp, Artificial
  CRISPR gRNA sequence
gctggtcctggggagggggc

SEQ ID NO: 232808 - DNA, 20 bp, Artificial
  CRISPR gRNA sequence
gtcctggggagggggcgggt

SEQ ID NO: 232809 - DNA, 20 bp, Artificial
  CRISPR gRNA sequence
tcctggggagggggcgggtg

SEQ ID NO: 232810 - DNA, 20 bp, Artificial
  CRISPR gRNA sequence
cctggggagggggcgggtga

SEQ ID NO: 232811 - DNA, 20 bp, Artificial
  CRISPR gRNA sequence
ctggggagggggcgggtgag

SEQ ID NO: 232812 - DNA, 20 bp, Artificial
  CRISPR gRNA sequence
ggagggggcgggtgaggggc

SEQ ID NO: 232813 - DNA, 20 bp, Artificial
  CRISPR gRNA sequence
gggcgggtgaggggccggcc

SEQ ID NO: 232814 - DNA, 20 bp, Artificial
  CRISPR gRNA sequence
ggtgaggggccggccaagcc

SEQ ID NO: 232815 - DNA, 20 bp, Artificial
  CRISPR gRNA sequence
gaggggccggccaagcctgg

SEQ ID NO: 232816 - DNA, 20 bp, Artificial
  CRISPR gRNA sequence
ggggccggccaagcctggca

SEQ ID NO: 232817 - DNA, 20 bp, Artificial
  CRISPR gRNA sequence
gggccggccaagcctggcag

SEQ ID NO: 232818 - DNA, 20 bp, Artificial
  CRISPR gRNA sequence
gccggccaagcctggcagag

SEQ ID NO: 232819 - DNA, 20 bp, Artificial
  CRISPR gRNA sequence
agcctggcagaggagccgcc

SEQ ID NO: 232820 - DNA, 20 bp, Artificial
  CRISPR gRNA sequence
gcctggcagaggagccgcct

SEQ ID NO: 232821 - DNA, 20 bp, Artificial
  CRISPR gRNA sequence
cctggcagaggagccgcctg

SEQ ID NO: 232822 - DNA, 20 bp, Artificial
  CRISPR gRNA sequence
ctggcagaggagccgcctgg

SEQ ID NO: 232823 - DNA, 20 bp, Artificial
  CRISPR gRNA sequence
tggcagaggagccgcctggg

SEQ ID NO: 232824 - DNA, 20 bp, Artificial
  CRISPR gRNA sequence
ggcagaggagccgcctgggg

SEQ ID NO: 232825 - DNA, 20 bp, Artificial
  CRISPR gRNA sequence
gagccgcctgggggggtcca

SEQ ID NO: 232826 - DNA, 20 bp, Artificial
  CRISPR gRNA sequence
agccgcctgggggggtccac

SEQ ID NO: 232827 - DNA, 20 bp, Artificial
  CRISPR gRNA sequence
ctgggggggtccacgggcgc

SEQ ID NO: 232828 - DNA, 20 bp, Artificial
  CRISPR gRNA sequence
ggggtccacgggcgcaagcc

SEQ ID NO: 232829 - DNA, 20 bp, Artificial
  CRISPR gRNA sequence
gggtccacgggcgcaagcct

SEQ ID NO: 232830 - DNA, 20 bp, Artificial
  CRISPR gRNA sequence
ggtccacgggcgcaagcctg

SEQ ID NO: 232831 - DNA, 20 bp, Artificial
  CRISPR gRNA sequence
gcctgaccgctgcctgacgc

SEQ ID NO: 232832 - DNA, 20 bp, Artificial
  CRISPR gRNA sequence
cctgacgccggcctctgctg

SEQ ID NO: 232833 - DNA, 20 bp, Artificial
  CRISPR gRNA sequence
ctgacgccggcctctgctgc

SEQ ID NO: 232834 - DNA, 20 bp, Artificial
  CRISPR gRNA sequence
ccggcctctgctgcaggcaa

SEQ ID NO: 232835 - DNA, 20 bp, Artificial
  CRISPR gRNA sequence
cggcctctgctgcaggcaac

SEQ ID NO: 232836 - DNA, 20 bp, Artificial
  CRISPR gRNA sequence
ctctgctgcaggcaacggga

SEQ ID NO: 232837 - DNA, 20 bp, Artificial
  CRISPR gRNA sequence
gctgcaggcaacgggatggt

SEQ ID NO: 232838 - DNA, 20 bp, Artificial
  CRISPR gRNA sequence
aacgggatggtgagccgctg

SEQ ID NO: 232839 - DNA, 20 bp, Artificial
  CRISPR gRNA sequence
tgagccgctgcagccgctcc

SEQ ID NO: 232840 - DNA, 20 bp, Artificial
  CRISPR gRNA sequence
ctgcagccgctcccagaaca

SEQ ID NO: 232841 - DNA, 20 bp, Artificial
  CRISPR gRNA sequence
aacacggtgtgccgtccgtg

SEQ ID NO: 232842 - DNA, 20 bp, Artificial
  CRISPR gRNA sequence
acacggtgtgccgtccgtgc

SEQ ID NO: 232843 - DNA, 20 bp, Artificial
  CRISPR gRNA sequence
ggtgtgccgtccgtgcgggc

SEQ ID NO: 232844 - DNA, 20 bp, Artificial
  CRISPR gRNA sequence
gtgtgccgtccgtgcgggcc

SEQ ID NO: 232845 - DNA, 20 bp, Artificial
  CRISPR gRNA sequence
gccgggcttctacaacgacg

SEQ ID NO: 232846 - DNA, 20 bp, Artificial
  CRISPR gRNA sequence
ggcttctacaacgacgtggt

SEQ ID NO: 232847 - DNA, 20 bp, Artificial
  CRISPR gRNA sequence
acaacgacgtggtcagctcc

SEQ ID NO: 232848 - DNA, 20 bp, Artificial
  CRISPR gRNA sequence
tggtcagctccaagccgtgc

SEQ ID NO: 232849 - DNA, 20 bp, Artificial
  CRISPR gRNA sequence
agccgtgcaagccctgcacg

SEQ ID NO: 232850 - DNA, 20 bp, Artificial
  CRISPR gRNA sequence
ccctgcacgtggtgtaacct

SEQ ID NO: 232851 - DNA, 20 bp, Artificial
  CRISPR gRNA sequence
gcacgtggtgtaacctcagt

SEQ ID NO: 232852 - DNA, 20 bp, Artificial
  CRISPR gRNA sequence
aacctcagtgagctcccacc

SEQ ID NO: 232853 - DNA, 20 bp, Artificial
  CRISPR gRNA sequence
tgagctcccacctggcccca

SEQ ID NO: 232854 - DNA, 20 bp, Artificial
  CRISPR gRNA sequence
cctggccccacagccccacc

SEQ ID NO: 232855 - DNA, 20 bp, Artificial
  CRISPR gRNA sequence
ccccacagccccacccagca

SEQ ID NO: 232856 - DNA, 20 bp, Artificial
  CRISPR gRNA sequence
cccacagccccacccagcac

SEQ ID NO: 232857 - DNA, 20 bp, Artificial
  CRISPR gRNA sequence
ccacagccccacccagcaca

SEQ ID NO: 232858 - DNA, 20 bp, Artificial
  CRISPR gRNA sequence
cacagccccacccagcacag

SEQ ID NO: 232859 - DNA, 20 bp, Artificial
  CRISPR gRNA sequence
acagccccacccagcacagg

SEQ ID NO: 232860 - DNA, 20 bp, Artificial
  CRISPR gRNA sequence
gccccacccagcacaggggg

SEQ ID NO: 232861 - DNA, 20 bp, Artificial
  CRISPR gRNA sequence
ccacccagcacagggggcgg

SEQ ID NO: 232862 - DNA, 20 bp, Artificial
  CRISPR gRNA sequence
cagcacagggggcggcagcc

SEQ ID NO: 232863 - DNA, 20 bp, Artificial
  CRISPR gRNA sequence
ctggcacccacattcccacg

SEQ ID NO: 232864 - DNA, 20 bp, Artificial
  CRISPR gRNA sequence
gcacccacattcccacgcag

SEQ ID NO: 232865 - DNA, 20 bp, Artificial
  CRISPR gRNA sequence
cacattcccacgcagcagca

SEQ ID NO: 232866 - DNA, 20 bp, Artificial
  CRISPR gRNA sequence
acattcccacgcagcagcat

SEQ ID NO: 232867 - DNA, 20 bp, Artificial
  CRISPR gRNA sequence
cattcccacgcagcagcatg

SEQ ID NO: 232868 - DNA, 20 bp, Artificial
  CRISPR gRNA sequence
gcagcagcatggggctccca

SEQ ID NO: 232869 - DNA, 20 bp, Artificial
  CRISPR gRNA sequence
gcatggggctcccacagccg

SEQ ID NO: 232870 - DNA, 20 bp, Artificial
  CRISPR gRNA sequence
cagaaacgaacctcaaacca

SEQ ID NO: 232871 - DNA, 20 bp, Artificial
  CRISPR gRNA sequence
aaacgaacctcaaaccacag

SEQ ID NO: 232872 - DNA, 20 bp, Artificial
  CRISPR gRNA sequence
aacgaacctcaaaccacagc

SEQ ID NO: 232873 - DNA, 20 bp, Artificial
  CRISPR gRNA sequence
acgaacctcaaaccacagcg

SEQ ID NO: 232874 - DNA, 20 bp, Artificial
  CRISPR gRNA sequence
cagcggggtctgctccgcca

SEQ ID NO: 232875 - DNA, 20 bp, Artificial
  CRISPR gRNA sequence
agcggggtctgctccgccac

SEQ ID NO: 232876 - DNA, 20 bp, Artificial
  CRISPR gRNA sequence
gcggggtctgctccgccaca

SEQ ID NO: 232877 - DNA, 20 bp, Artificial
  CRISPR gRNA sequence
cggggtctgctccgccacag

SEQ ID NO: 232878 - DNA, 20 bp, Artificial
  CRISPR gRNA sequence
ctccgccacaggggtccttc

SEQ ID NO: 232879 - DNA, 20 bp, Artificial
  CRISPR gRNA sequence
tccgccacaggggtccttcg

SEQ ID NO: 232880 - DNA, 20 bp, Artificial
  CRISPR gRNA sequence
cgccacaggggtccttcgag

SEQ ID NO: 232881 - DNA, 20 bp, Artificial
  CRISPR gRNA sequence
caggggtccttcgaggagct

SEQ ID NO: 232882 - DNA, 20 bp, Artificial
  CRISPR gRNA sequence
aggggtccttcgaggagctg

SEQ ID NO: 232883 - DNA, 20 bp, Artificial
  CRISPR gRNA sequence
cgaggagctgaggcgtctcc

SEQ ID NO: 232884 - DNA, 20 bp, Artificial
  CRISPR gRNA sequence
gaggagctgaggcgtctccc

SEQ ID NO: 232885 - DNA, 20 bp, Artificial
  CRISPR gRNA sequence
aggagctgaggcgtctccca

SEQ ID NO: 232886 - DNA, 20 bp, Artificial
  CRISPR gRNA sequence
ggagctgaggcgtctcccag

SEQ ID NO: 232887 - DNA, 20 bp, Artificial
  CRISPR gRNA sequence
aggggcaccccctctccctc

SEQ ID NO: 232888 - DNA, 20 bp, Artificial
  CRISPR gRNA sequence
ggggcaccccctctccctcc

SEQ ID NO: 232889 - DNA, 20 bp, Artificial
  CRISPR gRNA sequence
gggcaccccctctccctccg

SEQ ID NO: 232890 - DNA, 20 bp, Artificial
  CRISPR gRNA sequence
ggcaccccctctccctccgg

SEQ ID NO: 232891 - DNA, 20 bp, Artificial
  CRISPR gRNA sequence
cccctctccctccgggggcc

SEQ ID NO: 232892 - DNA, 20 bp, Artificial
  CRISPR gRNA sequence
tccctccgggggcccagact

SEQ ID NO: 232893 - DNA, 20 bp, Artificial
  CRISPR gRNA sequence
ccgggggcccagactcggcc

SEQ ID NO: 232894 - DNA, 20 bp, Artificial
  CRISPR gRNA sequence
cgggggcccagactcggccc

SEQ ID NO: 232895 - DNA, 20 bp, Artificial
  CRISPR gRNA sequence
cagactcggcccaggccacg

SEQ ID NO: 232896 - DNA, 20 bp, Artificial
  CRISPR gRNA sequence
gactcggcccaggccacgtg

SEQ ID NO: 232897 - DNA, 20 bp, Artificial
  CRISPR gRNA sequence
cggcccaggccacgtggagt

SEQ ID NO: 232898 - DNA, 20 bp, Artificial
  CRISPR gRNA sequence
ggcccaggccacgtggagtc

SEQ ID NO: 232899 - DNA, 20 bp, Artificial
  CRISPR gRNA sequence
gcccaggccacgtggagtcg

SEQ ID NO: 232900 - DNA, 20 bp, Artificial
  CRISPR gRNA sequence
ccaggccacgtggagtcggg

SEQ ID NO: 232901 - DNA, 20 bp, Artificial
  CRISPR gRNA sequence
tggagtcggggagaccacgc

SEQ ID NO: 232902 - DNA, 20 bp, Artificial
  CRISPR gRNA sequence
gggagaccacgctggccatg

SEQ ID NO: 232903 - DNA, 20 bp, Artificial
  CRISPR gRNA sequence
accacgctggccatgtggcc

SEQ ID NO: 232904 - DNA, 20 bp, Artificial
  CRISPR gRNA sequence
gccatgtggcctggccttgc

SEQ ID NO: 232905 - DNA, 20 bp, Artificial
  CRISPR gRNA sequence
tggcctggccttgctggcct

SEQ ID NO: 232906 - DNA, 20 bp, Artificial
  CRISPR gRNA sequence
cctggccttgctggcctgag

SEQ ID NO: 232907 - DNA, 20 bp, Artificial
  CRISPR gRNA sequence
gccttgctggcctgagcagt

SEQ ID NO: 232908 - DNA, 20 bp, Artificial
  CRISPR gRNA sequence
ccttgctggcctgagcagtg

SEQ ID NO: 232909 - DNA, 20 bp, Artificial
  CRISPR gRNA sequence
gctggcctgagcagtgaggc

SEQ ID NO: 232910 - DNA, 20 bp, Artificial
  CRISPR gRNA sequence
ctggcctgagcagtgaggct

SEQ ID NO: 232911 - DNA, 20 bp, Artificial
  CRISPR gRNA sequence
tggcctgagcagtgaggctg

SEQ ID NO: 232912 - DNA, 20 bp, Artificial
  CRISPR gRNA sequence
ggcctgagcagtgaggctgg

SEQ ID NO: 232913 - DNA, 20 bp, Artificial
  CRISPR gRNA sequence
gcctgagcagtgaggctggg

SEQ ID NO: 232914 - DNA, 20 bp, Artificial
  CRISPR gRNA sequence
gagcagtgaggctggggggt

SEQ ID NO: 232915 - DNA, 20 bp, Artificial
  CRISPR gRNA sequence
agcagtgaggctggggggtt

SEQ ID NO: 232916 - DNA, 20 bp, Artificial
  CRISPR gRNA sequence
gaggctggggggttgggcca

SEQ ID NO: 232917 - DNA, 20 bp, Artificial
  CRISPR gRNA sequence
ggctggggggttgggccatg

SEQ ID NO: 232918 - DNA, 20 bp, Artificial
  CRISPR gRNA sequence
gggccatggagaccctgccg

SEQ ID NO: 232919 - DNA, 20 bp, Artificial
  CRISPR gRNA sequence
ggccatggagaccctgccgc

SEQ ID NO: 232920 - DNA, 20 bp, Artificial
  CRISPR gRNA sequence
catggagaccctgccgcagg

SEQ ID NO: 232921 - DNA, 20 bp, Artificial
  CRISPR gRNA sequence
atggagaccctgccgcaggc

SEQ ID NO: 232922 - DNA, 20 bp, Artificial
  CRISPR gRNA sequence
tggagaccctgccgcaggcg

SEQ ID NO: 232923 - DNA, 20 bp, Artificial
  CRISPR gRNA sequence
gaccctgccgcaggcggggc

SEQ ID NO: 232924 - DNA, 20 bp, Artificial
  CRISPR gRNA sequence
cctgccgcaggcggggctgg

SEQ ID NO: 232925 - DNA, 20 bp, Artificial
  CRISPR gRNA sequence
ccgcaggcggggctggcggc

SEQ ID NO: 232926 - DNA, 20 bp, Artificial
  CRISPR gRNA sequence
gcaggcggggctggcggctg

SEQ ID NO: 232927 - DNA, 20 bp, Artificial
  CRISPR gRNA sequence
caggcggggctggcggctgg

SEQ ID NO: 232928 - DNA, 20 bp, Artificial
  CRISPR gRNA sequence
gcggggctggcggctggagg

SEQ ID NO: 232929 - DNA, 20 bp, Artificial
  CRISPR gRNA sequence
gggctggcggctggaggcgg

SEQ ID NO: 232930 - DNA, 20 bp, Artificial
  CRISPR gRNA sequence
gctggcggctggaggcggtg

SEQ ID NO: 232931 - DNA, 20 bp, Artificial
  CRISPR gRNA sequence
ctggcggctggaggcggtgg

SEQ ID NO: 232932 - DNA, 20 bp, Artificial
  CRISPR gRNA sequence
tggcggctggaggcggtgga

SEQ ID NO: 232933 - DNA, 20 bp, Artificial
  CRISPR gRNA sequence
ggcggctggaggcggtggag

SEQ ID NO: 232934 - DNA, 20 bp, Artificial
  CRISPR gRNA sequence
ggctggaggcggtggagggg

SEQ ID NO: 232935 - DNA, 20 bp, Artificial
  CRISPR gRNA sequence
gctggaggcggtggaggggt

SEQ ID NO: 232936 - DNA, 20 bp, Artificial
  CRISPR gRNA sequence
ctggaggcggtggaggggta

SEQ ID NO: 232937 - DNA, 20 bp, Artificial
  CRISPR gRNA sequence
gaggcggtggaggggtaggg

SEQ ID NO: 232938 - DNA, 20 bp, Artificial
  CRISPR gRNA sequence
aggcggtggaggggtaggga

SEQ ID NO: 232939 - DNA, 20 bp, Artificial
  CRISPR gRNA sequence
ggcggtggaggggtagggaa

SEQ ID NO: 232940 - DNA, 20 bp, Artificial
  CRISPR gRNA sequence
ggtggaggggtagggaaggg

SEQ ID NO: 232941 - DNA, 20 bp, Artificial
  CRISPR gRNA sequence
gaggggtagggaagggtggc

SEQ ID NO: 232942 - DNA, 20 bp, Artificial
  CRISPR gRNA sequence
aggggtagggaagggtggct

SEQ ID NO: 232943 - DNA, 20 bp, Artificial
  CRISPR gRNA sequence
ggggtagggaagggtggctg

SEQ ID NO: 232944 - DNA, 20 bp, Artificial
  CRISPR gRNA sequence
aagggtggctggggctgcca

SEQ ID NO: 232945 - DNA, 20 bp, Artificial
  CRISPR gRNA sequence
ggctggggctgccacggaac

SEQ ID NO: 232946 - DNA, 20 bp, Artificial
  CRISPR gRNA sequence
ggctgccacggaaccagccc

SEQ ID NO: 232947 - DNA, 20 bp, Artificial
  CRISPR gRNA sequence
gctgccacggaaccagcccc

SEQ ID NO: 232948 - DNA, 20 bp, Artificial
  CRISPR gRNA sequence
acggaaccagccccaggttg

SEQ ID NO: 232949 - DNA, 20 bp, Artificial
  CRISPR gRNA sequence
aaccagccccaggttgtggc

SEQ ID NO: 232950 - DNA, 20 bp, Artificial
  CRISPR gRNA sequence
accagccccaggttgtggcc

SEQ ID NO: 232951 - DNA, 20 bp, Artificial
  CRISPR gRNA sequence
agccccaggttgtggccagg

SEQ ID NO: 232952 - DNA, 20 bp, Artificial
  CRISPR gRNA sequence
gccccaggttgtggccagga

SEQ ID NO: 232953 - DNA, 20 bp, Artificial
  CRISPR gRNA sequence
ccccaggttgtggccaggaa

SEQ ID NO: 232954 - DNA, 20 bp, Artificial
  CRISPR gRNA sequence
ccaggttgtggccaggaagg

SEQ ID NO: 232955 - DNA, 20 bp, Artificial
  CRISPR gRNA sequence
caggttgtggccaggaaggg

SEQ ID NO: 232956 - DNA, 20 bp, Artificial
  CRISPR gRNA sequence
aggttgtggccaggaaggga

SEQ ID NO: 232957 - DNA, 20 bp, Artificial
  CRISPR gRNA sequence
gtggccaggaagggagggcc

SEQ ID NO: 232958 - DNA, 20 bp, Artificial
  CRISPR gRNA sequence
tggccaggaagggagggccc

SEQ ID NO: 232959 - DNA, 20 bp, Artificial
  CRISPR gRNA sequence
gccaggaagggagggcccag

SEQ ID NO: 232960 - DNA, 20 bp, Artificial
  CRISPR gRNA sequence
aagggagggcccaggagcct

SEQ ID NO: 232961 - DNA, 20 bp, Artificial
  CRISPR gRNA sequence
agggagggcccaggagcctc

SEQ ID NO: 232962 - DNA, 20 bp, Artificial
  CRISPR gRNA sequence
gggagggcccaggagcctcg

SEQ ID NO: 232963 - DNA, 20 bp, Artificial
  CRISPR gRNA sequence
ggagggcccaggagcctcgg

SEQ ID NO: 232964 - DNA, 20 bp, Artificial
  CRISPR gRNA sequence
cccaggagcctcgggggctg

SEQ ID NO: 232965 - DNA, 20 bp, Artificial
  CRISPR gRNA sequence
ccaggagcctcgggggctgc

SEQ ID NO: 232966 - DNA, 20 bp, Artificial
  CRISPR gRNA sequence
caggagcctcgggggctgca

SEQ ID NO: 232967 - DNA, 20 bp, Artificial
  CRISPR gRNA sequence
aggagcctcgggggctgcag

SEQ ID NO: 232968 - DNA, 20 bp, Artificial
  CRISPR gRNA sequence
tcgggggctgcaggggctcc

SEQ ID NO: 232969 - DNA, 20 bp, Artificial
  CRISPR gRNA sequence
gctgcaggggctccaagtct

SEQ ID NO: 232970 - DNA, 20 bp, Artificial
  CRISPR gRNA sequence
ctgcaggggctccaagtctc

SEQ ID NO: 232971 - DNA, 20 bp, Artificial
  CRISPR gRNA sequence
tgcaggggctccaagtctca

SEQ ID NO: 232972 - DNA, 20 bp, Artificial
  CRISPR gRNA sequence
gcaggggctccaagtctcag

SEQ ID NO: 232973 - DNA, 20 bp, Artificial
  CRISPR gRNA sequence
aggggctccaagtctcaggg

SEQ ID NO: 232974 - DNA, 20 bp, Artificial
  CRISPR gRNA sequence
ggggctccaagtctcagggg

SEQ ID NO: 232975 - DNA, 20 bp, Artificial
  CRISPR gRNA sequence
ccaagtctcaggggaggccg

SEQ ID NO: 232976 - DNA, 20 bp, Artificial
  CRISPR gRNA sequence
aggccgcagacccctgccca

SEQ ID NO: 232977 - DNA, 20 bp, Artificial
  CRISPR gRNA sequence
cctgcccacggccctctgtg

SEQ ID NO: 232978 - DNA, 20 bp, Artificial
  CRISPR gRNA sequence
gcccacggccctctgtgtgg

SEQ ID NO: 232979 - DNA, 20 bp, Artificial
  CRISPR gRNA sequence
cccacggccctctgtgtggt

SEQ ID NO: 232980 - DNA, 20 bp, Artificial
  CRISPR gRNA sequence
ccacggccctctgtgtggtg

SEQ ID NO: 232981 - DNA, 20 bp, Artificial
  CRISPR gRNA sequence
acggccctctgtgtggtggg

SEQ ID NO: 232982 - DNA, 20 bp, Artificial
  CRISPR gRNA sequence
cggccctctgtgtggtgggg

SEQ ID NO: 232983 - DNA, 20 bp, Artificial
  CRISPR gRNA sequence
ggggaggccaacctgtcctc

SEQ ID NO: 232984 - DNA, 20 bp, Artificial
  CRISPR gRNA sequence
ctccagtgcccacgcttcct

SEQ ID NO: 232985 - DNA, 20 bp, Artificial
  CRISPR gRNA sequence
tccagtgcccacgcttcctg

SEQ ID NO: 232986 - DNA, 20 bp, Artificial
  CRISPR gRNA sequence
cttcctgaggaccctgtcca

SEQ ID NO: 232987 - DNA, 20 bp, Artificial
  CRISPR gRNA sequence
cacctgaccacccccccatc

SEQ ID NO: 232988 - DNA, 20 bp, Artificial
  CRISPR gRNA sequence
ccccccatccggcccctgct

SEQ ID NO: 232989 - DNA, 20 bp, Artificial
  CRISPR gRNA sequence
cccccatccggcccctgctc

SEQ ID NO: 232990 - DNA, 20 bp, Artificial
  CRISPR gRNA sequence
ccatccggcccctgctcagg

SEQ ID NO: 232991 - DNA, 20 bp, Artificial
  CRISPR gRNA sequence
tccggcccctgctcaggaag

SEQ ID NO: 232992 - DNA, 20 bp, Artificial
  CRISPR gRNA sequence
ccggcccctgctcaggaagt

SEQ ID NO: 232993 - DNA, 20 bp, Artificial
  CRISPR gRNA sequence
ggcccctgctcaggaagtgg

SEQ ID NO: 232994 - DNA, 20 bp, Artificial
  CRISPR gRNA sequence
cctgctcaggaagtgggagt

SEQ ID NO: 232995 - DNA, 20 bp, Artificial
  CRISPR gRNA sequence
gctcaggaagtgggagtgag

SEQ ID NO: 232996 - DNA, 20 bp, Artificial
  CRISPR gRNA sequence
caggaagtgggagtgagcgg

SEQ ID NO: 232997 - DNA, 20 bp, Artificial
  CRISPR gRNA sequence
gaagtgggagtgagcggaag

SEQ ID NO: 232998 - DNA, 20 bp, Artificial
  CRISPR gRNA sequence
tgagcggaagcagctgtgca

SEQ ID NO: 232999 - DNA, 20 bp, Artificial
  CRISPR gRNA sequence
agcagctgtgcacggccaca

SEQ ID NO: 233000 - DNA, 20 bp, Artificial
  CRISPR gRNA sequence
gcagctgtgcacggccacac

SEQ ID NO: 233001 - DNA, 20 bp, Artificial
  CRISPR gRNA sequence
gtgcacggccacacaggaca

SEQ ID NO: 233002 - DNA, 20 bp, Artificial
  CRISPR gRNA sequence
aggacacagtctgccgctgc

SEQ ID NO: 233003 - DNA, 20 bp, Artificial
  CRISPR gRNA sequence
ggacacagtctgccgctgcc

SEQ ID NO: 233004 - DNA, 20 bp, Artificial
  CRISPR gRNA sequence
cacagtctgccgctgccggg

SEQ ID NO: 233005 - DNA, 20 bp, Artificial
  CRISPR gRNA sequence
acagtctgccgctgccgggc

SEQ ID NO: 233006 - DNA, 20 bp, Artificial
  CRISPR gRNA sequence
gccgctgccgggcgggcacc

SEQ ID NO: 233007 - DNA, 20 bp, Artificial
  CRISPR gRNA sequence
ccgggcgggcacccagcccc

SEQ ID NO: 233008 - DNA, 20 bp, Artificial
  CRISPR gRNA sequence
gcgggcacccagcccctgga

SEQ ID NO: 233009 - DNA, 20 bp, Artificial
  CRISPR gRNA sequence
cccagcccctggacagctac

SEQ ID NO: 233010 - DNA, 20 bp, Artificial
  CRISPR gRNA sequence
cccctggacagctacaagcc

SEQ ID NO: 233011 - DNA, 20 bp, Artificial
  CRISPR gRNA sequence
cctggacagctacaagcctg

SEQ ID NO: 233012 - DNA, 20 bp, Artificial
  CRISPR gRNA sequence
gacagctacaagcctggagt

SEQ ID NO: 233013 - DNA, 20 bp, Artificial
  CRISPR gRNA sequence
gctacaagcctggagttggt

SEQ ID NO: 233014 - DNA, 20 bp, Artificial
  CRISPR gRNA sequence
aagcctggagttggtgagct

SEQ ID NO: 233015 - DNA, 20 bp, Artificial
  CRISPR gRNA sequence
cctggagttggtgagctcgg

SEQ ID NO: 233016 - DNA, 20 bp, Artificial
  CRISPR gRNA sequence
gttggtgagctcggtggctg

SEQ ID NO: 233017 - DNA, 20 bp, Artificial
  CRISPR gRNA sequence
gtgagctcggtggctgcggc

SEQ ID NO: 233018 - DNA, 20 bp, Artificial
  CRISPR gRNA sequence
agctcggtggctgcggccgg

SEQ ID NO: 233019 - DNA, 20 bp, Artificial
  CRISPR gRNA sequence
cggtggctgcggccggcggt

SEQ ID NO: 233020 - DNA, 20 bp, Artificial
  CRISPR gRNA sequence
ggtggctgcggccggcggtt

SEQ ID NO: 233021 - DNA, 20 bp, Artificial
  CRISPR gRNA sequence
gtggctgcggccggcggttg

SEQ ID NO: 233022 - DNA, 20 bp, Artificial
  CRISPR gRNA sequence
tggctgcggccggcggttgg

SEQ ID NO: 233023 - DNA, 20 bp, Artificial
  CRISPR gRNA sequence
ccggcggttgggggtgtgca

SEQ ID NO: 233024 - DNA, 20 bp, Artificial
  CRISPR gRNA sequence
gcggttgggggtgtgcatag

SEQ ID NO: 233025 - DNA, 20 bp, Artificial
  CRISPR gRNA sequence
catagcggctgtctgtgacg

SEQ ID NO: 233026 - DNA, 20 bp, Artificial
  CRISPR gRNA sequence
gcggctgtctgtgacgcaga

SEQ ID NO: 233027 - DNA, 20 bp, Artificial
  CRISPR gRNA sequence
cggctgtctgtgacgcagat

SEQ ID NO: 233028 - DNA, 20 bp, Artificial
  CRISPR gRNA sequence
tctgtgacgcagatgggccg

SEQ ID NO: 233029 - DNA, 20 bp, Artificial
  CRISPR gRNA sequence
ctgtgacgcagatgggccgt

SEQ ID NO: 233030 - DNA, 20 bp, Artificial
  CRISPR gRNA sequence
cgcagatgggccgtgggccg

SEQ ID NO: 233031 - DNA, 20 bp, Artificial
  CRISPR gRNA sequence
gcagatgggccgtgggccgc

SEQ ID NO: 233032 - DNA, 20 bp, Artificial
  CRISPR gRNA sequence
cagatgggccgtgggccgca

SEQ ID NO: 233033 - DNA, 20 bp, Artificial
  CRISPR gRNA sequence
ggccgtgggccgcagggacc

SEQ ID NO: 233034 - DNA, 20 bp, Artificial
  CRISPR gRNA sequence
ccgcagggacctggccccac

SEQ ID NO: 233035 - DNA, 20 bp, Artificial
  CRISPR gRNA sequence
ggccccaccggtgcctcctc

SEQ ID NO: 233036 - DNA, 20 bp, Artificial
  CRISPR gRNA sequence
gtgcctcctctggcatcctc

SEQ ID NO: 233037 - DNA, 20 bp, Artificial
  CRISPR gRNA sequence
cctctggcatcctcaagacc

SEQ ID NO: 233038 - DNA, 20 bp, Artificial
  CRISPR gRNA sequence
catcctcaagaccgagctcc

SEQ ID NO: 233039 - DNA, 20 bp, Artificial
  CRISPR gRNA sequence
atcctcaagaccgagctccc

SEQ ID NO: 233040 - DNA, 20 bp, Artificial
  CRISPR gRNA sequence
tcaagaccgagctcccgggt

SEQ ID NO: 233041 - DNA, 20 bp, Artificial
  CRISPR gRNA sequence
caagaccgagctcccgggtc

SEQ ID NO: 233042 - DNA, 20 bp, Artificial
  CRISPR gRNA sequence
aagaccgagctcccgggtca

SEQ ID NO: 233043 - DNA, 20 bp, Artificial
  CRISPR gRNA sequence
agctcccgggtcagggccca

SEQ ID NO: 233044 - DNA, 20 bp, Artificial
  CRISPR gRNA sequence
gctcccgggtcagggcccac

SEQ ID NO: 233045 - DNA, 20 bp, Artificial
  CRISPR gRNA sequence
cccgggtcagggcccacggg

SEQ ID NO: 233046 - DNA, 20 bp, Artificial
  CRISPR gRNA sequence
ccgggtcagggcccacgggt

SEQ ID NO: 233047 - DNA, 20 bp, Artificial
  CRISPR gRNA sequence
cagggcccacgggtgggatg

SEQ ID NO: 233048 - DNA, 20 bp, Artificial
  CRISPR gRNA sequence
agggcccacgggtgggatgt

SEQ ID NO: 233049 - DNA, 20 bp, Artificial
  CRISPR gRNA sequence
gcccacgggtgggatgtggg

SEQ ID NO: 233050 - DNA, 20 bp, Artificial
  CRISPR gRNA sequence
cccacgggtgggatgtgggc

SEQ ID NO: 233051 - DNA, 20 bp, Artificial
  CRISPR gRNA sequence
ccacgggtgggatgtgggca

SEQ ID NO: 233052 - DNA, 20 bp, Artificial
  CRISPR gRNA sequence
acgggtgggatgtgggcagg

SEQ ID NO: 233053 - DNA, 20 bp, Artificial
  CRISPR gRNA sequence
cgggtgggatgtgggcaggg

SEQ ID NO: 233054 - DNA, 20 bp, Artificial
  CRISPR gRNA sequence
gggtgggatgtgggcaggga

SEQ ID NO: 233055 - DNA, 20 bp, Artificial
  CRISPR gRNA sequence
atgtgggcagggagggcttc

SEQ ID NO: 233056 - DNA, 20 bp, Artificial
  CRISPR gRNA sequence
gtgggcagggagggcttcca

SEQ ID NO: 233057 - DNA, 20 bp, Artificial
  CRISPR gRNA sequence
tgggcagggagggcttccag

SEQ ID NO: 233058 - DNA, 20 bp, Artificial
  CRISPR gRNA sequence
cagaggccaaacccaccacc

SEQ ID NO: 233059 - DNA, 20 bp, Artificial
  CRISPR gRNA sequence
ccaaacccaccacccagcca

SEQ ID NO: 233060 - DNA, 20 bp, Artificial
  CRISPR gRNA sequence
caaacccaccacccagccat

SEQ ID NO: 233061 - DNA, 20 bp, Artificial
  CRISPR gRNA sequence
aaacccaccacccagccatg

SEQ ID NO: 233062 - DNA, 20 bp, Artificial
  CRISPR gRNA sequence
aacccaccacccagccatgg

SEQ ID NO: 233063 - DNA, 20 bp, Artificial
  CRISPR gRNA sequence
acccaccacccagccatggg

SEQ ID NO: 233064 - DNA, 20 bp, Artificial
  CRISPR gRNA sequence
accacccagccatggggggc

SEQ ID NO: 233065 - DNA, 20 bp, Artificial
  CRISPR gRNA sequence
gggggcaagtgcctgcccca

SEQ ID NO: 233066 - DNA, 20 bp, Artificial
  CRISPR gRNA sequence
ggggcaagtgcctgccccac

SEQ ID NO: 233067 - DNA, 20 bp, Artificial
  CRISPR gRNA sequence
caggctctgccccatgtccc

SEQ ID NO: 233068 - DNA, 20 bp, Artificial
  CRISPR gRNA sequence
tgccccatgtccccagcacc

SEQ ID NO: 233069 - DNA, 20 bp, Artificial
  CRISPR gRNA sequence
gccccatgtccccagcaccc

SEQ ID NO: 233070 - DNA, 20 bp, Artificial
  CRISPR gRNA sequence
ccccatgtccccagcacccg

SEQ ID NO: 233071 - DNA, 20 bp, Artificial
  CRISPR gRNA sequence
tccccagcacccggggcctg

SEQ ID NO: 233072 - DNA, 20 bp, Artificial
  CRISPR gRNA sequence
ccccagcacccggggcctgt

SEQ ID NO: 233073 - DNA, 20 bp, Artificial
  CRISPR gRNA sequence
cagcacccggggcctgtggg

SEQ ID NO: 233074 - DNA, 20 bp, Artificial
  CRISPR gRNA sequence
tgaccaccctatctttgttg

SEQ ID NO: 233075 - DNA, 20 bp, Artificial
  CRISPR gRNA sequence
agactgtgccccctgccctc

SEQ ID NO: 233076 - DNA, 20 bp, Artificial
  CRISPR gRNA sequence
gactgtgccccctgccctcc

SEQ ID NO: 233077 - DNA, 20 bp, Artificial
  CRISPR gRNA sequence
actgtgccccctgccctcca

SEQ ID NO: 233078 - DNA, 20 bp, Artificial
  CRISPR gRNA sequence
ccctccagggcacttctccc

SEQ ID NO: 233079 - DNA, 20 bp, Artificial
  CRISPR gRNA sequence
cctccagggcacttctcccc

SEQ ID NO: 233080 - DNA, 20 bp, Artificial
  CRISPR gRNA sequence
acttctccccaggcgacaac

SEQ ID NO: 233081 - DNA, 20 bp, Artificial
  CRISPR gRNA sequence
cttctccccaggcgacaacc

SEQ ID NO: 233082 - DNA, 20 bp, Artificial
  CRISPR gRNA sequence
caggcgacaaccaggcctgc

SEQ ID NO: 233083 - DNA, 20 bp, Artificial
  CRISPR gRNA sequence
acaaccaggcctgcaagccc

SEQ ID NO: 233084 - DNA, 20 bp, Artificial
  CRISPR gRNA sequence
aggcctgcaagccctggacc

SEQ ID NO: 233085 - DNA, 20 bp, Artificial
  CRISPR gRNA sequence
ctgcaagccctggaccaagt

SEQ ID NO: 233086 - DNA, 20 bp, Artificial
  CRISPR gRNA sequence
tgcaagccctggaccaagtg

SEQ ID NO: 233087 - DNA, 20 bp, Artificial
  CRISPR gRNA sequence
gcaagccctggaccaagtga

SEQ ID NO: 233088 - DNA, 20 bp, Artificial
  CRISPR gRNA sequence
caagccctggaccaagtgag

SEQ ID NO: 233089 - DNA, 20 bp, Artificial
  CRISPR gRNA sequence
cctggaccaagtgaggggcc

SEQ ID NO: 233090 - DNA, 20 bp, Artificial
  CRISPR gRNA sequence
gaccaagtgaggggcctggc

SEQ ID NO: 233091 - DNA, 20 bp, Artificial
  CRISPR gRNA sequence
accaagtgaggggcctggcc

SEQ ID NO: 233092 - DNA, 20 bp, Artificial
  CRISPR gRNA sequence
ccaagtgaggggcctggcca

SEQ ID NO: 233093 - DNA, 20 bp, Artificial
  CRISPR gRNA sequence
caagtgaggggcctggccag

SEQ ID NO: 233094 - DNA, 20 bp, Artificial
  CRISPR gRNA sequence
tgaggggcctggccaggggc

SEQ ID NO: 233095 - DNA, 20 bp, Artificial
  CRISPR gRNA sequence
gaggggcctggccaggggct

SEQ ID NO: 233096 - DNA, 20 bp, Artificial
  CRISPR gRNA sequence
ggggcctggccaggggctgg

SEQ ID NO: 233097 - DNA, 20 bp, Artificial
  CRISPR gRNA sequence
gggcctggccaggggctggg

SEQ ID NO: 233098 - DNA, 20 bp, Artificial
  CRISPR gRNA sequence
ggcctggccaggggctggga

SEQ ID NO: 233099 - DNA, 20 bp, Artificial
  CRISPR gRNA sequence
gcctggccaggggctgggag

SEQ ID NO: 233100 - DNA, 20 bp, Artificial
  CRISPR gRNA sequence
ggccaggggctgggaggggc

SEQ ID NO: 233101 - DNA, 20 bp, Artificial
  CRISPR gRNA sequence
gccaggggctgggaggggct

SEQ ID NO: 233102 - DNA, 20 bp, Artificial
  CRISPR gRNA sequence
ccaggggctgggaggggctg

SEQ ID NO: 233103 - DNA, 20 bp, Artificial
  CRISPR gRNA sequence
caggggctgggaggggctgg

SEQ ID NO: 233104 - DNA, 20 bp, Artificial
  CRISPR gRNA sequence
aggggctgggaggggctggg

SEQ ID NO: 233105 - DNA, 20 bp, Artificial
  CRISPR gRNA sequence
ggggctgggaggggctgggg

SEQ ID NO: 233106 - DNA, 20 bp, Artificial
  CRISPR gRNA sequence
gggctgggaggggctggggg

SEQ ID NO: 233107 - DNA, 20 bp, Artificial
  CRISPR gRNA sequence
ggctgggaggggctgggggg

SEQ ID NO: 233108 - DNA, 20 bp, Artificial
  CRISPR gRNA sequence
gggaggggctgggggggggt

SEQ ID NO: 233109 - DNA, 20 bp, Artificial
  CRISPR gRNA sequence
ggaggggctgggggggggtt

SEQ ID NO: 233110 - DNA, 20 bp, Artificial
  CRISPR gRNA sequence
gaggggctgggggggggttg

SEQ ID NO: 233111 - DNA, 20 bp, Artificial
  CRISPR gRNA sequence
gggctgggggggggttgggg

SEQ ID NO: 233112 - DNA, 20 bp, Artificial
  CRISPR gRNA sequence
tgggggggggttggggtggt

SEQ ID NO: 233113 - DNA, 20 bp, Artificial
  CRISPR gRNA sequence
gggggggggttggggtggtt

SEQ ID NO: 233114 - DNA, 20 bp, Artificial
  CRISPR gRNA sequence
gggggggttggggtggttag

SEQ ID NO: 233115 - DNA, 20 bp, Artificial
  CRISPR gRNA sequence
ggggggttggggtggttagg

SEQ ID NO: 233116 - DNA, 20 bp, Artificial
  CRISPR gRNA sequence
gggggttggggtggttagga

SEQ ID NO: 233117 - DNA, 20 bp, Artificial
  CRISPR gRNA sequence
ggttggggtggttaggaggg

SEQ ID NO: 233118 - DNA, 20 bp, Artificial
  CRISPR gRNA sequence
ttggggtggttaggagggcg

SEQ ID NO: 233119 - DNA, 20 bp, Artificial
  CRISPR gRNA sequence
tggggtggttaggagggcgg

SEQ ID NO: 233120 - DNA, 20 bp, Artificial
  CRISPR gRNA sequence
gggtggttaggagggcggag

SEQ ID NO: 233121 - DNA, 20 bp, Artificial
  CRISPR gRNA sequence
ggttaggagggcggaggagc

SEQ ID NO: 233122 - DNA, 20 bp, Artificial
  CRISPR gRNA sequence
gttaggagggcggaggagct

SEQ ID NO: 233123 - DNA, 20 bp, Artificial
  CRISPR gRNA sequence
ttaggagggcggaggagctg

SEQ ID NO: 233124 - DNA, 20 bp, Artificial
  CRISPR gRNA sequence
aggagggcggaggagctggg

SEQ ID NO: 233125 - DNA, 20 bp, Artificial
  CRISPR gRNA sequence
gggcggaggagctggggagc

SEQ ID NO: 233126 - DNA, 20 bp, Artificial
  CRISPR gRNA sequence
ggcggaggagctggggagct

SEQ ID NO: 233127 - DNA, 20 bp, Artificial
  CRISPR gRNA sequence
cggaggagctggggagctgg

SEQ ID NO: 233128 - DNA, 20 bp, Artificial
  CRISPR gRNA sequence
ggaggagctggggagctggg

SEQ ID NO: 233129 - DNA, 20 bp, Artificial
  CRISPR gRNA sequence
gaggagctggggagctggga

SEQ ID NO: 233130 - DNA, 20 bp, Artificial
  CRISPR gRNA sequence
aggagctggggagctgggag

SEQ ID NO: 233131 - DNA, 20 bp, Artificial
  CRISPR gRNA sequence
gctggggagctgggaggggc

SEQ ID NO: 233132 - DNA, 20 bp, Artificial
  CRISPR gRNA sequence
ctggggagctgggaggggct

SEQ ID NO: 233133 - DNA, 20 bp, Artificial
  CRISPR gRNA sequence
tggggagctgggaggggctg

SEQ ID NO: 233134 - DNA, 20 bp, Artificial
  CRISPR gRNA sequence
ggggagctgggaggggctgg

SEQ ID NO: 233135 - DNA, 20 bp, Artificial
  CRISPR gRNA sequence
gggagctgggaggggctggg

SEQ ID NO: 233136 - DNA, 20 bp, Artificial
  CRISPR gRNA sequence
ggagctgggaggggctgggg

SEQ ID NO: 233137 - DNA, 20 bp, Artificial
  CRISPR gRNA sequence
gctgggaggggctggggggg

SEQ ID NO: 233138 - DNA, 20 bp, Artificial
  CRISPR gRNA sequence
ctgggaggggctgggggggc

SEQ ID NO: 233139 - DNA, 20 bp, Artificial
  CRISPR gRNA sequence
ggaggggctgggggggcagg

SEQ ID NO: 233140 - DNA, 20 bp, Artificial
  CRISPR gRNA sequence
gaggggctgggggggcaggt

SEQ ID NO: 233141 - DNA, 20 bp, Artificial
  CRISPR gRNA sequence
aggggctgggggggcaggtg

SEQ ID NO: 233142 - DNA, 20 bp, Artificial
  CRISPR gRNA sequence
ggctgggggggcaggtgggg

SEQ ID NO: 233143 - DNA, 20 bp, Artificial
  CRISPR gRNA sequence
gctgggggggcaggtggggt

SEQ ID NO: 233144 - DNA, 20 bp, Artificial
  CRISPR gRNA sequence
ctgggggggcaggtggggtg

SEQ ID NO: 233145 - DNA, 20 bp, Artificial
  CRISPR gRNA sequence
tgggggggcaggtggggtgg

SEQ ID NO: 233146 - DNA, 20 bp, Artificial
  CRISPR gRNA sequence
gggggcaggtggggtggggg

SEQ ID NO: 233147 - DNA, 20 bp, Artificial
  CRISPR gRNA sequence
aggtggggtgggggcagttt

SEQ ID NO: 233148 - DNA, 20 bp, Artificial
  CRISPR gRNA sequence
ggtggggtgggggcagtttt

SEQ ID NO: 233149 - DNA, 20 bp, Artificial
  CRISPR gRNA sequence
gtggggtgggggcagttttg

SEQ ID NO: 233150 - DNA, 20 bp, Artificial
  CRISPR gRNA sequence
tggggtgggggcagttttgg

SEQ ID NO: 233151 - DNA, 20 bp, Artificial
  CRISPR gRNA sequence
ggtgggggcagttttggggg

SEQ ID NO: 233152 - DNA, 20 bp, Artificial
  CRISPR gRNA sequence
gtgggggcagttttggggga

SEQ ID NO: 233153 - DNA, 20 bp, Artificial
  CRISPR gRNA sequence
tgggggcagttttgggggaa

SEQ ID NO: 233154 - DNA, 20 bp, Artificial
  CRISPR gRNA sequence
gggggcagttttgggggaag

SEQ ID NO: 233155 - DNA, 20 bp, Artificial
  CRISPR gRNA sequence
gggcagttttgggggaaggg

SEQ ID NO: 233156 - DNA, 20 bp, Artificial
  CRISPR gRNA sequence
ggcagttttgggggaagggg

SEQ ID NO: 233157 - DNA, 20 bp, Artificial
  CRISPR gRNA sequence
tttgggggaaggggaggtgc

SEQ ID NO: 233158 - DNA, 20 bp, Artificial
  CRISPR gRNA sequence
gggggaaggggaggtgctgg

SEQ ID NO: 233159 - DNA, 20 bp, Artificial
  CRISPR gRNA sequence
aggggaggtgctggtggccc

SEQ ID NO: 233160 - DNA, 20 bp, Artificial
  CRISPR gRNA sequence
ggggaggtgctggtggccct

SEQ ID NO: 233161 - DNA, 20 bp, Artificial
  CRISPR gRNA sequence
gggaggtgctggtggccctg

SEQ ID NO: 233162 - DNA, 20 bp, Artificial
  CRISPR gRNA sequence
ggaggtgctggtggccctgg

SEQ ID NO: 233163 - DNA, 20 bp, Artificial
  CRISPR gRNA sequence
tgctggtggccctgggggcc

SEQ ID NO: 233164 - DNA, 20 bp, Artificial
  CRISPR gRNA sequence
gccctgggggcctggctatg

SEQ ID NO: 233165 - DNA, 20 bp, Artificial
  CRISPR gRNA sequence
tgggggcctggctatgtggc

SEQ ID NO: 233166 - DNA, 20 bp, Artificial
  CRISPR gRNA sequence
cctggctatgtggctggacc

SEQ ID NO: 233167 - DNA, 20 bp, Artificial
  CRISPR gRNA sequence
gctatgtggctggacctggt

SEQ ID NO: 233168 - DNA, 20 bp, Artificial
  CRISPR gRNA sequence
ctatgtggctggacctggtt

SEQ ID NO: 233169 - DNA, 20 bp, Artificial
  CRISPR gRNA sequence
tatgtggctggacctggttg

SEQ ID NO: 233170 - DNA, 20 bp, Artificial
  CRISPR gRNA sequence
tgtggctggacctggttggg

SEQ ID NO: 233171 - DNA, 20 bp, Artificial
  CRISPR gRNA sequence
ggctggacctggttggggag

SEQ ID NO: 233172 - DNA, 20 bp, Artificial
  CRISPR gRNA sequence
gctggacctggttggggagc

SEQ ID NO: 233173 - DNA, 20 bp, Artificial
  CRISPR gRNA sequence
ggacctggttggggagcagg

SEQ ID NO: 233174 - DNA, 20 bp, Artificial
  CRISPR gRNA sequence
gggagcaggaagctgctgcc

SEQ ID NO: 233175 - DNA, 20 bp, Artificial
  CRISPR gRNA sequence
ggagcaggaagctgctgcct

SEQ ID NO: 233176 - DNA, 20 bp, Artificial
  CRISPR gRNA sequence
gagcaggaagctgctgcctg

SEQ ID NO: 233177 - DNA, 20 bp, Artificial
  CRISPR gRNA sequence
agcaggaagctgctgcctgg

SEQ ID NO: 233178 - DNA, 20 bp, Artificial
  CRISPR gRNA sequence
aggaagctgctgcctggggg

SEQ ID NO: 233179 - DNA, 20 bp, Artificial
  CRISPR gRNA sequence
ctgggggcagcctttccctg

SEQ ID NO: 233180 - DNA, 20 bp, Artificial
  CRISPR gRNA sequence
tgggggcagcctttccctgt

SEQ ID NO: 233181 - DNA, 20 bp, Artificial
  CRISPR gRNA sequence
gggcagcctttccctgtggg

SEQ ID NO: 233182 - DNA, 20 bp, Artificial
  CRISPR gRNA sequence
gcagcctttccctgtgggtg

SEQ ID NO: 233183 - DNA, 20 bp, Artificial
  CRISPR gRNA sequence
cctttccctgtgggtggagc

SEQ ID NO: 233184 - DNA, 20 bp, Artificial
  CRISPR gRNA sequence
ctttccctgtgggtggagct

SEQ ID NO: 233185 - DNA, 20 bp, Artificial
  CRISPR gRNA sequence
tgtgggtggagctgggtgtg

SEQ ID NO: 233186 - DNA, 20 bp, Artificial
  CRISPR gRNA sequence
gtgggtggagctgggtgtgt

SEQ ID NO: 233187 - DNA, 20 bp, Artificial
  CRISPR gRNA sequence
tgtgggaccctcaccctccg

SEQ ID NO: 233188 - DNA, 20 bp, Artificial
  CRISPR gRNA sequence
ggaccctcaccctccgcagc

SEQ ID NO: 233189 - DNA, 20 bp, Artificial
  CRISPR gRNA sequence
gaccctcaccctccgcagct

SEQ ID NO: 233190 - DNA, 20 bp, Artificial
  CRISPR gRNA sequence
ccctcaccctccgcagctgg

SEQ ID NO: 233191 - DNA, 20 bp, Artificial
  CRISPR gRNA sequence
cctcaccctccgcagctggg

SEQ ID NO: 233192 - DNA, 20 bp, Artificial
  CRISPR gRNA sequence
cctccgcagctgggaggccc

SEQ ID NO: 233193 - DNA, 20 bp, Artificial
  CRISPR gRNA sequence
ctccgcagctgggaggccct

SEQ ID NO: 233194 - DNA, 20 bp, Artificial
  CRISPR gRNA sequence
tccgcagctgggaggccctg

SEQ ID NO: 233195 - DNA, 20 bp, Artificial
  CRISPR gRNA sequence
ccgcagctgggaggccctgg

SEQ ID NO: 233196 - DNA, 20 bp, Artificial
  CRISPR gRNA sequence
gctgggaggccctgggggca

SEQ ID NO: 233197 - DNA, 20 bp, Artificial
  CRISPR gRNA sequence
ctgggaggccctgggggcac

SEQ ID NO: 233198 - DNA, 20 bp, Artificial
  CRISPR gRNA sequence
gaggccctgggggcacagga

SEQ ID NO: 233199 - DNA, 20 bp, Artificial
  CRISPR gRNA sequence
aggccctgggggcacaggac

SEQ ID NO: 233200 - DNA, 20 bp, Artificial
  CRISPR gRNA sequence
ggccctgggggcacaggaca

SEQ ID NO: 233201 - DNA, 20 bp, Artificial
  CRISPR gRNA sequence
ccctgggggcacaggacagg

SEQ ID NO: 233202 - DNA, 20 bp, Artificial
  CRISPR gRNA sequence
cctgggggcacaggacaggg

SEQ ID NO: 233203 - DNA, 20 bp, Artificial
  CRISPR gRNA sequence
ggcacaggacagggaggtgc

SEQ ID NO: 233204 - DNA, 20 bp, Artificial
  CRISPR gRNA sequence
acaggacagggaggtgctgg

SEQ ID NO: 233205 - DNA, 20 bp, Artificial
  CRISPR gRNA sequence
caggacagggaggtgctggt

SEQ ID NO: 233206 - DNA, 20 bp, Artificial
  CRISPR gRNA sequence
aggacagggaggtgctggtg

SEQ ID NO: 233207 - DNA, 20 bp, Artificial
  CRISPR gRNA sequence
ggacagggaggtgctggtgg

SEQ ID NO: 233208 - DNA, 20 bp, Artificial
  CRISPR gRNA sequence
gacagggaggtgctggtggg

SEQ ID NO: 233209 - DNA, 20 bp, Artificial
  CRISPR gRNA sequence
ggaggtgctggtggggggtg

SEQ ID NO: 233210 - DNA, 20 bp, Artificial
  CRISPR gRNA sequence
gctggtggggggtgtagatg

SEQ ID NO: 233211 - DNA, 20 bp, Artificial
  CRISPR gRNA sequence
ctggtggggggtgtagatgt

SEQ ID NO: 233212 - DNA, 20 bp, Artificial
  CRISPR gRNA sequence
ggtggggggtgtagatgtgg

SEQ ID NO: 233213 - DNA, 20 bp, Artificial
  CRISPR gRNA sequence
ggggggtgtagatgtgggag

SEQ ID NO: 233214 - DNA, 20 bp, Artificial
  CRISPR gRNA sequence
gggggtgtagatgtgggaga

SEQ ID NO: 233215 - DNA, 20 bp, Artificial
  CRISPR gRNA sequence
ggggtgtagatgtgggagaa

SEQ ID NO: 233216 - DNA, 20 bp, Artificial
  CRISPR gRNA sequence
agatgtgggagaagggtgtg

SEQ ID NO: 233217 - DNA, 20 bp, Artificial
  CRISPR gRNA sequence
gggagaagggtgtgtggcct

SEQ ID NO: 233218 - DNA, 20 bp, Artificial
  CRISPR gRNA sequence
gagaagggtgtgtggccttg

SEQ ID NO: 233219 - DNA, 20 bp, Artificial
  CRISPR gRNA sequence
agaagggtgtgtggccttgg

SEQ ID NO: 233220 - DNA, 20 bp, Artificial
  CRISPR gRNA sequence
tgtggccttggaggcccctg

SEQ ID NO: 233221 - DNA, 20 bp, Artificial
  CRISPR gRNA sequence
gtggccttggaggcccctgt

SEQ ID NO: 233222 - DNA, 20 bp, Artificial
  CRISPR gRNA sequence
tggccttggaggcccctgtg

SEQ ID NO: 233223 - DNA, 20 bp, Artificial
  CRISPR gRNA sequence
ggccttggaggcccctgtgg

SEQ ID NO: 233224 - DNA, 20 bp, Artificial
  CRISPR gRNA sequence
gccttggaggcccctgtggg

SEQ ID NO: 233225 - DNA, 20 bp, Artificial
  CRISPR gRNA sequence
aggcccctgtggggggcacg

SEQ ID NO: 233226 - DNA, 20 bp, Artificial
  CRISPR gRNA sequence
ggcccctgtggggggcacgt

SEQ ID NO: 233227 - DNA, 20 bp, Artificial
  CRISPR gRNA sequence
gcccctgtggggggcacgtg

SEQ ID NO: 233228 - DNA, 20 bp, Artificial
  CRISPR gRNA sequence
ctgtggggggcacgtggggc

SEQ ID NO: 233229 - DNA, 20 bp, Artificial
  CRISPR gRNA sequence
tgtggggggcacgtggggct

SEQ ID NO: 233230 - DNA, 20 bp, Artificial
  CRISPR gRNA sequence
ggggggcacgtggggctggg

SEQ ID NO: 233231 - DNA, 20 bp, Artificial
  CRISPR gRNA sequence
gtggggctgggcagcgtcct

SEQ ID NO: 233232 - DNA, 20 bp, Artificial
  CRISPR gRNA sequence
gcagcgtccttggctgtcac

SEQ ID NO: 233233 - DNA, 20 bp, Artificial
  CRISPR gRNA sequence
gtccttggctgtcactggcc

SEQ ID NO: 233234 - DNA, 20 bp, Artificial
  CRISPR gRNA sequence
tgtcactggcctggtgtctg

SEQ ID NO: 233235 - DNA, 20 bp, Artificial
  CRISPR gRNA sequence
cactggcctggtgtctgtgg

SEQ ID NO: 233236 - DNA, 20 bp, Artificial
  CRISPR gRNA sequence
tctgtggtagatgctgcctg

SEQ ID NO: 233237 - DNA, 20 bp, Artificial
  CRISPR gRNA sequence
tggtagatgctgcctgtggc

SEQ ID NO: 233238 - DNA, 20 bp, Artificial
  CRISPR gRNA sequence
agatgctgcctgtggctggc

SEQ ID NO: 233239 - DNA, 20 bp, Artificial
  CRISPR gRNA sequence
ctgcctgtggctggccagcg

SEQ ID NO: 233240 - DNA, 20 bp, Artificial
  CRISPR gRNA sequence
gttatccccaccgcatctcc

SEQ ID NO: 233241 - DNA, 20 bp, Artificial
  CRISPR gRNA sequence
ttatccccaccgcatctccc

SEQ ID NO: 233242 - DNA, 20 bp, Artificial
  CRISPR gRNA sequence
ccaccgcatctcccgggtcc

SEQ ID NO: 233243 - DNA, 20 bp, Artificial
  CRISPR gRNA sequence
caccgcatctcccgggtccc

SEQ ID NO: 233244 - DNA, 20 bp, Artificial
  CRISPR gRNA sequence
accgcatctcccgggtccca

SEQ ID NO: 233245 - DNA, 20 bp, Artificial
  CRISPR gRNA sequence
ccgcatctcccgggtcccag

SEQ ID NO: 233246 - DNA, 20 bp, Artificial
  CRISPR gRNA sequence
cgcatctcccgggtcccagg

SEQ ID NO: 233247 - DNA, 20 bp, Artificial
  CRISPR gRNA sequence
cccgggtcccagggggtttc

SEQ ID NO: 233248 - DNA, 20 bp, Artificial
  CRISPR gRNA sequence
tcccagggggtttctggcct

SEQ ID NO: 233249 - DNA, 20 bp, Artificial
  CRISPR gRNA sequence
caacacctcctgttccccaa

SEQ ID NO: 233250 - DNA, 20 bp, Artificial
  CRISPR gRNA sequence
gttccccaacagctgcacct

SEQ ID NO: 233251 - DNA, 20 bp, Artificial
  CRISPR gRNA sequence
cccaacagctgcaccttggc

SEQ ID NO: 233252 - DNA, 20 bp, Artificial
  CRISPR gRNA sequence
ccaacagctgcaccttggct

SEQ ID NO: 233253 - DNA, 20 bp, Artificial
  CRISPR gRNA sequence
acagctgcaccttggctggg

SEQ ID NO: 233254 - DNA, 20 bp, Artificial
  CRISPR gRNA sequence
tggctgggaagcacaccctg

SEQ ID NO: 233255 - DNA, 20 bp, Artificial
  CRISPR gRNA sequence
tgggaagcacaccctgcagc

SEQ ID NO: 233256 - DNA, 20 bp, Artificial
  CRISPR gRNA sequence
aagcacaccctgcagccggc

SEQ ID NO: 233257 - DNA, 20 bp, Artificial
  CRISPR gRNA sequence
accctgcagccggccagcaa

SEQ ID NO: 233258 - DNA, 20 bp, Artificial
  CRISPR gRNA sequence
gcagccggccagcaatagct

SEQ ID NO: 233259 - DNA, 20 bp, Artificial
  CRISPR gRNA sequence
atagctcggacgcaatctgt

SEQ ID NO: 233260 - DNA, 20 bp, Artificial
  CRISPR gRNA sequence
tagctcggacgcaatctgtg

SEQ ID NO: 233261 - DNA, 20 bp, Artificial
  CRISPR gRNA sequence
tcggacgcaatctgtgagga

SEQ ID NO: 233262 - DNA, 20 bp, Artificial
  CRISPR gRNA sequence
cggacgcaatctgtgaggac

SEQ ID NO: 233263 - DNA, 20 bp, Artificial
  CRISPR gRNA sequence
ggacgcaatctgtgaggaca

SEQ ID NO: 233264 - DNA, 20 bp, Artificial
  CRISPR gRNA sequence
ctgtgaggacagggaccccc

SEQ ID NO: 233265 - DNA, 20 bp, Artificial
  CRISPR gRNA sequence
acagggaccccccagccacg

SEQ ID NO: 233266 - DNA, 20 bp, Artificial
  CRISPR gRNA sequence
accccccagccacgcagccc

SEQ ID NO: 233267 - DNA, 20 bp, Artificial
  CRISPR gRNA sequence
ccccccagccacgcagcccc

SEQ ID NO: 233268 - DNA, 20 bp, Artificial
  CRISPR gRNA sequence
ccccagccacgcagccccag

SEQ ID NO: 233269 - DNA, 20 bp, Artificial
  CRISPR gRNA sequence
ccacgcagccccaggagacc

SEQ ID NO: 233270 - DNA, 20 bp, Artificial
  CRISPR gRNA sequence
cacgcagccccaggagaccc

SEQ ID NO: 233271 - DNA, 20 bp, Artificial
  CRISPR gRNA sequence
acgcagccccaggagaccca

SEQ ID NO: 233272 - DNA, 20 bp, Artificial
  CRISPR gRNA sequence
ccaggagacccagggccccc

SEQ ID NO: 233273 - DNA, 20 bp, Artificial
  CRISPR gRNA sequence
gagacccagggccccccggc

SEQ ID NO: 233274 - DNA, 20 bp, Artificial
  CRISPR gRNA sequence
agacccagggccccccggcc

SEQ ID NO: 233275 - DNA, 20 bp, Artificial
  CRISPR gRNA sequence
cggccaggcccatcactgtc

SEQ ID NO: 233276 - DNA, 20 bp, Artificial
  CRISPR gRNA sequence
catcactgtccagcccactg

SEQ ID NO: 233277 - DNA, 20 bp, Artificial
  CRISPR gRNA sequence
ctgtccagcccactgaagcc

SEQ ID NO: 233278 - DNA, 20 bp, Artificial
  CRISPR gRNA sequence
cagcccactgaagcctggcc

SEQ ID NO: 233279 - DNA, 20 bp, Artificial
  CRISPR gRNA sequence
aagcctggcccagaacctca

SEQ ID NO: 233280 - DNA, 20 bp, Artificial
  CRISPR gRNA sequence
agcctggcccagaacctcac

SEQ ID NO: 233281 - DNA, 20 bp, Artificial
  CRISPR gRNA sequence
gcctggcccagaacctcaca

SEQ ID NO: 233282 - DNA, 20 bp, Artificial
  CRISPR gRNA sequence
cctcacagggaccctccacc

SEQ ID NO: 233283 - DNA, 20 bp, Artificial
  CRISPR gRNA sequence
gggaccctccacccggcccg

SEQ ID NO: 233284 - DNA, 20 bp, Artificial
  CRISPR gRNA sequence
gaccctccacccggcccgtg

SEQ ID NO: 233285 - DNA, 20 bp, Artificial
  CRISPR gRNA sequence
accctccacccggcccgtgg

SEQ ID NO: 233286 - DNA, 20 bp, Artificial
  CRISPR gRNA sequence
acccggcccgtggaggtccc

SEQ ID NO: 233287 - DNA, 20 bp, Artificial
  CRISPR gRNA sequence
cccggcccgtggaggtcccc

SEQ ID NO: 233288 - DNA, 20 bp, Artificial
  CRISPR gRNA sequence
ccggcccgtggaggtccccg

SEQ ID NO: 233289 - DNA, 20 bp, Artificial
  CRISPR gRNA sequence
cggcccgtggaggtccccgg

SEQ ID NO: 233290 - DNA, 20 bp, Artificial
  CRISPR gRNA sequence
ccgtggaggtccccgggggt

SEQ ID NO: 233291 - DNA, 20 bp, Artificial
  CRISPR gRNA sequence
cgtggaggtccccgggggta

SEQ ID NO: 233292 - DNA, 20 bp, Artificial
  CRISPR gRNA sequence
gtggaggtccccgggggtaa

SEQ ID NO: 233293 - DNA, 20 bp, Artificial
  CRISPR gRNA sequence
tccccgggggtaagggcgcc

SEQ ID NO: 233294 - DNA, 20 bp, Artificial
  CRISPR gRNA sequence
gggggtaagggcgcctggcc

SEQ ID NO: 233295 - DNA, 20 bp, Artificial
  CRISPR gRNA sequence
taagggcgcctggcccagcc

SEQ ID NO: 233296 - DNA, 20 bp, Artificial
  CRISPR gRNA sequence
gggcgcctggcccagcccag

SEQ ID NO: 233297 - DNA, 20 bp, Artificial
  CRISPR gRNA sequence
ggcgcctggcccagcccagc

SEQ ID NO: 233298 - DNA, 20 bp, Artificial
  CRISPR gRNA sequence
gcgcctggcccagcccagcg

SEQ ID NO: 233299 - DNA, 20 bp, Artificial
  CRISPR gRNA sequence
agcggggcccccaacccgaa

SEQ ID NO: 233300 - DNA, 20 bp, Artificial
  CRISPR gRNA sequence
gcggggcccccaacccgaat

SEQ ID NO: 233301 - DNA, 20 bp, Artificial
  CRISPR gRNA sequence
ggggcccccaacccgaatag

SEQ ID NO: 233302 - DNA, 20 bp, Artificial
  CRISPR gRNA sequence
gcccccaacccgaataggag

SEQ ID NO: 233303 - DNA, 20 bp, Artificial
  CRISPR gRNA sequence
cccccaacccgaataggaga

SEQ ID NO: 233304 - DNA, 20 bp, Artificial
  CRISPR gRNA sequence
ccccaacccgaataggagaa

SEQ ID NO: 233305 - DNA, 20 bp, Artificial
  CRISPR gRNA sequence
cccaacccgaataggagaag

SEQ ID NO: 233306 - DNA, 20 bp, Artificial
  CRISPR gRNA sequence
caacccgaataggagaaggg

SEQ ID NO: 233307 - DNA, 20 bp, Artificial
  CRISPR gRNA sequence
aacccgaataggagaagggg

SEQ ID NO: 233308 - DNA, 20 bp, Artificial
  CRISPR gRNA sequence
acccgaataggagaagggga

SEQ ID NO: 233309 - DNA, 20 bp, Artificial
  CRISPR gRNA sequence
cgaataggagaaggggaggg

SEQ ID NO: 233310 - DNA, 20 bp, Artificial
  CRISPR gRNA sequence
aggagaaggggagggcggca

SEQ ID NO: 233311 - DNA, 20 bp, Artificial
  CRISPR gRNA sequence
ggagaaggggagggcggcat

SEQ ID NO: 233312 - DNA, 20 bp, Artificial
  CRISPR gRNA sequence
gagaaggggagggcggcatg

SEQ ID NO: 233313 - DNA, 20 bp, Artificial
  CRISPR gRNA sequence
agaaggggagggcggcatgg

SEQ ID NO: 233314 - DNA, 20 bp, Artificial
  CRISPR gRNA sequence
cggcatgggggcccctcctg

SEQ ID NO: 233315 - DNA, 20 bp, Artificial
  CRISPR gRNA sequence
cccctcctgtggaccccacc

SEQ ID NO: 233316 - DNA, 20 bp, Artificial
  CRISPR gRNA sequence
ctcctgtggaccccacccag

SEQ ID NO: 233317 - DNA, 20 bp, Artificial
  CRISPR gRNA sequence
acccagcagaccccttcctg

SEQ ID NO: 233318 - DNA, 20 bp, Artificial
  CRISPR gRNA sequence
cccagcagaccccttcctgc

SEQ ID NO: 233319 - DNA, 20 bp, Artificial
  CRISPR gRNA sequence
accccttcctgcaggccgtg

SEQ ID NO: 233320 - DNA, 20 bp, Artificial
  CRISPR gRNA sequence
ccgtgcggttgccgccatcc

SEQ ID NO: 233321 - DNA, 20 bp, Artificial
  CRISPR gRNA sequence
cgtgcggttgccgccatcct

SEQ ID NO: 233322 - DNA, 20 bp, Artificial
  CRISPR gRNA sequence
ggttgccgccatcctgggcc

SEQ ID NO: 233323 - DNA, 20 bp, Artificial
  CRISPR gRNA sequence
gttgccgccatcctgggcct

SEQ ID NO: 233324 - DNA, 20 bp, Artificial
  CRISPR gRNA sequence
cgccatcctgggcctgggcc

SEQ ID NO: 233325 - DNA, 20 bp, Artificial
  CRISPR gRNA sequence
cctgggcctgggcctggtgc

SEQ ID NO: 233326 - DNA, 20 bp, Artificial
  CRISPR gRNA sequence
ctgggcctgggcctggtgct

SEQ ID NO: 233327 - DNA, 20 bp, Artificial
  CRISPR gRNA sequence
tgggcctgggcctggtgctg

SEQ ID NO: 233328 - DNA, 20 bp, Artificial
  CRISPR gRNA sequence
gggcctggtgctggggctgc

SEQ ID NO: 233329 - DNA, 20 bp, Artificial
  CRISPR gRNA sequence
ggcctggtgctggggctgct

SEQ ID NO: 233330 - DNA, 20 bp, Artificial
  CRISPR gRNA sequence
gctggggctgctgggccccc

SEQ ID NO: 233331 - DNA, 20 bp, Artificial
  CRISPR gRNA sequence
gggccccctggccatcctgc

SEQ ID NO: 233332 - DNA, 20 bp, Artificial
  CRISPR gRNA sequence
tgctggccctgtacctgctc

SEQ ID NO: 233333 - DNA, 20 bp, Artificial
  CRISPR gRNA sequence
ctggccctgtacctgctccg

SEQ ID NO: 233334 - DNA, 20 bp, Artificial
  CRISPR gRNA sequence
tggccctgtacctgctccgg

SEQ ID NO: 233335 - DNA, 20 bp, Artificial
  CRISPR gRNA sequence
ggccctgtacctgctccgga

SEQ ID NO: 233336 - DNA, 20 bp, Artificial
  CRISPR gRNA sequence
tgtacctgctccggagggac

SEQ ID NO: 233337 - DNA, 20 bp, Artificial
  CRISPR gRNA sequence
tacctgctccggagggacca

SEQ ID NO: 233338 - DNA, 20 bp, Artificial
  CRISPR gRNA sequence
acctgctccggagggaccag

SEQ ID NO: 233339 - DNA, 20 bp, Artificial
  CRISPR gRNA sequence
ggctgccccccgatgcccac

SEQ ID NO: 233340 - DNA, 20 bp, Artificial
  CRISPR gRNA sequence
cccgatgcccacaagccccc

SEQ ID NO: 233341 - DNA, 20 bp, Artificial
  CRISPR gRNA sequence
atgcccacaagccccctggt

SEQ ID NO: 233342 - DNA, 20 bp, Artificial
  CRISPR gRNA sequence
gccccctggtgagtgcctca

SEQ ID NO: 233343 - DNA, 20 bp, Artificial
  CRISPR gRNA sequence
tggccctgccgcactgctcc

SEQ ID NO: 233344 - DNA, 20 bp, Artificial
  CRISPR gRNA sequence
ccctgccgcactgctcctgg

SEQ ID NO: 233345 - DNA, 20 bp, Artificial
  CRISPR gRNA sequence
cctgccgcactgctcctggc

SEQ ID NO: 233346 - DNA, 20 bp, Artificial
  CRISPR gRNA sequence
ccgcactgctcctggcgggt

SEQ ID NO: 233347 - DNA, 20 bp, Artificial
  CRISPR gRNA sequence
cgcactgctcctggcgggtg

SEQ ID NO: 233348 - DNA, 20 bp, Artificial
  CRISPR gRNA sequence
atctctccttttttcctccc

SEQ ID NO: 233349 - DNA, 20 bp, Artificial
  CRISPR gRNA sequence
tctctccttttttcctcccc

SEQ ID NO: 233350 - DNA, 20 bp, Artificial
  CRISPR gRNA sequence
ctctccttttttcctcccca

SEQ ID NO: 233351 - DNA, 20 bp, Artificial
  CRISPR gRNA sequence
tctccttttttcctccccag

SEQ ID NO: 233352 - DNA, 20 bp, Artificial
  CRISPR gRNA sequence
ctccttttttcctccccagg

SEQ ID NO: 233353 - DNA, 20 bp, Artificial
  CRISPR gRNA sequence
ccttttttcctccccagggg

SEQ ID NO: 233354 - DNA, 20 bp, Artificial
  CRISPR gRNA sequence
cttttttcctccccaggggg

SEQ ID NO: 233355 - DNA, 20 bp, Artificial
  CRISPR gRNA sequence
ttttcctccccagggggagg

SEQ ID NO: 233356 - DNA, 20 bp, Artificial
  CRISPR gRNA sequence
ccccagggggaggcagtttc

SEQ ID NO: 233357 - DNA, 20 bp, Artificial
  CRISPR gRNA sequence
cagtttccggacccccatcc

SEQ ID NO: 233358 - DNA, 20 bp, Artificial
  CRISPR gRNA sequence
gtttccggacccccatccaa

SEQ ID NO: 233359 - DNA, 20 bp, Artificial
  CRISPR gRNA sequence
tttccggacccccatccaag

SEQ ID NO: 233360 - DNA, 20 bp, Artificial
  CRISPR gRNA sequence
tccggacccccatccaagag

SEQ ID NO: 233361 - DNA, 20 bp, Artificial
  CRISPR gRNA sequence
ggacccccatccaagaggag

SEQ ID NO: 233362 - DNA, 20 bp, Artificial
  CRISPR gRNA sequence
gacccccatccaagaggagc

SEQ ID NO: 233363 - DNA, 20 bp, Artificial
  CRISPR gRNA sequence
ggccgacgcccactccaccc

SEQ ID NO: 233364 - DNA, 20 bp, Artificial
  CRISPR gRNA sequence
acgcccactccaccctggcc

SEQ ID NO: 233365 - DNA, 20 bp, Artificial
  CRISPR gRNA sequence
accctggccaagatctgacc

SEQ ID NO: 233366 - DNA, 20 bp, Artificial
  CRISPR gRNA sequence
ccctggccaagatctgacct

SEQ ID NO: 233367 - DNA, 20 bp, Artificial
  CRISPR gRNA sequence
agatctgacctgggcccacc

SEQ ID NO: 233368 - DNA, 20 bp, Artificial
  CRISPR gRNA sequence
gatctgacctgggcccacca

SEQ ID NO: 233369 - DNA, 20 bp, Artificial
  CRISPR gRNA sequence
ctgacctgggcccaccaagg

SEQ ID NO: 233370 - DNA, 20 bp, Artificial
  CRISPR gRNA sequence
gggcccaccaaggtggacgc

SEQ ID NO: 233371 - DNA, 20 bp, Artificial
  CRISPR gRNA sequence
ggcccaccaaggtggacgct

SEQ ID NO: 233372 - DNA, 20 bp, Artificial
  CRISPR gRNA sequence
aggtggacgctgggccccgc

SEQ ID NO: 233373 - DNA, 20 bp, Artificial
  CRISPR gRNA sequence
ggtggacgctgggccccgcc

SEQ ID NO: 233374 - DNA, 20 bp, Artificial
  CRISPR gRNA sequence
gacgctgggccccgccaggc

SEQ ID NO: 233375 - DNA, 20 bp, Artificial
  CRISPR gRNA sequence
cgctgggccccgccaggctg

SEQ ID NO: 233376 - DNA, 20 bp, Artificial
  CRISPR gRNA sequence
ggccccgccaggctggagcc

SEQ ID NO: 233377 - DNA, 20 bp, Artificial
  CRISPR gRNA sequence
ccccgccaggctggagcccg

SEQ ID NO: 233378 - DNA, 20 bp, Artificial
  CRISPR gRNA sequence
cccgccaggctggagcccgg

SEQ ID NO: 233379 - DNA, 20 bp, Artificial
  CRISPR gRNA sequence
ccgccaggctggagcccgga

SEQ ID NO: 233380 - DNA, 20 bp, Artificial
  CRISPR gRNA sequence
ctggagcccggagggtctgc

SEQ ID NO: 233381 - DNA, 20 bp, Artificial
  CRISPR gRNA sequence
tggagcccggagggtctgct

SEQ ID NO: 233382 - DNA, 20 bp, Artificial
  CRISPR gRNA sequence
gcccggagggtctgctgggc

SEQ ID NO: 233383 - DNA, 20 bp, Artificial
  CRISPR gRNA sequence
cggagggtctgctgggcgag

SEQ ID NO: 233384 - DNA, 20 bp, Artificial
  CRISPR gRNA sequence
ggagggtctgctgggcgagc

SEQ ID NO: 233385 - DNA, 20 bp, Artificial
  CRISPR gRNA sequence
gagggtctgctgggcgagca

SEQ ID NO: 233386 - DNA, 20 bp, Artificial
  CRISPR gRNA sequence
ggtctgctgggcgagcaggg

SEQ ID NO: 233387 - DNA, 20 bp, Artificial
  CRISPR gRNA sequence
gtctgctgggcgagcagggc

SEQ ID NO: 233388 - DNA, 20 bp, Artificial
  CRISPR gRNA sequence
ctgggcgagcagggcaggtg

SEQ ID NO: 233389 - DNA, 20 bp, Artificial
  CRISPR gRNA sequence
tgggcgagcagggcaggtgc

SEQ ID NO: 233390 - DNA, 20 bp, Artificial
  CRISPR gRNA sequence
cgcctgccccgccacgctcc

SEQ ID NO: 233391 - DNA, 20 bp, Artificial
  CRISPR gRNA sequence
gcctgccccgccacgctcct

SEQ ID NO: 233392 - DNA, 20 bp, Artificial
  CRISPR gRNA sequence
gggccaactctgcaccgttc

SEQ ID NO: 233393 - DNA, 20 bp, Artificial
  CRISPR gRNA sequence
ggccaactctgcaccgttct

SEQ ID NO: 233394 - DNA, 20 bp, Artificial
  CRISPR gRNA sequence
tgcaccgttctaggtgccga

SEQ ID NO: 233395 - DNA, 20 bp, Artificial
  CRISPR gRNA sequence
taggtgccgatggctgcctc

SEQ ID NO: 233396 - DNA, 20 bp, Artificial
  CRISPR gRNA sequence
catgcatacctcctgccccg

SEQ ID NO: 233397 - DNA, 20 bp, Artificial
  CRISPR gRNA sequence
atgcatacctcctgccccgc

SEQ ID NO: 233398 - DNA, 20 bp, Artificial
  CRISPR gRNA sequence
cgggaccacaataaaaacct

SEQ ID NO: 233399 - DNA, 20 bp, Artificial
  CRISPR gRNA sequence
gaccacaataaaaaccttgg

SEQ ID NO: 233400 - DNA, 20 bp, Artificial
  CRISPR gRNA sequence
acaataaaaaccttggcaga

SEQ ID NO: 233401 - DNA, 20 bp, Artificial
  CRISPR gRNA sequence
caataaaaaccttggcagac

SEQ ID NO: 233402 - DNA, 20 bp, Artificial
  CRISPR gRNA sequence
ataaaaaccttggcagacgg

SEQ ID NO: 233403 - DNA, 20 bp, Artificial
  CRISPR gRNA sequence
ggcagacgggagtctccgac

SEQ ID NO: 233404 - DNA, 20 bp, Artificial
  CRISPR gRNA sequence
ggagtctccgaccggcactg

SEQ ID NO: 233405 - DNA, 20 bp, Artificial
  CRISPR gRNA sequence
gagtctccgaccggcactgt

SEQ ID NO: 233406 - DNA, 20 bp, Artificial
  CRISPR gRNA sequence
cactgtgggctgcacacctg

SEQ ID NO: 233407 - DNA, 20 bp, Artificial
  CRISPR gRNA sequence
tgggctgcacacctgtggca

SEQ ID NO: 233408 - DNA, 20 bp, Artificial
  CRISPR gRNA sequence
ggctgcacacctgtggcatg

SEQ ID NO: 233409 - DNA, 20 bp, Artificial
  CRISPR gRNA sequence
gctgcacacctgtggcatgg

SEQ ID NO: 233410 - DNA, 20 bp, Artificial
  CRISPR gRNA sequence
acacctgtggcatggaggct

SEQ ID NO: 233411 - DNA, 20 bp, Artificial
  CRISPR gRNA sequence
cacctgtggcatggaggctt

SEQ ID NO: 233412 - DNA, 20 bp, Artificial
  CRISPR gRNA sequence
gggccgtgcccgcctctgac

SEQ ID NO: 233413 - DNA, 20 bp, Artificial
  CRISPR gRNA sequence
gccgtgcccgcctctgactg

SEQ ID NO: 233414 - DNA, 20 bp, Artificial
  CRISPR gRNA sequence
cgtgcccgcctctgactgga

SEQ ID NO: 233415 - DNA, 20 bp, Artificial
  CRISPR gRNA sequence
gtgcccgcctctgactggag

SEQ ID NO: 233416 - DNA, 20 bp, Artificial
  CRISPR gRNA sequence
tgcccgcctctgactggaga

SEQ ID NO: 233417 - DNA, 20 bp, Artificial
  CRISPR gRNA sequence
gcccgcctctgactggagag

SEQ ID NO: 233418 - DNA, 20 bp, Artificial
  CRISPR gRNA sequence
ctctgactggagaggggtct

SEQ ID NO: 233419 - DNA, 20 bp, Artificial
  CRISPR gRNA sequence
tctgactggagaggggtctt

SEQ ID NO: 233420 - DNA, 20 bp, Artificial
  CRISPR gRNA sequence
tgactggagaggggtcttgg

SEQ ID NO: 233421 - DNA, 20 bp, Artificial
  CRISPR gRNA sequence
gactggagaggggtcttggg

SEQ ID NO: 233422 - DNA, 20 bp, Artificial
  CRISPR gRNA sequence
gagaggggtcttgggaggct

SEQ ID NO: 233423 - DNA, 20 bp, Artificial
  CRISPR gRNA sequence
agaggggtcttgggaggctt

SEQ ID NO: 233424 - DNA, 20 bp, Artificial
  CRISPR gRNA sequence
catcggcacctagaacggtg

SEQ ID NO: 233425 - DNA, 20 bp, Artificial
  CRISPR gRNA sequence
ggcccaggtcagatcttggc

SEQ ID NO: 233426 - DNA, 20 bp, Artificial
  CRISPR gRNA sequence
aggtcagatcttggccaggg

SEQ ID NO: 233427 - DNA, 20 bp, Artificial
  CRISPR gRNA sequence
tgggcgtcggcctgctcctc

SEQ ID NO: 233428 - DNA, 20 bp, Artificial
  CRISPR gRNA sequence
tcggcctgctcctcttggat

SEQ ID NO: 233429 - DNA, 20 bp, Artificial
  CRISPR gRNA sequence
gaggaaaaaaggagagattg

SEQ ID NO: 233430 - DNA, 20 bp, Artificial
  CRISPR gRNA sequence
cggagcaggtacagggccag

SEQ ID NO: 233431 - DNA, 20 bp, Artificial
  CRISPR gRNA sequence
cccagcaccaggcccaggcc

SEQ ID NO: 233432 - DNA, 20 bp, Artificial
  CRISPR gRNA sequence
caaccgcacggcctgcagga

SEQ ID NO: 233433 - DNA, 20 bp, Artificial
  CRISPR gRNA sequence
ggcctgcaggaaggggtctg

SEQ ID NO: 233434 - DNA, 20 bp, Artificial
  CRISPR gRNA sequence
gcaggaaggggtctgctggg

SEQ ID NO: 233435 - DNA, 20 bp, Artificial
  CRISPR gRNA sequence
ccgccctccccttctcctat

SEQ ID NO: 233436 - DNA, 20 bp, Artificial
  CRISPR gRNA sequence
cccccggggacctccacggg

SEQ ID NO: 233437 - DNA, 20 bp, Artificial
  CRISPR gRNA sequence
ggacctccacgggccgggtg

SEQ ID NO: 233438 - DNA, 20 bp, Artificial
  CRISPR gRNA sequence
atgggcctggccggggggcc

SEQ ID NO: 233439 - DNA, 20 bp, Artificial
  CRISPR gRNA sequence
ctcctggggctgcgtggctg

SEQ ID NO: 233440 - DNA, 20 bp, Artificial
  CRISPR gRNA sequence
gagctattgctggccggctg

SEQ ID NO: 233441 - DNA, 20 bp, Artificial
  CRISPR gRNA sequence
tgggacccgggagatgcggt

SEQ ID NO: 233442 - DNA, 20 bp, Artificial
  CRISPR gRNA sequence
gggagatgcggtggggataa

SEQ ID NO: 233443 - DNA, 20 bp, Artificial
  CRISPR gRNA sequence
cccagggcctcccagctgcg

SEQ ID NO: 233444 - DNA, 20 bp, Artificial
  CRISPR gRNA sequence
gcctcccagctgcggagggt

SEQ ID NO: 233445 - DNA, 20 bp, Artificial
  CRISPR gRNA sequence
ggcacagtctgcaacaaaga

SEQ ID NO: 233446 - DNA, 20 bp, Artificial
  CRISPR gRNA sequence
tcaggggctgcccacaggcc

SEQ ID NO: 233447 - DNA, 20 bp, Artificial
  CRISPR gRNA sequence
caggcacttgccccccatgg

SEQ ID NO: 233448 - DNA, 20 bp, Artificial
  CRISPR gRNA sequence
ttgccccccatggctgggtg

SEQ ID NO: 233449 - DNA, 20 bp, Artificial
  CRISPR gRNA sequence
tgacccgggagctcggtctt

SEQ ID NO: 233450 - DNA, 20 bp, Artificial
  CRISPR gRNA sequence
ggcttgtagctgtccagggg

SEQ ID NO: 233451 - DNA, 20 bp, Artificial
  CRISPR gRNA sequence
tcccacttcctgagcagggg

SEQ ID NO: 233452 - DNA, 20 bp, Artificial
  CRISPR gRNA sequence
cctgagcaggggccggatgg

SEQ ID NO: 233453 - DNA, 20 bp, Artificial
  CRISPR gRNA sequence
ggtcaggtgggggctgtgga

SEQ ID NO: 233454 - DNA, 20 bp, Artificial
  CRISPR gRNA sequence
ccacacagagggccgtgggc

SEQ ID NO: 233455 - DNA, 20 bp, Artificial
  CRISPR gRNA sequence
gccgccagccccgcctgcgg

SEQ ID NO: 233456 - DNA, 20 bp, Artificial
  CRISPR gRNA sequence
ccgactccacgtggcctggg

SEQ ID NO: 233457 - DNA, 20 bp, Artificial
  CRISPR gRNA sequence
tctgggcccccggagggaga

SEQ ID NO: 233458 - DNA, 20 bp, Artificial
  CRISPR gRNA sequence
ggagccccatgctgctgcgt

SEQ ID NO: 233459 - DNA, 20 bp, Artificial
  CRISPR gRNA sequence
ccatgctgctgcgtgggaat

SEQ ID NO: 233460 - DNA, 20 bp, Artificial
  CRISPR gRNA sequence
ccaggctgccgccccctgtg

SEQ ID NO: 233461 - DNA, 20 bp, Artificial
  CRISPR gRNA sequence
ctgccccagcccccagtccc

SEQ ID NO: 233462 - DNA, 20 bp, Artificial
  CRISPR gRNA sequence
gtggcagcaccggtcgttgc

SEQ ID NO: 233463 - DNA, 20 bp, Artificial
  CRISPR gRNA sequence
atcctcgtctctgctgtcgc

SEQ ID NO: 233464 - DNA, 20 bp, Artificial
  CRISPR gRNA sequence
gtctctgctgtcgccagagt

SEQ ID NO: 233465 - DNA, 20 bp, Artificial
  CRISPR gRNA sequence
cagagtctgggttttccttg

SEQ ID NO: 233466 - DNA, 20 bp, Artificial
  CRISPR gRNA sequence
ctgtgggctgggcacaaagg

SEQ ID NO: 233467 - DNA, 20 bp, Artificial
  CRISPR gRNA sequence
caaaaaggtccatggagcac

SEQ ID NO: 233468 - DNA, 20 bp, Artificial
  CRISPR gRNA sequence
gtgggtaaactgaggcagca

SEQ ID NO: 233469 - DNA, 20 bp, Artificial
  CRISPR gRNA sequence
cagcactttgggaggccaag

SEQ ID NO: 233470 - DNA, 20 bp, Artificial
  CRISPR gRNA sequence
actttgggaggccaaggcgg

SEQ ID NO: 233471 - DNA, 20 bp, Artificial
  CRISPR gRNA sequence
cgggtggatcacctgaggtc

SEQ ID NO: 233472 - DNA, 20 bp, Artificial
  CRISPR gRNA sequence
accggcgcccgccaccacgc

SEQ ID NO: 233473 - DNA, 20 bp, Artificial
  CRISPR gRNA sequence
ttttgtagttttagtagaga

SEQ ID NO: 233474 - DNA, 20 bp, Artificial
  CRISPR gRNA sequence
gccttggcctcccaaagtgc

SEQ ID NO: 233475 - DNA, 20 bp, Artificial
  CRISPR gRNA sequence
gggagccaccgtgcctggcc

SEQ ID NO: 233476 - DNA, 20 bp, Artificial
  CRISPR gRNA sequence
agccctgaaggtccagactg

SEQ ID NO: 233477 - DNA, 20 bp, Artificial
  CRISPR gRNA sequence
gctccatggacctttttgct

SEQ ID NO: 233478 - DNA, 20 bp, Artificial
  CRISPR gRNA sequence
ggccaggccctactgtgccc

SEQ ID NO: 233479 - DNA, 20 bp, Artificial
  CRISPR gRNA sequence
gggcagaagaggtcagaagg

SEQ ID NO: 233480 - DNA, 20 bp, Artificial
  CRISPR gRNA sequence
aggcagaataagccaatgct

SEQ ID NO: 233481 - DNA, 20 bp, Artificial
  CRISPR gRNA sequence
ctttgtgcccagcccacagc

SEQ ID NO: 233482 - DNA, 20 bp, Artificial
  CRISPR gRNA sequence
actctggcgacagcagagac

SEQ ID NO: 233483 - DNA, 20 bp, Artificial
  CRISPR gRNA sequence
cagcaacgaccggtgctgcc

SEQ ID NO: 233484 - DNA, 20 bp, Artificial
  CRISPR gRNA sequence
aggccaggtgaggcctcagg

SEQ ID NO: 233485 - DNA, 20 bp, Artificial
  CRISPR gRNA sequence
cagggactgggggctggggc

SEQ ID NO: 233486 - DNA, 20 bp, Artificial
  CRISPR gRNA sequence
aggctggtcctggggagggg

SEQ ID NO: 233487 - DNA, 20 bp, Artificial
  CRISPR gRNA sequence
ctggcagaggagccgcctgg

SEQ ID NO: 233488 - DNA, 20 bp, Artificial
  CRISPR gRNA sequence
ccggcctctgctgcaggcaa

SEQ ID NO: 233489 - DNA, 20 bp, Artificial
  CRISPR gRNA sequence
aaacgaacctcaaaccacag

SEQ ID NO: 233490 - DNA, 20 bp, Artificial
  CRISPR gRNA sequence
agcggggtctgctccgccac

SEQ ID NO: 233491 - DNA, 20 bp, Artificial
  CRISPR gRNA sequence
cagactcggcccaggccacg

SEQ ID NO: 233492 - DNA, 20 bp, Artificial
  CRISPR gRNA sequence
tggcctgagcagtgaggctg

SEQ ID NO: 233493 - DNA, 20 bp, Artificial
  CRISPR gRNA sequence
ctggcggctggaggcggtgg

SEQ ID NO: 233494 - DNA, 20 bp, Artificial
  CRISPR gRNA sequence
gaggcggtggaggggtaggg

SEQ ID NO: 233495 - DNA, 20 bp, Artificial
  CRISPR gRNA sequence
ccggcccctgctcaggaagt

SEQ ID NO: 233496 - DNA, 20 bp, Artificial
  CRISPR gRNA sequence
cccctggacagctacaagcc

SEQ ID NO: 233497 - DNA, 20 bp, Artificial
  CRISPR gRNA sequence
ggtggctgcggccggcggtt

SEQ ID NO: 233498 - DNA, 20 bp, Artificial
  CRISPR gRNA sequence
gcatcctcaagaccgagctc

SEQ ID NO: 233499 - DNA, 20 bp, Artificial
  CRISPR gRNA sequence
gagctcccgggtcagggccc

SEQ ID NO: 233500 - DNA, 20 bp, Artificial
  CRISPR gRNA sequence
cccgggtcagggcccacggg

SEQ ID NO: 233501 - DNA, 20 bp, Artificial
  CRISPR gRNA sequence
ggggctgggaggggctgggg

SEQ ID NO: 233502 - DNA, 20 bp, Artificial
  CRISPR gRNA sequence
gggaggggctgggggggggt

SEQ ID NO: 233503 - DNA, 20 bp, Artificial
  CRISPR gRNA sequence
ggaggggctgggggggcagg

SEQ ID NO: 233504 - DNA, 20 bp, Artificial
  CRISPR gRNA sequence
cctgggggcagcctttccct

SEQ ID NO: 233505 - DNA, 20 bp, Artificial
  CRISPR gRNA sequence
gcctttccctgtgggtggag

SEQ ID NO: 233506 - DNA, 20 bp, Artificial
  CRISPR gRNA sequence
aggacagggaggtgctggtg

SEQ ID NO: 233507 - DNA, 20 bp, Artificial
  CRISPR gRNA sequence
ggggggtgtagatgtgggag

SEQ ID NO: 233508 - DNA, 20 bp, Artificial
  CRISPR gRNA sequence
tgttatccccaccgcatctc

SEQ ID NO: 233509 - DNA, 20 bp, Artificial
  CRISPR gRNA sequence
accgcatctcccgggtccca

SEQ ID NO: 233510 - DNA, 20 bp, Artificial
  CRISPR gRNA sequence
cccggcccgtggaggtcccc

SEQ ID NO: 233511 - DNA, 20 bp, Artificial
  CRISPR gRNA sequence
agcccagcggggcccccaac

SEQ ID NO: 233512 - DNA, 20 bp, Artificial
  CRISPR gRNA sequence
cgatgcccacaagccccctg

SEQ ID NO: 233513 - DNA, 20 bp, Artificial
  CRISPR gRNA sequence
gccctgccgcactgctcctg

SEQ ID NO: 233514 - DNA, 20 bp, Artificial
  CRISPR gRNA sequence
ccccgccaggctggagcccg

SEQ ID NO: 233515 - DNA, 20 bp, Artificial
  CRISPR gRNA sequence
caataaaaaccttggcagac

SEQ ID NO: 233516 - DNA, 20 bp, Artificial
  CRISPR gRNA sequence
gtgcccgcctctgactggag

SEQ ID NO: 233517 - DNA, 20 bp, Artificial
  CRISPR gRNA sequence
ggtcggagactcccgtctgc

SEQ ID NO: 233518 - DNA, 20 bp, Artificial
  CRISPR gRNA sequence
ccccctggggaggaaaaaag

SEQ ID NO: 233519 - DNA, 20 bp, Artificial
  CRISPR gRNA sequence
gggccatgaggcactcacca

SEQ ID NO: 233520 - DNA, 20 bp, Artificial
  CRISPR gRNA sequence
ggtccctgtgaggttctggg

SEQ ID NO: 233521 - DNA, 20 bp, Artificial
  CRISPR gRNA sequence
ggctggggggtccctgtcct

SEQ ID NO: 233522 - DNA, 20 bp, Artificial
  CRISPR gRNA sequence
tattgctggccggctgcagg

SEQ ID NO: 233523 - DNA, 20 bp, Artificial
  CRISPR gRNA sequence
gggaaaggctgcccccaggc

SEQ ID NO: 233524 - DNA, 20 bp, Artificial
  CRISPR gRNA sequence
gccaggcccctcacttggtc

SEQ ID NO: 233525 - DNA, 20 bp, Artificial
  CRISPR gRNA sequence
ttgccccccatggctgggtg

SEQ ID NO: 233526 - DNA, 20 bp, Artificial
  CRISPR gRNA sequence
agccaccgagctcaccaact

SEQ ID NO: 233527 - DNA, 20 bp, Artificial
  CRISPR gRNA sequence
tgtcctgtgtggccgtgcac

SEQ ID NO: 233528 - DNA, 20 bp, Artificial
  CRISPR gRNA sequence
tgtggcggagcagaccccgc

SEQ ID NO: 233529 - DNA, 20 bp, Artificial
  CRISPR gRNA sequence
agaccccgctgtggtttgag

SEQ ID NO: 233530 - DNA, 20 bp, Artificial
  CRISPR gRNA sequence
cactgaggttacaccacgtg

SEQ ID NO: 233531 - DNA, 20 bp, Artificial
  CRISPR gRNA sequence
tacaccacgtgcagggcttg

SEQ ID NO: 233532 - DNA, 20 bp, Artificial
  CRISPR gRNA sequence
cgtcaggcagcggtcaggcc

SEQ ID NO: 233533 - DNA, 20 bp, Artificial
  CRISPR gRNA sequence
ccccccaggcggctcctctg

SEQ ID NO: 233534 - DNA, 20 bp, Artificial
  CRISPR gRNA sequence
gtctctgctgtcgccagagt

SEQ ID NO: 233535 - DNA, 20 bp, Artificial
  CRISPR gRNA sequence
ggggtctgggcacccccagc

SEQ ID NO: 233536 - DNA, 20 bp, Artificial
  CRISPR gRNA sequence
caccacgcccgaataatttt

SEQ ID NO: 233537 - DNA, 20 bp, Artificial
  CRISPR gRNA sequence
tttttgtagttttagtagag

SEQ ID NO: 233538 - DNA, 20 bp, Artificial
  CRISPR gRNA sequence
cgccttggcctcccaaagtg

SEQ ID NO: 233539 - DNA, 20 bp, Artificial
  CRISPR gRNA sequence
tcttgggcatacaaggggga

SEQ ID NO: 233540 - DNA, 20 bp, Artificial
  CRISPR gRNA sequence
ctctcctgactcagtgctgc

SEQ ID NO: 233541 - DNA, 20 bp, Artificial
  CRISPR gRNA sequence
cggtgtgccgtccgtgcggg

SEQ ID NO: 233542 - DNA, 20 bp, Artificial
  CRISPR gRNA sequence
gccaacctgtcctccagtgc

SEQ ID NO: 233543 - DNA, 20 bp, Artificial
  CRISPR gRNA sequence
acgggtgggatgtgggcagg

SEQ ID NO: 233544 - DNA, 20 bp, Artificial
  CRISPR gRNA sequence
gggggggcaggtggggtggg

SEQ ID NO: 233545 - DNA, 20 bp, Artificial
  CRISPR gRNA sequence
accgcatctcccgggtccca

SEQ ID NO: 233546 - DNA, 20 bp, Artificial
  CRISPR gRNA sequence
ttttttcctccccaggggga

SEQ ID NO: 233547 - DNA, 20 bp, Artificial
  CRISPR gRNA sequence
gccgatggctgcctccggct

SEQ ID NO: 233548 - DNA, 20 bp, Artificial
  CRISPR gRNA sequence
gggctgcacacctgtggcat

SEQ ID NO: 233549 - DNA, 20 bp, Artificial
  CRISPR gRNA sequence
ctgactggagaggggtcttg

SEQ ID NO: 233550 - DNA, 20 bp, Artificial
  CRISPR gRNA sequence
aacaggaggtgttgctcagg

SEQ ID NO: 233551 - DNA, 20 bp, Artificial
  CRISPR gRNA sequence
tgggcagaagaggtcagaag

SEQ ID NO: 233552 - DNA, 20 bp, Artificial
  CRISPR gRNA sequence
agcatggggctcccacagcc

SEQ ID NO: 233553 - DNA, 20 bp, Artificial
  CRISPR gRNA sequence
accagcacctccccttcccc

SEQ ID NO: 233554 - DNA, 20 bp, Artificial
  CRISPR gRNA sequence
tggcgaaatcccgtctctac

SEQ ID NO: 233555 - DNA, 20 bp, Artificial
  CRISPR gRNA sequence
ttatagccacaccccgcaag

SEQ ID NO: 233556 - DNA, 20 bp, Artificial
  CRISPR gRNA sequence
ctgccccgcgggaccacaat

SEQ ID NO: 233557 - DNA, 20 bp, Artificial
  CRISPR gRNA sequence
ccaagacccctctccagtca

SEQ ID NO: 233558 - DNA, 20 bp, Artificial
  CRISPR gRNA sequence
tccagtcagaggcgggcacg

SEQ ID NO: 233559 - DNA, 20 bp, Artificial
  CRISPR gRNA sequence
cagtcagaggcgggcacggc

SEQ ID NO: 233560 - DNA, 20 bp, Artificial
  CRISPR gRNA sequence
catgccacaggtgtgcagcc

SEQ ID NO: 233561 - DNA, 20 bp, Artificial
  CRISPR gRNA sequence
ccgtctgccaaggtttttat

SEQ ID NO: 233562 - DNA, 20 bp, Artificial
  CRISPR gRNA sequence
ccaaggtttttattgtggtc

SEQ ID NO: 233563 - DNA, 20 bp, Artificial
  CRISPR gRNA sequence
ttattgtggtcccgcggggc

SEQ ID NO: 233564 - DNA, 20 bp, Artificial
  CRISPR gRNA sequence
tattgtggtcccgcggggca

SEQ ID NO: 233565 - DNA, 20 bp, Artificial
  CRISPR gRNA sequence
attgtggtcccgcggggcag

SEQ ID NO: 233566 - DNA, 20 bp, Artificial
  CRISPR gRNA sequence
ttgtggtcccgcggggcagg

SEQ ID NO: 233567 - DNA, 20 bp, Artificial
  CRISPR gRNA sequence
tggtcccgcggggcaggagg

SEQ ID NO: 233568 - DNA, 20 bp, Artificial
  CRISPR gRNA sequence
gaacggtgcagagttggccc

SEQ ID NO: 233569 - DNA, 20 bp, Artificial
  CRISPR gRNA sequence
gcccaggagcgtggcggggc

SEQ ID NO: 233570 - DNA, 20 bp, Artificial
  CRISPR gRNA sequence
cacctgccctgctcgcccag

SEQ ID NO: 233571 - DNA, 20 bp, Artificial
  CRISPR gRNA sequence
ccctgctcgcccagcagacc

SEQ ID NO: 233572 - DNA, 20 bp, Artificial
  CRISPR gRNA sequence
ctcgcccagcagaccctccg

SEQ ID NO: 233573 - DNA, 20 bp, Artificial
  CRISPR gRNA sequence
gcccagcagaccctccgggc

SEQ ID NO: 233574 - DNA, 20 bp, Artificial
  CRISPR gRNA sequence
cgggctccagcctggcgggg

SEQ ID NO: 233575 - DNA, 20 bp, Artificial
  CRISPR gRNA sequence
cagcctggcggggcccagcg

SEQ ID NO: 233576 - DNA, 20 bp, Artificial
  CRISPR gRNA sequence
gcggggcccagcgtccacct

SEQ ID NO: 233577 - DNA, 20 bp, Artificial
  CRISPR gRNA sequence
ggtgggcccaggtcagatct

SEQ ID NO: 233578 - DNA, 20 bp, Artificial
  CRISPR gRNA sequence
gtgggcccaggtcagatctt

SEQ ID NO: 233579 - DNA, 20 bp, Artificial
  CRISPR gRNA sequence
ggccagggtggagtgggcgt

SEQ ID NO: 233580 - DNA, 20 bp, Artificial
  CRISPR gRNA sequence
gccagggtggagtgggcgtc

SEQ ID NO: 233581 - DNA, 20 bp, Artificial
  CRISPR gRNA sequence
ctcctcttggatgggggtcc

SEQ ID NO: 233582 - DNA, 20 bp, Artificial
  CRISPR gRNA sequence
ctcttggatgggggtccgga

SEQ ID NO: 233583 - DNA, 20 bp, Artificial
  CRISPR gRNA sequence
ttggatgggggtccggaaac

SEQ ID NO: 233584 - DNA, 20 bp, Artificial
  CRISPR gRNA sequence
ggatgggggtccggaaactg

SEQ ID NO: 233585 - DNA, 20 bp, Artificial
  CRISPR gRNA sequence
gatgggggtccggaaactgc

SEQ ID NO: 233586 - DNA, 20 bp, Artificial
  CRISPR gRNA sequence
cctccccctggggaggaaaa

SEQ ID NO: 233587 - DNA, 20 bp, Artificial
  CRISPR gRNA sequence
cccctggggaggaaaaaagg

SEQ ID NO: 233588 - DNA, 20 bp, Artificial
  CRISPR gRNA sequence
gggaggaaaaaaggagagat

SEQ ID NO: 233589 - DNA, 20 bp, Artificial
  CRISPR gRNA sequence
gtgggtgggcctcacccgcc

SEQ ID NO: 233590 - DNA, 20 bp, Artificial
  CRISPR gRNA sequence
acccgccaggagcagtgcgg

SEQ ID NO: 233591 - DNA, 20 bp, Artificial
  CRISPR gRNA sequence
accagggggcttgtgggcat

SEQ ID NO: 233592 - DNA, 20 bp, Artificial
  CRISPR gRNA sequence
gtgggcatcggggggcagcc

SEQ ID NO: 233593 - DNA, 20 bp, Artificial
  CRISPR gRNA sequence
tgggcatcggggggcagcct

SEQ ID NO: 233594 - DNA, 20 bp, Artificial
  CRISPR gRNA sequence
tggtccctccggagcaggta

SEQ ID NO: 233595 - DNA, 20 bp, Artificial
  CRISPR gRNA sequence
gtccctccggagcaggtaca

SEQ ID NO: 233596 - DNA, 20 bp, Artificial
  CRISPR gRNA sequence
cggagcaggtacagggccag

SEQ ID NO: 233597 - DNA, 20 bp, Artificial
  CRISPR gRNA sequence
caggaaggggtctgctgggt

SEQ ID NO: 233598 - DNA, 20 bp, Artificial
  CRISPR gRNA sequence
ctgggtggggtccacaggag

SEQ ID NO: 233599 - DNA, 20 bp, Artificial
  CRISPR gRNA sequence
ggtggggtccacaggagggg

SEQ ID NO: 233600 - DNA, 20 bp, Artificial
  CRISPR gRNA sequence
cccttctcctattcgggttg

SEQ ID NO: 233601 - DNA, 20 bp, Artificial
  CRISPR gRNA sequence
ctcctattcgggttgggggc

SEQ ID NO: 233602 - DNA, 20 bp, Artificial
  CRISPR gRNA sequence
tcctattcgggttgggggcc

SEQ ID NO: 233603 - DNA, 20 bp, Artificial
  CRISPR gRNA sequence
ctattcgggttgggggcccc

SEQ ID NO: 233604 - DNA, 20 bp, Artificial
  CRISPR gRNA sequence
ttcgggttgggggccccgct

SEQ ID NO: 233605 - DNA, 20 bp, Artificial
  CRISPR gRNA sequence
gggttgggggccccgctggg

SEQ ID NO: 233606 - DNA, 20 bp, Artificial
  CRISPR gRNA sequence
ggggccccgctgggctgggc

SEQ ID NO: 233607 - DNA, 20 bp, Artificial
  CRISPR gRNA sequence
ggctgggccaggcgccctta

SEQ ID NO: 233608 - DNA, 20 bp, Artificial
  CRISPR gRNA sequence
ggccaggcgcccttaccccc

SEQ ID NO: 233609 - DNA, 20 bp, Artificial
  CRISPR gRNA sequence
acccccggggacctccacgg

SEQ ID NO: 233610 - DNA, 20 bp, Artificial
  CRISPR gRNA sequence
cccccggggacctccacggg

SEQ ID NO: 233611 - DNA, 20 bp, Artificial
  CRISPR gRNA sequence
cacgggccgggtggagggtc

SEQ ID NO: 233612 - DNA, 20 bp, Artificial
  CRISPR gRNA sequence
tgaggttctgggccaggctt

SEQ ID NO: 233613 - DNA, 20 bp, Artificial
  CRISPR gRNA sequence
tgggccaggcttcagtgggc

SEQ ID NO: 233614 - DNA, 20 bp, Artificial
  CRISPR gRNA sequence
ggccaggcttcagtgggctg

SEQ ID NO: 233615 - DNA, 20 bp, Artificial
  CRISPR gRNA sequence
cagtgggctggacagtgatg

SEQ ID NO: 233616 - DNA, 20 bp, Artificial
  CRISPR gRNA sequence
agtgggctggacagtgatgg

SEQ ID NO: 233617 - DNA, 20 bp, Artificial
  CRISPR gRNA sequence
gacagtgatgggcctggccg

SEQ ID NO: 233618 - DNA, 20 bp, Artificial
  CRISPR gRNA sequence
gccggggggccctgggtctc

SEQ ID NO: 233619 - DNA, 20 bp, Artificial
  CRISPR gRNA sequence
ggtctcctggggctgcgtgg

SEQ ID NO: 233620 - DNA, 20 bp, Artificial
  CRISPR gRNA sequence
ctggggctgcgtggctgggg

SEQ ID NO: 233621 - DNA, 20 bp, Artificial
  CRISPR gRNA sequence
gggctgcgtggctggggggt

SEQ ID NO: 233622 - DNA, 20 bp, Artificial
  CRISPR gRNA sequence
cgtggctggggggtccctgt

SEQ ID NO: 233623 - DNA, 20 bp, Artificial
  CRISPR gRNA sequence
gggggtccctgtcctcacag

SEQ ID NO: 233624 - DNA, 20 bp, Artificial
  CRISPR gRNA sequence
tcctcacagattgcgtccga

SEQ ID NO: 233625 - DNA, 20 bp, Artificial
  CRISPR gRNA sequence
acagattgcgtccgagctat

SEQ ID NO: 233626 - DNA, 20 bp, Artificial
  CRISPR gRNA sequence
cgtccgagctattgctggcc

SEQ ID NO: 233627 - DNA, 20 bp, Artificial
  CRISPR gRNA sequence
ttgctggccggctgcagggt

SEQ ID NO: 233628 - DNA, 20 bp, Artificial
  CRISPR gRNA sequence
ctggccggctgcagggtgtg

SEQ ID NO: 233629 - DNA, 20 bp, Artificial
  CRISPR gRNA sequence
gccggctgcagggtgtgctt

SEQ ID NO: 233630 - DNA, 20 bp, Artificial
  CRISPR gRNA sequence
cagggtgtgcttcccagcca

SEQ ID NO: 233631 - DNA, 20 bp, Artificial
  CRISPR gRNA sequence
cccagccaaggtgcagctgt

SEQ ID NO: 233632 - DNA, 20 bp, Artificial
  CRISPR gRNA sequence
ccagccaaggtgcagctgtt

SEQ ID NO: 233633 - DNA, 20 bp, Artificial
  CRISPR gRNA sequence
ttggggaacaggaggtgttg

SEQ ID NO: 233634 - DNA, 20 bp, Artificial
  CRISPR gRNA sequence
gggaacaggaggtgttgctc

SEQ ID NO: 233635 - DNA, 20 bp, Artificial
  CRISPR gRNA sequence
ctcaggccagaaaccccctg

SEQ ID NO: 233636 - DNA, 20 bp, Artificial
  CRISPR gRNA sequence
aggccagaaaccccctggga

SEQ ID NO: 233637 - DNA, 20 bp, Artificial
  CRISPR gRNA sequence
ggacccgggagatgcggtgg

SEQ ID NO: 233638 - DNA, 20 bp, Artificial
  CRISPR gRNA sequence
gccagccacaggcagcatct

SEQ ID NO: 233639 - DNA, 20 bp, Artificial
  CRISPR gRNA sequence
ccacagacaccaggccagtg

SEQ ID NO: 233640 - DNA, 20 bp, Artificial
  CRISPR gRNA sequence
cccagccccacgtgcccccc

SEQ ID NO: 233641 - DNA, 20 bp, Artificial
  CRISPR gRNA sequence
caaggccacacacccttctc

SEQ ID NO: 233642 - DNA, 20 bp, Artificial
  CRISPR gRNA sequence
ctcccacatctacacccccc

SEQ ID NO: 233643 - DNA, 20 bp, Artificial
  CRISPR gRNA sequence
tcccacatctacacccccca

SEQ ID NO: 233644 - DNA, 20 bp, Artificial
  CRISPR gRNA sequence
ccacatctacaccccccacc

SEQ ID NO: 233645 - DNA, 20 bp, Artificial
  CRISPR gRNA sequence
caccccccaccagcacctcc

SEQ ID NO: 233646 - DNA, 20 bp, Artificial
  CRISPR gRNA sequence
cctgtcctgtgcccccaggg

SEQ ID NO: 233647 - DNA, 20 bp, Artificial
  CRISPR gRNA sequence
tcctgtgcccccagggcctc

SEQ ID NO: 233648 - DNA, 20 bp, Artificial
  CRISPR gRNA sequence
tgcccccagggcctcccagc

SEQ ID NO: 233649 - DNA, 20 bp, Artificial
  CRISPR gRNA sequence
ccagctgcggagggtgaggg

SEQ ID NO: 233650 - DNA, 20 bp, Artificial
  CRISPR gRNA sequence
cggagggtgagggtcccaca

SEQ ID NO: 233651 - DNA, 20 bp, Artificial
  CRISPR gRNA sequence
cacccacagggaaaggctgc

SEQ ID NO: 233652 - DNA, 20 bp, Artificial
  CRISPR gRNA sequence
cccccaggcagcagcttcct

SEQ ID NO: 233653 - DNA, 20 bp, Artificial
  CRISPR gRNA sequence
cctgctccccaaccaggtcc

SEQ ID NO: 233654 - DNA, 20 bp, Artificial
  CRISPR gRNA sequence
ctgctccccaaccaggtcca

SEQ ID NO: 233655 - DNA, 20 bp, Artificial
  CRISPR gRNA sequence
ctccccaaccaggtccagcc

SEQ ID NO: 233656 - DNA, 20 bp, Artificial
  CRISPR gRNA sequence
cccaaccaggtccagccaca

SEQ ID NO: 233657 - DNA, 20 bp, Artificial
  CRISPR gRNA sequence
cccttcccccaaaactgccc

SEQ ID NO: 233658 - DNA, 20 bp, Artificial
  CRISPR gRNA sequence
cccccaaaactgcccccacc

SEQ ID NO: 233659 - DNA, 20 bp, Artificial
  CRISPR gRNA sequence
ccccaaaactgcccccaccc

SEQ ID NO: 233660 - DNA, 20 bp, Artificial
  CRISPR gRNA sequence
cccccaccccacctgccccc

SEQ ID NO: 233661 - DNA, 20 bp, Artificial
  CRISPR gRNA sequence
cccccccagcccctcccagc

SEQ ID NO: 233662 - DNA, 20 bp, Artificial
  CRISPR gRNA sequence
ccagctccccagctcctccg

SEQ ID NO: 233663 - DNA, 20 bp, Artificial
  CRISPR gRNA sequence
cccagctcctccgccctcct

SEQ ID NO: 233664 - DNA, 20 bp, Artificial
  CRISPR gRNA sequence
ctccgccctcctaaccaccc

SEQ ID NO: 233665 - DNA, 20 bp, Artificial
  CRISPR gRNA sequence
cgccctcctaaccaccccaa

SEQ ID NO: 233666 - DNA, 20 bp, Artificial
  CRISPR gRNA sequence
ctaaccaccccaaccccccc

SEQ ID NO: 233667 - DNA, 20 bp, Artificial
  CRISPR gRNA sequence
accaccccaaccccccccca

SEQ ID NO: 233668 - DNA, 20 bp, Artificial
  CRISPR gRNA sequence
ccagcccctggccaggcccc

SEQ ID NO: 233669 - DNA, 20 bp, Artificial
  CRISPR gRNA sequence
gccaggcccctcacttggtc

SEQ ID NO: 233670 - DNA, 20 bp, Artificial
  CRISPR gRNA sequence
acttggtccagggcttgcag

SEQ ID NO: 233671 - DNA, 20 bp, Artificial
  CRISPR gRNA sequence
ggtccagggcttgcaggcct

SEQ ID NO: 233672 - DNA, 20 bp, Artificial
  CRISPR gRNA sequence
gtccagggcttgcaggcctg

SEQ ID NO: 233673 - DNA, 20 bp, Artificial
  CRISPR gRNA sequence
gcaggcctggttgtcgcctg

SEQ ID NO: 233674 - DNA, 20 bp, Artificial
  CRISPR gRNA sequence
caggcctggttgtcgcctgg

SEQ ID NO: 233675 - DNA, 20 bp, Artificial
  CRISPR gRNA sequence
gttgtcgcctggggagaagt

SEQ ID NO: 233676 - DNA, 20 bp, Artificial
  CRISPR gRNA sequence
tcgcctggggagaagtgccc

SEQ ID NO: 233677 - DNA, 20 bp, Artificial
  CRISPR gRNA sequence
gggagaagtgccctggaggg

SEQ ID NO: 233678 - DNA, 20 bp, Artificial
  CRISPR gRNA sequence
gagggcagggggcacagtct

SEQ ID NO: 233679 - DNA, 20 bp, Artificial
  CRISPR gRNA sequence
caacaaagatagggtggtca

SEQ ID NO: 233680 - DNA, 20 bp, Artificial
  CRISPR gRNA sequence
cccacaggccccgggtgctg

SEQ ID NO: 233681 - DNA, 20 bp, Artificial
  CRISPR gRNA sequence
gggacatggggcagagcctg

SEQ ID NO: 233682 - DNA, 20 bp, Artificial
  CRISPR gRNA sequence
tggggcaggcacttgccccc

SEQ ID NO: 233683 - DNA, 20 bp, Artificial
  CRISPR gRNA sequence
gccccccatggctgggtggt

SEQ ID NO: 233684 - DNA, 20 bp, Artificial
  CRISPR gRNA sequence
ccccccatggctgggtggtg

SEQ ID NO: 233685 - DNA, 20 bp, Artificial
  CRISPR gRNA sequence
ggtggtgggtttggcctctg

SEQ ID NO: 233686 - DNA, 20 bp, Artificial
  CRISPR gRNA sequence
ggcctctggaagccctccct

SEQ ID NO: 233687 - DNA, 20 bp, Artificial
  CRISPR gRNA sequence
gcctctggaagccctccctg

SEQ ID NO: 233688 - DNA, 20 bp, Artificial
  CRISPR gRNA sequence
tggaagccctccctgcccac

SEQ ID NO: 233689 - DNA, 20 bp, Artificial
  CRISPR gRNA sequence
gaagccctccctgcccacat

SEQ ID NO: 233690 - DNA, 20 bp, Artificial
  CRISPR gRNA sequence
cctgcccacatcccacccgt

SEQ ID NO: 233691 - DNA, 20 bp, Artificial
  CRISPR gRNA sequence
cccacatcccacccgtgggc

SEQ ID NO: 233692 - DNA, 20 bp, Artificial
  CRISPR gRNA sequence
acccgggagctcggtcttga

SEQ ID NO: 233693 - DNA, 20 bp, Artificial
  CRISPR gRNA sequence
ggtcttgaggatgccagagg

SEQ ID NO: 233694 - DNA, 20 bp, Artificial
  CRISPR gRNA sequence
gaggatgccagaggaggcac

SEQ ID NO: 233695 - DNA, 20 bp, Artificial
  CRISPR gRNA sequence
aggatgccagaggaggcacc

SEQ ID NO: 233696 - DNA, 20 bp, Artificial
  CRISPR gRNA sequence
cggcccacggcccatctgcg

SEQ ID NO: 233697 - DNA, 20 bp, Artificial
  CRISPR gRNA sequence
cgtcacagacagccgctatg

SEQ ID NO: 233698 - DNA, 20 bp, Artificial
  CRISPR gRNA sequence
tgcacacccccaaccgccgg

SEQ ID NO: 233699 - DNA, 20 bp, Artificial
  CRISPR gRNA sequence
accaactccaggcttgtagc

SEQ ID NO: 233700 - DNA, 20 bp, Artificial
  CRISPR gRNA sequence
caggcttgtagctgtccagg

SEQ ID NO: 233701 - DNA, 20 bp, Artificial
  CRISPR gRNA sequence
gtagctgtccaggggctggg

SEQ ID NO: 233702 - DNA, 20 bp, Artificial
  CRISPR gRNA sequence
tagctgtccaggggctgggt

SEQ ID NO: 233703 - DNA, 20 bp, Artificial
  CRISPR gRNA sequence
tccaggggctgggtgcccgc

SEQ ID NO: 233704 - DNA, 20 bp, Artificial
  CRISPR gRNA sequence
ggtgcccgcccggcagcggc

SEQ ID NO: 233705 - DNA, 20 bp, Artificial
  CRISPR gRNA sequence
tgtcctgtgtggccgtgcac

SEQ ID NO: 233706 - DNA, 20 bp, Artificial
  CRISPR gRNA sequence
tgtggccgtgcacagctgct

SEQ ID NO: 233707 - DNA, 20 bp, Artificial
  CRISPR gRNA sequence
cttccgctcactcccacttc

SEQ ID NO: 233708 - DNA, 20 bp, Artificial
  CRISPR gRNA sequence
ccgctcactcccacttcctg

SEQ ID NO: 233709 - DNA, 20 bp, Artificial
  CRISPR gRNA sequence
cgctcactcccacttcctga

SEQ ID NO: 233710 - DNA, 20 bp, Artificial
  CRISPR gRNA sequence
actcccacttcctgagcagg

SEQ ID NO: 233711 - DNA, 20 bp, Artificial
  CRISPR gRNA sequence
ccacttcctgagcaggggcc

SEQ ID NO: 233712 - DNA, 20 bp, Artificial
  CRISPR gRNA sequence
cctgagcaggggccggatgg

SEQ ID NO: 233713 - DNA, 20 bp, Artificial
  CRISPR gRNA sequence
ctgagcaggggccggatggg

SEQ ID NO: 233714 - DNA, 20 bp, Artificial
  CRISPR gRNA sequence
agcaggggccggatgggggg

SEQ ID NO: 233715 - DNA, 20 bp, Artificial
  CRISPR gRNA sequence
tggacagggtcctcaggaag

SEQ ID NO: 233716 - DNA, 20 bp, Artificial
  CRISPR gRNA sequence
aggaagcgtgggcactggag

SEQ ID NO: 233717 - DNA, 20 bp, Artificial
  CRISPR gRNA sequence
gaggacaggttggcctcccc

SEQ ID NO: 233718 - DNA, 20 bp, Artificial
  CRISPR gRNA sequence
gcctccccaccacacagagg

SEQ ID NO: 233719 - DNA, 20 bp, Artificial
  CRISPR gRNA sequence
cccaccacacagagggccgt

SEQ ID NO: 233720 - DNA, 20 bp, Artificial
  CRISPR gRNA sequence
cggcctcccctgagacttgg

SEQ ID NO: 233721 - DNA, 20 bp, Artificial
  CRISPR gRNA sequence
ccctgagacttggagcccct

SEQ ID NO: 233722 - DNA, 20 bp, Artificial
  CRISPR gRNA sequence
agacttggagcccctgcagc

SEQ ID NO: 233723 - DNA, 20 bp, Artificial
  CRISPR gRNA sequence
ggagcccctgcagcccccga

SEQ ID NO: 233724 - DNA, 20 bp, Artificial
  CRISPR gRNA sequence
gagcccctgcagcccccgag

SEQ ID NO: 233725 - DNA, 20 bp, Artificial
  CRISPR gRNA sequence
cagcccccgaggctcctggg

SEQ ID NO: 233726 - DNA, 20 bp, Artificial
  CRISPR gRNA sequence
ctgggccctcccttcctggc

SEQ ID NO: 233727 - DNA, 20 bp, Artificial
  CRISPR gRNA sequence
ggccctcccttcctggccac

SEQ ID NO: 233728 - DNA, 20 bp, Artificial
  CRISPR gRNA sequence
ccttcctggccacaacctgg

SEQ ID NO: 233729 - DNA, 20 bp, Artificial
  CRISPR gRNA sequence
cctggccacaacctggggct

SEQ ID NO: 233730 - DNA, 20 bp, Artificial
  CRISPR gRNA sequence
ctggccacaacctggggctg

SEQ ID NO: 233731 - DNA, 20 bp, Artificial
  CRISPR gRNA sequence
gccacaacctggggctggtt

SEQ ID NO: 233732 - DNA, 20 bp, Artificial
  CRISPR gRNA sequence
gggctggttccgtggcagcc

SEQ ID NO: 233733 - DNA, 20 bp, Artificial
  CRISPR gRNA sequence
gttccgtggcagccccagcc

SEQ ID NO: 233734 - DNA, 20 bp, Artificial
  CRISPR gRNA sequence
cgtggcagccccagccaccc

SEQ ID NO: 233735 - DNA, 20 bp, Artificial
  CRISPR gRNA sequence
ccctacccctccaccgcctc

SEQ ID NO: 233736 - DNA, 20 bp, Artificial
  CRISPR gRNA sequence
cctacccctccaccgcctcc

SEQ ID NO: 233737 - DNA, 20 bp, Artificial
  CRISPR gRNA sequence
cccctccaccgcctccagcc

SEQ ID NO: 233738 - DNA, 20 bp, Artificial
  CRISPR gRNA sequence
caccgcctccagccgccagc

SEQ ID NO: 233739 - DNA, 20 bp, Artificial
  CRISPR gRNA sequence
cagccgccagccccgcctgc

SEQ ID NO: 233740 - DNA, 20 bp, Artificial
  CRISPR gRNA sequence
cggcagggtctccatggccc

SEQ ID NO: 233741 - DNA, 20 bp, Artificial
  CRISPR gRNA sequence
catggcccaaccccccagcc

SEQ ID NO: 233742 - DNA, 20 bp, Artificial
  CRISPR gRNA sequence
actgctcaggccagcaaggc

SEQ ID NO: 233743 - DNA, 20 bp, Artificial
  CRISPR gRNA sequence
ctcaggccagcaaggccagg

SEQ ID NO: 233744 - DNA, 20 bp, Artificial
  CRISPR gRNA sequence
aggccagcaaggccaggcca

SEQ ID NO: 233745 - DNA, 20 bp, Artificial
  CRISPR gRNA sequence
cccgactccacgtggcctgg

SEQ ID NO: 233746 - DNA, 20 bp, Artificial
  CRISPR gRNA sequence
cacgtggcctgggccgagtc

SEQ ID NO: 233747 - DNA, 20 bp, Artificial
  CRISPR gRNA sequence
ggccgagtctgggcccccgg

SEQ ID NO: 233748 - DNA, 20 bp, Artificial
  CRISPR gRNA sequence
ggcccccggagggagagggg

SEQ ID NO: 233749 - DNA, 20 bp, Artificial
  CRISPR gRNA sequence
ggagacgcctcagctcctcg

SEQ ID NO: 233750 - DNA, 20 bp, Artificial
  CRISPR gRNA sequence
agctcctcgaaggacccctg

SEQ ID NO: 233751 - DNA, 20 bp, Artificial
  CRISPR gRNA sequence
ctcgaaggacccctgtggcg

SEQ ID NO: 233752 - DNA, 20 bp, Artificial
  CRISPR gRNA sequence
gaaggacccctgtggcggag

SEQ ID NO: 233753 - DNA, 20 bp, Artificial
  CRISPR gRNA sequence
tggcggagcagaccccgctg

SEQ ID NO: 233754 - DNA, 20 bp, Artificial
  CRISPR gRNA sequence
tggtttgaggttcgtttctg

SEQ ID NO: 233755 - DNA, 20 bp, Artificial
  CRISPR gRNA sequence
gaggttcgtttctgcggctg

SEQ ID NO: 233756 - DNA, 20 bp, Artificial
  CRISPR gRNA sequence
aggttcgtttctgcggctgt

SEQ ID NO: 233757 - DNA, 20 bp, Artificial
  CRISPR gRNA sequence
gtttctgcggctgtgggagc

SEQ ID NO: 233758 - DNA, 20 bp, Artificial
  CRISPR gRNA sequence
ctgcggctgtgggagcccca

SEQ ID NO: 233759 - DNA, 20 bp, Artificial
  CRISPR gRNA sequence
tgcggctgtgggagccccat

SEQ ID NO: 233760 - DNA, 20 bp, Artificial
  CRISPR gRNA sequence
cggctgtgggagccccatgc

SEQ ID NO: 233761 - DNA, 20 bp, Artificial
  CRISPR gRNA sequence
tgggagccccatgctgctgc

SEQ ID NO: 233762 - DNA, 20 bp, Artificial
  CRISPR gRNA sequence
ctgcgtgggaatgtgggtgc

SEQ ID NO: 233763 - DNA, 20 bp, Artificial
  CRISPR gRNA sequence
cgtgggaatgtgggtgccag

SEQ ID NO: 233764 - DNA, 20 bp, Artificial
  CRISPR gRNA sequence
ccgccccctgtgctgggtgg

SEQ ID NO: 233765 - DNA, 20 bp, Artificial
  CRISPR gRNA sequence
tgctgggtggggctgtgggg

SEQ ID NO: 233766 - DNA, 20 bp, Artificial
  CRISPR gRNA sequence
ggtggggctgtggggccagg

SEQ ID NO: 233767 - DNA, 20 bp, Artificial
  CRISPR gRNA sequence
tggggccaggtgggagctca

SEQ ID NO: 233768 - DNA, 20 bp, Artificial
  CRISPR gRNA sequence
actgaggttacaccacgtgc

SEQ ID NO: 233769 - DNA, 20 bp, Artificial
  CRISPR gRNA sequence
aggttacaccacgtgcaggg

SEQ ID NO: 233770 - DNA, 20 bp, Artificial
  CRISPR gRNA sequence
caccacgtgcagggcttgca

SEQ ID NO: 233771 - DNA, 20 bp, Artificial
  CRISPR gRNA sequence
gcacggcttggagctgacca

SEQ ID NO: 233772 - DNA, 20 bp, Artificial
  CRISPR gRNA sequence
cacggcttggagctgaccac

SEQ ID NO: 233773 - DNA, 20 bp, Artificial
  CRISPR gRNA sequence
ggagctgaccacgtcgttgt

SEQ ID NO: 233774 - DNA, 20 bp, Artificial
  CRISPR gRNA sequence
gagctgaccacgtcgttgta

SEQ ID NO: 233775 - DNA, 20 bp, Artificial
  CRISPR gRNA sequence
accacgtcgttgtagaagcc

SEQ ID NO: 233776 - DNA, 20 bp, Artificial
  CRISPR gRNA sequence
tagaagcccggcccgcacgg

SEQ ID NO: 233777 - DNA, 20 bp, Artificial
  CRISPR gRNA sequence
tgggagcggctgcagcggct

SEQ ID NO: 233778 - DNA, 20 bp, Artificial
  CRISPR gRNA sequence
ggagcggctgcagcggctca

SEQ ID NO: 233779 - DNA, 20 bp, Artificial
  CRISPR gRNA sequence
cagcggctcaccatcccgtt

SEQ ID NO: 233780 - DNA, 20 bp, Artificial
  CRISPR gRNA sequence
accatcccgttgcctgcagc

SEQ ID NO: 233781 - DNA, 20 bp, Artificial
  CRISPR gRNA sequence
cctgcagcagaggccggcgt

SEQ ID NO: 233782 - DNA, 20 bp, Artificial
  CRISPR gRNA sequence
cagcagaggccggcgtcagg

SEQ ID NO: 233783 - DNA, 20 bp, Artificial
  CRISPR gRNA sequence
gcgcccgtggacccccccag

SEQ ID NO: 233784 - DNA, 20 bp, Artificial
  CRISPR gRNA sequence
cgcccgtggacccccccagg

SEQ ID NO: 233785 - DNA, 20 bp, Artificial
  CRISPR gRNA sequence
ctctgccaggcttggccggc

SEQ ID NO: 233786 - DNA, 20 bp, Artificial
  CRISPR gRNA sequence
tgccaggcttggccggcccc

SEQ ID NO: 233787 - DNA, 20 bp, Artificial
  CRISPR gRNA sequence
ccaggcttggccggcccctc

SEQ ID NO: 233788 - DNA, 20 bp, Artificial
  CRISPR gRNA sequence
ggccggcccctcacccgccc

SEQ ID NO: 233789 - DNA, 20 bp, Artificial
  CRISPR gRNA sequence
gccggcccctcacccgcccc

SEQ ID NO: 233790 - DNA, 20 bp, Artificial
  CRISPR gRNA sequence
acccgccccctccccaggac

SEQ ID NO: 233791 - DNA, 20 bp, Artificial
  CRISPR gRNA sequence
cccaggaccagcctcctggc

SEQ ID NO: 233792 - DNA, 20 bp, Artificial
  CRISPR gRNA sequence
ctggctggcccatccctgcc

SEQ ID NO: 233793 - DNA, 20 bp, Artificial
  CRISPR gRNA sequence
gctggcccatccctgcccca

SEQ ID NO: 233794 - DNA, 20 bp, Artificial
  CRISPR gRNA sequence
gcccatccctgccccagccc

SEQ ID NO: 233795 - DNA, 20 bp, Artificial
  CRISPR gRNA sequence
ccccagcccccagtccctgg

SEQ ID NO: 233796 - DNA, 20 bp, Artificial
  CRISPR gRNA sequence
gagtgcccgtgcgtggcgac

SEQ ID NO: 233797 - DNA, 20 bp, Artificial
  CRISPR gRNA sequence
ctgaggcctcacctggcctg

SEQ ID NO: 233798 - DNA, 20 bp, Artificial
  CRISPR gRNA sequence
aggcctcacctggcctgcac

SEQ ID NO: 233799 - DNA, 20 bp, Artificial
  CRISPR gRNA sequence
acctggcctgcactcgtggc

SEQ ID NO: 233800 - DNA, 20 bp, Artificial
  CRISPR gRNA sequence
gcctgcactcgtggcagcac

SEQ ID NO: 233801 - DNA, 20 bp, Artificial
  CRISPR gRNA sequence
cactcgtggcagcaccggtc

SEQ ID NO: 233802 - DNA, 20 bp, Artificial
  CRISPR gRNA sequence
gtggcagcaccggtcgttgc

SEQ ID NO: 233803 - DNA, 20 bp, Artificial
  CRISPR gRNA sequence
ctggggtaggtgtccccgac

SEQ ID NO: 233804 - DNA, 20 bp, Artificial
  CRISPR gRNA sequence
gggtaggtgtccccgacaca

SEQ ID NO: 233805 - DNA, 20 bp, Artificial
  CRISPR gRNA sequence
agccccaggcccaggaggag

SEQ ID NO: 233806 - DNA, 20 bp, Artificial
  CRISPR gRNA sequence
gtctctgctgtcgccagagt

SEQ ID NO: 233807 - DNA, 20 bp, Artificial
  CRISPR gRNA sequence
tgctgtcgccagagtctggg

SEQ ID NO: 233808 - DNA, 20 bp, Artificial
  CRISPR gRNA sequence
ctgtcgccagagtctgggtt

SEQ ID NO: 233809 - DNA, 20 bp, Artificial
  CRISPR gRNA sequence
tcgccagagtctgggttttc

SEQ ID NO: 233810 - DNA, 20 bp, Artificial
  CRISPR gRNA sequence
ggttttccttgcggggtgtg

SEQ ID NO: 233811 - DNA, 20 bp, Artificial
  CRISPR gRNA sequence
tccttgcggggtgtggctat

SEQ ID NO: 233812 - DNA, 20 bp, Artificial
  CRISPR gRNA sequence
ccttgcggggtgtggctata

SEQ ID NO: 233813 - DNA, 20 bp, Artificial
  CRISPR gRNA sequence
cttgcggggtgtggctataa

SEQ ID NO: 233814 - DNA, 20 bp, Artificial
  CRISPR gRNA sequence
gcggggtgtggctataagga

SEQ ID NO: 233815 - DNA, 20 bp, Artificial
  CRISPR gRNA sequence
cggggtgtggctataaggac

SEQ ID NO: 233816 - DNA, 20 bp, Artificial
  CRISPR gRNA sequence
taaggactgtggaggagggg

SEQ ID NO: 233817 - DNA, 20 bp, Artificial
  CRISPR gRNA sequence
tggaggaggggaggggagag

SEQ ID NO: 233818 - DNA, 20 bp, Artificial
  CRISPR gRNA sequence
gctgtgggctgggcacaaag

SEQ ID NO: 233819 - DNA, 20 bp, Artificial
  CRISPR gRNA sequence
tgggctgggcacaaaggcgg

SEQ ID NO: 233820 - DNA, 20 bp, Artificial
  CRISPR gRNA sequence
ggcacaaaggcggggtctgg

SEQ ID NO: 233821 - DNA, 20 bp, Artificial
  CRISPR gRNA sequence
ggcacccccagcattggctt

SEQ ID NO: 233822 - DNA, 20 bp, Artificial
  CRISPR gRNA sequence
gcttattctgccttctgacc

SEQ ID NO: 233823 - DNA, 20 bp, Artificial
  CRISPR gRNA sequence
attctgccttctgacctctt

SEQ ID NO: 233824 - DNA, 20 bp, Artificial
  CRISPR gRNA sequence
ttctgccttctgacctcttc

SEQ ID NO: 233825 - DNA, 20 bp, Artificial
  CRISPR gRNA sequence
tgccttctgacctcttctgc

SEQ ID NO: 233826 - DNA, 20 bp, Artificial
  CRISPR gRNA sequence
ccttctgacctcttctgccc

SEQ ID NO: 233827 - DNA, 20 bp, Artificial
  CRISPR gRNA sequence
ctgacctcttctgcccaaga

SEQ ID NO: 233828 - DNA, 20 bp, Artificial
  CRISPR gRNA sequence
tgacctcttctgcccaagac

SEQ ID NO: 233829 - DNA, 20 bp, Artificial
  CRISPR gRNA sequence
acctcttctgcccaagacca

SEQ ID NO: 233830 - DNA, 20 bp, Artificial
  CRISPR gRNA sequence
ttctgcccaagaccaccgtg

SEQ ID NO: 233831 - DNA, 20 bp, Artificial
  CRISPR gRNA sequence
ctgcccaagaccaccgtgtt

SEQ ID NO: 233832 - DNA, 20 bp, Artificial
  CRISPR gRNA sequence
tgcccaagaccaccgtgttc

SEQ ID NO: 233833 - DNA, 20 bp, Artificial
  CRISPR gRNA sequence
cccaagaccaccgtgttcag

SEQ ID NO: 233834 - DNA, 20 bp, Artificial
  CRISPR gRNA sequence
agaccccagggcacagtagg

SEQ ID NO: 233835 - DNA, 20 bp, Artificial
  CRISPR gRNA sequence
gcctgcggctcgaccctcag

SEQ ID NO: 233836 - DNA, 20 bp, Artificial
  CRISPR gRNA sequence
cggctcgaccctcagcaaaa

SEQ ID NO: 233837 - DNA, 20 bp, Artificial
  CRISPR gRNA sequence
gaccctcagcaaaaaggtcc

SEQ ID NO: 233838 - DNA, 20 bp, Artificial
  CRISPR gRNA sequence
agcaaaaaggtccatggagc

SEQ ID NO: 233839 - DNA, 20 bp, Artificial
  CRISPR gRNA sequence
aggcagcactgagtcaggag

SEQ ID NO: 233840 - DNA, 20 bp, Artificial
  CRISPR gRNA sequence
agtcaggagaggcaactcct

SEQ ID NO: 233841 - DNA, 20 bp, Artificial
  CRISPR gRNA sequence
ctcagtctggaccttcaggg

SEQ ID NO: 233842 - DNA, 20 bp, Artificial
  CRISPR gRNA sequence
agtctggaccttcagggctg

SEQ ID NO: 233843 - DNA, 20 bp, Artificial
  CRISPR gRNA sequence
gaccttcagggctgtggcac

SEQ ID NO: 233844 - DNA, 20 bp, Artificial
  CRISPR gRNA sequence
cagggctgtggcactgctga

SEQ ID NO: 233845 - DNA, 20 bp, Artificial
  CRISPR gRNA sequence
agggctgtggcactgctgaa

SEQ ID NO: 233846 - DNA, 20 bp, Artificial
  CRISPR gRNA sequence
tggcactgctgaagcatggt

SEQ ID NO: 233847 - DNA, 20 bp, Artificial
  CRISPR gRNA sequence
ctgaagcatggtcccccttg

SEQ ID NO: 233848 - DNA, 20 bp, Artificial
  CRISPR gRNA sequence
aagcatggtcccccttgtat

SEQ ID NO: 233849 - DNA, 20 bp, Artificial
  CRISPR gRNA sequence
gtatgcccaagactagctct

SEQ ID NO: 233850 - DNA, 20 bp, Artificial
  CRISPR gRNA sequence
tatgcccaagactagctctg

SEQ ID NO: 233851 - DNA, 20 bp, Artificial
  CRISPR gRNA sequence
gctctgagcagcagtgacca

SEQ ID NO: 233852 - DNA, 20 bp, Artificial
  CRISPR gRNA sequence
tgagcagcagtgaccacagc

SEQ ID NO: 233853 - DNA, 20 bp, Artificial
  CRISPR gRNA sequence
agcagcagtgaccacagcca

SEQ ID NO: 233854 - DNA, 20 bp, Artificial
  CRISPR gRNA sequence
ccgcctgtaatcccagcact

SEQ ID NO: 233855 - DNA, 20 bp, Artificial
  CRISPR gRNA sequence
taatcccagcactttgggag

SEQ ID NO: 233856 - DNA, 20 bp, Artificial
  CRISPR gRNA sequence
tgggaggccaaggcgggtgg

SEQ ID NO: 233857 - DNA, 20 bp, Artificial
  CRISPR gRNA sequence
gggaggccaaggcgggtgga

SEQ ID NO: 233858 - DNA, 20 bp, Artificial
  CRISPR gRNA sequence
ggaggccaaggcgggtggat

SEQ ID NO: 233859 - DNA, 20 bp, Artificial
  CRISPR gRNA sequence
aggtcaggagttcaagacca

SEQ ID NO: 233860 - DNA, 20 bp, Artificial
  CRISPR gRNA sequence
aagaccagtctggctaacat

SEQ ID NO: 233861 - DNA, 20 bp, Artificial
  CRISPR gRNA sequence
gctaacatggcgaaatcccg

SEQ ID NO: 233862 - DNA, 20 bp, Artificial
  CRISPR gRNA sequence
acatggcgaaatcccgtctc

SEQ ID NO: 233863 - DNA, 20 bp, Artificial
  CRISPR gRNA sequence
tactaaaactacaaaaatta

SEQ ID NO: 233864 - DNA, 20 bp, Artificial
  CRISPR gRNA sequence
ctaaaactacaaaaattatt

SEQ ID NO: 233865 - DNA, 20 bp, Artificial
  CRISPR gRNA sequence
aaactacaaaaattattcgg

SEQ ID NO: 233866 - DNA, 20 bp, Artificial
  CRISPR gRNA sequence
caaaaattattcgggcgtgg

SEQ ID NO: 233867 - DNA, 20 bp, Artificial
  CRISPR gRNA sequence
ttcgggcgtggtggcgggcg

SEQ ID NO: 233868 - DNA, 20 bp, Artificial
  CRISPR gRNA sequence
gggcgtggtggcgggcgccg

SEQ ID NO: 233869 - DNA, 20 bp, Artificial
  CRISPR gRNA sequence
ggattaccggcgcccgccac

SEQ ID NO: 233870 - DNA, 20 bp, Artificial
  CRISPR gRNA sequence
ccggcgcccgccaccacgcc

SEQ ID NO: 233871 - DNA, 20 bp, Artificial
  CRISPR gRNA sequence
ttgtagttttagtagagacg

SEQ ID NO: 233872 - DNA, 20 bp, Artificial
  CRISPR gRNA sequence
tgtagttttagtagagacgg

SEQ ID NO: 233873 - DNA, 20 bp, Artificial
  CRISPR gRNA sequence
gtagttttagtagagacggg

SEQ ID NO: 233874 - DNA, 20 bp, Artificial
  CRISPR gRNA sequence
tagttttagtagagacggga

SEQ ID NO: 233875 - DNA, 20 bp, Artificial
  CRISPR gRNA sequence
tagtagagacgggatttcgc

SEQ ID NO: 233876 - DNA, 20 bp, Artificial
  CRISPR gRNA sequence
agtagagacgggatttcgcc

SEQ ID NO: 233877 - DNA, 20 bp, Artificial
  CRISPR gRNA sequence
gtagagacgggatttcgcca

SEQ ID NO: 233878 - DNA, 20 bp, Artificial
  CRISPR gRNA sequence
cgccatgttagccagactgg

SEQ ID NO: 233879 - DNA, 20 bp, Artificial
  CRISPR gRNA sequence
gccatgttagccagactggt

SEQ ID NO: 233880 - DNA, 20 bp, Artificial
  CRISPR gRNA sequence
gccagactggtcttgaactc

SEQ ID NO: 233881 - DNA, 20 bp, Artificial
  CRISPR gRNA sequence
gtcttgaactcctgacctca

SEQ ID NO: 233882 - DNA, 20 bp, Artificial
  CRISPR gRNA sequence
gaactcctgacctcaggtga

SEQ ID NO: 233883 - DNA, 20 bp, Artificial
  CRISPR gRNA sequence
aactcctgacctcaggtgat

SEQ ID NO: 233884 - DNA, 20 bp, Artificial
  CRISPR gRNA sequence
ctgacctcaggtgatccacc

SEQ ID NO: 233885 - DNA, 20 bp, Artificial
  CRISPR gRNA sequence
acctcaggtgatccacccgc

SEQ ID NO: 233886 - DNA, 20 bp, Artificial
  CRISPR gRNA sequence
aggtgatccacccgccttgg

SEQ ID NO: 233887 - DNA, 20 bp, Artificial
  CRISPR gRNA sequence
ggcctcccaaagtgctggga

SEQ ID NO: 233888 - DNA, 20 bp, Artificial
  CRISPR gRNA sequence
gcctcccaaagtgctgggat

SEQ ID NO: 233889 - DNA, 20 bp, Artificial
  CRISPR gRNA sequence
ccaaagtgctgggattacag

SEQ ID NO: 233890 - DNA, 20 bp, Artificial
  CRISPR gRNA sequence
ggattacaggcgggagccac

SEQ ID NO: 233891 - DNA, 20 bp, Artificial
  CRISPR gRNA sequence
caggcgggagccaccgtgcc

SEQ ID NO: 233892 - DNA, 20 bp, Artificial
  CRISPR gRNA sequence
gccatgggtgtctgtcttac

SEQ ID NO: 233893 - DNA, 20 bp, Artificial
  CRISPR gRNA sequence
tcttaccatggctgtggtca

SEQ ID NO: 233894 - DNA, 20 bp, Artificial
  CRISPR gRNA sequence
accatggctgtggtcactgc

SEQ ID NO: 233895 - DNA, 20 bp, Artificial
  CRISPR gRNA sequence
ccatggctgtggtcactgct

SEQ ID NO: 233896 - DNA, 20 bp, Artificial
  CRISPR gRNA sequence
tggtcactgctgctcagagc

SEQ ID NO: 233897 - DNA, 20 bp, Artificial
  CRISPR gRNA sequence
ctgctcagagctagtcttgg

SEQ ID NO: 233898 - DNA, 20 bp, Artificial
  CRISPR gRNA sequence
ctcagagctagtcttgggca

SEQ ID NO: 233899 - DNA, 20 bp, Artificial
  CRISPR gRNA sequence
agagctagtcttgggcatac

SEQ ID NO: 233900 - DNA, 20 bp, Artificial
  CRISPR gRNA sequence
gtcttgggcatacaaggggg

SEQ ID NO: 233901 - DNA, 20 bp, Artificial
  CRISPR gRNA sequence
gggcatacaagggggaccat

SEQ ID NO: 233902 - DNA, 20 bp, Artificial
  CRISPR gRNA sequence
ggcatacaagggggaccatg

SEQ ID NO: 233903 - DNA, 20 bp, Artificial
  CRISPR gRNA sequence
cagcagtgccacagccctga

SEQ ID NO: 233904 - DNA, 20 bp, Artificial
  CRISPR gRNA sequence
agcagtgccacagccctgaa

SEQ ID NO: 233905 - DNA, 20 bp, Artificial
  CRISPR gRNA sequence
aaggtccagactgaggagtt

SEQ ID NO: 233906 - DNA, 20 bp, Artificial
  CRISPR gRNA sequence
aggagttgcctctcctgact

SEQ ID NO: 233907 - DNA, 20 bp, Artificial
  CRISPR gRNA sequence
cctctcctgactcagtgctg

SEQ ID NO: 233908 - DNA, 20 bp, Artificial
  CRISPR gRNA sequence
tcctgactcagtgctgcctc

SEQ ID NO: 233909 - DNA, 20 bp, Artificial
  CRISPR gRNA sequence
ctgactcagtgctgcctcag

SEQ ID NO: 233910 - DNA, 20 bp, Artificial
  CRISPR gRNA sequence
actcagtgctgcctcagttt

SEQ ID NO: 233911 - DNA, 20 bp, Artificial
  CRISPR gRNA sequence
agtgctgcctcagtttaccc

SEQ ID NO: 233912 - DNA, 20 bp, Artificial
  CRISPR gRNA sequence
cctcagtttacccacgtgct

SEQ ID NO: 233913 - DNA, 20 bp, Artificial
  CRISPR gRNA sequence
agtttacccacgtgctccat

SEQ ID NO: 233914 - DNA, 20 bp, Artificial
  CRISPR gRNA sequence
acccacgtgctccatggacc

SEQ ID NO: 233915 - DNA, 20 bp, Artificial
  CRISPR gRNA sequence
cccacgtgctccatggacct

SEQ ID NO: 233916 - DNA, 20 bp, Artificial
  CRISPR gRNA sequence
catggacctttttgctgagg

SEQ ID NO: 233917 - DNA, 20 bp, Artificial
  CRISPR gRNA sequence
tttgctgagggtcgagccgc

SEQ ID NO: 233918 - DNA, 20 bp, Artificial
  CRISPR gRNA sequence
ttgctgagggtcgagccgca

SEQ ID NO: 233919 - DNA, 20 bp, Artificial
  CRISPR gRNA sequence
tgctgagggtcgagccgcag

SEQ ID NO: 233920 - DNA, 20 bp, Artificial
  CRISPR gRNA sequence
gctgagggtcgagccgcagg

SEQ ID NO: 233921 - DNA, 20 bp, Artificial
  CRISPR gRNA sequence
ctgagggtcgagccgcaggc

SEQ ID NO: 233922 - DNA, 20 bp, Artificial
  CRISPR gRNA sequence
agggtcgagccgcaggccag

SEQ ID NO: 233923 - DNA, 20 bp, Artificial
  CRISPR gRNA sequence
ctgtgccctggggtctgaac

SEQ ID NO: 233924 - DNA, 20 bp, Artificial
  CRISPR gRNA sequence
tgccctggggtctgaacacg

SEQ ID NO: 233925 - DNA, 20 bp, Artificial
  CRISPR gRNA sequence
gggtctgaacacggtggtct

SEQ ID NO: 233926 - DNA, 20 bp, Artificial
  CRISPR gRNA sequence
aacacggtggtcttgggcag

SEQ ID NO: 233927 - DNA, 20 bp, Artificial
  CRISPR gRNA sequence
gggcagaagaggtcagaagg

SEQ ID NO: 233928 - DNA, 20 bp, Artificial
  CRISPR gRNA sequence
ggcagaagaggtcagaaggc

SEQ ID NO: 233929 - DNA, 20 bp, Artificial
  CRISPR gRNA sequence
ggggtgcccagaccccgcct

SEQ ID NO: 233930 - DNA, 20 bp, Artificial
  CRISPR gRNA sequence
tgtgcccagcccacagccag

SEQ ID NO: 233931 - DNA, 20 bp, Artificial
  CRISPR gRNA sequence
gtgcccagcccacagccagg

SEQ ID NO: 233932 - DNA, 20 bp, Artificial
  CRISPR gRNA sequence
tgcccagcccacagccaggg

SEQ ID NO: 233933 - DNA, 20 bp, Artificial
  CRISPR gRNA sequence
ccaccttcctcctcccgcct

SEQ ID NO: 233934 - DNA, 20 bp, Artificial
  CRISPR gRNA sequence
cctcctcccgcctcctctgc

SEQ ID NO: 233935 - DNA, 20 bp, Artificial
  CRISPR gRNA sequence
ctcctcccgcctcctctgcc

SEQ ID NO: 233936 - DNA, 20 bp, Artificial
  CRISPR gRNA sequence
ctcccgcctcctctgccctc

SEQ ID NO: 233937 - DNA, 20 bp, Artificial
  CRISPR gRNA sequence
ccgcctcctctgccctcctc

SEQ ID NO: 233938 - DNA, 20 bp, Artificial
  CRISPR gRNA sequence
ctctgccctcctcccctctc

SEQ ID NO: 233939 - DNA, 20 bp, Artificial
  CRISPR gRNA sequence
tgccctcctcccctctcccc

SEQ ID NO: 233940 - DNA, 20 bp, Artificial
  CRISPR gRNA sequence
ccctcctcccctctcccctc

SEQ ID NO: 233941 - DNA, 20 bp, Artificial
  CRISPR gRNA sequence
ctcccctctcccctcccctc

SEQ ID NO: 233942 - DNA, 20 bp, Artificial
  CRISPR gRNA sequence
ccctctcccctcccctcctc

SEQ ID NO: 233943 - DNA, 20 bp, Artificial
  CRISPR gRNA sequence
tcccctcccctcctccacag

SEQ ID NO: 233944 - DNA, 20 bp, Artificial
  CRISPR gRNA sequence
ccctcccctcctccacagtc

SEQ ID NO: 233945 - DNA, 20 bp, Artificial
  CRISPR gRNA sequence
ccctcctccacagtccttat

SEQ ID NO: 233946 - DNA, 20 bp, Artificial
  CRISPR gRNA sequence
ctccacagtccttatagcca

SEQ ID NO: 233947 - DNA, 20 bp, Artificial
  CRISPR gRNA sequence
cacagtccttatagccacac

SEQ ID NO: 233948 - DNA, 20 bp, Artificial
  CRISPR gRNA sequence
atagccacaccccgcaagga

SEQ ID NO: 233949 - DNA, 20 bp, Artificial
  CRISPR gRNA sequence
tagccacaccccgcaaggaa

SEQ ID NO: 233950 - DNA, 20 bp, Artificial
  CRISPR gRNA sequence
tggcgacagcagagacgagg

SEQ ID NO: 233951 - DNA, 20 bp, Artificial
  CRISPR gRNA sequence
gcgacagcagagacgaggat

SEQ ID NO: 233952 - DNA, 20 bp, Artificial
  CRISPR gRNA sequence
ggcggctgggccgcgggccg

SEQ ID NO: 233953 - DNA, 20 bp, Artificial
  CRISPR gRNA sequence
ggccgcgggccgtgtgcggc

SEQ ID NO: 233954 - DNA, 20 bp, Artificial
  CRISPR gRNA sequence
tgctcctcctgggcctgggg

SEQ ID NO: 233955 - DNA, 20 bp, Artificial
  CRISPR gRNA sequence
ctcctcctgggcctggggct

SEQ ID NO: 233956 - DNA, 20 bp, Artificial
  CRISPR gRNA sequence
ctcctgggcctggggctgag

SEQ ID NO: 233957 - DNA, 20 bp, Artificial
  CRISPR gRNA sequence
ctgggcctggggctgagcac

SEQ ID NO: 233958 - DNA, 20 bp, Artificial
  CRISPR gRNA sequence
ggcctggggctgagcaccgt

SEQ ID NO: 233959 - DNA, 20 bp, Artificial
  CRISPR gRNA sequence
gggctgagcaccgtgacggg

SEQ ID NO: 233960 - DNA, 20 bp, Artificial
  CRISPR gRNA sequence
agcaccgtgacggggctcca

SEQ ID NO: 233961 - DNA, 20 bp, Artificial
  CRISPR gRNA sequence
cactgtgtcggggacaccta

SEQ ID NO: 233962 - DNA, 20 bp, Artificial
  CRISPR gRNA sequence
tgtcggggacacctacccca

SEQ ID NO: 233963 - DNA, 20 bp, Artificial
  CRISPR gRNA sequence
ccccagcaacgaccggtgct

SEQ ID NO: 233964 - DNA, 20 bp, Artificial
  CRISPR gRNA sequence
ccacgagtgcaggccaggtg

SEQ ID NO: 233965 - DNA, 20 bp, Artificial
  CRISPR gRNA sequence
aggaggggtcgccacgcacg

SEQ ID NO: 233966 - DNA, 20 bp, Artificial
  CRISPR gRNA sequence
cagggactgggggctggggc

SEQ ID NO: 233967 - DNA, 20 bp, Artificial
  CRISPR gRNA sequence
ggggctggggcagggatggg

SEQ ID NO: 233968 - DNA, 20 bp, Artificial
  CRISPR gRNA sequence
gggcagggatgggccagcca

SEQ ID NO: 233969 - DNA, 20 bp, Artificial
  CRISPR gRNA sequence
gtcctggggagggggcgggt

SEQ ID NO: 233970 - DNA, 20 bp, Artificial
  CRISPR gRNA sequence
gggagggggcgggtgagggg

SEQ ID NO: 233971 - DNA, 20 bp, Artificial
  CRISPR gRNA sequence
gcagaggagccgcctggggg

SEQ ID NO: 233972 - DNA, 20 bp, Artificial
  CRISPR gRNA sequence
ggggggtccacgggcgcaag

SEQ ID NO: 233973 - DNA, 20 bp, Artificial
  CRISPR gRNA sequence
gggcctgaccgctgcctgac

SEQ ID NO: 233974 - DNA, 20 bp, Artificial
  CRISPR gRNA sequence
accgctgcctgacgccggcc

SEQ ID NO: 233975 - DNA, 20 bp, Artificial
  CRISPR gRNA sequence
cctgacgccggcctctgctg

SEQ ID NO: 233976 - DNA, 20 bp, Artificial
  CRISPR gRNA sequence
acgccggcctctgctgcagg

SEQ ID NO: 233977 - DNA, 20 bp, Artificial
  CRISPR gRNA sequence
tgctgcaggcaacgggatgg

SEQ ID NO: 233978 - DNA, 20 bp, Artificial
  CRISPR gRNA sequence
ctgcaggcaacgggatggtg

SEQ ID NO: 233979 - DNA, 20 bp, Artificial
  CRISPR gRNA sequence
caggcaacgggatggtgagc

SEQ ID NO: 233980 - DNA, 20 bp, Artificial
  CRISPR gRNA sequence
cagccgctcccagaacacgg

SEQ ID NO: 233981 - DNA, 20 bp, Artificial
  CRISPR gRNA sequence
ccagaacacggtgtgccgtc

SEQ ID NO: 233982 - DNA, 20 bp, Artificial
  CRISPR gRNA sequence
ctacaacgacgtggtcagct

SEQ ID NO: 233983 - DNA, 20 bp, Artificial
  CRISPR gRNA sequence
tacaacgacgtggtcagctc

SEQ ID NO: 233984 - DNA, 20 bp, Artificial
  CRISPR gRNA sequence
caacgacgtggtcagctcca

SEQ ID NO: 233985 - DNA, 20 bp, Artificial
  CRISPR gRNA sequence
caagccgtgcaagccctgca

SEQ ID NO: 233986 - DNA, 20 bp, Artificial
  CRISPR gRNA sequence
cacgtggtgtaacctcagtg

SEQ ID NO: 233987 - DNA, 20 bp, Artificial
  CRISPR gRNA sequence
agtgagctcccacctggccc

SEQ ID NO: 233988 - DNA, 20 bp, Artificial
  CRISPR gRNA sequence
ccacctggccccacagcccc

SEQ ID NO: 233989 - DNA, 20 bp, Artificial
  CRISPR gRNA sequence
gccccacagccccacccagc

SEQ ID NO: 233990 - DNA, 20 bp, Artificial
  CRISPR gRNA sequence
gcacccacattcccacgcag

SEQ ID NO: 233991 - DNA, 20 bp, Artificial
  CRISPR gRNA sequence
ccacgcagcagcatggggct

SEQ ID NO: 233992 - DNA, 20 bp, Artificial
  CRISPR gRNA sequence
ccacagccgcagaaacgaac

SEQ ID NO: 233993 - DNA, 20 bp, Artificial
  CRISPR gRNA sequence
aaaccacagcggggtctgct

SEQ ID NO: 233994 - DNA, 20 bp, Artificial
  CRISPR gRNA sequence
ctccgccacaggggtccttc

SEQ ID NO: 233995 - DNA, 20 bp, Artificial
  CRISPR gRNA sequence
cgccacaggggtccttcgag

SEQ ID NO: 233996 - DNA, 20 bp, Artificial
  CRISPR gRNA sequence
cgaggagctgaggcgtctcc

SEQ ID NO: 233997 - DNA, 20 bp, Artificial
  CRISPR gRNA sequence
gaggagctgaggcgtctccc

SEQ ID NO: 233998 - DNA, 20 bp, Artificial
  CRISPR gRNA sequence
aggcgtctcccaggggcacc

SEQ ID NO: 233999 - DNA, 20 bp, Artificial
  CRISPR gRNA sequence
ccaggggcaccccctctccc

SEQ ID NO: 234000 - DNA, 20 bp, Artificial
  CRISPR gRNA sequence
tccctccgggggcccagact

SEQ ID NO: 234001 - DNA, 20 bp, Artificial
  CRISPR gRNA sequence
cctccgggggcccagactcg

SEQ ID NO: 234002 - DNA, 20 bp, Artificial
  CRISPR gRNA sequence
cgggggcccagactcggccc

SEQ ID NO: 234003 - DNA, 20 bp, Artificial
  CRISPR gRNA sequence
ggcccaggccacgtggagtc

SEQ ID NO: 234004 - DNA, 20 bp, Artificial
  CRISPR gRNA sequence
gccatgtggcctggccttgc

SEQ ID NO: 234005 - DNA, 20 bp, Artificial
  CRISPR gRNA sequence
gccttgctggcctgagcagt

SEQ ID NO: 234006 - DNA, 20 bp, Artificial
  CRISPR gRNA sequence
gctggcctgagcagtgaggc

SEQ ID NO: 234007 - DNA, 20 bp, Artificial
  CRISPR gRNA sequence
ctggcctgagcagtgaggct

SEQ ID NO: 234008 - DNA, 20 bp, Artificial
  CRISPR gRNA sequence
gcctgagcagtgaggctggg

SEQ ID NO: 234009 - DNA, 20 bp, Artificial
  CRISPR gRNA sequence
agcagtgaggctggggggtt

SEQ ID NO: 234010 - DNA, 20 bp, Artificial
  CRISPR gRNA sequence
gggggttgggccatggagac

SEQ ID NO: 234011 - DNA, 20 bp, Artificial
  CRISPR gRNA sequence
ggccatggagaccctgccgc

SEQ ID NO: 234012 - DNA, 20 bp, Artificial
  CRISPR gRNA sequence
ccgcaggcggggctggcggc

SEQ ID NO: 234013 - DNA, 20 bp, Artificial
  CRISPR gRNA sequence
gcggctggaggcggtggagg

SEQ ID NO: 234014 - DNA, 20 bp, Artificial
  CRISPR gRNA sequence
gaggcggtggaggggtaggg

SEQ ID NO: 234015 - DNA, 20 bp, Artificial
  CRISPR gRNA sequence
gggctgccacggaaccagcc

SEQ ID NO: 234016 - DNA, 20 bp, Artificial
  CRISPR gRNA sequence
ccacggaaccagccccaggt

SEQ ID NO: 234017 - DNA, 20 bp, Artificial
  CRISPR gRNA sequence
tggccaggaagggagggccc

SEQ ID NO: 234018 - DNA, 20 bp, Artificial
  CRISPR gRNA sequence
gggggctgcaggggctccaa

SEQ ID NO: 234019 - DNA, 20 bp, Artificial
  CRISPR gRNA sequence
caggggctccaagtctcagg

SEQ ID NO: 234020 - DNA, 20 bp, Artificial
  CRISPR gRNA sequence
caagtctcaggggaggccgc

SEQ ID NO: 234021 - DNA, 20 bp, Artificial
  CRISPR gRNA sequence
aggggaggccgcagacccct

SEQ ID NO: 234022 - DNA, 20 bp, Artificial
  CRISPR gRNA sequence
cccacggccctctgtgtggt

SEQ ID NO: 234023 - DNA, 20 bp, Artificial
  CRISPR gRNA sequence
tgtgtggtggggaggccaac

SEQ ID NO: 234024 - DNA, 20 bp, Artificial
  CRISPR gRNA sequence
tgtggtggggaggccaacct

SEQ ID NO: 234025 - DNA, 20 bp, Artificial
  CRISPR gRNA sequence
tcctccagtgcccacgcttc

SEQ ID NO: 234026 - DNA, 20 bp, Artificial
  CRISPR gRNA sequence
cagtgcccacgcttcctgag

SEQ ID NO: 234027 - DNA, 20 bp, Artificial
  CRISPR gRNA sequence
cctgaggaccctgtccacag

SEQ ID NO: 234028 - DNA, 20 bp, Artificial
  CRISPR gRNA sequence
ctgaggaccctgtccacagc

SEQ ID NO: 234029 - DNA, 20 bp, Artificial
  CRISPR gRNA sequence
aggaccctgtccacagcccc

SEQ ID NO: 234030 - DNA, 20 bp, Artificial
  CRISPR gRNA sequence
tccacagcccccacctgacc

SEQ ID NO: 234031 - DNA, 20 bp, Artificial
  CRISPR gRNA sequence
accacccccccatccggccc

SEQ ID NO: 234032 - DNA, 20 bp, Artificial
  CRISPR gRNA sequence
ctcaggaagtgggagtgagc

SEQ ID NO: 234033 - DNA, 20 bp, Artificial
  CRISPR gRNA sequence
aggaagtgggagtgagcgga

SEQ ID NO: 234034 - DNA, 20 bp, Artificial
  CRISPR gRNA sequence
tgcacggccacacaggacac

SEQ ID NO: 234035 - DNA, 20 bp, Artificial
  CRISPR gRNA sequence
ccgctgccgggcgggcaccc

SEQ ID NO: 234036 - DNA, 20 bp, Artificial
  CRISPR gRNA sequence
ccgggcgggcacccagcccc

SEQ ID NO: 234037 - DNA, 20 bp, Artificial
  CRISPR gRNA sequence
gacagctacaagcctggagt

SEQ ID NO: 234038 - DNA, 20 bp, Artificial
  CRISPR gRNA sequence
caagcctggagttggtgagc

SEQ ID NO: 234039 - DNA, 20 bp, Artificial
  CRISPR gRNA sequence
gagttggtgagctcggtggc

SEQ ID NO: 234040 - DNA, 20 bp, Artificial
  CRISPR gRNA sequence
gtgagctcggtggctgcggc

SEQ ID NO: 234041 - DNA, 20 bp, Artificial
  CRISPR gRNA sequence
ggtggctgcggccggcggtt

SEQ ID NO: 234042 - DNA, 20 bp, Artificial
  CRISPR gRNA sequence
cggccggcggttgggggtgt

SEQ ID NO: 234043 - DNA, 20 bp, Artificial
  CRISPR gRNA sequence
ggggtgtgcatagcggctgt

SEQ ID NO: 234044 - DNA, 20 bp, Artificial
  CRISPR gRNA sequence
tctgtgacgcagatgggccg

SEQ ID NO: 234045 - DNA, 20 bp, Artificial
  CRISPR gRNA sequence
tgacgcagatgggccgtggg

SEQ ID NO: 234046 - DNA, 20 bp, Artificial
  CRISPR gRNA sequence
gccccaccggtgcctcctct

SEQ ID NO: 234047 - DNA, 20 bp, Artificial
  CRISPR gRNA sequence
ctctggcatcctcaagaccg

SEQ ID NO: 234048 - DNA, 20 bp, Artificial
  CRISPR gRNA sequence
tggcatcctcaagaccgagc

SEQ ID NO: 234049 - DNA, 20 bp, Artificial
  CRISPR gRNA sequence
gcatcctcaagaccgagctc

SEQ ID NO: 234050 - DNA, 20 bp, Artificial
  CRISPR gRNA sequence
aagaccgagctcccgggtca

SEQ ID NO: 234051 - DNA, 20 bp, Artificial
  CRISPR gRNA sequence
ccgggtcagggcccacgggt

SEQ ID NO: 234052 - DNA, 20 bp, Artificial
  CRISPR gRNA sequence
ccagaggccaaacccaccac

SEQ ID NO: 234053 - DNA, 20 bp, Artificial
  CRISPR gRNA sequence
cagaggccaaacccaccacc

SEQ ID NO: 234054 - DNA, 20 bp, Artificial
  CRISPR gRNA sequence
ccccacaggctctgccccat

SEQ ID NO: 234055 - DNA, 20 bp, Artificial
  CRISPR gRNA sequence
tgccccatgtccccagcacc

SEQ ID NO: 234056 - DNA, 20 bp, Artificial
  CRISPR gRNA sequence
ccccatgtccccagcacccg

SEQ ID NO: 234057 - DNA, 20 bp, Artificial
  CRISPR gRNA sequence
tgggcagcccctgaccaccc

SEQ ID NO: 234058 - DNA, 20 bp, Artificial
  CRISPR gRNA sequence
accaccctatctttgttgca

SEQ ID NO: 234059 - DNA, 20 bp, Artificial
  CRISPR gRNA sequence
tctttgttgcagactgtgcc

SEQ ID NO: 234060 - DNA, 20 bp, Artificial
  CRISPR gRNA sequence
tgttgcagactgtgccccct

SEQ ID NO: 234061 - DNA, 20 bp, Artificial
  CRISPR gRNA sequence
gttgcagactgtgccccctg

SEQ ID NO: 234062 - DNA, 20 bp, Artificial
  CRISPR gRNA sequence
ttgcagactgtgccccctgc

SEQ ID NO: 234063 - DNA, 20 bp, Artificial
  CRISPR gRNA sequence
cagactgtgccccctgccct

SEQ ID NO: 234064 - DNA, 20 bp, Artificial
  CRISPR gRNA sequence
tgccccctgccctccagggc

SEQ ID NO: 234065 - DNA, 20 bp, Artificial
  CRISPR gRNA sequence
ccctccagggcacttctccc

SEQ ID NO: 234066 - DNA, 20 bp, Artificial
  CRISPR gRNA sequence
cagggcacttctccccaggc

SEQ ID NO: 234067 - DNA, 20 bp, Artificial
  CRISPR gRNA sequence
ctccccaggcgacaaccagg

SEQ ID NO: 234068 - DNA, 20 bp, Artificial
  CRISPR gRNA sequence
tccccaggcgacaaccaggc

SEQ ID NO: 234069 - DNA, 20 bp, Artificial
  CRISPR gRNA sequence
cccaggcgacaaccaggcct

SEQ ID NO: 234070 - DNA, 20 bp, Artificial
  CRISPR gRNA sequence
caagccctggaccaagtgag

SEQ ID NO: 234071 - DNA, 20 bp, Artificial
  CRISPR gRNA sequence
gaccaagtgaggggcctggc

SEQ ID NO: 234072 - DNA, 20 bp, Artificial
  CRISPR gRNA sequence
gccaggggctgggaggggct

SEQ ID NO: 234073 - DNA, 20 bp, Artificial
  CRISPR gRNA sequence
ggaggggctgggggggggtt

SEQ ID NO: 234074 - DNA, 20 bp, Artificial
  CRISPR gRNA sequence
ggggggggttggggtggtta

SEQ ID NO: 234075 - DNA, 20 bp, Artificial
  CRISPR gRNA sequence
gggtggttaggagggcggag

SEQ ID NO: 234076 - DNA, 20 bp, Artificial
  CRISPR gRNA sequence
ggagggcggaggagctgggg

SEQ ID NO: 234077 - DNA, 20 bp, Artificial
  CRISPR gRNA sequence
gggagctgggaggggctggg

SEQ ID NO: 234078 - DNA, 20 bp, Artificial
  CRISPR gRNA sequence
ggaggggctgggggggcagg

SEQ ID NO: 234079 - DNA, 20 bp, Artificial
  CRISPR gRNA sequence
ggggggcaggtggggtgggg

SEQ ID NO: 234080 - DNA, 20 bp, Artificial
  CRISPR gRNA sequence
tgggggaaggggaggtgctg

SEQ ID NO: 234081 - DNA, 20 bp, Artificial
  CRISPR gRNA sequence
gggggaaggggaggtgctgg

SEQ ID NO: 234082 - DNA, 20 bp, Artificial
  CRISPR gRNA sequence
ggggaaggggaggtgctggt

SEQ ID NO: 234083 - DNA, 20 bp, Artificial
  CRISPR gRNA sequence
gtggccctgggggcctggct

SEQ ID NO: 234084 - DNA, 20 bp, Artificial
  CRISPR gRNA sequence
ggggcctggctatgtggctg

SEQ ID NO: 234085 - DNA, 20 bp, Artificial
  CRISPR gRNA sequence
gctatgtggctggacctggt

SEQ ID NO: 234086 - DNA, 20 bp, Artificial
  CRISPR gRNA sequence
tgtggctggacctggttggg

SEQ ID NO: 234087 - DNA, 20 bp, Artificial
  CRISPR gRNA sequence
gacctggttggggagcagga

SEQ ID NO: 234088 - DNA, 20 bp, Artificial
  CRISPR gRNA sequence
gttggggagcaggaagctgc

SEQ ID NO: 234089 - DNA, 20 bp, Artificial
  CRISPR gRNA sequence
gggagcaggaagctgctgcc

SEQ ID NO: 234090 - DNA, 20 bp, Artificial
  CRISPR gRNA sequence
ctgcctgggggcagcctttc

SEQ ID NO: 234091 - DNA, 20 bp, Artificial
  CRISPR gRNA sequence
cctgggggcagcctttccct

SEQ ID NO: 234092 - DNA, 20 bp, Artificial
  CRISPR gRNA sequence
ggggcagcctttccctgtgg

SEQ ID NO: 234093 - DNA, 20 bp, Artificial
  CRISPR gRNA sequence
tccctgtgggtggagctggg

SEQ ID NO: 234094 - DNA, 20 bp, Artificial
  CRISPR gRNA sequence
ccctgtgggtggagctgggt

SEQ ID NO: 234095 - DNA, 20 bp, Artificial
  CRISPR gRNA sequence
cctgtgggtggagctgggtg

SEQ ID NO: 234096 - DNA, 20 bp, Artificial
  CRISPR gRNA sequence
tgggtggagctgggtgtgtg

SEQ ID NO: 234097 - DNA, 20 bp, Artificial
  CRISPR gRNA sequence
ggtgtgtgggaccctcaccc

SEQ ID NO: 234098 - DNA, 20 bp, Artificial
  CRISPR gRNA sequence
accctccgcagctgggaggc

SEQ ID NO: 234099 - DNA, 20 bp, Artificial
  CRISPR gRNA sequence
cgcagctgggaggccctggg

SEQ ID NO: 234100 - DNA, 20 bp, Artificial
  CRISPR gRNA sequence
ggaggccctgggggcacagg

SEQ ID NO: 234101 - DNA, 20 bp, Artificial
  CRISPR gRNA sequence
ggggcacaggacagggaggt

SEQ ID NO: 234102 - DNA, 20 bp, Artificial
  CRISPR gRNA sequence
gtggggggtgtagatgtggg

SEQ ID NO: 234103 - DNA, 20 bp, Artificial
  CRISPR gRNA sequence
ggaggcccctgtggggggca

SEQ ID NO: 234104 - DNA, 20 bp, Artificial
  CRISPR gRNA sequence
gaggcccctgtggggggcac

SEQ ID NO: 234105 - DNA, 20 bp, Artificial
  CRISPR gRNA sequence
tggggggcacgtggggctgg

SEQ ID NO: 234106 - DNA, 20 bp, Artificial
  CRISPR gRNA sequence
ggcagcgtccttggctgtca

SEQ ID NO: 234107 - DNA, 20 bp, Artificial
  CRISPR gRNA sequence
ggctgtcactggcctggtgt

SEQ ID NO: 234108 - DNA, 20 bp, Artificial
  CRISPR gRNA sequence
gctgtcactggcctggtgtc

SEQ ID NO: 234109 - DNA, 20 bp, Artificial
  CRISPR gRNA sequence
tcactggcctggtgtctgtg

SEQ ID NO: 234110 - DNA, 20 bp, Artificial
  CRISPR gRNA sequence
gcctggtgtctgtggtagat

SEQ ID NO: 234111 - DNA, 20 bp, Artificial
  CRISPR gRNA sequence
gtgtctgtggtagatgctgc

SEQ ID NO: 234112 - DNA, 20 bp, Artificial
  CRISPR gRNA sequence
tggtagatgctgcctgtggc

SEQ ID NO: 234113 - DNA, 20 bp, Artificial
  CRISPR gRNA sequence
cctgtggctggccagcgtgg

SEQ ID NO: 234114 - DNA, 20 bp, Artificial
  CRISPR gRNA sequence
tggctggccagcgtggaccc

SEQ ID NO: 234115 - DNA, 20 bp, Artificial
  CRISPR gRNA sequence
gccagcgtggaccctgttat

SEQ ID NO: 234116 - DNA, 20 bp, Artificial
  CRISPR gRNA sequence
ttatccccaccgcatctccc

SEQ ID NO: 234117 - DNA, 20 bp, Artificial
  CRISPR gRNA sequence
tccccaccgcatctcccggg

SEQ ID NO: 234118 - DNA, 20 bp, Artificial
  CRISPR gRNA sequence
ccgggtcccagggggtttct

SEQ ID NO: 234119 - DNA, 20 bp, Artificial
  CRISPR gRNA sequence
ctggcctgagcaacacctcc

SEQ ID NO: 234120 - DNA, 20 bp, Artificial
  CRISPR gRNA sequence
tggcctgagcaacacctcct

SEQ ID NO: 234121 - DNA, 20 bp, Artificial
  CRISPR gRNA sequence
gcctgagcaacacctcctgt

SEQ ID NO: 234122 - DNA, 20 bp, Artificial
  CRISPR gRNA sequence
agcaacacctcctgttcccc

SEQ ID NO: 234123 - DNA, 20 bp, Artificial
  CRISPR gRNA sequence
ctgttccccaacagctgcac

SEQ ID NO: 234124 - DNA, 20 bp, Artificial
  CRISPR gRNA sequence
ttccccaacagctgcacctt

SEQ ID NO: 234125 - DNA, 20 bp, Artificial
  CRISPR gRNA sequence
cccaacagctgcaccttggc

SEQ ID NO: 234126 - DNA, 20 bp, Artificial
  CRISPR gRNA sequence
caccttggctgggaagcaca

SEQ ID NO: 234127 - DNA, 20 bp, Artificial
  CRISPR gRNA sequence
ggctgggaagcacaccctgc

SEQ ID NO: 234128 - DNA, 20 bp, Artificial
  CRISPR gRNA sequence
gctgggaagcacaccctgca

SEQ ID NO: 234129 - DNA, 20 bp, Artificial
  CRISPR gRNA sequence
ggaagcacaccctgcagccg

SEQ ID NO: 234130 - DNA, 20 bp, Artificial
  CRISPR gRNA sequence
cagccggccagcaatagctc

SEQ ID NO: 234131 - DNA, 20 bp, Artificial
  CRISPR gRNA sequence
ggacgcaatctgtgaggaca

SEQ ID NO: 234132 - DNA, 20 bp, Artificial
  CRISPR gRNA sequence
tgaggacagggaccccccag

SEQ ID NO: 234133 - DNA, 20 bp, Artificial
  CRISPR gRNA sequence
tccagcccactgaagcctgg

SEQ ID NO: 234134 - DNA, 20 bp, Artificial
  CRISPR gRNA sequence
aagcctggcccagaacctca

SEQ ID NO: 234135 - DNA, 20 bp, Artificial
  CRISPR gRNA sequence
gcccagaacctcacagggac

SEQ ID NO: 234136 - DNA, 20 bp, Artificial
  CRISPR gRNA sequence
acagggaccctccacccggc

SEQ ID NO: 234137 - DNA, 20 bp, Artificial
  CRISPR gRNA sequence
cacccggcccgtggaggtcc

SEQ ID NO: 234138 - DNA, 20 bp, Artificial
  CRISPR gRNA sequence
gcccagcccagcggggcccc

SEQ ID NO: 234139 - DNA, 20 bp, Artificial
  CRISPR gRNA sequence
ctgtggaccccacccagcag

SEQ ID NO: 234140 - DNA, 20 bp, Artificial
  CRISPR gRNA sequence
tggaccccacccagcagacc

SEQ ID NO: 234141 - DNA, 20 bp, Artificial
  CRISPR gRNA sequence
cctgcaggccgtgcggttgc

SEQ ID NO: 234142 - DNA, 20 bp, Artificial
  CRISPR gRNA sequence
ctgcaggccgtgcggttgcc

SEQ ID NO: 234143 - DNA, 20 bp, Artificial
  CRISPR gRNA sequence
caggccgtgcggttgccgcc

SEQ ID NO: 234144 - DNA, 20 bp, Artificial
  CRISPR gRNA sequence
ccgccatcctgggcctgggc

SEQ ID NO: 234145 - DNA, 20 bp, Artificial
  CRISPR gRNA sequence
ggcctgggcctggtgctggg

SEQ ID NO: 234146 - DNA, 20 bp, Artificial
  CRISPR gRNA sequence
ggcctggtgctggggctgct

SEQ ID NO: 234147 - DNA, 20 bp, Artificial
  CRISPR gRNA sequence
gtgctggggctgctgggccc

SEQ ID NO: 234148 - DNA, 20 bp, Artificial
  CRISPR gRNA sequence
gggctgctgggccccctggc

SEQ ID NO: 234149 - DNA, 20 bp, Artificial
  CRISPR gRNA sequence
ctgggccccctggccatcct

SEQ ID NO: 234150 - DNA, 20 bp, Artificial
  CRISPR gRNA sequence
ggccccctggccatcctgct

SEQ ID NO: 234151 - DNA, 20 bp, Artificial
  CRISPR gRNA sequence
gccatcctgctggccctgta

SEQ ID NO: 234152 - DNA, 20 bp, Artificial
  CRISPR gRNA sequence
ctggccctgtacctgctccg

SEQ ID NO: 234153 - DNA, 20 bp, Artificial
  CRISPR gRNA sequence
gccctgtacctgctccggag

SEQ ID NO: 234154 - DNA, 20 bp, Artificial
  CRISPR gRNA sequence
tacctgctccggagggacca

SEQ ID NO: 234155 - DNA, 20 bp, Artificial
  CRISPR gRNA sequence
ctccggagggaccagaggct

SEQ ID NO: 234156 - DNA, 20 bp, Artificial
  CRISPR gRNA sequence
cggagggaccagaggctgcc

SEQ ID NO: 234157 - DNA, 20 bp, Artificial
  CRISPR gRNA sequence
ccccccgatgcccacaagcc

SEQ ID NO: 234158 - DNA, 20 bp, Artificial
  CRISPR gRNA sequence
gtgagtgcctcatggccctg

SEQ ID NO: 234159 - DNA, 20 bp, Artificial
  CRISPR gRNA sequence
atggccctgccgcactgctc

SEQ ID NO: 234160 - DNA, 20 bp, Artificial
  CRISPR gRNA sequence
ccgcactgctcctggcgggt

SEQ ID NO: 234161 - DNA, 20 bp, Artificial
  CRISPR gRNA sequence
ctcctggcgggtgaggccca

SEQ ID NO: 234162 - DNA, 20 bp, Artificial
  CRISPR gRNA sequence
ctggcgggtgaggcccaccc

SEQ ID NO: 234163 - DNA, 20 bp, Artificial
  CRISPR gRNA sequence
gcgggtgaggcccacccacc

SEQ ID NO: 234164 - DNA, 20 bp, Artificial
  CRISPR gRNA sequence
tccttttttcctccccaggg

SEQ ID NO: 234165 - DNA, 20 bp, Artificial
  CRISPR gRNA sequence
cttttttcctccccaggggg

SEQ ID NO: 234166 - DNA, 20 bp, Artificial
  CRISPR gRNA sequence
ttttcctccccagggggagg

SEQ ID NO: 234167 - DNA, 20 bp, Artificial
  CRISPR gRNA sequence
tttcctccccagggggaggc

SEQ ID NO: 234168 - DNA, 20 bp, Artificial
  CRISPR gRNA sequence
ttcctccccagggggaggca

SEQ ID NO: 234169 - DNA, 20 bp, Artificial
  CRISPR gRNA sequence
tcctccccagggggaggcag

SEQ ID NO: 234170 - DNA, 20 bp, Artificial
  CRISPR gRNA sequence
cctccccagggggaggcagt

SEQ ID NO: 234171 - DNA, 20 bp, Artificial
  CRISPR gRNA sequence
ctccccagggggaggcagtt

SEQ ID NO: 234172 - DNA, 20 bp, Artificial
  CRISPR gRNA sequence
cccagggggaggcagtttcc

SEQ ID NO: 234173 - DNA, 20 bp, Artificial
  CRISPR gRNA sequence
ccggacccccatccaagagg

SEQ ID NO: 234174 - DNA, 20 bp, Artificial
  CRISPR gRNA sequence
cggacccccatccaagagga

SEQ ID NO: 234175 - DNA, 20 bp, Artificial
  CRISPR gRNA sequence
caccctggccaagatctgac

SEQ ID NO: 234176 - DNA, 20 bp, Artificial
  CRISPR gRNA sequence
gccaagatctgacctgggcc

SEQ ID NO: 234177 - DNA, 20 bp, Artificial
  CRISPR gRNA sequence
acctgggcccaccaaggtgg

SEQ ID NO: 234178 - DNA, 20 bp, Artificial
  CRISPR gRNA sequence
ggcccaccaaggtggacgct

SEQ ID NO: 234179 - DNA, 20 bp, Artificial
  CRISPR gRNA sequence
ggccccgccaggctggagcc

SEQ ID NO: 234180 - DNA, 20 bp, Artificial
  CRISPR gRNA sequence
gagcccggagggtctgctgg

SEQ ID NO: 234181 - DNA, 20 bp, Artificial
  CRISPR gRNA sequence
ctgggcgagcagggcaggtg

SEQ ID NO: 234182 - DNA, 20 bp, Artificial
  CRISPR gRNA sequence
ggcgagcagggcaggtgcag

SEQ ID NO: 234183 - DNA, 20 bp, Artificial
  CRISPR gRNA sequence
ccccgccacgctcctgggcc

SEQ ID NO: 234184 - DNA, 20 bp, Artificial
  CRISPR gRNA sequence
ctgggccaactctgcaccgt

SEQ ID NO: 234185 - DNA, 20 bp, Artificial
  CRISPR gRNA sequence
ggccaactctgcaccgttct

SEQ ID NO: 234186 - DNA, 20 bp, Artificial
  CRISPR gRNA sequence
tgcaccgttctaggtgccga

SEQ ID NO: 234187 - DNA, 20 bp, Artificial
  CRISPR gRNA sequence
caccgttctaggtgccgatg

SEQ ID NO: 234188 - DNA, 20 bp, Artificial
  CRISPR gRNA sequence
taggtgccgatggctgcctc

SEQ ID NO: 234189 - DNA, 20 bp, Artificial
  CRISPR gRNA sequence
ggtgccgatggctgcctccg

SEQ ID NO: 234190 - DNA, 20 bp, Artificial
  CRISPR gRNA sequence
cctccggctctctgcttacg

SEQ ID NO: 234191 - DNA, 20 bp, Artificial
  CRISPR gRNA sequence
cggctctctgcttacgtatg

SEQ ID NO: 234192 - DNA, 20 bp, Artificial
  CRISPR gRNA sequence
tctgcttacgtatgccatgc

SEQ ID NO: 234193 - DNA, 20 bp, Artificial
  CRISPR gRNA sequence
tgcttacgtatgccatgcat

SEQ ID NO: 234194 - DNA, 20 bp, Artificial
  CRISPR gRNA sequence
cttacgtatgccatgcatac

SEQ ID NO: 234195 - DNA, 20 bp, Artificial
  CRISPR gRNA sequence
acgtatgccatgcatacctc

SEQ ID NO: 234196 - DNA, 20 bp, Artificial
  CRISPR gRNA sequence
cgtatgccatgcatacctcc

SEQ ID NO: 234197 - DNA, 20 bp, Artificial
  CRISPR gRNA sequence
ctgccccgcgggaccacaat

SEQ ID NO: 234198 - DNA, 20 bp, Artificial
  CRISPR gRNA sequence
ccccgcgggaccacaataaa

SEQ ID NO: 234199 - DNA, 20 bp, Artificial
  CRISPR gRNA sequence
ggcagacgggagtctccgac

SEQ ID NO: 234200 - DNA, 20 bp, Artificial
  CRISPR gRNA sequence
gcagacgggagtctccgacc

SEQ ID NO: 234201 - DNA, 20 bp, Artificial
  CRISPR gRNA sequence
cgaccggcactgtgggctgc

SEQ ID NO: 234202 - DNA, 20 bp, Artificial
  CRISPR gRNA sequence
tgggctgcacacctgtggca

SEQ ID NO: 234203 - DNA, 20 bp, Artificial
  CRISPR gRNA sequence
cacacctgtggcatggaggc

SEQ ID NO: 234204 - DNA, 20 bp, Artificial
  CRISPR gRNA sequence
tggcatggaggcttgggccg

SEQ ID NO: 234205 - DNA, 20 bp, Artificial
  CRISPR gRNA sequence
gggccgtgcccgcctctgac

SEQ ID NO: 234206 - DNA, 20 bp, Artificial
  CRISPR gRNA sequence
ggccgtgcccgcctctgact

SEQ ID NO: 234207 - DNA, 20 bp, Artificial
  CRISPR gRNA sequence
tgactggagaggggtcttgg

SEQ ID NO: 234208 - DNA, 20 bp, Artificial
  CRISPR gRNA sequence
actggagaggggtcttggga

SEQ ID NO: 234209 - DNA, 20 bp, Artificial
  CRISPR gRNA sequence
gagaggggtcttgggaggct

SEQ ID NO: 234210 - DNA, 20 bp, Artificial
  CRISPR gRNA sequence
gggaggcttgggccgtgccc

SEQ ID NO: 234211 - DNA, 20 bp, Artificial
  CRISPR gRNA sequence
cctgtggaggggaccacggc

SEQ ID NO: 234212 - DNA, 20 bp, Artificial
  CRISPR gRNA sequence
ctgtggaggggaccacggcc

SEQ ID NO: 234213 - DNA, 20 bp, Artificial
  CRISPR gRNA sequence
aggggaccacggccaggcat

SEQ ID NO: 234214 - DNA, 20 bp, Artificial
  CRISPR gRNA sequence
accacggccaggcatgagca

SEQ ID NO: 234215 - DNA, 20 bp, Artificial
  CRISPR gRNA sequence
ggcatgagcacggtgcccca

SEQ ID NO: 234216 - DNA, 20 bp, Artificial
  CRISPR gRNA sequence
gagcacggtgccccaaagcc

SEQ ID NO: 234217 - DNA, 20 bp, Artificial
  CRISPR gRNA sequence
ggtgccccaaagcccagccc

SEQ ID NO: 234218 - DNA, 20 bp, Artificial
  CRISPR gRNA sequence
gtgccccaaagcccagcccc

SEQ ID NO: 234219 - DNA, 20 bp, Artificial
  CRISPR gRNA sequence
ccgggtgccccgtcctcccc

SEQ ID NO: 234220 - DNA, 20 bp, Artificial
  CRISPR gRNA sequence
ccccgtcctcccccagcacc

SEQ ID NO: 234221 - DNA, 20 bp, Artificial
  CRISPR gRNA sequence
gcacccagcatgcatccact

SEQ ID NO: 234222 - DNA, 20 bp, Artificial
  CRISPR gRNA sequence
cacccagcatgcatccactc

SEQ ID NO: 234223 - DNA, 20 bp, Artificial
  CRISPR gRNA sequence
catgcatccactcaggtcac

SEQ ID NO: 234224 - DNA, 20 bp, Artificial
  CRISPR gRNA sequence
atccactcaggtcactggac

SEQ ID NO: 234225 - DNA, 20 bp, Artificial
  CRISPR gRNA sequence
cactggacaagtgtttattg

SEQ ID NO: 234226 - DNA, 20 bp, Artificial
  CRISPR gRNA sequence
actggacaagtgtttattga

SEQ ID NO: 234227 - DNA, 20 bp, Artificial
  CRISPR gRNA sequence
tgtttattgaaggtcccctg

SEQ ID NO: 234228 - DNA, 20 bp, Artificial
  CRISPR gRNA sequence
tattgaaggtcccctgcagc

SEQ ID NO: 234229 - DNA, 20 bp, Artificial
  CRISPR gRNA sequence
attgaaggtcccctgcagcc

SEQ ID NO: 234230 - DNA, 20 bp, Artificial
  CRISPR gRNA sequence
cctgcagccgggtcccgtgc

SEQ ID NO: 234231 - DNA, 20 bp, Artificial
  CRISPR gRNA sequence
ctgcagccgggtcccgtgct

SEQ ID NO: 234232 - DNA, 20 bp, Artificial
  CRISPR gRNA sequence
tgctgggcactgcacaccca

SEQ ID NO: 234233 - DNA, 20 bp, Artificial
  CRISPR gRNA sequence
gcactgcacacccacggaca

SEQ ID NO: 234234 - DNA, 20 bp, Artificial
  CRISPR gRNA sequence
cggacacagcctcccgtcct

SEQ ID NO: 234235 - DNA, 20 bp, Artificial
  CRISPR gRNA sequence
gtcctaagaccccaccccat

SEQ ID NO: 234236 - DNA, 20 bp, Artificial
  CRISPR gRNA sequence
tcctaagaccccaccccatc

SEQ ID NO: 234237 - DNA, 20 bp, Artificial
  CRISPR gRNA sequence
cctaagaccccaccccatca

SEQ ID NO: 234238 - DNA, 20 bp, Artificial
  CRISPR gRNA sequence
agaccccaccccatcagggc

SEQ ID NO: 234239 - DNA, 20 bp, Artificial
  CRISPR gRNA sequence
cccaccccatcagggccagc

SEQ ID NO: 234240 - DNA, 20 bp, Artificial
  CRISPR gRNA sequence
ccaccccatcagggccagca

SEQ ID NO: 234241 - DNA, 20 bp, Artificial
  CRISPR gRNA sequence
caccccatcagggccagcaa

SEQ ID NO: 234242 - DNA, 20 bp, Artificial
  CRISPR gRNA sequence
ccccatcagggccagcaagg

SEQ ID NO: 234243 - DNA, 20 bp, Artificial
  CRISPR gRNA sequence
cccatcagggccagcaaggg

SEQ ID NO: 234244 - DNA, 20 bp, Artificial
  CRISPR gRNA sequence
atcagggccagcaagggagg

SEQ ID NO: 234245 - DNA, 20 bp, Artificial
  CRISPR gRNA sequence
tcagggccagcaagggagga

SEQ ID NO: 234246 - DNA, 20 bp, Artificial
  CRISPR gRNA sequence
cagggccagcaagggaggaa

SEQ ID NO: 234247 - DNA, 20 bp, Artificial
  CRISPR gRNA sequence
agggccagcaagggaggaag

SEQ ID NO: 234248 - DNA, 20 bp, Artificial
  CRISPR gRNA sequence
gggccagcaagggaggaagg

SEQ ID NO: 234249 - DNA, 20 bp, Artificial
  CRISPR gRNA sequence
gtgtctctctctccctcctg

SEQ ID NO: 234250 - DNA, 20 bp, Artificial
  CRISPR gRNA sequence
tgtctctctctccctcctgc

SEQ ID NO: 234251 - DNA, 20 bp, Artificial
  CRISPR gRNA sequence
gtctctctctccctcctgca

SEQ ID NO: 234252 - DNA, 20 bp, Artificial
  CRISPR gRNA sequence
tctctccctcctgcagggcc

SEQ ID NO: 234253 - DNA, 20 bp, Artificial
  CRISPR gRNA sequence
cctcctgcagggcccagccg

SEQ ID NO: 234254 - DNA, 20 bp, Artificial
  CRISPR gRNA sequence
gccgcggccgccgaactgca

SEQ ID NO: 234255 - DNA, 20 bp, Artificial
  CRISPR gRNA sequence
ggccgccgaactgcatggtc

SEQ ID NO: 234256 - DNA, 20 bp, Artificial
  CRISPR gRNA sequence
gccgccgaactgcatggtcc

SEQ ID NO: 234257 - DNA, 20 bp, Artificial
  CRISPR gRNA sequence
ccgccgaactgcatggtcca

SEQ ID NO: 234258 - DNA, 20 bp, Artificial
  CRISPR gRNA sequence
aactgcatggtccagggcgc

SEQ ID NO: 234259 - DNA, 20 bp, Artificial
  CRISPR gRNA sequence
cctgcacccacttctgctgc

SEQ ID NO: 234260 - DNA, 20 bp, Artificial
  CRISPR gRNA sequence
ctgcacccacttctgctgcc

SEQ ID NO: 234261 - DNA, 20 bp, Artificial
  CRISPR gRNA sequence
tgcacccacttctgctgcca

SEQ ID NO: 234262 - DNA, 20 bp, Artificial
  CRISPR gRNA sequence
gcacccacttctgctgccag

SEQ ID NO: 234263 - DNA, 20 bp, Artificial
  CRISPR gRNA sequence
acccacttctgctgccaggg

SEQ ID NO: 234264 - DNA, 20 bp, Artificial
  CRISPR gRNA sequence
cacttctgctgccaggggag

SEQ ID NO: 234265 - DNA, 20 bp, Artificial
  CRISPR gRNA sequence
acttctgctgccaggggagc

SEQ ID NO: 234266 - DNA, 20 bp, Artificial
  CRISPR gRNA sequence
cttctgctgccaggggagca

SEQ ID NO: 234267 - DNA, 20 bp, Artificial
  CRISPR gRNA sequence
gctgccaggggagcagggcc

SEQ ID NO: 234268 - DNA, 20 bp, Artificial
  CRISPR gRNA sequence
caggggagcagggcccggcc

SEQ ID NO: 234269 - DNA, 20 bp, Artificial
  CRISPR gRNA sequence
ggggagcagggcccggccca

SEQ ID NO: 234270 - DNA, 20 bp, Artificial
  CRISPR gRNA sequence
gagcagggcccggcccagag

SEQ ID NO: 234271 - DNA, 20 bp, Artificial
  CRISPR gRNA sequence
gcccggcccagagcagaacg

SEQ ID NO: 234272 - DNA, 20 bp, Artificial
  CRISPR gRNA sequence
ccggcccagagcagaacgca

SEQ ID NO: 234273 - DNA, 20 bp, Artificial
  CRISPR gRNA sequence
agcagaacgcagagcccctg

SEQ ID NO: 234274 - DNA, 20 bp, Artificial
  CRISPR gRNA sequence
aacgcagagcccctgcggcc

SEQ ID NO: 234275 - DNA, 20 bp, Artificial
  CRISPR gRNA sequence
acgcagagcccctgcggcct

SEQ ID NO: 234276 - DNA, 20 bp, Artificial
  CRISPR gRNA sequence
cgcagagcccctgcggcctg

SEQ ID NO: 234277 - DNA, 20 bp, Artificial
  CRISPR gRNA sequence
cagagcccctgcggcctggg

SEQ ID NO: 234278 - DNA, 20 bp, Artificial
  CRISPR gRNA sequence
cctgcggcctggggagctcc

SEQ ID NO: 234279 - DNA, 20 bp, Artificial
  CRISPR gRNA sequence
ctgcggcctggggagctcct

SEQ ID NO: 234280 - DNA, 20 bp, Artificial
  CRISPR gRNA sequence
tgcggcctggggagctcctg

SEQ ID NO: 234281 - DNA, 20 bp, Artificial
  CRISPR gRNA sequence
cggcctggggagctcctggg

SEQ ID NO: 234282 - DNA, 20 bp, Artificial
  CRISPR gRNA sequence
ggcctggggagctcctgggg

SEQ ID NO: 234283 - DNA, 20 bp, Artificial
  CRISPR gRNA sequence
gcctggggagctcctgggga

SEQ ID NO: 234284 - DNA, 20 bp, Artificial
  CRISPR gRNA sequence
cctggggagctcctggggag

SEQ ID NO: 234285 - DNA, 20 bp, Artificial
  CRISPR gRNA sequence
gggagctcctggggaggggc

SEQ ID NO: 234286 - DNA, 20 bp, Artificial
  CRISPR gRNA sequence
tcctggggaggggctggctg

SEQ ID NO: 234287 - DNA, 20 bp, Artificial
  CRISPR gRNA sequence
ggggaggggctggctgcggt

SEQ ID NO: 234288 - DNA, 20 bp, Artificial
  CRISPR gRNA sequence
gaggggctggctgcggtcgg

SEQ ID NO: 234289 - DNA, 20 bp, Artificial
  CRISPR gRNA sequence
ctggctgcggtcggtggccc

SEQ ID NO: 234290 - DNA, 20 bp, Artificial
  CRISPR gRNA sequence
ggctgcggtcggtggccccg

SEQ ID NO: 234291 - DNA, 20 bp, Artificial
  CRISPR gRNA sequence
gctgcggtcggtggccccgg

SEQ ID NO: 234292 - DNA, 20 bp, Artificial
  CRISPR gRNA sequence
cggtcggtggccccggagga

SEQ ID NO: 234293 - DNA, 20 bp, Artificial
  CRISPR gRNA sequence
cggtggccccggaggacggc

SEQ ID NO: 234294 - DNA, 20 bp, Artificial
  CRISPR gRNA sequence
ggtggccccggaggacggcc

SEQ ID NO: 234295 - DNA, 20 bp, Artificial
  CRISPR gRNA sequence
gacggccaggctcacaccca

SEQ ID NO: 234296 - DNA, 20 bp, Artificial
  CRISPR gRNA sequence
acggccaggctcacacccac

SEQ ID NO: 234297 - DNA, 20 bp, Artificial
  CRISPR gRNA sequence
gctcacacccacaggtctcc

SEQ ID NO: 234298 - DNA, 20 bp, Artificial
  CRISPR gRNA sequence
tcgctcgccccgctcttcct

SEQ ID NO: 234299 - DNA, 20 bp, Artificial
  CRISPR gRNA sequence
cgctcgccccgctcttcctc

SEQ ID NO: 234300 - DNA, 20 bp, Artificial
  CRISPR gRNA sequence
gctcgccccgctcttcctcg

SEQ ID NO: 234301 - DNA, 20 bp, Artificial
  CRISPR gRNA sequence
cccgctcttcctcggggaac

SEQ ID NO: 234302 - DNA, 20 bp, Artificial
  CRISPR gRNA sequence
gctcttcctcggggaactgg

SEQ ID NO: 234303 - DNA, 20 bp, Artificial
  CRISPR gRNA sequence
ctcggggaactggcagcttc

SEQ ID NO: 234304 - DNA, 20 bp, Artificial
  CRISPR gRNA sequence
ctggcagcttctggcgtctt

SEQ ID NO: 234305 - DNA, 20 bp, Artificial
  CRISPR gRNA sequence
cttctggcgtcttcggtcga

SEQ ID NO: 234306 - DNA, 20 bp, Artificial
  CRISPR gRNA sequence
ctggcgtcttcggtcgacgg

SEQ ID NO: 234307 - DNA, 20 bp, Artificial
  CRISPR gRNA sequence
tcggtcgacggcggcacctc

SEQ ID NO: 234308 - DNA, 20 bp, Artificial
  CRISPR gRNA sequence
gtcgacggcggcacctccag

SEQ ID NO: 234309 - DNA, 20 bp, Artificial
  CRISPR gRNA sequence
gacggcggcacctccagcag

SEQ ID NO: 234310 - DNA, 20 bp, Artificial
  CRISPR gRNA sequence
gcggcacctccagcagcagc

SEQ ID NO: 234311 - DNA, 20 bp, Artificial
  CRISPR gRNA sequence
cggcacctccagcagcagct

SEQ ID NO: 234312 - DNA, 20 bp, Artificial
  CRISPR gRNA sequence
cagcagcagctgggtctctg

SEQ ID NO: 234313 - DNA, 20 bp, Artificial
  CRISPR gRNA sequence
agcagcagctgggtctctgc

SEQ ID NO: 234314 - DNA, 20 bp, Artificial
  CRISPR gRNA sequence
gcagcagctgggtctctgca

SEQ ID NO: 234315 - DNA, 20 bp, Artificial
  CRISPR gRNA sequence
cagcagctgggtctctgcag

SEQ ID NO: 234316 - DNA, 20 bp, Artificial
  CRISPR gRNA sequence
agcagctgggtctctgcagg

SEQ ID NO: 234317 - DNA, 20 bp, Artificial
  CRISPR gRNA sequence
gcagctgggtctctgcaggg

SEQ ID NO: 234318 - DNA, 20 bp, Artificial
  CRISPR gRNA sequence
gggtctctgcaggggggcca

SEQ ID NO: 234319 - DNA, 20 bp, Artificial
  CRISPR gRNA sequence
ctctgcaggggggccacggt

SEQ ID NO: 234320 - DNA, 20 bp, Artificial
  CRISPR gRNA sequence
tgcaggggggccacggtcag

SEQ ID NO: 234321 - DNA, 20 bp, Artificial
  CRISPR gRNA sequence
gcaggggggccacggtcagc

SEQ ID NO: 234322 - DNA, 20 bp, Artificial
  CRISPR gRNA sequence
ggggggccacggtcagcagg

SEQ ID NO: 234323 - DNA, 20 bp, Artificial
  CRISPR gRNA sequence
atgctcccacctccccgcac

SEQ ID NO: 234324 - DNA, 20 bp, Artificial
  CRISPR gRNA sequence
tgctcccacctccccgcacc

SEQ ID NO: 234325 - DNA, 20 bp, Artificial
  CRISPR gRNA sequence
ctccccgcaccaggctgtga

SEQ ID NO: 234326 - DNA, 20 bp, Artificial
  CRISPR gRNA sequence
caccaggctgtgacagacct

SEQ ID NO: 234327 - DNA, 20 bp, Artificial
  CRISPR gRNA sequence
accaggctgtgacagacctc

SEQ ID NO: 234328 - DNA, 20 bp, Artificial
  CRISPR gRNA sequence
ccaggctgtgacagacctcg

SEQ ID NO: 234329 - DNA, 20 bp, Artificial
  CRISPR gRNA sequence
ggccacatgcactgactcct

SEQ ID NO: 234330 - DNA, 20 bp, Artificial
  CRISPR gRNA sequence
tgcactgactcctcagctgc

SEQ ID NO: 234331 - DNA, 20 bp, Artificial
  CRISPR gRNA sequence
ctcctcagctgccagatgtg

SEQ ID NO: 234332 - DNA, 20 bp, Artificial
  CRISPR gRNA sequence
agctgccagatgtgcagtcc

SEQ ID NO: 234333 - DNA, 20 bp, Artificial
  CRISPR gRNA sequence
gccagatgtgcagtccaagc

SEQ ID NO: 234334 - DNA, 20 bp, Artificial
  CRISPR gRNA sequence
ccagatgtgcagtccaagct

SEQ ID NO: 234335 - DNA, 20 bp, Artificial
  CRISPR gRNA sequence
tgtgcagtccaagctgggcc

SEQ ID NO: 234336 - DNA, 20 bp, Artificial
  CRISPR gRNA sequence
gtgcagtccaagctgggccg

SEQ ID NO: 234337 - DNA, 20 bp, Artificial
  CRISPR gRNA sequence
agtccaagctgggccgaggt

SEQ ID NO: 234338 - DNA, 20 bp, Artificial
  CRISPR gRNA sequence
gtccaagctgggccgaggtc

SEQ ID NO: 234339 - DNA, 20 bp, Artificial
  CRISPR gRNA sequence
ccaagctgggccgaggtcag

SEQ ID NO: 234340 - DNA, 20 bp, Artificial
  CRISPR gRNA sequence
caagctgggccgaggtcagg

SEQ ID NO: 234341 - DNA, 20 bp, Artificial
  CRISPR gRNA sequence
agctgggccgaggtcaggag

SEQ ID NO: 234342 - DNA, 20 bp, Artificial
  CRISPR gRNA sequence
gctgggccgaggtcaggagg

SEQ ID NO: 234343 - DNA, 20 bp, Artificial
  CRISPR gRNA sequence
ccgaggtcaggaggaggacg

SEQ ID NO: 234344 - DNA, 20 bp, Artificial
  CRISPR gRNA sequence
cgaggtcaggaggaggacgc

SEQ ID NO: 234345 - DNA, 20 bp, Artificial
  CRISPR gRNA sequence
ggtcaggaggaggacgcagg

SEQ ID NO: 234346 - DNA, 20 bp, Artificial
  CRISPR gRNA sequence
gaggaggacgcaggcggcca

SEQ ID NO: 234347 - DNA, 20 bp, Artificial
  CRISPR gRNA sequence
aggacgcaggcggccacggc

SEQ ID NO: 234348 - DNA, 20 bp, Artificial
  CRISPR gRNA sequence
ggacgcaggcggccacggcc

SEQ ID NO: 234349 - DNA, 20 bp, Artificial
  CRISPR gRNA sequence
acgcaggcggccacggccag

SEQ ID NO: 234350 - DNA, 20 bp, Artificial
  CRISPR gRNA sequence
cgcaggcggccacggccagg

SEQ ID NO: 234351 - DNA, 20 bp, Artificial
  CRISPR gRNA sequence
ggccacggccaggaggacga

SEQ ID NO: 234352 - DNA, 20 bp, Artificial
  CRISPR gRNA sequence
acggccaggaggacgacggt

SEQ ID NO: 234353 - DNA, 20 bp, Artificial
  CRISPR gRNA sequence
aggacgacggtcagccaccc

SEQ ID NO: 234354 - DNA, 20 bp, Artificial
  CRISPR gRNA sequence
acgacggtcagccacccaag

SEQ ID NO: 234355 - DNA, 20 bp, Artificial
  CRISPR gRNA sequence
agccacccaagcggctctgc

SEQ ID NO: 234356 - DNA, 20 bp, Artificial
  CRISPR gRNA sequence
cacccaagcggctctgccgg

SEQ ID NO: 234357 - DNA, 20 bp, Artificial
  CRISPR gRNA sequence
acccaagcggctctgccggc

SEQ ID NO: 234358 - DNA, 20 bp, Artificial
  CRISPR gRNA sequence
cccaagcggctctgccggcg

SEQ ID NO: 234359 - DNA, 20 bp, Artificial
  CRISPR gRNA sequence
ggctctgccggcggggaccc

SEQ ID NO: 234360 - DNA, 20 bp, Artificial
  CRISPR gRNA sequence
gctctgccggcggggaccct

SEQ ID NO: 234361 - DNA, 20 bp, Artificial
  CRISPR gRNA sequence
cggggaccctgggacgcaca

SEQ ID NO: 234362 - DNA, 20 bp, Artificial
  CRISPR gRNA sequence
ctgggacgcacacagcgttg

SEQ ID NO: 234363 - DNA, 20 bp, Artificial
  CRISPR gRNA sequence
tgggacgcacacagcgttgt

SEQ ID NO: 234364 - DNA, 20 bp, Artificial
  CRISPR gRNA sequence
agcgttgtgggtcttgttcc

SEQ ID NO: 234365 - DNA, 20 bp, Artificial
  CRISPR gRNA sequence
gcgttgtgggtcttgttccc

SEQ ID NO: 234366 - DNA, 20 bp, Artificial
  CRISPR gRNA sequence
cgttgtgggtcttgttccca

SEQ ID NO: 234367 - DNA, 20 bp, Artificial
  CRISPR gRNA sequence
ggtcttgttcccagggaaca

SEQ ID NO: 234368 - DNA, 20 bp, Artificial
  CRISPR gRNA sequence
ttgttcccagggaacacagt

SEQ ID NO: 234369 - DNA, 20 bp, Artificial
  CRISPR gRNA sequence
acacagtgagaaacccgaac

SEQ ID NO: 234370 - DNA, 20 bp, Artificial
  CRISPR gRNA sequence
cacagtgagaaacccgaact

SEQ ID NO: 234371 - DNA, 20 bp, Artificial
  CRISPR gRNA sequence
tgagaaacccgaactgggtg

SEQ ID NO: 234372 - DNA, 20 bp, Artificial
  CRISPR gRNA sequence
aaacccgaactgggtgcagc

SEQ ID NO: 234373 - DNA, 20 bp, Artificial
  CRISPR gRNA sequence
ctgggtgcagctggaataca

SEQ ID NO: 234374 - DNA, 20 bp, Artificial
  CRISPR gRNA sequence
gcagctggaatacatggacg

SEQ ID NO: 234375 - DNA, 20 bp, Artificial
  CRISPR gRNA sequence
acatggacgcggcctcctat

SEQ ID NO: 234376 - DNA, 20 bp, Artificial
  CRISPR gRNA sequence
cgcggcctcctatcagcccc

SEQ ID NO: 234377 - DNA, 20 bp, Artificial
  CRISPR gRNA sequence
ctcctatcagcccccggaca

SEQ ID NO: 234378 - DNA, 20 bp, Artificial
  CRISPR gRNA sequence
ccccggacacggcctccgat

SEQ ID NO: 234379 - DNA, 20 bp, Artificial
  CRISPR gRNA sequence
cacggcctccgatcagcccc

SEQ ID NO: 234380 - DNA, 20 bp, Artificial
  CRISPR gRNA sequence
ctgctgccctccgtgctgtc

SEQ ID NO: 234381 - DNA, 20 bp, Artificial
  CRISPR gRNA sequence
tgctgccctccgtgctgtct

SEQ ID NO: 234382 - DNA, 20 bp, Artificial
  CRISPR gRNA sequence
gctgccctccgtgctgtctg

SEQ ID NO: 234383 - DNA, 20 bp, Artificial
  CRISPR gRNA sequence
ccctccgtgctgtctggggc

SEQ ID NO: 234384 - DNA, 20 bp, Artificial
  CRISPR gRNA sequence
cctccgtgctgtctggggca

SEQ ID NO: 234385 - DNA, 20 bp, Artificial
  CRISPR gRNA sequence
ctccgtgctgtctggggcaa

SEQ ID NO: 234386 - DNA, 20 bp, Artificial
  CRISPR gRNA sequence
gtgctgtctggggcaaggga

SEQ ID NO: 234387 - DNA, 20 bp, Artificial
  CRISPR gRNA sequence
tgctgtctggggcaagggac

SEQ ID NO: 234388 - DNA, 20 bp, Artificial
  CRISPR gRNA sequence
ctgtctggggcaagggacag

SEQ ID NO: 234389 - DNA, 20 bp, Artificial
  CRISPR gRNA sequence
gtctggggcaagggacagga

SEQ ID NO: 234390 - DNA, 20 bp, Artificial
  CRISPR gRNA sequence
tctggggcaagggacaggag

SEQ ID NO: 234391 - DNA, 20 bp, Artificial
  CRISPR gRNA sequence
gacaggagaggacccttcct

SEQ ID NO: 234392 - DNA, 20 bp, Artificial
  CRISPR gRNA sequence
caggagaggacccttcctca

SEQ ID NO: 234393 - DNA, 20 bp, Artificial
  CRISPR gRNA sequence
gagaggacccttcctcagag

SEQ ID NO: 234394 - DNA, 20 bp, Artificial
  CRISPR gRNA sequence
agaggacccttcctcagagt

SEQ ID NO: 234395 - DNA, 20 bp, Artificial
  CRISPR gRNA sequence
acccttcctcagagtgggcc

SEQ ID NO: 234396 - DNA, 20 bp, Artificial
  CRISPR gRNA sequence
cagagtgggcctggaccacc

SEQ ID NO: 234397 - DNA, 20 bp, Artificial
  CRISPR gRNA sequence
ggcctggaccacccggccac

SEQ ID NO: 234398 - DNA, 20 bp, Artificial
  CRISPR gRNA sequence
ctggaccacccggccaccgg

SEQ ID NO: 234399 - DNA, 20 bp, Artificial
  CRISPR gRNA sequence
tggaccacccggccaccggc

SEQ ID NO: 234400 - DNA, 20 bp, Artificial
  CRISPR gRNA sequence
ggaccacccggccaccggca

SEQ ID NO: 234401 - DNA, 20 bp, Artificial
  CRISPR gRNA sequence
ggccaccggcagggcccacc

SEQ ID NO: 234402 - DNA, 20 bp, Artificial
  CRISPR gRNA sequence
gccaccggcagggcccaccc

SEQ ID NO: 234403 - DNA, 20 bp, Artificial
  CRISPR gRNA sequence
acccaggactcactctgtcc

SEQ ID NO: 234404 - DNA, 20 bp, Artificial
  CRISPR gRNA sequence
cccaggactcactctgtcca

SEQ ID NO: 234405 - DNA, 20 bp, Artificial
  CRISPR gRNA sequence
ctcactctgtccaaggtttg

SEQ ID NO: 234406 - DNA, 20 bp, Artificial
  CRISPR gRNA sequence
actctgtccaaggtttgcag

SEQ ID NO: 234407 - DNA, 20 bp, Artificial
  CRISPR gRNA sequence
aaggtttgcagtggccttcg

SEQ ID NO: 234408 - DNA, 20 bp, Artificial
  CRISPR gRNA sequence
gcagtggccttcgtggcccc

SEQ ID NO: 234409 - DNA, 20 bp, Artificial
  CRISPR gRNA sequence
agtggccttcgtggcccccg

SEQ ID NO: 234410 - DNA, 20 bp, Artificial
  CRISPR gRNA sequence
ggccttcgtggcccccggag

SEQ ID NO: 234411 - DNA, 20 bp, Artificial
  CRISPR gRNA sequence
gccttcgtggcccccggaga

SEQ ID NO: 234412 - DNA, 20 bp, Artificial
  CRISPR gRNA sequence
ggcccccggagaaggtcccc

SEQ ID NO: 234413 - DNA, 20 bp, Artificial
  CRISPR gRNA sequence
gcccccggagaaggtccccg

SEQ ID NO: 234414 - DNA, 20 bp, Artificial
  CRISPR gRNA sequence
cggagaaggtccccgaggca

SEQ ID NO: 234415 - DNA, 20 bp, Artificial
  CRISPR gRNA sequence
ccgaggcacagtcgatacac

SEQ ID NO: 234416 - DNA, 20 bp, Artificial
  CRISPR gRNA sequence
aggcacagtcgatacactgg

SEQ ID NO: 234417 - DNA, 20 bp, Artificial
  CRISPR gRNA sequence
aagccaaaactgaatttccc

SEQ ID NO: 234418 - DNA, 20 bp, Artificial
  CRISPR gRNA sequence
aaaactgaatttccctggtg

SEQ ID NO: 234419 - DNA, 20 bp, Artificial
  CRISPR gRNA sequence
aaactgaatttccctggtgt

SEQ ID NO: 234420 - DNA, 20 bp, Artificial
  CRISPR gRNA sequence
aactgaatttccctggtgtg

SEQ ID NO: 234421 - DNA, 20 bp, Artificial
  CRISPR gRNA sequence
aatttccctggtgtggggtg

SEQ ID NO: 234422 - DNA, 20 bp, Artificial
  CRISPR gRNA sequence
atttccctggtgtggggtgt

SEQ ID NO: 234423 - DNA, 20 bp, Artificial
  CRISPR gRNA sequence
tttccctggtgtggggtgtg

SEQ ID NO: 234424 - DNA, 20 bp, Artificial
  CRISPR gRNA sequence
ttccctggtgtggggtgtgg

SEQ ID NO: 234425 - DNA, 20 bp, Artificial
  CRISPR gRNA sequence
tccctggtgtggggtgtggg

SEQ ID NO: 234426 - DNA, 20 bp, Artificial
  CRISPR gRNA sequence
cctggtgtggggtgtggggg

SEQ ID NO: 234427 - DNA, 20 bp, Artificial
  CRISPR gRNA sequence
ctggtgtggggtgtgggggg

SEQ ID NO: 234428 - DNA, 20 bp, Artificial
  CRISPR gRNA sequence
tggtgtggggtgtgggggga

SEQ ID NO: 234429 - DNA, 20 bp, Artificial
  CRISPR gRNA sequence
gtgtggggtgtggggggagg

SEQ ID NO: 234430 - DNA, 20 bp, Artificial
  CRISPR gRNA sequence
tgtggggtgtggggggaggg

SEQ ID NO: 234431 - DNA, 20 bp, Artificial
  CRISPR gRNA sequence
gtggggtgtggggggaggga

SEQ ID NO: 234432 - DNA, 20 bp, Artificial
  CRISPR gRNA sequence
ggggtgtggggggagggagg

SEQ ID NO: 234433 - DNA, 20 bp, Artificial
  CRISPR gRNA sequence
gggtgtggggggagggaggg

SEQ ID NO: 234434 - DNA, 20 bp, Artificial
  CRISPR gRNA sequence
ggtgtggggggagggaggga

SEQ ID NO: 234435 - DNA, 20 bp, Artificial
  CRISPR gRNA sequence
tgtggggggagggagggagg

SEQ ID NO: 234436 - DNA, 20 bp, Artificial
  CRISPR gRNA sequence
gtggggggagggagggaggg

SEQ ID NO: 234437 - DNA, 20 bp, Artificial
  CRISPR gRNA sequence
ggggagggagggagggaggc

SEQ ID NO: 234438 - DNA, 20 bp, Artificial
  CRISPR gRNA sequence
gagggagggagggaggctgg

SEQ ID NO: 234439 - DNA, 20 bp, Artificial
  CRISPR gRNA sequence
gggagggagggaggctggtg

SEQ ID NO: 234440 - DNA, 20 bp, Artificial
  CRISPR gRNA sequence
agggaggctggtggagttgc

SEQ ID NO: 234441 - DNA, 20 bp, Artificial
  CRISPR gRNA sequence
gggaggctggtggagttgct

SEQ ID NO: 234442 - DNA, 20 bp, Artificial
  CRISPR gRNA sequence
ggctggtggagttgctggga

SEQ ID NO: 234443 - DNA, 20 bp, Artificial
  CRISPR gRNA sequence
gtggagttgctgggatggat

SEQ ID NO: 234444 - DNA, 20 bp, Artificial
  CRISPR gRNA sequence
tggagttgctgggatggatg

SEQ ID NO: 234445 - DNA, 20 bp, Artificial
  CRISPR gRNA sequence
gagttgctgggatggatgag

SEQ ID NO: 234446 - DNA, 20 bp, Artificial
  CRISPR gRNA sequence
agttgctgggatggatgagg

SEQ ID NO: 234447 - DNA, 20 bp, Artificial
  CRISPR gRNA sequence
gttgctgggatggatgagga

SEQ ID NO: 234448 - DNA, 20 bp, Artificial
  CRISPR gRNA sequence
gggatggatgaggagggcgt

SEQ ID NO: 234449 - DNA, 20 bp, Artificial
  CRISPR gRNA sequence
ggatggatgaggagggcgtc

SEQ ID NO: 234450 - DNA, 20 bp, Artificial
  CRISPR gRNA sequence
ggatgaggagggcgtcaggc

SEQ ID NO: 234451 - DNA, 20 bp, Artificial
  CRISPR gRNA sequence
aggagggcgtcaggccagtg

SEQ ID NO: 234452 - DNA, 20 bp, Artificial
  CRISPR gRNA sequence
ggagggcgtcaggccagtgc

SEQ ID NO: 234453 - DNA, 20 bp, Artificial
  CRISPR gRNA sequence
gagggcgtcaggccagtgca

SEQ ID NO: 234454 - DNA, 20 bp, Artificial
  CRISPR gRNA sequence
agggcgtcaggccagtgcag

SEQ ID NO: 234455 - DNA, 20 bp, Artificial
  CRISPR gRNA sequence
ggccagtgcaggggtccatc

SEQ ID NO: 234456 - DNA, 20 bp, Artificial
  CRISPR gRNA sequence
gccagtgcaggggtccatct

SEQ ID NO: 234457 - DNA, 20 bp, Artificial
  CRISPR gRNA sequence
ccagtgcaggggtccatctg

SEQ ID NO: 234458 - DNA, 20 bp, Artificial
  CRISPR gRNA sequence
gcaggggtccatctggggtc

SEQ ID NO: 234459 - DNA, 20 bp, Artificial
  CRISPR gRNA sequence
caggggtccatctggggtct

SEQ ID NO: 234460 - DNA, 20 bp, Artificial
  CRISPR gRNA sequence
ccatctggggtctgggtgct

SEQ ID NO: 234461 - DNA, 20 bp, Artificial
  CRISPR gRNA sequence
tctggggtctgggtgctgag

SEQ ID NO: 234462 - DNA, 20 bp, Artificial
  CRISPR gRNA sequence
cccccccatcatccattcaa

SEQ ID NO: 234463 - DNA, 20 bp, Artificial
  CRISPR gRNA sequence
cccccatcatccattcaaca

SEQ ID NO: 234464 - DNA, 20 bp, Artificial
  CRISPR gRNA sequence
ccattcaacagagttcttca

SEQ ID NO: 234465 - DNA, 20 bp, Artificial
  CRISPR gRNA sequence
caacagagttcttcatggcc

SEQ ID NO: 234466 - DNA, 20 bp, Artificial
  CRISPR gRNA sequence
aacagagttcttcatggccc

SEQ ID NO: 234467 - DNA, 20 bp, Artificial
  CRISPR gRNA sequence
agttcttcatggcccaggac

SEQ ID NO: 234468 - DNA, 20 bp, Artificial
  CRISPR gRNA sequence
gttcttcatggcccaggact

SEQ ID NO: 234469 - DNA, 20 bp, Artificial
  CRISPR gRNA sequence
ttcttcatggcccaggactg

SEQ ID NO: 234470 - DNA, 20 bp, Artificial
  CRISPR gRNA sequence
gggcccatgtctgcccgtcc

SEQ ID NO: 234471 - DNA, 20 bp, Artificial
  CRISPR gRNA sequence
ggcccatgtctgcccgtccc

SEQ ID NO: 234472 - DNA, 20 bp, Artificial
  CRISPR gRNA sequence
ccatgtctgcccgtcccagg

SEQ ID NO: 234473 - DNA, 20 bp, Artificial
  CRISPR gRNA sequence
catgtctgcccgtcccaggt

SEQ ID NO: 234474 - DNA, 20 bp, Artificial
  CRISPR gRNA sequence
atgtctgcccgtcccaggtg

SEQ ID NO: 234475 - DNA, 20 bp, Artificial
  CRISPR gRNA sequence
cccgtcccaggtggggcgtc

SEQ ID NO: 234476 - DNA, 20 bp, Artificial
  CRISPR gRNA sequence
ccgtcccaggtggggcgtct

SEQ ID NO: 234477 - DNA, 20 bp, Artificial
  CRISPR gRNA sequence
cgtcccaggtggggcgtctg

SEQ ID NO: 234478 - DNA, 20 bp, Artificial
  CRISPR gRNA sequence
cccaggtggggcgtctgggg

SEQ ID NO: 234479 - DNA, 20 bp, Artificial
  CRISPR gRNA sequence
ccaggtggggcgtctggggt

SEQ ID NO: 234480 - DNA, 20 bp, Artificial
  CRISPR gRNA sequence
caggtggggcgtctggggtg

SEQ ID NO: 234481 - DNA, 20 bp, Artificial
  CRISPR gRNA sequence
ggggcgtctggggtggggcc

SEQ ID NO: 234482 - DNA, 20 bp, Artificial
  CRISPR gRNA sequence
cgtctggggtggggcccagt

SEQ ID NO: 234483 - DNA, 20 bp, Artificial
  CRISPR gRNA sequence
gtctggggtggggcccagtg

SEQ ID NO: 234484 - DNA, 20 bp, Artificial
  CRISPR gRNA sequence
tctggggtggggcccagtga

SEQ ID NO: 234485 - DNA, 20 bp, Artificial
  CRISPR gRNA sequence
tggggcccagtgagggcacc

SEQ ID NO: 234486 - DNA, 20 bp, Artificial
  CRISPR gRNA sequence
ggggcccagtgagggcacct

SEQ ID NO: 234487 - DNA, 20 bp, Artificial
  CRISPR gRNA sequence
gggcccagtgagggcacctg

SEQ ID NO: 234488 - DNA, 20 bp, Artificial
  CRISPR gRNA sequence
ggcccagtgagggcacctgg

SEQ ID NO: 234489 - DNA, 20 bp, Artificial
  CRISPR gRNA sequence
cccagtgagggcacctgggg

SEQ ID NO: 234490 - DNA, 20 bp, Artificial
  CRISPR gRNA sequence
ccagtgagggcacctggggg

SEQ ID NO: 234491 - DNA, 20 bp, Artificial
  CRISPR gRNA sequence
gggcacctgggggaggtgcg

SEQ ID NO: 234492 - DNA, 20 bp, Artificial
  CRISPR gRNA sequence
gcacctgggggaggtgcgca

SEQ ID NO: 234493 - DNA, 20 bp, Artificial
  CRISPR gRNA sequence
tgggggaggtgcgcagagtg

SEQ ID NO: 234494 - DNA, 20 bp, Artificial
  CRISPR gRNA sequence
gggaggtgcgcagagtgcag

SEQ ID NO: 234495 - DNA, 20 bp, Artificial
  CRISPR gRNA sequence
ggaggtgcgcagagtgcagt

SEQ ID NO: 234496 - DNA, 20 bp, Artificial
  CRISPR gRNA sequence
gcagagtgcagtgggcctgc

SEQ ID NO: 234497 - DNA, 20 bp, Artificial
  CRISPR gRNA sequence
cagagtgcagtgggcctgcc

SEQ ID NO: 234498 - DNA, 20 bp, Artificial
  CRISPR gRNA sequence
agagtgcagtgggcctgcca

SEQ ID NO: 234499 - DNA, 20 bp, Artificial
  CRISPR gRNA sequence
agtgcagtgggcctgccagg

SEQ ID NO: 234500 - DNA, 20 bp, Artificial
  CRISPR gRNA sequence
gtgcagtgggcctgccaggg

SEQ ID NO: 234501 - DNA, 20 bp, Artificial
  CRISPR gRNA sequence
tgcagtgggcctgccaggga

SEQ ID NO: 234502 - DNA, 20 bp, Artificial
  CRISPR gRNA sequence
gcagtgggcctgccagggag

SEQ ID NO: 234503 - DNA, 20 bp, Artificial
  CRISPR gRNA sequence
tgggcctgccagggagggga

SEQ ID NO: 234504 - DNA, 20 bp, Artificial
  CRISPR gRNA sequence
gggcctgccagggaggggaa

SEQ ID NO: 234505 - DNA, 20 bp, Artificial
  CRISPR gRNA sequence
gaggggaaaggcctgcccat

SEQ ID NO: 234506 - DNA, 20 bp, Artificial
  CRISPR gRNA sequence
aggggaaaggcctgcccatt

SEQ ID NO: 234507 - DNA, 20 bp, Artificial
  CRISPR gRNA sequence
ggggaaaggcctgcccattg

SEQ ID NO: 234508 - DNA, 20 bp, Artificial
  CRISPR gRNA sequence
gggaaaggcctgcccattgg

SEQ ID NO: 234509 - DNA, 20 bp, Artificial
  CRISPR gRNA sequence
aggcctgcccattgggggct

SEQ ID NO: 234510 - DNA, 20 bp, Artificial
  CRISPR gRNA sequence
ggcctgcccattgggggctg

SEQ ID NO: 234511 - DNA, 20 bp, Artificial
  CRISPR gRNA sequence
gcctgcccattgggggctga

SEQ ID NO: 234512 - DNA, 20 bp, Artificial
  CRISPR gRNA sequence
tgcccattgggggctgaggg

SEQ ID NO: 234513 - DNA, 20 bp, Artificial
  CRISPR gRNA sequence
gcccattgggggctgagggt

SEQ ID NO: 234514 - DNA, 20 bp, Artificial
  CRISPR gRNA sequence
cattgggggctgagggtggg

SEQ ID NO: 234515 - DNA, 20 bp, Artificial
  CRISPR gRNA sequence
tgggggctgagggtgggcag

SEQ ID NO: 234516 - DNA, 20 bp, Artificial
  CRISPR gRNA sequence
ggctgagggtgggcagaagc

SEQ ID NO: 234517 - DNA, 20 bp, Artificial
  CRISPR gRNA sequence
gctgagggtgggcagaagcc

SEQ ID NO: 234518 - DNA, 20 bp, Artificial
  CRISPR gRNA sequence
gagggtgggcagaagccagg

SEQ ID NO: 234519 - DNA, 20 bp, Artificial
  CRISPR gRNA sequence
agggtgggcagaagccaggc

SEQ ID NO: 234520 - DNA, 20 bp, Artificial
  CRISPR gRNA sequence
ggcagaagccaggcaggacc

SEQ ID NO: 234521 - DNA, 20 bp, Artificial
  CRISPR gRNA sequence
agaagccaggcaggacccag

SEQ ID NO: 234522 - DNA, 20 bp, Artificial
  CRISPR gRNA sequence
ccaggcaggacccagtagaa

SEQ ID NO: 234523 - DNA, 20 bp, Artificial
  CRISPR gRNA sequence
aggcaggacccagtagaaca

SEQ ID NO: 234524 - DNA, 20 bp, Artificial
  CRISPR gRNA sequence
ggcaggacccagtagaacag

SEQ ID NO: 234525 - DNA, 20 bp, Artificial
  CRISPR gRNA sequence
gcaggacccagtagaacaga

SEQ ID NO: 234526 - DNA, 20 bp, Artificial
  CRISPR gRNA sequence
ggacccagtagaacagaggg

SEQ ID NO: 234527 - DNA, 20 bp, Artificial
  CRISPR gRNA sequence
acccagtagaacagagggtg

SEQ ID NO: 234528 - DNA, 20 bp, Artificial
  CRISPR gRNA sequence
gtagaacagagggtggagaa

SEQ ID NO: 234529 - DNA, 20 bp, Artificial
  CRISPR gRNA sequence
aacagagggtggagaacagt

SEQ ID NO: 234530 - DNA, 20 bp, Artificial
  CRISPR gRNA sequence
acagagggtggagaacagtg

SEQ ID NO: 234531 - DNA, 20 bp, Artificial
  CRISPR gRNA sequence
cagagggtggagaacagtga

SEQ ID NO: 234532 - DNA, 20 bp, Artificial
  CRISPR gRNA sequence
gtggagaacagtgagggtcc

SEQ ID NO: 234533 - DNA, 20 bp, Artificial
  CRISPR gRNA sequence
ggagaacagtgagggtccca

SEQ ID NO: 234534 - DNA, 20 bp, Artificial
  CRISPR gRNA sequence
agaacagtgagggtcccaga

SEQ ID NO: 234535 - DNA, 20 bp, Artificial
  CRISPR gRNA sequence
aacagtgagggtcccagaga

SEQ ID NO: 234536 - DNA, 20 bp, Artificial
  CRISPR gRNA sequence
gtgagggtcccagagagagt

SEQ ID NO: 234537 - DNA, 20 bp, Artificial
  CRISPR gRNA sequence
tgagggtcccagagagagtg

SEQ ID NO: 234538 - DNA, 20 bp, Artificial
  CRISPR gRNA sequence
ggtcccagagagagtgaggc

SEQ ID NO: 234539 - DNA, 20 bp, Artificial
  CRISPR gRNA sequence
gtcccagagagagtgaggct

SEQ ID NO: 234540 - DNA, 20 bp, Artificial
  CRISPR gRNA sequence
gagagagtgaggctgggtcc

SEQ ID NO: 234541 - DNA, 20 bp, Artificial
  CRISPR gRNA sequence
ggctgggtcccagttgaccc

SEQ ID NO: 234542 - DNA, 20 bp, Artificial
  CRISPR gRNA sequence
ccaacctgacacaacctccc

SEQ ID NO: 234543 - DNA, 20 bp, Artificial
  CRISPR gRNA sequence
tccccagttgtaccttctcc

SEQ ID NO: 234544 - DNA, 20 bp, Artificial
  CRISPR gRNA sequence
tctcccagctctcatgtgcc

SEQ ID NO: 234545 - DNA, 20 bp, Artificial
  CRISPR gRNA sequence
cccagcctgacctctcctgt

SEQ ID NO: 234546 - DNA, 20 bp, Artificial
  CRISPR gRNA sequence
ccagcctgacctctcctgtc

SEQ ID NO: 234547 - DNA, 20 bp, Artificial
  CRISPR gRNA sequence
acctctcctgtcaggtaaac

SEQ ID NO: 234548 - DNA, 20 bp, Artificial
  CRISPR gRNA sequence
tgtcaggtaaacaagccgct

SEQ ID NO: 234549 - DNA, 20 bp, Artificial
  CRISPR gRNA sequence
tcaggtaaacaagccgctaa

SEQ ID NO: 234550 - DNA, 20 bp, Artificial
  CRISPR gRNA sequence
caggtaaacaagccgctaag

SEQ ID NO: 234551 - DNA, 20 bp, Artificial
  CRISPR gRNA sequence
acaagccgctaagaggactt

SEQ ID NO: 234552 - DNA, 20 bp, Artificial
  CRISPR gRNA sequence
aggacttgagctgctccttc

SEQ ID NO: 234553 - DNA, 20 bp, Artificial
  CRISPR gRNA sequence
ttgagctgctccttccagaa

SEQ ID NO: 234554 - DNA, 20 bp, Artificial
  CRISPR gRNA sequence
tgagctgctccttccagaac

SEQ ID NO: 234555 - DNA, 20 bp, Artificial
  CRISPR gRNA sequence
gagctgctccttccagaaca

SEQ ID NO: 234556 - DNA, 20 bp, Artificial
  CRISPR gRNA sequence
gctccttccagaacagggtg

SEQ ID NO: 234557 - DNA, 20 bp, Artificial
  CRISPR gRNA sequence
tccagaacagggtgcagccc

SEQ ID NO: 234558 - DNA, 20 bp, Artificial
  CRISPR gRNA sequence
ccagaacagggtgcagcccc

SEQ ID NO: 234559 - DNA, 20 bp, Artificial
  CRISPR gRNA sequence
cagggtgcagccccaggccc

SEQ ID NO: 234560 - DNA, 20 bp, Artificial
  CRISPR gRNA sequence
gtgcagccccaggccccaga

SEQ ID NO: 234561 - DNA, 20 bp, Artificial
  CRISPR gRNA sequence
tgcagccccaggccccagac

SEQ ID NO: 234562 - DNA, 20 bp, Artificial
  CRISPR gRNA sequence
ccaggccccagacaggactc

SEQ ID NO: 234563 - DNA, 20 bp, Artificial
  CRISPR gRNA sequence
caggccccagacaggactcc

SEQ ID NO: 234564 - DNA, 20 bp, Artificial
  CRISPR gRNA sequence
aggccccagacaggactccg

SEQ ID NO: 234565 - DNA, 20 bp, Artificial
  CRISPR gRNA sequence
ggccccagacaggactccgg

SEQ ID NO: 234566 - DNA, 20 bp, Artificial
  CRISPR gRNA sequence
gccccagacaggactccggg

SEQ ID NO: 234567 - DNA, 20 bp, Artificial
  CRISPR gRNA sequence
agacaggactccggggggca

SEQ ID NO: 234568 - DNA, 20 bp, Artificial
  CRISPR gRNA sequence
gacaggactccggggggcac

SEQ ID NO: 234569 - DNA, 20 bp, Artificial
  CRISPR gRNA sequence
acaggactccggggggcaca

SEQ ID NO: 234570 - DNA, 20 bp, Artificial
  CRISPR gRNA sequence
ggactccggggggcacaggg

SEQ ID NO: 234571 - DNA, 20 bp, Artificial
  CRISPR gRNA sequence
gactccggggggcacagggc

SEQ ID NO: 234572 - DNA, 20 bp, Artificial
  CRISPR gRNA sequence
gggcacagggcaggctcttt

SEQ ID NO: 234573 - DNA, 20 bp, Artificial
  CRISPR gRNA sequence
gggcaggctctttcagtatg

SEQ ID NO: 234574 - DNA, 20 bp, Artificial
  CRISPR gRNA sequence
aggctctttcagtatgtggt

SEQ ID NO: 234575 - DNA, 20 bp, Artificial
  CRISPR gRNA sequence
ggctctttcagtatgtggtg

SEQ ID NO: 234576 - DNA, 20 bp, Artificial
  CRISPR gRNA sequence
ctttcagtatgtggtgagga

SEQ ID NO: 234577 - DNA, 20 bp, Artificial
  CRISPR gRNA sequence
cagtatgtggtgaggacaga

SEQ ID NO: 234578 - DNA, 20 bp, Artificial
  CRISPR gRNA sequence
agtatgtggtgaggacagac

SEQ ID NO: 234579 - DNA, 20 bp, Artificial
  CRISPR gRNA sequence
tgtggtgaggacagacagga

SEQ ID NO: 234580 - DNA, 20 bp, Artificial
  CRISPR gRNA sequence
gtggtgaggacagacaggat

SEQ ID NO: 234581 - DNA, 20 bp, Artificial
  CRISPR gRNA sequence
gacagacaggatgggtgtcc

SEQ ID NO: 234582 - DNA, 20 bp, Artificial
  CRISPR gRNA sequence
acagacaggatgggtgtccc

SEQ ID NO: 234583 - DNA, 20 bp, Artificial
  CRISPR gRNA sequence
aggatgggtgtcccgggcct

SEQ ID NO: 234584 - DNA, 20 bp, Artificial
  CRISPR gRNA sequence
gatgggtgtcccgggcctga

SEQ ID NO: 234585 - DNA, 20 bp, Artificial
  CRISPR gRNA sequence
ggtgtcccgggcctgagagc

SEQ ID NO: 234586 - DNA, 20 bp, Artificial
  CRISPR gRNA sequence
tcccgggcctgagagccaga

SEQ ID NO: 234587 - DNA, 20 bp, Artificial
  CRISPR gRNA sequence
cctgagagccagacagctcc

SEQ ID NO: 234588 - DNA, 20 bp, Artificial
  CRISPR gRNA sequence
aacccgcccccacctccccg

SEQ ID NO: 234589 - DNA, 20 bp, Artificial
  CRISPR gRNA sequence
acccgcccccacctccccgc

SEQ ID NO: 234590 - DNA, 20 bp, Artificial
  CRISPR gRNA sequence
cccgcccccacctccccgca

SEQ ID NO: 234591 - DNA, 20 bp, Artificial
  CRISPR gRNA sequence
acctccccgcagggttctca

SEQ ID NO: 234592 - DNA, 20 bp, Artificial
  CRISPR gRNA sequence
ggttctcacagccctcgtgc

SEQ ID NO: 234593 - DNA, 20 bp, Artificial
  CRISPR gRNA sequence
ctcacagccctcgtgctgga

SEQ ID NO: 234594 - DNA, 20 bp, Artificial
  CRISPR gRNA sequence
cacagccctcgtgctggatg

SEQ ID NO: 234595 - DNA, 20 bp, Artificial
  CRISPR gRNA sequence
agccctcgtgctggatggag

SEQ ID NO: 234596 - DNA, 20 bp, Artificial
  CRISPR gRNA sequence
tcgtgctggatggagaagcc

SEQ ID NO: 234597 - DNA, 20 bp, Artificial
  CRISPR gRNA sequence
cgtgctggatggagaagccc

SEQ ID NO: 234598 - DNA, 20 bp, Artificial
  CRISPR gRNA sequence
tggatggagaagcccaggct

SEQ ID NO: 234599 - DNA, 20 bp, Artificial
  CRISPR gRNA sequence
tggagaagcccaggctgaga

SEQ ID NO: 234600 - DNA, 20 bp, Artificial
  CRISPR gRNA sequence
agaagcccaggctgagaaag

SEQ ID NO: 234601 - DNA, 20 bp, Artificial
  CRISPR gRNA sequence
gaagcccaggctgagaaagc

SEQ ID NO: 234602 - DNA, 20 bp, Artificial
  CRISPR gRNA sequence
aagcccaggctgagaaagca

SEQ ID NO: 234603 - DNA, 20 bp, Artificial
  CRISPR gRNA sequence
ccaggctgagaaagcaggga

SEQ ID NO: 234604 - DNA, 20 bp, Artificial
  CRISPR gRNA sequence
caggctgagaaagcagggac

SEQ ID NO: 234605 - DNA, 20 bp, Artificial
  CRISPR gRNA sequence
aagcagggacaggacacccc

SEQ ID NO: 234606 - DNA, 20 bp, Artificial
  CRISPR gRNA sequence
gcagggacaggacaccccca

SEQ ID NO: 234607 - DNA, 20 bp, Artificial
  CRISPR gRNA sequence
aggacacccccagagcttca

SEQ ID NO: 234608 - DNA, 20 bp, Artificial
  CRISPR gRNA sequence
ccccagagcttcatggcctg

SEQ ID NO: 234609 - DNA, 20 bp, Artificial
  CRISPR gRNA sequence
cttcatggcctgtggtgcct

SEQ ID NO: 234610 - DNA, 20 bp, Artificial
  CRISPR gRNA sequence
tggcctgtggtgcctgagca

SEQ ID NO: 234611 - DNA, 20 bp, Artificial
  CRISPR gRNA sequence
tgtggtgcctgagcatggcc

SEQ ID NO: 234612 - DNA, 20 bp, Artificial
  CRISPR gRNA sequence
tgagcatggcctggcctgcc

SEQ ID NO: 234613 - DNA, 20 bp, Artificial
  CRISPR gRNA sequence
gcctggcctgcccggcctca

SEQ ID NO: 234614 - DNA, 20 bp, Artificial
  CRISPR gRNA sequence
cctggcctgcccggcctcac

SEQ ID NO: 234615 - DNA, 20 bp, Artificial
  CRISPR gRNA sequence
tgcccggcctcacaggactc

SEQ ID NO: 234616 - DNA, 20 bp, Artificial
  CRISPR gRNA sequence
cacacaccacatgtcctcgc

SEQ ID NO: 234617 - DNA, 20 bp, Artificial
  CRISPR gRNA sequence
cgccggacacctgtgcccac

SEQ ID NO: 234618 - DNA, 20 bp, Artificial
  CRISPR gRNA sequence
tgtgcccacgagctctgcct

SEQ ID NO: 234619 - DNA, 20 bp, Artificial
  CRISPR gRNA sequence
gtgcccacgagctctgcctc

SEQ ID NO: 234620 - DNA, 20 bp, Artificial
  CRISPR gRNA sequence
acgagctctgcctcgggccc

SEQ ID NO: 234621 - DNA, 20 bp, Artificial
  CRISPR gRNA sequence
agctctgcctcgggccctag

SEQ ID NO: 234622 - DNA, 20 bp, Artificial
  CRISPR gRNA sequence
tcgggccctagtggaacccc

SEQ ID NO: 234623 - DNA, 20 bp, Artificial
  CRISPR gRNA sequence
agtggaacccctggcctgtg

SEQ ID NO: 234624 - DNA, 20 bp, Artificial
  CRISPR gRNA sequence
ccctggcctgtgtggactcc

SEQ ID NO: 234625 - DNA, 20 bp, Artificial
  CRISPR gRNA sequence
ctggcctgtgtggactccca

SEQ ID NO: 234626 - DNA, 20 bp, Artificial
  CRISPR gRNA sequence
tggcctgtgtggactcccag

SEQ ID NO: 234627 - DNA, 20 bp, Artificial
  CRISPR gRNA sequence
tggactcccagaggcacctc

SEQ ID NO: 234628 - DNA, 20 bp, Artificial
  CRISPR gRNA sequence
ggactcccagaggcacctcc

SEQ ID NO: 234629 - DNA, 20 bp, Artificial
  CRISPR gRNA sequence
ggcacctccaggacttaccc

SEQ ID NO: 234630 - DNA, 20 bp, Artificial
  CRISPR gRNA sequence
gcacctccaggacttaccct

SEQ ID NO: 234631 - DNA, 20 bp, Artificial
  CRISPR gRNA sequence
taccctgggactgtaccccc

SEQ ID NO: 234632 - DNA, 20 bp, Artificial
  CRISPR gRNA sequence
tgggactgtaccccctggcc

SEQ ID NO: 234633 - DNA, 20 bp, Artificial
  CRISPR gRNA sequence
gggactgtaccccctggcct

SEQ ID NO: 234634 - DNA, 20 bp, Artificial
  CRISPR gRNA sequence
ggactgtaccccctggcctg

SEQ ID NO: 234635 - DNA, 20 bp, Artificial
  CRISPR gRNA sequence
gactgtaccccctggcctgg

SEQ ID NO: 234636 - DNA, 20 bp, Artificial
  CRISPR gRNA sequence
taccccctggcctgggggac

SEQ ID NO: 234637 - DNA, 20 bp, Artificial
  CRISPR gRNA sequence
accccctggcctgggggaca

SEQ ID NO: 234638 - DNA, 20 bp, Artificial
  CRISPR gRNA sequence
ccccctggcctgggggacaa

SEQ ID NO: 234639 - DNA, 20 bp, Artificial
  CRISPR gRNA sequence
cctggcctgggggacaaggg

SEQ ID NO: 234640 - DNA, 20 bp, Artificial
  CRISPR gRNA sequence
ctgggggacaagggtggtgc

SEQ ID NO: 234641 - DNA, 20 bp, Artificial
  CRISPR gRNA sequence
ggggacaagggtggtgccgg

SEQ ID NO: 234642 - DNA, 20 bp, Artificial
  CRISPR gRNA sequence
gggacaagggtggtgccggc

SEQ ID NO: 234643 - DNA, 20 bp, Artificial
  CRISPR gRNA sequence
ggtggtgccggcaggtcgtg

SEQ ID NO: 234644 - DNA, 20 bp, Artificial
  CRISPR gRNA sequence
gtgccggcaggtcgtgcagc

SEQ ID NO: 234645 - DNA, 20 bp, Artificial
  CRISPR gRNA sequence
tgccggcaggtcgtgcagca

SEQ ID NO: 234646 - DNA, 20 bp, Artificial
  CRISPR gRNA sequence
gccggcaggtcgtgcagcaa

SEQ ID NO: 234647 - DNA, 20 bp, Artificial
  CRISPR gRNA sequence
tcgtgcagcaagggtctccg

SEQ ID NO: 234648 - DNA, 20 bp, Artificial
  CRISPR gRNA sequence
tgcagcaagggtctccgcag

SEQ ID NO: 234649 - DNA, 20 bp, Artificial
  CRISPR gRNA sequence
agggtctccgcagtggaatt

SEQ ID NO: 234650 - DNA, 20 bp, Artificial
  CRISPR gRNA sequence
gggtctccgcagtggaattc

SEQ ID NO: 234651 - DNA, 20 bp, Artificial
  CRISPR gRNA sequence
ctccgcagtggaattcaggc

SEQ ID NO: 234652 - DNA, 20 bp, Artificial
  CRISPR gRNA sequence
attcaggctggacacacatg

SEQ ID NO: 234653 - DNA, 20 bp, Artificial
  CRISPR gRNA sequence
gacacacatgcagtcccact

SEQ ID NO: 234654 - DNA, 20 bp, Artificial
  CRISPR gRNA sequence
acatgcagtcccactcggaa

SEQ ID NO: 234655 - DNA, 20 bp, Artificial
  CRISPR gRNA sequence
tcggaacagcactcctcgcc

SEQ ID NO: 234656 - DNA, 20 bp, Artificial
  CRISPR gRNA sequence
cggaacagcactcctcgcct

SEQ ID NO: 234657 - DNA, 20 bp, Artificial
  CRISPR gRNA sequence
aacagcactcctcgcctggg

SEQ ID NO: 234658 - DNA, 20 bp, Artificial
  CRISPR gRNA sequence
acagcactcctcgcctgggc

SEQ ID NO: 234659 - DNA, 20 bp, Artificial
  CRISPR gRNA sequence
agcactcctcgcctgggcag

SEQ ID NO: 234660 - DNA, 20 bp, Artificial
  CRISPR gRNA sequence
ctcctcgcctgggcaggaga

SEQ ID NO: 234661 - DNA, 20 bp, Artificial
  CRISPR gRNA sequence
tcctcgcctgggcaggagac

SEQ ID NO: 234662 - DNA, 20 bp, Artificial
  CRISPR gRNA sequence
cgcctgggcaggagacaggc

SEQ ID NO: 234663 - DNA, 20 bp, Artificial
  CRISPR gRNA sequence
caggagacaggccagccccc

SEQ ID NO: 234664 - DNA, 20 bp, Artificial
  CRISPR gRNA sequence
gagacaggccagccccccag

SEQ ID NO: 234665 - DNA, 20 bp, Artificial
  CRISPR gRNA sequence
caggccagccccccagcagc

SEQ ID NO: 234666 - DNA, 20 bp, Artificial
  CRISPR gRNA sequence
aggccagccccccagcagct

SEQ ID NO: 234667 - DNA, 20 bp, Artificial
  CRISPR gRNA sequence
agccccccagcagctgggct

SEQ ID NO: 234668 - DNA, 20 bp, Artificial
  CRISPR gRNA sequence
gccccccagcagctgggctg

SEQ ID NO: 234669 - DNA, 20 bp, Artificial
  CRISPR gRNA sequence
ggctgaggccccctcctccc

SEQ ID NO: 234670 - DNA, 20 bp, Artificial
  CRISPR gRNA sequence
gctgaggccccctcctcccc

SEQ ID NO: 234671 - DNA, 20 bp, Artificial
  CRISPR gRNA sequence
ctcctccccaggcctcccct

SEQ ID NO: 234672 - DNA, 20 bp, Artificial
  CRISPR gRNA sequence
caggcctcccctcggccctc

SEQ ID NO: 234673 - DNA, 20 bp, Artificial
  CRISPR gRNA sequence
aggcctcccctcggccctcc

SEQ ID NO: 234674 - DNA, 20 bp, Artificial
  CRISPR gRNA sequence
ggcctcccctcggccctcca

SEQ ID NO: 234675 - DNA, 20 bp, Artificial
  CRISPR gRNA sequence
gcctcccctcggccctccag

SEQ ID NO: 234676 - DNA, 20 bp, Artificial
  CRISPR gRNA sequence
ctcccctcggccctccaggg

SEQ ID NO: 234677 - DNA, 20 bp, Artificial
  CRISPR gRNA sequence
cctcggccctccaggggagt

SEQ ID NO: 234678 - DNA, 20 bp, Artificial
  CRISPR gRNA sequence
ctcggccctccaggggagtg

SEQ ID NO: 234679 - DNA, 20 bp, Artificial
  CRISPR gRNA sequence
ggttgtccgttctccaccca

SEQ ID NO: 234680 - DNA, 20 bp, Artificial
  CRISPR gRNA sequence
gtccgttctccacccacagt

SEQ ID NO: 234681 - DNA, 20 bp, Artificial
  CRISPR gRNA sequence
tctccacccacagttggctc

SEQ ID NO: 234682 - DNA, 20 bp, Artificial
  CRISPR gRNA sequence
ctccacccacagttggctcc

SEQ ID NO: 234683 - DNA, 20 bp, Artificial
  CRISPR gRNA sequence
tccacccacagttggctcca

SEQ ID NO: 234684 - DNA, 20 bp, Artificial
  CRISPR gRNA sequence
cacccacagttggctccagg

SEQ ID NO: 234685 - DNA, 20 bp, Artificial
  CRISPR gRNA sequence
ccacagttggctccagggag

SEQ ID NO: 234686 - DNA, 20 bp, Artificial
  CRISPR gRNA sequence
acagttggctccagggagca

SEQ ID NO: 234687 - DNA, 20 bp, Artificial
  CRISPR gRNA sequence
cagttggctccagggagcag

SEQ ID NO: 234688 - DNA, 20 bp, Artificial
  CRISPR gRNA sequence
agttggctccagggagcaga

SEQ ID NO: 234689 - DNA, 20 bp, Artificial
  CRISPR gRNA sequence
tccagggagcagagggctcc

SEQ ID NO: 234690 - DNA, 20 bp, Artificial
  CRISPR gRNA sequence
gggagcagagggctcctggc

SEQ ID NO: 234691 - DNA, 20 bp, Artificial
  CRISPR gRNA sequence
ggagcagagggctcctggct

SEQ ID NO: 234692 - DNA, 20 bp, Artificial
  CRISPR gRNA sequence
agcagagggctcctggctgg

SEQ ID NO: 234693 - DNA, 20 bp, Artificial
  CRISPR gRNA sequence
agggctcctggctgggagtc

SEQ ID NO: 234694 - DNA, 20 bp, Artificial
  CRISPR gRNA sequence
ctggctgggagtctggaccc

SEQ ID NO: 234695 - DNA, 20 bp, Artificial
  CRISPR gRNA sequence
tggctgggagtctggaccct

SEQ ID NO: 234696 - DNA, 20 bp, Artificial
  CRISPR gRNA sequence
gtctggaccctgggtttatc

SEQ ID NO: 234697 - DNA, 20 bp, Artificial
  CRISPR gRNA sequence
atccagctgtctctttctcc

SEQ ID NO: 234698 - DNA, 20 bp, Artificial
  CRISPR gRNA sequence
tccagctgtctctttctcct

SEQ ID NO: 234699 - DNA, 20 bp, Artificial
  CRISPR gRNA sequence
ccagctgtctctttctcctg

SEQ ID NO: 234700 - DNA, 20 bp, Artificial
  CRISPR gRNA sequence
ctctttctcctggggccatg

SEQ ID NO: 234701 - DNA, 20 bp, Artificial
  CRISPR gRNA sequence
tctcctggggccatgtggcc

SEQ ID NO: 234702 - DNA, 20 bp, Artificial
  CRISPR gRNA sequence
tactccccctttgcgcccca

SEQ ID NO: 234703 - DNA, 20 bp, Artificial
  CRISPR gRNA sequence
gccccacagctgcccctgcc

SEQ ID NO: 234704 - DNA, 20 bp, Artificial
  CRISPR gRNA sequence
ccccacagctgcccctgccc

SEQ ID NO: 234705 - DNA, 20 bp, Artificial
  CRISPR gRNA sequence
gtgctaactccatatgcaac

SEQ ID NO: 234706 - DNA, 20 bp, Artificial
  CRISPR gRNA sequence
tgctaactccatatgcaacc

SEQ ID NO: 234707 - DNA, 20 bp, Artificial
  CRISPR gRNA sequence
ctaactccatatgcaaccag

SEQ ID NO: 234708 - DNA, 20 bp, Artificial
  CRISPR gRNA sequence
gcaaccaggagctgcccctg

SEQ ID NO: 234709 - DNA, 20 bp, Artificial
  CRISPR gRNA sequence
caaccaggagctgcccctgc

SEQ ID NO: 234710 - DNA, 20 bp, Artificial
  CRISPR gRNA sequence
ggagctgcccctgcaggacc

SEQ ID NO: 234711 - DNA, 20 bp, Artificial
  CRISPR gRNA sequence
gagctgcccctgcaggaccc

SEQ ID NO: 234712 - DNA, 20 bp, Artificial
  CRISPR gRNA sequence
agctgcccctgcaggaccca

SEQ ID NO: 234713 - DNA, 20 bp, Artificial
  CRISPR gRNA sequence
gctgcccctgcaggacccag

SEQ ID NO: 234714 - DNA, 20 bp, Artificial
  CRISPR gRNA sequence
gcccctgcaggacccagggg

SEQ ID NO: 234715 - DNA, 20 bp, Artificial
  CRISPR gRNA sequence
gacccaggggtggcccccaa

SEQ ID NO: 234716 - DNA, 20 bp, Artificial
  CRISPR gRNA sequence
gggtggcccccaacagtgca

SEQ ID NO: 234717 - DNA, 20 bp, Artificial
  CRISPR gRNA sequence
cccaacagtgcacagtcccc

SEQ ID NO: 234718 - DNA, 20 bp, Artificial
  CRISPR gRNA sequence
caacagtgcacagtcccctg

SEQ ID NO: 234719 - DNA, 20 bp, Artificial
  CRISPR gRNA sequence
aacagtgcacagtcccctgg

SEQ ID NO: 234720 - DNA, 20 bp, Artificial
  CRISPR gRNA sequence
ctggaggcccgtcgacacct

SEQ ID NO: 234721 - DNA, 20 bp, Artificial
  CRISPR gRNA sequence
ggaggcccgtcgacacctca

SEQ ID NO: 234722 - DNA, 20 bp, Artificial
  CRISPR gRNA sequence
gaggcccgtcgacacctcag

SEQ ID NO: 234723 - DNA, 20 bp, Artificial
  CRISPR gRNA sequence
cacctcagaggccgcctgcc

SEQ ID NO: 234724 - DNA, 20 bp, Artificial
  CRISPR gRNA sequence
gaggccgcctgcctggtgtc

SEQ ID NO: 234725 - DNA, 20 bp, Artificial
  CRISPR gRNA sequence
aggccgcctgcctggtgtct

SEQ ID NO: 234726 - DNA, 20 bp, Artificial
  CRISPR gRNA sequence
ggcgctgctgtccccaccac

SEQ ID NO: 234727 - DNA, 20 bp, Artificial
  CRISPR gRNA sequence
gtccccaccaccagccacac

SEQ ID NO: 234728 - DNA, 20 bp, Artificial
  CRISPR gRNA sequence
tccccaccaccagccacact

SEQ ID NO: 234729 - DNA, 20 bp, Artificial
  CRISPR gRNA sequence
caccagccacactgggcctc

SEQ ID NO: 234730 - DNA, 20 bp, Artificial
  CRISPR gRNA sequence
agccacactgggcctccgga

SEQ ID NO: 234731 - DNA, 20 bp, Artificial
  CRISPR gRNA sequence
ccacactgggcctccggaca

SEQ ID NO: 234732 - DNA, 20 bp, Artificial
  CRISPR gRNA sequence
gagcctcccttcccaaccca

SEQ ID NO: 234733 - DNA, 20 bp, Artificial
  CRISPR gRNA sequence
agcctcccttcccaacccac

SEQ ID NO: 234734 - DNA, 20 bp, Artificial
  CRISPR gRNA sequence
ccttcccaacccacaggccc

SEQ ID NO: 234735 - DNA, 20 bp, Artificial
  CRISPR gRNA sequence
ttcccaacccacaggccctg

SEQ ID NO: 234736 - DNA, 20 bp, Artificial
  CRISPR gRNA sequence
tcccaacccacaggccctgg

SEQ ID NO: 234737 - DNA, 20 bp, Artificial
  CRISPR gRNA sequence
caacccacaggccctggagg

SEQ ID NO: 234738 - DNA, 20 bp, Artificial
  CRISPR gRNA sequence
cccacaggccctggaggaag

SEQ ID NO: 234739 - DNA, 20 bp, Artificial
  CRISPR gRNA sequence
ggccctggaggaagaagctc

SEQ ID NO: 234740 - DNA, 20 bp, Artificial
  CRISPR gRNA sequence
gccctggaggaagaagctct

SEQ ID NO: 234741 - DNA, 20 bp, Artificial
  CRISPR gRNA sequence
ccctggaggaagaagctctg

SEQ ID NO: 234742 - DNA, 20 bp, Artificial
  CRISPR gRNA sequence
ctctggggtgacttccctgc

SEQ ID NO: 234743 - DNA, 20 bp, Artificial
  CRISPR gRNA sequence
ttccctgccagcttcctctc

SEQ ID NO: 234744 - DNA, 20 bp, Artificial
  CRISPR gRNA sequence
tgccagcttcctctccagac

SEQ ID NO: 234745 - DNA, 20 bp, Artificial
  CRISPR gRNA sequence
cctctccagaccagccgtgt

SEQ ID NO: 234746 - DNA, 20 bp, Artificial
  CRISPR gRNA sequence
gtcagctgaaccctcatccc

SEQ ID NO: 234747 - DNA, 20 bp, Artificial
  CRISPR gRNA sequence
tcagctgaaccctcatcccc

SEQ ID NO: 234748 - DNA, 20 bp, Artificial
  CRISPR gRNA sequence
tgaaccctcatccccaggtg

SEQ ID NO: 234749 - DNA, 20 bp, Artificial
  CRISPR gRNA sequence
gaaccctcatccccaggtgc

SEQ ID NO: 234750 - DNA, 20 bp, Artificial
  CRISPR gRNA sequence
cctcatccccaggtgcaggt

SEQ ID NO: 234751 - DNA, 20 bp, Artificial
  CRISPR gRNA sequence
tcatccccaggtgcaggtca

SEQ ID NO: 234752 - DNA, 20 bp, Artificial
  CRISPR gRNA sequence
catccccaggtgcaggtcag

SEQ ID NO: 234753 - DNA, 20 bp, Artificial
  CRISPR gRNA sequence
ccccaggtgcaggtcagagg

SEQ ID NO: 234754 - DNA, 20 bp, Artificial
  CRISPR gRNA sequence
cccaggtgcaggtcagaggc

SEQ ID NO: 234755 - DNA, 20 bp, Artificial
  CRISPR gRNA sequence
aggtgcaggtcagaggcagg

SEQ ID NO: 234756 - DNA, 20 bp, Artificial
  CRISPR gRNA sequence
tgcaggtcagaggcaggcag

SEQ ID NO: 234757 - DNA, 20 bp, Artificial
  CRISPR gRNA sequence
gcaggtcagaggcaggcagc

SEQ ID NO: 234758 - DNA, 20 bp, Artificial
  CRISPR gRNA sequence
gtcagaggcaggcagcaggc

SEQ ID NO: 234759 - DNA, 20 bp, Artificial
  CRISPR gRNA sequence
gaggcaggcagcaggccaga

SEQ ID NO: 234760 - DNA, 20 bp, Artificial
  CRISPR gRNA sequence
gcaggcagcaggccagacgg

SEQ ID NO: 234761 - DNA, 20 bp, Artificial
  CRISPR gRNA sequence
cagcaggccagacggtggtg

SEQ ID NO: 234762 - DNA, 20 bp, Artificial
  CRISPR gRNA sequence
agcaggccagacggtggtgc

SEQ ID NO: 234763 - DNA, 20 bp, Artificial
  CRISPR gRNA sequence
gcaggccagacggtggtgca

SEQ ID NO: 234764 - DNA, 20 bp, Artificial
  CRISPR gRNA sequence
caggccagacggtggtgcag

SEQ ID NO: 234765 - DNA, 20 bp, Artificial
  CRISPR gRNA sequence
aggccagacggtggtgcagg

SEQ ID NO: 234766 - DNA, 20 bp, Artificial
  CRISPR gRNA sequence
ggccagacggtggtgcaggg

SEQ ID NO: 234767 - DNA, 20 bp, Artificial
  CRISPR gRNA sequence
ggtgcaggggggccctcaac

SEQ ID NO: 234768 - DNA, 20 bp, Artificial
  CRISPR gRNA sequence
gtgcaggggggccctcaact

SEQ ID NO: 234769 - DNA, 20 bp, Artificial
  CRISPR gRNA sequence
caggggggccctcaactggg

SEQ ID NO: 234770 - DNA, 20 bp, Artificial
  CRISPR gRNA sequence
aggggggccctcaactgggc

SEQ ID NO: 234771 - DNA, 20 bp, Artificial
  CRISPR gRNA sequence
gggggccctcaactgggcag

SEQ ID NO: 234772 - DNA, 20 bp, Artificial
  CRISPR gRNA sequence
ggggccctcaactgggcagg

SEQ ID NO: 234773 - DNA, 20 bp, Artificial
  CRISPR gRNA sequence
gggccctcaactgggcagga

SEQ ID NO: 234774 - DNA, 20 bp, Artificial
  CRISPR gRNA sequence
ggccctcaactgggcaggag

SEQ ID NO: 234775 - DNA, 20 bp, Artificial
  CRISPR gRNA sequence
gccctcaactgggcaggagg

SEQ ID NO: 234776 - DNA, 20 bp, Artificial
  CRISPR gRNA sequence
tcaactgggcaggagggggc

SEQ ID NO: 234777 - DNA, 20 bp, Artificial
  CRISPR gRNA sequence
caactgggcaggagggggct

SEQ ID NO: 234778 - DNA, 20 bp, Artificial
  CRISPR gRNA sequence
ggcaggagggggctgggcga

SEQ ID NO: 234779 - DNA, 20 bp, Artificial
  CRISPR gRNA sequence
gagggggctgggcgatggcc

SEQ ID NO: 234780 - DNA, 20 bp, Artificial
  CRISPR gRNA sequence
agggggctgggcgatggcca

SEQ ID NO: 234781 - DNA, 20 bp, Artificial
  CRISPR gRNA sequence
gggggctgggcgatggccaa

SEQ ID NO: 234782 - DNA, 20 bp, Artificial
  CRISPR gRNA sequence
ccaagggctcacgacccgcc

SEQ ID NO: 234783 - DNA, 20 bp, Artificial
  CRISPR gRNA sequence
agggctcacgacccgcccag

SEQ ID NO: 234784 - DNA, 20 bp, Artificial
  CRISPR gRNA sequence
gggctcacgacccgcccagc

SEQ ID NO: 234785 - DNA, 20 bp, Artificial
  CRISPR gRNA sequence
acgacccgcccagcaggacc

SEQ ID NO: 234786 - DNA, 20 bp, Artificial
  CRISPR gRNA sequence
ccgcccagcaggacctggaa

SEQ ID NO: 234787 - DNA, 20 bp, Artificial
  CRISPR gRNA sequence
gaacagccgtcctccacctc

SEQ ID NO: 234788 - DNA, 20 bp, Artificial
  CRISPR gRNA sequence
cgtcctccacctccagaccc

SEQ ID NO: 234789 - DNA, 20 bp, Artificial
  CRISPR gRNA sequence
ccagaccccagacccctctt

SEQ ID NO: 234790 - DNA, 20 bp, Artificial
  CRISPR gRNA sequence
cagaccccagacccctcttg

SEQ ID NO: 234791 - DNA, 20 bp, Artificial
  CRISPR gRNA sequence
agaccccagacccctcttga

SEQ ID NO: 234792 - DNA, 20 bp, Artificial
  CRISPR gRNA sequence
ctcttgagggcgctcccacc

SEQ ID NO: 234793 - DNA, 20 bp, Artificial
  CRISPR gRNA sequence
acctggctcacccctgctcc

SEQ ID NO: 234794 - DNA, 20 bp, Artificial
  CRISPR gRNA sequence
ggctcacccctgctcccggc

SEQ ID NO: 234795 - DNA, 20 bp, Artificial
  CRISPR gRNA sequence
gctcacccctgctcccggcc

SEQ ID NO: 234796 - DNA, 20 bp, Artificial
  CRISPR gRNA sequence
ctcacccctgctcccggccg

SEQ ID NO: 234797 - DNA, 20 bp, Artificial
  CRISPR gRNA sequence
ctgctcccggccggggccac

SEQ ID NO: 234798 - DNA, 20 bp, Artificial
  CRISPR gRNA sequence
tcccggccggggccactggc

SEQ ID NO: 234799 - DNA, 20 bp, Artificial
  CRISPR gRNA sequence
ccggccggggccactggctg

SEQ ID NO: 234800 - DNA, 20 bp, Artificial
  CRISPR gRNA sequence
ccggggccactggctggagc

SEQ ID NO: 234801 - DNA, 20 bp, Artificial
  CRISPR gRNA sequence
ggcacacctccgcctccctc

SEQ ID NO: 234802 - DNA, 20 bp, Artificial
  CRISPR gRNA sequence
gcacacctccgcctccctct

SEQ ID NO: 234803 - DNA, 20 bp, Artificial
  CRISPR gRNA sequence
tctgggatcctgcctccctc

SEQ ID NO: 234804 - DNA, 20 bp, Artificial
  CRISPR gRNA sequence
gggatcctgcctccctccgg

SEQ ID NO: 234805 - DNA, 20 bp, Artificial
  CRISPR gRNA sequence
ggatcctgcctccctccgga

SEQ ID NO: 234806 - DNA, 20 bp, Artificial
  CRISPR gRNA sequence
ctccggaaggctcccgctgc

SEQ ID NO: 234807 - DNA, 20 bp, Artificial
  CRISPR gRNA sequence
cggaaggctcccgctgctgg

SEQ ID NO: 234808 - DNA, 20 bp, Artificial
  CRISPR gRNA sequence
ggctctgtgcccaccctcct

SEQ ID NO: 234809 - DNA, 20 bp, Artificial
  CRISPR gRNA sequence
tgcccaccctccttagacct

SEQ ID NO: 234810 - DNA, 20 bp, Artificial
  CRISPR gRNA sequence
tccttagacctcagcaacgc

SEQ ID NO: 234811 - DNA, 20 bp, Artificial
  CRISPR gRNA sequence
gacctcagcaacgccggtct

SEQ ID NO: 234812 - DNA, 20 bp, Artificial
  CRISPR gRNA sequence
cagcaacgccggtctgagca

SEQ ID NO: 234813 - DNA, 20 bp, Artificial
  CRISPR gRNA sequence
agcaacgccggtctgagcac

SEQ ID NO: 234814 - DNA, 20 bp, Artificial
  CRISPR gRNA sequence
aacgccggtctgagcacggg

SEQ ID NO: 234815 - DNA, 20 bp, Artificial
  CRISPR gRNA sequence
acgccggtctgagcacggga

SEQ ID NO: 234816 - DNA, 20 bp, Artificial
  CRISPR gRNA sequence
cgccggtctgagcacgggaa

SEQ ID NO: 234817 - DNA, 20 bp, Artificial
  CRISPR gRNA sequence
gccggtctgagcacgggaag

SEQ ID NO: 234818 - DNA, 20 bp, Artificial
  CRISPR gRNA sequence
ccggtctgagcacgggaagg

SEQ ID NO: 234819 - DNA, 20 bp, Artificial
  CRISPR gRNA sequence
cggtctgagcacgggaaggg

SEQ ID NO: 234820 - DNA, 20 bp, Artificial
  CRISPR gRNA sequence
aggggggcgcccacccatcc

SEQ ID NO: 234821 - DNA, 20 bp, Artificial
  CRISPR gRNA sequence
cccacccatcccggcttccg

SEQ ID NO: 234822 - DNA, 20 bp, Artificial
  CRISPR gRNA sequence
ccacccatcccggcttccgc

SEQ ID NO: 234823 - DNA, 20 bp, Artificial
  CRISPR gRNA sequence
ccggcttccgcgggacgcct

SEQ ID NO: 234824 - DNA, 20 bp, Artificial
  CRISPR gRNA sequence
cttccgcgggacgccttggc

SEQ ID NO: 234825 - DNA, 20 bp, Artificial
  CRISPR gRNA sequence
cgccttggccggtccgcgtt

SEQ ID NO: 234826 - DNA, 20 bp, Artificial
  CRISPR gRNA sequence
cggtccgcgttaagtaaacg

SEQ ID NO: 234827 - DNA, 20 bp, Artificial
  CRISPR gRNA sequence
gtaaacgcggtttacttacc

SEQ ID NO: 234828 - DNA, 20 bp, Artificial
  CRISPR gRNA sequence
taaacgcggtttacttaccc

SEQ ID NO: 234829 - DNA, 20 bp, Artificial
  CRISPR gRNA sequence
tttacttacccgggtaatcg

SEQ ID NO: 234830 - DNA, 20 bp, Artificial
  CRISPR gRNA sequence
acttacccgggtaatcgcgg

SEQ ID NO: 234831 - DNA, 20 bp, Artificial
  CRISPR gRNA sequence
tacccgggtaatcgcggcag

SEQ ID NO: 234832 - DNA, 20 bp, Artificial
  CRISPR gRNA sequence
agcagcgcgtcgtgtgaacc

SEQ ID NO: 234833 - DNA, 20 bp, Artificial
  CRISPR gRNA sequence
agcgcgtcgtgtgaacccgg

SEQ ID NO: 234834 - DNA, 20 bp, Artificial
  CRISPR gRNA sequence
gcgtcgtgtgaacccggcag

SEQ ID NO: 234835 - DNA, 20 bp, Artificial
  CRISPR gRNA sequence
cgcgcgtccgttcccgtccc

SEQ ID NO: 234836 - DNA, 20 bp, Artificial
  CRISPR gRNA sequence
gcgtccgttcccgtcccaag

SEQ ID NO: 234837 - DNA, 20 bp, Artificial
  CRISPR gRNA sequence
cgtccgttcccgtcccaagc

SEQ ID NO: 234838 - DNA, 20 bp, Artificial
  CRISPR gRNA sequence
tccgttcccgtcccaagcag

SEQ ID NO: 234839 - DNA, 20 bp, Artificial
  CRISPR gRNA sequence
ccgttcccgtcccaagcagg

SEQ ID NO: 234840 - DNA, 20 bp, Artificial
  CRISPR gRNA sequence
cgtcccaagcaggaggcgcc

SEQ ID NO: 234841 - DNA, 20 bp, Artificial
  CRISPR gRNA sequence
gtcccaagcaggaggcgccc

SEQ ID NO: 234842 - DNA, 20 bp, Artificial
  CRISPR gRNA sequence
tcccaagcaggaggcgccca

SEQ ID NO: 234843 - DNA, 20 bp, Artificial
  CRISPR gRNA sequence
gaggcgcccagggccgcacc

SEQ ID NO: 234844 - DNA, 20 bp, Artificial
  CRISPR gRNA sequence
aggcgcccagggccgcaccc

SEQ ID NO: 234845 - DNA, 20 bp, Artificial
  CRISPR gRNA sequence
agggccgcacccgggacccc

SEQ ID NO: 234846 - DNA, 20 bp, Artificial
  CRISPR gRNA sequence
gccgcacccgggacccccgg

SEQ ID NO: 234847 - DNA, 20 bp, Artificial
  CRISPR gRNA sequence
ccgcacccgggacccccggt

SEQ ID NO: 234848 - DNA, 20 bp, Artificial
  CRISPR gRNA sequence
cgcacccgggacccccggtg

SEQ ID NO: 234849 - DNA, 20 bp, Artificial
  CRISPR gRNA sequence
cccccggtggggcgctgacc

SEQ ID NO: 234850 - DNA, 20 bp, Artificial
  CRISPR gRNA sequence
ccccggtggggcgctgaccc

SEQ ID NO: 234851 - DNA, 20 bp, Artificial
  CRISPR gRNA sequence
gtggggcgctgacccaggct

SEQ ID NO: 234852 - DNA, 20 bp, Artificial
  CRISPR gRNA sequence
tgacccaggctgagcgcgca

SEQ ID NO: 234853 - DNA, 20 bp, Artificial
  CRISPR gRNA sequence
cccaggctgagcgcgcacag

SEQ ID NO: 234854 - DNA, 20 bp, Artificial
  CRISPR gRNA sequence
ctgagcgcgcacagcagcgc

SEQ ID NO: 234855 - DNA, 20 bp, Artificial
  CRISPR gRNA sequence
tgagcgcgcacagcagcgcc

SEQ ID NO: 234856 - DNA, 20 bp, Artificial
  CRISPR gRNA sequence
cacagcagcgccaggccgca

SEQ ID NO: 234857 - DNA, 20 bp, Artificial
  CRISPR gRNA sequence
acagcagcgccaggccgcac

SEQ ID NO: 234858 - DNA, 20 bp, Artificial
  CRISPR gRNA sequence
cagcagcgccaggccgcaca

SEQ ID NO: 234859 - DNA, 20 bp, Artificial
  CRISPR gRNA sequence
gccccgtgctgtgccatgct

SEQ ID NO: 234860 - DNA, 20 bp, Artificial
  CRISPR gRNA sequence
ccccgtgctgtgccatgctc

SEQ ID NO: 234861 - DNA, 20 bp, Artificial
  CRISPR gRNA sequence
ctgtgccatgctcgggtttc

SEQ ID NO: 234862 - DNA, 20 bp, Artificial
  CRISPR gRNA sequence
gtgccatgctcgggtttcaa

SEQ ID NO: 234863 - DNA, 20 bp, Artificial
  CRISPR gRNA sequence
gctcgggtttcaagagccca

SEQ ID NO: 234864 - DNA, 20 bp, Artificial
  CRISPR gRNA sequence
gggtttcaagagcccacagc

SEQ ID NO: 234865 - DNA, 20 bp, Artificial
  CRISPR gRNA sequence
ttcaagagcccacagccagt

SEQ ID NO: 234866 - DNA, 20 bp, Artificial
  CRISPR gRNA sequence
ccgtcctcacccgccctgcc

SEQ ID NO: 234867 - DNA, 20 bp, Artificial
  CRISPR gRNA sequence
gtcctcacccgccctgcccg

SEQ ID NO: 234868 - DNA, 20 bp, Artificial
  CRISPR gRNA sequence
tcctcacccgccctgcccgg

SEQ ID NO: 234869 - DNA, 20 bp, Artificial
  CRISPR gRNA sequence
tcacccgccctgcccggagg

SEQ ID NO: 234870 - DNA, 20 bp, Artificial
  CRISPR gRNA sequence
ccgccctgcccggaggtggc

SEQ ID NO: 234871 - DNA, 20 bp, Artificial
  CRISPR gRNA sequence
cgccctgcccggaggtggct

SEQ ID NO: 234872 - DNA, 20 bp, Artificial
  CRISPR gRNA sequence
gctgggaccgttcatgacct

SEQ ID NO: 234873 - DNA, 20 bp, Artificial
  CRISPR gRNA sequence
atgacctgagaatcccgacc

SEQ ID NO: 234874 - DNA, 20 bp, Artificial
  CRISPR gRNA sequence
tgacctgagaatcccgaccc

SEQ ID NO: 234875 - DNA, 20 bp, Artificial
  CRISPR gRNA sequence
tgagaatcccgacccaggtg

SEQ ID NO: 234876 - DNA, 20 bp, Artificial
  CRISPR gRNA sequence
gacccaggtgaagtgcgtgt

SEQ ID NO: 234877 - DNA, 20 bp, Artificial
  CRISPR gRNA sequence
acccaggtgaagtgcgtgtg

SEQ ID NO: 234878 - DNA, 20 bp, Artificial
  CRISPR gRNA sequence
ccaggtgaagtgcgtgtgag

SEQ ID NO: 234879 - DNA, 20 bp, Artificial
  CRISPR gRNA sequence
caggtgaagtgcgtgtgagg

SEQ ID NO: 234880 - DNA, 20 bp, Artificial
  CRISPR gRNA sequence
aggtgaagtgcgtgtgagga

SEQ ID NO: 234881 - DNA, 20 bp, Artificial
  CRISPR gRNA sequence
ggtgaagtgcgtgtgaggag

SEQ ID NO: 234882 - DNA, 20 bp, Artificial
  CRISPR gRNA sequence
gtgaagtgcgtgtgaggagg

SEQ ID NO: 234883 - DNA, 20 bp, Artificial
  CRISPR gRNA sequence
gtgcgtgtgaggagggggtg

SEQ ID NO: 234884 - DNA, 20 bp, Artificial
  CRISPR gRNA sequence
aggagggggtgtagacactg

SEQ ID NO: 234885 - DNA, 20 bp, Artificial
  CRISPR gRNA sequence
gggtgtagacactgcggaca

SEQ ID NO: 234886 - DNA, 20 bp, Artificial
  CRISPR gRNA sequence
tagacactgcggacacagcc

SEQ ID NO: 234887 - DNA, 20 bp, Artificial
  CRISPR gRNA sequence
ggacacagcccggtcccccg

SEQ ID NO: 234888 - DNA, 20 bp, Artificial
  CRISPR gRNA sequence
gacacagcccggtcccccgc

SEQ ID NO: 234889 - DNA, 20 bp, Artificial
  CRISPR gRNA sequence
cccggtcccccgcaggtcgc

SEQ ID NO: 234890 - DNA, 20 bp, Artificial
  CRISPR gRNA sequence
ggtcccccgcaggtcgccgg

SEQ ID NO: 234891 - DNA, 20 bp, Artificial
  CRISPR gRNA sequence
gtcccccgcaggtcgccggc

SEQ ID NO: 234892 - DNA, 20 bp, Artificial
  CRISPR gRNA sequence
tcccccgcaggtcgccggca

SEQ ID NO: 234893 - DNA, 20 bp, Artificial
  CRISPR gRNA sequence
cccccgcaggtcgccggcag

SEQ ID NO: 234894 - DNA, 20 bp, Artificial
  CRISPR gRNA sequence
ccgcaggtcgccggcagggg

SEQ ID NO: 234895 - DNA, 20 bp, Artificial
  CRISPR gRNA sequence
cgcaggtcgccggcaggggc

SEQ ID NO: 234896 - DNA, 20 bp, Artificial
  CRISPR gRNA sequence
gcaggtcgccggcaggggcg

SEQ ID NO: 234897 - DNA, 20 bp, Artificial
  CRISPR gRNA sequence
gccggcaggggcggggaaac

SEQ ID NO: 234898 - DNA, 20 bp, Artificial
  CRISPR gRNA sequence
ccggcaggggcggggaaacc

SEQ ID NO: 234899 - DNA, 20 bp, Artificial
  CRISPR gRNA sequence
caggggcggggaaaccaggc

SEQ ID NO: 234900 - DNA, 20 bp, Artificial
  CRISPR gRNA sequence
gggcggggaaaccaggctgg

SEQ ID NO: 234901 - DNA, 20 bp, Artificial
  CRISPR gRNA sequence
ggcggggaaaccaggctggc

SEQ ID NO: 234902 - DNA, 20 bp, Artificial
  CRISPR gRNA sequence
gcggggaaaccaggctggcg

SEQ ID NO: 234903 - DNA, 20 bp, Artificial
  CRISPR gRNA sequence
gaaaccaggctggcggggat

SEQ ID NO: 234904 - DNA, 20 bp, Artificial
  CRISPR gRNA sequence
ccaggctggcggggatcaga

SEQ ID NO: 234905 - DNA, 20 bp, Artificial
  CRISPR gRNA sequence
caggctggcggggatcagaa

SEQ ID NO: 234906 - DNA, 20 bp, Artificial
  CRISPR gRNA sequence
tcagaaaggttttctatgca

SEQ ID NO: 234907 - DNA, 20 bp, Artificial
  CRISPR gRNA sequence
ggttttctatgcaaagtctg

SEQ ID NO: 234908 - DNA, 20 bp, Artificial
  CRISPR gRNA sequence
aaaacctttctgatccccgc

SEQ ID NO: 234909 - DNA, 20 bp, Artificial
  CRISPR gRNA sequence
ctttctgatccccgccagcc

SEQ ID NO: 234910 - DNA, 20 bp, Artificial
  CRISPR gRNA sequence
cctggtttccccgcccctgc

SEQ ID NO: 234911 - DNA, 20 bp, Artificial
  CRISPR gRNA sequence
ccgcccctgccggcgacctg

SEQ ID NO: 234912 - DNA, 20 bp, Artificial
  CRISPR gRNA sequence
cgcccctgccggcgacctgc

SEQ ID NO: 234913 - DNA, 20 bp, Artificial
  CRISPR gRNA sequence
gcccctgccggcgacctgcg

SEQ ID NO: 234914 - DNA, 20 bp, Artificial
  CRISPR gRNA sequence
cccctgccggcgacctgcgg

SEQ ID NO: 234915 - DNA, 20 bp, Artificial
  CRISPR gRNA sequence
gccggcgacctgcgggggac

SEQ ID NO: 234916 - DNA, 20 bp, Artificial
  CRISPR gRNA sequence
ccggcgacctgcgggggacc

SEQ ID NO: 234917 - DNA, 20 bp, Artificial
  CRISPR gRNA sequence
gggggaccgggctgtgtccg

SEQ ID NO: 234918 - DNA, 20 bp, Artificial
  CRISPR gRNA sequence
ctcctcacacgcacttcacc

SEQ ID NO: 234919 - DNA, 20 bp, Artificial
  CRISPR gRNA sequence
tcctcacacgcacttcacct

SEQ ID NO: 234920 - DNA, 20 bp, Artificial
  CRISPR gRNA sequence
cacacgcacttcacctgggt

SEQ ID NO: 234921 - DNA, 20 bp, Artificial
  CRISPR gRNA sequence
acacgcacttcacctgggtc

SEQ ID NO: 234922 - DNA, 20 bp, Artificial
  CRISPR gRNA sequence
ttcacctgggtcgggattct

SEQ ID NO: 234923 - DNA, 20 bp, Artificial
  CRISPR gRNA sequence
tcacctgggtcgggattctc

SEQ ID NO: 234924 - DNA, 20 bp, Artificial
  CRISPR gRNA sequence
cgggattctcaggtcatgaa

SEQ ID NO: 234925 - DNA, 20 bp, Artificial
  CRISPR gRNA sequence
tctcaggtcatgaacggtcc

SEQ ID NO: 234926 - DNA, 20 bp, Artificial
  CRISPR gRNA sequence
tgaacggtcccagccacctc

SEQ ID NO: 234927 - DNA, 20 bp, Artificial
  CRISPR gRNA sequence
gaacggtcccagccacctcc

SEQ ID NO: 234928 - DNA, 20 bp, Artificial
  CRISPR gRNA sequence
cggtcccagccacctccggg

SEQ ID NO: 234929 - DNA, 20 bp, Artificial
  CRISPR gRNA sequence
ggtcccagccacctccgggc

SEQ ID NO: 234930 - DNA, 20 bp, Artificial
  CRISPR gRNA sequence
gtcccagccacctccgggca

SEQ ID NO: 234931 - DNA, 20 bp, Artificial
  CRISPR gRNA sequence
ccagccacctccgggcaggg

SEQ ID NO: 234932 - DNA, 20 bp, Artificial
  CRISPR gRNA sequence
cagccacctccgggcagggc

SEQ ID NO: 234933 - DNA, 20 bp, Artificial
  CRISPR gRNA sequence
cacctccgggcagggcgggt

SEQ ID NO: 234934 - DNA, 20 bp, Artificial
  CRISPR gRNA sequence
acctccgggcagggcgggtg

SEQ ID NO: 234935 - DNA, 20 bp, Artificial
  CRISPR gRNA sequence
ccgggcagggcgggtgagga

SEQ ID NO: 234936 - DNA, 20 bp, Artificial
  CRISPR gRNA sequence
cgggcagggcgggtgaggac

SEQ ID NO: 234937 - DNA, 20 bp, Artificial
  CRISPR gRNA sequence
gggcagggcgggtgaggacg

SEQ ID NO: 234938 - DNA, 20 bp, Artificial
  CRISPR gRNA sequence
agggcgggtgaggacgggga

SEQ ID NO: 234939 - DNA, 20 bp, Artificial
  CRISPR gRNA sequence
gggcgggtgaggacggggac

SEQ ID NO: 234940 - DNA, 20 bp, Artificial
  CRISPR gRNA sequence
ggcgggtgaggacggggacg

SEQ ID NO: 234941 - DNA, 20 bp, Artificial
  CRISPR gRNA sequence
ggggacggggcgtgtccaac

SEQ ID NO: 234942 - DNA, 20 bp, Artificial
  CRISPR gRNA sequence
ggggcgtgtccaactggctg

SEQ ID NO: 234943 - DNA, 20 bp, Artificial
  CRISPR gRNA sequence
gggcgtgtccaactggctgt

SEQ ID NO: 234944 - DNA, 20 bp, Artificial
  CRISPR gRNA sequence
gctgtgggctcttgaaaccc

SEQ ID NO: 234945 - DNA, 20 bp, Artificial
  CRISPR gRNA sequence
gggctcttgaaacccgagca

SEQ ID NO: 234946 - DNA, 20 bp, Artificial
  CRISPR gRNA sequence
cttgaaacccgagcatggca

SEQ ID NO: 234947 - DNA, 20 bp, Artificial
  CRISPR gRNA sequence
aacccgagcatggcacagca

SEQ ID NO: 234948 - DNA, 20 bp, Artificial
  CRISPR gRNA sequence
acccgagcatggcacagcac

SEQ ID NO: 234949 - DNA, 20 bp, Artificial
  CRISPR gRNA sequence
cccgagcatggcacagcacg

SEQ ID NO: 234950 - DNA, 20 bp, Artificial
  CRISPR gRNA sequence
catggcacagcacggggcga

SEQ ID NO: 234951 - DNA, 20 bp, Artificial
  CRISPR gRNA sequence
atggcacagcacggggcgat

SEQ ID NO: 234952 - DNA, 20 bp, Artificial
  CRISPR gRNA sequence
acggggcgatgggcgcgttt

SEQ ID NO: 234953 - DNA, 20 bp, Artificial
  CRISPR gRNA sequence
cggggcgatgggcgcgtttc

SEQ ID NO: 234954 - DNA, 20 bp, Artificial
  CRISPR gRNA sequence
ggcgcgtttcgggccctgtg

SEQ ID NO: 234955 - DNA, 20 bp, Artificial
  CRISPR gRNA sequence
gtttcgggccctgtgcggcc

SEQ ID NO: 234956 - DNA, 20 bp, Artificial
  CRISPR gRNA sequence
ctggcgctgctgtgcgcgct

SEQ ID NO: 234957 - DNA, 20 bp, Artificial
  CRISPR gRNA sequence
gctgctgtgcgcgctcagcc

SEQ ID NO: 234958 - DNA, 20 bp, Artificial
  CRISPR gRNA sequence
ctgctgtgcgcgctcagcct

SEQ ID NO: 234959 - DNA, 20 bp, Artificial
  CRISPR gRNA sequence
tgtgcgcgctcagcctgggt

SEQ ID NO: 234960 - DNA, 20 bp, Artificial
  CRISPR gRNA sequence
agcctgggtcagcgccccac

SEQ ID NO: 234961 - DNA, 20 bp, Artificial
  CRISPR gRNA sequence
gcctgggtcagcgccccacc

SEQ ID NO: 234962 - DNA, 20 bp, Artificial
  CRISPR gRNA sequence
cctgggtcagcgccccaccg

SEQ ID NO: 234963 - DNA, 20 bp, Artificial
  CRISPR gRNA sequence
ctgggtcagcgccccaccgg

SEQ ID NO: 234964 - DNA, 20 bp, Artificial
  CRISPR gRNA sequence
cagcgccccaccgggggtcc

SEQ ID NO: 234965 - DNA, 20 bp, Artificial
  CRISPR gRNA sequence
agcgccccaccgggggtccc

SEQ ID NO: 234966 - DNA, 20 bp, Artificial
  CRISPR gRNA sequence
cccaccgggggtcccgggtg

SEQ ID NO: 234967 - DNA, 20 bp, Artificial
  CRISPR gRNA sequence
gggggtcccgggtgcggccc

SEQ ID NO: 234968 - DNA, 20 bp, Artificial
  CRISPR gRNA sequence
ggggtcccgggtgcggccct

SEQ ID NO: 234969 - DNA, 20 bp, Artificial
  CRISPR gRNA sequence
ggccctgggcgcctcctgct

SEQ ID NO: 234970 - DNA, 20 bp, Artificial
  CRISPR gRNA sequence
gccctgggcgcctcctgctt

SEQ ID NO: 234971 - DNA, 20 bp, Artificial
  CRISPR gRNA sequence
tgggcgcctcctgcttggga

SEQ ID NO: 234972 - DNA, 20 bp, Artificial
  CRISPR gRNA sequence
gggcgcctcctgcttgggac

SEQ ID NO: 234973 - DNA, 20 bp, Artificial
  CRISPR gRNA sequence
cctcctgcttgggacgggaa

SEQ ID NO: 234974 - DNA, 20 bp, Artificial
  CRISPR gRNA sequence
gaacggacgcgcgctgctgc

SEQ ID NO: 234975 - DNA, 20 bp, Artificial
  CRISPR gRNA sequence
aacggacgcgcgctgctgcc

SEQ ID NO: 234976 - DNA, 20 bp, Artificial
  CRISPR gRNA sequence
gcgctgctgccgcgattacc

SEQ ID NO: 234977 - DNA, 20 bp, Artificial
  CRISPR gRNA sequence
cgctgctgccgcgattaccc

SEQ ID NO: 234978 - DNA, 20 bp, Artificial
  CRISPR gRNA sequence
gctgccgcgattacccgggt

SEQ ID NO: 234979 - DNA, 20 bp, Artificial
  CRISPR gRNA sequence
taaaccgcgtttacttaacg

SEQ ID NO: 234980 - DNA, 20 bp, Artificial
  CRISPR gRNA sequence
cgcgtttacttaacgcggac

SEQ ID NO: 234981 - DNA, 20 bp, Artificial
  CRISPR gRNA sequence
ttacttaacgcggaccggcc

SEQ ID NO: 234982 - DNA, 20 bp, Artificial
  CRISPR gRNA sequence
tacttaacgcggaccggcca

SEQ ID NO: 234983 - DNA, 20 bp, Artificial
  CRISPR gRNA sequence
ggaccggccaaggcgtcccg

SEQ ID NO: 234984 - DNA, 20 bp, Artificial
  CRISPR gRNA sequence
ccggccaaggcgtcccgcgg

SEQ ID NO: 234985 - DNA, 20 bp, Artificial
  CRISPR gRNA sequence
ccaaggcgtcccgcggaagc

SEQ ID NO: 234986 - DNA, 20 bp, Artificial
  CRISPR gRNA sequence
caaggcgtcccgcggaagcc

SEQ ID NO: 234987 - DNA, 20 bp, Artificial
  CRISPR gRNA sequence
gcgtcccgcggaagccggga

SEQ ID NO: 234988 - DNA, 20 bp, Artificial
  CRISPR gRNA sequence
cgtcccgcggaagccgggat

SEQ ID NO: 234989 - DNA, 20 bp, Artificial
  CRISPR gRNA sequence
cccgcggaagccgggatggg

SEQ ID NO: 234990 - DNA, 20 bp, Artificial
  CRISPR gRNA sequence
ccgcggaagccgggatgggt

SEQ ID NO: 234991 - DNA, 20 bp, Artificial
  CRISPR gRNA sequence
ggcgccccccttcccgtgct

SEQ ID NO: 234992 - DNA, 20 bp, Artificial
  CRISPR gRNA sequence
cccccttcccgtgctcagac

SEQ ID NO: 234993 - DNA, 20 bp, Artificial
  CRISPR gRNA sequence
gtgctcagaccggcgttgct

SEQ ID NO: 234994 - DNA, 20 bp, Artificial
  CRISPR gRNA sequence
tgctcagaccggcgttgctg

SEQ ID NO: 234995 - DNA, 20 bp, Artificial
  CRISPR gRNA sequence
gaccggcgttgctgaggtct

SEQ ID NO: 234996 - DNA, 20 bp, Artificial
  CRISPR gRNA sequence
accggcgttgctgaggtcta

SEQ ID NO: 234997 - DNA, 20 bp, Artificial
  CRISPR gRNA sequence
cggcgttgctgaggtctaag

SEQ ID NO: 234998 - DNA, 20 bp, Artificial
  CRISPR gRNA sequence
ggcgttgctgaggtctaagg

SEQ ID NO: 234999 - DNA, 20 bp, Artificial
  CRISPR gRNA sequence
gcgttgctgaggtctaagga

SEQ ID NO: 235000 - DNA, 20 bp, Artificial
  CRISPR gRNA sequence
ttgctgaggtctaaggaggg

SEQ ID NO: 235001 - DNA, 20 bp, Artificial
  CRISPR gRNA sequence
tgctgaggtctaaggagggt

SEQ ID NO: 235002 - DNA, 20 bp, Artificial
  CRISPR gRNA sequence
aggtctaaggagggtgggca

SEQ ID NO: 235003 - DNA, 20 bp, Artificial
  CRISPR gRNA sequence
gtctaaggagggtgggcaca

SEQ ID NO: 235004 - DNA, 20 bp, Artificial
  CRISPR gRNA sequence
gagggtgggcacagagccgc

SEQ ID NO: 235005 - DNA, 20 bp, Artificial
  CRISPR gRNA sequence
ggtgggcacagagccgccag

SEQ ID NO: 235006 - DNA, 20 bp, Artificial
  CRISPR gRNA sequence
gggcacagagccgccagcag

SEQ ID NO: 235007 - DNA, 20 bp, Artificial
  CRISPR gRNA sequence
ggcacagagccgccagcagc

SEQ ID NO: 235008 - DNA, 20 bp, Artificial
  CRISPR gRNA sequence
cacagagccgccagcagcgg

SEQ ID NO: 235009 - DNA, 20 bp, Artificial
  CRISPR gRNA sequence
cgccagcagcgggagccttc

SEQ ID NO: 235010 - DNA, 20 bp, Artificial
  CRISPR gRNA sequence
ccagcagcgggagccttccg

SEQ ID NO: 235011 - DNA, 20 bp, Artificial
  CRISPR gRNA sequence
cagcagcgggagccttccgg

SEQ ID NO: 235012 - DNA, 20 bp, Artificial
  CRISPR gRNA sequence
agcagcgggagccttccgga

SEQ ID NO: 235013 - DNA, 20 bp, Artificial
  CRISPR gRNA sequence
cagcgggagccttccggagg

SEQ ID NO: 235014 - DNA, 20 bp, Artificial
  CRISPR gRNA sequence
agcgggagccttccggaggg

SEQ ID NO: 235015 - DNA, 20 bp, Artificial
  CRISPR gRNA sequence
gggagccttccggagggagg

SEQ ID NO: 235016 - DNA, 20 bp, Artificial
  CRISPR gRNA sequence
ggagccttccggagggaggc

SEQ ID NO: 235017 - DNA, 20 bp, Artificial
  CRISPR gRNA sequence
tccggagggaggcaggatcc

SEQ ID NO: 235018 - DNA, 20 bp, Artificial
  CRISPR gRNA sequence
cggagggaggcaggatccca

SEQ ID NO: 235019 - DNA, 20 bp, Artificial
  CRISPR gRNA sequence
ggagggaggcaggatcccag

SEQ ID NO: 235020 - DNA, 20 bp, Artificial
  CRISPR gRNA sequence
gagggaggcaggatcccaga

SEQ ID NO: 235021 - DNA, 20 bp, Artificial
  CRISPR gRNA sequence
gggaggcaggatcccagagg

SEQ ID NO: 235022 - DNA, 20 bp, Artificial
  CRISPR gRNA sequence
ggaggcaggatcccagaggg

SEQ ID NO: 235023 - DNA, 20 bp, Artificial
  CRISPR gRNA sequence
ggcaggatcccagagggagg

SEQ ID NO: 235024 - DNA, 20 bp, Artificial
  CRISPR gRNA sequence
caggatcccagagggaggcg

SEQ ID NO: 235025 - DNA, 20 bp, Artificial
  CRISPR gRNA sequence
aggatcccagagggaggcgg

SEQ ID NO: 235026 - DNA, 20 bp, Artificial
  CRISPR gRNA sequence
agagggaggcggaggtgtgc

SEQ ID NO: 235027 - DNA, 20 bp, Artificial
  CRISPR gRNA sequence
aggcggaggtgtgccagctc

SEQ ID NO: 235028 - DNA, 20 bp, Artificial
  CRISPR gRNA sequence
ggaggtgtgccagctccagc

SEQ ID NO: 235029 - DNA, 20 bp, Artificial
  CRISPR gRNA sequence
ggtgtgccagctccagccag

SEQ ID NO: 235030 - DNA, 20 bp, Artificial
  CRISPR gRNA sequence
ccagctccagccagtggccc

SEQ ID NO: 235031 - DNA, 20 bp, Artificial
  CRISPR gRNA sequence
ctccagccagtggccccggc

SEQ ID NO: 235032 - DNA, 20 bp, Artificial
  CRISPR gRNA sequence
tccagccagtggccccggcc

SEQ ID NO: 235033 - DNA, 20 bp, Artificial
  CRISPR gRNA sequence
cagccagtggccccggccgg

SEQ ID NO: 235034 - DNA, 20 bp, Artificial
  CRISPR gRNA sequence
ccagtggccccggccgggag

SEQ ID NO: 235035 - DNA, 20 bp, Artificial
  CRISPR gRNA sequence
cagtggccccggccgggagc

SEQ ID NO: 235036 - DNA, 20 bp, Artificial
  CRISPR gRNA sequence
agtggccccggccgggagca

SEQ ID NO: 235037 - DNA, 20 bp, Artificial
  CRISPR gRNA sequence
gtggccccggccgggagcag

SEQ ID NO: 235038 - DNA, 20 bp, Artificial
  CRISPR gRNA sequence
ccccggccgggagcaggggt

SEQ ID NO: 235039 - DNA, 20 bp, Artificial
  CRISPR gRNA sequence
ggccgggagcaggggtgagc

SEQ ID NO: 235040 - DNA, 20 bp, Artificial
  CRISPR gRNA sequence
gccgggagcaggggtgagcc

SEQ ID NO: 235041 - DNA, 20 bp, Artificial
  CRISPR gRNA sequence
gggagcaggggtgagccagg

SEQ ID NO: 235042 - DNA, 20 bp, Artificial
  CRISPR gRNA sequence
ggagcaggggtgagccaggt

SEQ ID NO: 235043 - DNA, 20 bp, Artificial
  CRISPR gRNA sequence
agcaggggtgagccaggtgg

SEQ ID NO: 235044 - DNA, 20 bp, Artificial
  CRISPR gRNA sequence
agccaggtgggagcgccctc

SEQ ID NO: 235045 - DNA, 20 bp, Artificial
  CRISPR gRNA sequence
ccaggtgggagcgccctcaa

SEQ ID NO: 235046 - DNA, 20 bp, Artificial
  CRISPR gRNA sequence
caggtgggagcgccctcaag

SEQ ID NO: 235047 - DNA, 20 bp, Artificial
  CRISPR gRNA sequence
aggtgggagcgccctcaaga

SEQ ID NO: 235048 - DNA, 20 bp, Artificial
  CRISPR gRNA sequence
ggtgggagcgccctcaagag

SEQ ID NO: 235049 - DNA, 20 bp, Artificial
  CRISPR gRNA sequence
gagcgccctcaagaggggtc

SEQ ID NO: 235050 - DNA, 20 bp, Artificial
  CRISPR gRNA sequence
agcgccctcaagaggggtct

SEQ ID NO: 235051 - DNA, 20 bp, Artificial
  CRISPR gRNA sequence
gcgccctcaagaggggtctg

SEQ ID NO: 235052 - DNA, 20 bp, Artificial
  CRISPR gRNA sequence
ctcaagaggggtctggggtc

SEQ ID NO: 235053 - DNA, 20 bp, Artificial
  CRISPR gRNA sequence
caagaggggtctggggtctg

SEQ ID NO: 235054 - DNA, 20 bp, Artificial
  CRISPR gRNA sequence
aagaggggtctggggtctgg

SEQ ID NO: 235055 - DNA, 20 bp, Artificial
  CRISPR gRNA sequence
aggggtctggggtctggagg

SEQ ID NO: 235056 - DNA, 20 bp, Artificial
  CRISPR gRNA sequence
gggtctggggtctggaggtg

SEQ ID NO: 235057 - DNA, 20 bp, Artificial
  CRISPR gRNA sequence
ggtctggggtctggaggtgg

SEQ ID NO: 235058 - DNA, 20 bp, Artificial
  CRISPR gRNA sequence
tggggtctggaggtggagga

SEQ ID NO: 235059 - DNA, 20 bp, Artificial
  CRISPR gRNA sequence
gaggtggaggacggctgttc

SEQ ID NO: 235060 - DNA, 20 bp, Artificial
  CRISPR gRNA sequence
aggtggaggacggctgttcc

SEQ ID NO: 235061 - DNA, 20 bp, Artificial
  CRISPR gRNA sequence
acggctgttccaggtcctgc

SEQ ID NO: 235062 - DNA, 20 bp, Artificial
  CRISPR gRNA sequence
cggctgttccaggtcctgct

SEQ ID NO: 235063 - DNA, 20 bp, Artificial
  CRISPR gRNA sequence
ctgttccaggtcctgctggg

SEQ ID NO: 235064 - DNA, 20 bp, Artificial
  CRISPR gRNA sequence
tgttccaggtcctgctgggc

SEQ ID NO: 235065 - DNA, 20 bp, Artificial
  CRISPR gRNA sequence
ggtcctgctgggcgggtcgt

SEQ ID NO: 235066 - DNA, 20 bp, Artificial
  CRISPR gRNA sequence
ctgggcgggtcgtgagccct

SEQ ID NO: 235067 - DNA, 20 bp, Artificial
  CRISPR gRNA sequence
gtgagcccttggccatcgcc

SEQ ID NO: 235068 - DNA, 20 bp, Artificial
  CRISPR gRNA sequence
tcgcccagccccctcctgcc

SEQ ID NO: 235069 - DNA, 20 bp, Artificial
  CRISPR gRNA sequence
cagccccctcctgcccagtt

SEQ ID NO: 235070 - DNA, 20 bp, Artificial
  CRISPR gRNA sequence
agccccctcctgcccagttg

SEQ ID NO: 235071 - DNA, 20 bp, Artificial
  CRISPR gRNA sequence
gccccctcctgcccagttga

SEQ ID NO: 235072 - DNA, 20 bp, Artificial
  CRISPR gRNA sequence
ggcccccctgcaccaccgtc

SEQ ID NO: 235073 - DNA, 20 bp, Artificial
  CRISPR gRNA sequence
gcctgcctctgacctgcacc

SEQ ID NO: 235074 - DNA, 20 bp, Artificial
  CRISPR gRNA sequence
cctgcctctgacctgcacct

SEQ ID NO: 235075 - DNA, 20 bp, Artificial
  CRISPR gRNA sequence
ctgcctctgacctgcacctg

SEQ ID NO: 235076 - DNA, 20 bp, Artificial
  CRISPR gRNA sequence
tctgacctgcacctggggat

SEQ ID NO: 235077 - DNA, 20 bp, Artificial
  CRISPR gRNA sequence
ctgacctgcacctggggatg

SEQ ID NO: 235078 - DNA, 20 bp, Artificial
  CRISPR gRNA sequence
tgacctgcacctggggatga

SEQ ID NO: 235079 - DNA, 20 bp, Artificial
  CRISPR gRNA sequence
tgcacctggggatgagggtt

SEQ ID NO: 235080 - DNA, 20 bp, Artificial
  CRISPR gRNA sequence
ggatgagggttcagctgaca

SEQ ID NO: 235081 - DNA, 20 bp, Artificial
  CRISPR gRNA sequence
gagggttcagctgacacggc

SEQ ID NO: 235082 - DNA, 20 bp, Artificial
  CRISPR gRNA sequence
ttcagctgacacggctggtc

SEQ ID NO: 235083 - DNA, 20 bp, Artificial
  CRISPR gRNA sequence
cagctgacacggctggtctg

SEQ ID NO: 235084 - DNA, 20 bp, Artificial
  CRISPR gRNA sequence
gctgacacggctggtctgga

SEQ ID NO: 235085 - DNA, 20 bp, Artificial
  CRISPR gRNA sequence
ctgacacggctggtctggag

SEQ ID NO: 235086 - DNA, 20 bp, Artificial
  CRISPR gRNA sequence
acacggctggtctggagagg

SEQ ID NO: 235087 - DNA, 20 bp, Artificial
  CRISPR gRNA sequence
ggctggtctggagaggaagc

SEQ ID NO: 235088 - DNA, 20 bp, Artificial
  CRISPR gRNA sequence
tggtctggagaggaagctgg

SEQ ID NO: 235089 - DNA, 20 bp, Artificial
  CRISPR gRNA sequence
ggtctggagaggaagctggc

SEQ ID NO: 235090 - DNA, 20 bp, Artificial
  CRISPR gRNA sequence
gtctggagaggaagctggca

SEQ ID NO: 235091 - DNA, 20 bp, Artificial
  CRISPR gRNA sequence
tggagaggaagctggcaggg

SEQ ID NO: 235092 - DNA, 20 bp, Artificial
  CRISPR gRNA sequence
agctggcagggaagtcaccc

SEQ ID NO: 235093 - DNA, 20 bp, Artificial
  CRISPR gRNA sequence
ctggcagggaagtcacccca

SEQ ID NO: 235094 - DNA, 20 bp, Artificial
  CRISPR gRNA sequence
caccccagagcttcttcctc

SEQ ID NO: 235095 - DNA, 20 bp, Artificial
  CRISPR gRNA sequence
accccagagcttcttcctcc

SEQ ID NO: 235096 - DNA, 20 bp, Artificial
  CRISPR gRNA sequence
ccccagagcttcttcctcca

SEQ ID NO: 235097 - DNA, 20 bp, Artificial
  CRISPR gRNA sequence
gcttcttcctccagggcctg

SEQ ID NO: 235098 - DNA, 20 bp, Artificial
  CRISPR gRNA sequence
cttcttcctccagggcctgt

SEQ ID NO: 235099 - DNA, 20 bp, Artificial
  CRISPR gRNA sequence
ttcctccagggcctgtgggt

SEQ ID NO: 235100 - DNA, 20 bp, Artificial
  CRISPR gRNA sequence
tcctccagggcctgtgggtt

SEQ ID NO: 235101 - DNA, 20 bp, Artificial
  CRISPR gRNA sequence
tccagggcctgtgggttggg

SEQ ID NO: 235102 - DNA, 20 bp, Artificial
  CRISPR gRNA sequence
ccagggcctgtgggttggga

SEQ ID NO: 235103 - DNA, 20 bp, Artificial
  CRISPR gRNA sequence
cagggcctgtgggttgggaa

SEQ ID NO: 235104 - DNA, 20 bp, Artificial
  CRISPR gRNA sequence
gggcctgtgggttgggaagg

SEQ ID NO: 235105 - DNA, 20 bp, Artificial
  CRISPR gRNA sequence
ggcctgtgggttgggaaggg

SEQ ID NO: 235106 - DNA, 20 bp, Artificial
  CRISPR gRNA sequence
ttgggaagggaggctctgtc

SEQ ID NO: 235107 - DNA, 20 bp, Artificial
  CRISPR gRNA sequence
gggaagggaggctctgtccg

SEQ ID NO: 235108 - DNA, 20 bp, Artificial
  CRISPR gRNA sequence
ggaagggaggctctgtccgg

SEQ ID NO: 235109 - DNA, 20 bp, Artificial
  CRISPR gRNA sequence
ggaggctctgtccggaggcc

SEQ ID NO: 235110 - DNA, 20 bp, Artificial
  CRISPR gRNA sequence
ctctgtccggaggcccagtg

SEQ ID NO: 235111 - DNA, 20 bp, Artificial
  CRISPR gRNA sequence
gtccggaggcccagtgtggc

SEQ ID NO: 235112 - DNA, 20 bp, Artificial
  CRISPR gRNA sequence
cggaggcccagtgtggctgg

SEQ ID NO: 235113 - DNA, 20 bp, Artificial
  CRISPR gRNA sequence
aggcccagtgtggctggtgg

SEQ ID NO: 235114 - DNA, 20 bp, Artificial
  CRISPR gRNA sequence
ggcccagtgtggctggtggt

SEQ ID NO: 235115 - DNA, 20 bp, Artificial
  CRISPR gRNA sequence
gcccagtgtggctggtggtg

SEQ ID NO: 235116 - DNA, 20 bp, Artificial
  CRISPR gRNA sequence
agtgtggctggtggtgggga

SEQ ID NO: 235117 - DNA, 20 bp, Artificial
  CRISPR gRNA sequence
gtggctggtggtggggacag

SEQ ID NO: 235118 - DNA, 20 bp, Artificial
  CRISPR gRNA sequence
gtggtggggacagcagcgcc

SEQ ID NO: 235119 - DNA, 20 bp, Artificial
  CRISPR gRNA sequence
ggacagcagcgcccagacac

SEQ ID NO: 235120 - DNA, 20 bp, Artificial
  CRISPR gRNA sequence
gacagcagcgcccagacacc

SEQ ID NO: 235121 - DNA, 20 bp, Artificial
  CRISPR gRNA sequence
agcagcgcccagacaccagg

SEQ ID NO: 235122 - DNA, 20 bp, Artificial
  CRISPR gRNA sequence
gcagcgcccagacaccaggc

SEQ ID NO: 235123 - DNA, 20 bp, Artificial
  CRISPR gRNA sequence
gcgcccagacaccaggcagg

SEQ ID NO: 235124 - DNA, 20 bp, Artificial
  CRISPR gRNA sequence
acaccaggcaggcggcctct

SEQ ID NO: 235125 - DNA, 20 bp, Artificial
  CRISPR gRNA sequence
caccaggcaggcggcctctg

SEQ ID NO: 235126 - DNA, 20 bp, Artificial
  CRISPR gRNA sequence
ggcggcctctgaggtgtcga

SEQ ID NO: 235127 - DNA, 20 bp, Artificial
  CRISPR gRNA sequence
gcggcctctgaggtgtcgac

SEQ ID NO: 235128 - DNA, 20 bp, Artificial
  CRISPR gRNA sequence
ctgaggtgtcgacgggcctc

SEQ ID NO: 235129 - DNA, 20 bp, Artificial
  CRISPR gRNA sequence
tgaggtgtcgacgggcctcc

SEQ ID NO: 235130 - DNA, 20 bp, Artificial
  CRISPR gRNA sequence
gaggtgtcgacgggcctcca

SEQ ID NO: 235131 - DNA, 20 bp, Artificial
  CRISPR gRNA sequence
aggtgtcgacgggcctccag

SEQ ID NO: 235132 - DNA, 20 bp, Artificial
  CRISPR gRNA sequence
tccaggggactgtgcactgt

SEQ ID NO: 235133 - DNA, 20 bp, Artificial
  CRISPR gRNA sequence
ccaggggactgtgcactgtt

SEQ ID NO: 235134 - DNA, 20 bp, Artificial
  CRISPR gRNA sequence
caggggactgtgcactgttg

SEQ ID NO: 235135 - DNA, 20 bp, Artificial
  CRISPR gRNA sequence
aggggactgtgcactgttgg

SEQ ID NO: 235136 - DNA, 20 bp, Artificial
  CRISPR gRNA sequence
gcactgttgggggccacccc

SEQ ID NO: 235137 - DNA, 20 bp, Artificial
  CRISPR gRNA sequence
cactgttgggggccacccct

SEQ ID NO: 235138 - DNA, 20 bp, Artificial
  CRISPR gRNA sequence
ggggccacccctgggtcctg

SEQ ID NO: 235139 - DNA, 20 bp, Artificial
  CRISPR gRNA sequence
gggccacccctgggtcctgc

SEQ ID NO: 235140 - DNA, 20 bp, Artificial
  CRISPR gRNA sequence
ggccacccctgggtcctgca

SEQ ID NO: 235141 - DNA, 20 bp, Artificial
  CRISPR gRNA sequence
gccacccctgggtcctgcag

SEQ ID NO: 235142 - DNA, 20 bp, Artificial
  CRISPR gRNA sequence
acccctgggtcctgcagggg

SEQ ID NO: 235143 - DNA, 20 bp, Artificial
  CRISPR gRNA sequence
ggtcctgcaggggcagctcc

SEQ ID NO: 235144 - DNA, 20 bp, Artificial
  CRISPR gRNA sequence
gggcagctcctggttgcata

SEQ ID NO: 235145 - DNA, 20 bp, Artificial
  CRISPR gRNA sequence
gcagctcctggttgcatatg

SEQ ID NO: 235146 - DNA, 20 bp, Artificial
  CRISPR gRNA sequence
ctcctggttgcatatggagt

SEQ ID NO: 235147 - DNA, 20 bp, Artificial
  CRISPR gRNA sequence
ttgcatatggagttagcacc

SEQ ID NO: 235148 - DNA, 20 bp, Artificial
  CRISPR gRNA sequence
tgcatatggagttagcacct

SEQ ID NO: 235149 - DNA, 20 bp, Artificial
  CRISPR gRNA sequence
atatggagttagcacctggg

SEQ ID NO: 235150 - DNA, 20 bp, Artificial
  CRISPR gRNA sequence
tatggagttagcacctgggc

SEQ ID NO: 235151 - DNA, 20 bp, Artificial
  CRISPR gRNA sequence
atggagttagcacctgggca

SEQ ID NO: 235152 - DNA, 20 bp, Artificial
  CRISPR gRNA sequence
tggagttagcacctgggcag

SEQ ID NO: 235153 - DNA, 20 bp, Artificial
  CRISPR gRNA sequence
agttagcacctgggcagggg

SEQ ID NO: 235154 - DNA, 20 bp, Artificial
  CRISPR gRNA sequence
cacctgggcaggggcagctg

SEQ ID NO: 235155 - DNA, 20 bp, Artificial
  CRISPR gRNA sequence
acctgggcaggggcagctgt

SEQ ID NO: 235156 - DNA, 20 bp, Artificial
  CRISPR gRNA sequence
cctgggcaggggcagctgtg

SEQ ID NO: 235157 - DNA, 20 bp, Artificial
  CRISPR gRNA sequence
aggggcagctgtggggcgca

SEQ ID NO: 235158 - DNA, 20 bp, Artificial
  CRISPR gRNA sequence
ggggcagctgtggggcgcaa

SEQ ID NO: 235159 - DNA, 20 bp, Artificial
  CRISPR gRNA sequence
gggcagctgtggggcgcaaa

SEQ ID NO: 235160 - DNA, 20 bp, Artificial
  CRISPR gRNA sequence
ggcagctgtggggcgcaaag

SEQ ID NO: 235161 - DNA, 20 bp, Artificial
  CRISPR gRNA sequence
gcagctgtggggcgcaaagg

SEQ ID NO: 235162 - DNA, 20 bp, Artificial
  CRISPR gRNA sequence
agctgtggggcgcaaagggg

SEQ ID NO: 235163 - DNA, 20 bp, Artificial
  CRISPR gRNA sequence
tgtggggcgcaaagggggag

SEQ ID NO: 235164 - DNA, 20 bp, Artificial
  CRISPR gRNA sequence
gggcgcaaagggggagtagc

SEQ ID NO: 235165 - DNA, 20 bp, Artificial
  CRISPR gRNA sequence
ggcgcaaagggggagtagcc

SEQ ID NO: 235166 - DNA, 20 bp, Artificial
  CRISPR gRNA sequence
gggggagtagccaggccaca

SEQ ID NO: 235167 - DNA, 20 bp, Artificial
  CRISPR gRNA sequence
gtagccaggccacatggccc

SEQ ID NO: 235168 - DNA, 20 bp, Artificial
  CRISPR gRNA sequence
tagccaggccacatggcccc

SEQ ID NO: 235169 - DNA, 20 bp, Artificial
  CRISPR gRNA sequence
gccaggccacatggccccag

SEQ ID NO: 235170 - DNA, 20 bp, Artificial
  CRISPR gRNA sequence
ggccacatggccccaggaga

SEQ ID NO: 235171 - DNA, 20 bp, Artificial
  CRISPR gRNA sequence
ccacatggccccaggagaaa

SEQ ID NO: 235172 - DNA, 20 bp, Artificial
  CRISPR gRNA sequence
atggccccaggagaaagaga

SEQ ID NO: 235173 - DNA, 20 bp, Artificial
  CRISPR gRNA sequence
ccccaggagaaagagacagc

SEQ ID NO: 235174 - DNA, 20 bp, Artificial
  CRISPR gRNA sequence
aagagacagctggataaacc

SEQ ID NO: 235175 - DNA, 20 bp, Artificial
  CRISPR gRNA sequence
agagacagctggataaaccc

SEQ ID NO: 235176 - DNA, 20 bp, Artificial
  CRISPR gRNA sequence
gagacagctggataaaccca

SEQ ID NO: 235177 - DNA, 20 bp, Artificial
  CRISPR gRNA sequence
agctggataaacccagggtc

SEQ ID NO: 235178 - DNA, 20 bp, Artificial
  CRISPR gRNA sequence
aaacccagggtccagactcc

SEQ ID NO: 235179 - DNA, 20 bp, Artificial
  CRISPR gRNA sequence
ccagggtccagactcccagc

SEQ ID NO: 235180 - DNA, 20 bp, Artificial
  CRISPR gRNA sequence
cagggtccagactcccagcc

SEQ ID NO: 235181 - DNA, 20 bp, Artificial
  CRISPR gRNA sequence
gggtccagactcccagccag

SEQ ID NO: 235182 - DNA, 20 bp, Artificial
  CRISPR gRNA sequence
gccaggagccctctgctccc

SEQ ID NO: 235183 - DNA, 20 bp, Artificial
  CRISPR gRNA sequence
caggagccctctgctccctg

SEQ ID NO: 235184 - DNA, 20 bp, Artificial
  CRISPR gRNA sequence
ctgctccctggagccaactg

SEQ ID NO: 235185 - DNA, 20 bp, Artificial
  CRISPR gRNA sequence
tgctccctggagccaactgt

SEQ ID NO: 235186 - DNA, 20 bp, Artificial
  CRISPR gRNA sequence
tccctggagccaactgtggg

SEQ ID NO: 235187 - DNA, 20 bp, Artificial
  CRISPR gRNA sequence
cctggagccaactgtgggtg

SEQ ID NO: 235188 - DNA, 20 bp, Artificial
  CRISPR gRNA sequence
agccaactgtgggtggagaa

SEQ ID NO: 235189 - DNA, 20 bp, Artificial
  CRISPR gRNA sequence
aacggacaacctcactcccc

SEQ ID NO: 235190 - DNA, 20 bp, Artificial
  CRISPR gRNA sequence
cggacaacctcactcccctg

SEQ ID NO: 235191 - DNA, 20 bp, Artificial
  CRISPR gRNA sequence
ggacaacctcactcccctgg

SEQ ID NO: 235192 - DNA, 20 bp, Artificial
  CRISPR gRNA sequence
gacaacctcactcccctgga

SEQ ID NO: 235193 - DNA, 20 bp, Artificial
  CRISPR gRNA sequence
cctcactcccctggagggcc

SEQ ID NO: 235194 - DNA, 20 bp, Artificial
  CRISPR gRNA sequence
ctcactcccctggagggccg

SEQ ID NO: 235195 - DNA, 20 bp, Artificial
  CRISPR gRNA sequence
tcactcccctggagggccga

SEQ ID NO: 235196 - DNA, 20 bp, Artificial
  CRISPR gRNA sequence
cactcccctggagggccgag

SEQ ID NO: 235197 - DNA, 20 bp, Artificial
  CRISPR gRNA sequence
ctcccctggagggccgaggg

SEQ ID NO: 235198 - DNA, 20 bp, Artificial
  CRISPR gRNA sequence
tcccctggagggccgagggg

SEQ ID NO: 235199 - DNA, 20 bp, Artificial
  CRISPR gRNA sequence
tggagggccgaggggaggcc

SEQ ID NO: 235200 - DNA, 20 bp, Artificial
  CRISPR gRNA sequence
ggagggccgaggggaggcct

SEQ ID NO: 235201 - DNA, 20 bp, Artificial
  CRISPR gRNA sequence
gagggccgaggggaggcctg

SEQ ID NO: 235202 - DNA, 20 bp, Artificial
  CRISPR gRNA sequence
gggccgaggggaggcctggg

SEQ ID NO: 235203 - DNA, 20 bp, Artificial
  CRISPR gRNA sequence
ggccgaggggaggcctgggg

SEQ ID NO: 235204 - DNA, 20 bp, Artificial
  CRISPR gRNA sequence
ccgaggggaggcctggggag

SEQ ID NO: 235205 - DNA, 20 bp, Artificial
  CRISPR gRNA sequence
cgaggggaggcctggggagg

SEQ ID NO: 235206 - DNA, 20 bp, Artificial
  CRISPR gRNA sequence
gaggggaggcctggggagga

SEQ ID NO: 235207 - DNA, 20 bp, Artificial
  CRISPR gRNA sequence
aggggaggcctggggaggag

SEQ ID NO: 235208 - DNA, 20 bp, Artificial
  CRISPR gRNA sequence
ggggaggcctggggaggagg

SEQ ID NO: 235209 - DNA, 20 bp, Artificial
  CRISPR gRNA sequence
gcctggggaggagggggcct

SEQ ID NO: 235210 - DNA, 20 bp, Artificial
  CRISPR gRNA sequence
gggaggagggggcctcagcc

SEQ ID NO: 235211 - DNA, 20 bp, Artificial
  CRISPR gRNA sequence
gggggcctcagcccagctgc

SEQ ID NO: 235212 - DNA, 20 bp, Artificial
  CRISPR gRNA sequence
ggggcctcagcccagctgct

SEQ ID NO: 235213 - DNA, 20 bp, Artificial
  CRISPR gRNA sequence
gggcctcagcccagctgctg

SEQ ID NO: 235214 - DNA, 20 bp, Artificial
  CRISPR gRNA sequence
ggcctcagcccagctgctgg

SEQ ID NO: 235215 - DNA, 20 bp, Artificial
  CRISPR gRNA sequence
gcctcagcccagctgctggg

SEQ ID NO: 235216 - DNA, 20 bp, Artificial
  CRISPR gRNA sequence
cagcccagctgctggggggc

SEQ ID NO: 235217 - DNA, 20 bp, Artificial
  CRISPR gRNA sequence
gggctggcctgtctcctgcc

SEQ ID NO: 235218 - DNA, 20 bp, Artificial
  CRISPR gRNA sequence
ggctggcctgtctcctgccc

SEQ ID NO: 235219 - DNA, 20 bp, Artificial
  CRISPR gRNA sequence
ggcctgtctcctgcccaggc

SEQ ID NO: 235220 - DNA, 20 bp, Artificial
  CRISPR gRNA sequence
gcctgtctcctgcccaggcg

SEQ ID NO: 235221 - DNA, 20 bp, Artificial
  CRISPR gRNA sequence
ctgtctcctgcccaggcgag

SEQ ID NO: 235222 - DNA, 20 bp, Artificial
  CRISPR gRNA sequence
caggcgaggagtgctgttcc

SEQ ID NO: 235223 - DNA, 20 bp, Artificial
  CRISPR gRNA sequence
gcgaggagtgctgttccgag

SEQ ID NO: 235224 - DNA, 20 bp, Artificial
  CRISPR gRNA sequence
cgaggagtgctgttccgagt

SEQ ID NO: 235225 - DNA, 20 bp, Artificial
  CRISPR gRNA sequence
agtgggactgcatgtgtgtc

SEQ ID NO: 235226 - DNA, 20 bp, Artificial
  CRISPR gRNA sequence
gtccagcctgaattccactg

SEQ ID NO: 235227 - DNA, 20 bp, Artificial
  CRISPR gRNA sequence
ccagcctgaattccactgcg

SEQ ID NO: 235228 - DNA, 20 bp, Artificial
  CRISPR gRNA sequence
acccttgctgcacgacctgc

SEQ ID NO: 235229 - DNA, 20 bp, Artificial
  CRISPR gRNA sequence
ccggcaccacccttgtcccc

SEQ ID NO: 235230 - DNA, 20 bp, Artificial
  CRISPR gRNA sequence
cggcaccacccttgtccccc

SEQ ID NO: 235231 - DNA, 20 bp, Artificial
  CRISPR gRNA sequence
accacccttgtcccccaggc

SEQ ID NO: 235232 - DNA, 20 bp, Artificial
  CRISPR gRNA sequence
ccacccttgtcccccaggcc

SEQ ID NO: 235233 - DNA, 20 bp, Artificial
  CRISPR gRNA sequence
cacccttgtcccccaggcca

SEQ ID NO: 235234 - DNA, 20 bp, Artificial
  CRISPR gRNA sequence
acccttgtcccccaggccag

SEQ ID NO: 235235 - DNA, 20 bp, Artificial
  CRISPR gRNA sequence
cccttgtcccccaggccagg

SEQ ID NO: 235236 - DNA, 20 bp, Artificial
  CRISPR gRNA sequence
gtcccccaggccagggggta

SEQ ID NO: 235237 - DNA, 20 bp, Artificial
  CRISPR gRNA sequence
caggccagggggtacagtcc

SEQ ID NO: 235238 - DNA, 20 bp, Artificial
  CRISPR gRNA sequence
aggccagggggtacagtccc

SEQ ID NO: 235239 - DNA, 20 bp, Artificial
  CRISPR gRNA sequence
ggccagggggtacagtccca

SEQ ID NO: 235240 - DNA, 20 bp, Artificial
  CRISPR gRNA sequence
agggggtacagtcccagggt

SEQ ID NO: 235241 - DNA, 20 bp, Artificial
  CRISPR gRNA sequence
tacagtcccagggtaagtcc

SEQ ID NO: 235242 - DNA, 20 bp, Artificial
  CRISPR gRNA sequence
cagtcccagggtaagtcctg

SEQ ID NO: 235243 - DNA, 20 bp, Artificial
  CRISPR gRNA sequence
agtcccagggtaagtcctgg

SEQ ID NO: 235244 - DNA, 20 bp, Artificial
  CRISPR gRNA sequence
gtaagtcctggaggtgcctc

SEQ ID NO: 235245 - DNA, 20 bp, Artificial
  CRISPR gRNA sequence
taagtcctggaggtgcctct

SEQ ID NO: 235246 - DNA, 20 bp, Artificial
  CRISPR gRNA sequence
agtcctggaggtgcctctgg

SEQ ID NO: 235247 - DNA, 20 bp, Artificial
  CRISPR gRNA sequence
ggtgcctctgggagtccaca

SEQ ID NO: 235248 - DNA, 20 bp, Artificial
  CRISPR gRNA sequence
gtgcctctgggagtccacac

SEQ ID NO: 235249 - DNA, 20 bp, Artificial
  CRISPR gRNA sequence
ctctgggagtccacacaggc

SEQ ID NO: 235250 - DNA, 20 bp, Artificial
  CRISPR gRNA sequence
tctgggagtccacacaggcc

SEQ ID NO: 235251 - DNA, 20 bp, Artificial
  CRISPR gRNA sequence
ctgggagtccacacaggcca

SEQ ID NO: 235252 - DNA, 20 bp, Artificial
  CRISPR gRNA sequence
tgggagtccacacaggccag

SEQ ID NO: 235253 - DNA, 20 bp, Artificial
  CRISPR gRNA sequence
acacaggccaggggttccac

SEQ ID NO: 235254 - DNA, 20 bp, Artificial
  CRISPR gRNA sequence
cacaggccaggggttccact

SEQ ID NO: 235255 - DNA, 20 bp, Artificial
  CRISPR gRNA sequence
acaggccaggggttccacta

SEQ ID NO: 235256 - DNA, 20 bp, Artificial
  CRISPR gRNA sequence
caggggttccactagggccc

SEQ ID NO: 235257 - DNA, 20 bp, Artificial
  CRISPR gRNA sequence
aggggttccactagggcccg

SEQ ID NO: 235258 - DNA, 20 bp, Artificial
  CRISPR gRNA sequence
ggttccactagggcccgagg

SEQ ID NO: 235259 - DNA, 20 bp, Artificial
  CRISPR gRNA sequence
ttccactagggcccgaggca

SEQ ID NO: 235260 - DNA, 20 bp, Artificial
  CRISPR gRNA sequence
agggcccgaggcagagctcg

SEQ ID NO: 235261 - DNA, 20 bp, Artificial
  CRISPR gRNA sequence
gggcccgaggcagagctcgt

SEQ ID NO: 235262 - DNA, 20 bp, Artificial
  CRISPR gRNA sequence
cgaggcagagctcgtgggca

SEQ ID NO: 235263 - DNA, 20 bp, Artificial
  CRISPR gRNA sequence
gaggcagagctcgtgggcac

SEQ ID NO: 235264 - DNA, 20 bp, Artificial
  CRISPR gRNA sequence
agctcgtgggcacaggtgtc

SEQ ID NO: 235265 - DNA, 20 bp, Artificial
  CRISPR gRNA sequence
cgtgggcacaggtgtccggc

SEQ ID NO: 235266 - DNA, 20 bp, Artificial
  CRISPR gRNA sequence
gtgggcacaggtgtccggcg

SEQ ID NO: 235267 - DNA, 20 bp, Artificial
  CRISPR gRNA sequence
aggtgtccggcgaggacatg

SEQ ID NO: 235268 - DNA, 20 bp, Artificial
  CRISPR gRNA sequence
cggcgaggacatgtggtgtg

SEQ ID NO: 235269 - DNA, 20 bp, Artificial
  CRISPR gRNA sequence
ggcgaggacatgtggtgtgt

SEQ ID NO: 235270 - DNA, 20 bp, Artificial
  CRISPR gRNA sequence
gcgaggacatgtggtgtgtg

SEQ ID NO: 235271 - DNA, 20 bp, Artificial
  CRISPR gRNA sequence
gacatgtggtgtgtggggtc

SEQ ID NO: 235272 - DNA, 20 bp, Artificial
  CRISPR gRNA sequence
catgtggtgtgtggggtccg

SEQ ID NO: 235273 - DNA, 20 bp, Artificial
  CRISPR gRNA sequence
tgtggggtccggagtcctgt

SEQ ID NO: 235274 - DNA, 20 bp, Artificial
  CRISPR gRNA sequence
gtggggtccggagtcctgtg

SEQ ID NO: 235275 - DNA, 20 bp, Artificial
  CRISPR gRNA sequence
ggtccggagtcctgtgaggc

SEQ ID NO: 235276 - DNA, 20 bp, Artificial
  CRISPR gRNA sequence
gtccggagtcctgtgaggcc

SEQ ID NO: 235277 - DNA, 20 bp, Artificial
  CRISPR gRNA sequence
cggagtcctgtgaggccggg

SEQ ID NO: 235278 - DNA, 20 bp, Artificial
  CRISPR gRNA sequence
ggagtcctgtgaggccgggc

SEQ ID NO: 235279 - DNA, 20 bp, Artificial
  CRISPR gRNA sequence
tcctgtgaggccgggcaggc

SEQ ID NO: 235280 - DNA, 20 bp, Artificial
  CRISPR gRNA sequence
cctgtgaggccgggcaggcc

SEQ ID NO: 235281 - DNA, 20 bp, Artificial
  CRISPR gRNA sequence
cgggcaggccaggccatgct

SEQ ID NO: 235282 - DNA, 20 bp, Artificial
  CRISPR gRNA sequence
gggcaggccaggccatgctc

SEQ ID NO: 235283 - DNA, 20 bp, Artificial
  CRISPR gRNA sequence
caggccatgctcaggcacca

SEQ ID NO: 235284 - DNA, 20 bp, Artificial
  CRISPR gRNA sequence
aggccatgctcaggcaccac

SEQ ID NO: 235285 - DNA, 20 bp, Artificial
  CRISPR gRNA sequence
ctcaggcaccacaggccatg

SEQ ID NO: 235286 - DNA, 20 bp, Artificial
  CRISPR gRNA sequence
caccacaggccatgaagctc

SEQ ID NO: 235287 - DNA, 20 bp, Artificial
  CRISPR gRNA sequence
accacaggccatgaagctct

SEQ ID NO: 235288 - DNA, 20 bp, Artificial
  CRISPR gRNA sequence
ccacaggccatgaagctctg

SEQ ID NO: 235289 - DNA, 20 bp, Artificial
  CRISPR gRNA sequence
cacaggccatgaagctctgg

SEQ ID NO: 235290 - DNA, 20 bp, Artificial
  CRISPR gRNA sequence
gtgtcctgtccctgctttct

SEQ ID NO: 235291 - DNA, 20 bp, Artificial
  CRISPR gRNA sequence
ctgtccctgctttctcagcc

SEQ ID NO: 235292 - DNA, 20 bp, Artificial
  CRISPR gRNA sequence
tgtccctgctttctcagcct

SEQ ID NO: 235293 - DNA, 20 bp, Artificial
  CRISPR gRNA sequence
tcagcctgggcttctccatc

SEQ ID NO: 235294 - DNA, 20 bp, Artificial
  CRISPR gRNA sequence
tgggcttctccatccagcac

SEQ ID NO: 235295 - DNA, 20 bp, Artificial
  CRISPR gRNA sequence
gggcttctccatccagcacg

SEQ ID NO: 235296 - DNA, 20 bp, Artificial
  CRISPR gRNA sequence
ggcttctccatccagcacga

SEQ ID NO: 235297 - DNA, 20 bp, Artificial
  CRISPR gRNA sequence
ccatccagcacgagggctgt

SEQ ID NO: 235298 - DNA, 20 bp, Artificial
  CRISPR gRNA sequence
cgagggctgtgagaaccctg

SEQ ID NO: 235299 - DNA, 20 bp, Artificial
  CRISPR gRNA sequence
gagggctgtgagaaccctgc

SEQ ID NO: 235300 - DNA, 20 bp, Artificial
  CRISPR gRNA sequence
agggctgtgagaaccctgcg

SEQ ID NO: 235301 - DNA, 20 bp, Artificial
  CRISPR gRNA sequence
ggctgtgagaaccctgcggg

SEQ ID NO: 235302 - DNA, 20 bp, Artificial
  CRISPR gRNA sequence
gctgtgagaaccctgcgggg

SEQ ID NO: 235303 - DNA, 20 bp, Artificial
  CRISPR gRNA sequence
gtgagaaccctgcggggagg

SEQ ID NO: 235304 - DNA, 20 bp, Artificial
  CRISPR gRNA sequence
tgagaaccctgcggggaggt

SEQ ID NO: 235305 - DNA, 20 bp, Artificial
  CRISPR gRNA sequence
gagaaccctgcggggaggtg

SEQ ID NO: 235306 - DNA, 20 bp, Artificial
  CRISPR gRNA sequence
agaaccctgcggggaggtgg

SEQ ID NO: 235307 - DNA, 20 bp, Artificial
  CRISPR gRNA sequence
accctgcggggaggtggggg

SEQ ID NO: 235308 - DNA, 20 bp, Artificial
  CRISPR gRNA sequence
ccctgcggggaggtgggggc

SEQ ID NO: 235309 - DNA, 20 bp, Artificial
  CRISPR gRNA sequence
ggggaggtgggggcgggttc

SEQ ID NO: 235310 - DNA, 20 bp, Artificial
  CRISPR gRNA sequence
gggaggtgggggcgggttcc

SEQ ID NO: 235311 - DNA, 20 bp, Artificial
  CRISPR gRNA sequence
gaggtgggggcgggttccag

SEQ ID NO: 235312 - DNA, 20 bp, Artificial
  CRISPR gRNA sequence
ggcgggttccaggagctgtc

SEQ ID NO: 235313 - DNA, 20 bp, Artificial
  CRISPR gRNA sequence
tccaggagctgtctggctct

SEQ ID NO: 235314 - DNA, 20 bp, Artificial
  CRISPR gRNA sequence
ccaggagctgtctggctctc

SEQ ID NO: 235315 - DNA, 20 bp, Artificial
  CRISPR gRNA sequence
agctgtctggctctcaggcc

SEQ ID NO: 235316 - DNA, 20 bp, Artificial
  CRISPR gRNA sequence
gctgtctggctctcaggccc

SEQ ID NO: 235317 - DNA, 20 bp, Artificial
  CRISPR gRNA sequence
ctgtcctcaccacatactga

SEQ ID NO: 235318 - DNA, 20 bp, Artificial
  CRISPR gRNA sequence
gtcctcaccacatactgaaa

SEQ ID NO: 235319 - DNA, 20 bp, Artificial
  CRISPR gRNA sequence
agagcctgccctgtgccccc

SEQ ID NO: 235320 - DNA, 20 bp, Artificial
  CRISPR gRNA sequence
agcctgccctgtgccccccg

SEQ ID NO: 235321 - DNA, 20 bp, Artificial
  CRISPR gRNA sequence
gtgccccccggagtcctgtc

SEQ ID NO: 235322 - DNA, 20 bp, Artificial
  CRISPR gRNA sequence
tgccccccggagtcctgtct

SEQ ID NO: 235323 - DNA, 20 bp, Artificial
  CRISPR gRNA sequence
gccccccggagtcctgtctg

SEQ ID NO: 235324 - DNA, 20 bp, Artificial
  CRISPR gRNA sequence
ccggagtcctgtctggggcc

SEQ ID NO: 235325 - DNA, 20 bp, Artificial
  CRISPR gRNA sequence
cggagtcctgtctggggcct

SEQ ID NO: 235326 - DNA, 20 bp, Artificial
  CRISPR gRNA sequence
ggagtcctgtctggggcctg

SEQ ID NO: 235327 - DNA, 20 bp, Artificial
  CRISPR gRNA sequence
cctggggctgcaccctgttc

SEQ ID NO: 235328 - DNA, 20 bp, Artificial
  CRISPR gRNA sequence
ggggctgcaccctgttctgg

SEQ ID NO: 235329 - DNA, 20 bp, Artificial
  CRISPR gRNA sequence
gggctgcaccctgttctgga

SEQ ID NO: 235330 - DNA, 20 bp, Artificial
  CRISPR gRNA sequence
gctgcaccctgttctggaag

SEQ ID NO: 235331 - DNA, 20 bp, Artificial
  CRISPR gRNA sequence
gcaccctgttctggaaggag

SEQ ID NO: 235332 - DNA, 20 bp, Artificial
  CRISPR gRNA sequence
tgttctggaaggagcagctc

SEQ ID NO: 235333 - DNA, 20 bp, Artificial
  CRISPR gRNA sequence
aggagcagctcaagtcctct

SEQ ID NO: 235334 - DNA, 20 bp, Artificial
  CRISPR gRNA sequence
agcagctcaagtcctcttag

SEQ ID NO: 235335 - DNA, 20 bp, Artificial
  CRISPR gRNA sequence
ttagcggcttgtttacctga

SEQ ID NO: 235336 - DNA, 20 bp, Artificial
  CRISPR gRNA sequence
tagcggcttgtttacctgac

SEQ ID NO: 235337 - DNA, 20 bp, Artificial
  CRISPR gRNA sequence
gcggcttgtttacctgacag

SEQ ID NO: 235338 - DNA, 20 bp, Artificial
  CRISPR gRNA sequence
ggcttgtttacctgacagga

SEQ ID NO: 235339 - DNA, 20 bp, Artificial
  CRISPR gRNA sequence
gcttgtttacctgacaggag

SEQ ID NO: 235340 - DNA, 20 bp, Artificial
  CRISPR gRNA sequence
gtttacctgacaggagaggt

SEQ ID NO: 235341 - DNA, 20 bp, Artificial
  CRISPR gRNA sequence
tttacctgacaggagaggtc

SEQ ID NO: 235342 - DNA, 20 bp, Artificial
  CRISPR gRNA sequence
cctgacaggagaggtcaggc

SEQ ID NO: 235343 - DNA, 20 bp, Artificial
  CRISPR gRNA sequence
ctgacaggagaggtcaggct

SEQ ID NO: 235344 - DNA, 20 bp, Artificial
  CRISPR gRNA sequence
agaggtcaggctgggcacat

SEQ ID NO: 235345 - DNA, 20 bp, Artificial
  CRISPR gRNA sequence
aggtcaggctgggcacatga

SEQ ID NO: 235346 - DNA, 20 bp, Artificial
  CRISPR gRNA sequence
caggctgggcacatgagagc

SEQ ID NO: 235347 - DNA, 20 bp, Artificial
  CRISPR gRNA sequence
aggctgggcacatgagagct

SEQ ID NO: 235348 - DNA, 20 bp, Artificial
  CRISPR gRNA sequence
gctgggcacatgagagctgg

SEQ ID NO: 235349 - DNA, 20 bp, Artificial
  CRISPR gRNA sequence
gggcacatgagagctgggag

SEQ ID NO: 235350 - DNA, 20 bp, Artificial
  CRISPR gRNA sequence
ggcacatgagagctgggaga

SEQ ID NO: 235351 - DNA, 20 bp, Artificial
  CRISPR gRNA sequence
gagctgggagaaggtacaac

SEQ ID NO: 235352 - DNA, 20 bp, Artificial
  CRISPR gRNA sequence
agctgggagaaggtacaact

SEQ ID NO: 235353 - DNA, 20 bp, Artificial
  CRISPR gRNA sequence
gctgggagaaggtacaactg

SEQ ID NO: 235354 - DNA, 20 bp, Artificial
  CRISPR gRNA sequence
tgggagaaggtacaactggg

SEQ ID NO: 235355 - DNA, 20 bp, Artificial
  CRISPR gRNA sequence
gggagaaggtacaactgggg

SEQ ID NO: 235356 - DNA, 20 bp, Artificial
  CRISPR gRNA sequence
tacaactggggaggttgtgt

SEQ ID NO: 235357 - DNA, 20 bp, Artificial
  CRISPR gRNA sequence
acaactggggaggttgtgtc

SEQ ID NO: 235358 - DNA, 20 bp, Artificial
  CRISPR gRNA sequence
ctggggaggttgtgtcaggt

SEQ ID NO: 235359 - DNA, 20 bp, Artificial
  CRISPR gRNA sequence
ggaggttgtgtcaggttgga

SEQ ID NO: 235360 - DNA, 20 bp, Artificial
  CRISPR gRNA sequence
gaggttgtgtcaggttggac

SEQ ID NO: 235361 - DNA, 20 bp, Artificial
  CRISPR gRNA sequence
aggttgtgtcaggttggacg

SEQ ID NO: 235362 - DNA, 20 bp, Artificial
  CRISPR gRNA sequence
ttgtgtcaggttggacgggg

SEQ ID NO: 235363 - DNA, 20 bp, Artificial
  CRISPR gRNA sequence
tgtgtcaggttggacggggc

SEQ ID NO: 235364 - DNA, 20 bp, Artificial
  CRISPR gRNA sequence
gtgtcaggttggacggggca

SEQ ID NO: 235365 - DNA, 20 bp, Artificial
  CRISPR gRNA sequence
aggttggacggggcagggtc

SEQ ID NO: 235366 - DNA, 20 bp, Artificial
  CRISPR gRNA sequence
ggttggacggggcagggtct

SEQ ID NO: 235367 - DNA, 20 bp, Artificial
  CRISPR gRNA sequence
gttggacggggcagggtctg

SEQ ID NO: 235368 - DNA, 20 bp, Artificial
  CRISPR gRNA sequence
gggcagggtctggggtcaac

SEQ ID NO: 235369 - DNA, 20 bp, Artificial
  CRISPR gRNA sequence
ggcagggtctggggtcaact

SEQ ID NO: 235370 - DNA, 20 bp, Artificial
  CRISPR gRNA sequence
gtctggggtcaactgggacc

SEQ ID NO: 235371 - DNA, 20 bp, Artificial
  CRISPR gRNA sequence
ggacccagcctcactctctc

SEQ ID NO: 235372 - DNA, 20 bp, Artificial
  CRISPR gRNA sequence
gacccagcctcactctctct

SEQ ID NO: 235373 - DNA, 20 bp, Artificial
  CRISPR gRNA sequence
ttctccaccctctgttctac

SEQ ID NO: 235374 - DNA, 20 bp, Artificial
  CRISPR gRNA sequence
tctccaccctctgttctact

SEQ ID NO: 235375 - DNA, 20 bp, Artificial
  CRISPR gRNA sequence
ctgttctactgggtcctgcc

SEQ ID NO: 235376 - DNA, 20 bp, Artificial
  CRISPR gRNA sequence
gcctggcttctgcccaccct

SEQ ID NO: 235377 - DNA, 20 bp, Artificial
  CRISPR gRNA sequence
tgcccaccctcagcccccaa

SEQ ID NO: 235378 - DNA, 20 bp, Artificial
  CRISPR gRNA sequence
gcccaccctcagcccccaat

SEQ ID NO: 235379 - DNA, 20 bp, Artificial
  CRISPR gRNA sequence
caccctcagcccccaatggg

SEQ ID NO: 235380 - DNA, 20 bp, Artificial
  CRISPR gRNA sequence
accctcagcccccaatgggc

SEQ ID NO: 235381 - DNA, 20 bp, Artificial
  CRISPR gRNA sequence
gggcaggcctttcccctccc

SEQ ID NO: 235382 - DNA, 20 bp, Artificial
  CRISPR gRNA sequence
caggcctttcccctccctgg

SEQ ID NO: 235383 - DNA, 20 bp, Artificial
  CRISPR gRNA sequence
aggcctttcccctccctggc

SEQ ID NO: 235384 - DNA, 20 bp, Artificial
  CRISPR gRNA sequence
tgcactctgcgcacctcccc

SEQ ID NO: 235385 - DNA, 20 bp, Artificial
  CRISPR gRNA sequence
gcactctgcgcacctccccc

SEQ ID NO: 235386 - DNA, 20 bp, Artificial
  CRISPR gRNA sequence
cctcccccaggtgccctcac

SEQ ID NO: 235387 - DNA, 20 bp, Artificial
  CRISPR gRNA sequence
ctcccccaggtgccctcact

SEQ ID NO: 235388 - DNA, 20 bp, Artificial
  CRISPR gRNA sequence
gccctcactgggccccaccc

SEQ ID NO: 235389 - DNA, 20 bp, Artificial
  CRISPR gRNA sequence
cccaccccagacgccccacc

SEQ ID NO: 235390 - DNA, 20 bp, Artificial
  CRISPR gRNA sequence
ccaccccagacgccccacct

SEQ ID NO: 235391 - DNA, 20 bp, Artificial
  CRISPR gRNA sequence
cccagacgccccacctggga

SEQ ID NO: 235392 - DNA, 20 bp, Artificial
  CRISPR gRNA sequence
ccagacgccccacctgggac

SEQ ID NO: 235393 - DNA, 20 bp, Artificial
  CRISPR gRNA sequence
gacgccccacctgggacggg

SEQ ID NO: 235394 - DNA, 20 bp, Artificial
  CRISPR gRNA sequence
ccacctgggacgggcagaca

SEQ ID NO: 235395 - DNA, 20 bp, Artificial
  CRISPR gRNA sequence
cacctgggacgggcagacat

SEQ ID NO: 235396 - DNA, 20 bp, Artificial
  CRISPR gRNA sequence
ggacgggcagacatgggccc

SEQ ID NO: 235397 - DNA, 20 bp, Artificial
  CRISPR gRNA sequence
gcagacatgggccccagtcc

SEQ ID NO: 235398 - DNA, 20 bp, Artificial
  CRISPR gRNA sequence
cagacatgggccccagtcct

SEQ ID NO: 235399 - DNA, 20 bp, Artificial
  CRISPR gRNA sequence
ggccccagtcctgggccatg

SEQ ID NO: 235400 - DNA, 20 bp, Artificial
  CRISPR gRNA sequence
ccatgaagaactctgttgaa

SEQ ID NO: 235401 - DNA, 20 bp, Artificial
  CRISPR gRNA sequence
gaactctgttgaatggatga

SEQ ID NO: 235402 - DNA, 20 bp, Artificial
  CRISPR gRNA sequence
aactctgttgaatggatgat

SEQ ID NO: 235403 - DNA, 20 bp, Artificial
  CRISPR gRNA sequence
actctgttgaatggatgatg

SEQ ID NO: 235404 - DNA, 20 bp, Artificial
  CRISPR gRNA sequence
ctctgttgaatggatgatgg

SEQ ID NO: 235405 - DNA, 20 bp, Artificial
  CRISPR gRNA sequence
tctgttgaatggatgatggg

SEQ ID NO: 235406 - DNA, 20 bp, Artificial
  CRISPR gRNA sequence
ctgttgaatggatgatgggg

SEQ ID NO: 235407 - DNA, 20 bp, Artificial
  CRISPR gRNA sequence
tgttgaatggatgatggggg

SEQ ID NO: 235408 - DNA, 20 bp, Artificial
  CRISPR gRNA sequence
gatggggggggcattctact

SEQ ID NO: 235409 - DNA, 20 bp, Artificial
  CRISPR gRNA sequence
ggggcattctactcagcacc

SEQ ID NO: 235410 - DNA, 20 bp, Artificial
  CRISPR gRNA sequence
tctactcagcacccagaccc

SEQ ID NO: 235411 - DNA, 20 bp, Artificial
  CRISPR gRNA sequence
ctcagcacccagaccccaga

SEQ ID NO: 235412 - DNA, 20 bp, Artificial
  CRISPR gRNA sequence
ccccagatggacccctgcac

SEQ ID NO: 235413 - DNA, 20 bp, Artificial
  CRISPR gRNA sequence
gacgccctcctcatccatcc

SEQ ID NO: 235414 - DNA, 20 bp, Artificial
  CRISPR gRNA sequence
atccatcccagcaactccac

SEQ ID NO: 235415 - DNA, 20 bp, Artificial
  CRISPR gRNA sequence
cctccccccacaccccacac

SEQ ID NO: 235416 - DNA, 20 bp, Artificial
  CRISPR gRNA sequence
ctccccccacaccccacacc

SEQ ID NO: 235417 - DNA, 20 bp, Artificial
  CRISPR gRNA sequence
tccccccacaccccacacca

SEQ ID NO: 235418 - DNA, 20 bp, Artificial
  CRISPR gRNA sequence
caccccacaccagggaaatt

SEQ ID NO: 235419 - DNA, 20 bp, Artificial
  CRISPR gRNA sequence
acaccagggaaattcagttt

SEQ ID NO: 235420 - DNA, 20 bp, Artificial
  CRISPR gRNA sequence
ggaaattcagttttggcttc

SEQ ID NO: 235421 - DNA, 20 bp, Artificial
  CRISPR gRNA sequence
ccagtgtatcgactgtgcct

SEQ ID NO: 235422 - DNA, 20 bp, Artificial
  CRISPR gRNA sequence
cagtgtatcgactgtgcctc

SEQ ID NO: 235423 - DNA, 20 bp, Artificial
  CRISPR gRNA sequence
agtgtatcgactgtgcctcg

SEQ ID NO: 235424 - DNA, 20 bp, Artificial
  CRISPR gRNA sequence
tgtgcctcggggaccttctc

SEQ ID NO: 235425 - DNA, 20 bp, Artificial
  CRISPR gRNA sequence
gtgcctcggggaccttctcc

SEQ ID NO: 235426 - DNA, 20 bp, Artificial
  CRISPR gRNA sequence
tgcctcggggaccttctccg

SEQ ID NO: 235427 - DNA, 20 bp, Artificial
  CRISPR gRNA sequence
gcctcggggaccttctccgg

SEQ ID NO: 235428 - DNA, 20 bp, Artificial
  CRISPR gRNA sequence
gaccttctccgggggccacg

SEQ ID NO: 235429 - DNA, 20 bp, Artificial
  CRISPR gRNA sequence
accttctccgggggccacga

SEQ ID NO: 235430 - DNA, 20 bp, Artificial
  CRISPR gRNA sequence
acgaaggccactgcaaacct

SEQ ID NO: 235431 - DNA, 20 bp, Artificial
  CRISPR gRNA sequence
aggccactgcaaaccttgga

SEQ ID NO: 235432 - DNA, 20 bp, Artificial
  CRISPR gRNA sequence
gccactgcaaaccttggaca

SEQ ID NO: 235433 - DNA, 20 bp, Artificial
  CRISPR gRNA sequence
ctgcaaaccttggacagagt

SEQ ID NO: 235434 - DNA, 20 bp, Artificial
  CRISPR gRNA sequence
accttggacagagtgagtcc

SEQ ID NO: 235435 - DNA, 20 bp, Artificial
  CRISPR gRNA sequence
ccttggacagagtgagtcct

SEQ ID NO: 235436 - DNA, 20 bp, Artificial
  CRISPR gRNA sequence
tggacagagtgagtcctggg

SEQ ID NO: 235437 - DNA, 20 bp, Artificial
  CRISPR gRNA sequence
ggacagagtgagtcctgggt

SEQ ID NO: 235438 - DNA, 20 bp, Artificial
  CRISPR gRNA sequence
gagtcctgggtgggccctgc

SEQ ID NO: 235439 - DNA, 20 bp, Artificial
  CRISPR gRNA sequence
tcctgggtgggccctgccgg

SEQ ID NO: 235440 - DNA, 20 bp, Artificial
  CRISPR gRNA sequence
gggtgggccctgccggtggc

SEQ ID NO: 235441 - DNA, 20 bp, Artificial
  CRISPR gRNA sequence
ggtgggccctgccggtggcc

SEQ ID NO: 235442 - DNA, 20 bp, Artificial
  CRISPR gRNA sequence
gggccctgccggtggccggg

SEQ ID NO: 235443 - DNA, 20 bp, Artificial
  CRISPR gRNA sequence
ctgccggtggccgggtggtc

SEQ ID NO: 235444 - DNA, 20 bp, Artificial
  CRISPR gRNA sequence
tgccggtggccgggtggtcc

SEQ ID NO: 235445 - DNA, 20 bp, Artificial
  CRISPR gRNA sequence
gggtggtccaggcccactct

SEQ ID NO: 235446 - DNA, 20 bp, Artificial
  CRISPR gRNA sequence
ggtggtccaggcccactctg

SEQ ID NO: 235447 - DNA, 20 bp, Artificial
  CRISPR gRNA sequence
ggtccaggcccactctgagg

SEQ ID NO: 235448 - DNA, 20 bp, Artificial
  CRISPR gRNA sequence
gtccaggcccactctgagga

SEQ ID NO: 235449 - DNA, 20 bp, Artificial
  CRISPR gRNA sequence
tccaggcccactctgaggaa

SEQ ID NO: 235450 - DNA, 20 bp, Artificial
  CRISPR gRNA sequence
tcctctcctgtcccttgccc

SEQ ID NO: 235451 - DNA, 20 bp, Artificial
  CRISPR gRNA sequence
ctcctgtcccttgccccaga

SEQ ID NO: 235452 - DNA, 20 bp, Artificial
  CRISPR gRNA sequence
gtcccttgccccagacagca

SEQ ID NO: 235453 - DNA, 20 bp, Artificial
  CRISPR gRNA sequence
cccttgccccagacagcacg

SEQ ID NO: 235454 - DNA, 20 bp, Artificial
  CRISPR gRNA sequence
ccttgccccagacagcacgg

SEQ ID NO: 235455 - DNA, 20 bp, Artificial
  CRISPR gRNA sequence
cttgccccagacagcacgga

SEQ ID NO: 235456 - DNA, 20 bp, Artificial
  CRISPR gRNA sequence
gccccagacagcacggaggg

SEQ ID NO: 235457 - DNA, 20 bp, Artificial
  CRISPR gRNA sequence
ccagacagcacggagggcag

SEQ ID NO: 235458 - DNA, 20 bp, Artificial
  CRISPR gRNA sequence
acagcacggagggcagcagc

SEQ ID NO: 235459 - DNA, 20 bp, Artificial
  CRISPR gRNA sequence
cagcacggagggcagcagcc

SEQ ID NO: 235460 - DNA, 20 bp, Artificial
  CRISPR gRNA sequence
agcacggagggcagcagccg

SEQ ID NO: 235461 - DNA, 20 bp, Artificial
  CRISPR gRNA sequence
gcacggagggcagcagccgg

SEQ ID NO: 235462 - DNA, 20 bp, Artificial
  CRISPR gRNA sequence
ggcagcagccgggggctgat

SEQ ID NO: 235463 - DNA, 20 bp, Artificial
  CRISPR gRNA sequence
cagcagccgggggctgatcg

SEQ ID NO: 235464 - DNA, 20 bp, Artificial
  CRISPR gRNA sequence
agcagccgggggctgatcgg

SEQ ID NO: 235465 - DNA, 20 bp, Artificial
  CRISPR gRNA sequence
ggctgatcggaggccgtgtc

SEQ ID NO: 235466 - DNA, 20 bp, Artificial
  CRISPR gRNA sequence
gctgatcggaggccgtgtcc

SEQ ID NO: 235467 - DNA, 20 bp, Artificial
  CRISPR gRNA sequence
ctgatcggaggccgtgtccg

SEQ ID NO: 235468 - DNA, 20 bp, Artificial
  CRISPR gRNA sequence
tgatcggaggccgtgtccgg

SEQ ID NO: 235469 - DNA, 20 bp, Artificial
  CRISPR gRNA sequence
aggccgtgtccgggggctga

SEQ ID NO: 235470 - DNA, 20 bp, Artificial
  CRISPR gRNA sequence
ggccgtgtccgggggctgat

SEQ ID NO: 235471 - DNA, 20 bp, Artificial
  CRISPR gRNA sequence
ccgtgtccgggggctgatag

SEQ ID NO: 235472 - DNA, 20 bp, Artificial
  CRISPR gRNA sequence
cgtgtccgggggctgatagg

SEQ ID NO: 235473 - DNA, 20 bp, Artificial
  CRISPR gRNA sequence
gaggccgcgtccatgtattc

SEQ ID NO: 235474 - DNA, 20 bp, Artificial
  CRISPR gRNA sequence
ccatgtattccagctgcacc

SEQ ID NO: 235475 - DNA, 20 bp, Artificial
  CRISPR gRNA sequence
tattccagctgcacccagtt

SEQ ID NO: 235476 - DNA, 20 bp, Artificial
  CRISPR gRNA sequence
attccagctgcacccagttc

SEQ ID NO: 235477 - DNA, 20 bp, Artificial
  CRISPR gRNA sequence
gggtttctcactgtgttccc

SEQ ID NO: 235478 - DNA, 20 bp, Artificial
  CRISPR gRNA sequence
ggtttctcactgtgttccct

SEQ ID NO: 235479 - DNA, 20 bp, Artificial
  CRISPR gRNA sequence
tcactgtgttccctgggaac

SEQ ID NO: 235480 - DNA, 20 bp, Artificial
  CRISPR gRNA sequence
ccacaacgctgtgtgcgtcc

SEQ ID NO: 235481 - DNA, 20 bp, Artificial
  CRISPR gRNA sequence
cacaacgctgtgtgcgtccc

SEQ ID NO: 235482 - DNA, 20 bp, Artificial
  CRISPR gRNA sequence
acaacgctgtgtgcgtccca

SEQ ID NO: 235483 - DNA, 20 bp, Artificial
  CRISPR gRNA sequence
gtgcgtcccagggtccccgc

SEQ ID NO: 235484 - DNA, 20 bp, Artificial
  CRISPR gRNA sequence
cgtcccagggtccccgccgg

SEQ ID NO: 235485 - DNA, 20 bp, Artificial
  CRISPR gRNA sequence
tcccagggtccccgccggca

SEQ ID NO: 235486 - DNA, 20 bp, Artificial
  CRISPR gRNA sequence
tccccgccggcagagccgct

SEQ ID NO: 235487 - DNA, 20 bp, Artificial
  CRISPR gRNA sequence
ccccgccggcagagccgctt

SEQ ID NO: 235488 - DNA, 20 bp, Artificial
  CRISPR gRNA sequence
cgccggcagagccgcttggg

SEQ ID NO: 235489 - DNA, 20 bp, Artificial
  CRISPR gRNA sequence
gtggctgaccgtcgtcctcc

SEQ ID NO: 235490 - DNA, 20 bp, Artificial
  CRISPR gRNA sequence
gaccgtcgtcctcctggccg

SEQ ID NO: 235491 - DNA, 20 bp, Artificial
  CRISPR gRNA sequence
ctgcgtcctcctcctgacct

SEQ ID NO: 235492 - DNA, 20 bp, Artificial
  CRISPR gRNA sequence
tcctcctcctgacctcggcc

SEQ ID NO: 235493 - DNA, 20 bp, Artificial
  CRISPR gRNA sequence
ctcctgacctcggcccagct

SEQ ID NO: 235494 - DNA, 20 bp, Artificial
  CRISPR gRNA sequence
cccagcttggactgcacatc

SEQ ID NO: 235495 - DNA, 20 bp, Artificial
  CRISPR gRNA sequence
agcttggactgcacatctgg

SEQ ID NO: 235496 - DNA, 20 bp, Artificial
  CRISPR gRNA sequence
ggactgcacatctggcagct

SEQ ID NO: 235497 - DNA, 20 bp, Artificial
  CRISPR gRNA sequence
gactgcacatctggcagctg

SEQ ID NO: 235498 - DNA, 20 bp, Artificial
  CRISPR gRNA sequence
ctgcacatctggcagctgag

SEQ ID NO: 235499 - DNA, 20 bp, Artificial
  CRISPR gRNA sequence
acatctggcagctgaggagt

SEQ ID NO: 235500 - DNA, 20 bp, Artificial
  CRISPR gRNA sequence
agctgaggagtcagtgcatg

SEQ ID NO: 235501 - DNA, 20 bp, Artificial
  CRISPR gRNA sequence
gagtcagtgcatgtggcccc

SEQ ID NO: 235502 - DNA, 20 bp, Artificial
  CRISPR gRNA sequence
agtcagtgcatgtggccccg

SEQ ID NO: 235503 - DNA, 20 bp, Artificial
  CRISPR gRNA sequence
tgtggccccgaggtctgtca

SEQ ID NO: 235504 - DNA, 20 bp, Artificial
  CRISPR gRNA sequence
ccccgaggtctgtcacagcc

SEQ ID NO: 235505 - DNA, 20 bp, Artificial
  CRISPR gRNA sequence
aggtctgtcacagcctggtg

SEQ ID NO: 235506 - DNA, 20 bp, Artificial
  CRISPR gRNA sequence
ggtctgtcacagcctggtgc

SEQ ID NO: 235507 - DNA, 20 bp, Artificial
  CRISPR gRNA sequence
gtctgtcacagcctggtgcg

SEQ ID NO: 235508 - DNA, 20 bp, Artificial
  CRISPR gRNA sequence
ctgtcacagcctggtgcggg

SEQ ID NO: 235509 - DNA, 20 bp, Artificial
  CRISPR gRNA sequence
tgtcacagcctggtgcgggg

SEQ ID NO: 235510 - DNA, 20 bp, Artificial
  CRISPR gRNA sequence
cacagcctggtgcggggagg

SEQ ID NO: 235511 - DNA, 20 bp, Artificial
  CRISPR gRNA sequence
acagcctggtgcggggaggt

SEQ ID NO: 235512 - DNA, 20 bp, Artificial
  CRISPR gRNA sequence
agcctggtgcggggaggtgg

SEQ ID NO: 235513 - DNA, 20 bp, Artificial
  CRISPR gRNA sequence
ggtgcggggaggtgggagca

SEQ ID NO: 235514 - DNA, 20 bp, Artificial
  CRISPR gRNA sequence
gcatggctgcctgctgaccg

SEQ ID NO: 235515 - DNA, 20 bp, Artificial
  CRISPR gRNA sequence
tgctgaccgtggcccccctg

SEQ ID NO: 235516 - DNA, 20 bp, Artificial
  CRISPR gRNA sequence
ctgaccgtggcccccctgca

SEQ ID NO: 235517 - DNA, 20 bp, Artificial
  CRISPR gRNA sequence
gtggcccccctgcagagacc

SEQ ID NO: 235518 - DNA, 20 bp, Artificial
  CRISPR gRNA sequence
tgcagagacccagctgctgc

SEQ ID NO: 235519 - DNA, 20 bp, Artificial
  CRISPR gRNA sequence
cagagacccagctgctgctg

SEQ ID NO: 235520 - DNA, 20 bp, Artificial
  CRISPR gRNA sequence
agagacccagctgctgctgg

SEQ ID NO: 235521 - DNA, 20 bp, Artificial
  CRISPR gRNA sequence
ggaggtgccgccgtcgaccg

SEQ ID NO: 235522 - DNA, 20 bp, Artificial
  CRISPR gRNA sequence
ccgccgtcgaccgaagacgc

SEQ ID NO: 235523 - DNA, 20 bp, Artificial
  CRISPR gRNA sequence
ccgtcgaccgaagacgccag

SEQ ID NO: 235524 - DNA, 20 bp, Artificial
  CRISPR gRNA sequence
ccgaagacgccagaagctgc

SEQ ID NO: 235525 - DNA, 20 bp, Artificial
  CRISPR gRNA sequence
ccagaagctgccagttcccc

SEQ ID NO: 235526 - DNA, 20 bp, Artificial
  CRISPR gRNA sequence
cagaagctgccagttccccg

SEQ ID NO: 235527 - DNA, 20 bp, Artificial
  CRISPR gRNA sequence
aagctgccagttccccgagg

SEQ ID NO: 235528 - DNA, 20 bp, Artificial
  CRISPR gRNA sequence
gctgccagttccccgaggaa

SEQ ID NO: 235529 - DNA, 20 bp, Artificial
  CRISPR gRNA sequence
gccagttccccgaggaagag

SEQ ID NO: 235530 - DNA, 20 bp, Artificial
  CRISPR gRNA sequence
ccagttccccgaggaagagc

SEQ ID NO: 235531 - DNA, 20 bp, Artificial
  CRISPR gRNA sequence
cagttccccgaggaagagcg

SEQ ID NO: 235532 - DNA, 20 bp, Artificial
  CRISPR gRNA sequence
tccccgaggaagagcggggc

SEQ ID NO: 235533 - DNA, 20 bp, Artificial
  CRISPR gRNA sequence
ggaagagcggggcgagcgat

SEQ ID NO: 235534 - DNA, 20 bp, Artificial
  CRISPR gRNA sequence
agagcggggcgagcgatcgg

SEQ ID NO: 235535 - DNA, 20 bp, Artificial
  CRISPR gRNA sequence
agcggggcgagcgatcggca

SEQ ID NO: 235536 - DNA, 20 bp, Artificial
  CRISPR gRNA sequence
gcggggcgagcgatcggcag

SEQ ID NO: 235537 - DNA, 20 bp, Artificial
  CRISPR gRNA sequence
ggggcgagcgatcggcagag

SEQ ID NO: 235538 - DNA, 20 bp, Artificial
  CRISPR gRNA sequence
gcgagcgatcggcagaggag

SEQ ID NO: 235539 - DNA, 20 bp, Artificial
  CRISPR gRNA sequence
cgagcgatcggcagaggaga

SEQ ID NO: 235540 - DNA, 20 bp, Artificial
  CRISPR gRNA sequence
gagcgatcggcagaggagaa

SEQ ID NO: 235541 - DNA, 20 bp, Artificial
  CRISPR gRNA sequence
agcgatcggcagaggagaag

SEQ ID NO: 235542 - DNA, 20 bp, Artificial
  CRISPR gRNA sequence
gatcggcagaggagaagggg

SEQ ID NO: 235543 - DNA, 20 bp, Artificial
  CRISPR gRNA sequence
ggcagaggagaaggggcggc

SEQ ID NO: 235544 - DNA, 20 bp, Artificial
  CRISPR gRNA sequence
gcagaggagaaggggcggct

SEQ ID NO: 235545 - DNA, 20 bp, Artificial
  CRISPR gRNA sequence
agaggagaaggggcggctgg

SEQ ID NO: 235546 - DNA, 20 bp, Artificial
  CRISPR gRNA sequence
aggggcggctgggagacctg

SEQ ID NO: 235547 - DNA, 20 bp, Artificial
  CRISPR gRNA sequence
ggggcggctgggagacctgt

SEQ ID NO: 235548 - DNA, 20 bp, Artificial
  CRISPR gRNA sequence
gctgggagacctgtgggtgt

SEQ ID NO: 235549 - DNA, 20 bp, Artificial
  CRISPR gRNA sequence
gagacctgtgggtgtgagcc

SEQ ID NO: 235550 - DNA, 20 bp, Artificial
  CRISPR gRNA sequence
gtgtgagcctggccgtcctc

SEQ ID NO: 235551 - DNA, 20 bp, Artificial
  CRISPR gRNA sequence
tgtgagcctggccgtcctcc

SEQ ID NO: 235552 - DNA, 20 bp, Artificial
  CRISPR gRNA sequence
gtgagcctggccgtcctccg

SEQ ID NO: 235553 - DNA, 20 bp, Artificial
  CRISPR gRNA sequence
tcctccggggccaccgaccg

SEQ ID NO: 235554 - DNA, 20 bp, Artificial
  CRISPR gRNA sequence
ccggggccaccgaccgcagc

SEQ ID NO: 235555 - DNA, 20 bp, Artificial
  CRISPR gRNA sequence
gaccgcagccagcccctccc

SEQ ID NO: 235556 - DNA, 20 bp, Artificial
  CRISPR gRNA sequence
accgcagccagcccctcccc

SEQ ID NO: 235557 - DNA, 20 bp, Artificial
  CRISPR gRNA sequence
cgcagccagcccctccccag

SEQ ID NO: 235558 - DNA, 20 bp, Artificial
  CRISPR gRNA sequence
gcccctccccaggagctccc

SEQ ID NO: 235559 - DNA, 20 bp, Artificial
  CRISPR gRNA sequence
cccctccccaggagctcccc

SEQ ID NO: 235560 - DNA, 20 bp, Artificial
  CRISPR gRNA sequence
cccaggagctccccaggccg

SEQ ID NO: 235561 - DNA, 20 bp, Artificial
  CRISPR gRNA sequence
ccaggagctccccaggccgc

SEQ ID NO: 235562 - DNA, 20 bp, Artificial
  CRISPR gRNA sequence
caggagctccccaggccgca

SEQ ID NO: 235563 - DNA, 20 bp, Artificial
  CRISPR gRNA sequence
aggagctccccaggccgcag

SEQ ID NO: 235564 - DNA, 20 bp, Artificial
  CRISPR gRNA sequence
aggggctctgcgttctgctc

SEQ ID NO: 235565 - DNA, 20 bp, Artificial
  CRISPR gRNA sequence
ggggctctgcgttctgctct

SEQ ID NO: 235566 - DNA, 20 bp, Artificial
  CRISPR gRNA sequence
ctctgcgttctgctctgggc

SEQ ID NO: 235567 - DNA, 20 bp, Artificial
  CRISPR gRNA sequence
tctgcgttctgctctgggcc

SEQ ID NO: 235568 - DNA, 20 bp, Artificial
  CRISPR gRNA sequence
tgggccgggccctgctcccc

SEQ ID NO: 235569 - DNA, 20 bp, Artificial
  CRISPR gRNA sequence
gccgggccctgctcccctgg

SEQ ID NO: 235570 - DNA, 20 bp, Artificial
  CRISPR gRNA sequence
gggccctgctcccctggcag

SEQ ID NO: 235571 - DNA, 20 bp, Artificial
  CRISPR gRNA sequence
ccctgctcccctggcagcag

SEQ ID NO: 235572 - DNA, 20 bp, Artificial
  CRISPR gRNA sequence
tgctcccctggcagcagaag

SEQ ID NO: 235573 - DNA, 20 bp, Artificial
  CRISPR gRNA sequence
gctcccctggcagcagaagt

SEQ ID NO: 235574 - DNA, 20 bp, Artificial
  CRISPR gRNA sequence
cctggcagcagaagtgggtg

SEQ ID NO: 235575 - DNA, 20 bp, Artificial
  CRISPR gRNA sequence
ctggcagcagaagtgggtgc

SEQ ID NO: 235576 - DNA, 20 bp, Artificial
  CRISPR gRNA sequence
gcagcagaagtgggtgcagg

SEQ ID NO: 235577 - DNA, 20 bp, Artificial
  CRISPR gRNA sequence
cagcagaagtgggtgcagga

SEQ ID NO: 235578 - DNA, 20 bp, Artificial
  CRISPR gRNA sequence
cagaagtgggtgcaggaagg

SEQ ID NO: 235579 - DNA, 20 bp, Artificial
  CRISPR gRNA sequence
aagtgggtgcaggaaggtgg

SEQ ID NO: 235580 - DNA, 20 bp, Artificial
  CRISPR gRNA sequence
tgcaggaaggtggcagtgac

SEQ ID NO: 235581 - DNA, 20 bp, Artificial
  CRISPR gRNA sequence
ggtggcagtgaccagcgccc

SEQ ID NO: 235582 - DNA, 20 bp, Artificial
  CRISPR gRNA sequence
gaccagcgccctggaccatg

SEQ ID NO: 235583 - DNA, 20 bp, Artificial
  CRISPR gRNA sequence
gcgccctggaccatgcagtt

SEQ ID NO: 235584 - DNA, 20 bp, Artificial
  CRISPR gRNA sequence
ccctggaccatgcagttcgg

SEQ ID NO: 235585 - DNA, 20 bp, Artificial
  CRISPR gRNA sequence
accatgcagttcggcggccg

SEQ ID NO: 235586 - DNA, 20 bp, Artificial
  CRISPR gRNA sequence
tgcagttcggcggccgcggc

SEQ ID NO: 235587 - DNA, 20 bp, Artificial
  CRISPR gRNA sequence
gcagttcggcggccgcggct

SEQ ID NO: 235588 - DNA, 20 bp, Artificial
  CRISPR gRNA sequence
gcggccgcggctgggccctg

SEQ ID NO: 235589 - DNA, 20 bp, Artificial
  CRISPR gRNA sequence
cggccgcggctgggccctgc

SEQ ID NO: 235590 - DNA, 20 bp, Artificial
  CRISPR gRNA sequence
gccgcggctgggccctgcag

SEQ ID NO: 235591 - DNA, 20 bp, Artificial
  CRISPR gRNA sequence
ccgcggctgggccctgcagg

SEQ ID NO: 235592 - DNA, 20 bp, Artificial
  CRISPR gRNA sequence
cgcggctgggccctgcagga

SEQ ID NO: 235593 - DNA, 20 bp, Artificial
  CRISPR gRNA sequence
cggctgggccctgcaggagg

SEQ ID NO: 235594 - DNA, 20 bp, Artificial
  CRISPR gRNA sequence
gctgggccctgcaggaggga

SEQ ID NO: 235595 - DNA, 20 bp, Artificial
  CRISPR gRNA sequence
tgggccctgcaggagggaga

SEQ ID NO: 235596 - DNA, 20 bp, Artificial
  CRISPR gRNA sequence
ggccctgcaggagggagaga

SEQ ID NO: 235597 - DNA, 20 bp, Artificial
  CRISPR gRNA sequence
gcaggagggagagagagaca

SEQ ID NO: 235598 - DNA, 20 bp, Artificial
  CRISPR gRNA sequence
gggagagagagacacagtca

SEQ ID NO: 235599 - DNA, 20 bp, Artificial
  CRISPR gRNA sequence
tggcccccttcctcccttgc

SEQ ID NO: 235600 - DNA, 20 bp, Artificial
  CRISPR gRNA sequence
tcctcccttgctggccctga

SEQ ID NO: 235601 - DNA, 20 bp, Artificial
  CRISPR gRNA sequence
cctcccttgctggccctgat

SEQ ID NO: 235602 - DNA, 20 bp, Artificial
  CRISPR gRNA sequence
ctcccttgctggccctgatg

SEQ ID NO: 235603 - DNA, 20 bp, Artificial
  CRISPR gRNA sequence
ccttgctggccctgatgggg

SEQ ID NO: 235604 - DNA, 20 bp, Artificial
  CRISPR gRNA sequence
cttgctggccctgatggggt

SEQ ID NO: 235605 - DNA, 20 bp, Artificial
  CRISPR gRNA sequence
ttgctggccctgatggggtg

SEQ ID NO: 235606 - DNA, 20 bp, Artificial
  CRISPR gRNA sequence
gccctgatggggtggggtct

SEQ ID NO: 235607 - DNA, 20 bp, Artificial
  CRISPR gRNA sequence
ccctgatggggtggggtctt

SEQ ID NO: 235608 - DNA, 20 bp, Artificial
  CRISPR gRNA sequence
gatggggtggggtcttagga

SEQ ID NO: 235609 - DNA, 20 bp, Artificial
  CRISPR gRNA sequence
atggggtggggtcttaggac

SEQ ID NO: 235610 - DNA, 20 bp, Artificial
  CRISPR gRNA sequence
ggggtggggtcttaggacgg

SEQ ID NO: 235611 - DNA, 20 bp, Artificial
  CRISPR gRNA sequence
gggtggggtcttaggacggg

SEQ ID NO: 235612 - DNA, 20 bp, Artificial
  CRISPR gRNA sequence
aggacgggaggctgtgtccg

SEQ ID NO: 235613 - DNA, 20 bp, Artificial
  CRISPR gRNA sequence
ggacgggaggctgtgtccgt

SEQ ID NO: 235614 - DNA, 20 bp, Artificial
  CRISPR gRNA sequence
aggctgtgtccgtgggtgtg

SEQ ID NO: 235615 - DNA, 20 bp, Artificial
  CRISPR gRNA sequence
gtccgtgggtgtgcagtgcc

SEQ ID NO: 235616 - DNA, 20 bp, Artificial
  CRISPR gRNA sequence
tgggtgtgcagtgcccagca

SEQ ID NO: 235617 - DNA, 20 bp, Artificial
  CRISPR gRNA sequence
gggtgtgcagtgcccagcac

SEQ ID NO: 235618 - DNA, 20 bp, Artificial
  CRISPR gRNA sequence
gcagtgcccagcacgggacc

SEQ ID NO: 235619 - DNA, 20 bp, Artificial
  CRISPR gRNA sequence
cccagcacgggacccggctg

SEQ ID NO: 235620 - DNA, 20 bp, Artificial
  CRISPR gRNA sequence
ccagcacgggacccggctgc

SEQ ID NO: 235621 - DNA, 20 bp, Artificial
  CRISPR gRNA sequence
cagcacgggacccggctgca

SEQ ID NO: 235622 - DNA, 20 bp, Artificial
  CRISPR gRNA sequence
agcacgggacccggctgcag

SEQ ID NO: 235623 - DNA, 20 bp, Artificial
  CRISPR gRNA sequence
accttcaataaacacttgtc

SEQ ID NO: 235624 - DNA, 20 bp, Artificial
  CRISPR gRNA sequence
aaacacttgtccagtgacct

SEQ ID NO: 235625 - DNA, 20 bp, Artificial
  CRISPR gRNA sequence
cacttgtccagtgacctgag

SEQ ID NO: 235626 - DNA, 20 bp, Artificial
  CRISPR gRNA sequence
tgacctgagtggatgcatgc

SEQ ID NO: 235627 - DNA, 20 bp, Artificial
  CRISPR gRNA sequence
gacctgagtggatgcatgct

SEQ ID NO: 235628 - DNA, 20 bp, Artificial
  CRISPR gRNA sequence
agtggatgcatgctgggtgc

SEQ ID NO: 235629 - DNA, 20 bp, Artificial
  CRISPR gRNA sequence
gtggatgcatgctgggtgct

SEQ ID NO: 235630 - DNA, 20 bp, Artificial
  CRISPR gRNA sequence
tggatgcatgctgggtgctg

SEQ ID NO: 235631 - DNA, 20 bp, Artificial
  CRISPR gRNA sequence
ggatgcatgctgggtgctgg

SEQ ID NO: 235632 - DNA, 20 bp, Artificial
  CRISPR gRNA sequence
atgcatgctgggtgctgggg

SEQ ID NO: 235633 - DNA, 20 bp, Artificial
  CRISPR gRNA sequence
tgcatgctgggtgctggggg

SEQ ID NO: 235634 - DNA, 20 bp, Artificial
  CRISPR gRNA sequence
tgctgggtgctgggggagga

SEQ ID NO: 235635 - DNA, 20 bp, Artificial
  CRISPR gRNA sequence
gctgggtgctgggggaggac

SEQ ID NO: 235636 - DNA, 20 bp, Artificial
  CRISPR gRNA sequence
ctgggtgctgggggaggacg

SEQ ID NO: 235637 - DNA, 20 bp, Artificial
  CRISPR gRNA sequence
ctgggggaggacggggcacc

SEQ ID NO: 235638 - DNA, 20 bp, Artificial
  CRISPR gRNA sequence
tgggggaggacggggcaccc

SEQ ID NO: 235639 - DNA, 20 bp, Artificial
  CRISPR gRNA sequence
gggggaggacggggcacccg

SEQ ID NO: 235640 - DNA, 20 bp, Artificial
  CRISPR gRNA sequence
gaggacggggcacccggggc

SEQ ID NO: 235641 - DNA, 20 bp, Artificial
  CRISPR gRNA sequence
aggacggggcacccggggct

SEQ ID NO: 235642 - DNA, 20 bp, Artificial
  CRISPR gRNA sequence
gggcacccggggctgggctt

SEQ ID NO: 235643 - DNA, 20 bp, Artificial
  CRISPR gRNA sequence
ggcacccggggctgggcttt

SEQ ID NO: 235644 - DNA, 20 bp, Artificial
  CRISPR gRNA sequence
gcacccggggctgggctttg

SEQ ID NO: 235645 - DNA, 20 bp, Artificial
  CRISPR gRNA sequence
tggggcaccgtgctcatgcc

SEQ ID NO: 235646 - DNA, 20 bp, Artificial
  CRISPR gRNA sequence
accgtgctcatgcctggccg

SEQ ID NO: 235647 - DNA, 20 bp, Artificial
  CRISPR gRNA sequence
cctggccgtggtcccctcca

SEQ ID NO: 235648 - DNA, 20 bp, Artificial
  CRISPR gRNA sequence
ctggccgtggtcccctccac

SEQ ID NO: 235649 - DNA, 20 bp, Artificial
  CRISPR gRNA sequence
tggccgtggtcccctccaca

SEQ ID NO: 235650 - DNA, 20 bp, Artificial
  CRISPR gRNA sequence
ggccgtggtcccctccacag

SEQ ID NO: 235651 - DNA, 20 bp, Artificial
  CRISPR gRNA sequence
cggtgccccaaagcccagcc

SEQ ID NO: 235652 - DNA, 20 bp, Artificial
  CRISPR gRNA sequence
ttattgaaggtcccctgcag

SEQ ID NO: 235653 - DNA, 20 bp, Artificial
  CRISPR gRNA sequence
ggcggcacctccagcagcag

SEQ ID NO: 235654 - DNA, 20 bp, Artificial
  CRISPR gRNA sequence
cctgggacgcacacagcgtt

SEQ ID NO: 235655 - DNA, 20 bp, Artificial
  CRISPR gRNA sequence
aacacagtgagaaacccgaa

SEQ ID NO: 235656 - DNA, 20 bp, Artificial
  CRISPR gRNA sequence
aaacccgaactgggtgcagc

SEQ ID NO: 235657 - DNA, 20 bp, Artificial
  CRISPR gRNA sequence
gacaggagaggacccttcct

SEQ ID NO: 235658 - DNA, 20 bp, Artificial
  CRISPR gRNA sequence
cgatacactggaagccaaaa

SEQ ID NO: 235659 - DNA, 20 bp, Artificial
  CRISPR gRNA sequence
aaaactgaatttccctggtg

SEQ ID NO: 235660 - DNA, 20 bp, Artificial
  CRISPR gRNA sequence
gagggagggagggaggctgg

SEQ ID NO: 235661 - DNA, 20 bp, Artificial
  CRISPR gRNA sequence
agggaggctggtggagttgc

SEQ ID NO: 235662 - DNA, 20 bp, Artificial
  CRISPR gRNA sequence
aggctggtggagttgctggg

SEQ ID NO: 235663 - DNA, 20 bp, Artificial
  CRISPR gRNA sequence
ggagggcgtcaggccagtgc

SEQ ID NO: 235664 - DNA, 20 bp, Artificial
  CRISPR gRNA sequence
ggccagtgcaggggtccatc

SEQ ID NO: 235665 - DNA, 20 bp, Artificial
  CRISPR gRNA sequence
tgcaggggtccatctggggt

SEQ ID NO: 235666 - DNA, 20 bp, Artificial
  CRISPR gRNA sequence
gtccatctggggtctgggtg

SEQ ID NO: 235667 - DNA, 20 bp, Artificial
  CRISPR gRNA sequence
tctggggtctgggtgctgag

SEQ ID NO: 235668 - DNA, 20 bp, Artificial
  CRISPR gRNA sequence
cccccccatcatccattcaa

SEQ ID NO: 235669 - DNA, 20 bp, Artificial
  CRISPR gRNA sequence
cccgtcccaggtggggcgtc

SEQ ID NO: 235670 - DNA, 20 bp, Artificial
  CRISPR gRNA sequence
gggcacctgggggaggtgcg

SEQ ID NO: 235671 - DNA, 20 bp, Artificial
  CRISPR gRNA sequence
aggcctgcccattgggggct

SEQ ID NO: 235672 - DNA, 20 bp, Artificial
  CRISPR gRNA sequence
aggcaggacccagtagaaca

SEQ ID NO: 235673 - DNA, 20 bp, Artificial
  CRISPR gRNA sequence
aacagagggtggagaacagt

SEQ ID NO: 235674 - DNA, 20 bp, Artificial
  CRISPR gRNA sequence
agaacagtgagggtcccaga

SEQ ID NO: 235675 - DNA, 20 bp, Artificial
  CRISPR gRNA sequence
gggtcccagagagagtgagg

SEQ ID NO: 235676 - DNA, 20 bp, Artificial
  CRISPR gRNA sequence
ttgagctgctccttccagaa

SEQ ID NO: 235677 - DNA, 20 bp, Artificial
  CRISPR gRNA sequence
cagtatgtggtgaggacaga

SEQ ID NO: 235678 - DNA, 20 bp, Artificial
  CRISPR gRNA sequence
atgtggtgaggacagacagg

SEQ ID NO: 235679 - DNA, 20 bp, Artificial
  CRISPR gRNA sequence
aacccgcccccacctccccg

SEQ ID NO: 235680 - DNA, 20 bp, Artificial
  CRISPR gRNA sequence
gggttctcacagccctcgtg

SEQ ID NO: 235681 - DNA, 20 bp, Artificial
  CRISPR gRNA sequence
taccccctggcctgggggac

SEQ ID NO: 235682 - DNA, 20 bp, Artificial
  CRISPR gRNA sequence
gtgccggcaggtcgtgcagc

SEQ ID NO: 235683 - DNA, 20 bp, Artificial
  CRISPR gRNA sequence
tgcagcaagggtctccgcag

SEQ ID NO: 235684 - DNA, 20 bp, Artificial
  CRISPR gRNA sequence
gcctcccctcggccctccag

SEQ ID NO: 235685 - DNA, 20 bp, Artificial
  CRISPR gRNA sequence
ggagcagagggctcctggct

SEQ ID NO: 235686 - DNA, 20 bp, Artificial
  CRISPR gRNA sequence
cctggctgggagtctggacc

SEQ ID NO: 235687 - DNA, 20 bp, Artificial
  CRISPR gRNA sequence
gagctgcccctgcaggaccc

SEQ ID NO: 235688 - DNA, 20 bp, Artificial
  CRISPR gRNA sequence
ggccctggaggaagaagctc

SEQ ID NO: 235689 - DNA, 20 bp, Artificial
  CRISPR gRNA sequence
ggcacacctccgcctccctc

SEQ ID NO: 235690 - DNA, 20 bp, Artificial
  CRISPR gRNA sequence
agtaaacgcggtttacttac

SEQ ID NO: 235691 - DNA, 20 bp, Artificial
  CRISPR gRNA sequence
cgccccgtgctgtgccatgc

SEQ ID NO: 235692 - DNA, 20 bp, Artificial
  CRISPR gRNA sequence
gctgggaccgttcatgacct

SEQ ID NO: 235693 - DNA, 20 bp, Artificial
  CRISPR gRNA sequence
aggtgaagtgcgtgtgagga

SEQ ID NO: 235694 - DNA, 20 bp, Artificial
  CRISPR gRNA sequence
ggcggggaaaccaggctggc

SEQ ID NO: 235695 - DNA, 20 bp, Artificial
  CRISPR gRNA sequence
cctcctcacacgcacttcac

SEQ ID NO: 235696 - DNA, 20 bp, Artificial
  CRISPR gRNA sequence
cacacgcacttcacctgggt

SEQ ID NO: 235697 - DNA, 20 bp, Artificial
  CRISPR gRNA sequence
cccagccacctccgggcagg

SEQ ID NO: 235698 - DNA, 20 bp, Artificial
  CRISPR gRNA sequence
cgctgctgtgcgcgctcagc

SEQ ID NO: 235699 - DNA, 20 bp, Artificial
  CRISPR gRNA sequence
gcctgggtcagcgccccacc

SEQ ID NO: 235700 - DNA, 20 bp, Artificial
  CRISPR gRNA sequence
tcagcgccccaccgggggtc

SEQ ID NO: 235701 - DNA, 20 bp, Artificial
  CRISPR gRNA sequence
ggaacggacgcgcgctgctg

SEQ ID NO: 235702 - DNA, 20 bp, Artificial
  CRISPR gRNA sequence
cgcgctgctgccgcgattac

SEQ ID NO: 235703 - DNA, 20 bp, Artificial
  CRISPR gRNA sequence
ccaaggcgtcccgcggaagc

SEQ ID NO: 235704 - DNA, 20 bp, Artificial
  CRISPR gRNA sequence
ggcgtcccgcggaagccggg

SEQ ID NO: 235705 - DNA, 20 bp, Artificial
  CRISPR gRNA sequence
cggcgttgctgaggtctaag

SEQ ID NO: 235706 - DNA, 20 bp, Artificial
  CRISPR gRNA sequence
gggagccttccggagggagg

SEQ ID NO: 235707 - DNA, 20 bp, Artificial
  CRISPR gRNA sequence
cagtggccccggccgggagc

SEQ ID NO: 235708 - DNA, 20 bp, Artificial
  CRISPR gRNA sequence
caggtgggagcgccctcaag

SEQ ID NO: 235709 - DNA, 20 bp, Artificial
  CRISPR gRNA sequence
gagcgccctcaagaggggtc

SEQ ID NO: 235710 - DNA, 20 bp, Artificial
  CRISPR gRNA sequence
gctgttccaggtcctgctgg

SEQ ID NO: 235711 - DNA, 20 bp, Artificial
  CRISPR gRNA sequence
cctgcctctgacctgcacct

SEQ ID NO: 235712 - DNA, 20 bp, Artificial
  CRISPR gRNA sequence
tctgacctgcacctggggat

SEQ ID NO: 235713 - DNA, 20 bp, Artificial
  CRISPR gRNA sequence
agcttcttcctccagggcct

SEQ ID NO: 235714 - DNA, 20 bp, Artificial
  CRISPR gRNA sequence
tgcactgttgggggccaccc

SEQ ID NO: 235715 - DNA, 20 bp, Artificial
  CRISPR gRNA sequence
gggcagctcctggttgcata

SEQ ID NO: 235716 - DNA, 20 bp, Artificial
  CRISPR gRNA sequence
gcagctgtggggcgcaaagg

SEQ ID NO: 235717 - DNA, 20 bp, Artificial
  CRISPR gRNA sequence
gccccaggagaaagagacag

SEQ ID NO: 235718 - DNA, 20 bp, Artificial
  CRISPR gRNA sequence
aagagacagctggataaacc

SEQ ID NO: 235719 - DNA, 20 bp, Artificial
  CRISPR gRNA sequence
tctgctccctggagccaact

SEQ ID NO: 235720 - DNA, 20 bp, Artificial
  CRISPR gRNA sequence
gcctgtctcctgcccaggcg

SEQ ID NO: 235721 - DNA, 20 bp, Artificial
  CRISPR gRNA sequence
cccaggcgaggagtgctgtt

SEQ ID NO: 235722 - DNA, 20 bp, Artificial
  CRISPR gRNA sequence
ggactgcatgtgtgtccagc

SEQ ID NO: 235723 - DNA, 20 bp, Artificial
  CRISPR gRNA sequence
cacccttgtcccccaggcca

SEQ ID NO: 235724 - DNA, 20 bp, Artificial
  CRISPR gRNA sequence
caggccagggggtacagtcc

SEQ ID NO: 235725 - DNA, 20 bp, Artificial
  CRISPR gRNA sequence
taagtcctggaggtgcctct

SEQ ID NO: 235726 - DNA, 20 bp, Artificial
  CRISPR gRNA sequence
tctgggagtccacacaggcc

SEQ ID NO: 235727 - DNA, 20 bp, Artificial
  CRISPR gRNA sequence
cggcgaggacatgtggtgtg

SEQ ID NO: 235728 - DNA, 20 bp, Artificial
  CRISPR gRNA sequence
gacatgtggtgtgtggggtc

SEQ ID NO: 235729 - DNA, 20 bp, Artificial
  CRISPR gRNA sequence
accacaggccatgaagctct

SEQ ID NO: 235730 - DNA, 20 bp, Artificial
  CRISPR gRNA sequence
aaccctgcggggaggtgggg

SEQ ID NO: 235731 - DNA, 20 bp, Artificial
  CRISPR gRNA sequence
agagcctgccctgtgccccc

SEQ ID NO: 235732 - DNA, 20 bp, Artificial
  CRISPR gRNA sequence
ttgtgtcaggttggacgggg

SEQ ID NO: 235733 - DNA, 20 bp, Artificial
  CRISPR gRNA sequence
aggttggacggggcagggtc

SEQ ID NO: 235734 - DNA, 20 bp, Artificial
  CRISPR gRNA sequence
gttctccaccctctgttcta

SEQ ID NO: 235735 - DNA, 20 bp, Artificial
  CRISPR gRNA sequence
ctgggccatgaagaactctg

SEQ ID NO: 235736 - DNA, 20 bp, Artificial
  CRISPR gRNA sequence
gccatgaagaactctgttga

SEQ ID NO: 235737 - DNA, 20 bp, Artificial
  CRISPR gRNA sequence
aggccactgcaaaccttgga

SEQ ID NO: 235738 - DNA, 20 bp, Artificial
  CRISPR gRNA sequence
cactgcaaaccttggacaga

SEQ ID NO: 235739 - DNA, 20 bp, Artificial
  CRISPR gRNA sequence
aaccttggacagagtgagtc

SEQ ID NO: 235740 - DNA, 20 bp, Artificial
  CRISPR gRNA sequence
tgggtgggccctgccggtgg

SEQ ID NO: 235741 - DNA, 20 bp, Artificial
  CRISPR gRNA sequence
ggtccaggcccactctgagg

SEQ ID NO: 235742 - DNA, 20 bp, Artificial
  CRISPR gRNA sequence
gtattccagctgcacccagt

SEQ ID NO: 235743 - DNA, 20 bp, Artificial
  CRISPR gRNA sequence
ccacaacgctgtgtgcgtcc

SEQ ID NO: 235744 - DNA, 20 bp, Artificial
  CRISPR gRNA sequence
gtccccgccggcagagccgc

SEQ ID NO: 235745 - DNA, 20 bp, Artificial
  CRISPR gRNA sequence
gactgcacatctggcagctg

SEQ ID NO: 235746 - DNA, 20 bp, Artificial
  CRISPR gRNA sequence
aaggggcggctgggagacct

SEQ ID NO: 235747 - DNA, 20 bp, Artificial
  CRISPR gRNA sequence
ctgctcccctggcagcagaa

SEQ ID NO: 235748 - DNA, 20 bp, Artificial
  CRISPR gRNA sequence
tcctcccttgctggccctga

SEQ ID NO: 235749 - DNA, 20 bp, Artificial
  CRISPR gRNA sequence
ccttgctggccctgatgggg

SEQ ID NO: 235750 - DNA, 20 bp, Artificial
  CRISPR gRNA sequence
taggacgggaggctgtgtcc

SEQ ID NO: 235751 - DNA, 20 bp, Artificial
  CRISPR gRNA sequence
ataaacacttgtccagtgac

SEQ ID NO: 235752 - DNA, 20 bp, Artificial
  CRISPR gRNA sequence
acacttgtccagtgacctga

SEQ ID NO: 235753 - DNA, 20 bp, Artificial
  CRISPR gRNA sequence
gtgacctgagtggatgcatg

SEQ ID NO: 235754 - DNA, 20 bp, Artificial
  CRISPR gRNA sequence
atccactcaggtcactggac

SEQ ID NO: 235755 - DNA, 20 bp, Artificial
  CRISPR gRNA sequence
ccgctcttcctcggggaact

SEQ ID NO: 235756 - DNA, 20 bp, Artificial
  CRISPR gRNA sequence
cacccaggactcactctgtc

SEQ ID NO: 235757 - DNA, 20 bp, Artificial
  CRISPR gRNA sequence
aagcagggacaggacacccc

SEQ ID NO: 235758 - DNA, 20 bp, Artificial
  CRISPR gRNA sequence
cctggctgggagtctggacc

SEQ ID NO: 235759 - DNA, 20 bp, Artificial
  CRISPR gRNA sequence
agctctggggtgacttccct

SEQ ID NO: 235760 - DNA, 20 bp, Artificial
  CRISPR gRNA sequence
gaaggggggcgcccacccat

SEQ ID NO: 235761 - DNA, 20 bp, Artificial
  CRISPR gRNA sequence
gccggtccgcgttaagtaaa

SEQ ID NO: 235762 - DNA, 20 bp, Artificial
  CRISPR gRNA sequence
cgccccgtgctgtgccatgc

SEQ ID NO: 235763 - DNA, 20 bp, Artificial
  CRISPR gRNA sequence
accaggctggcggggatcag

SEQ ID NO: 235764 - DNA, 20 bp, Artificial
  CRISPR gRNA sequence
acctttctgatccccgccag

SEQ ID NO: 235765 - DNA, 20 bp, Artificial
  CRISPR gRNA sequence
tcacacgcacttcacctggg

SEQ ID NO: 235766 - DNA, 20 bp, Artificial
  CRISPR gRNA sequence
ggcacagcacggggcgatgg

SEQ ID NO: 235767 - DNA, 20 bp, Artificial
  CRISPR gRNA sequence
cgggtgcggccctgggcgcc

SEQ ID NO: 235768 - DNA, 20 bp, Artificial
  CRISPR gRNA sequence
gttcacacgacgcgctgctg

SEQ ID NO: 235769 - DNA, 20 bp, Artificial
  CRISPR gRNA sequence
cgattacccgggtaagtaaa

SEQ ID NO: 235770 - DNA, 20 bp, Artificial
  CRISPR gRNA sequence
agctggcagggaagtcaccc

SEQ ID NO: 235771 - DNA, 20 bp, Artificial
  CRISPR gRNA sequence
aagctctgggggtgtcctgt

SEQ ID NO: 235772 - DNA, 20 bp, Artificial
  CRISPR gRNA sequence
cctgtccctgctttctcagc

SEQ ID NO: 235773 - DNA, 20 bp, Artificial
  CRISPR gRNA sequence
ggagcagctcaagtcctctt

SEQ ID NO: 235774 - DNA, 20 bp, Artificial
  CRISPR gRNA sequence
cagctcaagtcctcttagcg

SEQ ID NO: 235775 - DNA, 20 bp, Artificial
  CRISPR gRNA sequence
ctctgttctactgggtcctg

SEQ ID NO: 235776 - DNA, 20 bp, Artificial
  CRISPR gRNA sequence
cacaccccacaccagggaaa

SEQ ID NO: 235777 - DNA, 20 bp, Artificial
  CRISPR gRNA sequence
ccacaccagggaaattcagt

SEQ ID NO: 235778 - DNA, 20 bp, Artificial
  CRISPR gRNA sequence
gtattccagctgcacccagt

SEQ ID NO: 235779 - DNA, 20 bp, Artificial
  CRISPR gRNA sequence
cccagggtccccgccggcag

SEQ ID NO: 235780 - DNA, 20 bp, Artificial
  CRISPR gRNA sequence
cgtcctcctcctgacctcgg

SEQ ID NO: 235781 - DNA, 20 bp, Artificial
  CRISPR gRNA sequence
ggaggacggggcacccgggg

SEQ ID NO: 235782 - DNA, 20 bp, Artificial
  CRISPR gRNA sequence
cttgttcccagggaacacag

SEQ ID NO: 235783 - DNA, 20 bp, Artificial
  CRISPR gRNA sequence
atctggggtctgggtgctga

SEQ ID NO: 235784 - DNA, 20 bp, Artificial
  CRISPR gRNA sequence
ctggatggagaagcccaggc

SEQ ID NO: 235785 - DNA, 20 bp, Artificial
  CRISPR gRNA sequence
ggctgggaccgttcatgacc

SEQ ID NO: 235786 - DNA, 20 bp, Artificial
  CRISPR gRNA sequence
ggaaaccaggctggcgggga

SEQ ID NO: 235787 - DNA, 20 bp, Artificial
  CRISPR gRNA sequence
agccaggccacatggcccca

SEQ ID NO: 235788 - DNA, 20 bp, Artificial
  CRISPR gRNA sequence
acagtcgatacactggaagc

SEQ ID NO: 235789 - DNA, 20 bp, Artificial
  CRISPR gRNA sequence
gtggccgcagactttgcata

SEQ ID NO: 235790 - DNA, 20 bp, Artificial
  CRISPR gRNA sequence
tggaggggaccacggccagg

SEQ ID NO: 235791 - DNA, 20 bp, Artificial
  CRISPR gRNA sequence
ccccagcacccagcatgcat

SEQ ID NO: 235792 - DNA, 20 bp, Artificial
  CRISPR gRNA sequence
aggtcactggacaagtgttt

SEQ ID NO: 235793 - DNA, 20 bp, Artificial
  CRISPR gRNA sequence
gacaagtgtttattgaaggt

SEQ ID NO: 235794 - DNA, 20 bp, Artificial
  CRISPR gRNA sequence
attgaaggtcccctgcagcc

SEQ ID NO: 235795 - DNA, 20 bp, Artificial
  CRISPR gRNA sequence
ttgaaggtcccctgcagccg

SEQ ID NO: 235796 - DNA, 20 bp, Artificial
  CRISPR gRNA sequence
aaggtcccctgcagccgggt

SEQ ID NO: 235797 - DNA, 20 bp, Artificial
  CRISPR gRNA sequence
cagccgggtcccgtgctggg

SEQ ID NO: 235798 - DNA, 20 bp, Artificial
  CRISPR gRNA sequence
ggcactgcacacccacggac

SEQ ID NO: 235799 - DNA, 20 bp, Artificial
  CRISPR gRNA sequence
cacacccacggacacagcct

SEQ ID NO: 235800 - DNA, 20 bp, Artificial
  CRISPR gRNA sequence
ccgtcctaagaccccacccc

SEQ ID NO: 235801 - DNA, 20 bp, Artificial
  CRISPR gRNA sequence
agaccccaccccatcagggc

SEQ ID NO: 235802 - DNA, 20 bp, Artificial
  CRISPR gRNA sequence
tgtctctctctccctcctgc

SEQ ID NO: 235803 - DNA, 20 bp, Artificial
  CRISPR gRNA sequence
tctctccctcctgcagggcc

SEQ ID NO: 235804 - DNA, 20 bp, Artificial
  CRISPR gRNA sequence
tctccctcctgcagggccca

SEQ ID NO: 235805 - DNA, 20 bp, Artificial
  CRISPR gRNA sequence
tccctcctgcagggcccagc

SEQ ID NO: 235806 - DNA, 20 bp, Artificial
  CRISPR gRNA sequence
cctcctgcagggcccagccg

SEQ ID NO: 235807 - DNA, 20 bp, Artificial
  CRISPR gRNA sequence
ctgcagggcccagccgcggc

SEQ ID NO: 235808 - DNA, 20 bp, Artificial
  CRISPR gRNA sequence
cagggcccagccgcggccgc

SEQ ID NO: 235809 - DNA, 20 bp, Artificial
  CRISPR gRNA sequence
catggtccagggcgctggtc

SEQ ID NO: 235810 - DNA, 20 bp, Artificial
  CRISPR gRNA sequence
gtcactgccaccttcctgca

SEQ ID NO: 235811 - DNA, 20 bp, Artificial
  CRISPR gRNA sequence
ccaccttcctgcacccactt

SEQ ID NO: 235812 - DNA, 20 bp, Artificial
  CRISPR gRNA sequence
cctgcacccacttctgctgc

SEQ ID NO: 235813 - DNA, 20 bp, Artificial
  CRISPR gRNA sequence
ctgcacccacttctgctgcc

SEQ ID NO: 235814 - DNA, 20 bp, Artificial
  CRISPR gRNA sequence
cacccacttctgctgccagg

SEQ ID NO: 235815 - DNA, 20 bp, Artificial
  CRISPR gRNA sequence
ctgctgccaggggagcaggg

SEQ ID NO: 235816 - DNA, 20 bp, Artificial
  CRISPR gRNA sequence
tgctgccaggggagcagggc

SEQ ID NO: 235817 - DNA, 20 bp, Artificial
  CRISPR gRNA sequence
ctgccaggggagcagggccc

SEQ ID NO: 235818 - DNA, 20 bp, Artificial
  CRISPR gRNA sequence
ccaggggagcagggcccggc

SEQ ID NO: 235819 - DNA, 20 bp, Artificial
  CRISPR gRNA sequence
cggcctggggagctcctggg

SEQ ID NO: 235820 - DNA, 20 bp, Artificial
  CRISPR gRNA sequence
gggagctcctggggaggggc

SEQ ID NO: 235821 - DNA, 20 bp, Artificial
  CRISPR gRNA sequence
ctggggaggggctggctgcg

SEQ ID NO: 235822 - DNA, 20 bp, Artificial
  CRISPR gRNA sequence
gggaggggctggctgcggtc

SEQ ID NO: 235823 - DNA, 20 bp, Artificial
  CRISPR gRNA sequence
gctgcggtcggtggccccgg

SEQ ID NO: 235824 - DNA, 20 bp, Artificial
  CRISPR gRNA sequence
cggtcggtggccccggagga

SEQ ID NO: 235825 - DNA, 20 bp, Artificial
  CRISPR gRNA sequence
acacccacaggtctcccagc

SEQ ID NO: 235826 - DNA, 20 bp, Artificial
  CRISPR gRNA sequence
ccagccgccccttctcctct

SEQ ID NO: 235827 - DNA, 20 bp, Artificial
  CRISPR gRNA sequence
ctcctctgccgatcgctcgc

SEQ ID NO: 235828 - DNA, 20 bp, Artificial
  CRISPR gRNA sequence
tcctctgccgatcgctcgcc

SEQ ID NO: 235829 - DNA, 20 bp, Artificial
  CRISPR gRNA sequence
ctctgccgatcgctcgcccc

SEQ ID NO: 235830 - DNA, 20 bp, Artificial
  CRISPR gRNA sequence
tgccgatcgctcgccccgct

SEQ ID NO: 235831 - DNA, 20 bp, Artificial
  CRISPR gRNA sequence
ccgatcgctcgccccgctct

SEQ ID NO: 235832 - DNA, 20 bp, Artificial
  CRISPR gRNA sequence
gccccgctcttcctcgggga

SEQ ID NO: 235833 - DNA, 20 bp, Artificial
  CRISPR gRNA sequence
ttcctcggggaactggcagc

SEQ ID NO: 235834 - DNA, 20 bp, Artificial
  CRISPR gRNA sequence
cctcggggaactggcagctt

SEQ ID NO: 235835 - DNA, 20 bp, Artificial
  CRISPR gRNA sequence
ctcggggaactggcagcttc

SEQ ID NO: 235836 - DNA, 20 bp, Artificial
  CRISPR gRNA sequence
ggggaactggcagcttctgg

SEQ ID NO: 235837 - DNA, 20 bp, Artificial
  CRISPR gRNA sequence
gcagcttctggcgtcttcgg

SEQ ID NO: 235838 - DNA, 20 bp, Artificial
  CRISPR gRNA sequence
ctggcgtcttcggtcgacgg

SEQ ID NO: 235839 - DNA, 20 bp, Artificial
  CRISPR gRNA sequence
tggcgtcttcggtcgacggc

SEQ ID NO: 235840 - DNA, 20 bp, Artificial
  CRISPR gRNA sequence
gcgtcttcggtcgacggcgg

SEQ ID NO: 235841 - DNA, 20 bp, Artificial
  CRISPR gRNA sequence
cggtcgacggcggcacctcc

SEQ ID NO: 235842 - DNA, 20 bp, Artificial
  CRISPR gRNA sequence
ggtcgacggcggcacctcca

SEQ ID NO: 235843 - DNA, 20 bp, Artificial
  CRISPR gRNA sequence
cagcagcagctgggtctctg

SEQ ID NO: 235844 - DNA, 20 bp, Artificial
  CRISPR gRNA sequence
ggtctctgcaggggggccac

SEQ ID NO: 235845 - DNA, 20 bp, Artificial
  CRISPR gRNA sequence
tgcaggggggccacggtcag

SEQ ID NO: 235846 - DNA, 20 bp, Artificial
  CRISPR gRNA sequence
caggggggccacggtcagca

SEQ ID NO: 235847 - DNA, 20 bp, Artificial
  CRISPR gRNA sequence
ccacctccccgcaccaggct

SEQ ID NO: 235848 - DNA, 20 bp, Artificial
  CRISPR gRNA sequence
cccgcaccaggctgtgacag

SEQ ID NO: 235849 - DNA, 20 bp, Artificial
  CRISPR gRNA sequence
tgacagacctcggggccaca

SEQ ID NO: 235850 - DNA, 20 bp, Artificial
  CRISPR gRNA sequence
ggggccacatgcactgactc

SEQ ID NO: 235851 - DNA, 20 bp, Artificial
  CRISPR gRNA sequence
actcctcagctgccagatgt

SEQ ID NO: 235852 - DNA, 20 bp, Artificial
  CRISPR gRNA sequence
ctcagctgccagatgtgcag

SEQ ID NO: 235853 - DNA, 20 bp, Artificial
  CRISPR gRNA sequence
agctgccagatgtgcagtcc

SEQ ID NO: 235854 - DNA, 20 bp, Artificial
  CRISPR gRNA sequence
ccagatgtgcagtccaagct

SEQ ID NO: 235855 - DNA, 20 bp, Artificial
  CRISPR gRNA sequence
ggccgaggtcaggaggagga

SEQ ID NO: 235856 - DNA, 20 bp, Artificial
  CRISPR gRNA sequence
tgccggcggggaccctggga

SEQ ID NO: 235857 - DNA, 20 bp, Artificial
  CRISPR gRNA sequence
ccggcggggaccctgggacg

SEQ ID NO: 235858 - DNA, 20 bp, Artificial
  CRISPR gRNA sequence
ggacgcacacagcgttgtgg

SEQ ID NO: 235859 - DNA, 20 bp, Artificial
  CRISPR gRNA sequence
tgggtcttgttcccagggaa

SEQ ID NO: 235860 - DNA, 20 bp, Artificial
  CRISPR gRNA sequence
gttcccagggaacacagtga

SEQ ID NO: 235861 - DNA, 20 bp, Artificial
  CRISPR gRNA sequence
ttcccagggaacacagtgag

SEQ ID NO: 235862 - DNA, 20 bp, Artificial
  CRISPR gRNA sequence
ccagggaacacagtgagaaa

SEQ ID NO: 235863 - DNA, 20 bp, Artificial
  CRISPR gRNA sequence
ggtgcagctggaatacatgg

SEQ ID NO: 235864 - DNA, 20 bp, Artificial
  CRISPR gRNA sequence
gaatacatggacgcggcctc

SEQ ID NO: 235865 - DNA, 20 bp, Artificial
  CRISPR gRNA sequence
ctatcagcccccggacacgg

SEQ ID NO: 235866 - DNA, 20 bp, Artificial
  CRISPR gRNA sequence
tcagcccccggacacggcct

SEQ ID NO: 235867 - DNA, 20 bp, Artificial
  CRISPR gRNA sequence
cgatcagcccccggctgctg

SEQ ID NO: 235868 - DNA, 20 bp, Artificial
  CRISPR gRNA sequence
ctgccctccgtgctgtctgg

SEQ ID NO: 235869 - DNA, 20 bp, Artificial
  CRISPR gRNA sequence
ccctccgtgctgtctggggc

SEQ ID NO: 235870 - DNA, 20 bp, Artificial
  CRISPR gRNA sequence
cgtgctgtctggggcaaggg

SEQ ID NO: 235871 - DNA, 20 bp, Artificial
  CRISPR gRNA sequence
tctggggcaagggacaggag

SEQ ID NO: 235872 - DNA, 20 bp, Artificial
  CRISPR gRNA sequence
gggcaagggacaggagagga

SEQ ID NO: 235873 - DNA, 20 bp, Artificial
  CRISPR gRNA sequence
cctcagagtgggcctggacc

SEQ ID NO: 235874 - DNA, 20 bp, Artificial
  CRISPR gRNA sequence
ctcagagtgggcctggacca

SEQ ID NO: 235875 - DNA, 20 bp, Artificial
  CRISPR gRNA sequence
agagtgggcctggaccaccc

SEQ ID NO: 235876 - DNA, 20 bp, Artificial
  CRISPR gRNA sequence
gaccacccggccaccggcag

SEQ ID NO: 235877 - DNA, 20 bp, Artificial
  CRISPR gRNA sequence
actctgtccaaggtttgcag

SEQ ID NO: 235878 - DNA, 20 bp, Artificial
  CRISPR gRNA sequence
tgtccaaggtttgcagtggc

SEQ ID NO: 235879 - DNA, 20 bp, Artificial
  CRISPR gRNA sequence
tccaaggtttgcagtggcct

SEQ ID NO: 235880 - DNA, 20 bp, Artificial
  CRISPR gRNA sequence
gcagtggccttcgtggcccc

SEQ ID NO: 235881 - DNA, 20 bp, Artificial
  CRISPR gRNA sequence
cagtggccttcgtggccccc

SEQ ID NO: 235882 - DNA, 20 bp, Artificial
  CRISPR gRNA sequence
cgtggcccccggagaaggtc

SEQ ID NO: 235883 - DNA, 20 bp, Artificial
  CRISPR gRNA sequence
gtggcccccggagaaggtcc

SEQ ID NO: 235884 - DNA, 20 bp, Artificial
  CRISPR gRNA sequence
gaagccaaaactgaatttcc

SEQ ID NO: 235885 - DNA, 20 bp, Artificial
  CRISPR gRNA sequence
aatttccctggtgtggggtg

SEQ ID NO: 235886 - DNA, 20 bp, Artificial
  CRISPR gRNA sequence
ccctggtgtggggtgtgggg

SEQ ID NO: 235887 - DNA, 20 bp, Artificial
  CRISPR gRNA sequence
cctggtgtggggtgtggggg

SEQ ID NO: 235888 - DNA, 20 bp, Artificial
  CRISPR gRNA sequence
gtgtggggtgtggggggagg

SEQ ID NO: 235889 - DNA, 20 bp, Artificial
  CRISPR gRNA sequence
gtggagttgctgggatggat

SEQ ID NO: 235890 - DNA, 20 bp, Artificial
  CRISPR gRNA sequence
ctgggatggatgaggagggc

SEQ ID NO: 235891 - DNA, 20 bp, Artificial
  CRISPR gRNA sequence
ggatggatgaggagggcgtc

SEQ ID NO: 235892 - DNA, 20 bp, Artificial
  CRISPR gRNA sequence
gggtctgggtgctgagtaga

SEQ ID NO: 235893 - DNA, 20 bp, Artificial
  CRISPR gRNA sequence
ggtgctgagtagaatgcccc

SEQ ID NO: 235894 - DNA, 20 bp, Artificial
  CRISPR gRNA sequence
agtagaatgccccccccatc

SEQ ID NO: 235895 - DNA, 20 bp, Artificial
  CRISPR gRNA sequence
aacagagttcttcatggccc

SEQ ID NO: 235896 - DNA, 20 bp, Artificial
  CRISPR gRNA sequence
ttcatggcccaggactgggg

SEQ ID NO: 235897 - DNA, 20 bp, Artificial
  CRISPR gRNA sequence
catggcccaggactggggcc

SEQ ID NO: 235898 - DNA, 20 bp, Artificial
  CRISPR gRNA sequence
atggcccaggactggggccc

SEQ ID NO: 235899 - DNA, 20 bp, Artificial
  CRISPR gRNA sequence
gggcccatgtctgcccgtcc

SEQ ID NO: 235900 - DNA, 20 bp, Artificial
  CRISPR gRNA sequence
cccgtcccaggtggggcgtc

SEQ ID NO: 235901 - DNA, 20 bp, Artificial
  CRISPR gRNA sequence
gggtggggcccagtgagggc

SEQ ID NO: 235902 - DNA, 20 bp, Artificial
  CRISPR gRNA sequence
ggggaggtgcgcagagtgca

SEQ ID NO: 235903 - DNA, 20 bp, Artificial
  CRISPR gRNA sequence
ccagggaggggaaaggcctg

SEQ ID NO: 235904 - DNA, 20 bp, Artificial
  CRISPR gRNA sequence
cccattgggggctgagggtg

SEQ ID NO: 235905 - DNA, 20 bp, Artificial
  CRISPR gRNA sequence
ggggctgagggtgggcagaa

SEQ ID NO: 235906 - DNA, 20 bp, Artificial
  CRISPR gRNA sequence
agggtgggcagaagccaggc

SEQ ID NO: 235907 - DNA, 20 bp, Artificial
  CRISPR gRNA sequence
ggtcccagttgaccccagac

SEQ ID NO: 235908 - DNA, 20 bp, Artificial
  CRISPR gRNA sequence
accccagaccctgccccgtc

SEQ ID NO: 235909 - DNA, 20 bp, Artificial
  CRISPR gRNA sequence
ccccgtccaacctgacacaa

SEQ ID NO: 235910 - DNA, 20 bp, Artificial
  CRISPR gRNA sequence
acacaacctccccagttgta

SEQ ID NO: 235911 - DNA, 20 bp, Artificial
  CRISPR gRNA sequence
cccagttgtaccttctccca

SEQ ID NO: 235912 - DNA, 20 bp, Artificial
  CRISPR gRNA sequence
taccttctcccagctctcat

SEQ ID NO: 235913 - DNA, 20 bp, Artificial
  CRISPR gRNA sequence
ctcccagctctcatgtgccc

SEQ ID NO: 235914 - DNA, 20 bp, Artificial
  CRISPR gRNA sequence
tcccagctctcatgtgccca

SEQ ID NO: 235915 - DNA, 20 bp, Artificial
  CRISPR gRNA sequence
ccagctctcatgtgcccagc

SEQ ID NO: 235916 - DNA, 20 bp, Artificial
  CRISPR gRNA sequence
tcatgtgcccagcctgacct

SEQ ID NO: 235917 - DNA, 20 bp, Artificial
  CRISPR gRNA sequence
atgtgcccagcctgacctct

SEQ ID NO: 235918 - DNA, 20 bp, Artificial
  CRISPR gRNA sequence
acctctcctgtcaggtaaac

SEQ ID NO: 235919 - DNA, 20 bp, Artificial
  CRISPR gRNA sequence
tcctgtcaggtaaacaagcc

SEQ ID NO: 235920 - DNA, 20 bp, Artificial
  CRISPR gRNA sequence
ctgtcaggtaaacaagccgc

SEQ ID NO: 235921 - DNA, 20 bp, Artificial
  CRISPR gRNA sequence
tcaggtaaacaagccgctaa

SEQ ID NO: 235922 - DNA, 20 bp, Artificial
  CRISPR gRNA sequence
agaggacttgagctgctcct

SEQ ID NO: 235923 - DNA, 20 bp, Artificial
  CRISPR gRNA sequence
gagctgctccttccagaaca

SEQ ID NO: 235924 - DNA, 20 bp, Artificial
  CRISPR gRNA sequence
agctgctccttccagaacag

SEQ ID NO: 235925 - DNA, 20 bp, Artificial
  CRISPR gRNA sequence
ctccttccagaacagggtgc

SEQ ID NO: 235926 - DNA, 20 bp, Artificial
  CRISPR gRNA sequence
cttccagaacagggtgcagc

SEQ ID NO: 235927 - DNA, 20 bp, Artificial
  CRISPR gRNA sequence
ccagaacagggtgcagcccc

SEQ ID NO: 235928 - DNA, 20 bp, Artificial
  CRISPR gRNA sequence
cagaacagggtgcagcccca

SEQ ID NO: 235929 - DNA, 20 bp, Artificial
  CRISPR gRNA sequence
cggggggcacagggcaggct

SEQ ID NO: 235930 - DNA, 20 bp, Artificial
  CRISPR gRNA sequence
tttcagtatgtggtgaggac

SEQ ID NO: 235931 - DNA, 20 bp, Artificial
  CRISPR gRNA sequence
tcagtatgtggtgaggacag

SEQ ID NO: 235932 - DNA, 20 bp, Artificial
  CRISPR gRNA sequence
cagtatgtggtgaggacaga

SEQ ID NO: 235933 - DNA, 20 bp, Artificial
  CRISPR gRNA sequence
agtatgtggtgaggacagac

SEQ ID NO: 235934 - DNA, 20 bp, Artificial
  CRISPR gRNA sequence
agagccagacagctcctgga

SEQ ID NO: 235935 - DNA, 20 bp, Artificial
  CRISPR gRNA sequence
ctggaacccgcccccacctc

SEQ ID NO: 235936 - DNA, 20 bp, Artificial
  CRISPR gRNA sequence
gaacccgcccccacctcccc

SEQ ID NO: 235937 - DNA, 20 bp, Artificial
  CRISPR gRNA sequence
cccgcagggttctcacagcc

SEQ ID NO: 235938 - DNA, 20 bp, Artificial
  CRISPR gRNA sequence
tcacagccctcgtgctggat

SEQ ID NO: 235939 - DNA, 20 bp, Artificial
  CRISPR gRNA sequence
acagccctcgtgctggatgg

SEQ ID NO: 235940 - DNA, 20 bp, Artificial
  CRISPR gRNA sequence
gtgctggatggagaagccca

SEQ ID NO: 235941 - DNA, 20 bp, Artificial
  CRISPR gRNA sequence
gatggagaagcccaggctga

SEQ ID NO: 235942 - DNA, 20 bp, Artificial
  CRISPR gRNA sequence
agaaagcagggacaggacac

SEQ ID NO: 235943 - DNA, 20 bp, Artificial
  CRISPR gRNA sequence
catggcctgtggtgcctgag

SEQ ID NO: 235944 - DNA, 20 bp, Artificial
  CRISPR gRNA sequence
atggcctgtggtgcctgagc

SEQ ID NO: 235945 - DNA, 20 bp, Artificial
  CRISPR gRNA sequence
tggtgcctgagcatggcctg

SEQ ID NO: 235946 - DNA, 20 bp, Artificial
  CRISPR gRNA sequence
agcatggcctggcctgcccg

SEQ ID NO: 235947 - DNA, 20 bp, Artificial
  CRISPR gRNA sequence
gcctgcccggcctcacagga

SEQ ID NO: 235948 - DNA, 20 bp, Artificial
  CRISPR gRNA sequence
cccggcctcacaggactccg

SEQ ID NO: 235949 - DNA, 20 bp, Artificial
  CRISPR gRNA sequence
acaggactccggaccccaca

SEQ ID NO: 235950 - DNA, 20 bp, Artificial
  CRISPR gRNA sequence
cggaccccacacaccacatg

SEQ ID NO: 235951 - DNA, 20 bp, Artificial
  CRISPR gRNA sequence
gccggacacctgtgcccacg

SEQ ID NO: 235952 - DNA, 20 bp, Artificial
  CRISPR gRNA sequence
tgcccacgagctctgcctcg

SEQ ID NO: 235953 - DNA, 20 bp, Artificial
  CRISPR gRNA sequence
tgcctcgggccctagtggaa

SEQ ID NO: 235954 - DNA, 20 bp, Artificial
  CRISPR gRNA sequence
cctcgggccctagtggaacc

SEQ ID NO: 235955 - DNA, 20 bp, Artificial
  CRISPR gRNA sequence
gggccctagtggaacccctg

SEQ ID NO: 235956 - DNA, 20 bp, Artificial
  CRISPR gRNA sequence
gtggaacccctggcctgtgt

SEQ ID NO: 235957 - DNA, 20 bp, Artificial
  CRISPR gRNA sequence
gcctgtgtggactcccagag

SEQ ID NO: 235958 - DNA, 20 bp, Artificial
  CRISPR gRNA sequence
tgtggactcccagaggcacc

SEQ ID NO: 235959 - DNA, 20 bp, Artificial
  CRISPR gRNA sequence
ccagaggcacctccaggact

SEQ ID NO: 235960 - DNA, 20 bp, Artificial
  CRISPR gRNA sequence
caggacttaccctgggactg

SEQ ID NO: 235961 - DNA, 20 bp, Artificial
  CRISPR gRNA sequence
accctgggactgtaccccct

SEQ ID NO: 235962 - DNA, 20 bp, Artificial
  CRISPR gRNA sequence
ccctgggactgtaccccctg

SEQ ID NO: 235963 - DNA, 20 bp, Artificial
  CRISPR gRNA sequence
ggactgtaccccctggcctg

SEQ ID NO: 235964 - DNA, 20 bp, Artificial
  CRISPR gRNA sequence
taccccctggcctgggggac

SEQ ID NO: 235965 - DNA, 20 bp, Artificial
  CRISPR gRNA sequence
gcctgggggacaagggtggt

SEQ ID NO: 235966 - DNA, 20 bp, Artificial
  CRISPR gRNA sequence
ggggacaagggtggtgccgg

SEQ ID NO: 235967 - DNA, 20 bp, Artificial
  CRISPR gRNA sequence
cgcagtggaattcaggctgg

SEQ ID NO: 235968 - DNA, 20 bp, Artificial
  CRISPR gRNA sequence
aggctggacacacatgcagt

SEQ ID NO: 235969 - DNA, 20 bp, Artificial
  CRISPR gRNA sequence
gacacacatgcagtcccact

SEQ ID NO: 235970 - DNA, 20 bp, Artificial
  CRISPR gRNA sequence
ggaacagcactcctcgcctg

SEQ ID NO: 235971 - DNA, 20 bp, Artificial
  CRISPR gRNA sequence
ctcgcctgggcaggagacag

SEQ ID NO: 235972 - DNA, 20 bp, Artificial
  CRISPR gRNA sequence
gcctgggcaggagacaggcc

SEQ ID NO: 235973 - DNA, 20 bp, Artificial
  CRISPR gRNA sequence
ggcaggagacaggccagccc

SEQ ID NO: 235974 - DNA, 20 bp, Artificial
  CRISPR gRNA sequence
ggctgaggccccctcctccc

SEQ ID NO: 235975 - DNA, 20 bp, Artificial
  CRISPR gRNA sequence
aggccccctcctccccaggc

SEQ ID NO: 235976 - DNA, 20 bp, Artificial
  CRISPR gRNA sequence
ctccccaggcctcccctcgg

SEQ ID NO: 235977 - DNA, 20 bp, Artificial
  CRISPR gRNA sequence
cccaggcctcccctcggccc

SEQ ID NO: 235978 - DNA, 20 bp, Artificial
  CRISPR gRNA sequence
ccctcggccctccaggggag

SEQ ID NO: 235979 - DNA, 20 bp, Artificial
  CRISPR gRNA sequence
ggccctccaggggagtgagg

SEQ ID NO: 235980 - DNA, 20 bp, Artificial
  CRISPR gRNA sequence
caggggagtgaggttgtccg

SEQ ID NO: 235981 - DNA, 20 bp, Artificial
  CRISPR gRNA sequence
tccgttctccacccacagtt

SEQ ID NO: 235982 - DNA, 20 bp, Artificial
  CRISPR gRNA sequence
tccacccacagttggctcca

SEQ ID NO: 235983 - DNA, 20 bp, Artificial
  CRISPR gRNA sequence
cacccacagttggctccagg

SEQ ID NO: 235984 - DNA, 20 bp, Artificial
  CRISPR gRNA sequence
gctccagggagcagagggct

SEQ ID NO: 235985 - DNA, 20 bp, Artificial
  CRISPR gRNA sequence
cagggagcagagggctcctg

SEQ ID NO: 235986 - DNA, 20 bp, Artificial
  CRISPR gRNA sequence
ctggctgggagtctggaccc

SEQ ID NO: 235987 - DNA, 20 bp, Artificial
  CRISPR gRNA sequence
gctgggagtctggaccctgg

SEQ ID NO: 235988 - DNA, 20 bp, Artificial
  CRISPR gRNA sequence
ggagtctggaccctgggttt

SEQ ID NO: 235989 - DNA, 20 bp, Artificial
  CRISPR gRNA sequence
gaccctgggtttatccagct

SEQ ID NO: 235990 - DNA, 20 bp, Artificial
  CRISPR gRNA sequence
ggtttatccagctgtctctt

SEQ ID NO: 235991 - DNA, 20 bp, Artificial
  CRISPR gRNA sequence
atccagctgtctctttctcc

SEQ ID NO: 235992 - DNA, 20 bp, Artificial
  CRISPR gRNA sequence
tccagctgtctctttctcct

SEQ ID NO: 235993 - DNA, 20 bp, Artificial
  CRISPR gRNA sequence
tctctttctcctggggccat

SEQ ID NO: 235994 - DNA, 20 bp, Artificial
  CRISPR gRNA sequence
tttctcctggggccatgtgg

SEQ ID NO: 235995 - DNA, 20 bp, Artificial
  CRISPR gRNA sequence
tctcctggggccatgtggcc

SEQ ID NO: 235996 - DNA, 20 bp, Artificial
  CRISPR gRNA sequence
ctcctggggccatgtggcct

SEQ ID NO: 235997 - DNA, 20 bp, Artificial
  CRISPR gRNA sequence
tcctggggccatgtggcctg

SEQ ID NO: 235998 - DNA, 20 bp, Artificial
  CRISPR gRNA sequence
ctggggccatgtggcctggc

SEQ ID NO: 235999 - DNA, 20 bp, Artificial
  CRISPR gRNA sequence
gggccatgtggcctggctac

SEQ ID NO: 236000 - DNA, 20 bp, Artificial
  CRISPR gRNA sequence
gctactccccctttgcgccc

SEQ ID NO: 236001 - DNA, 20 bp, Artificial
  CRISPR gRNA sequence
ctccccctttgcgccccaca

SEQ ID NO: 236002 - DNA, 20 bp, Artificial
  CRISPR gRNA sequence
cccctttgcgccccacagct

SEQ ID NO: 236003 - DNA, 20 bp, Artificial
  CRISPR gRNA sequence
tgcgccccacagctgcccct

SEQ ID NO: 236004 - DNA, 20 bp, Artificial
  CRISPR gRNA sequence
gcgccccacagctgcccctg

SEQ ID NO: 236005 - DNA, 20 bp, Artificial
  CRISPR gRNA sequence
cgccccacagctgcccctgc

SEQ ID NO: 236006 - DNA, 20 bp, Artificial
  CRISPR gRNA sequence
cccctgcccaggtgctaact

SEQ ID NO: 236007 - DNA, 20 bp, Artificial
  CRISPR gRNA sequence
cccaggtgctaactccatat

SEQ ID NO: 236008 - DNA, 20 bp, Artificial
  CRISPR gRNA sequence
actccatatgcaaccaggag

SEQ ID NO: 236009 - DNA, 20 bp, Artificial
  CRISPR gRNA sequence
catatgcaaccaggagctgc

SEQ ID NO: 236010 - DNA, 20 bp, Artificial
  CRISPR gRNA sequence
cccctgcaggacccaggggt

SEQ ID NO: 236011 - DNA, 20 bp, Artificial
  CRISPR gRNA sequence
caggacccaggggtggcccc

SEQ ID NO: 236012 - DNA, 20 bp, Artificial
  CRISPR gRNA sequence
gaggcccgtcgacacctcag

SEQ ID NO: 236013 - DNA, 20 bp, Artificial
  CRISPR gRNA sequence
agaggccgcctgcctggtgt

SEQ ID NO: 236014 - DNA, 20 bp, Artificial
  CRISPR gRNA sequence
cctggtgtctgggcgctgct

SEQ ID NO: 236015 - DNA, 20 bp, Artificial
  CRISPR gRNA sequence
gtgtctgggcgctgctgtcc

SEQ ID NO: 236016 - DNA, 20 bp, Artificial
  CRISPR gRNA sequence
ggcgctgctgtccccaccac

SEQ ID NO: 236017 - DNA, 20 bp, Artificial
  CRISPR gRNA sequence
ctgtccccaccaccagccac

SEQ ID NO: 236018 - DNA, 20 bp, Artificial
  CRISPR gRNA sequence
tccccaccaccagccacact

SEQ ID NO: 236019 - DNA, 20 bp, Artificial
  CRISPR gRNA sequence
ggcctccggacagagcctcc

SEQ ID NO: 236020 - DNA, 20 bp, Artificial
  CRISPR gRNA sequence
cggacagagcctcccttccc

SEQ ID NO: 236021 - DNA, 20 bp, Artificial
  CRISPR gRNA sequence
ccttcccaacccacaggccc

SEQ ID NO: 236022 - DNA, 20 bp, Artificial
  CRISPR gRNA sequence
cccaacccacaggccctgga

SEQ ID NO: 236023 - DNA, 20 bp, Artificial
  CRISPR gRNA sequence
ccaacccacaggccctggag

SEQ ID NO: 236024 - DNA, 20 bp, Artificial
  CRISPR gRNA sequence
gaggaagaagctctggggtg

SEQ ID NO: 236025 - DNA, 20 bp, Artificial
  CRISPR gRNA sequence
tggggtgacttccctgccag

SEQ ID NO: 236026 - DNA, 20 bp, Artificial
  CRISPR gRNA sequence
gggtgacttccctgccagct

SEQ ID NO: 236027 - DNA, 20 bp, Artificial
  CRISPR gRNA sequence
ccctgccagcttcctctcca

SEQ ID NO: 236028 - DNA, 20 bp, Artificial
  CRISPR gRNA sequence
cctgccagcttcctctccag

SEQ ID NO: 236029 - DNA, 20 bp, Artificial
  CRISPR gRNA sequence
ccagcttcctctccagacca

SEQ ID NO: 236030 - DNA, 20 bp, Artificial
  CRISPR gRNA sequence
cctctccagaccagccgtgt

SEQ ID NO: 236031 - DNA, 20 bp, Artificial
  CRISPR gRNA sequence
ctctccagaccagccgtgtc

SEQ ID NO: 236032 - DNA, 20 bp, Artificial
  CRISPR gRNA sequence
tccagaccagccgtgtcagc

SEQ ID NO: 236033 - DNA, 20 bp, Artificial
  CRISPR gRNA sequence
cagaccagccgtgtcagctg

SEQ ID NO: 236034 - DNA, 20 bp, Artificial
  CRISPR gRNA sequence
aaccctcatccccaggtgca

SEQ ID NO: 236035 - DNA, 20 bp, Artificial
  CRISPR gRNA sequence
atccccaggtgcaggtcaga

SEQ ID NO: 236036 - DNA, 20 bp, Artificial
  CRISPR gRNA sequence
aactgggcaggagggggctg

SEQ ID NO: 236037 - DNA, 20 bp, Artificial
  CRISPR gRNA sequence
ggcaggagggggctgggcga

SEQ ID NO: 236038 - DNA, 20 bp, Artificial
  CRISPR gRNA sequence
ggcgatggccaagggctcac

SEQ ID NO: 236039 - DNA, 20 bp, Artificial
  CRISPR gRNA sequence
acgacccgcccagcaggacc

SEQ ID NO: 236040 - DNA, 20 bp, Artificial
  CRISPR gRNA sequence
gaacagccgtcctccacctc

SEQ ID NO: 236041 - DNA, 20 bp, Artificial
  CRISPR gRNA sequence
cacctccagaccccagaccc

SEQ ID NO: 236042 - DNA, 20 bp, Artificial
  CRISPR gRNA sequence
cagaccccagacccctcttg

SEQ ID NO: 236043 - DNA, 20 bp, Artificial
  CRISPR gRNA sequence
ttgagggcgctcccacctgg

SEQ ID NO: 236044 - DNA, 20 bp, Artificial
  CRISPR gRNA sequence
gagggcgctcccacctggct

SEQ ID NO: 236045 - DNA, 20 bp, Artificial
  CRISPR gRNA sequence
agggcgctcccacctggctc

SEQ ID NO: 236046 - DNA, 20 bp, Artificial
  CRISPR gRNA sequence
ccacctggctcacccctgct

SEQ ID NO: 236047 - DNA, 20 bp, Artificial
  CRISPR gRNA sequence
gctcacccctgctcccggcc

SEQ ID NO: 236048 - DNA, 20 bp, Artificial
  CRISPR gRNA sequence
acccctgctcccggccgggg

SEQ ID NO: 236049 - DNA, 20 bp, Artificial
  CRISPR gRNA sequence
ctcccggccggggccactgg

SEQ ID NO: 236050 - DNA, 20 bp, Artificial
  CRISPR gRNA sequence
ccggccggggccactggctg

SEQ ID NO: 236051 - DNA, 20 bp, Artificial
  CRISPR gRNA sequence
gctggagctggcacacctcc

SEQ ID NO: 236052 - DNA, 20 bp, Artificial
  CRISPR gRNA sequence
gagctggcacacctccgcct

SEQ ID NO: 236053 - DNA, 20 bp, Artificial
  CRISPR gRNA sequence
gcacacctccgcctccctct

SEQ ID NO: 236054 - DNA, 20 bp, Artificial
  CRISPR gRNA sequence
cgcctccctctgggatcctg

SEQ ID NO: 236055 - DNA, 20 bp, Artificial
  CRISPR gRNA sequence
cctctgggatcctgcctccc

SEQ ID NO: 236056 - DNA, 20 bp, Artificial
  CRISPR gRNA sequence
tgggatcctgcctccctccg

SEQ ID NO: 236057 - DNA, 20 bp, Artificial
  CRISPR gRNA sequence
ggatcctgcctccctccgga

SEQ ID NO: 236058 - DNA, 20 bp, Artificial
  CRISPR gRNA sequence
cctccctccggaaggctccc

SEQ ID NO: 236059 - DNA, 20 bp, Artificial
  CRISPR gRNA sequence
cctccggaaggctcccgctg

SEQ ID NO: 236060 - DNA, 20 bp, Artificial
  CRISPR gRNA sequence
cggaaggctcccgctgctgg

SEQ ID NO: 236061 - DNA, 20 bp, Artificial
  CRISPR gRNA sequence
ccgctgctggcggctctgtg

SEQ ID NO: 236062 - DNA, 20 bp, Artificial
  CRISPR gRNA sequence
ctggcggctctgtgcccacc

SEQ ID NO: 236063 - DNA, 20 bp, Artificial
  CRISPR gRNA sequence
gcggctctgtgcccaccctc

SEQ ID NO: 236064 - DNA, 20 bp, Artificial
  CRISPR gRNA sequence
tgtgcccaccctccttagac

SEQ ID NO: 236065 - DNA, 20 bp, Artificial
  CRISPR gRNA sequence
tgcccaccctccttagacct

SEQ ID NO: 236066 - DNA, 20 bp, Artificial
  CRISPR gRNA sequence
cttagacctcagcaacgccg

SEQ ID NO: 236067 - DNA, 20 bp, Artificial
  CRISPR gRNA sequence
agacctcagcaacgccggtc

SEQ ID NO: 236068 - DNA, 20 bp, Artificial
  CRISPR gRNA sequence
gacctcagcaacgccggtct

SEQ ID NO: 236069 - DNA, 20 bp, Artificial
  CRISPR gRNA sequence
agcaacgccggtctgagcac

SEQ ID NO: 236070 - DNA, 20 bp, Artificial
  CRISPR gRNA sequence
agcacgggaaggggggcgcc

SEQ ID NO: 236071 - DNA, 20 bp, Artificial
  CRISPR gRNA sequence
ccgcgggacgccttggccgg

SEQ ID NO: 236072 - DNA, 20 bp, Artificial
  CRISPR gRNA sequence
cgcgggacgccttggccggt

SEQ ID NO: 236073 - DNA, 20 bp, Artificial
  CRISPR gRNA sequence
ggccggtccgcgttaagtaa

SEQ ID NO: 236074 - DNA, 20 bp, Artificial
  CRISPR gRNA sequence
gccggtccgcgttaagtaaa

SEQ ID NO: 236075 - DNA, 20 bp, Artificial
  CRISPR gRNA sequence
agtaaacgcggtttacttac

SEQ ID NO: 236076 - DNA, 20 bp, Artificial
  CRISPR gRNA sequence
acttacccgggtaatcgcgg

SEQ ID NO: 236077 - DNA, 20 bp, Artificial
  CRISPR gRNA sequence
cttacccgggtaatcgcggc

SEQ ID NO: 236078 - DNA, 20 bp, Artificial
  CRISPR gRNA sequence
acccgggtaatcgcggcagc

SEQ ID NO: 236079 - DNA, 20 bp, Artificial
  CRISPR gRNA sequence
cccgggtaatcgcggcagca

SEQ ID NO: 236080 - DNA, 20 bp, Artificial
  CRISPR gRNA sequence
ccgtcccaagcaggaggcgc

SEQ ID NO: 236081 - DNA, 20 bp, Artificial
  CRISPR gRNA sequence
acccaggctgagcgcgcaca

SEQ ID NO: 236082 - DNA, 20 bp, Artificial
  CRISPR gRNA sequence
agcgcgcacagcagcgccag

SEQ ID NO: 236083 - DNA, 20 bp, Artificial
  CRISPR gRNA sequence
tgccatgctcgggtttcaag

SEQ ID NO: 236084 - DNA, 20 bp, Artificial
  CRISPR gRNA sequence
gggtttcaagagcccacagc

SEQ ID NO: 236085 - DNA, 20 bp, Artificial
  CRISPR gRNA sequence
caagagcccacagccagttg

SEQ ID NO: 236086 - DNA, 20 bp, Artificial
  CRISPR gRNA sequence
aagagcccacagccagttgg

SEQ ID NO: 236087 - DNA, 20 bp, Artificial
  CRISPR gRNA sequence
gacacgccccgtccccgtcc

SEQ ID NO: 236088 - DNA, 20 bp, Artificial
  CRISPR gRNA sequence
acccgccctgcccggaggtg

SEQ ID NO: 236089 - DNA, 20 bp, Artificial
  CRISPR gRNA sequence
cccggaggtggctgggaccg

SEQ ID NO: 236090 - DNA, 20 bp, Artificial
  CRISPR gRNA sequence
ggaccgttcatgacctgaga

SEQ ID NO: 236091 - DNA, 20 bp, Artificial
  CRISPR gRNA sequence
atgacctgagaatcccgacc

SEQ ID NO: 236092 - DNA, 20 bp, Artificial
  CRISPR gRNA sequence
agaatcccgacccaggtgaa

SEQ ID NO: 236093 - DNA, 20 bp, Artificial
  CRISPR gRNA sequence
cggacacagcccggtccccc

SEQ ID NO: 236094 - DNA, 20 bp, Artificial
  CRISPR gRNA sequence
gcggggatcagaaaggtttt

SEQ ID NO: 236095 - DNA, 20 bp, Artificial
  CRISPR gRNA sequence
tctatgcaaagtctgcggcc

SEQ ID NO: 236096 - DNA, 20 bp, Artificial
  CRISPR gRNA sequence
ctatgcaaagtctgcggcca

SEQ ID NO: 236097 - DNA, 20 bp, Artificial
  CRISPR gRNA sequence
tatgcaaagtctgcggccac

SEQ ID NO: 236098 - DNA, 20 bp, Artificial
  CRISPR gRNA sequence
tgcatagaaaacctttctga

SEQ ID NO: 236099 - DNA, 20 bp, Artificial
  CRISPR gRNA sequence
gcatagaaaacctttctgat

SEQ ID NO: 236100 - DNA, 20 bp, Artificial
  CRISPR gRNA sequence
catagaaaacctttctgatc

SEQ ID NO: 236101 - DNA, 20 bp, Artificial
  CRISPR gRNA sequence
tctgatccccgccagcctgg

SEQ ID NO: 236102 - DNA, 20 bp, Artificial
  CRISPR gRNA sequence
ctgatccccgccagcctggt

SEQ ID NO: 236103 - DNA, 20 bp, Artificial
  CRISPR gRNA sequence
tgatccccgccagcctggtt

SEQ ID NO: 236104 - DNA, 20 bp, Artificial
  CRISPR gRNA sequence
atccccgccagcctggtttc

SEQ ID NO: 236105 - DNA, 20 bp, Artificial
  CRISPR gRNA sequence
gtttccccgcccctgccggc

SEQ ID NO: 236106 - DNA, 20 bp, Artificial
  CRISPR gRNA sequence
ccccgcccctgccggcgacc

SEQ ID NO: 236107 - DNA, 20 bp, Artificial
  CRISPR gRNA sequence
cccgcccctgccggcgacct

SEQ ID NO: 236108 - DNA, 20 bp, Artificial
  CRISPR gRNA sequence
ccggcgacctgcgggggacc

SEQ ID NO: 236109 - DNA, 20 bp, Artificial
  CRISPR gRNA sequence
cgggggaccgggctgtgtcc

SEQ ID NO: 236110 - DNA, 20 bp, Artificial
  CRISPR gRNA sequence
tgtccgcagtgtctacaccc

SEQ ID NO: 236111 - DNA, 20 bp, Artificial
  CRISPR gRNA sequence
caccccctcctcacacgcac

SEQ ID NO: 236112 - DNA, 20 bp, Artificial
  CRISPR gRNA sequence
ctcacacgcacttcacctgg

SEQ ID NO: 236113 - DNA, 20 bp, Artificial
  CRISPR gRNA sequence
acacgcacttcacctgggtc

SEQ ID NO: 236114 - DNA, 20 bp, Artificial
  CRISPR gRNA sequence
cacctgggtcgggattctca

SEQ ID NO: 236115 - DNA, 20 bp, Artificial
  CRISPR gRNA sequence
acctgggtcgggattctcag

SEQ ID NO: 236116 - DNA, 20 bp, Artificial
  CRISPR gRNA sequence
ggtcgggattctcaggtcat

SEQ ID NO: 236117 - DNA, 20 bp, Artificial
  CRISPR gRNA sequence
tcaggtcatgaacggtccca

SEQ ID NO: 236118 - DNA, 20 bp, Artificial
  CRISPR gRNA sequence
aggtcatgaacggtcccagc

SEQ ID NO: 236119 - DNA, 20 bp, Artificial
  CRISPR gRNA sequence
cgggcagggcgggtgaggac

SEQ ID NO: 236120 - DNA, 20 bp, Artificial
  CRISPR gRNA sequence
gctgtgggctcttgaaaccc

SEQ ID NO: 236121 - DNA, 20 bp, Artificial
  CRISPR gRNA sequence
tgggctcttgaaacccgagc

SEQ ID NO: 236122 - DNA, 20 bp, Artificial
  CRISPR gRNA sequence
ttgaaacccgagcatggcac

SEQ ID NO: 236123 - DNA, 20 bp, Artificial
  CRISPR gRNA sequence
gaaacccgagcatggcacag

SEQ ID NO: 236124 - DNA, 20 bp, Artificial
  CRISPR gRNA sequence
aaacccgagcatggcacagc

SEQ ID NO: 236125 - DNA, 20 bp, Artificial
  CRISPR gRNA sequence
cgggccctgtgcggcctggc

SEQ ID NO: 236126 - DNA, 20 bp, Artificial
  CRISPR gRNA sequence
gggccctgtgcggcctggcg

SEQ ID NO: 236127 - DNA, 20 bp, Artificial
  CRISPR gRNA sequence
tgcggcctggcgctgctgtg

SEQ ID NO: 236128 - DNA, 20 bp, Artificial
  CRISPR gRNA sequence
gcgctgctgtgcgcgctcag

SEQ ID NO: 236129 - DNA, 20 bp, Artificial
  CRISPR gRNA sequence
ctgtgcgcgctcagcctggg

SEQ ID NO: 236130 - DNA, 20 bp, Artificial
  CRISPR gRNA sequence
tgcgcgctcagcctgggtca

SEQ ID NO: 236131 - DNA, 20 bp, Artificial
  CRISPR gRNA sequence
agcctgggtcagcgccccac

SEQ ID NO: 236132 - DNA, 20 bp, Artificial
  CRISPR gRNA sequence
ggtcagcgccccaccggggg

SEQ ID NO: 236133 - DNA, 20 bp, Artificial
  CRISPR gRNA sequence
ggcgcctcctgcttgggacg

SEQ ID NO: 236134 - DNA, 20 bp, Artificial
  CRISPR gRNA sequence
ctgcttgggacgggaacgga

SEQ ID NO: 236135 - DNA, 20 bp, Artificial
  CRISPR gRNA sequence
cttgggacgggaacggacgc

SEQ ID NO: 236136 - DNA, 20 bp, Artificial
  CRISPR gRNA sequence
gggacgggaacggacgcgcg

SEQ ID NO: 236137 - DNA, 20 bp, Artificial
  CRISPR gRNA sequence
ggacgggaacggacgcgcgc

SEQ ID NO: 236138 - DNA, 20 bp, Artificial
  CRISPR gRNA sequence
ctgccgggttcacacgacgc

SEQ ID NO: 236139 - DNA, 20 bp, Artificial
  CRISPR gRNA sequence
ccgggttcacacgacgcgct

SEQ ID NO: 236140 - DNA, 20 bp, Artificial
  CRISPR gRNA sequence
acacgacgcgctgctgccgc

SEQ ID NO: 236141 - DNA, 20 bp, Artificial
  CRISPR gRNA sequence
ctgccgcgattacccgggta

SEQ ID NO: 236142 - DNA, 20 bp, Artificial
  CRISPR gRNA sequence
ccgcgattacccgggtaagt

SEQ ID NO: 236143 - DNA, 20 bp, Artificial
  CRISPR gRNA sequence
cccgggtaagtaaaccgcgt

SEQ ID NO: 236144 - DNA, 20 bp, Artificial
  CRISPR gRNA sequence
acttaacgcggaccggccaa

SEQ ID NO: 236145 - DNA, 20 bp, Artificial
  CRISPR gRNA sequence
cttaacgcggaccggccaag

SEQ ID NO: 236146 - DNA, 20 bp, Artificial
  CRISPR gRNA sequence
aacgcggaccggccaaggcg

SEQ ID NO: 236147 - DNA, 20 bp, Artificial
  CRISPR gRNA sequence
acgcggaccggccaaggcgt

SEQ ID NO: 236148 - DNA, 20 bp, Artificial
  CRISPR gRNA sequence
cccgtgctcagaccggcgtt

SEQ ID NO: 236149 - DNA, 20 bp, Artificial
  CRISPR gRNA sequence
ccgtgctcagaccggcgttg

SEQ ID NO: 236150 - DNA, 20 bp, Artificial
  CRISPR gRNA sequence
agaccggcgttgctgaggtc

SEQ ID NO: 236151 - DNA, 20 bp, Artificial
  CRISPR gRNA sequence
ctgaggtctaaggagggtgg

SEQ ID NO: 236152 - DNA, 20 bp, Artificial
  CRISPR gRNA sequence
aggtctaaggagggtgggca

SEQ ID NO: 236153 - DNA, 20 bp, Artificial
  CRISPR gRNA sequence
aggagggtgggcacagagcc

SEQ ID NO: 236154 - DNA, 20 bp, Artificial
  CRISPR gRNA sequence
ccggagggaggcaggatccc

SEQ ID NO: 236155 - DNA, 20 bp, Artificial
  CRISPR gRNA sequence
cggagggaggcaggatccca

SEQ ID NO: 236156 - DNA, 20 bp, Artificial
  CRISPR gRNA sequence
cagccagtggccccggccgg

SEQ ID NO: 236157 - DNA, 20 bp, Artificial
  CRISPR gRNA sequence
aagaggggtctggggtctgg

SEQ ID NO: 236158 - DNA, 20 bp, Artificial
  CRISPR gRNA sequence
gggtctggaggtggaggacg

SEQ ID NO: 236159 - DNA, 20 bp, Artificial
  CRISPR gRNA sequence
gaggtggaggacggctgttc

SEQ ID NO: 236160 - DNA, 20 bp, Artificial
  CRISPR gRNA sequence
ttccaggtcctgctgggcgg

SEQ ID NO: 236161 - DNA, 20 bp, Artificial
  CRISPR gRNA sequence
caggtcctgctgggcgggtc

SEQ ID NO: 236162 - DNA, 20 bp, Artificial
  CRISPR gRNA sequence
ctgggcgggtcgtgagccct

SEQ ID NO: 236163 - DNA, 20 bp, Artificial
  CRISPR gRNA sequence
ggcgggtcgtgagcccttgg

SEQ ID NO: 236164 - DNA, 20 bp, Artificial
  CRISPR gRNA sequence
ggccatcgcccagccccctc

SEQ ID NO: 236165 - DNA, 20 bp, Artificial
  CRISPR gRNA sequence
gccatcgcccagccccctcc

SEQ ID NO: 236166 - DNA, 20 bp, Artificial
  CRISPR gRNA sequence
ctgcccagttgagggccccc

SEQ ID NO: 236167 - DNA, 20 bp, Artificial
  CRISPR gRNA sequence
cccagttgagggcccccctg

SEQ ID NO: 236168 - DNA, 20 bp, Artificial
  CRISPR gRNA sequence
agggcccccctgcaccaccg

SEQ ID NO: 236169 - DNA, 20 bp, Artificial
  CRISPR gRNA sequence
caccaccgtctggcctgctg

SEQ ID NO: 236170 - DNA, 20 bp, Artificial
  CRISPR gRNA sequence
gcctgctgcctgcctctgac

SEQ ID NO: 236171 - DNA, 20 bp, Artificial
  CRISPR gRNA sequence
ctgcctgcctctgacctgca

SEQ ID NO: 236172 - DNA, 20 bp, Artificial
  CRISPR gRNA sequence
cctgcctctgacctgcacct

SEQ ID NO: 236173 - DNA, 20 bp, Artificial
  CRISPR gRNA sequence
cctctgacctgcacctgggg

SEQ ID NO: 236174 - DNA, 20 bp, Artificial
  CRISPR gRNA sequence
tgacctgcacctggggatga

SEQ ID NO: 236175 - DNA, 20 bp, Artificial
  CRISPR gRNA sequence
acctgcacctggggatgagg

SEQ ID NO: 236176 - DNA, 20 bp, Artificial
  CRISPR gRNA sequence
cacctggggatgagggttca

SEQ ID NO: 236177 - DNA, 20 bp, Artificial
  CRISPR gRNA sequence
gggatgagggttcagctgac

SEQ ID NO: 236178 - DNA, 20 bp, Artificial
  CRISPR gRNA sequence
agctgacacggctggtctgg

SEQ ID NO: 236179 - DNA, 20 bp, Artificial
  CRISPR gRNA sequence
acacggctggtctggagagg

SEQ ID NO: 236180 - DNA, 20 bp, Artificial
  CRISPR gRNA sequence
gtctggagaggaagctggca

SEQ ID NO: 236181 - DNA, 20 bp, Artificial
  CRISPR gRNA sequence
gagaggaagctggcagggaa

SEQ ID NO: 236182 - DNA, 20 bp, Artificial
  CRISPR gRNA sequence
gcagggaagtcaccccagag

SEQ ID NO: 236183 - DNA, 20 bp, Artificial
  CRISPR gRNA sequence
cttcctccagggcctgtggg

SEQ ID NO: 236184 - DNA, 20 bp, Artificial
  CRISPR gRNA sequence
ttcctccagggcctgtgggt

SEQ ID NO: 236185 - DNA, 20 bp, Artificial
  CRISPR gRNA sequence
cctccagggcctgtgggttg

SEQ ID NO: 236186 - DNA, 20 bp, Artificial
  CRISPR gRNA sequence
ctccagggcctgtgggttgg

SEQ ID NO: 236187 - DNA, 20 bp, Artificial
  CRISPR gRNA sequence
cagggcctgtgggttgggaa

SEQ ID NO: 236188 - DNA, 20 bp, Artificial
  CRISPR gRNA sequence
tgggttgggaagggaggctc

SEQ ID NO: 236189 - DNA, 20 bp, Artificial
  CRISPR gRNA sequence
ggaagggaggctctgtccgg

SEQ ID NO: 236190 - DNA, 20 bp, Artificial
  CRISPR gRNA sequence
tgtccggaggcccagtgtgg

SEQ ID NO: 236191 - DNA, 20 bp, Artificial
  CRISPR gRNA sequence
tccggaggcccagtgtggct

SEQ ID NO: 236192 - DNA, 20 bp, Artificial
  CRISPR gRNA sequence
gtggtggggacagcagcgcc

SEQ ID NO: 236193 - DNA, 20 bp, Artificial
  CRISPR gRNA sequence
tgaggtgtcgacgggcctcc

SEQ ID NO: 236194 - DNA, 20 bp, Artificial
  CRISPR gRNA sequence
aggtgtcgacgggcctccag

SEQ ID NO: 236195 - DNA, 20 bp, Artificial
  CRISPR gRNA sequence
caggggactgtgcactgttg

SEQ ID NO: 236196 - DNA, 20 bp, Artificial
  CRISPR gRNA sequence
tgcactgttgggggccaccc

SEQ ID NO: 236197 - DNA, 20 bp, Artificial
  CRISPR gRNA sequence
ttgggggccacccctgggtc

SEQ ID NO: 236198 - DNA, 20 bp, Artificial
  CRISPR gRNA sequence
ggggccacccctgggtcctg

SEQ ID NO: 236199 - DNA, 20 bp, Artificial
  CRISPR gRNA sequence
ggtcctgcaggggcagctcc

SEQ ID NO: 236200 - DNA, 20 bp, Artificial
  CRISPR gRNA sequence
caggggcagctcctggttgc

SEQ ID NO: 236201 - DNA, 20 bp, Artificial
  CRISPR gRNA sequence
ctggttgcatatggagttag

SEQ ID NO: 236202 - DNA, 20 bp, Artificial
  CRISPR gRNA sequence
gttgcatatggagttagcac

SEQ ID NO: 236203 - DNA, 20 bp, Artificial
  CRISPR gRNA sequence
catatggagttagcacctgg

SEQ ID NO: 236204 - DNA, 20 bp, Artificial
  CRISPR gRNA sequence
gcacctgggcaggggcagct

SEQ ID NO: 236205 - DNA, 20 bp, Artificial
  CRISPR gRNA sequence
ggcaggggcagctgtggggc

SEQ ID NO: 236206 - DNA, 20 bp, Artificial
  CRISPR gRNA sequence
tggggcgcaaagggggagta

SEQ ID NO: 236207 - DNA, 20 bp, Artificial
  CRISPR gRNA sequence
gataaacccagggtccagac

SEQ ID NO: 236208 - DNA, 20 bp, Artificial
  CRISPR gRNA sequence
ccagccaggagccctctgct

SEQ ID NO: 236209 - DNA, 20 bp, Artificial
  CRISPR gRNA sequence
tgctccctggagccaactgt

SEQ ID NO: 236210 - DNA, 20 bp, Artificial
  CRISPR gRNA sequence
ctccctggagccaactgtgg

SEQ ID NO: 236211 - DNA, 20 bp, Artificial
  CRISPR gRNA sequence
cctggagccaactgtgggtg

SEQ ID NO: 236212 - DNA, 20 bp, Artificial
  CRISPR gRNA sequence
gagccaactgtgggtggaga

SEQ ID NO: 236213 - DNA, 20 bp, Artificial
  CRISPR gRNA sequence
tgggtggagaacggacaacc

SEQ ID NO: 236214 - DNA, 20 bp, Artificial
  CRISPR gRNA sequence
actcccctggagggccgagg

SEQ ID NO: 236215 - DNA, 20 bp, Artificial
  CRISPR gRNA sequence
ccctggagggccgaggggag

SEQ ID NO: 236216 - DNA, 20 bp, Artificial
  CRISPR gRNA sequence
gagggccgaggggaggcctg

SEQ ID NO: 236217 - DNA, 20 bp, Artificial
  CRISPR gRNA sequence
gggaggagggggcctcagcc

SEQ ID NO: 236218 - DNA, 20 bp, Artificial
  CRISPR gRNA sequence
agcccagctgctggggggct

SEQ ID NO: 236219 - DNA, 20 bp, Artificial
  CRISPR gRNA sequence
ctggggggctggcctgtctc

SEQ ID NO: 236220 - DNA, 20 bp, Artificial
  CRISPR gRNA sequence
gggggctggcctgtctcctg

SEQ ID NO: 236221 - DNA, 20 bp, Artificial
  CRISPR gRNA sequence
gcctgtctcctgcccaggcg

SEQ ID NO: 236222 - DNA, 20 bp, Artificial
  CRISPR gRNA sequence
tctcctgcccaggcgaggag

SEQ ID NO: 236223 - DNA, 20 bp, Artificial
  CRISPR gRNA sequence
ctgcccaggcgaggagtgct

SEQ ID NO: 236224 - DNA, 20 bp, Artificial
  CRISPR gRNA sequence
cccaggcgaggagtgctgtt

SEQ ID NO: 236225 - DNA, 20 bp, Artificial
  CRISPR gRNA sequence
ttccgagtgggactgcatgt

SEQ ID NO: 236226 - DNA, 20 bp, Artificial
  CRISPR gRNA sequence
cgagtgggactgcatgtgtg

SEQ ID NO: 236227 - DNA, 20 bp, Artificial
  CRISPR gRNA sequence
catgtgtgtccagcctgaat

SEQ ID NO: 236228 - DNA, 20 bp, Artificial
  CRISPR gRNA sequence
aattccactgcggagaccct

SEQ ID NO: 236229 - DNA, 20 bp, Artificial
  CRISPR gRNA sequence
cactgcggagacccttgctg

SEQ ID NO: 236230 - DNA, 20 bp, Artificial
  CRISPR gRNA sequence
cggagacccttgctgcacga

SEQ ID NO: 236231 - DNA, 20 bp, Artificial
  CRISPR gRNA sequence
gctgcacgacctgccggcac

SEQ ID NO: 236232 - DNA, 20 bp, Artificial
  CRISPR gRNA sequence
ctgcacgacctgccggcacc

SEQ ID NO: 236233 - DNA, 20 bp, Artificial
  CRISPR gRNA sequence
cacgacctgccggcaccacc

SEQ ID NO: 236234 - DNA, 20 bp, Artificial
  CRISPR gRNA sequence
ccggcaccacccttgtcccc

SEQ ID NO: 236235 - DNA, 20 bp, Artificial
  CRISPR gRNA sequence
gtcccccaggccagggggta

SEQ ID NO: 236236 - DNA, 20 bp, Artificial
  CRISPR gRNA sequence
tcccccaggccagggggtac

SEQ ID NO: 236237 - DNA, 20 bp, Artificial
  CRISPR gRNA sequence
gaggtgcctctgggagtcca

SEQ ID NO: 236238 - DNA, 20 bp, Artificial
  CRISPR gRNA sequence
tgggagtccacacaggccag

SEQ ID NO: 236239 - DNA, 20 bp, Artificial
  CRISPR gRNA sequence
ggagtccacacaggccaggg

SEQ ID NO: 236240 - DNA, 20 bp, Artificial
  CRISPR gRNA sequence
cactagggcccgaggcagag

SEQ ID NO: 236241 - DNA, 20 bp, Artificial
  CRISPR gRNA sequence
gggcccgaggcagagctcgt

SEQ ID NO: 236242 - DNA, 20 bp, Artificial
  CRISPR gRNA sequence
gtgggcacaggtgtccggcg

SEQ ID NO: 236243 - DNA, 20 bp, Artificial
  CRISPR gRNA sequence
tgaggccgggcaggccaggc

SEQ ID NO: 236244 - DNA, 20 bp, Artificial
  CRISPR gRNA sequence
aggcaccacaggccatgaag

SEQ ID NO: 236245 - DNA, 20 bp, Artificial
  CRISPR gRNA sequence
tgggggtgtcctgtccctgc

SEQ ID NO: 236246 - DNA, 20 bp, Artificial
  CRISPR gRNA sequence
ggggtgtcctgtccctgctt

SEQ ID NO: 236247 - DNA, 20 bp, Artificial
  CRISPR gRNA sequence
tccctgctttctcagcctgg

SEQ ID NO: 236248 - DNA, 20 bp, Artificial
  CRISPR gRNA sequence
ctttctcagcctgggcttct

SEQ ID NO: 236249 - DNA, 20 bp, Artificial
  CRISPR gRNA sequence
tctcagcctgggcttctcca

SEQ ID NO: 236250 - DNA, 20 bp, Artificial
  CRISPR gRNA sequence
ctcagcctgggcttctccat

SEQ ID NO: 236251 - DNA, 20 bp, Artificial
  CRISPR gRNA sequence
tcagcctgggcttctccatc

SEQ ID NO: 236252 - DNA, 20 bp, Artificial
  CRISPR gRNA sequence
agcctgggcttctccatcca

SEQ ID NO: 236253 - DNA, 20 bp, Artificial
  CRISPR gRNA sequence
ggcttctccatccagcacga

SEQ ID NO: 236254 - DNA, 20 bp, Artificial
  CRISPR gRNA sequence
ctccatccagcacgagggct

SEQ ID NO: 236255 - DNA, 20 bp, Artificial
  CRISPR gRNA sequence
tccatccagcacgagggctg

SEQ ID NO: 236256 - DNA, 20 bp, Artificial
  CRISPR gRNA sequence
catccagcacgagggctgtg

SEQ ID NO: 236257 - DNA, 20 bp, Artificial
  CRISPR gRNA sequence
tgagaaccctgcggggaggt

SEQ ID NO: 236258 - DNA, 20 bp, Artificial
  CRISPR gRNA sequence
cggggaggtgggggcgggtt

SEQ ID NO: 236259 - DNA, 20 bp, Artificial
  CRISPR gRNA sequence
caggagctgtctggctctca

SEQ ID NO: 236260 - DNA, 20 bp, Artificial
  CRISPR gRNA sequence
tctggctctcaggcccggga

SEQ ID NO: 236261 - DNA, 20 bp, Artificial
  CRISPR gRNA sequence
gctctcaggcccgggacacc

SEQ ID NO: 236262 - DNA, 20 bp, Artificial
  CRISPR gRNA sequence
tcaggcccgggacacccatc

SEQ ID NO: 236263 - DNA, 20 bp, Artificial
  CRISPR gRNA sequence
aggcccgggacacccatcct

SEQ ID NO: 236264 - DNA, 20 bp, Artificial
  CRISPR gRNA sequence
tctgtcctcaccacatactg

SEQ ID NO: 236265 - DNA, 20 bp, Artificial
  CRISPR gRNA sequence
tcctcaccacatactgaaag

SEQ ID NO: 236266 - DNA, 20 bp, Artificial
  CRISPR gRNA sequence
accacatactgaaagagcct

SEQ ID NO: 236267 - DNA, 20 bp, Artificial
  CRISPR gRNA sequence
aaagagcctgccctgtgccc

SEQ ID NO: 236268 - DNA, 20 bp, Artificial
  CRISPR gRNA sequence
ccctgtgccccccggagtcc

SEQ ID NO: 236269 - DNA, 20 bp, Artificial
  CRISPR gRNA sequence
tgccccccggagtcctgtct

SEQ ID NO: 236270 - DNA, 20 bp, Artificial
  CRISPR gRNA sequence
tctggggcctggggctgcac

SEQ ID NO: 236271 - DNA, 20 bp, Artificial
  CRISPR gRNA sequence
gggcctggggctgcaccctg

SEQ ID NO: 236272 - DNA, 20 bp, Artificial
  CRISPR gRNA sequence
gggctgcaccctgttctgga

SEQ ID NO: 236273 - DNA, 20 bp, Artificial
  CRISPR gRNA sequence
caccctgttctggaaggagc

SEQ ID NO: 236274 - DNA, 20 bp, Artificial
  CRISPR gRNA sequence
ttctggaaggagcagctcaa

SEQ ID NO: 236275 - DNA, 20 bp, Artificial
  CRISPR gRNA sequence
tggaaggagcagctcaagtc

SEQ ID NO: 236276 - DNA, 20 bp, Artificial
  CRISPR gRNA sequence
gaaggagcagctcaagtcct

SEQ ID NO: 236277 - DNA, 20 bp, Artificial
  CRISPR gRNA sequence
aagtcctcttagcggcttgt

SEQ ID NO: 236278 - DNA, 20 bp, Artificial
  CRISPR gRNA sequence
ttagcggcttgtttacctga

SEQ ID NO: 236279 - DNA, 20 bp, Artificial
  CRISPR gRNA sequence
agcggcttgtttacctgaca

SEQ ID NO: 236280 - DNA, 20 bp, Artificial
  CRISPR gRNA sequence
gcggcttgtttacctgacag

SEQ ID NO: 236281 - DNA, 20 bp, Artificial
  CRISPR gRNA sequence
gtttacctgacaggagaggt

SEQ ID NO: 236282 - DNA, 20 bp, Artificial
  CRISPR gRNA sequence
tttacctgacaggagaggtc

SEQ ID NO: 236283 - DNA, 20 bp, Artificial
  CRISPR gRNA sequence
acctgacaggagaggtcagg

SEQ ID NO: 236284 - DNA, 20 bp, Artificial
  CRISPR gRNA sequence
cctgacaggagaggtcaggc

SEQ ID NO: 236285 - DNA, 20 bp, Artificial
  CRISPR gRNA sequence
acaggagaggtcaggctggg

SEQ ID NO: 236286 - DNA, 20 bp, Artificial
  CRISPR gRNA sequence
ggcacatgagagctgggaga

SEQ ID NO: 236287 - DNA, 20 bp, Artificial
  CRISPR gRNA sequence
ggagaaggtacaactgggga

SEQ ID NO: 236288 - DNA, 20 bp, Artificial
  CRISPR gRNA sequence
gggaggttgtgtcaggttgg

SEQ ID NO: 236289 - DNA, 20 bp, Artificial
  CRISPR gRNA sequence
tgtcaggttggacggggcag

SEQ ID NO: 236290 - DNA, 20 bp, Artificial
  CRISPR gRNA sequence
gacggggcagggtctggggt

SEQ ID NO: 236291 - DNA, 20 bp, Artificial
  CRISPR gRNA sequence
gggtcaactgggacccagcc

SEQ ID NO: 236292 - DNA, 20 bp, Artificial
  CRISPR gRNA sequence
ggacccagcctcactctctc

SEQ ID NO: 236293 - DNA, 20 bp, Artificial
  CRISPR gRNA sequence
actctctctgggaccctcac

SEQ ID NO: 236294 - DNA, 20 bp, Artificial
  CRISPR gRNA sequence
tctctgggaccctcactgtt

SEQ ID NO: 236295 - DNA, 20 bp, Artificial
  CRISPR gRNA sequence
tctgggaccctcactgttct

SEQ ID NO: 236296 - DNA, 20 bp, Artificial
  CRISPR gRNA sequence
tgggaccctcactgttctcc

SEQ ID NO: 236297 - DNA, 20 bp, Artificial
  CRISPR gRNA sequence
ggaccctcactgttctccac

SEQ ID NO: 236298 - DNA, 20 bp, Artificial
  CRISPR gRNA sequence
actgttctccaccctctgtt

SEQ ID NO: 236299 - DNA, 20 bp, Artificial
  CRISPR gRNA sequence
ttctccaccctctgttctac

SEQ ID NO: 236300 - DNA, 20 bp, Artificial
  CRISPR gRNA sequence
tccaccctctgttctactgg

SEQ ID NO: 236301 - DNA, 20 bp, Artificial
  CRISPR gRNA sequence
caccctctgttctactgggt

SEQ ID NO: 236302 - DNA, 20 bp, Artificial
  CRISPR gRNA sequence
tgttctactgggtcctgcct

SEQ ID NO: 236303 - DNA, 20 bp, Artificial
  CRISPR gRNA sequence
ttctactgggtcctgcctgg

SEQ ID NO: 236304 - DNA, 20 bp, Artificial
  CRISPR gRNA sequence
tactgggtcctgcctggctt

SEQ ID NO: 236305 - DNA, 20 bp, Artificial
  CRISPR gRNA sequence
ctgggtcctgcctggcttct

SEQ ID NO: 236306 - DNA, 20 bp, Artificial
  CRISPR gRNA sequence
ggtcctgcctggcttctgcc

SEQ ID NO: 236307 - DNA, 20 bp, Artificial
  CRISPR gRNA sequence
cctggcttctgcccaccctc

SEQ ID NO: 236308 - DNA, 20 bp, Artificial
  CRISPR gRNA sequence
gcttctgcccaccctcagcc

SEQ ID NO: 236309 - DNA, 20 bp, Artificial
  CRISPR gRNA sequence
ctgcccaccctcagccccca

SEQ ID NO: 236310 - DNA, 20 bp, Artificial
  CRISPR gRNA sequence
tgcccaccctcagcccccaa

SEQ ID NO: 236311 - DNA, 20 bp, Artificial
  CRISPR gRNA sequence
cccaccctcagcccccaatg

SEQ ID NO: 236312 - DNA, 20 bp, Artificial
  CRISPR gRNA sequence
agcccccaatgggcaggcct

SEQ ID NO: 236313 - DNA, 20 bp, Artificial
  CRISPR gRNA sequence
tcccctccctggcaggccca

SEQ ID NO: 236314 - DNA, 20 bp, Artificial
  CRISPR gRNA sequence
cccctccctggcaggcccac

SEQ ID NO: 236315 - DNA, 20 bp, Artificial
  CRISPR gRNA sequence
ccctccctggcaggcccact

SEQ ID NO: 236316 - DNA, 20 bp, Artificial
  CRISPR gRNA sequence
cctggcaggcccactgcact

SEQ ID NO: 236317 - DNA, 20 bp, Artificial
  CRISPR gRNA sequence
gcaggcccactgcactctgc

SEQ ID NO: 236318 - DNA, 20 bp, Artificial
  CRISPR gRNA sequence
cactctgcgcacctccccca

SEQ ID NO: 236319 - DNA, 20 bp, Artificial
  CRISPR gRNA sequence
tgcgcacctcccccaggtgc

SEQ ID NO: 236320 - DNA, 20 bp, Artificial
  CRISPR gRNA sequence
cgcacctcccccaggtgccc

SEQ ID NO: 236321 - DNA, 20 bp, Artificial
  CRISPR gRNA sequence
ccccaggtgccctcactggg

SEQ ID NO: 236322 - DNA, 20 bp, Artificial
  CRISPR gRNA sequence
actgggccccaccccagacg

SEQ ID NO: 236323 - DNA, 20 bp, Artificial
  CRISPR gRNA sequence
ggccccaccccagacgcccc

SEQ ID NO: 236324 - DNA, 20 bp, Artificial
  CRISPR gRNA sequence
ggacgggcagacatgggccc

SEQ ID NO: 236325 - DNA, 20 bp, Artificial
  CRISPR gRNA sequence
ggccatgaagaactctgttg

SEQ ID NO: 236326 - DNA, 20 bp, Artificial
  CRISPR gRNA sequence
tgttgaatggatgatggggg

SEQ ID NO: 236327 - DNA, 20 bp, Artificial
  CRISPR gRNA sequence
ttgaatggatgatggggggg

SEQ ID NO: 236328 - DNA, 20 bp, Artificial
  CRISPR gRNA sequence
aatggatgatggggggggca

SEQ ID NO: 236329 - DNA, 20 bp, Artificial
  CRISPR gRNA sequence
tactcagcacccagacccca

SEQ ID NO: 236330 - DNA, 20 bp, Artificial
  CRISPR gRNA sequence
ctcagcacccagaccccaga

SEQ ID NO: 236331 - DNA, 20 bp, Artificial
  CRISPR gRNA sequence
agcacccagaccccagatgg

SEQ ID NO: 236332 - DNA, 20 bp, Artificial
  CRISPR gRNA sequence
cactggcctgacgccctcct

SEQ ID NO: 236333 - DNA, 20 bp, Artificial
  CRISPR gRNA sequence
gcctgacgccctcctcatcc

SEQ ID NO: 236334 - DNA, 20 bp, Artificial
  CRISPR gRNA sequence
acgccctcctcatccatccc

SEQ ID NO: 236335 - DNA, 20 bp, Artificial
  CRISPR gRNA sequence
ctcatccatcccagcaactc

SEQ ID NO: 236336 - DNA, 20 bp, Artificial
  CRISPR gRNA sequence
atccatcccagcaactccac

SEQ ID NO: 236337 - DNA, 20 bp, Artificial
  CRISPR gRNA sequence
caccagcctccctccctccc

SEQ ID NO: 236338 - DNA, 20 bp, Artificial
  CRISPR gRNA sequence
cctccctccctccccccaca

SEQ ID NO: 236339 - DNA, 20 bp, Artificial
  CRISPR gRNA sequence
cctccctccccccacacccc

SEQ ID NO: 236340 - DNA, 20 bp, Artificial
  CRISPR gRNA sequence
cctccccccacaccccacac

SEQ ID NO: 236341 - DNA, 20 bp, Artificial
  CRISPR gRNA sequence
cccccacaccccacaccagg

SEQ ID NO: 236342 - DNA, 20 bp, Artificial
  CRISPR gRNA sequence
agttttggcttccagtgtat

SEQ ID NO: 236343 - DNA, 20 bp, Artificial
  CRISPR gRNA sequence
tggcttccagtgtatcgact

SEQ ID NO: 236344 - DNA, 20 bp, Artificial
  CRISPR gRNA sequence
ggcttccagtgtatcgactg

SEQ ID NO: 236345 - DNA, 20 bp, Artificial
  CRISPR gRNA sequence
gcttccagtgtatcgactgt

SEQ ID NO: 236346 - DNA, 20 bp, Artificial
  CRISPR gRNA sequence
ccagtgtatcgactgtgcct

SEQ ID NO: 236347 - DNA, 20 bp, Artificial
  CRISPR gRNA sequence
cagtgtatcgactgtgcctc

SEQ ID NO: 236348 - DNA, 20 bp, Artificial
  CRISPR gRNA sequence
tgcctcggggaccttctccg

SEQ ID NO: 236349 - DNA, 20 bp, Artificial
  CRISPR gRNA sequence
ggggaccttctccgggggcc

SEQ ID NO: 236350 - DNA, 20 bp, Artificial
  CRISPR gRNA sequence
ctccgggggccacgaaggcc

SEQ ID NO: 236351 - DNA, 20 bp, Artificial
  CRISPR gRNA sequence
tccgggggccacgaaggcca

SEQ ID NO: 236352 - DNA, 20 bp, Artificial
  CRISPR gRNA sequence
cgggggccacgaaggccact

SEQ ID NO: 236353 - DNA, 20 bp, Artificial
  CRISPR gRNA sequence
caaaccttggacagagtgag

SEQ ID NO: 236354 - DNA, 20 bp, Artificial
  CRISPR gRNA sequence
ggacagagtgagtcctgggt

SEQ ID NO: 236355 - DNA, 20 bp, Artificial
  CRISPR gRNA sequence
gacagagtgagtcctgggtg

SEQ ID NO: 236356 - DNA, 20 bp, Artificial
  CRISPR gRNA sequence
ggtgggccctgccggtggcc

SEQ ID NO: 236357 - DNA, 20 bp, Artificial
  CRISPR gRNA sequence
ccggtggccgggtggtccag

SEQ ID NO: 236358 - DNA, 20 bp, Artificial
  CRISPR gRNA sequence
tgaggaagggtcctctcctg

SEQ ID NO: 236359 - DNA, 20 bp, Artificial
  CRISPR gRNA sequence
aggaagggtcctctcctgtc

SEQ ID NO: 236360 - DNA, 20 bp, Artificial
  CRISPR gRNA sequence
tcctgtcccttgccccagac

SEQ ID NO: 236361 - DNA, 20 bp, Artificial
  CRISPR gRNA sequence
ctgtcccttgccccagacag

SEQ ID NO: 236362 - DNA, 20 bp, Artificial
  CRISPR gRNA sequence
tcccttgccccagacagcac

SEQ ID NO: 236363 - DNA, 20 bp, Artificial
  CRISPR gRNA sequence
gccccagacagcacggaggg

SEQ ID NO: 236364 - DNA, 20 bp, Artificial
  CRISPR gRNA sequence
ccccagacagcacggagggc

SEQ ID NO: 236365 - DNA, 20 bp, Artificial
  CRISPR gRNA sequence
atcggaggccgtgtccgggg

SEQ ID NO: 236366 - DNA, 20 bp, Artificial
  CRISPR gRNA sequence
ataggaggccgcgtccatgt

SEQ ID NO: 236367 - DNA, 20 bp, Artificial
  CRISPR gRNA sequence
cagctgcacccagttcgggt

SEQ ID NO: 236368 - DNA, 20 bp, Artificial
  CRISPR gRNA sequence
cacccagttcgggtttctca

SEQ ID NO: 236369 - DNA, 20 bp, Artificial
  CRISPR gRNA sequence
gggtttctcactgtgttccc

SEQ ID NO: 236370 - DNA, 20 bp, Artificial
  CRISPR gRNA sequence
ctcactgtgttccctgggaa

SEQ ID NO: 236371 - DNA, 20 bp, Artificial
  CRISPR gRNA sequence
tcactgtgttccctgggaac

SEQ ID NO: 236372 - DNA, 20 bp, Artificial
  CRISPR gRNA sequence
actgtgttccctgggaacaa

SEQ ID NO: 236373 - DNA, 20 bp, Artificial
  CRISPR gRNA sequence
tgttccctgggaacaagacc

SEQ ID NO: 236374 - DNA, 20 bp, Artificial
  CRISPR gRNA sequence
cctgggaacaagacccacaa

SEQ ID NO: 236375 - DNA, 20 bp, Artificial
  CRISPR gRNA sequence
ggaacaagacccacaacgct

SEQ ID NO: 236376 - DNA, 20 bp, Artificial
  CRISPR gRNA sequence
tgtgcgtcccagggtccccg

SEQ ID NO: 236377 - DNA, 20 bp, Artificial
  CRISPR gRNA sequence
gggtggctgaccgtcgtcct

SEQ ID NO: 236378 - DNA, 20 bp, Artificial
  CRISPR gRNA sequence
ggtggctgaccgtcgtcctc

SEQ ID NO: 236379 - DNA, 20 bp, Artificial
  CRISPR gRNA sequence
accgtcgtcctcctggccgt

SEQ ID NO: 236380 - DNA, 20 bp, Artificial
  CRISPR gRNA sequence
ctggccgtggccgcctgcgt

SEQ ID NO: 236381 - DNA, 20 bp, Artificial
  CRISPR gRNA sequence
gccgtggccgcctgcgtcct

SEQ ID NO: 236382 - DNA, 20 bp, Artificial
  CRISPR gRNA sequence
cgtcctcctcctgacctcgg

SEQ ID NO: 236383 - DNA, 20 bp, Artificial
  CRISPR gRNA sequence
ctcctgacctcggcccagct

SEQ ID NO: 236384 - DNA, 20 bp, Artificial
  CRISPR gRNA sequence
ctgacctcggcccagcttgg

SEQ ID NO: 236385 - DNA, 20 bp, Artificial
  CRISPR gRNA sequence
acctcggcccagcttggact

SEQ ID NO: 236386 - DNA, 20 bp, Artificial
  CRISPR gRNA sequence
ggcccagcttggactgcaca

SEQ ID NO: 236387 - DNA, 20 bp, Artificial
  CRISPR gRNA sequence
ggactgcacatctggcagct

SEQ ID NO: 236388 - DNA, 20 bp, Artificial
  CRISPR gRNA sequence
gactgcacatctggcagctg

SEQ ID NO: 236389 - DNA, 20 bp, Artificial
  CRISPR gRNA sequence
cacatctggcagctgaggag

SEQ ID NO: 236390 - DNA, 20 bp, Artificial
  CRISPR gRNA sequence
gcagctgaggagtcagtgca

SEQ ID NO: 236391 - DNA, 20 bp, Artificial
  CRISPR gRNA sequence
aggagtcagtgcatgtggcc

SEQ ID NO: 236392 - DNA, 20 bp, Artificial
  CRISPR gRNA sequence
tcacagcctggtgcggggag

SEQ ID NO: 236393 - DNA, 20 bp, Artificial
  CRISPR gRNA sequence
gtgcggggaggtgggagcat

SEQ ID NO: 236394 - DNA, 20 bp, Artificial
  CRISPR gRNA sequence
cctgctgaccgtggcccccc

SEQ ID NO: 236395 - DNA, 20 bp, Artificial
  CRISPR gRNA sequence
ctgaccgtggcccccctgca

SEQ ID NO: 236396 - DNA, 20 bp, Artificial
  CRISPR gRNA sequence
accgtggcccccctgcagag

SEQ ID NO: 236397 - DNA, 20 bp, Artificial
  CRISPR gRNA sequence
cagagacccagctgctgctg

SEQ ID NO: 236398 - DNA, 20 bp, Artificial
  CRISPR gRNA sequence
ctgctggaggtgccgccgtc

SEQ ID NO: 236399 - DNA, 20 bp, Artificial
  CRISPR gRNA sequence
ctggaggtgccgccgtcgac

SEQ ID NO: 236400 - DNA, 20 bp, Artificial
  CRISPR gRNA sequence
gaggtgccgccgtcgaccga

SEQ ID NO: 236401 - DNA, 20 bp, Artificial
  CRISPR gRNA sequence
ccagttccccgaggaagagc

SEQ ID NO: 236402 - DNA, 20 bp, Artificial
  CRISPR gRNA sequence
cccgaggaagagcggggcga

SEQ ID NO: 236403 - DNA, 20 bp, Artificial
  CRISPR gRNA sequence
ggagacctgtgggtgtgagc

SEQ ID NO: 236404 - DNA, 20 bp, Artificial
  CRISPR gRNA sequence
tgggtgtgagcctggccgtc

SEQ ID NO: 236405 - DNA, 20 bp, Artificial
  CRISPR gRNA sequence
gccgtcctccggggccaccg

SEQ ID NO: 236406 - DNA, 20 bp, Artificial
  CRISPR gRNA sequence
cggggccaccgaccgcagcc

SEQ ID NO: 236407 - DNA, 20 bp, Artificial
  CRISPR gRNA sequence
cccaggagctccccaggccg

SEQ ID NO: 236408 - DNA, 20 bp, Artificial
  CRISPR gRNA sequence
cccaggccgcaggggctctg

SEQ ID NO: 236409 - DNA, 20 bp, Artificial
  CRISPR gRNA sequence
tgcgttctgctctgggccgg

SEQ ID NO: 236410 - DNA, 20 bp, Artificial
  CRISPR gRNA sequence
cgttctgctctgggccgggc

SEQ ID NO: 236411 - DNA, 20 bp, Artificial
  CRISPR gRNA sequence
tgctctgggccgggccctgc

SEQ ID NO: 236412 - DNA, 20 bp, Artificial
  CRISPR gRNA sequence
ctctgggccgggccctgctc

SEQ ID NO: 236413 - DNA, 20 bp, Artificial
  CRISPR gRNA sequence
tgggccgggccctgctcccc

SEQ ID NO: 236414 - DNA, 20 bp, Artificial
  CRISPR gRNA sequence
ggccgggccctgctcccctg

SEQ ID NO: 236415 - DNA, 20 bp, Artificial
  CRISPR gRNA sequence
ctcccctggcagcagaagtg

SEQ ID NO: 236416 - DNA, 20 bp, Artificial
  CRISPR gRNA sequence
ccctggcagcagaagtgggt

SEQ ID NO: 236417 - DNA, 20 bp, Artificial
  CRISPR gRNA sequence
gcagcagaagtgggtgcagg

SEQ ID NO: 236418 - DNA, 20 bp, Artificial
  CRISPR gRNA sequence
gaccatgcagttcggcggcc

SEQ ID NO: 236419 - DNA, 20 bp, Artificial
  CRISPR gRNA sequence
ggcggccgcggctgggccct

SEQ ID NO: 236420 - DNA, 20 bp, Artificial
  CRISPR gRNA sequence
ggccctgcaggagggagaga

SEQ ID NO: 236421 - DNA, 20 bp, Artificial
  CRISPR gRNA sequence
caggagggagagagagacac

SEQ ID NO: 236422 - DNA, 20 bp, Artificial
  CRISPR gRNA sequence
cctcccttgctggccctgat

SEQ ID NO: 236423 - DNA, 20 bp, Artificial
  CRISPR gRNA sequence
ctcccttgctggccctgatg

SEQ ID NO: 236424 - DNA, 20 bp, Artificial
  CRISPR gRNA sequence
ccttgctggccctgatgggg

SEQ ID NO: 236425 - DNA, 20 bp, Artificial
  CRISPR gRNA sequence
gctggccctgatggggtggg

SEQ ID NO: 236426 - DNA, 20 bp, Artificial
  CRISPR gRNA sequence
ctggccctgatggggtgggg

SEQ ID NO: 236427 - DNA, 20 bp, Artificial
  CRISPR gRNA sequence
gccctgatggggtggggtct

SEQ ID NO: 236428 - DNA, 20 bp, Artificial
  CRISPR gRNA sequence
atggggtggggtcttaggac

SEQ ID NO: 236429 - DNA, 20 bp, Artificial
  CRISPR gRNA sequence
aggacgggaggctgtgtccg

SEQ ID NO: 236430 - DNA, 20 bp, Artificial
  CRISPR gRNA sequence
ggacgggaggctgtgtccgt

SEQ ID NO: 236431 - DNA, 20 bp, Artificial
  CRISPR gRNA sequence
tgtccgtgggtgtgcagtgc

SEQ ID NO: 236432 - DNA, 20 bp, Artificial
  CRISPR gRNA sequence
caggggaccttcaataaaca

SEQ ID NO: 236433 - DNA, 20 bp, Artificial
  CRISPR gRNA sequence
caataaacacttgtccagtg

SEQ ID NO: 236434 - DNA, 20 bp, Artificial
  CRISPR gRNA sequence
aataaacacttgtccagtga

SEQ ID NO: 236435 - DNA, 20 bp, Artificial
  CRISPR gRNA sequence
gtccagtgacctgagtggat

SEQ ID NO: 236436 - DNA, 20 bp, Artificial
  CRISPR gRNA sequence
tccagtgacctgagtggatg

SEQ ID NO: 236437 - DNA, 20 bp, Artificial
  CRISPR gRNA sequence
agtggatgcatgctgggtgc

SEQ ID NO: 236438 - DNA, 20 bp, Artificial
  CRISPR gRNA sequence
ggtgctgggggaggacgggg

SEQ ID NO: 236439 - DNA, 20 bp, Artificial
  CRISPR gRNA sequence
ggggaggacggggcacccgg

SEQ ID NO: 236440 - DNA, 20 bp, Artificial
  CRISPR gRNA sequence
ggctttggggcaccgtgctc

SEQ ID NO: 236441 - DNA, 20 bp, Artificial
  CRISPR gRNA sequence
tggggcaccgtgctcatgcc

SEQ ID NO: 236442 - DNA, 20 bp, Artificial
  CRISPR gRNA sequence
ggggcaccgtgctcatgcct

SEQ ID NO: 236443 - DNA, 20 bp, Artificial
  CRISPR gRNA sequence
gggcaccgtgctcatgcctg

SEQ ID NO: 236444 - DNA, 20 bp, Artificial
  CRISPR gRNA sequence
atgcctggccgtggtcccct

SEQ ID NO: 236445 - DNA, 20 bp, Artificial
  CRISPR gRNA sequence
gccgtggtcccctccacagg

SEQ ID NO: 236446 - DNA, 20 bp, Artificial
  CRISPR gRNA sequence
actaaaagccaaagtttaca

SEQ ID NO: 236447 - DNA, 20 bp, Artificial
  CRISPR gRNA sequence
aagccaaagtttacaaagaa

SEQ ID NO: 236448 - DNA, 20 bp, Artificial
  CRISPR gRNA sequence
tttatgatatgatgttgcaa

SEQ ID NO: 236449 - DNA, 20 bp, Artificial
  CRISPR gRNA sequence
gatgttgcaacagttataaa

SEQ ID NO: 236450 - DNA, 20 bp, Artificial
  CRISPR gRNA sequence
tataaaaagctttttaaaat

SEQ ID NO: 236451 - DNA, 20 bp, Artificial
  CRISPR gRNA sequence
ataaaaagctttttaaaata

SEQ ID NO: 236452 - DNA, 20 bp, Artificial
  CRISPR gRNA sequence
tttttttcctgtgaacatca

SEQ ID NO: 236453 - DNA, 20 bp, Artificial
  CRISPR gRNA sequence
atcatagttttgtgttttat

SEQ ID NO: 236454 - DNA, 20 bp, Artificial
  CRISPR gRNA sequence
tagttttgtgttttattaga

SEQ ID NO: 236455 - DNA, 20 bp, Artificial
  CRISPR gRNA sequence
tttaaataaaaacgttgata

SEQ ID NO: 236456 - DNA, 20 bp, Artificial
  CRISPR gRNA sequence
gttgataaagatcactctcc

SEQ ID NO: 236457 - DNA, 20 bp, Artificial
  CRISPR gRNA sequence
tctccaagtcctaccacaca

SEQ ID NO: 236458 - DNA, 20 bp, Artificial
  CRISPR gRNA sequence
ctccaagtcctaccacacac

SEQ ID NO: 236459 - DNA, 20 bp, Artificial
  CRISPR gRNA sequence
tccaagtcctaccacacaca

SEQ ID NO: 236460 - DNA, 20 bp, Artificial
  CRISPR gRNA sequence
agggcacatgtaacctgccc

SEQ ID NO: 236461 - DNA, 20 bp, Artificial
  CRISPR gRNA sequence
catgtaacctgccctagctg

SEQ ID NO: 236462 - DNA, 20 bp, Artificial
  CRISPR gRNA sequence
gtaacctgccctagctgcgg

SEQ ID NO: 236463 - DNA, 20 bp, Artificial
  CRISPR gRNA sequence
taacctgccctagctgcggt

SEQ ID NO: 236464 - DNA, 20 bp, Artificial
  CRISPR gRNA sequence
cggtgggcacctctcaccca

SEQ ID NO: 236465 - DNA, 20 bp, Artificial
  CRISPR gRNA sequence
gggcacctctcacccacaga

SEQ ID NO: 236466 - DNA, 20 bp, Artificial
  CRISPR gRNA sequence
cagatggaaacatcttcctg

SEQ ID NO: 236467 - DNA, 20 bp, Artificial
  CRISPR gRNA sequence
agatggaaacatcttcctgt

SEQ ID NO: 236468 - DNA, 20 bp, Artificial
  CRISPR gRNA sequence
gatggaaacatcttcctgtg

SEQ ID NO: 236469 - DNA, 20 bp, Artificial
  CRISPR gRNA sequence
atggaaacatcttcctgtgg

SEQ ID NO: 236470 - DNA, 20 bp, Artificial
  CRISPR gRNA sequence
gaaacatcttcctgtggggg

SEQ ID NO: 236471 - DNA, 20 bp, Artificial
  CRISPR gRNA sequence
gggggaagatgcccacttta

SEQ ID NO: 236472 - DNA, 20 bp, Artificial
  CRISPR gRNA sequence
ctcacatcaaaactttccgt

SEQ ID NO: 236473 - DNA, 20 bp, Artificial
  CRISPR gRNA sequence
cacatcaaaactttccgtca

SEQ ID NO: 236474 - DNA, 20 bp, Artificial
  CRISPR gRNA sequence
cagagtgatatcttccacta

SEQ ID NO: 236475 - DNA, 20 bp, Artificial
  CRISPR gRNA sequence
ctttcttctgaaaaaaacct

SEQ ID NO: 236476 - DNA, 20 bp, Artificial
  CRISPR gRNA sequence
aaaaaacctgagcttgtttt

SEQ ID NO: 236477 - DNA, 20 bp, Artificial
  CRISPR gRNA sequence
ctgagcttgtttttagcatt

SEQ ID NO: 236478 - DNA, 20 bp, Artificial
  CRISPR gRNA sequence
tgctaatttatttttaatca

SEQ ID NO: 236479 - DNA, 20 bp, Artificial
  CRISPR gRNA sequence
atttctattaaacctaatta

SEQ ID NO: 236480 - DNA, 20 bp, Artificial
  CRISPR gRNA sequence
ggaactttctaaattaaacc

SEQ ID NO: 236481 - DNA, 20 bp, Artificial
  CRISPR gRNA sequence
actttctaaattaaacccag

SEQ ID NO: 236482 - DNA, 20 bp, Artificial
  CRISPR gRNA sequence
ctttctaaattaaacccaga

SEQ ID NO: 236483 - DNA, 20 bp, Artificial
  CRISPR gRNA sequence
tttctaaattaaacccagaa

SEQ ID NO: 236484 - DNA, 20 bp, Artificial
  CRISPR gRNA sequence
ttctaaattaaacccagaag

SEQ ID NO: 236485 - DNA, 20 bp, Artificial
  CRISPR gRNA sequence
cttccttattaattgtcatt

SEQ ID NO: 236486 - DNA, 20 bp, Artificial
  CRISPR gRNA sequence
ttccttattaattgtcattt

SEQ ID NO: 236487 - DNA, 20 bp, Artificial
  CRISPR gRNA sequence
tccttattaattgtcattta

SEQ ID NO: 236488 - DNA, 20 bp, Artificial
  CRISPR gRNA sequence
ccttattaattgtcatttag

SEQ ID NO: 236489 - DNA, 20 bp, Artificial
  CRISPR gRNA sequence
cttattaattgtcatttagg

SEQ ID NO: 236490 - DNA, 20 bp, Artificial
  CRISPR gRNA sequence
tattaattgtcatttagggg

SEQ ID NO: 236491 - DNA, 20 bp, Artificial
  CRISPR gRNA sequence
ggagcaatgactcacatgcc

SEQ ID NO: 236492 - DNA, 20 bp, Artificial
  CRISPR gRNA sequence
gttcctgtgtttttcattta

SEQ ID NO: 236493 - DNA, 20 bp, Artificial
  CRISPR gRNA sequence
atagcttttgcacatgatac

SEQ ID NO: 236494 - DNA, 20 bp, Artificial
  CRISPR gRNA sequence
ttttgcacatgataccagaa

SEQ ID NO: 236495 - DNA, 20 bp, Artificial
  CRISPR gRNA sequence
tttgcacatgataccagaat

SEQ ID NO: 236496 - DNA, 20 bp, Artificial
  CRISPR gRNA sequence
aggctatgataaaaatatca

SEQ ID NO: 236497 - DNA, 20 bp, Artificial
  CRISPR gRNA sequence
cacagtctgtatcataaaca

SEQ ID NO: 236498 - DNA, 20 bp, Artificial
  CRISPR gRNA sequence
aacatagcctcctttcttca

SEQ ID NO: 236499 - DNA, 20 bp, Artificial
  CRISPR gRNA sequence
tttcttcacagaataaactg

SEQ ID NO: 236500 - DNA, 20 bp, Artificial
  CRISPR gRNA sequence
cagaataaactgtggatttt

SEQ ID NO: 236501 - DNA, 20 bp, Artificial
  CRISPR gRNA sequence
tggattttcggtgtgtaacc

SEQ ID NO: 236502 - DNA, 20 bp, Artificial
  CRISPR gRNA sequence
ggattttcggtgtgtaacct

SEQ ID NO: 236503 - DNA, 20 bp, Artificial
  CRISPR gRNA sequence
gtgtgtaacctaggacacat

SEQ ID NO: 236504 - DNA, 20 bp, Artificial
  CRISPR gRNA sequence
gtgtaacctaggacacatga

SEQ ID NO: 236505 - DNA, 20 bp, Artificial
  CRISPR gRNA sequence
agagcctcgctccattatct

SEQ ID NO: 236506 - DNA, 20 bp, Artificial
  CRISPR gRNA sequence
tcttggataccccaaccctg

SEQ ID NO: 236507 - DNA, 20 bp, Artificial
  CRISPR gRNA sequence
cttggataccccaaccctgt

SEQ ID NO: 236508 - DNA, 20 bp, Artificial
  CRISPR gRNA sequence
ttggataccccaaccctgtg

SEQ ID NO: 236509 - DNA, 20 bp, Artificial
  CRISPR gRNA sequence
ccaaccctgtggggcatgac

SEQ ID NO: 236510 - DNA, 20 bp, Artificial
  CRISPR gRNA sequence
gaccagtctctttctgtttg

SEQ ID NO: 236511 - DNA, 20 bp, Artificial
  CRISPR gRNA sequence
agtctctttctgtttgtgga

SEQ ID NO: 236512 - DNA, 20 bp, Artificial
  CRISPR gRNA sequence
tctttctgtttgtggatagt

SEQ ID NO: 236513 - DNA, 20 bp, Artificial
  CRISPR gRNA sequence
ttctgtttgtggatagtcag

SEQ ID NO: 236514 - DNA, 20 bp, Artificial
  CRISPR gRNA sequence
tgtttgtggatagtcagcag

SEQ ID NO: 236515 - DNA, 20 bp, Artificial
  CRISPR gRNA sequence
gtttgtggatagtcagcagt

SEQ ID NO: 236516 - DNA, 20 bp, Artificial
  CRISPR gRNA sequence
aattaaacaccatgtgtcca

SEQ ID NO: 236517 - DNA, 20 bp, Artificial
  CRISPR gRNA sequence
aacaccatgtgtccaaagcc

SEQ ID NO: 236518 - DNA, 20 bp, Artificial
  CRISPR gRNA sequence
caccatgtgtccaaagccaa

SEQ ID NO: 236519 - DNA, 20 bp, Artificial
  CRISPR gRNA sequence
accatgtgtccaaagccaag

SEQ ID NO: 236520 - DNA, 20 bp, Artificial
  CRISPR gRNA sequence
catgtgtccaaagccaagag

SEQ ID NO: 236521 - DNA, 20 bp, Artificial
  CRISPR gRNA sequence
gccaagaggagaaatcactt

SEQ ID NO: 236522 - DNA, 20 bp, Artificial
  CRISPR gRNA sequence
agaaatcactttagaactta

SEQ ID NO: 236523 - DNA, 20 bp, Artificial
  CRISPR gRNA sequence
gaacttacagcatcatgatt

SEQ ID NO: 236524 - DNA, 20 bp, Artificial
  CRISPR gRNA sequence
ttacagcatcatgattcaga

SEQ ID NO: 236525 - DNA, 20 bp, Artificial
  CRISPR gRNA sequence
aagacaaaaatattcgcacc

SEQ ID NO: 236526 - DNA, 20 bp, Artificial
  CRISPR gRNA sequence
acctagctttgttcctgaaa

SEQ ID NO: 236527 - DNA, 20 bp, Artificial
  CRISPR gRNA sequence
ctttgttcctgaaatggcac

SEQ ID NO: 236528 - DNA, 20 bp, Artificial
  CRISPR gRNA sequence
atggcaccagtatacttcct

SEQ ID NO: 236529 - DNA, 20 bp, Artificial
  CRISPR gRNA sequence
gctttgctttgcctactatt

SEQ ID NO: 236530 - DNA, 20 bp, Artificial
  CRISPR gRNA sequence
tgctttgcctactatttggc

SEQ ID NO: 236531 - DNA, 20 bp, Artificial
  CRISPR gRNA sequence
actatttggcaagaattgta

SEQ ID NO: 236532 - DNA, 20 bp, Artificial
  CRISPR gRNA sequence
aattgttctcttattcttat

SEQ ID NO: 236533 - DNA, 20 bp, Artificial
  CRISPR gRNA sequence
tcttattcttattggaacac

SEQ ID NO: 236534 - DNA, 20 bp, Artificial
  CRISPR gRNA sequence
actctccctaaattgacctg

SEQ ID NO: 236535 - DNA, 20 bp, Artificial
  CRISPR gRNA sequence
aatccaaatcttttcaaatt

SEQ ID NO: 236536 - DNA, 20 bp, Artificial
  CRISPR gRNA sequence
aaaatttatattgaataata

SEQ ID NO: 236537 - DNA, 20 bp, Artificial
  CRISPR gRNA sequence
atattgaataataaagaacc

SEQ ID NO: 236538 - DNA, 20 bp, Artificial
  CRISPR gRNA sequence
ataaagaaccaagaataacc

SEQ ID NO: 236539 - DNA, 20 bp, Artificial
  CRISPR gRNA sequence
tctcttttcttttttttcct

SEQ ID NO: 236540 - DNA, 20 bp, Artificial
  CRISPR gRNA sequence
ttttcttttttttcctgaga

SEQ ID NO: 236541 - DNA, 20 bp, Artificial
  CRISPR gRNA sequence
ttcttttttttcctgagaca

SEQ ID NO: 236542 - DNA, 20 bp, Artificial
  CRISPR gRNA sequence
cagagtttcgctctgtcacc

SEQ ID NO: 236543 - DNA, 20 bp, Artificial
  CRISPR gRNA sequence
agagtttcgctctgtcaccc

SEQ ID NO: 236544 - DNA, 20 bp, Artificial
  CRISPR gRNA sequence
tttcgctctgtcacccaggc

SEQ ID NO: 236545 - DNA, 20 bp, Artificial
  CRISPR gRNA sequence
tcgctctgtcacccaggctg

SEQ ID NO: 236546 - DNA, 20 bp, Artificial
  CRISPR gRNA sequence
tcacccaggctggagtgcaa

SEQ ID NO: 236547 - DNA, 20 bp, Artificial
  CRISPR gRNA sequence
ggagtgcaatggtacgatct

SEQ ID NO: 236548 - DNA, 20 bp, Artificial
  CRISPR gRNA sequence
tcactgcaacctccgccccc

SEQ ID NO: 236549 - DNA, 20 bp, Artificial
  CRISPR gRNA sequence
cactgcaacctccgcccccc

SEQ ID NO: 236550 - DNA, 20 bp, Artificial
  CRISPR gRNA sequence
aacctccgccccccgggttc

SEQ ID NO: 236551 - DNA, 20 bp, Artificial
  CRISPR gRNA sequence
cccgggttcaagcaattctc

SEQ ID NO: 236552 - DNA, 20 bp, Artificial
  CRISPR gRNA sequence
ttcaagcaattctccggcct

SEQ ID NO: 236553 - DNA, 20 bp, Artificial
  CRISPR gRNA sequence
tccggcctcagcctcccaaa

SEQ ID NO: 236554 - DNA, 20 bp, Artificial
  CRISPR gRNA sequence
gcctcagcctcccaaatagc

SEQ ID NO: 236555 - DNA, 20 bp, Artificial
  CRISPR gRNA sequence
cctcagcctcccaaatagct

SEQ ID NO: 236556 - DNA, 20 bp, Artificial
  CRISPR gRNA sequence
ctcccaaatagctgggatta

SEQ ID NO: 236557 - DNA, 20 bp, Artificial
  CRISPR gRNA sequence
tcccaaatagctgggattac

SEQ ID NO: 236558 - DNA, 20 bp, Artificial
  CRISPR gRNA sequence
tgactaatttttgtattttt

SEQ ID NO: 236559 - DNA, 20 bp, Artificial
  CRISPR gRNA sequence
ctaatttttgtattttttag

SEQ ID NO: 236560 - DNA, 20 bp, Artificial
  CRISPR gRNA sequence
aatttttgtattttttagta

SEQ ID NO: 236561 - DNA, 20 bp, Artificial
  CRISPR gRNA sequence
tttgtattttttagtagaga

SEQ ID NO: 236562 - DNA, 20 bp, Artificial
  CRISPR gRNA sequence
ttgtattttttagtagagat

SEQ ID NO: 236563 - DNA, 20 bp, Artificial
  CRISPR gRNA sequence
tgtattttttagtagagatg

SEQ ID NO: 236564 - DNA, 20 bp, Artificial
  CRISPR gRNA sequence
gagatggggtttcaccatgt

SEQ ID NO: 236565 - DNA, 20 bp, Artificial
  CRISPR gRNA sequence
tggggtttcaccatgttggc

SEQ ID NO: 236566 - DNA, 20 bp, Artificial
  CRISPR gRNA sequence
ggggtttcaccatgttggcc

SEQ ID NO: 236567 - DNA, 20 bp, Artificial
  CRISPR gRNA sequence
tgtctcaaaactcctgacct

SEQ ID NO: 236568 - DNA, 20 bp, Artificial
  CRISPR gRNA sequence
gtctcaaaactcctgacctc

SEQ ID NO: 236569 - DNA, 20 bp, Artificial
  CRISPR gRNA sequence
ctcaggtgatccatccgcgt

SEQ ID NO: 236570 - DNA, 20 bp, Artificial
  CRISPR gRNA sequence
ccatccgcgtcggcctccca

SEQ ID NO: 236571 - DNA, 20 bp, Artificial
  CRISPR gRNA sequence
gcgtcggcctcccaaagtgc

SEQ ID NO: 236572 - DNA, 20 bp, Artificial
  CRISPR gRNA sequence
cgtcggcctcccaaagtgct

SEQ ID NO: 236573 - DNA, 20 bp, Artificial
  CRISPR gRNA sequence
ctcccaaagtgctgggatta

SEQ ID NO: 236574 - DNA, 20 bp, Artificial
  CRISPR gRNA sequence
tcccaaagtgctgggattac

SEQ ID NO: 236575 - DNA, 20 bp, Artificial
  CRISPR gRNA sequence
agtgctgggattacaggcgt

SEQ ID NO: 236576 - DNA, 20 bp, Artificial
  CRISPR gRNA sequence
gtgagccaccgtgcctgacc

SEQ ID NO: 236577 - DNA, 20 bp, Artificial
  CRISPR gRNA sequence
ccaccgtgcctgacctagct

SEQ ID NO: 236578 - DNA, 20 bp, Artificial
  CRISPR gRNA sequence
acctagctaagacacttctg

SEQ ID NO: 236579 - DNA, 20 bp, Artificial
  CRISPR gRNA sequence
tagctaagacacttctgaag

SEQ ID NO: 236580 - DNA, 20 bp, Artificial
  CRISPR gRNA sequence
agacacttctgaagtagaaa

SEQ ID NO: 236581 - DNA, 20 bp, Artificial
  CRISPR gRNA sequence
cacttctgaagtagaaaaag

SEQ ID NO: 236582 - DNA, 20 bp, Artificial
  CRISPR gRNA sequence
acttctgaagtagaaaaaga

SEQ ID NO: 236583 - DNA, 20 bp, Artificial
  CRISPR gRNA sequence
tctgaagtagaaaaagaagg

SEQ ID NO: 236584 - DNA, 20 bp, Artificial
  CRISPR gRNA sequence
tgaagtagaaaaagaaggtg

SEQ ID NO: 236585 - DNA, 20 bp, Artificial
  CRISPR gRNA sequence
gaagtagaaaaagaaggtgg

SEQ ID NO: 236586 - DNA, 20 bp, Artificial
  CRISPR gRNA sequence
aagtagaaaaagaaggtgga

SEQ ID NO: 236587 - DNA, 20 bp, Artificial
  CRISPR gRNA sequence
gtagaaaaagaaggtggagg

SEQ ID NO: 236588 - DNA, 20 bp, Artificial
  CRISPR gRNA sequence
ggtggagggagatgtcctac

SEQ ID NO: 236589 - DNA, 20 bp, Artificial
  CRISPR gRNA sequence
gagatgtcctaccggatatc

SEQ ID NO: 236590 - DNA, 20 bp, Artificial
  CRISPR gRNA sequence
gatgtcctaccggatatcga

SEQ ID NO: 236591 - DNA, 20 bp, Artificial
  CRISPR gRNA sequence
ggatatcgagagctgttaca

SEQ ID NO: 236592 - DNA, 20 bp, Artificial
  CRISPR gRNA sequence
caaagctattgtaataaaca

SEQ ID NO: 236593 - DNA, 20 bp, Artificial
  CRISPR gRNA sequence
taataaacacagtgtgatac

SEQ ID NO: 236594 - DNA, 20 bp, Artificial
  CRISPR gRNA sequence
aacacagtgtgatactggca

SEQ ID NO: 236595 - DNA, 20 bp, Artificial
  CRISPR gRNA sequence
acacagtgtgatactggcac

SEQ ID NO: 236596 - DNA, 20 bp, Artificial
  CRISPR gRNA sequence
agtgtgatactggcacagga

SEQ ID NO: 236597 - DNA, 20 bp, Artificial
  CRISPR gRNA sequence
caggatagacaaattgacaa

SEQ ID NO: 236598 - DNA, 20 bp, Artificial
  CRISPR gRNA sequence
tagacaaattgacaatggaa

SEQ ID NO: 236599 - DNA, 20 bp, Artificial
  CRISPR gRNA sequence
aaattgacaatggaacagaa

SEQ ID NO: 236600 - DNA, 20 bp, Artificial
  CRISPR gRNA sequence
aattgacaatggaacagaac

SEQ ID NO: 236601 - DNA, 20 bp, Artificial
  CRISPR gRNA sequence
attgacaatggaacagaaca

SEQ ID NO: 236602 - DNA, 20 bp, Artificial
  CRISPR gRNA sequence
tgacaatggaacagaacagg

SEQ ID NO: 236603 - DNA, 20 bp, Artificial
  CRISPR gRNA sequence
atggaacagaacagggagcc

SEQ ID NO: 236604 - DNA, 20 bp, Artificial
  CRISPR gRNA sequence
gaacagaacagggagcccag

SEQ ID NO: 236605 - DNA, 20 bp, Artificial
  CRISPR gRNA sequence
cagaacagggagcccagaag

SEQ ID NO: 236606 - DNA, 20 bp, Artificial
  CRISPR gRNA sequence
ggagcccagaagcagaccca

SEQ ID NO: 236607 - DNA, 20 bp, Artificial
  CRISPR gRNA sequence
gaagcagacccatggcccta

SEQ ID NO: 236608 - DNA, 20 bp, Artificial
  CRISPR gRNA sequence
atggccctatggaaacttga

SEQ ID NO: 236609 - DNA, 20 bp, Artificial
  CRISPR gRNA sequence
ccctatggaaacttgatgga

SEQ ID NO: 236610 - DNA, 20 bp, Artificial
  CRISPR gRNA sequence
tatggaaacttgatggatgg

SEQ ID NO: 236611 - DNA, 20 bp, Artificial
  CRISPR gRNA sequence
atggaaacttgatggatggt

SEQ ID NO: 236612 - DNA, 20 bp, Artificial
  CRISPR gRNA sequence
aaacttgatggatggtaggt

SEQ ID NO: 236613 - DNA, 20 bp, Artificial
  CRISPR gRNA sequence
atggatggtaggtgagattg

SEQ ID NO: 236614 - DNA, 20 bp, Artificial
  CRISPR gRNA sequence
taggtgagattgcagacccg

SEQ ID NO: 236615 - DNA, 20 bp, Artificial
  CRISPR gRNA sequence
aggtgagattgcagacccgc

SEQ ID NO: 236616 - DNA, 20 bp, Artificial
  CRISPR gRNA sequence
gtgagattgcagacccgcag

SEQ ID NO: 236617 - DNA, 20 bp, Artificial
  CRISPR gRNA sequence
gattgcagacccgcaggaga

SEQ ID NO: 236618 - DNA, 20 bp, Artificial
  CRISPR gRNA sequence
aagacgacgtattgaataca

SEQ ID NO: 236619 - DNA, 20 bp, Artificial
  CRISPR gRNA sequence
gacgtattgaatacatggcg

SEQ ID NO: 236620 - DNA, 20 bp, Artificial
  CRISPR gRNA sequence
acgtattgaatacatggcgc

SEQ ID NO: 236621 - DNA, 20 bp, Artificial
  CRISPR gRNA sequence
cgtattgaatacatggcgca

SEQ ID NO: 236622 - DNA, 20 bp, Artificial
  CRISPR gRNA sequence
tgaatacatggcgcagggac

SEQ ID NO: 236623 - DNA, 20 bp, Artificial
  CRISPR gRNA sequence
atacatggcgcagggaccag

SEQ ID NO: 236624 - DNA, 20 bp, Artificial
  CRISPR gRNA sequence
accagtggttacctacatgc

SEQ ID NO: 236625 - DNA, 20 bp, Artificial
  CRISPR gRNA sequence
ggttacctacatgcaagaca

SEQ ID NO: 236626 - DNA, 20 bp, Artificial
  CRISPR gRNA sequence
ctacatgcaagacatggaat

SEQ ID NO: 236627 - DNA, 20 bp, Artificial
  CRISPR gRNA sequence
attggatcactacctcccaa

SEQ ID NO: 236628 - DNA, 20 bp, Artificial
  CRISPR gRNA sequence
ttggatcactacctcccaac

SEQ ID NO: 236629 - DNA, 20 bp, Artificial
  CRISPR gRNA sequence
ctacctcccaacaggcacaa

SEQ ID NO: 236630 - DNA, 20 bp, Artificial
  CRISPR gRNA sequence
ctcccaacaggcacaaaagc

SEQ ID NO: 236631 - DNA, 20 bp, Artificial
  CRISPR gRNA sequence
aaagccagttcctgatacat

SEQ ID NO: 236632 - DNA, 20 bp, Artificial
  CRISPR gRNA sequence
ttcctgatacattagacttc

SEQ ID NO: 236633 - DNA, 20 bp, Artificial
  CRISPR gRNA sequence
tacattagacttcaagatga

SEQ ID NO: 236634 - DNA, 20 bp, Artificial
  CRISPR gRNA sequence
aagacaaaacttaaaacttt

SEQ ID NO: 236635 - DNA, 20 bp, Artificial
  CRISPR gRNA sequence
aaaacttttggaataaaatg

SEQ ID NO: 236636 - DNA, 20 bp, Artificial
  CRISPR gRNA sequence
aaacttttggaataaaatgt

SEQ ID NO: 236637 - DNA, 20 bp, Artificial
  CRISPR gRNA sequence
aatgtgggcaaacctcttta

SEQ ID NO: 236638 - DNA, 20 bp, Artificial
  CRISPR gRNA sequence
ggcaaacctctttatagtat

SEQ ID NO: 236639 - DNA, 20 bp, Artificial
  CRISPR gRNA sequence
gcaaacctctttatagtatt

SEQ ID NO: 236640 - DNA, 20 bp, Artificial
  CRISPR gRNA sequence
aacctctttatagtattggg

SEQ ID NO: 236641 - DNA, 20 bp, Artificial
  CRISPR gRNA sequence
ctttatagtattgggcagaa

SEQ ID NO: 236642 - DNA, 20 bp, Artificial
  CRISPR gRNA sequence
tttatagtattgggcagaaa

SEQ ID NO: 236643 - DNA, 20 bp, Artificial
  CRISPR gRNA sequence
tgggcagaaaaggatttctt

SEQ ID NO: 236644 - DNA, 20 bp, Artificial
  CRISPR gRNA sequence
cagaaaaggatttctttagc

SEQ ID NO: 236645 - DNA, 20 bp, Artificial
  CRISPR gRNA sequence
agaaaaggatttctttagcc

SEQ ID NO: 236646 - DNA, 20 bp, Artificial
  CRISPR gRNA sequence
aaggatttctttagccaggc

SEQ ID NO: 236647 - DNA, 20 bp, Artificial
  CRISPR gRNA sequence
agaaaaaatgttaaccatat

SEQ ID NO: 236648 - DNA, 20 bp, Artificial
  CRISPR gRNA sequence
atgttaaccatatgagaaaa

SEQ ID NO: 236649 - DNA, 20 bp, Artificial
  CRISPR gRNA sequence
aaatttaaccaaatcaaatg

SEQ ID NO: 236650 - DNA, 20 bp, Artificial
  CRISPR gRNA sequence
aagaactttttgcttattac

SEQ ID NO: 236651 - DNA, 20 bp, Artificial
  CRISPR gRNA sequence
actttttgcttattaccaga

SEQ ID NO: 236652 - DNA, 20 bp, Artificial
  CRISPR gRNA sequence
tgcttattaccagaaagaca

SEQ ID NO: 236653 - DNA, 20 bp, Artificial
  CRISPR gRNA sequence
tattaccagaaagacaaaga

SEQ ID NO: 236654 - DNA, 20 bp, Artificial
  CRISPR gRNA sequence
caaagaaagacaccattaat

SEQ ID NO: 236655 - DNA, 20 bp, Artificial
  CRISPR gRNA sequence
aagaaagacaccattaatta

SEQ ID NO: 236656 - DNA, 20 bp, Artificial
  CRISPR gRNA sequence
caccattaattagagaaaaa

SEQ ID NO: 236657 - DNA, 20 bp, Artificial
  CRISPR gRNA sequence
accattaattagagaaaaac

SEQ ID NO: 236658 - DNA, 20 bp, Artificial
  CRISPR gRNA sequence
cattaattagagaaaaacag

SEQ ID NO: 236659 - DNA, 20 bp, Artificial
  CRISPR gRNA sequence
attaattagagaaaaacagg

SEQ ID NO: 236660 - DNA, 20 bp, Artificial
  CRISPR gRNA sequence
ttaattagagaaaaacagga

SEQ ID NO: 236661 - DNA, 20 bp, Artificial
  CRISPR gRNA sequence
taattagagaaaaacaggag

SEQ ID NO: 236662 - DNA, 20 bp, Artificial
  CRISPR gRNA sequence
agagaaaaacaggaggggcg

SEQ ID NO: 236663 - DNA, 20 bp, Artificial
  CRISPR gRNA sequence
gaaaaacaggaggggcgcgg

SEQ ID NO: 236664 - DNA, 20 bp, Artificial
  CRISPR gRNA sequence
gtggctcatgtctgcaattc

SEQ ID NO: 236665 - DNA, 20 bp, Artificial
  CRISPR gRNA sequence
tgtctgcaattccagcactt

SEQ ID NO: 236666 - DNA, 20 bp, Artificial
  CRISPR gRNA sequence
ctgcaattccagcactttgg

SEQ ID NO: 236667 - DNA, 20 bp, Artificial
  CRISPR gRNA sequence
tgcaattccagcactttgga

SEQ ID NO: 236668 - DNA, 20 bp, Artificial
  CRISPR gRNA sequence
ttccagcactttggaaggct

SEQ ID NO: 236669 - DNA, 20 bp, Artificial
  CRISPR gRNA sequence
tccagcactttggaaggctg

SEQ ID NO: 236670 - DNA, 20 bp, Artificial
  CRISPR gRNA sequence
agcactttggaaggctgagg

SEQ ID NO: 236671 - DNA, 20 bp, Artificial
  CRISPR gRNA sequence
gcactttggaaggctgaggt

SEQ ID NO: 236672 - DNA, 20 bp, Artificial
  CRISPR gRNA sequence
actttggaaggctgaggtgg

SEQ ID NO: 236673 - DNA, 20 bp, Artificial
  CRISPR gRNA sequence
ctttggaaggctgaggtggg

SEQ ID NO: 236674 - DNA, 20 bp, Artificial
  CRISPR gRNA sequence
ctgaggtgggaggatcactt

SEQ ID NO: 236675 - DNA, 20 bp, Artificial
  CRISPR gRNA sequence
gtgggaggatcacttgagct

SEQ ID NO: 236676 - DNA, 20 bp, Artificial
  CRISPR gRNA sequence
tgggaggatcacttgagctc

SEQ ID NO: 236677 - DNA, 20 bp, Artificial
  CRISPR gRNA sequence
ggaggatcacttgagctcag

SEQ ID NO: 236678 - DNA, 20 bp, Artificial
  CRISPR gRNA sequence
tcacttgagctcaggagttc

SEQ ID NO: 236679 - DNA, 20 bp, Artificial
  CRISPR gRNA sequence
tgagctcaggagttcaagac

SEQ ID NO: 236680 - DNA, 20 bp, Artificial
  CRISPR gRNA sequence
tcaggagttcaagaccagcc

SEQ ID NO: 236681 - DNA, 20 bp, Artificial
  CRISPR gRNA sequence
caggagttcaagaccagcct

SEQ ID NO: 236682 - DNA, 20 bp, Artificial
  CRISPR gRNA sequence
tgggcaacataatgaaacct

SEQ ID NO: 236683 - DNA, 20 bp, Artificial
  CRISPR gRNA sequence
tgctaaaaataaaaataaaa

SEQ ID NO: 236684 - DNA, 20 bp, Artificial
  CRISPR gRNA sequence
attttataaaaaattttaaa

SEQ ID NO: 236685 - DNA, 20 bp, Artificial
  CRISPR gRNA sequence
ttttataaaaaattttaaaa

SEQ ID NO: 236686 - DNA, 20 bp, Artificial
  CRISPR gRNA sequence
tttataaaaaattttaaaaa

SEQ ID NO: 236687 - DNA, 20 bp, Artificial
  CRISPR gRNA sequence
aaagggaaaaataaattaca

SEQ ID NO: 236688 - DNA, 20 bp, Artificial
  CRISPR gRNA sequence
aagggaaaaataaattacaa

SEQ ID NO: 236689 - DNA, 20 bp, Artificial
  CRISPR gRNA sequence
gatatatatatatatatata

SEQ ID NO: 236690 - DNA, 20 bp, Artificial
  CRISPR gRNA sequence
tatatatatatatatagata

SEQ ID NO: 236691 - DNA, 20 bp, Artificial
  CRISPR gRNA sequence
tatatatatatagatataga

SEQ ID NO: 236692 - DNA, 20 bp, Artificial
  CRISPR gRNA sequence
tatatatagatatagataga

SEQ ID NO: 236693 - DNA, 20 bp, Artificial
  CRISPR gRNA sequence
tatagatatagatagataga

SEQ ID NO: 236694 - DNA, 20 bp, Artificial
  CRISPR gRNA sequence
gatatagatagatagataga

SEQ ID NO: 236695 - DNA, 20 bp, Artificial
  CRISPR gRNA sequence
tagatagatagatagataga

SEQ ID NO: 236696 - DNA, 20 bp, Artificial
  CRISPR gRNA sequence
agatagatagatagatagat

SEQ ID NO: 236697 - DNA, 20 bp, Artificial
  CRISPR gRNA sequence
tagatagatagatagatagg

SEQ ID NO: 236698 - DNA, 20 bp, Artificial
  CRISPR gRNA sequence
agaatttcactcttgtcacc

SEQ ID NO: 236699 - DNA, 20 bp, Artificial
  CRISPR gRNA sequence
ttcactcttgtcacccagtc

SEQ ID NO: 236700 - DNA, 20 bp, Artificial
  CRISPR gRNA sequence
cactcttgtcacccagtctg

SEQ ID NO: 236701 - DNA, 20 bp, Artificial
  CRISPR gRNA sequence
tcacccagtctggagtgcaa

SEQ ID NO: 236702 - DNA, 20 bp, Artificial
  CRISPR gRNA sequence
ggagtgcaatggcacaatct

SEQ ID NO: 236703 - DNA, 20 bp, Artificial
  CRISPR gRNA sequence
tcgctgcaacctctgcctcc

SEQ ID NO: 236704 - DNA, 20 bp, Artificial
  CRISPR gRNA sequence
cgctgcaacctctgcctcct

SEQ ID NO: 236705 - DNA, 20 bp, Artificial
  CRISPR gRNA sequence
aacctctgcctcctgggttc

SEQ ID NO: 236706 - DNA, 20 bp, Artificial
  CRISPR gRNA sequence
ttcaagcgattcttctgcca

SEQ ID NO: 236707 - DNA, 20 bp, Artificial
  CRISPR gRNA sequence
gattcttctgccacagcctc

SEQ ID NO: 236708 - DNA, 20 bp, Artificial
  CRISPR gRNA sequence
ttcttctgccacagcctctg

SEQ ID NO: 236709 - DNA, 20 bp, Artificial
  CRISPR gRNA sequence
ttctgccacagcctctggag

SEQ ID NO: 236710 - DNA, 20 bp, Artificial
  CRISPR gRNA sequence
gccacagcctctggagcagc

SEQ ID NO: 236711 - DNA, 20 bp, Artificial
  CRISPR gRNA sequence
ccacagcctctggagcagct

SEQ ID NO: 236712 - DNA, 20 bp, Artificial
  CRISPR gRNA sequence
cacagcctctggagcagctg

SEQ ID NO: 236713 - DNA, 20 bp, Artificial
  CRISPR gRNA sequence
ctctggagcagctggggtta

SEQ ID NO: 236714 - DNA, 20 bp, Artificial
  CRISPR gRNA sequence
tctggagcagctggggttac

SEQ ID NO: 236715 - DNA, 20 bp, Artificial
  CRISPR gRNA sequence
caggcacccgccaccatacc

SEQ ID NO: 236716 - DNA, 20 bp, Artificial
  CRISPR gRNA sequence
acccgccaccatacccagct

SEQ ID NO: 236717 - DNA, 20 bp, Artificial
  CRISPR gRNA sequence
agctaagttttgtacatgtt

SEQ ID NO: 236718 - DNA, 20 bp, Artificial
  CRISPR gRNA sequence
taagttttgtacatgtttag

SEQ ID NO: 236719 - DNA, 20 bp, Artificial
  CRISPR gRNA sequence
agttttgtacatgtttagta

SEQ ID NO: 236720 - DNA, 20 bp, Artificial
  CRISPR gRNA sequence
ttgtacatgtttagtagaga

SEQ ID NO: 236721 - DNA, 20 bp, Artificial
  CRISPR gRNA sequence
tgtacatgtttagtagagat

SEQ ID NO: 236722 - DNA, 20 bp, Artificial
  CRISPR gRNA sequence
gtacatgtttagtagagatg

SEQ ID NO: 236723 - DNA, 20 bp, Artificial
  CRISPR gRNA sequence
gagatggggtttcactgtgt

SEQ ID NO: 236724 - DNA, 20 bp, Artificial
  CRISPR gRNA sequence
tggggtttcactgtgttggc

SEQ ID NO: 236725 - DNA, 20 bp, Artificial
  CRISPR gRNA sequence
ggggtttcactgtgttggcc

SEQ ID NO: 236726 - DNA, 20 bp, Artificial
  CRISPR gRNA sequence
tgatcttgaactcttgacct

SEQ ID NO: 236727 - DNA, 20 bp, Artificial
  CRISPR gRNA sequence
ctcagatgatccacccacct

SEQ ID NO: 236728 - DNA, 20 bp, Artificial
  CRISPR gRNA sequence
ccacccacctcagccccgca

SEQ ID NO: 236729 - DNA, 20 bp, Artificial
  CRISPR gRNA sequence
acctcagccccgcaaagtgc

SEQ ID NO: 236730 - DNA, 20 bp, Artificial
  CRISPR gRNA sequence
cctcagccccgcaaagtgct

SEQ ID NO: 236731 - DNA, 20 bp, Artificial
  CRISPR gRNA sequence
cccgcaaagtgctgggatta

SEQ ID NO: 236732 - DNA, 20 bp, Artificial
  CRISPR gRNA sequence
ccgcaaagtgctgggattac

SEQ ID NO: 236733 - DNA, 20 bp, Artificial
  CRISPR gRNA sequence
agtgctgggattacaggtgt

SEQ ID NO: 236734 - DNA, 20 bp, Artificial
  CRISPR gRNA sequence
caggtgtgagctaccgtgcc

SEQ ID NO: 236735 - DNA, 20 bp, Artificial
  CRISPR gRNA sequence
agctaccgtgcctggccaca

SEQ ID NO: 236736 - DNA, 20 bp, Artificial
  CRISPR gRNA sequence
taccgtgcctggccacaaag

SEQ ID NO: 236737 - DNA, 20 bp, Artificial
  CRISPR gRNA sequence
ttaacacatataactgacca

SEQ ID NO: 236738 - DNA, 20 bp, Artificial
  CRISPR gRNA sequence
actgaccaaagattattatc

SEQ ID NO: 236739 - DNA, 20 bp, Artificial
  CRISPR gRNA sequence
attattatctagaatacata

SEQ ID NO: 236740 - DNA, 20 bp, Artificial
  CRISPR gRNA sequence
tagaatacataaagaccttt

SEQ ID NO: 236741 - DNA, 20 bp, Artificial
  CRISPR gRNA sequence
agaatacataaagacctttt

SEQ ID NO: 236742 - DNA, 20 bp, Artificial
  CRISPR gRNA sequence
cataaagaccttttaggaat

SEQ ID NO: 236743 - DNA, 20 bp, Artificial
  CRISPR gRNA sequence
ataaagaccttttaggaatc

SEQ ID NO: 236744 - DNA, 20 bp, Artificial
  CRISPR gRNA sequence
tcaggacaaacaaccacatt

SEQ ID NO: 236745 - DNA, 20 bp, Artificial
  CRISPR gRNA sequence
caggacaaacaaccacattt

SEQ ID NO: 236746 - DNA, 20 bp, Artificial
  CRISPR gRNA sequence
atttgggtttgtttgtttct

SEQ ID NO: 236747 - DNA, 20 bp, Artificial
  CRISPR gRNA sequence
ggtttgtttgtttctgagaa

SEQ ID NO: 236748 - DNA, 20 bp, Artificial
  CRISPR gRNA sequence
gtttgtttgtttctgagaaa

SEQ ID NO: 236749 - DNA, 20 bp, Artificial
  CRISPR gRNA sequence
aaaggtttttctctgttgcc

SEQ ID NO: 236750 - DNA, 20 bp, Artificial
  CRISPR gRNA sequence
aaggtttttctctgttgccc

SEQ ID NO: 236751 - DNA, 20 bp, Artificial
  CRISPR gRNA sequence
tttctctgttgcccaggctg

SEQ ID NO: 236752 - DNA, 20 bp, Artificial
  CRISPR gRNA sequence
ctgttgcccaggctgaagtg

SEQ ID NO: 236753 - DNA, 20 bp, Artificial
  CRISPR gRNA sequence
caggctgaagtgtagtgatg

SEQ ID NO: 236754 - DNA, 20 bp, Artificial
  CRISPR gRNA sequence
gaagtgtagtgatgcggtcc

SEQ ID NO: 236755 - DNA, 20 bp, Artificial
  CRISPR gRNA sequence
tcactgcaacctctgcctcc

SEQ ID NO: 236756 - DNA, 20 bp, Artificial
  CRISPR gRNA sequence
cactgcaacctctgcctccc

SEQ ID NO: 236757 - DNA, 20 bp, Artificial
  CRISPR gRNA sequence
acctctgcctcccaggctca

SEQ ID NO: 236758 - DNA, 20 bp, Artificial
  CRISPR gRNA sequence
aggctcaaagcgaacctact

SEQ ID NO: 236759 - DNA, 20 bp, Artificial
  CRISPR gRNA sequence
ctcaaagcgaacctactgag

SEQ ID NO: 236760 - DNA, 20 bp, Artificial
  CRISPR gRNA sequence
aagcgaacctactgagtagc

SEQ ID NO: 236761 - DNA, 20 bp, Artificial
  CRISPR gRNA sequence
agcgaacctactgagtagct

SEQ ID NO: 236762 - DNA, 20 bp, Artificial
  CRISPR gRNA sequence
ctactgagtagctgggactt

SEQ ID NO: 236763 - DNA, 20 bp, Artificial
  CRISPR gRNA sequence
tactgagtagctgggacttc

SEQ ID NO: 236764 - DNA, 20 bp, Artificial
  CRISPR gRNA sequence
caggtgcacaccaccacacc

SEQ ID NO: 236765 - DNA, 20 bp, Artificial
  CRISPR gRNA sequence
taatttttgtattttttgta

SEQ ID NO: 236766 - DNA, 20 bp, Artificial
  CRISPR gRNA sequence
ttttgtattttttgtaaaga

SEQ ID NO: 236767 - DNA, 20 bp, Artificial
  CRISPR gRNA sequence
tttgtattttttgtaaagac

SEQ ID NO: 236768 - DNA, 20 bp, Artificial
  CRISPR gRNA sequence
ttgtattttttgtaaagaca

SEQ ID NO: 236769 - DNA, 20 bp, Artificial
  CRISPR gRNA sequence
cagggtttcgccatgttgcc

SEQ ID NO: 236770 - DNA, 20 bp, Artificial
  CRISPR gRNA sequence
agggtttcgccatgttgcca

SEQ ID NO: 236771 - DNA, 20 bp, Artificial
  CRISPR gRNA sequence
tttcgccatgttgccaaggc

SEQ ID NO: 236772 - DNA, 20 bp, Artificial
  CRISPR gRNA sequence
caaggctggtctcgaactcc

SEQ ID NO: 236773 - DNA, 20 bp, Artificial
  CRISPR gRNA sequence
aaggctggtctcgaactcct

SEQ ID NO: 236774 - DNA, 20 bp, Artificial
  CRISPR gRNA sequence
ggtctcgaactcctgggctc

SEQ ID NO: 236775 - DNA, 20 bp, Artificial
  CRISPR gRNA sequence
ctcaagcgatctgcccacct

SEQ ID NO: 236776 - DNA, 20 bp, Artificial
  CRISPR gRNA sequence
ctgcccaccttggcctccca

SEQ ID NO: 236777 - DNA, 20 bp, Artificial
  CRISPR gRNA sequence
gcccaccttggcctcccaaa

SEQ ID NO: 236778 - DNA, 20 bp, Artificial
  CRISPR gRNA sequence
accttggcctcccaaagagc

SEQ ID NO: 236779 - DNA, 20 bp, Artificial
  CRISPR gRNA sequence
ccttggcctcccaaagagct

SEQ ID NO: 236780 - DNA, 20 bp, Artificial
  CRISPR gRNA sequence
ctcccaaagagctgggacta

SEQ ID NO: 236781 - DNA, 20 bp, Artificial
  CRISPR gRNA sequence
tcccaaagagctgggactac

SEQ ID NO: 236782 - DNA, 20 bp, Artificial
  CRISPR gRNA sequence
agagctgggactacaggcat

SEQ ID NO: 236783 - DNA, 20 bp, Artificial
  CRISPR gRNA sequence
caggcatgagccactgcacc

SEQ ID NO: 236784 - DNA, 20 bp, Artificial
  CRISPR gRNA sequence
gagccactgcacccggcccc

SEQ ID NO: 236785 - DNA, 20 bp, Artificial
  CRISPR gRNA sequence
gccccaagtttttttgcaaa

SEQ ID NO: 236786 - DNA, 20 bp, Artificial
  CRISPR gRNA sequence
ccccaagtttttttgcaaat

SEQ ID NO: 236787 - DNA, 20 bp, Artificial
  CRISPR gRNA sequence
ttttttgcaaatgggcaaaa

SEQ ID NO: 236788 - DNA, 20 bp, Artificial
  CRISPR gRNA sequence
gcaaatgggcaaaaaagcat

SEQ ID NO: 236789 - DNA, 20 bp, Artificial
  CRISPR gRNA sequence
atgggcaaaaaagcatgagc

SEQ ID NO: 236790 - DNA, 20 bp, Artificial
  CRISPR gRNA sequence
tttaaaaaaataaacacaaa

SEQ ID NO: 236791 - DNA, 20 bp, Artificial
  CRISPR gRNA sequence
atggtatataaatatttgac

SEQ ID NO: 236792 - DNA, 20 bp, Artificial
  CRISPR gRNA sequence
tggtatataaatatttgaca

SEQ ID NO: 236793 - DNA, 20 bp, Artificial
  CRISPR gRNA sequence
atatttgacaaggtgctcat

SEQ ID NO: 236794 - DNA, 20 bp, Artificial
  CRISPR gRNA sequence
caaggtgctcatcagtaacc

SEQ ID NO: 236795 - DNA, 20 bp, Artificial
  CRISPR gRNA sequence
taaccaagcaaatgcaaact

SEQ ID NO: 236796 - DNA, 20 bp, Artificial
  CRISPR gRNA sequence
gcaaatgcaaactaagacca

SEQ ID NO: 236797 - DNA, 20 bp, Artificial
  CRISPR gRNA sequence
atgcaaactaagaccacagt

SEQ ID NO: 236798 - DNA, 20 bp, Artificial
  CRISPR gRNA sequence
agatctcattctatacccac

SEQ ID NO: 236799 - DNA, 20 bp, Artificial
  CRISPR gRNA sequence
tcattctatacccactggct

SEQ ID NO: 236800 - DNA, 20 bp, Artificial
  CRISPR gRNA sequence
cccactggcttggcaaaatt

SEQ ID NO: 236801 - DNA, 20 bp, Artificial
  CRISPR gRNA sequence
ccactggcttggcaaaatta

SEQ ID NO: 236802 - DNA, 20 bp, Artificial
  CRISPR gRNA sequence
cactggcttggcaaaattaa

SEQ ID NO: 236803 - DNA, 20 bp, Artificial
  CRISPR gRNA sequence
gcaaaattaagggcacctga

SEQ ID NO: 236804 - DNA, 20 bp, Artificial
  CRISPR gRNA sequence
ttaagggcacctgatagtac

SEQ ID NO: 236805 - DNA, 20 bp, Artificial
  CRISPR gRNA sequence
aagggcacctgatagtacca

SEQ ID NO: 236806 - DNA, 20 bp, Artificial
  CRISPR gRNA sequence
agggcacctgatagtaccag

SEQ ID NO: 236807 - DNA, 20 bp, Artificial
  CRISPR gRNA sequence
gggcacctgatagtaccaga

SEQ ID NO: 236808 - DNA, 20 bp, Artificial
  CRISPR gRNA sequence
cacctgatagtaccagaggg

SEQ ID NO: 236809 - DNA, 20 bp, Artificial
  CRISPR gRNA sequence
tgatagtaccagagggtagc

SEQ ID NO: 236810 - DNA, 20 bp, Artificial
  CRISPR gRNA sequence
gatagtaccagagggtagca

SEQ ID NO: 236811 - DNA, 20 bp, Artificial
  CRISPR gRNA sequence
accagagggtagcaaggatg

SEQ ID NO: 236812 - DNA, 20 bp, Artificial
  CRISPR gRNA sequence
gtagcaaggatgtggatcaa

SEQ ID NO: 236813 - DNA, 20 bp, Artificial
  CRISPR gRNA sequence
tagcaaggatgtggatcaat

SEQ ID NO: 236814 - DNA, 20 bp, Artificial
  CRISPR gRNA sequence
catgacacttatatgactga

SEQ ID NO: 236815 - DNA, 20 bp, Artificial
  CRISPR gRNA sequence
atgacacttatatgactgac

SEQ ID NO: 236816 - DNA, 20 bp, Artificial
  CRISPR gRNA sequence
gacacttatatgactgacgg

SEQ ID NO: 236817 - DNA, 20 bp, Artificial
  CRISPR gRNA sequence
tatgactgacgggagtacat

SEQ ID NO: 236818 - DNA, 20 bp, Artificial
  CRISPR gRNA sequence
ctgacgggagtacattagaa

SEQ ID NO: 236819 - DNA, 20 bp, Artificial
  CRISPR gRNA sequence
attagaacagccactttgaa

SEQ ID NO: 236820 - DNA, 20 bp, Artificial
  CRISPR gRNA sequence
agccactttgaaaagcaatt

SEQ ID NO: 236821 - DNA, 20 bp, Artificial
  CRISPR gRNA sequence
tgaaaagcaatttggtactg

SEQ ID NO: 236822 - DNA, 20 bp, Artificial
  CRISPR gRNA sequence
aaagcaatttggtactgcag

SEQ ID NO: 236823 - DNA, 20 bp, Artificial
  CRISPR gRNA sequence
tactgcagtagactattgtt

SEQ ID NO: 236824 - DNA, 20 bp, Artificial
  CRISPR gRNA sequence
cttctcctcacccctattta

SEQ ID NO: 236825 - DNA, 20 bp, Artificial
  CRISPR gRNA sequence
ttttctgccctattgatgcc

SEQ ID NO: 236826 - DNA, 20 bp, Artificial
  CRISPR gRNA sequence
tgccctattgatgcctggct

SEQ ID NO: 236827 - DNA, 20 bp, Artificial
  CRISPR gRNA sequence
attgatgcctggcttggctg

SEQ ID NO: 236828 - DNA, 20 bp, Artificial
  CRISPR gRNA sequence
ttgatgcctggcttggctgc

SEQ ID NO: 236829 - DNA, 20 bp, Artificial
  CRISPR gRNA sequence
tggctgcaggatttgctcta

SEQ ID NO: 236830 - DNA, 20 bp, Artificial
  CRISPR gRNA sequence
ggctgcaggatttgctctaa

SEQ ID NO: 236831 - DNA, 20 bp, Artificial
  CRISPR gRNA sequence
aggatttgctctaaaggtta

SEQ ID NO: 236832 - DNA, 20 bp, Artificial
  CRISPR gRNA sequence
atttgctctaaaggttatag

SEQ ID NO: 236833 - DNA, 20 bp, Artificial
  CRISPR gRNA sequence
ttatagtagaaccaactaaa

SEQ ID NO: 236834 - DNA, 20 bp, Artificial
  CRISPR gRNA sequence
tatagtagaaccaactaaat

SEQ ID NO: 236835 - DNA, 20 bp, Artificial
  CRISPR gRNA sequence
tagtagaaccaactaaatag

SEQ ID NO: 236836 - DNA, 20 bp, Artificial
  CRISPR gRNA sequence
tagaaccaactaaataggag

SEQ ID NO: 236837 - DNA, 20 bp, Artificial
  CRISPR gRNA sequence
aaccaactaaataggagcag

SEQ ID NO: 236838 - DNA, 20 bp, Artificial
  CRISPR gRNA sequence
ctaaataggagcagaagtga

SEQ ID NO: 236839 - DNA, 20 bp, Artificial
  CRISPR gRNA sequence
gatacccatttgccatgcga

SEQ ID NO: 236840 - DNA, 20 bp, Artificial
  CRISPR gRNA sequence
gcgatggccaatgttccaaa

SEQ ID NO: 236841 - DNA, 20 bp, Artificial
  CRISPR gRNA sequence
atggccaatgttccaaatag

SEQ ID NO: 236842 - DNA, 20 bp, Artificial
  CRISPR gRNA sequence
tgctccctccacctaaatcc

SEQ ID NO: 236843 - DNA, 20 bp, Artificial
  CRISPR gRNA sequence
ctccctccacctaaatccca

SEQ ID NO: 236844 - DNA, 20 bp, Artificial
  CRISPR gRNA sequence
aatcccagagtaaaataaca

SEQ ID NO: 236845 - DNA, 20 bp, Artificial
  CRISPR gRNA sequence
atcccagagtaaaataacat

SEQ ID NO: 236846 - DNA, 20 bp, Artificial
  CRISPR gRNA sequence
cagagtaaaataacatggga

SEQ ID NO: 236847 - DNA, 20 bp, Artificial
  CRISPR gRNA sequence
gagtaaaataacatgggaca

SEQ ID NO: 236848 - DNA, 20 bp, Artificial
  CRISPR gRNA sequence
agtaaaataacatgggacag

SEQ ID NO: 236849 - DNA, 20 bp, Artificial
  CRISPR gRNA sequence
aacatgggacagaggcacgc

SEQ ID NO: 236850 - DNA, 20 bp, Artificial
  CRISPR gRNA sequence
agaggcacgcaagcttgcaa

SEQ ID NO: 236851 - DNA, 20 bp, Artificial
  CRISPR gRNA sequence
gaggcacgcaagcttgcaat

SEQ ID NO: 236852 - DNA, 20 bp, Artificial
  CRISPR gRNA sequence
gcaataggcatgtcatacaa

SEQ ID NO: 236853 - DNA, 20 bp, Artificial
  CRISPR gRNA sequence
ggcatgtcatacaaaagtgt

SEQ ID NO: 236854 - DNA, 20 bp, Artificial
  CRISPR gRNA sequence
tcatacaaaagtgtaagaaa

SEQ ID NO: 236855 - DNA, 20 bp, Artificial
  CRISPR gRNA sequence
acaaaagtgtaagaaatggc

SEQ ID NO: 236856 - DNA, 20 bp, Artificial
  CRISPR gRNA sequence
caaaagtgtaagaaatggcc

SEQ ID NO: 236857 - DNA, 20 bp, Artificial
  CRISPR gRNA sequence
gtgtaagaaatggccaggca

SEQ ID NO: 236858 - DNA, 20 bp, Artificial
  CRISPR gRNA sequence
taagaaatggccaggcatgg

SEQ ID NO: 236859 - DNA, 20 bp, Artificial
  CRISPR gRNA sequence
gtggctcatgcctgtaatcc

SEQ ID NO: 236860 - DNA, 20 bp, Artificial
  CRISPR gRNA sequence
tgcctgtaatcccagcactt

SEQ ID NO: 236861 - DNA, 20 bp, Artificial
  CRISPR gRNA sequence
gcctgtaatcccagcacttt

SEQ ID NO: 236862 - DNA, 20 bp, Artificial
  CRISPR gRNA sequence
ctgtaatcccagcactttgg

SEQ ID NO: 236863 - DNA, 20 bp, Artificial
  CRISPR gRNA sequence
tgtaatcccagcactttggg

SEQ ID NO: 236864 - DNA, 20 bp, Artificial
  CRISPR gRNA sequence
aatcccagcactttgggagg

SEQ ID NO: 236865 - DNA, 20 bp, Artificial
  CRISPR gRNA sequence
tcccagcactttgggaggca

SEQ ID NO: 236866 - DNA, 20 bp, Artificial
  CRISPR gRNA sequence
cccagcactttgggaggcag

SEQ ID NO: 236867 - DNA, 20 bp, Artificial
  CRISPR gRNA sequence
agcactttgggaggcagagg

SEQ ID NO: 236868 - DNA, 20 bp, Artificial
  CRISPR gRNA sequence
gcactttgggaggcagaggt

SEQ ID NO: 236869 - DNA, 20 bp, Artificial
  CRISPR gRNA sequence
ctttgggaggcagaggtggg

SEQ ID NO: 236870 - DNA, 20 bp, Artificial
  CRISPR gRNA sequence
cagaggtgggcagatcacct

SEQ ID NO: 236871 - DNA, 20 bp, Artificial
  CRISPR gRNA sequence
agaggtgggcagatcacctg

SEQ ID NO: 236872 - DNA, 20 bp, Artificial
  CRISPR gRNA sequence
gtgggcagatcacctgaggt

SEQ ID NO: 236873 - DNA, 20 bp, Artificial
  CRISPR gRNA sequence
tgggcagatcacctgaggtc

SEQ ID NO: 236874 - DNA, 20 bp, Artificial
  CRISPR gRNA sequence
ggcagatcacctgaggtcag

SEQ ID NO: 236875 - DNA, 20 bp, Artificial
  CRISPR gRNA sequence
tcacctgaggtcaggagttt

SEQ ID NO: 236876 - DNA, 20 bp, Artificial
  CRISPR gRNA sequence
tgaggtcaggagtttgagac

SEQ ID NO: 236877 - DNA, 20 bp, Artificial
  CRISPR gRNA sequence
tcaggagtttgagaccagcc

SEQ ID NO: 236878 - DNA, 20 bp, Artificial
  CRISPR gRNA sequence
tgagaccagcctggacaaca

SEQ ID NO: 236879 - DNA, 20 bp, Artificial
  CRISPR gRNA sequence
tctactaaaaatataaaaat

SEQ ID NO: 236880 - DNA, 20 bp, Artificial
  CRISPR gRNA sequence
ctaaaaatataaaaattagc

SEQ ID NO: 236881 - DNA, 20 bp, Artificial
  CRISPR gRNA sequence
taaaaatataaaaattagcc

SEQ ID NO: 236882 - DNA, 20 bp, Artificial
  CRISPR gRNA sequence
atataaaaattagccaggcg

SEQ ID NO: 236883 - DNA, 20 bp, Artificial
  CRISPR gRNA sequence
taaaaattagccaggcgtgg

SEQ ID NO: 236884 - DNA, 20 bp, Artificial
  CRISPR gRNA sequence
ggcgtggtggcacatacctg

SEQ ID NO: 236885 - DNA, 20 bp, Artificial
  CRISPR gRNA sequence
gtggcacatacctgtagtcc

SEQ ID NO: 236886 - DNA, 20 bp, Artificial
  CRISPR gRNA sequence
tacctgtagtcccagctact

SEQ ID NO: 236887 - DNA, 20 bp, Artificial
  CRISPR gRNA sequence
acctgtagtcccagctactt

SEQ ID NO: 236888 - DNA, 20 bp, Artificial
  CRISPR gRNA sequence
ctgtagtcccagctacttag

SEQ ID NO: 236889 - DNA, 20 bp, Artificial
  CRISPR gRNA sequence
tgtagtcccagctacttagg

SEQ ID NO: 236890 - DNA, 20 bp, Artificial
  CRISPR gRNA sequence
tcccagctacttaggaggct

SEQ ID NO: 236891 - DNA, 20 bp, Artificial
  CRISPR gRNA sequence
cccagctacttaggaggctg

SEQ ID NO: 236892 - DNA, 20 bp, Artificial
  CRISPR gRNA sequence
agctacttaggaggctgagg

SEQ ID NO: 236893 - DNA, 20 bp, Artificial
  CRISPR gRNA sequence
gctacttaggaggctgaggc

SEQ ID NO: 236894 - DNA, 20 bp, Artificial
  CRISPR gRNA sequence
ctacttaggaggctgaggca

SEQ ID NO: 236895 - DNA, 20 bp, Artificial
  CRISPR gRNA sequence
acttaggaggctgaggcagg

SEQ ID NO: 236896 - DNA, 20 bp, Artificial
  CRISPR gRNA sequence
gcagggagatcacttgaaac

SEQ ID NO: 236897 - DNA, 20 bp, Artificial
  CRISPR gRNA sequence
cagggagatcacttgaaact

SEQ ID NO: 236898 - DNA, 20 bp, Artificial
  CRISPR gRNA sequence
gggagatcacttgaaactgg

SEQ ID NO: 236899 - DNA, 20 bp, Artificial
  CRISPR gRNA sequence
ggagatcacttgaaactggg

SEQ ID NO: 236900 - DNA, 20 bp, Artificial
  CRISPR gRNA sequence
gatcacttgaaactgggagg

SEQ ID NO: 236901 - DNA, 20 bp, Artificial
  CRISPR gRNA sequence
aaactgggaggcggtgatcc

SEQ ID NO: 236902 - DNA, 20 bp, Artificial
  CRISPR gRNA sequence
aagattgtaccactgtactc

SEQ ID NO: 236903 - DNA, 20 bp, Artificial
  CRISPR gRNA sequence
tgtaccactgtactccagcc

SEQ ID NO: 236904 - DNA, 20 bp, Artificial
  CRISPR gRNA sequence
gtaccactgtactccagcct

SEQ ID NO: 236905 - DNA, 20 bp, Artificial
  CRISPR gRNA sequence
accactgtactccagcctgg

SEQ ID NO: 236906 - DNA, 20 bp, Artificial
  CRISPR gRNA sequence
ctgtactccagcctgggaga

SEQ ID NO: 236907 - DNA, 20 bp, Artificial
  CRISPR gRNA sequence
gtactccagcctgggagaca

SEQ ID NO: 236908 - DNA, 20 bp, Artificial
  CRISPR gRNA sequence
tccagcctgggagacagagt

SEQ ID NO: 236909 - DNA, 20 bp, Artificial
  CRISPR gRNA sequence
taaaatgaataaaatttaaa

SEQ ID NO: 236910 - DNA, 20 bp, Artificial
  CRISPR gRNA sequence
aaaatttaaaaagctatcct

SEQ ID NO: 236911 - DNA, 20 bp, Artificial
  CRISPR gRNA sequence
aaaagctatccttagatcat

SEQ ID NO: 236912 - DNA, 20 bp, Artificial
  CRISPR gRNA sequence
ttagatcataagccaaacaa

SEQ ID NO: 236913 - DNA, 20 bp, Artificial
  CRISPR gRNA sequence
gatcataagccaaacaatgg

SEQ ID NO: 236914 - DNA, 20 bp, Artificial
  CRISPR gRNA sequence
atcataagccaaacaatggc

SEQ ID NO: 236915 - DNA, 20 bp, Artificial
  CRISPR gRNA sequence
ccaaacaatggcaggcatgc

SEQ ID NO: 236916 - DNA, 20 bp, Artificial
  CRISPR gRNA sequence
caaacaatggcaggcatgcc

SEQ ID NO: 236917 - DNA, 20 bp, Artificial
  CRISPR gRNA sequence
caggtttgcacctgtaatcc

SEQ ID NO: 236918 - DNA, 20 bp, Artificial
  CRISPR gRNA sequence
cacctgtaatcccagctact

SEQ ID NO: 236919 - DNA, 20 bp, Artificial
  CRISPR gRNA sequence
acctgtaatcccagctactt

SEQ ID NO: 236920 - DNA, 20 bp, Artificial
  CRISPR gRNA sequence
ctgtaatcccagctacttgg

SEQ ID NO: 236921 - DNA, 20 bp, Artificial
  CRISPR gRNA sequence
tcccagctacttgggagact

SEQ ID NO: 236922 - DNA, 20 bp, Artificial
  CRISPR gRNA sequence
cccagctacttgggagactg

SEQ ID NO: 236923 - DNA, 20 bp, Artificial
  CRISPR gRNA sequence
agctacttgggagactgagg

SEQ ID NO: 236924 - DNA, 20 bp, Artificial
  CRISPR gRNA sequence
gctacttgggagactgaggc

SEQ ID NO: 236925 - DNA, 20 bp, Artificial
  CRISPR gRNA sequence
acttgggagactgaggcggg

SEQ ID NO: 236926 - DNA, 20 bp, Artificial
  CRISPR gRNA sequence
ctgaggcgggtggatcactt

SEQ ID NO: 236927 - DNA, 20 bp, Artificial
  CRISPR gRNA sequence
gcgggtggatcacttgagcc

SEQ ID NO: 236928 - DNA, 20 bp, Artificial
  CRISPR gRNA sequence
cgggtggatcacttgagccc

SEQ ID NO: 236929 - DNA, 20 bp, Artificial
  CRISPR gRNA sequence
ggtggatcacttgagcccag

SEQ ID NO: 236930 - DNA, 20 bp, Artificial
  CRISPR gRNA sequence
tcacttgagcccaggagttt

SEQ ID NO: 236931 - DNA, 20 bp, Artificial
  CRISPR gRNA sequence
cacttgagcccaggagttta

SEQ ID NO: 236932 - DNA, 20 bp, Artificial
  CRISPR gRNA sequence
agcccaggagtttaaggcta

SEQ ID NO: 236933 - DNA, 20 bp, Artificial
  CRISPR gRNA sequence
gctatgattgtgcctgtgaa

SEQ ID NO: 236934 - DNA, 20 bp, Artificial
  CRISPR gRNA sequence
tgtgaatagccactccattc

SEQ ID NO: 236935 - DNA, 20 bp, Artificial
  CRISPR gRNA sequence
atagccactccattccagcc

SEQ ID NO: 236936 - DNA, 20 bp, Artificial
  CRISPR gRNA sequence
tagccactccattccagcct

SEQ ID NO: 236937 - DNA, 20 bp, Artificial
  CRISPR gRNA sequence
ctccattccagcctgggcaa

SEQ ID NO: 236938 - DNA, 20 bp, Artificial
  CRISPR gRNA sequence
ccattccagcctgggcaaca

SEQ ID NO: 236939 - DNA, 20 bp, Artificial
  CRISPR gRNA sequence
tccagcctgggcaacagagc

SEQ ID NO: 236940 - DNA, 20 bp, Artificial
  CRISPR gRNA sequence
caacagagcaagactgtctc

SEQ ID NO: 236941 - DNA, 20 bp, Artificial
  CRISPR gRNA sequence
gactgtctcaagcaaaccaa

SEQ ID NO: 236942 - DNA, 20 bp, Artificial
  CRISPR gRNA sequence
agcaaaccaacagacaaaca

SEQ ID NO: 236943 - DNA, 20 bp, Artificial
  CRISPR gRNA sequence
gcaaaccaacagacaaacaa

SEQ ID NO: 236944 - DNA, 20 bp, Artificial
  CRISPR gRNA sequence
aacagacaaacaaaggcaaa

SEQ ID NO: 236945 - DNA, 20 bp, Artificial
  CRISPR gRNA sequence
aacaaaggcaaatggtgcac

SEQ ID NO: 236946 - DNA, 20 bp, Artificial
  CRISPR gRNA sequence
acaaaggcaaatggtgcacc

SEQ ID NO: 236947 - DNA, 20 bp, Artificial
  CRISPR gRNA sequence
ggcaaatggtgcaccaggtt

SEQ ID NO: 236948 - DNA, 20 bp, Artificial
  CRISPR gRNA sequence
tggtgcaccaggtttggcca

SEQ ID NO: 236949 - DNA, 20 bp, Artificial
  CRISPR gRNA sequence
ggtgcaccaggtttggccat

SEQ ID NO: 236950 - DNA, 20 bp, Artificial
  CRISPR gRNA sequence
tgcaccaggtttggccatgg

SEQ ID NO: 236951 - DNA, 20 bp, Artificial
  CRISPR gRNA sequence
caggtttggccatgggagtt

SEQ ID NO: 236952 - DNA, 20 bp, Artificial
  CRISPR gRNA sequence
gtttggccatgggagtttgg

SEQ ID NO: 236953 - DNA, 20 bp, Artificial
  CRISPR gRNA sequence
gagtttggcggcccccactc

SEQ ID NO: 236954 - DNA, 20 bp, Artificial
  CRISPR gRNA sequence
cggcccccactctagtgctg

SEQ ID NO: 236955 - DNA, 20 bp, Artificial
  CRISPR gRNA sequence
cccccactctagtgctgtgg

SEQ ID NO: 236956 - DNA, 20 bp, Artificial
  CRISPR gRNA sequence
ccccactctagtgctgtggt

SEQ ID NO: 236957 - DNA, 20 bp, Artificial
  CRISPR gRNA sequence
tagtgctgtggtaggacaat

SEQ ID NO: 236958 - DNA, 20 bp, Artificial
  CRISPR gRNA sequence
gtggtaggacaatgagctca

SEQ ID NO: 236959 - DNA, 20 bp, Artificial
  CRISPR gRNA sequence
tggtaggacaatgagctcac

SEQ ID NO: 236960 - DNA, 20 bp, Artificial
  CRISPR gRNA sequence
tacttcatacctatcatatg

SEQ ID NO: 236961 - DNA, 20 bp, Artificial
  CRISPR gRNA sequence
atcatatgcagttcatttat

SEQ ID NO: 236962 - DNA, 20 bp, Artificial
  CRISPR gRNA sequence
tgcagttcatttattggctt

SEQ ID NO: 236963 - DNA, 20 bp, Artificial
  CRISPR gRNA sequence
ggtataaaatattatgttaa

SEQ ID NO: 236964 - DNA, 20 bp, Artificial
  CRISPR gRNA sequence
aaaatattatgttaaaagtt

SEQ ID NO: 236965 - DNA, 20 bp, Artificial
  CRISPR gRNA sequence
tgttaaaagttaagaatttt

SEQ ID NO: 236966 - DNA, 20 bp, Artificial
  CRISPR gRNA sequence
agaatttttagaatgtaacc

SEQ ID NO: 236967 - DNA, 20 bp, Artificial
  CRISPR gRNA sequence
tagaatgtaacctggcttaa

SEQ ID NO: 236968 - DNA, 20 bp, Artificial
  CRISPR gRNA sequence
agaatgtaacctggcttaaa

SEQ ID NO: 236969 - DNA, 20 bp, Artificial
  CRISPR gRNA sequence
gaatgtaacctggcttaaaa

SEQ ID NO: 236970 - DNA, 20 bp, Artificial
  CRISPR gRNA sequence
atgtaacctggcttaaaagg

SEQ ID NO: 236971 - DNA, 20 bp, Artificial
  CRISPR gRNA sequence
taacctggcttaaaagggag

SEQ ID NO: 236972 - DNA, 20 bp, Artificial
  CRISPR gRNA sequence
aacctggcttaaaagggagc

SEQ ID NO: 236973 - DNA, 20 bp, Artificial
  CRISPR gRNA sequence
gcttaaaagggagcaggaca

SEQ ID NO: 236974 - DNA, 20 bp, Artificial
  CRISPR gRNA sequence
cttaaaagggagcaggacaa

SEQ ID NO: 236975 - DNA, 20 bp, Artificial
  CRISPR gRNA sequence
aaaagggagcaggacaaagg

SEQ ID NO: 236976 - DNA, 20 bp, Artificial
  CRISPR gRNA sequence
agggagcaggacaaaggcag

SEQ ID NO: 236977 - DNA, 20 bp, Artificial
  CRISPR gRNA sequence
gggagcaggacaaaggcaga

SEQ ID NO: 236978 - DNA, 20 bp, Artificial
  CRISPR gRNA sequence
aggacaaaggcagaaggtgt

SEQ ID NO: 236979 - DNA, 20 bp, Artificial
  CRISPR gRNA sequence
ggacaaaggcagaaggtgtg

SEQ ID NO: 236980 - DNA, 20 bp, Artificial
  CRISPR gRNA sequence
aaaggcagaaggtgtgagga

SEQ ID NO: 236981 - DNA, 20 bp, Artificial
  CRISPR gRNA sequence
aggcagaaggtgtgaggatg

SEQ ID NO: 236982 - DNA, 20 bp, Artificial
  CRISPR gRNA sequence
cagaaggtgtgaggatggag

SEQ ID NO: 236983 - DNA, 20 bp, Artificial
  CRISPR gRNA sequence
tgtgaggatggagaagacca

SEQ ID NO: 236984 - DNA, 20 bp, Artificial
  CRISPR gRNA sequence
gtgaggatggagaagaccat

SEQ ID NO: 236985 - DNA, 20 bp, Artificial
  CRISPR gRNA sequence
ggagaagaccataggatata

SEQ ID NO: 236986 - DNA, 20 bp, Artificial
  CRISPR gRNA sequence
actctttccaaaacttcctc

SEQ ID NO: 236987 - DNA, 20 bp, Artificial
  CRISPR gRNA sequence
ctctttccaaaacttcctcc

SEQ ID NO: 236988 - DNA, 20 bp, Artificial
  CRISPR gRNA sequence
ccaaaacttcctccaggcct

SEQ ID NO: 236989 - DNA, 20 bp, Artificial
  CRISPR gRNA sequence
caaaacttcctccaggcctg

SEQ ID NO: 236990 - DNA, 20 bp, Artificial
  CRISPR gRNA sequence
tttgtccttgaccctaaact

SEQ ID NO: 236991 - DNA, 20 bp, Artificial
  CRISPR gRNA sequence
ttgtccttgaccctaaactc

SEQ ID NO: 236992 - DNA, 20 bp, Artificial
  CRISPR gRNA sequence
ctgctcatactcccccctga

SEQ ID NO: 236993 - DNA, 20 bp, Artificial
  CRISPR gRNA sequence
ctcatactcccccctgacgg

SEQ ID NO: 236994 - DNA, 20 bp, Artificial
  CRISPR gRNA sequence
catactcccccctgacggtg

SEQ ID NO: 236995 - DNA, 20 bp, Artificial
  CRISPR gRNA sequence
gagcatgtcgtgttacatga

SEQ ID NO: 236996 - DNA, 20 bp, Artificial
  CRISPR gRNA sequence
gtgttacatgacagaaccca

SEQ ID NO: 236997 - DNA, 20 bp, Artificial
  CRISPR gRNA sequence
gacagaacccacggaaactt

SEQ ID NO: 236998 - DNA, 20 bp, Artificial
  CRISPR gRNA sequence
gaacccacggaaactttagt

SEQ ID NO: 236999 - DNA, 20 bp, Artificial
  CRISPR gRNA sequence
aacccacggaaactttagtc

SEQ ID NO: 237000 - DNA, 20 bp, Artificial
  CRISPR gRNA sequence
cgggtacttactgcacctcg

SEQ ID NO: 237001 - DNA, 20 bp, Artificial
  CRISPR gRNA sequence
cttattgtcatatgtcatat

SEQ ID NO: 237002 - DNA, 20 bp, Artificial
  CRISPR gRNA sequence
attgattttgattataatta

SEQ ID NO: 237003 - DNA, 20 bp, Artificial
  CRISPR gRNA sequence
attttgattataattatagt

SEQ ID NO: 237004 - DNA, 20 bp, Artificial
  CRISPR gRNA sequence
tataattatagttggaccac

SEQ ID NO: 237005 - DNA, 20 bp, Artificial
  CRISPR gRNA sequence
atttaaactataattttctt

SEQ ID NO: 237006 - DNA, 20 bp, Artificial
  CRISPR gRNA sequence
tctttggatttcaaaaaaac

SEQ ID NO: 237007 - DNA, 20 bp, Artificial
  CRISPR gRNA sequence
aaaactagctcaaacctgtt

SEQ ID NO: 237008 - DNA, 20 bp, Artificial
  CRISPR gRNA sequence
actagctcaaacctgttaag

SEQ ID NO: 237009 - DNA, 20 bp, Artificial
  CRISPR gRNA sequence
caaacctgttaagtggtatc

SEQ ID NO: 237010 - DNA, 20 bp, Artificial
  CRISPR gRNA sequence
tttttttttttttttatcac

SEQ ID NO: 237011 - DNA, 20 bp, Artificial
  CRISPR gRNA sequence
tcatctgtctgttctgttaa

SEQ ID NO: 237012 - DNA, 20 bp, Artificial
  CRISPR gRNA sequence
tctgtctgttctgttaaaag

SEQ ID NO: 237013 - DNA, 20 bp, Artificial
  CRISPR gRNA sequence
ttaaaagtggtgcattattt

SEQ ID NO: 237014 - DNA, 20 bp, Artificial
  CRISPR gRNA sequence
aagtggtgcattattttggc

SEQ ID NO: 237015 - DNA, 20 bp, Artificial
  CRISPR gRNA sequence
agtggtgcattattttggcc

SEQ ID NO: 237016 - DNA, 20 bp, Artificial
  CRISPR gRNA sequence
tgcattattttggccgggcc

SEQ ID NO: 237017 - DNA, 20 bp, Artificial
  CRISPR gRNA sequence
attattttggccgggcctgg

SEQ ID NO: 237018 - DNA, 20 bp, Artificial
  CRISPR gRNA sequence
gcagttcatgtctgtaatcc

SEQ ID NO: 237019 - DNA, 20 bp, Artificial
  CRISPR gRNA sequence
tgtctgtaatcccagcactt

SEQ ID NO: 237020 - DNA, 20 bp, Artificial
  CRISPR gRNA sequence
gtctgtaatcccagcacttt

SEQ ID NO: 237021 - DNA, 20 bp, Artificial
  CRISPR gRNA sequence
ctgtaatcccagcactttgg

SEQ ID NO: 237022 - DNA, 20 bp, Artificial
  CRISPR gRNA sequence
tgtaatcccagcactttggg

SEQ ID NO: 237023 - DNA, 20 bp, Artificial
  CRISPR gRNA sequence
cccagcactttgggaggcca

SEQ ID NO: 237024 - DNA, 20 bp, Artificial
  CRISPR gRNA sequence
ttgggaggccaaagtgaacc

SEQ ID NO: 237025 - DNA, 20 bp, Artificial
  CRISPR gRNA sequence
tgggaggccaaagtgaacct

SEQ ID NO: 237026 - DNA, 20 bp, Artificial
  CRISPR gRNA sequence
ggaggccaaagtgaacctag

SEQ ID NO: 237027 - DNA, 20 bp, Artificial
  CRISPR gRNA sequence
caaagtgaacctaggagttt

SEQ ID NO: 237028 - DNA, 20 bp, Artificial
  CRISPR gRNA sequence
tgaacctaggagtttgagac

SEQ ID NO: 237029 - DNA, 20 bp, Artificial
  CRISPR gRNA sequence
tgagaccagcctgtacaaca

SEQ ID NO: 237030 - DNA, 20 bp, Artificial
  CRISPR gRNA sequence
ttaccaaacaaaaaacaaaa

SEQ ID NO: 237031 - DNA, 20 bp, Artificial
  CRISPR gRNA sequence
caaacaaaaaacaaaaaagt

SEQ ID NO: 237032 - DNA, 20 bp, Artificial
  CRISPR gRNA sequence
caaaaaacaaaaaagttagt

SEQ ID NO: 237033 - DNA, 20 bp, Artificial
  CRISPR gRNA sequence
aaaaaacaaaaaagttagtc

SEQ ID NO: 237034 - DNA, 20 bp, Artificial
  CRISPR gRNA sequence
acaaaaaagttagtcaggtg

SEQ ID NO: 237035 - DNA, 20 bp, Artificial
  CRISPR gRNA sequence
aaaaagttagtcaggtgtgg

SEQ ID NO: 237036 - DNA, 20 bp, Artificial
  CRISPR gRNA sequence
ggtgtggtggcccttccttg

SEQ ID NO: 237037 - DNA, 20 bp, Artificial
  CRISPR gRNA sequence
gtggcccttccttgtagttc

SEQ ID NO: 237038 - DNA, 20 bp, Artificial
  CRISPR gRNA sequence
tccttgtagttccagctact

SEQ ID NO: 237039 - DNA, 20 bp, Artificial
  CRISPR gRNA sequence
ccttgtagttccagctactc

SEQ ID NO: 237040 - DNA, 20 bp, Artificial
  CRISPR gRNA sequence
ttgtagttccagctactcag

SEQ ID NO: 237041 - DNA, 20 bp, Artificial
  CRISPR gRNA sequence
ttccagctactcaggagact

SEQ ID NO: 237042 - DNA, 20 bp, Artificial
  CRISPR gRNA sequence
tccagctactcaggagactg

SEQ ID NO: 237043 - DNA, 20 bp, Artificial
  CRISPR gRNA sequence
agctactcaggagactgagg

SEQ ID NO: 237044 - DNA, 20 bp, Artificial
  CRISPR gRNA sequence
gctactcaggagactgaggc

SEQ ID NO: 237045 - DNA, 20 bp, Artificial
  CRISPR gRNA sequence
tactcaggagactgaggcag

SEQ ID NO: 237046 - DNA, 20 bp, Artificial
  CRISPR gRNA sequence
actcaggagactgaggcagg

SEQ ID NO: 237047 - DNA, 20 bp, Artificial
  CRISPR gRNA sequence
ctgaggcaggaggatcactt

SEQ ID NO: 237048 - DNA, 20 bp, Artificial
  CRISPR gRNA sequence
aggaggatcacttgagctcc

SEQ ID NO: 237049 - DNA, 20 bp, Artificial
  CRISPR gRNA sequence
gaggatcacttgagctccca

SEQ ID NO: 237050 - DNA, 20 bp, Artificial
  CRISPR gRNA sequence
aggatcacttgagctcccag

SEQ ID NO: 237051 - DNA, 20 bp, Artificial
  CRISPR gRNA sequence
cacttgagctcccagaggtc

SEQ ID NO: 237052 - DNA, 20 bp, Artificial
  CRISPR gRNA sequence
acttgagctcccagaggtca

SEQ ID NO: 237053 - DNA, 20 bp, Artificial
  CRISPR gRNA sequence
gctcccagaggtcaaggctg

SEQ ID NO: 237054 - DNA, 20 bp, Artificial
  CRISPR gRNA sequence
tcccagaggtcaaggctgca

SEQ ID NO: 237055 - DNA, 20 bp, Artificial
  CRISPR gRNA sequence
ccagaggtcaaggctgcaga

SEQ ID NO: 237056 - DNA, 20 bp, Artificial
  CRISPR gRNA sequence
gtcaaggctgcagagagcca

SEQ ID NO: 237057 - DNA, 20 bp, Artificial
  CRISPR gRNA sequence
aaggctgcagagagccatgg

SEQ ID NO: 237058 - DNA, 20 bp, Artificial
  CRISPR gRNA sequence
atggtggtgccactgcactc

SEQ ID NO: 237059 - DNA, 20 bp, Artificial
  CRISPR gRNA sequence
ggtgccactgcactccagcc

SEQ ID NO: 237060 - DNA, 20 bp, Artificial
  CRISPR gRNA sequence
gtgccactgcactccagcct

SEQ ID NO: 237061 - DNA, 20 bp, Artificial
  CRISPR gRNA sequence
ctgcactccagcctgggtga

SEQ ID NO: 237062 - DNA, 20 bp, Artificial
  CRISPR gRNA sequence
gcactccagcctgggtgaca

SEQ ID NO: 237063 - DNA, 20 bp, Artificial
  CRISPR gRNA sequence
tccagcctgggtgacagagt

SEQ ID NO: 237064 - DNA, 20 bp, Artificial
  CRISPR gRNA sequence
ccctgtcaaaaaaaaaaaaa

SEQ ID NO: 237065 - DNA, 20 bp, Artificial
  CRISPR gRNA sequence
tgtcaaaaaaaaaaaaaaag

SEQ ID NO: 237066 - DNA, 20 bp, Artificial
  CRISPR gRNA sequence
aaaaaagtggtgcattttta

SEQ ID NO: 237067 - DNA, 20 bp, Artificial
  CRISPR gRNA sequence
aaaaagtggtgcatttttaa

SEQ ID NO: 237068 - DNA, 20 bp, Artificial
  CRISPR gRNA sequence
atttttaaaggccaactcat

SEQ ID NO: 237069 - DNA, 20 bp, Artificial
  CRISPR gRNA sequence
aaggccaactcattggcatt

SEQ ID NO: 237070 - DNA, 20 bp, Artificial
  CRISPR gRNA sequence
caactcattggcatttagaa

SEQ ID NO: 237071 - DNA, 20 bp, Artificial
  CRISPR gRNA sequence
atttagaaaagaacgtgtgt

SEQ ID NO: 237072 - DNA, 20 bp, Artificial
  CRISPR gRNA sequence
tttagaaaagaacgtgtgtt

SEQ ID NO: 237073 - DNA, 20 bp, Artificial
  CRISPR gRNA sequence
ttagaaaagaacgtgtgttg

SEQ ID NO: 237074 - DNA, 20 bp, Artificial
  CRISPR gRNA sequence
tagaaaagaacgtgtgttgg

SEQ ID NO: 237075 - DNA, 20 bp, Artificial
  CRISPR gRNA sequence
aacgtgtgttgggggaatcc

SEQ ID NO: 237076 - DNA, 20 bp, Artificial
  CRISPR gRNA sequence
acgtgtgttgggggaatcct

SEQ ID NO: 237077 - DNA, 20 bp, Artificial
  CRISPR gRNA sequence
ggggaatcctgggtattatg

SEQ ID NO: 237078 - DNA, 20 bp, Artificial
  CRISPR gRNA sequence
gggaatcctgggtattatgt

SEQ ID NO: 237079 - DNA, 20 bp, Artificial
  CRISPR gRNA sequence
atcctgggtattatgtagga

SEQ ID NO: 237080 - DNA, 20 bp, Artificial
  CRISPR gRNA sequence
gatggtgttcttgcttttga

SEQ ID NO: 237081 - DNA, 20 bp, Artificial
  CRISPR gRNA sequence
cttgcttttgaaagctgtga

SEQ ID NO: 237082 - DNA, 20 bp, Artificial
  CRISPR gRNA sequence
gcttttgaaagctgtgatag

SEQ ID NO: 237083 - DNA, 20 bp, Artificial
  CRISPR gRNA sequence
atatttccttgcttcttttc

SEQ ID NO: 237084 - DNA, 20 bp, Artificial
  CRISPR gRNA sequence
ttccttgcttcttttcaaga

SEQ ID NO: 237085 - DNA, 20 bp, Artificial
  CRISPR gRNA sequence
tcttttcaagaaagtcccaa

SEQ ID NO: 237086 - DNA, 20 bp, Artificial
  CRISPR gRNA sequence
ccctattgacttccatttca

SEQ ID NO: 237087 - DNA, 20 bp, Artificial
  CRISPR gRNA sequence
catcctccttcttcttcttc

SEQ ID NO: 237088 - DNA, 20 bp, Artificial
  CRISPR gRNA sequence
cttcttcttcttctggaaat

SEQ ID NO: 237089 - DNA, 20 bp, Artificial
  CRISPR gRNA sequence
cttcttcttctggaaatcgg

SEQ ID NO: 237090 - DNA, 20 bp, Artificial
  CRISPR gRNA sequence
cttctggaaatcggcagcta

SEQ ID NO: 237091 - DNA, 20 bp, Artificial
  CRISPR gRNA sequence
gctacagccatcttcctctt

SEQ ID NO: 237092 - DNA, 20 bp, Artificial
  CRISPR gRNA sequence
acagccatcttcctcttgag

SEQ ID NO: 237093 - DNA, 20 bp, Artificial
  CRISPR gRNA sequence
tcctcttgagtagtttgtac

SEQ ID NO: 237094 - DNA, 20 bp, Artificial
  CRISPR gRNA sequence
aatgctaaaaaaaaaatttt

SEQ ID NO: 237095 - DNA, 20 bp, Artificial
  CRISPR gRNA sequence
cacttattttccataaatta

SEQ ID NO: 237096 - DNA, 20 bp, Artificial
  CRISPR gRNA sequence
ttttccataaattatagctg

SEQ ID NO: 237097 - DNA, 20 bp, Artificial
  CRISPR gRNA sequence
tatagctgcagaacatctct

SEQ ID NO: 237098 - DNA, 20 bp, Artificial
  CRISPR gRNA sequence
agctgcagaacatctctaag

SEQ ID NO: 237099 - DNA, 20 bp, Artificial
  CRISPR gRNA sequence
ccctttaattttaacaaact

SEQ ID NO: 237100 - DNA, 20 bp, Artificial
  CRISPR gRNA sequence
ttaattttaacaaactcagc

SEQ ID NO: 237101 - DNA, 20 bp, Artificial
  CRISPR gRNA sequence
taattttaacaaactcagcc

SEQ ID NO: 237102 - DNA, 20 bp, Artificial
  CRISPR gRNA sequence
ttaacaaactcagccaggcg

SEQ ID NO: 237103 - DNA, 20 bp, Artificial
  CRISPR gRNA sequence
acaaactcagccaggcgtgg

SEQ ID NO: 237104 - DNA, 20 bp, Artificial
  CRISPR gRNA sequence
gtggctcatgcctgtaaccc

SEQ ID NO: 237105 - DNA, 20 bp, Artificial
  CRISPR gRNA sequence
tgcctgtaaccccagcactt

SEQ ID NO: 237106 - DNA, 20 bp, Artificial
  CRISPR gRNA sequence
ctgtaaccccagcactttgg

SEQ ID NO: 237107 - DNA, 20 bp, Artificial
  CRISPR gRNA sequence
tgtaaccccagcactttgga

SEQ ID NO: 237108 - DNA, 20 bp, Artificial
  CRISPR gRNA sequence
ccccagcactttggaaggcc

SEQ ID NO: 237109 - DNA, 20 bp, Artificial
  CRISPR gRNA sequence
cccagcactttggaaggccg

SEQ ID NO: 237110 - DNA, 20 bp, Artificial
  CRISPR gRNA sequence
agcactttggaaggccgagg

SEQ ID NO: 237111 - DNA, 20 bp, Artificial
  CRISPR gRNA sequence
gcactttggaaggccgaggt

SEQ ID NO: 237112 - DNA, 20 bp, Artificial
  CRISPR gRNA sequence
ctttggaaggccgaggtggg

SEQ ID NO: 237113 - DNA, 20 bp, Artificial
  CRISPR gRNA sequence
ccgaggtgggcagatcactt

SEQ ID NO: 237114 - DNA, 20 bp, Artificial
  CRISPR gRNA sequence
cgaggtgggcagatcacttg

SEQ ID NO: 237115 - DNA, 20 bp, Artificial
  CRISPR gRNA sequence
gtgggcagatcacttgaggt

SEQ ID NO: 237116 - DNA, 20 bp, Artificial
  CRISPR gRNA sequence
tgggcagatcacttgaggtc

SEQ ID NO: 237117 - DNA, 20 bp, Artificial
  CRISPR gRNA sequence
ggcagatcacttgaggtcag

SEQ ID NO: 237118 - DNA, 20 bp, Artificial
  CRISPR gRNA sequence
tcacttgaggtcaggagttc

SEQ ID NO: 237119 - DNA, 20 bp, Artificial
  CRISPR gRNA sequence
tgaggtcaggagttcaagac

SEQ ID NO: 237120 - DNA, 20 bp, Artificial
  CRISPR gRNA sequence
tcaggagttcaagaccagcg

SEQ ID NO: 237121 - DNA, 20 bp, Artificial
  CRISPR gRNA sequence
caagaccagcgtggccaaca

SEQ ID NO: 237122 - DNA, 20 bp, Artificial
  CRISPR gRNA sequence
cctactaaaaatacaaaaat

SEQ ID NO: 237123 - DNA, 20 bp, Artificial
  CRISPR gRNA sequence
ctaaaaatacaaaaattagc

SEQ ID NO: 237124 - DNA, 20 bp, Artificial
  CRISPR gRNA sequence
taaaaatacaaaaattagcc

SEQ ID NO: 237125 - DNA, 20 bp, Artificial
  CRISPR gRNA sequence
atacaaaaattagccgggcg

SEQ ID NO: 237126 - DNA, 20 bp, Artificial
  CRISPR gRNA sequence
caaaaattagccgggcgtgg

SEQ ID NO: 237127 - DNA, 20 bp, Artificial
  CRISPR gRNA sequence
aaattagccgggcgtggtgg

SEQ ID NO: 237128 - DNA, 20 bp, Artificial
  CRISPR gRNA sequence
aattagccgggcgtggtggc

SEQ ID NO: 237129 - DNA, 20 bp, Artificial
  CRISPR gRNA sequence
gtggcaggtgcctgtaatcc

SEQ ID NO: 237130 - DNA, 20 bp, Artificial
  CRISPR gRNA sequence
tgcctgtaatcccagctact

SEQ ID NO: 237131 - DNA, 20 bp, Artificial
  CRISPR gRNA sequence
gcctgtaatcccagctactc

SEQ ID NO: 237132 - DNA, 20 bp, Artificial
  CRISPR gRNA sequence
ctgtaatcccagctactcag

SEQ ID NO: 237133 - DNA, 20 bp, Artificial
  CRISPR gRNA sequence
tgtaatcccagctactcagg

SEQ ID NO: 237134 - DNA, 20 bp, Artificial
  CRISPR gRNA sequence
tcccagctactcaggaggct

SEQ ID NO: 237135 - DNA, 20 bp, Artificial
  CRISPR gRNA sequence
cccagctactcaggaggctg

SEQ ID NO: 237136 - DNA, 20 bp, Artificial
  CRISPR gRNA sequence
agctactcaggaggctgagg

SEQ ID NO: 237137 - DNA, 20 bp, Artificial
  CRISPR gRNA sequence
gctactcaggaggctgaggc

SEQ ID NO: 237138 - DNA, 20 bp, Artificial
  CRISPR gRNA sequence
gcaggacaattgcttgaacc

SEQ ID NO: 237139 - DNA, 20 bp, Artificial
  CRISPR gRNA sequence
caggacaattgcttgaaccc

SEQ ID NO: 237140 - DNA, 20 bp, Artificial
  CRISPR gRNA sequence
ggacaattgcttgaacccag

SEQ ID NO: 237141 - DNA, 20 bp, Artificial
  CRISPR gRNA sequence
aattgcttgaacccaggaga

SEQ ID NO: 237142 - DNA, 20 bp, Artificial
  CRISPR gRNA sequence
ttgcttgaacccaggagaca

SEQ ID NO: 237143 - DNA, 20 bp, Artificial
  CRISPR gRNA sequence
aacccaggagacagagattg

SEQ ID NO: 237144 - DNA, 20 bp, Artificial
  CRISPR gRNA sequence
gacagagattgcagtgactt

SEQ ID NO: 237145 - DNA, 20 bp, Artificial
  CRISPR gRNA sequence
gagattgcagtgacttgaga

SEQ ID NO: 237146 - DNA, 20 bp, Artificial
  CRISPR gRNA sequence
gagatggcgccattgcactc

SEQ ID NO: 237147 - DNA, 20 bp, Artificial
  CRISPR gRNA sequence
ggcgccattgcactccagcc

SEQ ID NO: 237148 - DNA, 20 bp, Artificial
  CRISPR gRNA sequence
gcgccattgcactccagcct

SEQ ID NO: 237149 - DNA, 20 bp, Artificial
  CRISPR gRNA sequence
cactccagcctgggtgacaa

SEQ ID NO: 237150 - DNA, 20 bp, Artificial
  CRISPR gRNA sequence
aaaacaaaacaaaacaaaaa

SEQ ID NO: 237151 - DNA, 20 bp, Artificial
  CRISPR gRNA sequence
aaacaaaacaaaacaaaaac

SEQ ID NO: 237152 - DNA, 20 bp, Artificial
  CRISPR gRNA sequence
aaaacaaaacaaaaacaggc

SEQ ID NO: 237153 - DNA, 20 bp, Artificial
  CRISPR gRNA sequence
aaacaaaacaaaaacaggcc

SEQ ID NO: 237154 - DNA, 20 bp, Artificial
  CRISPR gRNA sequence
aaacaaaaacaggccgggcg

SEQ ID NO: 237155 - DNA, 20 bp, Artificial
  CRISPR gRNA sequence
caaaaacaggccgggcgcag

SEQ ID NO: 237156 - DNA, 20 bp, Artificial
  CRISPR gRNA sequence
gtggctcatgcctgtaatcc

SEQ ID NO: 237157 - DNA, 20 bp, Artificial
  CRISPR gRNA sequence
tgcctgtaatcccagcactt

SEQ ID NO: 237158 - DNA, 20 bp, Artificial
  CRISPR gRNA sequence
gcctgtaatcccagcacttt

SEQ ID NO: 237159 - DNA, 20 bp, Artificial
  CRISPR gRNA sequence
ctgtaatcccagcactttgg

SEQ ID NO: 237160 - DNA, 20 bp, Artificial
  CRISPR gRNA sequence
tgtaatcccagcactttggg

SEQ ID NO: 237161 - DNA, 20 bp, Artificial
  CRISPR gRNA sequence
tcccagcactttgggaggct

SEQ ID NO: 237162 - DNA, 20 bp, Artificial
  CRISPR gRNA sequence
cccagcactttgggaggctg

SEQ ID NO: 237163 - DNA, 20 bp, Artificial
  CRISPR gRNA sequence
gcactttgggaggctgaggc

SEQ ID NO: 237164 - DNA, 20 bp, Artificial
  CRISPR gRNA sequence
ctttgggaggctgaggccgg

SEQ ID NO: 237165 - DNA, 20 bp, Artificial
  CRISPR gRNA sequence
ggctgaggccggtggatcac

SEQ ID NO: 237166 - DNA, 20 bp, Artificial
  CRISPR gRNA sequence
gctgaggccggtggatcaca

SEQ ID NO: 237167 - DNA, 20 bp, Artificial
  CRISPR gRNA sequence
aggccggtggatcacaaggt

SEQ ID NO: 237168 - DNA, 20 bp, Artificial
  CRISPR gRNA sequence
ggccggtggatcacaaggtc

SEQ ID NO: 237169 - DNA, 20 bp, Artificial
  CRISPR gRNA sequence
ccggtggatcacaaggtcag

SEQ ID NO: 237170 - DNA, 20 bp, Artificial
  CRISPR gRNA sequence
gatcacaaggtcaggagttc

SEQ ID NO: 237171 - DNA, 20 bp, Artificial
  CRISPR gRNA sequence
caaggtcaggagttcaagac

SEQ ID NO: 237172 - DNA, 20 bp, Artificial
  CRISPR gRNA sequence
tcaggagttcaagaccagcc

SEQ ID NO: 237173 - DNA, 20 bp, Artificial
  CRISPR gRNA sequence
agttcaagaccagcctggcc

SEQ ID NO: 237174 - DNA, 20 bp, Artificial
  CRISPR gRNA sequence
caagaccagcctggccaaga

SEQ ID NO: 237175 - DNA, 20 bp, Artificial
  CRISPR gRNA sequence
actaaaaataccaaaaaaat

SEQ ID NO: 237176 - DNA, 20 bp, Artificial
  CRISPR gRNA sequence
aaaataccaaaaaaattagc

SEQ ID NO: 237177 - DNA, 20 bp, Artificial
  CRISPR gRNA sequence
aaataccaaaaaaattagct

SEQ ID NO: 237178 - DNA, 20 bp, Artificial
  CRISPR gRNA sequence
ccaaaaaaattagctgggcg

SEQ ID NO: 237179 - DNA, 20 bp, Artificial
  CRISPR gRNA sequence
aaaaaattagctgggcgtgg

SEQ ID NO: 237180 - DNA, 20 bp, Artificial
  CRISPR gRNA sequence
aaattagctgggcgtggtgg

SEQ ID NO: 237181 - DNA, 20 bp, Artificial
  CRISPR gRNA sequence
aattagctgggcgtggtggt

SEQ ID NO: 237182 - DNA, 20 bp, Artificial
  CRISPR gRNA sequence
gtggtgggcgcctgtaatcc

SEQ ID NO: 237183 - DNA, 20 bp, Artificial
  CRISPR gRNA sequence
cgcctgtaatcccagctact

SEQ ID NO: 237184 - DNA, 20 bp, Artificial
  CRISPR gRNA sequence
gcctgtaatcccagctactc

SEQ ID NO: 237185 - DNA, 20 bp, Artificial
  CRISPR gRNA sequence
ctgtaatcccagctactcgg

SEQ ID NO: 237186 - DNA, 20 bp, Artificial
  CRISPR gRNA sequence
tgtaatcccagctactcggg

SEQ ID NO: 237187 - DNA, 20 bp, Artificial
  CRISPR gRNA sequence
tcccagctactcgggaggct

SEQ ID NO: 237188 - DNA, 20 bp, Artificial
  CRISPR gRNA sequence
cccagctactcgggaggctg

SEQ ID NO: 237189 - DNA, 20 bp, Artificial
  CRISPR gRNA sequence
agctactcgggaggctgagg

SEQ ID NO: 237190 - DNA, 20 bp, Artificial
  CRISPR gRNA sequence
ctactcgggaggctgaggca

SEQ ID NO: 237191 - DNA, 20 bp, Artificial
  CRISPR gRNA sequence
ggcagagaatcgcctgaacc

SEQ ID NO: 237192 - DNA, 20 bp, Artificial
  CRISPR gRNA sequence
gcagagaatcgcctgaacct

SEQ ID NO: 237193 - DNA, 20 bp, Artificial
  CRISPR gRNA sequence
agagaatcgcctgaacctgg

SEQ ID NO: 237194 - DNA, 20 bp, Artificial
  CRISPR gRNA sequence
gagaatcgcctgaacctggg

SEQ ID NO: 237195 - DNA, 20 bp, Artificial
  CRISPR gRNA sequence
aatcgcctgaacctgggagg

SEQ ID NO: 237196 - DNA, 20 bp, Artificial
  CRISPR gRNA sequence
tcgcctgaacctgggaggtg

SEQ ID NO: 237197 - DNA, 20 bp, Artificial
  CRISPR gRNA sequence
cgcctgaacctgggaggtgg

SEQ ID NO: 237198 - DNA, 20 bp, Artificial
  CRISPR gRNA sequence
aacctgggaggtggaggttg

SEQ ID NO: 237199 - DNA, 20 bp, Artificial
  CRISPR gRNA sequence
tgggaggtggaggttgcagt

SEQ ID NO: 237200 - DNA, 20 bp, Artificial
  CRISPR gRNA sequence
ggtggaggttgcagtgagct

SEQ ID NO: 237201 - DNA, 20 bp, Artificial
  CRISPR gRNA sequence
gagattgcgccactgcactc

SEQ ID NO: 237202 - DNA, 20 bp, Artificial
  CRISPR gRNA sequence
tgcgccactgcactccagcc

SEQ ID NO: 237203 - DNA, 20 bp, Artificial
  CRISPR gRNA sequence
gcgccactgcactccagcct

SEQ ID NO: 237204 - DNA, 20 bp, Artificial
  CRISPR gRNA sequence
ctgcactccagcctgggtga

SEQ ID NO: 237205 - DNA, 20 bp, Artificial
  CRISPR gRNA sequence
gcactccagcctgggtgaca

SEQ ID NO: 237206 - DNA, 20 bp, Artificial
  CRISPR gRNA sequence
tccagcctgggtgacagagt

SEQ ID NO: 237207 - DNA, 20 bp, Artificial
  CRISPR gRNA sequence
aaaaaaaattataataataa

SEQ ID NO: 237208 - DNA, 20 bp, Artificial
  CRISPR gRNA sequence
attttaacaaactcatccac

SEQ ID NO: 237209 - DNA, 20 bp, Artificial
  CRISPR gRNA sequence
tttaacaaactcatccacaa

SEQ ID NO: 237210 - DNA, 20 bp, Artificial
  CRISPR gRNA sequence
taacaaactcatccacaaga

SEQ ID NO: 237211 - DNA, 20 bp, Artificial
  CRISPR gRNA sequence
aacaaactcatccacaagag

SEQ ID NO: 237212 - DNA, 20 bp, Artificial
  CRISPR gRNA sequence
ctcatccacaagagaggtaa

SEQ ID NO: 237213 - DNA, 20 bp, Artificial
  CRISPR gRNA sequence
tccacaagagaggtaacagc

SEQ ID NO: 237214 - DNA, 20 bp, Artificial
  CRISPR gRNA sequence
ccacaagagaggtaacagca

SEQ ID NO: 237215 - DNA, 20 bp, Artificial
  CRISPR gRNA sequence
cagcaaggatgaacttcctc

SEQ ID NO: 237216 - DNA, 20 bp, Artificial
  CRISPR gRNA sequence
gcaaggatgaacttcctcta

SEQ ID NO: 237217 - DNA, 20 bp, Artificial
  CRISPR gRNA sequence
ctcttaccaaatatttgtat

SEQ ID NO: 237218 - DNA, 20 bp, Artificial
  CRISPR gRNA sequence
aaatatttgtattggtcttt

SEQ ID NO: 237219 - DNA, 20 bp, Artificial
  CRISPR gRNA sequence
attttctttattttctacat

SEQ ID NO: 237220 - DNA, 20 bp, Artificial
  CRISPR gRNA sequence
attttctacattagctaaaa

SEQ ID NO: 237221 - DNA, 20 bp, Artificial
  CRISPR gRNA sequence
gctaaaaaagcatgaatctt

SEQ ID NO: 237222 - DNA, 20 bp, Artificial
  CRISPR gRNA sequence
atcactaaaccataaaatat

SEQ ID NO: 237223 - DNA, 20 bp, Artificial
  CRISPR gRNA sequence
tattagccatatcccaatca

SEQ ID NO: 237224 - DNA, 20 bp, Artificial
  CRISPR gRNA sequence
ccatatcccaatcatagctc

SEQ ID NO: 237225 - DNA, 20 bp, Artificial
  CRISPR gRNA sequence
tcatagctctagtttcaatt

SEQ ID NO: 237226 - DNA, 20 bp, Artificial
  CRISPR gRNA sequence
tagctctagtttcaattcag

SEQ ID NO: 237227 - DNA, 20 bp, Artificial
  CRISPR gRNA sequence
gcagcacttattttcgtctt

SEQ ID NO: 237228 - DNA, 20 bp, Artificial
  CRISPR gRNA sequence
cagcacttattttcgtcttg

SEQ ID NO: 237229 - DNA, 20 bp, Artificial
  CRISPR gRNA sequence
agcacttattttcgtcttga

SEQ ID NO: 237230 - DNA, 20 bp, Artificial
  CRISPR gRNA sequence
ttttcgtcttgagggttact

SEQ ID NO: 237231 - DNA, 20 bp, Artificial
  CRISPR gRNA sequence
cttgagggttactgagattc

SEQ ID NO: 237232 - DNA, 20 bp, Artificial
  CRISPR gRNA sequence
tactgagattcgagatccga

SEQ ID NO: 237233 - DNA, 20 bp, Artificial
  CRISPR gRNA sequence
tcgagatccgatggtttcct

SEQ ID NO: 237234 - DNA, 20 bp, Artificial
  CRISPR gRNA sequence
ccgatggtttccttggaatg

SEQ ID NO: 237235 - DNA, 20 bp, Artificial
  CRISPR gRNA sequence
ggaatgcagtgttatgactc

SEQ ID NO: 237236 - DNA, 20 bp, Artificial
  CRISPR gRNA sequence
gaatgcagtgttatgactcc

SEQ ID NO: 237237 - DNA, 20 bp, Artificial
  CRISPR gRNA sequence
gttatgactccaggattgtg

SEQ ID NO: 237238 - DNA, 20 bp, Artificial
  CRISPR gRNA sequence
ttatgactccaggattgtga

SEQ ID NO: 237239 - DNA, 20 bp, Artificial
  CRISPR gRNA sequence
tccccactgcttccatctgt

SEQ ID NO: 237240 - DNA, 20 bp, Artificial
  CRISPR gRNA sequence
ccccactgcttccatctgtt

SEQ ID NO: 237241 - DNA, 20 bp, Artificial
  CRISPR gRNA sequence
gcttccatctgttaggaacc

SEQ ID NO: 237242 - DNA, 20 bp, Artificial
  CRISPR gRNA sequence
ccaagaaccgatctgtgcgt

SEQ ID NO: 237243 - DNA, 20 bp, Artificial
  CRISPR gRNA sequence
ccgatctgtgcgtgagctgc

SEQ ID NO: 237244 - DNA, 20 bp, Artificial
  CRISPR gRNA sequence
cgatctgtgcgtgagctgcc

SEQ ID NO: 237245 - DNA, 20 bp, Artificial
  CRISPR gRNA sequence
ccaggctttcttttacatgt

SEQ ID NO: 237246 - DNA, 20 bp, Artificial
  CRISPR gRNA sequence
ctttcttttacatgttagtg

SEQ ID NO: 237247 - DNA, 20 bp, Artificial
  CRISPR gRNA sequence
gctccgcaaatttcaatcct

SEQ ID NO: 237248 - DNA, 20 bp, Artificial
  CRISPR gRNA sequence
ccgcaaatttcaatcctaag

SEQ ID NO: 237249 - DNA, 20 bp, Artificial
  CRISPR gRNA sequence
cctaagcagatatttattta

SEQ ID NO: 237250 - DNA, 20 bp, Artificial
  CRISPR gRNA sequence
gcagatatttatttacagac

SEQ ID NO: 237251 - DNA, 20 bp, Artificial
  CRISPR gRNA sequence
atatttatttacagactggc

SEQ ID NO: 237252 - DNA, 20 bp, Artificial
  CRISPR gRNA sequence
tatttatttacagactggca

SEQ ID NO: 237253 - DNA, 20 bp, Artificial
  CRISPR gRNA sequence
ttacagactggcaaggcaaa

SEQ ID NO: 237254 - DNA, 20 bp, Artificial
  CRISPR gRNA sequence
aaaataaccacaccatctcc

SEQ ID NO: 237255 - DNA, 20 bp, Artificial
  CRISPR gRNA sequence
tcctagaacttatgaaaaac

SEQ ID NO: 237256 - DNA, 20 bp, Artificial
  CRISPR gRNA sequence
agaacttatgaaaaactggc

SEQ ID NO: 237257 - DNA, 20 bp, Artificial
  CRISPR gRNA sequence
tgaaaaactggcaagatgtt

SEQ ID NO: 237258 - DNA, 20 bp, Artificial
  CRISPR gRNA sequence
aagatgttcagaaataccaa

SEQ ID NO: 237259 - DNA, 20 bp, Artificial
  CRISPR gRNA sequence
agatgttcagaaataccaac

SEQ ID NO: 237260 - DNA, 20 bp, Artificial
  CRISPR gRNA sequence
atgtcttttgaaattgttcc

SEQ ID NO: 237261 - DNA, 20 bp, Artificial
  CRISPR gRNA sequence
tgtcttttgaaattgttccc

SEQ ID NO: 237262 - DNA, 20 bp, Artificial
  CRISPR gRNA sequence
tcccaggttgaatttcaaaa

SEQ ID NO: 237263 - DNA, 20 bp, Artificial
  CRISPR gRNA sequence
ccaggttgaatttcaaaatg

SEQ ID NO: 237264 - DNA, 20 bp, Artificial
  CRISPR gRNA sequence
ttcaaaatggagatctcttc

SEQ ID NO: 237265 - DNA, 20 bp, Artificial
  CRISPR gRNA sequence
aaatggagatctcttctgga

SEQ ID NO: 237266 - DNA, 20 bp, Artificial
  CRISPR gRNA sequence
agatctcttctggaaagatt

SEQ ID NO: 237267 - DNA, 20 bp, Artificial
  CRISPR gRNA sequence
ttttccgtatttgtcctgct

SEQ ID NO: 237268 - DNA, 20 bp, Artificial
  CRISPR gRNA sequence
gagtactgctgaaaacctct

SEQ ID NO: 237269 - DNA, 20 bp, Artificial
  CRISPR gRNA sequence
actgctgaaaacctctcaga

SEQ ID NO: 237270 - DNA, 20 bp, Artificial
  CRISPR gRNA sequence
ctgctgaaaacctctcagaa

SEQ ID NO: 237271 - DNA, 20 bp, Artificial
  CRISPR gRNA sequence
ctgaaaacctctcagaaagg

SEQ ID NO: 237272 - DNA, 20 bp, Artificial
  CRISPR gRNA sequence
gaaaacctctcagaaaggca

SEQ ID NO: 237273 - DNA, 20 bp, Artificial
  CRISPR gRNA sequence
aaacctctcagaaaggcaga

SEQ ID NO: 237274 - DNA, 20 bp, Artificial
  CRISPR gRNA sequence
acctctcagaaaggcagaga

SEQ ID NO: 237275 - DNA, 20 bp, Artificial
  CRISPR gRNA sequence
cctctcagaaaggcagagag

SEQ ID NO: 237276 - DNA, 20 bp, Artificial
  CRISPR gRNA sequence
ctcagaaaggcagagagagg

SEQ ID NO: 237277 - DNA, 20 bp, Artificial
  CRISPR gRNA sequence
tcagaaaggcagagagagga

SEQ ID NO: 237278 - DNA, 20 bp, Artificial
  CRISPR gRNA sequence
gcagagagaggaaggccaat

SEQ ID NO: 237279 - DNA, 20 bp, Artificial
  CRISPR gRNA sequence
cagagagaggaaggccaatt

SEQ ID NO: 237280 - DNA, 20 bp, Artificial
  CRISPR gRNA sequence
gagaggaaggccaattgggt

SEQ ID NO: 237281 - DNA, 20 bp, Artificial
  CRISPR gRNA sequence
agaggaaggccaattgggtc

SEQ ID NO: 237282 - DNA, 20 bp, Artificial
  CRISPR gRNA sequence
gccaattgggtcaggatctc

SEQ ID NO: 237283 - DNA, 20 bp, Artificial
  CRISPR gRNA sequence
gggtcaggatctccagaccc

SEQ ID NO: 237284 - DNA, 20 bp, Artificial
  CRISPR gRNA sequence
tccagacccaagaaacaaca

SEQ ID NO: 237285 - DNA, 20 bp, Artificial
  CRISPR gRNA sequence
cccaagaaacaacatggcaa

SEQ ID NO: 237286 - DNA, 20 bp, Artificial
  CRISPR gRNA sequence
ccaagaaacaacatggcaat

SEQ ID NO: 237287 - DNA, 20 bp, Artificial
  CRISPR gRNA sequence
ctgcctcatttccctctgac

SEQ ID NO: 237288 - DNA, 20 bp, Artificial
  CRISPR gRNA sequence
tgcctcatttccctctgact

SEQ ID NO: 237289 - DNA, 20 bp, Artificial
  CRISPR gRNA sequence
atttccctctgactgggaac

SEQ ID NO: 237290 - DNA, 20 bp, Artificial
  CRISPR gRNA sequence
ttccctctgactgggaacta

SEQ ID NO: 237291 - DNA, 20 bp, Artificial
  CRISPR gRNA sequence
cctctgactgggaactagag

SEQ ID NO: 237292 - DNA, 20 bp, Artificial
  CRISPR gRNA sequence
ctgactgggaactagagaag

SEQ ID NO: 237293 - DNA, 20 bp, Artificial
  CRISPR gRNA sequence
cagcactctaaaaatgccaa

SEQ ID NO: 237294 - DNA, 20 bp, Artificial
  CRISPR gRNA sequence
ctctaaaaatgccaatagcg

SEQ ID NO: 237295 - DNA, 20 bp, Artificial
  CRISPR gRNA sequence
ccaatagcgtggacaaaaca

SEQ ID NO: 237296 - DNA, 20 bp, Artificial
  CRISPR gRNA sequence
gacaaaacaaagcaaaaacc

SEQ ID NO: 237297 - DNA, 20 bp, Artificial
  CRISPR gRNA sequence
aaaacaaagcaaaaaccaag

SEQ ID NO: 237298 - DNA, 20 bp, Artificial
  CRISPR gRNA sequence
aacaaagcaaaaaccaagaa

SEQ ID NO: 237299 - DNA, 20 bp, Artificial
  CRISPR gRNA sequence
acaaagcaaaaaccaagaag

SEQ ID NO: 237300 - DNA, 20 bp, Artificial
  CRISPR gRNA sequence
agcaaaaaccaagaagaggc

SEQ ID NO: 237301 - DNA, 20 bp, Artificial
  CRISPR gRNA sequence
gcaaaaaccaagaagaggcc

SEQ ID NO: 237302 - DNA, 20 bp, Artificial
  CRISPR gRNA sequence
aaccaagaagaggccaggcg

SEQ ID NO: 237303 - DNA, 20 bp, Artificial
  CRISPR gRNA sequence
gtgactcacatctgtaatcc

SEQ ID NO: 237304 - DNA, 20 bp, Artificial
  CRISPR gRNA sequence
catctgtaatcccagcactt

SEQ ID NO: 237305 - DNA, 20 bp, Artificial
  CRISPR gRNA sequence
atctgtaatcccagcacttt

SEQ ID NO: 237306 - DNA, 20 bp, Artificial
  CRISPR gRNA sequence
tgtaatcccagcactttggg

SEQ ID NO: 237307 - DNA, 20 bp, Artificial
  CRISPR gRNA sequence
cccagcactttgggaagcca

SEQ ID NO: 237308 - DNA, 20 bp, Artificial
  CRISPR gRNA sequence
gcactttgggaagccaaagc

SEQ ID NO: 237309 - DNA, 20 bp, Artificial
  CRISPR gRNA sequence
ctttgggaagccaaagcaag

SEQ ID NO: 237310 - DNA, 20 bp, Artificial
  CRISPR gRNA sequence
ccaaagcaagcagatcatct

SEQ ID NO: 237311 - DNA, 20 bp, Artificial
  CRISPR gRNA sequence
caaagcaagcagatcatctg

SEQ ID NO: 237312 - DNA, 20 bp, Artificial
  CRISPR gRNA sequence
gcaagcagatcatctgaggt

SEQ ID NO: 237313 - DNA, 20 bp, Artificial
  CRISPR gRNA sequence
caagcagatcatctgaggtc

SEQ ID NO: 237314 - DNA, 20 bp, Artificial
  CRISPR gRNA sequence
tcatctgaggtcaggatttc

SEQ ID NO: 237315 - DNA, 20 bp, Artificial
  CRISPR gRNA sequence
tgaggtcaggatttcgagac

SEQ ID NO: 237316 - DNA, 20 bp, Artificial
  CRISPR gRNA sequence
tcaggatttcgagaccagcc

SEQ ID NO: 237317 - DNA, 20 bp, Artificial
  CRISPR gRNA sequence
cgagaccagcctggccaaca

SEQ ID NO: 237318 - DNA, 20 bp, Artificial
  CRISPR gRNA sequence
tctactaaaaacacaaaaat

SEQ ID NO: 237319 - DNA, 20 bp, Artificial
  CRISPR gRNA sequence
ctaaaaacacaaaaattagc

SEQ ID NO: 237320 - DNA, 20 bp, Artificial
  CRISPR gRNA sequence
taaaaacacaaaaattagct

SEQ ID NO: 237321 - DNA, 20 bp, Artificial
  CRISPR gRNA sequence
acacaaaaattagctgggca

SEQ ID NO: 237322 - DNA, 20 bp, Artificial
  CRISPR gRNA sequence
caaaaattagctgggcatgg

SEQ ID NO: 237323 - DNA, 20 bp, Artificial
  CRISPR gRNA sequence
gtggcgctcacctgtaatct

SEQ ID NO: 237324 - DNA, 20 bp, Artificial
  CRISPR gRNA sequence
cacctgtaatcttagctatt

SEQ ID NO: 237325 - DNA, 20 bp, Artificial
  CRISPR gRNA sequence
acctgtaatcttagctattc

SEQ ID NO: 237326 - DNA, 20 bp, Artificial
  CRISPR gRNA sequence
ctgtaatcttagctattcgg

SEQ ID NO: 237327 - DNA, 20 bp, Artificial
  CRISPR gRNA sequence
tcttagctattcgggagtct

SEQ ID NO: 237328 - DNA, 20 bp, Artificial
  CRISPR gRNA sequence
cttagctattcgggagtctg

SEQ ID NO: 237329 - DNA, 20 bp, Artificial
  CRISPR gRNA sequence
agctattcgggagtctgagg

SEQ ID NO: 237330 - DNA, 20 bp, Artificial
  CRISPR gRNA sequence
gctattcgggagtctgaggc

SEQ ID NO: 237331 - DNA, 20 bp, Artificial
  CRISPR gRNA sequence
gggagtctgaggcaggacaa

SEQ ID NO: 237332 - DNA, 20 bp, Artificial
  CRISPR gRNA sequence
gcaggacaatggcttaaacc

SEQ ID NO: 237333 - DNA, 20 bp, Artificial
  CRISPR gRNA sequence
caggacaatggcttaaaccc

SEQ ID NO: 237334 - DNA, 20 bp, Artificial
  CRISPR gRNA sequence
ggacaatggcttaaacccag

SEQ ID NO: 237335 - DNA, 20 bp, Artificial
  CRISPR gRNA sequence
gacaatggcttaaacccagg

SEQ ID NO: 237336 - DNA, 20 bp, Artificial
  CRISPR gRNA sequence
aatggcttaaacccaggagg

SEQ ID NO: 237337 - DNA, 20 bp, Artificial
  CRISPR gRNA sequence
tggcttaaacccaggaggca

SEQ ID NO: 237338 - DNA, 20 bp, Artificial
  CRISPR gRNA sequence
ggcttaaacccaggaggcag

SEQ ID NO: 237339 - DNA, 20 bp, Artificial
  CRISPR gRNA sequence
aacccaggaggcagaggttg

SEQ ID NO: 237340 - DNA, 20 bp, Artificial
  CRISPR gRNA sequence
cccaggaggcagaggttgca

SEQ ID NO: 237341 - DNA, 20 bp, Artificial
  CRISPR gRNA sequence
caggaggcagaggttgcaga

SEQ ID NO: 237342 - DNA, 20 bp, Artificial
  CRISPR gRNA sequence
ggcagaggttgcagagagct

SEQ ID NO: 237343 - DNA, 20 bp, Artificial
  CRISPR gRNA sequence
gagattacaccactgcactc

SEQ ID NO: 237344 - DNA, 20 bp, Artificial
  CRISPR gRNA sequence
tacaccactgcactccagcc

SEQ ID NO: 237345 - DNA, 20 bp, Artificial
  CRISPR gRNA sequence
acaccactgcactccagcct

SEQ ID NO: 237346 - DNA, 20 bp, Artificial
  CRISPR gRNA sequence
ctgcactccagcctgggcaa

SEQ ID NO: 237347 - DNA, 20 bp, Artificial
  CRISPR gRNA sequence
gcactccagcctgggcaaca

SEQ ID NO: 237348 - DNA, 20 bp, Artificial
  CRISPR gRNA sequence
tccagcctgggcaacagagc

SEQ ID NO: 237349 - DNA, 20 bp, Artificial
  CRISPR gRNA sequence
aaaaaaacacataaaaaact

SEQ ID NO: 237350 - DNA, 20 bp, Artificial
  CRISPR gRNA sequence
aaaaacacataaaaaactaa

SEQ ID NO: 237351 - DNA, 20 bp, Artificial
  CRISPR gRNA sequence
aaaacacataaaaaactaag

SEQ ID NO: 237352 - DNA, 20 bp, Artificial
  CRISPR gRNA sequence
aacacataaaaaactaagag

SEQ ID NO: 237353 - DNA, 20 bp, Artificial
  CRISPR gRNA sequence
taagaggagcttgtactctc

SEQ ID NO: 237354 - DNA, 20 bp, Artificial
  CRISPR gRNA sequence
agcttgtactctctagttat

SEQ ID NO: 237355 - DNA, 20 bp, Artificial
  CRISPR gRNA sequence
gtactctctagttatgagac

SEQ ID NO: 237356 - DNA, 20 bp, Artificial
  CRISPR gRNA sequence
tactctctagttatgagacc

SEQ ID NO: 237357 - DNA, 20 bp, Artificial
  CRISPR gRNA sequence
ctctagttatgagaccagga

SEQ ID NO: 237358 - DNA, 20 bp, Artificial
  CRISPR gRNA sequence
tctagttatgagaccaggaa

SEQ ID NO: 237359 - DNA, 20 bp, Artificial
  CRISPR gRNA sequence
ctagttatgagaccaggaaa

SEQ ID NO: 237360 - DNA, 20 bp, Artificial
  CRISPR gRNA sequence
tagttatgagaccaggaaag

SEQ ID NO: 237361 - DNA, 20 bp, Artificial
  CRISPR gRNA sequence
ttatgagaccaggaaagggg

SEQ ID NO: 237362 - DNA, 20 bp, Artificial
  CRISPR gRNA sequence
agaccaggaaaggggcagca

SEQ ID NO: 237363 - DNA, 20 bp, Artificial
  CRISPR gRNA sequence
caggaaaggggcagcatagc

SEQ ID NO: 237364 - DNA, 20 bp, Artificial
  CRISPR gRNA sequence
tttttttctttttttttttt

SEQ ID NO: 237365 - DNA, 20 bp, Artificial
  CRISPR gRNA sequence
tttcttttttttttttgaga

SEQ ID NO: 237366 - DNA, 20 bp, Artificial
  CRISPR gRNA sequence
tcttttttttttttgagatg

SEQ ID NO: 237367 - DNA, 20 bp, Artificial
  CRISPR gRNA sequence
tggagtctcactctgttgcc

SEQ ID NO: 237368 - DNA, 20 bp, Artificial
  CRISPR gRNA sequence
ggagtctcactctgttgccc

SEQ ID NO: 237369 - DNA, 20 bp, Artificial
  CRISPR gRNA sequence
tctcactctgttgcccaggc

SEQ ID NO: 237370 - DNA, 20 bp, Artificial
  CRISPR gRNA sequence
tcactctgttgcccaggctg

SEQ ID NO: 237371 - DNA, 20 bp, Artificial
  CRISPR gRNA sequence
ttgcccaggctggagtgcaa

SEQ ID NO: 237372 - DNA, 20 bp, Artificial
  CRISPR gRNA sequence
ggagtgcaatggcgtgatct

SEQ ID NO: 237373 - DNA, 20 bp, Artificial
  CRISPR gRNA sequence
tcactgcaacctccgcctct

SEQ ID NO: 237374 - DNA, 20 bp, Artificial
  CRISPR gRNA sequence
cactgcaacctccgcctctt

SEQ ID NO: 237375 - DNA, 20 bp, Artificial
  CRISPR gRNA sequence
aacctccgcctcttgggttc

SEQ ID NO: 237376 - DNA, 20 bp, Artificial
  CRISPR gRNA sequence
ctccgcctcttgggttcaag

SEQ ID NO: 237377 - DNA, 20 bp, Artificial
  CRISPR gRNA sequence
ttcaagcggttctcttgcct

SEQ ID NO: 237378 - DNA, 20 bp, Artificial
  CRISPR gRNA sequence
ttctcttgcctcagtctcct

SEQ ID NO: 237379 - DNA, 20 bp, Artificial
  CRISPR gRNA sequence
tcttgcctcagtctcctgag

SEQ ID NO: 237380 - DNA, 20 bp, Artificial
  CRISPR gRNA sequence
gcctcagtctcctgagtagc

SEQ ID NO: 237381 - DNA, 20 bp, Artificial
  CRISPR gRNA sequence
cctcagtctcctgagtagct

SEQ ID NO: 237382 - DNA, 20 bp, Artificial
  CRISPR gRNA sequence
ctcctgagtagctgggacta

SEQ ID NO: 237383 - DNA, 20 bp, Artificial
  CRISPR gRNA sequence
tcctgagtagctgggactac

SEQ ID NO: 237384 - DNA, 20 bp, Artificial
  CRISPR gRNA sequence
ggactacaggtgcccgccac

SEQ ID NO: 237385 - DNA, 20 bp, Artificial
  CRISPR gRNA sequence
gactacaggtgcccgccacc

SEQ ID NO: 237386 - DNA, 20 bp, Artificial
  CRISPR gRNA sequence
caggtgcccgccaccaggcc

SEQ ID NO: 237387 - DNA, 20 bp, Artificial
  CRISPR gRNA sequence
ccggctaatttttgtgtttt

SEQ ID NO: 237388 - DNA, 20 bp, Artificial
  CRISPR gRNA sequence
gctaatttttgtgtttttag

SEQ ID NO: 237389 - DNA, 20 bp, Artificial
  CRISPR gRNA sequence
taatttttgtgtttttagta

SEQ ID NO: 237390 - DNA, 20 bp, Artificial
  CRISPR gRNA sequence
ttttgtgtttttagtagaga

SEQ ID NO: 237391 - DNA, 20 bp, Artificial
  CRISPR gRNA sequence
tttgtgtttttagtagagat

SEQ ID NO: 237392 - DNA, 20 bp, Artificial
  CRISPR gRNA sequence
ttgtgtttttagtagagatg

SEQ ID NO: 237393 - DNA, 20 bp, Artificial
  CRISPR gRNA sequence
gagatggggtttcaccatat

SEQ ID NO: 237394 - DNA, 20 bp, Artificial
  CRISPR gRNA sequence
tggggtttcaccatattggc

SEQ ID NO: 237395 - DNA, 20 bp, Artificial
  CRISPR gRNA sequence
ggggtttcaccatattggcc

SEQ ID NO: 237396 - DNA, 20 bp, Artificial
  CRISPR gRNA sequence
tttcaccatattggccaggc

SEQ ID NO: 237397 - DNA, 20 bp, Artificial
  CRISPR gRNA sequence
gaccttatgatccgcccatc

SEQ ID NO: 237398 - DNA, 20 bp, Artificial
  CRISPR gRNA sequence
accttatgatccgcccatct

SEQ ID NO: 237399 - DNA, 20 bp, Artificial
  CRISPR gRNA sequence
ccgcccatctgggcctccca

SEQ ID NO: 237400 - DNA, 20 bp, Artificial
  CRISPR gRNA sequence
atctgggcctcccaaagtgc

SEQ ID NO: 237401 - DNA, 20 bp, Artificial
  CRISPR gRNA sequence
tctgggcctcccaaagtgct

SEQ ID NO: 237402 - DNA, 20 bp, Artificial
  CRISPR gRNA sequence
ctcccaaagtgctgggatta

SEQ ID NO: 237403 - DNA, 20 bp, Artificial
  CRISPR gRNA sequence
tcccaaagtgctgggattac

SEQ ID NO: 237404 - DNA, 20 bp, Artificial
  CRISPR gRNA sequence
agtgctgggattacaggcgt

SEQ ID NO: 237405 - DNA, 20 bp, Artificial
  CRISPR gRNA sequence
caggcgtgagccaccacacc

SEQ ID NO: 237406 - DNA, 20 bp, Artificial
  CRISPR gRNA sequence
acacctggtccaaaaacttc

SEQ ID NO: 237407 - DNA, 20 bp, Artificial
  CRISPR gRNA sequence
aaacaccacaaaaaacaccg

SEQ ID NO: 237408 - DNA, 20 bp, Artificial
  CRISPR gRNA sequence
aacaccgtggctccgcctgc

SEQ ID NO: 237409 - DNA, 20 bp, Artificial
  CRISPR gRNA sequence
ggctccgcctgcaagcccac

SEQ ID NO: 237410 - DNA, 20 bp, Artificial
  CRISPR gRNA sequence
gctccgcctgcaagcccacc

SEQ ID NO: 237411 - DNA, 20 bp, Artificial
  CRISPR gRNA sequence
ccgcctgcaagcccaccagg

SEQ ID NO: 237412 - DNA, 20 bp, Artificial
  CRISPR gRNA sequence
cgcctgcaagcccaccagga

SEQ ID NO: 237413 - DNA, 20 bp, Artificial
  CRISPR gRNA sequence
caagcccaccaggaaggact

SEQ ID NO: 237414 - DNA, 20 bp, Artificial
  CRISPR gRNA sequence
gcccaccaggaaggactgag

SEQ ID NO: 237415 - DNA, 20 bp, Artificial
  CRISPR gRNA sequence
ccaccaggaaggactgagta

SEQ ID NO: 237416 - DNA, 20 bp, Artificial
  CRISPR gRNA sequence
accaggaaggactgagtaga

SEQ ID NO: 237417 - DNA, 20 bp, Artificial
  CRISPR gRNA sequence
gaaggactgagtagagagcc

SEQ ID NO: 237418 - DNA, 20 bp, Artificial
  CRISPR gRNA sequence
agcctggacttccaccctca

SEQ ID NO: 237419 - DNA, 20 bp, Artificial
  CRISPR gRNA sequence
ttccaccctcacggctgatt

SEQ ID NO: 237420 - DNA, 20 bp, Artificial
  CRISPR gRNA sequence
tccaccctcacggctgatta

SEQ ID NO: 237421 - DNA, 20 bp, Artificial
  CRISPR gRNA sequence
gctcatctccccctccctcc

SEQ ID NO: 237422 - DNA, 20 bp, Artificial
  CRISPR gRNA sequence
ctcatctccccctccctcct

SEQ ID NO: 237423 - DNA, 20 bp, Artificial
  CRISPR gRNA sequence
tcatctccccctccctcctg

SEQ ID NO: 237424 - DNA, 20 bp, Artificial
  CRISPR gRNA sequence
tctccccctccctcctgggg

SEQ ID NO: 237425 - DNA, 20 bp, Artificial
  CRISPR gRNA sequence
cctccctcctggggtagtgt

SEQ ID NO: 237426 - DNA, 20 bp, Artificial
  CRISPR gRNA sequence
tccctcctggggtagtgtca

SEQ ID NO: 237427 - DNA, 20 bp, Artificial
  CRISPR gRNA sequence
ccctcctggggtagtgtcag

SEQ ID NO: 237428 - DNA, 20 bp, Artificial
  CRISPR gRNA sequence
ctcctggggtagtgtcagag

SEQ ID NO: 237429 - DNA, 20 bp, Artificial
  CRISPR gRNA sequence
tcctggggtagtgtcagagg

SEQ ID NO: 237430 - DNA, 20 bp, Artificial
  CRISPR gRNA sequence
gggtagtgtcagaggaggcc

SEQ ID NO: 237431 - DNA, 20 bp, Artificial
  CRISPR gRNA sequence
tagtgtcagaggaggcctag

SEQ ID NO: 237432 - DNA, 20 bp, Artificial
  CRISPR gRNA sequence
agtgtcagaggaggcctagt

SEQ ID NO: 237433 - DNA, 20 bp, Artificial
  CRISPR gRNA sequence
tgtcagaggaggcctagtgg

SEQ ID NO: 237434 - DNA, 20 bp, Artificial
  CRISPR gRNA sequence
agaggaggcctagtgggagc

SEQ ID NO: 237435 - DNA, 20 bp, Artificial
  CRISPR gRNA sequence
agctagaactcccacgtgtc

SEQ ID NO: 237436 - DNA, 20 bp, Artificial
  CRISPR gRNA sequence
tagaactcccacgtgtctag

SEQ ID NO: 237437 - DNA, 20 bp, Artificial
  CRISPR gRNA sequence
cccacgtgtctagcagtaaa

SEQ ID NO: 237438 - DNA, 20 bp, Artificial
  CRISPR gRNA sequence
ccacgtgtctagcagtaaaa

SEQ ID NO: 237439 - DNA, 20 bp, Artificial
  CRISPR gRNA sequence
acgtgtctagcagtaaaaag

SEQ ID NO: 237440 - DNA, 20 bp, Artificial
  CRISPR gRNA sequence
aaaaggagaccctcaccctc

SEQ ID NO: 237441 - DNA, 20 bp, Artificial
  CRISPR gRNA sequence
aaaggagaccctcaccctcc

SEQ ID NO: 237442 - DNA, 20 bp, Artificial
  CRISPR gRNA sequence
aggagaccctcaccctccag

SEQ ID NO: 237443 - DNA, 20 bp, Artificial
  CRISPR gRNA sequence
ggagaccctcaccctccagg

SEQ ID NO: 237444 - DNA, 20 bp, Artificial
  CRISPR gRNA sequence
ccctcaccctccaggaggta

SEQ ID NO: 237445 - DNA, 20 bp, Artificial
  CRISPR gRNA sequence
accctccaggaggtatagca

SEQ ID NO: 237446 - DNA, 20 bp, Artificial
  CRISPR gRNA sequence
aaacttcctccacccctgcc

SEQ ID NO: 237447 - DNA, 20 bp, Artificial
  CRISPR gRNA sequence
cacccctgcctggccgtaac

SEQ ID NO: 237448 - DNA, 20 bp, Artificial
  CRISPR gRNA sequence
gcccatcctccttccttccc

SEQ ID NO: 237449 - DNA, 20 bp, Artificial
  CRISPR gRNA sequence
ccatcctccttccttcccta

SEQ ID NO: 237450 - DNA, 20 bp, Artificial
  CRISPR gRNA sequence
ttccttccctagagtgatgt

SEQ ID NO: 237451 - DNA, 20 bp, Artificial
  CRISPR gRNA sequence
ccttccctagagtgatgtca

SEQ ID NO: 237452 - DNA, 20 bp, Artificial
  CRISPR gRNA sequence
cttccctagagtgatgtcag

SEQ ID NO: 237453 - DNA, 20 bp, Artificial
  CRISPR gRNA sequence
agtgatgtcagaggaaccct

SEQ ID NO: 237454 - DNA, 20 bp, Artificial
  CRISPR gRNA sequence
gaggaaccctgagaaaatac

SEQ ID NO: 237455 - DNA, 20 bp, Artificial
  CRISPR gRNA sequence
agaaaatacaagatctaaat

SEQ ID NO: 237456 - DNA, 20 bp, Artificial
  CRISPR gRNA sequence
tacaagatctaaattagatc

SEQ ID NO: 237457 - DNA, 20 bp, Artificial
  CRISPR gRNA sequence
tctaaattagatccagaaac

SEQ ID NO: 237458 - DNA, 20 bp, Artificial
  CRISPR gRNA sequence
ctaaattagatccagaaact

SEQ ID NO: 237459 - DNA, 20 bp, Artificial
  CRISPR gRNA sequence
ttagatccagaaactgggtg

SEQ ID NO: 237460 - DNA, 20 bp, Artificial
  CRISPR gRNA sequence
tagatccagaaactgggtgt

SEQ ID NO: 237461 - DNA, 20 bp, Artificial
  CRISPR gRNA sequence
agatccagaaactgggtgtg

SEQ ID NO: 237462 - DNA, 20 bp, Artificial
  CRISPR gRNA sequence
gatccagaaactgggtgtgg

SEQ ID NO: 237463 - DNA, 20 bp, Artificial
  CRISPR gRNA sequence
cgcctgtaatcccaatacta

SEQ ID NO: 237464 - DNA, 20 bp, Artificial
  CRISPR gRNA sequence
gcctgtaatcccaatactat

SEQ ID NO: 237465 - DNA, 20 bp, Artificial
  CRISPR gRNA sequence
cctgtaatcccaatactatg

SEQ ID NO: 237466 - DNA, 20 bp, Artificial
  CRISPR gRNA sequence
ctgtaatcccaatactatgg

SEQ ID NO: 237467 - DNA, 20 bp, Artificial
  CRISPR gRNA sequence
atcccaatactatgggggcc

SEQ ID NO: 237468 - DNA, 20 bp, Artificial
  CRISPR gRNA sequence
tcccaatactatgggggcca

SEQ ID NO: 237469 - DNA, 20 bp, Artificial
  CRISPR gRNA sequence
caatactatgggggccaagg

SEQ ID NO: 237470 - DNA, 20 bp, Artificial
  CRISPR gRNA sequence
aatactatgggggccaaggc

SEQ ID NO: 237471 - DNA, 20 bp, Artificial
  CRISPR gRNA sequence
tactatgggggccaaggcag

SEQ ID NO: 237472 - DNA, 20 bp, Artificial
  CRISPR gRNA sequence
actatgggggccaaggcagg

SEQ ID NO: 237473 - DNA, 20 bp, Artificial
  CRISPR gRNA sequence
ccaaggcaggaggatcgctt

SEQ ID NO: 237474 - DNA, 20 bp, Artificial
  CRISPR gRNA sequence
gcaggaggatcgcttgagtc

SEQ ID NO: 237475 - DNA, 20 bp, Artificial
  CRISPR gRNA sequence
caggaggatcgcttgagtcc

SEQ ID NO: 237476 - DNA, 20 bp, Artificial
  CRISPR gRNA sequence
ggaggatcgcttgagtccag

SEQ ID NO: 237477 - DNA, 20 bp, Artificial
  CRISPR gRNA sequence
tcgcttgagtccaggagttc

SEQ ID NO: 237478 - DNA, 20 bp, Artificial
  CRISPR gRNA sequence
tgagtccaggagttctagac

SEQ ID NO: 237479 - DNA, 20 bp, Artificial
  CRISPR gRNA sequence
ccaggagttctagaccagct

SEQ ID NO: 237480 - DNA, 20 bp, Artificial
  CRISPR gRNA sequence
caggagttctagaccagctt

SEQ ID NO: 237481 - DNA, 20 bp, Artificial
  CRISPR gRNA sequence
ttctagaccagcttgggtaa

SEQ ID NO: 237482 - DNA, 20 bp, Artificial
  CRISPR gRNA sequence
ctagaccagcttgggtaaca

SEQ ID NO: 237483 - DNA, 20 bp, Artificial
  CRISPR gRNA sequence
accagcttgggtaacagagc

SEQ ID NO: 237484 - DNA, 20 bp, Artificial
  CRISPR gRNA sequence
tctacaaaacatttaaaaat

SEQ ID NO: 237485 - DNA, 20 bp, Artificial
  CRISPR gRNA sequence
caaaacatttaaaaattagc

SEQ ID NO: 237486 - DNA, 20 bp, Artificial
  CRISPR gRNA sequence
aaaacatttaaaaattagcc

SEQ ID NO: 237487 - DNA, 20 bp, Artificial
  CRISPR gRNA sequence
aaacatttaaaaattagcca

SEQ ID NO: 237488 - DNA, 20 bp, Artificial
  CRISPR gRNA sequence
aacatttaaaaattagccag

SEQ ID NO: 237489 - DNA, 20 bp, Artificial
  CRISPR gRNA sequence
atttaaaaattagccagggg

SEQ ID NO: 237490 - DNA, 20 bp, Artificial
  CRISPR gRNA sequence
taaaaattagccaggggtgg

SEQ ID NO: 237491 - DNA, 20 bp, Artificial
  CRISPR gRNA sequence
ggggtggtggcacatgactg

SEQ ID NO: 237492 - DNA, 20 bp, Artificial
  CRISPR gRNA sequence
gtggcacatgactgtagtct

SEQ ID NO: 237493 - DNA, 20 bp, Artificial
  CRISPR gRNA sequence
gactgtagtctcagctactc

SEQ ID NO: 237494 - DNA, 20 bp, Artificial
  CRISPR gRNA sequence
ctgtagtctcagctactctg

SEQ ID NO: 237495 - DNA, 20 bp, Artificial
  CRISPR gRNA sequence
tgtagtctcagctactctgg

SEQ ID NO: 237496 - DNA, 20 bp, Artificial
  CRISPR gRNA sequence
tctcagctactctggaggct

SEQ ID NO: 237497 - DNA, 20 bp, Artificial
  CRISPR gRNA sequence
ctcagctactctggaggctg

SEQ ID NO: 237498 - DNA, 20 bp, Artificial
  CRISPR gRNA sequence
agctactctggaggctgagg

SEQ ID NO: 237499 - DNA, 20 bp, Artificial
  CRISPR gRNA sequence
gctactctggaggctgaggt

SEQ ID NO: 237500 - DNA, 20 bp, Artificial
  CRISPR gRNA sequence
tactctggaggctgaggtgg

SEQ ID NO: 237501 - DNA, 20 bp, Artificial
  CRISPR gRNA sequence
actctggaggctgaggtggg

SEQ ID NO: 237502 - DNA, 20 bp, Artificial
  CRISPR gRNA sequence
ctgaggtgggaggatcactt

SEQ ID NO: 237503 - DNA, 20 bp, Artificial
  CRISPR gRNA sequence
gtgggaggatcacttgagcc

SEQ ID NO: 237504 - DNA, 20 bp, Artificial
  CRISPR gRNA sequence
tgggaggatcacttgagccc

SEQ ID NO: 237505 - DNA, 20 bp, Artificial
  CRISPR gRNA sequence
gaggatcacttgagcccagg

SEQ ID NO: 237506 - DNA, 20 bp, Artificial
  CRISPR gRNA sequence
tcacttgagcccaggaagtt

SEQ ID NO: 237507 - DNA, 20 bp, Artificial
  CRISPR gRNA sequence
cacttgagcccaggaagttg

SEQ ID NO: 237508 - DNA, 20 bp, Artificial
  CRISPR gRNA sequence
caggaagttgaggctgcatt

SEQ ID NO: 237509 - DNA, 20 bp, Artificial
  CRISPR gRNA sequence
aggaagttgaggctgcattg

SEQ ID NO: 237510 - DNA, 20 bp, Artificial
  CRISPR gRNA sequence
catgccactgcactcccgcc

SEQ ID NO: 237511 - DNA, 20 bp, Artificial
  CRISPR gRNA sequence
atgccactgcactcccgcct

SEQ ID NO: 237512 - DNA, 20 bp, Artificial
  CRISPR gRNA sequence
ctgcactcccgcctgggtaa

SEQ ID NO: 237513 - DNA, 20 bp, Artificial
  CRISPR gRNA sequence
gcactcccgcctgggtaata

SEQ ID NO: 237514 - DNA, 20 bp, Artificial
  CRISPR gRNA sequence
tcccgcctgggtaatagagc

SEQ ID NO: 237515 - DNA, 20 bp, Artificial
  CRISPR gRNA sequence
gcctgggtaatagagcaagc

SEQ ID NO: 237516 - DNA, 20 bp, Artificial
  CRISPR gRNA sequence
taaaaaattttttttttact

SEQ ID NO: 237517 - DNA, 20 bp, Artificial
  CRISPR gRNA sequence
aaaaaattttttttttactt

SEQ ID NO: 237518 - DNA, 20 bp, Artificial
  CRISPR gRNA sequence
taaatctaacaaaacacata

SEQ ID NO: 237519 - DNA, 20 bp, Artificial
  CRISPR gRNA sequence
aaacacatacagaacttgta

SEQ ID NO: 237520 - DNA, 20 bp, Artificial
  CRISPR gRNA sequence
tagtgaaaactacaaaatgc

SEQ ID NO: 237521 - DNA, 20 bp, Artificial
  CRISPR gRNA sequence
aattttaaaatgtataaatg

SEQ ID NO: 237522 - DNA, 20 bp, Artificial
  CRISPR gRNA sequence
ttttaaaatgtataaatgaa

SEQ ID NO: 237523 - DNA, 20 bp, Artificial
  CRISPR gRNA sequence
gacatactatgttcctgcat

SEQ ID NO: 237524 - DNA, 20 bp, Artificial
  CRISPR gRNA sequence
tatgttcctgcattagaata

SEQ ID NO: 237525 - DNA, 20 bp, Artificial
  CRISPR gRNA sequence
tgcattagaatacagtcata

SEQ ID NO: 237526 - DNA, 20 bp, Artificial
  CRISPR gRNA sequence
tacagcgtacaacaacgttt

SEQ ID NO: 237527 - DNA, 20 bp, Artificial
  CRISPR gRNA sequence
aacaacgttttggtcaaaaa

SEQ ID NO: 237528 - DNA, 20 bp, Artificial
  CRISPR gRNA sequence
acagactgcatatatgatcg

SEQ ID NO: 237529 - DNA, 20 bp, Artificial
  CRISPR gRNA sequence
atatatgatcgtggtcccat

SEQ ID NO: 237530 - DNA, 20 bp, Artificial
  CRISPR gRNA sequence
atcgtggtcccataagatta

SEQ ID NO: 237531 - DNA, 20 bp, Artificial
  CRISPR gRNA sequence
gtggtcccataagattatag

SEQ ID NO: 237532 - DNA, 20 bp, Artificial
  CRISPR gRNA sequence
ggtcccataagattatagtg

SEQ ID NO: 237533 - DNA, 20 bp, Artificial
  CRISPR gRNA sequence
aagattatagtggagctgaa

SEQ ID NO: 237534 - DNA, 20 bp, Artificial
  CRISPR gRNA sequence
gtccaaccatcataacattg

SEQ ID NO: 237535 - DNA, 20 bp, Artificial
  CRISPR gRNA sequence
accatcataacattgcagca

SEQ ID NO: 237536 - DNA, 20 bp, Artificial
  CRISPR gRNA sequence
cagctcattgctcacgtttg

SEQ ID NO: 237537 - DNA, 20 bp, Artificial
  CRISPR gRNA sequence
actgatgtaaaaaacctact

SEQ ID NO: 237538 - DNA, 20 bp, Artificial
  CRISPR gRNA sequence
taaaaaacctactgagctgc

SEQ ID NO: 237539 - DNA, 20 bp, Artificial
  CRISPR gRNA sequence
actgagctgccagttgtgta

SEQ ID NO: 237540 - DNA, 20 bp, Artificial
  CRISPR gRNA sequence
gctgccagttgtgtaaagtg

SEQ ID NO: 237541 - DNA, 20 bp, Artificial
  CRISPR gRNA sequence
gtagcatatgcaattatgta

SEQ ID NO: 237542 - DNA, 20 bp, Artificial
  CRISPR gRNA sequence
atgacaataaatgactatgt

SEQ ID NO: 237543 - DNA, 20 bp, Artificial
  CRISPR gRNA sequence
acaataaatgactatgttag

SEQ ID NO: 237544 - DNA, 20 bp, Artificial
  CRISPR gRNA sequence
atgactatgttagtagttta

SEQ ID NO: 237545 - DNA, 20 bp, Artificial
  CRISPR gRNA sequence
ttactataccatacttttta

SEQ ID NO: 237546 - DNA, 20 bp, Artificial
  CRISPR gRNA sequence
tactttttatagttatttca

SEQ ID NO: 237547 - DNA, 20 bp, Artificial
  CRISPR gRNA sequence
tatatatatatatatataac

SEQ ID NO: 237548 - DNA, 20 bp, Artificial
  CRISPR gRNA sequence
atatatatatataaccagtt

SEQ ID NO: 237549 - DNA, 20 bp, Artificial
  CRISPR gRNA sequence
tatatatatataaccagtta

SEQ ID NO: 237550 - DNA, 20 bp, Artificial
  CRISPR gRNA sequence
tatatataaccagttaaggc

SEQ ID NO: 237551 - DNA, 20 bp, Artificial
  CRISPR gRNA sequence
atatataaccagttaaggcc

SEQ ID NO: 237552 - DNA, 20 bp, Artificial
  CRISPR gRNA sequence
ccagttaaggccgggtgttg

SEQ ID NO: 237553 - DNA, 20 bp, Artificial
  CRISPR gRNA sequence
gtggctcacacctgtaatcc

SEQ ID NO: 237554 - DNA, 20 bp, Artificial
  CRISPR gRNA sequence
cacctgtaatcccagcactt

SEQ ID NO: 237555 - DNA, 20 bp, Artificial
  CRISPR gRNA sequence
acctgtaatcccagcacttt

SEQ ID NO: 237556 - DNA, 20 bp, Artificial
  CRISPR gRNA sequence
ctgtaatcccagcactttgg

SEQ ID NO: 237557 - DNA, 20 bp, Artificial
  CRISPR gRNA sequence
tgtaatcccagcactttggg

SEQ ID NO: 237558 - DNA, 20 bp, Artificial
  CRISPR gRNA sequence
tcccagcactttgggaggcc

SEQ ID NO: 237559 - DNA, 20 bp, Artificial
  CRISPR gRNA sequence
cccagcactttgggaggcca

SEQ ID NO: 237560 - DNA, 20 bp, Artificial
  CRISPR gRNA sequence
agcactttgggaggccaagg

SEQ ID NO: 237561 - DNA, 20 bp, Artificial
  CRISPR gRNA sequence
gcactttgggaggccaaggc

SEQ ID NO: 237562 - DNA, 20 bp, Artificial
  CRISPR gRNA sequence
ctttgggaggccaaggcagg

SEQ ID NO: 237563 - DNA, 20 bp, Artificial
  CRISPR gRNA sequence
ccaaggcaggtggattgcct

SEQ ID NO: 237564 - DNA, 20 bp, Artificial
  CRISPR gRNA sequence
gcaggtggattgcctgagct

SEQ ID NO: 237565 - DNA, 20 bp, Artificial
  CRISPR gRNA sequence
caggtggattgcctgagctc

SEQ ID NO: 237566 - DNA, 20 bp, Artificial
  CRISPR gRNA sequence
ggtggattgcctgagctcag

SEQ ID NO: 237567 - DNA, 20 bp, Artificial
  CRISPR gRNA sequence
ttgcctgagctcaggagttt

SEQ ID NO: 237568 - DNA, 20 bp, Artificial
  CRISPR gRNA sequence
tgagctcaggagtttgagac

SEQ ID NO: 237569 - DNA, 20 bp, Artificial
  CRISPR gRNA sequence
tcaggagtttgagactagcc

SEQ ID NO: 237570 - DNA, 20 bp, Artificial
  CRISPR gRNA sequence
caggagtttgagactagcct

SEQ ID NO: 237571 - DNA, 20 bp, Artificial
  CRISPR gRNA sequence
tgagactagcctgggcaatt

SEQ ID NO: 237572 - DNA, 20 bp, Artificial
  CRISPR gRNA sequence
gtgaaaccctgtctctacta

SEQ ID NO: 237573 - DNA, 20 bp, Artificial
  CRISPR gRNA sequence
tctactaaagtacaaaaaat

SEQ ID NO: 237574 - DNA, 20 bp, Artificial
  CRISPR gRNA sequence
ctaaagtacaaaaaattagc

SEQ ID NO: 237575 - DNA, 20 bp, Artificial
  CRISPR gRNA sequence
taaagtacaaaaaattagcc

SEQ ID NO: 237576 - DNA, 20 bp, Artificial
  CRISPR gRNA sequence
tacaaaaaattagccaggca

SEQ ID NO: 237577 - DNA, 20 bp, Artificial
  CRISPR gRNA sequence
aaaaaattagccaggcatgg

SEQ ID NO: 237578 - DNA, 20 bp, Artificial
  CRISPR gRNA sequence
gcggcatgcacctgtaatcc

SEQ ID NO: 237579 - DNA, 20 bp, Artificial
  CRISPR gRNA sequence
cacctgtaatcccagctact

SEQ ID NO: 237580 - DNA, 20 bp, Artificial
  CRISPR gRNA sequence
acctgtaatcccagctactc

SEQ ID NO: 237581 - DNA, 20 bp, Artificial
  CRISPR gRNA sequence
ctgtaatcccagctactcgg

SEQ ID NO: 237582 - DNA, 20 bp, Artificial
  CRISPR gRNA sequence
tgtaatcccagctactcggg

SEQ ID NO: 237583 - DNA, 20 bp, Artificial
  CRISPR gRNA sequence
tcccagctactcgggaggct

SEQ ID NO: 237584 - DNA, 20 bp, Artificial
  CRISPR gRNA sequence
agctactcgggaggctgaga

SEQ ID NO: 237585 - DNA, 20 bp, Artificial
  CRISPR gRNA sequence
gctactcgggaggctgagac

SEQ ID NO: 237586 - DNA, 20 bp, Artificial
  CRISPR gRNA sequence
tactcgggaggctgagacag

SEQ ID NO: 237587 - DNA, 20 bp, Artificial
  CRISPR gRNA sequence
acaggagaatcccttgaacc

SEQ ID NO: 237588 - DNA, 20 bp, Artificial
  CRISPR gRNA sequence
caggagaatcccttgaaccc

SEQ ID NO: 237589 - DNA, 20 bp, Artificial
  CRISPR gRNA sequence
ggagaatcccttgaacccgg

SEQ ID NO: 237590 - DNA, 20 bp, Artificial
  CRISPR gRNA sequence
gagaatcccttgaacccggg

SEQ ID NO: 237591 - DNA, 20 bp, Artificial
  CRISPR gRNA sequence
aatcccttgaacccgggagg

SEQ ID NO: 237592 - DNA, 20 bp, Artificial
  CRISPR gRNA sequence
tcccttgaacccgggaggca

SEQ ID NO: 237593 - DNA, 20 bp, Artificial
  CRISPR gRNA sequence
cccttgaacccgggaggcag

SEQ ID NO: 237594 - DNA, 20 bp, Artificial
  CRISPR gRNA sequence
aacccgggaggcagaggttg

SEQ ID NO: 237595 - DNA, 20 bp, Artificial
  CRISPR gRNA sequence
acccgggaggcagaggttgc

SEQ ID NO: 237596 - DNA, 20 bp, Artificial
  CRISPR gRNA sequence
cccgggaggcagaggttgca

SEQ ID NO: 237597 - DNA, 20 bp, Artificial
  CRISPR gRNA sequence
cgggaggcagaggttgcagg

SEQ ID NO: 237598 - DNA, 20 bp, Artificial
  CRISPR gRNA sequence
ggcagaggttgcagggagcc

SEQ ID NO: 237599 - DNA, 20 bp, Artificial
  CRISPR gRNA sequence
gagaccgccccattgcactc

SEQ ID NO: 237600 - DNA, 20 bp, Artificial
  CRISPR gRNA sequence
cgccccattgcactccagcc

SEQ ID NO: 237601 - DNA, 20 bp, Artificial
  CRISPR gRNA sequence
gccccattgcactccagcct

SEQ ID NO: 237602 - DNA, 20 bp, Artificial
  CRISPR gRNA sequence
ttgcactccagcctgggcaa

SEQ ID NO: 237603 - DNA, 20 bp, Artificial
  CRISPR gRNA sequence
gcactccagcctgggcaaca

SEQ ID NO: 237604 - DNA, 20 bp, Artificial
  CRISPR gRNA sequence
tccagcctgggcaacagagc

SEQ ID NO: 237605 - DNA, 20 bp, Artificial
  CRISPR gRNA sequence
acaaacaaacaaacaaaaac

SEQ ID NO: 237606 - DNA, 20 bp, Artificial
  CRISPR gRNA sequence
aaaaccagttaattgtaaaa

SEQ ID NO: 237607 - DNA, 20 bp, Artificial
  CRISPR gRNA sequence
agttaattgtaaaacagcct

SEQ ID NO: 237608 - DNA, 20 bp, Artificial
  CRISPR gRNA sequence
gttaattgtaaaacagcctc

SEQ ID NO: 237609 - DNA, 20 bp, Artificial
  CRISPR gRNA sequence
aattgtaaaacagcctcagg

SEQ ID NO: 237610 - DNA, 20 bp, Artificial
  CRISPR gRNA sequence
attgtaaaacagcctcaggc

SEQ ID NO: 237611 - DNA, 20 bp, Artificial
  CRISPR gRNA sequence
acagcctcaggcaggtcctt

SEQ ID NO: 237612 - DNA, 20 bp, Artificial
  CRISPR gRNA sequence
cagcctcaggcaggtccttt

SEQ ID NO: 237613 - DNA, 20 bp, Artificial
  CRISPR gRNA sequence
gcctcaggcaggtcctttgg

SEQ ID NO: 237614 - DNA, 20 bp, Artificial
  CRISPR gRNA sequence
cctcaggcaggtcctttggg

SEQ ID NO: 237615 - DNA, 20 bp, Artificial
  CRISPR gRNA sequence
aggtcctttgggaggtattc

SEQ ID NO: 237616 - DNA, 20 bp, Artificial
  CRISPR gRNA sequence
tcctttgggaggtattccag

SEQ ID NO: 237617 - DNA, 20 bp, Artificial
  CRISPR gRNA sequence
tttgggaggtattccagaag

SEQ ID NO: 237618 - DNA, 20 bp, Artificial
  CRISPR gRNA sequence
agaagaagacattgttctca

SEQ ID NO: 237619 - DNA, 20 bp, Artificial
  CRISPR gRNA sequence
gaagaagacattgttctcat

SEQ ID NO: 237620 - DNA, 20 bp, Artificial
  CRISPR gRNA sequence
agaagacattgttctcatag

SEQ ID NO: 237621 - DNA, 20 bp, Artificial
  CRISPR gRNA sequence
attgttctcataggagatga

SEQ ID NO: 237622 - DNA, 20 bp, Artificial
  CRISPR gRNA sequence
acatgcatgtttttgcccca

SEQ ID NO: 237623 - DNA, 20 bp, Artificial
  CRISPR gRNA sequence
tttttgccccaaagatcttc

SEQ ID NO: 237624 - DNA, 20 bp, Artificial
  CRISPR gRNA sequence
ttgccccaaagatcttccag

SEQ ID NO: 237625 - DNA, 20 bp, Artificial
  CRISPR gRNA sequence
tgccccaaagatcttccagt

SEQ ID NO: 237626 - DNA, 20 bp, Artificial
  CRISPR gRNA sequence
caaagatcttccagtgggac

SEQ ID NO: 237627 - DNA, 20 bp, Artificial
  CRISPR gRNA sequence
tcttccagtgggacaagatg

SEQ ID NO: 237628 - DNA, 20 bp, Artificial
  CRISPR gRNA sequence
ttccagtgggacaagatgtg

SEQ ID NO: 237629 - DNA, 20 bp, Artificial
  CRISPR gRNA sequence
tccagtgggacaagatgtgg

SEQ ID NO: 237630 - DNA, 20 bp, Artificial
  CRISPR gRNA sequence
agtgggacaagatgtggagg

SEQ ID NO: 237631 - DNA, 20 bp, Artificial
  CRISPR gRNA sequence
gggacaagatgtggaggtgg

SEQ ID NO: 237632 - DNA, 20 bp, Artificial
  CRISPR gRNA sequence
tggcagacaccaactctgtg

SEQ ID NO: 237633 - DNA, 20 bp, Artificial
  CRISPR gRNA sequence
ggcagacaccaactctgtgt

SEQ ID NO: 237634 - DNA, 20 bp, Artificial
  CRISPR gRNA sequence
acaccaactctgtgtgggtc

SEQ ID NO: 237635 - DNA, 20 bp, Artificial
  CRISPR gRNA sequence
caccaactctgtgtgggtct

SEQ ID NO: 237636 - DNA, 20 bp, Artificial
  CRISPR gRNA sequence
ctgtgtgggtctaggctaat

SEQ ID NO: 237637 - DNA, 20 bp, Artificial
  CRISPR gRNA sequence
taataagtgtgttcgtgtct

SEQ ID NO: 237638 - DNA, 20 bp, Artificial
  CRISPR gRNA sequence
gtcttagtttttcacaaaaa

SEQ ID NO: 237639 - DNA, 20 bp, Artificial
  CRISPR gRNA sequence
tttcacaaaaaaagtttaaa

SEQ ID NO: 237640 - DNA, 20 bp, Artificial
  CRISPR gRNA sequence
aaaaaagtttaaaaagtaaa

SEQ ID NO: 237641 - DNA, 20 bp, Artificial
  CRISPR gRNA sequence
gcaatttaaaaacttttaaa

SEQ ID NO: 237642 - DNA, 20 bp, Artificial
  CRISPR gRNA sequence
aaaaacttttaaatagataa

SEQ ID NO: 237643 - DNA, 20 bp, Artificial
  CRISPR gRNA sequence
tttaaatagataaaagctta

SEQ ID NO: 237644 - DNA, 20 bp, Artificial
  CRISPR gRNA sequence
tagataaaagcttatagaat

SEQ ID NO: 237645 - DNA, 20 bp, Artificial
  CRISPR gRNA sequence
agataaaagcttatagaata

SEQ ID NO: 237646 - DNA, 20 bp, Artificial
  CRISPR gRNA sequence
gcttatagaataaggaaata

SEQ ID NO: 237647 - DNA, 20 bp, Artificial
  CRISPR gRNA sequence
ttatagaataaggaaataaa

SEQ ID NO: 237648 - DNA, 20 bp, Artificial
  CRISPR gRNA sequence
aaagagaaaatatttttgta

SEQ ID NO: 237649 - DNA, 20 bp, Artificial
  CRISPR gRNA sequence
gtacaatgtgcttgtgtttt

SEQ ID NO: 237650 - DNA, 20 bp, Artificial
  CRISPR gRNA sequence
atgtgcttgtgttttaagct

SEQ ID NO: 237651 - DNA, 20 bp, Artificial
  CRISPR gRNA sequence
gtgcttgtgttttaagctaa

SEQ ID NO: 237652 - DNA, 20 bp, Artificial
  CRISPR gRNA sequence
taagctaagagttattacaa

SEQ ID NO: 237653 - DNA, 20 bp, Artificial
  CRISPR gRNA sequence
agctaagagttattacaaaa

SEQ ID NO: 237654 - DNA, 20 bp, Artificial
  CRISPR gRNA sequence
gttattacaaaagagtcaaa

SEQ ID NO: 237655 - DNA, 20 bp, Artificial
  CRISPR gRNA sequence
agttaaaaaaaatttttttt

SEQ ID NO: 237656 - DNA, 20 bp, Artificial
  CRISPR gRNA sequence
aaaaattttttttaagttta

SEQ ID NO: 237657 - DNA, 20 bp, Artificial
  CRISPR gRNA sequence
aaaattttttttaagtttat

SEQ ID NO: 237658 - DNA, 20 bp, Artificial
  CRISPR gRNA sequence
ttttttttaagtttataggc

SEQ ID NO: 237659 - DNA, 20 bp, Artificial
  CRISPR gRNA sequence
tttttttaagtttataggct

SEQ ID NO: 237660 - DNA, 20 bp, Artificial
  CRISPR gRNA sequence
ttaagtttataggctgggtg

SEQ ID NO: 237661 - DNA, 20 bp, Artificial
  CRISPR gRNA sequence
agtttataggctgggtgcgg

SEQ ID NO: 237662 - DNA, 20 bp, Artificial
  CRISPR gRNA sequence
gtggctcatgcctgtaatcc

SEQ ID NO: 237663 - DNA, 20 bp, Artificial
  CRISPR gRNA sequence
tgcctgtaatcccagcactt

SEQ ID NO: 237664 - DNA, 20 bp, Artificial
  CRISPR gRNA sequence
gcctgtaatcccagcacttt

SEQ ID NO: 237665 - DNA, 20 bp, Artificial
  CRISPR gRNA sequence
ctgtaatcccagcactttgg

SEQ ID NO: 237666 - DNA, 20 bp, Artificial
  CRISPR gRNA sequence
tgtaatcccagcactttggg

SEQ ID NO: 237667 - DNA, 20 bp, Artificial
  CRISPR gRNA sequence
tcccagcactttgggaggcc

SEQ ID NO: 237668 - DNA, 20 bp, Artificial
  CRISPR gRNA sequence
cccagcactttgggaggccg

SEQ ID NO: 237669 - DNA, 20 bp, Artificial
  CRISPR gRNA sequence
agcactttgggaggccgagg

SEQ ID NO: 237670 - DNA, 20 bp, Artificial
  CRISPR gRNA sequence
gcactttgggaggccgaggt

SEQ ID NO: 237671 - DNA, 20 bp, Artificial
  CRISPR gRNA sequence
ctttgggaggccgaggtggg

SEQ ID NO: 237672 - DNA, 20 bp, Artificial
  CRISPR gRNA sequence
ggccgaggtgggcagattac

SEQ ID NO: 237673 - DNA, 20 bp, Artificial
  CRISPR gRNA sequence
ccgaggtgggcagattaccg

SEQ ID NO: 237674 - DNA, 20 bp, Artificial
  CRISPR gRNA sequence
gtgggcagattaccggagct

SEQ ID NO: 237675 - DNA, 20 bp, Artificial
  CRISPR gRNA sequence
tgggcagattaccggagctc

SEQ ID NO: 237676 - DNA, 20 bp, Artificial
  CRISPR gRNA sequence
ggcagattaccggagctcag

SEQ ID NO: 237677 - DNA, 20 bp, Artificial
  CRISPR gRNA sequence
ttaccggagctcaggagttc

SEQ ID NO: 237678 - DNA, 20 bp, Artificial
  CRISPR gRNA sequence
ggagctcaggagttcgagac

SEQ ID NO: 237679 - DNA, 20 bp, Artificial
  CRISPR gRNA sequence
tcaggagttcgagaccagcc

SEQ ID NO: 237680 - DNA, 20 bp, Artificial
  CRISPR gRNA sequence
cgagaccagcctagccaaca

SEQ ID NO: 237681 - DNA, 20 bp, Artificial
  CRISPR gRNA sequence
cccatctctaatacaaaaat

SEQ ID NO: 237682 - DNA, 20 bp, Artificial
  CRISPR gRNA sequence
tctctaatacaaaaattagc

SEQ ID NO: 237683 - DNA, 20 bp, Artificial
  CRISPR gRNA sequence
ctctaatacaaaaattagcc

SEQ ID NO: 237684 - DNA, 20 bp, Artificial
  CRISPR gRNA sequence
atacaaaaattagccaggcg

SEQ ID NO: 237685 - DNA, 20 bp, Artificial
  CRISPR gRNA sequence
caaaaattagccaggcgtgg

SEQ ID NO: 237686 - DNA, 20 bp, Artificial
  CRISPR gRNA sequence
aaattagccaggcgtggtgg

SEQ ID NO: 237687 - DNA, 20 bp, Artificial
  CRISPR gRNA sequence
ggcgtggtggcagctgcctg

SEQ ID NO: 237688 - DNA, 20 bp, Artificial
  CRISPR gRNA sequence
gtggcagctgcctgtagtcc

SEQ ID NO: 237689 - DNA, 20 bp, Artificial
  CRISPR gRNA sequence
tgcctgtagtcccagctact

SEQ ID NO: 237690 - DNA, 20 bp, Artificial
  CRISPR gRNA sequence
gcctgtagtcccagctactt

SEQ ID NO: 237691 - DNA, 20 bp, Artificial
  CRISPR gRNA sequence
cctgtagtcccagctacttg

SEQ ID NO: 237692 - DNA, 20 bp, Artificial
  CRISPR gRNA sequence
ctgtagtcccagctacttgg

SEQ ID NO: 237693 - DNA, 20 bp, Artificial
  CRISPR gRNA sequence
tgtagtcccagctacttggg

SEQ ID NO: 237694 - DNA, 20 bp, Artificial
  CRISPR gRNA sequence
tcccagctacttggggggct

SEQ ID NO: 237695 - DNA, 20 bp, Artificial
  CRISPR gRNA sequence
cccagctacttggggggctg

SEQ ID NO: 237696 - DNA, 20 bp, Artificial
  CRISPR gRNA sequence
agctacttggggggctgagg

SEQ ID NO: 237697 - DNA, 20 bp, Artificial
  CRISPR gRNA sequence
gctacttggggggctgaggc

SEQ ID NO: 237698 - DNA, 20 bp, Artificial
  CRISPR gRNA sequence
tacttggggggctgaggcag

SEQ ID NO: 237699 - DNA, 20 bp, Artificial
  CRISPR gRNA sequence
gcaggagaatcacttgaacc

SEQ ID NO: 237700 - DNA, 20 bp, Artificial
  CRISPR gRNA sequence
caggagaatcacttgaacct

SEQ ID NO: 237701 - DNA, 20 bp, Artificial
  CRISPR gRNA sequence
ggagaatcacttgaacctgg

SEQ ID NO: 237702 - DNA, 20 bp, Artificial
  CRISPR gRNA sequence
gagaatcacttgaacctggg

SEQ ID NO: 237703 - DNA, 20 bp, Artificial
  CRISPR gRNA sequence
tcacttgaacctgggaggtg

SEQ ID NO: 237704 - DNA, 20 bp, Artificial
  CRISPR gRNA sequence
cacttgaacctgggaggtgc

SEQ ID NO: 237705 - DNA, 20 bp, Artificial
  CRISPR gRNA sequence
aacctgggaggtgcaggctg

SEQ ID NO: 237706 - DNA, 20 bp, Artificial
  CRISPR gRNA sequence
tgggaggtgcaggctgcagt

SEQ ID NO: 237707 - DNA, 20 bp, Artificial
  CRISPR gRNA sequence
ggtgcaggctgcagtgagcc

SEQ ID NO: 237708 - DNA, 20 bp, Artificial
  CRISPR gRNA sequence
aagatctcgccactgcattc

SEQ ID NO: 237709 - DNA, 20 bp, Artificial
  CRISPR gRNA sequence
ctcgccactgcattccagcc

SEQ ID NO: 237710 - DNA, 20 bp, Artificial
  CRISPR gRNA sequence
tcgccactgcattccagcct

SEQ ID NO: 237711 - DNA, 20 bp, Artificial
  CRISPR gRNA sequence
ccactgcattccagcctggg

SEQ ID NO: 237712 - DNA, 20 bp, Artificial
  CRISPR gRNA sequence
tgcattccagcctgggcagc

SEQ ID NO: 237713 - DNA, 20 bp, Artificial
  CRISPR gRNA sequence
cctcaaaaaaaaaaaaatta

SEQ ID NO: 237714 - DNA, 20 bp, Artificial
  CRISPR gRNA sequence
aaaaaaaattaaagtttatg

SEQ ID NO: 237715 - DNA, 20 bp, Artificial
  CRISPR gRNA sequence
attaaagtttatgaagtaaa

SEQ ID NO: 237716 - DNA, 20 bp, Artificial
  CRISPR gRNA sequence
gtttatgaagtaaaaagtca

SEQ ID NO: 237717 - DNA, 20 bp, Artificial
  CRISPR gRNA sequence
atgaagtaaaaagtcacagt

SEQ ID NO: 237718 - DNA, 20 bp, Artificial
  CRISPR gRNA sequence
gtaaaaagtcacagtaagct

SEQ ID NO: 237719 - DNA, 20 bp, Artificial
  CRISPR gRNA sequence
taaaaagtcacagtaagcta

SEQ ID NO: 237720 - DNA, 20 bp, Artificial
  CRISPR gRNA sequence
ctaaggttaatttattattg

SEQ ID NO: 237721 - DNA, 20 bp, Artificial
  CRISPR gRNA sequence
ggttaatttattattgaaga

SEQ ID NO: 237722 - DNA, 20 bp, Artificial
  CRISPR gRNA sequence
ttaatttattattgaagaaa

SEQ ID NO: 237723 - DNA, 20 bp, Artificial
  CRISPR gRNA sequence
gagaacattttaaataaatt

SEQ ID NO: 237724 - DNA, 20 bp, Artificial
  CRISPR gRNA sequence
agaacattttaaataaattt

SEQ ID NO: 237725 - DNA, 20 bp, Artificial
  CRISPR gRNA sequence
cattttaaataaatttaggt

SEQ ID NO: 237726 - DNA, 20 bp, Artificial
  CRISPR gRNA sequence
aaataaatttaggttagctt

SEQ ID NO: 237727 - DNA, 20 bp, Artificial
  CRISPR gRNA sequence
tttaggttagcttaagtgta

SEQ ID NO: 237728 - DNA, 20 bp, Artificial
  CRISPR gRNA sequence
cttaagtgtacagtgtttat

SEQ ID NO: 237729 - DNA, 20 bp, Artificial
  CRISPR gRNA sequence
gtacagtgtttataagacta

SEQ ID NO: 237730 - DNA, 20 bp, Artificial
  CRISPR gRNA sequence
tataagactacagtgatata

SEQ ID NO: 237731 - DNA, 20 bp, Artificial
  CRISPR gRNA sequence
aagactacagtgatatacag

SEQ ID NO: 237732 - DNA, 20 bp, Artificial
  CRISPR gRNA sequence
gactacagtgatatacagca

SEQ ID NO: 237733 - DNA, 20 bp, Artificial
  CRISPR gRNA sequence
actacagtgatatacagcag

SEQ ID NO: 237734 - DNA, 20 bp, Artificial
  CRISPR gRNA sequence
gcagaggtccccaacctttt

SEQ ID NO: 237735 - DNA, 20 bp, Artificial
  CRISPR gRNA sequence
aggtccccaacctttttggc

SEQ ID NO: 237736 - DNA, 20 bp, Artificial
  CRISPR gRNA sequence
gtccccaacctttttggcaa

SEQ ID NO: 237737 - DNA, 20 bp, Artificial
  CRISPR gRNA sequence
tccccaacctttttggcaag

SEQ ID NO: 237738 - DNA, 20 bp, Artificial
  CRISPR gRNA sequence
ccccaacctttttggcaaga

SEQ ID NO: 237739 - DNA, 20 bp, Artificial
  CRISPR gRNA sequence
acctttttggcaagagggac

SEQ ID NO: 237740 - DNA, 20 bp, Artificial
  CRISPR gRNA sequence
ggcaagagggaccagttttg

SEQ ID NO: 237741 - DNA, 20 bp, Artificial
  CRISPR gRNA sequence
aagagggaccagttttgtgg

SEQ ID NO: 237742 - DNA, 20 bp, Artificial
  CRISPR gRNA sequence
tgtggaagacaatttttcca

SEQ ID NO: 237743 - DNA, 20 bp, Artificial
  CRISPR gRNA sequence
aagacaatttttccacggac

SEQ ID NO: 237744 - DNA, 20 bp, Artificial
  CRISPR gRNA sequence
agacaatttttccacggact

SEQ ID NO: 237745 - DNA, 20 bp, Artificial
  CRISPR gRNA sequence
caatttttccacggactggg

SEQ ID NO: 237746 - DNA, 20 bp, Artificial
  CRISPR gRNA sequence
aatttttccacggactgggt

SEQ ID NO: 237747 - DNA, 20 bp, Artificial
  CRISPR gRNA sequence
ttttccacggactgggtggg

SEQ ID NO: 237748 - DNA, 20 bp, Artificial
  CRISPR gRNA sequence
tttccacggactgggtgggt

SEQ ID NO: 237749 - DNA, 20 bp, Artificial
  CRISPR gRNA sequence
ttccacggactgggtgggtg

SEQ ID NO: 237750 - DNA, 20 bp, Artificial
  CRISPR gRNA sequence
tccacggactgggtgggtgg

SEQ ID NO: 237751 - DNA, 20 bp, Artificial
  CRISPR gRNA sequence
ccacggactgggtgggtggg

SEQ ID NO: 237752 - DNA, 20 bp, Artificial
  CRISPR gRNA sequence
ggactgggtgggtgggggga

SEQ ID NO: 237753 - DNA, 20 bp, Artificial
  CRISPR gRNA sequence
ggtgggtggggggatggttt

SEQ ID NO: 237754 - DNA, 20 bp, Artificial
  CRISPR gRNA sequence
gtgggtggggggatggtttc

SEQ ID NO: 237755 - DNA, 20 bp, Artificial
  CRISPR gRNA sequence
ggatggtttcaggatgattc

SEQ ID NO: 237756 - DNA, 20 bp, Artificial
  CRISPR gRNA sequence
ttatacaactccctgtaatg

SEQ ID NO: 237757 - DNA, 20 bp, Artificial
  CRISPR gRNA sequence
aactccctgtaatgtagaat

SEQ ID NO: 237758 - DNA, 20 bp, Artificial
  CRISPR gRNA sequence
tccctgtaatgtagaatcag

SEQ ID NO: 237759 - DNA, 20 bp, Artificial
  CRISPR gRNA sequence
ccctgtaatgtagaatcagt

SEQ ID NO: 237760 - DNA, 20 bp, Artificial
  CRISPR gRNA sequence
ctgtaatgtagaatcagtgg

SEQ ID NO: 237761 - DNA, 20 bp, Artificial
  CRISPR gRNA sequence
gtagaatcagtgggagccct

SEQ ID NO: 237762 - DNA, 20 bp, Artificial
  CRISPR gRNA sequence
tgagcttgttttcctacaac

SEQ ID NO: 237763 - DNA, 20 bp, Artificial
  CRISPR gRNA sequence
cttgttttcctacaactaga

SEQ ID NO: 237764 - DNA, 20 bp, Artificial
  CRISPR gRNA sequence
tacaactagacagtcccatc

SEQ ID NO: 237765 - DNA, 20 bp, Artificial
  CRISPR gRNA sequence
acaactagacagtcccatct

SEQ ID NO: 237766 - DNA, 20 bp, Artificial
  CRISPR gRNA sequence
caactagacagtcccatctg

SEQ ID NO: 237767 - DNA, 20 bp, Artificial
  CRISPR gRNA sequence
aactagacagtcccatctgg

SEQ ID NO: 237768 - DNA, 20 bp, Artificial
  CRISPR gRNA sequence
acagtcccatctgggggtga

SEQ ID NO: 237769 - DNA, 20 bp, Artificial
  CRISPR gRNA sequence
cagtcccatctgggggtgat

SEQ ID NO: 237770 - DNA, 20 bp, Artificial
  CRISPR gRNA sequence
agtcccatctgggggtgatg

SEQ ID NO: 237771 - DNA, 20 bp, Artificial
  CRISPR gRNA sequence
catctgggggtgatggggaa

SEQ ID NO: 237772 - DNA, 20 bp, Artificial
  CRISPR gRNA sequence
ggggtgatggggaacagtga

SEQ ID NO: 237773 - DNA, 20 bp, Artificial
  CRISPR gRNA sequence
ggggaacagtgacagatcat

SEQ ID NO: 237774 - DNA, 20 bp, Artificial
  CRISPR gRNA sequence
gggaacagtgacagatcatc

SEQ ID NO: 237775 - DNA, 20 bp, Artificial
  CRISPR gRNA sequence
agtgacagatcatcaggtac

SEQ ID NO: 237776 - DNA, 20 bp, Artificial
  CRISPR gRNA sequence
atcaggtactggattctcat

SEQ ID NO: 237777 - DNA, 20 bp, Artificial
  CRISPR gRNA sequence
tcaggtactggattctcata

SEQ ID NO: 237778 - DNA, 20 bp, Artificial
  CRISPR gRNA sequence
aggtactggattctcataag

SEQ ID NO: 237779 - DNA, 20 bp, Artificial
  CRISPR gRNA sequence
acctcgatccctcgtatgcg

SEQ ID NO: 237780 - DNA, 20 bp, Artificial
  CRISPR gRNA sequence
ctcgtatgcgcagttcacaa

SEQ ID NO: 237781 - DNA, 20 bp, Artificial
  CRISPR gRNA sequence
tcgtatgcgcagttcacaat

SEQ ID NO: 237782 - DNA, 20 bp, Artificial
  CRISPR gRNA sequence
aataggattcatgctcctat

SEQ ID NO: 237783 - DNA, 20 bp, Artificial
  CRISPR gRNA sequence
taatgccgctgctgatctga

SEQ ID NO: 237784 - DNA, 20 bp, Artificial
  CRISPR gRNA sequence
aatgccgctgctgatctgat

SEQ ID NO: 237785 - DNA, 20 bp, Artificial
  CRISPR gRNA sequence
tgccgctgctgatctgatgg

SEQ ID NO: 237786 - DNA, 20 bp, Artificial
  CRISPR gRNA sequence
gctgctgatctgatgggaga

SEQ ID NO: 237787 - DNA, 20 bp, Artificial
  CRISPR gRNA sequence
tgctgatctgatgggagatg

SEQ ID NO: 237788 - DNA, 20 bp, Artificial
  CRISPR gRNA sequence
atctgatgggagatggagat

SEQ ID NO: 237789 - DNA, 20 bp, Artificial
  CRISPR gRNA sequence
tctgatgggagatggagata

SEQ ID NO: 237790 - DNA, 20 bp, Artificial
  CRISPR gRNA sequence
gatgggagatggagataagg

SEQ ID NO: 237791 - DNA, 20 bp, Artificial
  CRISPR gRNA sequence
tggagataaggcggtaatgc

SEQ ID NO: 237792 - DNA, 20 bp, Artificial
  CRISPR gRNA sequence
taaggcggtaatgcaagtca

SEQ ID NO: 237793 - DNA, 20 bp, Artificial
  CRISPR gRNA sequence
aaggcggtaatgcaagtcat

SEQ ID NO: 237794 - DNA, 20 bp, Artificial
  CRISPR gRNA sequence
aggcggtaatgcaagtcatg

SEQ ID NO: 237795 - DNA, 20 bp, Artificial
  CRISPR gRNA sequence
gcggtaatgcaagtcatggg

SEQ ID NO: 237796 - DNA, 20 bp, Artificial
  CRISPR gRNA sequence
cggtaatgcaagtcatgggg

SEQ ID NO: 237797 - DNA, 20 bp, Artificial
  CRISPR gRNA sequence
ggtaatgcaagtcatgggga

SEQ ID NO: 237798 - DNA, 20 bp, Artificial
  CRISPR gRNA sequence
gtaatgcaagtcatggggag

SEQ ID NO: 237799 - DNA, 20 bp, Artificial
  CRISPR gRNA sequence
atggggaggggctataaata

SEQ ID NO: 237800 - DNA, 20 bp, Artificial
  CRISPR gRNA sequence
ggggaggggctataaataca

SEQ ID NO: 237801 - DNA, 20 bp, Artificial
  CRISPR gRNA sequence
gggaggggctataaatacag

SEQ ID NO: 237802 - DNA, 20 bp, Artificial
  CRISPR gRNA sequence
aggggctataaatacagagg

SEQ ID NO: 237803 - DNA, 20 bp, Artificial
  CRISPR gRNA sequence
gcccaccactctcctcctgc

SEQ ID NO: 237804 - DNA, 20 bp, Artificial
  CRISPR gRNA sequence
cccaccactctcctcctgct

SEQ ID NO: 237805 - DNA, 20 bp, Artificial
  CRISPR gRNA sequence
accactctcctcctgctggg

SEQ ID NO: 237806 - DNA, 20 bp, Artificial
  CRISPR gRNA sequence
tctcctcctgctgggtggcc

SEQ ID NO: 237807 - DNA, 20 bp, Artificial
  CRISPR gRNA sequence
ctgggtggcctggtttctaa

SEQ ID NO: 237808 - DNA, 20 bp, Artificial
  CRISPR gRNA sequence
tggcgtctcactctgttgcc

SEQ ID NO: 237809 - DNA, 20 bp, Artificial
  CRISPR gRNA sequence
gtctcactctgttgcccagc

SEQ ID NO: 237810 - DNA, 20 bp, Artificial
  CRISPR gRNA sequence
tctcactctgttgcccagcc

SEQ ID NO: 237811 - DNA, 20 bp, Artificial
  CRISPR gRNA sequence
tcactctgttgcccagccag

SEQ ID NO: 237812 - DNA, 20 bp, Artificial
  CRISPR gRNA sequence
ctgttgcccagccaggagtg

SEQ ID NO: 237813 - DNA, 20 bp, Artificial
  CRISPR gRNA sequence
ggagtgcagtgatgcgatct

SEQ ID NO: 237814 - DNA, 20 bp, Artificial
  CRISPR gRNA sequence
tcactgcaacctctgcctgt

SEQ ID NO: 237815 - DNA, 20 bp, Artificial
  CRISPR gRNA sequence
cactgcaacctctgcctgtc

SEQ ID NO: 237816 - DNA, 20 bp, Artificial
  CRISPR gRNA sequence
aacctctgcctgtcaggttc

SEQ ID NO: 237817 - DNA, 20 bp, Artificial
  CRISPR gRNA sequence
acctctgcctgtcaggttca

SEQ ID NO: 237818 - DNA, 20 bp, Artificial
  CRISPR gRNA sequence
cctctgcctgtcaggttcaa

SEQ ID NO: 237819 - DNA, 20 bp, Artificial
  CRISPR gRNA sequence
ttcaagggattctcccacct

SEQ ID NO: 237820 - DNA, 20 bp, Artificial
  CRISPR gRNA sequence
ttctcccacctcagcctccc

SEQ ID NO: 237821 - DNA, 20 bp, Artificial
  CRISPR gRNA sequence
tcccacctcagcctcccaag

SEQ ID NO: 237822 - DNA, 20 bp, Artificial
  CRISPR gRNA sequence
acctcagcctcccaagtggc

SEQ ID NO: 237823 - DNA, 20 bp, Artificial
  CRISPR gRNA sequence
ctcccaagtggctggaatta

SEQ ID NO: 237824 - DNA, 20 bp, Artificial
  CRISPR gRNA sequence
tcccaagtggctggaattac

SEQ ID NO: 237825 - DNA, 20 bp, Artificial
  CRISPR gRNA sequence
caggcatgcgccaccacacc

SEQ ID NO: 237826 - DNA, 20 bp, Artificial
  CRISPR gRNA sequence
ccggctaatttttgtatttt

SEQ ID NO: 237827 - DNA, 20 bp, Artificial
  CRISPR gRNA sequence
gctaatttttgtatttttag

SEQ ID NO: 237828 - DNA, 20 bp, Artificial
  CRISPR gRNA sequence
ttttgtatttttagtagaaa

SEQ ID NO: 237829 - DNA, 20 bp, Artificial
  CRISPR gRNA sequence
tttgtatttttagtagaaac

SEQ ID NO: 237830 - DNA, 20 bp, Artificial
  CRISPR gRNA sequence
ttgtatttttagtagaaaca

SEQ ID NO: 237831 - DNA, 20 bp, Artificial
  CRISPR gRNA sequence
gaaacagggtttcaccatgt

SEQ ID NO: 237832 - DNA, 20 bp, Artificial
  CRISPR gRNA sequence
cagggtttcaccatgttggc

SEQ ID NO: 237833 - DNA, 20 bp, Artificial
  CRISPR gRNA sequence
agggtttcaccatgttggcc

SEQ ID NO: 237834 - DNA, 20 bp, Artificial
  CRISPR gRNA sequence
tttcaccatgttggccaggc

SEQ ID NO: 237835 - DNA, 20 bp, Artificial
  CRISPR gRNA sequence
tagtctcgaactcctgacct

SEQ ID NO: 237836 - DNA, 20 bp, Artificial
  CRISPR gRNA sequence
agtctcgaactcctgacctc

SEQ ID NO: 237837 - DNA, 20 bp, Artificial
  CRISPR gRNA sequence
ctcaggtgatctgcccacct

SEQ ID NO: 237838 - DNA, 20 bp, Artificial
  CRISPR gRNA sequence
ctgcccaccttggtctccca

SEQ ID NO: 237839 - DNA, 20 bp, Artificial
  CRISPR gRNA sequence
accttggtctcccaaagtgt

SEQ ID NO: 237840 - DNA, 20 bp, Artificial
  CRISPR gRNA sequence
ccttggtctcccaaagtgtt

SEQ ID NO: 237841 - DNA, 20 bp, Artificial
  CRISPR gRNA sequence
ctcccaaagtgttgggatta

SEQ ID NO: 237842 - DNA, 20 bp, Artificial
  CRISPR gRNA sequence
agtgttgggattacagacat

SEQ ID NO: 237843 - DNA, 20 bp, Artificial
  CRISPR gRNA sequence
cagacatgagccactgcgcc

SEQ ID NO: 237844 - DNA, 20 bp, Artificial
  CRISPR gRNA sequence
atgagccactgcgcctggca

SEQ ID NO: 237845 - DNA, 20 bp, Artificial
  CRISPR gRNA sequence
caaagatcatattattttca

SEQ ID NO: 237846 - DNA, 20 bp, Artificial
  CRISPR gRNA sequence
cacggtacctcttctatgtt

SEQ ID NO: 237847 - DNA, 20 bp, Artificial
  CRISPR gRNA sequence
cttctatgtttagatatgtt

SEQ ID NO: 237848 - DNA, 20 bp, Artificial
  CRISPR gRNA sequence
acacaaataccattatgtta

SEQ ID NO: 237849 - DNA, 20 bp, Artificial
  CRISPR gRNA sequence
cattatgttacagttgccta

SEQ ID NO: 237850 - DNA, 20 bp, Artificial
  CRISPR gRNA sequence
ttacagttgcctatggtatt

SEQ ID NO: 237851 - DNA, 20 bp, Artificial
  CRISPR gRNA sequence
gttgcctatggtattcggta

SEQ ID NO: 237852 - DNA, 20 bp, Artificial
  CRISPR gRNA sequence
cggtacagtcacatgcctga

SEQ ID NO: 237853 - DNA, 20 bp, Artificial
  CRISPR gRNA sequence
ggtacagtcacatgcctgac

SEQ ID NO: 237854 - DNA, 20 bp, Artificial
  CRISPR gRNA sequence
tcacatgcctgacaggtttg

SEQ ID NO: 237855 - DNA, 20 bp, Artificial
  CRISPR gRNA sequence
tgcctgacaggtttgtagta

SEQ ID NO: 237856 - DNA, 20 bp, Artificial
  CRISPR gRNA sequence
gcctgacaggtttgtagtat

SEQ ID NO: 237857 - DNA, 20 bp, Artificial
  CRISPR gRNA sequence
ctgacaggtttgtagtatag

SEQ ID NO: 237858 - DNA, 20 bp, Artificial
  CRISPR gRNA sequence
tgacaggtttgtagtatagg

SEQ ID NO: 237859 - DNA, 20 bp, Artificial
  CRISPR gRNA sequence
gacaggtttgtagtatagga

SEQ ID NO: 237860 - DNA, 20 bp, Artificial
  CRISPR gRNA sequence
ggtttgtagtataggaggga

SEQ ID NO: 237861 - DNA, 20 bp, Artificial
  CRISPR gRNA sequence
gtttgtagtataggagggat

SEQ ID NO: 237862 - DNA, 20 bp, Artificial
  CRISPR gRNA sequence
gagggataggctataccatc

SEQ ID NO: 237863 - DNA, 20 bp, Artificial
  CRISPR gRNA sequence
ataggctataccatccagcc

SEQ ID NO: 237864 - DNA, 20 bp, Artificial
  CRISPR gRNA sequence
taggctataccatccagcct

SEQ ID NO: 237865 - DNA, 20 bp, Artificial
  CRISPR gRNA sequence
taccatccagcctaggtgta

SEQ ID NO: 237866 - DNA, 20 bp, Artificial
  CRISPR gRNA sequence
catccagcctaggtgtatag

SEQ ID NO: 237867 - DNA, 20 bp, Artificial
  CRISPR gRNA sequence
atccagcctaggtgtatagt

SEQ ID NO: 237868 - DNA, 20 bp, Artificial
  CRISPR gRNA sequence
gtatagtaggctgtaccatc

SEQ ID NO: 237869 - DNA, 20 bp, Artificial
  CRISPR gRNA sequence
tatagtaggctgtaccatct

SEQ ID NO: 237870 - DNA, 20 bp, Artificial
  CRISPR gRNA sequence
tgtaccatctaggtttgcat

SEQ ID NO: 237871 - DNA, 20 bp, Artificial
  CRISPR gRNA sequence
tcacttaacaacacatttct

SEQ ID NO: 237872 - DNA, 20 bp, Artificial
  CRISPR gRNA sequence
tcagaactacccctgtcatt

SEQ ID NO: 237873 - DNA, 20 bp, Artificial
  CRISPR gRNA sequence
atatgtgactgtacttcaca

SEQ ID NO: 237874 - DNA, 20 bp, Artificial
  CRISPR gRNA sequence
tgactgtacttcacatagta

SEQ ID NO: 237875 - DNA, 20 bp, Artificial
  CRISPR gRNA sequence
atttgcccgaaactgatatg

SEQ ID NO: 237876 - DNA, 20 bp, Artificial
  CRISPR gRNA sequence
agatttaacacaattgttat

SEQ ID NO: 237877 - DNA, 20 bp, Artificial
  CRISPR gRNA sequence
cacaattgttatcagaatcc

SEQ ID NO: 237878 - DNA, 20 bp, Artificial
  CRISPR gRNA sequence
attgttatcagaatcccagc

SEQ ID NO: 237879 - DNA, 20 bp, Artificial
  CRISPR gRNA sequence
gaatcccagccggctttttg

SEQ ID NO: 237880 - DNA, 20 bp, Artificial
  CRISPR gRNA sequence
cagccggctttttgtagata

SEQ ID NO: 237881 - DNA, 20 bp, Artificial
  CRISPR gRNA sequence
atattatcctaaaatgtatg

SEQ ID NO: 237882 - DNA, 20 bp, Artificial
  CRISPR gRNA sequence
aaaatgtatgtggaaatgca

SEQ ID NO: 237883 - DNA, 20 bp, Artificial
  CRISPR gRNA sequence
aaatgtatgtggaaatgcaa

SEQ ID NO: 237884 - DNA, 20 bp, Artificial
  CRISPR gRNA sequence
atgtggaaatgcaaaggaac

SEQ ID NO: 237885 - DNA, 20 bp, Artificial
  CRISPR gRNA sequence
gaaatgcaaaggaactagaa

SEQ ID NO: 237886 - DNA, 20 bp, Artificial
  CRISPR gRNA sequence
aattttgaaatgaaataata

SEQ ID NO: 237887 - DNA, 20 bp, Artificial
  CRISPR gRNA sequence
tttgaaatgaaataataaag

SEQ ID NO: 237888 - DNA, 20 bp, Artificial
  CRISPR gRNA sequence
ttgaaatgaaataataaagt

SEQ ID NO: 237889 - DNA, 20 bp, Artificial
  CRISPR gRNA sequence
gaaatgaaataataaagtgg

SEQ ID NO: 237890 - DNA, 20 bp, Artificial
  CRISPR gRNA sequence
aatgaaataataaagtggga

SEQ ID NO: 237891 - DNA, 20 bp, Artificial
  CRISPR gRNA sequence
taccaccctctacccaattt

SEQ ID NO: 237892 - DNA, 20 bp, Artificial
  CRISPR gRNA sequence
tcagtatttatgtataacta

SEQ ID NO: 237893 - DNA, 20 bp, Artificial
  CRISPR gRNA sequence
tatgtataactacagtaatc

SEQ ID NO: 237894 - DNA, 20 bp, Artificial
  CRISPR gRNA sequence
atgtataactacagtaatca

SEQ ID NO: 237895 - DNA, 20 bp, Artificial
  CRISPR gRNA sequence
ctacagtaatcaaggctgtg

SEQ ID NO: 237896 - DNA, 20 bp, Artificial
  CRISPR gRNA sequence
taatcaaggctgtgtggtat

SEQ ID NO: 237897 - DNA, 20 bp, Artificial
  CRISPR gRNA sequence
tcaaggctgtgtggtattgg

SEQ ID NO: 237898 - DNA, 20 bp, Artificial
  CRISPR gRNA sequence
aggctgtgtggtattggcag

SEQ ID NO: 237899 - DNA, 20 bp, Artificial
  CRISPR gRNA sequence
ctgtgtggtattggcagaag

SEQ ID NO: 237900 - DNA, 20 bp, Artificial
  CRISPR gRNA sequence
ttggcagaagaagaaacaca

SEQ ID NO: 237901 - DNA, 20 bp, Artificial
  CRISPR gRNA sequence
agaagaaacacatggatcaa

SEQ ID NO: 237902 - DNA, 20 bp, Artificial
  CRISPR gRNA sequence
aaacacatggatcaatggaa

SEQ ID NO: 237903 - DNA, 20 bp, Artificial
  CRISPR gRNA sequence
cacatggatcaatggaacag

SEQ ID NO: 237904 - DNA, 20 bp, Artificial
  CRISPR gRNA sequence
catggatcaatggaacagaa

SEQ ID NO: 237905 - DNA, 20 bp, Artificial
  CRISPR gRNA sequence
atggatcaatggaacagaag

SEQ ID NO: 237906 - DNA, 20 bp, Artificial
  CRISPR gRNA sequence
tggatcaatggaacagaaga

SEQ ID NO: 237907 - DNA, 20 bp, Artificial
  CRISPR gRNA sequence
atggaacagaagagggaaac

SEQ ID NO: 237908 - DNA, 20 bp, Artificial
  CRISPR gRNA sequence
aacagaagagggaaaccaga

SEQ ID NO: 237909 - DNA, 20 bp, Artificial
  CRISPR gRNA sequence
cagatagccccacgtaattg

SEQ ID NO: 237910 - DNA, 20 bp, Artificial
  CRISPR gRNA sequence
gcagccaactgactttgaca

SEQ ID NO: 237911 - DNA, 20 bp, Artificial
  CRISPR gRNA sequence
cagccaactgactttgacaa

SEQ ID NO: 237912 - DNA, 20 bp, Artificial
  CRISPR gRNA sequence
actttgacaaaggtacaatg

SEQ ID NO: 237913 - DNA, 20 bp, Artificial
  CRISPR gRNA sequence
ctttgacaaaggtacaatga

SEQ ID NO: 237914 - DNA, 20 bp, Artificial
  CRISPR gRNA sequence
ggatgactaatgttttccac

SEQ ID NO: 237915 - DNA, 20 bp, Artificial
  CRISPR gRNA sequence
tgactaatgttttccactag

SEQ ID NO: 237916 - DNA, 20 bp, Artificial
  CRISPR gRNA sequence
atgttttccactagtggtgc

SEQ ID NO: 237917 - DNA, 20 bp, Artificial
  CRISPR gRNA sequence
gttttccactagtggtgcta

SEQ ID NO: 237918 - DNA, 20 bp, Artificial
  CRISPR gRNA sequence
actagtggtgctagagcaat

SEQ ID NO: 237919 - DNA, 20 bp, Artificial
  CRISPR gRNA sequence
ctagagcaattggacgtcca

SEQ ID NO: 237920 - DNA, 20 bp, Artificial
  CRISPR gRNA sequence
aaaaacaacaacaaaaaact

SEQ ID NO: 237921 - DNA, 20 bp, Artificial
  CRISPR gRNA sequence
cgaaaaatttaaaacgaatc

SEQ ID NO: 237922 - DNA, 20 bp, Artificial
  CRISPR gRNA sequence
aatttaaaacgaatcaagca

SEQ ID NO: 237923 - DNA, 20 bp, Artificial
  CRISPR gRNA sequence
atttaaaacgaatcaagcat

SEQ ID NO: 237924 - DNA, 20 bp, Artificial
  CRISPR gRNA sequence
aaacgaatcaagcatgggca

SEQ ID NO: 237925 - DNA, 20 bp, Artificial
  CRISPR gRNA sequence
cgaatcaagcatgggcacag

SEQ ID NO: 237926 - DNA, 20 bp, Artificial
  CRISPR gRNA sequence
gtggctcacacctgtaatcc

SEQ ID NO: 237927 - DNA, 20 bp, Artificial
  CRISPR gRNA sequence
cacctgtaatcccagcactt

SEQ ID NO: 237928 - DNA, 20 bp, Artificial
  CRISPR gRNA sequence
acctgtaatcccagcacttt

SEQ ID NO: 237929 - DNA, 20 bp, Artificial
  CRISPR gRNA sequence
ctgtaatcccagcactttgg

SEQ ID NO: 237930 - DNA, 20 bp, Artificial
  CRISPR gRNA sequence
tgtaatcccagcactttggg

SEQ ID NO: 237931 - DNA, 20 bp, Artificial
  CRISPR gRNA sequence
tcccagcactttgggaggcc

SEQ ID NO: 237932 - DNA, 20 bp, Artificial
  CRISPR gRNA sequence
cccagcactttgggaggcca

SEQ ID NO: 237933 - DNA, 20 bp, Artificial
  CRISPR gRNA sequence
agcactttgggaggccaagg

SEQ ID NO: 237934 - DNA, 20 bp, Artificial
  CRISPR gRNA sequence
gcactttgggaggccaaggc

SEQ ID NO: 237935 - DNA, 20 bp, Artificial
  CRISPR gRNA sequence
actttgggaggccaaggcag

SEQ ID NO: 237936 - DNA, 20 bp, Artificial
  CRISPR gRNA sequence
ctttgggaggccaaggcagg

SEQ ID NO: 237937 - DNA, 20 bp, Artificial
  CRISPR gRNA sequence
ccaaggcaggaggattgttt

SEQ ID NO: 237938 - DNA, 20 bp, Artificial
  CRISPR gRNA sequence
caaggcaggaggattgttta

SEQ ID NO: 237939 - DNA, 20 bp, Artificial
  CRISPR gRNA sequence
gcaggaggattgtttaaggc

SEQ ID NO: 237940 - DNA, 20 bp, Artificial
  CRISPR gRNA sequence
caggaggattgtttaaggcc

SEQ ID NO: 237941 - DNA, 20 bp, Artificial
  CRISPR gRNA sequence
ggaggattgtttaaggccag

SEQ ID NO: 237942 - DNA, 20 bp, Artificial
  CRISPR gRNA sequence
ttgtttaaggccaggagttc

SEQ ID NO: 237943 - DNA, 20 bp, Artificial
  CRISPR gRNA sequence
taaggccaggagttcaagac

SEQ ID NO: 237944 - DNA, 20 bp, Artificial
  CRISPR gRNA sequence
caggagttcaagaccagcct

SEQ ID NO: 237945 - DNA, 20 bp, Artificial
  CRISPR gRNA sequence
caagaccagcctgagcaaca

SEQ ID NO: 237946 - DNA, 20 bp, Artificial
  CRISPR gRNA sequence
accagcctgagcaacatggt

SEQ ID NO: 237947 - DNA, 20 bp, Artificial
  CRISPR gRNA sequence
aaataaaaaaaaaaattacc

SEQ ID NO: 237948 - DNA, 20 bp, Artificial
  CRISPR gRNA sequence
aataaaaaaaaaaattaccc

SEQ ID NO: 237949 - DNA, 20 bp, Artificial
  CRISPR gRNA sequence
aaaaaaattacccaggcatg

SEQ ID NO: 237950 - DNA, 20 bp, Artificial
  CRISPR gRNA sequence
aaaaattacccaggcatgca

SEQ ID NO: 237951 - DNA, 20 bp, Artificial
  CRISPR gRNA sequence
aaattacccaggcatgcaga

SEQ ID NO: 237952 - DNA, 20 bp, Artificial
  CRISPR gRNA sequence
cccaggcatgcagagagcca

SEQ ID NO: 237953 - DNA, 20 bp, Artificial
  CRISPR gRNA sequence
tgcagagagccaaagcccgt

SEQ ID NO: 237954 - DNA, 20 bp, Artificial
  CRISPR gRNA sequence
tgaccaactcaacattccac

SEQ ID NO: 237955 - DNA, 20 bp, Artificial
  CRISPR gRNA sequence
accaactcaacattccactg

SEQ ID NO: 237956 - DNA, 20 bp, Artificial
  CRISPR gRNA sequence
ccaactcaacattccactgg

SEQ ID NO: 237957 - DNA, 20 bp, Artificial
  CRISPR gRNA sequence
ctggaggctatatgatcaaa

SEQ ID NO: 237958 - DNA, 20 bp, Artificial
  CRISPR gRNA sequence
ggctatatgatcaaacagca

SEQ ID NO: 237959 - DNA, 20 bp, Artificial
  CRISPR gRNA sequence
aaagtgttcatcacgaatgc

SEQ ID NO: 237960 - DNA, 20 bp, Artificial
  CRISPR gRNA sequence
tcatcacgaatgcaagatgt

SEQ ID NO: 237961 - DNA, 20 bp, Artificial
  CRISPR gRNA sequence
cacactgccctgccaccaaa

SEQ ID NO: 237962 - DNA, 20 bp, Artificial
  CRISPR gRNA sequence
ctgccaccaaaaagtttgct

SEQ ID NO: 237963 - DNA, 20 bp, Artificial
  CRISPR gRNA sequence
tgccaccaaaaagtttgctg

SEQ ID NO: 237964 - DNA, 20 bp, Artificial
  CRISPR gRNA sequence
gccaccaaaaagtttgctga

SEQ ID NO: 237965 - DNA, 20 bp, Artificial
  CRISPR gRNA sequence
tgctgagggacgctactccc

SEQ ID NO: 237966 - DNA, 20 bp, Artificial
  CRISPR gRNA sequence
cgctactccctggctccttg

SEQ ID NO: 237967 - DNA, 20 bp, Artificial
  CRISPR gRNA sequence
gctccttgaagttatctatt

SEQ ID NO: 237968 - DNA, 20 bp, Artificial
  CRISPR gRNA sequence
aagttatctattgagaaatc

SEQ ID NO: 237969 - DNA, 20 bp, Artificial
  CRISPR gRNA sequence
aatctagcacctattgttca

SEQ ID NO: 237970 - DNA, 20 bp, Artificial
  CRISPR gRNA sequence
atctagcacctattgttcaa

SEQ ID NO: 237971 - DNA, 20 bp, Artificial
  CRISPR gRNA sequence
cacctattgttcaaaggatg

SEQ ID NO: 237972 - DNA, 20 bp, Artificial
  CRISPR gRNA sequence
ttcaaaggatgcagtctcac

SEQ ID NO: 237973 - DNA, 20 bp, Artificial
  CRISPR gRNA sequence
gctgtgaaccaaacaccaaa

SEQ ID NO: 237974 - DNA, 20 bp, Artificial
  CRISPR gRNA sequence
tctcttttgcctaataaata

SEQ ID NO: 237975 - DNA, 20 bp, Artificial
  CRISPR gRNA sequence
tcttttgcctaataaatacg

SEQ ID NO: 237976 - DNA, 20 bp, Artificial
  CRISPR gRNA sequence
cttttgcctaataaatacgg

SEQ ID NO: 237977 - DNA, 20 bp, Artificial
  CRISPR gRNA sequence
ttttgcctaataaatacgga

SEQ ID NO: 237978 - DNA, 20 bp, Artificial
  CRISPR gRNA sequence
taaatacggagggctgtgta

SEQ ID NO: 237979 - DNA, 20 bp, Artificial
  CRISPR gRNA sequence
acggagggctgtgtaaagct

SEQ ID NO: 237980 - DNA, 20 bp, Artificial
  CRISPR gRNA sequence
cggagggctgtgtaaagctc

SEQ ID NO: 237981 - DNA, 20 bp, Artificial
  CRISPR gRNA sequence
ggagggctgtgtaaagctca

SEQ ID NO: 237982 - DNA, 20 bp, Artificial
  CRISPR gRNA sequence
agctcagggcccttgtccac

SEQ ID NO: 237983 - DNA, 20 bp, Artificial
  CRISPR gRNA sequence
ctcagggcccttgtccacta

SEQ ID NO: 237984 - DNA, 20 bp, Artificial
  CRISPR gRNA sequence
tcagggcccttgtccactag

SEQ ID NO: 237985 - DNA, 20 bp, Artificial
  CRISPR gRNA sequence
ggcccttgtccactagaggc

SEQ ID NO: 237986 - DNA, 20 bp, Artificial
  CRISPR gRNA sequence
gcccttgtccactagaggca

SEQ ID NO: 237987 - DNA, 20 bp, Artificial
  CRISPR gRNA sequence
cgcttttgcccccctttgtt

SEQ ID NO: 237988 - DNA, 20 bp, Artificial
  CRISPR gRNA sequence
cccccctttgttcagtccaa

SEQ ID NO: 237989 - DNA, 20 bp, Artificial
  CRISPR gRNA sequence
ccccctttgttcagtccaat

SEQ ID NO: 237990 - DNA, 20 bp, Artificial
  CRISPR gRNA sequence
tgttcagtccaataggtcca

SEQ ID NO: 237991 - DNA, 20 bp, Artificial
  CRISPR gRNA sequence
cagtccaataggtccacagc

SEQ ID NO: 237992 - DNA, 20 bp, Artificial
  CRISPR gRNA sequence
aataggtccacagcaagtgc

SEQ ID NO: 237993 - DNA, 20 bp, Artificial
  CRISPR gRNA sequence
caagtgctggcacactcctg

SEQ ID NO: 237994 - DNA, 20 bp, Artificial
  CRISPR gRNA sequence
ctggcacactcctgtagtcc

SEQ ID NO: 237995 - DNA, 20 bp, Artificial
  CRISPR gRNA sequence
ctcctgtagtcccagctact

SEQ ID NO: 237996 - DNA, 20 bp, Artificial
  CRISPR gRNA sequence
tcctgtagtcccagctactt

SEQ ID NO: 237997 - DNA, 20 bp, Artificial
  CRISPR gRNA sequence
ctgtagtcccagctacttgg

SEQ ID NO: 237998 - DNA, 20 bp, Artificial
  CRISPR gRNA sequence
tgtagtcccagctacttggg

SEQ ID NO: 237999 - DNA, 20 bp, Artificial
  CRISPR gRNA sequence
tcccagctacttgggaggcc

SEQ ID NO: 238000 - DNA, 20 bp, Artificial
  CRISPR gRNA sequence
cccagctacttgggaggcca

SEQ ID NO: 238001 - DNA, 20 bp, Artificial
  CRISPR gRNA sequence
cagctacttgggaggccaag

SEQ ID NO: 238002 - DNA, 20 bp, Artificial
  CRISPR gRNA sequence
agctacttgggaggccaagg

SEQ ID NO: 238003 - DNA, 20 bp, Artificial
  CRISPR gRNA sequence
gctacttgggaggccaagga

SEQ ID NO: 238004 - DNA, 20 bp, Artificial
  CRISPR gRNA sequence
tacttgggaggccaaggagg

SEQ ID NO: 238005 - DNA, 20 bp, Artificial
  CRISPR gRNA sequence
acttgggaggccaaggaggg

SEQ ID NO: 238006 - DNA, 20 bp, Artificial
  CRISPR gRNA sequence
ccaaggagggaggatcactt

SEQ ID NO: 238007 - DNA, 20 bp, Artificial
  CRISPR gRNA sequence
gagggaggatcacttgagcc

SEQ ID NO: 238008 - DNA, 20 bp, Artificial
  CRISPR gRNA sequence
agggaggatcacttgagccc

SEQ ID NO: 238009 - DNA, 20 bp, Artificial
  CRISPR gRNA sequence
ggaggatcacttgagcccag

SEQ ID NO: 238010 - DNA, 20 bp, Artificial
  CRISPR gRNA sequence
gaggatcacttgagcccagg

SEQ ID NO: 238011 - DNA, 20 bp, Artificial
  CRISPR gRNA sequence
gatcacttgagcccaggagg

SEQ ID NO: 238012 - DNA, 20 bp, Artificial
  CRISPR gRNA sequence
tcacttgagcccaggaggtg

SEQ ID NO: 238013 - DNA, 20 bp, Artificial
  CRISPR gRNA sequence
cacttgagcccaggaggtgg

SEQ ID NO: 238014 - DNA, 20 bp, Artificial
  CRISPR gRNA sequence
agcccaggaggtggaggctg

SEQ ID NO: 238015 - DNA, 20 bp, Artificial
  CRISPR gRNA sequence
caggaggtggaggctgcagt

SEQ ID NO: 238016 - DNA, 20 bp, Artificial
  CRISPR gRNA sequence
atgatcacaccactgcactc

SEQ ID NO: 238017 - DNA, 20 bp, Artificial
  CRISPR gRNA sequence
cacaccactgcactccagcc

SEQ ID NO: 238018 - DNA, 20 bp, Artificial
  CRISPR gRNA sequence
acaccactgcactccagcct

SEQ ID NO: 238019 - DNA, 20 bp, Artificial
  CRISPR gRNA sequence
gcactccagcctgggtgaca

SEQ ID NO: 238020 - DNA, 20 bp, Artificial
  CRISPR gRNA sequence
ctccagcctgggtgacaaag

SEQ ID NO: 238021 - DNA, 20 bp, Artificial
  CRISPR gRNA sequence
ccagcctgggtgacaaagca

SEQ ID NO: 238022 - DNA, 20 bp, Artificial
  CRISPR gRNA sequence
acaaagcagagaccctgtct

SEQ ID NO: 238023 - DNA, 20 bp, Artificial
  CRISPR gRNA sequence
tgtctcagaaaaaaaaaatc

SEQ ID NO: 238024 - DNA, 20 bp, Artificial
  CRISPR gRNA sequence
atcaagatttaaatatgaaa

SEQ ID NO: 238025 - DNA, 20 bp, Artificial
  CRISPR gRNA sequence
tatgaaatagaaaactgtaa

SEQ ID NO: 238026 - DNA, 20 bp, Artificial
  CRISPR gRNA sequence
tagaaaactgtaaaagttat

SEQ ID NO: 238027 - DNA, 20 bp, Artificial
  CRISPR gRNA sequence
gaaaactgtaaaagttataa

SEQ ID NO: 238028 - DNA, 20 bp, Artificial
  CRISPR gRNA sequence
actgtaaaagttataagaga

SEQ ID NO: 238029 - DNA, 20 bp, Artificial
  CRISPR gRNA sequence
tgtaaaagttataagagata

SEQ ID NO: 238030 - DNA, 20 bp, Artificial
  CRISPR gRNA sequence
gtaaaagttataagagatag

SEQ ID NO: 238031 - DNA, 20 bp, Artificial
  CRISPR gRNA sequence
aaaaaaaaccctaaatcttt

SEQ ID NO: 238032 - DNA, 20 bp, Artificial
  CRISPR gRNA sequence
aaccctaaatctttgagacc

SEQ ID NO: 238033 - DNA, 20 bp, Artificial
  CRISPR gRNA sequence
accctaaatctttgagaccc

SEQ ID NO: 238034 - DNA, 20 bp, Artificial
  CRISPR gRNA sequence
aatctttgagacccaggact

SEQ ID NO: 238035 - DNA, 20 bp, Artificial
  CRISPR gRNA sequence
ttgagacccaggactcagtg

SEQ ID NO: 238036 - DNA, 20 bp, Artificial
  CRISPR gRNA sequence
aggactcagtgaagaattct

SEQ ID NO: 238037 - DNA, 20 bp, Artificial
  CRISPR gRNA sequence
aaatgaaaaaatccataaac

SEQ ID NO: 238038 - DNA, 20 bp, Artificial
  CRISPR gRNA sequence
aaaatccataaactggactt

SEQ ID NO: 238039 - DNA, 20 bp, Artificial
  CRISPR gRNA sequence
tggacttcagcaaaattaaa

SEQ ID NO: 238040 - DNA, 20 bp, Artificial
  CRISPR gRNA sequence
aattaaatagcttttctctg

SEQ ID NO: 238041 - DNA, 20 bp, Artificial
  CRISPR gRNA sequence
taaatagcttttctctgtgg

SEQ ID NO: 238042 - DNA, 20 bp, Artificial
  CRISPR gRNA sequence
aatagcttttctctgtggaa

SEQ ID NO: 238043 - DNA, 20 bp, Artificial
  CRISPR gRNA sequence
ttttctctgtggaagagcct

SEQ ID NO: 238044 - DNA, 20 bp, Artificial
  CRISPR gRNA sequence
tctctgtggaagagcctgag

SEQ ID NO: 238045 - DNA, 20 bp, Artificial
  CRISPR gRNA sequence
tctgtggaagagcctgagaa

SEQ ID NO: 238046 - DNA, 20 bp, Artificial
  CRISPR gRNA sequence
ctgtggaagagcctgagaag

SEQ ID NO: 238047 - DNA, 20 bp, Artificial
  CRISPR gRNA sequence
gagcctgagaagaggatgaa

SEQ ID NO: 238048 - DNA, 20 bp, Artificial
  CRISPR gRNA sequence
agcctgagaagaggatgaaa

SEQ ID NO: 238049 - DNA, 20 bp, Artificial
  CRISPR gRNA sequence
tgagaagaggatgaaaaggc

SEQ ID NO: 238050 - DNA, 20 bp, Artificial
  CRISPR gRNA sequence
tgaaaaggcaagctactgac

SEQ ID NO: 238051 - DNA, 20 bp, Artificial
  CRISPR gRNA sequence
gaaaaggcaagctactgact

SEQ ID NO: 238052 - DNA, 20 bp, Artificial
  CRISPR gRNA sequence
aaaggcaagctactgactgg

SEQ ID NO: 238053 - DNA, 20 bp, Artificial
  CRISPR gRNA sequence
tataaaccatatatatgcca

SEQ ID NO: 238054 - DNA, 20 bp, Artificial
  CRISPR gRNA sequence
ataaaccatatatatgccaa

SEQ ID NO: 238055 - DNA, 20 bp, Artificial
  CRISPR gRNA sequence
tatgccaaaggactcctatc

SEQ ID NO: 238056 - DNA, 20 bp, Artificial
  CRISPR gRNA sequence
atgccaaaggactcctatct

SEQ ID NO: 238057 - DNA, 20 bp, Artificial
  CRISPR gRNA sequence
actcctatctgggaaatacg

SEQ ID NO: 238058 - DNA, 20 bp, Artificial
  CRISPR gRNA sequence
gaagaactcttgaatctcaa

SEQ ID NO: 238059 - DNA, 20 bp, Artificial
  CRISPR gRNA sequence
aaacaaacaaataatccaac

SEQ ID NO: 238060 - DNA, 20 bp, Artificial
  CRISPR gRNA sequence
caaataatccaactagaaaa

SEQ ID NO: 238061 - DNA, 20 bp, Artificial
  CRISPR gRNA sequence
aaataatccaactagaaaat

SEQ ID NO: 238062 - DNA, 20 bp, Artificial
  CRISPR gRNA sequence
tccaactagaaaataggtga

SEQ ID NO: 238063 - DNA, 20 bp, Artificial
  CRISPR gRNA sequence
acctgaacaacacttcactg

SEQ ID NO: 238064 - DNA, 20 bp, Artificial
  CRISPR gRNA sequence
tgaacaacacttcactgaag

SEQ ID NO: 238065 - DNA, 20 bp, Artificial
  CRISPR gRNA sequence
acttcactgaagaagatata

SEQ ID NO: 238066 - DNA, 20 bp, Artificial
  CRISPR gRNA sequence
cactgaagaagatataaaga

SEQ ID NO: 238067 - DNA, 20 bp, Artificial
  CRISPR gRNA sequence
aagatataaagatggaaaat

SEQ ID NO: 238068 - DNA, 20 bp, Artificial
  CRISPR gRNA sequence
atggaaaataagcacatgaa

SEQ ID NO: 238069 - DNA, 20 bp, Artificial
  CRISPR gRNA sequence
atgaaaagatgtccacccat

SEQ ID NO: 238070 - DNA, 20 bp, Artificial
  CRISPR gRNA sequence
tgaaaagatgtccacccata

SEQ ID NO: 238071 - DNA, 20 bp, Artificial
  CRISPR gRNA sequence
gaaaagatgtccacccataa

SEQ ID NO: 238072 - DNA, 20 bp, Artificial
  CRISPR gRNA sequence
aagatgtccacccataaggg

SEQ ID NO: 238073 - DNA, 20 bp, Artificial
  CRISPR gRNA sequence
cataagggaagtgcaaatta

SEQ ID NO: 238074 - DNA, 20 bp, Artificial
  CRISPR gRNA sequence
gtgcaaattaaagccccaat

SEQ ID NO: 238075 - DNA, 20 bp, Artificial
  CRISPR gRNA sequence
agatgtcactacatacctat

SEQ ID NO: 238076 - DNA, 20 bp, Artificial
  CRISPR gRNA sequence
tcactacatacctattagaa

SEQ ID NO: 238077 - DNA, 20 bp, Artificial
  CRISPR gRNA sequence
aacagctgaaataaaaattg

SEQ ID NO: 238078 - DNA, 20 bp, Artificial
  CRISPR gRNA sequence
attgtggcaatgcaaaatgc

SEQ ID NO: 238079 - DNA, 20 bp, Artificial
  CRISPR gRNA sequence
tggcaatgcaaaatgcaagc

SEQ ID NO: 238080 - DNA, 20 bp, Artificial
  CRISPR gRNA sequence
ggcaatgcaaaatgcaagca

SEQ ID NO: 238081 - DNA, 20 bp, Artificial
  CRISPR gRNA sequence
gcaaaatgcaagcaaggatg

SEQ ID NO: 238082 - DNA, 20 bp, Artificial
  CRISPR gRNA sequence
aaaatgcaagcaaggatgca

SEQ ID NO: 238083 - DNA, 20 bp, Artificial
  CRISPR gRNA sequence
ggatgcagagaaactccgat

SEQ ID NO: 238084 - DNA, 20 bp, Artificial
  CRISPR gRNA sequence
gtaaaatgatacacttcctc

SEQ ID NO: 238085 - DNA, 20 bp, Artificial
  CRISPR gRNA sequence
gatacacttcctctggaaaa

SEQ ID NO: 238086 - DNA, 20 bp, Artificial
  CRISPR gRNA sequence
caacttcttaaaaactaaac

SEQ ID NO: 238087 - DNA, 20 bp, Artificial
  CRISPR gRNA sequence
ctaaacaagcaccaaacata

SEQ ID NO: 238088 - DNA, 20 bp, Artificial
  CRISPR gRNA sequence
caagcaccaaacatatagcc

SEQ ID NO: 238089 - DNA, 20 bp, Artificial
  CRISPR gRNA sequence
agcccagcaattgcactcct

SEQ ID NO: 238090 - DNA, 20 bp, Artificial
  CRISPR gRNA sequence
gcactcctgagcatttatca

SEQ ID NO: 238091 - DNA, 20 bp, Artificial
  CRISPR gRNA sequence
actcctgagcatttatcata

SEQ ID NO: 238092 - DNA, 20 bp, Artificial
  CRISPR gRNA sequence
ctgtacataattattcctcg

SEQ ID NO: 238093 - DNA, 20 bp, Artificial
  CRISPR gRNA sequence
cctcgcagctttatatgtaa

SEQ ID NO: 238094 - DNA, 20 bp, Artificial
  CRISPR gRNA sequence
tttatatgtaatagtcaaaa

SEQ ID NO: 238095 - DNA, 20 bp, Artificial
  CRISPR gRNA sequence
ttatatgtaatagtcaaaac

SEQ ID NO: 238096 - DNA, 20 bp, Artificial
  CRISPR gRNA sequence
tatgtaatagtcaaaacagg

SEQ ID NO: 238097 - DNA, 20 bp, Artificial
  CRISPR gRNA sequence
gcaaacaaaatatcttttaa

SEQ ID NO: 238098 - DNA, 20 bp, Artificial
  CRISPR gRNA sequence
caaacaaaatatcttttaat

SEQ ID NO: 238099 - DNA, 20 bp, Artificial
  CRISPR gRNA sequence
aatatcttttaatgggtgca

SEQ ID NO: 238100 - DNA, 20 bp, Artificial
  CRISPR gRNA sequence
gtgcatggtaaaacaaactg

SEQ ID NO: 238101 - DNA, 20 bp, Artificial
  CRISPR gRNA sequence
ggtaaaacaaactgtggcac

SEQ ID NO: 238102 - DNA, 20 bp, Artificial
  CRISPR gRNA sequence
actgtggcacaagcatatcg

SEQ ID NO: 238103 - DNA, 20 bp, Artificial
  CRISPR gRNA sequence
gcatatcgtggaatactatt

SEQ ID NO: 238104 - DNA, 20 bp, Artificial
  CRISPR gRNA sequence
atcgtggaatactattcagc

SEQ ID NO: 238105 - DNA, 20 bp, Artificial
  CRISPR gRNA sequence
tcgtggaatactattcagca

SEQ ID NO: 238106 - DNA, 20 bp, Artificial
  CRISPR gRNA sequence
aatactattcagcaaggaaa

SEQ ID NO: 238107 - DNA, 20 bp, Artificial
  CRISPR gRNA sequence
gaattaaccattgaaacaca

SEQ ID NO: 238108 - DNA, 20 bp, Artificial
  CRISPR gRNA sequence
cattgaaacacacagcaact

SEQ ID NO: 238109 - DNA, 20 bp, Artificial
  CRISPR gRNA sequence
gaaacacacagcaacttgga

SEQ ID NO: 238110 - DNA, 20 bp, Artificial
  CRISPR gRNA sequence
cagcaacttggatggatatc

SEQ ID NO: 238111 - DNA, 20 bp, Artificial
  CRISPR gRNA sequence
agcaacttggatggatatca

SEQ ID NO: 238112 - DNA, 20 bp, Artificial
  CRISPR gRNA sequence
gcaacttggatggatatcaa

SEQ ID NO: 238113 - DNA, 20 bp, Artificial
  CRISPR gRNA sequence
gatatcaagggcattgtgct

SEQ ID NO: 238114 - DNA, 20 bp, Artificial
  CRISPR gRNA sequence
gggcattgtgctgagtgaaa

SEQ ID NO: 238115 - DNA, 20 bp, Artificial
  CRISPR gRNA sequence
aaaaagcaaaatcttaaaaa

SEQ ID NO: 238116 - DNA, 20 bp, Artificial
  CRISPR gRNA sequence
aaaaaagttcacgtttgtga

SEQ ID NO: 238117 - DNA, 20 bp, Artificial
  CRISPR gRNA sequence
ttcacgtttgtgaaagttgt

SEQ ID NO: 238118 - DNA, 20 bp, Artificial
  CRISPR gRNA sequence
gaaagttgtcagaatcaaaa

SEQ ID NO: 238119 - DNA, 20 bp, Artificial
  CRISPR gRNA sequence
aagttgtcagaatcaaaatg

SEQ ID NO: 238120 - DNA, 20 bp, Artificial
  CRISPR gRNA sequence
tgtgtcaaaaccctgacaaa

SEQ ID NO: 238121 - DNA, 20 bp, Artificial
  CRISPR gRNA sequence
gtgtcaaaaccctgacaaat

SEQ ID NO: 238122 - DNA, 20 bp, Artificial
  CRISPR gRNA sequence
caaaaccctgacaaatgggc

SEQ ID NO: 238123 - DNA, 20 bp, Artificial
  CRISPR gRNA sequence
aaaaccctgacaaatgggcc

SEQ ID NO: 238124 - DNA, 20 bp, Artificial
  CRISPR gRNA sequence
cctgacaaatgggccgggca

SEQ ID NO: 238125 - DNA, 20 bp, Artificial
  CRISPR gRNA sequence
gacaaatgggccgggcatgg

SEQ ID NO: 238126 - DNA, 20 bp, Artificial
  CRISPR gRNA sequence
gtggctcatgcctgtaatcc

SEQ ID NO: 238127 - DNA, 20 bp, Artificial
  CRISPR gRNA sequence
tgcctgtaatcccagcactt

SEQ ID NO: 238128 - DNA, 20 bp, Artificial
  CRISPR gRNA sequence
gcctgtaatcccagcacttt

SEQ ID NO: 238129 - DNA, 20 bp, Artificial
  CRISPR gRNA sequence
ctgtaatcccagcactttgg

SEQ ID NO: 238130 - DNA, 20 bp, Artificial
  CRISPR gRNA sequence
tcccagcactttgggagact

SEQ ID NO: 238131 - DNA, 20 bp, Artificial
  CRISPR gRNA sequence
cccagcactttgggagactg

SEQ ID NO: 238132 - DNA, 20 bp, Artificial
  CRISPR gRNA sequence
agcactttgggagactgagg

SEQ ID NO: 238133 - DNA, 20 bp, Artificial
  CRISPR gRNA sequence
gcactttgggagactgaggc

SEQ ID NO: 238134 - DNA, 20 bp, Artificial
  CRISPR gRNA sequence
ctttgggagactgaggcagg

SEQ ID NO: 238135 - DNA, 20 bp, Artificial
  CRISPR gRNA sequence
ctgaggcaggcagatcacat

SEQ ID NO: 238136 - DNA, 20 bp, Artificial
  CRISPR gRNA sequence
tgaggcaggcagatcacatg

SEQ ID NO: 238137 - DNA, 20 bp, Artificial
  CRISPR gRNA sequence
gcaggcagatcacatgaggc

SEQ ID NO: 238138 - DNA, 20 bp, Artificial
  CRISPR gRNA sequence
caggcagatcacatgaggcc

SEQ ID NO: 238139 - DNA, 20 bp, Artificial
  CRISPR gRNA sequence
ggcagatcacatgaggccag

SEQ ID NO: 238140 - DNA, 20 bp, Artificial
  CRISPR gRNA sequence
tcacatgaggccaggagttc

SEQ ID NO: 238141 - DNA, 20 bp, Artificial
  CRISPR gRNA sequence
tgaggccaggagttcaagac

SEQ ID NO: 238142 - DNA, 20 bp, Artificial
  CRISPR gRNA sequence
ccaggagttcaagaccagcc

SEQ ID NO: 238143 - DNA, 20 bp, Artificial
  CRISPR gRNA sequence
caagaccagcctggccaacg

SEQ ID NO: 238144 - DNA, 20 bp, Artificial
  CRISPR gRNA sequence
gcaaaaccccgtctctacta

SEQ ID NO: 238145 - DNA, 20 bp, Artificial
  CRISPR gRNA sequence
aaccccgtctctactatagc

SEQ ID NO: 238146 - DNA, 20 bp, Artificial
  CRISPR gRNA sequence
accccgtctctactatagcc

SEQ ID NO: 238147 - DNA, 20 bp, Artificial
  CRISPR gRNA sequence
gtctctactatagccgggca

SEQ ID NO: 238148 - DNA, 20 bp, Artificial
  CRISPR gRNA sequence
tctactatagccgggcatgg

SEQ ID NO: 238149 - DNA, 20 bp, Artificial
  CRISPR gRNA sequence
actatagccgggcatggtgg

SEQ ID NO: 238150 - DNA, 20 bp, Artificial
  CRISPR gRNA sequence
gtggcagctgcctgtaatcc

SEQ ID NO: 238151 - DNA, 20 bp, Artificial
  CRISPR gRNA sequence
tgcctgtaatcccagctact

SEQ ID NO: 238152 - DNA, 20 bp, Artificial
  CRISPR gRNA sequence
gcctgtaatcccagctactc

SEQ ID NO: 238153 - DNA, 20 bp, Artificial
  CRISPR gRNA sequence
ctgtaatcccagctactcag

SEQ ID NO: 238154 - DNA, 20 bp, Artificial
  CRISPR gRNA sequence
tgtaatcccagctactcagg

SEQ ID NO: 238155 - DNA, 20 bp, Artificial
  CRISPR gRNA sequence
tcccagctactcaggaggct

SEQ ID NO: 238156 - DNA, 20 bp, Artificial
  CRISPR gRNA sequence
cccagctactcaggaggctg

SEQ ID NO: 238157 - DNA, 20 bp, Artificial
  CRISPR gRNA sequence
ggctgaggcacgaaaatcgc

SEQ ID NO: 238158 - DNA, 20 bp, Artificial
  CRISPR gRNA sequence
gcacgaaaatcgctggaacc

SEQ ID NO: 238159 - DNA, 20 bp, Artificial
  CRISPR gRNA sequence
cacgaaaatcgctggaaccc

SEQ ID NO: 238160 - DNA, 20 bp, Artificial
  CRISPR gRNA sequence
cgaaaatcgctggaacccag

SEQ ID NO: 238161 - DNA, 20 bp, Artificial
  CRISPR gRNA sequence
gaaaatcgctggaacccagg

SEQ ID NO: 238162 - DNA, 20 bp, Artificial
  CRISPR gRNA sequence
aatcgctggaacccaggagg

SEQ ID NO: 238163 - DNA, 20 bp, Artificial
  CRISPR gRNA sequence
tcgctggaacccaggaggcg

SEQ ID NO: 238164 - DNA, 20 bp, Artificial
  CRISPR gRNA sequence
cgctggaacccaggaggcgg

SEQ ID NO: 238165 - DNA, 20 bp, Artificial
  CRISPR gRNA sequence
aacccaggaggcggaggttg

SEQ ID NO: 238166 - DNA, 20 bp, Artificial
  CRISPR gRNA sequence
caggaggcggaggttgcagc

SEQ ID NO: 238167 - DNA, 20 bp, Artificial
  CRISPR gRNA sequence
gaggcggaggttgcagcgag

SEQ ID NO: 238168 - DNA, 20 bp, Artificial
  CRISPR gRNA sequence
ggcggaggttgcagcgagtg

SEQ ID NO: 238169 - DNA, 20 bp, Artificial
  CRISPR gRNA sequence
gagatcacgccactgcactc

SEQ ID NO: 238170 - DNA, 20 bp, Artificial
  CRISPR gRNA sequence
gcactccagcctgaatgaca

SEQ ID NO: 238171 - DNA, 20 bp, Artificial
  CRISPR gRNA sequence
cactccagcctgaatgacac

SEQ ID NO: 238172 - DNA, 20 bp, Artificial
  CRISPR gRNA sequence
actccagcctgaatgacaca

SEQ ID NO: 238173 - DNA, 20 bp, Artificial
  CRISPR gRNA sequence
tccagcctgaatgacacagg

SEQ ID NO: 238174 - DNA, 20 bp, Artificial
  CRISPR gRNA sequence
caaacaaaaaccctgacaaa

SEQ ID NO: 238175 - DNA, 20 bp, Artificial
  CRISPR gRNA sequence
aacaaaaaccctgacaaatg

SEQ ID NO: 238176 - DNA, 20 bp, Artificial
  CRISPR gRNA sequence
aaaaccctgacaaatggagc

SEQ ID NO: 238177 - DNA, 20 bp, Artificial
  CRISPR gRNA sequence
aaaccctgacaaatggagcc

SEQ ID NO: 238178 - DNA, 20 bp, Artificial
  CRISPR gRNA sequence
aaccctgacaaatggagcca

SEQ ID NO: 238179 - DNA, 20 bp, Artificial
  CRISPR gRNA sequence
cctgacaaatggagccaggg

SEQ ID NO: 238180 - DNA, 20 bp, Artificial
  CRISPR gRNA sequence
ctgacaaatggagccaggga

SEQ ID NO: 238181 - DNA, 20 bp, Artificial
  CRISPR gRNA sequence
tggagccagggaaggccgtg

SEQ ID NO: 238182 - DNA, 20 bp, Artificial
  CRISPR gRNA sequence
ggagccagggaaggccgtga

SEQ ID NO: 238183 - DNA, 20 bp, Artificial
  CRISPR gRNA sequence
gagccagggaaggccgtgaa

SEQ ID NO: 238184 - DNA, 20 bp, Artificial
  CRISPR gRNA sequence
agccagggaaggccgtgaag

SEQ ID NO: 238185 - DNA, 20 bp, Artificial
  CRISPR gRNA sequence
gccagggaaggccgtgaagg

SEQ ID NO: 238186 - DNA, 20 bp, Artificial
  CRISPR gRNA sequence
gataaaaacaactatcacaa

SEQ ID NO: 238187 - DNA, 20 bp, Artificial
  CRISPR gRNA sequence
aaaacaactatcacaaaaga

SEQ ID NO: 238188 - DNA, 20 bp, Artificial
  CRISPR gRNA sequence
acaactatcacaaaagatgg

SEQ ID NO: 238189 - DNA, 20 bp, Artificial
  CRISPR gRNA sequence
agaaaccacaaccttgcacc

SEQ ID NO: 238190 - DNA, 20 bp, Artificial
  CRISPR gRNA sequence
gaaaccacaaccttgcacca

SEQ ID NO: 238191 - DNA, 20 bp, Artificial
  CRISPR gRNA sequence
taacaaaaaaatacttctgc

SEQ ID NO: 238192 - DNA, 20 bp, Artificial
  CRISPR gRNA sequence
tctgccggtattgatctttg

SEQ ID NO: 238193 - DNA, 20 bp, Artificial
  CRISPR gRNA sequence
cggtattgatctttgtagca

SEQ ID NO: 238194 - DNA, 20 bp, Artificial
  CRISPR gRNA sequence
ggtattgatctttgtagcaa

SEQ ID NO: 238195 - DNA, 20 bp, Artificial
  CRISPR gRNA sequence
ataacttacataaccctcct

SEQ ID NO: 238196 - DNA, 20 bp, Artificial
  CRISPR gRNA sequence
tttttttttttttttttttt

SEQ ID NO: 238197 - DNA, 20 bp, Artificial
  CRISPR gRNA sequence
ttttttttttttttttgaga

SEQ ID NO: 238198 - DNA, 20 bp, Artificial
  CRISPR gRNA sequence
ttttttttttttttgagaca

SEQ ID NO: 238199 - DNA, 20 bp, Artificial
  CRISPR gRNA sequence
cagagtcttgctctgtcgcc

SEQ ID NO: 238200 - DNA, 20 bp, Artificial
  CRISPR gRNA sequence
agagtcttgctctgtcgccc

SEQ ID NO: 238201 - DNA, 20 bp, Artificial
  CRISPR gRNA sequence
tcttgctctgtcgcccaggc

SEQ ID NO: 238202 - DNA, 20 bp, Artificial
  CRISPR gRNA sequence
ttgctctgtcgcccaggctg

SEQ ID NO: 238203 - DNA, 20 bp, Artificial
  CRISPR gRNA sequence
ctgtcgcccaggctggagtg

SEQ ID NO: 238204 - DNA, 20 bp, Artificial
  CRISPR gRNA sequence
gcccaggctggagtgaagtg

SEQ ID NO: 238205 - DNA, 20 bp, Artificial
  CRISPR gRNA sequence
cccaggctggagtgaagtgc

SEQ ID NO: 238206 - DNA, 20 bp, Artificial
  CRISPR gRNA sequence
tgaagtgcaggatgcgatat

SEQ ID NO: 238207 - DNA, 20 bp, Artificial
  CRISPR gRNA sequence
tcactgcaacctccgcctcc

SEQ ID NO: 238208 - DNA, 20 bp, Artificial
  CRISPR gRNA sequence
cactgcaacctccgcctccc

SEQ ID NO: 238209 - DNA, 20 bp, Artificial
  CRISPR gRNA sequence
aacctccgcctcccaggttc

SEQ ID NO: 238210 - DNA, 20 bp, Artificial
  CRISPR gRNA sequence
ttcaagtaattcttgtgcct

SEQ ID NO: 238211 - DNA, 20 bp, Artificial
  CRISPR gRNA sequence
ttcttgtgcctcagcctccc

SEQ ID NO: 238212 - DNA, 20 bp, Artificial
  CRISPR gRNA sequence
gcctcagcctcccaagtatc

SEQ ID NO: 238213 - DNA, 20 bp, Artificial
  CRISPR gRNA sequence
cctcagcctcccaagtatct

SEQ ID NO: 238214 - DNA, 20 bp, Artificial
  CRISPR gRNA sequence
ctcccaagtatctgggatta

SEQ ID NO: 238215 - DNA, 20 bp, Artificial
  CRISPR gRNA sequence
tcccaagtatctgggattac

SEQ ID NO: 238216 - DNA, 20 bp, Artificial
  CRISPR gRNA sequence
tacaggcacgtgccaccatg

SEQ ID NO: 238217 - DNA, 20 bp, Artificial
  CRISPR gRNA sequence
acaggcacgtgccaccatgc

SEQ ID NO: 238218 - DNA, 20 bp, Artificial
  CRISPR gRNA sequence
caggcacgtgccaccatgca

SEQ ID NO: 238219 - DNA, 20 bp, Artificial
  CRISPR gRNA sequence
gggctaactttttgtatttt

SEQ ID NO: 238220 - DNA, 20 bp, Artificial
  CRISPR gRNA sequence
ctaactttttgtatttttag

SEQ ID NO: 238221 - DNA, 20 bp, Artificial
  CRISPR gRNA sequence
aactttttgtatttttagta

SEQ ID NO: 238222 - DNA, 20 bp, Artificial
  CRISPR gRNA sequence
ttttgtatttttagtagaga

SEQ ID NO: 238223 - DNA, 20 bp, Artificial
  CRISPR gRNA sequence
tttgtatttttagtagagat

SEQ ID NO: 238224 - DNA, 20 bp, Artificial
  CRISPR gRNA sequence
ttgtatttttagtagagatg

SEQ ID NO: 238225 - DNA, 20 bp, Artificial
  CRISPR gRNA sequence
gagatggggtttcaccatgt

SEQ ID NO: 238226 - DNA, 20 bp, Artificial
  CRISPR gRNA sequence
tggggtttcaccatgttggc

SEQ ID NO: 238227 - DNA, 20 bp, Artificial
  CRISPR gRNA sequence
ggggtttcaccatgttggcc

SEQ ID NO: 238228 - DNA, 20 bp, Artificial
  CRISPR gRNA sequence
tttcaccatgttggccaggc

SEQ ID NO: 238229 - DNA, 20 bp, Artificial
  CRISPR gRNA sequence
tggtctcgaactcctgacct

SEQ ID NO: 238230 - DNA, 20 bp, Artificial
  CRISPR gRNA sequence
ggtctcgaactcctgacctc

SEQ ID NO: 238231 - DNA, 20 bp, Artificial
  CRISPR gRNA sequence
ctcaggtgatccatccgcct

SEQ ID NO: 238232 - DNA, 20 bp, Artificial
  CRISPR gRNA sequence
ccatccgcctcagcctccca

SEQ ID NO: 238233 - DNA, 20 bp, Artificial
  CRISPR gRNA sequence
gcctcagcctcccaaagcgc

SEQ ID NO: 238234 - DNA, 20 bp, Artificial
  CRISPR gRNA sequence
cctcagcctcccaaagcgct

SEQ ID NO: 238235 - DNA, 20 bp, Artificial
  CRISPR gRNA sequence
ctcccaaagcgctgggatta

SEQ ID NO: 238236 - DNA, 20 bp, Artificial
  CRISPR gRNA sequence
tcccaaagcgctgggattat

SEQ ID NO: 238237 - DNA, 20 bp, Artificial
  CRISPR gRNA sequence
agcgctgggattataggcat

SEQ ID NO: 238238 - DNA, 20 bp, Artificial
  CRISPR gRNA sequence
cctgaaaaaatataatcttt

SEQ ID NO: 238239 - DNA, 20 bp, Artificial
  CRISPR gRNA sequence
tgaaaaaatataatctttta

SEQ ID NO: 238240 - DNA, 20 bp, Artificial
  CRISPR gRNA sequence
aaaaaatataatcttttaga

SEQ ID NO: 238241 - DNA, 20 bp, Artificial
  CRISPR gRNA sequence
aaaaatataatcttttagag

SEQ ID NO: 238242 - DNA, 20 bp, Artificial
  CRISPR gRNA sequence
ggctctctctatctatgatt

SEQ ID NO: 238243 - DNA, 20 bp, Artificial
  CRISPR gRNA sequence
ccatattccttaaataacaa

SEQ ID NO: 238244 - DNA, 20 bp, Artificial
  CRISPR gRNA sequence
ttccttaaataacaaaagta

SEQ ID NO: 238245 - DNA, 20 bp, Artificial
  CRISPR gRNA sequence
ccttaaataacaaaagtata

SEQ ID NO: 238246 - DNA, 20 bp, Artificial
  CRISPR gRNA sequence
taacaaaagtatagagatga

SEQ ID NO: 238247 - DNA, 20 bp, Artificial
  CRISPR gRNA sequence
aaaagtatagagatgaaaga

SEQ ID NO: 238248 - DNA, 20 bp, Artificial
  CRISPR gRNA sequence
tatagagatgaaagacagat

SEQ ID NO: 238249 - DNA, 20 bp, Artificial
  CRISPR gRNA sequence
agagatgaaagacagataag

SEQ ID NO: 238250 - DNA, 20 bp, Artificial
  CRISPR gRNA sequence
aaagacagataagtggttgc

SEQ ID NO: 238251 - DNA, 20 bp, Artificial
  CRISPR gRNA sequence
aagacagataagtggttgcc

SEQ ID NO: 238252 - DNA, 20 bp, Artificial
  CRISPR gRNA sequence
agacagataagtggttgcca

SEQ ID NO: 238253 - DNA, 20 bp, Artificial
  CRISPR gRNA sequence
gacagataagtggttgccag

SEQ ID NO: 238254 - DNA, 20 bp, Artificial
  CRISPR gRNA sequence
gataagtggttgccagggga

SEQ ID NO: 238255 - DNA, 20 bp, Artificial
  CRISPR gRNA sequence
aagtggttgccaggggatgg

SEQ ID NO: 238256 - DNA, 20 bp, Artificial
  CRISPR gRNA sequence
agtggttgccaggggatggt

SEQ ID NO: 238257 - DNA, 20 bp, Artificial
  CRISPR gRNA sequence
gtggttgccaggggatggtg

SEQ ID NO: 238258 - DNA, 20 bp, Artificial
  CRISPR gRNA sequence
ggttgccaggggatggtggg

SEQ ID NO: 238259 - DNA, 20 bp, Artificial
  CRISPR gRNA sequence
ttgccaggggatggtgggga

SEQ ID NO: 238260 - DNA, 20 bp, Artificial
  CRISPR gRNA sequence
tgccaggggatggtggggag

SEQ ID NO: 238261 - DNA, 20 bp, Artificial
  CRISPR gRNA sequence
caggggatggtggggagagg

SEQ ID NO: 238262 - DNA, 20 bp, Artificial
  CRISPR gRNA sequence
ggggatggtggggagaggta

SEQ ID NO: 238263 - DNA, 20 bp, Artificial
  CRISPR gRNA sequence
gggatggtggggagaggtag

SEQ ID NO: 238264 - DNA, 20 bp, Artificial
  CRISPR gRNA sequence
ggagaggtagaggacctaac

SEQ ID NO: 238265 - DNA, 20 bp, Artificial
  CRISPR gRNA sequence
aggtagaggacctaactaga

SEQ ID NO: 238266 - DNA, 20 bp, Artificial
  CRISPR gRNA sequence
ggtagaggacctaactagaa

SEQ ID NO: 238267 - DNA, 20 bp, Artificial
  CRISPR gRNA sequence
aggacctaactagaaaggaa

SEQ ID NO: 238268 - DNA, 20 bp, Artificial
  CRISPR gRNA sequence
acctaactagaaaggaatag

SEQ ID NO: 238269 - DNA, 20 bp, Artificial
  CRISPR gRNA sequence
taactagaaaggaatagtgg

SEQ ID NO: 238270 - DNA, 20 bp, Artificial
  CRISPR gRNA sequence
aactagaaaggaatagtgga

SEQ ID NO: 238271 - DNA, 20 bp, Artificial
  CRISPR gRNA sequence
ctagaaaggaatagtggaag

SEQ ID NO: 238272 - DNA, 20 bp, Artificial
  CRISPR gRNA sequence
atagtggaaggagatctctg

SEQ ID NO: 238273 - DNA, 20 bp, Artificial
  CRISPR gRNA sequence
gaaggagatctctgtggtga

SEQ ID NO: 238274 - DNA, 20 bp, Artificial
  CRISPR gRNA sequence
gagatctctgtggtgatgga

SEQ ID NO: 238275 - DNA, 20 bp, Artificial
  CRISPR gRNA sequence
tagttctgattttattgtgc

SEQ ID NO: 238276 - DNA, 20 bp, Artificial
  CRISPR gRNA sequence
acaactccacatgtgtgata

SEQ ID NO: 238277 - DNA, 20 bp, Artificial
  CRISPR gRNA sequence
caactccacatgtgtgataa

SEQ ID NO: 238278 - DNA, 20 bp, Artificial
  CRISPR gRNA sequence
aactccacatgtgtgataaa

SEQ ID NO: 238279 - DNA, 20 bp, Artificial
  CRISPR gRNA sequence
ttcctgctttgccattgtac

SEQ ID NO: 238280 - DNA, 20 bp, Artificial
  CRISPR gRNA sequence
cctgctttgccattgtactg

SEQ ID NO: 238281 - DNA, 20 bp, Artificial
  CRISPR gRNA sequence
tttgccattgtactggagaa

SEQ ID NO: 238282 - DNA, 20 bp, Artificial
  CRISPR gRNA sequence
ttgtactggagaatggaacc

SEQ ID NO: 238283 - DNA, 20 bp, Artificial
  CRISPR gRNA sequence
atggaacccagaaaccgcat

SEQ ID NO: 238284 - DNA, 20 bp, Artificial
  CRISPR gRNA sequence
ggaacccagaaaccgcatga

SEQ ID NO: 238285 - DNA, 20 bp, Artificial
  CRISPR gRNA sequence
catgagagatgttcctgtct

SEQ ID NO: 238286 - DNA, 20 bp, Artificial
  CRISPR gRNA sequence
tataattacgtcaaaattga

SEQ ID NO: 238287 - DNA, 20 bp, Artificial
  CRISPR gRNA sequence
cttttttttttttttttttt

SEQ ID NO: 238288 - DNA, 20 bp, Artificial
  CRISPR gRNA sequence
ttttttttttttttttgaga

SEQ ID NO: 238289 - DNA, 20 bp, Artificial
  CRISPR gRNA sequence
ttttttttttttttgagacg

SEQ ID NO: 238290 - DNA, 20 bp, Artificial
  CRISPR gRNA sequence
ggagtttcgcttttgttgcc

SEQ ID NO: 238291 - DNA, 20 bp, Artificial
  CRISPR gRNA sequence
gagtttcgcttttgttgccc

SEQ ID NO: 238292 - DNA, 20 bp, Artificial
  CRISPR gRNA sequence
ttcgcttttgttgcccaggc

SEQ ID NO: 238293 - DNA, 20 bp, Artificial
  CRISPR gRNA sequence
cgcttttgttgcccaggctg

SEQ ID NO: 238294 - DNA, 20 bp, Artificial
  CRISPR gRNA sequence
ttgcccaggctggagtgcaa

SEQ ID NO: 238295 - DNA, 20 bp, Artificial
  CRISPR gRNA sequence
ggagtgcaatggcacgatct

SEQ ID NO: 238296 - DNA, 20 bp, Artificial
  CRISPR gRNA sequence
tcactgcaacctccacctcc

SEQ ID NO: 238297 - DNA, 20 bp, Artificial
  CRISPR gRNA sequence
cactgcaacctccacctccc

SEQ ID NO: 238298 - DNA, 20 bp, Artificial
  CRISPR gRNA sequence
aacctccacctcccgggttc

SEQ ID NO: 238299 - DNA, 20 bp, Artificial
  CRISPR gRNA sequence
ttcaagcgattctcctgtct

SEQ ID NO: 238300 - DNA, 20 bp, Artificial
  CRISPR gRNA sequence
ttctcctgtctcagcctcct

SEQ ID NO: 238301 - DNA, 20 bp, Artificial
  CRISPR gRNA sequence
tcctgtctcagcctcctgag

SEQ ID NO: 238302 - DNA, 20 bp, Artificial
  CRISPR gRNA sequence
gtctcagcctcctgagtagc

SEQ ID NO: 238303 - DNA, 20 bp, Artificial
  CRISPR gRNA sequence
tctcagcctcctgagtagct

SEQ ID NO: 238304 - DNA, 20 bp, Artificial
  CRISPR gRNA sequence
ctcctgagtagctgggatta

SEQ ID NO: 238305 - DNA, 20 bp, Artificial
  CRISPR gRNA sequence
tcctgagtagctgggattac

SEQ ID NO: 238306 - DNA, 20 bp, Artificial
  CRISPR gRNA sequence
caggcatgcaccaccacgcc

SEQ ID NO: 238307 - DNA, 20 bp, Artificial
  CRISPR gRNA sequence
tggctaattttttgtatttt

SEQ ID NO: 238308 - DNA, 20 bp, Artificial
  CRISPR gRNA sequence
ctaattttttgtatttttag

SEQ ID NO: 238309 - DNA, 20 bp, Artificial
  CRISPR gRNA sequence
aattttttgtatttttagta

SEQ ID NO: 238310 - DNA, 20 bp, Artificial
  CRISPR gRNA sequence
ttttgtatttttagtagaga

SEQ ID NO: 238311 - DNA, 20 bp, Artificial
  CRISPR gRNA sequence
tttgtatttttagtagagac

SEQ ID NO: 238312 - DNA, 20 bp, Artificial
  CRISPR gRNA sequence
ttgtatttttagtagagacg

SEQ ID NO: 238313 - DNA, 20 bp, Artificial
  CRISPR gRNA sequence
gtagagacggggtttcacca

SEQ ID NO: 238314 - DNA, 20 bp, Artificial
  CRISPR gRNA sequence
agacggggtttcaccatggc

SEQ ID NO: 238315 - DNA, 20 bp, Artificial
  CRISPR gRNA sequence
gacggggtttcaccatggcc

SEQ ID NO: 238316 - DNA, 20 bp, Artificial
  CRISPR gRNA sequence
gggtttcaccatggccaggc

SEQ ID NO: 238317 - DNA, 20 bp, Artificial
  CRISPR gRNA sequence
tggtgttgaactcctaacct

SEQ ID NO: 238318 - DNA, 20 bp, Artificial
  CRISPR gRNA sequence
ggtgttgaactcctaacctc

SEQ ID NO: 238319 - DNA, 20 bp, Artificial
  CRISPR gRNA sequence
ctcaggtgatctgcccgcct

SEQ ID NO: 238320 - DNA, 20 bp, Artificial
  CRISPR gRNA sequence
atctgcccgcctcagccccc

SEQ ID NO: 238321 - DNA, 20 bp, Artificial
  CRISPR gRNA sequence
gcctcagccccccagaatgc

SEQ ID NO: 238322 - DNA, 20 bp, Artificial
  CRISPR gRNA sequence
cctcagccccccagaatgct

SEQ ID NO: 238323 - DNA, 20 bp, Artificial
  CRISPR gRNA sequence
cccccagaatgctaggatta

SEQ ID NO: 238324 - DNA, 20 bp, Artificial
  CRISPR gRNA sequence
ccccagaatgctaggattac

SEQ ID NO: 238325 - DNA, 20 bp, Artificial
  CRISPR gRNA sequence
aatgctaggattacaggcgt

SEQ ID NO: 238326 - DNA, 20 bp, Artificial
  CRISPR gRNA sequence
aggattacaggcgtgagcca

SEQ ID NO: 238327 - DNA, 20 bp, Artificial
  CRISPR gRNA sequence
caggcgtgagccacagcgcc

SEQ ID NO: 238328 - DNA, 20 bp, Artificial
  CRISPR gRNA sequence
cgtgagccacagcgcccagc

SEQ ID NO: 238329 - DNA, 20 bp, Artificial
  CRISPR gRNA sequence
gagccacagcgcccagccag

SEQ ID NO: 238330 - DNA, 20 bp, Artificial
  CRISPR gRNA sequence
agccacagcgcccagccaga

SEQ ID NO: 238331 - DNA, 20 bp, Artificial
  CRISPR gRNA sequence
cacagcgcccagccagaagg

SEQ ID NO: 238332 - DNA, 20 bp, Artificial
  CRISPR gRNA sequence
acagcgcccagccagaagga

SEQ ID NO: 238333 - DNA, 20 bp, Artificial
  CRISPR gRNA sequence
agaaggaaggcttccctgac

SEQ ID NO: 238334 - DNA, 20 bp, Artificial
  CRISPR gRNA sequence
gaaggaaggcttccctgacc

SEQ ID NO: 238335 - DNA, 20 bp, Artificial
  CRISPR gRNA sequence
ccctgaccaggaatcgaacc

SEQ ID NO: 238336 - DNA, 20 bp, Artificial
  CRISPR gRNA sequence
cctgaccaggaatcgaaccc

SEQ ID NO: 238337 - DNA, 20 bp, Artificial
  CRISPR gRNA sequence
gaatcgaacccgggtcgtga

SEQ ID NO: 238338 - DNA, 20 bp, Artificial
  CRISPR gRNA sequence
cgaacccgggtcgtgatggc

SEQ ID NO: 238339 - DNA, 20 bp, Artificial
  CRISPR gRNA sequence
ccgggtcgtgatggcgagcg

SEQ ID NO: 238340 - DNA, 20 bp, Artificial
  CRISPR gRNA sequence
gagcgcggaatcctaaccac

SEQ ID NO: 238341 - DNA, 20 bp, Artificial
  CRISPR gRNA sequence
aatcctaaccactagactac

SEQ ID NO: 238342 - DNA, 20 bp, Artificial
  CRISPR gRNA sequence
atcctaaccactagactacc

SEQ ID NO: 238343 - DNA, 20 bp, Artificial
  CRISPR gRNA sequence
tcctaaccactagactacca

SEQ ID NO: 238344 - DNA, 20 bp, Artificial
  CRISPR gRNA sequence
ctaaccactagactaccagg

SEQ ID NO: 238345 - DNA, 20 bp, Artificial
  CRISPR gRNA sequence
tcctaaaaacttttaaaaaa

SEQ ID NO: 238346 - DNA, 20 bp, Artificial
  CRISPR gRNA sequence
aacttttaaaaaatggatta

SEQ ID NO: 238347 - DNA, 20 bp, Artificial
  CRISPR gRNA sequence
tactcataaatacttttgaa

SEQ ID NO: 238348 - DNA, 20 bp, Artificial
  CRISPR gRNA sequence
ttttataacgaactttgttg

SEQ ID NO: 238349 - DNA, 20 bp, Artificial
  CRISPR gRNA sequence
taacgaactttgttgcagtc

SEQ ID NO: 238350 - DNA, 20 bp, Artificial
  CRISPR gRNA sequence
aacgaactttgttgcagtct

SEQ ID NO: 238351 - DNA, 20 bp, Artificial
  CRISPR gRNA sequence
acgaactttgttgcagtctg

SEQ ID NO: 238352 - DNA, 20 bp, Artificial
  CRISPR gRNA sequence
ctttgttgcagtctggggtg

SEQ ID NO: 238353 - DNA, 20 bp, Artificial
  CRISPR gRNA sequence
gttgcagtctggggtgtgga

SEQ ID NO: 238354 - DNA, 20 bp, Artificial
  CRISPR gRNA sequence
gtgtggatggaactttgttg

SEQ ID NO: 238355 - DNA, 20 bp, Artificial
  CRISPR gRNA sequence
gtggatggaactttgttgca

SEQ ID NO: 238356 - DNA, 20 bp, Artificial
  CRISPR gRNA sequence
gcagagatactcctttaaat

SEQ ID NO: 238357 - DNA, 20 bp, Artificial
  CRISPR gRNA sequence
cagagatactcctttaaatc

SEQ ID NO: 238358 - DNA, 20 bp, Artificial
  CRISPR gRNA sequence
tactcctttaaatcaggatt

SEQ ID NO: 238359 - DNA, 20 bp, Artificial
  CRISPR gRNA sequence
ctttaaatcaggattaagtc

SEQ ID NO: 238360 - DNA, 20 bp, Artificial
  CRISPR gRNA sequence
caggattaagtccagcactt

SEQ ID NO: 238361 - DNA, 20 bp, Artificial
  CRISPR gRNA sequence
aggattaagtccagcacttt

SEQ ID NO: 238362 - DNA, 20 bp, Artificial
  CRISPR gRNA sequence
gtccagcactttgggaaacc

SEQ ID NO: 238363 - DNA, 20 bp, Artificial
  CRISPR gRNA sequence
tccagcactttgggaaaccg

SEQ ID NO: 238364 - DNA, 20 bp, Artificial
  CRISPR gRNA sequence
agcactttgggaaaccgagg

SEQ ID NO: 238365 - DNA, 20 bp, Artificial
  CRISPR gRNA sequence
gcactttgggaaaccgaggt

SEQ ID NO: 238366 - DNA, 20 bp, Artificial
  CRISPR gRNA sequence
actttgggaaaccgaggtgg

SEQ ID NO: 238367 - DNA, 20 bp, Artificial
  CRISPR gRNA sequence
ctttgggaaaccgaggtggg

SEQ ID NO: 238368 - DNA, 20 bp, Artificial
  CRISPR gRNA sequence
ccgaggtgggaggatcgctt

SEQ ID NO: 238369 - DNA, 20 bp, Artificial
  CRISPR gRNA sequence
gtgggaggatcgcttgagcc

SEQ ID NO: 238370 - DNA, 20 bp, Artificial
  CRISPR gRNA sequence
tgggaggatcgcttgagccc

SEQ ID NO: 238371 - DNA, 20 bp, Artificial
  CRISPR gRNA sequence
ggaggatcgcttgagcccag

SEQ ID NO: 238372 - DNA, 20 bp, Artificial
  CRISPR gRNA sequence
tcgcttgagcccaggagttt

SEQ ID NO: 238373 - DNA, 20 bp, Artificial
  CRISPR gRNA sequence
tgagcccaggagtttaagac

SEQ ID NO: 238374 - DNA, 20 bp, Artificial
  CRISPR gRNA sequence
ccaggagtttaagactggcc

SEQ ID NO: 238375 - DNA, 20 bp, Artificial
  CRISPR gRNA sequence
ctggacaacaccgtgaatcc

SEQ ID NO: 238376 - DNA, 20 bp, Artificial
  CRISPR gRNA sequence
actaaaaatcaattaaaaat

SEQ ID NO: 238377 - DNA, 20 bp, Artificial
  CRISPR gRNA sequence
aaatcaattaaaaattagct

SEQ ID NO: 238378 - DNA, 20 bp, Artificial
  CRISPR gRNA sequence
aattaaaaattagctgagtg

SEQ ID NO: 238379 - DNA, 20 bp, Artificial
  CRISPR gRNA sequence
taaaaattagctgagtgtgg

SEQ ID NO: 238380 - DNA, 20 bp, Artificial
  CRISPR gRNA sequence
agtgtggtggtatgcaccta

SEQ ID NO: 238381 - DNA, 20 bp, Artificial
  CRISPR gRNA sequence
gtggtatgcacctatagtcc

SEQ ID NO: 238382 - DNA, 20 bp, Artificial
  CRISPR gRNA sequence
cacctatagtcccagctatt

SEQ ID NO: 238383 - DNA, 20 bp, Artificial
  CRISPR gRNA sequence
ctatagtcccagctatttag

SEQ ID NO: 238384 - DNA, 20 bp, Artificial
  CRISPR gRNA sequence
tatagtcccagctatttagt

SEQ ID NO: 238385 - DNA, 20 bp, Artificial
  CRISPR gRNA sequence
tcccagctatttagtaggct

SEQ ID NO: 238386 - DNA, 20 bp, Artificial
  CRISPR gRNA sequence
cccagctatttagtaggctg

SEQ ID NO: 238387 - DNA, 20 bp, Artificial
  CRISPR gRNA sequence
agctatttagtaggctgagg

SEQ ID NO: 238388 - DNA, 20 bp, Artificial
  CRISPR gRNA sequence
gctatttagtaggctgaggc

SEQ ID NO: 238389 - DNA, 20 bp, Artificial
  CRISPR gRNA sequence
tatttagtaggctgaggcag

SEQ ID NO: 238390 - DNA, 20 bp, Artificial
  CRISPR gRNA sequence
atttagtaggctgaggcagg

SEQ ID NO: 238391 - DNA, 20 bp, Artificial
  CRISPR gRNA sequence
ctgaggcaggaggattgctc

SEQ ID NO: 238392 - DNA, 20 bp, Artificial
  CRISPR gRNA sequence
caggaggattgctcgagctc

SEQ ID NO: 238393 - DNA, 20 bp, Artificial
  CRISPR gRNA sequence
ggaggattgctcgagctctg

SEQ ID NO: 238394 - DNA, 20 bp, Artificial
  CRISPR gRNA sequence
ttgctcgagctctggagttc

SEQ ID NO: 238395 - DNA, 20 bp, Artificial
  CRISPR gRNA sequence
tgctcgagctctggagttcg

SEQ ID NO: 238396 - DNA, 20 bp, Artificial
  CRISPR gRNA sequence
agctctggagttcgaggcta

SEQ ID NO: 238397 - DNA, 20 bp, Artificial
  CRISPR gRNA sequence
ctggagttcgaggctacagt

SEQ ID NO: 238398 - DNA, 20 bp, Artificial
  CRISPR gRNA sequence
gtgatcgcaccattgcactt

SEQ ID NO: 238399 - DNA, 20 bp, Artificial
  CRISPR gRNA sequence
cgcaccattgcacttcagcc

SEQ ID NO: 238400 - DNA, 20 bp, Artificial
  CRISPR gRNA sequence
gcaccattgcacttcagcct

SEQ ID NO: 238401 - DNA, 20 bp, Artificial
  CRISPR gRNA sequence
gcacttcagcctgggtgaca

SEQ ID NO: 238402 - DNA, 20 bp, Artificial
  CRISPR gRNA sequence
actctgtctcaaaaaaacaa

SEQ ID NO: 238403 - DNA, 20 bp, Artificial
  CRISPR gRNA sequence
acaaaagacaaaactgaaat

SEQ ID NO: 238404 - DNA, 20 bp, Artificial
  CRISPR gRNA sequence
caaaagacaaaactgaaatc

SEQ ID NO: 238405 - DNA, 20 bp, Artificial
  CRISPR gRNA sequence
acaaaactgaaatcaggttt

SEQ ID NO: 238406 - DNA, 20 bp, Artificial
  CRISPR gRNA sequence
aactgaaatcaggtttaagt

SEQ ID NO: 238407 - DNA, 20 bp, Artificial
  CRISPR gRNA sequence
atcaggtttaagtgagaacg

SEQ ID NO: 238408 - DNA, 20 bp, Artificial
  CRISPR gRNA sequence
caggtttaagtgagaacgca

SEQ ID NO: 238409 - DNA, 20 bp, Artificial
  CRISPR gRNA sequence
aggtttaagtgagaacgcag

SEQ ID NO: 238410 - DNA, 20 bp, Artificial
  CRISPR gRNA sequence
gagaacgcagaggtttaaac

SEQ ID NO: 238411 - DNA, 20 bp, Artificial
  CRISPR gRNA sequence
gaacgcagaggtttaaactg

SEQ ID NO: 238412 - DNA, 20 bp, Artificial
  CRISPR gRNA sequence
aacgcagaggtttaaactgg

SEQ ID NO: 238413 - DNA, 20 bp, Artificial
  CRISPR gRNA sequence
agaggtttaaactggaggtg

SEQ ID NO: 238414 - DNA, 20 bp, Artificial
  CRISPR gRNA sequence
ggaggtgtagacctcaaaaa

SEQ ID NO: 238415 - DNA, 20 bp, Artificial
  CRISPR gRNA sequence
agacctcaaaaaaagaatga

SEQ ID NO: 238416 - DNA, 20 bp, Artificial
  CRISPR gRNA sequence
acctcaaaaaaagaatgaaa

SEQ ID NO: 238417 - DNA, 20 bp, Artificial
  CRISPR gRNA sequence
aagaatgaaagagcaaacca

SEQ ID NO: 238418 - DNA, 20 bp, Artificial
  CRISPR gRNA sequence
tgaaagagcaaaccacagaa

SEQ ID NO: 238419 - DNA, 20 bp, Artificial
  CRISPR gRNA sequence
gaaagagcaaaccacagaat

SEQ ID NO: 238420 - DNA, 20 bp, Artificial
  CRISPR gRNA sequence
agcaaaccacagaataggaa

SEQ ID NO: 238421 - DNA, 20 bp, Artificial
  CRISPR gRNA sequence
agaataggaaaagatatttg

SEQ ID NO: 238422 - DNA, 20 bp, Artificial
  CRISPR gRNA sequence
agatatttgcagctcatgaa

SEQ ID NO: 238423 - DNA, 20 bp, Artificial
  CRISPR gRNA sequence
tatttgcagctcatgaacag

SEQ ID NO: 238424 - DNA, 20 bp, Artificial
  CRISPR gRNA sequence
actaaaaacttcctatacgt

SEQ ID NO: 238425 - DNA, 20 bp, Artificial
  CRISPR gRNA sequence
aaaacttcctatacgttagt

SEQ ID NO: 238426 - DNA, 20 bp, Artificial
  CRISPR gRNA sequence
ttcctatacgttagtaagaa

SEQ ID NO: 238427 - DNA, 20 bp, Artificial
  CRISPR gRNA sequence
tcctatacgttagtaagaaa

SEQ ID NO: 238428 - DNA, 20 bp, Artificial
  CRISPR gRNA sequence
atacgttagtaagaaaagga

SEQ ID NO: 238429 - DNA, 20 bp, Artificial
  CRISPR gRNA sequence
aaaaggacagacaatcctat

SEQ ID NO: 238430 - DNA, 20 bp, Artificial
  CRISPR gRNA sequence
tcctatgagaaaatactcaa

SEQ ID NO: 238431 - DNA, 20 bp, Artificial
  CRISPR gRNA sequence
aaatactcaaaagacttgat

SEQ ID NO: 238432 - DNA, 20 bp, Artificial
  CRISPR gRNA sequence
aatactcaaaagacttgatc

SEQ ID NO: 238433 - DNA, 20 bp, Artificial
  CRISPR gRNA sequence
cttgatcaggcccttcacta

SEQ ID NO: 238434 - DNA, 20 bp, Artificial
  CRISPR gRNA sequence
tgatcaggcccttcactaaa

SEQ ID NO: 238435 - DNA, 20 bp, Artificial
  CRISPR gRNA sequence
gatcaggcccttcactaaag

SEQ ID NO: 238436 - DNA, 20 bp, Artificial
  CRISPR gRNA sequence
cactaaagaggaaatccaaa

SEQ ID NO: 238437 - DNA, 20 bp, Artificial
  CRISPR gRNA sequence
aatagccaaaataacatgaa

SEQ ID NO: 238438 - DNA, 20 bp, Artificial
  CRISPR gRNA sequence
atagccaaaataacatgaaa

SEQ ID NO: 238439 - DNA, 20 bp, Artificial
  CRISPR gRNA sequence
gaaaaggcgtctaacctcac

SEQ ID NO: 238440 - DNA, 20 bp, Artificial
  CRISPR gRNA sequence
cgtctaacctcactagcaac

SEQ ID NO: 238441 - DNA, 20 bp, Artificial
  CRISPR gRNA sequence
gtctaacctcactagcaacc

SEQ ID NO: 238442 - DNA, 20 bp, Artificial
  CRISPR gRNA sequence
taacctcactagcaaccagg

SEQ ID NO: 238443 - DNA, 20 bp, Artificial
  CRISPR gRNA sequence
cactagcaaccaggaagtgt

SEQ ID NO: 238444 - DNA, 20 bp, Artificial
  CRISPR gRNA sequence
gtgtaagttaaaaccacaat

SEQ ID NO: 238445 - DNA, 20 bp, Artificial
  CRISPR gRNA sequence
aaaaataatctgatgatacc

SEQ ID NO: 238446 - DNA, 20 bp, Artificial
  CRISPR gRNA sequence
aaataatctgatgataccaa

SEQ ID NO: 238447 - DNA, 20 bp, Artificial
  CRISPR gRNA sequence
ctgatgataccaagagttat

SEQ ID NO: 238448 - DNA, 20 bp, Artificial
  CRISPR gRNA sequence
tgatgataccaagagttatc

SEQ ID NO: 238449 - DNA, 20 bp, Artificial
  CRISPR gRNA sequence
gatgataccaagagttatca

SEQ ID NO: 238450 - DNA, 20 bp, Artificial
  CRISPR gRNA sequence
atgataccaagagttatcag

SEQ ID NO: 238451 - DNA, 20 bp, Artificial
  CRISPR gRNA sequence
ccaagagttatcaggggatg

SEQ ID NO: 238452 - DNA, 20 bp, Artificial
  CRISPR gRNA sequence
aagagttatcaggggatgtg

SEQ ID NO: 238453 - DNA, 20 bp, Artificial
  CRISPR gRNA sequence
tatcaggggatgtggagtaa

SEQ ID NO: 238454 - DNA, 20 bp, Artificial
  CRISPR gRNA sequence
atcaggggatgtggagtaac

SEQ ID NO: 238455 - DNA, 20 bp, Artificial
  CRISPR gRNA sequence
aacaggaaactcattaccgc

SEQ ID NO: 238456 - DNA, 20 bp, Artificial
  CRISPR gRNA sequence
acaggaaactcattaccgcc

SEQ ID NO: 238457 - DNA, 20 bp, Artificial
  CRISPR gRNA sequence
caggaaactcattaccgcca

SEQ ID NO: 238458 - DNA, 20 bp, Artificial
  CRISPR gRNA sequence
aggaaactcattaccgccag

SEQ ID NO: 238459 - DNA, 20 bp, Artificial
  CRISPR gRNA sequence
gaaactcattaccgccaggg

SEQ ID NO: 238460 - DNA, 20 bp, Artificial
  CRISPR gRNA sequence
taccgccaggggagtgtaaa

SEQ ID NO: 238461 - DNA, 20 bp, Artificial
  CRISPR gRNA sequence
accgccaggggagtgtaaat

SEQ ID NO: 238462 - DNA, 20 bp, Artificial
  CRISPR gRNA sequence
ccgccaggggagtgtaaatg

SEQ ID NO: 238463 - DNA, 20 bp, Artificial
  CRISPR gRNA sequence
gtaaatggggtccaatcatt

SEQ ID NO: 238464 - DNA, 20 bp, Artificial
  CRISPR gRNA sequence
taaatggggtccaatcattt

SEQ ID NO: 238465 - DNA, 20 bp, Artificial
  CRISPR gRNA sequence
ggtccaatcatttaggaaaa

SEQ ID NO: 238466 - DNA, 20 bp, Artificial
  CRISPR gRNA sequence
aatcatttaggaaaacagtt

SEQ ID NO: 238467 - DNA, 20 bp, Artificial
  CRISPR gRNA sequence
agtttggcatattcacgacc

SEQ ID NO: 238468 - DNA, 20 bp, Artificial
  CRISPR gRNA sequence
caagatacacatgttccttg

SEQ ID NO: 238469 - DNA, 20 bp, Artificial
  CRISPR gRNA sequence
tacacatgttccttgtagct

SEQ ID NO: 238470 - DNA, 20 bp, Artificial
  CRISPR gRNA sequence
tagctcagcaacgttatttc

SEQ ID NO: 238471 - DNA, 20 bp, Artificial
  CRISPR gRNA sequence
agctcagcaacgttatttct

SEQ ID NO: 238472 - DNA, 20 bp, Artificial
  CRISPR gRNA sequence
ctaggttaaaaaacaaaacc

SEQ ID NO: 238473 - DNA, 20 bp, Artificial
  CRISPR gRNA sequence
gttaaaaaacaaaaccaagc

SEQ ID NO: 238474 - DNA, 20 bp, Artificial
  CRISPR gRNA sequence
aacacgtgtttacgtgtgct

SEQ ID NO: 238475 - DNA, 20 bp, Artificial
  CRISPR gRNA sequence
tttacgtgtgctgagataca

SEQ ID NO: 238476 - DNA, 20 bp, Artificial
  CRISPR gRNA sequence
tcattacatgtaataacccc

SEQ ID NO: 238477 - DNA, 20 bp, Artificial
  CRISPR gRNA sequence
tacatgtaataaccccaagc

SEQ ID NO: 238478 - DNA, 20 bp, Artificial
  CRISPR gRNA sequence
gaaatgatcccgctgtccat

SEQ ID NO: 238479 - DNA, 20 bp, Artificial
  CRISPR gRNA sequence
atcccgctgtccatcagtac

SEQ ID NO: 238480 - DNA, 20 bp, Artificial
  CRISPR gRNA sequence
gctgtccatcagtactagaa

SEQ ID NO: 238481 - DNA, 20 bp, Artificial
  CRISPR gRNA sequence
ctgtccatcagtactagaat

SEQ ID NO: 238482 - DNA, 20 bp, Artificial
  CRISPR gRNA sequence
caatgatgtcatcattcaac

SEQ ID NO: 238483 - DNA, 20 bp, Artificial
  CRISPR gRNA sequence
atgatgtcatcattcaacaa

SEQ ID NO: 238484 - DNA, 20 bp, Artificial
  CRISPR gRNA sequence
cattcaacaagagtgtgcaa

SEQ ID NO: 238485 - DNA, 20 bp, Artificial
  CRISPR gRNA sequence
tcaacaagagtgtgcaacag

SEQ ID NO: 238486 - DNA, 20 bp, Artificial
  CRISPR gRNA sequence
gcaacagtggaaatcaacta

SEQ ID NO: 238487 - DNA, 20 bp, Artificial
  CRISPR gRNA sequence
aactaaagatgaactcaaca

SEQ ID NO: 238488 - DNA, 20 bp, Artificial
  CRISPR gRNA sequence
tcttcatgatacaacgttga

SEQ ID NO: 238489 - DNA, 20 bp, Artificial
  CRISPR gRNA sequence
tcatgatacaacgttgaaag

SEQ ID NO: 238490 - DNA, 20 bp, Artificial
  CRISPR gRNA sequence
tgatacaacgttgaaagaag

SEQ ID NO: 238491 - DNA, 20 bp, Artificial
  CRISPR gRNA sequence
acaacgttgaaagaagaagc

SEQ ID NO: 238492 - DNA, 20 bp, Artificial
  CRISPR gRNA sequence
ttgaaagaagaagcaagata

SEQ ID NO: 238493 - DNA, 20 bp, Artificial
  CRISPR gRNA sequence
aagaagcaagatacagaaaa

SEQ ID NO: 238494 - DNA, 20 bp, Artificial
  CRISPR gRNA sequence
agtgtgattctatttgtatg

SEQ ID NO: 238495 - DNA, 20 bp, Artificial
  CRISPR gRNA sequence
tctatttgtatgaagttcac

SEQ ID NO: 238496 - DNA, 20 bp, Artificial
  CRISPR gRNA sequence
atttgtatgaagttcacaag

SEQ ID NO: 238497 - DNA, 20 bp, Artificial
  CRISPR gRNA sequence
gcccaataaaactgtgttat

SEQ ID NO: 238498 - DNA, 20 bp, Artificial
  CRISPR gRNA sequence
cccaataaaactgtgttatt

SEQ ID NO: 238499 - DNA, 20 bp, Artificial
  CRISPR gRNA sequence
aataaaactgtgttattagg

SEQ ID NO: 238500 - DNA, 20 bp, Artificial
  CRISPR gRNA sequence
gttattaggtagcaaaacta

SEQ ID NO: 238501 - DNA, 20 bp, Artificial
  CRISPR gRNA sequence
aggtagcaaaactacagcaa

SEQ ID NO: 238502 - DNA, 20 bp, Artificial
  CRISPR gRNA sequence
ggtagcaaaactacagcaaa

SEQ ID NO: 238503 - DNA, 20 bp, Artificial
  CRISPR gRNA sequence
agcaaaactacagcaaaagg

SEQ ID NO: 238504 - DNA, 20 bp, Artificial
  CRISPR gRNA sequence
aaaggaagttaataccatac

SEQ ID NO: 238505 - DNA, 20 bp, Artificial
  CRISPR gRNA sequence
aagttaataccatacaagtc

SEQ ID NO: 238506 - DNA, 20 bp, Artificial
  CRISPR gRNA sequence
ataccatacaagtctagatg

SEQ ID NO: 238507 - DNA, 20 bp, Artificial
  CRISPR gRNA sequence
catacaagtctagatgtggt

SEQ ID NO: 238508 - DNA, 20 bp, Artificial
  CRISPR gRNA sequence
acaagtctagatgtggttag

SEQ ID NO: 238509 - DNA, 20 bp, Artificial
  CRISPR gRNA sequence
agtctagatgtggttagcag

SEQ ID NO: 238510 - DNA, 20 bp, Artificial
  CRISPR gRNA sequence
ctagatgtggttagcagtag

SEQ ID NO: 238511 - DNA, 20 bp, Artificial
  CRISPR gRNA sequence
tagatgtggttagcagtagt

SEQ ID NO: 238512 - DNA, 20 bp, Artificial
  CRISPR gRNA sequence
gtggttagcagtagtgggca

SEQ ID NO: 238513 - DNA, 20 bp, Artificial
  CRISPR gRNA sequence
ggttagcagtagtgggcaaa

SEQ ID NO: 238514 - DNA, 20 bp, Artificial
  CRISPR gRNA sequence
gttagcagtagtgggcaaag

SEQ ID NO: 238515 - DNA, 20 bp, Artificial
  CRISPR gRNA sequence
ttagcagtagtgggcaaaga

SEQ ID NO: 238516 - DNA, 20 bp, Artificial
  CRISPR gRNA sequence
gggcaaagagggctgtgatc

SEQ ID NO: 238517 - DNA, 20 bp, Artificial
  CRISPR gRNA sequence
aaagagggctgtgatctaga

SEQ ID NO: 238518 - DNA, 20 bp, Artificial
  CRISPR gRNA sequence
aagagggctgtgatctagaa

SEQ ID NO: 238519 - DNA, 20 bp, Artificial
  CRISPR gRNA sequence
agagggctgtgatctagaaa

SEQ ID NO: 238520 - DNA, 20 bp, Artificial
  CRISPR gRNA sequence
tgatctagaaagggcatgcc

SEQ ID NO: 238521 - DNA, 20 bp, Artificial
  CRISPR gRNA sequence
gatctagaaagggcatgcca

SEQ ID NO: 238522 - DNA, 20 bp, Artificial
  CRISPR gRNA sequence
atctagaaagggcatgccaa

SEQ ID NO: 238523 - DNA, 20 bp, Artificial
  CRISPR gRNA sequence
aaagggcatgccaagggctt

SEQ ID NO: 238524 - DNA, 20 bp, Artificial
  CRISPR gRNA sequence
aagggcatgccaagggcttc

SEQ ID NO: 238525 - DNA, 20 bp, Artificial
  CRISPR gRNA sequence
atgccaagggcttcgggaat

SEQ ID NO: 238526 - DNA, 20 bp, Artificial
  CRISPR gRNA sequence
tatgttccacttctttaccc

SEQ ID NO: 238527 - DNA, 20 bp, Artificial
  CRISPR gRNA sequence
gttccacttctttaccctgg

SEQ ID NO: 238528 - DNA, 20 bp, Artificial
  CRISPR gRNA sequence
tccacttctttaccctggta

SEQ ID NO: 238529 - DNA, 20 bp, Artificial
  CRISPR gRNA sequence
catttatgcatttttctgta

SEQ ID NO: 238530 - DNA, 20 bp, Artificial
  CRISPR gRNA sequence
atttatgcatttttctgtat

SEQ ID NO: 238531 - DNA, 20 bp, Artificial
  CRISPR gRNA sequence
gtataggtcacaatgtataa

SEQ ID NO: 238532 - DNA, 20 bp, Artificial
  CRISPR gRNA sequence
aagttctatattgctttaaa

SEQ ID NO: 238533 - DNA, 20 bp, Artificial
  CRISPR gRNA sequence
gttctatattgctttaaaaa

SEQ ID NO: 238534 - DNA, 20 bp, Artificial
  CRISPR gRNA sequence
aaaagagcctttaaatacat

SEQ ID NO: 238535 - DNA, 20 bp, Artificial
  CRISPR gRNA sequence
aatacattagcataatttat

SEQ ID NO: 238536 - DNA, 20 bp, Artificial
  CRISPR gRNA sequence
attagcataatttattagat

SEQ ID NO: 238537 - DNA, 20 bp, Artificial
  CRISPR gRNA sequence
tttattagataagactttac

SEQ ID NO: 238538 - DNA, 20 bp, Artificial
  CRISPR gRNA sequence
tagataagactttactggct

SEQ ID NO: 238539 - DNA, 20 bp, Artificial
  CRISPR gRNA sequence
aagactttactggctgagcg

SEQ ID NO: 238540 - DNA, 20 bp, Artificial
  CRISPR gRNA sequence
actttactggctgagcgcag

SEQ ID NO: 238541 - DNA, 20 bp, Artificial
  CRISPR gRNA sequence
cgcctgtaatcccaacactt

SEQ ID NO: 238542 - DNA, 20 bp, Artificial
  CRISPR gRNA sequence
gcctgtaatcccaacacttt

SEQ ID NO: 238543 - DNA, 20 bp, Artificial
  CRISPR gRNA sequence
ctgtaatcccaacactttgg

SEQ ID NO: 238544 - DNA, 20 bp, Artificial
  CRISPR gRNA sequence
tgtaatcccaacactttggg

SEQ ID NO: 238545 - DNA, 20 bp, Artificial
  CRISPR gRNA sequence
tcccaacactttgggaggct

SEQ ID NO: 238546 - DNA, 20 bp, Artificial
  CRISPR gRNA sequence
cccaacactttgggaggctg

SEQ ID NO: 238547 - DNA, 20 bp, Artificial
  CRISPR gRNA sequence
aacactttgggaggctgagg

SEQ ID NO: 238548 - DNA, 20 bp, Artificial
  CRISPR gRNA sequence
acactttgggaggctgaggc

SEQ ID NO: 238549 - DNA, 20 bp, Artificial
  CRISPR gRNA sequence
ctttgggaggctgaggcggg

SEQ ID NO: 238550 - DNA, 20 bp, Artificial
  CRISPR gRNA sequence
ctgaggcgggcggatcacct

SEQ ID NO: 238551 - DNA, 20 bp, Artificial
  CRISPR gRNA sequence
tgaggcgggcggatcacctg

SEQ ID NO: 238552 - DNA, 20 bp, Artificial
  CRISPR gRNA sequence
gcgggcggatcacctgaggt

SEQ ID NO: 238553 - DNA, 20 bp, Artificial
  CRISPR gRNA sequence
cgggcggatcacctgaggtt

SEQ ID NO: 238554 - DNA, 20 bp, Artificial
  CRISPR gRNA sequence
ggcggatcacctgaggttgg

SEQ ID NO: 238555 - DNA, 20 bp, Artificial
  CRISPR gRNA sequence
tcacctgaggttgggagttc

SEQ ID NO: 238556 - DNA, 20 bp, Artificial
  CRISPR gRNA sequence
tgaggttgggagttcaagac

SEQ ID NO: 238557 - DNA, 20 bp, Artificial
  CRISPR gRNA sequence
ttgggagttcaagaccagcc

SEQ ID NO: 238558 - DNA, 20 bp, Artificial
  CRISPR gRNA sequence
caagaccagcctggccaaca

SEQ ID NO: 238559 - DNA, 20 bp, Artificial
  CRISPR gRNA sequence
agaccagcctggccaacatg

SEQ ID NO: 238560 - DNA, 20 bp, Artificial
  CRISPR gRNA sequence
ctctactaaaaatgcaaaat

SEQ ID NO: 238561 - DNA, 20 bp, Artificial
  CRISPR gRNA sequence
actaaaaatgcaaaattagc

SEQ ID NO: 238562 - DNA, 20 bp, Artificial
  CRISPR gRNA sequence
ctaaaaatgcaaaattagct

SEQ ID NO: 238563 - DNA, 20 bp, Artificial
  CRISPR gRNA sequence
aatgcaaaattagctgggtg

SEQ ID NO: 238564 - DNA, 20 bp, Artificial
  CRISPR gRNA sequence
gcaaaattagctgggtgtgg

SEQ ID NO: 238565 - DNA, 20 bp, Artificial
  CRISPR gRNA sequence
ggcgcatgcctgtaatgcct

SEQ ID NO: 238566 - DNA, 20 bp, Artificial
  CRISPR gRNA sequence
gcgcatgcctgtaatgcctc

SEQ ID NO: 238567 - DNA, 20 bp, Artificial
  CRISPR gRNA sequence
gcatgcctgtaatgcctcgg

SEQ ID NO: 238568 - DNA, 20 bp, Artificial
  CRISPR gRNA sequence
ctgtaatgcctcgggagcct

SEQ ID NO: 238569 - DNA, 20 bp, Artificial
  CRISPR gRNA sequence
tgtaatgcctcgggagcctg

SEQ ID NO: 238570 - DNA, 20 bp, Artificial
  CRISPR gRNA sequence
aatgcctcgggagcctgagg

SEQ ID NO: 238571 - DNA, 20 bp, Artificial
  CRISPR gRNA sequence
atgcctcgggagcctgaggc

SEQ ID NO: 238572 - DNA, 20 bp, Artificial
  CRISPR gRNA sequence
gcctcgggagcctgaggcag

SEQ ID NO: 238573 - DNA, 20 bp, Artificial
  CRISPR gRNA sequence
gcaggagaatcgcttgaacc

SEQ ID NO: 238574 - DNA, 20 bp, Artificial
  CRISPR gRNA sequence
ggagaatcgcttgaacccgg

SEQ ID NO: 238575 - DNA, 20 bp, Artificial
  CRISPR gRNA sequence
gagaatcgcttgaacccgga

SEQ ID NO: 238576 - DNA, 20 bp, Artificial
  CRISPR gRNA sequence
gaatcgcttgaacccggaag

SEQ ID NO: 238577 - DNA, 20 bp, Artificial
  CRISPR gRNA sequence
aatcgcttgaacccggaagg

SEQ ID NO: 238578 - DNA, 20 bp, Artificial
  CRISPR gRNA sequence
tcgcttgaacccggaaggag

SEQ ID NO: 238579 - DNA, 20 bp, Artificial
  CRISPR gRNA sequence
cgcttgaacccggaaggagg

SEQ ID NO: 238580 - DNA, 20 bp, Artificial
  CRISPR gRNA sequence
aacccggaaggaggaggttg

SEQ ID NO: 238581 - DNA, 20 bp, Artificial
  CRISPR gRNA sequence
cggaaggaggaggttgcggt

SEQ ID NO: 238582 - DNA, 20 bp, Artificial
  CRISPR gRNA sequence
aggaggaggttgcggtaagc

SEQ ID NO: 238583 - DNA, 20 bp, Artificial
  CRISPR gRNA sequence
ggaggaggttgcggtaagcc

SEQ ID NO: 238584 - DNA, 20 bp, Artificial
  CRISPR gRNA sequence
gggatcacgccattgcactc

SEQ ID NO: 238585 - DNA, 20 bp, Artificial
  CRISPR gRNA sequence
cacgccattgcactccagcc

SEQ ID NO: 238586 - DNA, 20 bp, Artificial
  CRISPR gRNA sequence
acgccattgcactccagcct

SEQ ID NO: 238587 - DNA, 20 bp, Artificial
  CRISPR gRNA sequence
tgcactccagcctgggcaac

SEQ ID NO: 238588 - DNA, 20 bp, Artificial
  CRISPR gRNA sequence
cactccagcctgggcaacaa

SEQ ID NO: 238589 - DNA, 20 bp, Artificial
  CRISPR gRNA sequence
agtgaaactctgtctcaaaa

SEQ ID NO: 238590 - DNA, 20 bp, Artificial
  CRISPR gRNA sequence
tgtctcaaaaaagaaaaaaa

SEQ ID NO: 238591 - DNA, 20 bp, Artificial
  CRISPR gRNA sequence
tatttttaacaatctccaaa

SEQ ID NO: 238592 - DNA, 20 bp, Artificial
  CRISPR gRNA sequence
atttttaacaatctccaaat

SEQ ID NO: 238593 - DNA, 20 bp, Artificial
  CRISPR gRNA sequence
atctccaaataggcacattc

SEQ ID NO: 238594 - DNA, 20 bp, Artificial
  CRISPR gRNA sequence
aggcacattctggtcttaca

SEQ ID NO: 238595 - DNA, 20 bp, Artificial
  CRISPR gRNA sequence
tctggtcttacatggtgctt

SEQ ID NO: 238596 - DNA, 20 bp, Artificial
  CRISPR gRNA sequence
ctggtcttacatggtgcttt

SEQ ID NO: 238597 - DNA, 20 bp, Artificial
  CRISPR gRNA sequence
gttaaaattttgctctcaaa

SEQ ID NO: 238598 - DNA, 20 bp, Artificial
  CRISPR gRNA sequence
tttattatatccctcttatt

SEQ ID NO: 238599 - DNA, 20 bp, Artificial
  CRISPR gRNA sequence
ccctcttattaagtcttatt

SEQ ID NO: 238600 - DNA, 20 bp, Artificial
  CRISPR gRNA sequence
gtctcatcctaatgtccatg

SEQ ID NO: 238601 - DNA, 20 bp, Artificial
  CRISPR gRNA sequence
atgtccatgaagacaaaaaa

SEQ ID NO: 238602 - DNA, 20 bp, Artificial
  CRISPR gRNA sequence
ctttttcaaataaatatcaa

SEQ ID NO: 238603 - DNA, 20 bp, Artificial
  CRISPR gRNA sequence
aaatatcaatggcttttgtc

SEQ ID NO: 238604 - DNA, 20 bp, Artificial
  CRISPR gRNA sequence
tatcaatggcttttgtctag

SEQ ID NO: 238605 - DNA, 20 bp, Artificial
  CRISPR gRNA sequence
ttgtctagtggatgctgact

SEQ ID NO: 238606 - DNA, 20 bp, Artificial
  CRISPR gRNA sequence
agtggatgctgactcagtgc

SEQ ID NO: 238607 - DNA, 20 bp, Artificial
  CRISPR gRNA sequence
gtggatgctgactcagtgcc

SEQ ID NO: 238608 - DNA, 20 bp, Artificial
  CRISPR gRNA sequence
ctcagtgccaggcacttgct

SEQ ID NO: 238609 - DNA, 20 bp, Artificial
  CRISPR gRNA sequence
ggcacttgctgagtacctta

SEQ ID NO: 238610 - DNA, 20 bp, Artificial
  CRISPR gRNA sequence
tacagaaataattgttgaac

SEQ ID NO: 238611 - DNA, 20 bp, Artificial
  CRISPR gRNA sequence
atttttcatgtaatccatac

SEQ ID NO: 238612 - DNA, 20 bp, Artificial
  CRISPR gRNA sequence
tcatttgttaaacccccttc

SEQ ID NO: 238613 - DNA, 20 bp, Artificial
  CRISPR gRNA sequence
ctccttgccttcctcaaata

SEQ ID NO: 238614 - DNA, 20 bp, Artificial
  CRISPR gRNA sequence
tccttgccttcctcaaatat

SEQ ID NO: 238615 - DNA, 20 bp, Artificial
  CRISPR gRNA sequence
tatgggtctaaactcatttt

SEQ ID NO: 238616 - DNA, 20 bp, Artificial
  CRISPR gRNA sequence
ggtctaaactcattttaagc

SEQ ID NO: 238617 - DNA, 20 bp, Artificial
  CRISPR gRNA sequence
ttttaagccagtttatcaac

SEQ ID NO: 238618 - DNA, 20 bp, Artificial
  CRISPR gRNA sequence
ttaagccagtttatcaacca

SEQ ID NO: 238619 - DNA, 20 bp, Artificial
  CRISPR gRNA sequence
taagccagtttatcaaccag

SEQ ID NO: 238620 - DNA, 20 bp, Artificial
  CRISPR gRNA sequence
aagccagtttatcaaccaga

SEQ ID NO: 238621 - DNA, 20 bp, Artificial
  CRISPR gRNA sequence
gtttatcaaccagagggaca

SEQ ID NO: 238622 - DNA, 20 bp, Artificial
  CRISPR gRNA sequence
ttatcaaccagagggacata

SEQ ID NO: 238623 - DNA, 20 bp, Artificial
  CRISPR gRNA sequence
tatcaaccagagggacatag

SEQ ID NO: 238624 - DNA, 20 bp, Artificial
  CRISPR gRNA sequence
atcaaccagagggacataga

SEQ ID NO: 238625 - DNA, 20 bp, Artificial
  CRISPR gRNA sequence
agagggacatagagggaaca

SEQ ID NO: 238626 - DNA, 20 bp, Artificial
  CRISPR gRNA sequence
gttttctgattcttctttgc

SEQ ID NO: 238627 - DNA, 20 bp, Artificial
  CRISPR gRNA sequence
cacacacacgcacacacaca

SEQ ID NO: 238628 - DNA, 20 bp, Artificial
  CRISPR gRNA sequence
acacatacatgcaataatcc

SEQ ID NO: 238629 - DNA, 20 bp, Artificial
  CRISPR gRNA sequence
cacatacatgcaataatcca

SEQ ID NO: 238630 - DNA, 20 bp, Artificial
  CRISPR gRNA sequence
catgcaataatccaaggctg

SEQ ID NO: 238631 - DNA, 20 bp, Artificial
  CRISPR gRNA sequence
atttaaatctgtcatttttc

SEQ ID NO: 238632 - DNA, 20 bp, Artificial
  CRISPR gRNA sequence
tctgtcatttttctagaacc

SEQ ID NO: 238633 - DNA, 20 bp, Artificial
  CRISPR gRNA sequence
ctgtcatttttctagaaccg

SEQ ID NO: 238634 - DNA, 20 bp, Artificial
  CRISPR gRNA sequence
aggtgtgctcttctatatgc

SEQ ID NO: 238635 - DNA, 20 bp, Artificial
  CRISPR gRNA sequence
tatgcaagctttctccacct

SEQ ID NO: 238636 - DNA, 20 bp, Artificial
  CRISPR gRNA sequence
acctcagcactattgacatt

SEQ ID NO: 238637 - DNA, 20 bp, Artificial
  CRISPR gRNA sequence
cctcagcactattgacattt

SEQ ID NO: 238638 - DNA, 20 bp, Artificial
  CRISPR gRNA sequence
ctcagcactattgacatttg

SEQ ID NO: 238639 - DNA, 20 bp, Artificial
  CRISPR gRNA sequence
agcactattgacatttgggg

SEQ ID NO: 238640 - DNA, 20 bp, Artificial
  CRISPR gRNA sequence
ggggcagcatcattctttgc

SEQ ID NO: 238641 - DNA, 20 bp, Artificial
  CRISPR gRNA sequence
gggcagcatcattctttgct

SEQ ID NO: 238642 - DNA, 20 bp, Artificial
  CRISPR gRNA sequence
gcagcatcattctttgctgg

SEQ ID NO: 238643 - DNA, 20 bp, Artificial
  CRISPR gRNA sequence
cagcatcattctttgctggg

SEQ ID NO: 238644 - DNA, 20 bp, Artificial
  CRISPR gRNA sequence
ctgggaggctgtcccgtgca

SEQ ID NO: 238645 - DNA, 20 bp, Artificial
  CRISPR gRNA sequence
ggaggctgtcccgtgcacgg

SEQ ID NO: 238646 - DNA, 20 bp, Artificial
  CRISPR gRNA sequence
gaggctgtcccgtgcacggt

SEQ ID NO: 238647 - DNA, 20 bp, Artificial
  CRISPR gRNA sequence
ggctgtcccgtgcacggtag

SEQ ID NO: 238648 - DNA, 20 bp, Artificial
  CRISPR gRNA sequence
tcccgtgcacggtaggagtt

SEQ ID NO: 238649 - DNA, 20 bp, Artificial
  CRISPR gRNA sequence
cgtgcacggtaggagttgag

SEQ ID NO: 238650 - DNA, 20 bp, Artificial
  CRISPR gRNA sequence
cattgctgacctctactcac

SEQ ID NO: 238651 - DNA, 20 bp, Artificial
  CRISPR gRNA sequence
cctctactcactagatgcaa

SEQ ID NO: 238652 - DNA, 20 bp, Artificial
  CRISPR gRNA sequence
taatcaccaccatcaccacc

SEQ ID NO: 238653 - DNA, 20 bp, Artificial
  CRISPR gRNA sequence
tcaccaccatcaccaccgag

SEQ ID NO: 238654 - DNA, 20 bp, Artificial
  CRISPR gRNA sequence
gtgaacactgcaactgtctc

SEQ ID NO: 238655 - DNA, 20 bp, Artificial
  CRISPR gRNA sequence
ccagacactgcaaatattcc

SEQ ID NO: 238656 - DNA, 20 bp, Artificial
  CRISPR gRNA sequence
cagacactgcaaatattccc

SEQ ID NO: 238657 - DNA, 20 bp, Artificial
  CRISPR gRNA sequence
agacactgcaaatattccca

SEQ ID NO: 238658 - DNA, 20 bp, Artificial
  CRISPR gRNA sequence
acgaaattgcccctgcgtga

SEQ ID NO: 238659 - DNA, 20 bp, Artificial
  CRISPR gRNA sequence
ttgcccctgcgtgatagcca

SEQ ID NO: 238660 - DNA, 20 bp, Artificial
  CRISPR gRNA sequence
tgcccctgcgtgatagccac

SEQ ID NO: 238661 - DNA, 20 bp, Artificial
  CRISPR gRNA sequence
gcccctgcgtgatagccacg

SEQ ID NO: 238662 - DNA, 20 bp, Artificial
  CRISPR gRNA sequence
ggctatatgaacctcatttc

SEQ ID NO: 238663 - DNA, 20 bp, Artificial
  CRISPR gRNA sequence
attttcctttctattataaa

SEQ ID NO: 238664 - DNA, 20 bp, Artificial
  CRISPR gRNA sequence
tataaaaagccttgccttgc

SEQ ID NO: 238665 - DNA, 20 bp, Artificial
  CRISPR gRNA sequence
taaaaagccttgccttgcca

SEQ ID NO: 238666 - DNA, 20 bp, Artificial
  CRISPR gRNA sequence
ttacgttgtttgaatatata

SEQ ID NO: 238667 - DNA, 20 bp, Artificial
  CRISPR gRNA sequence
tacgttgtttgaatatatac

SEQ ID NO: 238668 - DNA, 20 bp, Artificial
  CRISPR gRNA sequence
cgttgtttgaatatatacag

SEQ ID NO: 238669 - DNA, 20 bp, Artificial
  CRISPR gRNA sequence
ctttctgccccgtttaacaa

SEQ ID NO: 238670 - DNA, 20 bp, Artificial
  CRISPR gRNA sequence
ttctgccccgtttaacaaca

SEQ ID NO: 238671 - DNA, 20 bp, Artificial
  CRISPR gRNA sequence
cccgtttaacaacagagaaa

SEQ ID NO: 238672 - DNA, 20 bp, Artificial
  CRISPR gRNA sequence
cgtttaacaacagagaaacg

SEQ ID NO: 238673 - DNA, 20 bp, Artificial
  CRISPR gRNA sequence
acaacagagaaacggagcgt

SEQ ID NO: 238674 - DNA, 20 bp, Artificial
  CRISPR gRNA sequence
caacagagaaacggagcgtg

SEQ ID NO: 238675 - DNA, 20 bp, Artificial
  CRISPR gRNA sequence
cagagaaacggagcgtgagg

SEQ ID NO: 238676 - DNA, 20 bp, Artificial
  CRISPR gRNA sequence
aaacggagcgtgaggaagaa

SEQ ID NO: 238677 - DNA, 20 bp, Artificial
  CRISPR gRNA sequence
cggagcgtgaggaagaacag

SEQ ID NO: 238678 - DNA, 20 bp, Artificial
  CRISPR gRNA sequence
ggagcgtgaggaagaacagc

SEQ ID NO: 238679 - DNA, 20 bp, Artificial
  CRISPR gRNA sequence
gcgtgaggaagaacagcagg

SEQ ID NO: 238680 - DNA, 20 bp, Artificial
  CRISPR gRNA sequence
gtgaggaagaacagcaggaa

SEQ ID NO: 238681 - DNA, 20 bp, Artificial
  CRISPR gRNA sequence
gaacagcaggaagagcaacg

SEQ ID NO: 238682 - DNA, 20 bp, Artificial
  CRISPR gRNA sequence
aagagcaacgcagtcgacgt

SEQ ID NO: 238683 - DNA, 20 bp, Artificial
  CRISPR gRNA sequence
aacgcagtcgacgtcagcgc

SEQ ID NO: 238684 - DNA, 20 bp, Artificial
  CRISPR gRNA sequence
cagtcgacgtcagcgcaaga

SEQ ID NO: 238685 - DNA, 20 bp, Artificial
  CRISPR gRNA sequence
tcgacgtcagcgcaagaaag

SEQ ID NO: 238686 - DNA, 20 bp, Artificial
  CRISPR gRNA sequence
cgacgtcagcgcaagaaaga

SEQ ID NO: 238687 - DNA, 20 bp, Artificial
  CRISPR gRNA sequence
acgtcagcgcaagaaagaag

SEQ ID NO: 238688 - DNA, 20 bp, Artificial
  CRISPR gRNA sequence
agaaagaaggagatgatctg

SEQ ID NO: 238689 - DNA, 20 bp, Artificial
  CRISPR gRNA sequence
aaagaaggagatgatctgcg

SEQ ID NO: 238690 - DNA, 20 bp, Artificial
  CRISPR gRNA sequence
agaaggagatgatctgcgga

SEQ ID NO: 238691 - DNA, 20 bp, Artificial
  CRISPR gRNA sequence
ggagagtgtcctgcaaaaca

SEQ ID NO: 238692 - DNA, 20 bp, Artificial
  CRISPR gRNA sequence
tgtcctgcaaaacacagcaa

SEQ ID NO: 238693 - DNA, 20 bp, Artificial
  CRISPR gRNA sequence
gtcctgcaaaacacagcaaa

SEQ ID NO: 238694 - DNA, 20 bp, Artificial
  CRISPR gRNA sequence
cctgcaaaacacagcaaaag

SEQ ID NO: 238695 - DNA, 20 bp, Artificial
  CRISPR gRNA sequence
agcaaaaggagaaacgcatg

SEQ ID NO: 238696 - DNA, 20 bp, Artificial
  CRISPR gRNA sequence
acccatgtatatatttacat

SEQ ID NO: 238697 - DNA, 20 bp, Artificial
  CRISPR gRNA sequence
atttacattggtaaatttct

SEQ ID NO: 238698 - DNA, 20 bp, Artificial
  CRISPR gRNA sequence
attggtaaatttctaagcat

SEQ ID NO: 238699 - DNA, 20 bp, Artificial
  CRISPR gRNA sequence
ggtaaatttctaagcatgag

SEQ ID NO: 238700 - DNA, 20 bp, Artificial
  CRISPR gRNA sequence
tctaagcatgagaagaatca

SEQ ID NO: 238701 - DNA, 20 bp, Artificial
  CRISPR gRNA sequence
catgagaagaatcacagcct

SEQ ID NO: 238702 - DNA, 20 bp, Artificial
  CRISPR gRNA sequence
atgagaagaatcacagcctt

SEQ ID NO: 238703 - DNA, 20 bp, Artificial
  CRISPR gRNA sequence
gggcatctccaacctgctaa

SEQ ID NO: 238704 - DNA, 20 bp, Artificial
  CRISPR gRNA sequence
gcatctccaacctgctaatg

SEQ ID NO: 238705 - DNA, 20 bp, Artificial
  CRISPR gRNA sequence
acctgctaatggagtaaact

SEQ ID NO: 238706 - DNA, 20 bp, Artificial
  CRISPR gRNA sequence
gtaaacttagaaaactttta

SEQ ID NO: 238707 - DNA, 20 bp, Artificial
  CRISPR gRNA sequence
aaacttagaaaacttttaaa

SEQ ID NO: 238708 - DNA, 20 bp, Artificial
  CRISPR gRNA sequence
aacttagaaaacttttaaag

SEQ ID NO: 238709 - DNA, 20 bp, Artificial
  CRISPR gRNA sequence
tagaaaacttttaaagaggc

SEQ ID NO: 238710 - DNA, 20 bp, Artificial
  CRISPR gRNA sequence
acttttaaagaggccagaca

SEQ ID NO: 238711 - DNA, 20 bp, Artificial
  CRISPR gRNA sequence
tttaaagaggccagacatgg

SEQ ID NO: 238712 - DNA, 20 bp, Artificial
  CRISPR gRNA sequence
cgcctgtaatcccaacactt

SEQ ID NO: 238713 - DNA, 20 bp, Artificial
  CRISPR gRNA sequence
ctgtaatcccaacactttgg

SEQ ID NO: 238714 - DNA, 20 bp, Artificial
  CRISPR gRNA sequence
tgtaatcccaacactttgga

SEQ ID NO: 238715 - DNA, 20 bp, Artificial
  CRISPR gRNA sequence
tcccaacactttggaaggcc

SEQ ID NO: 238716 - DNA, 20 bp, Artificial
  CRISPR gRNA sequence
cccaacactttggaaggccg

SEQ ID NO: 238717 - DNA, 20 bp, Artificial
  CRISPR gRNA sequence
aacactttggaaggccgagg

SEQ ID NO: 238718 - DNA, 20 bp, Artificial
  CRISPR gRNA sequence
acactttggaaggccgaggc

SEQ ID NO: 238719 - DNA, 20 bp, Artificial
  CRISPR gRNA sequence
actttggaaggccgaggcag

SEQ ID NO: 238720 - DNA, 20 bp, Artificial
  CRISPR gRNA sequence
ctttggaaggccgaggcagg

SEQ ID NO: 238721 - DNA, 20 bp, Artificial
  CRISPR gRNA sequence
gccgaggcaggaggatcact

SEQ ID NO: 238722 - DNA, 20 bp, Artificial
  CRISPR gRNA sequence
cgaggcaggaggatcactta

SEQ ID NO: 238723 - DNA, 20 bp, Artificial
  CRISPR gRNA sequence
gcaggaggatcacttagagt

SEQ ID NO: 238724 - DNA, 20 bp, Artificial
  CRISPR gRNA sequence
caggaggatcacttagagtc

SEQ ID NO: 238725 - DNA, 20 bp, Artificial
  CRISPR gRNA sequence
ggaggatcacttagagtcag

SEQ ID NO: 238726 - DNA, 20 bp, Artificial
  CRISPR gRNA sequence
tcacttagagtcaggagttc

SEQ ID NO: 238727 - DNA, 20 bp, Artificial
  CRISPR gRNA sequence
tagagtcaggagttcaagac

SEQ ID NO: 238728 - DNA, 20 bp, Artificial
  CRISPR gRNA sequence
tcaggagttcaagaccagcc

SEQ ID NO: 238729 - DNA, 20 bp, Artificial
  CRISPR gRNA sequence
caagaccagcctggccaaca

SEQ ID NO: 238730 - DNA, 20 bp, Artificial
  CRISPR gRNA sequence
gaccagcctggccaacatag

SEQ ID NO: 238731 - DNA, 20 bp, Artificial
  CRISPR gRNA sequence
cagcctggccaacatagtgg

SEQ ID NO: 238732 - DNA, 20 bp, Artificial
  CRISPR gRNA sequence
cctggccaacatagtggtgg

SEQ ID NO: 238733 - DNA, 20 bp, Artificial
  CRISPR gRNA sequence
ctggccaacatagtggtggc

SEQ ID NO: 238734 - DNA, 20 bp, Artificial
  CRISPR gRNA sequence
gtggcaggaacttgtaatcc

SEQ ID NO: 238735 - DNA, 20 bp, Artificial
  CRISPR gRNA sequence
aacttgtaatcccagctact

SEQ ID NO: 238736 - DNA, 20 bp, Artificial
  CRISPR gRNA sequence
ttgtaatcccagctacttgg

SEQ ID NO: 238737 - DNA, 20 bp, Artificial
  CRISPR gRNA sequence
tgtaatcccagctacttggc

SEQ ID NO: 238738 - DNA, 20 bp, Artificial
  CRISPR gRNA sequence
tcccagctacttggcaggat

SEQ ID NO: 238739 - DNA, 20 bp, Artificial
  CRISPR gRNA sequence
cccagctacttggcaggatg

SEQ ID NO: 238740 - DNA, 20 bp, Artificial
  CRISPR gRNA sequence
agctacttggcaggatgagg

SEQ ID NO: 238741 - DNA, 20 bp, Artificial
  CRISPR gRNA sequence
gctacttggcaggatgaggc

SEQ ID NO: 238742 - DNA, 20 bp, Artificial
  CRISPR gRNA sequence
tacttggcaggatgaggcag

SEQ ID NO: 238743 - DNA, 20 bp, Artificial
  CRISPR gRNA sequence
ggcaggatgaggcaggagaa

SEQ ID NO: 238744 - DNA, 20 bp, Artificial
  CRISPR gRNA sequence
gcaggagaatggcttgaacc

SEQ ID NO: 238745 - DNA, 20 bp, Artificial
  CRISPR gRNA sequence
caggagaatggcttgaaccc

SEQ ID NO: 238746 - DNA, 20 bp, Artificial
  CRISPR gRNA sequence
ggagaatggcttgaacccgg

SEQ ID NO: 238747 - DNA, 20 bp, Artificial
  CRISPR gRNA sequence
gagaatggcttgaacccggg

SEQ ID NO: 238748 - DNA, 20 bp, Artificial
  CRISPR gRNA sequence
aatggcttgaacccgggagg

SEQ ID NO: 238749 - DNA, 20 bp, Artificial
  CRISPR gRNA sequence
tggcttgaacccgggaggcg

SEQ ID NO: 238750 - DNA, 20 bp, Artificial
  CRISPR gRNA sequence
ggcttgaacccgggaggcgg

SEQ ID NO: 238751 - DNA, 20 bp, Artificial
  CRISPR gRNA sequence
aacccgggaggcggaggttg

SEQ ID NO: 238752 - DNA, 20 bp, Artificial
  CRISPR gRNA sequence
cgggaggcggaggttgcagt

SEQ ID NO: 238753 - DNA, 20 bp, Artificial
  CRISPR gRNA sequence
ggcggaggttgcagtgagct

SEQ ID NO: 238754 - DNA, 20 bp, Artificial
  CRISPR gRNA sequence
gaggttgcagtgagctaaga

SEQ ID NO: 238755 - DNA, 20 bp, Artificial
  CRISPR gRNA sequence
ggtgccactgcactccaacc

SEQ ID NO: 238756 - DNA, 20 bp, Artificial
  CRISPR gRNA sequence
gtgccactgcactccaacct

SEQ ID NO: 238757 - DNA, 20 bp, Artificial
  CRISPR gRNA sequence
ctgcactccaacctgggcaa

SEQ ID NO: 238758 - DNA, 20 bp, Artificial
  CRISPR gRNA sequence
gcactccaacctgggcaaca

SEQ ID NO: 238759 - DNA, 20 bp, Artificial
  CRISPR gRNA sequence
tccaacctgggcaacagagt

SEQ ID NO: 238760 - DNA, 20 bp, Artificial
  CRISPR gRNA sequence
tgagactccatctcaaaaaa

SEQ ID NO: 238761 - DNA, 20 bp, Artificial
  CRISPR gRNA sequence
ctccatctcaaaaaaaagaa

SEQ ID NO: 238762 - DNA, 20 bp, Artificial
  CRISPR gRNA sequence
atctcaaaaaaaagaaaaga

SEQ ID NO: 238763 - DNA, 20 bp, Artificial
  CRISPR gRNA sequence
aaaaaaaagaaaagaaagaa

SEQ ID NO: 238764 - DNA, 20 bp, Artificial
  CRISPR gRNA sequence
aagaaaagaaagaaaagaaa

SEQ ID NO: 238765 - DNA, 20 bp, Artificial
  CRISPR gRNA sequence
gaaaagaaagaaaagaaaaa

SEQ ID NO: 238766 - DNA, 20 bp, Artificial
  CRISPR gRNA sequence
aaagaaaaagagaaacttaa

SEQ ID NO: 238767 - DNA, 20 bp, Artificial
  CRISPR gRNA sequence
gaaaaagagaaacttaatgg

SEQ ID NO: 238768 - DNA, 20 bp, Artificial
  CRISPR gRNA sequence
aaaaagagaaacttaatggc

SEQ ID NO: 238769 - DNA, 20 bp, Artificial
  CRISPR gRNA sequence
aaaagagaaacttaatggca

SEQ ID NO: 238770 - DNA, 20 bp, Artificial
  CRISPR gRNA sequence
aagagaaacttaatggcagg

SEQ ID NO: 238771 - DNA, 20 bp, Artificial
  CRISPR gRNA sequence
agaaacttaatggcagggag

SEQ ID NO: 238772 - DNA, 20 bp, Artificial
  CRISPR gRNA sequence
aacttaatggcagggagcgg

SEQ ID NO: 238773 - DNA, 20 bp, Artificial
  CRISPR gRNA sequence
gtggctcacacctgtaatcc

SEQ ID NO: 238774 - DNA, 20 bp, Artificial
  CRISPR gRNA sequence
cacctgtaatcctagcactt

SEQ ID NO: 238775 - DNA, 20 bp, Artificial
  CRISPR gRNA sequence
acctgtaatcctagcacttt

SEQ ID NO: 238776 - DNA, 20 bp, Artificial
  CRISPR gRNA sequence
ctgtaatcctagcactttgg

SEQ ID NO: 238777 - DNA, 20 bp, Artificial
  CRISPR gRNA sequence
tgtaatcctagcactttggg

SEQ ID NO: 238778 - DNA, 20 bp, Artificial
  CRISPR gRNA sequence
tcctagcactttgggaggcc

SEQ ID NO: 238779 - DNA, 20 bp, Artificial
  CRISPR gRNA sequence
cctagcactttgggaggcca

SEQ ID NO: 238780 - DNA, 20 bp, Artificial
  CRISPR gRNA sequence
agcactttgggaggccaagg

SEQ ID NO: 238781 - DNA, 20 bp, Artificial
  CRISPR gRNA sequence
gcactttgggaggccaaggt

SEQ ID NO: 238782 - DNA, 20 bp, Artificial
  CRISPR gRNA sequence
ctttgggaggccaaggtggg

SEQ ID NO: 238783 - DNA, 20 bp, Artificial
  CRISPR gRNA sequence
ccaaggtgggcagatcacct

SEQ ID NO: 238784 - DNA, 20 bp, Artificial
  CRISPR gRNA sequence
caaggtgggcagatcacctg

SEQ ID NO: 238785 - DNA, 20 bp, Artificial
  CRISPR gRNA sequence
tgggcagatcacctgaggtc

SEQ ID NO: 238786 - DNA, 20 bp, Artificial
  CRISPR gRNA sequence
ggcagatcacctgaggtcaa

SEQ ID NO: 238787 - DNA, 20 bp, Artificial
  CRISPR gRNA sequence
tgaggtcaagagtttgaaac

SEQ ID NO: 238788 - DNA, 20 bp, Artificial
  CRISPR gRNA sequence
tcaagagtttgaaaccagcc

SEQ ID NO: 238789 - DNA, 20 bp, Artificial
  CRISPR gRNA sequence
tgaaaccagcctggccaaca

SEQ ID NO: 238790 - DNA, 20 bp, Artificial
  CRISPR gRNA sequence
aaaccagcctggccaacatg

SEQ ID NO: 238791 - DNA, 20 bp, Artificial
  CRISPR gRNA sequence
tctactaaaaatacaaaaat

SEQ ID NO: 238792 - DNA, 20 bp, Artificial
  CRISPR gRNA sequence
ctaaaaatacaaaaattagc

SEQ ID NO: 238793 - DNA, 20 bp, Artificial
  CRISPR gRNA sequence
taaaaatacaaaaattagct

SEQ ID NO: 238794 - DNA, 20 bp, Artificial
  CRISPR gRNA sequence
caaaaattagctgggtgccg

SEQ ID NO: 238795 - DNA, 20 bp, Artificial
  CRISPR gRNA sequence
aaattagctgggtgccgtgg

SEQ ID NO: 238796 - DNA, 20 bp, Artificial
  CRISPR gRNA sequence
aattagctgggtgccgtggt

SEQ ID NO: 238797 - DNA, 20 bp, Artificial
  CRISPR gRNA sequence
gtggtgggcgcctgtaatcc

SEQ ID NO: 238798 - DNA, 20 bp, Artificial
  CRISPR gRNA sequence
cgcctgtaatcccagctact

SEQ ID NO: 238799 - DNA, 20 bp, Artificial
  CRISPR gRNA sequence
gcctgtaatcccagctactc

SEQ ID NO: 238800 - DNA, 20 bp, Artificial
  CRISPR gRNA sequence
ctgtaatcccagctactcag

SEQ ID NO: 238801 - DNA, 20 bp, Artificial
  CRISPR gRNA sequence
tgtaatcccagctactcagg

SEQ ID NO: 238802 - DNA, 20 bp, Artificial
  CRISPR gRNA sequence
tcccagctactcaggaggct

SEQ ID NO: 238803 - DNA, 20 bp, Artificial
  CRISPR gRNA sequence
agctactcaggaggctgagt

SEQ ID NO: 238804 - DNA, 20 bp, Artificial
  CRISPR gRNA sequence
gctactcaggaggctgagtc

SEQ ID NO: 238805 - DNA, 20 bp, Artificial
  CRISPR gRNA sequence
tactcaggaggctgagtcag

SEQ ID NO: 238806 - DNA, 20 bp, Artificial
  CRISPR gRNA sequence
tcaggagaatcgcttgaacc

SEQ ID NO: 238807 - DNA, 20 bp, Artificial
  CRISPR gRNA sequence
caggagaatcgcttgaacct

SEQ ID NO: 238808 - DNA, 20 bp, Artificial
  CRISPR gRNA sequence
ggagaatcgcttgaacctgg

SEQ ID NO: 238809 - DNA, 20 bp, Artificial
  CRISPR gRNA sequence
gagaatcgcttgaacctggg

SEQ ID NO: 238810 - DNA, 20 bp, Artificial
  CRISPR gRNA sequence
aatcgcttgaacctgggagg

SEQ ID NO: 238811 - DNA, 20 bp, Artificial
  CRISPR gRNA sequence
tcgcttgaacctgggaggta

SEQ ID NO: 238812 - DNA, 20 bp, Artificial
  CRISPR gRNA sequence
cgcttgaacctgggaggtag

SEQ ID NO: 238813 - DNA, 20 bp, Artificial
  CRISPR gRNA sequence
aacctgggaggtagaggttg

SEQ ID NO: 238814 - DNA, 20 bp, Artificial
  CRISPR gRNA sequence
tgggaggtagaggttgcagt

SEQ ID NO: 238815 - DNA, 20 bp, Artificial
  CRISPR gRNA sequence
ggtagaggttgcagtgagcc

SEQ ID NO: 238816 - DNA, 20 bp, Artificial
  CRISPR gRNA sequence
gagattgcgccattgcactc

SEQ ID NO: 238817 - DNA, 20 bp, Artificial
  CRISPR gRNA sequence
tgcgccattgcactccagcc

SEQ ID NO: 238818 - DNA, 20 bp, Artificial
  CRISPR gRNA sequence
gcgccattgcactccagcct

SEQ ID NO: 238819 - DNA, 20 bp, Artificial
  CRISPR gRNA sequence
ttgcactccagcctgggtga

SEQ ID NO: 238820 - DNA, 20 bp, Artificial
  CRISPR gRNA sequence
gcactccagcctgggtgaca

SEQ ID NO: 238821 - DNA, 20 bp, Artificial
  CRISPR gRNA sequence
actccagcctgggtgacaga

SEQ ID NO: 238822 - DNA, 20 bp, Artificial
  CRISPR gRNA sequence
tccagcctgggtgacagaga

SEQ ID NO: 238823 - DNA, 20 bp, Artificial
  CRISPR gRNA sequence
ccacccccccaaaaaaataa

SEQ ID NO: 238824 - DNA, 20 bp, Artificial
  CRISPR gRNA sequence
ataaaagaaacttaataatt

SEQ ID NO: 238825 - DNA, 20 bp, Artificial
  CRISPR gRNA sequence
aaagaaacttaataattgag

SEQ ID NO: 238826 - DNA, 20 bp, Artificial
  CRISPR gRNA sequence
attgagcagtttatcctttc

SEQ ID NO: 238827 - DNA, 20 bp, Artificial
  CRISPR gRNA sequence
agtttatcctttctagcaca

SEQ ID NO: 238828 - DNA, 20 bp, Artificial
  CRISPR gRNA sequence
tttctagcacatagaaaata

SEQ ID NO: 238829 - DNA, 20 bp, Artificial
  CRISPR gRNA sequence
ttctagcacatagaaaatat

SEQ ID NO: 238830 - DNA, 20 bp, Artificial
  CRISPR gRNA sequence
cacatagaaaatatgggacc

SEQ ID NO: 238831 - DNA, 20 bp, Artificial
  CRISPR gRNA sequence
acatagaaaatatgggacct

SEQ ID NO: 238832 - DNA, 20 bp, Artificial
  CRISPR gRNA sequence
catagaaaatatgggacctg

SEQ ID NO: 238833 - DNA, 20 bp, Artificial
  CRISPR gRNA sequence
aaaatatgggacctggggac

SEQ ID NO: 238834 - DNA, 20 bp, Artificial
  CRISPR gRNA sequence
aaatatgggacctggggacc

SEQ ID NO: 238835 - DNA, 20 bp, Artificial
  CRISPR gRNA sequence
tgggacctggggaccaggcg

SEQ ID NO: 238836 - DNA, 20 bp, Artificial
  CRISPR gRNA sequence
gacctggggaccaggcgtgg

SEQ ID NO: 238837 - DNA, 20 bp, Artificial
  CRISPR gRNA sequence
tgcctgtaatcccaacactt

SEQ ID NO: 238838 - DNA, 20 bp, Artificial
  CRISPR gRNA sequence
gcctgtaatcccaacacttt

SEQ ID NO: 238839 - DNA, 20 bp, Artificial
  CRISPR gRNA sequence
ctgtaatcccaacactttgg

SEQ ID NO: 238840 - DNA, 20 bp, Artificial
  CRISPR gRNA sequence
tcccaacactttgggagccc

SEQ ID NO: 238841 - DNA, 20 bp, Artificial
  CRISPR gRNA sequence
cccaacactttgggagccca

SEQ ID NO: 238842 - DNA, 20 bp, Artificial
  CRISPR gRNA sequence
aacactttgggagcccaagg

SEQ ID NO: 238843 - DNA, 20 bp, Artificial
  CRISPR gRNA sequence
acactttgggagcccaaggc

SEQ ID NO: 238844 - DNA, 20 bp, Artificial
  CRISPR gRNA sequence
actttgggagcccaaggcag

SEQ ID NO: 238845 - DNA, 20 bp, Artificial
  CRISPR gRNA sequence
ctttgggagcccaaggcagg

SEQ ID NO: 238846 - DNA, 20 bp, Artificial
  CRISPR gRNA sequence
ccaaggcaggaggattgctt

SEQ ID NO: 238847 - DNA, 20 bp, Artificial
  CRISPR gRNA sequence
caggaggattgcttgagccc

SEQ ID NO: 238848 - DNA, 20 bp, Artificial
  CRISPR gRNA sequence
ggaggattgcttgagcccaa

SEQ ID NO: 238849 - DNA, 20 bp, Artificial
  CRISPR gRNA sequence
ttgcttgagcccaagagttt

SEQ ID NO: 238850 - DNA, 20 bp, Artificial
  CRISPR gRNA sequence
gcttgagcccaagagtttga

SEQ ID NO: 238851 - DNA, 20 bp, Artificial
  CRISPR gRNA sequence
tgagcccaagagtttgagag

SEQ ID NO: 238852 - DNA, 20 bp, Artificial
  CRISPR gRNA sequence
caagagtttgagagcagcct

SEQ ID NO: 238853 - DNA, 20 bp, Artificial
  CRISPR gRNA sequence
tgagagcagcctgagcaaca

SEQ ID NO: 238854 - DNA, 20 bp, Artificial
  CRISPR gRNA sequence
agcagcctgagcaacatagc

SEQ ID NO: 238855 - DNA, 20 bp, Artificial
  CRISPR gRNA sequence
ctgccaaaaaaataaaaaat

SEQ ID NO: 238856 - DNA, 20 bp, Artificial
  CRISPR gRNA sequence
caaaaaaataaaaaattagc

SEQ ID NO: 238857 - DNA, 20 bp, Artificial
  CRISPR gRNA sequence
aaaaaaataaaaaattagcc

SEQ ID NO: 238858 - DNA, 20 bp, Artificial
  CRISPR gRNA sequence
aataaaaaattagccaggtg

SEQ ID NO: 238859 - DNA, 20 bp, Artificial
  CRISPR gRNA sequence
aaaaaattagccaggtgtag

SEQ ID NO: 238860 - DNA, 20 bp, Artificial
  CRISPR gRNA sequence
aattagccaggtgtagtggt

SEQ ID NO: 238861 - DNA, 20 bp, Artificial
  CRISPR gRNA sequence
ggtgtagtggtgagtgccta

SEQ ID NO: 238862 - DNA, 20 bp, Artificial
  CRISPR gRNA sequence
gtggtgagtgcctatagtcc

SEQ ID NO: 238863 - DNA, 20 bp, Artificial
  CRISPR gRNA sequence
gtgcctatagtcccagctac

SEQ ID NO: 238864 - DNA, 20 bp, Artificial
  CRISPR gRNA sequence
tgcctatagtcccagctact

SEQ ID NO: 238865 - DNA, 20 bp, Artificial
  CRISPR gRNA sequence
gcctatagtcccagctactg

SEQ ID NO: 238866 - DNA, 20 bp, Artificial
  CRISPR gRNA sequence
ctatagtcccagctactggg

SEQ ID NO: 238867 - DNA, 20 bp, Artificial
  CRISPR gRNA sequence
tatagtcccagctactgggg

SEQ ID NO: 238868 - DNA, 20 bp, Artificial
  CRISPR gRNA sequence
tcccagctactggggaggct

SEQ ID NO: 238869 - DNA, 20 bp, Artificial
  CRISPR gRNA sequence
cccagctactggggaggctg

SEQ ID NO: 238870 - DNA, 20 bp, Artificial
  CRISPR gRNA sequence
agctactggggaggctgagg

SEQ ID NO: 238871 - DNA, 20 bp, Artificial
  CRISPR gRNA sequence
gctactggggaggctgaggt

SEQ ID NO: 238872 - DNA, 20 bp, Artificial
  CRISPR gRNA sequence
tactggggaggctgaggtgg

SEQ ID NO: 238873 - DNA, 20 bp, Artificial
  CRISPR gRNA sequence
actggggaggctgaggtggg

SEQ ID NO: 238874 - DNA, 20 bp, Artificial
  CRISPR gRNA sequence
ggaggctgaggtgggaggat

SEQ ID NO: 238875 - DNA, 20 bp, Artificial
  CRISPR gRNA sequence
ctgaggtgggaggattggtt

SEQ ID NO: 238876 - DNA, 20 bp, Artificial
  CRISPR gRNA sequence
gtgggaggattggttgagca

SEQ ID NO: 238877 - DNA, 20 bp, Artificial
  CRISPR gRNA sequence
tgggaggattggttgagcac

SEQ ID NO: 238878 - DNA, 20 bp, Artificial
  CRISPR gRNA sequence
ggaggattggttgagcacag

SEQ ID NO: 238879 - DNA, 20 bp, Artificial
  CRISPR gRNA sequence
gaggattggttgagcacagg

SEQ ID NO: 238880 - DNA, 20 bp, Artificial
  CRISPR gRNA sequence
gattggttgagcacaggagg

SEQ ID NO: 238881 - DNA, 20 bp, Artificial
  CRISPR gRNA sequence
ttggttgagcacaggaggtg

SEQ ID NO: 238882 - DNA, 20 bp, Artificial
  CRISPR gRNA sequence
tggttgagcacaggaggtgg

SEQ ID NO: 238883 - DNA, 20 bp, Artificial
  CRISPR gRNA sequence
agcacaggaggtggaggttg

SEQ ID NO: 238884 - DNA, 20 bp, Artificial
  CRISPR gRNA sequence
caggaggtggaggttgcagt

SEQ ID NO: 238885 - DNA, 20 bp, Artificial
  CRISPR gRNA sequence
ggttgcagtgagccaatatc

SEQ ID NO: 238886 - DNA, 20 bp, Artificial
  CRISPR gRNA sequence
aatatcaagccactgcactc

SEQ ID NO: 238887 - DNA, 20 bp, Artificial
  CRISPR gRNA sequence
caagccactgcactccagcc

SEQ ID NO: 238888 - DNA, 20 bp, Artificial
  CRISPR gRNA sequence
cactgcactccagcctggca

SEQ ID NO: 238889 - DNA, 20 bp, Artificial
  CRISPR gRNA sequence
actccagcctggcacagaac

SEQ ID NO: 238890 - DNA, 20 bp, Artificial
  CRISPR gRNA sequence
ctccagcctggcacagaaca

SEQ ID NO: 238891 - DNA, 20 bp, Artificial
  CRISPR gRNA sequence
ggcacagaacaaggcactct

SEQ ID NO: 238892 - DNA, 20 bp, Artificial
  CRISPR gRNA sequence
gcacagaacaaggcactctc

SEQ ID NO: 238893 - DNA, 20 bp, Artificial
  CRISPR gRNA sequence
cacagaacaaggcactctcg

SEQ ID NO: 238894 - DNA, 20 bp, Artificial
  CRISPR gRNA sequence
acagaacaaggcactctcgg

SEQ ID NO: 238895 - DNA, 20 bp, Artificial
  CRISPR gRNA sequence
gcactctcgggggaaaaaaa

SEQ ID NO: 238896 - DNA, 20 bp, Artificial
  CRISPR gRNA sequence
tctcgggggaaaaaaaaagc

SEQ ID NO: 238897 - DNA, 20 bp, Artificial
  CRISPR gRNA sequence
tcgggggaaaaaaaaagcga

SEQ ID NO: 238898 - DNA, 20 bp, Artificial
  CRISPR gRNA sequence
gggggaaaaaaaaagcgaga

SEQ ID NO: 238899 - DNA, 20 bp, Artificial
  CRISPR gRNA sequence
gggaaaaaaaaagcgagaga

SEQ ID NO: 238900 - DNA, 20 bp, Artificial
  CRISPR gRNA sequence
aaaaaaaagcgagagagaga

SEQ ID NO: 238901 - DNA, 20 bp, Artificial
  CRISPR gRNA sequence
agcgagagagagaaagaaaa

SEQ ID NO: 238902 - DNA, 20 bp, Artificial
  CRISPR gRNA sequence
gagagagaaagaaaaaagaa

SEQ ID NO: 238903 - DNA, 20 bp, Artificial
  CRISPR gRNA sequence
agaaaaaagaaaagaaaata

SEQ ID NO: 238904 - DNA, 20 bp, Artificial
  CRISPR gRNA sequence
gaaaaaagaaaagaaaatat

SEQ ID NO: 238905 - DNA, 20 bp, Artificial
  CRISPR gRNA sequence
gaaaagaaaatatgggaccc

SEQ ID NO: 238906 - DNA, 20 bp, Artificial
  CRISPR gRNA sequence
agaaaatatgggaccctgga

SEQ ID NO: 238907 - DNA, 20 bp, Artificial
  CRISPR gRNA sequence
gaaaatatgggaccctggac

SEQ ID NO: 238908 - DNA, 20 bp, Artificial
  CRISPR gRNA sequence
tatgggaccctggacgggcg

SEQ ID NO: 238909 - DNA, 20 bp, Artificial
  CRISPR gRNA sequence
gggaccctggacgggcgtgg

SEQ ID NO: 238910 - DNA, 20 bp, Artificial
  CRISPR gRNA sequence
gtggctcacacctgtaatcc

SEQ ID NO: 238911 - DNA, 20 bp, Artificial
  CRISPR gRNA sequence
cacctgtaatcccagcactt

SEQ ID NO: 238912 - DNA, 20 bp, Artificial
  CRISPR gRNA sequence
acctgtaatcccagcacttt

SEQ ID NO: 238913 - DNA, 20 bp, Artificial
  CRISPR gRNA sequence
ctgtaatcccagcactttgg

SEQ ID NO: 238914 - DNA, 20 bp, Artificial
  CRISPR gRNA sequence
tgtaatcccagcactttggg

SEQ ID NO: 238915 - DNA, 20 bp, Artificial
  CRISPR gRNA sequence
tcccagcactttgggaggcc

SEQ ID NO: 238916 - DNA, 20 bp, Artificial
  CRISPR gRNA sequence
cccagcactttgggaggccg

SEQ ID NO: 238917 - DNA, 20 bp, Artificial
  CRISPR gRNA sequence
agcactttgggaggccgagg

SEQ ID NO: 238918 - DNA, 20 bp, Artificial
  CRISPR gRNA sequence
gcactttgggaggccgaggt

SEQ ID NO: 238919 - DNA, 20 bp, Artificial
  CRISPR gRNA sequence
ctttgggaggccgaggtggg

SEQ ID NO: 238920 - DNA, 20 bp, Artificial
  CRISPR gRNA sequence
gccgaggtgggcggatcatg

SEQ ID NO: 238921 - DNA, 20 bp, Artificial
  CRISPR gRNA sequence
aggtgggcggatcatgcggt

SEQ ID NO: 238922 - DNA, 20 bp, Artificial
  CRISPR gRNA sequence
ggtgggcggatcatgcggtc

SEQ ID NO: 238923 - DNA, 20 bp, Artificial
  CRISPR gRNA sequence
tgggcggatcatgcggtcag

SEQ ID NO: 238924 - DNA, 20 bp, Artificial
  CRISPR gRNA sequence
gatcatgcggtcaggagttc

SEQ ID NO: 238925 - DNA, 20 bp, Artificial
  CRISPR gRNA sequence
tgcggtcaggagttcaagac

SEQ ID NO: 238926 - DNA, 20 bp, Artificial
  CRISPR gRNA sequence
tcaggagttcaagaccagac

SEQ ID NO: 238927 - DNA, 20 bp, Artificial
  CRISPR gRNA sequence
gagttcaagaccagactggc

SEQ ID NO: 238928 - DNA, 20 bp, Artificial
  CRISPR gRNA sequence
caagaccagactggccagca

SEQ ID NO: 238929 - DNA, 20 bp, Artificial
  CRISPR gRNA sequence
tctactaaaaatacaaaaat

SEQ ID NO: 238930 - DNA, 20 bp, Artificial
  CRISPR gRNA sequence
ctaaaaatacaaaaattagc

SEQ ID NO: 238931 - DNA, 20 bp, Artificial
  CRISPR gRNA sequence
taaaaatacaaaaattagcc

SEQ ID NO: 238932 - DNA, 20 bp, Artificial
  CRISPR gRNA sequence
atacaaaaattagccgggcg

SEQ ID NO: 238933 - DNA, 20 bp, Artificial
  CRISPR gRNA sequence
caaaaattagccgggcgtgg

SEQ ID NO: 238934 - DNA, 20 bp, Artificial
  CRISPR gRNA sequence
gtggtgcatgcctataatcc

SEQ ID NO: 238935 - DNA, 20 bp, Artificial
  CRISPR gRNA sequence
tgcctataatcccagctact

SEQ ID NO: 238936 - DNA, 20 bp, Artificial
  CRISPR gRNA sequence
gcctataatcccagctactt

SEQ ID NO: 238937 - DNA, 20 bp, Artificial
  CRISPR gRNA sequence
ctataatcccagctacttgg

SEQ ID NO: 238938 - DNA, 20 bp, Artificial
  CRISPR gRNA sequence
tataatcccagctacttggg

SEQ ID NO: 238939 - DNA, 20 bp, Artificial
  CRISPR gRNA sequence
tcccagctacttgggaggct

SEQ ID NO: 238940 - DNA, 20 bp, Artificial
  CRISPR gRNA sequence
cccagctacttgggaggctg

SEQ ID NO: 238941 - DNA, 20 bp, Artificial
  CRISPR gRNA sequence
agctacttgggaggctgagg

SEQ ID NO: 238942 - DNA, 20 bp, Artificial
  CRISPR gRNA sequence
gctacttgggaggctgaggc

SEQ ID NO: 238943 - DNA, 20 bp, Artificial
  CRISPR gRNA sequence
tacttgggaggctgaggcag

SEQ ID NO: 238944 - DNA, 20 bp, Artificial
  CRISPR gRNA sequence
gcaggagaatcacttgaacc

SEQ ID NO: 238945 - DNA, 20 bp, Artificial
  CRISPR gRNA sequence
caggagaatcacttgaaccc

SEQ ID NO: 238946 - DNA, 20 bp, Artificial
  CRISPR gRNA sequence
ggagaatcacttgaacccag

SEQ ID NO: 238947 - DNA, 20 bp, Artificial
  CRISPR gRNA sequence
gagaatcacttgaacccagg

SEQ ID NO: 238948 - DNA, 20 bp, Artificial
  CRISPR gRNA sequence
aatcacttgaacccaggagg

SEQ ID NO: 238949 - DNA, 20 bp, Artificial
  CRISPR gRNA sequence
tcacttgaacccaggaggtg

SEQ ID NO: 238950 - DNA, 20 bp, Artificial
  CRISPR gRNA sequence
aacccaggaggtggagattg

SEQ ID NO: 238951 - DNA, 20 bp, Artificial
  CRISPR gRNA sequence
caggaggtggagattgcagt

SEQ ID NO: 238952 - DNA, 20 bp, Artificial
  CRISPR gRNA sequence
ggtggagattgcagtgagct

SEQ ID NO: 238953 - DNA, 20 bp, Artificial
  CRISPR gRNA sequence
gagactgcaccactgcactc

SEQ ID NO: 238954 - DNA, 20 bp, Artificial
  CRISPR gRNA sequence
tgcaccactgcactccagcc

SEQ ID NO: 238955 - DNA, 20 bp, Artificial
  CRISPR gRNA sequence
cactgcactccagcctggca

SEQ ID NO: 238956 - DNA, 20 bp, Artificial
  CRISPR gRNA sequence
ctgcactccagcctggcaca

SEQ ID NO: 238957 - DNA, 20 bp, Artificial
  CRISPR gRNA sequence
actccagcctggcacagagc

SEQ ID NO: 238958 - DNA, 20 bp, Artificial
  CRISPR gRNA sequence
ctctcttaaaaacaaaaaaa

SEQ ID NO: 238959 - DNA, 20 bp, Artificial
  CRISPR gRNA sequence
ttaaaaacaaaaaaaaagaa

SEQ ID NO: 238960 - DNA, 20 bp, Artificial
  CRISPR gRNA sequence
aacaaaaaaaaagaaaagaa

SEQ ID NO: 238961 - DNA, 20 bp, Artificial
  CRISPR gRNA sequence
aaaaaaagaaaagaaaagaa

SEQ ID NO: 238962 - DNA, 20 bp, Artificial
  CRISPR gRNA sequence
agaaaagaaaagaaaaaata

SEQ ID NO: 238963 - DNA, 20 bp, Artificial
  CRISPR gRNA sequence
gaaaagaaaagaaaaaatat

SEQ ID NO: 238964 - DNA, 20 bp, Artificial
  CRISPR gRNA sequence
accctataatcccctttcct

SEQ ID NO: 238965 - DNA, 20 bp, Artificial
  CRISPR gRNA sequence
ccctttccttggcattgata

SEQ ID NO: 238966 - DNA, 20 bp, Artificial
  CRISPR gRNA sequence
ccttggcattgataaagata

SEQ ID NO: 238967 - DNA, 20 bp, Artificial
  CRISPR gRNA sequence
ataaagatatagactctgtt

SEQ ID NO: 238968 - DNA, 20 bp, Artificial
  CRISPR gRNA sequence
taaagatatagactctgttt

SEQ ID NO: 238969 - DNA, 20 bp, Artificial
  CRISPR gRNA sequence
atatagactctgtttgggtg

SEQ ID NO: 238970 - DNA, 20 bp, Artificial
  CRISPR gRNA sequence
tgtttgggtgaagtgtcctc

SEQ ID NO: 238971 - DNA, 20 bp, Artificial
  CRISPR gRNA sequence
ccgcttacaaatgtgtatct

SEQ ID NO: 238972 - DNA, 20 bp, Artificial
  CRISPR gRNA sequence
cagactgaataacaaatgcc

SEQ ID NO: 238973 - DNA, 20 bp, Artificial
  CRISPR gRNA sequence
agactgaataacaaatgcct

SEQ ID NO: 238974 - DNA, 20 bp, Artificial
  CRISPR gRNA sequence
ctgaataacaaatgcctggg

SEQ ID NO: 238975 - DNA, 20 bp, Artificial
  CRISPR gRNA sequence
atgcctgggaagaaaactgc

SEQ ID NO: 238976 - DNA, 20 bp, Artificial
  CRISPR gRNA sequence
tgcctgggaagaaaactgct

SEQ ID NO: 238977 - DNA, 20 bp, Artificial
  CRISPR gRNA sequence
aagaaaactgctgggtccct

SEQ ID NO: 238978 - DNA, 20 bp, Artificial
  CRISPR gRNA sequence
agaaaactgctgggtccctg

SEQ ID NO: 238979 - DNA, 20 bp, Artificial
  CRISPR gRNA sequence
gaaaactgctgggtccctga

SEQ ID NO: 238980 - DNA, 20 bp, Artificial
  CRISPR gRNA sequence
aactgctgggtccctgaggg

SEQ ID NO: 238981 - DNA, 20 bp, Artificial
  CRISPR gRNA sequence
actgctgggtccctgagggc

SEQ ID NO: 238982 - DNA, 20 bp, Artificial
  CRISPR gRNA sequence
gggtccctgagggcaggatt

SEQ ID NO: 238983 - DNA, 20 bp, Artificial
  CRISPR gRNA sequence
ggtccctgagggcaggattc

SEQ ID NO: 238984 - DNA, 20 bp, Artificial
  CRISPR gRNA sequence
ccctgagggcaggattcagg

SEQ ID NO: 238985 - DNA, 20 bp, Artificial
  CRISPR gRNA sequence
ggattcaggaagaatgcacg

SEQ ID NO: 238986 - DNA, 20 bp, Artificial
  CRISPR gRNA sequence
gattcaggaagaatgcacgt

SEQ ID NO: 238987 - DNA, 20 bp, Artificial
  CRISPR gRNA sequence
ttcaggaagaatgcacgtgg

SEQ ID NO: 238988 - DNA, 20 bp, Artificial
  CRISPR gRNA sequence
tcaggaagaatgcacgtggg

SEQ ID NO: 238989 - DNA, 20 bp, Artificial
  CRISPR gRNA sequence
acgtgggaggtgcctgatat

SEQ ID NO: 238990 - DNA, 20 bp, Artificial
  CRISPR gRNA sequence
gatatgagatatcatgatat

SEQ ID NO: 238991 - DNA, 20 bp, Artificial
  CRISPR gRNA sequence
atatgagatatcatgatatt

SEQ ID NO: 238992 - DNA, 20 bp, Artificial
  CRISPR gRNA sequence
tatgagatatcatgatattg

SEQ ID NO: 238993 - DNA, 20 bp, Artificial
  CRISPR gRNA sequence
atcatgatattggggcaatt

SEQ ID NO: 238994 - DNA, 20 bp, Artificial
  CRISPR gRNA sequence
ggggcaatttagatacaatc

SEQ ID NO: 238995 - DNA, 20 bp, Artificial
  CRISPR gRNA sequence
atacaatctggaatcaccat

SEQ ID NO: 238996 - DNA, 20 bp, Artificial
  CRISPR gRNA sequence
tcaccataagatacgcactt

SEQ ID NO: 238997 - DNA, 20 bp, Artificial
  CRISPR gRNA sequence
aagatacgcactttggcgta

SEQ ID NO: 238998 - DNA, 20 bp, Artificial
  CRISPR gRNA sequence
agatacgcactttggcgtaa

SEQ ID NO: 238999 - DNA, 20 bp, Artificial
  CRISPR gRNA sequence
cgcactttggcgtaaaggca

SEQ ID NO: 239000 - DNA, 20 bp, Artificial
  CRISPR gRNA sequence
tttggcgtaaaggcatagcc

SEQ ID NO: 239001 - DNA, 20 bp, Artificial
  CRISPR gRNA sequence
aaaggcatagcccagttacc

SEQ ID NO: 239002 - DNA, 20 bp, Artificial
  CRISPR gRNA sequence
ccagttacctggctctctcg

SEQ ID NO: 239003 - DNA, 20 bp, Artificial
  CRISPR gRNA sequence
cagttacctggctctctcgc

SEQ ID NO: 239004 - DNA, 20 bp, Artificial
  CRISPR gRNA sequence
agttacctggctctctcgca

SEQ ID NO: 239005 - DNA, 20 bp, Artificial
  CRISPR gRNA sequence
gttacctggctctctcgcag

SEQ ID NO: 239006 - DNA, 20 bp, Artificial
  CRISPR gRNA sequence
acctggctctctcgcagggg

SEQ ID NO: 239007 - DNA, 20 bp, Artificial
  CRISPR gRNA sequence
cctggctctctcgcaggggc

SEQ ID NO: 239008 - DNA, 20 bp, Artificial
  CRISPR gRNA sequence
ggctctctcgcaggggcagg

SEQ ID NO: 239009 - DNA, 20 bp, Artificial
  CRISPR gRNA sequence
gctctctcgcaggggcaggc

SEQ ID NO: 239010 - DNA, 20 bp, Artificial
  CRISPR gRNA sequence
ctctctcgcaggggcaggcg

SEQ ID NO: 239011 - DNA, 20 bp, Artificial
  CRISPR gRNA sequence
cgcaggggcaggcggggtca

SEQ ID NO: 239012 - DNA, 20 bp, Artificial
  CRISPR gRNA sequence
caggggcaggcggggtcaca

SEQ ID NO: 239013 - DNA, 20 bp, Artificial
  CRISPR gRNA sequence
aggggcaggcggggtcacag

SEQ ID NO: 239014 - DNA, 20 bp, Artificial
  CRISPR gRNA sequence
ggggtcacagaggatgctcc

SEQ ID NO: 239015 - DNA, 20 bp, Artificial
  CRISPR gRNA sequence
ggtcacagaggatgctcccg

SEQ ID NO: 239016 - DNA, 20 bp, Artificial
  CRISPR gRNA sequence
tcacagaggatgctcccgga

SEQ ID NO: 239017 - DNA, 20 bp, Artificial
  CRISPR gRNA sequence
acagaggatgctcccggaga

SEQ ID NO: 239018 - DNA, 20 bp, Artificial
  CRISPR gRNA sequence
cagaggatgctcccggagag

SEQ ID NO: 239019 - DNA, 20 bp, Artificial
  CRISPR gRNA sequence
ggatgctcccggagagaggt

SEQ ID NO: 239020 - DNA, 20 bp, Artificial
  CRISPR gRNA sequence
gctcccggagagaggtcggc

SEQ ID NO: 239021 - DNA, 20 bp, Artificial
  CRISPR gRNA sequence
tcccggagagaggtcggctg

SEQ ID NO: 239022 - DNA, 20 bp, Artificial
  CRISPR gRNA sequence
ggagagaggtcggctggaga

SEQ ID NO: 239023 - DNA, 20 bp, Artificial
  CRISPR gRNA sequence
ggtcggctggagatggtcca

SEQ ID NO: 239024 - DNA, 20 bp, Artificial
  CRISPR gRNA sequence
ctctccttcgtcccattcac

SEQ ID NO: 239025 - DNA, 20 bp, Artificial
  CRISPR gRNA sequence
cttcgtcccattcacaagca

SEQ ID NO: 239026 - DNA, 20 bp, Artificial
  CRISPR gRNA sequence
aagcacagactttccatcca

SEQ ID NO: 239027 - DNA, 20 bp, Artificial
  CRISPR gRNA sequence
cagactttccatccaaagaa

SEQ ID NO: 239028 - DNA, 20 bp, Artificial
  CRISPR gRNA sequence
tttccatccaaagaacagct

SEQ ID NO: 239029 - DNA, 20 bp, Artificial
  CRISPR gRNA sequence
catccaaagaacagcttaga

SEQ ID NO: 239030 - DNA, 20 bp, Artificial
  CRISPR gRNA sequence
aataatttaaataattaact

SEQ ID NO: 239031 - DNA, 20 bp, Artificial
  CRISPR gRNA sequence
ataatttaaataattaactt

SEQ ID NO: 239032 - DNA, 20 bp, Artificial
  CRISPR gRNA sequence
ttaaataattaacttaggtc

SEQ ID NO: 239033 - DNA, 20 bp, Artificial
  CRISPR gRNA sequence
aataattaacttaggtccag

SEQ ID NO: 239034 - DNA, 20 bp, Artificial
  CRISPR gRNA sequence
aacttaggtccagaagattc

SEQ ID NO: 239035 - DNA, 20 bp, Artificial
  CRISPR gRNA sequence
ttgtcatttttcacccaatg

SEQ ID NO: 239036 - DNA, 20 bp, Artificial
  CRISPR gRNA sequence
tcatttttcacccaatgaag

SEQ ID NO: 239037 - DNA, 20 bp, Artificial
  CRISPR gRNA sequence
tttcacccaatgaagtagcc

SEQ ID NO: 239038 - DNA, 20 bp, Artificial
  CRISPR gRNA sequence
aatgaagtagcctagtgaaa

SEQ ID NO: 239039 - DNA, 20 bp, Artificial
  CRISPR gRNA sequence
agcctagtgaaaaagatata

SEQ ID NO: 239040 - DNA, 20 bp, Artificial
  CRISPR gRNA sequence
gcctagtgaaaaagatatat

SEQ ID NO: 239041 - DNA, 20 bp, Artificial
  CRISPR gRNA sequence
gtgaaaaagatatatgggtc

SEQ ID NO: 239042 - DNA, 20 bp, Artificial
  CRISPR gRNA sequence
tgaaaaagatatatgggtct

SEQ ID NO: 239043 - DNA, 20 bp, Artificial
  CRISPR gRNA sequence
atatatgggtctgggttcga

SEQ ID NO: 239044 - DNA, 20 bp, Artificial
  CRISPR gRNA sequence
ctgggttcgaaagcgatgca

SEQ ID NO: 239045 - DNA, 20 bp, Artificial
  CRISPR gRNA sequence
aaaacttccacttgaccatc

SEQ ID NO: 239046 - DNA, 20 bp, Artificial
  CRISPR gRNA sequence
cttgaccatctggctccctg

SEQ ID NO: 239047 - DNA, 20 bp, Artificial
  CRISPR gRNA sequence
tggctccctgcagctttcca

SEQ ID NO: 239048 - DNA, 20 bp, Artificial
  CRISPR gRNA sequence
ttccatggcttccttctgtt

SEQ ID NO: 239049 - DNA, 20 bp, Artificial
  CRISPR gRNA sequence
ggcttccttctgttcagtga

SEQ ID NO: 239050 - DNA, 20 bp, Artificial
  CRISPR gRNA sequence
ccttctgttcagtgacagct

SEQ ID NO: 239051 - DNA, 20 bp, Artificial
  CRISPR gRNA sequence
tgttcagtgacagcttagtt

SEQ ID NO: 239052 - DNA, 20 bp, Artificial
  CRISPR gRNA sequence
ttcagtctgtcttgcctgct

SEQ ID NO: 239053 - DNA, 20 bp, Artificial
  CRISPR gRNA sequence
cctgcttagtctctcacccc

SEQ ID NO: 239054 - DNA, 20 bp, Artificial
  CRISPR gRNA sequence
ctcacccccagtttcttaat

SEQ ID NO: 239055 - DNA, 20 bp, Artificial
  CRISPR gRNA sequence
taatcggacttgaccatctc

SEQ ID NO: 239056 - DNA, 20 bp, Artificial
  CRISPR gRNA sequence
ggacttgaccatctccggca

SEQ ID NO: 239057 - DNA, 20 bp, Artificial
  CRISPR gRNA sequence
gaccatctccggcacagatg

SEQ ID NO: 239058 - DNA, 20 bp, Artificial
  CRISPR gRNA sequence
accatctccggcacagatga

SEQ ID NO: 239059 - DNA, 20 bp, Artificial
  CRISPR gRNA sequence
tctccggcacagatgaaggc

SEQ ID NO: 239060 - DNA, 20 bp, Artificial
  CRISPR gRNA sequence
ggcacagatgaaggctagca

SEQ ID NO: 239061 - DNA, 20 bp, Artificial
  CRISPR gRNA sequence
gcacagatgaaggctagcat

SEQ ID NO: 239062 - DNA, 20 bp, Artificial
  CRISPR gRNA sequence
cacagatgaaggctagcata

SEQ ID NO: 239063 - DNA, 20 bp, Artificial
  CRISPR gRNA sequence
gatgaaggctagcatagggt

SEQ ID NO: 239064 - DNA, 20 bp, Artificial
  CRISPR gRNA sequence
atgaaggctagcatagggtt

SEQ ID NO: 239065 - DNA, 20 bp, Artificial
  CRISPR gRNA sequence
gaaggctagcatagggttag

SEQ ID NO: 239066 - DNA, 20 bp, Artificial
  CRISPR gRNA sequence
aaggctagcatagggttagg

SEQ ID NO: 239067 - DNA, 20 bp, Artificial
  CRISPR gRNA sequence
tagcatagggttaggaggtc

SEQ ID NO: 239068 - DNA, 20 bp, Artificial
  CRISPR gRNA sequence
agggttaggaggtccagcac

SEQ ID NO: 239069 - DNA, 20 bp, Artificial
  CRISPR gRNA sequence
aggaggtccagcactagcat

SEQ ID NO: 239070 - DNA, 20 bp, Artificial
  CRISPR gRNA sequence
ggaggtccagcactagcatc

SEQ ID NO: 239071 - DNA, 20 bp, Artificial
  CRISPR gRNA sequence
agcactagcatcaggcaaac

SEQ ID NO: 239072 - DNA, 20 bp, Artificial
  CRISPR gRNA sequence
gcactagcatcaggcaaacc

SEQ ID NO: 239073 - DNA, 20 bp, Artificial
  CRISPR gRNA sequence
cactagcatcaggcaaacca

SEQ ID NO: 239074 - DNA, 20 bp, Artificial
  CRISPR gRNA sequence
catcaggcaaaccagggttt

SEQ ID NO: 239075 - DNA, 20 bp, Artificial
  CRISPR gRNA sequence
gcaaaccagggtttgagccc

SEQ ID NO: 239076 - DNA, 20 bp, Artificial
  CRISPR gRNA sequence
caaaccagggtttgagccct

SEQ ID NO: 239077 - DNA, 20 bp, Artificial
  CRISPR gRNA sequence
gccctgggtctgctgctttc

SEQ ID NO: 239078 - DNA, 20 bp, Artificial
  CRISPR gRNA sequence
gctgctttccagaatgactt

SEQ ID NO: 239079 - DNA, 20 bp, Artificial
  CRISPR gRNA sequence
ctgctttccagaatgacttt

SEQ ID NO: 239080 - DNA, 20 bp, Artificial
  CRISPR gRNA sequence
tttccagaatgactttgggc

SEQ ID NO: 239081 - DNA, 20 bp, Artificial
  CRISPR gRNA sequence
agaatgactttgggcaagtc

SEQ ID NO: 239082 - DNA, 20 bp, Artificial
  CRISPR gRNA sequence
tcaagaaatctctgtaaccc

SEQ ID NO: 239083 - DNA, 20 bp, Artificial
  CRISPR gRNA sequence
aaatctctgtaaccccagca

SEQ ID NO: 239084 - DNA, 20 bp, Artificial
  CRISPR gRNA sequence
tctctgtaaccccagcatgg

SEQ ID NO: 239085 - DNA, 20 bp, Artificial
  CRISPR gRNA sequence
cgcctataatctcaacactt

SEQ ID NO: 239086 - DNA, 20 bp, Artificial
  CRISPR gRNA sequence
ctataatctcaacactttgg

SEQ ID NO: 239087 - DNA, 20 bp, Artificial
  CRISPR gRNA sequence
tataatctcaacactttggt

SEQ ID NO: 239088 - DNA, 20 bp, Artificial
  CRISPR gRNA sequence
tctcaacactttggtaggct

SEQ ID NO: 239089 - DNA, 20 bp, Artificial
  CRISPR gRNA sequence
ctcaacactttggtaggctg

SEQ ID NO: 239090 - DNA, 20 bp, Artificial
  CRISPR gRNA sequence
acactttggtaggctgaggc

SEQ ID NO: 239091 - DNA, 20 bp, Artificial
  CRISPR gRNA sequence
actttggtaggctgaggcca

SEQ ID NO: 239092 - DNA, 20 bp, Artificial
  CRISPR gRNA sequence
ctttggtaggctgaggccag

SEQ ID NO: 239093 - DNA, 20 bp, Artificial
  CRISPR gRNA sequence
ctgaggccagaggatcactt

SEQ ID NO: 239094 - DNA, 20 bp, Artificial
  CRISPR gRNA sequence
gccagaggatcacttgagac

SEQ ID NO: 239095 - DNA, 20 bp, Artificial
  CRISPR gRNA sequence
ccagaggatcacttgagacc

SEQ ID NO: 239096 - DNA, 20 bp, Artificial
  CRISPR gRNA sequence
gatcacttgagaccaggcgt

SEQ ID NO: 239097 - DNA, 20 bp, Artificial
  CRISPR gRNA sequence
tcacttgagaccaggcgttg

SEQ ID NO: 239098 - DNA, 20 bp, Artificial
  CRISPR gRNA sequence
tgagaccaggcgttggagac

SEQ ID NO: 239099 - DNA, 20 bp, Artificial
  CRISPR gRNA sequence
caggcgttggagaccagcct

SEQ ID NO: 239100 - DNA, 20 bp, Artificial
  CRISPR gRNA sequence
ggagaccagcctgagcaaca

SEQ ID NO: 239101 - DNA, 20 bp, Artificial
  CRISPR gRNA sequence
accagcctgagcaacatagc

SEQ ID NO: 239102 - DNA, 20 bp, Artificial
  CRISPR gRNA sequence
cccatctctacaaaaattaa

SEQ ID NO: 239103 - DNA, 20 bp, Artificial
  CRISPR gRNA sequence
gacaaacaaaaattaactga

SEQ ID NO: 239104 - DNA, 20 bp, Artificial
  CRISPR gRNA sequence
taactgatggtgcatgcctg

SEQ ID NO: 239105 - DNA, 20 bp, Artificial
  CRISPR gRNA sequence
atggtgcatgcctgtggccc

SEQ ID NO: 239106 - DNA, 20 bp, Artificial
  CRISPR gRNA sequence
tgcctgtggccccagctact

SEQ ID NO: 239107 - DNA, 20 bp, Artificial
  CRISPR gRNA sequence
gcctgtggccccagctactc

SEQ ID NO: 239108 - DNA, 20 bp, Artificial
  CRISPR gRNA sequence
ctgtggccccagctactcgg

SEQ ID NO: 239109 - DNA, 20 bp, Artificial
  CRISPR gRNA sequence
ccccagctactcgggagact

SEQ ID NO: 239110 - DNA, 20 bp, Artificial
  CRISPR gRNA sequence
cccagctactcgggagactg

SEQ ID NO: 239111 - DNA, 20 bp, Artificial
  CRISPR gRNA sequence
agctactcgggagactgagg

SEQ ID NO: 239112 - DNA, 20 bp, Artificial
  CRISPR gRNA sequence
gctactcgggagactgaggt

SEQ ID NO: 239113 - DNA, 20 bp, Artificial
  CRISPR gRNA sequence
tactcgggagactgaggtgg

SEQ ID NO: 239114 - DNA, 20 bp, Artificial
  CRISPR gRNA sequence
actcgggagactgaggtggg

SEQ ID NO: 239115 - DNA, 20 bp, Artificial
  CRISPR gRNA sequence
gtgggaggatcacttgaacc

SEQ ID NO: 239116 - DNA, 20 bp, Artificial
  CRISPR gRNA sequence
tgggaggatcacttgaaccc

SEQ ID NO: 239117 - DNA, 20 bp, Artificial
  CRISPR gRNA sequence
ggaggatcacttgaacccag

SEQ ID NO: 239118 - DNA, 20 bp, Artificial
  CRISPR gRNA sequence
tcacttgaacccaggagttt

SEQ ID NO: 239119 - DNA, 20 bp, Artificial
  CRISPR gRNA sequence
cacttgaacccaggagtttg

SEQ ID NO: 239120 - DNA, 20 bp, Artificial
  CRISPR gRNA sequence
tgaggctgatcacttgaacc

SEQ ID NO: 239121 - DNA, 20 bp, Artificial
  CRISPR gRNA sequence
gaggctgatcacttgaaccc

SEQ ID NO: 239122 - DNA, 20 bp, Artificial
  CRISPR gRNA sequence
ggctgatcacttgaacccag

SEQ ID NO: 239123 - DNA, 20 bp, Artificial
  CRISPR gRNA sequence
ccaggagtttgacgctgtct

SEQ ID NO: 239124 - DNA, 20 bp, Artificial
  CRISPR gRNA sequence
gagtttgacgctgtctcaga

SEQ ID NO: 239125 - DNA, 20 bp, Artificial
  CRISPR gRNA sequence
tgacgctgtctcagaaagaa

SEQ ID NO: 239126 - DNA, 20 bp, Artificial
  CRISPR gRNA sequence
gtctcagaaagaaaagaaaa

SEQ ID NO: 239127 - DNA, 20 bp, Artificial
  CRISPR gRNA sequence
aagaaaaaagaaacctccct

SEQ ID NO: 239128 - DNA, 20 bp, Artificial
  CRISPR gRNA sequence
aaagaaacctccctaagcct

SEQ ID NO: 239129 - DNA, 20 bp, Artificial
  CRISPR gRNA sequence
agttttctcatctgcaaaat

SEQ ID NO: 239130 - DNA, 20 bp, Artificial
  CRISPR gRNA sequence
gttttctcatctgcaaaatt

SEQ ID NO: 239131 - DNA, 20 bp, Artificial
  CRISPR gRNA sequence
attaggattgtatgtgctgc

SEQ ID NO: 239132 - DNA, 20 bp, Artificial
  CRISPR gRNA sequence
gtgctgccagaactgtttca

SEQ ID NO: 239133 - DNA, 20 bp, Artificial
  CRISPR gRNA sequence
aactgtttcaaagaacaaac

SEQ ID NO: 239134 - DNA, 20 bp, Artificial
  CRISPR gRNA sequence
gtttcaaagaacaaacgagt

SEQ ID NO: 239135 - DNA, 20 bp, Artificial
  CRISPR gRNA sequence
ttcaaagaacaaacgagtga

SEQ ID NO: 239136 - DNA, 20 bp, Artificial
  CRISPR gRNA sequence
aagaacaaacgagtgagagt

SEQ ID NO: 239137 - DNA, 20 bp, Artificial
  CRISPR gRNA sequence
tcttgcacatctgacacgct

SEQ ID NO: 239138 - DNA, 20 bp, Artificial
  CRISPR gRNA sequence
catctgacacgctgagtaaa

SEQ ID NO: 239139 - DNA, 20 bp, Artificial
  CRISPR gRNA sequence
ctgacacgctgagtaaatgg

SEQ ID NO: 239140 - DNA, 20 bp, Artificial
  CRISPR gRNA sequence
ccccaaatccgcccgtcctc

SEQ ID NO: 239141 - DNA, 20 bp, Artificial
  CRISPR gRNA sequence
ccaaatccgcccgtcctcca

SEQ ID NO: 239142 - DNA, 20 bp, Artificial
  CRISPR gRNA sequence
tccgcccgtcctccagagcc

SEQ ID NO: 239143 - DNA, 20 bp, Artificial
  CRISPR gRNA sequence
ttcaaacccatttttccatg

SEQ ID NO: 239144 - DNA, 20 bp, Artificial
  CRISPR gRNA sequence
ctctgaaaaatttgtattga

SEQ ID NO: 239145 - DNA, 20 bp, Artificial
  CRISPR gRNA sequence
attgaaagaccttttttaaa

SEQ ID NO: 239146 - DNA, 20 bp, Artificial
  CRISPR gRNA sequence
ttttttaaaaagccactttc

SEQ ID NO: 239147 - DNA, 20 bp, Artificial
  CRISPR gRNA sequence
ttaaaaagccactttccagc

SEQ ID NO: 239148 - DNA, 20 bp, Artificial
  CRISPR gRNA sequence
taaaaagccactttccagct

SEQ ID NO: 239149 - DNA, 20 bp, Artificial
  CRISPR gRNA sequence
agccactttccagctgggca

SEQ ID NO: 239150 - DNA, 20 bp, Artificial
  CRISPR gRNA sequence
cactttccagctgggcacag

SEQ ID NO: 239151 - DNA, 20 bp, Artificial
  CRISPR gRNA sequence
gtggctcacacctgtaatcc

SEQ ID NO: 239152 - DNA, 20 bp, Artificial
  CRISPR gRNA sequence
cacctgtaatcccagcactt

SEQ ID NO: 239153 - DNA, 20 bp, Artificial
  CRISPR gRNA sequence
acctgtaatcccagcacttt

SEQ ID NO: 239154 - DNA, 20 bp, Artificial
  CRISPR gRNA sequence
ctgtaatcccagcactttgg

SEQ ID NO: 239155 - DNA, 20 bp, Artificial
  CRISPR gRNA sequence
tgtaatcccagcactttggg

SEQ ID NO: 239156 - DNA, 20 bp, Artificial
  CRISPR gRNA sequence
tcccagcactttgggaggcc

SEQ ID NO: 239157 - DNA, 20 bp, Artificial
  CRISPR gRNA sequence
cccagcactttgggaggcca

SEQ ID NO: 239158 - DNA, 20 bp, Artificial
  CRISPR gRNA sequence
gcactttgggaggccaaggc

SEQ ID NO: 239159 - DNA, 20 bp, Artificial
  CRISPR gRNA sequence
ctttgggaggccaaggcaag

SEQ ID NO: 239160 - DNA, 20 bp, Artificial
  CRISPR gRNA sequence
ccaaggcaagcggatcactt

SEQ ID NO: 239161 - DNA, 20 bp, Artificial
  CRISPR gRNA sequence
caaggcaagcggatcacttg

SEQ ID NO: 239162 - DNA, 20 bp, Artificial
  CRISPR gRNA sequence
gcaagcggatcacttgaggt

SEQ ID NO: 239163 - DNA, 20 bp, Artificial
  CRISPR gRNA sequence
caagcggatcacttgaggtc

SEQ ID NO: 239164 - DNA, 20 bp, Artificial
  CRISPR gRNA sequence
agcggatcacttgaggtcag

SEQ ID NO: 239165 - DNA, 20 bp, Artificial
  CRISPR gRNA sequence
tcacttgaggtcaggagtgc

SEQ ID NO: 239166 - DNA, 20 bp, Artificial
  CRISPR gRNA sequence
tgaggtcaggagtgcgagac

SEQ ID NO: 239167 - DNA, 20 bp, Artificial
  CRISPR gRNA sequence
tcaggagtgcgagaccagcc

SEQ ID NO: 239168 - DNA, 20 bp, Artificial
  CRISPR gRNA sequence
cgagaccagcctggctaaca

SEQ ID NO: 239169 - DNA, 20 bp, Artificial
  CRISPR gRNA sequence
cagcctggctaacatggtga

SEQ ID NO: 239170 - DNA, 20 bp, Artificial
  CRISPR gRNA sequence
catctctactaaaaatacaa

SEQ ID NO: 239171 - DNA, 20 bp, Artificial
  CRISPR gRNA sequence
tactaaaaatacaaaagcac

SEQ ID NO: 239172 - DNA, 20 bp, Artificial
  CRISPR gRNA sequence
aaaaatacaaaagcactagc

SEQ ID NO: 239173 - DNA, 20 bp, Artificial
  CRISPR gRNA sequence
aaaatacaaaagcactagcc

SEQ ID NO: 239174 - DNA, 20 bp, Artificial
  CRISPR gRNA sequence
acaaaagcactagccaggcg

SEQ ID NO: 239175 - DNA, 20 bp, Artificial
  CRISPR gRNA sequence
gttgtgtgcacctgtaatcc

SEQ ID NO: 239176 - DNA, 20 bp, Artificial
  CRISPR gRNA sequence
gcacctgtaatcccagctac

SEQ ID NO: 239177 - DNA, 20 bp, Artificial
  CRISPR gRNA sequence
cacctgtaatcccagctact

SEQ ID NO: 239178 - DNA, 20 bp, Artificial
  CRISPR gRNA sequence
cctgtaatcccagctactag

SEQ ID NO: 239179 - DNA, 20 bp, Artificial
  CRISPR gRNA sequence
ctgtaatcccagctactagg

SEQ ID NO: 239180 - DNA, 20 bp, Artificial
  CRISPR gRNA sequence
atcccagctactaggaggcc

SEQ ID NO: 239181 - DNA, 20 bp, Artificial
  CRISPR gRNA sequence
tcccagctactaggaggccg

SEQ ID NO: 239182 - DNA, 20 bp, Artificial
  CRISPR gRNA sequence
cagctactaggaggccgagg

SEQ ID NO: 239183 - DNA, 20 bp, Artificial
  CRISPR gRNA sequence
agctactaggaggccgaggc

SEQ ID NO: 239184 - DNA, 20 bp, Artificial
  CRISPR gRNA sequence
ctactaggaggccgaggcag

SEQ ID NO: 239185 - DNA, 20 bp, Artificial
  CRISPR gRNA sequence
gcaggagaatctcttgaacc

SEQ ID NO: 239186 - DNA, 20 bp, Artificial
  CRISPR gRNA sequence
caggagaatctcttgaaccc

SEQ ID NO: 239187 - DNA, 20 bp, Artificial
  CRISPR gRNA sequence
ggagaatctcttgaacccag

SEQ ID NO: 239188 - DNA, 20 bp, Artificial
  CRISPR gRNA sequence
gagaatctcttgaacccagg

SEQ ID NO: 239189 - DNA, 20 bp, Artificial
  CRISPR gRNA sequence
aatctcttgaacccaggagg

SEQ ID NO: 239190 - DNA, 20 bp, Artificial
  CRISPR gRNA sequence
tctcttgaacccaggaggca

SEQ ID NO: 239191 - DNA, 20 bp, Artificial
  CRISPR gRNA sequence
aacccaggaggcagagtttg

SEQ ID NO: 239192 - DNA, 20 bp, Artificial
  CRISPR gRNA sequence
caggaggcagagtttgcagt

SEQ ID NO: 239193 - DNA, 20 bp, Artificial
  CRISPR gRNA sequence
aggaggcagagtttgcagtg

SEQ ID NO: 239194 - DNA, 20 bp, Artificial
  CRISPR gRNA sequence
ggcagagtttgcagtgaggc

SEQ ID NO: 239195 - DNA, 20 bp, Artificial
  CRISPR gRNA sequence
gagaccgtgccattgcactc

SEQ ID NO: 239196 - DNA, 20 bp, Artificial
  CRISPR gRNA sequence
cgtgccattgcactccagcc

SEQ ID NO: 239197 - DNA, 20 bp, Artificial
  CRISPR gRNA sequence
gtgccattgcactccagcct

SEQ ID NO: 239198 - DNA, 20 bp, Artificial
  CRISPR gRNA sequence
cattgcactccagcctgggc

SEQ ID NO: 239199 - DNA, 20 bp, Artificial
  CRISPR gRNA sequence
tgcactccagcctgggcaag

SEQ ID NO: 239200 - DNA, 20 bp, Artificial
  CRISPR gRNA sequence
cactccagcctgggcaagaa

SEQ ID NO: 239201 - DNA, 20 bp, Artificial
  CRISPR gRNA sequence
aaacaaacaaaacaaacaaa

SEQ ID NO: 239202 - DNA, 20 bp, Artificial
  CRISPR gRNA sequence
acaaacagacctttttaaaa

SEQ ID NO: 239203 - DNA, 20 bp, Artificial
  CRISPR gRNA sequence
tttaaaaaagccactttcca

SEQ ID NO: 239204 - DNA, 20 bp, Artificial
  CRISPR gRNA sequence
aaaaagccactttccaaaga

SEQ ID NO: 239205 - DNA, 20 bp, Artificial
  CRISPR gRNA sequence
cactttccaaagacagaatt

SEQ ID NO: 239206 - DNA, 20 bp, Artificial
  CRISPR gRNA sequence
tccaaagacagaattcagct

SEQ ID NO: 239207 - DNA, 20 bp, Artificial
  CRISPR gRNA sequence
gacagaattcagctaagtcc

SEQ ID NO: 239208 - DNA, 20 bp, Artificial
  CRISPR gRNA sequence
ttcagctaagtccgagaaaa

SEQ ID NO: 239209 - DNA, 20 bp, Artificial
  CRISPR gRNA sequence
tgaatcatgattccattcgt

SEQ ID NO: 239210 - DNA, 20 bp, Artificial
  CRISPR gRNA sequence
tgataaattataaatgacaa

SEQ ID NO: 239211 - DNA, 20 bp, Artificial
  CRISPR gRNA sequence
taaattataaatgacaaaag

SEQ ID NO: 239212 - DNA, 20 bp, Artificial
  CRISPR gRNA sequence
aattataaatgacaaaagca

SEQ ID NO: 239213 - DNA, 20 bp, Artificial
  CRISPR gRNA sequence
ttataaatgacaaaagcaga

SEQ ID NO: 239214 - DNA, 20 bp, Artificial
  CRISPR gRNA sequence
cactttattttctctcaaaa

SEQ ID NO: 239215 - DNA, 20 bp, Artificial
  CRISPR gRNA sequence
ctctcaaaaaagtcactttc

SEQ ID NO: 239216 - DNA, 20 bp, Artificial
  CRISPR gRNA sequence
gaaatacaataaaaatgtaa

SEQ ID NO: 239217 - DNA, 20 bp, Artificial
  CRISPR gRNA sequence
aaataataaaaatgattttc

SEQ ID NO: 239218 - DNA, 20 bp, Artificial
  CRISPR gRNA sequence
aataaaaatgattttctagt

SEQ ID NO: 239219 - DNA, 20 bp, Artificial
  CRISPR gRNA sequence
tttctagtaagaaaatgaaa

SEQ ID NO: 239220 - DNA, 20 bp, Artificial
  CRISPR gRNA sequence
gtaagaaaatgaaacggaaa

SEQ ID NO: 239221 - DNA, 20 bp, Artificial
  CRISPR gRNA sequence
aacgcccaaatttttattct

SEQ ID NO: 239222 - DNA, 20 bp, Artificial
  CRISPR gRNA sequence
aaatttttattcttagtcaa

SEQ ID NO: 239223 - DNA, 20 bp, Artificial
  CRISPR gRNA sequence
actctgccaatttgccttaa

SEQ ID NO: 239224 - DNA, 20 bp, Artificial
  CRISPR gRNA sequence
taaccctacaccactgtcga

SEQ ID NO: 239225 - DNA, 20 bp, Artificial
  CRISPR gRNA sequence
aaccctacaccactgtcgat

SEQ ID NO: 239226 - DNA, 20 bp, Artificial
  CRISPR gRNA sequence
accctacaccactgtcgatg

SEQ ID NO: 239227 - DNA, 20 bp, Artificial
  CRISPR gRNA sequence
caccactgtcgatggggaca

SEQ ID NO: 239228 - DNA, 20 bp, Artificial
  CRISPR gRNA sequence
accactgtcgatggggacac

SEQ ID NO: 239229 - DNA, 20 bp, Artificial
  CRISPR gRNA sequence
tgtcgatggggacacaggac

SEQ ID NO: 239230 - DNA, 20 bp, Artificial
  CRISPR gRNA sequence
gacacaggacaagccatttg

SEQ ID NO: 239231 - DNA, 20 bp, Artificial
  CRISPR gRNA sequence
aggacaagccatttgtggac

SEQ ID NO: 239232 - DNA, 20 bp, Artificial
  CRISPR gRNA sequence
tgtggaccagcacccatcca

SEQ ID NO: 239233 - DNA, 20 bp, Artificial
  CRISPR gRNA sequence
cagcacccatccacagacca

SEQ ID NO: 239234 - DNA, 20 bp, Artificial
  CRISPR gRNA sequence
ccatccacagaccacagtgt

SEQ ID NO: 239235 - DNA, 20 bp, Artificial
  CRISPR gRNA sequence
acagaccacagtgtaagttc

SEQ ID NO: 239236 - DNA, 20 bp, Artificial
  CRISPR gRNA sequence
gttctggttccacaaaacaa

SEQ ID NO: 239237 - DNA, 20 bp, Artificial
  CRISPR gRNA sequence
cacattctctcgtatactat

SEQ ID NO: 239238 - DNA, 20 bp, Artificial
  CRISPR gRNA sequence
tggctttttaccacctgtga

SEQ ID NO: 239239 - DNA, 20 bp, Artificial
  CRISPR gRNA sequence
tgtgatggccttgtgtgccc

SEQ ID NO: 239240 - DNA, 20 bp, Artificial
  CRISPR gRNA sequence
cccaagtctgtgccacattt

SEQ ID NO: 239241 - DNA, 20 bp, Artificial
  CRISPR gRNA sequence
caagtctgtgccacattttg

SEQ ID NO: 239242 - DNA, 20 bp, Artificial
  CRISPR gRNA sequence
aagtctgtgccacattttgg

SEQ ID NO: 239243 - DNA, 20 bp, Artificial
  CRISPR gRNA sequence
agtctgtgccacattttgga

SEQ ID NO: 239244 - DNA, 20 bp, Artificial
  CRISPR gRNA sequence
gccacattttggagggtaac

SEQ ID NO: 239245 - DNA, 20 bp, Artificial
  CRISPR gRNA sequence
ggagggtaacgagcaattgt

SEQ ID NO: 239246 - DNA, 20 bp, Artificial
  CRISPR gRNA sequence
tagtttcttctgtatcattc

SEQ ID NO: 239247 - DNA, 20 bp, Artificial
  CRISPR gRNA sequence
agtttcttctgtatcattct

SEQ ID NO: 239248 - DNA, 20 bp, Artificial
  CRISPR gRNA sequence
gtttcttctgtatcattcta

SEQ ID NO: 239249 - DNA, 20 bp, Artificial
  CRISPR gRNA sequence
tttcttctgtatcattctag

SEQ ID NO: 239250 - DNA, 20 bp, Artificial
  CRISPR gRNA sequence
ttctgtatcattctaggggc

SEQ ID NO: 239251 - DNA, 20 bp, Artificial
  CRISPR gRNA sequence
aggggctggcattgaacaca

SEQ ID NO: 239252 - DNA, 20 bp, Artificial
  CRISPR gRNA sequence
gggctggcattgaacacatg

SEQ ID NO: 239253 - DNA, 20 bp, Artificial
  CRISPR gRNA sequence
tggcattgaacacatggaga

SEQ ID NO: 239254 - DNA, 20 bp, Artificial
  CRISPR gRNA sequence
ggcattgaacacatggagac

SEQ ID NO: 239255 - DNA, 20 bp, Artificial
  CRISPR gRNA sequence
atggagacaggctgatcaat

SEQ ID NO: 239256 - DNA, 20 bp, Artificial
  CRISPR gRNA sequence
ggagacaggctgatcaatga

SEQ ID NO: 239257 - DNA, 20 bp, Artificial
  CRISPR gRNA sequence
gacaggctgatcaatgagag

SEQ ID NO: 239258 - DNA, 20 bp, Artificial
  CRISPR gRNA sequence
gctgatcaatgagagaagat

SEQ ID NO: 239259 - DNA, 20 bp, Artificial
  CRISPR gRNA sequence
tgatcaatgagagaagataa

SEQ ID NO: 239260 - DNA, 20 bp, Artificial
  CRISPR gRNA sequence
gatcaatgagagaagataag

SEQ ID NO: 239261 - DNA, 20 bp, Artificial
  CRISPR gRNA sequence
caatgagagaagataagagg

SEQ ID NO: 239262 - DNA, 20 bp, Artificial
  CRISPR gRNA sequence
agagaagataagaggcagca

SEQ ID NO: 239263 - DNA, 20 bp, Artificial
  CRISPR gRNA sequence
gagaagataagaggcagcaa

SEQ ID NO: 239264 - DNA, 20 bp, Artificial
  CRISPR gRNA sequence
ataagaggcagcaaaggaat

SEQ ID NO: 239265 - DNA, 20 bp, Artificial
  CRISPR gRNA sequence
agaggcagcaaaggaatgag

SEQ ID NO: 239266 - DNA, 20 bp, Artificial
  CRISPR gRNA sequence
gaggcagcaaaggaatgaga

SEQ ID NO: 239267 - DNA, 20 bp, Artificial
  CRISPR gRNA sequence
gcaaaggaatgagaaggaaa

SEQ ID NO: 239268 - DNA, 20 bp, Artificial
  CRISPR gRNA sequence
ggaatgagaaggaaacagaa

SEQ ID NO: 239269 - DNA, 20 bp, Artificial
  CRISPR gRNA sequence
aatgagaaggaaacagaaaa

SEQ ID NO: 239270 - DNA, 20 bp, Artificial
  CRISPR gRNA sequence
atgagaaggaaacagaaaag

SEQ ID NO: 239271 - DNA, 20 bp, Artificial
  CRISPR gRNA sequence
agaaggaaacagaaaagagg

SEQ ID NO: 239272 - DNA, 20 bp, Artificial
  CRISPR gRNA sequence
ggaaacagaaaagaggcaga

SEQ ID NO: 239273 - DNA, 20 bp, Artificial
  CRISPR gRNA sequence
aacagaaaagaggcagacag

SEQ ID NO: 239274 - DNA, 20 bp, Artificial
  CRISPR gRNA sequence
aaaagaggcagacagcggca

SEQ ID NO: 239275 - DNA, 20 bp, Artificial
  CRISPR gRNA sequence
agacagcggcaaagttccac

SEQ ID NO: 239276 - DNA, 20 bp, Artificial
  CRISPR gRNA sequence
caattcttttcctttctttt

SEQ ID NO: 239277 - DNA, 20 bp, Artificial
  CRISPR gRNA sequence
tcttttcctttcttttgaga

SEQ ID NO: 239278 - DNA, 20 bp, Artificial
  CRISPR gRNA sequence
cttttcctttcttttgagac

SEQ ID NO: 239279 - DNA, 20 bp, Artificial
  CRISPR gRNA sequence
ttgagacaggctctctgctc

SEQ ID NO: 239280 - DNA, 20 bp, Artificial
  CRISPR gRNA sequence
gagacaggctctctgctctg

SEQ ID NO: 239281 - DNA, 20 bp, Artificial
  CRISPR gRNA sequence
ctctctgctctggagtgcga

SEQ ID NO: 239282 - DNA, 20 bp, Artificial
  CRISPR gRNA sequence
ggagtgcgatggtgcgatca

SEQ ID NO: 239283 - DNA, 20 bp, Artificial
  CRISPR gRNA sequence
ggtgcgatcatagctcattg

SEQ ID NO: 239284 - DNA, 20 bp, Artificial
  CRISPR gRNA sequence
tcattgcagcctcaacctcc

SEQ ID NO: 239285 - DNA, 20 bp, Artificial
  CRISPR gRNA sequence
cagcctcaacctcccagact

SEQ ID NO: 239286 - DNA, 20 bp, Artificial
  CRISPR gRNA sequence
agcctcaacctcccagactc

SEQ ID NO: 239287 - DNA, 20 bp, Artificial
  CRISPR gRNA sequence
aggtgatcctcctgcctcat

SEQ ID NO: 239288 - DNA, 20 bp, Artificial
  CRISPR gRNA sequence
tgcctcatcagccttcccta

SEQ ID NO: 239289 - DNA, 20 bp, Artificial
  CRISPR gRNA sequence
tcatcagccttccctatagc

SEQ ID NO: 239290 - DNA, 20 bp, Artificial
  CRISPR gRNA sequence
catcagccttccctatagct

SEQ ID NO: 239291 - DNA, 20 bp, Artificial
  CRISPR gRNA sequence
cttccctatagctgggacca

SEQ ID NO: 239292 - DNA, 20 bp, Artificial
  CRISPR gRNA sequence
ttccctatagctgggaccac

SEQ ID NO: 239293 - DNA, 20 bp, Artificial
  CRISPR gRNA sequence
caggcatgtgccattatgcc

SEQ ID NO: 239294 - DNA, 20 bp, Artificial
  CRISPR gRNA sequence
gctaattttttgattttttg

SEQ ID NO: 239295 - DNA, 20 bp, Artificial
  CRISPR gRNA sequence
taattttttgattttttgta

SEQ ID NO: 239296 - DNA, 20 bp, Artificial
  CRISPR gRNA sequence
tttttgattttttgtagaga

SEQ ID NO: 239297 - DNA, 20 bp, Artificial
  CRISPR gRNA sequence
ttttgattttttgtagagac

SEQ ID NO: 239298 - DNA, 20 bp, Artificial
  CRISPR gRNA sequence
tttgattttttgtagagaca

SEQ ID NO: 239299 - DNA, 20 bp, Artificial
  CRISPR gRNA sequence
tgtagagacagggtctcacc

SEQ ID NO: 239300 - DNA, 20 bp, Artificial
  CRISPR gRNA sequence
gtagagacagggtctcaccc

SEQ ID NO: 239301 - DNA, 20 bp, Artificial
  CRISPR gRNA sequence
agacagggtctcacccaggc

SEQ ID NO: 239302 - DNA, 20 bp, Artificial
  CRISPR gRNA sequence
ccaggctggttttgaactcc

SEQ ID NO: 239303 - DNA, 20 bp, Artificial
  CRISPR gRNA sequence
caggctggttttgaactcct

SEQ ID NO: 239304 - DNA, 20 bp, Artificial
  CRISPR gRNA sequence
ggttttgaactcctgggctc

SEQ ID NO: 239305 - DNA, 20 bp, Artificial
  CRISPR gRNA sequence
gttttgaactcctgggctca

SEQ ID NO: 239306 - DNA, 20 bp, Artificial
  CRISPR gRNA sequence
tttgaactcctgggctcaag

SEQ ID NO: 239307 - DNA, 20 bp, Artificial
  CRISPR gRNA sequence
ctcaaggagtcctcctgtct

SEQ ID NO: 239308 - DNA, 20 bp, Artificial
  CRISPR gRNA sequence
cctcctgtctcagcctccca

SEQ ID NO: 239309 - DNA, 20 bp, Artificial
  CRISPR gRNA sequence
gtctcagcctcccaaagtgc

SEQ ID NO: 239310 - DNA, 20 bp, Artificial
  CRISPR gRNA sequence
tctcagcctcccaaagtgct

SEQ ID NO: 239311 - DNA, 20 bp, Artificial
  CRISPR gRNA sequence
ctcccaaagtgctgggatta

SEQ ID NO: 239312 - DNA, 20 bp, Artificial
  CRISPR gRNA sequence
tcccaaagtgctgggattac

SEQ ID NO: 239313 - DNA, 20 bp, Artificial
  CRISPR gRNA sequence
cgtgaaccactgcacgtgcc

SEQ ID NO: 239314 - DNA, 20 bp, Artificial
  CRISPR gRNA sequence
tgcacgtgcccagcctccac

SEQ ID NO: 239315 - DNA, 20 bp, Artificial
  CRISPR gRNA sequence
ctccactggcaattctgatc

SEQ ID NO: 239316 - DNA, 20 bp, Artificial
  CRISPR gRNA sequence
caattctgatctagatgttc

SEQ ID NO: 239317 - DNA, 20 bp, Artificial
  CRISPR gRNA sequence
aattctgatctagatgttcc

SEQ ID NO: 239318 - DNA, 20 bp, Artificial
  CRISPR gRNA sequence
gatgttccaggcactatttc

SEQ ID NO: 239319 - DNA, 20 bp, Artificial
  CRISPR gRNA sequence
tgttccaggcactatttctg

SEQ ID NO: 239320 - DNA, 20 bp, Artificial
  CRISPR gRNA sequence
aaatgcccactttgcctatt

SEQ ID NO: 239321 - DNA, 20 bp, Artificial
  CRISPR gRNA sequence
attgagttgctacgacctca

SEQ ID NO: 239322 - DNA, 20 bp, Artificial
  CRISPR gRNA sequence
agtgttcccacgctgcctat

SEQ ID NO: 239323 - DNA, 20 bp, Artificial
  CRISPR gRNA sequence
tacattctgtctacacttga

SEQ ID NO: 239324 - DNA, 20 bp, Artificial
  CRISPR gRNA sequence
acattctgtctacacttgat

SEQ ID NO: 239325 - DNA, 20 bp, Artificial
  CRISPR gRNA sequence
tacacttgatgggtgcaaaa

SEQ ID NO: 239326 - DNA, 20 bp, Artificial
  CRISPR gRNA sequence
gtgcaaaaaagcttcaatga

SEQ ID NO: 239327 - DNA, 20 bp, Artificial
  CRISPR gRNA sequence
atcttccaaaaaatttaacc

SEQ ID NO: 239328 - DNA, 20 bp, Artificial
  CRISPR gRNA sequence
attctttattccataaacta

SEQ ID NO: 239329 - DNA, 20 bp, Artificial
  CRISPR gRNA sequence
ttctttattccataaactaa

SEQ ID NO: 239330 - DNA, 20 bp, Artificial
  CRISPR gRNA sequence
gaaattatacgtactttgtc

SEQ ID NO: 239331 - DNA, 20 bp, Artificial
  CRISPR gRNA sequence
aaattatacgtactttgtcc

SEQ ID NO: 239332 - DNA, 20 bp, Artificial
  CRISPR gRNA sequence
aattatacgtactttgtcca

SEQ ID NO: 239333 - DNA, 20 bp, Artificial
  CRISPR gRNA sequence
cgtactttgtccagggtcga

SEQ ID NO: 239334 - DNA, 20 bp, Artificial
  CRISPR gRNA sequence
tctgatcgttaaatgtccca

SEQ ID NO: 239335 - DNA, 20 bp, Artificial
  CRISPR gRNA sequence
cgttaaatgtcccaaagcaa

SEQ ID NO: 239336 - DNA, 20 bp, Artificial
  CRISPR gRNA sequence
caaccttgtattaaaaatga

SEQ ID NO: 239337 - DNA, 20 bp, Artificial
  CRISPR gRNA sequence
aaaaatgaaagcaataataa

SEQ ID NO: 239338 - DNA, 20 bp, Artificial
  CRISPR gRNA sequence
aaaatgaaagcaataataaa

SEQ ID NO: 239339 - DNA, 20 bp, Artificial
  CRISPR gRNA sequence
aaatgaaagcaataataaaa

SEQ ID NO: 239340 - DNA, 20 bp, Artificial
  CRISPR gRNA sequence
tgaaagcaataataaaaggg

SEQ ID NO: 239341 - DNA, 20 bp, Artificial
  CRISPR gRNA sequence
tcctgtgatgaacttaatat

SEQ ID NO: 239342 - DNA, 20 bp, Artificial
  CRISPR gRNA sequence
aattcttgaaacaacaccct

SEQ ID NO: 239343 - DNA, 20 bp, Artificial
  CRISPR gRNA sequence
cttgaaacaacaccctaaga

SEQ ID NO: 239344 - DNA, 20 bp, Artificial
  CRISPR gRNA sequence
aaacaacaccctaagatggc

SEQ ID NO: 239345 - DNA, 20 bp, Artificial
  CRISPR gRNA sequence
ttttattttaattgtacata

SEQ ID NO: 239346 - DNA, 20 bp, Artificial
  CRISPR gRNA sequence
cataaagtattgtatatgtc

SEQ ID NO: 239347 - DNA, 20 bp, Artificial
  CRISPR gRNA sequence
gtatatgtctggaacatgtg

SEQ ID NO: 239348 - DNA, 20 bp, Artificial
  CRISPR gRNA sequence
ctggaacatgtgaagattaa

SEQ ID NO: 239349 - DNA, 20 bp, Artificial
  CRISPR gRNA sequence
catgtgaagattaatggttc

SEQ ID NO: 239350 - DNA, 20 bp, Artificial
  CRISPR gRNA sequence
tcaaattatttccatttatg

SEQ ID NO: 239351 - DNA, 20 bp, Artificial
  CRISPR gRNA sequence
ttccatttatgaagaaataa

SEQ ID NO: 239352 - DNA, 20 bp, Artificial
  CRISPR gRNA sequence
atatactcccttgttacttt

SEQ ID NO: 239353 - DNA, 20 bp, Artificial
  CRISPR gRNA sequence
tatactcccttgttacttta

SEQ ID NO: 239354 - DNA, 20 bp, Artificial
  CRISPR gRNA sequence
aatctgtttgtttattttca

SEQ ID NO: 239355 - DNA, 20 bp, Artificial
  CRISPR gRNA sequence
atctgtttgtttattttcaa

SEQ ID NO: 239356 - DNA, 20 bp, Artificial
  CRISPR gRNA sequence
ttgtttattttcaaaggatc

SEQ ID NO: 239357 - DNA, 20 bp, Artificial
  CRISPR gRNA sequence
ttttcaaaggatcaagatca

SEQ ID NO: 239358 - DNA, 20 bp, Artificial
  CRISPR gRNA sequence
aaaggatcaagatcaaagct

SEQ ID NO: 239359 - DNA, 20 bp, Artificial
  CRISPR gRNA sequence
tctatgtcacaaaactacac

SEQ ID NO: 239360 - DNA, 20 bp, Artificial
  CRISPR gRNA sequence
cacaaaactacactagatca

SEQ ID NO: 239361 - DNA, 20 bp, Artificial
  CRISPR gRNA sequence
gcaaacgtacctttttttgt

SEQ ID NO: 239362 - DNA, 20 bp, Artificial
  CRISPR gRNA sequence
cacatgctgcatcctgcccc

SEQ ID NO: 239363 - DNA, 20 bp, Artificial
  CRISPR gRNA sequence
acatgctgcatcctgccccc

SEQ ID NO: 239364 - DNA, 20 bp, Artificial
  CRISPR gRNA sequence
tgctgcatcctgcccccagg

SEQ ID NO: 239365 - DNA, 20 bp, Artificial
  CRISPR gRNA sequence
gcccccaggcagtgaaaccc

SEQ ID NO: 239366 - DNA, 20 bp, Artificial
  CRISPR gRNA sequence
ccccaggcagtgaaaccctg

SEQ ID NO: 239367 - DNA, 20 bp, Artificial
  CRISPR gRNA sequence
ggcagtgaaaccctggagtg

SEQ ID NO: 239368 - DNA, 20 bp, Artificial
  CRISPR gRNA sequence
gcagtcacactctgcattgc

SEQ ID NO: 239369 - DNA, 20 bp, Artificial
  CRISPR gRNA sequence
gtcacactctgcattgctgg

SEQ ID NO: 239370 - DNA, 20 bp, Artificial
  CRISPR gRNA sequence
cacactctgcattgctggtg

SEQ ID NO: 239371 - DNA, 20 bp, Artificial
  CRISPR gRNA sequence
acactctgcattgctggtgg

SEQ ID NO: 239372 - DNA, 20 bp, Artificial
  CRISPR gRNA sequence
ggtggaggaacactccttcc

SEQ ID NO: 239373 - DNA, 20 bp, Artificial
  CRISPR gRNA sequence
tggtcctgaaaacacctaca

SEQ ID NO: 239374 - DNA, 20 bp, Artificial
  CRISPR gRNA sequence
aaacacctacaaagtccccc

SEQ ID NO: 239375 - DNA, 20 bp, Artificial
  CRISPR gRNA sequence
ttacacttgacctccaaatc

SEQ ID NO: 239376 - DNA, 20 bp, Artificial
  CRISPR gRNA sequence
tacacttgacctccaaatcc

SEQ ID NO: 239377 - DNA, 20 bp, Artificial
  CRISPR gRNA sequence
acttgacctccaaatccagg

SEQ ID NO: 239378 - DNA, 20 bp, Artificial
  CRISPR gRNA sequence
ggaagcgaatttatgctctg

SEQ ID NO: 239379 - DNA, 20 bp, Artificial
  CRISPR gRNA sequence
aatcatgctcactctactta

SEQ ID NO: 239380 - DNA, 20 bp, Artificial
  CRISPR gRNA sequence
cactctacttatagtgttcc

SEQ ID NO: 239381 - DNA, 20 bp, Artificial
  CRISPR gRNA sequence
tagtgttcccagtaatttta

SEQ ID NO: 239382 - DNA, 20 bp, Artificial
  CRISPR gRNA sequence
tttacttttaaatctccata

SEQ ID NO: 239383 - DNA, 20 bp, Artificial
  CRISPR gRNA sequence
cataaagacatttttacatt

SEQ ID NO: 239384 - DNA, 20 bp, Artificial
  CRISPR gRNA sequence
ataaagacatttttacattt

SEQ ID NO: 239385 - DNA, 20 bp, Artificial
  CRISPR gRNA sequence
agacatttttacatttaggt

SEQ ID NO: 239386 - DNA, 20 bp, Artificial
  CRISPR gRNA sequence
tgaatgtttcctctaatatt

SEQ ID NO: 239387 - DNA, 20 bp, Artificial
  CRISPR gRNA sequence
tgtttcctctaatatttaga

SEQ ID NO: 239388 - DNA, 20 bp, Artificial
  CRISPR gRNA sequence
cctctaatatttagaaagct

SEQ ID NO: 239389 - DNA, 20 bp, Artificial
  CRISPR gRNA sequence
ccacaaataattgctgtcac

SEQ ID NO: 239390 - DNA, 20 bp, Artificial
  CRISPR gRNA sequence
gtcactggatattattgtcc

SEQ ID NO: 239391 - DNA, 20 bp, Artificial
  CRISPR gRNA sequence
tattattgtcctagacctgc

SEQ ID NO: 239392 - DNA, 20 bp, Artificial
  CRISPR gRNA sequence
attgtcctagacctgctggt

SEQ ID NO: 239393 - DNA, 20 bp, Artificial
  CRISPR gRNA sequence
gtcctagacctgctggttgg

SEQ ID NO: 239394 - DNA, 20 bp, Artificial
  CRISPR gRNA sequence
ctagacctgctggttggcag

SEQ ID NO: 239395 - DNA, 20 bp, Artificial
  CRISPR gRNA sequence
ctgctggttggcagaagaat

SEQ ID NO: 239396 - DNA, 20 bp, Artificial
  CRISPR gRNA sequence
agaatcagtctttgacactt

SEQ ID NO: 239397 - DNA, 20 bp, Artificial
  CRISPR gRNA sequence
ttgacacttgagattttcaa

SEQ ID NO: 239398 - DNA, 20 bp, Artificial
  CRISPR gRNA sequence
gacacttgagattttcaaaa

SEQ ID NO: 239399 - DNA, 20 bp, Artificial
  CRISPR gRNA sequence
cacttgagattttcaaaaga

SEQ ID NO: 239400 - DNA, 20 bp, Artificial
  CRISPR gRNA sequence
ttgagattttcaaaagagag

SEQ ID NO: 239401 - DNA, 20 bp, Artificial
  CRISPR gRNA sequence
gattttcaaaagagagcagt

SEQ ID NO: 239402 - DNA, 20 bp, Artificial
  CRISPR gRNA sequence
aaaagagagcagttagtaaa

SEQ ID NO: 239403 - DNA, 20 bp, Artificial
  CRISPR gRNA sequence
aaagagagcagttagtaaat

SEQ ID NO: 239404 - DNA, 20 bp, Artificial
  CRISPR gRNA sequence
agagcagttagtaaatggga

SEQ ID NO: 239405 - DNA, 20 bp, Artificial
  CRISPR gRNA sequence
agttagtaaatgggaaagaa

SEQ ID NO: 239406 - DNA, 20 bp, Artificial
  CRISPR gRNA sequence
ttatcttcccaactatcttc

SEQ ID NO: 239407 - DNA, 20 bp, Artificial
  CRISPR gRNA sequence
tcttcccaactatcttctag

SEQ ID NO: 239408 - DNA, 20 bp, Artificial
  CRISPR gRNA sequence
tcccaactatcttctagaag

SEQ ID NO: 239409 - DNA, 20 bp, Artificial
  CRISPR gRNA sequence
tacactgcctgcatatgtca

SEQ ID NO: 239410 - DNA, 20 bp, Artificial
  CRISPR gRNA sequence
acactgcctgcatatgtcac

SEQ ID NO: 239411 - DNA, 20 bp, Artificial
  CRISPR gRNA sequence
ggtcctttgtccacctgcgc

SEQ ID NO: 239412 - DNA, 20 bp, Artificial
  CRISPR gRNA sequence
tcctttgtccacctgcgctg

SEQ ID NO: 239413 - DNA, 20 bp, Artificial
  CRISPR gRNA sequence
cctgcgctggagaaactatt

SEQ ID NO: 239414 - DNA, 20 bp, Artificial
  CRISPR gRNA sequence
tgcgctggagaaactatttg

SEQ ID NO: 239415 - DNA, 20 bp, Artificial
  CRISPR gRNA sequence
gcgctggagaaactatttgg

SEQ ID NO: 239416 - DNA, 20 bp, Artificial
  CRISPR gRNA sequence
tggagaaactatttggagga

SEQ ID NO: 239417 - DNA, 20 bp, Artificial
  CRISPR gRNA sequence
ggagaaactatttggaggac

SEQ ID NO: 239418 - DNA, 20 bp, Artificial
  CRISPR gRNA sequence
gagaaactatttggaggaca

SEQ ID NO: 239419 - DNA, 20 bp, Artificial
  CRISPR gRNA sequence
tctgattcctgttattatca

SEQ ID NO: 239420 - DNA, 20 bp, Artificial
  CRISPR gRNA sequence
tattatcacagaatgtacct

SEQ ID NO: 239421 - DNA, 20 bp, Artificial
  CRISPR gRNA sequence
atcacagaatgtacctaaga

SEQ ID NO: 239422 - DNA, 20 bp, Artificial
  CRISPR gRNA sequence
tcacagaatgtacctaagaa

SEQ ID NO: 239423 - DNA, 20 bp, Artificial
  CRISPR gRNA sequence
cagaatgtacctaagaaagg

SEQ ID NO: 239424 - DNA, 20 bp, Artificial
  CRISPR gRNA sequence
tacctaagaaaggcagacaa

SEQ ID NO: 239425 - DNA, 20 bp, Artificial
  CRISPR gRNA sequence
ctaagaaaggcagacaatag

SEQ ID NO: 239426 - DNA, 20 bp, Artificial
  CRISPR gRNA sequence
tagtggtacacgtttgacaa

SEQ ID NO: 239427 - DNA, 20 bp, Artificial
  CRISPR gRNA sequence
agtggtacacgtttgacaat

SEQ ID NO: 239428 - DNA, 20 bp, Artificial
  CRISPR gRNA sequence
acaatgggcaatcgtcaccc

SEQ ID NO: 239429 - DNA, 20 bp, Artificial
  CRISPR gRNA sequence
caatgggcaatcgtcaccca

SEQ ID NO: 239430 - DNA, 20 bp, Artificial
  CRISPR gRNA sequence
tcgtcacccaaggcattccg

SEQ ID NO: 239431 - DNA, 20 bp, Artificial
  CRISPR gRNA sequence
tccgaagtttacaataaaat

SEQ ID NO: 239432 - DNA, 20 bp, Artificial
  CRISPR gRNA sequence
acaataaaataagattataa

SEQ ID NO: 239433 - DNA, 20 bp, Artificial
  CRISPR gRNA sequence
taagattataaaagaatgat

SEQ ID NO: 239434 - DNA, 20 bp, Artificial
  CRISPR gRNA sequence
taaaagaatgatgagttttc

SEQ ID NO: 239435 - DNA, 20 bp, Artificial
  CRISPR gRNA sequence
gatgagttttctagatgcca

SEQ ID NO: 239436 - DNA, 20 bp, Artificial
  CRISPR gRNA sequence
gagttttctagatgccacag

SEQ ID NO: 239437 - DNA, 20 bp, Artificial
  CRISPR gRNA sequence
ttttctagatgccacagtgg

SEQ ID NO: 239438 - DNA, 20 bp, Artificial
  CRISPR gRNA sequence
gatgccacagtggtggacat

SEQ ID NO: 239439 - DNA, 20 bp, Artificial
  CRISPR gRNA sequence
tcctaaaacaatacatttgc

SEQ ID NO: 239440 - DNA, 20 bp, Artificial
  CRISPR gRNA sequence
gattattctttgtgtaatca

SEQ ID NO: 239441 - DNA, 20 bp, Artificial
  CRISPR gRNA sequence
tctttgtgtaatcacagaat

SEQ ID NO: 239442 - DNA, 20 bp, Artificial
  CRISPR gRNA sequence
gaattagaaataacaaaata

SEQ ID NO: 239443 - DNA, 20 bp, Artificial
  CRISPR gRNA sequence
aattagaaataacaaaatac

SEQ ID NO: 239444 - DNA, 20 bp, Artificial
  CRISPR gRNA sequence
agaaataacaaaatacaggc

SEQ ID NO: 239445 - DNA, 20 bp, Artificial
  CRISPR gRNA sequence
gaaataacaaaatacaggcc

SEQ ID NO: 239446 - DNA, 20 bp, Artificial
  CRISPR gRNA sequence
aacaaaatacaggccaggtg

SEQ ID NO: 239447 - DNA, 20 bp, Artificial
  CRISPR gRNA sequence
aaaatacaggccaggtgcag

SEQ ID NO: 239448 - DNA, 20 bp, Artificial
  CRISPR gRNA sequence
gtggctcacgcctgtaatca

SEQ ID NO: 239449 - DNA, 20 bp, Artificial
  CRISPR gRNA sequence
cgcctgtaatcacagcactt

SEQ ID NO: 239450 - DNA, 20 bp, Artificial
  CRISPR gRNA sequence
gcctgtaatcacagcacttt

SEQ ID NO: 239451 - DNA, 20 bp, Artificial
  CRISPR gRNA sequence
ctgtaatcacagcactttgg

SEQ ID NO: 239452 - DNA, 20 bp, Artificial
  CRISPR gRNA sequence
tgtaatcacagcactttggg

SEQ ID NO: 239453 - DNA, 20 bp, Artificial
  CRISPR gRNA sequence
cacagcactttgggaggccg

SEQ ID NO: 239454 - DNA, 20 bp, Artificial
  CRISPR gRNA sequence
agcactttgggaggccgaag

SEQ ID NO: 239455 - DNA, 20 bp, Artificial
  CRISPR gRNA sequence
gcactttgggaggccgaagc

SEQ ID NO: 239456 - DNA, 20 bp, Artificial
  CRISPR gRNA sequence
ctttgggaggccgaagcggg

SEQ ID NO: 239457 - DNA, 20 bp, Artificial
  CRISPR gRNA sequence
ccgaagcgggcagatcacct

SEQ ID NO: 239458 - DNA, 20 bp, Artificial
  CRISPR gRNA sequence
cgaagcgggcagatcacctg

SEQ ID NO: 239459 - DNA, 20 bp, Artificial
  CRISPR gRNA sequence
gcgggcagatcacctgaggt

SEQ ID NO: 239460 - DNA, 20 bp, Artificial
  CRISPR gRNA sequence
ggcagatcacctgaggtcag

SEQ ID NO: 239461 - DNA, 20 bp, Artificial
  CRISPR gRNA sequence
tcacctgaggtcagcagttc

SEQ ID NO: 239462 - DNA, 20 bp, Artificial
  CRISPR gRNA sequence
tgaggtcagcagttcaagac

SEQ ID NO: 239463 - DNA, 20 bp, Artificial
  CRISPR gRNA sequence
tcagcagttcaagaccagct

SEQ ID NO: 239464 - DNA, 20 bp, Artificial
  CRISPR gRNA sequence
caagaccagcttggccaaca

SEQ ID NO: 239465 - DNA, 20 bp, Artificial
  CRISPR gRNA sequence
tctactaaaaatacaaaaat

SEQ ID NO: 239466 - DNA, 20 bp, Artificial
  CRISPR gRNA sequence
ctaaaaatacaaaaattagc

SEQ ID NO: 239467 - DNA, 20 bp, Artificial
  CRISPR gRNA sequence
taaaaatacaaaaattagcc

SEQ ID NO: 239468 - DNA, 20 bp, Artificial
  CRISPR gRNA sequence
atacaaaaattagccaggcg

SEQ ID NO: 239469 - DNA, 20 bp, Artificial
  CRISPR gRNA sequence
caaaaattagccaggcgcag

SEQ ID NO: 239470 - DNA, 20 bp, Artificial
  CRISPR gRNA sequence
gtggtgcacacctgtaatcc

SEQ ID NO: 239471 - DNA, 20 bp, Artificial
  CRISPR gRNA sequence
cacctgtaatcccagctact

SEQ ID NO: 239472 - DNA, 20 bp, Artificial
  CRISPR gRNA sequence
acctgtaatcccagctactc

SEQ ID NO: 239473 - DNA, 20 bp, Artificial
  CRISPR gRNA sequence
ctgtaatcccagctactcgg

SEQ ID NO: 239474 - DNA, 20 bp, Artificial
  CRISPR gRNA sequence
tgtaatcccagctactcggg

SEQ ID NO: 239475 - DNA, 20 bp, Artificial
  CRISPR gRNA sequence
tcccagctactcgggaggct

SEQ ID NO: 239476 - DNA, 20 bp, Artificial
  CRISPR gRNA sequence
cccagctactcgggaggctg

SEQ ID NO: 239477 - DNA, 20 bp, Artificial
  CRISPR gRNA sequence
agctactcgggaggctgagg

SEQ ID NO: 239478 - DNA, 20 bp, Artificial
  CRISPR gRNA sequence
gctactcgggaggctgaggc

SEQ ID NO: 239479 - DNA, 20 bp, Artificial
  CRISPR gRNA sequence
tactcgggaggctgaggcag

SEQ ID NO: 239480 - DNA, 20 bp, Artificial
  CRISPR gRNA sequence
gcaggagaattgcttgaacc

SEQ ID NO: 239481 - DNA, 20 bp, Artificial
  CRISPR gRNA sequence
caggagaattgcttgaacct

SEQ ID NO: 239482 - DNA, 20 bp, Artificial
  CRISPR gRNA sequence
ggagaattgcttgaacctgg

SEQ ID NO: 239483 - DNA, 20 bp, Artificial
  CRISPR gRNA sequence
gagaattgcttgaacctggg

SEQ ID NO: 239484 - DNA, 20 bp, Artificial
  CRISPR gRNA sequence
ttgcttgaacctgggaggcc

SEQ ID NO: 239485 - DNA, 20 bp, Artificial
  CRISPR gRNA sequence
tgcttgaacctgggaggcca

SEQ ID NO: 239486 - DNA, 20 bp, Artificial
  CRISPR gRNA sequence
aacctgggaggccaaggttg

SEQ ID NO: 239487 - DNA, 20 bp, Artificial
  CRISPR gRNA sequence
tgggaggccaaggttgcagt

SEQ ID NO: 239488 - DNA, 20 bp, Artificial
  CRISPR gRNA sequence
ggccaaggttgcagtgagct

SEQ ID NO: 239489 - DNA, 20 bp, Artificial
  CRISPR gRNA sequence
gagatcgtgccactgcactc

SEQ ID NO: 239490 - DNA, 20 bp, Artificial
  CRISPR gRNA sequence
cgtgccactgcactccagcc

SEQ ID NO: 239491 - DNA, 20 bp, Artificial
  CRISPR gRNA sequence
gtgccactgcactccagcct

SEQ ID NO: 239492 - DNA, 20 bp, Artificial
  CRISPR gRNA sequence
ctgcactccagcctgggcga

SEQ ID NO: 239493 - DNA, 20 bp, Artificial
  CRISPR gRNA sequence
gcactccagcctgggcgaca

SEQ ID NO: 239494 - DNA, 20 bp, Artificial
  CRISPR gRNA sequence
tccagcctgggcgacagagt

SEQ ID NO: 239495 - DNA, 20 bp, Artificial
  CRISPR gRNA sequence
cacaaaaaaaacaaaaaaac

SEQ ID NO: 239496 - DNA, 20 bp, Artificial
  CRISPR gRNA sequence
tattgtaacaaataaatcaa

SEQ ID NO: 239497 - DNA, 20 bp, Artificial
  CRISPR gRNA sequence
gtaacaaataaatcaacaga

SEQ ID NO: 239498 - DNA, 20 bp, Artificial
  CRISPR gRNA sequence
aatgattatcttgattgatg

SEQ ID NO: 239499 - DNA, 20 bp, Artificial
  CRISPR gRNA sequence
atgattatcttgattgatgt

SEQ ID NO: 239500 - DNA, 20 bp, Artificial
  CRISPR gRNA sequence
gattatcttgattgatgtag

SEQ ID NO: 239501 - DNA, 20 bp, Artificial
  CRISPR gRNA sequence
atgtaggagatgaatatgac

SEQ ID NO: 239502 - DNA, 20 bp, Artificial
  CRISPR gRNA sequence
gagatgaatatgactggatc

SEQ ID NO: 239503 - DNA, 20 bp, Artificial
  CRISPR gRNA sequence
agatgaatatgactggatcc

SEQ ID NO: 239504 - DNA, 20 bp, Artificial
  CRISPR gRNA sequence
atgaatatgactggatccag

SEQ ID NO: 239505 - DNA, 20 bp, Artificial
  CRISPR gRNA sequence
tgaatatgactggatccagg

SEQ ID NO: 239506 - DNA, 20 bp, Artificial
  CRISPR gRNA sequence
ctgaccgtccccactctgtt

SEQ ID NO: 239507 - DNA, 20 bp, Artificial
  CRISPR gRNA sequence
cttactcgctgctatgcccc

SEQ ID NO: 239508 - DNA, 20 bp, Artificial
  CRISPR gRNA sequence
ctcgctgctatgcccccagt

SEQ ID NO: 239509 - DNA, 20 bp, Artificial
  CRISPR gRNA sequence
cgctgctatgcccccagtcg

SEQ ID NO: 239510 - DNA, 20 bp, Artificial
  CRISPR gRNA sequence
atgcccccagtcggagcaca

SEQ ID NO: 239511 - DNA, 20 bp, Artificial
  CRISPR gRNA sequence
cacaaaactaacatttattg

SEQ ID NO: 239512 - DNA, 20 bp, Artificial
  CRISPR gRNA sequence
cttgtgccatgcactgttct

SEQ ID NO: 239513 - DNA, 20 bp, Artificial
  CRISPR gRNA sequence
agcccttcatttgatcctcc

SEQ ID NO: 239514 - DNA, 20 bp, Artificial
  CRISPR gRNA sequence
ctcccagccatcctataaaa

SEQ ID NO: 239515 - DNA, 20 bp, Artificial
  CRISPR gRNA sequence
tcccagccatcctataaaac

SEQ ID NO: 239516 - DNA, 20 bp, Artificial
  CRISPR gRNA sequence
acaggttctcttattatccc

SEQ ID NO: 239517 - DNA, 20 bp, Artificial
  CRISPR gRNA sequence
ttctcttattatccccagat

SEQ ID NO: 239518 - DNA, 20 bp, Artificial
  CRISPR gRNA sequence
cttattatccccagatgaga

SEQ ID NO: 239519 - DNA, 20 bp, Artificial
  CRISPR gRNA sequence
tatccccagatgagaaagtc

SEQ ID NO: 239520 - DNA, 20 bp, Artificial
  CRISPR gRNA sequence
atccccagatgagaaagtca

SEQ ID NO: 239521 - DNA, 20 bp, Artificial
  CRISPR gRNA sequence
agatgagaaagtcaaggcac

SEQ ID NO: 239522 - DNA, 20 bp, Artificial
  CRISPR gRNA sequence
atgagaaagtcaaggcacaa

SEQ ID NO: 239523 - DNA, 20 bp, Artificial
  CRISPR gRNA sequence
tgagaaagtcaaggcacaag

SEQ ID NO: 239524 - DNA, 20 bp, Artificial
  CRISPR gRNA sequence
atgactttgctgtgttcaca

SEQ ID NO: 239525 - DNA, 20 bp, Artificial
  CRISPR gRNA sequence
ctttgctgtgttcacacagc

SEQ ID NO: 239526 - DNA, 20 bp, Artificial
  CRISPR gRNA sequence
tttgctgtgttcacacagct

SEQ ID NO: 239527 - DNA, 20 bp, Artificial
  CRISPR gRNA sequence
gtgttcacacagctaggttg

SEQ ID NO: 239528 - DNA, 20 bp, Artificial
  CRISPR gRNA sequence
tttcattttcctttccttaa

SEQ ID NO: 239529 - DNA, 20 bp, Artificial
  CRISPR gRNA sequence
ttcattttcctttccttaaa

SEQ ID NO: 239530 - DNA, 20 bp, Artificial
  CRISPR gRNA sequence
tcattttcctttccttaaaa

SEQ ID NO: 239531 - DNA, 20 bp, Artificial
  CRISPR gRNA sequence
attttcctttccttaaaagg

SEQ ID NO: 239532 - DNA, 20 bp, Artificial
  CRISPR gRNA sequence
ttccttaaaagggagctcgt

SEQ ID NO: 239533 - DNA, 20 bp, Artificial
  CRISPR gRNA sequence
agctcgttagccctgactac

SEQ ID NO: 239534 - DNA, 20 bp, Artificial
  CRISPR gRNA sequence
taactgaaccatacttccaa

SEQ ID NO: 239535 - DNA, 20 bp, Artificial
  CRISPR gRNA sequence
actgaaccatacttccaaca

SEQ ID NO: 239536 - DNA, 20 bp, Artificial
  CRISPR gRNA sequence
gaaccatacttccaacagag

SEQ ID NO: 239537 - DNA, 20 bp, Artificial
  CRISPR gRNA sequence
gatcaaatgcacatgataac

SEQ ID NO: 239538 - DNA, 20 bp, Artificial
  CRISPR gRNA sequence
atcaaatgcacatgataact

SEQ ID NO: 239539 - DNA, 20 bp, Artificial
  CRISPR gRNA sequence
catgataactgggtactcac

SEQ ID NO: 239540 - DNA, 20 bp, Artificial
  CRISPR gRNA sequence
ataactgggtactcaccagc

SEQ ID NO: 239541 - DNA, 20 bp, Artificial
  CRISPR gRNA sequence
taactgggtactcaccagct

SEQ ID NO: 239542 - DNA, 20 bp, Artificial
  CRISPR gRNA sequence
ctgggtactcaccagctggg

SEQ ID NO: 239543 - DNA, 20 bp, Artificial
  CRISPR gRNA sequence
accagctgggcagttactac

SEQ ID NO: 239544 - DNA, 20 bp, Artificial
  CRISPR gRNA sequence
ccagctgggcagttactaca

SEQ ID NO: 239545 - DNA, 20 bp, Artificial
  CRISPR gRNA sequence
gcaatgatcttgtcctctca

SEQ ID NO: 239546 - DNA, 20 bp, Artificial
  CRISPR gRNA sequence
gatcttgtcctctcaaagtt

SEQ ID NO: 239547 - DNA, 20 bp, Artificial
  CRISPR gRNA sequence
atcttgtcctctcaaagttg

SEQ ID NO: 239548 - DNA, 20 bp, Artificial
  CRISPR gRNA sequence
gtcctctcaaagttgaggac

SEQ ID NO: 239549 - DNA, 20 bp, Artificial
  CRISPR gRNA sequence
tcaaagttgaggaccagcaa

SEQ ID NO: 239550 - DNA, 20 bp, Artificial
  CRISPR gRNA sequence
aaagttgaggaccagcaaca

SEQ ID NO: 239551 - DNA, 20 bp, Artificial
  CRISPR gRNA sequence
gttgaggaccagcaacagag

SEQ ID NO: 239552 - DNA, 20 bp, Artificial
  CRISPR gRNA sequence
gagtggctactatgttgtaa

SEQ ID NO: 239553 - DNA, 20 bp, Artificial
  CRISPR gRNA sequence
ctgtttcccatgatgaaatc

SEQ ID NO: 239554 - DNA, 20 bp, Artificial
  CRISPR gRNA sequence
tcccatgatgaaatctggca

SEQ ID NO: 239555 - DNA, 20 bp, Artificial
  CRISPR gRNA sequence
cccatgatgaaatctggcac

SEQ ID NO: 239556 - DNA, 20 bp, Artificial
  CRISPR gRNA sequence
atctggcacaggtatgatac

SEQ ID NO: 239557 - DNA, 20 bp, Artificial
  CRISPR gRNA sequence
gcacaggtatgatactagca

SEQ ID NO: 239558 - DNA, 20 bp, Artificial
  CRISPR gRNA sequence
atactagcaaagctgattcc

SEQ ID NO: 239559 - DNA, 20 bp, Artificial
  CRISPR gRNA sequence
actagcaaagctgattccaa

SEQ ID NO: 239560 - DNA, 20 bp, Artificial
  CRISPR gRNA sequence
caagagaattttaatcaaat

SEQ ID NO: 239561 - DNA, 20 bp, Artificial
  CRISPR gRNA sequence
agaattttaatcaaattagc

SEQ ID NO: 239562 - DNA, 20 bp, Artificial
  CRISPR gRNA sequence
tcacaaatgtcactctgcaa

SEQ ID NO: 239563 - DNA, 20 bp, Artificial
  CRISPR gRNA sequence
tgcaaaagataaacatttcc

SEQ ID NO: 239564 - DNA, 20 bp, Artificial
  CRISPR gRNA sequence
gcaaaagataaacatttcca

SEQ ID NO: 239565 - DNA, 20 bp, Artificial
  CRISPR gRNA sequence
aagataaacatttccaagga

SEQ ID NO: 239566 - DNA, 20 bp, Artificial
  CRISPR gRNA sequence
agataaacatttccaaggaa

SEQ ID NO: 239567 - DNA, 20 bp, Artificial
  CRISPR gRNA sequence
taaacatttccaaggaaagg

SEQ ID NO: 239568 - DNA, 20 bp, Artificial
  CRISPR gRNA sequence
cattacttatacaattctat

SEQ ID NO: 239569 - DNA, 20 bp, Artificial
  CRISPR gRNA sequence
ttacttatacaattctataa

SEQ ID NO: 239570 - DNA, 20 bp, Artificial
  CRISPR gRNA sequence
tacttatacaattctataag

SEQ ID NO: 239571 - DNA, 20 bp, Artificial
  CRISPR gRNA sequence
aattctataagaggataact

SEQ ID NO: 239572 - DNA, 20 bp, Artificial
  CRISPR gRNA sequence
attctataagaggataactc

SEQ ID NO: 239573 - DNA, 20 bp, Artificial
  CRISPR gRNA sequence
ttctataagaggataactca

SEQ ID NO: 239574 - DNA, 20 bp, Artificial
  CRISPR gRNA sequence
gaggataactcagggttttt

SEQ ID NO: 239575 - DNA, 20 bp, Artificial
  CRISPR gRNA sequence
aggataactcagggtttttc

SEQ ID NO: 239576 - DNA, 20 bp, Artificial
  CRISPR gRNA sequence
caattaatgatgcaatatta

SEQ ID NO: 239577 - DNA, 20 bp, Artificial
  CRISPR gRNA sequence
aatgatgcaatattacggaa

SEQ ID NO: 239578 - DNA, 20 bp, Artificial
  CRISPR gRNA sequence
gatgcaatattacggaaaag

SEQ ID NO: 239579 - DNA, 20 bp, Artificial
  CRISPR gRNA sequence
gcaatattacggaaaagtag

SEQ ID NO: 239580 - DNA, 20 bp, Artificial
  CRISPR gRNA sequence
acggaaaagtagcagattca

SEQ ID NO: 239581 - DNA, 20 bp, Artificial
  CRISPR gRNA sequence
agcagattcatagaaaccac

SEQ ID NO: 239582 - DNA, 20 bp, Artificial
  CRISPR gRNA sequence
gcagattcatagaaaccact

SEQ ID NO: 239583 - DNA, 20 bp, Artificial
  CRISPR gRNA sequence
ttcatagaaaccactaggac

SEQ ID NO: 239584 - DNA, 20 bp, Artificial
  CRISPR gRNA sequence
tcatagaaaccactaggaca

SEQ ID NO: 239585 - DNA, 20 bp, Artificial
  CRISPR gRNA sequence
tagaaaccactaggacaagg

SEQ ID NO: 239586 - DNA, 20 bp, Artificial
  CRISPR gRNA sequence
agaaaccactaggacaaggc

SEQ ID NO: 239587 - DNA, 20 bp, Artificial
  CRISPR gRNA sequence
ggcaggcgtgattaaacaca

SEQ ID NO: 239588 - DNA, 20 bp, Artificial
  CRISPR gRNA sequence
ttaaacacacagctttgtgc

SEQ ID NO: 239589 - DNA, 20 bp, Artificial
  CRISPR gRNA sequence
agctttgtgccggtttgcca

SEQ ID NO: 239590 - DNA, 20 bp, Artificial
  CRISPR gRNA sequence
gtgccggtttgccaaagttt

SEQ ID NO: 239591 - DNA, 20 bp, Artificial
  CRISPR gRNA sequence
tgccggtttgccaaagtttg

SEQ ID NO: 239592 - DNA, 20 bp, Artificial
  CRISPR gRNA sequence
gccggtttgccaaagtttga

SEQ ID NO: 239593 - DNA, 20 bp, Artificial
  CRISPR gRNA sequence
catcatgttctgccaaaatg

SEQ ID NO: 239594 - DNA, 20 bp, Artificial
  CRISPR gRNA sequence
ccaaaatgcagaaataacaa

SEQ ID NO: 239595 - DNA, 20 bp, Artificial
  CRISPR gRNA sequence
aatgcagaaataacaatagc

SEQ ID NO: 239596 - DNA, 20 bp, Artificial
  CRISPR gRNA sequence
ataacaatagcaagaacttt

SEQ ID NO: 239597 - DNA, 20 bp, Artificial
  CRISPR gRNA sequence
taacaatagcaagaactttt

SEQ ID NO: 239598 - DNA, 20 bp, Artificial
  CRISPR gRNA sequence
aacaatagcaagaacttttg

SEQ ID NO: 239599 - DNA, 20 bp, Artificial
  CRISPR gRNA sequence
agaacttttggggactttca

SEQ ID NO: 239600 - DNA, 20 bp, Artificial
  CRISPR gRNA sequence
gaacttttggggactttcat

SEQ ID NO: 239601 - DNA, 20 bp, Artificial
  CRISPR gRNA sequence
ggactttcataggtactttg

SEQ ID NO: 239602 - DNA, 20 bp, Artificial
  CRISPR gRNA sequence
aggtactttgcagtaccaac

SEQ ID NO: 239603 - DNA, 20 bp, Artificial
  CRISPR gRNA sequence
cctgaaataaactccttaca

SEQ ID NO: 239604 - DNA, 20 bp, Artificial
  CRISPR gRNA sequence
tgaaataaactccttacaaa

SEQ ID NO: 239605 - DNA, 20 bp, Artificial
  CRISPR gRNA sequence
tccttacaaagagaatctgt

SEQ ID NO: 239606 - DNA, 20 bp, Artificial
  CRISPR gRNA sequence
ccttacaaagagaatctgtc

SEQ ID NO: 239607 - DNA, 20 bp, Artificial
  CRISPR gRNA sequence
cttacaaagagaatctgtca

SEQ ID NO: 239608 - DNA, 20 bp, Artificial
  CRISPR gRNA sequence
ttacaaagagaatctgtcag

SEQ ID NO: 239609 - DNA, 20 bp, Artificial
  CRISPR gRNA sequence
agagaatctgtcaggggcat

SEQ ID NO: 239610 - DNA, 20 bp, Artificial
  CRISPR gRNA sequence
gtcaggggcatcagacaatt

SEQ ID NO: 239611 - DNA, 20 bp, Artificial
  CRISPR gRNA sequence
ggcatcagacaattcagttc

SEQ ID NO: 239612 - DNA, 20 bp, Artificial
  CRISPR gRNA sequence
atcagacaattcagttcaag

SEQ ID NO: 239613 - DNA, 20 bp, Artificial
  CRISPR gRNA sequence
agacaattcagttcaagaag

SEQ ID NO: 239614 - DNA, 20 bp, Artificial
  CRISPR gRNA sequence
cataatcactcttccccctt

SEQ ID NO: 239615 - DNA, 20 bp, Artificial
  CRISPR gRNA sequence
aacacctaactactaacatg

SEQ ID NO: 239616 - DNA, 20 bp, Artificial
  CRISPR gRNA sequence
cctaactactaacatgtgga

SEQ ID NO: 239617 - DNA, 20 bp, Artificial
  CRISPR gRNA sequence
cactaacacattttcttaaa

SEQ ID NO: 239618 - DNA, 20 bp, Artificial
  CRISPR gRNA sequence
ctaacacattttcttaaaca

SEQ ID NO: 239619 - DNA, 20 bp, Artificial
  CRISPR gRNA sequence
cttaaacagagacatgtttt

SEQ ID NO: 239620 - DNA, 20 bp, Artificial
  CRISPR gRNA sequence
gagacatgttttgagatgtg

SEQ ID NO: 239621 - DNA, 20 bp, Artificial
  CRISPR gRNA sequence
tttgagatgtgaagtttgta

SEQ ID NO: 239622 - DNA, 20 bp, Artificial
  CRISPR gRNA sequence
gtttgtatggtaacaaaact

SEQ ID NO: 239623 - DNA, 20 bp, Artificial
  CRISPR gRNA sequence
tttgtatggtaacaaaacta

SEQ ID NO: 239624 - DNA, 20 bp, Artificial
  CRISPR gRNA sequence
tgtatggtaacaaaactaag

SEQ ID NO: 239625 - DNA, 20 bp, Artificial
  CRISPR gRNA sequence
ctaaggagtgaaaaactctt

SEQ ID NO: 239626 - DNA, 20 bp, Artificial
  CRISPR gRNA sequence
taaggagtgaaaaactcttc

SEQ ID NO: 239627 - DNA, 20 bp, Artificial
  CRISPR gRNA sequence
agtgaaaaactcttcaggct

SEQ ID NO: 239628 - DNA, 20 bp, Artificial
  CRISPR gRNA sequence
aagttattgatgtttattta

SEQ ID NO: 239629 - DNA, 20 bp, Artificial
  CRISPR gRNA sequence
agttattgatgtttatttaa

SEQ ID NO: 239630 - DNA, 20 bp, Artificial
  CRISPR gRNA sequence
gttattgatgtttatttaaa

SEQ ID NO: 239631 - DNA, 20 bp, Artificial
  CRISPR gRNA sequence
gtttatttaaagggctattg

SEQ ID NO: 239632 - DNA, 20 bp, Artificial
  CRISPR gRNA sequence
ttatttaaagggctattgaa

SEQ ID NO: 239633 - DNA, 20 bp, Artificial
  CRISPR gRNA sequence
tttaaagggctattgaagag

SEQ ID NO: 239634 - DNA, 20 bp, Artificial
  CRISPR gRNA sequence
gaagagaagttattacatat

SEQ ID NO: 239635 - DNA, 20 bp, Artificial
  CRISPR gRNA sequence
aagagaagttattacatatt

SEQ ID NO: 239636 - DNA, 20 bp, Artificial
  CRISPR gRNA sequence
gagaagttattacatattag

SEQ ID NO: 239637 - DNA, 20 bp, Artificial
  CRISPR gRNA sequence
ttattacatattaggagaaa

SEQ ID NO: 239638 - DNA, 20 bp, Artificial
  CRISPR gRNA sequence
acatattaggagaaaaagtc

SEQ ID NO: 239639 - DNA, 20 bp, Artificial
  CRISPR gRNA sequence
taggagaaaaagtctagaaa

SEQ ID NO: 239640 - DNA, 20 bp, Artificial
  CRISPR gRNA sequence
aggagaaaaagtctagaaat

SEQ ID NO: 239641 - DNA, 20 bp, Artificial
  CRISPR gRNA sequence
aaaaagtctagaaatgggca

SEQ ID NO: 239642 - DNA, 20 bp, Artificial
  CRISPR gRNA sequence
aaaagtctagaaatgggcaa

SEQ ID NO: 239643 - DNA, 20 bp, Artificial
  CRISPR gRNA sequence
aaagtctagaaatgggcaaa

SEQ ID NO: 239644 - DNA, 20 bp, Artificial
  CRISPR gRNA sequence
agtctagaaatgggcaaagg

SEQ ID NO: 239645 - DNA, 20 bp, Artificial
  CRISPR gRNA sequence
gaaatgggcaaagggagcaa

SEQ ID NO: 239646 - DNA, 20 bp, Artificial
  CRISPR gRNA sequence
gttccaatctcaccccttct

SEQ ID NO: 239647 - DNA, 20 bp, Artificial
  CRISPR gRNA sequence
agtgcccccacccactcccc

SEQ ID NO: 239648 - DNA, 20 bp, Artificial
  CRISPR gRNA sequence
cccccacccactcccccaga

SEQ ID NO: 239649 - DNA, 20 bp, Artificial
  CRISPR gRNA sequence
cacccactcccccagatgga

SEQ ID NO: 239650 - DNA, 20 bp, Artificial
  CRISPR gRNA sequence
cccccagatggacagacctt

SEQ ID NO: 239651 - DNA, 20 bp, Artificial
  CRISPR gRNA sequence
atggacagaccttgagatct

SEQ ID NO: 239652 - DNA, 20 bp, Artificial
  CRISPR gRNA sequence
tggacagaccttgagatctc

SEQ ID NO: 239653 - DNA, 20 bp, Artificial
  CRISPR gRNA sequence
ggacagaccttgagatctca

SEQ ID NO: 239654 - DNA, 20 bp, Artificial
  CRISPR gRNA sequence
ccttgagatctcagggctgc

SEQ ID NO: 239655 - DNA, 20 bp, Artificial
  CRISPR gRNA sequence
ttgagatctcagggctgccg

SEQ ID NO: 239656 - DNA, 20 bp, Artificial
  CRISPR gRNA sequence
ccggagaactttccactcct

SEQ ID NO: 239657 - DNA, 20 bp, Artificial
  CRISPR gRNA sequence
actttccactccttggtctt

SEQ ID NO: 239658 - DNA, 20 bp, Artificial
  CRISPR gRNA sequence
ctttccactccttggtcttc

SEQ ID NO: 239659 - DNA, 20 bp, Artificial
  CRISPR gRNA sequence
ccttggtcttcaggcttctg

SEQ ID NO: 239660 - DNA, 20 bp, Artificial
  CRISPR gRNA sequence
tcttcaggcttctgcagctc

SEQ ID NO: 239661 - DNA, 20 bp, Artificial
  CRISPR gRNA sequence
ttcaggcttctgcagctcga

SEQ ID NO: 239662 - DNA, 20 bp, Artificial
  CRISPR gRNA sequence
tcaggcttctgcagctcgag

SEQ ID NO: 239663 - DNA, 20 bp, Artificial
  CRISPR gRNA sequence
tctgcagctcgagaggactt

SEQ ID NO: 239664 - DNA, 20 bp, Artificial
  CRISPR gRNA sequence
ctgcagctcgagaggacttc

SEQ ID NO: 239665 - DNA, 20 bp, Artificial
  CRISPR gRNA sequence
agaggacttcaggtcaaaca

SEQ ID NO: 239666 - DNA, 20 bp, Artificial
  CRISPR gRNA sequence
gaggacttcaggtcaaacac

SEQ ID NO: 239667 - DNA, 20 bp, Artificial
  CRISPR gRNA sequence
ggacttcaggtcaaacacag

SEQ ID NO: 239668 - DNA, 20 bp, Artificial
  CRISPR gRNA sequence
tcaggtcaaacacaggagtg

SEQ ID NO: 239669 - DNA, 20 bp, Artificial
  CRISPR gRNA sequence
aacacaggagtgcggtgact

SEQ ID NO: 239670 - DNA, 20 bp, Artificial
  CRISPR gRNA sequence
caggagtgcggtgactcagc

SEQ ID NO: 239671 - DNA, 20 bp, Artificial
  CRISPR gRNA sequence
aggagtgcggtgactcagcc

SEQ ID NO: 239672 - DNA, 20 bp, Artificial
  CRISPR gRNA sequence
ggagtgcggtgactcagcca

SEQ ID NO: 239673 - DNA, 20 bp, Artificial
  CRISPR gRNA sequence
gagtgcggtgactcagccag

SEQ ID NO: 239674 - DNA, 20 bp, Artificial
  CRISPR gRNA sequence
tgcggtgactcagccagggg

SEQ ID NO: 239675 - DNA, 20 bp, Artificial
  CRISPR gRNA sequence
gcggtgactcagccaggggc

SEQ ID NO: 239676 - DNA, 20 bp, Artificial
  CRISPR gRNA sequence
cggtgactcagccaggggcg

SEQ ID NO: 239677 - DNA, 20 bp, Artificial
  CRISPR gRNA sequence
cagccaggggcggggtctca

SEQ ID NO: 239678 - DNA, 20 bp, Artificial
  CRISPR gRNA sequence
agccaggggcggggtctcat

SEQ ID NO: 239679 - DNA, 20 bp, Artificial
  CRISPR gRNA sequence
ctcatgggaaattcccacca

SEQ ID NO: 239680 - DNA, 20 bp, Artificial
  CRISPR gRNA sequence
ttcccaccacagctctgtga

SEQ ID NO: 239681 - DNA, 20 bp, Artificial
  CRISPR gRNA sequence
ctgctgaccccgaaatcccc

SEQ ID NO: 239682 - DNA, 20 bp, Artificial
  CRISPR gRNA sequence
gctgaccccgaaatccccta

SEQ ID NO: 239683 - DNA, 20 bp, Artificial
  CRISPR gRNA sequence
cccccgtccctgcctgataa

SEQ ID NO: 239684 - DNA, 20 bp, Artificial
  CRISPR gRNA sequence
tggcacttcaaattgcttct

SEQ ID NO: 239685 - DNA, 20 bp, Artificial
  CRISPR gRNA sequence
cacttcaaattgcttcttgg

SEQ ID NO: 239686 - DNA, 20 bp, Artificial
  CRISPR gRNA sequence
ttcaaattgcttcttggaag

SEQ ID NO: 239687 - DNA, 20 bp, Artificial
  CRISPR gRNA sequence
tggaagcagctctctactgt

SEQ ID NO: 239688 - DNA, 20 bp, Artificial
  CRISPR gRNA sequence
ggaagcagctctctactgtc

SEQ ID NO: 239689 - DNA, 20 bp, Artificial
  CRISPR gRNA sequence
tctactgtcaggatgtgtca

SEQ ID NO: 239690 - DNA, 20 bp, Artificial
  CRISPR gRNA sequence
ggatgtgtcacagatgacgc

SEQ ID NO: 239691 - DNA, 20 bp, Artificial
  CRISPR gRNA sequence
gatgtgtcacagatgacgct

SEQ ID NO: 239692 - DNA, 20 bp, Artificial
  CRISPR gRNA sequence
tcatctgtgacacatcctga

SEQ ID NO: 239693 - DNA, 20 bp, Artificial
  CRISPR gRNA sequence
tctgtgacacatcctgacag

SEQ ID NO: 239694 - DNA, 20 bp, Artificial
  CRISPR gRNA sequence
tgtgacacatcctgacagta

SEQ ID NO: 239695 - DNA, 20 bp, Artificial
  CRISPR gRNA sequence
tgacacatcctgacagtaga

SEQ ID NO: 239696 - DNA, 20 bp, Artificial
  CRISPR gRNA sequence
gacagtagagagctgcttcc

SEQ ID NO: 239697 - DNA, 20 bp, Artificial
  CRISPR gRNA sequence
agtagagagctgcttccaag

SEQ ID NO: 239698 - DNA, 20 bp, Artificial
  CRISPR gRNA sequence
tgcttccaagaagcaatttg

SEQ ID NO: 239699 - DNA, 20 bp, Artificial
  CRISPR gRNA sequence
gcaatttgaagtgccattat

SEQ ID NO: 239700 - DNA, 20 bp, Artificial
  CRISPR gRNA sequence
caatttgaagtgccattatc

SEQ ID NO: 239701 - DNA, 20 bp, Artificial
  CRISPR gRNA sequence
tttgaagtgccattatcagg

SEQ ID NO: 239702 - DNA, 20 bp, Artificial
  CRISPR gRNA sequence
ttgaagtgccattatcaggc

SEQ ID NO: 239703 - DNA, 20 bp, Artificial
  CRISPR gRNA sequence
tgaagtgccattatcaggca

SEQ ID NO: 239704 - DNA, 20 bp, Artificial
  CRISPR gRNA sequence
gtgccattatcaggcaggga

SEQ ID NO: 239705 - DNA, 20 bp, Artificial
  CRISPR gRNA sequence
tgccattatcaggcagggac

SEQ ID NO: 239706 - DNA, 20 bp, Artificial
  CRISPR gRNA sequence
gccattatcaggcagggacg

SEQ ID NO: 239707 - DNA, 20 bp, Artificial
  CRISPR gRNA sequence
ccattatcaggcagggacgg

SEQ ID NO: 239708 - DNA, 20 bp, Artificial
  CRISPR gRNA sequence
tcaggcagggacgggggctc

SEQ ID NO: 239709 - DNA, 20 bp, Artificial
  CRISPR gRNA sequence
caggcagggacgggggctct

SEQ ID NO: 239710 - DNA, 20 bp, Artificial
  CRISPR gRNA sequence
aggcagggacgggggctcta

SEQ ID NO: 239711 - DNA, 20 bp, Artificial
  CRISPR gRNA sequence
ggcagggacgggggctctag

SEQ ID NO: 239712 - DNA, 20 bp, Artificial
  CRISPR gRNA sequence
acgggggctctaggggattt

SEQ ID NO: 239713 - DNA, 20 bp, Artificial
  CRISPR gRNA sequence
cgggggctctaggggatttc

SEQ ID NO: 239714 - DNA, 20 bp, Artificial
  CRISPR gRNA sequence
gggggctctaggggatttcg

SEQ ID NO: 239715 - DNA, 20 bp, Artificial
  CRISPR gRNA sequence
gctctaggggatttcggggt

SEQ ID NO: 239716 - DNA, 20 bp, Artificial
  CRISPR gRNA sequence
ctaggggatttcggggtcag

SEQ ID NO: 239717 - DNA, 20 bp, Artificial
  CRISPR gRNA sequence
atatgaaatgaatgatttca

SEQ ID NO: 239718 - DNA, 20 bp, Artificial
  CRISPR gRNA sequence
tatgaaatgaatgatttcat

SEQ ID NO: 239719 - DNA, 20 bp, Artificial
  CRISPR gRNA sequence
atgaaatgaatgatttcata

SEQ ID NO: 239720 - DNA, 20 bp, Artificial
  CRISPR gRNA sequence
atgatttcatagggctgtca

SEQ ID NO: 239721 - DNA, 20 bp, Artificial
  CRISPR gRNA sequence
gatttcatagggctgtcaca

SEQ ID NO: 239722 - DNA, 20 bp, Artificial
  CRISPR gRNA sequence
atagggctgtcacagagctg

SEQ ID NO: 239723 - DNA, 20 bp, Artificial
  CRISPR gRNA sequence
gggctgtcacagagctgtgg

SEQ ID NO: 239724 - DNA, 20 bp, Artificial
  CRISPR gRNA sequence
ggctgtcacagagctgtggt

SEQ ID NO: 239725 - DNA, 20 bp, Artificial
  CRISPR gRNA sequence
ctgtggtgggaatttcccat

SEQ ID NO: 239726 - DNA, 20 bp, Artificial
  CRISPR gRNA sequence
ttcccatgagaccccgcccc

SEQ ID NO: 239727 - DNA, 20 bp, Artificial
  CRISPR gRNA sequence
atgagaccccgcccctggct

SEQ ID NO: 239728 - DNA, 20 bp, Artificial
  CRISPR gRNA sequence
gcactcctgtgtttgacctg

SEQ ID NO: 239729 - DNA, 20 bp, Artificial
  CRISPR gRNA sequence
gtttgacctgaagtcctctc

SEQ ID NO: 239730 - DNA, 20 bp, Artificial
  CRISPR gRNA sequence
cctgaagtcctctcgagctg

SEQ ID NO: 239731 - DNA, 20 bp, Artificial
  CRISPR gRNA sequence
gaagtcctctcgagctgcag

SEQ ID NO: 239732 - DNA, 20 bp, Artificial
  CRISPR gRNA sequence
tctcgagctgcagaagcctg

SEQ ID NO: 239733 - DNA, 20 bp, Artificial
  CRISPR gRNA sequence
gctgcagaagcctgaagacc

SEQ ID NO: 239734 - DNA, 20 bp, Artificial
  CRISPR gRNA sequence
ctgcagaagcctgaagacca

SEQ ID NO: 239735 - DNA, 20 bp, Artificial
  CRISPR gRNA sequence
gcagaagcctgaagaccaag

SEQ ID NO: 239736 - DNA, 20 bp, Artificial
  CRISPR gRNA sequence
gaagcctgaagaccaaggag

SEQ ID NO: 239737 - DNA, 20 bp, Artificial
  CRISPR gRNA sequence
cctgaagaccaaggagtgga

SEQ ID NO: 239738 - DNA, 20 bp, Artificial
  CRISPR gRNA sequence
ccaaggagtggaaagttctc

SEQ ID NO: 239739 - DNA, 20 bp, Artificial
  CRISPR gRNA sequence
aggagtggaaagttctccgg

SEQ ID NO: 239740 - DNA, 20 bp, Artificial
  CRISPR gRNA sequence
gaaagttctccggcagccct

SEQ ID NO: 239741 - DNA, 20 bp, Artificial
  CRISPR gRNA sequence
tccggcagccctgagatctc

SEQ ID NO: 239742 - DNA, 20 bp, Artificial
  CRISPR gRNA sequence
ccggcagccctgagatctca

SEQ ID NO: 239743 - DNA, 20 bp, Artificial
  CRISPR gRNA sequence
gatctcaaggtctgtccatc

SEQ ID NO: 239744 - DNA, 20 bp, Artificial
  CRISPR gRNA sequence
atctcaaggtctgtccatct

SEQ ID NO: 239745 - DNA, 20 bp, Artificial
  CRISPR gRNA sequence
tctcaaggtctgtccatctg

SEQ ID NO: 239746 - DNA, 20 bp, Artificial
  CRISPR gRNA sequence
ctcaaggtctgtccatctgg

SEQ ID NO: 239747 - DNA, 20 bp, Artificial
  CRISPR gRNA sequence
caaggtctgtccatctgggg

SEQ ID NO: 239748 - DNA, 20 bp, Artificial
  CRISPR gRNA sequence
ggtctgtccatctgggggag

SEQ ID NO: 239749 - DNA, 20 bp, Artificial
  CRISPR gRNA sequence
gtctgtccatctgggggagt

SEQ ID NO: 239750 - DNA, 20 bp, Artificial
  CRISPR gRNA sequence
tgtccatctgggggagtggg

SEQ ID NO: 239751 - DNA, 20 bp, Artificial
  CRISPR gRNA sequence
gtccatctgggggagtgggt

SEQ ID NO: 239752 - DNA, 20 bp, Artificial
  CRISPR gRNA sequence
tccatctgggggagtgggtg

SEQ ID NO: 239753 - DNA, 20 bp, Artificial
  CRISPR gRNA sequence
ccatctgggggagtgggtgg

SEQ ID NO: 239754 - DNA, 20 bp, Artificial
  CRISPR gRNA sequence
ggggagtgggtgggggcact

SEQ ID NO: 239755 - DNA, 20 bp, Artificial
  CRISPR gRNA sequence
gagtgggtgggggcactgag

SEQ ID NO: 239756 - DNA, 20 bp, Artificial
  CRISPR gRNA sequence
agtgggtgggggcactgaga

SEQ ID NO: 239757 - DNA, 20 bp, Artificial
  CRISPR gRNA sequence
gtgggtgggggcactgagaa

SEQ ID NO: 239758 - DNA, 20 bp, Artificial
  CRISPR gRNA sequence
tgggtgggggcactgagaag

SEQ ID NO: 239759 - DNA, 20 bp, Artificial
  CRISPR gRNA sequence
tgggggcactgagaaggggt

SEQ ID NO: 239760 - DNA, 20 bp, Artificial
  CRISPR gRNA sequence
gcactgagaaggggtgagat

SEQ ID NO: 239761 - DNA, 20 bp, Artificial
  CRISPR gRNA sequence
ttgctccctttgcccatttc

SEQ ID NO: 239762 - DNA, 20 bp, Artificial
  CRISPR gRNA sequence
atgtaataacttctcttcaa

SEQ ID NO: 239763 - DNA, 20 bp, Artificial
  CRISPR gRNA sequence
ttaaataaacatcaataact

SEQ ID NO: 239764 - DNA, 20 bp, Artificial
  CRISPR gRNA sequence
aacatcaataacttagcctg

SEQ ID NO: 239765 - DNA, 20 bp, Artificial
  CRISPR gRNA sequence
catcaataacttagcctgaa

SEQ ID NO: 239766 - DNA, 20 bp, Artificial
  CRISPR gRNA sequence
ctgaagagtttttcactcct

SEQ ID NO: 239767 - DNA, 20 bp, Artificial
  CRISPR gRNA sequence
ctcaaaacatgtctctgttt

SEQ ID NO: 239768 - DNA, 20 bp, Artificial
  CRISPR gRNA sequence
ctctgtttaagaaaatgtgt

SEQ ID NO: 239769 - DNA, 20 bp, Artificial
  CRISPR gRNA sequence
gtttaagaaaatgtgttagt

SEQ ID NO: 239770 - DNA, 20 bp, Artificial
  CRISPR gRNA sequence
aaatgtgttagtgagttgaa

SEQ ID NO: 239771 - DNA, 20 bp, Artificial
  CRISPR gRNA sequence
aatgtgttagtgagttgaac

SEQ ID NO: 239772 - DNA, 20 bp, Artificial
  CRISPR gRNA sequence
atgtgttagtgagttgaaca

SEQ ID NO: 239773 - DNA, 20 bp, Artificial
  CRISPR gRNA sequence
gtgttagtgagttgaacagg

SEQ ID NO: 239774 - DNA, 20 bp, Artificial
  CRISPR gRNA sequence
tgttagtgagttgaacaggg

SEQ ID NO: 239775 - DNA, 20 bp, Artificial
  CRISPR gRNA sequence
agggaggtctttccacatgt

SEQ ID NO: 239776 - DNA, 20 bp, Artificial
  CRISPR gRNA sequence
gaggtctttccacatgttag

SEQ ID NO: 239777 - DNA, 20 bp, Artificial
  CRISPR gRNA sequence
tctttccacatgttagtagt

SEQ ID NO: 239778 - DNA, 20 bp, Artificial
  CRISPR gRNA sequence
ctttccacatgttagtagtt

SEQ ID NO: 239779 - DNA, 20 bp, Artificial
  CRISPR gRNA sequence
catgttagtagttaggtgtt

SEQ ID NO: 239780 - DNA, 20 bp, Artificial
  CRISPR gRNA sequence
agtagttaggtgttcagcta

SEQ ID NO: 239781 - DNA, 20 bp, Artificial
  CRISPR gRNA sequence
gtagttaggtgttcagctaa

SEQ ID NO: 239782 - DNA, 20 bp, Artificial
  CRISPR gRNA sequence
tagttaggtgttcagctaaa

SEQ ID NO: 239783 - DNA, 20 bp, Artificial
  CRISPR gRNA sequence
agttaggtgttcagctaaag

SEQ ID NO: 239784 - DNA, 20 bp, Artificial
  CRISPR gRNA sequence
gttaggtgttcagctaaagg

SEQ ID NO: 239785 - DNA, 20 bp, Artificial
  CRISPR gRNA sequence
aggtgttcagctaaaggggg

SEQ ID NO: 239786 - DNA, 20 bp, Artificial
  CRISPR gRNA sequence
gtgttcagctaaagggggaa

SEQ ID NO: 239787 - DNA, 20 bp, Artificial
  CRISPR gRNA sequence
ggggaagagtgattatgtga

SEQ ID NO: 239788 - DNA, 20 bp, Artificial
  CRISPR gRNA sequence
gaattgtctgatgcccctga

SEQ ID NO: 239789 - DNA, 20 bp, Artificial
  CRISPR gRNA sequence
ccctgacagattctctttgt

SEQ ID NO: 239790 - DNA, 20 bp, Artificial
  CRISPR gRNA sequence
cctgacagattctctttgta

SEQ ID NO: 239791 - DNA, 20 bp, Artificial
  CRISPR gRNA sequence
tgacagattctctttgtaag

SEQ ID NO: 239792 - DNA, 20 bp, Artificial
  CRISPR gRNA sequence
tctttgtaaggagtttattt

SEQ ID NO: 239793 - DNA, 20 bp, Artificial
  CRISPR gRNA sequence
ctttgtaaggagtttatttc

SEQ ID NO: 239794 - DNA, 20 bp, Artificial
  CRISPR gRNA sequence
tttgtaaggagtttatttca

SEQ ID NO: 239795 - DNA, 20 bp, Artificial
  CRISPR gRNA sequence
ttgtaaggagtttatttcag

SEQ ID NO: 239796 - DNA, 20 bp, Artificial
  CRISPR gRNA sequence
gagtttatttcaggggcaat

SEQ ID NO: 239797 - DNA, 20 bp, Artificial
  CRISPR gRNA sequence
tttcaggggcaataagtaat

SEQ ID NO: 239798 - DNA, 20 bp, Artificial
  CRISPR gRNA sequence
taagtaattggcattattgc

SEQ ID NO: 239799 - DNA, 20 bp, Artificial
  CRISPR gRNA sequence
taattggcattattgctggt

SEQ ID NO: 239800 - DNA, 20 bp, Artificial
  CRISPR gRNA sequence
tattgctggttggtactgca

SEQ ID NO: 239801 - DNA, 20 bp, Artificial
  CRISPR gRNA sequence
gtactgcaaagtacctatga

SEQ ID NO: 239802 - DNA, 20 bp, Artificial
  CRISPR gRNA sequence
gtacctatgaaagtccccaa

SEQ ID NO: 239803 - DNA, 20 bp, Artificial
  CRISPR gRNA sequence
ctattgttatttctgcattt

SEQ ID NO: 239804 - DNA, 20 bp, Artificial
  CRISPR gRNA sequence
ttgttatttctgcattttgg

SEQ ID NO: 239805 - DNA, 20 bp, Artificial
  CRISPR gRNA sequence
tgcattttggcagaacatga

SEQ ID NO: 239806 - DNA, 20 bp, Artificial
  CRISPR gRNA sequence
gaaaatgcaccctcaaactt

SEQ ID NO: 239807 - DNA, 20 bp, Artificial
  CRISPR gRNA sequence
accctcaaactttggcaaac

SEQ ID NO: 239808 - DNA, 20 bp, Artificial
  CRISPR gRNA sequence
aactttggcaaaccggcaca

SEQ ID NO: 239809 - DNA, 20 bp, Artificial
  CRISPR gRNA sequence
taatcacgcctgccttgtcc

SEQ ID NO: 239810 - DNA, 20 bp, Artificial
  CRISPR gRNA sequence
tcacgcctgccttgtcctag

SEQ ID NO: 239811 - DNA, 20 bp, Artificial
  CRISPR gRNA sequence
aattgttcctgaaaaaccct

SEQ ID NO: 239812 - DNA, 20 bp, Artificial
  CRISPR gRNA sequence
aaccctgagttatcctctta

SEQ ID NO: 239813 - DNA, 20 bp, Artificial
  CRISPR gRNA sequence
atcctcttatagaattgtat

SEQ ID NO: 239814 - DNA, 20 bp, Artificial
  CRISPR gRNA sequence
tataagtaatgattgcaata

SEQ ID NO: 239815 - DNA, 20 bp, Artificial
  CRISPR gRNA sequence
tgcaatatagataattttga

SEQ ID NO: 239816 - DNA, 20 bp, Artificial
  CRISPR gRNA sequence
gcaatatagataattttgaa

SEQ ID NO: 239817 - DNA, 20 bp, Artificial
  CRISPR gRNA sequence
aatatagataattttgaaag

SEQ ID NO: 239818 - DNA, 20 bp, Artificial
  CRISPR gRNA sequence
aaggagaaaccacctttcct

SEQ ID NO: 239819 - DNA, 20 bp, Artificial
  CRISPR gRNA sequence
ttggaaatgtttatcttttg

SEQ ID NO: 239820 - DNA, 20 bp, Artificial
  CRISPR gRNA sequence
ggaaatgtttatcttttgca

SEQ ID NO: 239821 - DNA, 20 bp, Artificial
  CRISPR gRNA sequence
ttttgcagagtgacatttgt

SEQ ID NO: 239822 - DNA, 20 bp, Artificial
  CRISPR gRNA sequence
cagagtgacatttgtgagac

SEQ ID NO: 239823 - DNA, 20 bp, Artificial
  CRISPR gRNA sequence
taatttgattaaaattctct

SEQ ID NO: 239824 - DNA, 20 bp, Artificial
  CRISPR gRNA sequence
gattaaaattctcttggaat

SEQ ID NO: 239825 - DNA, 20 bp, Artificial
  CRISPR gRNA sequence
tctcttggaatcagctttgc

SEQ ID NO: 239826 - DNA, 20 bp, Artificial
  CRISPR gRNA sequence
tgctagtatcatacctgtgc

SEQ ID NO: 239827 - DNA, 20 bp, Artificial
  CRISPR gRNA sequence
acctgtgccagatttcatca

SEQ ID NO: 239828 - DNA, 20 bp, Artificial
  CRISPR gRNA sequence
cctgtgccagatttcatcat

SEQ ID NO: 239829 - DNA, 20 bp, Artificial
  CRISPR gRNA sequence
ccagatttcatcatgggaaa

SEQ ID NO: 239830 - DNA, 20 bp, Artificial
  CRISPR gRNA sequence
gggaaacagctgttacaaca

SEQ ID NO: 239831 - DNA, 20 bp, Artificial
  CRISPR gRNA sequence
aaacagctgttacaacatag

SEQ ID NO: 239832 - DNA, 20 bp, Artificial
  CRISPR gRNA sequence
catagtagccactctgttgc

SEQ ID NO: 239833 - DNA, 20 bp, Artificial
  CRISPR gRNA sequence
tgttgctggtcctcaacttt

SEQ ID NO: 239834 - DNA, 20 bp, Artificial
  CRISPR gRNA sequence
ttgctggtcctcaactttga

SEQ ID NO: 239835 - DNA, 20 bp, Artificial
  CRISPR gRNA sequence
tgctggtcctcaactttgag

SEQ ID NO: 239836 - DNA, 20 bp, Artificial
  CRISPR gRNA sequence
gtcctcaactttgagaggac

SEQ ID NO: 239837 - DNA, 20 bp, Artificial
  CRISPR gRNA sequence
ttgagaggacaagatcattg

SEQ ID NO: 239838 - DNA, 20 bp, Artificial
  CRISPR gRNA sequence
tgagaggacaagatcattgc

SEQ ID NO: 239839 - DNA, 20 bp, Artificial
  CRISPR gRNA sequence
agatcattgcaggatccttg

SEQ ID NO: 239840 - DNA, 20 bp, Artificial
  CRISPR gRNA sequence
ggatccttgtagtaactgcc

SEQ ID NO: 239841 - DNA, 20 bp, Artificial
  CRISPR gRNA sequence
ccttgtagtaactgcccagc

SEQ ID NO: 239842 - DNA, 20 bp, Artificial
  CRISPR gRNA sequence
gtagtaactgcccagctggt

SEQ ID NO: 239843 - DNA, 20 bp, Artificial
  CRISPR gRNA sequence
ctgcccagctggtgagtacc

SEQ ID NO: 239844 - DNA, 20 bp, Artificial
  CRISPR gRNA sequence
gtgcatttgatctgctctgt

SEQ ID NO: 239845 - DNA, 20 bp, Artificial
  CRISPR gRNA sequence
catttgatctgctctgttgg

SEQ ID NO: 239846 - DNA, 20 bp, Artificial
  CRISPR gRNA sequence
gatctgctctgttggaagta

SEQ ID NO: 239847 - DNA, 20 bp, Artificial
  CRISPR gRNA sequence
gctctgttggaagtatggtt

SEQ ID NO: 239848 - DNA, 20 bp, Artificial
  CRISPR gRNA sequence
tgttggaagtatggttcagt

SEQ ID NO: 239849 - DNA, 20 bp, Artificial
  CRISPR gRNA sequence
gaagtatggttcagttagtc

SEQ ID NO: 239850 - DNA, 20 bp, Artificial
  CRISPR gRNA sequence
gtatggttcagttagtctag

SEQ ID NO: 239851 - DNA, 20 bp, Artificial
  CRISPR gRNA sequence
ggttcagttagtctagtagt

SEQ ID NO: 239852 - DNA, 20 bp, Artificial
  CRISPR gRNA sequence
gttcagttagtctagtagtc

SEQ ID NO: 239853 - DNA, 20 bp, Artificial
  CRISPR gRNA sequence
ttcagttagtctagtagtca

SEQ ID NO: 239854 - DNA, 20 bp, Artificial
  CRISPR gRNA sequence
gtctagtagtcagggctaac

SEQ ID NO: 239855 - DNA, 20 bp, Artificial
  CRISPR gRNA sequence
gggctaacgagctccctttt

SEQ ID NO: 239856 - DNA, 20 bp, Artificial
  CRISPR gRNA sequence
ggctaacgagctccctttta

SEQ ID NO: 239857 - DNA, 20 bp, Artificial
  CRISPR gRNA sequence
aacgagctcccttttaagga

SEQ ID NO: 239858 - DNA, 20 bp, Artificial
  CRISPR gRNA sequence
acgagctcccttttaaggaa

SEQ ID NO: 239859 - DNA, 20 bp, Artificial
  CRISPR gRNA sequence
attcatttacaaatgtttat

SEQ ID NO: 239860 - DNA, 20 bp, Artificial
  CRISPR gRNA sequence
gtttattggatgctacaacc

SEQ ID NO: 239861 - DNA, 20 bp, Artificial
  CRISPR gRNA sequence
acaacctagctgtgtgaaca

SEQ ID NO: 239862 - DNA, 20 bp, Artificial
  CRISPR gRNA sequence
ctagctgtgtgaacacagca

SEQ ID NO: 239863 - DNA, 20 bp, Artificial
  CRISPR gRNA sequence
tgtgccttgactttctcatc

SEQ ID NO: 239864 - DNA, 20 bp, Artificial
  CRISPR gRNA sequence
gtgccttgactttctcatct

SEQ ID NO: 239865 - DNA, 20 bp, Artificial
  CRISPR gRNA sequence
tgccttgactttctcatctg

SEQ ID NO: 239866 - DNA, 20 bp, Artificial
  CRISPR gRNA sequence
ctttctcatctggggataat

SEQ ID NO: 239867 - DNA, 20 bp, Artificial
  CRISPR gRNA sequence
ttctcatctggggataataa

SEQ ID NO: 239868 - DNA, 20 bp, Artificial
  CRISPR gRNA sequence
taataagagaacctgtttta

SEQ ID NO: 239869 - DNA, 20 bp, Artificial
  CRISPR gRNA sequence
aataagagaacctgttttat

SEQ ID NO: 239870 - DNA, 20 bp, Artificial
  CRISPR gRNA sequence
agagaacctgttttatagga

SEQ ID NO: 239871 - DNA, 20 bp, Artificial
  CRISPR gRNA sequence
aacctgttttataggatggc

SEQ ID NO: 239872 - DNA, 20 bp, Artificial
  CRISPR gRNA sequence
acctgttttataggatggct

SEQ ID NO: 239873 - DNA, 20 bp, Artificial
  CRISPR gRNA sequence
ctgttttataggatggctgg

SEQ ID NO: 239874 - DNA, 20 bp, Artificial
  CRISPR gRNA sequence
tgttttataggatggctggg

SEQ ID NO: 239875 - DNA, 20 bp, Artificial
  CRISPR gRNA sequence
atggctgggaggatcaaatg

SEQ ID NO: 239876 - DNA, 20 bp, Artificial
  CRISPR gRNA sequence
tggctgggaggatcaaatga

SEQ ID NO: 239877 - DNA, 20 bp, Artificial
  CRISPR gRNA sequence
ggctgggaggatcaaatgaa

SEQ ID NO: 239878 - DNA, 20 bp, Artificial
  CRISPR gRNA sequence
ggaggatcaaatgaagggct

SEQ ID NO: 239879 - DNA, 20 bp, Artificial
  CRISPR gRNA sequence
atcaaatgaagggcttagaa

SEQ ID NO: 239880 - DNA, 20 bp, Artificial
  CRISPR gRNA sequence
gaagggcttagaacagtgca

SEQ ID NO: 239881 - DNA, 20 bp, Artificial
  CRISPR gRNA sequence
cttagaacagtgcatggcac

SEQ ID NO: 239882 - DNA, 20 bp, Artificial
  CRISPR gRNA sequence
ttagaacagtgcatggcaca

SEQ ID NO: 239883 - DNA, 20 bp, Artificial
  CRISPR gRNA sequence
aacagtgcatggcacaaggc

SEQ ID NO: 239884 - DNA, 20 bp, Artificial
  CRISPR gRNA sequence
ggcaagacttcaataaatgt

SEQ ID NO: 239885 - DNA, 20 bp, Artificial
  CRISPR gRNA sequence
ataaatgttagttttgtgtg

SEQ ID NO: 239886 - DNA, 20 bp, Artificial
  CRISPR gRNA sequence
taaatgttagttttgtgtgt

SEQ ID NO: 239887 - DNA, 20 bp, Artificial
  CRISPR gRNA sequence
aaatgttagttttgtgtgta

SEQ ID NO: 239888 - DNA, 20 bp, Artificial
  CRISPR gRNA sequence
gtagggctttgtgctccgac

SEQ ID NO: 239889 - DNA, 20 bp, Artificial
  CRISPR gRNA sequence
tagggctttgtgctccgact

SEQ ID NO: 239890 - DNA, 20 bp, Artificial
  CRISPR gRNA sequence
agggctttgtgctccgactg

SEQ ID NO: 239891 - DNA, 20 bp, Artificial
  CRISPR gRNA sequence
gggctttgtgctccgactgg

SEQ ID NO: 239892 - DNA, 20 bp, Artificial
  CRISPR gRNA sequence
ttgtgctccgactgggggca

SEQ ID NO: 239893 - DNA, 20 bp, Artificial
  CRISPR gRNA sequence
tgctccgactgggggcatag

SEQ ID NO: 239894 - DNA, 20 bp, Artificial
  CRISPR gRNA sequence
ccgactgggggcatagcagc

SEQ ID NO: 239895 - DNA, 20 bp, Artificial
  CRISPR gRNA sequence
ctgggggcatagcagcgagt

SEQ ID NO: 239896 - DNA, 20 bp, Artificial
  CRISPR gRNA sequence
catagcagcgagtaagcgcg

SEQ ID NO: 239897 - DNA, 20 bp, Artificial
  CRISPR gRNA sequence
cagcgagtaagcgcgtagta

SEQ ID NO: 239898 - DNA, 20 bp, Artificial
  CRISPR gRNA sequence
agcgagtaagcgcgtagtaa

SEQ ID NO: 239899 - DNA, 20 bp, Artificial
  CRISPR gRNA sequence
gcgagtaagcgcgtagtaaa

SEQ ID NO: 239900 - DNA, 20 bp, Artificial
  CRISPR gRNA sequence
gcgcgtagtaaagggcttaa

SEQ ID NO: 239901 - DNA, 20 bp, Artificial
  CRISPR gRNA sequence
gcgtagtaaagggcttaaca

SEQ ID NO: 239902 - DNA, 20 bp, Artificial
  CRISPR gRNA sequence
tagtaaagggcttaacagag

SEQ ID NO: 239903 - DNA, 20 bp, Artificial
  CRISPR gRNA sequence
agtaaagggcttaacagagt

SEQ ID NO: 239904 - DNA, 20 bp, Artificial
  CRISPR gRNA sequence
gtaaagggcttaacagagtg

SEQ ID NO: 239905 - DNA, 20 bp, Artificial
  CRISPR gRNA sequence
agggcttaacagagtgggga

SEQ ID NO: 239906 - DNA, 20 bp, Artificial
  CRISPR gRNA sequence
cttaacagagtggggacggt

SEQ ID NO: 239907 - DNA, 20 bp, Artificial
  CRISPR gRNA sequence
ggtcagtcgcatttaaattt

SEQ ID NO: 239908 - DNA, 20 bp, Artificial
  CRISPR gRNA sequence
gtcgcatttaaattttagtg

SEQ ID NO: 239909 - DNA, 20 bp, Artificial
  CRISPR gRNA sequence
tcgcatttaaattttagtgt

SEQ ID NO: 239910 - DNA, 20 bp, Artificial
  CRISPR gRNA sequence
gtaggacattgatgtcctcc

SEQ ID NO: 239911 - DNA, 20 bp, Artificial
  CRISPR gRNA sequence
cattgatgtcctcctggatc

SEQ ID NO: 239912 - DNA, 20 bp, Artificial
  CRISPR gRNA sequence
attcatctcctacatcaatc

SEQ ID NO: 239913 - DNA, 20 bp, Artificial
  CRISPR gRNA sequence
aatcattttgttttattcaa

SEQ ID NO: 239914 - DNA, 20 bp, Artificial
  CRISPR gRNA sequence
tttgttttattcaatagata

SEQ ID NO: 239915 - DNA, 20 bp, Artificial
  CRISPR gRNA sequence
gatttatttgttacaatatc

SEQ ID NO: 239916 - DNA, 20 bp, Artificial
  CRISPR gRNA sequence
atgttttttttttttttttt

SEQ ID NO: 239917 - DNA, 20 bp, Artificial
  CRISPR gRNA sequence
ttttttttttttttgagaca

SEQ ID NO: 239918 - DNA, 20 bp, Artificial
  CRISPR gRNA sequence
cacagtctcactctgtcgcc

SEQ ID NO: 239919 - DNA, 20 bp, Artificial
  CRISPR gRNA sequence
acagtctcactctgtcgccc

SEQ ID NO: 239920 - DNA, 20 bp, Artificial
  CRISPR gRNA sequence
tctcactctgtcgcccaggc

SEQ ID NO: 239921 - DNA, 20 bp, Artificial
  CRISPR gRNA sequence
tcactctgtcgcccaggctg

SEQ ID NO: 239922 - DNA, 20 bp, Artificial
  CRISPR gRNA sequence
ctgtcgcccaggctggagtg

SEQ ID NO: 239923 - DNA, 20 bp, Artificial
  CRISPR gRNA sequence
tcgcccaggctggagtgcag

SEQ ID NO: 239924 - DNA, 20 bp, Artificial
  CRISPR gRNA sequence
ggagtgcagtggcacgatct

SEQ ID NO: 239925 - DNA, 20 bp, Artificial
  CRISPR gRNA sequence
atctcagctcactgcaacct

SEQ ID NO: 239926 - DNA, 20 bp, Artificial
  CRISPR gRNA sequence
tcactgcaaccttggcctcc

SEQ ID NO: 239927 - DNA, 20 bp, Artificial
  CRISPR gRNA sequence
cactgcaaccttggcctccc

SEQ ID NO: 239928 - DNA, 20 bp, Artificial
  CRISPR gRNA sequence
aaccttggcctcccaggttc

SEQ ID NO: 239929 - DNA, 20 bp, Artificial
  CRISPR gRNA sequence
ttcaagcaattctcctgcct

SEQ ID NO: 239930 - DNA, 20 bp, Artificial
  CRISPR gRNA sequence
ttctcctgcctcagcctccc

SEQ ID NO: 239931 - DNA, 20 bp, Artificial
  CRISPR gRNA sequence
tcctgcctcagcctcccgag

SEQ ID NO: 239932 - DNA, 20 bp, Artificial
  CRISPR gRNA sequence
gcctcagcctcccgagtagc

SEQ ID NO: 239933 - DNA, 20 bp, Artificial
  CRISPR gRNA sequence
cctcagcctcccgagtagct

SEQ ID NO: 239934 - DNA, 20 bp, Artificial
  CRISPR gRNA sequence
ctcccgagtagctgggatta

SEQ ID NO: 239935 - DNA, 20 bp, Artificial
  CRISPR gRNA sequence
tcccgagtagctgggattac

SEQ ID NO: 239936 - DNA, 20 bp, Artificial
  CRISPR gRNA sequence
caggtgtgcaccactgcgcc

SEQ ID NO: 239937 - DNA, 20 bp, Artificial
  CRISPR gRNA sequence
ctggctaatttttgtatttt

SEQ ID NO: 239938 - DNA, 20 bp, Artificial
  CRISPR gRNA sequence
gctaatttttgtatttttag

SEQ ID NO: 239939 - DNA, 20 bp, Artificial
  CRISPR gRNA sequence
taatttttgtatttttagta

SEQ ID NO: 239940 - DNA, 20 bp, Artificial
  CRISPR gRNA sequence
ttttgtatttttagtagaga

SEQ ID NO: 239941 - DNA, 20 bp, Artificial
  CRISPR gRNA sequence
tttgtatttttagtagagac

SEQ ID NO: 239942 - DNA, 20 bp, Artificial
  CRISPR gRNA sequence
gagacaggatttcaccatgt

SEQ ID NO: 239943 - DNA, 20 bp, Artificial
  CRISPR gRNA sequence
aggatttcaccatgttggcc

SEQ ID NO: 239944 - DNA, 20 bp, Artificial
  CRISPR gRNA sequence
tttcaccatgttggccaagc

SEQ ID NO: 239945 - DNA, 20 bp, Artificial
  CRISPR gRNA sequence
tggtcttgaactgctgacct

SEQ ID NO: 239946 - DNA, 20 bp, Artificial
  CRISPR gRNA sequence
ggtcttgaactgctgacctc

SEQ ID NO: 239947 - DNA, 20 bp, Artificial
  CRISPR gRNA sequence
ctcaggtgatctgcccgctt

SEQ ID NO: 239948 - DNA, 20 bp, Artificial
  CRISPR gRNA sequence
ctgcccgcttcggcctccca

SEQ ID NO: 239949 - DNA, 20 bp, Artificial
  CRISPR gRNA sequence
ctcccaaagtgctgtgatta

SEQ ID NO: 239950 - DNA, 20 bp, Artificial
  CRISPR gRNA sequence
tcccaaagtgctgtgattac

SEQ ID NO: 239951 - DNA, 20 bp, Artificial
  CRISPR gRNA sequence
agtgctgtgattacaggcgt

SEQ ID NO: 239952 - DNA, 20 bp, Artificial
  CRISPR gRNA sequence
caggcgtgagccactgcacc

SEQ ID NO: 239953 - DNA, 20 bp, Artificial
  CRISPR gRNA sequence
tctaattctgtgattacaca

SEQ ID NO: 239954 - DNA, 20 bp, Artificial
  CRISPR gRNA sequence
atcttgcaaatgtattgttt

SEQ ID NO: 239955 - DNA, 20 bp, Artificial
  CRISPR gRNA sequence
tcttgcaaatgtattgtttt

SEQ ID NO: 239956 - DNA, 20 bp, Artificial
  CRISPR gRNA sequence
tgcaaatgtattgttttagg

SEQ ID NO: 239957 - DNA, 20 bp, Artificial
  CRISPR gRNA sequence
caaactaatgtccaccactg

SEQ ID NO: 239958 - DNA, 20 bp, Artificial
  CRISPR gRNA sequence
atgtccaccactgtggcatc

SEQ ID NO: 239959 - DNA, 20 bp, Artificial
  CRISPR gRNA sequence
tcttattttattgtaaactt

SEQ ID NO: 239960 - DNA, 20 bp, Artificial
  CRISPR gRNA sequence
ttgtaaacttcggaatgcct

SEQ ID NO: 239961 - DNA, 20 bp, Artificial
  CRISPR gRNA sequence
tgtaaacttcggaatgcctt

SEQ ID NO: 239962 - DNA, 20 bp, Artificial
  CRISPR gRNA sequence
ccactattgtctgcctttct

SEQ ID NO: 239963 - DNA, 20 bp, Artificial
  CRISPR gRNA sequence
cactattgtctgcctttctt

SEQ ID NO: 239964 - DNA, 20 bp, Artificial
  CRISPR gRNA sequence
ggtacattctgtgataataa

SEQ ID NO: 239965 - DNA, 20 bp, Artificial
  CRISPR gRNA sequence
gtacattctgtgataataac

SEQ ID NO: 239966 - DNA, 20 bp, Artificial
  CRISPR gRNA sequence
tctgtgataataacaggaat

SEQ ID NO: 239967 - DNA, 20 bp, Artificial
  CRISPR gRNA sequence
aataacaggaatcagatttg

SEQ ID NO: 239968 - DNA, 20 bp, Artificial
  CRISPR gRNA sequence
tgcagtccctgtcctccaaa

SEQ ID NO: 239969 - DNA, 20 bp, Artificial
  CRISPR gRNA sequence
tgtcctccaaatagtttctc

SEQ ID NO: 239970 - DNA, 20 bp, Artificial
  CRISPR gRNA sequence
tccaaatagtttctccagcg

SEQ ID NO: 239971 - DNA, 20 bp, Artificial
  CRISPR gRNA sequence
ccaaatagtttctccagcgc

SEQ ID NO: 239972 - DNA, 20 bp, Artificial
  CRISPR gRNA sequence
aatagtttctccagcgcagg

SEQ ID NO: 239973 - DNA, 20 bp, Artificial
  CRISPR gRNA sequence
ttctccagcgcaggtggaca

SEQ ID NO: 239974 - DNA, 20 bp, Artificial
  CRISPR gRNA sequence
tctccagcgcaggtggacaa

SEQ ID NO: 239975 - DNA, 20 bp, Artificial
  CRISPR gRNA sequence
caaaggacctgtgacatatg

SEQ ID NO: 239976 - DNA, 20 bp, Artificial
  CRISPR gRNA sequence
aaaggacctgtgacatatgc

SEQ ID NO: 239977 - DNA, 20 bp, Artificial
  CRISPR gRNA sequence
ggacctgtgacatatgcagg

SEQ ID NO: 239978 - DNA, 20 bp, Artificial
  CRISPR gRNA sequence
tgacatatgcaggcagtgta

SEQ ID NO: 239979 - DNA, 20 bp, Artificial
  CRISPR gRNA sequence
gacatatgcaggcagtgtaa

SEQ ID NO: 239980 - DNA, 20 bp, Artificial
  CRISPR gRNA sequence
tgcaggcagtgtaaaggtat

SEQ ID NO: 239981 - DNA, 20 bp, Artificial
  CRISPR gRNA sequence
agtgtaaaggtatgagttca

SEQ ID NO: 239982 - DNA, 20 bp, Artificial
  CRISPR gRNA sequence
tcaaagatattttcttcttc

SEQ ID NO: 239983 - DNA, 20 bp, Artificial
  CRISPR gRNA sequence
aagatattttcttcttctag

SEQ ID NO: 239984 - DNA, 20 bp, Artificial
  CRISPR gRNA sequence
tattttcttcttctagaaga

SEQ ID NO: 239985 - DNA, 20 bp, Artificial
  CRISPR gRNA sequence
ttcttcttctagaagatagt

SEQ ID NO: 239986 - DNA, 20 bp, Artificial
  CRISPR gRNA sequence
tcttcttctagaagatagtt

SEQ ID NO: 239987 - DNA, 20 bp, Artificial
  CRISPR gRNA sequence
tcttctagaagatagttggg

SEQ ID NO: 239988 - DNA, 20 bp, Artificial
  CRISPR gRNA sequence
tagaagatagttgggaagat

SEQ ID NO: 239989 - DNA, 20 bp, Artificial
  CRISPR gRNA sequence
tgctctcttttgaaaatctc

SEQ ID NO: 239990 - DNA, 20 bp, Artificial
  CRISPR gRNA sequence
tttgaaaatctcaagtgtca

SEQ ID NO: 239991 - DNA, 20 bp, Artificial
  CRISPR gRNA sequence
agactgattcttctgccaac

SEQ ID NO: 239992 - DNA, 20 bp, Artificial
  CRISPR gRNA sequence
ctgattcttctgccaaccag

SEQ ID NO: 239993 - DNA, 20 bp, Artificial
  CRISPR gRNA sequence
tgattcttctgccaaccagc

SEQ ID NO: 239994 - DNA, 20 bp, Artificial
  CRISPR gRNA sequence
cttctgccaaccagcaggtc

SEQ ID NO: 239995 - DNA, 20 bp, Artificial
  CRISPR gRNA sequence
ttctgccaaccagcaggtct

SEQ ID NO: 239996 - DNA, 20 bp, Artificial
  CRISPR gRNA sequence
aggtctaggacaataatatc

SEQ ID NO: 239997 - DNA, 20 bp, Artificial
  CRISPR gRNA sequence
aggacaataatatccagtga

SEQ ID NO: 239998 - DNA, 20 bp, Artificial
  CRISPR gRNA sequence
ccagtgacagcaattatttg

SEQ ID NO: 239999 - DNA, 20 bp, Artificial
  CRISPR gRNA sequence
acagcaattatttgtggact

SEQ ID NO: 240000 - DNA, 20 bp, Artificial
  CRISPR gRNA sequence
ggactgagctttctaaatat

SEQ ID NO: 240001 - DNA, 20 bp, Artificial
  CRISPR gRNA sequence
actgagctttctaaatatta

SEQ ID NO: 240002 - DNA, 20 bp, Artificial
  CRISPR gRNA sequence
ctgagctttctaaatattag

SEQ ID NO: 240003 - DNA, 20 bp, Artificial
  CRISPR gRNA sequence
agaggaaacattcatttgac

SEQ ID NO: 240004 - DNA, 20 bp, Artificial
  CRISPR gRNA sequence
aggaaacattcatttgacaa

SEQ ID NO: 240005 - DNA, 20 bp, Artificial
  CRISPR gRNA sequence
gaaacattcatttgacaaga

SEQ ID NO: 240006 - DNA, 20 bp, Artificial
  CRISPR gRNA sequence
acattcatttgacaagagag

SEQ ID NO: 240007 - DNA, 20 bp, Artificial
  CRISPR gRNA sequence
taaatgtaaaaatgtcttta

SEQ ID NO: 240008 - DNA, 20 bp, Artificial
  CRISPR gRNA sequence
aatgtaaaaatgtctttatg

SEQ ID NO: 240009 - DNA, 20 bp, Artificial
  CRISPR gRNA sequence
atgtctttatggagatttaa

SEQ ID NO: 240010 - DNA, 20 bp, Artificial
  CRISPR gRNA sequence
aaagtaaactttaaaattac

SEQ ID NO: 240011 - DNA, 20 bp, Artificial
  CRISPR gRNA sequence
aagtaaactttaaaattact

SEQ ID NO: 240012 - DNA, 20 bp, Artificial
  CRISPR gRNA sequence
aaaattactgggaacactat

SEQ ID NO: 240013 - DNA, 20 bp, Artificial
  CRISPR gRNA sequence
attactgggaacactataag

SEQ ID NO: 240014 - DNA, 20 bp, Artificial
  CRISPR gRNA sequence
tactgggaacactataagta

SEQ ID NO: 240015 - DNA, 20 bp, Artificial
  CRISPR gRNA sequence
gggaacactataagtagagt

SEQ ID NO: 240016 - DNA, 20 bp, Artificial
  CRISPR gRNA sequence
agtgagcatgatttttactg

SEQ ID NO: 240017 - DNA, 20 bp, Artificial
  CRISPR gRNA sequence
tgagcatgatttttactgca

SEQ ID NO: 240018 - DNA, 20 bp, Artificial
  CRISPR gRNA sequence
cagagcataaattcgcttcc

SEQ ID NO: 240019 - DNA, 20 bp, Artificial
  CRISPR gRNA sequence
ataaattcgcttcctggatt

SEQ ID NO: 240020 - DNA, 20 bp, Artificial
  CRISPR gRNA sequence
aaattcgcttcctggatttg

SEQ ID NO: 240021 - DNA, 20 bp, Artificial
  CRISPR gRNA sequence
aattcgcttcctggatttgg

SEQ ID NO: 240022 - DNA, 20 bp, Artificial
  CRISPR gRNA sequence
gcttcctggatttggaggtc

SEQ ID NO: 240023 - DNA, 20 bp, Artificial
  CRISPR gRNA sequence
ggtcaagtgtaataaaatgt

SEQ ID NO: 240024 - DNA, 20 bp, Artificial
  CRISPR gRNA sequence
gtcaagtgtaataaaatgtt

SEQ ID NO: 240025 - DNA, 20 bp, Artificial
  CRISPR gRNA sequence
tcaagtgtaataaaatgttg

SEQ ID NO: 240026 - DNA, 20 bp, Artificial
  CRISPR gRNA sequence
caagtgtaataaaatgttgg

SEQ ID NO: 240027 - DNA, 20 bp, Artificial
  CRISPR gRNA sequence
tgtaataaaatgttgggggc

SEQ ID NO: 240028 - DNA, 20 bp, Artificial
  CRISPR gRNA sequence
gtaataaaatgttgggggct

SEQ ID NO: 240029 - DNA, 20 bp, Artificial
  CRISPR gRNA sequence
taataaaatgttgggggctg

SEQ ID NO: 240030 - DNA, 20 bp, Artificial
  CRISPR gRNA sequence
aataaaatgttgggggctgg

SEQ ID NO: 240031 - DNA, 20 bp, Artificial
  CRISPR gRNA sequence
ataaaatgttgggggctggg

SEQ ID NO: 240032 - DNA, 20 bp, Artificial
  CRISPR gRNA sequence
tgggggctggggggactttg

SEQ ID NO: 240033 - DNA, 20 bp, Artificial
  CRISPR gRNA sequence
gggggctggggggactttgt

SEQ ID NO: 240034 - DNA, 20 bp, Artificial
  CRISPR gRNA sequence
ggggactttgtaggtgtttt

SEQ ID NO: 240035 - DNA, 20 bp, Artificial
  CRISPR gRNA sequence
gggactttgtaggtgttttc

SEQ ID NO: 240036 - DNA, 20 bp, Artificial
  CRISPR gRNA sequence
tttgtaggtgttttcaggac

SEQ ID NO: 240037 - DNA, 20 bp, Artificial
  CRISPR gRNA sequence
ttgtaggtgttttcaggacc

SEQ ID NO: 240038 - DNA, 20 bp, Artificial
  CRISPR gRNA sequence
taggtgttttcaggaccagg

SEQ ID NO: 240039 - DNA, 20 bp, Artificial
  CRISPR gRNA sequence
aggtgttttcaggaccagga

SEQ ID NO: 240040 - DNA, 20 bp, Artificial
  CRISPR gRNA sequence
gtgttttcaggaccaggaag

SEQ ID NO: 240041 - DNA, 20 bp, Artificial
  CRISPR gRNA sequence
aggaaggagtgttcctccac

SEQ ID NO: 240042 - DNA, 20 bp, Artificial
  CRISPR gRNA sequence
gtgttcctccaccagcaatg

SEQ ID NO: 240043 - DNA, 20 bp, Artificial
  CRISPR gRNA sequence
gttcctccaccagcaatgca

SEQ ID NO: 240044 - DNA, 20 bp, Artificial
  CRISPR gRNA sequence
tgcagagtgtgactgcactc

SEQ ID NO: 240045 - DNA, 20 bp, Artificial
  CRISPR gRNA sequence
gcagagtgtgactgcactcc

SEQ ID NO: 240046 - DNA, 20 bp, Artificial
  CRISPR gRNA sequence
cagagtgtgactgcactcca

SEQ ID NO: 240047 - DNA, 20 bp, Artificial
  CRISPR gRNA sequence
cactccagggtttcactgcc

SEQ ID NO: 240048 - DNA, 20 bp, Artificial
  CRISPR gRNA sequence
actccagggtttcactgcct

SEQ ID NO: 240049 - DNA, 20 bp, Artificial
  CRISPR gRNA sequence
ctccagggtttcactgcctg

SEQ ID NO: 240050 - DNA, 20 bp, Artificial
  CRISPR gRNA sequence
tccagggtttcactgcctgg

SEQ ID NO: 240051 - DNA, 20 bp, Artificial
  CRISPR gRNA sequence
agggtttcactgcctggggg

SEQ ID NO: 240052 - DNA, 20 bp, Artificial
  CRISPR gRNA sequence
gggtttcactgcctgggggc

SEQ ID NO: 240053 - DNA, 20 bp, Artificial
  CRISPR gRNA sequence
cactgcctgggggcaggatg

SEQ ID NO: 240054 - DNA, 20 bp, Artificial
  CRISPR gRNA sequence
caggatgcagcatgtgtgaa

SEQ ID NO: 240055 - DNA, 20 bp, Artificial
  CRISPR gRNA sequence
aggatgcagcatgtgtgaac

SEQ ID NO: 240056 - DNA, 20 bp, Artificial
  CRISPR gRNA sequence
gtgtgaacaggattgtaaac

SEQ ID NO: 240057 - DNA, 20 bp, Artificial
  CRISPR gRNA sequence
tgtgaacaggattgtaaaca

SEQ ID NO: 240058 - DNA, 20 bp, Artificial
  CRISPR gRNA sequence
acaggattgtaaacaaggtc

SEQ ID NO: 240059 - DNA, 20 bp, Artificial
  CRISPR gRNA sequence
aggtcaagaactgacaaaaa

SEQ ID NO: 240060 - DNA, 20 bp, Artificial
  CRISPR gRNA sequence
ggtcaagaactgacaaaaaa

SEQ ID NO: 240061 - DNA, 20 bp, Artificial
  CRISPR gRNA sequence
acgtttgcgtttctttgatc

SEQ ID NO: 240062 - DNA, 20 bp, Artificial
  CRISPR gRNA sequence
tgcgtttctttgatctagtg

SEQ ID NO: 240063 - DNA, 20 bp, Artificial
  CRISPR gRNA sequence
tctagtgtagttttgtgaca

SEQ ID NO: 240064 - DNA, 20 bp, Artificial
  CRISPR gRNA sequence
ttttgtgacatagacaaact

SEQ ID NO: 240065 - DNA, 20 bp, Artificial
  CRISPR gRNA sequence
atcctttgaaaataaacaaa

SEQ ID NO: 240066 - DNA, 20 bp, Artificial
  CRISPR gRNA sequence
aaaataaacaaacagatttg

SEQ ID NO: 240067 - DNA, 20 bp, Artificial
  CRISPR gRNA sequence
aacagatttgtagaacctta

SEQ ID NO: 240068 - DNA, 20 bp, Artificial
  CRISPR gRNA sequence
ttgtagaaccttaaagtaac

SEQ ID NO: 240069 - DNA, 20 bp, Artificial
  CRISPR gRNA sequence
tgtagaaccttaaagtaaca

SEQ ID NO: 240070 - DNA, 20 bp, Artificial
  CRISPR gRNA sequence
gtagaaccttaaagtaacaa

SEQ ID NO: 240071 - DNA, 20 bp, Artificial
  CRISPR gRNA sequence
agaaccttaaagtaacaagg

SEQ ID NO: 240072 - DNA, 20 bp, Artificial
  CRISPR gRNA sequence
ttccgttatttcttcataaa

SEQ ID NO: 240073 - DNA, 20 bp, Artificial
  CRISPR gRNA sequence
aaatggaaataatttgaaat

SEQ ID NO: 240074 - DNA, 20 bp, Artificial
  CRISPR gRNA sequence
tcagaacatttgttaattgc

SEQ ID NO: 240075 - DNA, 20 bp, Artificial
  CRISPR gRNA sequence
ccattaatcttcacatgttc

SEQ ID NO: 240076 - DNA, 20 bp, Artificial
  CRISPR gRNA sequence
tgtacaattaaaataaaaac

SEQ ID NO: 240077 - DNA, 20 bp, Artificial
  CRISPR gRNA sequence
aaaataaaaactagccatct

SEQ ID NO: 240078 - DNA, 20 bp, Artificial
  CRISPR gRNA sequence
aaataaaaactagccatctt

SEQ ID NO: 240079 - DNA, 20 bp, Artificial
  CRISPR gRNA sequence
aataaaaactagccatctta

SEQ ID NO: 240080 - DNA, 20 bp, Artificial
  CRISPR gRNA sequence
ccatcttagggtgttgtttc

SEQ ID NO: 240081 - DNA, 20 bp, Artificial
  CRISPR gRNA sequence
gaattattgaacaatttgtg

SEQ ID NO: 240082 - DNA, 20 bp, Artificial
  CRISPR gRNA sequence
aatttgtgcagattgcatta

SEQ ID NO: 240083 - DNA, 20 bp, Artificial
  CRISPR gRNA sequence
ttatggtaatgacttatatt

SEQ ID NO: 240084 - DNA, 20 bp, Artificial
  CRISPR gRNA sequence
gacttatattaagttcatca

SEQ ID NO: 240085 - DNA, 20 bp, Artificial
  CRISPR gRNA sequence
acttatattaagttcatcac

SEQ ID NO: 240086 - DNA, 20 bp, Artificial
  CRISPR gRNA sequence
tattaagttcatcacaggaa

SEQ ID NO: 240087 - DNA, 20 bp, Artificial
  CRISPR gRNA sequence
attgctttcatttttaatac

SEQ ID NO: 240088 - DNA, 20 bp, Artificial
  CRISPR gRNA sequence
ttgctttcatttttaataca

SEQ ID NO: 240089 - DNA, 20 bp, Artificial
  CRISPR gRNA sequence
atttttaatacaaggttgta

SEQ ID NO: 240090 - DNA, 20 bp, Artificial
  CRISPR gRNA sequence
ggttgtaaagactgttgctt

SEQ ID NO: 240091 - DNA, 20 bp, Artificial
  CRISPR gRNA sequence
gttgtaaagactgttgcttt

SEQ ID NO: 240092 - DNA, 20 bp, Artificial
  CRISPR gRNA sequence
gctttgggacatttaacgat

SEQ ID NO: 240093 - DNA, 20 bp, Artificial
  CRISPR gRNA sequence
acatttaacgatcagaaacg

SEQ ID NO: 240094 - DNA, 20 bp, Artificial
  CRISPR gRNA sequence
aacgtggcatctgtcgaccc

SEQ ID NO: 240095 - DNA, 20 bp, Artificial
  CRISPR gRNA sequence
gcatctgtcgaccctggaca

SEQ ID NO: 240096 - DNA, 20 bp, Artificial
  CRISPR gRNA sequence
aaagtacgtataatttcctt

SEQ ID NO: 240097 - DNA, 20 bp, Artificial
  CRISPR gRNA sequence
gtataatttcctttagttta

SEQ ID NO: 240098 - DNA, 20 bp, Artificial
  CRISPR gRNA sequence
ttcctttagtttatggaata

SEQ ID NO: 240099 - DNA, 20 bp, Artificial
  CRISPR gRNA sequence
agtttatggaataaagaatc

SEQ ID NO: 240100 - DNA, 20 bp, Artificial
  CRISPR gRNA sequence
gtttatggaataaagaatct

SEQ ID NO: 240101 - DNA, 20 bp, Artificial
  CRISPR gRNA sequence
agaatctgggttaaattttt

SEQ ID NO: 240102 - DNA, 20 bp, Artificial
  CRISPR gRNA sequence
atctgggttaaattttttgg

SEQ ID NO: 240103 - DNA, 20 bp, Artificial
  CRISPR gRNA sequence
ggttaaattttttggaagat

SEQ ID NO: 240104 - DNA, 20 bp, Artificial
  CRISPR gRNA sequence
gttaaattttttggaagata

SEQ ID NO: 240105 - DNA, 20 bp, Artificial
  CRISPR gRNA sequence
gataaggaatgctatcattg

SEQ ID NO: 240106 - DNA, 20 bp, Artificial
  CRISPR gRNA sequence
gaagcttttttgcacccatc

SEQ ID NO: 240107 - DNA, 20 bp, Artificial
  CRISPR gRNA sequence
ttttttgcacccatcaagtg

SEQ ID NO: 240108 - DNA, 20 bp, Artificial
  CRISPR gRNA sequence
ttgcacccatcaagtgtaga

SEQ ID NO: 240109 - DNA, 20 bp, Artificial
  CRISPR gRNA sequence
gacagaatgtaacatactaa

SEQ ID NO: 240110 - DNA, 20 bp, Artificial
  CRISPR gRNA sequence
acagaatgtaacatactaat

SEQ ID NO: 240111 - DNA, 20 bp, Artificial
  CRISPR gRNA sequence
gaatgtaacatactaatagg

SEQ ID NO: 240112 - DNA, 20 bp, Artificial
  CRISPR gRNA sequence
taacatactaataggcagcg

SEQ ID NO: 240113 - DNA, 20 bp, Artificial
  CRISPR gRNA sequence
aacatactaataggcagcgt

SEQ ID NO: 240114 - DNA, 20 bp, Artificial
  CRISPR gRNA sequence
aggcagcgtgggaacactgt

SEQ ID NO: 240115 - DNA, 20 bp, Artificial
  CRISPR gRNA sequence
ggcagcgtgggaacactgtg

SEQ ID NO: 240116 - DNA, 20 bp, Artificial
  CRISPR gRNA sequence
gtgggaacactgtgaggtcg

SEQ ID NO: 240117 - DNA, 20 bp, Artificial
  CRISPR gRNA sequence
gtgaggtcgtagcaactcaa

SEQ ID NO: 240118 - DNA, 20 bp, Artificial
  CRISPR gRNA sequence
tgaggtcgtagcaactcaat

SEQ ID NO: 240119 - DNA, 20 bp, Artificial
  CRISPR gRNA sequence
tcgtagcaactcaataggca

SEQ ID NO: 240120 - DNA, 20 bp, Artificial
  CRISPR gRNA sequence
tagcaactcaataggcaaag

SEQ ID NO: 240121 - DNA, 20 bp, Artificial
  CRISPR gRNA sequence
agcaactcaataggcaaagt

SEQ ID NO: 240122 - DNA, 20 bp, Artificial
  CRISPR gRNA sequence
ggcaaagtgggcattttctc

SEQ ID NO: 240123 - DNA, 20 bp, Artificial
  CRISPR gRNA sequence
gtgggcattttctccagaaa

SEQ ID NO: 240124 - DNA, 20 bp, Artificial
  CRISPR gRNA sequence
ttttctccagaaatagtgcc

SEQ ID NO: 240125 - DNA, 20 bp, Artificial
  CRISPR gRNA sequence
gaaatagtgcctggaacatc

SEQ ID NO: 240126 - DNA, 20 bp, Artificial
  CRISPR gRNA sequence
agtgcctggaacatctagat

SEQ ID NO: 240127 - DNA, 20 bp, Artificial
  CRISPR gRNA sequence
aacatctagatcagaattgc

SEQ ID NO: 240128 - DNA, 20 bp, Artificial
  CRISPR gRNA sequence
atctagatcagaattgccag

SEQ ID NO: 240129 - DNA, 20 bp, Artificial
  CRISPR gRNA sequence
ctagatcagaattgccagtg

SEQ ID NO: 240130 - DNA, 20 bp, Artificial
  CRISPR gRNA sequence
tagatcagaattgccagtgg

SEQ ID NO: 240131 - DNA, 20 bp, Artificial
  CRISPR gRNA sequence
tcagaattgccagtggaggc

SEQ ID NO: 240132 - DNA, 20 bp, Artificial
  CRISPR gRNA sequence
cagaattgccagtggaggct

SEQ ID NO: 240133 - DNA, 20 bp, Artificial
  CRISPR gRNA sequence
cagtggaggctgggcacgtg

SEQ ID NO: 240134 - DNA, 20 bp, Artificial
  CRISPR gRNA sequence
tggaggctgggcacgtgcag

SEQ ID NO: 240135 - DNA, 20 bp, Artificial
  CRISPR gRNA sequence
gtggttcacgcctgtaatcc

SEQ ID NO: 240136 - DNA, 20 bp, Artificial
  CRISPR gRNA sequence
cgcctgtaatcccagcactt

SEQ ID NO: 240137 - DNA, 20 bp, Artificial
  CRISPR gRNA sequence
gcctgtaatcccagcacttt

SEQ ID NO: 240138 - DNA, 20 bp, Artificial
  CRISPR gRNA sequence
ctgtaatcccagcactttgg

SEQ ID NO: 240139 - DNA, 20 bp, Artificial
  CRISPR gRNA sequence
tgtaatcccagcactttggg

SEQ ID NO: 240140 - DNA, 20 bp, Artificial
  CRISPR gRNA sequence
tcccagcactttgggaggct

SEQ ID NO: 240141 - DNA, 20 bp, Artificial
  CRISPR gRNA sequence
agcactttgggaggctgaga

SEQ ID NO: 240142 - DNA, 20 bp, Artificial
  CRISPR gRNA sequence
gcactttgggaggctgagac

SEQ ID NO: 240143 - DNA, 20 bp, Artificial
  CRISPR gRNA sequence
actttgggaggctgagacag

SEQ ID NO: 240144 - DNA, 20 bp, Artificial
  CRISPR gRNA sequence
ctttgggaggctgagacagg

SEQ ID NO: 240145 - DNA, 20 bp, Artificial
  CRISPR gRNA sequence
ctgagacaggaggactcctt

SEQ ID NO: 240146 - DNA, 20 bp, Artificial
  CRISPR gRNA sequence
acaggaggactccttgagcc

SEQ ID NO: 240147 - DNA, 20 bp, Artificial
  CRISPR gRNA sequence
caggaggactccttgagccc

SEQ ID NO: 240148 - DNA, 20 bp, Artificial
  CRISPR gRNA sequence
ggaggactccttgagcccag

SEQ ID NO: 240149 - DNA, 20 bp, Artificial
  CRISPR gRNA sequence
tgagcccaggagttcaaaac

SEQ ID NO: 240150 - DNA, 20 bp, Artificial
  CRISPR gRNA sequence
ccaggagttcaaaaccagcc

SEQ ID NO: 240151 - DNA, 20 bp, Artificial
  CRISPR gRNA sequence
caggagttcaaaaccagcct

SEQ ID NO: 240152 - DNA, 20 bp, Artificial
  CRISPR gRNA sequence
agttcaaaaccagcctgggt

SEQ ID NO: 240153 - DNA, 20 bp, Artificial
  CRISPR gRNA sequence
tctacaaaaaatcaaaaaat

SEQ ID NO: 240154 - DNA, 20 bp, Artificial
  CRISPR gRNA sequence
caaaaaatcaaaaaattagc

SEQ ID NO: 240155 - DNA, 20 bp, Artificial
  CRISPR gRNA sequence
aaaaaatcaaaaaattagcc

SEQ ID NO: 240156 - DNA, 20 bp, Artificial
  CRISPR gRNA sequence
aaaaaattagccaggcataa

SEQ ID NO: 240157 - DNA, 20 bp, Artificial
  CRISPR gRNA sequence
ggcataatggcacatgcctg

SEQ ID NO: 240158 - DNA, 20 bp, Artificial
  CRISPR gRNA sequence
atggcacatgcctgtggtcc

SEQ ID NO: 240159 - DNA, 20 bp, Artificial
  CRISPR gRNA sequence
catgcctgtggtcccagcta

SEQ ID NO: 240160 - DNA, 20 bp, Artificial
  CRISPR gRNA sequence
atgcctgtggtcccagctat

SEQ ID NO: 240161 - DNA, 20 bp, Artificial
  CRISPR gRNA sequence
tgcctgtggtcccagctata

SEQ ID NO: 240162 - DNA, 20 bp, Artificial
  CRISPR gRNA sequence
ctgtggtcccagctataggg

SEQ ID NO: 240163 - DNA, 20 bp, Artificial
  CRISPR gRNA sequence
tgtggtcccagctataggga

SEQ ID NO: 240164 - DNA, 20 bp, Artificial
  CRISPR gRNA sequence
cagctatagggaaggctgat

SEQ ID NO: 240165 - DNA, 20 bp, Artificial
  CRISPR gRNA sequence
agctatagggaaggctgatg

SEQ ID NO: 240166 - DNA, 20 bp, Artificial
  CRISPR gRNA sequence
tatagggaaggctgatgagg

SEQ ID NO: 240167 - DNA, 20 bp, Artificial
  CRISPR gRNA sequence
atagggaaggctgatgaggc

SEQ ID NO: 240168 - DNA, 20 bp, Artificial
  CRISPR gRNA sequence
agggaaggctgatgaggcag

SEQ ID NO: 240169 - DNA, 20 bp, Artificial
  CRISPR gRNA sequence
gggaaggctgatgaggcagg

SEQ ID NO: 240170 - DNA, 20 bp, Artificial
  CRISPR gRNA sequence
atgaggcaggaggatcacct

SEQ ID NO: 240171 - DNA, 20 bp, Artificial
  CRISPR gRNA sequence
gcaggaggatcacctgagtc

SEQ ID NO: 240172 - DNA, 20 bp, Artificial
  CRISPR gRNA sequence
caggaggatcacctgagtct

SEQ ID NO: 240173 - DNA, 20 bp, Artificial
  CRISPR gRNA sequence
ggaggatcacctgagtctgg

SEQ ID NO: 240174 - DNA, 20 bp, Artificial
  CRISPR gRNA sequence
gaggatcacctgagtctggg

SEQ ID NO: 240175 - DNA, 20 bp, Artificial
  CRISPR gRNA sequence
tcacctgagtctgggaggtt

SEQ ID NO: 240176 - DNA, 20 bp, Artificial
  CRISPR gRNA sequence
cacctgagtctgggaggttg

SEQ ID NO: 240177 - DNA, 20 bp, Artificial
  CRISPR gRNA sequence
tgggaggttgaggctgcaat

SEQ ID NO: 240178 - DNA, 20 bp, Artificial
  CRISPR gRNA sequence
atgatcgcaccatcgcactc

SEQ ID NO: 240179 - DNA, 20 bp, Artificial
  CRISPR gRNA sequence
gatcgcaccatcgcactcca

SEQ ID NO: 240180 - DNA, 20 bp, Artificial
  CRISPR gRNA sequence
cgcaccatcgcactccagag

SEQ ID NO: 240181 - DNA, 20 bp, Artificial
  CRISPR gRNA sequence
caccatcgcactccagagca

SEQ ID NO: 240182 - DNA, 20 bp, Artificial
  CRISPR gRNA sequence
ccatcgcactccagagcaga

SEQ ID NO: 240183 - DNA, 20 bp, Artificial
  CRISPR gRNA sequence
gagcagagagcctgtctcaa

SEQ ID NO: 240184 - DNA, 20 bp, Artificial
  CRISPR gRNA sequence
agagagcctgtctcaaaaga

SEQ ID NO: 240185 - DNA, 20 bp, Artificial
  CRISPR gRNA sequence
gagagcctgtctcaaaagaa

SEQ ID NO: 240186 - DNA, 20 bp, Artificial
  CRISPR gRNA sequence
cctgtctcaaaagaaaggaa

SEQ ID NO: 240187 - DNA, 20 bp, Artificial
  CRISPR gRNA sequence
aaagaaaggaaaagaattgc

SEQ ID NO: 240188 - DNA, 20 bp, Artificial
  CRISPR gRNA sequence
gaaaggaaaagaattgccag

SEQ ID NO: 240189 - DNA, 20 bp, Artificial
  CRISPR gRNA sequence
tcttatcttctctcattgat

SEQ ID NO: 240190 - DNA, 20 bp, Artificial
  CRISPR gRNA sequence
tgtctccatgtgttcaatgc

SEQ ID NO: 240191 - DNA, 20 bp, Artificial
  CRISPR gRNA sequence
atgtgttcaatgccagcccc

SEQ ID NO: 240192 - DNA, 20 bp, Artificial
  CRISPR gRNA sequence
tgccagcccctagaatgata

SEQ ID NO: 240193 - DNA, 20 bp, Artificial
  CRISPR gRNA sequence
cagcccctagaatgatacag

SEQ ID NO: 240194 - DNA, 20 bp, Artificial
  CRISPR gRNA sequence
gctcgttaccctccaaaatg

SEQ ID NO: 240195 - DNA, 20 bp, Artificial
  CRISPR gRNA sequence
ttaccctccaaaatgtggca

SEQ ID NO: 240196 - DNA, 20 bp, Artificial
  CRISPR gRNA sequence
tccaaaatgtggcacagact

SEQ ID NO: 240197 - DNA, 20 bp, Artificial
  CRISPR gRNA sequence
ccaaaatgtggcacagactt

SEQ ID NO: 240198 - DNA, 20 bp, Artificial
  CRISPR gRNA sequence
tggcacagacttgggcacac

SEQ ID NO: 240199 - DNA, 20 bp, Artificial
  CRISPR gRNA sequence
ggcacagacttgggcacaca

SEQ ID NO: 240200 - DNA, 20 bp, Artificial
  CRISPR gRNA sequence
ttgggcacacaaggccatca

SEQ ID NO: 240201 - DNA, 20 bp, Artificial
  CRISPR gRNA sequence
tgggcacacaaggccatcac

SEQ ID NO: 240202 - DNA, 20 bp, Artificial
  CRISPR gRNA sequence
gcacacaaggccatcacagg

SEQ ID NO: 240203 - DNA, 20 bp, Artificial
  CRISPR gRNA sequence
aggccatcacaggtggtaaa

SEQ ID NO: 240204 - DNA, 20 bp, Artificial
  CRISPR gRNA sequence
cacaggtggtaaaaagccaa

SEQ ID NO: 240205 - DNA, 20 bp, Artificial
  CRISPR gRNA sequence
gtaaaaagccaatagtatac

SEQ ID NO: 240206 - DNA, 20 bp, Artificial
  CRISPR gRNA sequence
aaaaagccaatagtatacga

SEQ ID NO: 240207 - DNA, 20 bp, Artificial
  CRISPR gRNA sequence
agaatgtgactgttgttttg

SEQ ID NO: 240208 - DNA, 20 bp, Artificial
  CRISPR gRNA sequence
tgactgttgttttgtggaac

SEQ ID NO: 240209 - DNA, 20 bp, Artificial
  CRISPR gRNA sequence
tggaaccagaacttacactg

SEQ ID NO: 240210 - DNA, 20 bp, Artificial
  CRISPR gRNA sequence
agaacttacactgtggtctg

SEQ ID NO: 240211 - DNA, 20 bp, Artificial
  CRISPR gRNA sequence
cttacactgtggtctgtgga

SEQ ID NO: 240212 - DNA, 20 bp, Artificial
  CRISPR gRNA sequence
ttacactgtggtctgtggat

SEQ ID NO: 240213 - DNA, 20 bp, Artificial
  CRISPR gRNA sequence
tgtggtctgtggatgggtgc

SEQ ID NO: 240214 - DNA, 20 bp, Artificial
  CRISPR gRNA sequence
gatgggtgctggtccacaaa

SEQ ID NO: 240215 - DNA, 20 bp, Artificial
  CRISPR gRNA sequence
ttgtcctgtgtccccatcga

SEQ ID NO: 240216 - DNA, 20 bp, Artificial
  CRISPR gRNA sequence
tcctgtgtccccatcgacag

SEQ ID NO: 240217 - DNA, 20 bp, Artificial
  CRISPR gRNA sequence
tgtccccatcgacagtggtg

SEQ ID NO: 240218 - DNA, 20 bp, Artificial
  CRISPR gRNA sequence
gtccccatcgacagtggtgt

SEQ ID NO: 240219 - DNA, 20 bp, Artificial
  CRISPR gRNA sequence
tccccatcgacagtggtgta

SEQ ID NO: 240220 - DNA, 20 bp, Artificial
  CRISPR gRNA sequence
catcgacagtggtgtagggt

SEQ ID NO: 240221 - DNA, 20 bp, Artificial
  CRISPR gRNA sequence
tcgacagtggtgtagggtta

SEQ ID NO: 240222 - DNA, 20 bp, Artificial
  CRISPR gRNA sequence
gacagtggtgtagggttaga

SEQ ID NO: 240223 - DNA, 20 bp, Artificial
  CRISPR gRNA sequence
agggttagagagtaaacatt

SEQ ID NO: 240224 - DNA, 20 bp, Artificial
  CRISPR gRNA sequence
gtaaacatttagaaactttt

SEQ ID NO: 240225 - DNA, 20 bp, Artificial
  CRISPR gRNA sequence
taaacatttagaaactttta

SEQ ID NO: 240226 - DNA, 20 bp, Artificial
  CRISPR gRNA sequence
tagaaacttttaaggcaaat

SEQ ID NO: 240227 - DNA, 20 bp, Artificial
  CRISPR gRNA sequence
aaacttttaaggcaaattgg

SEQ ID NO: 240228 - DNA, 20 bp, Artificial
  CRISPR gRNA sequence
acttttaaggcaaattggca

SEQ ID NO: 240229 - DNA, 20 bp, Artificial
  CRISPR gRNA sequence
ggcaaattggcagagtaatg

SEQ ID NO: 240230 - DNA, 20 bp, Artificial
  CRISPR gRNA sequence
agtaatgtggtctgttgact

SEQ ID NO: 240231 - DNA, 20 bp, Artificial
  CRISPR gRNA sequence
gttgactaagaataaaaatt

SEQ ID NO: 240232 - DNA, 20 bp, Artificial
  CRISPR gRNA sequence
ttgactaagaataaaaattt

SEQ ID NO: 240233 - DNA, 20 bp, Artificial
  CRISPR gRNA sequence
tttccgtttcattttcttac

SEQ ID NO: 240234 - DNA, 20 bp, Artificial
  CRISPR gRNA sequence
acatttttattgtatttcaa

SEQ ID NO: 240235 - DNA, 20 bp, Artificial
  CRISPR gRNA sequence
attgtatttcaaaagtgtat

SEQ ID NO: 240236 - DNA, 20 bp, Artificial
  CRISPR gRNA sequence
aaaagtgtattggtttgtaa

SEQ ID NO: 240237 - DNA, 20 bp, Artificial
  CRISPR gRNA sequence
tgtattggtttgtaacagac

SEQ ID NO: 240238 - DNA, 20 bp, Artificial
  CRISPR gRNA sequence
ttggtttgtaacagactgga

SEQ ID NO: 240239 - DNA, 20 bp, Artificial
  CRISPR gRNA sequence
gactggaaagtgactttttt

SEQ ID NO: 240240 - DNA, 20 bp, Artificial
  CRISPR gRNA sequence
ctggaaagtgacttttttga

SEQ ID NO: 240241 - DNA, 20 bp, Artificial
  CRISPR gRNA sequence
gacttttttgagagaaaata

SEQ ID NO: 240242 - DNA, 20 bp, Artificial
  CRISPR gRNA sequence
gaaaataaagtgttttgaaa

SEQ ID NO: 240243 - DNA, 20 bp, Artificial
  CRISPR gRNA sequence
aaaataaagtgttttgaaac

SEQ ID NO: 240244 - DNA, 20 bp, Artificial
  CRISPR gRNA sequence
gtgttttgaaacaggaatca

SEQ ID NO: 240245 - DNA, 20 bp, Artificial
  CRISPR gRNA sequence
ttttgtcatttataatttat

SEQ ID NO: 240246 - DNA, 20 bp, Artificial
  CRISPR gRNA sequence
catttataatttatcagcat

SEQ ID NO: 240247 - DNA, 20 bp, Artificial
  CRISPR gRNA sequence
tttataatttatcagcatca

SEQ ID NO: 240248 - DNA, 20 bp, Artificial
  CRISPR gRNA sequence
ataatttatcagcatcagag

SEQ ID NO: 240249 - DNA, 20 bp, Artificial
  CRISPR gRNA sequence
gcatcagagtggctgacgaa

SEQ ID NO: 240250 - DNA, 20 bp, Artificial
  CRISPR gRNA sequence
cgaatggaatcatgattcac

SEQ ID NO: 240251 - DNA, 20 bp, Artificial
  CRISPR gRNA sequence
ggaatcatgattcacaagaa

SEQ ID NO: 240252 - DNA, 20 bp, Artificial
  CRISPR gRNA sequence
aaaagtattgactattttct

SEQ ID NO: 240253 - DNA, 20 bp, Artificial
  CRISPR gRNA sequence
attgactattttctcggact

SEQ ID NO: 240254 - DNA, 20 bp, Artificial
  CRISPR gRNA sequence
acttagctgaattctgtctt

SEQ ID NO: 240255 - DNA, 20 bp, Artificial
  CRISPR gRNA sequence
agctgaattctgtctttgga

SEQ ID NO: 240256 - DNA, 20 bp, Artificial
  CRISPR gRNA sequence
tgaattctgtctttggaaag

SEQ ID NO: 240257 - DNA, 20 bp, Artificial
  CRISPR gRNA sequence
tggaaagtggcttttttaaa

SEQ ID NO: 240258 - DNA, 20 bp, Artificial
  CRISPR gRNA sequence
ggaaagtggcttttttaaaa

SEQ ID NO: 240259 - DNA, 20 bp, Artificial
  CRISPR gRNA sequence
tttgtttgtttgtttgtttt

SEQ ID NO: 240260 - DNA, 20 bp, Artificial
  CRISPR gRNA sequence
tttgtttgtttgttttgaga

SEQ ID NO: 240261 - DNA, 20 bp, Artificial
  CRISPR gRNA sequence
tgtttgtttgttttgagatg

SEQ ID NO: 240262 - DNA, 20 bp, Artificial
  CRISPR gRNA sequence
ggagtttcgctcttcttgcc

SEQ ID NO: 240263 - DNA, 20 bp, Artificial
  CRISPR gRNA sequence
gagtttcgctcttcttgccc

SEQ ID NO: 240264 - DNA, 20 bp, Artificial
  CRISPR gRNA sequence
ttcgctcttcttgcccaggc

SEQ ID NO: 240265 - DNA, 20 bp, Artificial
  CRISPR gRNA sequence
cgctcttcttgcccaggctg

SEQ ID NO: 240266 - DNA, 20 bp, Artificial
  CRISPR gRNA sequence
ttgcccaggctggagtgcaa

SEQ ID NO: 240267 - DNA, 20 bp, Artificial
  CRISPR gRNA sequence
caggctggagtgcaatggca

SEQ ID NO: 240268 - DNA, 20 bp, Artificial
  CRISPR gRNA sequence
tcactgcaaactctgcctcc

SEQ ID NO: 240269 - DNA, 20 bp, Artificial
  CRISPR gRNA sequence
cactgcaaactctgcctcct

SEQ ID NO: 240270 - DNA, 20 bp, Artificial
  CRISPR gRNA sequence
aaactctgcctcctgggttc

SEQ ID NO: 240271 - DNA, 20 bp, Artificial
  CRISPR gRNA sequence
actctgcctcctgggttcaa

SEQ ID NO: 240272 - DNA, 20 bp, Artificial
  CRISPR gRNA sequence
ttcaagagattctcctgcct

SEQ ID NO: 240273 - DNA, 20 bp, Artificial
  CRISPR gRNA sequence
attctcctgcctcggcctcc

SEQ ID NO: 240274 - DNA, 20 bp, Artificial
  CRISPR gRNA sequence
ctcctgcctcggcctcctag

SEQ ID NO: 240275 - DNA, 20 bp, Artificial
  CRISPR gRNA sequence
tgcctcggcctcctagtagc

SEQ ID NO: 240276 - DNA, 20 bp, Artificial
  CRISPR gRNA sequence
gcctcggcctcctagtagct

SEQ ID NO: 240277 - DNA, 20 bp, Artificial
  CRISPR gRNA sequence
cctcctagtagctgggatta

SEQ ID NO: 240278 - DNA, 20 bp, Artificial
  CRISPR gRNA sequence
ctcctagtagctgggattac

SEQ ID NO: 240279 - DNA, 20 bp, Artificial
  CRISPR gRNA sequence
caggtgcacacaaccacgcc

SEQ ID NO: 240280 - DNA, 20 bp, Artificial
  CRISPR gRNA sequence
tgcacacaaccacgcctggc

SEQ ID NO: 240281 - DNA, 20 bp, Artificial
  CRISPR gRNA sequence
ggctagtgcttttgtatttt

SEQ ID NO: 240282 - DNA, 20 bp, Artificial
  CRISPR gRNA sequence
tagtgcttttgtatttttag

SEQ ID NO: 240283 - DNA, 20 bp, Artificial
  CRISPR gRNA sequence
gtgcttttgtatttttagta

SEQ ID NO: 240284 - DNA, 20 bp, Artificial
  CRISPR gRNA sequence
ttttgtatttttagtagaga

SEQ ID NO: 240285 - DNA, 20 bp, Artificial
  CRISPR gRNA sequence
tttgtatttttagtagagat

SEQ ID NO: 240286 - DNA, 20 bp, Artificial
  CRISPR gRNA sequence
gagatgggctttcaccatgt

SEQ ID NO: 240287 - DNA, 20 bp, Artificial
  CRISPR gRNA sequence
tgggctttcaccatgttagc

SEQ ID NO: 240288 - DNA, 20 bp, Artificial
  CRISPR gRNA sequence
gggctttcaccatgttagcc

SEQ ID NO: 240289 - DNA, 20 bp, Artificial
  CRISPR gRNA sequence
tttcaccatgttagccaggc

SEQ ID NO: 240290 - DNA, 20 bp, Artificial
  CRISPR gRNA sequence
ggtctcgcactcctgacctc

SEQ ID NO: 240291 - DNA, 20 bp, Artificial
  CRISPR gRNA sequence
ctcaagtgatccgcttgcct

SEQ ID NO: 240292 - DNA, 20 bp, Artificial
  CRISPR gRNA sequence
ccgcttgccttggcctccca

SEQ ID NO: 240293 - DNA, 20 bp, Artificial
  CRISPR gRNA sequence
gccttggcctcccaaagtgc

SEQ ID NO: 240294 - DNA, 20 bp, Artificial
  CRISPR gRNA sequence
ccttggcctcccaaagtgct

SEQ ID NO: 240295 - DNA, 20 bp, Artificial
  CRISPR gRNA sequence
ctcccaaagtgctgggatta

SEQ ID NO: 240296 - DNA, 20 bp, Artificial
  CRISPR gRNA sequence
tcccaaagtgctgggattac

SEQ ID NO: 240297 - DNA, 20 bp, Artificial
  CRISPR gRNA sequence
agtgctgggattacaggtgt

SEQ ID NO: 240298 - DNA, 20 bp, Artificial
  CRISPR gRNA sequence
caggtgtgagccactgtgcc

SEQ ID NO: 240299 - DNA, 20 bp, Artificial
  CRISPR gRNA sequence
tgtgagccactgtgcccagc

SEQ ID NO: 240300 - DNA, 20 bp, Artificial
  CRISPR gRNA sequence
agccactgtgcccagctgga

SEQ ID NO: 240301 - DNA, 20 bp, Artificial
  CRISPR gRNA sequence
cactgtgcccagctggaaag

SEQ ID NO: 240302 - DNA, 20 bp, Artificial
  CRISPR gRNA sequence
tggaaagtggctttttaaaa

SEQ ID NO: 240303 - DNA, 20 bp, Artificial
  CRISPR gRNA sequence
ggaaagtggctttttaaaaa

SEQ ID NO: 240304 - DNA, 20 bp, Artificial
  CRISPR gRNA sequence
gtctttcaatacaaattttt

SEQ ID NO: 240305 - DNA, 20 bp, Artificial
  CRISPR gRNA sequence
ctttcaatacaaatttttca

SEQ ID NO: 240306 - DNA, 20 bp, Artificial
  CRISPR gRNA sequence
acaaatttttcagagttgtt

SEQ ID NO: 240307 - DNA, 20 bp, Artificial
  CRISPR gRNA sequence
atttttcagagttgttaagt

SEQ ID NO: 240308 - DNA, 20 bp, Artificial
  CRISPR gRNA sequence
agttgttaagtgagtctgca

SEQ ID NO: 240309 - DNA, 20 bp, Artificial
  CRISPR gRNA sequence
agtgagtctgcatggaaaaa

SEQ ID NO: 240310 - DNA, 20 bp, Artificial
  CRISPR gRNA sequence
gtgagtctgcatggaaaaat

SEQ ID NO: 240311 - DNA, 20 bp, Artificial
  CRISPR gRNA sequence
atggaaaaatgggtttgaac

SEQ ID NO: 240312 - DNA, 20 bp, Artificial
  CRISPR gRNA sequence
tggaaaaatgggtttgaact

SEQ ID NO: 240313 - DNA, 20 bp, Artificial
  CRISPR gRNA sequence
aatgggtttgaactgggctc

SEQ ID NO: 240314 - DNA, 20 bp, Artificial
  CRISPR gRNA sequence
tgggtttgaactgggctctg

SEQ ID NO: 240315 - DNA, 20 bp, Artificial
  CRISPR gRNA sequence
gggtttgaactgggctctgg

SEQ ID NO: 240316 - DNA, 20 bp, Artificial
  CRISPR gRNA sequence
ttgaactgggctctggagga

SEQ ID NO: 240317 - DNA, 20 bp, Artificial
  CRISPR gRNA sequence
tgaactgggctctggaggac

SEQ ID NO: 240318 - DNA, 20 bp, Artificial
  CRISPR gRNA sequence
actgggctctggaggacggg

SEQ ID NO: 240319 - DNA, 20 bp, Artificial
  CRISPR gRNA sequence
ctctggaggacgggcggatt

SEQ ID NO: 240320 - DNA, 20 bp, Artificial
  CRISPR gRNA sequence
tctggaggacgggcggattt

SEQ ID NO: 240321 - DNA, 20 bp, Artificial
  CRISPR gRNA sequence
ctggaggacgggcggatttg

SEQ ID NO: 240322 - DNA, 20 bp, Artificial
  CRISPR gRNA sequence
gaggacgggcggatttgggg

SEQ ID NO: 240323 - DNA, 20 bp, Artificial
  CRISPR gRNA sequence
aggacgggcggatttggggt

SEQ ID NO: 240324 - DNA, 20 bp, Artificial
  CRISPR gRNA sequence
gggcggatttggggtaggta

SEQ ID NO: 240325 - DNA, 20 bp, Artificial
  CRISPR gRNA sequence
ggcggatttggggtaggtaa

SEQ ID NO: 240326 - DNA, 20 bp, Artificial
  CRISPR gRNA sequence
gcggatttggggtaggtaaa

SEQ ID NO: 240327 - DNA, 20 bp, Artificial
  CRISPR gRNA sequence
tttggggtaggtaaagggac

SEQ ID NO: 240328 - DNA, 20 bp, Artificial
  CRISPR gRNA sequence
ttggggtaggtaaagggaca

SEQ ID NO: 240329 - DNA, 20 bp, Artificial
  CRISPR gRNA sequence
tggggtaggtaaagggacaa

SEQ ID NO: 240330 - DNA, 20 bp, Artificial
  CRISPR gRNA sequence
gtaggtaaagggacaaggga

SEQ ID NO: 240331 - DNA, 20 bp, Artificial
  CRISPR gRNA sequence
taggtaaagggacaagggaa

SEQ ID NO: 240332 - DNA, 20 bp, Artificial
  CRISPR gRNA sequence
agggaaaggtgtcacaacaa

SEQ ID NO: 240333 - DNA, 20 bp, Artificial
  CRISPR gRNA sequence
cacaacaacagcaacaatga

SEQ ID NO: 240334 - DNA, 20 bp, Artificial
  CRISPR gRNA sequence
agcaacaatgatggcgatga

SEQ ID NO: 240335 - DNA, 20 bp, Artificial
  CRISPR gRNA sequence
ggcgatgatggtgataatga

SEQ ID NO: 240336 - DNA, 20 bp, Artificial
  CRISPR gRNA sequence
aatgatagctaccatttact

SEQ ID NO: 240337 - DNA, 20 bp, Artificial
  CRISPR gRNA sequence
ctaccatttactcagcgtgt

SEQ ID NO: 240338 - DNA, 20 bp, Artificial
  CRISPR gRNA sequence
actcagcgtgtcagatgtgc

SEQ ID NO: 240339 - DNA, 20 bp, Artificial
  CRISPR gRNA sequence
tcagcgtgtcagatgtgcaa

SEQ ID NO: 240340 - DNA, 20 bp, Artificial
  CRISPR gRNA sequence
cactcgtttgttctttgaaa

SEQ ID NO: 240341 - DNA, 20 bp, Artificial
  CRISPR gRNA sequence
tttgttctttgaaacagttc

SEQ ID NO: 240342 - DNA, 20 bp, Artificial
  CRISPR gRNA sequence
gttctttgaaacagttctgg

SEQ ID NO: 240343 - DNA, 20 bp, Artificial
  CRISPR gRNA sequence
cacatacaatcctaattttg

SEQ ID NO: 240344 - DNA, 20 bp, Artificial
  CRISPR gRNA sequence
acaatcctaattttgcagat

SEQ ID NO: 240345 - DNA, 20 bp, Artificial
  CRISPR gRNA sequence
attttgcagatgagaaaact

SEQ ID NO: 240346 - DNA, 20 bp, Artificial
  CRISPR gRNA sequence
ttttgcagatgagaaaactg

SEQ ID NO: 240347 - DNA, 20 bp, Artificial
  CRISPR gRNA sequence
cagatgagaaaactgaggct

SEQ ID NO: 240348 - DNA, 20 bp, Artificial
  CRISPR gRNA sequence
agatgagaaaactgaggctt

SEQ ID NO: 240349 - DNA, 20 bp, Artificial
  CRISPR gRNA sequence
gatgagaaaactgaggctta

SEQ ID NO: 240350 - DNA, 20 bp, Artificial
  CRISPR gRNA sequence
tgagaaaactgaggcttagg

SEQ ID NO: 240351 - DNA, 20 bp, Artificial
  CRISPR gRNA sequence
gagaaaactgaggcttaggg

SEQ ID NO: 240352 - DNA, 20 bp, Artificial
  CRISPR gRNA sequence
ttcttttttcttttctttct

SEQ ID NO: 240353 - DNA, 20 bp, Artificial
  CRISPR gRNA sequence
tttttcttttctttctgaga

SEQ ID NO: 240354 - DNA, 20 bp, Artificial
  CRISPR gRNA sequence
ctgagacagcgtcaaactcc

SEQ ID NO: 240355 - DNA, 20 bp, Artificial
  CRISPR gRNA sequence
tgagacagcgtcaaactcct

SEQ ID NO: 240356 - DNA, 20 bp, Artificial
  CRISPR gRNA sequence
agcgtcaaactcctgggttc

SEQ ID NO: 240357 - DNA, 20 bp, Artificial
  CRISPR gRNA sequence
aactcctgggttcaagtgat

SEQ ID NO: 240358 - DNA, 20 bp, Artificial
  CRISPR gRNA sequence
agtgatcagcctcaaactcc

SEQ ID NO: 240359 - DNA, 20 bp, Artificial
  CRISPR gRNA sequence
gtgatcagcctcaaactcct

SEQ ID NO: 240360 - DNA, 20 bp, Artificial
  CRISPR gRNA sequence
agcctcaaactcctgggttc

SEQ ID NO: 240361 - DNA, 20 bp, Artificial
  CRISPR gRNA sequence
ttcaagtgatcctcccacct

SEQ ID NO: 240362 - DNA, 20 bp, Artificial
  CRISPR gRNA sequence
tcctcccacctcagtctccc

SEQ ID NO: 240363 - DNA, 20 bp, Artificial
  CRISPR gRNA sequence
tcccacctcagtctcccgag

SEQ ID NO: 240364 - DNA, 20 bp, Artificial
  CRISPR gRNA sequence
acctcagtctcccgagtagc

SEQ ID NO: 240365 - DNA, 20 bp, Artificial
  CRISPR gRNA sequence
cctcagtctcccgagtagct

SEQ ID NO: 240366 - DNA, 20 bp, Artificial
  CRISPR gRNA sequence
ctcagtctcccgagtagctg

SEQ ID NO: 240367 - DNA, 20 bp, Artificial
  CRISPR gRNA sequence
ctcccgagtagctggggcca

SEQ ID NO: 240368 - DNA, 20 bp, Artificial
  CRISPR gRNA sequence
tcccgagtagctggggccac

SEQ ID NO: 240369 - DNA, 20 bp, Artificial
  CRISPR gRNA sequence
gggccacaggcatgcaccat

SEQ ID NO: 240370 - DNA, 20 bp, Artificial
  CRISPR gRNA sequence
tgtttgtcttttaatttttg

SEQ ID NO: 240371 - DNA, 20 bp, Artificial
  CRISPR gRNA sequence
tttgtcttttaatttttgta

SEQ ID NO: 240372 - DNA, 20 bp, Artificial
  CRISPR gRNA sequence
tcttttaatttttgtagaga

SEQ ID NO: 240373 - DNA, 20 bp, Artificial
  CRISPR gRNA sequence
cttttaatttttgtagagat

SEQ ID NO: 240374 - DNA, 20 bp, Artificial
  CRISPR gRNA sequence
ttttaatttttgtagagatg

SEQ ID NO: 240375 - DNA, 20 bp, Artificial
  CRISPR gRNA sequence
tggggtcttgctatgttgct

SEQ ID NO: 240376 - DNA, 20 bp, Artificial
  CRISPR gRNA sequence
ggggtcttgctatgttgctc

SEQ ID NO: 240377 - DNA, 20 bp, Artificial
  CRISPR gRNA sequence
tcttgctatgttgctcaggc

SEQ ID NO: 240378 - DNA, 20 bp, Artificial
  CRISPR gRNA sequence
tcaggctggtctccaacgcc

SEQ ID NO: 240379 - DNA, 20 bp, Artificial
  CRISPR gRNA sequence
ggtctccaacgcctggtctc

SEQ ID NO: 240380 - DNA, 20 bp, Artificial
  CRISPR gRNA sequence
cctggtctcaagtgatcctc

SEQ ID NO: 240381 - DNA, 20 bp, Artificial
  CRISPR gRNA sequence
ctcaagtgatcctctggcct

SEQ ID NO: 240382 - DNA, 20 bp, Artificial
  CRISPR gRNA sequence
cctctggcctcagcctacca

SEQ ID NO: 240383 - DNA, 20 bp, Artificial
  CRISPR gRNA sequence
cctcagcctaccaaagtgtt

SEQ ID NO: 240384 - DNA, 20 bp, Artificial
  CRISPR gRNA sequence
ctaccaaagtgttgagatta

SEQ ID NO: 240385 - DNA, 20 bp, Artificial
  CRISPR gRNA sequence
taccaaagtgttgagattat

SEQ ID NO: 240386 - DNA, 20 bp, Artificial
  CRISPR gRNA sequence
agtgttgagattataggcgt

SEQ ID NO: 240387 - DNA, 20 bp, Artificial
  CRISPR gRNA sequence
ataggcgtgagccaccatgc

SEQ ID NO: 240388 - DNA, 20 bp, Artificial
  CRISPR gRNA sequence
taggcgtgagccaccatgct

SEQ ID NO: 240389 - DNA, 20 bp, Artificial
  CRISPR gRNA sequence
aggcgtgagccaccatgctg

SEQ ID NO: 240390 - DNA, 20 bp, Artificial
  CRISPR gRNA sequence
gagccaccatgctggggtta

SEQ ID NO: 240391 - DNA, 20 bp, Artificial
  CRISPR gRNA sequence
gccaccatgctggggttaca

SEQ ID NO: 240392 - DNA, 20 bp, Artificial
  CRISPR gRNA sequence
gagatttcttgacttgccca

SEQ ID NO: 240393 - DNA, 20 bp, Artificial
  CRISPR gRNA sequence
tgacttgcccaaagtcattc

SEQ ID NO: 240394 - DNA, 20 bp, Artificial
  CRISPR gRNA sequence
ttgcccaaagtcattctgga

SEQ ID NO: 240395 - DNA, 20 bp, Artificial
  CRISPR gRNA sequence
cccaaagtcattctggaaag

SEQ ID NO: 240396 - DNA, 20 bp, Artificial
  CRISPR gRNA sequence
aaagtcattctggaaagcag

SEQ ID NO: 240397 - DNA, 20 bp, Artificial
  CRISPR gRNA sequence
attctggaaagcagcagacc

SEQ ID NO: 240398 - DNA, 20 bp, Artificial
  CRISPR gRNA sequence
ttctggaaagcagcagaccc

SEQ ID NO: 240399 - DNA, 20 bp, Artificial
  CRISPR gRNA sequence
tctggaaagcagcagaccca

SEQ ID NO: 240400 - DNA, 20 bp, Artificial
  CRISPR gRNA sequence
cagacccagggctcaaaccc

SEQ ID NO: 240401 - DNA, 20 bp, Artificial
  CRISPR gRNA sequence
aaccctggtttgcctgatgc

SEQ ID NO: 240402 - DNA, 20 bp, Artificial
  CRISPR gRNA sequence
ggtttgcctgatgctagtgc

SEQ ID NO: 240403 - DNA, 20 bp, Artificial
  CRISPR gRNA sequence
tggacctcctaaccctatgc

SEQ ID NO: 240404 - DNA, 20 bp, Artificial
  CRISPR gRNA sequence
atgctagccttcatctgtgc

SEQ ID NO: 240405 - DNA, 20 bp, Artificial
  CRISPR gRNA sequence
gctagccttcatctgtgccg

SEQ ID NO: 240406 - DNA, 20 bp, Artificial
  CRISPR gRNA sequence
gccttcatctgtgccggaga

SEQ ID NO: 240407 - DNA, 20 bp, Artificial
  CRISPR gRNA sequence
catctgtgccggagatggtc

SEQ ID NO: 240408 - DNA, 20 bp, Artificial
  CRISPR gRNA sequence
ggagatggtcaagtccgatt

SEQ ID NO: 240409 - DNA, 20 bp, Artificial
  CRISPR gRNA sequence
gtcaagtccgattaagaaac

SEQ ID NO: 240410 - DNA, 20 bp, Artificial
  CRISPR gRNA sequence
tcaagtccgattaagaaact

SEQ ID NO: 240411 - DNA, 20 bp, Artificial
  CRISPR gRNA sequence
caagtccgattaagaaactg

SEQ ID NO: 240412 - DNA, 20 bp, Artificial
  CRISPR gRNA sequence
aagtccgattaagaaactgg

SEQ ID NO: 240413 - DNA, 20 bp, Artificial
  CRISPR gRNA sequence
ccgattaagaaactgggggt

SEQ ID NO: 240414 - DNA, 20 bp, Artificial
  CRISPR gRNA sequence
gattaagaaactgggggtga

SEQ ID NO: 240415 - DNA, 20 bp, Artificial
  CRISPR gRNA sequence
gaaactgggggtgagagact

SEQ ID NO: 240416 - DNA, 20 bp, Artificial
  CRISPR gRNA sequence
actgggggtgagagactaag

SEQ ID NO: 240417 - DNA, 20 bp, Artificial
  CRISPR gRNA sequence
ctgggggtgagagactaagc

SEQ ID NO: 240418 - DNA, 20 bp, Artificial
  CRISPR gRNA sequence
gggtgagagactaagcaggc

SEQ ID NO: 240419 - DNA, 20 bp, Artificial
  CRISPR gRNA sequence
gagagactaagcaggcaaga

SEQ ID NO: 240420 - DNA, 20 bp, Artificial
  CRISPR gRNA sequence
caggcaagacagactgaact

SEQ ID NO: 240421 - DNA, 20 bp, Artificial
  CRISPR gRNA sequence
tgaactaagctgtcactgaa

SEQ ID NO: 240422 - DNA, 20 bp, Artificial
  CRISPR gRNA sequence
actaagctgtcactgaacag

SEQ ID NO: 240423 - DNA, 20 bp, Artificial
  CRISPR gRNA sequence
ctaagctgtcactgaacaga

SEQ ID NO: 240424 - DNA, 20 bp, Artificial
  CRISPR gRNA sequence
agctgtcactgaacagaagg

SEQ ID NO: 240425 - DNA, 20 bp, Artificial
  CRISPR gRNA sequence
cactgaacagaaggaagcca

SEQ ID NO: 240426 - DNA, 20 bp, Artificial
  CRISPR gRNA sequence
gaacagaaggaagccatgga

SEQ ID NO: 240427 - DNA, 20 bp, Artificial
  CRISPR gRNA sequence
aaggaagccatggaaagctg

SEQ ID NO: 240428 - DNA, 20 bp, Artificial
  CRISPR gRNA sequence
aggaagccatggaaagctgc

SEQ ID NO: 240429 - DNA, 20 bp, Artificial
  CRISPR gRNA sequence
ggaagccatggaaagctgca

SEQ ID NO: 240430 - DNA, 20 bp, Artificial
  CRISPR gRNA sequence
aagccatggaaagctgcagg

SEQ ID NO: 240431 - DNA, 20 bp, Artificial
  CRISPR gRNA sequence
catggaaagctgcagggagc

SEQ ID NO: 240432 - DNA, 20 bp, Artificial
  CRISPR gRNA sequence
gaaagctgcagggagccaga

SEQ ID NO: 240433 - DNA, 20 bp, Artificial
  CRISPR gRNA sequence
ctgcagggagccagatggtc

SEQ ID NO: 240434 - DNA, 20 bp, Artificial
  CRISPR gRNA sequence
cagggagccagatggtcaag

SEQ ID NO: 240435 - DNA, 20 bp, Artificial
  CRISPR gRNA sequence
ggagccagatggtcaagtgg

SEQ ID NO: 240436 - DNA, 20 bp, Artificial
  CRISPR gRNA sequence
ctttgcatcgctttcgaacc

SEQ ID NO: 240437 - DNA, 20 bp, Artificial
  CRISPR gRNA sequence
gacccatatatctttttcac

SEQ ID NO: 240438 - DNA, 20 bp, Artificial
  CRISPR gRNA sequence
acccatatatctttttcact

SEQ ID NO: 240439 - DNA, 20 bp, Artificial
  CRISPR gRNA sequence
ttttcactaggctacttcat

SEQ ID NO: 240440 - DNA, 20 bp, Artificial
  CRISPR gRNA sequence
tttcactaggctacttcatt

SEQ ID NO: 240441 - DNA, 20 bp, Artificial
  CRISPR gRNA sequence
tcattgggtgaaaaatgaca

SEQ ID NO: 240442 - DNA, 20 bp, Artificial
  CRISPR gRNA sequence
aaaatgacaaagttttaaac

SEQ ID NO: 240443 - DNA, 20 bp, Artificial
  CRISPR gRNA sequence
agttttaaaccagaatcttc

SEQ ID NO: 240444 - DNA, 20 bp, Artificial
  CRISPR gRNA sequence
aaccagaatcttctggacct

SEQ ID NO: 240445 - DNA, 20 bp, Artificial
  CRISPR gRNA sequence
ttattttcattgaactgtct

SEQ ID NO: 240446 - DNA, 20 bp, Artificial
  CRISPR gRNA sequence
gaactgtctaagctgttctt

SEQ ID NO: 240447 - DNA, 20 bp, Artificial
  CRISPR gRNA sequence
tgtctaagctgttctttgga

SEQ ID NO: 240448 - DNA, 20 bp, Artificial
  CRISPR gRNA sequence
taagctgttctttggatgga

SEQ ID NO: 240449 - DNA, 20 bp, Artificial
  CRISPR gRNA sequence
ggaaagtctgtgcttgtgaa

SEQ ID NO: 240450 - DNA, 20 bp, Artificial
  CRISPR gRNA sequence
gaaagtctgtgcttgtgaat

SEQ ID NO: 240451 - DNA, 20 bp, Artificial
  CRISPR gRNA sequence
ctgtgcttgtgaatgggacg

SEQ ID NO: 240452 - DNA, 20 bp, Artificial
  CRISPR gRNA sequence
tgtgcttgtgaatgggacga

SEQ ID NO: 240453 - DNA, 20 bp, Artificial
  CRISPR gRNA sequence
tgcttgtgaatgggacgaag

SEQ ID NO: 240454 - DNA, 20 bp, Artificial
  CRISPR gRNA sequence
cttgtgaatgggacgaagga

SEQ ID NO: 240455 - DNA, 20 bp, Artificial
  CRISPR gRNA sequence
ttgtgaatgggacgaaggag

SEQ ID NO: 240456 - DNA, 20 bp, Artificial
  CRISPR gRNA sequence
tgtgaatgggacgaaggaga

SEQ ID NO: 240457 - DNA, 20 bp, Artificial
  CRISPR gRNA sequence
tgggacgaaggagagggacg

SEQ ID NO: 240458 - DNA, 20 bp, Artificial
  CRISPR gRNA sequence
aaggagagggacgtggtctg

SEQ ID NO: 240459 - DNA, 20 bp, Artificial
  CRISPR gRNA sequence
cgtggtctgtggaccatctc

SEQ ID NO: 240460 - DNA, 20 bp, Artificial
  CRISPR gRNA sequence
atctccagccgacctctctc

SEQ ID NO: 240461 - DNA, 20 bp, Artificial
  CRISPR gRNA sequence
tctccagccgacctctctcc

SEQ ID NO: 240462 - DNA, 20 bp, Artificial
  CRISPR gRNA sequence
tccagccgacctctctccgg

SEQ ID NO: 240463 - DNA, 20 bp, Artificial
  CRISPR gRNA sequence
gtgaccccgcctgcccctgc

SEQ ID NO: 240464 - DNA, 20 bp, Artificial
  CRISPR gRNA sequence
gaccccgcctgcccctgcga

SEQ ID NO: 240465 - DNA, 20 bp, Artificial
  CRISPR gRNA sequence
ccccgcctgcccctgcgaga

SEQ ID NO: 240466 - DNA, 20 bp, Artificial
  CRISPR gRNA sequence
gcctgcccctgcgagagagc

SEQ ID NO: 240467 - DNA, 20 bp, Artificial
  CRISPR gRNA sequence
cctgcccctgcgagagagcc

SEQ ID NO: 240468 - DNA, 20 bp, Artificial
  CRISPR gRNA sequence
ctgcgagagagccaggtaac

SEQ ID NO: 240469 - DNA, 20 bp, Artificial
  CRISPR gRNA sequence
tgcgagagagccaggtaact

SEQ ID NO: 240470 - DNA, 20 bp, Artificial
  CRISPR gRNA sequence
tgggctatgcctttacgcca

SEQ ID NO: 240471 - DNA, 20 bp, Artificial
  CRISPR gRNA sequence
acgccaaagtgcgtatctta

SEQ ID NO: 240472 - DNA, 20 bp, Artificial
  CRISPR gRNA sequence
tgcgtatcttatggtgattc

SEQ ID NO: 240473 - DNA, 20 bp, Artificial
  CRISPR gRNA sequence
aatatcatgatatctcatat

SEQ ID NO: 240474 - DNA, 20 bp, Artificial
  CRISPR gRNA sequence
atatcatgatatctcatatc

SEQ ID NO: 240475 - DNA, 20 bp, Artificial
  CRISPR gRNA sequence
ttcttcctgaatcctgccct

SEQ ID NO: 240476 - DNA, 20 bp, Artificial
  CRISPR gRNA sequence
tcttcctgaatcctgccctc

SEQ ID NO: 240477 - DNA, 20 bp, Artificial
  CRISPR gRNA sequence
cttcctgaatcctgccctca

SEQ ID NO: 240478 - DNA, 20 bp, Artificial
  CRISPR gRNA sequence
gaatcctgccctcagggacc

SEQ ID NO: 240479 - DNA, 20 bp, Artificial
  CRISPR gRNA sequence
tcctgccctcagggacccag

SEQ ID NO: 240480 - DNA, 20 bp, Artificial
  CRISPR gRNA sequence
ggacccagcagttttcttcc

SEQ ID NO: 240481 - DNA, 20 bp, Artificial
  CRISPR gRNA sequence
gacccagcagttttcttccc

SEQ ID NO: 240482 - DNA, 20 bp, Artificial
  CRISPR gRNA sequence
cttcccaggcatttgttatt

SEQ ID NO: 240483 - DNA, 20 bp, Artificial
  CRISPR gRNA sequence
aggcatttgttattcagtct

SEQ ID NO: 240484 - DNA, 20 bp, Artificial
  CRISPR gRNA sequence
agtctgagatacacatttgt

SEQ ID NO: 240485 - DNA, 20 bp, Artificial
  CRISPR gRNA sequence
ctgagatacacatttgtaag

SEQ ID NO: 240486 - DNA, 20 bp, Artificial
  CRISPR gRNA sequence
tacacatttgtaagcggtgc

SEQ ID NO: 240487 - DNA, 20 bp, Artificial
  CRISPR gRNA sequence
cacatttgtaagcggtgcca

SEQ ID NO: 240488 - DNA, 20 bp, Artificial
  CRISPR gRNA sequence
acatttgtaagcggtgccag

SEQ ID NO: 240489 - DNA, 20 bp, Artificial
  CRISPR gRNA sequence
cagaggacacttcacccaaa

SEQ ID NO: 240490 - DNA, 20 bp, Artificial
  CRISPR gRNA sequence
gaggacacttcacccaaaca

SEQ ID NO: 240491 - DNA, 20 bp, Artificial
  CRISPR gRNA sequence
tctatatctttatcaatgcc

SEQ ID NO: 240492 - DNA, 20 bp, Artificial
  CRISPR gRNA sequence
ctatatctttatcaatgcca

SEQ ID NO: 240493 - DNA, 20 bp, Artificial
  CRISPR gRNA sequence
atctttatcaatgccaagga

SEQ ID NO: 240494 - DNA, 20 bp, Artificial
  CRISPR gRNA sequence
tctttatcaatgccaaggaa

SEQ ID NO: 240495 - DNA, 20 bp, Artificial
  CRISPR gRNA sequence
ctttatcaatgccaaggaaa

SEQ ID NO: 240496 - DNA, 20 bp, Artificial
  CRISPR gRNA sequence
tttatcaatgccaaggaaag

SEQ ID NO: 240497 - DNA, 20 bp, Artificial
  CRISPR gRNA sequence
atgccaaggaaaggggatta

SEQ ID NO: 240498 - DNA, 20 bp, Artificial
  CRISPR gRNA sequence
tgccaaggaaaggggattat

SEQ ID NO: 240499 - DNA, 20 bp, Artificial
  CRISPR gRNA sequence
gccaaggaaaggggattata

SEQ ID NO: 240500 - DNA, 20 bp, Artificial
  CRISPR gRNA sequence
ttttctttttttttgttttt

SEQ ID NO: 240501 - DNA, 20 bp, Artificial
  CRISPR gRNA sequence
ttctttttttttgtttttaa

SEQ ID NO: 240502 - DNA, 20 bp, Artificial
  CRISPR gRNA sequence
ctttttttttgtttttaaga

SEQ ID NO: 240503 - DNA, 20 bp, Artificial
  CRISPR gRNA sequence
gagagtgtcttgctctgtgc

SEQ ID NO: 240504 - DNA, 20 bp, Artificial
  CRISPR gRNA sequence
agagtgtcttgctctgtgcc

SEQ ID NO: 240505 - DNA, 20 bp, Artificial
  CRISPR gRNA sequence
tgtcttgctctgtgccaggc

SEQ ID NO: 240506 - DNA, 20 bp, Artificial
  CRISPR gRNA sequence
tcttgctctgtgccaggctg

SEQ ID NO: 240507 - DNA, 20 bp, Artificial
  CRISPR gRNA sequence
ctctgtgccaggctggagtg

SEQ ID NO: 240508 - DNA, 20 bp, Artificial
  CRISPR gRNA sequence
tgtgccaggctggagtgcag

SEQ ID NO: 240509 - DNA, 20 bp, Artificial
  CRISPR gRNA sequence
caggctggagtgcagtggtg

SEQ ID NO: 240510 - DNA, 20 bp, Artificial
  CRISPR gRNA sequence
ggagtgcagtggtgcagtct

SEQ ID NO: 240511 - DNA, 20 bp, Artificial
  CRISPR gRNA sequence
tcactgcaatctccacctcc

SEQ ID NO: 240512 - DNA, 20 bp, Artificial
  CRISPR gRNA sequence
cactgcaatctccacctcct

SEQ ID NO: 240513 - DNA, 20 bp, Artificial
  CRISPR gRNA sequence
aatctccacctcctgggttc

SEQ ID NO: 240514 - DNA, 20 bp, Artificial
  CRISPR gRNA sequence
ttcaagtgattctcctgcct

SEQ ID NO: 240515 - DNA, 20 bp, Artificial
  CRISPR gRNA sequence
ttctcctgcctcagcctccc

SEQ ID NO: 240516 - DNA, 20 bp, Artificial
  CRISPR gRNA sequence
tcctgcctcagcctcccaag

SEQ ID NO: 240517 - DNA, 20 bp, Artificial
  CRISPR gRNA sequence
gcctcagcctcccaagtagc

SEQ ID NO: 240518 - DNA, 20 bp, Artificial
  CRISPR gRNA sequence
cctcagcctcccaagtagct

SEQ ID NO: 240519 - DNA, 20 bp, Artificial
  CRISPR gRNA sequence
ctcccaagtagctgggatta

SEQ ID NO: 240520 - DNA, 20 bp, Artificial
  CRISPR gRNA sequence
tcccaagtagctgggattat

SEQ ID NO: 240521 - DNA, 20 bp, Artificial
  CRISPR gRNA sequence
taggcatgcaccaccacgcc

SEQ ID NO: 240522 - DNA, 20 bp, Artificial
  CRISPR gRNA sequence
ccggctaatttttgtatttt

SEQ ID NO: 240523 - DNA, 20 bp, Artificial
  CRISPR gRNA sequence
gctaatttttgtatttttag

SEQ ID NO: 240524 - DNA, 20 bp, Artificial
  CRISPR gRNA sequence
taatttttgtatttttagta

SEQ ID NO: 240525 - DNA, 20 bp, Artificial
  CRISPR gRNA sequence
tttgtatttttagtagagat

SEQ ID NO: 240526 - DNA, 20 bp, Artificial
  CRISPR gRNA sequence
ttgtatttttagtagagatg

SEQ ID NO: 240527 - DNA, 20 bp, Artificial
  CRISPR gRNA sequence
gagatgaggtttcaccatgc

SEQ ID NO: 240528 - DNA, 20 bp, Artificial
  CRISPR gRNA sequence
tgaggtttcaccatgctggc

SEQ ID NO: 240529 - DNA, 20 bp, Artificial
  CRISPR gRNA sequence
tttcaccatgctggccagtc

SEQ ID NO: 240530 - DNA, 20 bp, Artificial
  CRISPR gRNA sequence
accgcatgatccgcccacct

SEQ ID NO: 240531 - DNA, 20 bp, Artificial
  CRISPR gRNA sequence
ccgcccacctcggcctccca

SEQ ID NO: 240532 - DNA, 20 bp, Artificial
  CRISPR gRNA sequence
acctcggcctcccaaagtgc

SEQ ID NO: 240533 - DNA, 20 bp, Artificial
  CRISPR gRNA sequence
cctcggcctcccaaagtgct

SEQ ID NO: 240534 - DNA, 20 bp, Artificial
  CRISPR gRNA sequence
ctcccaaagtgctgggatta

SEQ ID NO: 240535 - DNA, 20 bp, Artificial
  CRISPR gRNA sequence
tcccaaagtgctgggattac

SEQ ID NO: 240536 - DNA, 20 bp, Artificial
  CRISPR gRNA sequence
agtgctgggattacaggtgt

SEQ ID NO: 240537 - DNA, 20 bp, Artificial
  CRISPR gRNA sequence
tgtgagccaccacgcccgtc

SEQ ID NO: 240538 - DNA, 20 bp, Artificial
  CRISPR gRNA sequence
gtgagccaccacgcccgtcc

SEQ ID NO: 240539 - DNA, 20 bp, Artificial
  CRISPR gRNA sequence
tgagccaccacgcccgtcca

SEQ ID NO: 240540 - DNA, 20 bp, Artificial
  CRISPR gRNA sequence
tctcgctttttttttccccc

SEQ ID NO: 240541 - DNA, 20 bp, Artificial
  CRISPR gRNA sequence
tcgctttttttttcccccga

SEQ ID NO: 240542 - DNA, 20 bp, Artificial
  CRISPR gRNA sequence
gagagtgccttgttctgtgc

SEQ ID NO: 240543 - DNA, 20 bp, Artificial
  CRISPR gRNA sequence
agagtgccttgttctgtgcc

SEQ ID NO: 240544 - DNA, 20 bp, Artificial
  CRISPR gRNA sequence
tgccttgttctgtgccaggc

SEQ ID NO: 240545 - DNA, 20 bp, Artificial
  CRISPR gRNA sequence
ccttgttctgtgccaggctg

SEQ ID NO: 240546 - DNA, 20 bp, Artificial
  CRISPR gRNA sequence
ttctgtgccaggctggagtg

SEQ ID NO: 240547 - DNA, 20 bp, Artificial
  CRISPR gRNA sequence
tgtgccaggctggagtgcag

SEQ ID NO: 240548 - DNA, 20 bp, Artificial
  CRISPR gRNA sequence
ggagtgcagtggcttgatat

SEQ ID NO: 240549 - DNA, 20 bp, Artificial
  CRISPR gRNA sequence
ctcaaccaatcctcccacct

SEQ ID NO: 240550 - DNA, 20 bp, Artificial
  CRISPR gRNA sequence
tcctcccacctcagcctccc

SEQ ID NO: 240551 - DNA, 20 bp, Artificial
  CRISPR gRNA sequence
tcccacctcagcctccccag

SEQ ID NO: 240552 - DNA, 20 bp, Artificial
  CRISPR gRNA sequence
acctcagcctccccagtagc

SEQ ID NO: 240553 - DNA, 20 bp, Artificial
  CRISPR gRNA sequence
cctcagcctccccagtagct

SEQ ID NO: 240554 - DNA, 20 bp, Artificial
  CRISPR gRNA sequence
ctccccagtagctgggacta

SEQ ID NO: 240555 - DNA, 20 bp, Artificial
  CRISPR gRNA sequence
tccccagtagctgggactat

SEQ ID NO: 240556 - DNA, 20 bp, Artificial
  CRISPR gRNA sequence
taggcactcaccactacacc

SEQ ID NO: 240557 - DNA, 20 bp, Artificial
  CRISPR gRNA sequence
tggctaattttttatttttt

SEQ ID NO: 240558 - DNA, 20 bp, Artificial
  CRISPR gRNA sequence
ctaattttttatttttttgg

SEQ ID NO: 240559 - DNA, 20 bp, Artificial
  CRISPR gRNA sequence
aattttttatttttttggca

SEQ ID NO: 240560 - DNA, 20 bp, Artificial
  CRISPR gRNA sequence
ttttatttttttggcagagt

SEQ ID NO: 240561 - DNA, 20 bp, Artificial
  CRISPR gRNA sequence
tttatttttttggcagagtc

SEQ ID NO: 240562 - DNA, 20 bp, Artificial
  CRISPR gRNA sequence
ttatttttttggcagagtcg

SEQ ID NO: 240563 - DNA, 20 bp, Artificial
  CRISPR gRNA sequence
cggggtcttgctatgttgct

SEQ ID NO: 240564 - DNA, 20 bp, Artificial
  CRISPR gRNA sequence
ggggtcttgctatgttgctc

SEQ ID NO: 240565 - DNA, 20 bp, Artificial
  CRISPR gRNA sequence
tcaggctgctctcaaactct

SEQ ID NO: 240566 - DNA, 20 bp, Artificial
  CRISPR gRNA sequence
caggctgctctcaaactctt

SEQ ID NO: 240567 - DNA, 20 bp, Artificial
  CRISPR gRNA sequence
gctctcaaactcttgggctc

SEQ ID NO: 240568 - DNA, 20 bp, Artificial
  CRISPR gRNA sequence
ctcaagcaatcctcctgcct

SEQ ID NO: 240569 - DNA, 20 bp, Artificial
  CRISPR gRNA sequence
tcaagcaatcctcctgcctt

SEQ ID NO: 240570 - DNA, 20 bp, Artificial
  CRISPR gRNA sequence
cctcctgccttgggctccca

SEQ ID NO: 240571 - DNA, 20 bp, Artificial
  CRISPR gRNA sequence
gccttgggctcccaaagtgt

SEQ ID NO: 240572 - DNA, 20 bp, Artificial
  CRISPR gRNA sequence
ccttgggctcccaaagtgtt

SEQ ID NO: 240573 - DNA, 20 bp, Artificial
  CRISPR gRNA sequence
ctcccaaagtgttgggatta

SEQ ID NO: 240574 - DNA, 20 bp, Artificial
  CRISPR gRNA sequence
tcccaaagtgttgggattac

SEQ ID NO: 240575 - DNA, 20 bp, Artificial
  CRISPR gRNA sequence
agtgttgggattacaggcat

SEQ ID NO: 240576 - DNA, 20 bp, Artificial
  CRISPR gRNA sequence
caggcataagccgccacgcc

SEQ ID NO: 240577 - DNA, 20 bp, Artificial
  CRISPR gRNA sequence
aagccgccacgcctggtccc

SEQ ID NO: 240578 - DNA, 20 bp, Artificial
  CRISPR gRNA sequence
agccgccacgcctggtcccc

SEQ ID NO: 240579 - DNA, 20 bp, Artificial
  CRISPR gRNA sequence
gtcccatattttctatgtgc

SEQ ID NO: 240580 - DNA, 20 bp, Artificial
  CRISPR gRNA sequence
catattttctatgtgctaga

SEQ ID NO: 240581 - DNA, 20 bp, Artificial
  CRISPR gRNA sequence
atattttctatgtgctagaa

SEQ ID NO: 240582 - DNA, 20 bp, Artificial
  CRISPR gRNA sequence
ggataaactgctcaattatt

SEQ ID NO: 240583 - DNA, 20 bp, Artificial
  CRISPR gRNA sequence
ttaagtttcttttatttttt

SEQ ID NO: 240584 - DNA, 20 bp, Artificial
  CRISPR gRNA sequence
taagtttcttttattttttt

SEQ ID NO: 240585 - DNA, 20 bp, Artificial
  CRISPR gRNA sequence
aagtttcttttatttttttg

SEQ ID NO: 240586 - DNA, 20 bp, Artificial
  CRISPR gRNA sequence
agtttcttttatttttttgg

SEQ ID NO: 240587 - DNA, 20 bp, Artificial
  CRISPR gRNA sequence
gtttcttttatttttttggg

SEQ ID NO: 240588 - DNA, 20 bp, Artificial
  CRISPR gRNA sequence
tttcttttatttttttgggg

SEQ ID NO: 240589 - DNA, 20 bp, Artificial
  CRISPR gRNA sequence
cttttatttttttggggggg

SEQ ID NO: 240590 - DNA, 20 bp, Artificial
  CRISPR gRNA sequence
tatttttttgggggggtgga

SEQ ID NO: 240591 - DNA, 20 bp, Artificial
  CRISPR gRNA sequence
tttttttgggggggtggaca

SEQ ID NO: 240592 - DNA, 20 bp, Artificial
  CRISPR gRNA sequence
cagagtctctctctgtcacc

SEQ ID NO: 240593 - DNA, 20 bp, Artificial
  CRISPR gRNA sequence
agagtctctctctgtcaccc

SEQ ID NO: 240594 - DNA, 20 bp, Artificial
  CRISPR gRNA sequence
tctctctctgtcacccaggc

SEQ ID NO: 240595 - DNA, 20 bp, Artificial
  CRISPR gRNA sequence
tctctctgtcacccaggctg

SEQ ID NO: 240596 - DNA, 20 bp, Artificial
  CRISPR gRNA sequence
tcacccaggctggagtgcaa

SEQ ID NO: 240597 - DNA, 20 bp, Artificial
  CRISPR gRNA sequence
ggagtgcaatggcgcaatct

SEQ ID NO: 240598 - DNA, 20 bp, Artificial
  CRISPR gRNA sequence
tcactgcaacctctacctcc

SEQ ID NO: 240599 - DNA, 20 bp, Artificial
  CRISPR gRNA sequence
cactgcaacctctacctccc

SEQ ID NO: 240600 - DNA, 20 bp, Artificial
  CRISPR gRNA sequence
aacctctacctcccaggttc

SEQ ID NO: 240601 - DNA, 20 bp, Artificial
  CRISPR gRNA sequence
ttcaagcgattctcctgact

SEQ ID NO: 240602 - DNA, 20 bp, Artificial
  CRISPR gRNA sequence
ttctcctgactcagcctcct

SEQ ID NO: 240603 - DNA, 20 bp, Artificial
  CRISPR gRNA sequence
tcctgactcagcctcctgag

SEQ ID NO: 240604 - DNA, 20 bp, Artificial
  CRISPR gRNA sequence
gactcagcctcctgagtagc

SEQ ID NO: 240605 - DNA, 20 bp, Artificial
  CRISPR gRNA sequence
actcagcctcctgagtagct

SEQ ID NO: 240606 - DNA, 20 bp, Artificial
  CRISPR gRNA sequence
ctcctgagtagctgggatta

SEQ ID NO: 240607 - DNA, 20 bp, Artificial
  CRISPR gRNA sequence
tcctgagtagctgggattac

SEQ ID NO: 240608 - DNA, 20 bp, Artificial
  CRISPR gRNA sequence
gggattacaggcgcccacca

SEQ ID NO: 240609 - DNA, 20 bp, Artificial
  CRISPR gRNA sequence
caggcgcccaccacggcacc

SEQ ID NO: 240610 - DNA, 20 bp, Artificial
  CRISPR gRNA sequence
ccagctaatttttgtatttt

SEQ ID NO: 240611 - DNA, 20 bp, Artificial
  CRISPR gRNA sequence
gctaatttttgtatttttag

SEQ ID NO: 240612 - DNA, 20 bp, Artificial
  CRISPR gRNA sequence
taatttttgtatttttagta

SEQ ID NO: 240613 - DNA, 20 bp, Artificial
  CRISPR gRNA sequence
ttttgtatttttagtagaga

SEQ ID NO: 240614 - DNA, 20 bp, Artificial
  CRISPR gRNA sequence
ttgtatttttagtagagatg

SEQ ID NO: 240615 - DNA, 20 bp, Artificial
  CRISPR gRNA sequence
gagatggagtttctccatgt

SEQ ID NO: 240616 - DNA, 20 bp, Artificial
  CRISPR gRNA sequence
tggagtttctccatgttggc

SEQ ID NO: 240617 - DNA, 20 bp, Artificial
  CRISPR gRNA sequence
ggagtttctccatgttggcc

SEQ ID NO: 240618 - DNA, 20 bp, Artificial
  CRISPR gRNA sequence
tttctccatgttggccaggc

SEQ ID NO: 240619 - DNA, 20 bp, Artificial
  CRISPR gRNA sequence
tggtttcaaactcttgacct

SEQ ID NO: 240620 - DNA, 20 bp, Artificial
  CRISPR gRNA sequence
ggtttcaaactcttgacctc

SEQ ID NO: 240621 - DNA, 20 bp, Artificial
  CRISPR gRNA sequence
ctcaggtgatctgcccacct

SEQ ID NO: 240622 - DNA, 20 bp, Artificial
  CRISPR gRNA sequence
ctgcccaccttggcctccca

SEQ ID NO: 240623 - DNA, 20 bp, Artificial
  CRISPR gRNA sequence
accttggcctcccaaagtgc

SEQ ID NO: 240624 - DNA, 20 bp, Artificial
  CRISPR gRNA sequence
ccttggcctcccaaagtgct

SEQ ID NO: 240625 - DNA, 20 bp, Artificial
  CRISPR gRNA sequence
ctcccaaagtgctaggatta

SEQ ID NO: 240626 - DNA, 20 bp, Artificial
  CRISPR gRNA sequence
tcccaaagtgctaggattac

SEQ ID NO: 240627 - DNA, 20 bp, Artificial
  CRISPR gRNA sequence
agtgctaggattacaggtgt

SEQ ID NO: 240628 - DNA, 20 bp, Artificial
  CRISPR gRNA sequence
agccaccgctccctgccatt

SEQ ID NO: 240629 - DNA, 20 bp, Artificial
  CRISPR gRNA sequence
ttctttcttttctttttttt

SEQ ID NO: 240630 - DNA, 20 bp, Artificial
  CRISPR gRNA sequence
ttcttttcttttttttgaga

SEQ ID NO: 240631 - DNA, 20 bp, Artificial
  CRISPR gRNA sequence
cttttcttttttttgagatg

SEQ ID NO: 240632 - DNA, 20 bp, Artificial
  CRISPR gRNA sequence
tggagtctcactctgttgcc

SEQ ID NO: 240633 - DNA, 20 bp, Artificial
  CRISPR gRNA sequence
ggagtctcactctgttgccc

SEQ ID NO: 240634 - DNA, 20 bp, Artificial
  CRISPR gRNA sequence
tctcactctgttgcccaggt

SEQ ID NO: 240635 - DNA, 20 bp, Artificial
  CRISPR gRNA sequence
tcactctgttgcccaggttg

SEQ ID NO: 240636 - DNA, 20 bp, Artificial
  CRISPR gRNA sequence
ctgttgcccaggttggagtg

SEQ ID NO: 240637 - DNA, 20 bp, Artificial
  CRISPR gRNA sequence
ttgcccaggttggagtgcag

SEQ ID NO: 240638 - DNA, 20 bp, Artificial
  CRISPR gRNA sequence
ggagtgcagtggcaccatct

SEQ ID NO: 240639 - DNA, 20 bp, Artificial
  CRISPR gRNA sequence
tcactgcaacctccgcctcc

SEQ ID NO: 240640 - DNA, 20 bp, Artificial
  CRISPR gRNA sequence
cactgcaacctccgcctccc

SEQ ID NO: 240641 - DNA, 20 bp, Artificial
  CRISPR gRNA sequence
aacctccgcctcccgggttc

SEQ ID NO: 240642 - DNA, 20 bp, Artificial
  CRISPR gRNA sequence
ttctcctgcctcatcctgcc

SEQ ID NO: 240643 - DNA, 20 bp, Artificial
  CRISPR gRNA sequence
tcctgcctcatcctgccaag

SEQ ID NO: 240644 - DNA, 20 bp, Artificial
  CRISPR gRNA sequence
gcctcatcctgccaagtagc

SEQ ID NO: 240645 - DNA, 20 bp, Artificial
  CRISPR gRNA sequence
cctcatcctgccaagtagct

SEQ ID NO: 240646 - DNA, 20 bp, Artificial
  CRISPR gRNA sequence
tgccaagtagctgggattac

SEQ ID NO: 240647 - DNA, 20 bp, Artificial
  CRISPR gRNA sequence
agttcctgccaccactatgt

SEQ ID NO: 240648 - DNA, 20 bp, Artificial
  CRISPR gRNA sequence
cctgccaccactatgttggc

SEQ ID NO: 240649 - DNA, 20 bp, Artificial
  CRISPR gRNA sequence
ctgccaccactatgttggcc

SEQ ID NO: 240650 - DNA, 20 bp, Artificial
  CRISPR gRNA sequence
caccactatgttggccaggc

SEQ ID NO: 240651 - DNA, 20 bp, Artificial
  CRISPR gRNA sequence
ggtcttgaactcctgactct

SEQ ID NO: 240652 - DNA, 20 bp, Artificial
  CRISPR gRNA sequence
tctaagtgatcctcctgcct

SEQ ID NO: 240653 - DNA, 20 bp, Artificial
  CRISPR gRNA sequence
cctcctgcctcggccttcca

SEQ ID NO: 240654 - DNA, 20 bp, Artificial
  CRISPR gRNA sequence
gcctcggccttccaaagtgt

SEQ ID NO: 240655 - DNA, 20 bp, Artificial
  CRISPR gRNA sequence
cctcggccttccaaagtgtt

SEQ ID NO: 240656 - DNA, 20 bp, Artificial
  CRISPR gRNA sequence
cttccaaagtgttgggatta

SEQ ID NO: 240657 - DNA, 20 bp, Artificial
  CRISPR gRNA sequence
ttccaaagtgttgggattac

SEQ ID NO: 240658 - DNA, 20 bp, Artificial
  CRISPR gRNA sequence
agtgttgggattacaggcgt

SEQ ID NO: 240659 - DNA, 20 bp, Artificial
  CRISPR gRNA sequence
caggcgtgagccaccatgtc

SEQ ID NO: 240660 - DNA, 20 bp, Artificial
  CRISPR gRNA sequence
accatgtctggcctctttaa

SEQ ID NO: 240661 - DNA, 20 bp, Artificial
  CRISPR gRNA sequence
ggcctctttaaaagttttct

SEQ ID NO: 240662 - DNA, 20 bp, Artificial
  CRISPR gRNA sequence
gttttctaagtttactccat

SEQ ID NO: 240663 - DNA, 20 bp, Artificial
  CRISPR gRNA sequence
ttctaagtttactccattag

SEQ ID NO: 240664 - DNA, 20 bp, Artificial
  CRISPR gRNA sequence
tctaagtttactccattagc

SEQ ID NO: 240665 - DNA, 20 bp, Artificial
  CRISPR gRNA sequence
agtttactccattagcaggt

SEQ ID NO: 240666 - DNA, 20 bp, Artificial
  CRISPR gRNA sequence
tttactccattagcaggttg

SEQ ID NO: 240667 - DNA, 20 bp, Artificial
  CRISPR gRNA sequence
ttagcaggttggagatgccc

SEQ ID NO: 240668 - DNA, 20 bp, Artificial
  CRISPR gRNA sequence
tagcaggttggagatgccca

SEQ ID NO: 240669 - DNA, 20 bp, Artificial
  CRISPR gRNA sequence
gctgtgattcttctcatgct

SEQ ID NO: 240670 - DNA, 20 bp, Artificial
  CRISPR gRNA sequence
taccaatgtaaatatataca

SEQ ID NO: 240671 - DNA, 20 bp, Artificial
  CRISPR gRNA sequence
accaatgtaaatatatacat

SEQ ID NO: 240672 - DNA, 20 bp, Artificial
  CRISPR gRNA sequence
aaatatatacatgggtgtat

SEQ ID NO: 240673 - DNA, 20 bp, Artificial
  CRISPR gRNA sequence
tctccttttgctgtgttttg

SEQ ID NO: 240674 - DNA, 20 bp, Artificial
  CRISPR gRNA sequence
ctccttttgctgtgttttgc

SEQ ID NO: 240675 - DNA, 20 bp, Artificial
  CRISPR gRNA sequence
gttttgcaggacactctccg

SEQ ID NO: 240676 - DNA, 20 bp, Artificial
  CRISPR gRNA sequence
tccgtttctctgttgttaaa

SEQ ID NO: 240677 - DNA, 20 bp, Artificial
  CRISPR gRNA sequence
ccgtttctctgttgttaaac

SEQ ID NO: 240678 - DNA, 20 bp, Artificial
  CRISPR gRNA sequence
cgtttctctgttgttaaacg

SEQ ID NO: 240679 - DNA, 20 bp, Artificial
  CRISPR gRNA sequence
ttctctgttgttaaacgggg

SEQ ID NO: 240680 - DNA, 20 bp, Artificial
  CRISPR gRNA sequence
ctgttgttaaacggggcaga

SEQ ID NO: 240681 - DNA, 20 bp, Artificial
  CRISPR gRNA sequence
tgtatatattcaaacaacgt

SEQ ID NO: 240682 - DNA, 20 bp, Artificial
  CRISPR gRNA sequence
agattaacataatcatatta

SEQ ID NO: 240683 - DNA, 20 bp, Artificial
  CRISPR gRNA sequence
acataatcatattacagctc

SEQ ID NO: 240684 - DNA, 20 bp, Artificial
  CRISPR gRNA sequence
aatcatattacagctctggc

SEQ ID NO: 240685 - DNA, 20 bp, Artificial
  CRISPR gRNA sequence
atcatattacagctctggca

SEQ ID NO: 240686 - DNA, 20 bp, Artificial
  CRISPR gRNA sequence
tattacagctctggcaaggc

SEQ ID NO: 240687 - DNA, 20 bp, Artificial
  CRISPR gRNA sequence
attacagctctggcaaggca

SEQ ID NO: 240688 - DNA, 20 bp, Artificial
  CRISPR gRNA sequence
caaggcaaggctttttataa

SEQ ID NO: 240689 - DNA, 20 bp, Artificial
  CRISPR gRNA sequence
gcaaggctttttataataga

SEQ ID NO: 240690 - DNA, 20 bp, Artificial
  CRISPR gRNA sequence
caaggctttttataatagaa

SEQ ID NO: 240691 - DNA, 20 bp, Artificial
  CRISPR gRNA sequence
tatgattttaaaaaaaattc

SEQ ID NO: 240692 - DNA, 20 bp, Artificial
  CRISPR gRNA sequence
ttaaaaaaaattctagaaat

SEQ ID NO: 240693 - DNA, 20 bp, Artificial
  CRISPR gRNA sequence
taaaaaaaattctagaaatg

SEQ ID NO: 240694 - DNA, 20 bp, Artificial
  CRISPR gRNA sequence
ttctagaaatgaggttcata

SEQ ID NO: 240695 - DNA, 20 bp, Artificial
  CRISPR gRNA sequence
atgaggttcatatagccccg

SEQ ID NO: 240696 - DNA, 20 bp, Artificial
  CRISPR gRNA sequence
atagccccgtggctatcacg

SEQ ID NO: 240697 - DNA, 20 bp, Artificial
  CRISPR gRNA sequence
tagccccgtggctatcacgc

SEQ ID NO: 240698 - DNA, 20 bp, Artificial
  CRISPR gRNA sequence
agccccgtggctatcacgca

SEQ ID NO: 240699 - DNA, 20 bp, Artificial
  CRISPR gRNA sequence
gccccgtggctatcacgcag

SEQ ID NO: 240700 - DNA, 20 bp, Artificial
  CRISPR gRNA sequence
cgcaggggcaatttcgtccc

SEQ ID NO: 240701 - DNA, 20 bp, Artificial
  CRISPR gRNA sequence
gcaggggcaatttcgtccct

SEQ ID NO: 240702 - DNA, 20 bp, Artificial
  CRISPR gRNA sequence
ttcgtccctgggaatatttg

SEQ ID NO: 240703 - DNA, 20 bp, Artificial
  CRISPR gRNA sequence
ctgggaatatttgcagtgtc

SEQ ID NO: 240704 - DNA, 20 bp, Artificial
  CRISPR gRNA sequence
gggaatatttgcagtgtctg

SEQ ID NO: 240705 - DNA, 20 bp, Artificial
  CRISPR gRNA sequence
atatttgcagtgtctggaga

SEQ ID NO: 240706 - DNA, 20 bp, Artificial
  CRISPR gRNA sequence
gcagtgtctggagacagttg

SEQ ID NO: 240707 - DNA, 20 bp, Artificial
  CRISPR gRNA sequence
cagttgcagtgttcaccgct

SEQ ID NO: 240708 - DNA, 20 bp, Artificial
  CRISPR gRNA sequence
ttgcagtgttcaccgctcgg

SEQ ID NO: 240709 - DNA, 20 bp, Artificial
  CRISPR gRNA sequence
tgttcaccgctcggtggtga

SEQ ID NO: 240710 - DNA, 20 bp, Artificial
  CRISPR gRNA sequence
tcaccgctcggtggtgatgg

SEQ ID NO: 240711 - DNA, 20 bp, Artificial
  CRISPR gRNA sequence
tcggtggtgatggtggtgat

SEQ ID NO: 240712 - DNA, 20 bp, Artificial
  CRISPR gRNA sequence
cggtggtgatggtggtgatt

SEQ ID NO: 240713 - DNA, 20 bp, Artificial
  CRISPR gRNA sequence
ggtggtgatggtggtgatta

SEQ ID NO: 240714 - DNA, 20 bp, Artificial
  CRISPR gRNA sequence
gtggtgatggtggtgattag

SEQ ID NO: 240715 - DNA, 20 bp, Artificial
  CRISPR gRNA sequence
tgattaggggctattgcatc

SEQ ID NO: 240716 - DNA, 20 bp, Artificial
  CRISPR gRNA sequence
taggggctattgcatctagt

SEQ ID NO: 240717 - DNA, 20 bp, Artificial
  CRISPR gRNA sequence
gggctattgcatctagtgag

SEQ ID NO: 240718 - DNA, 20 bp, Artificial
  CRISPR gRNA sequence
gctattgcatctagtgagta

SEQ ID NO: 240719 - DNA, 20 bp, Artificial
  CRISPR gRNA sequence
ctattgcatctagtgagtag

SEQ ID NO: 240720 - DNA, 20 bp, Artificial
  CRISPR gRNA sequence
tgcatctagtgagtagaggt

SEQ ID NO: 240721 - DNA, 20 bp, Artificial
  CRISPR gRNA sequence
tgctcaactcctaccgtgca

SEQ ID NO: 240722 - DNA, 20 bp, Artificial
  CRISPR gRNA sequence
gctcaactcctaccgtgcac

SEQ ID NO: 240723 - DNA, 20 bp, Artificial
  CRISPR gRNA sequence
aactcctaccgtgcacggga

SEQ ID NO: 240724 - DNA, 20 bp, Artificial
  CRISPR gRNA sequence
ccgtgcacgggacagcctcc

SEQ ID NO: 240725 - DNA, 20 bp, Artificial
  CRISPR gRNA sequence
cacgggacagcctcccagca

SEQ ID NO: 240726 - DNA, 20 bp, Artificial
  CRISPR gRNA sequence
gatgctgccccaaatgtcaa

SEQ ID NO: 240727 - DNA, 20 bp, Artificial
  CRISPR gRNA sequence
ccccaaatgtcaatagtgct

SEQ ID NO: 240728 - DNA, 20 bp, Artificial
  CRISPR gRNA sequence
cccaaatgtcaatagtgctg

SEQ ID NO: 240729 - DNA, 20 bp, Artificial
  CRISPR gRNA sequence
aaatgtcaatagtgctgagg

SEQ ID NO: 240730 - DNA, 20 bp, Artificial
  CRISPR gRNA sequence
atgtcaatagtgctgaggtg

SEQ ID NO: 240731 - DNA, 20 bp, Artificial
  CRISPR gRNA sequence
caatagtgctgaggtggaga

SEQ ID NO: 240732 - DNA, 20 bp, Artificial
  CRISPR gRNA sequence
aggtggagaaagcttgcata

SEQ ID NO: 240733 - DNA, 20 bp, Artificial
  CRISPR gRNA sequence
tggagaaagcttgcatatag

SEQ ID NO: 240734 - DNA, 20 bp, Artificial
  CRISPR gRNA sequence
gagaaagcttgcatatagaa

SEQ ID NO: 240735 - DNA, 20 bp, Artificial
  CRISPR gRNA sequence
gcatatagaagagcacacct

SEQ ID NO: 240736 - DNA, 20 bp, Artificial
  CRISPR gRNA sequence
agaagagcacacctcggttc

SEQ ID NO: 240737 - DNA, 20 bp, Artificial
  CRISPR gRNA sequence
cctcggttctagaaaaatga

SEQ ID NO: 240738 - DNA, 20 bp, Artificial
  CRISPR gRNA sequence
tgacagatttaaatatgctg

SEQ ID NO: 240739 - DNA, 20 bp, Artificial
  CRISPR gRNA sequence
atttaaatatgctgcagcct

SEQ ID NO: 240740 - DNA, 20 bp, Artificial
  CRISPR gRNA sequence
tgtatgtgtgtgtgtgcgtg

SEQ ID NO: 240741 - DNA, 20 bp, Artificial
  CRISPR gRNA sequence
tatgtgtgtgtgtgcgtgtg

SEQ ID NO: 240742 - DNA, 20 bp, Artificial
  CRISPR gRNA sequence
atgtgtgtgtgtgcgtgtgg

SEQ ID NO: 240743 - DNA, 20 bp, Artificial
  CRISPR gRNA sequence
tgtgtgcgtgtggaggacac

SEQ ID NO: 240744 - DNA, 20 bp, Artificial
  CRISPR gRNA sequence
gcgtgtggaggacactggca

SEQ ID NO: 240745 - DNA, 20 bp, Artificial
  CRISPR gRNA sequence
tgtggaggacactggcaaag

SEQ ID NO: 240746 - DNA, 20 bp, Artificial
  CRISPR gRNA sequence
ggacactggcaaagaagaat

SEQ ID NO: 240747 - DNA, 20 bp, Artificial
  CRISPR gRNA sequence
atgttccctctatgtccctc

SEQ ID NO: 240748 - DNA, 20 bp, Artificial
  CRISPR gRNA sequence
tgtccctctggttgataaac

SEQ ID NO: 240749 - DNA, 20 bp, Artificial
  CRISPR gRNA sequence
ttgataaactggcttaaaat

SEQ ID NO: 240750 - DNA, 20 bp, Artificial
  CRISPR gRNA sequence
aaactggcttaaaatgagtt

SEQ ID NO: 240751 - DNA, 20 bp, Artificial
  CRISPR gRNA sequence
atgagtttagacccatattt

SEQ ID NO: 240752 - DNA, 20 bp, Artificial
  CRISPR gRNA sequence
tgagtttagacccatatttg

SEQ ID NO: 240753 - DNA, 20 bp, Artificial
  CRISPR gRNA sequence
gtttagacccatatttgagg

SEQ ID NO: 240754 - DNA, 20 bp, Artificial
  CRISPR gRNA sequence
tttagacccatatttgagga

SEQ ID NO: 240755 - DNA, 20 bp, Artificial
  CRISPR gRNA sequence
gacccatatttgaggaaggc

SEQ ID NO: 240756 - DNA, 20 bp, Artificial
  CRISPR gRNA sequence
acccatatttgaggaaggca

SEQ ID NO: 240757 - DNA, 20 bp, Artificial
  CRISPR gRNA sequence
ccatatttgaggaaggcaag

SEQ ID NO: 240758 - DNA, 20 bp, Artificial
  CRISPR gRNA sequence
tgaggaaggcaaggagaaca

SEQ ID NO: 240759 - DNA, 20 bp, Artificial
  CRISPR gRNA sequence
aggaaggcaaggagaacaaa

SEQ ID NO: 240760 - DNA, 20 bp, Artificial
  CRISPR gRNA sequence
ggaaggcaaggagaacaaag

SEQ ID NO: 240761 - DNA, 20 bp, Artificial
  CRISPR gRNA sequence
gaaggcaaggagaacaaaga

SEQ ID NO: 240762 - DNA, 20 bp, Artificial
  CRISPR gRNA sequence
aggcaaggagaacaaagagg

SEQ ID NO: 240763 - DNA, 20 bp, Artificial
  CRISPR gRNA sequence
gagaacaaagagggagcttg

SEQ ID NO: 240764 - DNA, 20 bp, Artificial
  CRISPR gRNA sequence
agaacaaagagggagcttga

SEQ ID NO: 240765 - DNA, 20 bp, Artificial
  CRISPR gRNA sequence
gaacaaagagggagcttgaa

SEQ ID NO: 240766 - DNA, 20 bp, Artificial
  CRISPR gRNA sequence
aacaaagagggagcttgaag

SEQ ID NO: 240767 - DNA, 20 bp, Artificial
  CRISPR gRNA sequence
acaaagagggagcttgaagg

SEQ ID NO: 240768 - DNA, 20 bp, Artificial
  CRISPR gRNA sequence
gtttaacaaatgaattatta

SEQ ID NO: 240769 - DNA, 20 bp, Artificial
  CRISPR gRNA sequence
caaatgaattattacagcac

SEQ ID NO: 240770 - DNA, 20 bp, Artificial
  CRISPR gRNA sequence
gaattattacagcaccagta

SEQ ID NO: 240771 - DNA, 20 bp, Artificial
  CRISPR gRNA sequence
tgttcaacaattatttctgt

SEQ ID NO: 240772 - DNA, 20 bp, Artificial
  CRISPR gRNA sequence
gttcaacaattatttctgta

SEQ ID NO: 240773 - DNA, 20 bp, Artificial
  CRISPR gRNA sequence
aattatttctgtaaggtact

SEQ ID NO: 240774 - DNA, 20 bp, Artificial
  CRISPR gRNA sequence
atttctgtaaggtactcagc

SEQ ID NO: 240775 - DNA, 20 bp, Artificial
  CRISPR gRNA sequence
taaggtactcagcaagtgcc

SEQ ID NO: 240776 - DNA, 20 bp, Artificial
  CRISPR gRNA sequence
ctcagcaagtgcctggcact

SEQ ID NO: 240777 - DNA, 20 bp, Artificial
  CRISPR gRNA sequence
gcaagtgcctggcactgagt

SEQ ID NO: 240778 - DNA, 20 bp, Artificial
  CRISPR gRNA sequence
ggcactgagtcagcatccac

SEQ ID NO: 240779 - DNA, 20 bp, Artificial
  CRISPR gRNA sequence
agtcagcatccactagacaa

SEQ ID NO: 240780 - DNA, 20 bp, Artificial
  CRISPR gRNA sequence
ccattgatatttatttgaaa

SEQ ID NO: 240781 - DNA, 20 bp, Artificial
  CRISPR gRNA sequence
tatttatttgaaaaagtata

SEQ ID NO: 240782 - DNA, 20 bp, Artificial
  CRISPR gRNA sequence
tatttgaaaaagtatataga

SEQ ID NO: 240783 - DNA, 20 bp, Artificial
  CRISPR gRNA sequence
ttgaaaaagtatatagatgg

SEQ ID NO: 240784 - DNA, 20 bp, Artificial
  CRISPR gRNA sequence
tgaaaaagtatatagatgga

SEQ ID NO: 240785 - DNA, 20 bp, Artificial
  CRISPR gRNA sequence
caatctgttttttgtcttca

SEQ ID NO: 240786 - DNA, 20 bp, Artificial
  CRISPR gRNA sequence
ttttttgtcttcatggacat

SEQ ID NO: 240787 - DNA, 20 bp, Artificial
  CRISPR gRNA sequence
tttttgtcttcatggacatt

SEQ ID NO: 240788 - DNA, 20 bp, Artificial
  CRISPR gRNA sequence
gtcttcatggacattaggat

SEQ ID NO: 240789 - DNA, 20 bp, Artificial
  CRISPR gRNA sequence
gacattaggatgagacataa

SEQ ID NO: 240790 - DNA, 20 bp, Artificial
  CRISPR gRNA sequence
acattaggatgagacataac

SEQ ID NO: 240791 - DNA, 20 bp, Artificial
  CRISPR gRNA sequence
tgagacataacaggcttaat

SEQ ID NO: 240792 - DNA, 20 bp, Artificial
  CRISPR gRNA sequence
caggcttaataagacttaat

SEQ ID NO: 240793 - DNA, 20 bp, Artificial
  CRISPR gRNA sequence
ggcttaataagacttaataa

SEQ ID NO: 240794 - DNA, 20 bp, Artificial
  CRISPR gRNA sequence
gcttaataagacttaataag

SEQ ID NO: 240795 - DNA, 20 bp, Artificial
  CRISPR gRNA sequence
cttaataagacttaataaga

SEQ ID NO: 240796 - DNA, 20 bp, Artificial
  CRISPR gRNA sequence
taataagagggatataataa

SEQ ID NO: 240797 - DNA, 20 bp, Artificial
  CRISPR gRNA sequence
aataagagggatataataaa

SEQ ID NO: 240798 - DNA, 20 bp, Artificial
  CRISPR gRNA sequence
taagagggatataataaaag

SEQ ID NO: 240799 - DNA, 20 bp, Artificial
  CRISPR gRNA sequence
tataataaaaggagcttttt

SEQ ID NO: 240800 - DNA, 20 bp, Artificial
  CRISPR gRNA sequence
taataaaaggagctttttga

SEQ ID NO: 240801 - DNA, 20 bp, Artificial
  CRISPR gRNA sequence
gagagcaaaattttaaccca

SEQ ID NO: 240802 - DNA, 20 bp, Artificial
  CRISPR gRNA sequence
tttaacccaaagcaccatgt

SEQ ID NO: 240803 - DNA, 20 bp, Artificial
  CRISPR gRNA sequence
cccaaagcaccatgtaagac

SEQ ID NO: 240804 - DNA, 20 bp, Artificial
  CRISPR gRNA sequence
aagaccagaatgtgcctatt

SEQ ID NO: 240805 - DNA, 20 bp, Artificial
  CRISPR gRNA sequence
gaccagaatgtgcctatttg

SEQ ID NO: 240806 - DNA, 20 bp, Artificial
  CRISPR gRNA sequence
gattgttaaaaatatatatg

SEQ ID NO: 240807 - DNA, 20 bp, Artificial
  CRISPR gRNA sequence
attgttaaaaatatatatgc

SEQ ID NO: 240808 - DNA, 20 bp, Artificial
  CRISPR gRNA sequence
taaaaatatatatgcaggaa

SEQ ID NO: 240809 - DNA, 20 bp, Artificial
  CRISPR gRNA sequence
tatatatgcaggaacagcat

SEQ ID NO: 240810 - DNA, 20 bp, Artificial
  CRISPR gRNA sequence
atgcaggaacagcattagta

SEQ ID NO: 240811 - DNA, 20 bp, Artificial
  CRISPR gRNA sequence
agtctttttttttctttttt

SEQ ID NO: 240812 - DNA, 20 bp, Artificial
  CRISPR gRNA sequence
tttttttttcttttttgaga

SEQ ID NO: 240813 - DNA, 20 bp, Artificial
  CRISPR gRNA sequence
tttttttcttttttgagaca

SEQ ID NO: 240814 - DNA, 20 bp, Artificial
  CRISPR gRNA sequence
agagtttcactcttgttgcc

SEQ ID NO: 240815 - DNA, 20 bp, Artificial
  CRISPR gRNA sequence
gagtttcactcttgttgccc

SEQ ID NO: 240816 - DNA, 20 bp, Artificial
  CRISPR gRNA sequence
ttcactcttgttgcccaggc

SEQ ID NO: 240817 - DNA, 20 bp, Artificial
  CRISPR gRNA sequence
cactcttgttgcccaggctg

SEQ ID NO: 240818 - DNA, 20 bp, Artificial
  CRISPR gRNA sequence
ttgcccaggctggagtgcaa

SEQ ID NO: 240819 - DNA, 20 bp, Artificial
  CRISPR gRNA sequence
ggagtgcaatggcgtgatcc

SEQ ID NO: 240820 - DNA, 20 bp, Artificial
  CRISPR gRNA sequence
ttaccgcaacctcctccttc

SEQ ID NO: 240821 - DNA, 20 bp, Artificial
  CRISPR gRNA sequence
taccgcaacctcctccttcc

SEQ ID NO: 240822 - DNA, 20 bp, Artificial
  CRISPR gRNA sequence
aacctcctccttccgggttc

SEQ ID NO: 240823 - DNA, 20 bp, Artificial
  CRISPR gRNA sequence
ttcaagcgattctcctgcct

SEQ ID NO: 240824 - DNA, 20 bp, Artificial
  CRISPR gRNA sequence
tcaagcgattctcctgcctc

SEQ ID NO: 240825 - DNA, 20 bp, Artificial
  CRISPR gRNA sequence
ttctcctgcctcaggctccc

SEQ ID NO: 240826 - DNA, 20 bp, Artificial
  CRISPR gRNA sequence
tctcctgcctcaggctcccg

SEQ ID NO: 240827 - DNA, 20 bp, Artificial
  CRISPR gRNA sequence
ctcaggctcccgaggcatta

SEQ ID NO: 240828 - DNA, 20 bp, Artificial
  CRISPR gRNA sequence
tcaggctcccgaggcattac

SEQ ID NO: 240829 - DNA, 20 bp, Artificial
  CRISPR gRNA sequence
caggcatgcgccaccacacc

SEQ ID NO: 240830 - DNA, 20 bp, Artificial
  CRISPR gRNA sequence
cccagctaattttgcatttt

SEQ ID NO: 240831 - DNA, 20 bp, Artificial
  CRISPR gRNA sequence
agctaattttgcatttttag

SEQ ID NO: 240832 - DNA, 20 bp, Artificial
  CRISPR gRNA sequence
ctaattttgcatttttagta

SEQ ID NO: 240833 - DNA, 20 bp, Artificial
  CRISPR gRNA sequence
ttttgcatttttagtagaga

SEQ ID NO: 240834 - DNA, 20 bp, Artificial
  CRISPR gRNA sequence
tttgcatttttagtagagac

SEQ ID NO: 240835 - DNA, 20 bp, Artificial
  CRISPR gRNA sequence
ttgcatttttagtagagacg

SEQ ID NO: 240836 - DNA, 20 bp, Artificial
  CRISPR gRNA sequence
gagacggggtttctccatgt

SEQ ID NO: 240837 - DNA, 20 bp, Artificial
  CRISPR gRNA sequence
cggggtttctccatgttggc

SEQ ID NO: 240838 - DNA, 20 bp, Artificial
  CRISPR gRNA sequence
ggggtttctccatgttggcc

SEQ ID NO: 240839 - DNA, 20 bp, Artificial
  CRISPR gRNA sequence
tttctccatgttggccaggc

SEQ ID NO: 240840 - DNA, 20 bp, Artificial
  CRISPR gRNA sequence
tggtcttgaactcccaacct

SEQ ID NO: 240841 - DNA, 20 bp, Artificial
  CRISPR gRNA sequence
ggtcttgaactcccaacctc

SEQ ID NO: 240842 - DNA, 20 bp, Artificial
  CRISPR gRNA sequence
ctcaggtgatccgcccgcct

SEQ ID NO: 240843 - DNA, 20 bp, Artificial
  CRISPR gRNA sequence
ccgcccgcctcagcctccca

SEQ ID NO: 240844 - DNA, 20 bp, Artificial
  CRISPR gRNA sequence
gcctcagcctcccaaagtgt

SEQ ID NO: 240845 - DNA, 20 bp, Artificial
  CRISPR gRNA sequence
cctcagcctcccaaagtgtt

SEQ ID NO: 240846 - DNA, 20 bp, Artificial
  CRISPR gRNA sequence
ctcccaaagtgttgggatta

SEQ ID NO: 240847 - DNA, 20 bp, Artificial
  CRISPR gRNA sequence
tcccaaagtgttgggattac

SEQ ID NO: 240848 - DNA, 20 bp, Artificial
  CRISPR gRNA sequence
agtgttgggattacaggcgt

SEQ ID NO: 240849 - DNA, 20 bp, Artificial
  CRISPR gRNA sequence
caggcgtgagccactgcgct

SEQ ID NO: 240850 - DNA, 20 bp, Artificial
  CRISPR gRNA sequence
cgtgagccactgcgctcagc

SEQ ID NO: 240851 - DNA, 20 bp, Artificial
  CRISPR gRNA sequence
gccactgcgctcagccagta

SEQ ID NO: 240852 - DNA, 20 bp, Artificial
  CRISPR gRNA sequence
aaattatgctaatgtattta

SEQ ID NO: 240853 - DNA, 20 bp, Artificial
  CRISPR gRNA sequence
aattatgctaatgtatttaa

SEQ ID NO: 240854 - DNA, 20 bp, Artificial
  CRISPR gRNA sequence
gtatttaaaggctcttttta

SEQ ID NO: 240855 - DNA, 20 bp, Artificial
  CRISPR gRNA sequence
aggctctttttaaagcaata

SEQ ID NO: 240856 - DNA, 20 bp, Artificial
  CRISPR gRNA sequence
tttatacattgtgacctata

SEQ ID NO: 240857 - DNA, 20 bp, Artificial
  CRISPR gRNA sequence
cagaaaaatgcataaatgta

SEQ ID NO: 240858 - DNA, 20 bp, Artificial
  CRISPR gRNA sequence
aaacattcaaataactctac

SEQ ID NO: 240859 - DNA, 20 bp, Artificial
  CRISPR gRNA sequence
aacattcaaataactctacc

SEQ ID NO: 240860 - DNA, 20 bp, Artificial
  CRISPR gRNA sequence
acattcaaataactctacca

SEQ ID NO: 240861 - DNA, 20 bp, Artificial
  CRISPR gRNA sequence
caaataactctaccagggta

SEQ ID NO: 240862 - DNA, 20 bp, Artificial
  CRISPR gRNA sequence
ataactctaccagggtaaag

SEQ ID NO: 240863 - DNA, 20 bp, Artificial
  CRISPR gRNA sequence
actctaccagggtaaagaag

SEQ ID NO: 240864 - DNA, 20 bp, Artificial
  CRISPR gRNA sequence
tggaacataactcattcccg

SEQ ID NO: 240865 - DNA, 20 bp, Artificial
  CRISPR gRNA sequence
taactcattcccgaagccct

SEQ ID NO: 240866 - DNA, 20 bp, Artificial
  CRISPR gRNA sequence
agcccttggcatgccctttc

SEQ ID NO: 240867 - DNA, 20 bp, Artificial
  CRISPR gRNA sequence
ggcatgccctttctagatca

SEQ ID NO: 240868 - DNA, 20 bp, Artificial
  CRISPR gRNA sequence
ccactactgctaaccacatc

SEQ ID NO: 240869 - DNA, 20 bp, Artificial
  CRISPR gRNA sequence
taaccacatctagacttgta

SEQ ID NO: 240870 - DNA, 20 bp, Artificial
  CRISPR gRNA sequence
gtattaacttccttttgctg

SEQ ID NO: 240871 - DNA, 20 bp, Artificial
  CRISPR gRNA sequence
agttttgctacctaataaca

SEQ ID NO: 240872 - DNA, 20 bp, Artificial
  CRISPR gRNA sequence
acctaataacacagttttat

SEQ ID NO: 240873 - DNA, 20 bp, Artificial
  CRISPR gRNA sequence
cctaataacacagttttatt

SEQ ID NO: 240874 - DNA, 20 bp, Artificial
  CRISPR gRNA sequence
gcttgtgaacttcatacaaa

SEQ ID NO: 240875 - DNA, 20 bp, Artificial
  CRISPR gRNA sequence
tctttcaacgttgtatcatg

SEQ ID NO: 240876 - DNA, 20 bp, Artificial
  CRISPR gRNA sequence
catgaagattcatccatgtt

SEQ ID NO: 240877 - DNA, 20 bp, Artificial
  CRISPR gRNA sequence
atccatgttgagttcatctt

SEQ ID NO: 240878 - DNA, 20 bp, Artificial
  CRISPR gRNA sequence
acatcattgttcacctattc

SEQ ID NO: 240879 - DNA, 20 bp, Artificial
  CRISPR gRNA sequence
ttcacctattctagtactga

SEQ ID NO: 240880 - DNA, 20 bp, Artificial
  CRISPR gRNA sequence
cctattctagtactgatgga

SEQ ID NO: 240881 - DNA, 20 bp, Artificial
  CRISPR gRNA sequence
attctagtactgatggacag

SEQ ID NO: 240882 - DNA, 20 bp, Artificial
  CRISPR gRNA sequence
ttctagtactgatggacagc

SEQ ID NO: 240883 - DNA, 20 bp, Artificial
  CRISPR gRNA sequence
atggacagcgggatcatttc

SEQ ID NO: 240884 - DNA, 20 bp, Artificial
  CRISPR gRNA sequence
cagcgggatcatttccagct

SEQ ID NO: 240885 - DNA, 20 bp, Artificial
  CRISPR gRNA sequence
agcgggatcatttccagctt

SEQ ID NO: 240886 - DNA, 20 bp, Artificial
  CRISPR gRNA sequence
gcgggatcatttccagcttg

SEQ ID NO: 240887 - DNA, 20 bp, Artificial
  CRISPR gRNA sequence
atatttttgtccgtgtatct

SEQ ID NO: 240888 - DNA, 20 bp, Artificial
  CRISPR gRNA sequence
cacacgtaaacacgtgtttc

SEQ ID NO: 240889 - DNA, 20 bp, Artificial
  CRISPR gRNA sequence
gtaaacacgtgtttctggct

SEQ ID NO: 240890 - DNA, 20 bp, Artificial
  CRISPR gRNA sequence
cttggttttgttttttaacc

SEQ ID NO: 240891 - DNA, 20 bp, Artificial
  CRISPR gRNA sequence
aacctagaaataacgttgct

SEQ ID NO: 240892 - DNA, 20 bp, Artificial
  CRISPR gRNA sequence
aaataacgttgctgagctac

SEQ ID NO: 240893 - DNA, 20 bp, Artificial
  CRISPR gRNA sequence
aataacgttgctgagctaca

SEQ ID NO: 240894 - DNA, 20 bp, Artificial
  CRISPR gRNA sequence
tacaaggaacatgtgtatct

SEQ ID NO: 240895 - DNA, 20 bp, Artificial
  CRISPR gRNA sequence
aaactgttttcctaaatgat

SEQ ID NO: 240896 - DNA, 20 bp, Artificial
  CRISPR gRNA sequence
ggaccccatttacactcccc

SEQ ID NO: 240897 - DNA, 20 bp, Artificial
  CRISPR gRNA sequence
ccccatttacactcccctgg

SEQ ID NO: 240898 - DNA, 20 bp, Artificial
  CRISPR gRNA sequence
tacactcccctggcggtaat

SEQ ID NO: 240899 - DNA, 20 bp, Artificial
  CRISPR gRNA sequence
ccacatcccctgataactct

SEQ ID NO: 240900 - DNA, 20 bp, Artificial
  CRISPR gRNA sequence
ctgataactcttggtatcat

SEQ ID NO: 240901 - DNA, 20 bp, Artificial
  CRISPR gRNA sequence
tcagattatttttatcgata

SEQ ID NO: 240902 - DNA, 20 bp, Artificial
  CRISPR gRNA sequence
gattatttttatcgatatgg

SEQ ID NO: 240903 - DNA, 20 bp, Artificial
  CRISPR gRNA sequence
attatttttatcgatatggt

SEQ ID NO: 240904 - DNA, 20 bp, Artificial
  CRISPR gRNA sequence
atttttatcgatatggtggg

SEQ ID NO: 240905 - DNA, 20 bp, Artificial
  CRISPR gRNA sequence
ttatcgatatggtgggtgga

SEQ ID NO: 240906 - DNA, 20 bp, Artificial
  CRISPR gRNA sequence
tggatagttgtatctcattg

SEQ ID NO: 240907 - DNA, 20 bp, Artificial
  CRISPR gRNA sequence
tggttttaacttacacttcc

SEQ ID NO: 240908 - DNA, 20 bp, Artificial
  CRISPR gRNA sequence
aacttacacttcctggttgc

SEQ ID NO: 240909 - DNA, 20 bp, Artificial
  CRISPR gRNA sequence
tacacttcctggttgctagt

SEQ ID NO: 240910 - DNA, 20 bp, Artificial
  CRISPR gRNA sequence
acacttcctggttgctagtg

SEQ ID NO: 240911 - DNA, 20 bp, Artificial
  CRISPR gRNA sequence
ttcctggttgctagtgaggt

SEQ ID NO: 240912 - DNA, 20 bp, Artificial
  CRISPR gRNA sequence
gacgccttttcatgttattt

SEQ ID NO: 240913 - DNA, 20 bp, Artificial
  CRISPR gRNA sequence
ttcatgttattttggctatt

SEQ ID NO: 240914 - DNA, 20 bp, Artificial
  CRISPR gRNA sequence
ggctatttggatttcctctt

SEQ ID NO: 240915 - DNA, 20 bp, Artificial
  CRISPR gRNA sequence
tttggatttcctctttagtg

SEQ ID NO: 240916 - DNA, 20 bp, Artificial
  CRISPR gRNA sequence
ttggatttcctctttagtga

SEQ ID NO: 240917 - DNA, 20 bp, Artificial
  CRISPR gRNA sequence
tggatttcctctttagtgaa

SEQ ID NO: 240918 - DNA, 20 bp, Artificial
  CRISPR gRNA sequence
ctttagtgaagggcctgatc

SEQ ID NO: 240919 - DNA, 20 bp, Artificial
  CRISPR gRNA sequence
agggcctgatcaagtctttt

SEQ ID NO: 240920 - DNA, 20 bp, Artificial
  CRISPR gRNA sequence
gtcttttgagtattttctca

SEQ ID NO: 240921 - DNA, 20 bp, Artificial
  CRISPR gRNA sequence
tcttttgagtattttctcat

SEQ ID NO: 240922 - DNA, 20 bp, Artificial
  CRISPR gRNA sequence
gtccttttcttactaacgta

SEQ ID NO: 240923 - DNA, 20 bp, Artificial
  CRISPR gRNA sequence
tccttttcttactaacgtat

SEQ ID NO: 240924 - DNA, 20 bp, Artificial
  CRISPR gRNA sequence
ttttcttactaacgtatagg

SEQ ID NO: 240925 - DNA, 20 bp, Artificial
  CRISPR gRNA sequence
actaacgtataggaagtttt

SEQ ID NO: 240926 - DNA, 20 bp, Artificial
  CRISPR gRNA sequence
gtttttagtctgctgttcat

SEQ ID NO: 240927 - DNA, 20 bp, Artificial
  CRISPR gRNA sequence
aaatatcttttcctattctg

SEQ ID NO: 240928 - DNA, 20 bp, Artificial
  CRISPR gRNA sequence
tgctctttcattcttttttt

SEQ ID NO: 240929 - DNA, 20 bp, Artificial
  CRISPR gRNA sequence
gctctttcattctttttttg

SEQ ID NO: 240930 - DNA, 20 bp, Artificial
  CRISPR gRNA sequence
ttttttgaggtctacacctc

SEQ ID NO: 240931 - DNA, 20 bp, Artificial
  CRISPR gRNA sequence
ttctcacttaaacctgattt

SEQ ID NO: 240932 - DNA, 20 bp, Artificial
  CRISPR gRNA sequence
gttttgtcttttgttttttt

SEQ ID NO: 240933 - DNA, 20 bp, Artificial
  CRISPR gRNA sequence
tgtcttttgtttttttgaga

SEQ ID NO: 240934 - DNA, 20 bp, Artificial
  CRISPR gRNA sequence
tcttttgtttttttgagaca

SEQ ID NO: 240935 - DNA, 20 bp, Artificial
  CRISPR gRNA sequence
cagagtttcactgtgtcacc

SEQ ID NO: 240936 - DNA, 20 bp, Artificial
  CRISPR gRNA sequence
agagtttcactgtgtcaccc

SEQ ID NO: 240937 - DNA, 20 bp, Artificial
  CRISPR gRNA sequence
tcactgtgtcacccaggctg

SEQ ID NO: 240938 - DNA, 20 bp, Artificial
  CRISPR gRNA sequence
tcacccaggctgaagtgcaa

SEQ ID NO: 240939 - DNA, 20 bp, Artificial
  CRISPR gRNA sequence
gaagtgcaatggtgcgatca

SEQ ID NO: 240940 - DNA, 20 bp, Artificial
  CRISPR gRNA sequence
ggtgcgatcacagctcactg

SEQ ID NO: 240941 - DNA, 20 bp, Artificial
  CRISPR gRNA sequence
ctcactgtagcctcgaactc

SEQ ID NO: 240942 - DNA, 20 bp, Artificial
  CRISPR gRNA sequence
cactgtagcctcgaactcca

SEQ ID NO: 240943 - DNA, 20 bp, Artificial
  CRISPR gRNA sequence
agcctcgaactccagagctc

SEQ ID NO: 240944 - DNA, 20 bp, Artificial
  CRISPR gRNA sequence
ctcgagcaatcctcctgcct

SEQ ID NO: 240945 - DNA, 20 bp, Artificial
  CRISPR gRNA sequence
tcctgcctcagcctactaaa

SEQ ID NO: 240946 - DNA, 20 bp, Artificial
  CRISPR gRNA sequence
gcctcagcctactaaatagc

SEQ ID NO: 240947 - DNA, 20 bp, Artificial
  CRISPR gRNA sequence
cctcagcctactaaatagct

SEQ ID NO: 240948 - DNA, 20 bp, Artificial
  CRISPR gRNA sequence
ctactaaatagctgggacta

SEQ ID NO: 240949 - DNA, 20 bp, Artificial
  CRISPR gRNA sequence
tactaaatagctgggactat

SEQ ID NO: 240950 - DNA, 20 bp, Artificial
  CRISPR gRNA sequence
taggtgcataccaccacact

SEQ ID NO: 240951 - DNA, 20 bp, Artificial
  CRISPR gRNA sequence
gctaatttttaattgatttt

SEQ ID NO: 240952 - DNA, 20 bp, Artificial
  CRISPR gRNA sequence
attgatttttagtgtttttg

SEQ ID NO: 240953 - DNA, 20 bp, Artificial
  CRISPR gRNA sequence
tgatttttagtgtttttgta

SEQ ID NO: 240954 - DNA, 20 bp, Artificial
  CRISPR gRNA sequence
tttagtgtttttgtagagac

SEQ ID NO: 240955 - DNA, 20 bp, Artificial
  CRISPR gRNA sequence
ttagtgtttttgtagagact

SEQ ID NO: 240956 - DNA, 20 bp, Artificial
  CRISPR gRNA sequence
tttgtagagactgggattca

SEQ ID NO: 240957 - DNA, 20 bp, Artificial
  CRISPR gRNA sequence
ctgggattcacggtgttgtc

SEQ ID NO: 240958 - DNA, 20 bp, Artificial
  CRISPR gRNA sequence
tgggattcacggtgttgtcc

SEQ ID NO: 240959 - DNA, 20 bp, Artificial
  CRISPR gRNA sequence
attcacggtgttgtccaggc

SEQ ID NO: 240960 - DNA, 20 bp, Artificial
  CRISPR gRNA sequence
ccaggccagtcttaaactcc

SEQ ID NO: 240961 - DNA, 20 bp, Artificial
  CRISPR gRNA sequence
caggccagtcttaaactcct

SEQ ID NO: 240962 - DNA, 20 bp, Artificial
  CRISPR gRNA sequence
agtcttaaactcctgggctc

SEQ ID NO: 240963 - DNA, 20 bp, Artificial
  CRISPR gRNA sequence
ctcaagcgatcctcccacct

SEQ ID NO: 240964 - DNA, 20 bp, Artificial
  CRISPR gRNA sequence
cctcccacctcggtttccca

SEQ ID NO: 240965 - DNA, 20 bp, Artificial
  CRISPR gRNA sequence
acctcggtttcccaaagtgc

SEQ ID NO: 240966 - DNA, 20 bp, Artificial
  CRISPR gRNA sequence
ctggacttaatcctgattta

SEQ ID NO: 240967 - DNA, 20 bp, Artificial
  CRISPR gRNA sequence
tggacttaatcctgatttaa

SEQ ID NO: 240968 - DNA, 20 bp, Artificial
  CRISPR gRNA sequence
gacttaatcctgatttaaag

SEQ ID NO: 240969 - DNA, 20 bp, Artificial
  CRISPR gRNA sequence
aaaggagtatctctgcaaca

SEQ ID NO: 240970 - DNA, 20 bp, Artificial
  CRISPR gRNA sequence
acaaagttccatccacaccc

SEQ ID NO: 240971 - DNA, 20 bp, Artificial
  CRISPR gRNA sequence
ccacaccccagactgcaaca

SEQ ID NO: 240972 - DNA, 20 bp, Artificial
  CRISPR gRNA sequence
cgttataaaatgcttttcaa

SEQ ID NO: 240973 - DNA, 20 bp, Artificial
  CRISPR gRNA sequence
tgcttttcaaaagtatttat

SEQ ID NO: 240974 - DNA, 20 bp, Artificial
  CRISPR gRNA sequence
caaaagtatttatgagtaat

SEQ ID NO: 240975 - DNA, 20 bp, Artificial
  CRISPR gRNA sequence
agtatttatgagtaattagt

SEQ ID NO: 240976 - DNA, 20 bp, Artificial
  CRISPR gRNA sequence
gagtaattagtgagtttcaa

SEQ ID NO: 240977 - DNA, 20 bp, Artificial
  CRISPR gRNA sequence
aactgtaatccattttttaa

SEQ ID NO: 240978 - DNA, 20 bp, Artificial
  CRISPR gRNA sequence
atccattttttaaaagtttt

SEQ ID NO: 240979 - DNA, 20 bp, Artificial
  CRISPR gRNA sequence
tccattttttaaaagttttt

SEQ ID NO: 240980 - DNA, 20 bp, Artificial
  CRISPR gRNA sequence
aaagtttttaggacactccc

SEQ ID NO: 240981 - DNA, 20 bp, Artificial
  CRISPR gRNA sequence
gtttttaggacactccctgg

SEQ ID NO: 240982 - DNA, 20 bp, Artificial
  CRISPR gRNA sequence
taggacactccctggtagtc

SEQ ID NO: 240983 - DNA, 20 bp, Artificial
  CRISPR gRNA sequence
gacactccctggtagtctag

SEQ ID NO: 240984 - DNA, 20 bp, Artificial
  CRISPR gRNA sequence
ctccctggtagtctagtggt

SEQ ID NO: 240985 - DNA, 20 bp, Artificial
  CRISPR gRNA sequence
tccctggtagtctagtggtt

SEQ ID NO: 240986 - DNA, 20 bp, Artificial
  CRISPR gRNA sequence
ccgcgctcgccatcacgacc

SEQ ID NO: 240987 - DNA, 20 bp, Artificial
  CRISPR gRNA sequence
cgcgctcgccatcacgaccc

SEQ ID NO: 240988 - DNA, 20 bp, Artificial
  CRISPR gRNA sequence
cacgacccgggttcgattcc

SEQ ID NO: 240989 - DNA, 20 bp, Artificial
  CRISPR gRNA sequence
acccgggttcgattcctggt

SEQ ID NO: 240990 - DNA, 20 bp, Artificial
  CRISPR gRNA sequence
cccgggttcgattcctggtc

SEQ ID NO: 240991 - DNA, 20 bp, Artificial
  CRISPR gRNA sequence
ccgggttcgattcctggtca

SEQ ID NO: 240992 - DNA, 20 bp, Artificial
  CRISPR gRNA sequence
ggttcgattcctggtcaggg

SEQ ID NO: 240993 - DNA, 20 bp, Artificial
  CRISPR gRNA sequence
ggtcagggaagccttccttc

SEQ ID NO: 240994 - DNA, 20 bp, Artificial
  CRISPR gRNA sequence
agggaagccttccttctggc

SEQ ID NO: 240995 - DNA, 20 bp, Artificial
  CRISPR gRNA sequence
gggaagccttccttctggct

SEQ ID NO: 240996 - DNA, 20 bp, Artificial
  CRISPR gRNA sequence
ttccttctggctgggcgctg

SEQ ID NO: 240997 - DNA, 20 bp, Artificial
  CRISPR gRNA sequence
gtggctcacgcctgtaatcc

SEQ ID NO: 240998 - DNA, 20 bp, Artificial
  CRISPR gRNA sequence
cgcctgtaatcctagcattc

SEQ ID NO: 240999 - DNA, 20 bp, Artificial
  CRISPR gRNA sequence
gcctgtaatcctagcattct

SEQ ID NO: 241000 - DNA, 20 bp, Artificial
  CRISPR gRNA sequence
cctgtaatcctagcattctg

SEQ ID NO: 241001 - DNA, 20 bp, Artificial
  CRISPR gRNA sequence
ctgtaatcctagcattctgg

SEQ ID NO: 241002 - DNA, 20 bp, Artificial
  CRISPR gRNA sequence
tgtaatcctagcattctggg

SEQ ID NO: 241003 - DNA, 20 bp, Artificial
  CRISPR gRNA sequence
tcctagcattctggggggct

SEQ ID NO: 241004 - DNA, 20 bp, Artificial
  CRISPR gRNA sequence
cctagcattctggggggctg

SEQ ID NO: 241005 - DNA, 20 bp, Artificial
  CRISPR gRNA sequence
agcattctggggggctgagg

SEQ ID NO: 241006 - DNA, 20 bp, Artificial
  CRISPR gRNA sequence
gcattctggggggctgaggc

SEQ ID NO: 241007 - DNA, 20 bp, Artificial
  CRISPR gRNA sequence
ttctggggggctgaggcggg

SEQ ID NO: 241008 - DNA, 20 bp, Artificial
  CRISPR gRNA sequence
ctgaggcgggcagatcacct

SEQ ID NO: 241009 - DNA, 20 bp, Artificial
  CRISPR gRNA sequence
tgaggcgggcagatcacctg

SEQ ID NO: 241010 - DNA, 20 bp, Artificial
  CRISPR gRNA sequence
gcgggcagatcacctgaggt

SEQ ID NO: 241011 - DNA, 20 bp, Artificial
  CRISPR gRNA sequence
cgggcagatcacctgaggtt

SEQ ID NO: 241012 - DNA, 20 bp, Artificial
  CRISPR gRNA sequence
ggcagatcacctgaggttag

SEQ ID NO: 241013 - DNA, 20 bp, Artificial
  CRISPR gRNA sequence
tgaggttaggagttcaacac

SEQ ID NO: 241014 - DNA, 20 bp, Artificial
  CRISPR gRNA sequence
ttaggagttcaacaccagcc

SEQ ID NO: 241015 - DNA, 20 bp, Artificial
  CRISPR gRNA sequence
gttcaacaccagcctggcca

SEQ ID NO: 241016 - DNA, 20 bp, Artificial
  CRISPR gRNA sequence
ctactaaaaatacaaaaaat

SEQ ID NO: 241017 - DNA, 20 bp, Artificial
  CRISPR gRNA sequence
taaaaatacaaaaaattagc

SEQ ID NO: 241018 - DNA, 20 bp, Artificial
  CRISPR gRNA sequence
aaaaatacaaaaaattagcc

SEQ ID NO: 241019 - DNA, 20 bp, Artificial
  CRISPR gRNA sequence
tacaaaaaattagccaggcg

SEQ ID NO: 241020 - DNA, 20 bp, Artificial
  CRISPR gRNA sequence
aaaaaattagccaggcgtgg

SEQ ID NO: 241021 - DNA, 20 bp, Artificial
  CRISPR gRNA sequence
gtggtgcatgcctgtaatcc

SEQ ID NO: 241022 - DNA, 20 bp, Artificial
  CRISPR gRNA sequence
tgcctgtaatcccagctact

SEQ ID NO: 241023 - DNA, 20 bp, Artificial
  CRISPR gRNA sequence
gcctgtaatcccagctactc

SEQ ID NO: 241024 - DNA, 20 bp, Artificial
  CRISPR gRNA sequence
ctgtaatcccagctactcag

SEQ ID NO: 241025 - DNA, 20 bp, Artificial
  CRISPR gRNA sequence
tgtaatcccagctactcagg

SEQ ID NO: 241026 - DNA, 20 bp, Artificial
  CRISPR gRNA sequence
tcccagctactcaggaggct

SEQ ID NO: 241027 - DNA, 20 bp, Artificial
  CRISPR gRNA sequence
agctactcaggaggctgaga

SEQ ID NO: 241028 - DNA, 20 bp, Artificial
  CRISPR gRNA sequence
gctactcaggaggctgagac

SEQ ID NO: 241029 - DNA, 20 bp, Artificial
  CRISPR gRNA sequence
tactcaggaggctgagacag

SEQ ID NO: 241030 - DNA, 20 bp, Artificial
  CRISPR gRNA sequence
acaggagaatcgcttgaacc

SEQ ID NO: 241031 - DNA, 20 bp, Artificial
  CRISPR gRNA sequence
caggagaatcgcttgaaccc

SEQ ID NO: 241032 - DNA, 20 bp, Artificial
  CRISPR gRNA sequence
ggagaatcgcttgaacccgg

SEQ ID NO: 241033 - DNA, 20 bp, Artificial
  CRISPR gRNA sequence
gagaatcgcttgaacccggg

SEQ ID NO: 241034 - DNA, 20 bp, Artificial
  CRISPR gRNA sequence
aatcgcttgaacccgggagg

SEQ ID NO: 241035 - DNA, 20 bp, Artificial
  CRISPR gRNA sequence
tcgcttgaacccgggaggtg

SEQ ID NO: 241036 - DNA, 20 bp, Artificial
  CRISPR gRNA sequence
cgcttgaacccgggaggtgg

SEQ ID NO: 241037 - DNA, 20 bp, Artificial
  CRISPR gRNA sequence
aacccgggaggtggaggttg

SEQ ID NO: 241038 - DNA, 20 bp, Artificial
  CRISPR gRNA sequence
ggtggaggttgcagtgaact

SEQ ID NO: 241039 - DNA, 20 bp, Artificial
  CRISPR gRNA sequence
gagatcgtgccattgcactc

SEQ ID NO: 241040 - DNA, 20 bp, Artificial
  CRISPR gRNA sequence
cgtgccattgcactccagcc

SEQ ID NO: 241041 - DNA, 20 bp, Artificial
  CRISPR gRNA sequence
gtgccattgcactccagcct

SEQ ID NO: 241042 - DNA, 20 bp, Artificial
  CRISPR gRNA sequence
cactccagcctgggcaacaa

SEQ ID NO: 241043 - DNA, 20 bp, Artificial
  CRISPR gRNA sequence
ctcaaaaaaaaaaaaaaaaa

SEQ ID NO: 241044 - DNA, 20 bp, Artificial
  CRISPR gRNA sequence
tcaaaaaaaaaaaaaaaaaa

SEQ ID NO: 241045 - DNA, 20 bp, Artificial
  CRISPR gRNA sequence
aaaaaaaaaaaaaaaggttt

SEQ ID NO: 241046 - DNA, 20 bp, Artificial
  CRISPR gRNA sequence
aaaaaaaaaaaaaaggtttt

SEQ ID NO: 241047 - DNA, 20 bp, Artificial
  CRISPR gRNA sequence
aaaggttttaggtcgttcaa

SEQ ID NO: 241048 - DNA, 20 bp, Artificial
  CRISPR gRNA sequence
tttcaattttgacgtaatta

SEQ ID NO: 241049 - DNA, 20 bp, Artificial
  CRISPR gRNA sequence
ttgacgtaattatagattca

SEQ ID NO: 241050 - DNA, 20 bp, Artificial
  CRISPR gRNA sequence
tgacgtaattatagattcac

SEQ ID NO: 241051 - DNA, 20 bp, Artificial
  CRISPR gRNA sequence
tagattcacaggaatttgcc

SEQ ID NO: 241052 - DNA, 20 bp, Artificial
  CRISPR gRNA sequence
ttcacaggaatttgccaaga

SEQ ID NO: 241053 - DNA, 20 bp, Artificial
  CRISPR gRNA sequence
tcacaggaatttgccaagac

SEQ ID NO: 241054 - DNA, 20 bp, Artificial
  CRISPR gRNA sequence
agacaggaacatctctcatg

SEQ ID NO: 241055 - DNA, 20 bp, Artificial
  CRISPR gRNA sequence
aacatctctcatgcggtttc

SEQ ID NO: 241056 - DNA, 20 bp, Artificial
  CRISPR gRNA sequence
acatctctcatgcggtttct

SEQ ID NO: 241057 - DNA, 20 bp, Artificial
  CRISPR gRNA sequence
ggtttctgggttccattctc

SEQ ID NO: 241058 - DNA, 20 bp, Artificial
  CRISPR gRNA sequence
ggttccattctccagtacaa

SEQ ID NO: 241059 - DNA, 20 bp, Artificial
  CRISPR gRNA sequence
cattctccagtacaatggca

SEQ ID NO: 241060 - DNA, 20 bp, Artificial
  CRISPR gRNA sequence
tctccagtacaatggcaaag

SEQ ID NO: 241061 - DNA, 20 bp, Artificial
  CRISPR gRNA sequence
ctccagtacaatggcaaagc

SEQ ID NO: 241062 - DNA, 20 bp, Artificial
  CRISPR gRNA sequence
gcaaagcaggaaattgacat

SEQ ID NO: 241063 - DNA, 20 bp, Artificial
  CRISPR gRNA sequence
gcaggaaattgacattggca

SEQ ID NO: 241064 - DNA, 20 bp, Artificial
  CRISPR gRNA sequence
attggcacagtgtgcgtgtg

SEQ ID NO: 241065 - DNA, 20 bp, Artificial
  CRISPR gRNA sequence
ttgtccctttatcacacatg

SEQ ID NO: 241066 - DNA, 20 bp, Artificial
  CRISPR gRNA sequence
gtccctttatcacacatgtg

SEQ ID NO: 241067 - DNA, 20 bp, Artificial
  CRISPR gRNA sequence
atgtggagttgtataacaac

SEQ ID NO: 241068 - DNA, 20 bp, Artificial
  CRISPR gRNA sequence
aacaaccagcacaataaaat

SEQ ID NO: 241069 - DNA, 20 bp, Artificial
  CRISPR gRNA sequence
atcagaactatccatcacca

SEQ ID NO: 241070 - DNA, 20 bp, Artificial
  CRISPR gRNA sequence
cagaactatccatcaccaca

SEQ ID NO: 241071 - DNA, 20 bp, Artificial
  CRISPR gRNA sequence
ctccttccactattcctttc

SEQ ID NO: 241072 - DNA, 20 bp, Artificial
  CRISPR gRNA sequence
ttccactattcctttctagt

SEQ ID NO: 241073 - DNA, 20 bp, Artificial
  CRISPR gRNA sequence
tccactattcctttctagtt

SEQ ID NO: 241074 - DNA, 20 bp, Artificial
  CRISPR gRNA sequence
tacctctccccaccatcccc

SEQ ID NO: 241075 - DNA, 20 bp, Artificial
  CRISPR gRNA sequence
tctctatacttttgttattt

SEQ ID NO: 241076 - DNA, 20 bp, Artificial
  CRISPR gRNA sequence
ctctatacttttgttattta

SEQ ID NO: 241077 - DNA, 20 bp, Artificial
  CRISPR gRNA sequence
cttttgttatttaaggaata

SEQ ID NO: 241078 - DNA, 20 bp, Artificial
  CRISPR gRNA sequence
tttaaggaatatggtataaa

SEQ ID NO: 241079 - DNA, 20 bp, Artificial
  CRISPR gRNA sequence
atggtataaatagaatcata

SEQ ID NO: 241080 - DNA, 20 bp, Artificial
  CRISPR gRNA sequence
agaatcatatggtatgtgtc

SEQ ID NO: 241081 - DNA, 20 bp, Artificial
  CRISPR gRNA sequence
gtatgtgtcaagctaaatca

SEQ ID NO: 241082 - DNA, 20 bp, Artificial
  CRISPR gRNA sequence
gtgtcaagctaaatcataga

SEQ ID NO: 241083 - DNA, 20 bp, Artificial
  CRISPR gRNA sequence
gtcaagctaaatcatagata

SEQ ID NO: 241084 - DNA, 20 bp, Artificial
  CRISPR gRNA sequence
caagctaaatcatagataga

SEQ ID NO: 241085 - DNA, 20 bp, Artificial
  CRISPR gRNA sequence
agctaaatcatagatagaga

SEQ ID NO: 241086 - DNA, 20 bp, Artificial
  CRISPR gRNA sequence
gatagagagagcctctctaa

SEQ ID NO: 241087 - DNA, 20 bp, Artificial
  CRISPR gRNA sequence
tctaaaagattatatttttt

SEQ ID NO: 241088 - DNA, 20 bp, Artificial
  CRISPR gRNA sequence
ctaaaagattatattttttc

SEQ ID NO: 241089 - DNA, 20 bp, Artificial
  CRISPR gRNA sequence
aaaagattatattttttcag

SEQ ID NO: 241090 - DNA, 20 bp, Artificial
  CRISPR gRNA sequence
agattatattttttcaggag

SEQ ID NO: 241091 - DNA, 20 bp, Artificial
  CRISPR gRNA sequence
ttttttcaggagtagcattg

SEQ ID NO: 241092 - DNA, 20 bp, Artificial
  CRISPR gRNA sequence
tttcaggagtagcattgcag

SEQ ID NO: 241093 - DNA, 20 bp, Artificial
  CRISPR gRNA sequence
ttcaggagtagcattgcagt

SEQ ID NO: 241094 - DNA, 20 bp, Artificial
  CRISPR gRNA sequence
gtagcattgcagtgggaata

SEQ ID NO: 241095 - DNA, 20 bp, Artificial
  CRISPR gRNA sequence
gcattgcagtgggaatacgg

SEQ ID NO: 241096 - DNA, 20 bp, Artificial
  CRISPR gRNA sequence
cattgcagtgggaatacggt

SEQ ID NO: 241097 - DNA, 20 bp, Artificial
  CRISPR gRNA sequence
gggaatacggtgggtgtatt

SEQ ID NO: 241098 - DNA, 20 bp, Artificial
  CRISPR gRNA sequence
ggaatacggtgggtgtattc

SEQ ID NO: 241099 - DNA, 20 bp, Artificial
  CRISPR gRNA sequence
gaatacggtgggtgtattca

SEQ ID NO: 241100 - DNA, 20 bp, Artificial
  CRISPR gRNA sequence
tgggtgtattcagggatgta

SEQ ID NO: 241101 - DNA, 20 bp, Artificial
  CRISPR gRNA sequence
gggtgtattcagggatgtaa

SEQ ID NO: 241102 - DNA, 20 bp, Artificial
  CRISPR gRNA sequence
cagggatgtaaaggtgatgc

SEQ ID NO: 241103 - DNA, 20 bp, Artificial
  CRISPR gRNA sequence
aaggtgatgcgagtttttaa

SEQ ID NO: 241104 - DNA, 20 bp, Artificial
  CRISPR gRNA sequence
gagtttttaaaagaaaaaat

SEQ ID NO: 241105 - DNA, 20 bp, Artificial
  CRISPR gRNA sequence
agtttttaaaagaaaaaatg

SEQ ID NO: 241106 - DNA, 20 bp, Artificial
  CRISPR gRNA sequence
gtttttaaaagaaaaaatga

SEQ ID NO: 241107 - DNA, 20 bp, Artificial
  CRISPR gRNA sequence
tttttaaaagaaaaaatgag

SEQ ID NO: 241108 - DNA, 20 bp, Artificial
  CRISPR gRNA sequence
ttaaaagaaaaaatgagggg

SEQ ID NO: 241109 - DNA, 20 bp, Artificial
  CRISPR gRNA sequence
taaaagaaaaaatgaggggc

SEQ ID NO: 241110 - DNA, 20 bp, Artificial
  CRISPR gRNA sequence
aaaagaaaaaatgaggggcg

SEQ ID NO: 241111 - DNA, 20 bp, Artificial
  CRISPR gRNA sequence
aaaaaatgaggggcggggca

SEQ ID NO: 241112 - DNA, 20 bp, Artificial
  CRISPR gRNA sequence
aaatgaggggcggggcacag

SEQ ID NO: 241113 - DNA, 20 bp, Artificial
  CRISPR gRNA sequence
gtggctcatgcctataatcc

SEQ ID NO: 241114 - DNA, 20 bp, Artificial
  CRISPR gRNA sequence
tgcctataatcccagcgctt

SEQ ID NO: 241115 - DNA, 20 bp, Artificial
  CRISPR gRNA sequence
gcctataatcccagcgcttt

SEQ ID NO: 241116 - DNA, 20 bp, Artificial
  CRISPR gRNA sequence
ctataatcccagcgctttgg

SEQ ID NO: 241117 - DNA, 20 bp, Artificial
  CRISPR gRNA sequence
tataatcccagcgctttggg

SEQ ID NO: 241118 - DNA, 20 bp, Artificial
  CRISPR gRNA sequence
tcccagcgctttgggaggct

SEQ ID NO: 241119 - DNA, 20 bp, Artificial
  CRISPR gRNA sequence
cccagcgctttgggaggctg

SEQ ID NO: 241120 - DNA, 20 bp, Artificial
  CRISPR gRNA sequence
agcgctttgggaggctgagg

SEQ ID NO: 241121 - DNA, 20 bp, Artificial
  CRISPR gRNA sequence
ctttgggaggctgaggcgga

SEQ ID NO: 241122 - DNA, 20 bp, Artificial
  CRISPR gRNA sequence
ctgaggcggatggatcacct

SEQ ID NO: 241123 - DNA, 20 bp, Artificial
  CRISPR gRNA sequence
tgaggcggatggatcacctg

SEQ ID NO: 241124 - DNA, 20 bp, Artificial
  CRISPR gRNA sequence
gcggatggatcacctgaggt

SEQ ID NO: 241125 - DNA, 20 bp, Artificial
  CRISPR gRNA sequence
cggatggatcacctgaggtc

SEQ ID NO: 241126 - DNA, 20 bp, Artificial
  CRISPR gRNA sequence
gatggatcacctgaggtcag

SEQ ID NO: 241127 - DNA, 20 bp, Artificial
  CRISPR gRNA sequence
tcacctgaggtcaggagttc

SEQ ID NO: 241128 - DNA, 20 bp, Artificial
  CRISPR gRNA sequence
tgaggtcaggagttcgagac

SEQ ID NO: 241129 - DNA, 20 bp, Artificial
  CRISPR gRNA sequence
tcaggagttcgagaccagcc

SEQ ID NO: 241130 - DNA, 20 bp, Artificial
  CRISPR gRNA sequence
cgagaccagcctggccaaca

SEQ ID NO: 241131 - DNA, 20 bp, Artificial
  CRISPR gRNA sequence
atctctactaaaaatacaaa

SEQ ID NO: 241132 - DNA, 20 bp, Artificial
  CRISPR gRNA sequence
ctactaaaaatacaaaaagt

SEQ ID NO: 241133 - DNA, 20 bp, Artificial
  CRISPR gRNA sequence
tacaaaaagttagccctgca

SEQ ID NO: 241134 - DNA, 20 bp, Artificial
  CRISPR gRNA sequence
aaaaagttagccctgcatgg

SEQ ID NO: 241135 - DNA, 20 bp, Artificial
  CRISPR gRNA sequence
gtggcacgtgcctgtaatcc

SEQ ID NO: 241136 - DNA, 20 bp, Artificial
  CRISPR gRNA sequence
tgcctgtaatcccagatact

SEQ ID NO: 241137 - DNA, 20 bp, Artificial
  CRISPR gRNA sequence
gcctgtaatcccagatactt

SEQ ID NO: 241138 - DNA, 20 bp, Artificial
  CRISPR gRNA sequence
ctgtaatcccagatacttgg

SEQ ID NO: 241139 - DNA, 20 bp, Artificial
  CRISPR gRNA sequence
tgtaatcccagatacttggg

SEQ ID NO: 241140 - DNA, 20 bp, Artificial
  CRISPR gRNA sequence
tcccagatacttgggaggct

SEQ ID NO: 241141 - DNA, 20 bp, Artificial
  CRISPR gRNA sequence
cccagatacttgggaggctg

SEQ ID NO: 241142 - DNA, 20 bp, Artificial
  CRISPR gRNA sequence
tacttgggaggctgaggcac

SEQ ID NO: 241143 - DNA, 20 bp, Artificial
  CRISPR gRNA sequence
gcacaagaattacttgaacc

SEQ ID NO: 241144 - DNA, 20 bp, Artificial
  CRISPR gRNA sequence
cacaagaattacttgaacct

SEQ ID NO: 241145 - DNA, 20 bp, Artificial
  CRISPR gRNA sequence
caagaattacttgaacctgg

SEQ ID NO: 241146 - DNA, 20 bp, Artificial
  CRISPR gRNA sequence
aagaattacttgaacctggg

SEQ ID NO: 241147 - DNA, 20 bp, Artificial
  CRISPR gRNA sequence
aattacttgaacctgggagg

SEQ ID NO: 241148 - DNA, 20 bp, Artificial
  CRISPR gRNA sequence
ttacttgaacctgggaggcg

SEQ ID NO: 241149 - DNA, 20 bp, Artificial
  CRISPR gRNA sequence
tacttgaacctgggaggcgg

SEQ ID NO: 241150 - DNA, 20 bp, Artificial
  CRISPR gRNA sequence
aacctgggaggcggaggttg

SEQ ID NO: 241151 - DNA, 20 bp, Artificial
  CRISPR gRNA sequence
tgggaggcggaggttgcagt

SEQ ID NO: 241152 - DNA, 20 bp, Artificial
  CRISPR gRNA sequence
tcgcatcctgcacttcactc

SEQ ID NO: 241153 - DNA, 20 bp, Artificial
  CRISPR gRNA sequence
tcctgcacttcactccagcc

SEQ ID NO: 241154 - DNA, 20 bp, Artificial
  CRISPR gRNA sequence
cctgcacttcactccagcct

SEQ ID NO: 241155 - DNA, 20 bp, Artificial
  CRISPR gRNA sequence
cttcactccagcctgggcga

SEQ ID NO: 241156 - DNA, 20 bp, Artificial
  CRISPR gRNA sequence
tcactccagcctgggcgaca

SEQ ID NO: 241157 - DNA, 20 bp, Artificial
  CRISPR gRNA sequence
tccagcctgggcgacagagc

SEQ ID NO: 241158 - DNA, 20 bp, Artificial
  CRISPR gRNA sequence
caaaaaaaaaaaaaaaaaaa

SEQ ID NO: 241159 - DNA, 20 bp, Artificial
  CRISPR gRNA sequence
aaaaaaaaaaaaaaaaaaaa

SEQ ID NO: 241160 - DNA, 20 bp, Artificial
  CRISPR gRNA sequence
aaaaaaaaaaaaaaaggaaa

SEQ ID NO: 241161 - DNA, 20 bp, Artificial
  CRISPR gRNA sequence
aaaaaaggaaaaagaaaaaa

SEQ ID NO: 241162 - DNA, 20 bp, Artificial
  CRISPR gRNA sequence
aaagaaaaaaaagaaaaact

SEQ ID NO: 241163 - DNA, 20 bp, Artificial
  CRISPR gRNA sequence
aagaaaaaaaagaaaaactg

SEQ ID NO: 241164 - DNA, 20 bp, Artificial
  CRISPR gRNA sequence
gaaaaaaaagaaaaactgag

SEQ ID NO: 241165 - DNA, 20 bp, Artificial
  CRISPR gRNA sequence
aaaaaaaagaaaaactgagg

SEQ ID NO: 241166 - DNA, 20 bp, Artificial
  CRISPR gRNA sequence
aaaaaaagaaaaactgagga

SEQ ID NO: 241167 - DNA, 20 bp, Artificial
  CRISPR gRNA sequence
aaaactgaggagggttatgt

SEQ ID NO: 241168 - DNA, 20 bp, Artificial
  CRISPR gRNA sequence
aacaattatcctttgctaca

SEQ ID NO: 241169 - DNA, 20 bp, Artificial
  CRISPR gRNA sequence
tttgctacaaagatcaatac

SEQ ID NO: 241170 - DNA, 20 bp, Artificial
  CRISPR gRNA sequence
gctacaaagatcaataccgg

SEQ ID NO: 241171 - DNA, 20 bp, Artificial
  CRISPR gRNA sequence
acaaagatcaataccggcag

SEQ ID NO: 241172 - DNA, 20 bp, Artificial
  CRISPR gRNA sequence
ggcagaagtatttttttgtt

SEQ ID NO: 241173 - DNA, 20 bp, Artificial
  CRISPR gRNA sequence
agtatttttttgttaagata

SEQ ID NO: 241174 - DNA, 20 bp, Artificial
  CRISPR gRNA sequence
atttttttgttaagatacag

SEQ ID NO: 241175 - DNA, 20 bp, Artificial
  CRISPR gRNA sequence
ttgttaagatacagtagcct

SEQ ID NO: 241176 - DNA, 20 bp, Artificial
  CRISPR gRNA sequence
agatacagtagccttggtgc

SEQ ID NO: 241177 - DNA, 20 bp, Artificial
  CRISPR gRNA sequence
gatacagtagccttggtgca

SEQ ID NO: 241178 - DNA, 20 bp, Artificial
  CRISPR gRNA sequence
gtagccttggtgcaaggttg

SEQ ID NO: 241179 - DNA, 20 bp, Artificial
  CRISPR gRNA sequence
gtttctgccatcttttgtga

SEQ ID NO: 241180 - DNA, 20 bp, Artificial
  CRISPR gRNA sequence
tttgtgatagttgtttttat

SEQ ID NO: 241181 - DNA, 20 bp, Artificial
  CRISPR gRNA sequence
ttgtgatagttgtttttatc

SEQ ID NO: 241182 - DNA, 20 bp, Artificial
  CRISPR gRNA sequence
tttatcaggcatgcatgcat

SEQ ID NO: 241183 - DNA, 20 bp, Artificial
  CRISPR gRNA sequence
tgcataagaaacccccttca

SEQ ID NO: 241184 - DNA, 20 bp, Artificial
  CRISPR gRNA sequence
acccccttcacggccttccc

SEQ ID NO: 241185 - DNA, 20 bp, Artificial
  CRISPR gRNA sequence
ccttccctggctccatttgt

SEQ ID NO: 241186 - DNA, 20 bp, Artificial
  CRISPR gRNA sequence
cttccctggctccatttgtc

SEQ ID NO: 241187 - DNA, 20 bp, Artificial
  CRISPR gRNA sequence
ttccctggctccatttgtca

SEQ ID NO: 241188 - DNA, 20 bp, Artificial
  CRISPR gRNA sequence
ttgtttgtttgtttgttttt

SEQ ID NO: 241189 - DNA, 20 bp, Artificial
  CRISPR gRNA sequence
tattgttgttgtttgttttt

SEQ ID NO: 241190 - DNA, 20 bp, Artificial
  CRISPR gRNA sequence
gttgttgtttgtttttgaga

SEQ ID NO: 241191 - DNA, 20 bp, Artificial
  CRISPR gRNA sequence
ttgttgtttgtttttgagac

SEQ ID NO: 241192 - DNA, 20 bp, Artificial
  CRISPR gRNA sequence
caggatctccctgtgtcatt

SEQ ID NO: 241193 - DNA, 20 bp, Artificial
  CRISPR gRNA sequence
aggatctccctgtgtcattc

SEQ ID NO: 241194 - DNA, 20 bp, Artificial
  CRISPR gRNA sequence
tctccctgtgtcattcaggc

SEQ ID NO: 241195 - DNA, 20 bp, Artificial
  CRISPR gRNA sequence
tccctgtgtcattcaggctg

SEQ ID NO: 241196 - DNA, 20 bp, Artificial
  CRISPR gRNA sequence
gtgtcattcaggctggagtg

SEQ ID NO: 241197 - DNA, 20 bp, Artificial
  CRISPR gRNA sequence
tcattcaggctggagtgcag

SEQ ID NO: 241198 - DNA, 20 bp, Artificial
  CRISPR gRNA sequence
tcgctgcaacctccgcctcc

SEQ ID NO: 241199 - DNA, 20 bp, Artificial
  CRISPR gRNA sequence
cgctgcaacctccgcctcct

SEQ ID NO: 241200 - DNA, 20 bp, Artificial
  CRISPR gRNA sequence
aacctccgcctcctgggttc

SEQ ID NO: 241201 - DNA, 20 bp, Artificial
  CRISPR gRNA sequence
ttccagcgattttcgtgcct

SEQ ID NO: 241202 - DNA, 20 bp, Artificial
  CRISPR gRNA sequence
ttttcgtgcctcagcctcct

SEQ ID NO: 241203 - DNA, 20 bp, Artificial
  CRISPR gRNA sequence
tcgtgcctcagcctcctgag

SEQ ID NO: 241204 - DNA, 20 bp, Artificial
  CRISPR gRNA sequence
gcctcagcctcctgagtagc

SEQ ID NO: 241205 - DNA, 20 bp, Artificial
  CRISPR gRNA sequence
cctcagcctcctgagtagct

SEQ ID NO: 241206 - DNA, 20 bp, Artificial
  CRISPR gRNA sequence
ctcctgagtagctgggatta

SEQ ID NO: 241207 - DNA, 20 bp, Artificial
  CRISPR gRNA sequence
tcctgagtagctgggattac

SEQ ID NO: 241208 - DNA, 20 bp, Artificial
  CRISPR gRNA sequence
tgagtagctgggattacagg

SEQ ID NO: 241209 - DNA, 20 bp, Artificial
  CRISPR gRNA sequence
caggcagctgccaccatgcc

SEQ ID NO: 241210 - DNA, 20 bp, Artificial
  CRISPR gRNA sequence
gctgccaccatgcccggcta

SEQ ID NO: 241211 - DNA, 20 bp, Artificial
  CRISPR gRNA sequence
gccaccatgcccggctatag

SEQ ID NO: 241212 - DNA, 20 bp, Artificial
  CRISPR gRNA sequence
caccatgcccggctatagta

SEQ ID NO: 241213 - DNA, 20 bp, Artificial
  CRISPR gRNA sequence
atgcccggctatagtagaga

SEQ ID NO: 241214 - DNA, 20 bp, Artificial
  CRISPR gRNA sequence
tgcccggctatagtagagac

SEQ ID NO: 241215 - DNA, 20 bp, Artificial
  CRISPR gRNA sequence
gcccggctatagtagagacg

SEQ ID NO: 241216 - DNA, 20 bp, Artificial
  CRISPR gRNA sequence
gagacggggttttgccacgt

SEQ ID NO: 241217 - DNA, 20 bp, Artificial
  CRISPR gRNA sequence
cggggttttgccacgttggc

SEQ ID NO: 241218 - DNA, 20 bp, Artificial
  CRISPR gRNA sequence
ggggttttgccacgttggcc

SEQ ID NO: 241219 - DNA, 20 bp, Artificial
  CRISPR gRNA sequence
ttttgccacgttggccaggc

SEQ ID NO: 241220 - DNA, 20 bp, Artificial
  CRISPR gRNA sequence
ccaggctggtcttgaactcc

SEQ ID NO: 241221 - DNA, 20 bp, Artificial
  CRISPR gRNA sequence
ctcatgtgatctgcctgcct

SEQ ID NO: 241222 - DNA, 20 bp, Artificial
  CRISPR gRNA sequence
ctgcctgcctcagtctccca

SEQ ID NO: 241223 - DNA, 20 bp, Artificial
  CRISPR gRNA sequence
gcctcagtctcccaaagtgc

SEQ ID NO: 241224 - DNA, 20 bp, Artificial
  CRISPR gRNA sequence
cctcagtctcccaaagtgct

SEQ ID NO: 241225 - DNA, 20 bp, Artificial
  CRISPR gRNA sequence
ctcccaaagtgctgggatta

SEQ ID NO: 241226 - DNA, 20 bp, Artificial
  CRISPR gRNA sequence
tcccaaagtgctgggattac

SEQ ID NO: 241227 - DNA, 20 bp, Artificial
  CRISPR gRNA sequence
agtgctgggattacaggcat

SEQ ID NO: 241228 - DNA, 20 bp, Artificial
  CRISPR gRNA sequence
caggcatgagccaccatgcc

SEQ ID NO: 241229 - DNA, 20 bp, Artificial
  CRISPR gRNA sequence
accatgcccggcccatttgt

SEQ ID NO: 241230 - DNA, 20 bp, Artificial
  CRISPR gRNA sequence
ccatgcccggcccatttgtc

SEQ ID NO: 241231 - DNA, 20 bp, Artificial
  CRISPR gRNA sequence
catgcccggcccatttgtca

SEQ ID NO: 241232 - DNA, 20 bp, Artificial
  CRISPR gRNA sequence
atttgtcagggttttgacac

SEQ ID NO: 241233 - DNA, 20 bp, Artificial
  CRISPR gRNA sequence
cacaaacgtgaacttttttt

SEQ ID NO: 241234 - DNA, 20 bp, Artificial
  CRISPR gRNA sequence
taagattttgctttttcact

SEQ ID NO: 241235 - DNA, 20 bp, Artificial
  CRISPR gRNA sequence
aatgcccttgatatccatcc

SEQ ID NO: 241236 - DNA, 20 bp, Artificial
  CRISPR gRNA sequence
caagttgctgtgtgtttcaa

SEQ ID NO: 241237 - DNA, 20 bp, Artificial
  CRISPR gRNA sequence
aattctttttccttgctgaa

SEQ ID NO: 241238 - DNA, 20 bp, Artificial
  CRISPR gRNA sequence
tccacgatatgcttgtgcca

SEQ ID NO: 241239 - DNA, 20 bp, Artificial
  CRISPR gRNA sequence
ttttaccatgcacccattaa

SEQ ID NO: 241240 - DNA, 20 bp, Artificial
  CRISPR gRNA sequence
tgttttgactattacatata

SEQ ID NO: 241241 - DNA, 20 bp, Artificial
  CRISPR gRNA sequence
actattacatataaagctgc

SEQ ID NO: 241242 - DNA, 20 bp, Artificial
  CRISPR gRNA sequence
ctattacatataaagctgcg

SEQ ID NO: 241243 - DNA, 20 bp, Artificial
  CRISPR gRNA sequence
ctgcgaggaataattatgta

SEQ ID NO: 241244 - DNA, 20 bp, Artificial
  CRISPR gRNA sequence
tgcgaggaataattatgtac

SEQ ID NO: 241245 - DNA, 20 bp, Artificial
  CRISPR gRNA sequence
aattatgtacaggttttgtg

SEQ ID NO: 241246 - DNA, 20 bp, Artificial
  CRISPR gRNA sequence
gtatctctatgataaatgct

SEQ ID NO: 241247 - DNA, 20 bp, Artificial
  CRISPR gRNA sequence
tatctctatgataaatgctc

SEQ ID NO: 241248 - DNA, 20 bp, Artificial
  CRISPR gRNA sequence
tctctatgataaatgctcag

SEQ ID NO: 241249 - DNA, 20 bp, Artificial
  CRISPR gRNA sequence
atgctcaggagtgcaattgc

SEQ ID NO: 241250 - DNA, 20 bp, Artificial
  CRISPR gRNA sequence
tgctcaggagtgcaattgct

SEQ ID NO: 241251 - DNA, 20 bp, Artificial
  CRISPR gRNA sequence
caattgctgggctatatgtt

SEQ ID NO: 241252 - DNA, 20 bp, Artificial
  CRISPR gRNA sequence
ctatatgtttggtgcttgtt

SEQ ID NO: 241253 - DNA, 20 bp, Artificial
  CRISPR gRNA sequence
ttggtgcttgtttagttttt

SEQ ID NO: 241254 - DNA, 20 bp, Artificial
  CRISPR gRNA sequence
gtgcttgtttagtttttaag

SEQ ID NO: 241255 - DNA, 20 bp, Artificial
  CRISPR gRNA sequence
gaagttgtcgaactattttc

SEQ ID NO: 241256 - DNA, 20 bp, Artificial
  CRISPR gRNA sequence
agttgtcgaactattttcca

SEQ ID NO: 241257 - DNA, 20 bp, Artificial
  CRISPR gRNA sequence
gttgtcgaactattttccag

SEQ ID NO: 241258 - DNA, 20 bp, Artificial
  CRISPR gRNA sequence
gtcgaactattttccagagg

SEQ ID NO: 241259 - DNA, 20 bp, Artificial
  CRISPR gRNA sequence
gtatcattttacattctcat

SEQ ID NO: 241260 - DNA, 20 bp, Artificial
  CRISPR gRNA sequence
atcattttacattctcatcg

SEQ ID NO: 241261 - DNA, 20 bp, Artificial
  CRISPR gRNA sequence
cattgccacaatttttattt

SEQ ID NO: 241262 - DNA, 20 bp, Artificial
  CRISPR gRNA sequence
ttttatttcagctgttctaa

SEQ ID NO: 241263 - DNA, 20 bp, Artificial
  CRISPR gRNA sequence
tttatttcagctgttctaat

SEQ ID NO: 241264 - DNA, 20 bp, Artificial
  CRISPR gRNA sequence
cagctgttctaataggtatg

SEQ ID NO: 241265 - DNA, 20 bp, Artificial
  CRISPR gRNA sequence
ggtatgtagtgacatctcat

SEQ ID NO: 241266 - DNA, 20 bp, Artificial
  CRISPR gRNA sequence
gtatgtagtgacatctcatt

SEQ ID NO: 241267 - DNA, 20 bp, Artificial
  CRISPR gRNA sequence
tatgtagtgacatctcattg

SEQ ID NO: 241268 - DNA, 20 bp, Artificial
  CRISPR gRNA sequence
tttaatttgcacttccctta

SEQ ID NO: 241269 - DNA, 20 bp, Artificial
  CRISPR gRNA sequence
ttaatttgcacttcccttat

SEQ ID NO: 241270 - DNA, 20 bp, Artificial
  CRISPR gRNA sequence
atttgcacttcccttatggg

SEQ ID NO: 241271 - DNA, 20 bp, Artificial
  CRISPR gRNA sequence
ttccatctttatatcttctt

SEQ ID NO: 241272 - DNA, 20 bp, Artificial
  CRISPR gRNA sequence
tctttatatcttcttcagtg

SEQ ID NO: 241273 - DNA, 20 bp, Artificial
  CRISPR gRNA sequence
ttcttcagtgaagtgttgtt

SEQ ID NO: 241274 - DNA, 20 bp, Artificial
  CRISPR gRNA sequence
tcttcagtgaagtgttgttc

SEQ ID NO: 241275 - DNA, 20 bp, Artificial
  CRISPR gRNA sequence
caggtctttcacctattttc

SEQ ID NO: 241276 - DNA, 20 bp, Artificial
  CRISPR gRNA sequence
tctttcacctattttctagt

SEQ ID NO: 241277 - DNA, 20 bp, Artificial
  CRISPR gRNA sequence
tatttgtttgttttactgtt

SEQ ID NO: 241278 - DNA, 20 bp, Artificial
  CRISPR gRNA sequence
ttgttttactgttgagattc

SEQ ID NO: 241279 - DNA, 20 bp, Artificial
  CRISPR gRNA sequence
gttttactgttgagattcaa

SEQ ID NO: 241280 - DNA, 20 bp, Artificial
  CRISPR gRNA sequence
caagagttcttcgtatttcc

SEQ ID NO: 241281 - DNA, 20 bp, Artificial
  CRISPR gRNA sequence
agttcttcgtatttcccaga

SEQ ID NO: 241282 - DNA, 20 bp, Artificial
  CRISPR gRNA sequence
gttcttcgtatttcccagat

SEQ ID NO: 241283 - DNA, 20 bp, Artificial
  CRISPR gRNA sequence
tcttcgtatttcccagatag

SEQ ID NO: 241284 - DNA, 20 bp, Artificial
  CRISPR gRNA sequence
tttcccagataggagtcctt

SEQ ID NO: 241285 - DNA, 20 bp, Artificial
  CRISPR gRNA sequence
ggagtcctttggcatatata

SEQ ID NO: 241286 - DNA, 20 bp, Artificial
  CRISPR gRNA sequence
ggtttataaatattttctcc

SEQ ID NO: 241287 - DNA, 20 bp, Artificial
  CRISPR gRNA sequence
tataaatattttctcccagt

SEQ ID NO: 241288 - DNA, 20 bp, Artificial
  CRISPR gRNA sequence
aaatattttctcccagtcag

SEQ ID NO: 241289 - DNA, 20 bp, Artificial
  CRISPR gRNA sequence
ttgccttttcatcctcttct

SEQ ID NO: 241290 - DNA, 20 bp, Artificial
  CRISPR gRNA sequence
tgccttttcatcctcttctc

SEQ ID NO: 241291 - DNA, 20 bp, Artificial
  CRISPR gRNA sequence
cctcttctcaggctcttcca

SEQ ID NO: 241292 - DNA, 20 bp, Artificial
  CRISPR gRNA sequence
tcttctcaggctcttccaca

SEQ ID NO: 241293 - DNA, 20 bp, Artificial
  CRISPR gRNA sequence
tcaggctcttccacagagaa

SEQ ID NO: 241294 - DNA, 20 bp, Artificial
  CRISPR gRNA sequence
aaagctatttaattttgctg

SEQ ID NO: 241295 - DNA, 20 bp, Artificial
  CRISPR gRNA sequence
tatttaattttgctgaagtc

SEQ ID NO: 241296 - DNA, 20 bp, Artificial
  CRISPR gRNA sequence
ttttgctgaagtccagttta

SEQ ID NO: 241297 - DNA, 20 bp, Artificial
  CRISPR gRNA sequence
tttatggattttttcattta

SEQ ID NO: 241298 - DNA, 20 bp, Artificial
  CRISPR gRNA sequence
tatggattttttcatttatg

SEQ ID NO: 241299 - DNA, 20 bp, Artificial
  CRISPR gRNA sequence
tcatttatggagtcatgtct

SEQ ID NO: 241300 - DNA, 20 bp, Artificial
  CRISPR gRNA sequence
atgtctaagaattcttcact

SEQ ID NO: 241301 - DNA, 20 bp, Artificial
  CRISPR gRNA sequence
aagaattcttcactgagtcc

SEQ ID NO: 241302 - DNA, 20 bp, Artificial
  CRISPR gRNA sequence
agaattcttcactgagtcct

SEQ ID NO: 241303 - DNA, 20 bp, Artificial
  CRISPR gRNA sequence
tcactgagtcctgggtctca

SEQ ID NO: 241304 - DNA, 20 bp, Artificial
  CRISPR gRNA sequence
agtcctgggtctcaaagatt

SEQ ID NO: 241305 - DNA, 20 bp, Artificial
  CRISPR gRNA sequence
gtcctgggtctcaaagattt

SEQ ID NO: 241306 - DNA, 20 bp, Artificial
  CRISPR gRNA sequence
tcctgggtctcaaagattta

SEQ ID NO: 241307 - DNA, 20 bp, Artificial
  CRISPR gRNA sequence
tctatctcttataactttta

SEQ ID NO: 241308 - DNA, 20 bp, Artificial
  CRISPR gRNA sequence
aatcttgattttttttttct

SEQ ID NO: 241309 - DNA, 20 bp, Artificial
  CRISPR gRNA sequence
ttgattttttttttctgaga

SEQ ID NO: 241310 - DNA, 20 bp, Artificial
  CRISPR gRNA sequence
tgattttttttttctgagac

SEQ ID NO: 241311 - DNA, 20 bp, Artificial
  CRISPR gRNA sequence
gattttttttttctgagaca

SEQ ID NO: 241312 - DNA, 20 bp, Artificial
  CRISPR gRNA sequence
agggtctctgctttgtcacc

SEQ ID NO: 241313 - DNA, 20 bp, Artificial
  CRISPR gRNA sequence
gggtctctgctttgtcaccc

SEQ ID NO: 241314 - DNA, 20 bp, Artificial
  CRISPR gRNA sequence
ctctgctttgtcacccaggc

SEQ ID NO: 241315 - DNA, 20 bp, Artificial
  CRISPR gRNA sequence
ctgctttgtcacccaggctg

SEQ ID NO: 241316 - DNA, 20 bp, Artificial
  CRISPR gRNA sequence
ttgtcacccaggctggagtg

SEQ ID NO: 241317 - DNA, 20 bp, Artificial
  CRISPR gRNA sequence
tcacccaggctggagtgcag

SEQ ID NO: 241318 - DNA, 20 bp, Artificial
  CRISPR gRNA sequence
ggagtgcagtggtgtgatca

SEQ ID NO: 241319 - DNA, 20 bp, Artificial
  CRISPR gRNA sequence
ggtgtgatcatggcttactg

SEQ ID NO: 241320 - DNA, 20 bp, Artificial
  CRISPR gRNA sequence
ttactgcagcctccacctcc

SEQ ID NO: 241321 - DNA, 20 bp, Artificial
  CRISPR gRNA sequence
tactgcagcctccacctcct

SEQ ID NO: 241322 - DNA, 20 bp, Artificial
  CRISPR gRNA sequence
agcctccacctcctgggctc

SEQ ID NO: 241323 - DNA, 20 bp, Artificial
  CRISPR gRNA sequence
ctcaagtgatcctccctcct

SEQ ID NO: 241324 - DNA, 20 bp, Artificial
  CRISPR gRNA sequence
tcctccctccttggcctccc

SEQ ID NO: 241325 - DNA, 20 bp, Artificial
  CRISPR gRNA sequence
tccctccttggcctcccaag

SEQ ID NO: 241326 - DNA, 20 bp, Artificial
  CRISPR gRNA sequence
tccttggcctcccaagtagc

SEQ ID NO: 241327 - DNA, 20 bp, Artificial
  CRISPR gRNA sequence
ccttggcctcccaagtagct

SEQ ID NO: 241328 - DNA, 20 bp, Artificial
  CRISPR gRNA sequence
ctcccaagtagctgggacta

SEQ ID NO: 241329 - DNA, 20 bp, Artificial
  CRISPR gRNA sequence
tcccaagtagctgggactac

SEQ ID NO: 241330 - DNA, 20 bp, Artificial
  CRISPR gRNA sequence
ccaagtagctgggactacag

SEQ ID NO: 241331 - DNA, 20 bp, Artificial
  CRISPR gRNA sequence
ctgggactacaggagtgtgc

SEQ ID NO: 241332 - DNA, 20 bp, Artificial
  CRISPR gRNA sequence
gagtgtgccagcacttgctg

SEQ ID NO: 241333 - DNA, 20 bp, Artificial
  CRISPR gRNA sequence
agcacttgctgtggacctat

SEQ ID NO: 241334 - DNA, 20 bp, Artificial
  CRISPR gRNA sequence
tggacctattggactgaaca

SEQ ID NO: 241335 - DNA, 20 bp, Artificial
  CRISPR gRNA sequence
ggacctattggactgaacaa

SEQ ID NO: 241336 - DNA, 20 bp, Artificial
  CRISPR gRNA sequence
gacctattggactgaacaaa

SEQ ID NO: 241337 - DNA, 20 bp, Artificial
  CRISPR gRNA sequence
acctattggactgaacaaag

SEQ ID NO: 241338 - DNA, 20 bp, Artificial
  CRISPR gRNA sequence
cctattggactgaacaaagg

SEQ ID NO: 241339 - DNA, 20 bp, Artificial
  CRISPR gRNA sequence
ctattggactgaacaaaggg

SEQ ID NO: 241340 - DNA, 20 bp, Artificial
  CRISPR gRNA sequence
gactgaacaaaggggggcaa

SEQ ID NO: 241341 - DNA, 20 bp, Artificial
  CRISPR gRNA sequence
tgaacaaaggggggcaaaag

SEQ ID NO: 241342 - DNA, 20 bp, Artificial
  CRISPR gRNA sequence
gaacaaaggggggcaaaagc

SEQ ID NO: 241343 - DNA, 20 bp, Artificial
  CRISPR gRNA sequence
gggggcaaaagcgggaataa

SEQ ID NO: 241344 - DNA, 20 bp, Artificial
  CRISPR gRNA sequence
caaaagcgggaataaaagac

SEQ ID NO: 241345 - DNA, 20 bp, Artificial
  CRISPR gRNA sequence
gggaataaaagacgagacaa

SEQ ID NO: 241346 - DNA, 20 bp, Artificial
  CRISPR gRNA sequence
gaataaaagacgagacaaaa

SEQ ID NO: 241347 - DNA, 20 bp, Artificial
  CRISPR gRNA sequence
acgagacaaaagagtatatt

SEQ ID NO: 241348 - DNA, 20 bp, Artificial
  CRISPR gRNA sequence
agacaaaagagtatatttgg

SEQ ID NO: 241349 - DNA, 20 bp, Artificial
  CRISPR gRNA sequence
caaaagagtatatttggaag

SEQ ID NO: 241350 - DNA, 20 bp, Artificial
  CRISPR gRNA sequence
aaaagagtatatttggaaga

SEQ ID NO: 241351 - DNA, 20 bp, Artificial
  CRISPR gRNA sequence
aaagagtatatttggaagaa

SEQ ID NO: 241352 - DNA, 20 bp, Artificial
  CRISPR gRNA sequence
aagagtatatttggaagaag

SEQ ID NO: 241353 - DNA, 20 bp, Artificial
  CRISPR gRNA sequence
gtatatttggaagaaggggt

SEQ ID NO: 241354 - DNA, 20 bp, Artificial
  CRISPR gRNA sequence
tatatttggaagaaggggtc

SEQ ID NO: 241355 - DNA, 20 bp, Artificial
  CRISPR gRNA sequence
atatttggaagaaggggtca

SEQ ID NO: 241356 - DNA, 20 bp, Artificial
  CRISPR gRNA sequence
tatttggaagaaggggtcag

SEQ ID NO: 241357 - DNA, 20 bp, Artificial
  CRISPR gRNA sequence
atttggaagaaggggtcagg

SEQ ID NO: 241358 - DNA, 20 bp, Artificial
  CRISPR gRNA sequence
gtcagggggcaccttgcctc

SEQ ID NO: 241359 - DNA, 20 bp, Artificial
  CRISPR gRNA sequence
agggggcaccttgcctctag

SEQ ID NO: 241360 - DNA, 20 bp, Artificial
  CRISPR gRNA sequence
gcaccttgcctctagtggac

SEQ ID NO: 241361 - DNA, 20 bp, Artificial
  CRISPR gRNA sequence
caccttgcctctagtggaca

SEQ ID NO: 241362 - DNA, 20 bp, Artificial
  CRISPR gRNA sequence
accttgcctctagtggacaa

SEQ ID NO: 241363 - DNA, 20 bp, Artificial
  CRISPR gRNA sequence
ctctagtggacaagggccct

SEQ ID NO: 241364 - DNA, 20 bp, Artificial
  CRISPR gRNA sequence
caagggccctgagctttaca

SEQ ID NO: 241365 - DNA, 20 bp, Artificial
  CRISPR gRNA sequence
acacagccctccgtatttat

SEQ ID NO: 241366 - DNA, 20 bp, Artificial
  CRISPR gRNA sequence
cacagccctccgtatttatt

SEQ ID NO: 241367 - DNA, 20 bp, Artificial
  CRISPR gRNA sequence
cctccgtatttattaggcaa

SEQ ID NO: 241368 - DNA, 20 bp, Artificial
  CRISPR gRNA sequence
tccgtatttattaggcaaaa

SEQ ID NO: 241369 - DNA, 20 bp, Artificial
  CRISPR gRNA sequence
tatttattaggcaaaagaga

SEQ ID NO: 241370 - DNA, 20 bp, Artificial
  CRISPR gRNA sequence
tattaggcaaaagagatagt

SEQ ID NO: 241371 - DNA, 20 bp, Artificial
  CRISPR gRNA sequence
aggcaaaagagatagtgaga

SEQ ID NO: 241372 - DNA, 20 bp, Artificial
  CRISPR gRNA sequence
caaaagagatagtgagaaag

SEQ ID NO: 241373 - DNA, 20 bp, Artificial
  CRISPR gRNA sequence
aaaagagatagtgagaaagc

SEQ ID NO: 241374 - DNA, 20 bp, Artificial
  CRISPR gRNA sequence
aaagagatagtgagaaagcg

SEQ ID NO: 241375 - DNA, 20 bp, Artificial
  CRISPR gRNA sequence
gagaaagcggggatgattgt

SEQ ID NO: 241376 - DNA, 20 bp, Artificial
  CRISPR gRNA sequence
agaaagcggggatgattgtc

SEQ ID NO: 241377 - DNA, 20 bp, Artificial
  CRISPR gRNA sequence
gatgattgtcgggtaattgt

SEQ ID NO: 241378 - DNA, 20 bp, Artificial
  CRISPR gRNA sequence
attgtcgggtaattgtcagt

SEQ ID NO: 241379 - DNA, 20 bp, Artificial
  CRISPR gRNA sequence
gtaattgtcagttagccgtt

SEQ ID NO: 241380 - DNA, 20 bp, Artificial
  CRISPR gRNA sequence
tcagttagccgtttggtgtt

SEQ ID NO: 241381 - DNA, 20 bp, Artificial
  CRISPR gRNA sequence
gccgtttggtgtttggttca

SEQ ID NO: 241382 - DNA, 20 bp, Artificial
  CRISPR gRNA sequence
gtttggtgtttggttcacag

SEQ ID NO: 241383 - DNA, 20 bp, Artificial
  CRISPR gRNA sequence
tttggtgtttggttcacagc

SEQ ID NO: 241384 - DNA, 20 bp, Artificial
  CRISPR gRNA sequence
ttggttcacagcaggcttgt

SEQ ID NO: 241385 - DNA, 20 bp, Artificial
  CRISPR gRNA sequence
agactgcatcctttgaacaa

SEQ ID NO: 241386 - DNA, 20 bp, Artificial
  CRISPR gRNA sequence
gactgcatcctttgaacaat

SEQ ID NO: 241387 - DNA, 20 bp, Artificial
  CRISPR gRNA sequence
atcctttgaacaataggtgc

SEQ ID NO: 241388 - DNA, 20 bp, Artificial
  CRISPR gRNA sequence
ataggtgctagatttctcaa

SEQ ID NO: 241389 - DNA, 20 bp, Artificial
  CRISPR gRNA sequence
atttctcaatagataacttc

SEQ ID NO: 241390 - DNA, 20 bp, Artificial
  CRISPR gRNA sequence
tttctcaatagataacttca

SEQ ID NO: 241391 - DNA, 20 bp, Artificial
  CRISPR gRNA sequence
tctcaatagataacttcaag

SEQ ID NO: 241392 - DNA, 20 bp, Artificial
  CRISPR gRNA sequence
aatagataacttcaaggagc

SEQ ID NO: 241393 - DNA, 20 bp, Artificial
  CRISPR gRNA sequence
atagataacttcaaggagcc

SEQ ID NO: 241394 - DNA, 20 bp, Artificial
  CRISPR gRNA sequence
tagataacttcaaggagcca

SEQ ID NO: 241395 - DNA, 20 bp, Artificial
  CRISPR gRNA sequence
gataacttcaaggagccagg

SEQ ID NO: 241396 - DNA, 20 bp, Artificial
  CRISPR gRNA sequence
aacttcaaggagccagggag

SEQ ID NO: 241397 - DNA, 20 bp, Artificial
  CRISPR gRNA sequence
agccagggagtagcgtccct

SEQ ID NO: 241398 - DNA, 20 bp, Artificial
  CRISPR gRNA sequence
gcgtccctcagcaaactttt

SEQ ID NO: 241399 - DNA, 20 bp, Artificial
  CRISPR gRNA sequence
tccctcagcaaactttttgg

SEQ ID NO: 241400 - DNA, 20 bp, Artificial
  CRISPR gRNA sequence
ctcagcaaactttttggtgg

SEQ ID NO: 241401 - DNA, 20 bp, Artificial
  CRISPR gRNA sequence
tcagcaaactttttggtggc

SEQ ID NO: 241402 - DNA, 20 bp, Artificial
  CRISPR gRNA sequence
cagcaaactttttggtggca

SEQ ID NO: 241403 - DNA, 20 bp, Artificial
  CRISPR gRNA sequence
caaactttttggtggcaggg

SEQ ID NO: 241404 - DNA, 20 bp, Artificial
  CRISPR gRNA sequence
ttttggtggcagggcagtgt

SEQ ID NO: 241405 - DNA, 20 bp, Artificial
  CRISPR gRNA sequence
cactttgctgtttgatcata

SEQ ID NO: 241406 - DNA, 20 bp, Artificial
  CRISPR gRNA sequence
ctgtttgatcatatagcctc

SEQ ID NO: 241407 - DNA, 20 bp, Artificial
  CRISPR gRNA sequence
tttgatcatatagcctccag

SEQ ID NO: 241408 - DNA, 20 bp, Artificial
  CRISPR gRNA sequence
atagcctccagtggaatgtt

SEQ ID NO: 241409 - DNA, 20 bp, Artificial
  CRISPR gRNA sequence
cctccagtggaatgttgagt

SEQ ID NO: 241410 - DNA, 20 bp, Artificial
  CRISPR gRNA sequence
gttgagttggtcacgtctca

SEQ ID NO: 241411 - DNA, 20 bp, Artificial
  CRISPR gRNA sequence
ttgagttggtcacgtctcac

SEQ ID NO: 241412 - DNA, 20 bp, Artificial
  CRISPR gRNA sequence
tggtcacgtctcacgggctt

SEQ ID NO: 241413 - DNA, 20 bp, Artificial
  CRISPR gRNA sequence
gctttggctctctgcatgcc

SEQ ID NO: 241414 - DNA, 20 bp, Artificial
  CRISPR gRNA sequence
ctttggctctctgcatgcct

SEQ ID NO: 241415 - DNA, 20 bp, Artificial
  CRISPR gRNA sequence
gtaatttttttttttatttt

SEQ ID NO: 241416 - DNA, 20 bp, Artificial
  CRISPR gRNA sequence
tttttttttttattttgaga

SEQ ID NO: 241417 - DNA, 20 bp, Artificial
  CRISPR gRNA sequence
tttttttttattttgagaca

SEQ ID NO: 241418 - DNA, 20 bp, Artificial
  CRISPR gRNA sequence
cagagtctcaccatgttgct

SEQ ID NO: 241419 - DNA, 20 bp, Artificial
  CRISPR gRNA sequence
agagtctcaccatgttgctc

SEQ ID NO: 241420 - DNA, 20 bp, Artificial
  CRISPR gRNA sequence
tctcaccatgttgctcaggc

SEQ ID NO: 241421 - DNA, 20 bp, Artificial
  CRISPR gRNA sequence
tcaggctggtcttgaactcc

SEQ ID NO: 241422 - DNA, 20 bp, Artificial
  CRISPR gRNA sequence
cttaaacaatcctcctgcct

SEQ ID NO: 241423 - DNA, 20 bp, Artificial
  CRISPR gRNA sequence
cctcctgccttggcctccca

SEQ ID NO: 241424 - DNA, 20 bp, Artificial
  CRISPR gRNA sequence
gccttggcctcccaaagtgc

SEQ ID NO: 241425 - DNA, 20 bp, Artificial
  CRISPR gRNA sequence
ccttggcctcccaaagtgct

SEQ ID NO: 241426 - DNA, 20 bp, Artificial
  CRISPR gRNA sequence
ctcccaaagtgctgggatta

SEQ ID NO: 241427 - DNA, 20 bp, Artificial
  CRISPR gRNA sequence
tcccaaagtgctgggattac

SEQ ID NO: 241428 - DNA, 20 bp, Artificial
  CRISPR gRNA sequence
agtgctgggattacaggtgt

SEQ ID NO: 241429 - DNA, 20 bp, Artificial
  CRISPR gRNA sequence
tcgttttaaatttttcgtat

SEQ ID NO: 241430 - DNA, 20 bp, Artificial
  CRISPR gRNA sequence
cgttttaaatttttcgtata

SEQ ID NO: 241431 - DNA, 20 bp, Artificial
  CRISPR gRNA sequence
aaatttttcgtataaggtgt

SEQ ID NO: 241432 - DNA, 20 bp, Artificial
  CRISPR gRNA sequence
atttttcgtataaggtgtga

SEQ ID NO: 241433 - DNA, 20 bp, Artificial
  CRISPR gRNA sequence
tttttcgtataaggtgtgag

SEQ ID NO: 241434 - DNA, 20 bp, Artificial
  CRISPR gRNA sequence
gtataaggtgtgagaggttt

SEQ ID NO: 241435 - DNA, 20 bp, Artificial
  CRISPR gRNA sequence
aggtgtgagaggttttagcc

SEQ ID NO: 241436 - DNA, 20 bp, Artificial
  CRISPR gRNA sequence
tttgttgttgtttttgttgt

SEQ ID NO: 241437 - DNA, 20 bp, Artificial
  CRISPR gRNA sequence
ttgtttttgttgttggacta

SEQ ID NO: 241438 - DNA, 20 bp, Artificial
  CRISPR gRNA sequence
ctatggacgtccaattgctc

SEQ ID NO: 241439 - DNA, 20 bp, Artificial
  CRISPR gRNA sequence
tccaattgctctagcaccac

SEQ ID NO: 241440 - DNA, 20 bp, Artificial
  CRISPR gRNA sequence
aattgctctagcaccactag

SEQ ID NO: 241441 - DNA, 20 bp, Artificial
  CRISPR gRNA sequence
gcaccactagtggaaaacat

SEQ ID NO: 241442 - DNA, 20 bp, Artificial
  CRISPR gRNA sequence
ccttcattgtacctttgtca

SEQ ID NO: 241443 - DNA, 20 bp, Artificial
  CRISPR gRNA sequence
cattgtacctttgtcaaagt

SEQ ID NO: 241444 - DNA, 20 bp, Artificial
  CRISPR gRNA sequence
gtacctttgtcaaagtcagt

SEQ ID NO: 241445 - DNA, 20 bp, Artificial
  CRISPR gRNA sequence
gtcagttggctgcaattacg

SEQ ID NO: 241446 - DNA, 20 bp, Artificial
  CRISPR gRNA sequence
tcagttggctgcaattacgt

SEQ ID NO: 241447 - DNA, 20 bp, Artificial
  CRISPR gRNA sequence
cagttggctgcaattacgtg

SEQ ID NO: 241448 - DNA, 20 bp, Artificial
  CRISPR gRNA sequence
tgcaattacgtggggctatc

SEQ ID NO: 241449 - DNA, 20 bp, Artificial
  CRISPR gRNA sequence
cttcttctgccaataccaca

SEQ ID NO: 241450 - DNA, 20 bp, Artificial
  CRISPR gRNA sequence
ccacacagccttgattactg

SEQ ID NO: 241451 - DNA, 20 bp, Artificial
  CRISPR gRNA sequence
ttatacataaatactgaaat

SEQ ID NO: 241452 - DNA, 20 bp, Artificial
  CRISPR gRNA sequence
tatacataaatactgaaatt

SEQ ID NO: 241453 - DNA, 20 bp, Artificial
  CRISPR gRNA sequence
acataaatactgaaattggg

SEQ ID NO: 241454 - DNA, 20 bp, Artificial
  CRISPR gRNA sequence
ataaatactgaaattgggta

SEQ ID NO: 241455 - DNA, 20 bp, Artificial
  CRISPR gRNA sequence
taaatactgaaattgggtag

SEQ ID NO: 241456 - DNA, 20 bp, Artificial
  CRISPR gRNA sequence
aaatactgaaattgggtaga

SEQ ID NO: 241457 - DNA, 20 bp, Artificial
  CRISPR gRNA sequence
tactgaaattgggtagaggg

SEQ ID NO: 241458 - DNA, 20 bp, Artificial
  CRISPR gRNA sequence
tgaaattgggtagagggtgg

SEQ ID NO: 241459 - DNA, 20 bp, Artificial
  CRISPR gRNA sequence
caaaattgttttatctattc

SEQ ID NO: 241460 - DNA, 20 bp, Artificial
  CRISPR gRNA sequence
ttgcatttccacatacattt

SEQ ID NO: 241461 - DNA, 20 bp, Artificial
  CRISPR gRNA sequence
tgcatttccacatacatttt

SEQ ID NO: 241462 - DNA, 20 bp, Artificial
  CRISPR gRNA sequence
ataatatctatatctacaaa

SEQ ID NO: 241463 - DNA, 20 bp, Artificial
  CRISPR gRNA sequence
tatctatatctacaaaaagc

SEQ ID NO: 241464 - DNA, 20 bp, Artificial
  CRISPR gRNA sequence
tatatctacaaaaagccggc

SEQ ID NO: 241465 - DNA, 20 bp, Artificial
  CRISPR gRNA sequence
atatctacaaaaagccggct

SEQ ID NO: 241466 - DNA, 20 bp, Artificial
  CRISPR gRNA sequence
attgtgttaaatctgcatat

SEQ ID NO: 241467 - DNA, 20 bp, Artificial
  CRISPR gRNA sequence
ttaaatctgcatatcagttt

SEQ ID NO: 241468 - DNA, 20 bp, Artificial
  CRISPR gRNA sequence
taaatctgcatatcagtttc

SEQ ID NO: 241469 - DNA, 20 bp, Artificial
  CRISPR gRNA sequence
attgacatctttactatgtg

SEQ ID NO: 241470 - DNA, 20 bp, Artificial
  CRISPR gRNA sequence
catctttactatgtgaagta

SEQ ID NO: 241471 - DNA, 20 bp, Artificial
  CRISPR gRNA sequence
agtcacatatcacttaatga

SEQ ID NO: 241472 - DNA, 20 bp, Artificial
  CRISPR gRNA sequence
gtcacatatcacttaatgac

SEQ ID NO: 241473 - DNA, 20 bp, Artificial
  CRISPR gRNA sequence
tcacatatcacttaatgaca

SEQ ID NO: 241474 - DNA, 20 bp, Artificial
  CRISPR gRNA sequence
cacatatcacttaatgacag

SEQ ID NO: 241475 - DNA, 20 bp, Artificial
  CRISPR gRNA sequence
atatcacttaatgacagggg

SEQ ID NO: 241476 - DNA, 20 bp, Artificial
  CRISPR gRNA sequence
ttaatgacaggggtagttct

SEQ ID NO: 241477 - DNA, 20 bp, Artificial
  CRISPR gRNA sequence
gttctgagaaatgtgttgtt

SEQ ID NO: 241478 - DNA, 20 bp, Artificial
  CRISPR gRNA sequence
tcgttgttgtgtgaacatca

SEQ ID NO: 241479 - DNA, 20 bp, Artificial
  CRISPR gRNA sequence
gttgttgtgtgaacatcata

SEQ ID NO: 241480 - DNA, 20 bp, Artificial
  CRISPR gRNA sequence
ttgttgtgtgaacatcatag

SEQ ID NO: 241481 - DNA, 20 bp, Artificial
  CRISPR gRNA sequence
tgttgtgtgaacatcataga

SEQ ID NO: 241482 - DNA, 20 bp, Artificial
  CRISPR gRNA sequence
agagggcacttatgcaaacc

SEQ ID NO: 241483 - DNA, 20 bp, Artificial
  CRISPR gRNA sequence
ggcacttatgcaaacctaga

SEQ ID NO: 241484 - DNA, 20 bp, Artificial
  CRISPR gRNA sequence
ttatgcaaacctagatggta

SEQ ID NO: 241485 - DNA, 20 bp, Artificial
  CRISPR gRNA sequence
ggtacagcctactatacacc

SEQ ID NO: 241486 - DNA, 20 bp, Artificial
  CRISPR gRNA sequence
gtacagcctactatacacct

SEQ ID NO: 241487 - DNA, 20 bp, Artificial
  CRISPR gRNA sequence
agcctactatacacctaggc

SEQ ID NO: 241488 - DNA, 20 bp, Artificial
  CRISPR gRNA sequence
tactatacacctaggctgga

SEQ ID NO: 241489 - DNA, 20 bp, Artificial
  CRISPR gRNA sequence
tacacctaggctggatggta

SEQ ID NO: 241490 - DNA, 20 bp, Artificial
  CRISPR gRNA sequence
ctcctatactacaaacctgt

SEQ ID NO: 241491 - DNA, 20 bp, Artificial
  CRISPR gRNA sequence
tcctatactacaaacctgtc

SEQ ID NO: 241492 - DNA, 20 bp, Artificial
  CRISPR gRNA sequence
tgtgactgtaccgaatacca

SEQ ID NO: 241493 - DNA, 20 bp, Artificial
  CRISPR gRNA sequence
gtgactgtaccgaataccat

SEQ ID NO: 241494 - DNA, 20 bp, Artificial
  CRISPR gRNA sequence
cataggcaactgtaacataa

SEQ ID NO: 241495 - DNA, 20 bp, Artificial
  CRISPR gRNA sequence
gtaacataatggtatttgtg

SEQ ID NO: 241496 - DNA, 20 bp, Artificial
  CRISPR gRNA sequence
tagctaaacatatctaaaca

SEQ ID NO: 241497 - DNA, 20 bp, Artificial
  CRISPR gRNA sequence
ctaaacatatctaaacatag

SEQ ID NO: 241498 - DNA, 20 bp, Artificial
  CRISPR gRNA sequence
aaacatatctaaacatagaa

SEQ ID NO: 241499 - DNA, 20 bp, Artificial
  CRISPR gRNA sequence
aacatatctaaacatagaag

SEQ ID NO: 241500 - DNA, 20 bp, Artificial
  CRISPR gRNA sequence
gaaaataatatgatctttgc

SEQ ID NO: 241501 - DNA, 20 bp, Artificial
  CRISPR gRNA sequence
aaaataatatgatctttgcc

SEQ ID NO: 241502 - DNA, 20 bp, Artificial
  CRISPR gRNA sequence
aatatgatctttgccaggcg

SEQ ID NO: 241503 - DNA, 20 bp, Artificial
  CRISPR gRNA sequence
atgatctttgccaggcgcag

SEQ ID NO: 241504 - DNA, 20 bp, Artificial
  CRISPR gRNA sequence
tgtctgtaatcccaacactt

SEQ ID NO: 241505 - DNA, 20 bp, Artificial
  CRISPR gRNA sequence
gtctgtaatcccaacacttt

SEQ ID NO: 241506 - DNA, 20 bp, Artificial
  CRISPR gRNA sequence
ctgtaatcccaacactttgg

SEQ ID NO: 241507 - DNA, 20 bp, Artificial
  CRISPR gRNA sequence
tcccaacactttgggagacc

SEQ ID NO: 241508 - DNA, 20 bp, Artificial
  CRISPR gRNA sequence
cccaacactttgggagacca

SEQ ID NO: 241509 - DNA, 20 bp, Artificial
  CRISPR gRNA sequence
aacactttgggagaccaagg

SEQ ID NO: 241510 - DNA, 20 bp, Artificial
  CRISPR gRNA sequence
acactttgggagaccaaggt

SEQ ID NO: 241511 - DNA, 20 bp, Artificial
  CRISPR gRNA sequence
ctttgggagaccaaggtggg

SEQ ID NO: 241512 - DNA, 20 bp, Artificial
  CRISPR gRNA sequence
ccaaggtgggcagatcacct

SEQ ID NO: 241513 - DNA, 20 bp, Artificial
  CRISPR gRNA sequence
caaggtgggcagatcacctg

SEQ ID NO: 241514 - DNA, 20 bp, Artificial
  CRISPR gRNA sequence
gtgggcagatcacctgaggt

SEQ ID NO: 241515 - DNA, 20 bp, Artificial
  CRISPR gRNA sequence
tgggcagatcacctgaggtc

SEQ ID NO: 241516 - DNA, 20 bp, Artificial
  CRISPR gRNA sequence
ggcagatcacctgaggtcag

SEQ ID NO: 241517 - DNA, 20 bp, Artificial
  CRISPR gRNA sequence
tcacctgaggtcaggagttc

SEQ ID NO: 241518 - DNA, 20 bp, Artificial
  CRISPR gRNA sequence
tgaggtcaggagttcgagac

SEQ ID NO: 241519 - DNA, 20 bp, Artificial
  CRISPR gRNA sequence
tcaggagttcgagactagcc

SEQ ID NO: 241520 - DNA, 20 bp, Artificial
  CRISPR gRNA sequence
cgagactagcctggccaaca

SEQ ID NO: 241521 - DNA, 20 bp, Artificial
  CRISPR gRNA sequence
tctactaaaaatacaaaaat

SEQ ID NO: 241522 - DNA, 20 bp, Artificial
  CRISPR gRNA sequence
ctaaaaatacaaaaattagc

SEQ ID NO: 241523 - DNA, 20 bp, Artificial
  CRISPR gRNA sequence
taaaaatacaaaaattagcc

SEQ ID NO: 241524 - DNA, 20 bp, Artificial
  CRISPR gRNA sequence
atacaaaaattagccgggtg

SEQ ID NO: 241525 - DNA, 20 bp, Artificial
  CRISPR gRNA sequence
caaaaattagccgggtgtgg

SEQ ID NO: 241526 - DNA, 20 bp, Artificial
  CRISPR gRNA sequence
gtggcgcatgcctgtaattc

SEQ ID NO: 241527 - DNA, 20 bp, Artificial
  CRISPR gRNA sequence
tgcctgtaattccagccact

SEQ ID NO: 241528 - DNA, 20 bp, Artificial
  CRISPR gRNA sequence
gcctgtaattccagccactt

SEQ ID NO: 241529 - DNA, 20 bp, Artificial
  CRISPR gRNA sequence
ctgtaattccagccacttgg

SEQ ID NO: 241530 - DNA, 20 bp, Artificial
  CRISPR gRNA sequence
tgtaattccagccacttggg

SEQ ID NO: 241531 - DNA, 20 bp, Artificial
  CRISPR gRNA sequence
ttccagccacttgggaggct

SEQ ID NO: 241532 - DNA, 20 bp, Artificial
  CRISPR gRNA sequence
tccagccacttgggaggctg

SEQ ID NO: 241533 - DNA, 20 bp, Artificial
  CRISPR gRNA sequence
agccacttgggaggctgagg

SEQ ID NO: 241534 - DNA, 20 bp, Artificial
  CRISPR gRNA sequence
gccacttgggaggctgaggt

SEQ ID NO: 241535 - DNA, 20 bp, Artificial
  CRISPR gRNA sequence
cacttgggaggctgaggtgg

SEQ ID NO: 241536 - DNA, 20 bp, Artificial
  CRISPR gRNA sequence
ggagaatcccttgaacctga

SEQ ID NO: 241537 - DNA, 20 bp, Artificial
  CRISPR gRNA sequence
gagaatcccttgaacctgac

SEQ ID NO: 241538 - DNA, 20 bp, Artificial
  CRISPR gRNA sequence
aatcccttgaacctgacagg

SEQ ID NO: 241539 - DNA, 20 bp, Artificial
  CRISPR gRNA sequence
tcccttgaacctgacaggca

SEQ ID NO: 241540 - DNA, 20 bp, Artificial
  CRISPR gRNA sequence
cccttgaacctgacaggcag

SEQ ID NO: 241541 - DNA, 20 bp, Artificial
  CRISPR gRNA sequence
aacctgacaggcagaggttg

SEQ ID NO: 241542 - DNA, 20 bp, Artificial
  CRISPR gRNA sequence
tgacaggcagaggttgcagt

SEQ ID NO: 241543 - DNA, 20 bp, Artificial
  CRISPR gRNA sequence
ggcagaggttgcagtgagcc

SEQ ID NO: 241544 - DNA, 20 bp, Artificial
  CRISPR gRNA sequence
agatcgcatcactgcactcc

SEQ ID NO: 241545 - DNA, 20 bp, Artificial
  CRISPR gRNA sequence
cgcatcactgcactcctggc

SEQ ID NO: 241546 - DNA, 20 bp, Artificial
  CRISPR gRNA sequence
gcatcactgcactcctggct

SEQ ID NO: 241547 - DNA, 20 bp, Artificial
  CRISPR gRNA sequence
ctgcactcctggctgggcaa

SEQ ID NO: 241548 - DNA, 20 bp, Artificial
  CRISPR gRNA sequence
gcactcctggctgggcaaca

SEQ ID NO: 241549 - DNA, 20 bp, Artificial
  CRISPR gRNA sequence
tcctggctgggcaacagagt

SEQ ID NO: 241550 - DNA, 20 bp, Artificial
  CRISPR gRNA sequence
gcaacagagtgagacgccat

SEQ ID NO: 241551 - DNA, 20 bp, Artificial
  CRISPR gRNA sequence
agtgagacgccattagaaac

SEQ ID NO: 241552 - DNA, 20 bp, Artificial
  CRISPR gRNA sequence
gtgagacgccattagaaacc

SEQ ID NO: 241553 - DNA, 20 bp, Artificial
  CRISPR gRNA sequence
ccattagaaaccaggccacc

SEQ ID NO: 241554 - DNA, 20 bp, Artificial
  CRISPR gRNA sequence
ttagaaaccaggccacccag

SEQ ID NO: 241555 - DNA, 20 bp, Artificial
  CRISPR gRNA sequence
tagaaaccaggccacccagc

SEQ ID NO: 241556 - DNA, 20 bp, Artificial
  CRISPR gRNA sequence
gaaaccaggccacccagcag

SEQ ID NO: 241557 - DNA, 20 bp, Artificial
  CRISPR gRNA sequence
aaaccaggccacccagcagg

SEQ ID NO: 241558 - DNA, 20 bp, Artificial
  CRISPR gRNA sequence
accaggccacccagcaggag

SEQ ID NO: 241559 - DNA, 20 bp, Artificial
  CRISPR gRNA sequence
caggccacccagcaggagga

SEQ ID NO: 241560 - DNA, 20 bp, Artificial
  CRISPR gRNA sequence
gccacccagcaggaggagag

SEQ ID NO: 241561 - DNA, 20 bp, Artificial
  CRISPR gRNA sequence
acccagcaggaggagagtgg

SEQ ID NO: 241562 - DNA, 20 bp, Artificial
  CRISPR gRNA sequence
cccagcaggaggagagtggt

SEQ ID NO: 241563 - DNA, 20 bp, Artificial
  CRISPR gRNA sequence
gcaggaggagagtggtgggc

SEQ ID NO: 241564 - DNA, 20 bp, Artificial
  CRISPR gRNA sequence
gagtggtgggcaagcacgtg

SEQ ID NO: 241565 - DNA, 20 bp, Artificial
  CRISPR gRNA sequence
tgaagcttcctctgtattta

SEQ ID NO: 241566 - DNA, 20 bp, Artificial
  CRISPR gRNA sequence
gccttatctccatctcccat

SEQ ID NO: 241567 - DNA, 20 bp, Artificial
  CRISPR gRNA sequence
atctccatctcccatcagat

SEQ ID NO: 241568 - DNA, 20 bp, Artificial
  CRISPR gRNA sequence
tccatctcccatcagatcag

SEQ ID NO: 241569 - DNA, 20 bp, Artificial
  CRISPR gRNA sequence
atctcccatcagatcagcag

SEQ ID NO: 241570 - DNA, 20 bp, Artificial
  CRISPR gRNA sequence
catcagatcagcagcggcat

SEQ ID NO: 241571 - DNA, 20 bp, Artificial
  CRISPR gRNA sequence
gcagcggcattagattctca

SEQ ID NO: 241572 - DNA, 20 bp, Artificial
  CRISPR gRNA sequence
cagcggcattagattctcat

SEQ ID NO: 241573 - DNA, 20 bp, Artificial
  CRISPR gRNA sequence
gcggcattagattctcatag

SEQ ID NO: 241574 - DNA, 20 bp, Artificial
  CRISPR gRNA sequence
ctattgtgaactgcgcatac

SEQ ID NO: 241575 - DNA, 20 bp, Artificial
  CRISPR gRNA sequence
tattgtgaactgcgcatacg

SEQ ID NO: 241576 - DNA, 20 bp, Artificial
  CRISPR gRNA sequence
attgtgaactgcgcatacga

SEQ ID NO: 241577 - DNA, 20 bp, Artificial
  CRISPR gRNA sequence
aactgcgcatacgagggatc

SEQ ID NO: 241578 - DNA, 20 bp, Artificial
  CRISPR gRNA sequence
actgcgcatacgagggatcg

SEQ ID NO: 241579 - DNA, 20 bp, Artificial
  CRISPR gRNA sequence
cgaggttgcacgctccttat

SEQ ID NO: 241580 - DNA, 20 bp, Artificial
  CRISPR gRNA sequence
gcacgctccttatgagaatc

SEQ ID NO: 241581 - DNA, 20 bp, Artificial
  CRISPR gRNA sequence
tcactgttccccatcacccc

SEQ ID NO: 241582 - DNA, 20 bp, Artificial
  CRISPR gRNA sequence
tgttccccatcacccccaga

SEQ ID NO: 241583 - DNA, 20 bp, Artificial
  CRISPR gRNA sequence
gttccccatcacccccagat

SEQ ID NO: 241584 - DNA, 20 bp, Artificial
  CRISPR gRNA sequence
cacccccagatgggactgtc

SEQ ID NO: 241585 - DNA, 20 bp, Artificial
  CRISPR gRNA sequence
cagatgggactgtctagttg

SEQ ID NO: 241586 - DNA, 20 bp, Artificial
  CRISPR gRNA sequence
agatgggactgtctagttgt

SEQ ID NO: 241587 - DNA, 20 bp, Artificial
  CRISPR gRNA sequence
ctgtctagttgtaggaaaac

SEQ ID NO: 241588 - DNA, 20 bp, Artificial
  CRISPR gRNA sequence
tagttgtaggaaaacaagct

SEQ ID NO: 241589 - DNA, 20 bp, Artificial
  CRISPR gRNA sequence
agttgtaggaaaacaagctc

SEQ ID NO: 241590 - DNA, 20 bp, Artificial
  CRISPR gRNA sequence
gttgtaggaaaacaagctca

SEQ ID NO: 241591 - DNA, 20 bp, Artificial
  CRISPR gRNA sequence
ctcccactgattctacatta

SEQ ID NO: 241592 - DNA, 20 bp, Artificial
  CRISPR gRNA sequence
tcccactgattctacattac

SEQ ID NO: 241593 - DNA, 20 bp, Artificial
  CRISPR gRNA sequence
cccactgattctacattaca

SEQ ID NO: 241594 - DNA, 20 bp, Artificial
  CRISPR gRNA sequence
cactgattctacattacagg

SEQ ID NO: 241595 - DNA, 20 bp, Artificial
  CRISPR gRNA sequence
ttatttcattatatattaca

SEQ ID NO: 241596 - DNA, 20 bp, Artificial
  CRISPR gRNA sequence
atattacaaagtaataataa

SEQ ID NO: 241597 - DNA, 20 bp, Artificial
  CRISPR gRNA sequence
aagtaataataatagaaata

SEQ ID NO: 241598 - DNA, 20 bp, Artificial
  CRISPR gRNA sequence
aaaccatccccccacccacc

SEQ ID NO: 241599 - DNA, 20 bp, Artificial
  CRISPR gRNA sequence
ccccccacccacccagtccg

SEQ ID NO: 241600 - DNA, 20 bp, Artificial
  CRISPR gRNA sequence
aaaattgtcttccacaaaac

SEQ ID NO: 241601 - DNA, 20 bp, Artificial
  CRISPR gRNA sequence
aactggtccctcttgccaaa

SEQ ID NO: 241602 - DNA, 20 bp, Artificial
  CRISPR gRNA sequence
actggtccctcttgccaaaa

SEQ ID NO: 241603 - DNA, 20 bp, Artificial
  CRISPR gRNA sequence
gtccctcttgccaaaaaggt

SEQ ID NO: 241604 - DNA, 20 bp, Artificial
  CRISPR gRNA sequence
tccctcttgccaaaaaggtt

SEQ ID NO: 241605 - DNA, 20 bp, Artificial
  CRISPR gRNA sequence
ccctcttgccaaaaaggttg

SEQ ID NO: 241606 - DNA, 20 bp, Artificial
  CRISPR gRNA sequence
acctctgctgtatatcactg

SEQ ID NO: 241607 - DNA, 20 bp, Artificial
  CRISPR gRNA sequence
cttataaacactgtacactt

SEQ ID NO: 241608 - DNA, 20 bp, Artificial
  CRISPR gRNA sequence
cttcaataataaattaacct

SEQ ID NO: 241609 - DNA, 20 bp, Artificial
  CRISPR gRNA sequence
actttaattttttttttttt

SEQ ID NO: 241610 - DNA, 20 bp, Artificial
  CRISPR gRNA sequence
ctttaatttttttttttttg

SEQ ID NO: 241611 - DNA, 20 bp, Artificial
  CRISPR gRNA sequence
taatttttttttttttgagg

SEQ ID NO: 241612 - DNA, 20 bp, Artificial
  CRISPR gRNA sequence
aatttttttttttttgaggc

SEQ ID NO: 241613 - DNA, 20 bp, Artificial
  CRISPR gRNA sequence
atttttttttttttgaggca

SEQ ID NO: 241614 - DNA, 20 bp, Artificial
  CRISPR gRNA sequence
tgaggcagggtcttgctgcc

SEQ ID NO: 241615 - DNA, 20 bp, Artificial
  CRISPR gRNA sequence
gaggcagggtcttgctgccc

SEQ ID NO: 241616 - DNA, 20 bp, Artificial
  CRISPR gRNA sequence
cagggtcttgctgcccaggc

SEQ ID NO: 241617 - DNA, 20 bp, Artificial
  CRISPR gRNA sequence
ttgctgcccaggctggaatg

SEQ ID NO: 241618 - DNA, 20 bp, Artificial
  CRISPR gRNA sequence
ctgcccaggctggaatgcag

SEQ ID NO: 241619 - DNA, 20 bp, Artificial
  CRISPR gRNA sequence
ccaggctggaatgcagtggc

SEQ ID NO: 241620 - DNA, 20 bp, Artificial
  CRISPR gRNA sequence
ggaatgcagtggcgagatct

SEQ ID NO: 241621 - DNA, 20 bp, Artificial
  CRISPR gRNA sequence
ggcgagatcttggctcactg

SEQ ID NO: 241622 - DNA, 20 bp, Artificial
  CRISPR gRNA sequence
tcactgcagcctgcacctcc

SEQ ID NO: 241623 - DNA, 20 bp, Artificial
  CRISPR gRNA sequence
cactgcagcctgcacctccc

SEQ ID NO: 241624 - DNA, 20 bp, Artificial
  CRISPR gRNA sequence
agcctgcacctcccaggttc

SEQ ID NO: 241625 - DNA, 20 bp, Artificial
  CRISPR gRNA sequence
ttcaagtgattctcctgcct

SEQ ID NO: 241626 - DNA, 20 bp, Artificial
  CRISPR gRNA sequence
ttctcctgcctcagcccccc

SEQ ID NO: 241627 - DNA, 20 bp, Artificial
  CRISPR gRNA sequence
tcctgcctcagccccccaag

SEQ ID NO: 241628 - DNA, 20 bp, Artificial
  CRISPR gRNA sequence
gcctcagccccccaagtagc

SEQ ID NO: 241629 - DNA, 20 bp, Artificial
  CRISPR gRNA sequence
cctcagccccccaagtagct

SEQ ID NO: 241630 - DNA, 20 bp, Artificial
  CRISPR gRNA sequence
cccccaagtagctgggacta

SEQ ID NO: 241631 - DNA, 20 bp, Artificial
  CRISPR gRNA sequence
ccccaagtagctgggactac

SEQ ID NO: 241632 - DNA, 20 bp, Artificial
  CRISPR gRNA sequence
caagtagctgggactacagg

SEQ ID NO: 241633 - DNA, 20 bp, Artificial
  CRISPR gRNA sequence
caggcagctgccaccacgcc

SEQ ID NO: 241634 - DNA, 20 bp, Artificial
  CRISPR gRNA sequence
cgcctggctaatttttgtat

SEQ ID NO: 241635 - DNA, 20 bp, Artificial
  CRISPR gRNA sequence
cctggctaatttttgtatta

SEQ ID NO: 241636 - DNA, 20 bp, Artificial
  CRISPR gRNA sequence
gctaatttttgtattagaga

SEQ ID NO: 241637 - DNA, 20 bp, Artificial
  CRISPR gRNA sequence
ctaatttttgtattagagat

SEQ ID NO: 241638 - DNA, 20 bp, Artificial
  CRISPR gRNA sequence
taatttttgtattagagatg

SEQ ID NO: 241639 - DNA, 20 bp, Artificial
  CRISPR gRNA sequence
gagatggggtttcaccatgt

SEQ ID NO: 241640 - DNA, 20 bp, Artificial
  CRISPR gRNA sequence
tggggtttcaccatgttggc

SEQ ID NO: 241641 - DNA, 20 bp, Artificial
  CRISPR gRNA sequence
ggggtttcaccatgttggct

SEQ ID NO: 241642 - DNA, 20 bp, Artificial
  CRISPR gRNA sequence
tttcaccatgttggctaggc

SEQ ID NO: 241643 - DNA, 20 bp, Artificial
  CRISPR gRNA sequence
taggctggtctcgaactcct

SEQ ID NO: 241644 - DNA, 20 bp, Artificial
  CRISPR gRNA sequence
ggtctcgaactcctgagctc

SEQ ID NO: 241645 - DNA, 20 bp, Artificial
  CRISPR gRNA sequence
ctccggtaatctgcccacct

SEQ ID NO: 241646 - DNA, 20 bp, Artificial
  CRISPR gRNA sequence
ctgcccacctcggcctccca

SEQ ID NO: 241647 - DNA, 20 bp, Artificial
  CRISPR gRNA sequence
acctcggcctcccaaagtgc

SEQ ID NO: 241648 - DNA, 20 bp, Artificial
  CRISPR gRNA sequence
cctcggcctcccaaagtgct

SEQ ID NO: 241649 - DNA, 20 bp, Artificial
  CRISPR gRNA sequence
ctcccaaagtgctgggatta

SEQ ID NO: 241650 - DNA, 20 bp, Artificial
  CRISPR gRNA sequence
tcccaaagtgctgggattac

SEQ ID NO: 241651 - DNA, 20 bp, Artificial
  CRISPR gRNA sequence
agtgctgggattacaggcat

SEQ ID NO: 241652 - DNA, 20 bp, Artificial
  CRISPR gRNA sequence
caggcatgagccaccgcacc

SEQ ID NO: 241653 - DNA, 20 bp, Artificial
  CRISPR gRNA sequence
gactcttttgtaataactct

SEQ ID NO: 241654 - DNA, 20 bp, Artificial
  CRISPR gRNA sequence
taactcttagcttaaaacac

SEQ ID NO: 241655 - DNA, 20 bp, Artificial
  CRISPR gRNA sequence
taaaacacaagcacattgta

SEQ ID NO: 241656 - DNA, 20 bp, Artificial
  CRISPR gRNA sequence
tctttatttccttattctat

SEQ ID NO: 241657 - DNA, 20 bp, Artificial
  CRISPR gRNA sequence
ataagcttttatctatttaa

SEQ ID NO: 241658 - DNA, 20 bp, Artificial
  CRISPR gRNA sequence
aactttttttgtgaaaaact

SEQ ID NO: 241659 - DNA, 20 bp, Artificial
  CRISPR gRNA sequence
taagacacgaacacacttat

SEQ ID NO: 241660 - DNA, 20 bp, Artificial
  CRISPR gRNA sequence
cacgaacacacttattagcc

SEQ ID NO: 241661 - DNA, 20 bp, Artificial
  CRISPR gRNA sequence
cttattagcctagacccaca

SEQ ID NO: 241662 - DNA, 20 bp, Artificial
  CRISPR gRNA sequence
tattagcctagacccacaca

SEQ ID NO: 241663 - DNA, 20 bp, Artificial
  CRISPR gRNA sequence
agcctagacccacacagagt

SEQ ID NO: 241664 - DNA, 20 bp, Artificial
  CRISPR gRNA sequence
acctccacatcttgtcccac

SEQ ID NO: 241665 - DNA, 20 bp, Artificial
  CRISPR gRNA sequence
tccacatcttgtcccactgg

SEQ ID NO: 241666 - DNA, 20 bp, Artificial
  CRISPR gRNA sequence
ttgtcccactggaagatctt

SEQ ID NO: 241667 - DNA, 20 bp, Artificial
  CRISPR gRNA sequence
tgtcccactggaagatcttt

SEQ ID NO: 241668 - DNA, 20 bp, Artificial
  CRISPR gRNA sequence
gtcccactggaagatctttg

SEQ ID NO: 241669 - DNA, 20 bp, Artificial
  CRISPR gRNA sequence
ttggggcaaaaacatgcatg

SEQ ID NO: 241670 - DNA, 20 bp, Artificial
  CRISPR gRNA sequence
atgtagctgtcatctcctat

SEQ ID NO: 241671 - DNA, 20 bp, Artificial
  CRISPR gRNA sequence
atgagaacaatgtcttcttc

SEQ ID NO: 241672 - DNA, 20 bp, Artificial
  CRISPR gRNA sequence
ttcttctggaatacctccca

SEQ ID NO: 241673 - DNA, 20 bp, Artificial
  CRISPR gRNA sequence
tcttctggaatacctcccaa

SEQ ID NO: 241674 - DNA, 20 bp, Artificial
  CRISPR gRNA sequence
acctcccaaaggacctgcct

SEQ ID NO: 241675 - DNA, 20 bp, Artificial
  CRISPR gRNA sequence
cctcccaaaggacctgcctg

SEQ ID NO: 241676 - DNA, 20 bp, Artificial
  CRISPR gRNA sequence
gaggctgttttacaattaac

SEQ ID NO: 241677 - DNA, 20 bp, Artificial
  CRISPR gRNA sequence
tgtttgtttgttttttgttt

SEQ ID NO: 241678 - DNA, 20 bp, Artificial
  CRISPR gRNA sequence
tttgtttgttttttgtttga

SEQ ID NO: 241679 - DNA, 20 bp, Artificial
  CRISPR gRNA sequence
ttgtttgttttttgtttgag

SEQ ID NO: 241680 - DNA, 20 bp, Artificial
  CRISPR gRNA sequence
gtttgttttttgtttgagag

SEQ ID NO: 241681 - DNA, 20 bp, Artificial
  CRISPR gRNA sequence
aggagtcttgctctgttgcc

SEQ ID NO: 241682 - DNA, 20 bp, Artificial
  CRISPR gRNA sequence
ggagtcttgctctgttgccc

SEQ ID NO: 241683 - DNA, 20 bp, Artificial
  CRISPR gRNA sequence
tcttgctctgttgcccaggc

SEQ ID NO: 241684 - DNA, 20 bp, Artificial
  CRISPR gRNA sequence
ttgctctgttgcccaggctg

SEQ ID NO: 241685 - DNA, 20 bp, Artificial
  CRISPR gRNA sequence
ttgcccaggctggagtgcaa

SEQ ID NO: 241686 - DNA, 20 bp, Artificial
  CRISPR gRNA sequence
tgcccaggctggagtgcaat

SEQ ID NO: 241687 - DNA, 20 bp, Artificial
  CRISPR gRNA sequence
gcccaggctggagtgcaatg

SEQ ID NO: 241688 - DNA, 20 bp, Artificial
  CRISPR gRNA sequence
caggctggagtgcaatgggg

SEQ ID NO: 241689 - DNA, 20 bp, Artificial
  CRISPR gRNA sequence
ggagtgcaatggggcggtct

SEQ ID NO: 241690 - DNA, 20 bp, Artificial
  CRISPR gRNA sequence
tccctgcaacctctgcctcc

SEQ ID NO: 241691 - DNA, 20 bp, Artificial
  CRISPR gRNA sequence
ccctgcaacctctgcctccc

SEQ ID NO: 241692 - DNA, 20 bp, Artificial
  CRISPR gRNA sequence
aacctctgcctcccgggttc

SEQ ID NO: 241693 - DNA, 20 bp, Artificial
  CRISPR gRNA sequence
acctctgcctcccgggttca

SEQ ID NO: 241694 - DNA, 20 bp, Artificial
  CRISPR gRNA sequence
cctctgcctcccgggttcaa

SEQ ID NO: 241695 - DNA, 20 bp, Artificial
  CRISPR gRNA sequence
ttcaagggattctcctgtct

SEQ ID NO: 241696 - DNA, 20 bp, Artificial
  CRISPR gRNA sequence
ttctcctgtctcagcctccc

SEQ ID NO: 241697 - DNA, 20 bp, Artificial
  CRISPR gRNA sequence
tcctgtctcagcctcccgag

SEQ ID NO: 241698 - DNA, 20 bp, Artificial
  CRISPR gRNA sequence
gtctcagcctcccgagtagc

SEQ ID NO: 241699 - DNA, 20 bp, Artificial
  CRISPR gRNA sequence
tctcagcctcccgagtagct

SEQ ID NO: 241700 - DNA, 20 bp, Artificial
  CRISPR gRNA sequence
ctcccgagtagctgggatta

SEQ ID NO: 241701 - DNA, 20 bp, Artificial
  CRISPR gRNA sequence
tcccgagtagctgggattac

SEQ ID NO: 241702 - DNA, 20 bp, Artificial
  CRISPR gRNA sequence
caggtgcatgccgccatgcc

SEQ ID NO: 241703 - DNA, 20 bp, Artificial
  CRISPR gRNA sequence
ctggctaattttttgtactt

SEQ ID NO: 241704 - DNA, 20 bp, Artificial
  CRISPR gRNA sequence
gctaattttttgtactttag

SEQ ID NO: 241705 - DNA, 20 bp, Artificial
  CRISPR gRNA sequence
taattttttgtactttagta

SEQ ID NO: 241706 - DNA, 20 bp, Artificial
  CRISPR gRNA sequence
tttttgtactttagtagaga

SEQ ID NO: 241707 - DNA, 20 bp, Artificial
  CRISPR gRNA sequence
ttttgtactttagtagagac

SEQ ID NO: 241708 - DNA, 20 bp, Artificial
  CRISPR gRNA sequence
tttgtactttagtagagaca

SEQ ID NO: 241709 - DNA, 20 bp, Artificial
  CRISPR gRNA sequence
cagggtttcaccaaattgcc

SEQ ID NO: 241710 - DNA, 20 bp, Artificial
  CRISPR gRNA sequence
agggtttcaccaaattgccc

SEQ ID NO: 241711 - DNA, 20 bp, Artificial
  CRISPR gRNA sequence
tttcaccaaattgcccaggc

SEQ ID NO: 241712 - DNA, 20 bp, Artificial
  CRISPR gRNA sequence
caggctagtctcaaactcct

SEQ ID NO: 241713 - DNA, 20 bp, Artificial
  CRISPR gRNA sequence
tagtctcaaactcctgagct

SEQ ID NO: 241714 - DNA, 20 bp, Artificial
  CRISPR gRNA sequence
agtctcaaactcctgagctc

SEQ ID NO: 241715 - DNA, 20 bp, Artificial
  CRISPR gRNA sequence
ctcaggcaatccacctgcct

SEQ ID NO: 241716 - DNA, 20 bp, Artificial
  CRISPR gRNA sequence
ccacctgccttggcctccca

SEQ ID NO: 241717 - DNA, 20 bp, Artificial
  CRISPR gRNA sequence
gccttggcctcccaaagtgc

SEQ ID NO: 241718 - DNA, 20 bp, Artificial
  CRISPR gRNA sequence
ccttggcctcccaaagtgct

SEQ ID NO: 241719 - DNA, 20 bp, Artificial
  CRISPR gRNA sequence
ctcccaaagtgctgggatta

SEQ ID NO: 241720 - DNA, 20 bp, Artificial
  CRISPR gRNA sequence
tcccaaagtgctgggattac

SEQ ID NO: 241721 - DNA, 20 bp, Artificial
  CRISPR gRNA sequence
agtgctgggattacaggtgt

SEQ ID NO: 241722 - DNA, 20 bp, Artificial
  CRISPR gRNA sequence
caggtgtgagccacaacacc

SEQ ID NO: 241723 - DNA, 20 bp, Artificial
  CRISPR gRNA sequence
ccacaacacccggccttaac

SEQ ID NO: 241724 - DNA, 20 bp, Artificial
  CRISPR gRNA sequence
tatatatatatatatatata

SEQ ID NO: 241725 - DNA, 20 bp, Artificial
  CRISPR gRNA sequence
tactatgaaataactataaa

SEQ ID NO: 241726 - DNA, 20 bp, Artificial
  CRISPR gRNA sequence
tgaaataactataaaaagta

SEQ ID NO: 241727 - DNA, 20 bp, Artificial
  CRISPR gRNA sequence
taactataaaaagtatggta

SEQ ID NO: 241728 - DNA, 20 bp, Artificial
  CRISPR gRNA sequence
tataaaaagtatggtatagt

SEQ ID NO: 241729 - DNA, 20 bp, Artificial
  CRISPR gRNA sequence
aagtccataaactactaaca

SEQ ID NO: 241730 - DNA, 20 bp, Artificial
  CRISPR gRNA sequence
agtcatttattgtcattgtc

SEQ ID NO: 241731 - DNA, 20 bp, Artificial
  CRISPR gRNA sequence
gtcatttattgtcattgtca

SEQ ID NO: 241732 - DNA, 20 bp, Artificial
  CRISPR gRNA sequence
tatgctacactttacacaac

SEQ ID NO: 241733 - DNA, 20 bp, Artificial
  CRISPR gRNA sequence
gctacactttacacaactgg

SEQ ID NO: 241734 - DNA, 20 bp, Artificial
  CRISPR gRNA sequence
actttacacaactggcagct

SEQ ID NO: 241735 - DNA, 20 bp, Artificial
  CRISPR gRNA sequence
ttacacaactggcagctcag

SEQ ID NO: 241736 - DNA, 20 bp, Artificial
  CRISPR gRNA sequence
tacacaactggcagctcagt

SEQ ID NO: 241737 - DNA, 20 bp, Artificial
  CRISPR gRNA sequence
gctcagtaggttttttacat

SEQ ID NO: 241738 - DNA, 20 bp, Artificial
  CRISPR gRNA sequence
atcagtatcaccacaaacgt

SEQ ID NO: 241739 - DNA, 20 bp, Artificial
  CRISPR gRNA sequence
tcaccacaaacgtgagcaat

SEQ ID NO: 241740 - DNA, 20 bp, Artificial
  CRISPR gRNA sequence
gctgtgctgcaatgttatga

SEQ ID NO: 241741 - DNA, 20 bp, Artificial
  CRISPR gRNA sequence
tgctgcaatgttatgatggt

SEQ ID NO: 241742 - DNA, 20 bp, Artificial
  CRISPR gRNA sequence
ttatgatggttggacatcac

SEQ ID NO: 241743 - DNA, 20 bp, Artificial
  CRISPR gRNA sequence
tatgatggttggacatcacg

SEQ ID NO: 241744 - DNA, 20 bp, Artificial
  CRISPR gRNA sequence
ggttggacatcacgaggcaa

SEQ ID NO: 241745 - DNA, 20 bp, Artificial
  CRISPR gRNA sequence
gttggacatcacgaggcaat

SEQ ID NO: 241746 - DNA, 20 bp, Artificial
  CRISPR gRNA sequence
acgaggcaataggaactttt

SEQ ID NO: 241747 - DNA, 20 bp, Artificial
  CRISPR gRNA sequence
tcagctccactataatctta

SEQ ID NO: 241748 - DNA, 20 bp, Artificial
  CRISPR gRNA sequence
cagctccactataatcttat

SEQ ID NO: 241749 - DNA, 20 bp, Artificial
  CRISPR gRNA sequence
tgggaccacgatcatatatg

SEQ ID NO: 241750 - DNA, 20 bp, Artificial
  CRISPR gRNA sequence
tgtatgactgtattctaatg

SEQ ID NO: 241751 - DNA, 20 bp, Artificial
  CRISPR gRNA sequence
gtatgactgtattctaatgc

SEQ ID NO: 241752 - DNA, 20 bp, Artificial
  CRISPR gRNA sequence
tgtattctaatgcaggaaca

SEQ ID NO: 241753 - DNA, 20 bp, Artificial
  CRISPR gRNA sequence
cattttaaaatttatttcac

SEQ ID NO: 241754 - DNA, 20 bp, Artificial
  CRISPR gRNA sequence
tttatttcaccagcattttg

SEQ ID NO: 241755 - DNA, 20 bp, Artificial
  CRISPR gRNA sequence
ttttgtagttttcactatac

SEQ ID NO: 241756 - DNA, 20 bp, Artificial
  CRISPR gRNA sequence
aagttctgtatgtgttttgt

SEQ ID NO: 241757 - DNA, 20 bp, Artificial
  CRISPR gRNA sequence
tgtatgtgttttgttagatt

SEQ ID NO: 241758 - DNA, 20 bp, Artificial
  CRISPR gRNA sequence
gtatgtgttttgttagattt

SEQ ID NO: 241759 - DNA, 20 bp, Artificial
  CRISPR gRNA sequence
gttttgttagatttaggcct

SEQ ID NO: 241760 - DNA, 20 bp, Artificial
  CRISPR gRNA sequence
taagtaaaaaaaaaattttt

SEQ ID NO: 241761 - DNA, 20 bp, Artificial
  CRISPR gRNA sequence
gtaaaaaaaaaattttttag

SEQ ID NO: 241762 - DNA, 20 bp, Artificial
  CRISPR gRNA sequence
aaaaaaaattttttagaagt

SEQ ID NO: 241763 - DNA, 20 bp, Artificial
  CRISPR gRNA sequence
aaaaaaattttttagaagtc

SEQ ID NO: 241764 - DNA, 20 bp, Artificial
  CRISPR gRNA sequence
aaaaaattttttagaagtca

SEQ ID NO: 241765 - DNA, 20 bp, Artificial
  CRISPR gRNA sequence
gtcttgcttgctctattacc

SEQ ID NO: 241766 - DNA, 20 bp, Artificial
  CRISPR gRNA sequence
tcttgcttgctctattaccc

SEQ ID NO: 241767 - DNA, 20 bp, Artificial
  CRISPR gRNA sequence
tgcttgctctattacccagg

SEQ ID NO: 241768 - DNA, 20 bp, Artificial
  CRISPR gRNA sequence
gcttgctctattacccaggc

SEQ ID NO: 241769 - DNA, 20 bp, Artificial
  CRISPR gRNA sequence
ttgctctattacccaggcgg

SEQ ID NO: 241770 - DNA, 20 bp, Artificial
  CRISPR gRNA sequence
ctattacccaggcgggagtg

SEQ ID NO: 241771 - DNA, 20 bp, Artificial
  CRISPR gRNA sequence
ttacccaggcgggagtgcag

SEQ ID NO: 241772 - DNA, 20 bp, Artificial
  CRISPR gRNA sequence
ggcatgatcacgcctcaatg

SEQ ID NO: 241773 - DNA, 20 bp, Artificial
  CRISPR gRNA sequence
tcaatgcagcctcaacttcc

SEQ ID NO: 241774 - DNA, 20 bp, Artificial
  CRISPR gRNA sequence
caatgcagcctcaacttcct

SEQ ID NO: 241775 - DNA, 20 bp, Artificial
  CRISPR gRNA sequence
agcctcaacttcctgggctc

SEQ ID NO: 241776 - DNA, 20 bp, Artificial
  CRISPR gRNA sequence
ctcaagtgatcctcccacct

SEQ ID NO: 241777 - DNA, 20 bp, Artificial
  CRISPR gRNA sequence
gatcctcccacctcagcctc

SEQ ID NO: 241778 - DNA, 20 bp, Artificial
  CRISPR gRNA sequence
tcctcccacctcagcctcca

SEQ ID NO: 241779 - DNA, 20 bp, Artificial
  CRISPR gRNA sequence
tcccacctcagcctccagag

SEQ ID NO: 241780 - DNA, 20 bp, Artificial
  CRISPR gRNA sequence
cctcagcctccagagtagct

SEQ ID NO: 241781 - DNA, 20 bp, Artificial
  CRISPR gRNA sequence
ctccagagtagctgagacta

SEQ ID NO: 241782 - DNA, 20 bp, Artificial
  CRISPR gRNA sequence
cagtcatgtgccaccacccc

SEQ ID NO: 241783 - DNA, 20 bp, Artificial
  CRISPR gRNA sequence
gctaatttttaaatgttttg

SEQ ID NO: 241784 - DNA, 20 bp, Artificial
  CRISPR gRNA sequence
taatttttaaatgttttgta

SEQ ID NO: 241785 - DNA, 20 bp, Artificial
  CRISPR gRNA sequence
ttttaaatgttttgtagaga

SEQ ID NO: 241786 - DNA, 20 bp, Artificial
  CRISPR gRNA sequence
tttaaatgttttgtagagac

SEQ ID NO: 241787 - DNA, 20 bp, Artificial
  CRISPR gRNA sequence
ttaaatgttttgtagagaca

SEQ ID NO: 241788 - DNA, 20 bp, Artificial
  CRISPR gRNA sequence
agggtcttgctctgttaccc

SEQ ID NO: 241789 - DNA, 20 bp, Artificial
  CRISPR gRNA sequence
tcttgctctgttacccaagc

SEQ ID NO: 241790 - DNA, 20 bp, Artificial
  CRISPR gRNA sequence
ctctgttacccaagctggtc

SEQ ID NO: 241791 - DNA, 20 bp, Artificial
  CRISPR gRNA sequence
ccaagctggtctagaactcc

SEQ ID NO: 241792 - DNA, 20 bp, Artificial
  CRISPR gRNA sequence
ggtctagaactcctggactc

SEQ ID NO: 241793 - DNA, 20 bp, Artificial
  CRISPR gRNA sequence
ctcaagcgatcctcctgcct

SEQ ID NO: 241794 - DNA, 20 bp, Artificial
  CRISPR gRNA sequence
tcctcctgccttggccccca

SEQ ID NO: 241795 - DNA, 20 bp, Artificial
  CRISPR gRNA sequence
tgccttggcccccatagtat

SEQ ID NO: 241796 - DNA, 20 bp, Artificial
  CRISPR gRNA sequence
gccttggcccccatagtatt

SEQ ID NO: 241797 - DNA, 20 bp, Artificial
  CRISPR gRNA sequence
cccccatagtattgggatta

SEQ ID NO: 241798 - DNA, 20 bp, Artificial
  CRISPR gRNA sequence
ccccatagtattgggattac

SEQ ID NO: 241799 - DNA, 20 bp, Artificial
  CRISPR gRNA sequence
agtattgggattacaggcgt

SEQ ID NO: 241800 - DNA, 20 bp, Artificial
  CRISPR gRNA sequence
caggcgtgagcccccacacc

SEQ ID NO: 241801 - DNA, 20 bp, Artificial
  CRISPR gRNA sequence
gagcccccacacccagtttc

SEQ ID NO: 241802 - DNA, 20 bp, Artificial
  CRISPR gRNA sequence
cccagtttctggatctaatt

SEQ ID NO: 241803 - DNA, 20 bp, Artificial
  CRISPR gRNA sequence
atttagatcttgtattttct

SEQ ID NO: 241804 - DNA, 20 bp, Artificial
  CRISPR gRNA sequence
tttagatcttgtattttctc

SEQ ID NO: 241805 - DNA, 20 bp, Artificial
  CRISPR gRNA sequence
ttagatcttgtattttctca

SEQ ID NO: 241806 - DNA, 20 bp, Artificial
  CRISPR gRNA sequence
gggttcctctgacatcactc

SEQ ID NO: 241807 - DNA, 20 bp, Artificial
  CRISPR gRNA sequence
ggttcctctgacatcactct

SEQ ID NO: 241808 - DNA, 20 bp, Artificial
  CRISPR gRNA sequence
gttcctctgacatcactcta

SEQ ID NO: 241809 - DNA, 20 bp, Artificial
  CRISPR gRNA sequence
cctctgacatcactctaggg

SEQ ID NO: 241810 - DNA, 20 bp, Artificial
  CRISPR gRNA sequence
ctctgacatcactctaggga

SEQ ID NO: 241811 - DNA, 20 bp, Artificial
  CRISPR gRNA sequence
tgacatcactctagggaagg

SEQ ID NO: 241812 - DNA, 20 bp, Artificial
  CRISPR gRNA sequence
gacatcactctagggaagga

SEQ ID NO: 241813 - DNA, 20 bp, Artificial
  CRISPR gRNA sequence
catcactctagggaaggaag

SEQ ID NO: 241814 - DNA, 20 bp, Artificial
  CRISPR gRNA sequence
atcactctagggaaggaagg

SEQ ID NO: 241815 - DNA, 20 bp, Artificial
  CRISPR gRNA sequence
ctctagggaaggaaggagga

SEQ ID NO: 241816 - DNA, 20 bp, Artificial
  CRISPR gRNA sequence
tctagggaaggaaggaggat

SEQ ID NO: 241817 - DNA, 20 bp, Artificial
  CRISPR gRNA sequence
agggaaggaaggaggatggg

SEQ ID NO: 241818 - DNA, 20 bp, Artificial
  CRISPR gRNA sequence
ggaggatgggcagctcgtta

SEQ ID NO: 241819 - DNA, 20 bp, Artificial
  CRISPR gRNA sequence
gatgggcagctcgttacggc

SEQ ID NO: 241820 - DNA, 20 bp, Artificial
  CRISPR gRNA sequence
atgggcagctcgttacggcc

SEQ ID NO: 241821 - DNA, 20 bp, Artificial
  CRISPR gRNA sequence
ggcagctcgttacggccagg

SEQ ID NO: 241822 - DNA, 20 bp, Artificial
  CRISPR gRNA sequence
gcagctcgttacggccaggc

SEQ ID NO: 241823 - DNA, 20 bp, Artificial
  CRISPR gRNA sequence
cagctcgttacggccaggca

SEQ ID NO: 241824 - DNA, 20 bp, Artificial
  CRISPR gRNA sequence
agctcgttacggccaggcag

SEQ ID NO: 241825 - DNA, 20 bp, Artificial
  CRISPR gRNA sequence
tcgttacggccaggcagggg

SEQ ID NO: 241826 - DNA, 20 bp, Artificial
  CRISPR gRNA sequence
gttacggccaggcaggggtg

SEQ ID NO: 241827 - DNA, 20 bp, Artificial
  CRISPR gRNA sequence
ttacggccaggcaggggtgg

SEQ ID NO: 241828 - DNA, 20 bp, Artificial
  CRISPR gRNA sequence
cggccaggcaggggtggagg

SEQ ID NO: 241829 - DNA, 20 bp, Artificial
  CRISPR gRNA sequence
aggcaggggtggaggaagtt

SEQ ID NO: 241830 - DNA, 20 bp, Artificial
  CRISPR gRNA sequence
ggcaggggtggaggaagttt

SEQ ID NO: 241831 - DNA, 20 bp, Artificial
  CRISPR gRNA sequence
gggttctatgctatacctcc

SEQ ID NO: 241832 - DNA, 20 bp, Artificial
  CRISPR gRNA sequence
gttctatgctatacctcctg

SEQ ID NO: 241833 - DNA, 20 bp, Artificial
  CRISPR gRNA sequence
ttctatgctatacctcctgg

SEQ ID NO: 241834 - DNA, 20 bp, Artificial
  CRISPR gRNA sequence
tctatgctatacctcctgga

SEQ ID NO: 241835 - DNA, 20 bp, Artificial
  CRISPR gRNA sequence
tgctatacctcctggagggt

SEQ ID NO: 241836 - DNA, 20 bp, Artificial
  CRISPR gRNA sequence
gctatacctcctggagggtg

SEQ ID NO: 241837 - DNA, 20 bp, Artificial
  CRISPR gRNA sequence
ctatacctcctggagggtga

SEQ ID NO: 241838 - DNA, 20 bp, Artificial
  CRISPR gRNA sequence
gagggtctcctttttactgc

SEQ ID NO: 241839 - DNA, 20 bp, Artificial
  CRISPR gRNA sequence
cctttttactgctagacacg

SEQ ID NO: 241840 - DNA, 20 bp, Artificial
  CRISPR gRNA sequence
ctttttactgctagacacgt

SEQ ID NO: 241841 - DNA, 20 bp, Artificial
  CRISPR gRNA sequence
ttttactgctagacacgtgg

SEQ ID NO: 241842 - DNA, 20 bp, Artificial
  CRISPR gRNA sequence
tgctagacacgtgggagttc

SEQ ID NO: 241843 - DNA, 20 bp, Artificial
  CRISPR gRNA sequence
gtgggagttctagctcccac

SEQ ID NO: 241844 - DNA, 20 bp, Artificial
  CRISPR gRNA sequence
tgggagttctagctcccact

SEQ ID NO: 241845 - DNA, 20 bp, Artificial
  CRISPR gRNA sequence
ggcctcctctgacactaccc

SEQ ID NO: 241846 - DNA, 20 bp, Artificial
  CRISPR gRNA sequence
gcctcctctgacactacccc

SEQ ID NO: 241847 - DNA, 20 bp, Artificial
  CRISPR gRNA sequence
ctcctctgacactaccccag

SEQ ID NO: 241848 - DNA, 20 bp, Artificial
  CRISPR gRNA sequence
tcctctgacactaccccagg

SEQ ID NO: 241849 - DNA, 20 bp, Artificial
  CRISPR gRNA sequence
cctctgacactaccccagga

SEQ ID NO: 241850 - DNA, 20 bp, Artificial
  CRISPR gRNA sequence
tctgacactaccccaggagg

SEQ ID NO: 241851 - DNA, 20 bp, Artificial
  CRISPR gRNA sequence
ctgacactaccccaggaggg

SEQ ID NO: 241852 - DNA, 20 bp, Artificial
  CRISPR gRNA sequence
tgacactaccccaggaggga

SEQ ID NO: 241853 - DNA, 20 bp, Artificial
  CRISPR gRNA sequence
gacactaccccaggagggag

SEQ ID NO: 241854 - DNA, 20 bp, Artificial
  CRISPR gRNA sequence
acactaccccaggagggagg

SEQ ID NO: 241855 - DNA, 20 bp, Artificial
  CRISPR gRNA sequence
actaccccaggagggagggg

SEQ ID NO: 241856 - DNA, 20 bp, Artificial
  CRISPR gRNA sequence
cccaggagggagggggagat

SEQ ID NO: 241857 - DNA, 20 bp, Artificial
  CRISPR gRNA sequence
agggggagatgagccttaat

SEQ ID NO: 241858 - DNA, 20 bp, Artificial
  CRISPR gRNA sequence
gatgagccttaatcagccgt

SEQ ID NO: 241859 - DNA, 20 bp, Artificial
  CRISPR gRNA sequence
atgagccttaatcagccgtg

SEQ ID NO: 241860 - DNA, 20 bp, Artificial
  CRISPR gRNA sequence
tgagccttaatcagccgtga

SEQ ID NO: 241861 - DNA, 20 bp, Artificial
  CRISPR gRNA sequence
gccttaatcagccgtgaggg

SEQ ID NO: 241862 - DNA, 20 bp, Artificial
  CRISPR gRNA sequence
ttaatcagccgtgagggtgg

SEQ ID NO: 241863 - DNA, 20 bp, Artificial
  CRISPR gRNA sequence
cagccgtgagggtggaagtc

SEQ ID NO: 241864 - DNA, 20 bp, Artificial
  CRISPR gRNA sequence
agccgtgagggtggaagtcc

SEQ ID NO: 241865 - DNA, 20 bp, Artificial
  CRISPR gRNA sequence
ggaagtccaggctctctact

SEQ ID NO: 241866 - DNA, 20 bp, Artificial
  CRISPR gRNA sequence
gctctctactcagtccttcc

SEQ ID NO: 241867 - DNA, 20 bp, Artificial
  CRISPR gRNA sequence
ctctactcagtccttcctgg

SEQ ID NO: 241868 - DNA, 20 bp, Artificial
  CRISPR gRNA sequence
tctactcagtccttcctggt

SEQ ID NO: 241869 - DNA, 20 bp, Artificial
  CRISPR gRNA sequence
agtccttcctggtgggcttg

SEQ ID NO: 241870 - DNA, 20 bp, Artificial
  CRISPR gRNA sequence
gtccttcctggtgggcttgc

SEQ ID NO: 241871 - DNA, 20 bp, Artificial
  CRISPR gRNA sequence
cttcctggtgggcttgcagg

SEQ ID NO: 241872 - DNA, 20 bp, Artificial
  CRISPR gRNA sequence
tcctggtgggcttgcaggcg

SEQ ID NO: 241873 - DNA, 20 bp, Artificial
  CRISPR gRNA sequence
tgggcttgcaggcggagcca

SEQ ID NO: 241874 - DNA, 20 bp, Artificial
  CRISPR gRNA sequence
cggagccacggtgttttttg

SEQ ID NO: 241875 - DNA, 20 bp, Artificial
  CRISPR gRNA sequence
tgttttttgtggtgttttgt

SEQ ID NO: 241876 - DNA, 20 bp, Artificial
  CRISPR gRNA sequence
tgtggtgttttgttagaatt

SEQ ID NO: 241877 - DNA, 20 bp, Artificial
  CRISPR gRNA sequence
ggtgttttgttagaattgag

SEQ ID NO: 241878 - DNA, 20 bp, Artificial
  CRISPR gRNA sequence
agaattgagtggttattgtc

SEQ ID NO: 241879 - DNA, 20 bp, Artificial
  CRISPR gRNA sequence
attgagtggttattgtctag

SEQ ID NO: 241880 - DNA, 20 bp, Artificial
  CRISPR gRNA sequence
ggttattgtctagaagtttt

SEQ ID NO: 241881 - DNA, 20 bp, Artificial
  CRISPR gRNA sequence
ttgtctagaagtttttggac

SEQ ID NO: 241882 - DNA, 20 bp, Artificial
  CRISPR gRNA sequence
tgtctagaagtttttggacc

SEQ ID NO: 241883 - DNA, 20 bp, Artificial
  CRISPR gRNA sequence
agaagtttttggaccaggtg

SEQ ID NO: 241884 - DNA, 20 bp, Artificial
  CRISPR gRNA sequence
agtttttggaccaggtgtgg

SEQ ID NO: 241885 - DNA, 20 bp, Artificial
  CRISPR gRNA sequence
gtggctcacgcctgtaatcc

SEQ ID NO: 241886 - DNA, 20 bp, Artificial
  CRISPR gRNA sequence
cgcctgtaatcccagcactt

SEQ ID NO: 241887 - DNA, 20 bp, Artificial
  CRISPR gRNA sequence
gcctgtaatcccagcacttt

SEQ ID NO: 241888 - DNA, 20 bp, Artificial
  CRISPR gRNA sequence
ctgtaatcccagcactttgg

SEQ ID NO: 241889 - DNA, 20 bp, Artificial
  CRISPR gRNA sequence
tgtaatcccagcactttggg

SEQ ID NO: 241890 - DNA, 20 bp, Artificial
  CRISPR gRNA sequence
tcccagcactttgggaggcc

SEQ ID NO: 241891 - DNA, 20 bp, Artificial
  CRISPR gRNA sequence
agcactttgggaggcccaga

SEQ ID NO: 241892 - DNA, 20 bp, Artificial
  CRISPR gRNA sequence
gcactttgggaggcccagat

SEQ ID NO: 241893 - DNA, 20 bp, Artificial
  CRISPR gRNA sequence
ctttgggaggcccagatggg

SEQ ID NO: 241894 - DNA, 20 bp, Artificial
  CRISPR gRNA sequence
ggcccagatgggcggatcat

SEQ ID NO: 241895 - DNA, 20 bp, Artificial
  CRISPR gRNA sequence
gcccagatgggcggatcata

SEQ ID NO: 241896 - DNA, 20 bp, Artificial
  CRISPR gRNA sequence
agatgggcggatcataaggt

SEQ ID NO: 241897 - DNA, 20 bp, Artificial
  CRISPR gRNA sequence
gatgggcggatcataaggtc

SEQ ID NO: 241898 - DNA, 20 bp, Artificial
  CRISPR gRNA sequence
tgggcggatcataaggtcag

SEQ ID NO: 241899 - DNA, 20 bp, Artificial
  CRISPR gRNA sequence
gatcataaggtcaggagttt

SEQ ID NO: 241900 - DNA, 20 bp, Artificial
  CRISPR gRNA sequence
taaggtcaggagtttgagac

SEQ ID NO: 241901 - DNA, 20 bp, Artificial
  CRISPR gRNA sequence
tcaggagtttgagaccagcc

SEQ ID NO: 241902 - DNA, 20 bp, Artificial
  CRISPR gRNA sequence
tgagaccagcctggccaata

SEQ ID NO: 241903 - DNA, 20 bp, Artificial
  CRISPR gRNA sequence
tctactaaaaacacaaaaat

SEQ ID NO: 241904 - DNA, 20 bp, Artificial
  CRISPR gRNA sequence
ctaaaaacacaaaaattagc

SEQ ID NO: 241905 - DNA, 20 bp, Artificial
  CRISPR gRNA sequence
taaaaacacaaaaattagcc

SEQ ID NO: 241906 - DNA, 20 bp, Artificial
  CRISPR gRNA sequence
acacaaaaattagccgggcc

SEQ ID NO: 241907 - DNA, 20 bp, Artificial
  CRISPR gRNA sequence
caaaaattagccgggcctgg

SEQ ID NO: 241908 - DNA, 20 bp, Artificial
  CRISPR gRNA sequence
aaattagccgggcctggtgg

SEQ ID NO: 241909 - DNA, 20 bp, Artificial
  CRISPR gRNA sequence
aattagccgggcctggtggc

SEQ ID NO: 241910 - DNA, 20 bp, Artificial
  CRISPR gRNA sequence
ggcctggtggcgggcacctg

SEQ ID NO: 241911 - DNA, 20 bp, Artificial
  CRISPR gRNA sequence
gtggcgggcacctgtagtcc

SEQ ID NO: 241912 - DNA, 20 bp, Artificial
  CRISPR gRNA sequence
cacctgtagtcccagctact

SEQ ID NO: 241913 - DNA, 20 bp, Artificial
  CRISPR gRNA sequence
acctgtagtcccagctactc

SEQ ID NO: 241914 - DNA, 20 bp, Artificial
  CRISPR gRNA sequence
ctgtagtcccagctactcag

SEQ ID NO: 241915 - DNA, 20 bp, Artificial
  CRISPR gRNA sequence
tcccagctactcaggagact

SEQ ID NO: 241916 - DNA, 20 bp, Artificial
  CRISPR gRNA sequence
cccagctactcaggagactg

SEQ ID NO: 241917 - DNA, 20 bp, Artificial
  CRISPR gRNA sequence
gctactcaggagactgaggc

SEQ ID NO: 241918 - DNA, 20 bp, Artificial
  CRISPR gRNA sequence
tactcaggagactgaggcaa

SEQ ID NO: 241919 - DNA, 20 bp, Artificial
  CRISPR gRNA sequence
caagagaaccgcttgaaccc

SEQ ID NO: 241920 - DNA, 20 bp, Artificial
  CRISPR gRNA sequence
agagaaccgcttgaacccaa

SEQ ID NO: 241921 - DNA, 20 bp, Artificial
  CRISPR gRNA sequence
gagaaccgcttgaacccaag

SEQ ID NO: 241922 - DNA, 20 bp, Artificial
  CRISPR gRNA sequence
aaccgcttgaacccaagagg

SEQ ID NO: 241923 - DNA, 20 bp, Artificial
  CRISPR gRNA sequence
ccgcttgaacccaagaggcg

SEQ ID NO: 241924 - DNA, 20 bp, Artificial
  CRISPR gRNA sequence
cgcttgaacccaagaggcgg

SEQ ID NO: 241925 - DNA, 20 bp, Artificial
  CRISPR gRNA sequence
aacccaagaggcggaggttg

SEQ ID NO: 241926 - DNA, 20 bp, Artificial
  CRISPR gRNA sequence
caagaggcggaggttgcagt

SEQ ID NO: 241927 - DNA, 20 bp, Artificial
  CRISPR gRNA sequence
ggcggaggttgcagtgagct

SEQ ID NO: 241928 - DNA, 20 bp, Artificial
  CRISPR gRNA sequence
gagatcacgccattgcactc

SEQ ID NO: 241929 - DNA, 20 bp, Artificial
  CRISPR gRNA sequence
cacgccattgcactccagcc

SEQ ID NO: 241930 - DNA, 20 bp, Artificial
  CRISPR gRNA sequence
acgccattgcactccagcct

SEQ ID NO: 241931 - DNA, 20 bp, Artificial
  CRISPR gRNA sequence
ttgcactccagcctgggcaa

SEQ ID NO: 241932 - DNA, 20 bp, Artificial
  CRISPR gRNA sequence
gcactccagcctgggcaaca

SEQ ID NO: 241933 - DNA, 20 bp, Artificial
  CRISPR gRNA sequence
tccagcctgggcaacagagt

SEQ ID NO: 241934 - DNA, 20 bp, Artificial
  CRISPR gRNA sequence
actccatctcaaaaaaaaaa

SEQ ID NO: 241935 - DNA, 20 bp, Artificial
  CRISPR gRNA sequence
aaaaaaaaaaagaaaaaaaa

SEQ ID NO: 241936 - DNA, 20 bp, Artificial
  CRISPR gRNA sequence
aaaaaaaagaaaaaaaaaag

SEQ ID NO: 241937 - DNA, 20 bp, Artificial
  CRISPR gRNA sequence
agaaaaaaaaaagaagtttg

SEQ ID NO: 241938 - DNA, 20 bp, Artificial
  CRISPR gRNA sequence
ttgctatgctgcccctttcc

SEQ ID NO: 241939 - DNA, 20 bp, Artificial
  CRISPR gRNA sequence
ccctttcctggtctcataac

SEQ ID NO: 241940 - DNA, 20 bp, Artificial
  CRISPR gRNA sequence
ctttcctggtctcataacta

SEQ ID NO: 241941 - DNA, 20 bp, Artificial
  CRISPR gRNA sequence
ttcctggtctcataactaga

SEQ ID NO: 241942 - DNA, 20 bp, Artificial
  CRISPR gRNA sequence
gtctcataactagagagtac

SEQ ID NO: 241943 - DNA, 20 bp, Artificial
  CRISPR gRNA sequence
tagagagtacaagctcctct

SEQ ID NO: 241944 - DNA, 20 bp, Artificial
  CRISPR gRNA sequence
agttttttatgtgttttttt

SEQ ID NO: 241945 - DNA, 20 bp, Artificial
  CRISPR gRNA sequence
ttttatgtgtttttttgaga

SEQ ID NO: 241946 - DNA, 20 bp, Artificial
  CRISPR gRNA sequence
ttatgtgtttttttgagatg

SEQ ID NO: 241947 - DNA, 20 bp, Artificial
  CRISPR gRNA sequence
tggagtcttgctctgttgcc

SEQ ID NO: 241948 - DNA, 20 bp, Artificial
  CRISPR gRNA sequence
ggagtcttgctctgttgccc

SEQ ID NO: 241949 - DNA, 20 bp, Artificial
  CRISPR gRNA sequence
tcttgctctgttgcccaggc

SEQ ID NO: 241950 - DNA, 20 bp, Artificial
  CRISPR gRNA sequence
ttgctctgttgcccaggctg

SEQ ID NO: 241951 - DNA, 20 bp, Artificial
  CRISPR gRNA sequence
ctgttgcccaggctggagtg

SEQ ID NO: 241952 - DNA, 20 bp, Artificial
  CRISPR gRNA sequence
ttgcccaggctggagtgcag

SEQ ID NO: 241953 - DNA, 20 bp, Artificial
  CRISPR gRNA sequence
ggagtgcagtggtgtaatct

SEQ ID NO: 241954 - DNA, 20 bp, Artificial
  CRISPR gRNA sequence
tctctgcaacctctgcctcc

SEQ ID NO: 241955 - DNA, 20 bp, Artificial
  CRISPR gRNA sequence
ctctgcaacctctgcctcct

SEQ ID NO: 241956 - DNA, 20 bp, Artificial
  CRISPR gRNA sequence
aacctctgcctcctgggttt

SEQ ID NO: 241957 - DNA, 20 bp, Artificial
  CRISPR gRNA sequence
tttaagccattgtcctgcct

SEQ ID NO: 241958 - DNA, 20 bp, Artificial
  CRISPR gRNA sequence
tcctgcctcagactcccgaa

SEQ ID NO: 241959 - DNA, 20 bp, Artificial
  CRISPR gRNA sequence
cctcagactcccgaatagct

SEQ ID NO: 241960 - DNA, 20 bp, Artificial
  CRISPR gRNA sequence
ctcccgaatagctaagatta

SEQ ID NO: 241961 - DNA, 20 bp, Artificial
  CRISPR gRNA sequence
tcccgaatagctaagattac

SEQ ID NO: 241962 - DNA, 20 bp, Artificial
  CRISPR gRNA sequence
gaatagctaagattacaggt

SEQ ID NO: 241963 - DNA, 20 bp, Artificial
  CRISPR gRNA sequence
caggtgagcgccaccatgcc

SEQ ID NO: 241964 - DNA, 20 bp, Artificial
  CRISPR gRNA sequence
ccagctaatttttgtgtttt

SEQ ID NO: 241965 - DNA, 20 bp, Artificial
  CRISPR gRNA sequence
gctaatttttgtgtttttag

SEQ ID NO: 241966 - DNA, 20 bp, Artificial
  CRISPR gRNA sequence
taatttttgtgtttttagta

SEQ ID NO: 241967 - DNA, 20 bp, Artificial
  CRISPR gRNA sequence
ttttgtgtttttagtagaga

SEQ ID NO: 241968 - DNA, 20 bp, Artificial
  CRISPR gRNA sequence
tttgtgtttttagtagagac

SEQ ID NO: 241969 - DNA, 20 bp, Artificial
  CRISPR gRNA sequence
ttgtgtttttagtagagaca

SEQ ID NO: 241970 - DNA, 20 bp, Artificial
  CRISPR gRNA sequence
gagacagggtttcgccatgt

SEQ ID NO: 241971 - DNA, 20 bp, Artificial
  CRISPR gRNA sequence
cagggtttcgccatgttggc

SEQ ID NO: 241972 - DNA, 20 bp, Artificial
  CRISPR gRNA sequence
agggtttcgccatgttggcc

SEQ ID NO: 241973 - DNA, 20 bp, Artificial
  CRISPR gRNA sequence
tttcgccatgttggccaggc

SEQ ID NO: 241974 - DNA, 20 bp, Artificial
  CRISPR gRNA sequence
tggtctcgaaatcctgacct

SEQ ID NO: 241975 - DNA, 20 bp, Artificial
  CRISPR gRNA sequence
ctcagatgatctgcttgctt

SEQ ID NO: 241976 - DNA, 20 bp, Artificial
  CRISPR gRNA sequence
ctgcttgctttggcttccca

SEQ ID NO: 241977 - DNA, 20 bp, Artificial
  CRISPR gRNA sequence
gctttggcttcccaaagtgc

SEQ ID NO: 241978 - DNA, 20 bp, Artificial
  CRISPR gRNA sequence
ctttggcttcccaaagtgct

SEQ ID NO: 241979 - DNA, 20 bp, Artificial
  CRISPR gRNA sequence
ttcccaaagtgctgggatta

SEQ ID NO: 241980 - DNA, 20 bp, Artificial
  CRISPR gRNA sequence
agtgctgggattacagatgt

SEQ ID NO: 241981 - DNA, 20 bp, Artificial
  CRISPR gRNA sequence
cagatgtgagtcaccacgcc

SEQ ID NO: 241982 - DNA, 20 bp, Artificial
  CRISPR gRNA sequence
caccacgcctggcctcttct

SEQ ID NO: 241983 - DNA, 20 bp, Artificial
  CRISPR gRNA sequence
ctttgttttgtccacgctat

SEQ ID NO: 241984 - DNA, 20 bp, Artificial
  CRISPR gRNA sequence
gtccacgctattggcatttt

SEQ ID NO: 241985 - DNA, 20 bp, Artificial
  CRISPR gRNA sequence
ccacgctattggcattttta

SEQ ID NO: 241986 - DNA, 20 bp, Artificial
  CRISPR gRNA sequence
tttttagagtgctgcttctc

SEQ ID NO: 241987 - DNA, 20 bp, Artificial
  CRISPR gRNA sequence
agtgctgcttctctagttcc

SEQ ID NO: 241988 - DNA, 20 bp, Artificial
  CRISPR gRNA sequence
ctgcttctctagttcccagt

SEQ ID NO: 241989 - DNA, 20 bp, Artificial
  CRISPR gRNA sequence
gcttctctagttcccagtca

SEQ ID NO: 241990 - DNA, 20 bp, Artificial
  CRISPR gRNA sequence
cttctctagttcccagtcag

SEQ ID NO: 241991 - DNA, 20 bp, Artificial
  CRISPR gRNA sequence
ttctctagttcccagtcaga

SEQ ID NO: 241992 - DNA, 20 bp, Artificial
  CRISPR gRNA sequence
gttcccagtcagagggaaat

SEQ ID NO: 241993 - DNA, 20 bp, Artificial
  CRISPR gRNA sequence
ttcccagtcagagggaaatg

SEQ ID NO: 241994 - DNA, 20 bp, Artificial
  CRISPR gRNA sequence
ccagtcagagggaaatgagg

SEQ ID NO: 241995 - DNA, 20 bp, Artificial
  CRISPR gRNA sequence
tcagagggaaatgaggcaga

SEQ ID NO: 241996 - DNA, 20 bp, Artificial
  CRISPR gRNA sequence
cccattgccatgttgtttct

SEQ ID NO: 241997 - DNA, 20 bp, Artificial
  CRISPR gRNA sequence
ccattgccatgttgtttctt

SEQ ID NO: 241998 - DNA, 20 bp, Artificial
  CRISPR gRNA sequence
gccatgttgtttcttgggtc

SEQ ID NO: 241999 - DNA, 20 bp, Artificial
  CRISPR gRNA sequence
catgttgtttcttgggtctg

SEQ ID NO: 242000 - DNA, 20 bp, Artificial
  CRISPR gRNA sequence
tctggagatcctgacccaat

SEQ ID NO: 242001 - DNA, 20 bp, Artificial
  CRISPR gRNA sequence
cttcctctctctgcctttct

SEQ ID NO: 242002 - DNA, 20 bp, Artificial
  CRISPR gRNA sequence
tcctctctctgcctttctga

SEQ ID NO: 242003 - DNA, 20 bp, Artificial
  CRISPR gRNA sequence
cctctctctgcctttctgag

SEQ ID NO: 242004 - DNA, 20 bp, Artificial
  CRISPR gRNA sequence
ctgcctttctgagaggtttt

SEQ ID NO: 242005 - DNA, 20 bp, Artificial
  CRISPR gRNA sequence
cctttctgagaggttttcag

SEQ ID NO: 242006 - DNA, 20 bp, Artificial
  CRISPR gRNA sequence
gagaggttttcagcagtact

SEQ ID NO: 242007 - DNA, 20 bp, Artificial
  CRISPR gRNA sequence
aggttttcagcagtactcag

SEQ ID NO: 242008 - DNA, 20 bp, Artificial
  CRISPR gRNA sequence
ggttttcagcagtactcagc

SEQ ID NO: 242009 - DNA, 20 bp, Artificial
  CRISPR gRNA sequence
agtactcagcaggacaaata

SEQ ID NO: 242010 - DNA, 20 bp, Artificial
  CRISPR gRNA sequence
acatgacatctcaatctttc

SEQ ID NO: 242011 - DNA, 20 bp, Artificial
  CRISPR gRNA sequence
tgacatctcaatctttccag

SEQ ID NO: 242012 - DNA, 20 bp, Artificial
  CRISPR gRNA sequence
acatctcaatctttccagaa

SEQ ID NO: 242013 - DNA, 20 bp, Artificial
  CRISPR gRNA sequence
ctccattttgaaattcaacc

SEQ ID NO: 242014 - DNA, 20 bp, Artificial
  CRISPR gRNA sequence
tccattttgaaattcaacct

SEQ ID NO: 242015 - DNA, 20 bp, Artificial
  CRISPR gRNA sequence
caacctgggaacaatttcaa

SEQ ID NO: 242016 - DNA, 20 bp, Artificial
  CRISPR gRNA sequence
aatttcaaaagacatcccgt

SEQ ID NO: 242017 - DNA, 20 bp, Artificial
  CRISPR gRNA sequence
ggtatttctgaacatcttgc

SEQ ID NO: 242018 - DNA, 20 bp, Artificial
  CRISPR gRNA sequence
acatcttgccagtttttcat

SEQ ID NO: 242019 - DNA, 20 bp, Artificial
  CRISPR gRNA sequence
tgccagtttttcataagttc

SEQ ID NO: 242020 - DNA, 20 bp, Artificial
  CRISPR gRNA sequence
gccagtttttcataagttct

SEQ ID NO: 242021 - DNA, 20 bp, Artificial
  CRISPR gRNA sequence
cagtttttcataagttctag

SEQ ID NO: 242022 - DNA, 20 bp, Artificial
  CRISPR gRNA sequence
ttttcataagttctaggaga

SEQ ID NO: 242023 - DNA, 20 bp, Artificial
  CRISPR gRNA sequence
ataagttctaggagatggtg

SEQ ID NO: 242024 - DNA, 20 bp, Artificial
  CRISPR gRNA sequence
gatggtgtggttatttttta

SEQ ID NO: 242025 - DNA, 20 bp, Artificial
  CRISPR gRNA sequence
tggttattttttatagcaac

SEQ ID NO: 242026 - DNA, 20 bp, Artificial
  CRISPR gRNA sequence
tagcaacaagcatatgaaat

SEQ ID NO: 242027 - DNA, 20 bp, Artificial
  CRISPR gRNA sequence
agcaacaagcatatgaaatc

SEQ ID NO: 242028 - DNA, 20 bp, Artificial
  CRISPR gRNA sequence
gcaacaagcatatgaaatcg

SEQ ID NO: 242029 - DNA, 20 bp, Artificial
  CRISPR gRNA sequence
acaagcatatgaaatcgggg

SEQ ID NO: 242030 - DNA, 20 bp, Artificial
  CRISPR gRNA sequence
caagcatatgaaatcggggt

SEQ ID NO: 242031 - DNA, 20 bp, Artificial
  CRISPR gRNA sequence
ggtaggactttttgccttgc

SEQ ID NO: 242032 - DNA, 20 bp, Artificial
  CRISPR gRNA sequence
tctgtaaataaatatctgct

SEQ ID NO: 242033 - DNA, 20 bp, Artificial
  CRISPR gRNA sequence
ctgtaaataaatatctgctt

SEQ ID NO: 242034 - DNA, 20 bp, Artificial
  CRISPR gRNA sequence
ctgcttaggattgaaatttg

SEQ ID NO: 242035 - DNA, 20 bp, Artificial
  CRISPR gRNA sequence
gcttaggattgaaatttgcg

SEQ ID NO: 242036 - DNA, 20 bp, Artificial
  CRISPR gRNA sequence
taggattgaaatttgcggag

SEQ ID NO: 242037 - DNA, 20 bp, Artificial
  CRISPR gRNA sequence
aatacttcactaacatgtaa

SEQ ID NO: 242038 - DNA, 20 bp, Artificial
  CRISPR gRNA sequence
cttcactaacatgtaaaaga

SEQ ID NO: 242039 - DNA, 20 bp, Artificial
  CRISPR gRNA sequence
ctaacatgtaaaagaaagcc

SEQ ID NO: 242040 - DNA, 20 bp, Artificial
  CRISPR gRNA sequence
acatgtaaaagaaagcctgg

SEQ ID NO: 242041 - DNA, 20 bp, Artificial
  CRISPR gRNA sequence
aaagcctggcagctcacgca

SEQ ID NO: 242042 - DNA, 20 bp, Artificial
  CRISPR gRNA sequence
ctggcagctcacgcacagat

SEQ ID NO: 242043 - DNA, 20 bp, Artificial
  CRISPR gRNA sequence
ctcacgcacagatcggttct

SEQ ID NO: 242044 - DNA, 20 bp, Artificial
  CRISPR gRNA sequence
gatcggttcttggttcctaa

SEQ ID NO: 242045 - DNA, 20 bp, Artificial
  CRISPR gRNA sequence
ggttcttggttcctaacaga

SEQ ID NO: 242046 - DNA, 20 bp, Artificial
  CRISPR gRNA sequence
tcttggttcctaacagatgg

SEQ ID NO: 242047 - DNA, 20 bp, Artificial
  CRISPR gRNA sequence
tggttcctaacagatggaag

SEQ ID NO: 242048 - DNA, 20 bp, Artificial
  CRISPR gRNA sequence
ttcctaacagatggaagcag

SEQ ID NO: 242049 - DNA, 20 bp, Artificial
  CRISPR gRNA sequence
tcctaacagatggaagcagt

SEQ ID NO: 242050 - DNA, 20 bp, Artificial
  CRISPR gRNA sequence
cctaacagatggaagcagtg

SEQ ID NO: 242051 - DNA, 20 bp, Artificial
  CRISPR gRNA sequence
tggggataccttcacaatcc

SEQ ID NO: 242052 - DNA, 20 bp, Artificial
  CRISPR gRNA sequence
gggataccttcacaatcctg

SEQ ID NO: 242053 - DNA, 20 bp, Artificial
  CRISPR gRNA sequence
gagtcataacactgcattcc

SEQ ID NO: 242054 - DNA, 20 bp, Artificial
  CRISPR gRNA sequence
agtcataacactgcattcca

SEQ ID NO: 242055 - DNA, 20 bp, Artificial
  CRISPR gRNA sequence
ctgcattccaaggaaaccat

SEQ ID NO: 242056 - DNA, 20 bp, Artificial
  CRISPR gRNA sequence
aaccatcggatctcgaatct

SEQ ID NO: 242057 - DNA, 20 bp, Artificial
  CRISPR gRNA sequence
ctcgaatctcagtaaccctc

SEQ ID NO: 242058 - DNA, 20 bp, Artificial
  CRISPR gRNA sequence
gtaaccctcaagacgaaaat

SEQ ID NO: 242059 - DNA, 20 bp, Artificial
  CRISPR gRNA sequence
aagtgctgctgaattgaaac

SEQ ID NO: 242060 - DNA, 20 bp, Artificial
  CRISPR gRNA sequence
gtgctgctgaattgaaacta

SEQ ID NO: 242061 - DNA, 20 bp, Artificial
  CRISPR gRNA sequence
attgaaactagagctatgat

SEQ ID NO: 242062 - DNA, 20 bp, Artificial
  CRISPR gRNA sequence
ttgaaactagagctatgatt

SEQ ID NO: 242063 - DNA, 20 bp, Artificial
  CRISPR gRNA sequence
ctagagctatgattgggata

SEQ ID NO: 242064 - DNA, 20 bp, Artificial
  CRISPR gRNA sequence
gggatatggctaatatttta

SEQ ID NO: 242065 - DNA, 20 bp, Artificial
  CRISPR gRNA sequence
atggctaatattttatggtt

SEQ ID NO: 242066 - DNA, 20 bp, Artificial
  CRISPR gRNA sequence
tggtttagtgattcatgctt

SEQ ID NO: 242067 - DNA, 20 bp, Artificial
  CRISPR gRNA sequence
gcttaagattcatgcttttt

SEQ ID NO: 242068 - DNA, 20 bp, Artificial
  CRISPR gRNA sequence
tcatgcttttttagctaatg

SEQ ID NO: 242069 - DNA, 20 bp, Artificial
  CRISPR gRNA sequence
tttagctaatgtagaaaata

SEQ ID NO: 242070 - DNA, 20 bp, Artificial
  CRISPR gRNA sequence
aatgtagaaaataaagaaaa

SEQ ID NO: 242071 - DNA, 20 bp, Artificial
  CRISPR gRNA sequence
aataaagaaaatagttctta

SEQ ID NO: 242072 - DNA, 20 bp, Artificial
  CRISPR gRNA sequence
taaagaccaatacaaatatt

SEQ ID NO: 242073 - DNA, 20 bp, Artificial
  CRISPR gRNA sequence
gaccaatacaaatatttggt

SEQ ID NO: 242074 - DNA, 20 bp, Artificial
  CRISPR gRNA sequence
ccaatacaaatatttggtaa

SEQ ID NO: 242075 - DNA, 20 bp, Artificial
  CRISPR gRNA sequence
caatacaaatatttggtaag

SEQ ID NO: 242076 - DNA, 20 bp, Artificial
  CRISPR gRNA sequence
aacaaatttcaaataatctc

SEQ ID NO: 242077 - DNA, 20 bp, Artificial
  CRISPR gRNA sequence
caaatttcaaataatctcta

SEQ ID NO: 242078 - DNA, 20 bp, Artificial
  CRISPR gRNA sequence
aaatttcaaataatctctag

SEQ ID NO: 242079 - DNA, 20 bp, Artificial
  CRISPR gRNA sequence
tttcaaataatctctagagg

SEQ ID NO: 242080 - DNA, 20 bp, Artificial
  CRISPR gRNA sequence
ccttgctgttacctctcttg

SEQ ID NO: 242081 - DNA, 20 bp, Artificial
  CRISPR gRNA sequence
ctgttacctctcttgtggat

SEQ ID NO: 242082 - DNA, 20 bp, Artificial
  CRISPR gRNA sequence
attattattataattttttt

SEQ ID NO: 242083 - DNA, 20 bp, Artificial
  CRISPR gRNA sequence
ttattataattttttttaga

SEQ ID NO: 242084 - DNA, 20 bp, Artificial
  CRISPR gRNA sequence
attataattttttttagatg

SEQ ID NO: 242085 - DNA, 20 bp, Artificial
  CRISPR gRNA sequence
tggagtctcactctgtcacc

SEQ ID NO: 242086 - DNA, 20 bp, Artificial
  CRISPR gRNA sequence
ggagtctcactctgtcaccc

SEQ ID NO: 242087 - DNA, 20 bp, Artificial
  CRISPR gRNA sequence
tctcactctgtcacccaggc

SEQ ID NO: 242088 - DNA, 20 bp, Artificial
  CRISPR gRNA sequence
tcactctgtcacccaggctg

SEQ ID NO: 242089 - DNA, 20 bp, Artificial
  CRISPR gRNA sequence
ctgtcacccaggctggagtg

SEQ ID NO: 242090 - DNA, 20 bp, Artificial
  CRISPR gRNA sequence
tcacccaggctggagtgcag

SEQ ID NO: 242091 - DNA, 20 bp, Artificial
  CRISPR gRNA sequence
ggagtgcagtggcgcaatct

SEQ ID NO: 242092 - DNA, 20 bp, Artificial
  CRISPR gRNA sequence
tcactgcaacctccacctcc

SEQ ID NO: 242093 - DNA, 20 bp, Artificial
  CRISPR gRNA sequence
cactgcaacctccacctccc

SEQ ID NO: 242094 - DNA, 20 bp, Artificial
  CRISPR gRNA sequence
caacctccacctcccaggtt

SEQ ID NO: 242095 - DNA, 20 bp, Artificial
  CRISPR gRNA sequence
aacctccacctcccaggttc

SEQ ID NO: 242096 - DNA, 20 bp, Artificial
  CRISPR gRNA sequence
gttcaggcgattctctgcct

SEQ ID NO: 242097 - DNA, 20 bp, Artificial
  CRISPR gRNA sequence
attctctgcctcagcctccc

SEQ ID NO: 242098 - DNA, 20 bp, Artificial
  CRISPR gRNA sequence
ctctgcctcagcctcccgag

SEQ ID NO: 242099 - DNA, 20 bp, Artificial
  CRISPR gRNA sequence
gcctcagcctcccgagtagc

SEQ ID NO: 242100 - DNA, 20 bp, Artificial
  CRISPR gRNA sequence
cctcagcctcccgagtagct

SEQ ID NO: 242101 - DNA, 20 bp, Artificial
  CRISPR gRNA sequence
ctcccgagtagctgggatta

SEQ ID NO: 242102 - DNA, 20 bp, Artificial
  CRISPR gRNA sequence
tcccgagtagctgggattac

SEQ ID NO: 242103 - DNA, 20 bp, Artificial
  CRISPR gRNA sequence
caggcgcccaccaccacgcc

SEQ ID NO: 242104 - DNA, 20 bp, Artificial
  CRISPR gRNA sequence
ccacgcccagctaatttttt

SEQ ID NO: 242105 - DNA, 20 bp, Artificial
  CRISPR gRNA sequence
gctaatttttttggtatttt

SEQ ID NO: 242106 - DNA, 20 bp, Artificial
  CRISPR gRNA sequence
aatttttttggtatttttag

SEQ ID NO: 242107 - DNA, 20 bp, Artificial
  CRISPR gRNA sequence
tttttttggtatttttagta

SEQ ID NO: 242108 - DNA, 20 bp, Artificial
  CRISPR gRNA sequence
tttggtatttttagtagaga

SEQ ID NO: 242109 - DNA, 20 bp, Artificial
  CRISPR gRNA sequence
ttggtatttttagtagagac

SEQ ID NO: 242110 - DNA, 20 bp, Artificial
  CRISPR gRNA sequence
tggtatttttagtagagacg

SEQ ID NO: 242111 - DNA, 20 bp, Artificial
  CRISPR gRNA sequence
gagacggggtttcaccatct

SEQ ID NO: 242112 - DNA, 20 bp, Artificial
  CRISPR gRNA sequence
cggggtttcaccatcttggc

SEQ ID NO: 242113 - DNA, 20 bp, Artificial
  CRISPR gRNA sequence
ggggtttcaccatcttggcc

SEQ ID NO: 242114 - DNA, 20 bp, Artificial
  CRISPR gRNA sequence
tttcaccatcttggccaggc

SEQ ID NO: 242115 - DNA, 20 bp, Artificial
  CRISPR gRNA sequence
ctcctgaccttgtgatccac

SEQ ID NO: 242116 - DNA, 20 bp, Artificial
  CRISPR gRNA sequence
accttgtgatccaccggcct

SEQ ID NO: 242117 - DNA, 20 bp, Artificial
  CRISPR gRNA sequence
ccaccggcctcagcctccca

SEQ ID NO: 242118 - DNA, 20 bp, Artificial
  CRISPR gRNA sequence
gcctcagcctcccaaagtgc

SEQ ID NO: 242119 - DNA, 20 bp, Artificial
  CRISPR gRNA sequence
cctcagcctcccaaagtgct

SEQ ID NO: 242120 - DNA, 20 bp, Artificial
  CRISPR gRNA sequence
ctcccaaagtgctgggatta

SEQ ID NO: 242121 - DNA, 20 bp, Artificial
  CRISPR gRNA sequence
tcccaaagtgctgggattac

SEQ ID NO: 242122 - DNA, 20 bp, Artificial
  CRISPR gRNA sequence
agtgctgggattacaggcat

SEQ ID NO: 242123 - DNA, 20 bp, Artificial
  CRISPR gRNA sequence
caggcatgagccactgcgcc

SEQ ID NO: 242124 - DNA, 20 bp, Artificial
  CRISPR gRNA sequence
tttgttttgttttgtttttt

SEQ ID NO: 242125 - DNA, 20 bp, Artificial
  CRISPR gRNA sequence
ttttgttttgttttttgaga

SEQ ID NO: 242126 - DNA, 20 bp, Artificial
  CRISPR gRNA sequence
ttgttttgttttttgagaca

SEQ ID NO: 242127 - DNA, 20 bp, Artificial
  CRISPR gRNA sequence
agagtttcgctgttgtcacc

SEQ ID NO: 242128 - DNA, 20 bp, Artificial
  CRISPR gRNA sequence
gagtttcgctgttgtcaccc

SEQ ID NO: 242129 - DNA, 20 bp, Artificial
  CRISPR gRNA sequence
ttcgctgttgtcacccaggc

SEQ ID NO: 242130 - DNA, 20 bp, Artificial
  CRISPR gRNA sequence
cgctgttgtcacccaggctg

SEQ ID NO: 242131 - DNA, 20 bp, Artificial
  CRISPR gRNA sequence
tcacccaggctggagtgcaa

SEQ ID NO: 242132 - DNA, 20 bp, Artificial
  CRISPR gRNA sequence
gagtgcaatggcgccatctc

SEQ ID NO: 242133 - DNA, 20 bp, Artificial
  CRISPR gRNA sequence
tcactgcaatctctgtctcc

SEQ ID NO: 242134 - DNA, 20 bp, Artificial
  CRISPR gRNA sequence
cactgcaatctctgtctcct

SEQ ID NO: 242135 - DNA, 20 bp, Artificial
  CRISPR gRNA sequence
aatctctgtctcctgggttc

SEQ ID NO: 242136 - DNA, 20 bp, Artificial
  CRISPR gRNA sequence
ttcaagcaattgtcctgcct

SEQ ID NO: 242137 - DNA, 20 bp, Artificial
  CRISPR gRNA sequence
ttgtcctgcctcagcctcct

SEQ ID NO: 242138 - DNA, 20 bp, Artificial
  CRISPR gRNA sequence
tcctgcctcagcctcctgag

SEQ ID NO: 242139 - DNA, 20 bp, Artificial
  CRISPR gRNA sequence
gcctcagcctcctgagtagc

SEQ ID NO: 242140 - DNA, 20 bp, Artificial
  CRISPR gRNA sequence
cctcagcctcctgagtagct

SEQ ID NO: 242141 - DNA, 20 bp, Artificial
  CRISPR gRNA sequence
ctcctgagtagctgggatta

SEQ ID NO: 242142 - DNA, 20 bp, Artificial
  CRISPR gRNA sequence
tcctgagtagctgggattac

SEQ ID NO: 242143 - DNA, 20 bp, Artificial
  CRISPR gRNA sequence
caggcacctgccaccacgcc

SEQ ID NO: 242144 - DNA, 20 bp, Artificial
  CRISPR gRNA sequence
ccggctaatttttgtatttt

SEQ ID NO: 242145 - DNA, 20 bp, Artificial
  CRISPR gRNA sequence
gctaatttttgtatttttag

SEQ ID NO: 242146 - DNA, 20 bp, Artificial
  CRISPR gRNA sequence
ctaatttttgtatttttagt

SEQ ID NO: 242147 - DNA, 20 bp, Artificial
  CRISPR gRNA sequence
taatttttgtatttttagta

SEQ ID NO: 242148 - DNA, 20 bp, Artificial
  CRISPR gRNA sequence
ttttgtatttttagtaggga

SEQ ID NO: 242149 - DNA, 20 bp, Artificial
  CRISPR gRNA sequence
tttgtatttttagtagggat

SEQ ID NO: 242150 - DNA, 20 bp, Artificial
  CRISPR gRNA sequence
ttgtatttttagtagggatg

SEQ ID NO: 242151 - DNA, 20 bp, Artificial
  CRISPR gRNA sequence
gggatggggttttgctatgt

SEQ ID NO: 242152 - DNA, 20 bp, Artificial
  CRISPR gRNA sequence
ttttgctatgttggccacgc

SEQ ID NO: 242153 - DNA, 20 bp, Artificial
  CRISPR gRNA sequence
ggtcttgaactcctgacctc

SEQ ID NO: 242154 - DNA, 20 bp, Artificial
  CRISPR gRNA sequence
ctcaagtgatctgcccacct

SEQ ID NO: 242155 - DNA, 20 bp, Artificial
  CRISPR gRNA sequence
ctgcccacctcggccttcca

SEQ ID NO: 242156 - DNA, 20 bp, Artificial
  CRISPR gRNA sequence
acctcggccttccaaagtgc

SEQ ID NO: 242157 - DNA, 20 bp, Artificial
  CRISPR gRNA sequence
cctcggccttccaaagtgct

SEQ ID NO: 242158 - DNA, 20 bp, Artificial
  CRISPR gRNA sequence
ctcggccttccaaagtgctg

SEQ ID NO: 242159 - DNA, 20 bp, Artificial
  CRISPR gRNA sequence
cttccaaagtgctggggtta

SEQ ID NO: 242160 - DNA, 20 bp, Artificial
  CRISPR gRNA sequence
ttccaaagtgctggggttac

SEQ ID NO: 242161 - DNA, 20 bp, Artificial
  CRISPR gRNA sequence
agtgctggggttacaggcat

SEQ ID NO: 242162 - DNA, 20 bp, Artificial
  CRISPR gRNA sequence
caggcatgagccaccacgcc

SEQ ID NO: 242163 - DNA, 20 bp, Artificial
  CRISPR gRNA sequence
atgagccaccacgcctggct

SEQ ID NO: 242164 - DNA, 20 bp, Artificial
  CRISPR gRNA sequence
ggctgagtttgttaaaatta

SEQ ID NO: 242165 - DNA, 20 bp, Artificial
  CRISPR gRNA sequence
gctgagtttgttaaaattaa

SEQ ID NO: 242166 - DNA, 20 bp, Artificial
  CRISPR gRNA sequence
ctgagtttgttaaaattaaa

SEQ ID NO: 242167 - DNA, 20 bp, Artificial
  CRISPR gRNA sequence
tgagtttgttaaaattaaag

SEQ ID NO: 242168 - DNA, 20 bp, Artificial
  CRISPR gRNA sequence
agtttgttaaaattaaaggg

SEQ ID NO: 242169 - DNA, 20 bp, Artificial
  CRISPR gRNA sequence
aggggagaatgtttgctgct

SEQ ID NO: 242170 - DNA, 20 bp, Artificial
  CRISPR gRNA sequence
gggagaatgtttgctgctta

SEQ ID NO: 242171 - DNA, 20 bp, Artificial
  CRISPR gRNA sequence
tgctgcttagagatgttctg

SEQ ID NO: 242172 - DNA, 20 bp, Artificial
  CRISPR gRNA sequence
tgttctgcagctataattta

SEQ ID NO: 242173 - DNA, 20 bp, Artificial
  CRISPR gRNA sequence
agctataatttatggaaaat

SEQ ID NO: 242174 - DNA, 20 bp, Artificial
  CRISPR gRNA sequence
taagtgttaaatgattcaaa

SEQ ID NO: 242175 - DNA, 20 bp, Artificial
  CRISPR gRNA sequence
gtatcttaaaattttttttt

SEQ ID NO: 242176 - DNA, 20 bp, Artificial
  CRISPR gRNA sequence
attttttttttagcatttat

SEQ ID NO: 242177 - DNA, 20 bp, Artificial
  CRISPR gRNA sequence
ttttttagcatttatgagac

SEQ ID NO: 242178 - DNA, 20 bp, Artificial
  CRISPR gRNA sequence
gagaccagtacaaactactc

SEQ ID NO: 242179 - DNA, 20 bp, Artificial
  CRISPR gRNA sequence
gaccagtacaaactactcaa

SEQ ID NO: 242180 - DNA, 20 bp, Artificial
  CRISPR gRNA sequence
accagtacaaactactcaag

SEQ ID NO: 242181 - DNA, 20 bp, Artificial
  CRISPR gRNA sequence
agtacaaactactcaagagg

SEQ ID NO: 242182 - DNA, 20 bp, Artificial
  CRISPR gRNA sequence
caaactactcaagaggaaga

SEQ ID NO: 242183 - DNA, 20 bp, Artificial
  CRISPR gRNA sequence
actcaagaggaagatggctg

SEQ ID NO: 242184 - DNA, 20 bp, Artificial
  CRISPR gRNA sequence
tggctgtagctgccgatttc

SEQ ID NO: 242185 - DNA, 20 bp, Artificial
  CRISPR gRNA sequence
ctgtagctgccgatttccag

SEQ ID NO: 242186 - DNA, 20 bp, Artificial
  CRISPR gRNA sequence
tagctgccgatttccagaag

SEQ ID NO: 242187 - DNA, 20 bp, Artificial
  CRISPR gRNA sequence
ctgccgatttccagaagaag

SEQ ID NO: 242188 - DNA, 20 bp, Artificial
  CRISPR gRNA sequence
ccgatttccagaagaagaag

SEQ ID NO: 242189 - DNA, 20 bp, Artificial
  CRISPR gRNA sequence
cgatttccagaagaagaaga

SEQ ID NO: 242190 - DNA, 20 bp, Artificial
  CRISPR gRNA sequence
atttccagaagaagaagaag

SEQ ID NO: 242191 - DNA, 20 bp, Artificial
  CRISPR gRNA sequence
tttccagaagaagaagaagg

SEQ ID NO: 242192 - DNA, 20 bp, Artificial
  CRISPR gRNA sequence
ggaggatgtgaactgtgaaa

SEQ ID NO: 242193 - DNA, 20 bp, Artificial
  CRISPR gRNA sequence
ggatgtgaactgtgaaatgg

SEQ ID NO: 242194 - DNA, 20 bp, Artificial
  CRISPR gRNA sequence
aactgtgaaatggaagtcaa

SEQ ID NO: 242195 - DNA, 20 bp, Artificial
  CRISPR gRNA sequence
actgtgaaatggaagtcaat

SEQ ID NO: 242196 - DNA, 20 bp, Artificial
  CRISPR gRNA sequence
ctgtgaaatggaagtcaata

SEQ ID NO: 242197 - DNA, 20 bp, Artificial
  CRISPR gRNA sequence
atggaagtcaatagggctgt

SEQ ID NO: 242198 - DNA, 20 bp, Artificial
  CRISPR gRNA sequence
tggaagtcaatagggctgtt

SEQ ID NO: 242199 - DNA, 20 bp, Artificial
  CRISPR gRNA sequence
gctgttgggactttcttgaa

SEQ ID NO: 242200 - DNA, 20 bp, Artificial
  CRISPR gRNA sequence
gttgggactttcttgaaaag

SEQ ID NO: 242201 - DNA, 20 bp, Artificial
  CRISPR gRNA sequence
ggactttcttgaaaagaagc

SEQ ID NO: 242202 - DNA, 20 bp, Artificial
  CRISPR gRNA sequence
gactttcttgaaaagaagca

SEQ ID NO: 242203 - DNA, 20 bp, Artificial
  CRISPR gRNA sequence
gaaaagaagcaaggaaatat

SEQ ID NO: 242204 - DNA, 20 bp, Artificial
  CRISPR gRNA sequence
atatgagtcatccgctatca

SEQ ID NO: 242205 - DNA, 20 bp, Artificial
  CRISPR gRNA sequence
tccgctatcacagctttcaa

SEQ ID NO: 242206 - DNA, 20 bp, Artificial
  CRISPR gRNA sequence
ctatcacagctttcaaaagc

SEQ ID NO: 242207 - DNA, 20 bp, Artificial
  CRISPR gRNA sequence
acaccatcctacataatacc

SEQ ID NO: 242208 - DNA, 20 bp, Artificial
  CRISPR gRNA sequence
caccatcctacataataccc

SEQ ID NO: 242209 - DNA, 20 bp, Artificial
  CRISPR gRNA sequence
gttcttttctaaatgccaat

SEQ ID NO: 242210 - DNA, 20 bp, Artificial
  CRISPR gRNA sequence
ttttctaaatgccaatgagt

SEQ ID NO: 242211 - DNA, 20 bp, Artificial
  CRISPR gRNA sequence
cactttttttttttttttga

SEQ ID NO: 242212 - DNA, 20 bp, Artificial
  CRISPR gRNA sequence
actttttttttttttttgac

SEQ ID NO: 242213 - DNA, 20 bp, Artificial
  CRISPR gRNA sequence
ctttttttttttttttgaca

SEQ ID NO: 242214 - DNA, 20 bp, Artificial
  CRISPR gRNA sequence
cagggtctcactctgtcacc

SEQ ID NO: 242215 - DNA, 20 bp, Artificial
  CRISPR gRNA sequence
agggtctcactctgtcaccc

SEQ ID NO: 242216 - DNA, 20 bp, Artificial
  CRISPR gRNA sequence
tctcactctgtcacccaggc

SEQ ID NO: 242217 - DNA, 20 bp, Artificial
  CRISPR gRNA sequence
tcactctgtcacccaggctg

SEQ ID NO: 242218 - DNA, 20 bp, Artificial
  CRISPR gRNA sequence
ctgtcacccaggctggagtg

SEQ ID NO: 242219 - DNA, 20 bp, Artificial
  CRISPR gRNA sequence
tcacccaggctggagtgcag

SEQ ID NO: 242220 - DNA, 20 bp, Artificial
  CRISPR gRNA sequence
ggagtgcagtggcaccacca

SEQ ID NO: 242221 - DNA, 20 bp, Artificial
  CRISPR gRNA sequence
ggcaccaccatggctctctg

SEQ ID NO: 242222 - DNA, 20 bp, Artificial
  CRISPR gRNA sequence
ctctctgcagccttgacctc

SEQ ID NO: 242223 - DNA, 20 bp, Artificial
  CRISPR gRNA sequence
tctctgcagccttgacctct

SEQ ID NO: 242224 - DNA, 20 bp, Artificial
  CRISPR gRNA sequence
tctgcagccttgacctctgg

SEQ ID NO: 242225 - DNA, 20 bp, Artificial
  CRISPR gRNA sequence
gccttgacctctgggagctc

SEQ ID NO: 242226 - DNA, 20 bp, Artificial
  CRISPR gRNA sequence
ctcaagtgatcctcctgcct

SEQ ID NO: 242227 - DNA, 20 bp, Artificial
  CRISPR gRNA sequence
tcctcctgcctcagtctcct

SEQ ID NO: 242228 - DNA, 20 bp, Artificial
  CRISPR gRNA sequence
tcctgcctcagtctcctgag

SEQ ID NO: 242229 - DNA, 20 bp, Artificial
  CRISPR gRNA sequence
gcctcagtctcctgagtagc

SEQ ID NO: 242230 - DNA, 20 bp, Artificial
  CRISPR gRNA sequence
tcctgagtagctggaactac

SEQ ID NO: 242231 - DNA, 20 bp, Artificial
  CRISPR gRNA sequence
cctgagtagctggaactaca

SEQ ID NO: 242232 - DNA, 20 bp, Artificial
  CRISPR gRNA sequence
gagtagctggaactacaagg

SEQ ID NO: 242233 - DNA, 20 bp, Artificial
  CRISPR gRNA sequence
agtagctggaactacaagga

SEQ ID NO: 242234 - DNA, 20 bp, Artificial
  CRISPR gRNA sequence
gtagctggaactacaaggaa

SEQ ID NO: 242235 - DNA, 20 bp, Artificial
  CRISPR gRNA sequence
taacttttttgttttttgtt

SEQ ID NO: 242236 - DNA, 20 bp, Artificial
  CRISPR gRNA sequence
tttttgttttttgtttggta

SEQ ID NO: 242237 - DNA, 20 bp, Artificial
  CRISPR gRNA sequence
tgttttttgtttggtaaaga

SEQ ID NO: 242238 - DNA, 20 bp, Artificial
  CRISPR gRNA sequence
tggcatttcaccatgttgta

SEQ ID NO: 242239 - DNA, 20 bp, Artificial
  CRISPR gRNA sequence
ggcatttcaccatgttgtac

SEQ ID NO: 242240 - DNA, 20 bp, Artificial
  CRISPR gRNA sequence
tttcaccatgttgtacaggc

SEQ ID NO: 242241 - DNA, 20 bp, Artificial
  CRISPR gRNA sequence
acaggctggtctcaaactcc

SEQ ID NO: 242242 - DNA, 20 bp, Artificial
  CRISPR gRNA sequence
caggctggtctcaaactcct

SEQ ID NO: 242243 - DNA, 20 bp, Artificial
  CRISPR gRNA sequence
tcaaactcctaggttcactt

SEQ ID NO: 242244 - DNA, 20 bp, Artificial
  CRISPR gRNA sequence
aggttcactttggcctccca

SEQ ID NO: 242245 - DNA, 20 bp, Artificial
  CRISPR gRNA sequence
actttggcctcccaaagtgc

SEQ ID NO: 242246 - DNA, 20 bp, Artificial
  CRISPR gRNA sequence
ctttggcctcccaaagtgct

SEQ ID NO: 242247 - DNA, 20 bp, Artificial
  CRISPR gRNA sequence
ctcccaaagtgctgggatta

SEQ ID NO: 242248 - DNA, 20 bp, Artificial
  CRISPR gRNA sequence
ggattacagacatgaactgc

SEQ ID NO: 242249 - DNA, 20 bp, Artificial
  CRISPR gRNA sequence
gattacagacatgaactgcc

SEQ ID NO: 242250 - DNA, 20 bp, Artificial
  CRISPR gRNA sequence
cagacatgaactgccaggcc

SEQ ID NO: 242251 - DNA, 20 bp, Artificial
  CRISPR gRNA sequence
aaataatgcaccacttttaa

SEQ ID NO: 242252 - DNA, 20 bp, Artificial
  CRISPR gRNA sequence
atgcaccacttttaacagaa

SEQ ID NO: 242253 - DNA, 20 bp, Artificial
  CRISPR gRNA sequence
accacttttaacagaacaga

SEQ ID NO: 242254 - DNA, 20 bp, Artificial
  CRISPR gRNA sequence
ttttaacagaacagacagat

SEQ ID NO: 242255 - DNA, 20 bp, Artificial
  CRISPR gRNA sequence
tttaacagaacagacagatg

SEQ ID NO: 242256 - DNA, 20 bp, Artificial
  CRISPR gRNA sequence
acagaacagacagatgagga

SEQ ID NO: 242257 - DNA, 20 bp, Artificial
  CRISPR gRNA sequence
agaacagacagatgaggaca

SEQ ID NO: 242258 - DNA, 20 bp, Artificial
  CRISPR gRNA sequence
cagacagatgaggacagagc

SEQ ID NO: 242259 - DNA, 20 bp, Artificial
  CRISPR gRNA sequence
tgataaaaaaaaaaaaaaaa

SEQ ID NO: 242260 - DNA, 20 bp, Artificial
  CRISPR gRNA sequence
aaaaaaaaaaaagcattttc

SEQ ID NO: 242261 - DNA, 20 bp, Artificial
  CRISPR gRNA sequence
attttctagataccacttaa

SEQ ID NO: 242262 - DNA, 20 bp, Artificial
  CRISPR gRNA sequence
ttttctagataccacttaac

SEQ ID NO: 242263 - DNA, 20 bp, Artificial
  CRISPR gRNA sequence
agataccacttaacaggttt

SEQ ID NO: 242264 - DNA, 20 bp, Artificial
  CRISPR gRNA sequence
accacttaacaggtttgagc

SEQ ID NO: 242265 - DNA, 20 bp, Artificial
  CRISPR gRNA sequence
gctagtttttttgaaatcca

SEQ ID NO: 242266 - DNA, 20 bp, Artificial
  CRISPR gRNA sequence
ttgaaatccaaagaaaatta

SEQ ID NO: 242267 - DNA, 20 bp, Artificial
  CRISPR gRNA sequence
atagtttaaattcaattaca

SEQ ID NO: 242268 - DNA, 20 bp, Artificial
  CRISPR gRNA sequence
ttaaattcaattacatagtc

SEQ ID NO: 242269 - DNA, 20 bp, Artificial
  CRISPR gRNA sequence
aattcaattacatagtccag

SEQ ID NO: 242270 - DNA, 20 bp, Artificial
  CRISPR gRNA sequence
aattataatcaaaatcaatg

SEQ ID NO: 242271 - DNA, 20 bp, Artificial
  CRISPR gRNA sequence
attataatcaaaatcaatgc

SEQ ID NO: 242272 - DNA, 20 bp, Artificial
  CRISPR gRNA sequence
atcaatgcaggtttgttttt

SEQ ID NO: 242273 - DNA, 20 bp, Artificial
  CRISPR gRNA sequence
ctaatatgacatatgacaat

SEQ ID NO: 242274 - DNA, 20 bp, Artificial
  CRISPR gRNA sequence
gacatatgacaataagccac

SEQ ID NO: 242275 - DNA, 20 bp, Artificial
  CRISPR gRNA sequence
acatatgacaataagccacg

SEQ ID NO: 242276 - DNA, 20 bp, Artificial
  CRISPR gRNA sequence
tgacaataagccacgaggtg

SEQ ID NO: 242277 - DNA, 20 bp, Artificial
  CRISPR gRNA sequence
aataagccacgaggtgcagt

SEQ ID NO: 242278 - DNA, 20 bp, Artificial
  CRISPR gRNA sequence
gtgcagtaagtacccgacta

SEQ ID NO: 242279 - DNA, 20 bp, Artificial
  CRISPR gRNA sequence
gtacccgactaaagtttccg

SEQ ID NO: 242280 - DNA, 20 bp, Artificial
  CRISPR gRNA sequence
tacccgactaaagtttccgt

SEQ ID NO: 242281 - DNA, 20 bp, Artificial
  CRISPR gRNA sequence
aacacgacatgctccaccgt

SEQ ID NO: 242282 - DNA, 20 bp, Artificial
  CRISPR gRNA sequence
acacgacatgctccaccgtc

SEQ ID NO: 242283 - DNA, 20 bp, Artificial
  CRISPR gRNA sequence
cacgacatgctccaccgtca

SEQ ID NO: 242284 - DNA, 20 bp, Artificial
  CRISPR gRNA sequence
acgacatgctccaccgtcag

SEQ ID NO: 242285 - DNA, 20 bp, Artificial
  CRISPR gRNA sequence
cgacatgctccaccgtcagg

SEQ ID NO: 242286 - DNA, 20 bp, Artificial
  CRISPR gRNA sequence
gacatgctccaccgtcaggg

SEQ ID NO: 242287 - DNA, 20 bp, Artificial
  CRISPR gRNA sequence
catgctccaccgtcaggggg

SEQ ID NO: 242288 - DNA, 20 bp, Artificial
  CRISPR gRNA sequence
ccaccgtcaggggggagtat

SEQ ID NO: 242289 - DNA, 20 bp, Artificial
  CRISPR gRNA sequence
ccgtcaggggggagtatgag

SEQ ID NO: 242290 - DNA, 20 bp, Artificial
  CRISPR gRNA sequence
gtcaggggggagtatgagca

SEQ ID NO: 242291 - DNA, 20 bp, Artificial
  CRISPR gRNA sequence
ggagtatgagcagagtgcct

SEQ ID NO: 242292 - DNA, 20 bp, Artificial
  CRISPR gRNA sequence
atgagcagagtgcctgagtt

SEQ ID NO: 242293 - DNA, 20 bp, Artificial
  CRISPR gRNA sequence
tgagcagagtgcctgagttt

SEQ ID NO: 242294 - DNA, 20 bp, Artificial
  CRISPR gRNA sequence
gagcagagtgcctgagttta

SEQ ID NO: 242295 - DNA, 20 bp, Artificial
  CRISPR gRNA sequence
gagtgcctgagtttagggtc

SEQ ID NO: 242296 - DNA, 20 bp, Artificial
  CRISPR gRNA sequence
agtgcctgagtttagggtca

SEQ ID NO: 242297 - DNA, 20 bp, Artificial
  CRISPR gRNA sequence
gggtcaaggacaaaaaacct

SEQ ID NO: 242298 - DNA, 20 bp, Artificial
  CRISPR gRNA sequence
ggtcaaggacaaaaaacctc

SEQ ID NO: 242299 - DNA, 20 bp, Artificial
  CRISPR gRNA sequence
aggacaaaaaacctcaggcc

SEQ ID NO: 242300 - DNA, 20 bp, Artificial
  CRISPR gRNA sequence
gacaaaaaacctcaggcctg

SEQ ID NO: 242301 - DNA, 20 bp, Artificial
  CRISPR gRNA sequence
acaaaaaacctcaggcctgg

SEQ ID NO: 242302 - DNA, 20 bp, Artificial
  CRISPR gRNA sequence
aaaaacctcaggcctggagg

SEQ ID NO: 242303 - DNA, 20 bp, Artificial
  CRISPR gRNA sequence
ctcaggcctggaggaagttt

SEQ ID NO: 242304 - DNA, 20 bp, Artificial
  CRISPR gRNA sequence
ggcctggaggaagttttgga

SEQ ID NO: 242305 - DNA, 20 bp, Artificial
  CRISPR gRNA sequence
cctggaggaagttttggaaa

SEQ ID NO: 242306 - DNA, 20 bp, Artificial
  CRISPR gRNA sequence
ggaagttttggaaagagttc

SEQ ID NO: 242307 - DNA, 20 bp, Artificial
  CRISPR gRNA sequence
tcaagtgtctgtatatccta

SEQ ID NO: 242308 - DNA, 20 bp, Artificial
  CRISPR gRNA sequence
cctttgtcctgctccctttt

SEQ ID NO: 242309 - DNA, 20 bp, Artificial
  CRISPR gRNA sequence
tgtcctgctcccttttaagc

SEQ ID NO: 242310 - DNA, 20 bp, Artificial
  CRISPR gRNA sequence
gtcctgctcccttttaagcc

SEQ ID NO: 242311 - DNA, 20 bp, Artificial
  CRISPR gRNA sequence
taacataatattttatacca

SEQ ID NO: 242312 - DNA, 20 bp, Artificial
  CRISPR gRNA sequence
aataaatgaactgcatatga

SEQ ID NO: 242313 - DNA, 20 bp, Artificial
  CRISPR gRNA sequence
ataaatgaactgcatatgat

SEQ ID NO: 242314 - DNA, 20 bp, Artificial
  CRISPR gRNA sequence
aactgcatatgataggtatg

SEQ ID NO: 242315 - DNA, 20 bp, Artificial
  CRISPR gRNA sequence
catatgataggtatgaagta

SEQ ID NO: 242316 - DNA, 20 bp, Artificial
  CRISPR gRNA sequence
tgataggtatgaagtacagt

SEQ ID NO: 242317 - DNA, 20 bp, Artificial
  CRISPR gRNA sequence
gtgagaaaattaacacctgt

SEQ ID NO: 242318 - DNA, 20 bp, Artificial
  CRISPR gRNA sequence
gtgagctcattgtcctacca

SEQ ID NO: 242319 - DNA, 20 bp, Artificial
  CRISPR gRNA sequence
tcattgtcctaccacagcac

SEQ ID NO: 242320 - DNA, 20 bp, Artificial
  CRISPR gRNA sequence
attgtcctaccacagcacta

SEQ ID NO: 242321 - DNA, 20 bp, Artificial
  CRISPR gRNA sequence
gtcctaccacagcactagag

SEQ ID NO: 242322 - DNA, 20 bp, Artificial
  CRISPR gRNA sequence
tcctaccacagcactagagt

SEQ ID NO: 242323 - DNA, 20 bp, Artificial
  CRISPR gRNA sequence
cctaccacagcactagagtg

SEQ ID NO: 242324 - DNA, 20 bp, Artificial
  CRISPR gRNA sequence
ctaccacagcactagagtgg

SEQ ID NO: 242325 - DNA, 20 bp, Artificial
  CRISPR gRNA sequence
tgggggccgccaaactccca

SEQ ID NO: 242326 - DNA, 20 bp, Artificial
  CRISPR gRNA sequence
caaactcccatggccaaacc

SEQ ID NO: 242327 - DNA, 20 bp, Artificial
  CRISPR gRNA sequence
atttgcctttgtttgtctgt

SEQ ID NO: 242328 - DNA, 20 bp, Artificial
  CRISPR gRNA sequence
gtttgtctgttggtttgctt

SEQ ID NO: 242329 - DNA, 20 bp, Artificial
  CRISPR gRNA sequence
gtctgttggtttgcttgaga

SEQ ID NO: 242330 - DNA, 20 bp, Artificial
  CRISPR gRNA sequence
gacagtcttgctctgttgcc

SEQ ID NO: 242331 - DNA, 20 bp, Artificial
  CRISPR gRNA sequence
acagtcttgctctgttgccc

SEQ ID NO: 242332 - DNA, 20 bp, Artificial
  CRISPR gRNA sequence
tcttgctctgttgcccaggc

SEQ ID NO: 242333 - DNA, 20 bp, Artificial
  CRISPR gRNA sequence
ctctgttgcccaggctggaa

SEQ ID NO: 242334 - DNA, 20 bp, Artificial
  CRISPR gRNA sequence
ctgttgcccaggctggaatg

SEQ ID NO: 242335 - DNA, 20 bp, Artificial
  CRISPR gRNA sequence
ttgcccaggctggaatggag

SEQ ID NO: 242336 - DNA, 20 bp, Artificial
  CRISPR gRNA sequence
tggaatggagtggctattca

SEQ ID NO: 242337 - DNA, 20 bp, Artificial
  CRISPR gRNA sequence
ggaatggagtggctattcac

SEQ ID NO: 242338 - DNA, 20 bp, Artificial
  CRISPR gRNA sequence
gctattcacaggcacaatca

SEQ ID NO: 242339 - DNA, 20 bp, Artificial
  CRISPR gRNA sequence
ggcacaatcatagcacactt

SEQ ID NO: 242340 - DNA, 20 bp, Artificial
  CRISPR gRNA sequence
acactttagccttaaactcc

SEQ ID NO: 242341 - DNA, 20 bp, Artificial
  CRISPR gRNA sequence
cactttagccttaaactcct

SEQ ID NO: 242342 - DNA, 20 bp, Artificial
  CRISPR gRNA sequence
agccttaaactcctgggctc

SEQ ID NO: 242343 - DNA, 20 bp, Artificial
  CRISPR gRNA sequence
ctcaagtgatccacccgcct

SEQ ID NO: 242344 - DNA, 20 bp, Artificial
  CRISPR gRNA sequence
tccacccgcctcagtctccc

SEQ ID NO: 242345 - DNA, 20 bp, Artificial
  CRISPR gRNA sequence
acccgcctcagtctcccaag

SEQ ID NO: 242346 - DNA, 20 bp, Artificial
  CRISPR gRNA sequence
gcctcagtctcccaagtagc

SEQ ID NO: 242347 - DNA, 20 bp, Artificial
  CRISPR gRNA sequence
cctcagtctcccaagtagct

SEQ ID NO: 242348 - DNA, 20 bp, Artificial
  CRISPR gRNA sequence
ctcccaagtagctgggatta

SEQ ID NO: 242349 - DNA, 20 bp, Artificial
  CRISPR gRNA sequence
tcccaagtagctgggattac

SEQ ID NO: 242350 - DNA, 20 bp, Artificial
  CRISPR gRNA sequence
tgggattacaggtgcaaacc

SEQ ID NO: 242351 - DNA, 20 bp, Artificial
  CRISPR gRNA sequence
ctggcatgcctgccattgtt

SEQ ID NO: 242352 - DNA, 20 bp, Artificial
  CRISPR gRNA sequence
cattgtttggcttatgatct

SEQ ID NO: 242353 - DNA, 20 bp, Artificial
  CRISPR gRNA sequence
attgtttggcttatgatcta

SEQ ID NO: 242354 - DNA, 20 bp, Artificial
  CRISPR gRNA sequence
tttggcttatgatctaagga

SEQ ID NO: 242355 - DNA, 20 bp, Artificial
  CRISPR gRNA sequence
tattcattttattttttttt

SEQ ID NO: 242356 - DNA, 20 bp, Artificial
  CRISPR gRNA sequence
cattttatttttttttgaga

SEQ ID NO: 242357 - DNA, 20 bp, Artificial
  CRISPR gRNA sequence
cagtgtctcactctgtctcc

SEQ ID NO: 242358 - DNA, 20 bp, Artificial
  CRISPR gRNA sequence
agtgtctcactctgtctccc

SEQ ID NO: 242359 - DNA, 20 bp, Artificial
  CRISPR gRNA sequence
tctcactctgtctcccaggc

SEQ ID NO: 242360 - DNA, 20 bp, Artificial
  CRISPR gRNA sequence
tcactctgtctcccaggctg

SEQ ID NO: 242361 - DNA, 20 bp, Artificial
  CRISPR gRNA sequence
ctgtctcccaggctggagta

SEQ ID NO: 242362 - DNA, 20 bp, Artificial
  CRISPR gRNA sequence
tctcccaggctggagtacag

SEQ ID NO: 242363 - DNA, 20 bp, Artificial
  CRISPR gRNA sequence
ggagtacagtggtacaatct

SEQ ID NO: 242364 - DNA, 20 bp, Artificial
  CRISPR gRNA sequence
aatcttggatcaccgcctcc

SEQ ID NO: 242365 - DNA, 20 bp, Artificial
  CRISPR gRNA sequence
gatcaccgcctcccagtttc

SEQ ID NO: 242366 - DNA, 20 bp, Artificial
  CRISPR gRNA sequence
ttcaagtgatctccctgcct

SEQ ID NO: 242367 - DNA, 20 bp, Artificial
  CRISPR gRNA sequence
tctccctgcctcagcctcct

SEQ ID NO: 242368 - DNA, 20 bp, Artificial
  CRISPR gRNA sequence
ccctgcctcagcctcctaag

SEQ ID NO: 242369 - DNA, 20 bp, Artificial
  CRISPR gRNA sequence
gcctcagcctcctaagtagc

SEQ ID NO: 242370 - DNA, 20 bp, Artificial
  CRISPR gRNA sequence
cctcagcctcctaagtagct

SEQ ID NO: 242371 - DNA, 20 bp, Artificial
  CRISPR gRNA sequence
ctcctaagtagctgggacta

SEQ ID NO: 242372 - DNA, 20 bp, Artificial
  CRISPR gRNA sequence
tcctaagtagctgggactac

SEQ ID NO: 242373 - DNA, 20 bp, Artificial
  CRISPR gRNA sequence
caggtatgtgccaccacgcc

SEQ ID NO: 242374 - DNA, 20 bp, Artificial
  CRISPR gRNA sequence
ctggctaatttttatatttt

SEQ ID NO: 242375 - DNA, 20 bp, Artificial
  CRISPR gRNA sequence
gctaatttttatatttttag

SEQ ID NO: 242376 - DNA, 20 bp, Artificial
  CRISPR gRNA sequence
taatttttatatttttagta

SEQ ID NO: 242377 - DNA, 20 bp, Artificial
  CRISPR gRNA sequence
ttttatatttttagtagaga

SEQ ID NO: 242378 - DNA, 20 bp, Artificial
  CRISPR gRNA sequence
tttatatttttagtagagac

SEQ ID NO: 242379 - DNA, 20 bp, Artificial
  CRISPR gRNA sequence
ttatatttttagtagagacg

SEQ ID NO: 242380 - DNA, 20 bp, Artificial
  CRISPR gRNA sequence
cggggtttcaccatgttgtc

SEQ ID NO: 242381 - DNA, 20 bp, Artificial
  CRISPR gRNA sequence
ggggtttcaccatgttgtcc

SEQ ID NO: 242382 - DNA, 20 bp, Artificial
  CRISPR gRNA sequence
tttcaccatgttgtccaggc

SEQ ID NO: 242383 - DNA, 20 bp, Artificial
  CRISPR gRNA sequence
tggtctcaaactcctgacct

SEQ ID NO: 242384 - DNA, 20 bp, Artificial
  CRISPR gRNA sequence
ggtctcaaactcctgacctc

SEQ ID NO: 242385 - DNA, 20 bp, Artificial
  CRISPR gRNA sequence
ctgcccacctctgcctccca

SEQ ID NO: 242386 - DNA, 20 bp, Artificial
  CRISPR gRNA sequence
acctctgcctcccaaagtgc

SEQ ID NO: 242387 - DNA, 20 bp, Artificial
  CRISPR gRNA sequence
cctctgcctcccaaagtgct

SEQ ID NO: 242388 - DNA, 20 bp, Artificial
  CRISPR gRNA sequence
ctcccaaagtgctgggatta

SEQ ID NO: 242389 - DNA, 20 bp, Artificial
  CRISPR gRNA sequence
tcccaaagtgctgggattac

SEQ ID NO: 242390 - DNA, 20 bp, Artificial
  CRISPR gRNA sequence
agtgctgggattacaggcat

SEQ ID NO: 242391 - DNA, 20 bp, Artificial
  CRISPR gRNA sequence
caggcatgagccaccatgcc

SEQ ID NO: 242392 - DNA, 20 bp, Artificial
  CRISPR gRNA sequence
ttgtatgacatgcctattgc

SEQ ID NO: 242393 - DNA, 20 bp, Artificial
  CRISPR gRNA sequence
tgtcccatgttattttactc

SEQ ID NO: 242394 - DNA, 20 bp, Artificial
  CRISPR gRNA sequence
gtcccatgttattttactct

SEQ ID NO: 242395 - DNA, 20 bp, Artificial
  CRISPR gRNA sequence
tgttattttactctgggatt

SEQ ID NO: 242396 - DNA, 20 bp, Artificial
  CRISPR gRNA sequence
gttattttactctgggattt

SEQ ID NO: 242397 - DNA, 20 bp, Artificial
  CRISPR gRNA sequence
attttactctgggatttagg

SEQ ID NO: 242398 - DNA, 20 bp, Artificial
  CRISPR gRNA sequence
tttactctgggatttaggtg

SEQ ID NO: 242399 - DNA, 20 bp, Artificial
  CRISPR gRNA sequence
ttactctgggatttaggtgg

SEQ ID NO: 242400 - DNA, 20 bp, Artificial
  CRISPR gRNA sequence
tactctgggatttaggtgga

SEQ ID NO: 242401 - DNA, 20 bp, Artificial
  CRISPR gRNA sequence
ctctgggatttaggtggagg

SEQ ID NO: 242402 - DNA, 20 bp, Artificial
  CRISPR gRNA sequence
tgggatttaggtggagggag

SEQ ID NO: 242403 - DNA, 20 bp, Artificial
  CRISPR gRNA sequence
tggagggagcagcttctatt

SEQ ID NO: 242404 - DNA, 20 bp, Artificial
  CRISPR gRNA sequence
gcagcttctatttggaacat

SEQ ID NO: 242405 - DNA, 20 bp, Artificial
  CRISPR gRNA sequence
ttggaacattggccatcgca

SEQ ID NO: 242406 - DNA, 20 bp, Artificial
  CRISPR gRNA sequence
attggccatcgcatggcaaa

SEQ ID NO: 242407 - DNA, 20 bp, Artificial
  CRISPR gRNA sequence
ttggccatcgcatggcaaat

SEQ ID NO: 242408 - DNA, 20 bp, Artificial
  CRISPR gRNA sequence
ctgtcacttctgctcctatt

SEQ ID NO: 242409 - DNA, 20 bp, Artificial
  CRISPR gRNA sequence
cacttctgctcctatttagt

SEQ ID NO: 242410 - DNA, 20 bp, Artificial
  CRISPR gRNA sequence
gttggttctactataacctt

SEQ ID NO: 242411 - DNA, 20 bp, Artificial
  CRISPR gRNA sequence
tggttctactataaccttta

SEQ ID NO: 242412 - DNA, 20 bp, Artificial
  CRISPR gRNA sequence
aacctttagagcaaatcctg

SEQ ID NO: 242413 - DNA, 20 bp, Artificial
  CRISPR gRNA sequence
ttagagcaaatcctgcagcc

SEQ ID NO: 242414 - DNA, 20 bp, Artificial
  CRISPR gRNA sequence
agcaaatcctgcagccaagc

SEQ ID NO: 242415 - DNA, 20 bp, Artificial
  CRISPR gRNA sequence
gcaaatcctgcagccaagcc

SEQ ID NO: 242416 - DNA, 20 bp, Artificial
  CRISPR gRNA sequence
gcagccaagccaggcatcaa

SEQ ID NO: 242417 - DNA, 20 bp, Artificial
  CRISPR gRNA sequence
cagccaagccaggcatcaat

SEQ ID NO: 242418 - DNA, 20 bp, Artificial
  CRISPR gRNA sequence
agccaagccaggcatcaata

SEQ ID NO: 242419 - DNA, 20 bp, Artificial
  CRISPR gRNA sequence
caagccaggcatcaataggg

SEQ ID NO: 242420 - DNA, 20 bp, Artificial
  CRISPR gRNA sequence
caggcatcaatagggcagaa

SEQ ID NO: 242421 - DNA, 20 bp, Artificial
  CRISPR gRNA sequence
agaaaagtatattctgtaaa

SEQ ID NO: 242422 - DNA, 20 bp, Artificial
  CRISPR gRNA sequence
gaaaagtatattctgtaaat

SEQ ID NO: 242423 - DNA, 20 bp, Artificial
  CRISPR gRNA sequence
aaaagtatattctgtaaata

SEQ ID NO: 242424 - DNA, 20 bp, Artificial
  CRISPR gRNA sequence
aaagtatattctgtaaatag

SEQ ID NO: 242425 - DNA, 20 bp, Artificial
  CRISPR gRNA sequence
tatattctgtaaataggggt

SEQ ID NO: 242426 - DNA, 20 bp, Artificial
  CRISPR gRNA sequence
atattctgtaaataggggtg

SEQ ID NO: 242427 - DNA, 20 bp, Artificial
  CRISPR gRNA sequence
attctgtaaataggggtgag

SEQ ID NO: 242428 - DNA, 20 bp, Artificial
  CRISPR gRNA sequence
ctgtaaataggggtgaggag

SEQ ID NO: 242429 - DNA, 20 bp, Artificial
  CRISPR gRNA sequence
gagaagatatttctgaacaa

SEQ ID NO: 242430 - DNA, 20 bp, Artificial
  CRISPR gRNA sequence
ttctgaacaatagtctactg

SEQ ID NO: 242431 - DNA, 20 bp, Artificial
  CRISPR gRNA sequence
cagtaccaaattgcttttca

SEQ ID NO: 242432 - DNA, 20 bp, Artificial
  CRISPR gRNA sequence
taccaaattgcttttcaaag

SEQ ID NO: 242433 - DNA, 20 bp, Artificial
  CRISPR gRNA sequence
ctgttctaatgtactcccgt

SEQ ID NO: 242434 - DNA, 20 bp, Artificial
  CRISPR gRNA sequence
tgtactcccgtcagtcatat

SEQ ID NO: 242435 - DNA, 20 bp, Artificial
  CRISPR gRNA sequence
cagtcatataagtgtcatgt

SEQ ID NO: 242436 - DNA, 20 bp, Artificial
  CRISPR gRNA sequence
tccacatccttgctaccctc

SEQ ID NO: 242437 - DNA, 20 bp, Artificial
  CRISPR gRNA sequence
ttgctaccctctggtactat

SEQ ID NO: 242438 - DNA, 20 bp, Artificial
  CRISPR gRNA sequence
tgctaccctctggtactatc

SEQ ID NO: 242439 - DNA, 20 bp, Artificial
  CRISPR gRNA sequence
caggtgcccttaattttgcc

SEQ ID NO: 242440 - DNA, 20 bp, Artificial
  CRISPR gRNA sequence
tgcccttaattttgccaagc

SEQ ID NO: 242441 - DNA, 20 bp, Artificial
  CRISPR gRNA sequence
ccttaattttgccaagccag

SEQ ID NO: 242442 - DNA, 20 bp, Artificial
  CRISPR gRNA sequence
cttaattttgccaagccagt

SEQ ID NO: 242443 - DNA, 20 bp, Artificial
  CRISPR gRNA sequence
ttttgccaagccagtgggta

SEQ ID NO: 242444 - DNA, 20 bp, Artificial
  CRISPR gRNA sequence
caagccagtgggtatagaat

SEQ ID NO: 242445 - DNA, 20 bp, Artificial
  CRISPR gRNA sequence
tatagaatgagatctcactg

SEQ ID NO: 242446 - DNA, 20 bp, Artificial
  CRISPR gRNA sequence
atgagatctcactgtggtct

SEQ ID NO: 242447 - DNA, 20 bp, Artificial
  CRISPR gRNA sequence
ggtcttagtttgcatttgct

SEQ ID NO: 242448 - DNA, 20 bp, Artificial
  CRISPR gRNA sequence
gcatttgcttggttactgat

SEQ ID NO: 242449 - DNA, 20 bp, Artificial
  CRISPR gRNA sequence
tgcccatttgcaaaaaaact

SEQ ID NO: 242450 - DNA, 20 bp, Artificial
  CRISPR gRNA sequence
gcccatttgcaaaaaaactt

SEQ ID NO: 242451 - DNA, 20 bp, Artificial
  CRISPR gRNA sequence
cccatttgcaaaaaaacttg

SEQ ID NO: 242452 - DNA, 20 bp, Artificial
  CRISPR gRNA sequence
tttgcaaaaaaacttggggc

SEQ ID NO: 242453 - DNA, 20 bp, Artificial
  CRISPR gRNA sequence
ttgcaaaaaaacttggggcc

SEQ ID NO: 242454 - DNA, 20 bp, Artificial
  CRISPR gRNA sequence
aaaaaacttggggccgggtg

SEQ ID NO: 242455 - DNA, 20 bp, Artificial
  CRISPR gRNA sequence
aaacttggggccgggtgcag

SEQ ID NO: 242456 - DNA, 20 bp, Artificial
  CRISPR gRNA sequence
ggtgcagtggctcatgcctg

SEQ ID NO: 242457 - DNA, 20 bp, Artificial
  CRISPR gRNA sequence
gtggctcatgcctgtagtcc

SEQ ID NO: 242458 - DNA, 20 bp, Artificial
  CRISPR gRNA sequence
tgcctgtagtcccagctctt

SEQ ID NO: 242459 - DNA, 20 bp, Artificial
  CRISPR gRNA sequence
gcctgtagtcccagctcttt

SEQ ID NO: 242460 - DNA, 20 bp, Artificial
  CRISPR gRNA sequence
ctgtagtcccagctctttgg

SEQ ID NO: 242461 - DNA, 20 bp, Artificial
  CRISPR gRNA sequence
tgtagtcccagctctttggg

SEQ ID NO: 242462 - DNA, 20 bp, Artificial
  CRISPR gRNA sequence
tcccagctctttgggaggcc

SEQ ID NO: 242463 - DNA, 20 bp, Artificial
  CRISPR gRNA sequence
cccagctctttgggaggcca

SEQ ID NO: 242464 - DNA, 20 bp, Artificial
  CRISPR gRNA sequence
agctctttgggaggccaagg

SEQ ID NO: 242465 - DNA, 20 bp, Artificial
  CRISPR gRNA sequence
gctctttgggaggccaaggt

SEQ ID NO: 242466 - DNA, 20 bp, Artificial
  CRISPR gRNA sequence
ctttgggaggccaaggtggg

SEQ ID NO: 242467 - DNA, 20 bp, Artificial
  CRISPR gRNA sequence
ccaaggtgggcagatcgctt

SEQ ID NO: 242468 - DNA, 20 bp, Artificial
  CRISPR gRNA sequence
gtgggcagatcgcttgagcc

SEQ ID NO: 242469 - DNA, 20 bp, Artificial
  CRISPR gRNA sequence
tgggcagatcgcttgagccc

SEQ ID NO: 242470 - DNA, 20 bp, Artificial
  CRISPR gRNA sequence
ggcagatcgcttgagcccag

SEQ ID NO: 242471 - DNA, 20 bp, Artificial
  CRISPR gRNA sequence
tcgcttgagcccaggagttc

SEQ ID NO: 242472 - DNA, 20 bp, Artificial
  CRISPR gRNA sequence
tgagcccaggagttcgagac

SEQ ID NO: 242473 - DNA, 20 bp, Artificial
  CRISPR gRNA sequence
caggagttcgagaccagcct

SEQ ID NO: 242474 - DNA, 20 bp, Artificial
  CRISPR gRNA sequence
cgagaccagccttggcaaca

SEQ ID NO: 242475 - DNA, 20 bp, Artificial
  CRISPR gRNA sequence
tttacaaaaaatacaaaaat

SEQ ID NO: 242476 - DNA, 20 bp, Artificial
  CRISPR gRNA sequence
caaaaaatacaaaaattagc

SEQ ID NO: 242477 - DNA, 20 bp, Artificial
  CRISPR gRNA sequence
aaaaaatacaaaaattagcc

SEQ ID NO: 242478 - DNA, 20 bp, Artificial
  CRISPR gRNA sequence
atacaaaaattagccgggtg

SEQ ID NO: 242479 - DNA, 20 bp, Artificial
  CRISPR gRNA sequence
caaaaattagccgggtgtgg

SEQ ID NO: 242480 - DNA, 20 bp, Artificial
  CRISPR gRNA sequence
ggtgtggtggtgtgcacctg

SEQ ID NO: 242481 - DNA, 20 bp, Artificial
  CRISPR gRNA sequence
gtggtgtgcacctgaagtcc

SEQ ID NO: 242482 - DNA, 20 bp, Artificial
  CRISPR gRNA sequence
cacctgaagtcccagctact

SEQ ID NO: 242483 - DNA, 20 bp, Artificial
  CRISPR gRNA sequence
ctgaagtcccagctactcag

SEQ ID NO: 242484 - DNA, 20 bp, Artificial
  CRISPR gRNA sequence
tgaagtcccagctactcagt

SEQ ID NO: 242485 - DNA, 20 bp, Artificial
  CRISPR gRNA sequence
ctactcagtaggttcgcttt

SEQ ID NO: 242486 - DNA, 20 bp, Artificial
  CRISPR gRNA sequence
cagtaggttcgctttgagcc

SEQ ID NO: 242487 - DNA, 20 bp, Artificial
  CRISPR gRNA sequence
agtaggttcgctttgagcct

SEQ ID NO: 242488 - DNA, 20 bp, Artificial
  CRISPR gRNA sequence
taggttcgctttgagcctgg

SEQ ID NO: 242489 - DNA, 20 bp, Artificial
  CRISPR gRNA sequence
aggttcgctttgagcctggg

SEQ ID NO: 242490 - DNA, 20 bp, Artificial
  CRISPR gRNA sequence
ttcgctttgagcctgggagg

SEQ ID NO: 242491 - DNA, 20 bp, Artificial
  CRISPR gRNA sequence
cgctttgagcctgggaggca

SEQ ID NO: 242492 - DNA, 20 bp, Artificial
  CRISPR gRNA sequence
gctttgagcctgggaggcag

SEQ ID NO: 242493 - DNA, 20 bp, Artificial
  CRISPR gRNA sequence
agcctgggaggcagaggttg

SEQ ID NO: 242494 - DNA, 20 bp, Artificial
  CRISPR gRNA sequence
tgggaggcagaggttgcagt

SEQ ID NO: 242495 - DNA, 20 bp, Artificial
  CRISPR gRNA sequence
aggcagaggttgcagtgagc

SEQ ID NO: 242496 - DNA, 20 bp, Artificial
  CRISPR gRNA sequence
ggcagaggttgcagtgagct

SEQ ID NO: 242497 - DNA, 20 bp, Artificial
  CRISPR gRNA sequence
gggaccgcatcactacactt

SEQ ID NO: 242498 - DNA, 20 bp, Artificial
  CRISPR gRNA sequence
cgcatcactacacttcagcc

SEQ ID NO: 242499 - DNA, 20 bp, Artificial
  CRISPR gRNA sequence
gcatcactacacttcagcct

SEQ ID NO: 242500 - DNA, 20 bp, Artificial
  CRISPR gRNA sequence
ctacacttcagcctgggcaa

SEQ ID NO: 242501 - DNA, 20 bp, Artificial
  CRISPR gRNA sequence
acacttcagcctgggcaaca

SEQ ID NO: 242502 - DNA, 20 bp, Artificial
  CRISPR gRNA sequence
aacagagaaaaaccttttct

SEQ ID NO: 242503 - DNA, 20 bp, Artificial
  CRISPR gRNA sequence
gaaacaaacaaacccaaatg

SEQ ID NO: 242504 - DNA, 20 bp, Artificial
  CRISPR gRNA sequence
ttgtttgtcctgattcctaa

SEQ ID NO: 242505 - DNA, 20 bp, Artificial
  CRISPR gRNA sequence
tgtttgtcctgattcctaaa

SEQ ID NO: 242506 - DNA, 20 bp, Artificial
  CRISPR gRNA sequence
taaaaggtctttatgtattc

SEQ ID NO: 242507 - DNA, 20 bp, Artificial
  CRISPR gRNA sequence
gtattctagataataatctt

SEQ ID NO: 242508 - DNA, 20 bp, Artificial
  CRISPR gRNA sequence
tctagataataatctttggt

SEQ ID NO: 242509 - DNA, 20 bp, Artificial
  CRISPR gRNA sequence
gttaaaaaatatcttctttg

SEQ ID NO: 242510 - DNA, 20 bp, Artificial
  CRISPR gRNA sequence
aaaaatatcttctttgtggc

SEQ ID NO: 242511 - DNA, 20 bp, Artificial
  CRISPR gRNA sequence
aaaatatcttctttgtggcc

SEQ ID NO: 242512 - DNA, 20 bp, Artificial
  CRISPR gRNA sequence
atcttctttgtggccaggca

SEQ ID NO: 242513 - DNA, 20 bp, Artificial
  CRISPR gRNA sequence
ttctttgtggccaggcacgg

SEQ ID NO: 242514 - DNA, 20 bp, Artificial
  CRISPR gRNA sequence
gtagctcacacctgtaatcc

SEQ ID NO: 242515 - DNA, 20 bp, Artificial
  CRISPR gRNA sequence
cctgtaatcccagcactttg

SEQ ID NO: 242516 - DNA, 20 bp, Artificial
  CRISPR gRNA sequence
ctgtaatcccagcactttgc

SEQ ID NO: 242517 - DNA, 20 bp, Artificial
  CRISPR gRNA sequence
tgtaatcccagcactttgcg

SEQ ID NO: 242518 - DNA, 20 bp, Artificial
  CRISPR gRNA sequence
tcccagcactttgcggggct

SEQ ID NO: 242519 - DNA, 20 bp, Artificial
  CRISPR gRNA sequence
cccagcactttgcggggctg

SEQ ID NO: 242520 - DNA, 20 bp, Artificial
  CRISPR gRNA sequence
agcactttgcggggctgagg

SEQ ID NO: 242521 - DNA, 20 bp, Artificial
  CRISPR gRNA sequence
gcactttgcggggctgaggt

SEQ ID NO: 242522 - DNA, 20 bp, Artificial
  CRISPR gRNA sequence
ctttgcggggctgaggtggg

SEQ ID NO: 242523 - DNA, 20 bp, Artificial
  CRISPR gRNA sequence
ctgaggtgggtggatcatct

SEQ ID NO: 242524 - DNA, 20 bp, Artificial
  CRISPR gRNA sequence
tgaggtgggtggatcatctg

SEQ ID NO: 242525 - DNA, 20 bp, Artificial
  CRISPR gRNA sequence
tgggtggatcatctgaggtc

SEQ ID NO: 242526 - DNA, 20 bp, Artificial
  CRISPR gRNA sequence
ggtggatcatctgaggtcaa

SEQ ID NO: 242527 - DNA, 20 bp, Artificial
  CRISPR gRNA sequence
tcatctgaggtcaagagttc

SEQ ID NO: 242528 - DNA, 20 bp, Artificial
  CRISPR gRNA sequence
tgaggtcaagagttcaagat

SEQ ID NO: 242529 - DNA, 20 bp, Artificial
  CRISPR gRNA sequence
tcaagagttcaagatcagcc

SEQ ID NO: 242530 - DNA, 20 bp, Artificial
  CRISPR gRNA sequence
caagatcagcctggccaaca

SEQ ID NO: 242531 - DNA, 20 bp, Artificial
  CRISPR gRNA sequence
tactaaacatgtacaaaact

SEQ ID NO: 242532 - DNA, 20 bp, Artificial
  CRISPR gRNA sequence
aaacatgtacaaaacttagc

SEQ ID NO: 242533 - DNA, 20 bp, Artificial
  CRISPR gRNA sequence
aacatgtacaaaacttagct

SEQ ID NO: 242534 - DNA, 20 bp, Artificial
  CRISPR gRNA sequence
gtacaaaacttagctgggta

SEQ ID NO: 242535 - DNA, 20 bp, Artificial
  CRISPR gRNA sequence
caaaacttagctgggtatgg

SEQ ID NO: 242536 - DNA, 20 bp, Artificial
  CRISPR gRNA sequence
aacttagctgggtatggtgg

SEQ ID NO: 242537 - DNA, 20 bp, Artificial
  CRISPR gRNA sequence
acttagctgggtatggtggc

SEQ ID NO: 242538 - DNA, 20 bp, Artificial
  CRISPR gRNA sequence
gtggcgggtgcctgtaaccc

SEQ ID NO: 242539 - DNA, 20 bp, Artificial
  CRISPR gRNA sequence
gcctgtaaccccagctgctc

SEQ ID NO: 242540 - DNA, 20 bp, Artificial
  CRISPR gRNA sequence
ctgtaaccccagctgctcca

SEQ ID NO: 242541 - DNA, 20 bp, Artificial
  CRISPR gRNA sequence
tgtaaccccagctgctccag

SEQ ID NO: 242542 - DNA, 20 bp, Artificial
  CRISPR gRNA sequence
cccagctgctccagaggctg

SEQ ID NO: 242543 - DNA, 20 bp, Artificial
  CRISPR gRNA sequence
agctgctccagaggctgtgg

SEQ ID NO: 242544 - DNA, 20 bp, Artificial
  CRISPR gRNA sequence
tgctccagaggctgtggcag

SEQ ID NO: 242545 - DNA, 20 bp, Artificial
  CRISPR gRNA sequence
gcagaagaatcgcttgaacc

SEQ ID NO: 242546 - DNA, 20 bp, Artificial
  CRISPR gRNA sequence
cagaagaatcgcttgaaccc

SEQ ID NO: 242547 - DNA, 20 bp, Artificial
  CRISPR gRNA sequence
gaagaatcgcttgaacccag

SEQ ID NO: 242548 - DNA, 20 bp, Artificial
  CRISPR gRNA sequence
aagaatcgcttgaacccagg

SEQ ID NO: 242549 - DNA, 20 bp, Artificial
  CRISPR gRNA sequence
aatcgcttgaacccaggagg

SEQ ID NO: 242550 - DNA, 20 bp, Artificial
  CRISPR gRNA sequence
tcgcttgaacccaggaggca

SEQ ID NO: 242551 - DNA, 20 bp, Artificial
  CRISPR gRNA sequence
cgcttgaacccaggaggcag

SEQ ID NO: 242552 - DNA, 20 bp, Artificial
  CRISPR gRNA sequence
aacccaggaggcagaggttg

SEQ ID NO: 242553 - DNA, 20 bp, Artificial
  CRISPR gRNA sequence
caggaggcagaggttgcagc

SEQ ID NO: 242554 - DNA, 20 bp, Artificial
  CRISPR gRNA sequence
ggcagaggttgcagcgagcc

SEQ ID NO: 242555 - DNA, 20 bp, Artificial
  CRISPR gRNA sequence
aagattgtgccattgcactc

SEQ ID NO: 242556 - DNA, 20 bp, Artificial
  CRISPR gRNA sequence
tgtgccattgcactccagac

SEQ ID NO: 242557 - DNA, 20 bp, Artificial
  CRISPR gRNA sequence
gtgccattgcactccagact

SEQ ID NO: 242558 - DNA, 20 bp, Artificial
  CRISPR gRNA sequence
tgcactccagactgggtgac

SEQ ID NO: 242559 - DNA, 20 bp, Artificial
  CRISPR gRNA sequence
cactccagactgggtgacaa

SEQ ID NO: 242560 - DNA, 20 bp, Artificial
  CRISPR gRNA sequence
ttcttttttatttttatttt

SEQ ID NO: 242561 - DNA, 20 bp, Artificial
  CRISPR gRNA sequence
ttttttatttttatttttag

SEQ ID NO: 242562 - DNA, 20 bp, Artificial
  CRISPR gRNA sequence
ttttatttttatttttagca

SEQ ID NO: 242563 - DNA, 20 bp, Artificial
  CRISPR gRNA sequence
tttatttttatttttagcag

SEQ ID NO: 242564 - DNA, 20 bp, Artificial
  CRISPR gRNA sequence
tttttatttttagcagaggt

SEQ ID NO: 242565 - DNA, 20 bp, Artificial
  CRISPR gRNA sequence
ttttatttttagcagaggtg

SEQ ID NO: 242566 - DNA, 20 bp, Artificial
  CRISPR gRNA sequence
ttagcagaggtgaggtttct

SEQ ID NO: 242567 - DNA, 20 bp, Artificial
  CRISPR gRNA sequence
tagcagaggtgaggtttctg

SEQ ID NO: 242568 - DNA, 20 bp, Artificial
  CRISPR gRNA sequence
tgaggtttcattatgttgcc

SEQ ID NO: 242569 - DNA, 20 bp, Artificial
  CRISPR gRNA sequence
gaggtttcattatgttgccc

SEQ ID NO: 242570 - DNA, 20 bp, Artificial
  CRISPR gRNA sequence
tttcattatgttgcccaggc

SEQ ID NO: 242571 - DNA, 20 bp, Artificial
  CRISPR gRNA sequence
caggctggtcttgaactcct

SEQ ID NO: 242572 - DNA, 20 bp, Artificial
  CRISPR gRNA sequence
ggtcttgaactcctgagctc

SEQ ID NO: 242573 - DNA, 20 bp, Artificial
  CRISPR gRNA sequence
ctcaagtgatcctcccacct

SEQ ID NO: 242574 - DNA, 20 bp, Artificial
  CRISPR gRNA sequence
cctcccacctcagccttcca

SEQ ID NO: 242575 - DNA, 20 bp, Artificial
  CRISPR gRNA sequence
acctcagccttccaaagtgc

SEQ ID NO: 242576 - DNA, 20 bp, Artificial
  CRISPR gRNA sequence
cttccaaagtgctggaattg

SEQ ID NO: 242577 - DNA, 20 bp, Artificial
  CRISPR gRNA sequence
agtgctggaattgcagacat

SEQ ID NO: 242578 - DNA, 20 bp, Artificial
  CRISPR gRNA sequence
tcctgtttttctctaattaa

SEQ ID NO: 242579 - DNA, 20 bp, Artificial
  CRISPR gRNA sequence
ggtgtctttctttgtctttc

SEQ ID NO: 242580 - DNA, 20 bp, Artificial
  CRISPR gRNA sequence
ttctttgtctttctggtaat

SEQ ID NO: 242581 - DNA, 20 bp, Artificial
  CRISPR gRNA sequence
tctttctggtaataagcaaa

SEQ ID NO: 242582 - DNA, 20 bp, Artificial
  CRISPR gRNA sequence
aaaaagttcttcatttgatt

SEQ ID NO: 242583 - DNA, 20 bp, Artificial
  CRISPR gRNA sequence
tttataactgttttctcata

SEQ ID NO: 242584 - DNA, 20 bp, Artificial
  CRISPR gRNA sequence
ggttaacattttttcttgcc

SEQ ID NO: 242585 - DNA, 20 bp, Artificial
  CRISPR gRNA sequence
cattttttcttgcctggcta

SEQ ID NO: 242586 - DNA, 20 bp, Artificial
  CRISPR gRNA sequence
cttttctgcccaatactata

SEQ ID NO: 242587 - DNA, 20 bp, Artificial
  CRISPR gRNA sequence
tttctgcccaatactataaa

SEQ ID NO: 242588 - DNA, 20 bp, Artificial
  CRISPR gRNA sequence
ttctgcccaatactataaag

SEQ ID NO: 242589 - DNA, 20 bp, Artificial
  CRISPR gRNA sequence
ttgcccacattttattccaa

SEQ ID NO: 242590 - DNA, 20 bp, Artificial
  CRISPR gRNA sequence
cattttattccaaaagtttt

SEQ ID NO: 242591 - DNA, 20 bp, Artificial
  CRISPR gRNA sequence
aagttttgtctttcatcttg

SEQ ID NO: 242592 - DNA, 20 bp, Artificial
  CRISPR gRNA sequence
catcttgaagtctaatgtat

SEQ ID NO: 242593 - DNA, 20 bp, Artificial
  CRISPR gRNA sequence
atcttgaagtctaatgtatc

SEQ ID NO: 242594 - DNA, 20 bp, Artificial
  CRISPR gRNA sequence
aagtctaatgtatcaggaac

SEQ ID NO: 242595 - DNA, 20 bp, Artificial
  CRISPR gRNA sequence
gaactggcttttgtgcctgt

SEQ ID NO: 242596 - DNA, 20 bp, Artificial
  CRISPR gRNA sequence
aactggcttttgtgcctgtt

SEQ ID NO: 242597 - DNA, 20 bp, Artificial
  CRISPR gRNA sequence
ctggcttttgtgcctgttgg

SEQ ID NO: 242598 - DNA, 20 bp, Artificial
  CRISPR gRNA sequence
tggcttttgtgcctgttggg

SEQ ID NO: 242599 - DNA, 20 bp, Artificial
  CRISPR gRNA sequence
cttttgtgcctgttgggagg

SEQ ID NO: 242600 - DNA, 20 bp, Artificial
  CRISPR gRNA sequence
ccaattccatgtcttgcatg

SEQ ID NO: 242601 - DNA, 20 bp, Artificial
  CRISPR gRNA sequence
caattccatgtcttgcatgt

SEQ ID NO: 242602 - DNA, 20 bp, Artificial
  CRISPR gRNA sequence
tcttgcatgtaggtaaccac

SEQ ID NO: 242603 - DNA, 20 bp, Artificial
  CRISPR gRNA sequence
aatacgtcgtctttctcctg

SEQ ID NO: 242604 - DNA, 20 bp, Artificial
  CRISPR gRNA sequence
atacgtcgtctttctcctgc

SEQ ID NO: 242605 - DNA, 20 bp, Artificial
  CRISPR gRNA sequence
aatctcacctaccatccatc

SEQ ID NO: 242606 - DNA, 20 bp, Artificial
  CRISPR gRNA sequence
taccatccatcaagtttcca

SEQ ID NO: 242607 - DNA, 20 bp, Artificial
  CRISPR gRNA sequence
accatccatcaagtttccat

SEQ ID NO: 242608 - DNA, 20 bp, Artificial
  CRISPR gRNA sequence
ccatccatcaagtttccata

SEQ ID NO: 242609 - DNA, 20 bp, Artificial
  CRISPR gRNA sequence
atcaagtttccatagggcca

SEQ ID NO: 242610 - DNA, 20 bp, Artificial
  CRISPR gRNA sequence
tcaagtttccatagggccat

SEQ ID NO: 242611 - DNA, 20 bp, Artificial
  CRISPR gRNA sequence
tagggccatgggtctgcttc

SEQ ID NO: 242612 - DNA, 20 bp, Artificial
  CRISPR gRNA sequence
agggccatgggtctgcttct

SEQ ID NO: 242613 - DNA, 20 bp, Artificial
  CRISPR gRNA sequence
tcaatttgtctatcctgtgc

SEQ ID NO: 242614 - DNA, 20 bp, Artificial
  CRISPR gRNA sequence
tcacactgtgtttattacaa

SEQ ID NO: 242615 - DNA, 20 bp, Artificial
  CRISPR gRNA sequence
ttattacaatagctttgtaa

SEQ ID NO: 242616 - DNA, 20 bp, Artificial
  CRISPR gRNA sequence
ttgtaacagctctcgatatc

SEQ ID NO: 242617 - DNA, 20 bp, Artificial
  CRISPR gRNA sequence
taacagctctcgatatccgg

SEQ ID NO: 242618 - DNA, 20 bp, Artificial
  CRISPR gRNA sequence
aacagctctcgatatccggt

SEQ ID NO: 242619 - DNA, 20 bp, Artificial
  CRISPR gRNA sequence
tccaccttctttttctactt

SEQ ID NO: 242620 - DNA, 20 bp, Artificial
  CRISPR gRNA sequence
accttctttttctacttcag

SEQ ID NO: 242621 - DNA, 20 bp, Artificial
  CRISPR gRNA sequence
tttctacttcagaagtgtct

SEQ ID NO: 242622 - DNA, 20 bp, Artificial
  CRISPR gRNA sequence
tacttcagaagtgtcttagc

SEQ ID NO: 242623 - DNA, 20 bp, Artificial
  CRISPR gRNA sequence
acttcagaagtgtcttagct

SEQ ID NO: 242624 - DNA, 20 bp, Artificial
  CRISPR gRNA sequence
cagaagtgtcttagctaggt

SEQ ID NO: 242625 - DNA, 20 bp, Artificial
  CRISPR gRNA sequence
agaagtgtcttagctaggtc

SEQ ID NO: 242626 - DNA, 20 bp, Artificial
  CRISPR gRNA sequence
tgtcttagctaggtcaggca

SEQ ID NO: 242627 - DNA, 20 bp, Artificial
  CRISPR gRNA sequence
cttagctaggtcaggcacgg

SEQ ID NO: 242628 - DNA, 20 bp, Artificial
  CRISPR gRNA sequence
gtggctcacgcctgtaatcc

SEQ ID NO: 242629 - DNA, 20 bp, Artificial
  CRISPR gRNA sequence
cgcctgtaatcccagcactt

SEQ ID NO: 242630 - DNA, 20 bp, Artificial
  CRISPR gRNA sequence
gcctgtaatcccagcacttt

SEQ ID NO: 242631 - DNA, 20 bp, Artificial
  CRISPR gRNA sequence
ctgtaatcccagcactttgg

SEQ ID NO: 242632 - DNA, 20 bp, Artificial
  CRISPR gRNA sequence
tgtaatcccagcactttggg

SEQ ID NO: 242633 - DNA, 20 bp, Artificial
  CRISPR gRNA sequence
agcactttgggaggccgacg

SEQ ID NO: 242634 - DNA, 20 bp, Artificial
  CRISPR gRNA sequence
ctttgggaggccgacgcgga

SEQ ID NO: 242635 - DNA, 20 bp, Artificial
  CRISPR gRNA sequence
ccgacgcggatggatcacct

SEQ ID NO: 242636 - DNA, 20 bp, Artificial
  CRISPR gRNA sequence
cgacgcggatggatcacctg

SEQ ID NO: 242637 - DNA, 20 bp, Artificial
  CRISPR gRNA sequence
gcggatggatcacctgaggt

SEQ ID NO: 242638 - DNA, 20 bp, Artificial
  CRISPR gRNA sequence
cggatggatcacctgaggtc

SEQ ID NO: 242639 - DNA, 20 bp, Artificial
  CRISPR gRNA sequence
gatggatcacctgaggtcag

SEQ ID NO: 242640 - DNA, 20 bp, Artificial
  CRISPR gRNA sequence
cacctgaggtcaggagtttt

SEQ ID NO: 242641 - DNA, 20 bp, Artificial
  CRISPR gRNA sequence
tgaggtcaggagttttgaga

SEQ ID NO: 242642 - DNA, 20 bp, Artificial
  CRISPR gRNA sequence
tcaggagttttgagacagcc

SEQ ID NO: 242643 - DNA, 20 bp, Artificial
  CRISPR gRNA sequence
ttgagacagcctggccaaca

SEQ ID NO: 242644 - DNA, 20 bp, Artificial
  CRISPR gRNA sequence
ctactaaaaaatacaaaaat

SEQ ID NO: 242645 - DNA, 20 bp, Artificial
  CRISPR gRNA sequence
taaaaaatacaaaaattagt

SEQ ID NO: 242646 - DNA, 20 bp, Artificial
  CRISPR gRNA sequence
aaaaaatacaaaaattagtc

SEQ ID NO: 242647 - DNA, 20 bp, Artificial
  CRISPR gRNA sequence
atacaaaaattagtcaggca

SEQ ID NO: 242648 - DNA, 20 bp, Artificial
  CRISPR gRNA sequence
caaaaattagtcaggcatgg

SEQ ID NO: 242649 - DNA, 20 bp, Artificial
  CRISPR gRNA sequence
gtggcatgtgcctgtaatcc

SEQ ID NO: 242650 - DNA, 20 bp, Artificial
  CRISPR gRNA sequence
tgcctgtaatcccagctatt

SEQ ID NO: 242651 - DNA, 20 bp, Artificial
  CRISPR gRNA sequence
gcctgtaatcccagctattt

SEQ ID NO: 242652 - DNA, 20 bp, Artificial
  CRISPR gRNA sequence
ctgtaatcccagctatttgg

SEQ ID NO: 242653 - DNA, 20 bp, Artificial
  CRISPR gRNA sequence
tgtaatcccagctatttggg

SEQ ID NO: 242654 - DNA, 20 bp, Artificial
  CRISPR gRNA sequence
tcccagctatttgggaggct

SEQ ID NO: 242655 - DNA, 20 bp, Artificial
  CRISPR gRNA sequence
cccagctatttgggaggctg

SEQ ID NO: 242656 - DNA, 20 bp, Artificial
  CRISPR gRNA sequence
gctatttgggaggctgaggc

SEQ ID NO: 242657 - DNA, 20 bp, Artificial
  CRISPR gRNA sequence
tatttgggaggctgaggccg

SEQ ID NO: 242658 - DNA, 20 bp, Artificial
  CRISPR gRNA sequence
gccggagaattgcttgaacc

SEQ ID NO: 242659 - DNA, 20 bp, Artificial
  CRISPR gRNA sequence
ccggagaattgcttgaaccc

SEQ ID NO: 242660 - DNA, 20 bp, Artificial
  CRISPR gRNA sequence
cggagaattgcttgaacccg

SEQ ID NO: 242661 - DNA, 20 bp, Artificial
  CRISPR gRNA sequence
ggagaattgcttgaacccgg

SEQ ID NO: 242662 - DNA, 20 bp, Artificial
  CRISPR gRNA sequence
gagaattgcttgaacccggg

SEQ ID NO: 242663 - DNA, 20 bp, Artificial
  CRISPR gRNA sequence
aattgcttgaacccgggggg

SEQ ID NO: 242664 - DNA, 20 bp, Artificial
  CRISPR gRNA sequence
ttgcttgaacccggggggcg

SEQ ID NO: 242665 - DNA, 20 bp, Artificial
  CRISPR gRNA sequence
tgcttgaacccggggggcgg

SEQ ID NO: 242666 - DNA, 20 bp, Artificial
  CRISPR gRNA sequence
aacccggggggcggaggttg

SEQ ID NO: 242667 - DNA, 20 bp, Artificial
  CRISPR gRNA sequence
cggggggcggaggttgcagt

SEQ ID NO: 242668 - DNA, 20 bp, Artificial
  CRISPR gRNA sequence
ggcggaggttgcagtgagcc

SEQ ID NO: 242669 - DNA, 20 bp, Artificial
  CRISPR gRNA sequence
gagatcgtaccattgcactc

SEQ ID NO: 242670 - DNA, 20 bp, Artificial
  CRISPR gRNA sequence
cgtaccattgcactccagcc

SEQ ID NO: 242671 - DNA, 20 bp, Artificial
  CRISPR gRNA sequence
gtaccattgcactccagcct

SEQ ID NO: 242672 - DNA, 20 bp, Artificial
  CRISPR gRNA sequence
ttgcactccagcctgggtga

SEQ ID NO: 242673 - DNA, 20 bp, Artificial
  CRISPR gRNA sequence
gcactccagcctgggtgaca

SEQ ID NO: 242674 - DNA, 20 bp, Artificial
  CRISPR gRNA sequence
gacagagcgaaactctgtct

SEQ ID NO: 242675 - DNA, 20 bp, Artificial
  CRISPR gRNA sequence
acagagcgaaactctgtctc

SEQ ID NO: 242676 - DNA, 20 bp, Artificial
  CRISPR gRNA sequence
aactctgtctcaggaaaaaa

SEQ ID NO: 242677 - DNA, 20 bp, Artificial
  CRISPR gRNA sequence
tgtctcaggaaaaaaaagaa

SEQ ID NO: 242678 - DNA, 20 bp, Artificial
  CRISPR gRNA sequence
tctcaggaaaaaaaagaaaa

SEQ ID NO: 242679 - DNA, 20 bp, Artificial
  CRISPR gRNA sequence
aaaaaagaaaagagatgtct

SEQ ID NO: 242680 - DNA, 20 bp, Artificial
  CRISPR gRNA sequence
agagatgtcttggttattct

SEQ ID NO: 242681 - DNA, 20 bp, Artificial
  CRISPR gRNA sequence
ttattattcaatataaattt

SEQ ID NO: 242682 - DNA, 20 bp, Artificial
  CRISPR gRNA sequence
ttattcaatataaattttag

SEQ ID NO: 242683 - DNA, 20 bp, Artificial
  CRISPR gRNA sequence
ttttagaagctgaatttgaa

SEQ ID NO: 242684 - DNA, 20 bp, Artificial
  CRISPR gRNA sequence
aagctgaatttgaaaagatt

SEQ ID NO: 242685 - DNA, 20 bp, Artificial
  CRISPR gRNA sequence
gaatttgaaaagatttggat

SEQ ID NO: 242686 - DNA, 20 bp, Artificial
  CRISPR gRNA sequence
ttggaatttcattaaatcta

SEQ ID NO: 242687 - DNA, 20 bp, Artificial
  CRISPR gRNA sequence
tggaatttcattaaatctac

SEQ ID NO: 242688 - DNA, 20 bp, Artificial
  CRISPR gRNA sequence
attaaatctacaggtcaatt

SEQ ID NO: 242689 - DNA, 20 bp, Artificial
  CRISPR gRNA sequence
ttaaatctacaggtcaattt

SEQ ID NO: 242690 - DNA, 20 bp, Artificial
  CRISPR gRNA sequence
taaatctacaggtcaattta

SEQ ID NO: 242691 - DNA, 20 bp, Artificial
  CRISPR gRNA sequence
aatctacaggtcaatttagg

SEQ ID NO: 242692 - DNA, 20 bp, Artificial
  CRISPR gRNA sequence
tctacaggtcaatttaggga

SEQ ID NO: 242693 - DNA, 20 bp, Artificial
  CRISPR gRNA sequence
agggagagttgataatttta

SEQ ID NO: 242694 - DNA, 20 bp, Artificial
  CRISPR gRNA sequence
gttgataattttacagaatt

SEQ ID NO: 242695 - DNA, 20 bp, Artificial
  CRISPR gRNA sequence
ttttacagaattgagtcatc

SEQ ID NO: 242696 - DNA, 20 bp, Artificial
  CRISPR gRNA sequence
gagtcatctggtgttccaat

SEQ ID NO: 242697 - DNA, 20 bp, Artificial
  CRISPR gRNA sequence
tctggtgttccaataagaat

SEQ ID NO: 242698 - DNA, 20 bp, Artificial
  CRISPR gRNA sequence
tggtgttccaataagaataa

SEQ ID NO: 242699 - DNA, 20 bp, Artificial
  CRISPR gRNA sequence
aagaataagagaacaattat

SEQ ID NO: 242700 - DNA, 20 bp, Artificial
  CRISPR gRNA sequence
gctgtacaattcttgccaaa

SEQ ID NO: 242701 - DNA, 20 bp, Artificial
  CRISPR gRNA sequence
gtacaattcttgccaaatag

SEQ ID NO: 242702 - DNA, 20 bp, Artificial
  CRISPR gRNA sequence
tacaattcttgccaaatagt

SEQ ID NO: 242703 - DNA, 20 bp, Artificial
  CRISPR gRNA sequence
ttcttgccaaatagtaggca

SEQ ID NO: 242704 - DNA, 20 bp, Artificial
  CRISPR gRNA sequence
gccaaatagtaggcaaagca

SEQ ID NO: 242705 - DNA, 20 bp, Artificial
  CRISPR gRNA sequence
atagtaggcaaagcaaagct

SEQ ID NO: 242706 - DNA, 20 bp, Artificial
  CRISPR gRNA sequence
tagtaggcaaagcaaagctt

SEQ ID NO: 242707 - DNA, 20 bp, Artificial
  CRISPR gRNA sequence
taggcaaagcaaagcttagg

SEQ ID NO: 242708 - DNA, 20 bp, Artificial
  CRISPR gRNA sequence
gcaaagcttaggaagtatac

SEQ ID NO: 242709 - DNA, 20 bp, Artificial
  CRISPR gRNA sequence
gaagtatactggtgccattt

SEQ ID NO: 242710 - DNA, 20 bp, Artificial
  CRISPR gRNA sequence
aagtatactggtgccatttc

SEQ ID NO: 242711 - DNA, 20 bp, Artificial
  CRISPR gRNA sequence
ctggtgccatttcaggaaca

SEQ ID NO: 242712 - DNA, 20 bp, Artificial
  CRISPR gRNA sequence
tgccatttcaggaacaaagc

SEQ ID NO: 242713 - DNA, 20 bp, Artificial
  CRISPR gRNA sequence
gccatttcaggaacaaagct

SEQ ID NO: 242714 - DNA, 20 bp, Artificial
  CRISPR gRNA sequence
tttctgaatcatgatgctgt

SEQ ID NO: 242715 - DNA, 20 bp, Artificial
  CRISPR gRNA sequence
tcatgatgctgtaagttcta

SEQ ID NO: 242716 - DNA, 20 bp, Artificial
  CRISPR gRNA sequence
tctaaagtgatttctcctct

SEQ ID NO: 242717 - DNA, 20 bp, Artificial
  CRISPR gRNA sequence
gtgatttctcctcttggctt

SEQ ID NO: 242718 - DNA, 20 bp, Artificial
  CRISPR gRNA sequence
tcctcttggctttggacaca

SEQ ID NO: 242719 - DNA, 20 bp, Artificial
  CRISPR gRNA sequence
tactgctgactatccacaaa

SEQ ID NO: 242720 - DNA, 20 bp, Artificial
  CRISPR gRNA sequence
gctgactatccacaaacaga

SEQ ID NO: 242721 - DNA, 20 bp, Artificial
  CRISPR gRNA sequence
tgactatccacaaacagaaa

SEQ ID NO: 242722 - DNA, 20 bp, Artificial
  CRISPR gRNA sequence
atccacaaacagaaagagac

SEQ ID NO: 242723 - DNA, 20 bp, Artificial
  CRISPR gRNA sequence
aagagactggtcatgcccca

SEQ ID NO: 242724 - DNA, 20 bp, Artificial
  CRISPR gRNA sequence
agagactggtcatgccccac

SEQ ID NO: 242725 - DNA, 20 bp, Artificial
  CRISPR gRNA sequence
gagactggtcatgccccaca

SEQ ID NO: 242726 - DNA, 20 bp, Artificial
  CRISPR gRNA sequence
ctggtcatgccccacagggt

SEQ ID NO: 242727 - DNA, 20 bp, Artificial
  CRISPR gRNA sequence
tggtcatgccccacagggtt

SEQ ID NO: 242728 - DNA, 20 bp, Artificial
  CRISPR gRNA sequence
ggtcatgccccacagggttg

SEQ ID NO: 242729 - DNA, 20 bp, Artificial
  CRISPR gRNA sequence
cccacagggttggggtatcc

SEQ ID NO: 242730 - DNA, 20 bp, Artificial
  CRISPR gRNA sequence
ggttggggtatccaagataa

SEQ ID NO: 242731 - DNA, 20 bp, Artificial
  CRISPR gRNA sequence
ttggggtatccaagataatg

SEQ ID NO: 242732 - DNA, 20 bp, Artificial
  CRISPR gRNA sequence
ggtatccaagataatggagc

SEQ ID NO: 242733 - DNA, 20 bp, Artificial
  CRISPR gRNA sequence
gtatccaagataatggagcg

SEQ ID NO: 242734 - DNA, 20 bp, Artificial
  CRISPR gRNA sequence
agcgaggctctcatgtgtcc

SEQ ID NO: 242735 - DNA, 20 bp, Artificial
  CRISPR gRNA sequence
gcgaggctctcatgtgtcct

SEQ ID NO: 242736 - DNA, 20 bp, Artificial
  CRISPR gRNA sequence
ggttacacaccgaaaatcca

SEQ ID NO: 242737 - DNA, 20 bp, Artificial
  CRISPR gRNA sequence
aatccacagtttattctgtg

SEQ ID NO: 242738 - DNA, 20 bp, Artificial
  CRISPR gRNA sequence
cacagtttattctgtgaaga

SEQ ID NO: 242739 - DNA, 20 bp, Artificial
  CRISPR gRNA sequence
acagtttattctgtgaagaa

SEQ ID NO: 242740 - DNA, 20 bp, Artificial
  CRISPR gRNA sequence
agtttattctgtgaagaaag

SEQ ID NO: 242741 - DNA, 20 bp, Artificial
  CRISPR gRNA sequence
gtttattctgtgaagaaagg

SEQ ID NO: 242742 - DNA, 20 bp, Artificial
  CRISPR gRNA sequence
aggaggctatgtttatgata

SEQ ID NO: 242743 - DNA, 20 bp, Artificial
  CRISPR gRNA sequence
agactgtgatatttttatca

SEQ ID NO: 242744 - DNA, 20 bp, Artificial
  CRISPR gRNA sequence
atttttatcatagcctattc

SEQ ID NO: 242745 - DNA, 20 bp, Artificial
  CRISPR gRNA sequence
tattctggtatcatgtgcaa

SEQ ID NO: 242746 - DNA, 20 bp, Artificial
  CRISPR gRNA sequence
aaagctataaatgaaaaaca

SEQ ID NO: 242747 - DNA, 20 bp, Artificial
  CRISPR gRNA sequence
aagctataaatgaaaaacac

SEQ ID NO: 242748 - DNA, 20 bp, Artificial
  CRISPR gRNA sequence
aaatgaaaaacacaggaact

SEQ ID NO: 242749 - DNA, 20 bp, Artificial
  CRISPR gRNA sequence
aacacaggaacttggcatgt

SEQ ID NO: 242750 - DNA, 20 bp, Artificial
  CRISPR gRNA sequence
ccccctaaatgacaattaat

SEQ ID NO: 242751 - DNA, 20 bp, Artificial
  CRISPR gRNA sequence
cccctaaatgacaattaata

SEQ ID NO: 242752 - DNA, 20 bp, Artificial
  CRISPR gRNA sequence
ctaaatgacaattaataagg

SEQ ID NO: 242753 - DNA, 20 bp, Artificial
  CRISPR gRNA sequence
taaatgacaattaataagga

SEQ ID NO: 242754 - DNA, 20 bp, Artificial
  CRISPR gRNA sequence
attaataaggaaggaacatt

SEQ ID NO: 242755 - DNA, 20 bp, Artificial
  CRISPR gRNA sequence
ataaggaaggaacattgaga

SEQ ID NO: 242756 - DNA, 20 bp, Artificial
  CRISPR gRNA sequence
agaataaaatgatccccttc

SEQ ID NO: 242757 - DNA, 20 bp, Artificial
  CRISPR gRNA sequence
gaataaaatgatccccttct

SEQ ID NO: 242758 - DNA, 20 bp, Artificial
  CRISPR gRNA sequence
atccccttctgggtttaatt

SEQ ID NO: 242759 - DNA, 20 bp, Artificial
  CRISPR gRNA sequence
ccttctgggtttaatttaga

SEQ ID NO: 242760 - DNA, 20 bp, Artificial
  CRISPR gRNA sequence
aatttagaaagttccataat

SEQ ID NO: 242761 - DNA, 20 bp, Artificial
  CRISPR gRNA sequence
atttagaaagttccataatt

SEQ ID NO: 242762 - DNA, 20 bp, Artificial
  CRISPR gRNA sequence
agttccataattaggtttaa

SEQ ID NO: 242763 - DNA, 20 bp, Artificial
  CRISPR gRNA sequence
ttctatgattaaaaataaat

SEQ ID NO: 242764 - DNA, 20 bp, Artificial
  CRISPR gRNA sequence
taaaaataaattagcacatt

SEQ ID NO: 242765 - DNA, 20 bp, Artificial
  CRISPR gRNA sequence
aaaaataaattagcacattt

SEQ ID NO: 242766 - DNA, 20 bp, Artificial
  CRISPR gRNA sequence
aaaataaattagcacattta

SEQ ID NO: 242767 - DNA, 20 bp, Artificial
  CRISPR gRNA sequence
attttctaaatgctaaaaac

SEQ ID NO: 242768 - DNA, 20 bp, Artificial
  CRISPR gRNA sequence
ctaaatgctaaaaacaagct

SEQ ID NO: 242769 - DNA, 20 bp, Artificial
  CRISPR gRNA sequence
taaatgctaaaaacaagctc

SEQ ID NO: 242770 - DNA, 20 bp, Artificial
  CRISPR gRNA sequence
aaacaagctcaggttttttt

SEQ ID NO: 242771 - DNA, 20 bp, Artificial
  CRISPR gRNA sequence
caagctcaggtttttttcag

SEQ ID NO: 242772 - DNA, 20 bp, Artificial
  CRISPR gRNA sequence
ctcaggtttttttcagaaga

SEQ ID NO: 242773 - DNA, 20 bp, Artificial
  CRISPR gRNA sequence
aagttttaattttttttctt

SEQ ID NO: 242774 - DNA, 20 bp, Artificial
  CRISPR gRNA sequence
ttttaattttttttctttag

SEQ ID NO: 242775 - DNA, 20 bp, Artificial
  CRISPR gRNA sequence
taattttttttctttagtgg

SEQ ID NO: 242776 - DNA, 20 bp, Artificial
  CRISPR gRNA sequence
agtggaagatatcactctga

SEQ ID NO: 242777 - DNA, 20 bp, Artificial
  CRISPR gRNA sequence
gaagatatcactctgacgga

SEQ ID NO: 242778 - DNA, 20 bp, Artificial
  CRISPR gRNA sequence
ctgacggaaagttttgatgt

SEQ ID NO: 242779 - DNA, 20 bp, Artificial
  CRISPR gRNA sequence
tgacggaaagttttgatgtg

SEQ ID NO: 242780 - DNA, 20 bp, Artificial
  CRISPR gRNA sequence
gacggaaagttttgatgtga

SEQ ID NO: 242781 - DNA, 20 bp, Artificial
  CRISPR gRNA sequence
acggaaagttttgatgtgag

SEQ ID NO: 242782 - DNA, 20 bp, Artificial
  CRISPR gRNA sequence
gaaagttttgatgtgagggg

SEQ ID NO: 242783 - DNA, 20 bp, Artificial
  CRISPR gRNA sequence
gtgaggggcggatgactata

SEQ ID NO: 242784 - DNA, 20 bp, Artificial
  CRISPR gRNA sequence
aggggcggatgactataaag

SEQ ID NO: 242785 - DNA, 20 bp, Artificial
  CRISPR gRNA sequence
ggggcggatgactataaagt

SEQ ID NO: 242786 - DNA, 20 bp, Artificial
  CRISPR gRNA sequence
aaagtgggcatcttccccca

SEQ ID NO: 242787 - DNA, 20 bp, Artificial
  CRISPR gRNA sequence
aagtgggcatcttcccccac

SEQ ID NO: 242788 - DNA, 20 bp, Artificial
  CRISPR gRNA sequence
tgggcatcttcccccacagg

SEQ ID NO: 242789 - DNA, 20 bp, Artificial
  CRISPR gRNA sequence
caggaagatgtttccatctg

SEQ ID NO: 242790 - DNA, 20 bp, Artificial
  CRISPR gRNA sequence
aggaagatgtttccatctgt

SEQ ID NO: 242791 - DNA, 20 bp, Artificial
  CRISPR gRNA sequence
agatgtttccatctgtgggt

SEQ ID NO: 242792 - DNA, 20 bp, Artificial
  CRISPR gRNA sequence
atgtttccatctgtgggtga

SEQ ID NO: 242793 - DNA, 20 bp, Artificial
  CRISPR gRNA sequence
tgtttccatctgtgggtgag

SEQ ID NO: 242794 - DNA, 20 bp, Artificial
  CRISPR gRNA sequence
tgggtgagaggtgcccaccg

SEQ ID NO: 242795 - DNA, 20 bp, Artificial
  CRISPR gRNA sequence
tgagaggtgcccaccgcagc

SEQ ID NO: 242796 - DNA, 20 bp, Artificial
  CRISPR gRNA sequence
gagaggtgcccaccgcagct

SEQ ID NO: 242797 - DNA, 20 bp, Artificial
  CRISPR gRNA sequence
agaggtgcccaccgcagcta

SEQ ID NO: 242798 - DNA, 20 bp, Artificial
  CRISPR gRNA sequence
ggtgcccaccgcagctaggg

SEQ ID NO: 242799 - DNA, 20 bp, Artificial
  CRISPR gRNA sequence
gtgcccaccgcagctagggc

SEQ ID NO: 242800 - DNA, 20 bp, Artificial
  CRISPR gRNA sequence
ggttacatgtgccctgtgtg

SEQ ID NO: 242801 - DNA, 20 bp, Artificial
  CRISPR gRNA sequence
tacatgtgccctgtgtgtgg

SEQ ID NO: 242802 - DNA, 20 bp, Artificial
  CRISPR gRNA sequence
acatgtgccctgtgtgtggt

SEQ ID NO: 242803 - DNA, 20 bp, Artificial
  CRISPR gRNA sequence
gccctgtgtgtggtaggact

SEQ ID NO: 242804 - DNA, 20 bp, Artificial
  CRISPR gRNA sequence
cctgtgtgtggtaggacttg

SEQ ID NO: 242805 - DNA, 20 bp, Artificial
  CRISPR gRNA sequence
tgtgtgtggtaggacttgga

SEQ ID NO: 242806 - DNA, 20 bp, Artificial
  CRISPR gRNA sequence
ttatcaacgtttttatttaa

SEQ ID NO: 242807 - DNA, 20 bp, Artificial
  CRISPR gRNA sequence
acacaaaactatgatgttca

SEQ ID NO: 242808 - DNA, 20 bp, Artificial
  CRISPR gRNA sequence
cacaaaactatgatgttcac

SEQ ID NO: 242809 - DNA, 20 bp, Artificial
  CRISPR gRNA sequence
tatgatgttcacaggaaaaa

SEQ ID NO: 242810 - DNA, 20 bp, Artificial
  CRISPR gRNA sequence
gttcacaggaaaaaaagaat

SEQ ID NO: 242811 - DNA, 20 bp, Artificial
  CRISPR gRNA sequence
gaaaaaaagaataagaaaaa

SEQ ID NO: 242812 - DNA, 20 bp, Artificial
  CRISPR gRNA sequence
aaaaaagaccttattttaaa

SEQ ID NO: 242813 - DNA, 20 bp, Artificial
  CRISPR gRNA sequence
tgttgcaacatcatatcata

SEQ ID NO: 242814 - DNA, 20 bp, Artificial
  CRISPR gRNA sequence
gttgcaacatcatatcataa

SEQ ID NO: 242815 - DNA, 20 bp, Artificial
  CRISPR gRNA sequence
ttgcaacatcatatcataaa

SEQ ID NO: 242816 - DNA, 20 bp, Artificial
  CRISPR gRNA sequence
ataaagggtaatcatgaaat

SEQ ID NO: 242817 - DNA, 20 bp, Artificial
  CRISPR gRNA sequence
taaagggtaatcatgaaata

SEQ ID NO: 242818 - DNA, 20 bp, Artificial
  CRISPR gRNA sequence
gtgccattctttgtaaactt

SEQ ID NO: 242819 - DNA, 20 bp, Artificial
  CRISPR gRNA sequence
tctttgtaaactttggcttt

SEQ ID NO: 242820 - DNA, 20 bp, Artificial
  CRISPR gRNA sequence
actaaaagccaaagtttaca

SEQ ID NO: 242821 - DNA, 20 bp, Artificial
  CRISPR gRNA sequence
ctcacatcaaaactttccgt

SEQ ID NO: 242822 - DNA, 20 bp, Artificial
  CRISPR gRNA sequence
tttctaaattaaacccagaa

SEQ ID NO: 242823 - DNA, 20 bp, Artificial
  CRISPR gRNA sequence
atagcttttgcacatgatac

SEQ ID NO: 242824 - DNA, 20 bp, Artificial
  CRISPR gRNA sequence
aacatagcctcctttcttca

SEQ ID NO: 242825 - DNA, 20 bp, Artificial
  CRISPR gRNA sequence
ctttcttcacagaataaact

SEQ ID NO: 242826 - DNA, 20 bp, Artificial
  CRISPR gRNA sequence
gagagcctcgctccattatc

SEQ ID NO: 242827 - DNA, 20 bp, Artificial
  CRISPR gRNA sequence
tgaccagtctctttctgttt

SEQ ID NO: 242828 - DNA, 20 bp, Artificial
  CRISPR gRNA sequence
tgctttgcctactatttggc

SEQ ID NO: 242829 - DNA, 20 bp, Artificial
  CRISPR gRNA sequence
ttcagcttctaaaatttata

SEQ ID NO: 242830 - DNA, 20 bp, Artificial
  CRISPR gRNA sequence
atattgaataataaagaacc

SEQ ID NO: 242831 - DNA, 20 bp, Artificial
  CRISPR gRNA sequence
ttttcttttttttcctgaga

SEQ ID NO: 242832 - DNA, 20 bp, Artificial
  CRISPR gRNA sequence
tttcgctctgtcacccaggc

SEQ ID NO: 242833 - DNA, 20 bp, Artificial
  CRISPR gRNA sequence
ctcactgcaacctccgcccc

SEQ ID NO: 242834 - DNA, 20 bp, Artificial
  CRISPR gRNA sequence
gcctcagcctcccaaatagc

SEQ ID NO: 242835 - DNA, 20 bp, Artificial
  CRISPR gRNA sequence
tttgtattttttagtagaga

SEQ ID NO: 242836 - DNA, 20 bp, Artificial
  CRISPR gRNA sequence
gcgtcggcctcccaaagtgc

SEQ ID NO: 242837 - DNA, 20 bp, Artificial
  CRISPR gRNA sequence
aggtggagggagatgtccta

SEQ ID NO: 242838 - DNA, 20 bp, Artificial
  CRISPR gRNA sequence
aacacagtgtgatactggca

SEQ ID NO: 242839 - DNA, 20 bp, Artificial
  CRISPR gRNA sequence
catggccctatggaaacttg

SEQ ID NO: 242840 - DNA, 20 bp, Artificial
  CRISPR gRNA sequence
cgcaggagaaagacgacgta

SEQ ID NO: 242841 - DNA, 20 bp, Artificial
  CRISPR gRNA sequence
ggttacctacatgcaagaca

SEQ ID NO: 242842 - DNA, 20 bp, Artificial
  CRISPR gRNA sequence
cctacatgcaagacatggaa

SEQ ID NO: 242843 - DNA, 20 bp, Artificial
  CRISPR gRNA sequence
aagacaaaacttaaaacttt

SEQ ID NO: 242844 - DNA, 20 bp, Artificial
  CRISPR gRNA sequence
ctttatagtattgggcagaa

SEQ ID NO: 242845 - DNA, 20 bp, Artificial
  CRISPR gRNA sequence
actttggaaggctgaggtgg

SEQ ID NO: 242846 - DNA, 20 bp, Artificial
  CRISPR gRNA sequence
tgggaggatcacttgagctc

SEQ ID NO: 242847 - DNA, 20 bp, Artificial
  CRISPR gRNA sequence
tgctaaaaataaaaataaaa

SEQ ID NO: 242848 - DNA, 20 bp, Artificial
  CRISPR gRNA sequence
aaagggaaaaataaattaca

SEQ ID NO: 242849 - DNA, 20 bp, Artificial
  CRISPR gRNA sequence
tagatagatagatagatagg

SEQ ID NO: 242850 - DNA, 20 bp, Artificial
  CRISPR gRNA sequence
ttcactcttgtcacccagtc

SEQ ID NO: 242851 - DNA, 20 bp, Artificial
  CRISPR gRNA sequence
ctcgctgcaacctctgcctc

SEQ ID NO: 242852 - DNA, 20 bp, Artificial
  CRISPR gRNA sequence
gccacagcctctggagcagc

SEQ ID NO: 242853 - DNA, 20 bp, Artificial
  CRISPR gRNA sequence
ttgtacatgtttagtagaga

SEQ ID NO: 242854 - DNA, 20 bp, Artificial
  CRISPR gRNA sequence
acctcagccccgcaaagtgc

SEQ ID NO: 242855 - DNA, 20 bp, Artificial
  CRISPR gRNA sequence
actgaccaaagattattatc

SEQ ID NO: 242856 - DNA, 20 bp, Artificial
  CRISPR gRNA sequence
agaatacataaagacctttt

SEQ ID NO: 242857 - DNA, 20 bp, Artificial
  CRISPR gRNA sequence
atcaggacaaacaaccacat

SEQ ID NO: 242858 - DNA, 20 bp, Artificial
  CRISPR gRNA sequence
ccaggctcaaagcgaaccta

SEQ ID NO: 242859 - DNA, 20 bp, Artificial
  CRISPR gRNA sequence
ttttgtattttttgtaaaga

SEQ ID NO: 242860 - DNA, 20 bp, Artificial
  CRISPR gRNA sequence
aagggcacctgatagtacca

SEQ ID NO: 242861 - DNA, 20 bp, Artificial
  CRISPR gRNA sequence
tgatagtaccagagggtagc

SEQ ID NO: 242862 - DNA, 20 bp, Artificial
  CRISPR gRNA sequence
taccagagggtagcaaggat

SEQ ID NO: 242863 - DNA, 20 bp, Artificial
  CRISPR gRNA sequence
gtagcaaggatgtggatcaa

SEQ ID NO: 242864 - DNA, 20 bp, Artificial
  CRISPR gRNA sequence
atgacacttatatgactgac

SEQ ID NO: 242865 - DNA, 20 bp, Artificial
  CRISPR gRNA sequence
cttctcctcacccctattta

SEQ ID NO: 242866 - DNA, 20 bp, Artificial
  CRISPR gRNA sequence
attgatgcctggcttggctg

SEQ ID NO: 242867 - DNA, 20 bp, Artificial
  CRISPR gRNA sequence
tgctccctccacctaaatcc

SEQ ID NO: 242868 - DNA, 20 bp, Artificial
  CRISPR gRNA sequence
tgggcagatcacctgaggtc

SEQ ID NO: 242869 - DNA, 20 bp, Artificial
  CRISPR gRNA sequence
ctgtactccagcctgggaga

SEQ ID NO: 242870 - DNA, 20 bp, Artificial
  CRISPR gRNA sequence
ctgtctcaaaaaaaaataaa

SEQ ID NO: 242871 - DNA, 20 bp, Artificial
  CRISPR gRNA sequence
cagctacttgggagactgag

SEQ ID NO: 242872 - DNA, 20 bp, Artificial
  CRISPR gRNA sequence
tacttgggagactgaggcgg

SEQ ID NO: 242873 - DNA, 20 bp, Artificial
  CRISPR gRNA sequence
cgggtggatcacttgagccc

SEQ ID NO: 242874 - DNA, 20 bp, Artificial
  CRISPR gRNA sequence
agtgtgctatgattgtgcct

SEQ ID NO: 242875 - DNA, 20 bp, Artificial
  CRISPR gRNA sequence
ggtgcaccaggtttggccat

SEQ ID NO: 242876 - DNA, 20 bp, Artificial
  CRISPR gRNA sequence
aaaatattatgttaaaagtt

SEQ ID NO: 242877 - DNA, 20 bp, Artificial
  CRISPR gRNA sequence
tgttaaaagttaagaatttt

SEQ ID NO: 242878 - DNA, 20 bp, Artificial
  CRISPR gRNA sequence
aggacaaaggcagaaggtgt

SEQ ID NO: 242879 - DNA, 20 bp, Artificial
  CRISPR gRNA sequence
tgtgaggatggagaagacca

SEQ ID NO: 242880 - DNA, 20 bp, Artificial
  CRISPR gRNA sequence
agaacccacggaaactttag

SEQ ID NO: 242881 - DNA, 20 bp, Artificial
  CRISPR gRNA sequence
tggaccactggactatgtaa

SEQ ID NO: 242882 - DNA, 20 bp, Artificial
  CRISPR gRNA sequence
aatttaaactataattttct

SEQ ID NO: 242883 - DNA, 20 bp, Artificial
  CRISPR gRNA sequence
tgggaggccaaagtgaacct

SEQ ID NO: 242884 - DNA, 20 bp, Artificial
  CRISPR gRNA sequence
tactcaggagactgaggcag

SEQ ID NO: 242885 - DNA, 20 bp, Artificial
  CRISPR gRNA sequence
tggtgccactgcactccagc

SEQ ID NO: 242886 - DNA, 20 bp, Artificial
  CRISPR gRNA sequence
ctgcactccagcctgggtga

SEQ ID NO: 242887 - DNA, 20 bp, Artificial
  CRISPR gRNA sequence
tagaaaagaacgtgtgttgg

SEQ ID NO: 242888 - DNA, 20 bp, Artificial
  CRISPR gRNA sequence
gaacgtgtgttgggggaatc

SEQ ID NO: 242889 - DNA, 20 bp, Artificial
  CRISPR gRNA sequence
ggggaatcctgggtattatg

SEQ ID NO: 242890 - DNA, 20 bp, Artificial
  CRISPR gRNA sequence
tgcttttgaaagctgtgata

SEQ ID NO: 242891 - DNA, 20 bp, Artificial
  CRISPR gRNA sequence
cagctacagccatcttcctc

SEQ ID NO: 242892 - DNA, 20 bp, Artificial
  CRISPR gRNA sequence
acgtatattttgttgtctat

SEQ ID NO: 242893 - DNA, 20 bp, Artificial
  CRISPR gRNA sequence
tgggcagatcacttgaggtc

SEQ ID NO: 242894 - DNA, 20 bp, Artificial
  CRISPR gRNA sequence
tggcgccattgcactccagc

SEQ ID NO: 242895 - DNA, 20 bp, Artificial
  CRISPR gRNA sequence
actttgggaggctgaggccg

SEQ ID NO: 242896 - DNA, 20 bp, Artificial
  CRISPR gRNA sequence
ggccggtggatcacaaggtc

SEQ ID NO: 242897 - DNA, 20 bp, Artificial
  CRISPR gRNA sequence
ctactcgggaggctgaggca

SEQ ID NO: 242898 - DNA, 20 bp, Artificial
  CRISPR gRNA sequence
ttgcgccactgcactccagc

SEQ ID NO: 242899 - DNA, 20 bp, Artificial
  CRISPR gRNA sequence
ctgcactccagcctgggtga

SEQ ID NO: 242900 - DNA, 20 bp, Artificial
  CRISPR gRNA sequence
tccacaagagaggtaacagc

SEQ ID NO: 242901 - DNA, 20 bp, Artificial
  CRISPR gRNA sequence
tctacattagctaaaaaagc

SEQ ID NO: 242902 - DNA, 20 bp, Artificial
  CRISPR gRNA sequence
aaaaagcatgaatcttaagc

SEQ ID NO: 242903 - DNA, 20 bp, Artificial
  CRISPR gRNA sequence
gcagcacttattttcgtctt

SEQ ID NO: 242904 - DNA, 20 bp, Artificial
  CRISPR gRNA sequence
tcgagatccgatggtttcct

SEQ ID NO: 242905 - DNA, 20 bp, Artificial
  CRISPR gRNA sequence
ggaatgcagtgttatgactc

SEQ ID NO: 242906 - DNA, 20 bp, Artificial
  CRISPR gRNA sequence
aagatgttcagaaataccaa

SEQ ID NO: 242907 - DNA, 20 bp, Artificial
  CRISPR gRNA sequence
cttttgaaattgttcccagg

SEQ ID NO: 242908 - DNA, 20 bp, Artificial
  CRISPR gRNA sequence
tgttttccgtatttgtcctg

SEQ ID NO: 242909 - DNA, 20 bp, Artificial
  CRISPR gRNA sequence
ggcagagagaggaaggccaa

SEQ ID NO: 242910 - DNA, 20 bp, Artificial
  CRISPR gRNA sequence
gagaggaaggccaattgggt

SEQ ID NO: 242911 - DNA, 20 bp, Artificial
  CRISPR gRNA sequence
acccaagaaacaacatggca

SEQ ID NO: 242912 - DNA, 20 bp, Artificial
  CRISPR gRNA sequence
gcaagcagatcatctgaggt

SEQ ID NO: 242913 - DNA, 20 bp, Artificial
  CRISPR gRNA sequence
acctgtaatcttagctattc

SEQ ID NO: 242914 - DNA, 20 bp, Artificial
  CRISPR gRNA sequence
tttcttttttttttttgaga

SEQ ID NO: 242915 - DNA, 20 bp, Artificial
  CRISPR gRNA sequence
tctcactctgttgcccaggc

SEQ ID NO: 242916 - DNA, 20 bp, Artificial
  CRISPR gRNA sequence
ctcactgcaacctccgcctc

SEQ ID NO: 242917 - DNA, 20 bp, Artificial
  CRISPR gRNA sequence
ggttctcttgcctcagtctc

SEQ ID NO: 242918 - DNA, 20 bp, Artificial
  CRISPR gRNA sequence
ttttgtgtttttagtagaga

SEQ ID NO: 242919 - DNA, 20 bp, Artificial
  CRISPR gRNA sequence
atctgggcctcccaaagtgc

SEQ ID NO: 242920 - DNA, 20 bp, Artificial
  CRISPR gRNA sequence
tgcaagcccaccaggaagga

SEQ ID NO: 242921 - DNA, 20 bp, Artificial
  CRISPR gRNA sequence
gctcatctccccctccctcc

SEQ ID NO: 242922 - DNA, 20 bp, Artificial
  CRISPR gRNA sequence
gcccatcctccttccttccc

SEQ ID NO: 242923 - DNA, 20 bp, Artificial
  CRISPR gRNA sequence
atctaaattagatccagaaa

SEQ ID NO: 242924 - DNA, 20 bp, Artificial
  CRISPR gRNA sequence
tactatgggggccaaggcag

SEQ ID NO: 242925 - DNA, 20 bp, Artificial
  CRISPR gRNA sequence
ggccaaggcaggaggatcgc

SEQ ID NO: 242926 - DNA, 20 bp, Artificial
  CRISPR gRNA sequence
caggaggatcgcttgagtcc

SEQ ID NO: 242927 - DNA, 20 bp, Artificial
  CRISPR gRNA sequence
tccaggagttctagaccagc

SEQ ID NO: 242928 - DNA, 20 bp, Artificial
  CRISPR gRNA sequence
aaaacatttaaaaattagcc

SEQ ID NO: 242929 - DNA, 20 bp, Artificial
  CRISPR gRNA sequence
tactctggaggctgaggtgg

SEQ ID NO: 242930 - DNA, 20 bp, Artificial
  CRISPR gRNA sequence
tcatgccactgcactcccgc

SEQ ID NO: 242931 - DNA, 20 bp, Artificial
  CRISPR gRNA sequence
gacatactatgttcctgcat

SEQ ID NO: 242932 - DNA, 20 bp, Artificial
  CRISPR gRNA sequence
atatatataaccagttaagg

SEQ ID NO: 242933 - DNA, 20 bp, Artificial
  CRISPR gRNA sequence
actttgggaggccaaggcag

SEQ ID NO: 242934 - DNA, 20 bp, Artificial
  CRISPR gRNA sequence
caggtggattgcctgagctc

SEQ ID NO: 242935 - DNA, 20 bp, Artificial
  CRISPR gRNA sequence
tactcgggaggctgagacag

SEQ ID NO: 242936 - DNA, 20 bp, Artificial
  CRISPR gRNA sequence
gtggcagacaccaactctgt

SEQ ID NO: 242937 - DNA, 20 bp, Artificial
  CRISPR gRNA sequence
tttaaatagataaaagctta

SEQ ID NO: 242938 - DNA, 20 bp, Artificial
  CRISPR gRNA sequence
atgtgcttgtgttttaagct

SEQ ID NO: 242939 - DNA, 20 bp, Artificial
  CRISPR gRNA sequence
taagctaagagttattacaa

SEQ ID NO: 242940 - DNA, 20 bp, Artificial
  CRISPR gRNA sequence
attttttttaagtttatagg

SEQ ID NO: 242941 - DNA, 20 bp, Artificial
  CRISPR gRNA sequence
tgggcagattaccggagctc

SEQ ID NO: 242942 - DNA, 20 bp, Artificial
  CRISPR gRNA sequence
tacttggggggctgaggcag

SEQ ID NO: 242943 - DNA, 20 bp, Artificial
  CRISPR gRNA sequence
gaagacaatttttccacgga

SEQ ID NO: 242944 - DNA, 20 bp, Artificial
  CRISPR gRNA sequence
acaatttttccacggactgg

SEQ ID NO: 242945 - DNA, 20 bp, Artificial
  CRISPR gRNA sequence
tccacggactgggtgggtgg

SEQ ID NO: 242946 - DNA, 20 bp, Artificial
  CRISPR gRNA sequence
ggtgggtggggggatggttt

SEQ ID NO: 242947 - DNA, 20 bp, Artificial
  CRISPR gRNA sequence
ttatacaactccctgtaatg

SEQ ID NO: 242948 - DNA, 20 bp, Artificial
  CRISPR gRNA sequence
acaactagacagtcccatct

SEQ ID NO: 242949 - DNA, 20 bp, Artificial
  CRISPR gRNA sequence
cagtgacagatcatcaggta

SEQ ID NO: 242950 - DNA, 20 bp, Artificial
  CRISPR gRNA sequence
ctcgtatgcgcagttcacaa

SEQ ID NO: 242951 - DNA, 20 bp, Artificial
  CRISPR gRNA sequence
aataggattcatgctcctat

SEQ ID NO: 242952 - DNA, 20 bp, Artificial
  CRISPR gRNA sequence
tgcccaccactctcctcctg

SEQ ID NO: 242953 - DNA, 20 bp, Artificial
  CRISPR gRNA sequence
tctcactctgttgcccagcc

SEQ ID NO: 242954 - DNA, 20 bp, Artificial
  CRISPR gRNA sequence
acctctgcctgtcaggttca

SEQ ID NO: 242955 - DNA, 20 bp, Artificial
  CRISPR gRNA sequence
acctcagcctcccaagtggc

SEQ ID NO: 242956 - DNA, 20 bp, Artificial
  CRISPR gRNA sequence
ttttgtatttttagtagaaa

SEQ ID NO: 242957 - DNA, 20 bp, Artificial
  CRISPR gRNA sequence
accttggtctcccaaagtgt

SEQ ID NO: 242958 - DNA, 20 bp, Artificial
  CRISPR gRNA sequence
tgacaggtttgtagtatagg

SEQ ID NO: 242959 - DNA, 20 bp, Artificial
  CRISPR gRNA sequence
agatttaacacaattgttat

SEQ ID NO: 242960 - DNA, 20 bp, Artificial
  CRISPR gRNA sequence
atgtggaaatgcaaaggaac

SEQ ID NO: 242961 - DNA, 20 bp, Artificial
  CRISPR gRNA sequence
attggcagaagaagaaacac

SEQ ID NO: 242962 - DNA, 20 bp, Artificial
  CRISPR gRNA sequence
actttgacaaaggtacaatg

SEQ ID NO: 242963 - DNA, 20 bp, Artificial
  CRISPR gRNA sequence
ccttatacgaaaaatttaaa

SEQ ID NO: 242964 - DNA, 20 bp, Artificial
  CRISPR gRNA sequence
actttgggaggccaaggcag

SEQ ID NO: 242965 - DNA, 20 bp, Artificial
  CRISPR gRNA sequence
caggaggattgtttaaggcc

SEQ ID NO: 242966 - DNA, 20 bp, Artificial
  CRISPR gRNA sequence
caaacagcaaagtgttcatc

SEQ ID NO: 242967 - DNA, 20 bp, Artificial
  CRISPR gRNA sequence
aatctagcacctattgttca

SEQ ID NO: 242968 - DNA, 20 bp, Artificial
  CRISPR gRNA sequence
tacttgggaggccaaggagg

SEQ ID NO: 242969 - DNA, 20 bp, Artificial
  CRISPR gRNA sequence
tcacaccactgcactccagc

SEQ ID NO: 242970 - DNA, 20 bp, Artificial
  CRISPR gRNA sequence
ttgagacccaggactcagtg

SEQ ID NO: 242971 - DNA, 20 bp, Artificial
  CRISPR gRNA sequence
tctgtggaagagcctgagaa

SEQ ID NO: 242972 - DNA, 20 bp, Artificial
  CRISPR gRNA sequence
ctgggaaatacgaagaactc

SEQ ID NO: 242973 - DNA, 20 bp, Artificial
  CRISPR gRNA sequence
tggcaatgcaaaatgcaagc

SEQ ID NO: 242974 - DNA, 20 bp, Artificial
  CRISPR gRNA sequence
ggatgcagagaaactccgat

SEQ ID NO: 242975 - DNA, 20 bp, Artificial
  CRISPR gRNA sequence
agcaaacaaaatatctttta

SEQ ID NO: 242976 - DNA, 20 bp, Artificial
  CRISPR gRNA sequence
actgtggcacaagcatatcg

SEQ ID NO: 242977 - DNA, 20 bp, Artificial
  CRISPR gRNA sequence
aatactattcagcaaggaaa

SEQ ID NO: 242978 - DNA, 20 bp, Artificial
  CRISPR gRNA sequence
ccattgaaacacacagcaac

SEQ ID NO: 242979 - DNA, 20 bp, Artificial
  CRISPR gRNA sequence
tgaaacacacagcaacttgg

SEQ ID NO: 242980 - DNA, 20 bp, Artificial
  CRISPR gRNA sequence
tggatatcaagggcattgtg

SEQ ID NO: 242981 - DNA, 20 bp, Artificial
  CRISPR gRNA sequence
ttcacgtttgtgaaagttgt

SEQ ID NO: 242982 - DNA, 20 bp, Artificial
  CRISPR gRNA sequence
gaaagttgtcagaatcaaaa

SEQ ID NO: 242983 - DNA, 20 bp, Artificial
  CRISPR gRNA sequence
caggcagatcacatgaggcc

SEQ ID NO: 242984 - DNA, 20 bp, Artificial
  CRISPR gRNA sequence
cccaggaggcggaggttgca

SEQ ID NO: 242985 - DNA, 20 bp, Artificial
  CRISPR gRNA sequence
tcacgccactgcactccagc

SEQ ID NO: 242986 - DNA, 20 bp, Artificial
  CRISPR gRNA sequence
gagccagggaaggccgtgaa

SEQ ID NO: 242987 - DNA, 20 bp, Artificial
  CRISPR gRNA sequence
cggtattgatctttgtagca

SEQ ID NO: 242988 - DNA, 20 bp, Artificial
  CRISPR gRNA sequence
ttttttttttttttttgaga

SEQ ID NO: 242989 - DNA, 20 bp, Artificial
  CRISPR gRNA sequence
tcttgctctgtcgcccaggc

SEQ ID NO: 242990 - DNA, 20 bp, Artificial
  CRISPR gRNA sequence
gcccaggctggagtgaagtg

SEQ ID NO: 242991 - DNA, 20 bp, Artificial
  CRISPR gRNA sequence
gcctcagcctcccaagtatc

SEQ ID NO: 242992 - DNA, 20 bp, Artificial
  CRISPR gRNA sequence
ttttgtatttttagtagaga

SEQ ID NO: 242993 - DNA, 20 bp, Artificial
  CRISPR gRNA sequence
gcctcagcctcccaaagcgc

SEQ ID NO: 242994 - DNA, 20 bp, Artificial
  CRISPR gRNA sequence
ctcgcatcacctttacatcc

SEQ ID NO: 242995 - DNA, 20 bp, Artificial
  CRISPR gRNA sequence
agacagataagtggttgcca

SEQ ID NO: 242996 - DNA, 20 bp, Artificial
  CRISPR gRNA sequence
ggtagaggacctaactagaa

SEQ ID NO: 242997 - DNA, 20 bp, Artificial
  CRISPR gRNA sequence
ggaaggagatctctgtggtg

SEQ ID NO: 242998 - DNA, 20 bp, Artificial
  CRISPR gRNA sequence
cctgctttgccattgtactg

SEQ ID NO: 242999 - DNA, 20 bp, Artificial
  CRISPR gRNA sequence
tcctgtcttggcaaattcct

SEQ ID NO: 243000 - DNA, 20 bp, Artificial
  CRISPR gRNA sequence
ttttttttttttttttgaga

SEQ ID NO: 243001 - DNA, 20 bp, Artificial
  CRISPR gRNA sequence
ttcgcttttgttgcccaggc

SEQ ID NO: 243002 - DNA, 20 bp, Artificial
  CRISPR gRNA sequence
ttcactgcaacctccacctc

SEQ ID NO: 243003 - DNA, 20 bp, Artificial
  CRISPR gRNA sequence
gattctcctgtctcagcctc

SEQ ID NO: 243004 - DNA, 20 bp, Artificial
  CRISPR gRNA sequence
gtctcagcctcctgagtagc

SEQ ID NO: 243005 - DNA, 20 bp, Artificial
  CRISPR gRNA sequence
ttttgtatttttagtagaga

SEQ ID NO: 243006 - DNA, 20 bp, Artificial
  CRISPR gRNA sequence
atctgcccgcctcagccccc

SEQ ID NO: 243007 - DNA, 20 bp, Artificial
  CRISPR gRNA sequence
gcctcagccccccagaatgc

SEQ ID NO: 243008 - DNA, 20 bp, Artificial
  CRISPR gRNA sequence
gaaggaaggcttccctgacc

SEQ ID NO: 243009 - DNA, 20 bp, Artificial
  CRISPR gRNA sequence
tccctgaccaggaatcgaac

SEQ ID NO: 243010 - DNA, 20 bp, Artificial
  CRISPR gRNA sequence
ccgggtcgtgatggcgagcg

SEQ ID NO: 243011 - DNA, 20 bp, Artificial
  CRISPR gRNA sequence
tcctaaccactagactacca

SEQ ID NO: 243012 - DNA, 20 bp, Artificial
  CRISPR gRNA sequence
gtcctaaaaacttttaaaaa

SEQ ID NO: 243013 - DNA, 20 bp, Artificial
  CRISPR gRNA sequence
taacgaactttgttgcagtc

SEQ ID NO: 243014 - DNA, 20 bp, Artificial
  CRISPR gRNA sequence
actttgttgcagtctggggt

SEQ ID NO: 243015 - DNA, 20 bp, Artificial
  CRISPR gRNA sequence
gcagagatactcctttaaat

SEQ ID NO: 243016 - DNA, 20 bp, Artificial
  CRISPR gRNA sequence
actttgggaaaccgaggtgg

SEQ ID NO: 243017 - DNA, 20 bp, Artificial
  CRISPR gRNA sequence
tgggaggatcgcttgagccc

SEQ ID NO: 243018 - DNA, 20 bp, Artificial
  CRISPR gRNA sequence
agactggcctggacaacacc

SEQ ID NO: 243019 - DNA, 20 bp, Artificial
  CRISPR gRNA sequence
aaaaatcaattaaaaattag

SEQ ID NO: 243020 - DNA, 20 bp, Artificial
  CRISPR gRNA sequence
tatttagtaggctgaggcag

SEQ ID NO: 243021 - DNA, 20 bp, Artificial
  CRISPR gRNA sequence
caggaggattgctcgagctc

SEQ ID NO: 243022 - DNA, 20 bp, Artificial
  CRISPR gRNA sequence
tcgcaccattgcacttcagc

SEQ ID NO: 243023 - DNA, 20 bp, Artificial
  CRISPR gRNA sequence
ggaggtgtagacctcaaaaa

SEQ ID NO: 243024 - DNA, 20 bp, Artificial
  CRISPR gRNA sequence
aagaatgaaagagcaaacca

SEQ ID NO: 243025 - DNA, 20 bp, Artificial
  CRISPR gRNA sequence
aaaaataatctgatgatacc

SEQ ID NO: 243026 - DNA, 20 bp, Artificial
  CRISPR gRNA sequence
gatgataccaagagttatca

SEQ ID NO: 243027 - DNA, 20 bp, Artificial
  CRISPR gRNA sequence
ccaagagttatcaggggatg

SEQ ID NO: 243028 - DNA, 20 bp, Artificial
  CRISPR gRNA sequence
aggaaactcattaccgccag

SEQ ID NO: 243029 - DNA, 20 bp, Artificial
  CRISPR gRNA sequence
taccgccaggggagtgtaaa

SEQ ID NO: 243030 - DNA, 20 bp, Artificial
  CRISPR gRNA sequence
atcccgctgtccatcagtac

SEQ ID NO: 243031 - DNA, 20 bp, Artificial
  CRISPR gRNA sequence
caatgatgtcatcattcaac

SEQ ID NO: 243032 - DNA, 20 bp, Artificial
  CRISPR gRNA sequence
caactaaagatgaactcaac

SEQ ID NO: 243033 - DNA, 20 bp, Artificial
  CRISPR gRNA sequence
taaagatgaactcaacatgg

SEQ ID NO: 243034 - DNA, 20 bp, Artificial
  CRISPR gRNA sequence
aagggcatgccaagggcttc

SEQ ID NO: 243035 - DNA, 20 bp, Artificial
  CRISPR gRNA sequence
gcatgccaagggcttcggga

SEQ ID NO: 243036 - DNA, 20 bp, Artificial
  CRISPR gRNA sequence
gttccacttctttaccctgg

SEQ ID NO: 243037 - DNA, 20 bp, Artificial
  CRISPR gRNA sequence
ctttaccctggtagagttat

SEQ ID NO: 243038 - DNA, 20 bp, Artificial
  CRISPR gRNA sequence
actttgggaggctgaggcgg

SEQ ID NO: 243039 - DNA, 20 bp, Artificial
  CRISPR gRNA sequence
cgggcggatcacctgaggtt

SEQ ID NO: 243040 - DNA, 20 bp, Artificial
  CRISPR gRNA sequence
tactaaaaatgcaaaattag

SEQ ID NO: 243041 - DNA, 20 bp, Artificial
  CRISPR gRNA sequence
gcctcgggagcctgaggcag

SEQ ID NO: 243042 - DNA, 20 bp, Artificial
  CRISPR gRNA sequence
aggaggaggttgcggtaagc

SEQ ID NO: 243043 - DNA, 20 bp, Artificial
  CRISPR gRNA sequence
tgcactccagcctgggcaac

SEQ ID NO: 243044 - DNA, 20 bp, Artificial
  CRISPR gRNA sequence
ttctggtcttacatggtgct

SEQ ID NO: 243045 - DNA, 20 bp, Artificial
  CRISPR gRNA sequence
atatcaatggcttttgtcta

SEQ ID NO: 243046 - DNA, 20 bp, Artificial
  CRISPR gRNA sequence
gactcagtgccaggcacttg

SEQ ID NO: 243047 - DNA, 20 bp, Artificial
  CRISPR gRNA sequence
cagaaataattgttgaacaa

SEQ ID NO: 243048 - DNA, 20 bp, Artificial
  CRISPR gRNA sequence
aataattgttgaacaagtga

SEQ ID NO: 243049 - DNA, 20 bp, Artificial
  CRISPR gRNA sequence
tctccttgccttcctcaaat

SEQ ID NO: 243050 - DNA, 20 bp, Artificial
  CRISPR gRNA sequence
gaggctgtcccgtgcacggt

SEQ ID NO: 243051 - DNA, 20 bp, Artificial
  CRISPR gRNA sequence
ggctatatgaacctcatttc

SEQ ID NO: 243052 - DNA, 20 bp, Artificial
  CRISPR gRNA sequence
ttatgttaatcttacgttgt

SEQ ID NO: 243053 - DNA, 20 bp, Artificial
  CRISPR gRNA sequence
tacgttgtttgaatatatac

SEQ ID NO: 243054 - DNA, 20 bp, Artificial
  CRISPR gRNA sequence
aaagaaggagatgatctgcg

SEQ ID NO: 243055 - DNA, 20 bp, Artificial
  CRISPR gRNA sequence
ggtaaatttctaagcatgag

SEQ ID NO: 243056 - DNA, 20 bp, Artificial
  CRISPR gRNA sequence
gggcatctccaacctgctaa

SEQ ID NO: 243057 - DNA, 20 bp, Artificial
  CRISPR gRNA sequence
actttggaaggccgaggcag

SEQ ID NO: 243058 - DNA, 20 bp, Artificial
  CRISPR gRNA sequence
gccgaggcaggaggatcact

SEQ ID NO: 243059 - DNA, 20 bp, Artificial
  CRISPR gRNA sequence
caggaggatcacttagagtc

SEQ ID NO: 243060 - DNA, 20 bp, Artificial
  CRISPR gRNA sequence
ttgtaatcccagctacttgg

SEQ ID NO: 243061 - DNA, 20 bp, Artificial
  CRISPR gRNA sequence
tacttggcaggatgaggcag

SEQ ID NO: 243062 - DNA, 20 bp, Artificial
  CRISPR gRNA sequence
ctgcactccaacctgggcaa

SEQ ID NO: 243063 - DNA, 20 bp, Artificial
  CRISPR gRNA sequence
tgggcagatcacctgaggtc

SEQ ID NO: 243064 - DNA, 20 bp, Artificial
  CRISPR gRNA sequence
actaaaaatacaaaaattag

SEQ ID NO: 243065 - DNA, 20 bp, Artificial
  CRISPR gRNA sequence
aatcccagctactcaggagg

SEQ ID NO: 243066 - DNA, 20 bp, Artificial
  CRISPR gRNA sequence
tactcaggaggctgagtcag

SEQ ID NO: 243067 - DNA, 20 bp, Artificial
  CRISPR gRNA sequence
ttgcgccattgcactccagc

SEQ ID NO: 243068 - DNA, 20 bp, Artificial
  CRISPR gRNA sequence
actttgggagcccaaggcag

SEQ ID NO: 243069 - DNA, 20 bp, Artificial
  CRISPR gRNA sequence
caggaggattgcttgagccc

SEQ ID NO: 243070 - DNA, 20 bp, Artificial
  CRISPR gRNA sequence
aaaattagccaggtgtagtg

SEQ ID NO: 243071 - DNA, 20 bp, Artificial
  CRISPR gRNA sequence
tactggggaggctgaggtgg

SEQ ID NO: 243072 - DNA, 20 bp, Artificial
  CRISPR gRNA sequence
actttgggaggccgaggtgg

SEQ ID NO: 243073 - DNA, 20 bp, Artificial
  CRISPR gRNA sequence
ggtgggcggatcatgcggtc

SEQ ID NO: 243074 - DNA, 20 bp, Artificial
  CRISPR gRNA sequence
tacttgggaggctgaggcag

SEQ ID NO: 243075 - DNA, 20 bp, Artificial
  CRISPR gRNA sequence
gataaagatatagactctgt

SEQ ID NO: 243076 - DNA, 20 bp, Artificial
  CRISPR gRNA sequence
ttacaaatgtgtatctcaga

SEQ ID NO: 243077 - DNA, 20 bp, Artificial
  CRISPR gRNA sequence
aatgcctgggaagaaaactg

SEQ ID NO: 243078 - DNA, 20 bp, Artificial
  CRISPR gRNA sequence
aactgctgggtccctgaggg

SEQ ID NO: 243079 - DNA, 20 bp, Artificial
  CRISPR gRNA sequence
ccctgagggcaggattcagg

SEQ ID NO: 243080 - DNA, 20 bp, Artificial
  CRISPR gRNA sequence
ggggcaatttagatacaatc

SEQ ID NO: 243081 - DNA, 20 bp, Artificial
  CRISPR gRNA sequence
ggctctctcgcaggggcagg

SEQ ID NO: 243082 - DNA, 20 bp, Artificial
  CRISPR gRNA sequence
caggggcaggcggggtcaca

SEQ ID NO: 243083 - DNA, 20 bp, Artificial
  CRISPR gRNA sequence
tagcctagtgaaaaagatat

SEQ ID NO: 243084 - DNA, 20 bp, Artificial
  CRISPR gRNA sequence
agtgaaaaagatatatgggt

SEQ ID NO: 243085 - DNA, 20 bp, Artificial
  CRISPR gRNA sequence
ggcacagatgaaggctagca

SEQ ID NO: 243086 - DNA, 20 bp, Artificial
  CRISPR gRNA sequence
agcactagcatcaggcaaac

SEQ ID NO: 243087 - DNA, 20 bp, Artificial
  CRISPR gRNA sequence
ggcaaaccagggtttgagcc

SEQ ID NO: 243088 - DNA, 20 bp, Artificial
  CRISPR gRNA sequence
gccctgggtctgctgctttc

SEQ ID NO: 243089 - DNA, 20 bp, Artificial
  CRISPR gRNA sequence
actttggtaggctgaggcca

SEQ ID NO: 243090 - DNA, 20 bp, Artificial
  CRISPR gRNA sequence
tactcgggagactgaggtgg

SEQ ID NO: 243091 - DNA, 20 bp, Artificial
  CRISPR gRNA sequence
tgggaggatcacttgaaccc

SEQ ID NO: 243092 - DNA, 20 bp, Artificial
  CRISPR gRNA sequence
gaggctgatcacttgaaccc

SEQ ID NO: 243093 - DNA, 20 bp, Artificial
  CRISPR gRNA sequence
agttttctcatctgcaaaat

SEQ ID NO: 243094 - DNA, 20 bp, Artificial
  CRISPR gRNA sequence
agaactgtttcaaagaacaa

SEQ ID NO: 243095 - DNA, 20 bp, Artificial
  CRISPR gRNA sequence
gtttcaaagaacaaacgagt

SEQ ID NO: 243096 - DNA, 20 bp, Artificial
  CRISPR gRNA sequence
actcttgcacatctgacacg

SEQ ID NO: 243097 - DNA, 20 bp, Artificial
  CRISPR gRNA sequence
actttgggaggccaaggcaa

SEQ ID NO: 243098 - DNA, 20 bp, Artificial
  CRISPR gRNA sequence
caagcggatcacttgaggtc

SEQ ID NO: 243099 - DNA, 20 bp, Artificial
  CRISPR gRNA sequence
ctactaggaggccgaggcag

SEQ ID NO: 243100 - DNA, 20 bp, Artificial
  CRISPR gRNA sequence
aatctcttgaacccaggagg

SEQ ID NO: 243101 - DNA, 20 bp, Artificial
  CRISPR gRNA sequence
aaaaagccactttccaaaga

SEQ ID NO: 243102 - DNA, 20 bp, Artificial
  CRISPR gRNA sequence
aaatagtcaatacttttctt

SEQ ID NO: 243103 - DNA, 20 bp, Artificial
  CRISPR gRNA sequence
caagtctgtgccacattttg

SEQ ID NO: 243104 - DNA, 20 bp, Artificial
  CRISPR gRNA sequence
gagaagataagaggcagcaa

SEQ ID NO: 243105 - DNA, 20 bp, Artificial
  CRISPR gRNA sequence
ttgagacaggctctctgctc

SEQ ID NO: 243106 - DNA, 20 bp, Artificial
  CRISPR gRNA sequence
tttttgattttttgtagaga

SEQ ID NO: 243107 - DNA, 20 bp, Artificial
  CRISPR gRNA sequence
gttttgaactcctgggctca

SEQ ID NO: 243108 - DNA, 20 bp, Artificial
  CRISPR gRNA sequence
gtctcagcctcccaaagtgc

SEQ ID NO: 243109 - DNA, 20 bp, Artificial
  CRISPR gRNA sequence
gaaaatgcccactttgccta

SEQ ID NO: 243110 - DNA, 20 bp, Artificial
  CRISPR gRNA sequence
ttacattctgtctacacttg

SEQ ID NO: 243111 - DNA, 20 bp, Artificial
  CRISPR gRNA sequence
gaaattatacgtactttgtc

SEQ ID NO: 243112 - DNA, 20 bp, Artificial
  CRISPR gRNA sequence
aatctgtttgtttattttca

SEQ ID NO: 243113 - DNA, 20 bp, Artificial
  CRISPR gRNA sequence
gcccccaggcagtgaaaccc

SEQ ID NO: 243114 - DNA, 20 bp, Artificial
  CRISPR gRNA sequence
ttgacctccaaatccaggaa

SEQ ID NO: 243115 - DNA, 20 bp, Artificial
  CRISPR gRNA sequence
aaaaacttctctcttgtcaa

SEQ ID NO: 243116 - DNA, 20 bp, Artificial
  CRISPR gRNA sequence
tccacaaataattgctgtca

SEQ ID NO: 243117 - DNA, 20 bp, Artificial
  CRISPR gRNA sequence
ctagacctgctggttggcag

SEQ ID NO: 243118 - DNA, 20 bp, Artificial
  CRISPR gRNA sequence
tctgattcctgttattatca

SEQ ID NO: 243119 - DNA, 20 bp, Artificial
  CRISPR gRNA sequence
acaataaaataagattataa

SEQ ID NO: 243120 - DNA, 20 bp, Artificial
  CRISPR gRNA sequence
aataagattataaaagaatg

SEQ ID NO: 243121 - DNA, 20 bp, Artificial
  CRISPR gRNA sequence
gattattctttgtgtaatca

SEQ ID NO: 243122 - DNA, 20 bp, Artificial
  CRISPR gRNA sequence
tactcgggaggctgaggcag

SEQ ID NO: 243123 - DNA, 20 bp, Artificial
  CRISPR gRNA sequence
ctgcactccagcctgggcga

SEQ ID NO: 243124 - DNA, 20 bp, Artificial
  CRISPR gRNA sequence
gaaagaaaatactttatcta

SEQ ID NO: 243125 - DNA, 20 bp, Artificial
  CRISPR gRNA sequence
tatcttgattgatgtaggag

SEQ ID NO: 243126 - DNA, 20 bp, Artificial
  CRISPR gRNA sequence
gatgtaggagatgaatatga

SEQ ID NO: 243127 - DNA, 20 bp, Artificial
  CRISPR gRNA sequence
gaaagtcaaggcacaagagg

SEQ ID NO: 243128 - DNA, 20 bp, Artificial
  CRISPR gRNA sequence
catccaataaacatttgtaa

SEQ ID NO: 243129 - DNA, 20 bp, Artificial
  CRISPR gRNA sequence
caataaacatttgtaaatga

SEQ ID NO: 243130 - DNA, 20 bp, Artificial
  CRISPR gRNA sequence
agatcaaatgcacatgataa

SEQ ID NO: 243131 - DNA, 20 bp, Artificial
  CRISPR gRNA sequence
accagctgggcagttactac

SEQ ID NO: 243132 - DNA, 20 bp, Artificial
  CRISPR gRNA sequence
tcaaagttgaggaccagcaa

SEQ ID NO: 243133 - DNA, 20 bp, Artificial
  CRISPR gRNA sequence
actagcaaagctgattccaa

SEQ ID NO: 243134 - DNA, 20 bp, Artificial
  CRISPR gRNA sequence
ttacttatacaattctataa

SEQ ID NO: 243135 - DNA, 20 bp, Artificial
  CRISPR gRNA sequence
aattctataagaggataact

SEQ ID NO: 243136 - DNA, 20 bp, Artificial
  CRISPR gRNA sequence
gtgccggtttgccaaagttt

SEQ ID NO: 243137 - DNA, 20 bp, Artificial
  CRISPR gRNA sequence
tgaaataaactccttacaaa

SEQ ID NO: 243138 - DNA, 20 bp, Artificial
  CRISPR gRNA sequence
tttgtatggtaacaaaacta

SEQ ID NO: 243139 - DNA, 20 bp, Artificial
  CRISPR gRNA sequence
gaggacttcaggtcaaacac

SEQ ID NO: 243140 - DNA, 20 bp, Artificial
  CRISPR gRNA sequence
tgcggtgactcagccagggg

SEQ ID NO: 243141 - DNA, 20 bp, Artificial
  CRISPR gRNA sequence
tggaagcagctctctactgt

SEQ ID NO: 243142 - DNA, 20 bp, Artificial
  CRISPR gRNA sequence
aggcagggacgggggctcta

SEQ ID NO: 243143 - DNA, 20 bp, Artificial
  CRISPR gRNA sequence
acgggggctctaggggattt

SEQ ID NO: 243144 - DNA, 20 bp, Artificial
  CRISPR gRNA sequence
tcggggtcagcagatatgaa

SEQ ID NO: 243145 - DNA, 20 bp, Artificial
  CRISPR gRNA sequence
ggctgtcacagagctgtggt

SEQ ID NO: 243146 - DNA, 20 bp, Artificial
  CRISPR gRNA sequence
ccatgagaccccgcccctgg

SEQ ID NO: 243147 - DNA, 20 bp, Artificial
  CRISPR gRNA sequence
ctgcagaagcctgaagacca

SEQ ID NO: 243148 - DNA, 20 bp, Artificial
  CRISPR gRNA sequence
ctcaaggtctgtccatctgg

SEQ ID NO: 243149 - DNA, 20 bp, Artificial
  CRISPR gRNA sequence
aggtctgtccatctggggga

SEQ ID NO: 243150 - DNA, 20 bp, Artificial
  CRISPR gRNA sequence
agtgggtgggggcactgaga

SEQ ID NO: 243151 - DNA, 20 bp, Artificial
  CRISPR gRNA sequence
aacatcaataacttagcctg

SEQ ID NO: 243152 - DNA, 20 bp, Artificial
  CRISPR gRNA sequence
ctgtttaagaaaatgtgtta

SEQ ID NO: 243153 - DNA, 20 bp, Artificial
  CRISPR gRNA sequence
aggtgttcagctaaaggggg

SEQ ID NO: 243154 - DNA, 20 bp, Artificial
  CRISPR gRNA sequence
tgtgatagcttcttcttgaa

SEQ ID NO: 243155 - DNA, 20 bp, Artificial
  CRISPR gRNA sequence
cctgacagattctctttgta

SEQ ID NO: 243156 - DNA, 20 bp, Artificial
  CRISPR gRNA sequence
gccttgtcctagtggtttct

SEQ ID NO: 243157 - DNA, 20 bp, Artificial
  CRISPR gRNA sequence
ttaattgttcctgaaaaacc

SEQ ID NO: 243158 - DNA, 20 bp, Artificial
  CRISPR gRNA sequence
aaccctgagttatcctctta

SEQ ID NO: 243159 - DNA, 20 bp, Artificial
  CRISPR gRNA sequence
ttggaaatgtttatcttttg

SEQ ID NO: 243160 - DNA, 20 bp, Artificial
  CRISPR gRNA sequence
taatttgattaaaattctct

SEQ ID NO: 243161 - DNA, 20 bp, Artificial
  CRISPR gRNA sequence
ttgagaggacaagatcattg

SEQ ID NO: 243162 - DNA, 20 bp, Artificial
  CRISPR gRNA sequence
ttgtagtaactgcccagctg

SEQ ID NO: 243163 - DNA, 20 bp, Artificial
  CRISPR gRNA sequence
cattcatttacaaatgttta

SEQ ID NO: 243164 - DNA, 20 bp, Artificial
  CRISPR gRNA sequence
gtgccttgactttctcatct

SEQ ID NO: 243165 - DNA, 20 bp, Artificial
  CRISPR gRNA sequence
taataagagaacctgtttta

SEQ ID NO: 243166 - DNA, 20 bp, Artificial
  CRISPR gRNA sequence
ctgttttataggatggctgg

SEQ ID NO: 243167 - DNA, 20 bp, Artificial
  CRISPR gRNA sequence
ctccgactgggggcatagca

SEQ ID NO: 243168 - DNA, 20 bp, Artificial
  CRISPR gRNA sequence
gcgcgtagtaaagggcttaa

SEQ ID NO: 243169 - DNA, 20 bp, Artificial
  CRISPR gRNA sequence
tgtaggacattgatgtcctc

SEQ ID NO: 243170 - DNA, 20 bp, Artificial
  CRISPR gRNA sequence
tctcactctgtcgcccaggc

SEQ ID NO: 243171 - DNA, 20 bp, Artificial
  CRISPR gRNA sequence
aattctcctgcctcagcctc

SEQ ID NO: 243172 - DNA, 20 bp, Artificial
  CRISPR gRNA sequence
gcctcagcctcccgagtagc

SEQ ID NO: 243173 - DNA, 20 bp, Artificial
  CRISPR gRNA sequence
ttttgtatttttagtagaga

SEQ ID NO: 243174 - DNA, 20 bp, Artificial
  CRISPR gRNA sequence
tctaattctgtgattacaca

SEQ ID NO: 243175 - DNA, 20 bp, Artificial
  CRISPR gRNA sequence
tcttattttattgtaaactt

SEQ ID NO: 243176 - DNA, 20 bp, Artificial
  CRISPR gRNA sequence
attgtaaacttcggaatgcc

SEQ ID NO: 243177 - DNA, 20 bp, Artificial
  CRISPR gRNA sequence
gtacattctgtgataataac

SEQ ID NO: 243178 - DNA, 20 bp, Artificial
  CRISPR gRNA sequence
tatgcaggcagtgtaaaggt

SEQ ID NO: 243179 - DNA, 20 bp, Artificial
  CRISPR gRNA sequence
attactgggaacactataag

SEQ ID NO: 243180 - DNA, 20 bp, Artificial
  CRISPR gRNA sequence
gcagagcataaattcgcttc

SEQ ID NO: 243181 - DNA, 20 bp, Artificial
  CRISPR gRNA sequence
aggtgttttcaggaccagga

SEQ ID NO: 243182 - DNA, 20 bp, Artificial
  CRISPR gRNA sequence
gtgttcctccaccagcaatg

SEQ ID NO: 243183 - DNA, 20 bp, Artificial
  CRISPR gRNA sequence
tgcagagtgtgactgcactc

SEQ ID NO: 243184 - DNA, 20 bp, Artificial
  CRISPR gRNA sequence
agggtttcactgcctggggg

SEQ ID NO: 243185 - DNA, 20 bp, Artificial
  CRISPR gRNA sequence
caggatgcagcatgtgtgaa

SEQ ID NO: 243186 - DNA, 20 bp, Artificial
  CRISPR gRNA sequence
gtagaaccttaaagtaacaa

SEQ ID NO: 243187 - DNA, 20 bp, Artificial
  CRISPR gRNA sequence
aaaataaaaactagccatct

SEQ ID NO: 243188 - DNA, 20 bp, Artificial
  CRISPR gRNA sequence
ccatcttagggtgttgtttc

SEQ ID NO: 243189 - DNA, 20 bp, Artificial
  CRISPR gRNA sequence
gtataatttcctttagttta

SEQ ID NO: 243190 - DNA, 20 bp, Artificial
  CRISPR gRNA sequence
ttcctttagtttatggaata

SEQ ID NO: 243191 - DNA, 20 bp, Artificial
  CRISPR gRNA sequence
tagtttatggaataaagaat

SEQ ID NO: 243192 - DNA, 20 bp, Artificial
  CRISPR gRNA sequence
gttaaattttttggaagata

SEQ ID NO: 243193 - DNA, 20 bp, Artificial
  CRISPR gRNA sequence
ttgcacccatcaagtgtaga

SEQ ID NO: 243194 - DNA, 20 bp, Artificial
  CRISPR gRNA sequence
agtgcctggaacatctagat

SEQ ID NO: 243195 - DNA, 20 bp, Artificial
  CRISPR gRNA sequence
caggaggactccttgagccc

SEQ ID NO: 243196 - DNA, 20 bp, Artificial
  CRISPR gRNA sequence
cccaggagttcaaaaccagc

SEQ ID NO: 243197 - DNA, 20 bp, Artificial
  CRISPR gRNA sequence
agggaaggctgatgaggcag

SEQ ID NO: 243198 - DNA, 20 bp, Artificial
  CRISPR gRNA sequence
tgatgaggcaggaggatcac

SEQ ID NO: 243199 - DNA, 20 bp, Artificial
  CRISPR gRNA sequence
cctgtctcaaaagaaaggaa

SEQ ID NO: 243200 - DNA, 20 bp, Artificial
  CRISPR gRNA sequence
atgtgttcaatgccagcccc

SEQ ID NO: 243201 - DNA, 20 bp, Artificial
  CRISPR gRNA sequence
aaaaagccaatagtatacga

SEQ ID NO: 243202 - DNA, 20 bp, Artificial
  CRISPR gRNA sequence
cagaacttacactgtggtct

SEQ ID NO: 243203 - DNA, 20 bp, Artificial
  CRISPR gRNA sequence
acttacactgtggtctgtgg

SEQ ID NO: 243204 - DNA, 20 bp, Artificial
  CRISPR gRNA sequence
tgtccccatcgacagtggtg

SEQ ID NO: 243205 - DNA, 20 bp, Artificial
  CRISPR gRNA sequence
tcgacagtggtgtagggtta

SEQ ID NO: 243206 - DNA, 20 bp, Artificial
  CRISPR gRNA sequence
aaacttttaaggcaaattgg

SEQ ID NO: 243207 - DNA, 20 bp, Artificial
  CRISPR gRNA sequence
agtaatgtggtctgttgact

SEQ ID NO: 243208 - DNA, 20 bp, Artificial
  CRISPR gRNA sequence
aaaataaagtgttttgaaac

SEQ ID NO: 243209 - DNA, 20 bp, Artificial
  CRISPR gRNA sequence
catttataatttatcagcat

SEQ ID NO: 243210 - DNA, 20 bp, Artificial
  CRISPR gRNA sequence
tatcagcatcagagtggctg

SEQ ID NO: 243211 - DNA, 20 bp, Artificial
  CRISPR gRNA sequence
gcatcagagtggctgacgaa

SEQ ID NO: 243212 - DNA, 20 bp, Artificial
  CRISPR gRNA sequence
gactattttctcggacttag

SEQ ID NO: 243213 - DNA, 20 bp, Artificial
  CRISPR gRNA sequence
tttgtttgtttgttttgaga

SEQ ID NO: 243214 - DNA, 20 bp, Artificial
  CRISPR gRNA sequence
ttcgctcttcttgcccaggc

SEQ ID NO: 243215 - DNA, 20 bp, Artificial
  CRISPR gRNA sequence
ctcactgcaaactctgcctc

SEQ ID NO: 243216 - DNA, 20 bp, Artificial
  CRISPR gRNA sequence
tgcctcggcctcctagtagc

SEQ ID NO: 243217 - DNA, 20 bp, Artificial
  CRISPR gRNA sequence
gccttggcctcccaaagtgc

SEQ ID NO: 243218 - DNA, 20 bp, Artificial
  CRISPR gRNA sequence
gtctttcaatacaaattttt

SEQ ID NO: 243219 - DNA, 20 bp, Artificial
  CRISPR gRNA sequence
aaatttttcagagttgttaa

SEQ ID NO: 243220 - DNA, 20 bp, Artificial
  CRISPR gRNA sequence
aagtgagtctgcatggaaaa

SEQ ID NO: 243221 - DNA, 20 bp, Artificial
  CRISPR gRNA sequence
aactgggctctggaggacgg

SEQ ID NO: 243222 - DNA, 20 bp, Artificial
  CRISPR gRNA sequence
ctctggaggacgggcggatt

SEQ ID NO: 243223 - DNA, 20 bp, Artificial
  CRISPR gRNA sequence
actcagcgtgtcagatgtgc

SEQ ID NO: 243224 - DNA, 20 bp, Artificial
  CRISPR gRNA sequence
tctgagacagcgtcaaactc

SEQ ID NO: 243225 - DNA, 20 bp, Artificial
  CRISPR gRNA sequence
aagtgatcagcctcaaactc

SEQ ID NO: 243226 - DNA, 20 bp, Artificial
  CRISPR gRNA sequence
gatcctcccacctcagtctc

SEQ ID NO: 243227 - DNA, 20 bp, Artificial
  CRISPR gRNA sequence
tcttttaatttttgtagaga

SEQ ID NO: 243228 - DNA, 20 bp, Artificial
  CRISPR gRNA sequence
ataggcgtgagccaccatgc

SEQ ID NO: 243229 - DNA, 20 bp, Artificial
  CRISPR gRNA sequence
tcaagtccgattaagaaact

SEQ ID NO: 243230 - DNA, 20 bp, Artificial
  CRISPR gRNA sequence
tttttcactaggctacttca

SEQ ID NO: 243231 - DNA, 20 bp, Artificial
  CRISPR gRNA sequence
aaaatgacaaagttttaaac

SEQ ID NO: 243232 - DNA, 20 bp, Artificial
  CRISPR gRNA sequence
tgaactgtctaagctgttct

SEQ ID NO: 243233 - DNA, 20 bp, Artificial
  CRISPR gRNA sequence
tggatggaaagtctgtgctt

SEQ ID NO: 243234 - DNA, 20 bp, Artificial
  CRISPR gRNA sequence
acctcccacgtgcattcttc

SEQ ID NO: 243235 - DNA, 20 bp, Artificial
  CRISPR gRNA sequence
cagaggacacttcacccaaa

SEQ ID NO: 243236 - DNA, 20 bp, Artificial
  CRISPR gRNA sequence
ctttatcaatgccaaggaaa

SEQ ID NO: 243237 - DNA, 20 bp, Artificial
  CRISPR gRNA sequence
atgccaaggaaaggggatta

SEQ ID NO: 243238 - DNA, 20 bp, Artificial
  CRISPR gRNA sequence
ttctttttttttgtttttaa

SEQ ID NO: 243239 - DNA, 20 bp, Artificial
  CRISPR gRNA sequence
tgtcttgctctgtgccaggc

SEQ ID NO: 243240 - DNA, 20 bp, Artificial
  CRISPR gRNA sequence
ctcactgcaatctccacctc

SEQ ID NO: 243241 - DNA, 20 bp, Artificial
  CRISPR gRNA sequence
gcctcagcctcccaagtagc

SEQ ID NO: 243242 - DNA, 20 bp, Artificial
  CRISPR gRNA sequence
acctcggcctcccaaagtgc

SEQ ID NO: 243243 - DNA, 20 bp, Artificial
  CRISPR gRNA sequence
tgtgagccaccacgcccgtc

SEQ ID NO: 243244 - DNA, 20 bp, Artificial
  CRISPR gRNA sequence
tctcgctttttttttccccc

SEQ ID NO: 243245 - DNA, 20 bp, Artificial
  CRISPR gRNA sequence
tgccttgttctgtgccaggc

SEQ ID NO: 243246 - DNA, 20 bp, Artificial
  CRISPR gRNA sequence
ctaattttttatttttttgg

SEQ ID NO: 243247 - DNA, 20 bp, Artificial
  CRISPR gRNA sequence
ttttatttttttggcagagt

SEQ ID NO: 243248 - DNA, 20 bp, Artificial
  CRISPR gRNA sequence
gccttgggctcccaaagtgt

SEQ ID NO: 243249 - DNA, 20 bp, Artificial
  CRISPR gRNA sequence
catattttctatgtgctaga

SEQ ID NO: 243250 - DNA, 20 bp, Artificial
  CRISPR gRNA sequence
agtttcttttatttttttgg

SEQ ID NO: 243251 - DNA, 20 bp, Artificial
  CRISPR gRNA sequence
tatttttttgggggggtgga

SEQ ID NO: 243252 - DNA, 20 bp, Artificial
  CRISPR gRNA sequence
tctctctctgtcacccaggc

SEQ ID NO: 243253 - DNA, 20 bp, Artificial
  CRISPR gRNA sequence
gattctcctgactcagcctc

SEQ ID NO: 243254 - DNA, 20 bp, Artificial
  CRISPR gRNA sequence
gactcagcctcctgagtagc

SEQ ID NO: 243255 - DNA, 20 bp, Artificial
  CRISPR gRNA sequence
ttttgtatttttagtagaga

SEQ ID NO: 243256 - DNA, 20 bp, Artificial
  CRISPR gRNA sequence
accttggcctcccaaagtgc

SEQ ID NO: 243257 - DNA, 20 bp, Artificial
  CRISPR gRNA sequence
ttcttttcttttttttgaga

SEQ ID NO: 243258 - DNA, 20 bp, Artificial
  CRISPR gRNA sequence
tctcactctgttgcccaggt

SEQ ID NO: 243259 - DNA, 20 bp, Artificial
  CRISPR gRNA sequence
ctcactgcaacctccgcctc

SEQ ID NO: 243260 - DNA, 20 bp, Artificial
  CRISPR gRNA sequence
gcctcatcctgccaagtagc

SEQ ID NO: 243261 - DNA, 20 bp, Artificial
  CRISPR gRNA sequence
gcctcggccttccaaagtgt

SEQ ID NO: 243262 - DNA, 20 bp, Artificial
  CRISPR gRNA sequence
ttaccaatgtaaatatatac

SEQ ID NO: 243263 - DNA, 20 bp, Artificial
  CRISPR gRNA sequence
gtaaatatatacatgggtgt

SEQ ID NO: 243264 - DNA, 20 bp, Artificial
  CRISPR gRNA sequence
gcaggggcaatttcgtccct

SEQ ID NO: 243265 - DNA, 20 bp, Artificial
  CRISPR gRNA sequence
attaggggctattgcatcta

SEQ ID NO: 243266 - DNA, 20 bp, Artificial
  CRISPR gRNA sequence
cacgggacagcctcccagca

SEQ ID NO: 243267 - DNA, 20 bp, Artificial
  CRISPR gRNA sequence
gatttaaatatgctgcagcc

SEQ ID NO: 243268 - DNA, 20 bp, Artificial
  CRISPR gRNA sequence
tgtggaggacactggcaaag

SEQ ID NO: 243269 - DNA, 20 bp, Artificial
  CRISPR gRNA sequence
ggttgataaactggcttaaa

SEQ ID NO: 243270 - DNA, 20 bp, Artificial
  CRISPR gRNA sequence
gaacaaagagggagcttgaa

SEQ ID NO: 243271 - DNA, 20 bp, Artificial
  CRISPR gRNA sequence
gcttgaagggggtttaacaa

SEQ ID NO: 243272 - DNA, 20 bp, Artificial
  CRISPR gRNA sequence
tgaattattacagcaccagt

SEQ ID NO: 243273 - DNA, 20 bp, Artificial
  CRISPR gRNA sequence
ttacatgaaaaatttcaata

SEQ ID NO: 243274 - DNA, 20 bp, Artificial
  CRISPR gRNA sequence
tactcagcaagtgcctggca

SEQ ID NO: 243275 - DNA, 20 bp, Artificial
  CRISPR gRNA sequence
ttttttgtcttcatggacat

SEQ ID NO: 243276 - DNA, 20 bp, Artificial
  CRISPR gRNA sequence
gcttaataagacttaataag

SEQ ID NO: 243277 - DNA, 20 bp, Artificial
  CRISPR gRNA sequence
cccaaagcaccatgtaagac

SEQ ID NO: 243278 - DNA, 20 bp, Artificial
  CRISPR gRNA sequence
tttttttttcttttttgaga

SEQ ID NO: 243279 - DNA, 20 bp, Artificial
  CRISPR gRNA sequence
ttcactcttgttgcccaggc

SEQ ID NO: 243280 - DNA, 20 bp, Artificial
  CRISPR gRNA sequence
cttaccgcaacctcctcctt

SEQ ID NO: 243281 - DNA, 20 bp, Artificial
  CRISPR gRNA sequence
ttttgcatttttagtagaga

SEQ ID NO: 243282 - DNA, 20 bp, Artificial
  CRISPR gRNA sequence
gcctcagcctcccaaagtgt

SEQ ID NO: 243283 - DNA, 20 bp, Artificial
  CRISPR gRNA sequence
aaacattcaaataactctac

SEQ ID NO: 243284 - DNA, 20 bp, Artificial
  CRISPR gRNA sequence
gcttgtgaacttcatacaaa

SEQ ID NO: 243285 - DNA, 20 bp, Artificial
  CRISPR gRNA sequence
atcatgaagattcatccatg

SEQ ID NO: 243286 - DNA, 20 bp, Artificial
  CRISPR gRNA sequence
tccactgttgcacactcttg

SEQ ID NO: 243287 - DNA, 20 bp, Artificial
  CRISPR gRNA sequence
attctagtactgatggacag

SEQ ID NO: 243288 - DNA, 20 bp, Artificial
  CRISPR gRNA sequence
cagcgggatcatttccagct

SEQ ID NO: 243289 - DNA, 20 bp, Artificial
  CRISPR gRNA sequence
gttattacatgtaatgacgt

SEQ ID NO: 243290 - DNA, 20 bp, Artificial
  CRISPR gRNA sequence
ggaacatgtgtatcttggtc

SEQ ID NO: 243291 - DNA, 20 bp, Artificial
  CRISPR gRNA sequence
tttacactcccctggcggta

SEQ ID NO: 243292 - DNA, 20 bp, Artificial
  CRISPR gRNA sequence
agattatttttatcgatatg

SEQ ID NO: 243293 - DNA, 20 bp, Artificial
  CRISPR gRNA sequence
tatttttatcgatatggtgg

SEQ ID NO: 243294 - DNA, 20 bp, Artificial
  CRISPR gRNA sequence
tttcatgttattttggctat

SEQ ID NO: 243295 - DNA, 20 bp, Artificial
  CRISPR gRNA sequence
gaagggcctgatcaagtctt

SEQ ID NO: 243296 - DNA, 20 bp, Artificial
  CRISPR gRNA sequence
gtcttttgagtattttctca

SEQ ID NO: 243297 - DNA, 20 bp, Artificial
  CRISPR gRNA sequence
tgtcttttgtttttttgaga

SEQ ID NO: 243298 - DNA, 20 bp, Artificial
  CRISPR gRNA sequence
tttagtgtttttgtagagac

SEQ ID NO: 243299 - DNA, 20 bp, Artificial
  CRISPR gRNA sequence
tggacttaatcctgatttaa

SEQ ID NO: 243300 - DNA, 20 bp, Artificial
  CRISPR gRNA sequence
aatgcttttcaaaagtattt

SEQ ID NO: 243301 - DNA, 20 bp, Artificial
  CRISPR gRNA sequence
aaagtatttatgagtaatta

SEQ ID NO: 243302 - DNA, 20 bp, Artificial
  CRISPR gRNA sequence
ctccctggtagtctagtggt

SEQ ID NO: 243303 - DNA, 20 bp, Artificial
  CRISPR gRNA sequence
tccgcgctcgccatcacgac

SEQ ID NO: 243304 - DNA, 20 bp, Artificial
  CRISPR gRNA sequence
cgggcagatcacctgaggtt

SEQ ID NO: 243305 - DNA, 20 bp, Artificial
  CRISPR gRNA sequence
tactcaggaggctgagacag

SEQ ID NO: 243306 - DNA, 20 bp, Artificial
  CRISPR gRNA sequence
tgacgtaattatagattcac

SEQ ID NO: 243307 - DNA, 20 bp, Artificial
  CRISPR gRNA sequence
gaacatctctcatgcggttt

SEQ ID NO: 243308 - DNA, 20 bp, Artificial
  CRISPR gRNA sequence
ttgtccctttatcacacatg

SEQ ID NO: 243309 - DNA, 20 bp, Artificial
  CRISPR gRNA sequence
ctctatacttttgttattta

SEQ ID NO: 243310 - DNA, 20 bp, Artificial
  CRISPR gRNA sequence
tttaaggaatatggtataaa

SEQ ID NO: 243311 - DNA, 20 bp, Artificial
  CRISPR gRNA sequence
ctaaaagattatattttttc

SEQ ID NO: 243312 - DNA, 20 bp, Artificial
  CRISPR gRNA sequence
ttcaggagtagcattgcagt

SEQ ID NO: 243313 - DNA, 20 bp, Artificial
  CRISPR gRNA sequence
agcattgcagtgggaatacg

SEQ ID NO: 243314 - DNA, 20 bp, Artificial
  CRISPR gRNA sequence
ggaatacggtgggtgtattc

SEQ ID NO: 243315 - DNA, 20 bp, Artificial
  CRISPR gRNA sequence
ttcagggatgtaaaggtgat

SEQ ID NO: 243316 - DNA, 20 bp, Artificial
  CRISPR gRNA sequence
cagcgctttgggaggctgag

SEQ ID NO: 243317 - DNA, 20 bp, Artificial
  CRISPR gRNA sequence
gctttgggaggctgaggcgg

SEQ ID NO: 243318 - DNA, 20 bp, Artificial
  CRISPR gRNA sequence
cggatggatcacctgaggtc

SEQ ID NO: 243319 - DNA, 20 bp, Artificial
  CRISPR gRNA sequence
tacttgggaggctgaggcac

SEQ ID NO: 243320 - DNA, 20 bp, Artificial
  CRISPR gRNA sequence
gaaaaaaaagaaaaactgag

SEQ ID NO: 243321 - DNA, 20 bp, Artificial
  CRISPR gRNA sequence
ccttccctggctccatttgt

SEQ ID NO: 243322 - DNA, 20 bp, Artificial
  CRISPR gRNA sequence
gttgttgtttgtttttgaga

SEQ ID NO: 243323 - DNA, 20 bp, Artificial
  CRISPR gRNA sequence
tctccctgtgtcattcaggc

SEQ ID NO: 243324 - DNA, 20 bp, Artificial
  CRISPR gRNA sequence
ctcgctgcaacctccgcctc

SEQ ID NO: 243325 - DNA, 20 bp, Artificial
  CRISPR gRNA sequence
gattttcgtgcctcagcctc

SEQ ID NO: 243326 - DNA, 20 bp, Artificial
  CRISPR gRNA sequence
gcctcagcctcctgagtagc

SEQ ID NO: 243327 - DNA, 20 bp, Artificial
  CRISPR gRNA sequence
atgcccggctatagtagaga

SEQ ID NO: 243328 - DNA, 20 bp, Artificial
  CRISPR gRNA sequence
gcctcagtctcccaaagtgc

SEQ ID NO: 243329 - DNA, 20 bp, Artificial
  CRISPR gRNA sequence
accatgcccggcccatttgt

SEQ ID NO: 243330 - DNA, 20 bp, Artificial
  CRISPR gRNA sequence
tggttaattctttttccttg

SEQ ID NO: 243331 - DNA, 20 bp, Artificial
  CRISPR gRNA sequence
ctattacatataaagctgcg

SEQ ID NO: 243332 - DNA, 20 bp, Artificial
  CRISPR gRNA sequence
tatctctatgataaatgctc

SEQ ID NO: 243333 - DNA, 20 bp, Artificial
  CRISPR gRNA sequence
gtatcattttacattctcat

SEQ ID NO: 243334 - DNA, 20 bp, Artificial
  CRISPR gRNA sequence
ctttaatttgcacttccctt

SEQ ID NO: 243335 - DNA, 20 bp, Artificial
  CRISPR gRNA sequence
gtctttcacctattttctag

SEQ ID NO: 243336 - DNA, 20 bp, Artificial
  CRISPR gRNA sequence
ttgttttactgttgagattc

SEQ ID NO: 243337 - DNA, 20 bp, Artificial
  CRISPR gRNA sequence
gttcttcgtatttcccagat

SEQ ID NO: 243338 - DNA, 20 bp, Artificial
  CRISPR gRNA sequence
attttgctgaagtccagttt

SEQ ID NO: 243339 - DNA, 20 bp, Artificial
  CRISPR gRNA sequence
tttatggattttttcattta

SEQ ID NO: 243340 - DNA, 20 bp, Artificial
  CRISPR gRNA sequence
tcatttatggagtcatgtct

SEQ ID NO: 243341 - DNA, 20 bp, Artificial
  CRISPR gRNA sequence
tcatgtctaagaattcttca

SEQ ID NO: 243342 - DNA, 20 bp, Artificial
  CRISPR gRNA sequence
taagaattcttcactgagtc

SEQ ID NO: 243343 - DNA, 20 bp, Artificial
  CRISPR gRNA sequence
agtcctgggtctcaaagatt

SEQ ID NO: 243344 - DNA, 20 bp, Artificial
  CRISPR gRNA sequence
ttgattttttttttctgaga

SEQ ID NO: 243345 - DNA, 20 bp, Artificial
  CRISPR gRNA sequence
ctctgctttgtcacccaggc

SEQ ID NO: 243346 - DNA, 20 bp, Artificial
  CRISPR gRNA sequence
tcccaagtagctgggactac

SEQ ID NO: 243347 - DNA, 20 bp, Artificial
  CRISPR gRNA sequence
gaacaaaggggggcaaaagc

SEQ ID NO: 243348 - DNA, 20 bp, Artificial
  CRISPR gRNA sequence
gggaataaaagacgagacaa

SEQ ID NO: 243349 - DNA, 20 bp, Artificial
  CRISPR gRNA sequence
aaaagagtatatttggaaga

SEQ ID NO: 243350 - DNA, 20 bp, Artificial
  CRISPR gRNA sequence
aaaagagatagtgagaaagc

SEQ ID NO: 243351 - DNA, 20 bp, Artificial
  CRISPR gRNA sequence
tgagaaagcggggatgattg

SEQ ID NO: 243352 - DNA, 20 bp, Artificial
  CRISPR gRNA sequence
tagataacttcaaggagcca

SEQ ID NO: 243353 - DNA, 20 bp, Artificial
  CRISPR gRNA sequence
ctttttggtggcagggcagt

SEQ ID NO: 243354 - DNA, 20 bp, Artificial
  CRISPR gRNA sequence
tttgatcatatagcctccag

SEQ ID NO: 243355 - DNA, 20 bp, Artificial
  CRISPR gRNA sequence
atatagcctccagtggaatg

SEQ ID NO: 243356 - DNA, 20 bp, Artificial
  CRISPR gRNA sequence
ggctttggctctctgcatgc

SEQ ID NO: 243357 - DNA, 20 bp, Artificial
  CRISPR gRNA sequence
tttttttttttattttgaga

SEQ ID NO: 243358 - DNA, 20 bp, Artificial
  CRISPR gRNA sequence
gccttggcctcccaaagtgc

SEQ ID NO: 243359 - DNA, 20 bp, Artificial
  CRISPR gRNA sequence
gttatacataaatactgaaa

SEQ ID NO: 243360 - DNA, 20 bp, Artificial
  CRISPR gRNA sequence
ataaatactgaaattgggta

SEQ ID NO: 243361 - DNA, 20 bp, Artificial
  CRISPR gRNA sequence
ttgcatttccacatacattt

SEQ ID NO: 243362 - DNA, 20 bp, Artificial
  CRISPR gRNA sequence
tatatctacaaaaagccggc

SEQ ID NO: 243363 - DNA, 20 bp, Artificial
  CRISPR gRNA sequence
gtcacatatcacttaatgac

SEQ ID NO: 243364 - DNA, 20 bp, Artificial
  CRISPR gRNA sequence
cagcctactatacacctagg

SEQ ID NO: 243365 - DNA, 20 bp, Artificial
  CRISPR gRNA sequence
ctgtcaggcatgtgactgta

SEQ ID NO: 243366 - DNA, 20 bp, Artificial
  CRISPR gRNA sequence
tgggcagatcacctgaggtc

SEQ ID NO: 243367 - DNA, 20 bp, Artificial
  CRISPR gRNA sequence
actaaaaatacaaaaattag

SEQ ID NO: 243368 - DNA, 20 bp, Artificial
  CRISPR gRNA sequence
cacttgggaggctgaggtgg

SEQ ID NO: 243369 - DNA, 20 bp, Artificial
  CRISPR gRNA sequence
ctgcactcctggctgggcaa

SEQ ID NO: 243370 - DNA, 20 bp, Artificial
  CRISPR gRNA sequence
accaggccacccagcaggag

SEQ ID NO: 243371 - DNA, 20 bp, Artificial
  CRISPR gRNA sequence
cattagattctcataggagc

SEQ ID NO: 243372 - DNA, 20 bp, Artificial
  CRISPR gRNA sequence
tattgtgaactgcgcatacg

SEQ ID NO: 243373 - DNA, 20 bp, Artificial
  CRISPR gRNA sequence
cgaggttgcacgctccttat

SEQ ID NO: 243374 - DNA, 20 bp, Artificial
  CRISPR gRNA sequence
cccactgattctacattaca

SEQ ID NO: 243375 - DNA, 20 bp, Artificial
  CRISPR gRNA sequence
gcacaataaatgtaatgtgc

SEQ ID NO: 243376 - DNA, 20 bp, Artificial
  CRISPR gRNA sequence
taatttttttttttttgagg

SEQ ID NO: 243377 - DNA, 20 bp, Artificial
  CRISPR gRNA sequence
cagggtcttgctgcccaggc

SEQ ID NO: 243378 - DNA, 20 bp, Artificial
  CRISPR gRNA sequence
gctaatttttgtattagaga

SEQ ID NO: 243379 - DNA, 20 bp, Artificial
  CRISPR gRNA sequence
acctcggcctcccaaagtgc

SEQ ID NO: 243380 - DNA, 20 bp, Artificial
  CRISPR gRNA sequence
cttattagcctagacccaca

SEQ ID NO: 243381 - DNA, 20 bp, Artificial
  CRISPR gRNA sequence
atgagaacaatgtcttcttc

SEQ ID NO: 243382 - DNA, 20 bp, Artificial
  CRISPR gRNA sequence
ttgtttgttttttgtttgag

SEQ ID NO: 243383 - DNA, 20 bp, Artificial
  CRISPR gRNA sequence
tcttgctctgttgcccaggc

SEQ ID NO: 243384 - DNA, 20 bp, Artificial
  CRISPR gRNA sequence
ctccctgcaacctctgcctc

SEQ ID NO: 243385 - DNA, 20 bp, Artificial
  CRISPR gRNA sequence
acctctgcctcccgggttca

SEQ ID NO: 243386 - DNA, 20 bp, Artificial
  CRISPR gRNA sequence
gattctcctgtctcagcctc

SEQ ID NO: 243387 - DNA, 20 bp, Artificial
  CRISPR gRNA sequence
gtctcagcctcccgagtagc

SEQ ID NO: 243388 - DNA, 20 bp, Artificial
  CRISPR gRNA sequence
tttttgtactttagtagaga

SEQ ID NO: 243389 - DNA, 20 bp, Artificial
  CRISPR gRNA sequence
gccttggcctcccaaagtgc

SEQ ID NO: 243390 - DNA, 20 bp, Artificial
  CRISPR gRNA sequence
tatatatatatatatatata

SEQ ID NO: 243391 - DNA, 20 bp, Artificial
  CRISPR gRNA sequence
agtcatttattgtcattgtc

SEQ ID NO: 243392 - DNA, 20 bp, Artificial
  CRISPR gRNA sequence
aaaaaaaattttttagaagt

SEQ ID NO: 243393 - DNA, 20 bp, Artificial
  CRISPR gRNA sequence
gcttgctctattacccaggc

SEQ ID NO: 243394 - DNA, 20 bp, Artificial
  CRISPR gRNA sequence
gatcctcccacctcagcctc

SEQ ID NO: 243395 - DNA, 20 bp, Artificial
  CRISPR gRNA sequence
ttttaaatgttttgtagaga

SEQ ID NO: 243396 - DNA, 20 bp, Artificial
  CRISPR gRNA sequence
tgccttggcccccatagtat

SEQ ID NO: 243397 - DNA, 20 bp, Artificial
  CRISPR gRNA sequence
tgagcccccacacccagttt

SEQ ID NO: 243398 - DNA, 20 bp, Artificial
  CRISPR gRNA sequence
atttagatcttgtattttct

SEQ ID NO: 243399 - DNA, 20 bp, Artificial
  CRISPR gRNA sequence
catcactctagggaaggaag

SEQ ID NO: 243400 - DNA, 20 bp, Artificial
  CRISPR gRNA sequence
gcagctcgttacggccaggc

SEQ ID NO: 243401 - DNA, 20 bp, Artificial
  CRISPR gRNA sequence
caggcaggggtggaggaagt

SEQ ID NO: 243402 - DNA, 20 bp, Artificial
  CRISPR gRNA sequence
gttctatgctatacctcctg

SEQ ID NO: 243403 - DNA, 20 bp, Artificial
  CRISPR gRNA sequence
tgctatacctcctggagggt

SEQ ID NO: 243404 - DNA, 20 bp, Artificial
  CRISPR gRNA sequence
ctttttactgctagacacgt

SEQ ID NO: 243405 - DNA, 20 bp, Artificial
  CRISPR gRNA sequence
gatgagccttaatcagccgt

SEQ ID NO: 243406 - DNA, 20 bp, Artificial
  CRISPR gRNA sequence
tgttttttgtggtgttttgt

SEQ ID NO: 243407 - DNA, 20 bp, Artificial
  CRISPR gRNA sequence
tttgtggtgttttgttagaa

SEQ ID NO: 243408 - DNA, 20 bp, Artificial
  CRISPR gRNA sequence
actttgggaggcccagatgg

SEQ ID NO: 243409 - DNA, 20 bp, Artificial
  CRISPR gRNA sequence
gatgggcggatcataaggtc

SEQ ID NO: 243410 - DNA, 20 bp, Artificial
  CRISPR gRNA sequence
ttgcactccagcctgggcaa

SEQ ID NO: 243411 - DNA, 20 bp, Artificial
  CRISPR gRNA sequence
ctttcctggtctcataacta

SEQ ID NO: 243412 - DNA, 20 bp, Artificial
  CRISPR gRNA sequence
ttttatgtgtttttttgaga

SEQ ID NO: 243413 - DNA, 20 bp, Artificial
  CRISPR gRNA sequence
tcttgctctgttgcccaggc

SEQ ID NO: 243414 - DNA, 20 bp, Artificial
  CRISPR gRNA sequence
ctctctgcaacctctgcctc

SEQ ID NO: 243415 - DNA, 20 bp, Artificial
  CRISPR gRNA sequence
cattgtcctgcctcagactc

SEQ ID NO: 243416 - DNA, 20 bp, Artificial
  CRISPR gRNA sequence
ttttgtgtttttagtagaga

SEQ ID NO: 243417 - DNA, 20 bp, Artificial
  CRISPR gRNA sequence
gctttggcttcccaaagtgc

SEQ ID NO: 243418 - DNA, 20 bp, Artificial
  CRISPR gRNA sequence
aaagtgctgggattacagat

SEQ ID NO: 243419 - DNA, 20 bp, Artificial
  CRISPR gRNA sequence
gtccacgctattggcatttt

SEQ ID NO: 243420 - DNA, 20 bp, Artificial
  CRISPR gRNA sequence
acccattgccatgttgtttc

SEQ ID NO: 243421 - DNA, 20 bp, Artificial
  CRISPR gRNA sequence
tagcaacaagcatatgaaat

SEQ ID NO: 243422 - DNA, 20 bp, Artificial
  CRISPR gRNA sequence
tctgtaaataaatatctgct

SEQ ID NO: 243423 - DNA, 20 bp, Artificial
  CRISPR gRNA sequence
tcctaacagatggaagcagt

SEQ ID NO: 243424 - DNA, 20 bp, Artificial
  CRISPR gRNA sequence
tggggataccttcacaatcc

SEQ ID NO: 243425 - DNA, 20 bp, Artificial
  CRISPR gRNA sequence
actgcattccaaggaaacca

SEQ ID NO: 243426 - DNA, 20 bp, Artificial
  CRISPR gRNA sequence
tccaaggaaaccatcggatc

SEQ ID NO: 243427 - DNA, 20 bp, Artificial
  CRISPR gRNA sequence
caagacgaaaataagtgctg

SEQ ID NO: 243428 - DNA, 20 bp, Artificial
  CRISPR gRNA sequence
attgaaactagagctatgat

SEQ ID NO: 243429 - DNA, 20 bp, Artificial
  CRISPR gRNA sequence
tccttgctgttacctctctt

SEQ ID NO: 243430 - DNA, 20 bp, Artificial
  CRISPR gRNA sequence
tgctgttacctctcttgtgg

SEQ ID NO: 243431 - DNA, 20 bp, Artificial
  CRISPR gRNA sequence
ttattataattttttttaga

SEQ ID NO: 243432 - DNA, 20 bp, Artificial
  CRISPR gRNA sequence
tctcactctgtcacccaggc

SEQ ID NO: 243433 - DNA, 20 bp, Artificial
  CRISPR gRNA sequence
cgattctctgcctcagcctc

SEQ ID NO: 243434 - DNA, 20 bp, Artificial
  CRISPR gRNA sequence
gcctcagcctcccgagtagc

SEQ ID NO: 243435 - DNA, 20 bp, Artificial
  CRISPR gRNA sequence
tttggtatttttagtagaga

SEQ ID NO: 243436 - DNA, 20 bp, Artificial
  CRISPR gRNA sequence
gcctcagcctcccaaagtgc

SEQ ID NO: 243437 - DNA, 20 bp, Artificial
  CRISPR gRNA sequence
ttttgttttgttttttgaga

SEQ ID NO: 243438 - DNA, 20 bp, Artificial
  CRISPR gRNA sequence
ttcgctgttgtcacccaggc

SEQ ID NO: 243439 - DNA, 20 bp, Artificial
  CRISPR gRNA sequence
gtcactgcaatctctgtctc

SEQ ID NO: 243440 - DNA, 20 bp, Artificial
  CRISPR gRNA sequence
aattgtcctgcctcagcctc

SEQ ID NO: 243441 - DNA, 20 bp, Artificial
  CRISPR gRNA sequence
gcctcagcctcctgagtagc

SEQ ID NO: 243442 - DNA, 20 bp, Artificial
  CRISPR gRNA sequence
ctaatttttgtatttttagt

SEQ ID NO: 243443 - DNA, 20 bp, Artificial
  CRISPR gRNA sequence
ttttgtatttttagtaggga

SEQ ID NO: 243444 - DNA, 20 bp, Artificial
  CRISPR gRNA sequence
acctcggccttccaaagtgc

SEQ ID NO: 243445 - DNA, 20 bp, Artificial
  CRISPR gRNA sequence
gcatgagccaccacgcctgg

SEQ ID NO: 243446 - DNA, 20 bp, Artificial
  CRISPR gRNA sequence
agtttgttaaaattaaaggg

SEQ ID NO: 243447 - DNA, 20 bp, Artificial
  CRISPR gRNA sequence
atttccagaagaagaagaag

SEQ ID NO: 243448 - DNA, 20 bp, Artificial
  CRISPR gRNA sequence
ttgaaaagaagcaaggaaat

SEQ ID NO: 243449 - DNA, 20 bp, Artificial
  CRISPR gRNA sequence
acaccatcctacataatacc

SEQ ID NO: 243450 - DNA, 20 bp, Artificial
  CRISPR gRNA sequence
acgttcttttctaaatgcca

SEQ ID NO: 243451 - DNA, 20 bp, Artificial
  CRISPR gRNA sequence
cactttttttttttttttga

SEQ ID NO: 243452 - DNA, 20 bp, Artificial
  CRISPR gRNA sequence
tctcactctgtcacccaggc

SEQ ID NO: 243453 - DNA, 20 bp, Artificial
  CRISPR gRNA sequence
gatcctcctgcctcagtctc

SEQ ID NO: 243454 - DNA, 20 bp, Artificial
  CRISPR gRNA sequence
actttggcctcccaaagtgc

SEQ ID NO: 243455 - DNA, 20 bp, Artificial
  CRISPR gRNA sequence
agtacccgactaaagtttcc

SEQ ID NO: 243456 - DNA, 20 bp, Artificial
  CRISPR gRNA sequence
gacatgctccaccgtcaggg

SEQ ID NO: 243457 - DNA, 20 bp, Artificial
  CRISPR gRNA sequence
ccgtcaggggggagtatgag

SEQ ID NO: 243458 - DNA, 20 bp, Artificial
  CRISPR gRNA sequence
ggggagtatgagcagagtgc

SEQ ID NO: 243459 - DNA, 20 bp, Artificial
  CRISPR gRNA sequence
atgagcagagtgcctgagtt

SEQ ID NO: 243460 - DNA, 20 bp, Artificial
  CRISPR gRNA sequence
ggcctggaggaagttttgga

SEQ ID NO: 243461 - DNA, 20 bp, Artificial
  CRISPR gRNA sequence
tcattgtcctaccacagcac

SEQ ID NO: 243462 - DNA, 20 bp, Artificial
  CRISPR gRNA sequence
tcttgctctgttgcccaggc

SEQ ID NO: 243463 - DNA, 20 bp, Artificial
  CRISPR gRNA sequence
ctctgttgcccaggctggaa

SEQ ID NO: 243464 - DNA, 20 bp, Artificial
  CRISPR gRNA sequence
gcctcagtctcccaagtagc

SEQ ID NO: 243465 - DNA, 20 bp, Artificial
  CRISPR gRNA sequence
cattgtttggcttatgatct

SEQ ID NO: 243466 - DNA, 20 bp, Artificial
  CRISPR gRNA sequence
tctcactctgtctcccaggc

SEQ ID NO: 243467 - DNA, 20 bp, Artificial
  CRISPR gRNA sequence
tggagtacagtggtacaatc

SEQ ID NO: 243468 - DNA, 20 bp, Artificial
  CRISPR gRNA sequence
ttttatatttttagtagaga

SEQ ID NO: 243469 - DNA, 20 bp, Artificial
  CRISPR gRNA sequence
acctctgcctcccaaagtgc

SEQ ID NO: 243470 - DNA, 20 bp, Artificial
  CRISPR gRNA sequence
tgtcccatgttattttactc

SEQ ID NO: 243471 - DNA, 20 bp, Artificial
  CRISPR gRNA sequence
cattggccatcgcatggcaa

SEQ ID NO: 243472 - DNA, 20 bp, Artificial
  CRISPR gRNA sequence
gaaaagtatattctgtaaat

SEQ ID NO: 243473 - DNA, 20 bp, Artificial
  CRISPR gRNA sequence
cccttaattttgccaagcca

SEQ ID NO: 243474 - DNA, 20 bp, Artificial
  CRISPR gRNA sequence
ttttgccaagccagtgggta

SEQ ID NO: 243475 - DNA, 20 bp, Artificial
  CRISPR gRNA sequence
atttgcaaaaaaacttgggg

SEQ ID NO: 243476 - DNA, 20 bp, Artificial
  CRISPR gRNA sequence
tgggcagatcgcttgagccc

SEQ ID NO: 243477 - DNA, 20 bp, Artificial
  CRISPR gRNA sequence
acaaaaaatacaaaaattag

SEQ ID NO: 243478 - DNA, 20 bp, Artificial
  CRISPR gRNA sequence
cagcactttgcggggctgag

SEQ ID NO: 243479 - DNA, 20 bp, Artificial
  CRISPR gRNA sequence
actttgcggggctgaggtgg

SEQ ID NO: 243480 - DNA, 20 bp, Artificial
  CRISPR gRNA sequence
tgggtggatcatctgaggtc

SEQ ID NO: 243481 - DNA, 20 bp, Artificial
  CRISPR gRNA sequence
taaacatgtacaaaacttag

SEQ ID NO: 243482 - DNA, 20 bp, Artificial
  CRISPR gRNA sequence
aaacttagctgggtatggtg

SEQ ID NO: 243483 - DNA, 20 bp, Artificial
  CRISPR gRNA sequence
tgctccagaggctgtggcag

SEQ ID NO: 243484 - DNA, 20 bp, Artificial
  CRISPR gRNA sequence
ttgtgccattgcactccaga

SEQ ID NO: 243485 - DNA, 20 bp, Artificial
  CRISPR gRNA sequence
tgcactccagactgggtgac

SEQ ID NO: 243486 - DNA, 20 bp, Artificial
  CRISPR gRNA sequence
acctcagccttccaaagtgc

SEQ ID NO: 243487 - DNA, 20 bp, Artificial
  CRISPR gRNA sequence
caatacgtcgtctttctcct

SEQ ID NO: 243488 - DNA, 20 bp, Artificial
  CRISPR gRNA sequence
catcaagtttccatagggcc

SEQ ID NO: 243489 - DNA, 20 bp, Artificial
  CRISPR gRNA sequence
cagcactttgggaggccgac

SEQ ID NO: 243490 - DNA, 20 bp, Artificial
  CRISPR gRNA sequence
actttgggaggccgacgcgg

SEQ ID NO: 243491 - DNA, 20 bp, Artificial
  CRISPR gRNA sequence
cggatggatcacctgaggtc

SEQ ID NO: 243492 - DNA, 20 bp, Artificial
  CRISPR gRNA sequence
tatttgggaggctgaggccg

SEQ ID NO: 243493 - DNA, 20 bp, Artificial
  CRISPR gRNA sequence
tcgtaccattgcactccagc

SEQ ID NO: 243494 - DNA, 20 bp, Artificial
  CRISPR gRNA sequence
ttcaatataaattttagaag

SEQ ID NO: 243495 - DNA, 20 bp, Artificial
  CRISPR gRNA sequence
gaagctgaatttgaaaagat

SEQ ID NO: 243496 - DNA, 20 bp, Artificial
  CRISPR gRNA sequence
gaatttgaaaagatttggat

SEQ ID NO: 243497 - DNA, 20 bp, Artificial
  CRISPR gRNA sequence
aatctacaggtcaatttagg

SEQ ID NO: 243498 - DNA, 20 bp, Artificial
  CRISPR gRNA sequence
agggagagttgataatttta

SEQ ID NO: 243499 - DNA, 20 bp, Artificial
  CRISPR gRNA sequence
gagttgataattttacagaa

SEQ ID NO: 243500 - DNA, 20 bp, Artificial
  CRISPR gRNA sequence
gagtcatctggtgttccaat

SEQ ID NO: 243501 - DNA, 20 bp, Artificial
  CRISPR gRNA sequence
tttcaggaacaaagctaggt

SEQ ID NO: 243502 - DNA, 20 bp, Artificial
  CRISPR gRNA sequence
gtgcgaatatttttgtcttt

SEQ ID NO: 243503 - DNA, 20 bp, Artificial
  CRISPR gRNA sequence
aagagactggtcatgcccca

SEQ ID NO: 243504 - DNA, 20 bp, Artificial
  CRISPR gRNA sequence
ctggtcatgccccacagggt

SEQ ID NO: 243505 - DNA, 20 bp, Artificial
  CRISPR gRNA sequence
aaaacacaggaacttggcat

SEQ ID NO: 243506 - DNA, 20 bp, Artificial
  CRISPR gRNA sequence
ataaggaaggaacattgaga

SEQ ID NO: 243507 - DNA, 20 bp, Artificial
  CRISPR gRNA sequence
cagaataaaatgatcccctt

SEQ ID NO: 243508 - DNA, 20 bp, Artificial
  CRISPR gRNA sequence
aaaaataaattagcacattt

SEQ ID NO: 243509 - DNA, 20 bp, Artificial
  CRISPR gRNA sequence
ggaaagttttgatgtgaggg

SEQ ID NO: 243510 - DNA, 20 bp, Artificial
  CRISPR gRNA sequence
acaggaagatgtttccatct

SEQ ID NO: 243511 - DNA, 20 bp, Artificial
  CRISPR gRNA sequence
cctgtgtgtggtaggacttg

SEQ ID NO: 243512 - DNA, 20 bp, Artificial
  CRISPR gRNA sequence
tatgatgttcacaggaaaaa

SEQ ID NO: 243513 - DNA, 20 bp, Artificial
  CRISPR gRNA sequence
tgttgcaacatcatatcata

SEQ ID NO: 243514 - DNA, 20 bp, Artificial
  CRISPR gRNA sequence
acaaagaatggcaccttatt

SEQ ID NO: 243515 - DNA, 20 bp, Artificial
  CRISPR gRNA sequence
atgatgttgcaacagttata

SEQ ID NO: 243516 - DNA, 20 bp, Artificial
  CRISPR gRNA sequence
tctttttttcctgtgaacat

SEQ ID NO: 243517 - DNA, 20 bp, Artificial
  CRISPR gRNA sequence
ttcctgtgaacatcatagtt

SEQ ID NO: 243518 - DNA, 20 bp, Artificial
  CRISPR gRNA sequence
aactttcttctgaaaaaaac

SEQ ID NO: 243519 - DNA, 20 bp, Artificial
  CRISPR gRNA sequence
ttcttctgaaaaaaacctga

SEQ ID NO: 243520 - DNA, 20 bp, Artificial
  CRISPR gRNA sequence
gcttgtttttagcatttaga

SEQ ID NO: 243521 - DNA, 20 bp, Artificial
  CRISPR gRNA sequence
atgactcacatgccaagttc

SEQ ID NO: 243522 - DNA, 20 bp, Artificial
  CRISPR gRNA sequence
aagttcctgtgtttttcatt

SEQ ID NO: 243523 - DNA, 20 bp, Artificial
  CRISPR gRNA sequence
cctttcttcacagaataaac

SEQ ID NO: 243524 - DNA, 20 bp, Artificial
  CRISPR gRNA sequence
gtggggcatgaccagtctct

SEQ ID NO: 243525 - DNA, 20 bp, Artificial
  CRISPR gRNA sequence
tcactttagaacttacagca

SEQ ID NO: 243526 - DNA, 20 bp, Artificial
  CRISPR gRNA sequence
gaaagacaaaaatattcgca

SEQ ID NO: 243527 - DNA, 20 bp, Artificial
  CRISPR gRNA sequence
aaatggcaccagtatacttc

SEQ ID NO: 243528 - DNA, 20 bp, Artificial
  CRISPR gRNA sequence
gcaccagtatacttcctaag

SEQ ID NO: 243529 - DNA, 20 bp, Artificial
  CRISPR gRNA sequence
caactctccctaaattgacc

SEQ ID NO: 243530 - DNA, 20 bp, Artificial
  CRISPR gRNA sequence
ccaatccaaatcttttcaaa

SEQ ID NO: 243531 - DNA, 20 bp, Artificial
  CRISPR gRNA sequence
ttttcttttttttcctgaga

SEQ ID NO: 243532 - DNA, 20 bp, Artificial
  CRISPR gRNA sequence
ggcctcagcctcccaaatag

SEQ ID NO: 243533 - DNA, 20 bp, Artificial
  CRISPR gRNA sequence
tttgtattttttagtagaga

SEQ ID NO: 243534 - DNA, 20 bp, Artificial
  CRISPR gRNA sequence
cgcgtcggcctcccaaagtg

SEQ ID NO: 243535 - DNA, 20 bp, Artificial
  CRISPR gRNA sequence
ggaaacttgatggatggtag

SEQ ID NO: 243536 - DNA, 20 bp, Artificial
  CRISPR gRNA sequence
tctttatagtattgggcaga

SEQ ID NO: 243537 - DNA, 20 bp, Artificial
  CRISPR gRNA sequence
accaaatcaaatgaagaact

SEQ ID NO: 243538 - DNA, 20 bp, Artificial
  CRISPR gRNA sequence
aacctctgcctcctgggttc

SEQ ID NO: 243539 - DNA, 20 bp, Artificial
  CRISPR gRNA sequence
gcacccgccaccatacccag

SEQ ID NO: 243540 - DNA, 20 bp, Artificial
  CRISPR gRNA sequence
catacccagctaagttttgt

SEQ ID NO: 243541 - DNA, 20 bp, Artificial
  CRISPR gRNA sequence
ttgtacatgtttagtagaga

SEQ ID NO: 243542 - DNA, 20 bp, Artificial
  CRISPR gRNA sequence
cacctcagccccgcaaagtg

SEQ ID NO: 243543 - DNA, 20 bp, Artificial
  CRISPR gRNA sequence
ttttaacacatataactgac

SEQ ID NO: 243544 - DNA, 20 bp, Artificial
  CRISPR gRNA sequence
atcaggacaaacaaccacat

SEQ ID NO: 243545 - DNA, 20 bp, Artificial
  CRISPR gRNA sequence
ggacaaacaaccacatttgg

SEQ ID NO: 243546 - DNA, 20 bp, Artificial
  CRISPR gRNA sequence
aaacaaccacatttgggttt

SEQ ID NO: 243547 - DNA, 20 bp, Artificial
  CRISPR gRNA sequence
gggtttgtttgtttctgaga

SEQ ID NO: 243548 - DNA, 20 bp, Artificial
  CRISPR gRNA sequence
ttttgtattttttgtaaaga

SEQ ID NO: 243549 - DNA, 20 bp, Artificial
  CRISPR gRNA sequence
atgagccactgcacccggcc

SEQ ID NO: 243550 - DNA, 20 bp, Artificial
  CRISPR gRNA sequence
tgagatctcattctataccc

SEQ ID NO: 243551 - DNA, 20 bp, Artificial
  CRISPR gRNA sequence
acttttctgccctattgatg

SEQ ID NO: 243552 - DNA, 20 bp, Artificial
  CRISPR gRNA sequence
tattgatgcctggcttggct

SEQ ID NO: 243553 - DNA, 20 bp, Artificial
  CRISPR gRNA sequence
ataacatgggacagaggcac

SEQ ID NO: 243554 - DNA, 20 bp, Artificial
  CRISPR gRNA sequence
tgggcagatcacctgaggtc

SEQ ID NO: 243555 - DNA, 20 bp, Artificial
  CRISPR gRNA sequence
tgaaactgggaggcggtgat

SEQ ID NO: 243556 - DNA, 20 bp, Artificial
  CRISPR gRNA sequence
gccaaacaatggcaggcatg

SEQ ID NO: 243557 - DNA, 20 bp, Artificial
  CRISPR gRNA sequence
cgggtggatcacttgagccc

SEQ ID NO: 243558 - DNA, 20 bp, Artificial
  CRISPR gRNA sequence
gagtttaaggctaaagtgtg

SEQ ID NO: 243559 - DNA, 20 bp, Artificial
  CRISPR gRNA sequence
aaacaaaggcaaatggtgca

SEQ ID NO: 243560 - DNA, 20 bp, Artificial
  CRISPR gRNA sequence
ggtgcaccaggtttggccat

SEQ ID NO: 243561 - DNA, 20 bp, Artificial
  CRISPR gRNA sequence
ctatcatatgcagttcattt

SEQ ID NO: 243562 - DNA, 20 bp, Artificial
  CRISPR gRNA sequence
taagaatttttagaatgtaa

SEQ ID NO: 243563 - DNA, 20 bp, Artificial
  CRISPR gRNA sequence
tccaaaacttcctccaggcc

SEQ ID NO: 243564 - DNA, 20 bp, Artificial
  CRISPR gRNA sequence
gtcgggtacttactgcacct

SEQ ID NO: 243565 - DNA, 20 bp, Artificial
  CRISPR gRNA sequence
agcaccaaaaaacaaacctg

SEQ ID NO: 243566 - DNA, 20 bp, Artificial
  CRISPR gRNA sequence
aaaaaacaaacctgcattga

SEQ ID NO: 243567 - DNA, 20 bp, Artificial
  CRISPR gRNA sequence
gaatttaaactataattttc

SEQ ID NO: 243568 - DNA, 20 bp, Artificial
  CRISPR gRNA sequence
cctgttaagtggtatctaga

SEQ ID NO: 243569 - DNA, 20 bp, Artificial
  CRISPR gRNA sequence
tgggaggccaaagtgaacct

SEQ ID NO: 243570 - DNA, 20 bp, Artificial
  CRISPR gRNA sequence
ggtattatgtaggatggtgt

SEQ ID NO: 243571 - DNA, 20 bp, Artificial
  CRISPR gRNA sequence
atagcggatgactcatattt

SEQ ID NO: 243572 - DNA, 20 bp, Artificial
  CRISPR gRNA sequence
ctacagccatcttcctcttg

SEQ ID NO: 243573 - DNA, 20 bp, Artificial
  CRISPR gRNA sequence
tcaggaggctgaggcaggac

SEQ ID NO: 243574 - DNA, 20 bp, Artificial
  CRISPR gRNA sequence
aattgcttgaacccaggaga

SEQ ID NO: 243575 - DNA, 20 bp, Artificial
  CRISPR gRNA sequence
gaggtggaggttgcagtgag

SEQ ID NO: 243576 - DNA, 20 bp, Artificial
  CRISPR gRNA sequence
cagcaaggatgaacttcctc

SEQ ID NO: 243577 - DNA, 20 bp, Artificial
  CRISPR gRNA sequence
tcctctagagattatttgaa

SEQ ID NO: 243578 - DNA, 20 bp, Artificial
  CRISPR gRNA sequence
agccatatcccaatcatagc

SEQ ID NO: 243579 - DNA, 20 bp, Artificial
  CRISPR gRNA sequence
tattttcgtcttgagggtta

SEQ ID NO: 243580 - DNA, 20 bp, Artificial
  CRISPR gRNA sequence
gttactgagattcgagatcc

SEQ ID NO: 243581 - DNA, 20 bp, Artificial
  CRISPR gRNA sequence
tggaatgcagtgttatgact

SEQ ID NO: 243582 - DNA, 20 bp, Artificial
  CRISPR gRNA sequence
caggattgtgaaggtatccc

SEQ ID NO: 243583 - DNA, 20 bp, Artificial
  CRISPR gRNA sequence
accgatctgtgcgtgagctg

SEQ ID NO: 243584 - DNA, 20 bp, Artificial
  CRISPR gRNA sequence
tggcaaggcaaaaagtccta

SEQ ID NO: 243585 - DNA, 20 bp, Artificial
  CRISPR gRNA sequence
aaaagtcctaccccgatttc

SEQ ID NO: 243586 - DNA, 20 bp, Artificial
  CRISPR gRNA sequence
caaaatggagatctcttctg

SEQ ID NO: 243587 - DNA, 20 bp, Artificial
  CRISPR gRNA sequence
cttctggaaagattgagatg

SEQ ID NO: 243588 - DNA, 20 bp, Artificial
  CRISPR gRNA sequence
acccaagaaacaacatggca

SEQ ID NO: 243589 - DNA, 20 bp, Artificial
  CRISPR gRNA sequence
agcaagcagatcatctgagg

SEQ ID NO: 243590 - DNA, 20 bp, Artificial
  CRISPR gRNA sequence
tcgggagtctgaggcaggac

SEQ ID NO: 243591 - DNA, 20 bp, Artificial
  CRISPR gRNA sequence
gaggcagaggttgcagagag

SEQ ID NO: 243592 - DNA, 20 bp, Artificial
  CRISPR gRNA sequence
aaaacacataaaaaactaag

SEQ ID NO: 243593 - DNA, 20 bp, Artificial
  CRISPR gRNA sequence
ccaccaggcccggctaattt

SEQ ID NO: 243594 - DNA, 20 bp, Artificial
  CRISPR gRNA sequence
ttttgtgtttttagtagaga

SEQ ID NO: 243595 - DNA, 20 bp, Artificial
  CRISPR gRNA sequence
catctgggcctcccaaagtg

SEQ ID NO: 243596 - DNA, 20 bp, Artificial
  CRISPR gRNA sequence
gcctggacttccaccctcac

SEQ ID NO: 243597 - DNA, 20 bp, Artificial
  CRISPR gRNA sequence
tatgggggccaaggcaggag

SEQ ID NO: 243598 - DNA, 20 bp, Artificial
  CRISPR gRNA sequence
cttgagtccaggagttctag

SEQ ID NO: 243599 - DNA, 20 bp, Artificial
  CRISPR gRNA sequence
tacagtcatacagcgtacaa

SEQ ID NO: 243600 - DNA, 20 bp, Artificial
  CRISPR gRNA sequence
gcatatatgatcgtggtccc

SEQ ID NO: 243601 - DNA, 20 bp, Artificial
  CRISPR gRNA sequence
attgcagcacagctcattgc

SEQ ID NO: 243602 - DNA, 20 bp, Artificial
  CRISPR gRNA sequence
tgacaataaatgactatgtt

SEQ ID NO: 243603 - DNA, 20 bp, Artificial
  CRISPR gRNA sequence
cactttgggaggccaaggca

SEQ ID NO: 243604 - DNA, 20 bp, Artificial
  CRISPR gRNA sequence
caggtggattgcctgagctc

SEQ ID NO: 243605 - DNA, 20 bp, Artificial
  CRISPR gRNA sequence
ataggagatgacagctacat

SEQ ID NO: 243606 - DNA, 20 bp, Artificial
  CRISPR gRNA sequence
gctaataagtgtgttcgtgt

SEQ ID NO: 243607 - DNA, 20 bp, Artificial
  CRISPR gRNA sequence
gtgtcttagtttttcacaaa

SEQ ID NO: 243608 - DNA, 20 bp, Artificial
  CRISPR gRNA sequence
ttaaaaacttttaaatagat

SEQ ID NO: 243609 - DNA, 20 bp, Artificial
  CRISPR gRNA sequence
tatttttgtacagctgtaca

SEQ ID NO: 243610 - DNA, 20 bp, Artificial
  CRISPR gRNA sequence
tgtacagctgtacaatgtgc

SEQ ID NO: 243611 - DNA, 20 bp, Artificial
  CRISPR gRNA sequence
aaagttaaaaaaaatttttt

SEQ ID NO: 243612 - DNA, 20 bp, Artificial
  CRISPR gRNA sequence
cactttgggaggccgaggtg

SEQ ID NO: 243613 - DNA, 20 bp, Artificial
  CRISPR gRNA sequence
tgcctcaaaaaaaaaaaaat

SEQ ID NO: 243614 - DNA, 20 bp, Artificial
  CRISPR gRNA sequence
aacattttaaataaatttag

SEQ ID NO: 243615 - DNA, 20 bp, Artificial
  CRISPR gRNA sequence
tttaggttagcttaagtgta

SEQ ID NO: 243616 - DNA, 20 bp, Artificial
  CRISPR gRNA sequence
caacctttttggcaagaggg

SEQ ID NO: 243617 - DNA, 20 bp, Artificial
  CRISPR gRNA sequence
acggactgggtgggtggggg

SEQ ID NO: 243618 - DNA, 20 bp, Artificial
  CRISPR gRNA sequence
tgggtggggggatggtttca

SEQ ID NO: 243619 - DNA, 20 bp, Artificial
  CRISPR gRNA sequence
atgtagaatcagtgggagcc

SEQ ID NO: 243620 - DNA, 20 bp, Artificial
  CRISPR gRNA sequence
agaatcagtgggagccctga

SEQ ID NO: 243621 - DNA, 20 bp, Artificial
  CRISPR gRNA sequence
acagtgacagatcatcaggt

SEQ ID NO: 243622 - DNA, 20 bp, Artificial
  CRISPR gRNA sequence
cctcgtatgcgcagttcaca

SEQ ID NO: 243623 - DNA, 20 bp, Artificial
  CRISPR gRNA sequence
ggaggggctataaatacaga

SEQ ID NO: 243624 - DNA, 20 bp, Artificial
  CRISPR gRNA sequence
ataaatacagaggaagcttc

SEQ ID NO: 243625 - DNA, 20 bp, Artificial
  CRISPR gRNA sequence
actctcctcctgctgggtgg

SEQ ID NO: 243626 - DNA, 20 bp, Artificial
  CRISPR gRNA sequence
aacctctgcctgtcaggttc

SEQ ID NO: 243627 - DNA, 20 bp, Artificial
  CRISPR gRNA sequence
ttttgtatttttagtagaaa

SEQ ID NO: 243628 - DNA, 20 bp, Artificial
  CRISPR gRNA sequence
caccttggtctcccaaagtg

SEQ ID NO: 243629 - DNA, 20 bp, Artificial
  CRISPR gRNA sequence
ttattttcacggtacctctt

SEQ ID NO: 243630 - DNA, 20 bp, Artificial
  CRISPR gRNA sequence
ggtacctcttctatgtttag

SEQ ID NO: 243631 - DNA, 20 bp, Artificial
  CRISPR gRNA sequence
tcggtacagtcacatgcctg

SEQ ID NO: 243632 - DNA, 20 bp, Artificial
  CRISPR gRNA sequence
tgtatagtaggctgtaccat

SEQ ID NO: 243633 - DNA, 20 bp, Artificial
  CRISPR gRNA sequence
caatttgcccgaaactgata

SEQ ID NO: 243634 - DNA, 20 bp, Artificial
  CRISPR gRNA sequence
caattgttatcagaatccca

SEQ ID NO: 243635 - DNA, 20 bp, Artificial
  CRISPR gRNA sequence
aaggtacaatgaaggatgac

SEQ ID NO: 243636 - DNA, 20 bp, Artificial
  CRISPR gRNA sequence
cactttgggaggccaaggca

SEQ ID NO: 243637 - DNA, 20 bp, Artificial
  CRISPR gRNA sequence
ttgggaggccaaggcaggag

SEQ ID NO: 243638 - DNA, 20 bp, Artificial
  CRISPR gRNA sequence
ctcacactgccctgccacca

SEQ ID NO: 243639 - DNA, 20 bp, Artificial
  CRISPR gRNA sequence
gacaattacccgacaatcat

SEQ ID NO: 243640 - DNA, 20 bp, Artificial
  CRISPR gRNA sequence
tcttttgtctcgtcttttat

SEQ ID NO: 243641 - DNA, 20 bp, Artificial
  CRISPR gRNA sequence
cctgtctcagaaaaaaaaaa

SEQ ID NO: 243642 - DNA, 20 bp, Artificial
  CRISPR gRNA sequence
actggacttcagcaaaatta

SEQ ID NO: 243643 - DNA, 20 bp, Artificial
  CRISPR gRNA sequence
acctgtacataattattcct

SEQ ID NO: 243644 - DNA, 20 bp, Artificial
  CRISPR gRNA sequence
agcaaaatcttaaaaaaagt

SEQ ID NO: 243645 - DNA, 20 bp, Artificial
  CRISPR gRNA sequence
gagccagggaaggccgtgaa

SEQ ID NO: 243646 - DNA, 20 bp, Artificial
  CRISPR gRNA sequence
tgatctttgtagcaaaggat

SEQ ID NO: 243647 - DNA, 20 bp, Artificial
  CRISPR gRNA sequence
aaataacttacataaccctc

SEQ ID NO: 243648 - DNA, 20 bp, Artificial
  CRISPR gRNA sequence
tgcctcagcctcccaagtat

SEQ ID NO: 243649 - DNA, 20 bp, Artificial
  CRISPR gRNA sequence
ttttgtatttttagtagaga

SEQ ID NO: 243650 - DNA, 20 bp, Artificial
  CRISPR gRNA sequence
cgcctcagcctcccaaagcg

SEQ ID NO: 243651 - DNA, 20 bp, Artificial
  CRISPR gRNA sequence
tttagagaggctctctctat

SEQ ID NO: 243652 - DNA, 20 bp, Artificial
  CRISPR gRNA sequence
gaggctctctctatctatga

SEQ ID NO: 243653 - DNA, 20 bp, Artificial
  CRISPR gRNA sequence
gatttagcttgacacatacc

SEQ ID NO: 243654 - DNA, 20 bp, Artificial
  CRISPR gRNA sequence
atctctgtggtgatggatag

SEQ ID NO: 243655 - DNA, 20 bp, Artificial
  CRISPR gRNA sequence
acactgtgccaatgtcaatt

SEQ ID NO: 243656 - DNA, 20 bp, Artificial
  CRISPR gRNA sequence
ttttttttttttttttgaga

SEQ ID NO: 243657 - DNA, 20 bp, Artificial
  CRISPR gRNA sequence
tttttttttttgagacggag

SEQ ID NO: 243658 - DNA, 20 bp, Artificial
  CRISPR gRNA sequence
aacctccacctcccgggttc

SEQ ID NO: 243659 - DNA, 20 bp, Artificial
  CRISPR gRNA sequence
tgtctcagcctcctgagtag

SEQ ID NO: 243660 - DNA, 20 bp, Artificial
  CRISPR gRNA sequence
ttttgtatttttagtagaga

SEQ ID NO: 243661 - DNA, 20 bp, Artificial
  CRISPR gRNA sequence
cgcctcagccccccagaatg

SEQ ID NO: 243662 - DNA, 20 bp, Artificial
  CRISPR gRNA sequence
ccacagcgcccagccagaag

SEQ ID NO: 243663 - DNA, 20 bp, Artificial
  CRISPR gRNA sequence
tgtcctaaaaacttttaaaa

SEQ ID NO: 243664 - DNA, 20 bp, Artificial
  CRISPR gRNA sequence
tgcagagatactcctttaaa

SEQ ID NO: 243665 - DNA, 20 bp, Artificial
  CRISPR gRNA sequence
ttgggaaaccgaggtgggag

SEQ ID NO: 243666 - DNA, 20 bp, Artificial
  CRISPR gRNA sequence
tgggaggatcgcttgagccc

SEQ ID NO: 243667 - DNA, 20 bp, Artificial
  CRISPR gRNA sequence
ctatttagtaggctgaggca

SEQ ID NO: 243668 - DNA, 20 bp, Artificial
  CRISPR gRNA sequence
aacaaaagacaaaactgaaa

SEQ ID NO: 243669 - DNA, 20 bp, Artificial
  CRISPR gRNA sequence
tcaggtttaagtgagaacgc

SEQ ID NO: 243670 - DNA, 20 bp, Artificial
  CRISPR gRNA sequence
ggggtccaatcatttaggaa

SEQ ID NO: 243671 - DNA, 20 bp, Artificial
  CRISPR gRNA sequence
aacaaaaccaagccagaaac

SEQ ID NO: 243672 - DNA, 20 bp, Artificial
  CRISPR gRNA sequence
gaagcaagatacagaaaaca

SEQ ID NO: 243673 - DNA, 20 bp, Artificial
  CRISPR gRNA sequence
tgatctagaaagggcatgcc

SEQ ID NO: 243674 - DNA, 20 bp, Artificial
  CRISPR gRNA sequence
ttaccctggtagagttattt

SEQ ID NO: 243675 - DNA, 20 bp, Artificial
  CRISPR gRNA sequence
cctggtagagttatttgaat

SEQ ID NO: 243676 - DNA, 20 bp, Artificial
  CRISPR gRNA sequence
cacaatgtataaaagttcta

SEQ ID NO: 243677 - DNA, 20 bp, Artificial
  CRISPR gRNA sequence
tcgggagcctgaggcaggag

SEQ ID NO: 243678 - DNA, 20 bp, Artificial
  CRISPR gRNA sequence
aggcacattctggtcttaca

SEQ ID NO: 243679 - DNA, 20 bp, Artificial
  CRISPR gRNA sequence
taatgtccatgaagacaaaa

SEQ ID NO: 243680 - DNA, 20 bp, Artificial
  CRISPR gRNA sequence
tactttttcaaataaatatc

SEQ ID NO: 243681 - DNA, 20 bp, Artificial
  CRISPR gRNA sequence
tgggtctaaactcattttaa

SEQ ID NO: 243682 - DNA, 20 bp, Artificial
  CRISPR gRNA sequence
ccagagggacatagagggaa

SEQ ID NO: 243683 - DNA, 20 bp, Artificial
  CRISPR gRNA sequence
gacatagagggaacatggtt

SEQ ID NO: 243684 - DNA, 20 bp, Artificial
  CRISPR gRNA sequence
cgaggtgtgctcttctatat

SEQ ID NO: 243685 - DNA, 20 bp, Artificial
  CRISPR gRNA sequence
cttgccttgccagagctgta

SEQ ID NO: 243686 - DNA, 20 bp, Artificial
  CRISPR gRNA sequence
atatgattatgttaatctta

SEQ ID NO: 243687 - DNA, 20 bp, Artificial
  CRISPR gRNA sequence
tacgttgtttgaatatatac

SEQ ID NO: 243688 - DNA, 20 bp, Artificial
  CRISPR gRNA sequence
tatacaggagtttctttctg

SEQ ID NO: 243689 - DNA, 20 bp, Artificial
  CRISPR gRNA sequence
ttggcaggatgaggcaggag

SEQ ID NO: 243690 - DNA, 20 bp, Artificial
  CRISPR gRNA sequence
tgggcagatcacctgaggtc

SEQ ID NO: 243691 - DNA, 20 bp, Artificial
  CRISPR gRNA sequence
tcaggaggctgagtcaggag

SEQ ID NO: 243692 - DNA, 20 bp, Artificial
  CRISPR gRNA sequence
gaggtagaggttgcagtgag

SEQ ID NO: 243693 - DNA, 20 bp, Artificial
  CRISPR gRNA sequence
taaaagaaacttaataattg

SEQ ID NO: 243694 - DNA, 20 bp, Artificial
  CRISPR gRNA sequence
gggacctggggaccaggcgt

SEQ ID NO: 243695 - DNA, 20 bp, Artificial
  CRISPR gRNA sequence
cactttgggagcccaaggca

SEQ ID NO: 243696 - DNA, 20 bp, Artificial
  CRISPR gRNA sequence
ttgggagcccaaggcaggag

SEQ ID NO: 243697 - DNA, 20 bp, Artificial
  CRISPR gRNA sequence
caggaggattgcttgagccc

SEQ ID NO: 243698 - DNA, 20 bp, Artificial
  CRISPR gRNA sequence
ctactggggaggctgaggtg

SEQ ID NO: 243699 - DNA, 20 bp, Artificial
  CRISPR gRNA sequence
aatcacttgaacccaggagg

SEQ ID NO: 243700 - DNA, 20 bp, Artificial
  CRISPR gRNA sequence
ggcattgataaagatataga

SEQ ID NO: 243701 - DNA, 20 bp, Artificial
  CRISPR gRNA sequence
ttgggtgaagtgtcctctgg

SEQ ID NO: 243702 - DNA, 20 bp, Artificial
  CRISPR gRNA sequence
aaactgctgggtccctgagg

SEQ ID NO: 243703 - DNA, 20 bp, Artificial
  CRISPR gRNA sequence
cacagactttccatccaaag

SEQ ID NO: 243704 - DNA, 20 bp, Artificial
  CRISPR gRNA sequence
taaataattaacttaggtcc

SEQ ID NO: 243705 - DNA, 20 bp, Artificial
  CRISPR gRNA sequence
ttaacttaggtccagaagat

SEQ ID NO: 243706 - DNA, 20 bp, Artificial
  CRISPR gRNA sequence
cacttgaccatctggctccc

SEQ ID NO: 243707 - DNA, 20 bp, Artificial
  CRISPR gRNA sequence
tctggctccctgcagctttc

SEQ ID NO: 243708 - DNA, 20 bp, Artificial
  CRISPR gRNA sequence
atggcttccttctgttcagt

SEQ ID NO: 243709 - DNA, 20 bp, Artificial
  CRISPR gRNA sequence
agcttagttcagtctgtctt

SEQ ID NO: 243710 - DNA, 20 bp, Artificial
  CRISPR gRNA sequence
tgcctgcttagtctctcacc

SEQ ID NO: 243711 - DNA, 20 bp, Artificial
  CRISPR gRNA sequence
agcactagcatcaggcaaac

SEQ ID NO: 243712 - DNA, 20 bp, Artificial
  CRISPR gRNA sequence
cagggtttgagccctgggtc

SEQ ID NO: 243713 - DNA, 20 bp, Artificial
  CRISPR gRNA sequence
tgggaggatcacttgaaccc

SEQ ID NO: 243714 - DNA, 20 bp, Artificial
  CRISPR gRNA sequence
gaggctgatcacttgaaccc

SEQ ID NO: 243715 - DNA, 20 bp, Artificial
  CRISPR gRNA sequence
aaaaagaaacctccctaagc

SEQ ID NO: 243716 - DNA, 20 bp, Artificial
  CRISPR gRNA sequence
cagttttctcatctgcaaaa

SEQ ID NO: 243717 - DNA, 20 bp, Artificial
  CRISPR gRNA sequence
aggattgtatgtgctgccag

SEQ ID NO: 243718 - DNA, 20 bp, Artificial
  CRISPR gRNA sequence
aatctcttgaacccaggagg

SEQ ID NO: 243719 - DNA, 20 bp, Artificial
  CRISPR gRNA sequence
gtcaatacttttcttgtgaa

SEQ ID NO: 243720 - DNA, 20 bp, Artificial
  CRISPR gRNA sequence
atgacaaaagcagagagata

SEQ ID NO: 243721 - DNA, 20 bp, Artificial
  CRISPR gRNA sequence
aagcagagagataccatgat

SEQ ID NO: 243722 - DNA, 20 bp, Artificial
  CRISPR gRNA sequence
atgtaaaagtaaaataataa

SEQ ID NO: 243723 - DNA, 20 bp, Artificial
  CRISPR gRNA sequence
ttactctgccaatttgcctt

SEQ ID NO: 243724 - DNA, 20 bp, Artificial
  CRISPR gRNA sequence
aatttgccttaaaagtttct

SEQ ID NO: 243725 - DNA, 20 bp, Artificial
  CRISPR gRNA sequence
gtcacattctctcgtatact

SEQ ID NO: 243726 - DNA, 20 bp, Artificial
  CRISPR gRNA sequence
ttggagggtaacgagcaatt

SEQ ID NO: 243727 - DNA, 20 bp, Artificial
  CRISPR gRNA sequence
gccattatgcctggctaatt

SEQ ID NO: 243728 - DNA, 20 bp, Artificial
  CRISPR gRNA sequence
agagacagggtctcacccag

SEQ ID NO: 243729 - DNA, 20 bp, Artificial
  CRISPR gRNA sequence
tgtctcagcctcccaaagtg

SEQ ID NO: 243730 - DNA, 20 bp, Artificial
  CRISPR gRNA sequence
tctacacttgatgggtgcaa

SEQ ID NO: 243731 - DNA, 20 bp, Artificial
  CRISPR gRNA sequence
ttatcttccaaaaaatttaa

SEQ ID NO: 243732 - DNA, 20 bp, Artificial
  CRISPR gRNA sequence
ttgtccagggtcgacagatg

SEQ ID NO: 243733 - DNA, 20 bp, Artificial
  CRISPR gRNA sequence
tgaaacaacaccctaagatg

SEQ ID NO: 243734 - DNA, 20 bp, Artificial
  CRISPR gRNA sequence
ttgtatatgtctggaacatg

SEQ ID NO: 243735 - DNA, 20 bp, Artificial
  CRISPR gRNA sequence
gttctggcaattaacaaatg

SEQ ID NO: 243736 - DNA, 20 bp, Artificial
  CRISPR gRNA sequence
gttactttaaggttctacaa

SEQ ID NO: 243737 - DNA, 20 bp, Artificial
  CRISPR gRNA sequence
ctttaaggttctacaaatct

SEQ ID NO: 243738 - DNA, 20 bp, Artificial
  CRISPR gRNA sequence
tcaaaggatcaagatcaaag

SEQ ID NO: 243739 - DNA, 20 bp, Artificial
  CRISPR gRNA sequence
ctttttttgtcagttcttga

SEQ ID NO: 243740 - DNA, 20 bp, Artificial
  CRISPR gRNA sequence
tatagtgttcccagtaattt

SEQ ID NO: 243741 - DNA, 20 bp, Artificial
  CRISPR gRNA sequence
aaacttctctcttgtcaaat

SEQ ID NO: 243742 - DNA, 20 bp, Artificial
  CRISPR gRNA sequence
gaagaatcagtctttgacac

SEQ ID NO: 243743 - DNA, 20 bp, Artificial
  CRISPR gRNA sequence
gcagttagtaaatgggaaag

SEQ ID NO: 243744 - DNA, 20 bp, Artificial
  CRISPR gRNA sequence
ttggaggacagggactgcaa

SEQ ID NO: 243745 - DNA, 20 bp, Artificial
  CRISPR gRNA sequence
gaaaggcagacaatagtggt

SEQ ID NO: 243746 - DNA, 20 bp, Artificial
  CRISPR gRNA sequence
aatcgtcacccaaggcattc

SEQ ID NO: 243747 - DNA, 20 bp, Artificial
  CRISPR gRNA sequence
attccgaagtttacaataaa

SEQ ID NO: 243748 - DNA, 20 bp, Artificial
  CRISPR gRNA sequence
aataagattataaaagaatg

SEQ ID NO: 243749 - DNA, 20 bp, Artificial
  CRISPR gRNA sequence
tagatgccacagtggtggac

SEQ ID NO: 243750 - DNA, 20 bp, Artificial
  CRISPR gRNA sequence
tgccacagtggtggacatta

SEQ ID NO: 243751 - DNA, 20 bp, Artificial
  CRISPR gRNA sequence
cttcctaaaacaatacattt

SEQ ID NO: 243752 - DNA, 20 bp, Artificial
  CRISPR gRNA sequence
cctgaggtcagcagttcaag

SEQ ID NO: 243753 - DNA, 20 bp, Artificial
  CRISPR gRNA sequence
tcgggaggctgaggcaggag

SEQ ID NO: 243754 - DNA, 20 bp, Artificial
  CRISPR gRNA sequence
tttatctattgaataaaaca

SEQ ID NO: 243755 - DNA, 20 bp, Artificial
  CRISPR gRNA sequence
tgaataaaacaaaatgatta

SEQ ID NO: 243756 - DNA, 20 bp, Artificial
  CRISPR gRNA sequence
actctgttaagccctttact

SEQ ID NO: 243757 - DNA, 20 bp, Artificial
  CRISPR gRNA sequence
agtggctactatgttgtaac

SEQ ID NO: 243758 - DNA, 20 bp, Artificial
  CRISPR gRNA sequence
cacaggtatgatactagcaa

SEQ ID NO: 243759 - DNA, 20 bp, Artificial
  CRISPR gRNA sequence
gataaacatttccaaggaaa

SEQ ID NO: 243760 - DNA, 20 bp, Artificial
  CRISPR gRNA sequence
aattctataagaggataact

SEQ ID NO: 243761 - DNA, 20 bp, Artificial
  CRISPR gRNA sequence
atgcaatattacggaaaagt

SEQ ID NO: 243762 - DNA, 20 bp, Artificial
  CRISPR gRNA sequence
aaaccactaggacaaggcag

SEQ ID NO: 243763 - DNA, 20 bp, Artificial
  CRISPR gRNA sequence
aaggcaggcgtgattaaaca

SEQ ID NO: 243764 - DNA, 20 bp, Artificial
  CRISPR gRNA sequence
gattaaacacacagctttgt

SEQ ID NO: 243765 - DNA, 20 bp, Artificial
  CRISPR gRNA sequence
acagctttgtgccggtttgc

SEQ ID NO: 243766 - DNA, 20 bp, Artificial
  CRISPR gRNA sequence
acacattttcttaaacagag

SEQ ID NO: 243767 - DNA, 20 bp, Artificial
  CRISPR gRNA sequence
cagagacatgttttgagatg

SEQ ID NO: 243768 - DNA, 20 bp, Artificial
  CRISPR gRNA sequence
aactcttcaggctaagttat

SEQ ID NO: 243769 - DNA, 20 bp, Artificial
  CRISPR gRNA sequence
aactttccactccttggtct

SEQ ID NO: 243770 - DNA, 20 bp, Artificial
  CRISPR gRNA sequence
tgcctgataatggcacttca

SEQ ID NO: 243771 - DNA, 20 bp, Artificial
  CRISPR gRNA sequence
tgtcacagatgacgctggga

SEQ ID NO: 243772 - DNA, 20 bp, Artificial
  CRISPR gRNA sequence
gacacatcctgacagtagag

SEQ ID NO: 243773 - DNA, 20 bp, Artificial
  CRISPR gRNA sequence
caggcagggacgggggctct

SEQ ID NO: 243774 - DNA, 20 bp, Artificial
  CRISPR gRNA sequence
ggggtcagcagatatgaaat

SEQ ID NO: 243775 - DNA, 20 bp, Artificial
  CRISPR gRNA sequence
ctggctgagtcaccgcactc

SEQ ID NO: 243776 - DNA, 20 bp, Artificial
  CRISPR gRNA sequence
ggtgggggcactgagaaggg

SEQ ID NO: 243777 - DNA, 20 bp, Artificial
  CRISPR gRNA sequence
aacatcaataacttagcctg

SEQ ID NO: 243778 - DNA, 20 bp, Artificial
  CRISPR gRNA sequence
gcctgaagagtttttcactc

SEQ ID NO: 243779 - DNA, 20 bp, Artificial
  CRISPR gRNA sequence
cttcacatctcaaaacatgt

SEQ ID NO: 243780 - DNA, 20 bp, Artificial
  CRISPR gRNA sequence
gtgttcagctaaagggggaa

SEQ ID NO: 243781 - DNA, 20 bp, Artificial
  CRISPR gRNA sequence
agggggaagagtgattatgt

SEQ ID NO: 243782 - DNA, 20 bp, Artificial
  CRISPR gRNA sequence
ctgaattgtctgatgcccct

SEQ ID NO: 243783 - DNA, 20 bp, Artificial
  CRISPR gRNA sequence
cctgacagattctctttgta

SEQ ID NO: 243784 - DNA, 20 bp, Artificial
  CRISPR gRNA sequence
tggcaaaccggcacaaagct

SEQ ID NO: 243785 - DNA, 20 bp, Artificial
  CRISPR gRNA sequence
aatcacgcctgccttgtcct

SEQ ID NO: 243786 - DNA, 20 bp, Artificial
  CRISPR gRNA sequence
ctcttatagaattgtataag

SEQ ID NO: 243787 - DNA, 20 bp, Artificial
  CRISPR gRNA sequence
gagaaaccacctttccttgg

SEQ ID NO: 243788 - DNA, 20 bp, Artificial
  CRISPR gRNA sequence
gacatttgtgagaccagcta

SEQ ID NO: 243789 - DNA, 20 bp, Artificial
  CRISPR gRNA sequence
ttgattaaaattctcttgga

SEQ ID NO: 243790 - DNA, 20 bp, Artificial
  CRISPR gRNA sequence
tttgctagtatcatacctgt

SEQ ID NO: 243791 - DNA, 20 bp, Artificial
  CRISPR gRNA sequence
atgaaaattcattcatttac

SEQ ID NO: 243792 - DNA, 20 bp, Artificial
  CRISPR gRNA sequence
catctggggataataagaga

SEQ ID NO: 243793 - DNA, 20 bp, Artificial
  CRISPR gRNA sequence
atggctgggaggatcaaatg

SEQ ID NO: 243794 - DNA, 20 bp, Artificial
  CRISPR gRNA sequence
aaggcaagacttcaataaat

SEQ ID NO: 243795 - DNA, 20 bp, Artificial
  CRISPR gRNA sequence
ataaatgttagttttgtgtg

SEQ ID NO: 243796 - DNA, 20 bp, Artificial
  CRISPR gRNA sequence
cagcgagtaagcgcgtagta

SEQ ID NO: 243797 - DNA, 20 bp, Artificial
  CRISPR gRNA sequence
tacatcaatcaagataatca

SEQ ID NO: 243798 - DNA, 20 bp, Artificial
  CRISPR gRNA sequence
tagataaagtattttctttc

SEQ ID NO: 243799 - DNA, 20 bp, Artificial
  CRISPR gRNA sequence
ttgatttatttgttacaata

SEQ ID NO: 243800 - DNA, 20 bp, Artificial
  CRISPR gRNA sequence
tttgttacaatatctggttt

SEQ ID NO: 243801 - DNA, 20 bp, Artificial
  CRISPR gRNA sequence
tttttgttttttttgtgtgt

SEQ ID NO: 243802 - DNA, 20 bp, Artificial
  CRISPR gRNA sequence
tgcctcagcctcccgagtag

SEQ ID NO: 243803 - DNA, 20 bp, Artificial
  CRISPR gRNA sequence
tttttgtatttttagtagag

SEQ ID NO: 243804 - DNA, 20 bp, Artificial
  CRISPR gRNA sequence
ctgctgacctcaggtgatct

SEQ ID NO: 243805 - DNA, 20 bp, Artificial
  CRISPR gRNA sequence
cgcttcggcctcccaaagtg

SEQ ID NO: 243806 - DNA, 20 bp, Artificial
  CRISPR gRNA sequence
gtattttgttatttctaatt

SEQ ID NO: 243807 - DNA, 20 bp, Artificial
  CRISPR gRNA sequence
aaagaataatcttgcaaatg

SEQ ID NO: 243808 - DNA, 20 bp, Artificial
  CRISPR gRNA sequence
aaacttcggaatgccttggg

SEQ ID NO: 243809 - DNA, 20 bp, Artificial
  CRISPR gRNA sequence
attctgtgataataacagga

SEQ ID NO: 243810 - DNA, 20 bp, Artificial
  CRISPR gRNA sequence
tttgcagtccctgtcctcca

SEQ ID NO: 243811 - DNA, 20 bp, Artificial
  CRISPR gRNA sequence
tctagaagatagttgggaag

SEQ ID NO: 243812 - DNA, 20 bp, Artificial
  CRISPR gRNA sequence
tgaaaatctcaagtgtcaaa

SEQ ID NO: 243813 - DNA, 20 bp, Artificial
  CRISPR gRNA sequence
tgacagcaattatttgtgga

SEQ ID NO: 243814 - DNA, 20 bp, Artificial
  CRISPR gRNA sequence
aaacattcatttgacaagag

SEQ ID NO: 243815 - DNA, 20 bp, Artificial
  CRISPR gRNA sequence
taaatgtaaaaatgtcttta

SEQ ID NO: 243816 - DNA, 20 bp, Artificial
  CRISPR gRNA sequence
gaacactataagtagagtga

SEQ ID NO: 243817 - DNA, 20 bp, Artificial
  CRISPR gRNA sequence
atttttactgcagagcataa

SEQ ID NO: 243818 - DNA, 20 bp, Artificial
  CRISPR gRNA sequence
tgcagagcataaattcgctt

SEQ ID NO: 243819 - DNA, 20 bp, Artificial
  CRISPR gRNA sequence
gggggctggggggactttgt

SEQ ID NO: 243820 - DNA, 20 bp, Artificial
  CRISPR gRNA sequence
tgcagagtgtgactgcactc

SEQ ID NO: 243821 - DNA, 20 bp, Artificial
  CRISPR gRNA sequence
gcaggatgcagcatgtgtga

SEQ ID NO: 243822 - DNA, 20 bp, Artificial
  CRISPR gRNA sequence
tcaagaactgacaaaaaaag

SEQ ID NO: 243823 - DNA, 20 bp, Artificial
  CRISPR gRNA sequence
actgacaaaaaaaggtacgt

SEQ ID NO: 243824 - DNA, 20 bp, Artificial
  CRISPR gRNA sequence
tttgcgtttctttgatctag

SEQ ID NO: 243825 - DNA, 20 bp, Artificial
  CRISPR gRNA sequence
agttttgtgacatagacaaa

SEQ ID NO: 243826 - DNA, 20 bp, Artificial
  CRISPR gRNA sequence
tgatcctttgaaaataaaca

SEQ ID NO: 243827 - DNA, 20 bp, Artificial
  CRISPR gRNA sequence
aaaaactagccatcttaggg

SEQ ID NO: 243828 - DNA, 20 bp, Artificial
  CRISPR gRNA sequence
aagaattattgaacaatttg

SEQ ID NO: 243829 - DNA, 20 bp, Artificial
  CRISPR gRNA sequence
gaaaagttacaaaatgatga

SEQ ID NO: 243830 - DNA, 20 bp, Artificial
  CRISPR gRNA sequence
tgaaaatgcttcccttttat

SEQ ID NO: 243831 - DNA, 20 bp, Artificial
  CRISPR gRNA sequence
taatacaaggttgtaaagac

SEQ ID NO: 243832 - DNA, 20 bp, Artificial
  CRISPR gRNA sequence
acaaagtacgtataatttcc

SEQ ID NO: 243833 - DNA, 20 bp, Artificial
  CRISPR gRNA sequence
aagataaggaatgctatcat

SEQ ID NO: 243834 - DNA, 20 bp, Artificial
  CRISPR gRNA sequence
tttgccgctgtctgcctctt

SEQ ID NO: 243835 - DNA, 20 bp, Artificial
  CRISPR gRNA sequence
agtatacgagagaatgtgac

SEQ ID NO: 243836 - DNA, 20 bp, Artificial
  CRISPR gRNA sequence
tggatgggtgctggtccaca

SEQ ID NO: 243837 - DNA, 20 bp, Artificial
  CRISPR gRNA sequence
tttatatgtatttgttcttt

SEQ ID NO: 243838 - DNA, 20 bp, Artificial
  CRISPR gRNA sequence
ttattgtatttcaaaagtgt

SEQ ID NO: 243839 - DNA, 20 bp, Artificial
  CRISPR gRNA sequence
gacttttttgagagaaaata

SEQ ID NO: 243840 - DNA, 20 bp, Artificial
  CRISPR gRNA sequence
aaacaggaatcatggtatct

SEQ ID NO: 243841 - DNA, 20 bp, Artificial
  CRISPR gRNA sequence
agagtggctgacgaatggaa

SEQ ID NO: 243842 - DNA, 20 bp, Artificial
  CRISPR gRNA sequence
gctgaattctgtctttggaa

SEQ ID NO: 243843 - DNA, 20 bp, Artificial
  CRISPR gRNA sequence
aaagtggcttttttaaaaag

SEQ ID NO: 243844 - DNA, 20 bp, Artificial
  CRISPR gRNA sequence
tggcttttttaaaaaggtct

SEQ ID NO: 243845 - DNA, 20 bp, Artificial
  CRISPR gRNA sequence
ttttttaaaaaggtctgttt

SEQ ID NO: 243846 - DNA, 20 bp, Artificial
  CRISPR gRNA sequence
taaaaaggtctgtttgtttg

SEQ ID NO: 243847 - DNA, 20 bp, Artificial
  CRISPR gRNA sequence
aaggtctgtttgtttgtttt

SEQ ID NO: 243848 - DNA, 20 bp, Artificial
  CRISPR gRNA sequence
tctgtttgtttgttttgttt

SEQ ID NO: 243849 - DNA, 20 bp, Artificial
  CRISPR gRNA sequence
tttgtttgttttgtttgttt

SEQ ID NO: 243850 - DNA, 20 bp, Artificial
  CRISPR gRNA sequence
tttgttttgtttgtttgttt

SEQ ID NO: 243851 - DNA, 20 bp, Artificial
  CRISPR gRNA sequence
ttttgtttgtttgtttgttt

SEQ ID NO: 243852 - DNA, 20 bp, Artificial
  CRISPR gRNA sequence
tttgtttgtttgttttgaga

SEQ ID NO: 243853 - DNA, 20 bp, Artificial
  CRISPR gRNA sequence
aaactctgcctcctgggttc

SEQ ID NO: 243854 - DNA, 20 bp, Artificial
  CRISPR gRNA sequence
ctgcctcggcctcctagtag

SEQ ID NO: 243855 - DNA, 20 bp, Artificial
  CRISPR gRNA sequence
tgcacacaaccacgcctggc

SEQ ID NO: 243856 - DNA, 20 bp, Artificial
  CRISPR gRNA sequence
cttttgtatttttagtagag

SEQ ID NO: 243857 - DNA, 20 bp, Artificial
  CRISPR gRNA sequence
cgcactcctgacctcaagtg

SEQ ID NO: 243858 - DNA, 20 bp, Artificial
  CRISPR gRNA sequence
tgccttggcctcccaaagtg

SEQ ID NO: 243859 - DNA, 20 bp, Artificial
  CRISPR gRNA sequence
gccactgtgcccagctggaa

SEQ ID NO: 243860 - DNA, 20 bp, Artificial
  CRISPR gRNA sequence
aagtgagtctgcatggaaaa

SEQ ID NO: 243861 - DNA, 20 bp, Artificial
  CRISPR gRNA sequence
gaactgggctctggaggacg

SEQ ID NO: 243862 - DNA, 20 bp, Artificial
  CRISPR gRNA sequence
agagtgtgtcactgactctc

SEQ ID NO: 243863 - DNA, 20 bp, Artificial
  CRISPR gRNA sequence
aattttgcagatgagaaaac

SEQ ID NO: 243864 - DNA, 20 bp, Artificial
  CRISPR gRNA sequence
atgagaaaactgaggcttag

SEQ ID NO: 243865 - DNA, 20 bp, Artificial
  CRISPR gRNA sequence
ggcatgcaccatcagttaat

SEQ ID NO: 243866 - DNA, 20 bp, Artificial
  CRISPR gRNA sequence
ggcctcagcctaccaaagtg

SEQ ID NO: 243867 - DNA, 20 bp, Artificial
  CRISPR gRNA sequence
gagccaccatgctggggtta

SEQ ID NO: 243868 - DNA, 20 bp, Artificial
  CRISPR gRNA sequence
agcagacccagggctcaaac

SEQ ID NO: 243869 - DNA, 20 bp, Artificial
  CRISPR gRNA sequence
tctgtgccggagatggtcaa

SEQ ID NO: 243870 - DNA, 20 bp, Artificial
  CRISPR gRNA sequence
agggagccagatggtcaagt

SEQ ID NO: 243871 - DNA, 20 bp, Artificial
  CRISPR gRNA sequence
agtttttcaaaatatctttg

SEQ ID NO: 243872 - DNA, 20 bp, Artificial
  CRISPR gRNA sequence
cttcattgggtgaaaaatga

SEQ ID NO: 243873 - DNA, 20 bp, Artificial
  CRISPR gRNA sequence
ctgttctttggatggaaagt

SEQ ID NO: 243874 - DNA, 20 bp, Artificial
  CRISPR gRNA sequence
acgccaaagtgcgtatctta

SEQ ID NO: 243875 - DNA, 20 bp, Artificial
  CRISPR gRNA sequence
agtgcgtatcttatggtgat

SEQ ID NO: 243876 - DNA, 20 bp, Artificial
  CRISPR gRNA sequence
aatcctgccctcagggaccc

SEQ ID NO: 243877 - DNA, 20 bp, Artificial
  CRISPR gRNA sequence
tctttatcaatgccaaggaa

SEQ ID NO: 243878 - DNA, 20 bp, Artificial
  CRISPR gRNA sequence
ttttcttttcttttcttttt

SEQ ID NO: 243879 - DNA, 20 bp, Artificial
  CRISPR gRNA sequence
aatctccacctcctgggttc

SEQ ID NO: 243880 - DNA, 20 bp, Artificial
  CRISPR gRNA sequence
tgcctcagcctcccaagtag

SEQ ID NO: 243881 - DNA, 20 bp, Artificial
  CRISPR gRNA sequence
ttttgtatttttagtagaga

SEQ ID NO: 243882 - DNA, 20 bp, Artificial
  CRISPR gRNA sequence
cacctcggcctcccaaagtg

SEQ ID NO: 243883 - DNA, 20 bp, Artificial
  CRISPR gRNA sequence
ttttcttttttctttctctc

SEQ ID NO: 243884 - DNA, 20 bp, Artificial
  CRISPR gRNA sequence
tctgtgccaggctggagtgc

SEQ ID NO: 243885 - DNA, 20 bp, Artificial
  CRISPR gRNA sequence
tgccttgggctcccaaagtg

SEQ ID NO: 243886 - DNA, 20 bp, Artificial
  CRISPR gRNA sequence
aaggataaactgctcaatta

SEQ ID NO: 243887 - DNA, 20 bp, Artificial
  CRISPR gRNA sequence
aacctctacctcccaggttc

SEQ ID NO: 243888 - DNA, 20 bp, Artificial
  CRISPR gRNA sequence
tgactcagcctcctgagtag

SEQ ID NO: 243889 - DNA, 20 bp, Artificial
  CRISPR gRNA sequence
ttttgtatttttagtagaga

SEQ ID NO: 243890 - DNA, 20 bp, Artificial
  CRISPR gRNA sequence
agtttctccatgttggccag

SEQ ID NO: 243891 - DNA, 20 bp, Artificial
  CRISPR gRNA sequence
caccttggcctcccaaagtg

SEQ ID NO: 243892 - DNA, 20 bp, Artificial
  CRISPR gRNA sequence
tgagccaccgctccctgcca

SEQ ID NO: 243893 - DNA, 20 bp, Artificial
  CRISPR gRNA sequence
tgcctcatcctgccaagtag

SEQ ID NO: 243894 - DNA, 20 bp, Artificial
  CRISPR gRNA sequence
tgcctcggccttccaaagtg

SEQ ID NO: 243895 - DNA, 20 bp, Artificial
  CRISPR gRNA sequence
ccaccatgtctggcctcttt

SEQ ID NO: 243896 - DNA, 20 bp, Artificial
  CRISPR gRNA sequence
ctggcctctttaaaagtttt

SEQ ID NO: 243897 - DNA, 20 bp, Artificial
  CRISPR gRNA sequence
caggttggagatgcccaagg

SEQ ID NO: 243898 - DNA, 20 bp, Artificial
  CRISPR gRNA sequence
gcccaaggctgtgattcttc

SEQ ID NO: 243899 - DNA, 20 bp, Artificial
  CRISPR gRNA sequence
gagtgtcaacacatttctgc

SEQ ID NO: 243900 - DNA, 20 bp, Artificial
  CRISPR gRNA sequence
tgcatgcgtttctccttttg

SEQ ID NO: 243901 - DNA, 20 bp, Artificial
  CRISPR gRNA sequence
tcctgctgttcttcctcacg

SEQ ID NO: 243902 - DNA, 20 bp, Artificial
  CRISPR gRNA sequence
cctgtatatattcaaacaac

SEQ ID NO: 243903 - DNA, 20 bp, Artificial
  CRISPR gRNA sequence
atattacagctctggcaagg

SEQ ID NO: 243904 - DNA, 20 bp, Artificial
  CRISPR gRNA sequence
tttttataatagaaaggaaa

SEQ ID NO: 243905 - DNA, 20 bp, Artificial
  CRISPR gRNA sequence
tcaccgctcggtggtgatgg

SEQ ID NO: 243906 - DNA, 20 bp, Artificial
  CRISPR gRNA sequence
gtcaatagtgctgaggtgga

SEQ ID NO: 243907 - DNA, 20 bp, Artificial
  CRISPR gRNA sequence
cacctcggttctagaaaaat

SEQ ID NO: 243908 - DNA, 20 bp, Artificial
  CRISPR gRNA sequence
agatttaaatatgctgcagc

SEQ ID NO: 243909 - DNA, 20 bp, Artificial
  CRISPR gRNA sequence
tatgtccctctggttgataa

SEQ ID NO: 243910 - DNA, 20 bp, Artificial
  CRISPR gRNA sequence
ggttgataaactggcttaaa

SEQ ID NO: 243911 - DNA, 20 bp, Artificial
  CRISPR gRNA sequence
gaaggcaaggagaacaaaga

SEQ ID NO: 243912 - DNA, 20 bp, Artificial
  CRISPR gRNA sequence
gaacaaagagggagcttgaa

SEQ ID NO: 243913 - DNA, 20 bp, Artificial
  CRISPR gRNA sequence
atgaattattacagcaccag

SEQ ID NO: 243914 - DNA, 20 bp, Artificial
  CRISPR gRNA sequence
aagtatatagatggaaggca

SEQ ID NO: 243915 - DNA, 20 bp, Artificial
  CRISPR gRNA sequence
ggacattaggatgagacata

SEQ ID NO: 243916 - DNA, 20 bp, Artificial
  CRISPR gRNA sequence
aataagagggatataataaa

SEQ ID NO: 243917 - DNA, 20 bp, Artificial
  CRISPR gRNA sequence
aagaccagaatgtgcctatt

SEQ ID NO: 243918 - DNA, 20 bp, Artificial
  CRISPR gRNA sequence
tttttttttcttttttgaga

SEQ ID NO: 243919 - DNA, 20 bp, Artificial
  CRISPR gRNA sequence
ctggagtgcaatggcgtgat

SEQ ID NO: 243920 - DNA, 20 bp, Artificial
  CRISPR gRNA sequence
aacctcctccttccgggttc

SEQ ID NO: 243921 - DNA, 20 bp, Artificial
  CRISPR gRNA sequence
ttttgcatttttagtagaga

SEQ ID NO: 243922 - DNA, 20 bp, Artificial
  CRISPR gRNA sequence
cgcctcagcctcccaaagtg

SEQ ID NO: 243923 - DNA, 20 bp, Artificial
  CRISPR gRNA sequence
tacagaaaaatgcataaatg

SEQ ID NO: 243924 - DNA, 20 bp, Artificial
  CRISPR gRNA sequence
tggtattaacttccttttgc

SEQ ID NO: 243925 - DNA, 20 bp, Artificial
  CRISPR gRNA sequence
gtagttttgctacctaataa

SEQ ID NO: 243926 - DNA, 20 bp, Artificial
  CRISPR gRNA sequence
ctaataacacagttttattg

SEQ ID NO: 243927 - DNA, 20 bp, Artificial
  CRISPR gRNA sequence
acttcatacaaatagaatca

SEQ ID NO: 243928 - DNA, 20 bp, Artificial
  CRISPR gRNA sequence
gaatcacactgttttctgta

SEQ ID NO: 243929 - DNA, 20 bp, Artificial
  CRISPR gRNA sequence
cttctttcaacgttgtatca

SEQ ID NO: 243930 - DNA, 20 bp, Artificial
  CRISPR gRNA sequence
tccatgttgagttcatcttt

SEQ ID NO: 243931 - DNA, 20 bp, Artificial
  CRISPR gRNA sequence
tgatggacagcgggatcatt

SEQ ID NO: 243932 - DNA, 20 bp, Artificial
  CRISPR gRNA sequence
cttggggttattacatgtaa

SEQ ID NO: 243933 - DNA, 20 bp, Artificial
  CRISPR gRNA sequence
gtatctcagcacacgtaaac

SEQ ID NO: 243934 - DNA, 20 bp, Artificial
  CRISPR gRNA sequence
agcacacgtaaacacgtgtt

SEQ ID NO: 243935 - DNA, 20 bp, Artificial
  CRISPR gRNA sequence
acgtaaacacgtgtttctgg

SEQ ID NO: 243936 - DNA, 20 bp, Artificial
  CRISPR gRNA sequence
aacacgtgtttctggcttgg

SEQ ID NO: 243937 - DNA, 20 bp, Artificial
  CRISPR gRNA sequence
tcttggtcgtgaatatgcca

SEQ ID NO: 243938 - DNA, 20 bp, Artificial
  CRISPR gRNA sequence
atatgccaaactgttttcct

SEQ ID NO: 243939 - DNA, 20 bp, Artificial
  CRISPR gRNA sequence
tttacactcccctggcggta

SEQ ID NO: 243940 - DNA, 20 bp, Artificial
  CRISPR gRNA sequence
ccctgataactcttggtatc

SEQ ID NO: 243941 - DNA, 20 bp, Artificial
  CRISPR gRNA sequence
ggtggatagttgtatctcat

SEQ ID NO: 243942 - DNA, 20 bp, Artificial
  CRISPR gRNA sequence
ttttcatgttattttggcta

SEQ ID NO: 243943 - DNA, 20 bp, Artificial
  CRISPR gRNA sequence
agtcttttgagtattttctc

SEQ ID NO: 243944 - DNA, 20 bp, Artificial
  CRISPR gRNA sequence
ccttttcttactaacgtata

SEQ ID NO: 243945 - DNA, 20 bp, Artificial
  CRISPR gRNA sequence
gcaaatatcttttcctattc

SEQ ID NO: 243946 - DNA, 20 bp, Artificial
  CRISPR gRNA sequence
ctttttttgaggtctacacc

SEQ ID NO: 243947 - DNA, 20 bp, Artificial
  CRISPR gRNA sequence
acctctgcgttctcacttaa

SEQ ID NO: 243948 - DNA, 20 bp, Artificial
  CRISPR gRNA sequence
cgttctcacttaaacctgat

SEQ ID NO: 243949 - DNA, 20 bp, Artificial
  CRISPR gRNA sequence
aacctgatttcagttttgtc

SEQ ID NO: 243950 - DNA, 20 bp, Artificial
  CRISPR gRNA sequence
tgtcttttgtttttttgaga

SEQ ID NO: 243951 - DNA, 20 bp, Artificial
  CRISPR gRNA sequence
accacactcagctaattttt

SEQ ID NO: 243952 - DNA, 20 bp, Artificial
  CRISPR gRNA sequence
gctaatttttaattgatttt

SEQ ID NO: 243953 - DNA, 20 bp, Artificial
  CRISPR gRNA sequence
ttttagtgtttttgtagaga

SEQ ID NO: 243954 - DNA, 20 bp, Artificial
  CRISPR gRNA sequence
ggctcaagcgatcctcccac

SEQ ID NO: 243955 - DNA, 20 bp, Artificial
  CRISPR gRNA sequence
tcccaaagtgctggacttaa

SEQ ID NO: 243956 - DNA, 20 bp, Artificial
  CRISPR gRNA sequence
ctgcaacaaagttcgttata

SEQ ID NO: 243957 - DNA, 20 bp, Artificial
  CRISPR gRNA sequence
aaagtatttatgagtaatta

SEQ ID NO: 243958 - DNA, 20 bp, Artificial
  CRISPR gRNA sequence
ggaactgtaatccatttttt

SEQ ID NO: 243959 - DNA, 20 bp, Artificial
  CRISPR gRNA sequence
actccctggtagtctagtgg

SEQ ID NO: 243960 - DNA, 20 bp, Artificial
  CRISPR gRNA sequence
cgctcgccatcacgacccgg

SEQ ID NO: 243961 - DNA, 20 bp, Artificial
  CRISPR gRNA sequence
tcaggaggctgagacaggag

SEQ ID NO: 243962 - DNA, 20 bp, Artificial
  CRISPR gRNA sequence
tctcaaaaaaaaaaaaaaaa

SEQ ID NO: 243963 - DNA, 20 bp, Artificial
  CRISPR gRNA sequence
actttcaattttgacgtaat

SEQ ID NO: 243964 - DNA, 20 bp, Artificial
  CRISPR gRNA sequence
caagacaggaacatctctca

SEQ ID NO: 243965 - DNA, 20 bp, Artificial
  CRISPR gRNA sequence
ttggcacagtgtgcgtgtgt

SEQ ID NO: 243966 - DNA, 20 bp, Artificial
  CRISPR gRNA sequence
tagatagagagagcctctct

SEQ ID NO: 243967 - DNA, 20 bp, Artificial
  CRISPR gRNA sequence
ttcagggatgtaaaggtgat

SEQ ID NO: 243968 - DNA, 20 bp, Artificial
  CRISPR gRNA sequence
gtggctcatgcctataatcc

SEQ ID NO: 243969 - DNA, 20 bp, Artificial
  CRISPR gRNA sequence
cagtagccttggtgcaaggt

SEQ ID NO: 243970 - DNA, 20 bp, Artificial
  CRISPR gRNA sequence
tttctgccatcttttgtgat

SEQ ID NO: 243971 - DNA, 20 bp, Artificial
  CRISPR gRNA sequence
ccttccctggctccatttgt

SEQ ID NO: 243972 - DNA, 20 bp, Artificial
  CRISPR gRNA sequence
ctggctccatttgtcagggt

SEQ ID NO: 243973 - DNA, 20 bp, Artificial
  CRISPR gRNA sequence
ctccatttgtcagggttttt

SEQ ID NO: 243974 - DNA, 20 bp, Artificial
  CRISPR gRNA sequence
atttgtcagggtttttgttt

SEQ ID NO: 243975 - DNA, 20 bp, Artificial
  CRISPR gRNA sequence
gtcagggtttttgtttgttt

SEQ ID NO: 243976 - DNA, 20 bp, Artificial
  CRISPR gRNA sequence
ttttgtttgtttgtttgttt

SEQ ID NO: 243977 - DNA, 20 bp, Artificial
  CRISPR gRNA sequence
tggttttttgttgttattgt

SEQ ID NO: 243978 - DNA, 20 bp, Artificial
  CRISPR gRNA sequence
tttttgttgttattgttgtt

SEQ ID NO: 243979 - DNA, 20 bp, Artificial
  CRISPR gRNA sequence
aacctccgcctcctgggttc

SEQ ID NO: 243980 - DNA, 20 bp, Artificial
  CRISPR gRNA sequence
tgcctcagcctcctgagtag

SEQ ID NO: 243981 - DNA, 20 bp, Artificial
  CRISPR gRNA sequence
atgcccggctatagtagaga

SEQ ID NO: 243982 - DNA, 20 bp, Artificial
  CRISPR gRNA sequence
tgcctcagtctcccaaagtg

SEQ ID NO: 243983 - DNA, 20 bp, Artificial
  CRISPR gRNA sequence
accatgcccggcccatttgt

SEQ ID NO: 243984 - DNA, 20 bp, Artificial
  CRISPR gRNA sequence
ttttgacacaagttactcca

SEQ ID NO: 243985 - DNA, 20 bp, Artificial
  CRISPR gRNA sequence
ttcacaaacgtgaacttttt

SEQ ID NO: 243986 - DNA, 20 bp, Artificial
  CRISPR gRNA sequence
aacgtgaactttttttaaga

SEQ ID NO: 243987 - DNA, 20 bp, Artificial
  CRISPR gRNA sequence
tgatatccatccaagttgct

SEQ ID NO: 243988 - DNA, 20 bp, Artificial
  CRISPR gRNA sequence
ttgctgaatagtattccacg

SEQ ID NO: 243989 - DNA, 20 bp, Artificial
  CRISPR gRNA sequence
attccacgatatgcttgtgc

SEQ ID NO: 243990 - DNA, 20 bp, Artificial
  CRISPR gRNA sequence
cacgatatgcttgtgccaca

SEQ ID NO: 243991 - DNA, 20 bp, Artificial
  CRISPR gRNA sequence
catgcacccattaaaagata

SEQ ID NO: 243992 - DNA, 20 bp, Artificial
  CRISPR gRNA sequence
cacccattaaaagatatttt

SEQ ID NO: 243993 - DNA, 20 bp, Artificial
  CRISPR gRNA sequence
taaaagatattttgtttgct

SEQ ID NO: 243994 - DNA, 20 bp, Artificial
  CRISPR gRNA sequence
gctgcgaggaataattatgt

SEQ ID NO: 243995 - DNA, 20 bp, Artificial
  CRISPR gRNA sequence
aggagtgcaattgctgggct

SEQ ID NO: 243996 - DNA, 20 bp, Artificial
  CRISPR gRNA sequence
caattgctgggctatatgtt

SEQ ID NO: 243997 - DNA, 20 bp, Artificial
  CRISPR gRNA sequence
tgctgggctatatgtttggt

SEQ ID NO: 243998 - DNA, 20 bp, Artificial
  CRISPR gRNA sequence
ggctatatgtttggtgcttg

SEQ ID NO: 243999 - DNA, 20 bp, Artificial
  CRISPR gRNA sequence
gtatcattttacattctcat

SEQ ID NO: 244000 - DNA, 20 bp, Artificial
  CRISPR gRNA sequence
tcatcggagtttctctgcat

SEQ ID NO: 244001 - DNA, 20 bp, Artificial
  CRISPR gRNA sequence
ggtatgtagtgacatctcat

SEQ ID NO: 244002 - DNA, 20 bp, Artificial
  CRISPR gRNA sequence
ttatgggtggacatcttttc

SEQ ID NO: 244003 - DNA, 20 bp, Artificial
  CRISPR gRNA sequence
ggtctttcacctattttcta

SEQ ID NO: 244004 - DNA, 20 bp, Artificial
  CRISPR gRNA sequence
acctattttctagttggatt

SEQ ID NO: 244005 - DNA, 20 bp, Artificial
  CRISPR gRNA sequence
attttctagttggattattt

SEQ ID NO: 244006 - DNA, 20 bp, Artificial
  CRISPR gRNA sequence
attatttgtttgttttactg

SEQ ID NO: 244007 - DNA, 20 bp, Artificial
  CRISPR gRNA sequence
taggagtcctttggcatata

SEQ ID NO: 244008 - DNA, 20 bp, Artificial
  CRISPR gRNA sequence
ataaatattttctcccagtc

SEQ ID NO: 244009 - DNA, 20 bp, Artificial
  CRISPR gRNA sequence
gctatttaattttgctgaag

SEQ ID NO: 244010 - DNA, 20 bp, Artificial
  CRISPR gRNA sequence
aattttgctgaagtccagtt

SEQ ID NO: 244011 - DNA, 20 bp, Artificial
  CRISPR gRNA sequence
cttcactgagtcctgggtct

SEQ ID NO: 244012 - DNA, 20 bp, Artificial
  CRISPR gRNA sequence
agtcctgggtctcaaagatt

SEQ ID NO: 244013 - DNA, 20 bp, Artificial
  CRISPR gRNA sequence
cctctatctcttataacttt

SEQ ID NO: 244014 - DNA, 20 bp, Artificial
  CRISPR gRNA sequence
ttttctatttcatatttaaa

SEQ ID NO: 244015 - DNA, 20 bp, Artificial
  CRISPR gRNA sequence
ttttttttctgagacagggt

SEQ ID NO: 244016 - DNA, 20 bp, Artificial
  CRISPR gRNA sequence
ctggagtgcagtggtgtgat

SEQ ID NO: 244017 - DNA, 20 bp, Artificial
  CRISPR gRNA sequence
gcctctagtggacaagggcc

SEQ ID NO: 244018 - DNA, 20 bp, Artificial
  CRISPR gRNA sequence
aagagatagtgagaaagcgg

SEQ ID NO: 244019 - DNA, 20 bp, Artificial
  CRISPR gRNA sequence
ttgtcgggtaattgtcagtt

SEQ ID NO: 244020 - DNA, 20 bp, Artificial
  CRISPR gRNA sequence
gtaattgtcagttagccgtt

SEQ ID NO: 244021 - DNA, 20 bp, Artificial
  CRISPR gRNA sequence
cgtttggtgtttggttcaca

SEQ ID NO: 244022 - DNA, 20 bp, Artificial
  CRISPR gRNA sequence
gcatcctttgaacaataggt

SEQ ID NO: 244023 - DNA, 20 bp, Artificial
  CRISPR gRNA sequence
ctttttggtggcagggcagt

SEQ ID NO: 244024 - DNA, 20 bp, Artificial
  CRISPR gRNA sequence
tgcattcgtgatgaacactt

SEQ ID NO: 244025 - DNA, 20 bp, Artificial
  CRISPR gRNA sequence
tgttgagttggtcacgtctc

SEQ ID NO: 244026 - DNA, 20 bp, Artificial
  CRISPR gRNA sequence
tgccttggcctcccaaagtg

SEQ ID NO: 244027 - DNA, 20 bp, Artificial
  CRISPR gRNA sequence
acaggtgtgagccactgtgc

SEQ ID NO: 244028 - DNA, 20 bp, Artificial
  CRISPR gRNA sequence
gtgtgagccactgtgcccat

SEQ ID NO: 244029 - DNA, 20 bp, Artificial
  CRISPR gRNA sequence
agccactgtgcccatgcttg

SEQ ID NO: 244030 - DNA, 20 bp, Artificial
  CRISPR gRNA sequence
aatttttcgtataaggtgtg

SEQ ID NO: 244031 - DNA, 20 bp, Artificial
  CRISPR gRNA sequence
taaggtgtgagaggttttag

SEQ ID NO: 244032 - DNA, 20 bp, Artificial
  CRISPR gRNA sequence
gttttagccaagttttttgt

SEQ ID NO: 244033 - DNA, 20 bp, Artificial
  CRISPR gRNA sequence
gctgcaattacgtggggcta

SEQ ID NO: 244034 - DNA, 20 bp, Artificial
  CRISPR gRNA sequence
ctcttctgttccattgatcc

SEQ ID NO: 244035 - DNA, 20 bp, Artificial
  CRISPR gRNA sequence
cttctgccaataccacacag

SEQ ID NO: 244036 - DNA, 20 bp, Artificial
  CRISPR gRNA sequence
actttattatttcatttcaa

SEQ ID NO: 244037 - DNA, 20 bp, Artificial
  CRISPR gRNA sequence
ctatatctacaaaaagccgg

SEQ ID NO: 244038 - DNA, 20 bp, Artificial
  CRISPR gRNA sequence
caattgtgttaaatctgcat

SEQ ID NO: 244039 - DNA, 20 bp, Artificial
  CRISPR gRNA sequence
gttctgagaaatgtgttgtt

SEQ ID NO: 244040 - DNA, 20 bp, Artificial
  CRISPR gRNA sequence
gcctggccaacatggtgaaa

SEQ ID NO: 244041 - DNA, 20 bp, Artificial
  CRISPR gRNA sequence
gagagtggtgggcaagcacg

SEQ ID NO: 244042 - DNA, 20 bp, Artificial
  CRISPR gRNA sequence
cccatcagatcagcagcggc

SEQ ID NO: 244043 - DNA, 20 bp, Artificial
  CRISPR gRNA sequence
gaaaacaagctcagggctcc

SEQ ID NO: 244044 - DNA, 20 bp, Artificial
  CRISPR gRNA sequence
taaagtgcacaataaatgta

SEQ ID NO: 244045 - DNA, 20 bp, Artificial
  CRISPR gRNA sequence
ttcttcaataataaattaac

SEQ ID NO: 244046 - DNA, 20 bp, Artificial
  CRISPR gRNA sequence
agcctgcacctcccaggttc

SEQ ID NO: 244047 - DNA, 20 bp, Artificial
  CRISPR gRNA sequence
gctaatttttgtattagaga

SEQ ID NO: 244048 - DNA, 20 bp, Artificial
  CRISPR gRNA sequence
cacctcggcctcccaaagtg

SEQ ID NO: 244049 - DNA, 20 bp, Artificial
  CRISPR gRNA sequence
ttgactcttttgtaataact

SEQ ID NO: 244050 - DNA, 20 bp, Artificial
  CRISPR gRNA sequence
tctctttatttccttattct

SEQ ID NO: 244051 - DNA, 20 bp, Artificial
  CRISPR gRNA sequence
ctataagcttttatctattt

SEQ ID NO: 244052 - DNA, 20 bp, Artificial
  CRISPR gRNA sequence
tatctatttaaaagttttta

SEQ ID NO: 244053 - DNA, 20 bp, Artificial
  CRISPR gRNA sequence
ctcccaaaggacctgcctga

SEQ ID NO: 244054 - DNA, 20 bp, Artificial
  CRISPR gRNA sequence
ctgaggctgttttacaatta

SEQ ID NO: 244055 - DNA, 20 bp, Artificial
  CRISPR gRNA sequence
ctgttttacaattaactggt

SEQ ID NO: 244056 - DNA, 20 bp, Artificial
  CRISPR gRNA sequence
tttacaattaactggttttt

SEQ ID NO: 244057 - DNA, 20 bp, Artificial
  CRISPR gRNA sequence
caattaactggtttttgttt

SEQ ID NO: 244058 - DNA, 20 bp, Artificial
  CRISPR gRNA sequence
taactggtttttgtttgttt

SEQ ID NO: 244059 - DNA, 20 bp, Artificial
  CRISPR gRNA sequence
tggtttttgtttgtttgttt

SEQ ID NO: 244060 - DNA, 20 bp, Artificial
  CRISPR gRNA sequence
ttttgtttgtttgtttgttt

SEQ ID NO: 244061 - DNA, 20 bp, Artificial
  CRISPR gRNA sequence
tgtttgtttgtttgtttgtt

SEQ ID NO: 244062 - DNA, 20 bp, Artificial
  CRISPR gRNA sequence
aacctctgcctcccgggttc

SEQ ID NO: 244063 - DNA, 20 bp, Artificial
  CRISPR gRNA sequence
tgtctcagcctcccgagtag

SEQ ID NO: 244064 - DNA, 20 bp, Artificial
  CRISPR gRNA sequence
tttttgtactttagtagaga

SEQ ID NO: 244065 - DNA, 20 bp, Artificial
  CRISPR gRNA sequence
tgccttggcctcccaaagtg

SEQ ID NO: 244066 - DNA, 20 bp, Artificial
  CRISPR gRNA sequence
tagtcatttattgtcattgt

SEQ ID NO: 244067 - DNA, 20 bp, Artificial
  CRISPR gRNA sequence
tttacacaactggcagctca

SEQ ID NO: 244068 - DNA, 20 bp, Artificial
  CRISPR gRNA sequence
ggaccacgatcatatatgca

SEQ ID NO: 244069 - DNA, 20 bp, Artificial
  CRISPR gRNA sequence
aatttatttcaccagcattt

SEQ ID NO: 244070 - DNA, 20 bp, Artificial
  CRISPR gRNA sequence
tttcactatacaagttctgt

SEQ ID NO: 244071 - DNA, 20 bp, Artificial
  CRISPR gRNA sequence
acaagttctgtatgtgtttt

SEQ ID NO: 244072 - DNA, 20 bp, Artificial
  CRISPR gRNA sequence
aaattttttagaagtcaggg

SEQ ID NO: 244073 - DNA, 20 bp, Artificial
  CRISPR gRNA sequence
accacccctggctaattttt

SEQ ID NO: 244074 - DNA, 20 bp, Artificial
  CRISPR gRNA sequence
ctgccttggcccccatagta

SEQ ID NO: 244075 - DNA, 20 bp, Artificial
  CRISPR gRNA sequence
tacaggcgtgagcccccaca

SEQ ID NO: 244076 - DNA, 20 bp, Artificial
  CRISPR gRNA sequence
tacggccaggcaggggtgga

SEQ ID NO: 244077 - DNA, 20 bp, Artificial
  CRISPR gRNA sequence
tctctactcagtccttcctg

SEQ ID NO: 244078 - DNA, 20 bp, Artificial
  CRISPR gRNA sequence
tgggcttgcaggcggagcca

SEQ ID NO: 244079 - DNA, 20 bp, Artificial
  CRISPR gRNA sequence
cggagccacggtgttttttg

SEQ ID NO: 244080 - DNA, 20 bp, Artificial
  CRISPR gRNA sequence
gaattgagtggttattgtct

SEQ ID NO: 244081 - DNA, 20 bp, Artificial
  CRISPR gRNA sequence
gatgggcggatcataaggtc

SEQ ID NO: 244082 - DNA, 20 bp, Artificial
  CRISPR gRNA sequence
tcaggagactgaggcaagag

SEQ ID NO: 244083 - DNA, 20 bp, Artificial
  CRISPR gRNA sequence
aaaaaaaaaagaaaaaaaaa

SEQ ID NO: 244084 - DNA, 20 bp, Artificial
  CRISPR gRNA sequence
actagagagtacaagctcct

SEQ ID NO: 244085 - DNA, 20 bp, Artificial
  CRISPR gRNA sequence
caagctcctcttagtttttt

SEQ ID NO: 244086 - DNA, 20 bp, Artificial
  CRISPR gRNA sequence
ctctctgcaacctctgcctc

SEQ ID NO: 244087 - DNA, 20 bp, Artificial
  CRISPR gRNA sequence
tgcctcagactcccgaatag

SEQ ID NO: 244088 - DNA, 20 bp, Artificial
  CRISPR gRNA sequence
ccaccatgcccagctaattt

SEQ ID NO: 244089 - DNA, 20 bp, Artificial
  CRISPR gRNA sequence
ttttgtgtttttagtagaga

SEQ ID NO: 244090 - DNA, 20 bp, Artificial
  CRISPR gRNA sequence
cgaaatcctgacctcagatg

SEQ ID NO: 244091 - DNA, 20 bp, Artificial
  CRISPR gRNA sequence
atcctgacctcagatgatct

SEQ ID NO: 244092 - DNA, 20 bp, Artificial
  CRISPR gRNA sequence
acctcagatgatctgcttgc

SEQ ID NO: 244093 - DNA, 20 bp, Artificial
  CRISPR gRNA sequence
tgctttggcttcccaaagtg

SEQ ID NO: 244094 - DNA, 20 bp, Artificial
  CRISPR gRNA sequence
gtcaccacgcctggcctctt

SEQ ID NO: 244095 - DNA, 20 bp, Artificial
  CRISPR gRNA sequence
acgcctggcctcttcttggt

SEQ ID NO: 244096 - DNA, 20 bp, Artificial
  CRISPR gRNA sequence
tggcctcttcttggtttttg

SEQ ID NO: 244097 - DNA, 20 bp, Artificial
  CRISPR gRNA sequence
cgctattggcatttttagag

SEQ ID NO: 244098 - DNA, 20 bp, Artificial
  CRISPR gRNA sequence
cagaaagaaacccattgcca

SEQ ID NO: 244099 - DNA, 20 bp, Artificial
  CRISPR gRNA sequence
ttcctctctctgcctttctg

SEQ ID NO: 244100 - DNA, 20 bp, Artificial
  CRISPR gRNA sequence
ttggtatttctgaacatctt

SEQ ID NO: 244101 - DNA, 20 bp, Artificial
  CRISPR gRNA sequence
ttgccagtctgtaaataaat

SEQ ID NO: 244102 - DNA, 20 bp, Artificial
  CRISPR gRNA sequence
gtctgtaaataaatatctgc

SEQ ID NO: 244103 - DNA, 20 bp, Artificial
  CRISPR gRNA sequence
ctgctgaattgaaactagag

SEQ ID NO: 244104 - DNA, 20 bp, Artificial
  CRISPR gRNA sequence
ttgggatatggctaatattt

SEQ ID NO: 244105 - DNA, 20 bp, Artificial
  CRISPR gRNA sequence
atggctaatattttatggtt

SEQ ID NO: 244106 - DNA, 20 bp, Artificial
  CRISPR gRNA sequence
atattttatggtttagtgat

SEQ ID NO: 244107 - DNA, 20 bp, Artificial
  CRISPR gRNA sequence
tatggtttagtgattcatgc

SEQ ID NO: 244108 - DNA, 20 bp, Artificial
  CRISPR gRNA sequence
tagtgattcatgcttaagat

SEQ ID NO: 244109 - DNA, 20 bp, Artificial
  CRISPR gRNA sequence
tgctgttacctctcttgtgg

SEQ ID NO: 244110 - DNA, 20 bp, Artificial
  CRISPR gRNA sequence
aacctccacctcccaggttc

SEQ ID NO: 244111 - DNA, 20 bp, Artificial
  CRISPR gRNA sequence
tgcctcagcctcccgagtag

SEQ ID NO: 244112 - DNA, 20 bp, Artificial
  CRISPR gRNA sequence
tttggtatttttagtagaga

SEQ ID NO: 244113 - DNA, 20 bp, Artificial
  CRISPR gRNA sequence
ggcctcagcctcccaaagtg

SEQ ID NO: 244114 - DNA, 20 bp, Artificial
  CRISPR gRNA sequence
ggcatgagccactgcgcccg

SEQ ID NO: 244115 - DNA, 20 bp, Artificial
  CRISPR gRNA sequence
agccactgcgcccggcctgt

SEQ ID NO: 244116 - DNA, 20 bp, Artificial
  CRISPR gRNA sequence
ctgcgcccggcctgtttttg

SEQ ID NO: 244117 - DNA, 20 bp, Artificial
  CRISPR gRNA sequence
cccggcctgtttttgttttg

SEQ ID NO: 244118 - DNA, 20 bp, Artificial
  CRISPR gRNA sequence
cctgtttttgttttgttttg

SEQ ID NO: 244119 - DNA, 20 bp, Artificial
  CRISPR gRNA sequence
ttttgttttgttttgttttg

SEQ ID NO: 244120 - DNA, 20 bp, Artificial
  CRISPR gRNA sequence
ttttgttttgttttgttttg

SEQ ID NO: 244121 - DNA, 20 bp, Artificial
  CRISPR gRNA sequence
ttttgttttgttttgttttg

SEQ ID NO: 244122 - DNA, 20 bp, Artificial
  CRISPR gRNA sequence
ttttgttttgttttgttttg

SEQ ID NO: 244123 - DNA, 20 bp, Artificial
  CRISPR gRNA sequence
ttttgttttgttttttgaga

SEQ ID NO: 244124 - DNA, 20 bp, Artificial
  CRISPR gRNA sequence
tgcctcagcctcctgagtag

SEQ ID NO: 244125 - DNA, 20 bp, Artificial
  CRISPR gRNA sequence
ttttgtatttttagtaggga

SEQ ID NO: 244126 - DNA, 20 bp, Artificial
  CRISPR gRNA sequence
gcatgagccaccacgcctgg

SEQ ID NO: 244127 - DNA, 20 bp, Artificial
  CRISPR gRNA sequence
tttgttaaaattaaagggga

SEQ ID NO: 244128 - DNA, 20 bp, Artificial
  CRISPR gRNA sequence
aaattaaaggggagaatgtt

SEQ ID NO: 244129 - DNA, 20 bp, Artificial
  CRISPR gRNA sequence
atttatggaaaataagtgtt

SEQ ID NO: 244130 - DNA, 20 bp, Artificial
  CRISPR gRNA sequence
aagaggaagatggctgtagc

SEQ ID NO: 244131 - DNA, 20 bp, Artificial
  CRISPR gRNA sequence
aaatatgagtcatccgctat

SEQ ID NO: 244132 - DNA, 20 bp, Artificial
  CRISPR gRNA sequence
aacaccatcctacataatac

SEQ ID NO: 244133 - DNA, 20 bp, Artificial
  CRISPR gRNA sequence
ccaccacacctgactaactt

SEQ ID NO: 244134 - DNA, 20 bp, Artificial
  CRISPR gRNA sequence
acctgactaacttttttgtt

SEQ ID NO: 244135 - DNA, 20 bp, Artificial
  CRISPR gRNA sequence
cactttggcctcccaaagtg

SEQ ID NO: 244136 - DNA, 20 bp, Artificial
  CRISPR gRNA sequence
cattttctagataccactta

SEQ ID NO: 244137 - DNA, 20 bp, Artificial
  CRISPR gRNA sequence
ataccacttaacaggtttga

SEQ ID NO: 244138 - DNA, 20 bp, Artificial
  CRISPR gRNA sequence
ttttgaaatccaaagaaaat

SEQ ID NO: 244139 - DNA, 20 bp, Artificial
  CRISPR gRNA sequence
taattataatcaaaatcaat

SEQ ID NO: 244140 - DNA, 20 bp, Artificial
  CRISPR gRNA sequence
tataatcaaaatcaatgcag

SEQ ID NO: 244141 - DNA, 20 bp, Artificial
  CRISPR gRNA sequence
aggtgcagtaagtacccgac

SEQ ID NO: 244142 - DNA, 20 bp, Artificial
  CRISPR gRNA sequence
ggggagtatgagcagagtgc

SEQ ID NO: 244143 - DNA, 20 bp, Artificial
  CRISPR gRNA sequence
caaaaaacctcaggcctgga

SEQ ID NO: 244144 - DNA, 20 bp, Artificial
  CRISPR gRNA sequence
aaacctggtgcaccatttgc

SEQ ID NO: 244145 - DNA, 20 bp, Artificial
  CRISPR gRNA sequence
ccatttgcctttgtttgtct

SEQ ID NO: 244146 - DNA, 20 bp, Artificial
  CRISPR gRNA sequence
ttgcctttgtttgtctgttg

SEQ ID NO: 244147 - DNA, 20 bp, Artificial
  CRISPR gRNA sequence
cgcctcagtctcccaagtag

SEQ ID NO: 244148 - DNA, 20 bp, Artificial
  CRISPR gRNA sequence
tgcaaacctggcatgcctgc

SEQ ID NO: 244149 - DNA, 20 bp, Artificial
  CRISPR gRNA sequence
acctggcatgcctgccattg

SEQ ID NO: 244150 - DNA, 20 bp, Artificial
  CRISPR gRNA sequence
tgtttggcttatgatctaag

SEQ ID NO: 244151 - DNA, 20 bp, Artificial
  CRISPR gRNA sequence
acaatcttggatcaccgcct

SEQ ID NO: 244152 - DNA, 20 bp, Artificial
  CRISPR gRNA sequence
ttttatatttttagtagaga

SEQ ID NO: 244153 - DNA, 20 bp, Artificial
  CRISPR gRNA sequence
cacctctgcctcccaaagtg

SEQ ID NO: 244154 - DNA, 20 bp, Artificial
  CRISPR gRNA sequence
ttttgtatgacatgcctatt

SEQ ID NO: 244155 - DNA, 20 bp, Artificial
  CRISPR gRNA sequence
ctgtcccatgttattttact

SEQ ID NO: 244156 - DNA, 20 bp, Artificial
  CRISPR gRNA sequence
tctgggatttaggtggaggg

SEQ ID NO: 244157 - DNA, 20 bp, Artificial
  CRISPR gRNA sequence
aatagtctactgcagtacca

SEQ ID NO: 244158 - DNA, 20 bp, Artificial
  CRISPR gRNA sequence
gaatgagatctcactgtggt

SEQ ID NO: 244159 - DNA, 20 bp, Artificial
  CRISPR gRNA sequence
tcactgtggtcttagtttgc

SEQ ID NO: 244160 - DNA, 20 bp, Artificial
  CRISPR gRNA sequence
gtcaaatatttatataccat

SEQ ID NO: 244161 - DNA, 20 bp, Artificial
  CRISPR gRNA sequence
tgtgtttatttttttaaata

SEQ ID NO: 244162 - DNA, 20 bp, Artificial
  CRISPR gRNA sequence
tttttaaataaaatgcttgc

SEQ ID NO: 244163 - DNA, 20 bp, Artificial
  CRISPR gRNA sequence
ttgggaggccaaggtgggca

SEQ ID NO: 244164 - DNA, 20 bp, Artificial
  CRISPR gRNA sequence
aagtcccagctactcagtag

SEQ ID NO: 244165 - DNA, 20 bp, Artificial
  CRISPR gRNA sequence
aaacaaacaaacccaaatgt

SEQ ID NO: 244166 - DNA, 20 bp, Artificial
  CRISPR gRNA sequence
aacccaaatgtggttgtttg

SEQ ID NO: 244167 - DNA, 20 bp, Artificial
  CRISPR gRNA sequence
tccagaggctgtggcagaag

SEQ ID NO: 244168 - DNA, 20 bp, Artificial
  CRISPR gRNA sequence
gaggcagaggttgcagcgag

SEQ ID NO: 244169 - DNA, 20 bp, Artificial
  CRISPR gRNA sequence
atttttatttttagcagagg

SEQ ID NO: 244170 - DNA, 20 bp, Artificial
  CRISPR gRNA sequence
tttagcagaggtgaggtttc

SEQ ID NO: 244171 - DNA, 20 bp, Artificial
  CRISPR gRNA sequence
gacatgagccaccgcgcccc

SEQ ID NO: 244172 - DNA, 20 bp, Artificial
  CRISPR gRNA sequence
taataagcaaaaagttcttc

SEQ ID NO: 244173 - DNA, 20 bp, Artificial
  CRISPR gRNA sequence
tttgatttggttaaatttat

SEQ ID NO: 244174 - DNA, 20 bp, Artificial
  CRISPR gRNA sequence
ttttctgcccaatactataa

SEQ ID NO: 244175 - DNA, 20 bp, Artificial
  CRISPR gRNA sequence
gtttgcccacattttattcc

SEQ ID NO: 244176 - DNA, 20 bp, Artificial
  CRISPR gRNA sequence
cacattttattccaaaagtt

SEQ ID NO: 244177 - DNA, 20 bp, Artificial
  CRISPR gRNA sequence
tgaagtctaatgtatcagga

SEQ ID NO: 244178 - DNA, 20 bp, Artificial
  CRISPR gRNA sequence
gcaatctcacctaccatcca

SEQ ID NO: 244179 - DNA, 20 bp, Artificial
  CRISPR gRNA sequence
aagtttccatagggccatgg

SEQ ID NO: 244180 - DNA, 20 bp, Artificial
  CRISPR gRNA sequence
tatcctgtgccagtatcaca

SEQ ID NO: 244181 - DNA, 20 bp, Artificial
  CRISPR gRNA sequence
tatcacactgtgtttattac

SEQ ID NO: 244182 - DNA, 20 bp, Artificial
  CRISPR gRNA sequence
cggatggatcacctgaggtc

SEQ ID NO: 244183 - DNA, 20 bp, Artificial
  CRISPR gRNA sequence
ttgggaggctgaggccggag

SEQ ID NO: 244184 - DNA, 20 bp, Artificial
  CRISPR gRNA sequence
aattttagaagctgaatttg

SEQ ID NO: 244185 - DNA, 20 bp, Artificial
  CRISPR gRNA sequence
agaagctgaatttgaaaaga

SEQ ID NO: 244186 - DNA, 20 bp, Artificial
  CRISPR gRNA sequence
ttgccaaatagtaggcaaag

SEQ ID NO: 244187 - DNA, 20 bp, Artificial
  CRISPR gRNA sequence
tcatgatgctgtaagttcta

SEQ ID NO: 244188 - DNA, 20 bp, Artificial
  CRISPR gRNA sequence
gttctaaagtgatttctcct

SEQ ID NO: 244189 - DNA, 20 bp, Artificial
  CRISPR gRNA sequence
tcctcttggctttggacaca

SEQ ID NO: 244190 - DNA, 20 bp, Artificial
  CRISPR gRNA sequence
taggttacacaccgaaaatc

SEQ ID NO: 244191 - DNA, 20 bp, Artificial
  CRISPR gRNA sequence
tattctgtgaagaaaggagg

SEQ ID NO: 244192 - DNA, 20 bp, Artificial
  CRISPR gRNA sequence
cagaataaaatgatcccctt

SEQ ID NO: 244193 - DNA, 20 bp, Artificial
  CRISPR gRNA sequence
taatttagaaagttccataa

SEQ ID NO: 244194 - DNA, 20 bp, Artificial
  CRISPR gRNA sequence
atagaaataaatgtaaattt

SEQ ID NO: 244195 - DNA, 20 bp, Artificial
  CRISPR gRNA sequence
tctaaatgctaaaaacaagc

SEQ ID NO: 244196 - DNA, 20 bp, Artificial
  CRISPR gRNA sequence
agctcaggtttttttcagaa

SEQ ID NO: 244197 - DNA, 20 bp, Artificial
  CRISPR gRNA sequence
tggaagatatcactctgacg

SEQ ID NO: 244198 - DNA, 20 bp, Artificial
  CRISPR gRNA sequence
gggcatcttcccccacagga

SEQ ID NO: 244199 - DNA, 20 bp, Artificial
  CRISPR gRNA sequence
acttggagagtgatctttat

SEQ ID NO: 244200 - DNA, 20 bp, Artificial
  CRISPR gRNA sequence
gaaaaaaagaccttatttta

SEQ ID NO: 244201 - DNA, 20 bp, Artificial
  CRISPR gRNA sequence
aggtgccattctttgtaaac

SEQ ID NO: 244202 - DNA, 20 bp, Artificial
  CRISPR gRNA sequence
cactaaaagccaaagtttac

SEQ ID NO: 244203 - DNA, 20 bp, Artificial
  CRISPR gRNA sequence
tcagagtgatatcttccact

SEQ ID NO: 244204 - DNA, 20 bp, Artificial
  CRISPR gRNA sequence
cctgagcttgtttttagcat

SEQ ID NO: 244205 - DNA, 20 bp, Artificial
  CRISPR gRNA sequence
gtgctaatttatttttaatc

SEQ ID NO: 244206 - DNA, 20 bp, Artificial
  CRISPR gRNA sequence
tatagcttttgcacatgata

SEQ ID NO: 244207 - DNA, 20 bp, Artificial
  CRISPR gRNA sequence
aaacatagcctcctttcttc

SEQ ID NO: 244208 - DNA, 20 bp, Artificial
  CRISPR gRNA sequence
ccatgtgtccaaagccaaga

SEQ ID NO: 244209 - DNA, 20 bp, Artificial
  CRISPR gRNA sequence
agaacttacagcatcatgat

SEQ ID NO: 244210 - DNA, 20 bp, Artificial
  CRISPR gRNA sequence
ttgctttgcctactatttgg

SEQ ID NO: 244211 - DNA, 20 bp, Artificial
  CRISPR gRNA sequence
tatattgaataataaagaac

SEQ ID NO: 244212 - DNA, 20 bp, Artificial
  CRISPR gRNA sequence
ctagctaagacacttctgaa

SEQ ID NO: 244213 - DNA, 20 bp, Artificial
  CRISPR gRNA sequence
ggtgagattgcagacccgca

SEQ ID NO: 244214 - DNA, 20 bp, Artificial
  CRISPR gRNA sequence
aaacctctttatagtattgg

SEQ ID NO: 244215 - DNA, 20 bp, Artificial
  CRISPR gRNA sequence
aaaggatttctttagccagg

SEQ ID NO: 244216 - DNA, 20 bp, Artificial
  CRISPR gRNA sequence
aagaaaaaatgttaaccata

SEQ ID NO: 244217 - DNA, 20 bp, Artificial
  CRISPR gRNA sequence
gaagaactttttgcttatta

SEQ ID NO: 244218 - DNA, 20 bp, Artificial
  CRISPR gRNA sequence
ttgcttattaccagaaagac

SEQ ID NO: 244219 - DNA, 20 bp, Artificial
  CRISPR gRNA sequence
aaagaaagacaccattaatt

SEQ ID NO: 244220 - DNA, 20 bp, Artificial
  CRISPR gRNA sequence
ctgggcaacataatgaaacc

SEQ ID NO: 244221 - DNA, 20 bp, Artificial
  CRISPR gRNA sequence
ctgctaaaaataaaaataaa

SEQ ID NO: 244222 - DNA, 20 bp, Artificial
  CRISPR gRNA sequence
atagatagatagatagatag

SEQ ID NO: 244223 - DNA, 20 bp, Artificial
  CRISPR gRNA sequence
aactgaccaaagattattat

SEQ ID NO: 244224 - DNA, 20 bp, Artificial
  CRISPR gRNA sequence
catttgggtttgtttgtttc

SEQ ID NO: 244225 - DNA, 20 bp, Artificial
  CRISPR gRNA sequence
gtactgcagtagactattgt

SEQ ID NO: 244226 - DNA, 20 bp, Artificial
  CRISPR gRNA sequence
tcttctcctcacccctattt

SEQ ID NO: 244227 - DNA, 20 bp, Artificial
  CRISPR gRNA sequence
aggcatgtcatacaaaagtg

SEQ ID NO: 244228 - DNA, 20 bp, Artificial
  CRISPR gRNA sequence
taaaatattatgttaaaagt

SEQ ID NO: 244229 - DNA, 20 bp, Artificial
  CRISPR gRNA sequence
atgttaaaagttaagaattt

SEQ ID NO: 244230 - DNA, 20 bp, Artificial
  CRISPR gRNA sequence
tcaaacctgttaagtggtat

SEQ ID NO: 244231 - DNA, 20 bp, Artificial
  CRISPR gRNA sequence
aaaggccaactcattggcat

SEQ ID NO: 244232 - DNA, 20 bp, Artificial
  CRISPR gRNA sequence
catatttccttgcttctttt

SEQ ID NO: 244233 - DNA, 20 bp, Artificial
  CRISPR gRNA sequence
gctactcgggaggctgaggc

SEQ ID NO: 244234 - DNA, 20 bp, Artificial
  CRISPR gRNA sequence
atgaaaaactggcaagatgt

SEQ ID NO: 244235 - DNA, 20 bp, Artificial
  CRISPR gRNA sequence
tgagtactgctgaaaacctc

SEQ ID NO: 244236 - DNA, 20 bp, Artificial
  CRISPR gRNA sequence
tgggtcaggatctccagacc

SEQ ID NO: 244237 - DNA, 20 bp, Artificial
  CRISPR gRNA sequence
gagtgatgtcagaggaaccc

SEQ ID NO: 244238 - DNA, 20 bp, Artificial
  CRISPR gRNA sequence
atacaagatctaaattagat

SEQ ID NO: 244239 - DNA, 20 bp, Artificial
  CRISPR gRNA sequence
agacatactatgttcctgca

SEQ ID NO: 244240 - DNA, 20 bp, Artificial
  CRISPR gRNA sequence
ctactcgggaggctgagaca

SEQ ID NO: 244241 - DNA, 20 bp, Artificial
  CRISPR gRNA sequence
ttttaaatagataaaagctt

SEQ ID NO: 244242 - DNA, 20 bp, Artificial
  CRISPR gRNA sequence
cttatagaataaggaaataa

SEQ ID NO: 244243 - DNA, 20 bp, Artificial
  CRISPR gRNA sequence
ctacttggggggctgaggca

SEQ ID NO: 244244 - DNA, 20 bp, Artificial
  CRISPR gRNA sequence
gctaaggttaatttattatt

SEQ ID NO: 244245 - DNA, 20 bp, Artificial
  CRISPR gRNA sequence
attatacaactccctgtaat

SEQ ID NO: 244246 - DNA, 20 bp, Artificial
  CRISPR gRNA sequence
caataggattcatgctccta

SEQ ID NO: 244247 - DNA, 20 bp, Artificial
  CRISPR gRNA sequence
ggctaatttttgtattttta

SEQ ID NO: 244248 - DNA, 20 bp, Artificial
  CRISPR gRNA sequence
cagatttaacacaattgtta

SEQ ID NO: 244249 - DNA, 20 bp, Artificial
  CRISPR gRNA sequence
tatgtggaaatgcaaaggaa

SEQ ID NO: 244250 - DNA, 20 bp, Artificial
  CRISPR gRNA sequence
gctgtgtggtattggcagaa

SEQ ID NO: 244251 - DNA, 20 bp, Artificial
  CRISPR gRNA sequence
ggctccttgaagttatctat

SEQ ID NO: 244252 - DNA, 20 bp, Artificial
  CRISPR gRNA sequence
gacaaagcagagaccctgtc

SEQ ID NO: 244253 - DNA, 20 bp, Artificial
  CRISPR gRNA sequence
aatcaagatttaaatatgaa

SEQ ID NO: 244254 - DNA, 20 bp, Artificial
  CRISPR gRNA sequence
tttgagacccaggactcagt

SEQ ID NO: 244255 - DNA, 20 bp, Artificial
  CRISPR gRNA sequence
aaaaggcaagctactgactg

SEQ ID NO: 244256 - DNA, 20 bp, Artificial
  CRISPR gRNA sequence
aaaacaaacaaataatccaa

SEQ ID NO: 244257 - DNA, 20 bp, Artificial
  CRISPR gRNA sequence
caaaatgcaagcaaggatgc

SEQ ID NO: 244258 - DNA, 20 bp, Artificial
  CRISPR gRNA sequence
aggatgcagagaaactccga

SEQ ID NO: 244259 - DNA, 20 bp, Artificial
  CRISPR gRNA sequence
gaatactattcagcaaggaa

SEQ ID NO: 244260 - DNA, 20 bp, Artificial
  CRISPR gRNA sequence
gttcacgtttgtgaaagttg

SEQ ID NO: 244261 - DNA, 20 bp, Artificial
  CRISPR gRNA sequence
aacaactatcacaaaagatg

SEQ ID NO: 244262 - DNA, 20 bp, Artificial
  CRISPR gRNA sequence
gggagaggtagaggacctaa

SEQ ID NO: 244263 - DNA, 20 bp, Artificial
  CRISPR gRNA sequence
tcctgctttgccattgtact

SEQ ID NO: 244264 - DNA, 20 bp, Artificial
  CRISPR gRNA sequence
attgtactggagaatggaac

SEQ ID NO: 244265 - DNA, 20 bp, Artificial
  CRISPR gRNA sequence
gatctgcccgcctcagcccc

SEQ ID NO: 244266 - DNA, 20 bp, Artificial
  CRISPR gRNA sequence
tggaggtgtagacctcaaaa

SEQ ID NO: 244267 - DNA, 20 bp, Artificial
  CRISPR gRNA sequence
aaagaatgaaagagcaaacc

SEQ ID NO: 244268 - DNA, 20 bp, Artificial
  CRISPR gRNA sequence
aaaaacttcctatacgttag

SEQ ID NO: 244269 - DNA, 20 bp, Artificial
  CRISPR gRNA sequence
gaaaaggacagacaatccta

SEQ ID NO: 244270 - DNA, 20 bp, Artificial
  CRISPR gRNA sequence
ggttaaaaaacaaaaccaag

SEQ ID NO: 244271 - DNA, 20 bp, Artificial
  CRISPR gRNA sequence
gatcccgctgtccatcagta

SEQ ID NO: 244272 - DNA, 20 bp, Artificial
  CRISPR gRNA sequence
gttgaaagaagaagcaagat

SEQ ID NO: 244273 - DNA, 20 bp, Artificial
  CRISPR gRNA sequence
tgggcaaagagggctgtgat

SEQ ID NO: 244274 - DNA, 20 bp, Artificial
  CRISPR gRNA sequence
aagaccagcctggccaacat

SEQ ID NO: 244275 - DNA, 20 bp, Artificial
  CRISPR gRNA sequence
tgcctcgggagcctgaggca

SEQ ID NO: 244276 - DNA, 20 bp, Artificial
  CRISPR gRNA sequence
gagtgaaactctgtctcaaa

SEQ ID NO: 244277 - DNA, 20 bp, Artificial
  CRISPR gRNA sequence
aggcacttgctgagtacctt

SEQ ID NO: 244278 - DNA, 20 bp, Artificial
  CRISPR gRNA sequence
gggctatatgaacctcattt

SEQ ID NO: 244279 - DNA, 20 bp, Artificial
  CRISPR gRNA sequence
tttctgccccgtttaacaac

SEQ ID NO: 244280 - DNA, 20 bp, Artificial
  CRISPR gRNA sequence
caacgcagtcgacgtcagcg

SEQ ID NO: 244281 - DNA, 20 bp, Artificial
  CRISPR gRNA sequence
tcctgcaaaacacagcaaaa

SEQ ID NO: 244282 - DNA, 20 bp, Artificial
  CRISPR gRNA sequence
cagcaaaaggagaaacgcat

SEQ ID NO: 244283 - DNA, 20 bp, Artificial
  CRISPR gRNA sequence
tggtaaatttctaagcatga

SEQ ID NO: 244284 - DNA, 20 bp, Artificial
  CRISPR gRNA sequence
aacctgctaatggagtaaac

SEQ ID NO: 244285 - DNA, 20 bp, Artificial
  CRISPR gRNA sequence
ctacttggcaggatgaggca

SEQ ID NO: 244286 - DNA, 20 bp, Artificial
  CRISPR gRNA sequence
gtgagactccatctcaaaaa

SEQ ID NO: 244287 - DNA, 20 bp, Artificial
  CRISPR gRNA sequence
actccatctcaaaaaaaaga

SEQ ID NO: 244288 - DNA, 20 bp, Artificial
  CRISPR gRNA sequence
catctcaaaaaaaagaaaag

SEQ ID NO: 244289 - DNA, 20 bp, Artificial
  CRISPR gRNA sequence
caaaaaaaagaaaagaaaga

SEQ ID NO: 244290 - DNA, 20 bp, Artificial
  CRISPR gRNA sequence
agaaaagaaagaaaagaaaa

SEQ ID NO: 244291 - DNA, 20 bp, Artificial
  CRISPR gRNA sequence
gaaaccagcctggccaacat

SEQ ID NO: 244292 - DNA, 20 bp, Artificial
  CRISPR gRNA sequence
ctactcaggaggctgagtca

SEQ ID NO: 244293 - DNA, 20 bp, Artificial
  CRISPR gRNA sequence
tccacccccccaaaaaaata

SEQ ID NO: 244294 - DNA, 20 bp, Artificial
  CRISPR gRNA sequence
cagtttatcctttctagcac

SEQ ID NO: 244295 - DNA, 20 bp, Artificial
  CRISPR gRNA sequence
ggggaaaaaaaaagcgagag

SEQ ID NO: 244296 - DNA, 20 bp, Artificial
  CRISPR gRNA sequence
aaaaaaaaagcgagagagag

SEQ ID NO: 244297 - DNA, 20 bp, Artificial
  CRISPR gRNA sequence
aagcgagagagagaaagaaa

SEQ ID NO: 244298 - DNA, 20 bp, Artificial
  CRISPR gRNA sequence
agagagagaaagaaaaaaga

SEQ ID NO: 244299 - DNA, 20 bp, Artificial
  CRISPR gRNA sequence
ctacttgggaggctgaggca

SEQ ID NO: 244300 - DNA, 20 bp, Artificial
  CRISPR gRNA sequence
actctcttaaaaacaaaaaa

SEQ ID NO: 244301 - DNA, 20 bp, Artificial
  CRISPR gRNA sequence
cttaaaaacaaaaaaaaaga

SEQ ID NO: 244302 - DNA, 20 bp, Artificial
  CRISPR gRNA sequence
aaacaaaaaaaaagaaaaga

SEQ ID NO: 244303 - DNA, 20 bp, Artificial
  CRISPR gRNA sequence
aaaaaaaagaaaagaaaaga

SEQ ID NO: 244304 - DNA, 20 bp, Artificial
  CRISPR gRNA sequence
actgaataacaaatgcctgg

SEQ ID NO: 244305 - DNA, 20 bp, Artificial
  CRISPR gRNA sequence
tccctgagggcaggattcag

SEQ ID NO: 244306 - DNA, 20 bp, Artificial
  CRISPR gRNA sequence
agccctgggtctgctgcttt

SEQ ID NO: 244307 - DNA, 20 bp, Artificial
  CRISPR gRNA sequence
cagaatgactttgggcaagt

SEQ ID NO: 244308 - DNA, 20 bp, Artificial
  CRISPR gRNA sequence
cccaggagtttgacgctgtc

SEQ ID NO: 244309 - DNA, 20 bp, Artificial
  CRISPR gRNA sequence
ggagtttgacgctgtctcag

SEQ ID NO: 244310 - DNA, 20 bp, Artificial
  CRISPR gRNA sequence
ttgacgctgtctcagaaaga

SEQ ID NO: 244311 - DNA, 20 bp, Artificial
  CRISPR gRNA sequence
tgtctcagaaagaaaagaaa

SEQ ID NO: 244312 - DNA, 20 bp, Artificial
  CRISPR gRNA sequence
gctactaggaggccgaggca

SEQ ID NO: 244313 - DNA, 20 bp, Artificial
  CRISPR gRNA sequence
aaaaaagccactttccaaag

SEQ ID NO: 244314 - DNA, 20 bp, Artificial
  CRISPR gRNA sequence
agacagaattcagctaagtc

SEQ ID NO: 244315 - DNA, 20 bp, Artificial
  CRISPR gRNA sequence
taataaaaatgattttctag

SEQ ID NO: 244316 - DNA, 20 bp, Artificial
  CRISPR gRNA sequence
agcaaaggaatgagaaggaa

SEQ ID NO: 244317 - DNA, 20 bp, Artificial
  CRISPR gRNA sequence
atgttccaggcactatttct

SEQ ID NO: 244318 - DNA, 20 bp, Artificial
  CRISPR gRNA sequence
ttcaaattatttccatttat

SEQ ID NO: 244319 - DNA, 20 bp, Artificial
  CRISPR gRNA sequence
tcacaaaactacactagatc

SEQ ID NO: 244320 - DNA, 20 bp, Artificial
  CRISPR gRNA sequence
atgaatgtttcctctaatat

SEQ ID NO: 244321 - DNA, 20 bp, Artificial
  CRISPR gRNA sequence
cctagacctgctggttggca

SEQ ID NO: 244322 - DNA, 20 bp, Artificial
  CRISPR gRNA sequence
gagagcagttagtaaatggg

SEQ ID NO: 244323 - DNA, 20 bp, Artificial
  CRISPR gRNA sequence
ttcccaactatcttctagaa

SEQ ID NO: 244324 - DNA, 20 bp, Artificial
  CRISPR gRNA sequence
gtcctttgtccacctgcgct

SEQ ID NO: 244325 - DNA, 20 bp, Artificial
  CRISPR gRNA sequence
atctgattcctgttattatc

SEQ ID NO: 244326 - DNA, 20 bp, Artificial
  CRISPR gRNA sequence
ttattatcacagaatgtacc

SEQ ID NO: 244327 - DNA, 20 bp, Artificial
  CRISPR gRNA sequence
tacaataaaataagattata

SEQ ID NO: 244328 - DNA, 20 bp, Artificial
  CRISPR gRNA sequence
agattattctttgtgtaatc

SEQ ID NO: 244329 - DNA, 20 bp, Artificial
  CRISPR gRNA sequence
ttctttgtgtaatcacagaa

SEQ ID NO: 244330 - DNA, 20 bp, Artificial
  CRISPR gRNA sequence
ctactcgggaggctgaggca

SEQ ID NO: 244331 - DNA, 20 bp, Artificial
  CRISPR gRNA sequence
atattgtaacaaataaatca

SEQ ID NO: 244332 - DNA, 20 bp, Artificial
  CRISPR gRNA sequence
tgtaacaaataaatcaacag

SEQ ID NO: 244333 - DNA, 20 bp, Artificial
  CRISPR gRNA sequence
gttctcttattatccccaga

SEQ ID NO: 244334 - DNA, 20 bp, Artificial
  CRISPR gRNA sequence
tactagcaaagctgattcca

SEQ ID NO: 244335 - DNA, 20 bp, Artificial
  CRISPR gRNA sequence
tacggaaaagtagcagattc

SEQ ID NO: 244336 - DNA, 20 bp, Artificial
  CRISPR gRNA sequence
ccatcatgttctgccaaaat

SEQ ID NO: 244337 - DNA, 20 bp, Artificial
  CRISPR gRNA sequence
ctgaaataaactccttacaa

SEQ ID NO: 244338 - DNA, 20 bp, Artificial
  CRISPR gRNA sequence
agagaagttattacatatta

SEQ ID NO: 244339 - DNA, 20 bp, Artificial
  CRISPR gRNA sequence
tacatattaggagaaaaagt

SEQ ID NO: 244340 - DNA, 20 bp, Artificial
  CRISPR gRNA sequence
tctcaaaacatgtctctgtt

SEQ ID NO: 244341 - DNA, 20 bp, Artificial
  CRISPR gRNA sequence
aaaccctgagttatcctctt

SEQ ID NO: 244342 - DNA, 20 bp, Artificial
  CRISPR gRNA sequence
caatatagataattttgaaa

SEQ ID NO: 244343 - DNA, 20 bp, Artificial
  CRISPR gRNA sequence
ttctaattctgtgattacac

SEQ ID NO: 244344 - DNA, 20 bp, Artificial
  CRISPR gRNA sequence
aatgtccaccactgtggcat

SEQ ID NO: 244345 - DNA, 20 bp, Artificial
  CRISPR gRNA sequence
gccatcttagggtgttgttt

SEQ ID NO: 244346 - DNA, 20 bp, Artificial
  CRISPR gRNA sequence
tgctttgggacatttaacga

SEQ ID NO: 244347 - DNA, 20 bp, Artificial
  CRISPR gRNA sequence
tttcctttagtttatggaat

SEQ ID NO: 244348 - DNA, 20 bp, Artificial
  CRISPR gRNA sequence
tttgcacccatcaagtgtag

SEQ ID NO: 244349 - DNA, 20 bp, Artificial
  CRISPR gRNA sequence
aggcaaagtgggcattttct

SEQ ID NO: 244350 - DNA, 20 bp, Artificial
  CRISPR gRNA sequence
tagtgcctggaacatctaga

SEQ ID NO: 244351 - DNA, 20 bp, Artificial
  CRISPR gRNA sequence
agagcagagagcctgtctca

SEQ ID NO: 244352 - DNA, 20 bp, Artificial
  CRISPR gRNA sequence
gcctgtctcaaaagaaagga

SEQ ID NO: 244353 - DNA, 20 bp, Artificial
  CRISPR gRNA sequence
catgtgttcaatgccagccc

SEQ ID NO: 244354 - DNA, 20 bp, Artificial
  CRISPR gRNA sequence
ccagcccctagaatgataca

SEQ ID NO: 244355 - DNA, 20 bp, Artificial
  CRISPR gRNA sequence
taaaaagccaatagtatacg

SEQ ID NO: 244356 - DNA, 20 bp, Artificial
  CRISPR gRNA sequence
tagggttagagagtaaacat

SEQ ID NO: 244357 - DNA, 20 bp, Artificial
  CRISPR gRNA sequence
gagtaatgtggtctgttgac

SEQ ID NO: 244358 - DNA, 20 bp, Artificial
  CRISPR gRNA sequence
ttttccgtttcattttctta

SEQ ID NO: 244359 - DNA, 20 bp, Artificial
  CRISPR gRNA sequence
actggaaagtgacttttttg

SEQ ID NO: 244360 - DNA, 20 bp, Artificial
  CRISPR gRNA sequence
acgaatggaatcatgattca

SEQ ID NO: 244361 - DNA, 20 bp, Artificial
  CRISPR gRNA sequence
tacaatcctaattttgcaga

SEQ ID NO: 244362 - DNA, 20 bp, Artificial
  CRISPR gRNA sequence
cggagatggtcaagtccgat

SEQ ID NO: 244363 - DNA, 20 bp, Artificial
  CRISPR gRNA sequence
aaaaatgacaaagttttaaa

SEQ ID NO: 244364 - DNA, 20 bp, Artificial
  CRISPR gRNA sequence
ggtcccatattttctatgtg

SEQ ID NO: 244365 - DNA, 20 bp, Artificial
  CRISPR gRNA sequence
ggctgtgattcttctcatgc

SEQ ID NO: 244366 - DNA, 20 bp, Artificial
  CRISPR gRNA sequence
tttctctgttgttaaacggg

SEQ ID NO: 244367 - DNA, 20 bp, Artificial
  CRISPR gRNA sequence
tctgttgttaaacggggcag

SEQ ID NO: 244368 - DNA, 20 bp, Artificial
  CRISPR gRNA sequence
gcaaggcaaggctttttata

SEQ ID NO: 244369 - DNA, 20 bp, Artificial
  CRISPR gRNA sequence
atatgattttaaaaaaaatt

SEQ ID NO: 244370 - DNA, 20 bp, Artificial
  CRISPR gRNA sequence
gcacgggacagcctcccagc

SEQ ID NO: 244371 - DNA, 20 bp, Artificial
  CRISPR gRNA sequence
aatgtcaatagtgctgaggt

SEQ ID NO: 244372 - DNA, 20 bp, Artificial
  CRISPR gRNA sequence
tagaagagcacacctcggtt

SEQ ID NO: 244373 - DNA, 20 bp, Artificial
  CRISPR gRNA sequence
gtgtggaggacactggcaaa

SEQ ID NO: 244374 - DNA, 20 bp, Artificial
  CRISPR gRNA sequence
aggacactggcaaagaagaa

SEQ ID NO: 244375 - DNA, 20 bp, Artificial
  CRISPR gRNA sequence
acccaaagcaccatgtaaga

SEQ ID NO: 244376 - DNA, 20 bp, Artificial
  CRISPR gRNA sequence
ttttatacattgtgacctat

SEQ ID NO: 244377 - DNA, 20 bp, Artificial
  CRISPR gRNA sequence
tgcttgtgaacttcatacaa

SEQ ID NO: 244378 - DNA, 20 bp, Artificial
  CRISPR gRNA sequence
gcttggttttgttttttaac

SEQ ID NO: 244379 - DNA, 20 bp, Artificial
  CRISPR gRNA sequence
ctactcaggaggctgagaca

SEQ ID NO: 244380 - DNA, 20 bp, Artificial
  CRISPR gRNA sequence
atttaaggaatatggtataa

SEQ ID NO: 244381 - DNA, 20 bp, Artificial
  CRISPR gRNA sequence
aaaggtgatgcgagttttta

SEQ ID NO: 244382 - DNA, 20 bp, Artificial
  CRISPR gRNA sequence
atacttgggaggctgaggca

SEQ ID NO: 244383 - DNA, 20 bp, Artificial
  CRISPR gRNA sequence
aaaaaaaaaaaaaaaaggaa

SEQ ID NO: 244384 - DNA, 20 bp, Artificial
  CRISPR gRNA sequence
aaaaaaaggaaaaagaaaaa

SEQ ID NO: 244385 - DNA, 20 bp, Artificial
  CRISPR gRNA sequence
ttttatcaggcatgcatgca

SEQ ID NO: 244386 - DNA, 20 bp, Artificial
  CRISPR gRNA sequence
ctcttctcaggctcttccac

SEQ ID NO: 244387 - DNA, 20 bp, Artificial
  CRISPR gRNA sequence
ttcatttatggagtcatgtc

SEQ ID NO: 244388 - DNA, 20 bp, Artificial
  CRISPR gRNA sequence
ttattaggcaaaagagatag

SEQ ID NO: 244389 - DNA, 20 bp, Artificial
  CRISPR gRNA sequence
cttaatgacaggggtagttc

SEQ ID NO: 244390 - DNA, 20 bp, Artificial
  CRISPR gRNA sequence
ccacttgggaggctgaggtg

SEQ ID NO: 244391 - DNA, 20 bp, Artificial
  CRISPR gRNA sequence
ggcaacagagtgagacgcca

SEQ ID NO: 244392 - DNA, 20 bp, Artificial
  CRISPR gRNA sequence
tcgaggttgcacgctcctta

SEQ ID NO: 244393 - DNA, 20 bp, Artificial
  CRISPR gRNA sequence
tatattacaaagtaataata

SEQ ID NO: 244394 - DNA, 20 bp, Artificial
  CRISPR gRNA sequence
gtgttttttgtggtgttttg

SEQ ID NO: 244395 - DNA, 20 bp, Artificial
  CRISPR gRNA sequence
gactccatctcaaaaaaaaa

SEQ ID NO: 244396 - DNA, 20 bp, Artificial
  CRISPR gRNA sequence
cccagtcagagggaaatgag

SEQ ID NO: 244397 - DNA, 20 bp, Artificial
  CRISPR gRNA sequence
gtcagagggaaatgaggcag

SEQ ID NO: 244398 - DNA, 20 bp, Artificial
  CRISPR gRNA sequence
aaatacttcactaacatgta

SEQ ID NO: 244399 - DNA, 20 bp, Artificial
  CRISPR gRNA sequence
ttcatgcttttttagctaat

SEQ ID NO: 244400 - DNA, 20 bp, Artificial
  CRISPR gRNA sequence
ttttagctaatgtagaaaat

SEQ ID NO: 244401 - DNA, 20 bp, Artificial
  CRISPR gRNA sequence
gagtttgttaaaattaaagg

SEQ ID NO: 244402 - DNA, 20 bp, Artificial
  CRISPR gRNA sequence
agctagtttttttgaaatcc

SEQ ID NO: 244403 - DNA, 20 bp, Artificial
  CRISPR gRNA sequence
atgataggtatgaagtacag

SEQ ID NO: 244404 - DNA, 20 bp, Artificial
  CRISPR gRNA sequence
ccaagccaggcatcaatagg

SEQ ID NO: 244405 - DNA, 20 bp, Artificial
  CRISPR gRNA sequence
attttgccaagccagtgggt

SEQ ID NO: 244406 - DNA, 20 bp, Artificial
  CRISPR gRNA sequence
tacacttcagcctgggcaac

SEQ ID NO: 244407 - DNA, 20 bp, Artificial
  CRISPR gRNA sequence
caacagagaaaaaccttttc

SEQ ID NO: 244408 - DNA, 20 bp, Artificial
  CRISPR gRNA sequence
ctgctccagaggctgtggca

SEQ ID NO: 244409 - DNA, 20 bp, Artificial
  CRISPR gRNA sequence
acattttttcttgcctggct

SEQ ID NO: 244410 - DNA, 20 bp, Artificial
  CRISPR gRNA sequence
ctatttgggaggctgaggcc

SEQ ID NO: 244411 - DNA, 20 bp, Artificial
  CRISPR gRNA sequence
aaactctgtctcaggaaaaa

SEQ ID NO: 244412 - DNA, 20 bp, Artificial
  CRISPR gRNA sequence
tagggagagttgataatttt

SEQ ID NO: 244413 - DNA, 20 bp, Artificial
  CRISPR gRNA sequence
tgagtcatctggtgttccaa

SEQ ID NO: 244414 - DNA, 20 bp, Artificial
  CRISPR gRNA sequence
ctactgctgactatccacaa

SEQ ID NO: 244415 - DNA, 20 bp, Artificial
  CRISPR gRNA sequence
aaatccacagtttattctgt

SEQ ID NO: 244416 - DNA, 20 bp, Artificial
  CRISPR gRNA sequence
aataaggaaggaacattgag

SEQ ID NO: 244417 - DNA, 20 bp, Artificial
  CRISPR gRNA sequence
gatccccttctgggtttaat

SEQ ID NO: 244418 - DNA, 20 bp, Artificial
  CRISPR gRNA sequence
aagttccataattaggttta

SEQ ID NO: 244419 - DNA, 20 bp, Artificial
  CRISPR gRNA sequence
acaagctcaggtttttttca

SEQ ID NO: 244420 - DNA, 20 bp, Artificial
  CRISPR gRNA sequence
ctatgatgttcacaggaaaa

SEQ ID NO: 244421 - DNA, 20 bp, Artificial
  CRISPR gRNA sequence
tgttcacaggaaaaaaagaa

SEQ ID NO: 244422 - DNA, 20 bp, Artificial
  CRISPR gRNA sequence
tattagatagtcttttaaat

SEQ ID NO: 244423 - DNA, 20 bp, Artificial
  CRISPR gRNA sequence
tagtcatccgcccctcacat

SEQ ID NO: 244424 - DNA, 20 bp, Artificial
  CRISPR gRNA sequence
ttccactaaagaaaaaaaat

SEQ ID NO: 244425 - DNA, 20 bp, Artificial
  CRISPR gRNA sequence
aattaaaactttcttctgaa

SEQ ID NO: 244426 - DNA, 20 bp, Artificial
  CRISPR gRNA sequence
ccatgttggccaggctgtct

SEQ ID NO: 244427 - DNA, 20 bp, Artificial
  CRISPR gRNA sequence
ttagacttcaagatgaaaga

SEQ ID NO: 244428 - DNA, 20 bp, Artificial
  CRISPR gRNA sequence
tcaagatgaaagacaaaact

SEQ ID NO: 244429 - DNA, 20 bp, Artificial
  CRISPR gRNA sequence
aaaaaatgttaaccatatga

SEQ ID NO: 244430 - DNA, 20 bp, Artificial
  CRISPR gRNA sequence
aaagacaccattaattagag

SEQ ID NO: 244431 - DNA, 20 bp, Artificial
  CRISPR gRNA sequence
acagacacttgaactctttc

SEQ ID NO: 244432 - DNA, 20 bp, Artificial
  CRISPR gRNA sequence
catatgtcatattagcacca

SEQ ID NO: 244433 - DNA, 20 bp, Artificial
  CRISPR gRNA sequence
taattttctttggatttcaa

SEQ ID NO: 244434 - DNA, 20 bp, Artificial
  CRISPR gRNA sequence
aatgccatctttaccaaaca

SEQ ID NO: 244435 - DNA, 20 bp, Artificial
  CRISPR gRNA sequence
gaccagcgtggccaacatag

SEQ ID NO: 244436 - DNA, 20 bp, Artificial
  CRISPR gRNA sequence
aacagcgaaactctgtctca

SEQ ID NO: 244437 - DNA, 20 bp, Artificial
  CRISPR gRNA sequence
cgaaactctgtctcaaaaaa

SEQ ID NO: 244438 - DNA, 20 bp, Artificial
  CRISPR gRNA sequence
ctctgtctcaaaaaacaaaa

SEQ ID NO: 244439 - DNA, 20 bp, Artificial
  CRISPR gRNA sequence
tctcaaaaaacaaaacaaaa

SEQ ID NO: 244440 - DNA, 20 bp, Artificial
  CRISPR gRNA sequence
aaaaacaaaacaaaacaaaa

SEQ ID NO: 244441 - DNA, 20 bp, Artificial
  CRISPR gRNA sequence
caaaacaaaacaaaacaaaa

SEQ ID NO: 244442 - DNA, 20 bp, Artificial
  CRISPR gRNA sequence
caaaacaaaacaaaacaaaa

SEQ ID NO: 244443 - DNA, 20 bp, Artificial
  CRISPR gRNA sequence
caaaacaaaacaaaacaaaa

SEQ ID NO: 244444 - DNA, 20 bp, Artificial
  CRISPR gRNA sequence
aaaacaaaacaaaacaaaac

SEQ ID NO: 244445 - DNA, 20 bp, Artificial
  CRISPR gRNA sequence
accatctcctagaacttatg

SEQ ID NO: 244446 - DNA, 20 bp, Artificial
  CRISPR gRNA sequence
ttgtcctgctgagtactgct

SEQ ID NO: 244447 - DNA, 20 bp, Artificial
  CRISPR gRNA sequence
aaaaatgccaatagcgtgga

SEQ ID NO: 244448 - DNA, 20 bp, Artificial
  CRISPR gRNA sequence
tagcgtggacaaaacaaagc

SEQ ID NO: 244449 - DNA, 20 bp, Artificial
  CRISPR gRNA sequence
ggcgaaaccctgtctctact

SEQ ID NO: 244450 - DNA, 20 bp, Artificial
  CRISPR gRNA sequence
agagcaagactccatctcaa

SEQ ID NO: 244451 - DNA, 20 bp, Artificial
  CRISPR gRNA sequence
ccatctcaaaaaaacacata

SEQ ID NO: 244452 - DNA, 20 bp, Artificial
  CRISPR gRNA sequence
tgagccaccacacctggtcc

SEQ ID NO: 244453 - DNA, 20 bp, Artificial
  CRISPR gRNA sequence
caataaccactcaattctaa

SEQ ID NO: 244454 - DNA, 20 bp, Artificial
  CRISPR gRNA sequence
aattctaacaaaacaccaca

SEQ ID NO: 244455 - DNA, 20 bp, Artificial
  CRISPR gRNA sequence
agagcaagaccctgtctcta

SEQ ID NO: 244456 - DNA, 20 bp, Artificial
  CRISPR gRNA sequence
ttacttaggcctaaatctaa

SEQ ID NO: 244457 - DNA, 20 bp, Artificial
  CRISPR gRNA sequence
acatacagaacttgtatagt

SEQ ID NO: 244458 - DNA, 20 bp, Artificial
  CRISPR gRNA sequence
cgtacaacaacgttttggtc

SEQ ID NO: 244459 - DNA, 20 bp, Artificial
  CRISPR gRNA sequence
tttgtggtgatactgatgta

SEQ ID NO: 244460 - DNA, 20 bp, Artificial
  CRISPR gRNA sequence
agcaagactcctctcaaaca

SEQ ID NO: 244461 - DNA, 20 bp, Artificial
  CRISPR gRNA sequence
aaacaaacaaacaaacaaac

SEQ ID NO: 244462 - DNA, 20 bp, Artificial
  CRISPR gRNA sequence
aaacaaaaaccagttaattg

SEQ ID NO: 244463 - DNA, 20 bp, Artificial
  CRISPR gRNA sequence
taaaaagtaaaaagcaattt

SEQ ID NO: 244464 - DNA, 20 bp, Artificial
  CRISPR gRNA sequence
tgcaaaggaactagaataga

SEQ ID NO: 244465 - DNA, 20 bp, Artificial
  CRISPR gRNA sequence
gacgtccatagtccaacaac

SEQ ID NO: 244466 - DNA, 20 bp, Artificial
  CRISPR gRNA sequence
caacaacaaaaacaacaaca

SEQ ID NO: 244467 - DNA, 20 bp, Artificial
  CRISPR gRNA sequence
acaacaacaaaaaacttggc

SEQ ID NO: 244468 - DNA, 20 bp, Artificial
  CRISPR gRNA sequence
cacaccttatacgaaaaatt

SEQ ID NO: 244469 - DNA, 20 bp, Artificial
  CRISPR gRNA sequence
caagatttaaatatgaaata

SEQ ID NO: 244470 - DNA, 20 bp, Artificial
  CRISPR gRNA sequence
ataagagatagaggaaaaaa

SEQ ID NO: 244471 - DNA, 20 bp, Artificial
  CRISPR gRNA sequence
gaactcttgaatctcaacag

SEQ ID NO: 244472 - DNA, 20 bp, Artificial
  CRISPR gRNA sequence
aaatagttcgacaacttctt

SEQ ID NO: 244473 - DNA, 20 bp, Artificial
  CRISPR gRNA sequence
tacaaaaatacatgtccaca

SEQ ID NO: 244474 - DNA, 20 bp, Artificial
  CRISPR gRNA sequence
gcagctttatatgtaatagt

SEQ ID NO: 244475 - DNA, 20 bp, Artificial
  CRISPR gRNA sequence
atcttttaatgggtgcatgg

SEQ ID NO: 244476 - DNA, 20 bp, Artificial
  CRISPR gRNA sequence
caaaatggagtaacttgtgt

SEQ ID NO: 244477 - DNA, 20 bp, Artificial
  CRISPR gRNA sequence
gaccagcctggccaacgtgg

SEQ ID NO: 244478 - DNA, 20 bp, Artificial
  CRISPR gRNA sequence
acacagggagatcctgtctc

SEQ ID NO: 244479 - DNA, 20 bp, Artificial
  CRISPR gRNA sequence
aaacaacaacaataacaaca

SEQ ID NO: 244480 - DNA, 20 bp, Artificial
  CRISPR gRNA sequence
acaataacaacaaaaaacca

SEQ ID NO: 244481 - DNA, 20 bp, Artificial
  CRISPR gRNA sequence
caaaaaacaaacaaacaaac

SEQ ID NO: 244482 - DNA, 20 bp, Artificial
  CRISPR gRNA sequence
cttatgcatgcatgcctgat

SEQ ID NO: 244483 - DNA, 20 bp, Artificial
  CRISPR gRNA sequence
cgcccctcattttttctttt

SEQ ID NO: 244484 - DNA, 20 bp, Artificial
  CRISPR gRNA sequence
gaaagttcttttgaacgacc

SEQ ID NO: 244485 - DNA, 20 bp, Artificial
  CRISPR gRNA sequence
agactaccagggagtgtcct

SEQ ID NO: 244486 - DNA, 20 bp, Artificial
  CRISPR gRNA sequence
ccgtgaatcccagtctctac

SEQ ID NO: 244487 - DNA, 20 bp, Artificial
  CRISPR gRNA sequence
acagtgaaactctgtctcaa

SEQ ID NO: 244488 - DNA, 20 bp, Artificial
  CRISPR gRNA sequence
tgtctcaaaaaaacaaaaga

SEQ ID NO: 244489 - DNA, 20 bp, Artificial
  CRISPR gRNA sequence
cagctcatgaacagcagact

SEQ ID NO: 244490 - DNA, 20 bp, Artificial
  CRISPR gRNA sequence
agcaaccaggaagtgtaagt

SEQ ID NO: 244491 - DNA, 20 bp, Artificial
  CRISPR gRNA sequence
aatggggtccaatcatttag

SEQ ID NO: 244492 - DNA, 20 bp, Artificial
  CRISPR gRNA sequence
gcaacgttatttctaggtta

SEQ ID NO: 244493 - DNA, 20 bp, Artificial
  CRISPR gRNA sequence
gttatttctaggttaaaaaa

SEQ ID NO: 244494 - DNA, 20 bp, Artificial
  CRISPR gRNA sequence
gaaagaagaagcaagataca

SEQ ID NO: 244495 - DNA, 20 bp, Artificial
  CRISPR gRNA sequence
gaagttcacaagcagcccaa

SEQ ID NO: 244496 - DNA, 20 bp, Artificial
  CRISPR gRNA sequence
aaaactgtgttattaggtag

SEQ ID NO: 244497 - DNA, 20 bp, Artificial
  CRISPR gRNA sequence
tcctaatgtccatgaagaca

SEQ ID NO: 244498 - DNA, 20 bp, Artificial
  CRISPR gRNA sequence
gatctgcggagagtgtcctg

SEQ ID NO: 244499 - DNA, 20 bp, Artificial
  CRISPR gRNA sequence
ctgctaatggagtaaactta

SEQ ID NO: 244500 - DNA, 20 bp, Artificial
  CRISPR gRNA sequence
acagagcaagacactctctt

SEQ ID NO: 244501 - DNA, 20 bp, Artificial
  CRISPR gRNA sequence
gaataacaaatgcctgggaa

SEQ ID NO: 244502 - DNA, 20 bp, Artificial
  CRISPR gRNA sequence
aggtccagaagattctggtt

SEQ ID NO: 244503 - DNA, 20 bp, Artificial
  CRISPR gRNA sequence
agcgatgcaaagatattttg

SEQ ID NO: 244504 - DNA, 20 bp, Artificial
  CRISPR gRNA sequence
agaagagcgaaactccatct

SEQ ID NO: 244505 - DNA, 20 bp, Artificial
  CRISPR gRNA sequence
caaacaaacaaacaaacaaa

SEQ ID NO: 244506 - DNA, 20 bp, Artificial
  CRISPR gRNA sequence
agataccatgattcctgttt

SEQ ID NO: 244507 - DNA, 20 bp, Artificial
  CRISPR gRNA sequence
cagtgtaagttctggttcca

SEQ ID NO: 244508 - DNA, 20 bp, Artificial
  CRISPR gRNA sequence
agctaagtttgtctatgtca

SEQ ID NO: 244509 - DNA, 20 bp, Artificial
  CRISPR gRNA sequence
gaacactccttcctggtcct

SEQ ID NO: 244510 - DNA, 20 bp, Artificial
  CRISPR gRNA sequence
atttttacatttaggtaagt

SEQ ID NO: 244511 - DNA, 20 bp, Artificial
  CRISPR gRNA sequence
cattagtttgattgacttcc

SEQ ID NO: 244512 - DNA, 20 bp, Artificial
  CRISPR gRNA sequence
tgtgtctcaaaaaaaaaaaa

SEQ ID NO: 244513 - DNA, 20 bp, Artificial
  CRISPR gRNA sequence
aaaaaacatacacacacaaa

SEQ ID NO: 244514 - DNA, 20 bp, Artificial
  CRISPR gRNA sequence
tacacacacaaaaaaaacaa

SEQ ID NO: 244515 - DNA, 20 bp, Artificial
  CRISPR gRNA sequence
aaaatactttatctattgaa

SEQ ID NO: 244516 - DNA, 20 bp, Artificial
  CRISPR gRNA sequence
ggagcacaaagccctacaca

SEQ ID NO: 244517 - DNA, 20 bp, Artificial
  CRISPR gRNA sequence
tgatcctcccagccatccta

SEQ ID NO: 244518 - DNA, 20 bp, Artificial
  CRISPR gRNA sequence
atgtgaagtttgtatggtaa

SEQ ID NO: 244519 - DNA, 20 bp, Artificial
  CRISPR gRNA sequence
ggtaacaaaactaaggagtg

SEQ ID NO: 244520 - DNA, 20 bp, Artificial
  CRISPR gRNA sequence
tgtgtcacagatgacgctgg

SEQ ID NO: 244521 - DNA, 20 bp, Artificial
  CRISPR gRNA sequence
accatacaaacttcacatct

SEQ ID NO: 244522 - DNA, 20 bp, Artificial
  CRISPR gRNA sequence
tgcatcattaattgttcctg

SEQ ID NO: 244523 - DNA, 20 bp, Artificial
  CRISPR gRNA sequence
gtccaccactgtggcatcta

SEQ ID NO: 244524 - DNA, 20 bp, Artificial
  CRISPR gRNA sequence
actttatgtacaattaaaat

SEQ ID NO: 244525 - DNA, 20 bp, Artificial
  CRISPR gRNA sequence
actccttgagcccaggagtt

SEQ ID NO: 244526 - DNA, 20 bp, Artificial
  CRISPR gRNA sequence
aatcctaattttgcagatga

SEQ ID NO: 244527 - DNA, 20 bp, Artificial
  CRISPR gRNA sequence
acactggcaaagaagaatca

SEQ ID NO: 244528 - DNA, 20 bp, Artificial
  CRISPR gRNA sequence
aaaggaaaaagaaaaaaaag

SEQ ID NO: 244529 - DNA, 20 bp, Artificial
  CRISPR gRNA sequence
ttgctctagcaccactagtg

SEQ ID NO: 244530 - DNA, 20 bp, Artificial
  CRISPR gRNA sequence
atgggactgtctagttgtag

SEQ ID NO: 244531 - DNA, 20 bp, Artificial
  CRISPR gRNA sequence
cgtggaaaaattgtcttcca

SEQ ID NO: 244532 - DNA, 20 bp, Artificial
  CRISPR gRNA sequence
ttttgtaataactcttagct

SEQ ID NO: 244533 - DNA, 20 bp, Artificial
  CRISPR gRNA sequence
ctttttaaactttttttgtg

SEQ ID NO: 244534 - DNA, 20 bp, Artificial
  CRISPR gRNA sequence
cactggaagatctttggggc

SEQ ID NO: 244535 - DNA, 20 bp, Artificial
  CRISPR gRNA sequence
atatgcagtctgtttttgac

SEQ ID NO: 244536 - DNA, 20 bp, Artificial
  CRISPR gRNA sequence
ggtgaaaccccatctctact

SEQ ID NO: 244537 - DNA, 20 bp, Artificial
  CRISPR gRNA sequence
tactcagcaggacaaatacg

SEQ ID NO: 244538 - DNA, 20 bp, Artificial
  CRISPR gRNA sequence
tgagtttagggtcaaggaca

SEQ ID NO: 244539 - DNA, 20 bp, Artificial
  CRISPR gRNA sequence
gcttttttgcccatttgcaa

SEQ ID NO: 244540 - DNA, 20 bp, Artificial
  CRISPR gRNA sequence
cttcagcctgggcaacagag

SEQ ID NO: 244541 - DNA, 20 bp, Artificial
  CRISPR gRNA sequence
ccatctctactaaacatgta

SEQ ID NO: 244542 - DNA, 20 bp, Artificial
  CRISPR gRNA sequence
atgtgcaaaagctataaatg

SEQ ID NO: 244543 - DNA, 20 bp, Artificial
  CRISPR gRNA sequence
taaatcattttctaaatgct

SEQ ID NO: 244544 - DNA, 20 bp, Artificial
  CRISPR gRNA sequence
ttatttaaaagactatctaa

SEQ ID NO: 244545 - DNA, 20 bp, Artificial
  CRISPR gRNA sequence
aaagactatctaataaaaca

SEQ ID NO: 244546 - DNA, 20 bp, Artificial
  CRISPR gRNA sequence
aaagccaaagtttacaaaga

SEQ ID NO: 244547 - DNA, 20 bp, Artificial
  CRISPR gRNA sequence
acaaagaatggcaccttatt

SEQ ID NO: 244548 - DNA, 20 bp, Artificial
  CRISPR gRNA sequence
caaagaatggcaccttattt

SEQ ID NO: 244549 - DNA, 20 bp, Artificial
  CRISPR gRNA sequence
atttcatgattaccctttat

SEQ ID NO: 244550 - DNA, 20 bp, Artificial
  CRISPR gRNA sequence
tttcatgattaccctttatg

SEQ ID NO: 244551 - DNA, 20 bp, Artificial
  CRISPR gRNA sequence
catgattaccctttatgata

SEQ ID NO: 244552 - DNA, 20 bp, Artificial
  CRISPR gRNA sequence
atgattaccctttatgatat

SEQ ID NO: 244553 - DNA, 20 bp, Artificial
  CRISPR gRNA sequence
ccctttatgatatgatgttg

SEQ ID NO: 244554 - DNA, 20 bp, Artificial
  CRISPR gRNA sequence
tatgatatgatgttgcaaca

SEQ ID NO: 244555 - DNA, 20 bp, Artificial
  CRISPR gRNA sequence
atgatatgatgttgcaacag

SEQ ID NO: 244556 - DNA, 20 bp, Artificial
  CRISPR gRNA sequence
tgatatgatgttgcaacagt

SEQ ID NO: 244557 - DNA, 20 bp, Artificial
  CRISPR gRNA sequence
caacagttataaaaagcttt

SEQ ID NO: 244558 - DNA, 20 bp, Artificial
  CRISPR gRNA sequence
taaaaagctttttaaaataa

SEQ ID NO: 244559 - DNA, 20 bp, Artificial
  CRISPR gRNA sequence
tttaaaataaggtctttttt

SEQ ID NO: 244560 - DNA, 20 bp, Artificial
  CRISPR gRNA sequence
ttaaaataaggtcttttttt

SEQ ID NO: 244561 - DNA, 20 bp, Artificial
  CRISPR gRNA sequence
taaaataaggtctttttttc

SEQ ID NO: 244562 - DNA, 20 bp, Artificial
  CRISPR gRNA sequence
aaaataaggtctttttttct

SEQ ID NO: 244563 - DNA, 20 bp, Artificial
  CRISPR gRNA sequence
aaataaggtctttttttctt

SEQ ID NO: 244564 - DNA, 20 bp, Artificial
  CRISPR gRNA sequence
tttttcttattctttttttc

SEQ ID NO: 244565 - DNA, 20 bp, Artificial
  CRISPR gRNA sequence
ttttcttattctttttttcc

SEQ ID NO: 244566 - DNA, 20 bp, Artificial
  CRISPR gRNA sequence
tttcttattctttttttcct

SEQ ID NO: 244567 - DNA, 20 bp, Artificial
  CRISPR gRNA sequence
ttcttattctttttttcctg

SEQ ID NO: 244568 - DNA, 20 bp, Artificial
  CRISPR gRNA sequence
tcttattctttttttcctgt

SEQ ID NO: 244569 - DNA, 20 bp, Artificial
  CRISPR gRNA sequence
cttattctttttttcctgtg

SEQ ID NO: 244570 - DNA, 20 bp, Artificial
  CRISPR gRNA sequence
ttattctttttttcctgtga

SEQ ID NO: 244571 - DNA, 20 bp, Artificial
  CRISPR gRNA sequence
attctttttttcctgtgaac

SEQ ID NO: 244572 - DNA, 20 bp, Artificial
  CRISPR gRNA sequence
ttctttttttcctgtgaaca

SEQ ID NO: 244573 - DNA, 20 bp, Artificial
  CRISPR gRNA sequence
tttttttcctgtgaacatca

SEQ ID NO: 244574 - DNA, 20 bp, Artificial
  CRISPR gRNA sequence
tttttcctgtgaacatcata

SEQ ID NO: 244575 - DNA, 20 bp, Artificial
  CRISPR gRNA sequence
ttttcctgtgaacatcatag

SEQ ID NO: 244576 - DNA, 20 bp, Artificial
  CRISPR gRNA sequence
tttcctgtgaacatcatagt

SEQ ID NO: 244577 - DNA, 20 bp, Artificial
  CRISPR gRNA sequence
ttcctgtgaacatcatagtt

SEQ ID NO: 244578 - DNA, 20 bp, Artificial
  CRISPR gRNA sequence
tcctgtgaacatcatagttt

SEQ ID NO: 244579 - DNA, 20 bp, Artificial
  CRISPR gRNA sequence
cctgtgaacatcatagtttt

SEQ ID NO: 244580 - DNA, 20 bp, Artificial
  CRISPR gRNA sequence
ctgtgaacatcatagttttg

SEQ ID NO: 244581 - DNA, 20 bp, Artificial
  CRISPR gRNA sequence
tgaacatcatagttttgtgt

SEQ ID NO: 244582 - DNA, 20 bp, Artificial
  CRISPR gRNA sequence
tgtgttttattagatagtct

SEQ ID NO: 244583 - DNA, 20 bp, Artificial
  CRISPR gRNA sequence
gtgttttattagatagtctt

SEQ ID NO: 244584 - DNA, 20 bp, Artificial
  CRISPR gRNA sequence
tgttttattagatagtcttt

SEQ ID NO: 244585 - DNA, 20 bp, Artificial
  CRISPR gRNA sequence
tattagatagtcttttaaat

SEQ ID NO: 244586 - DNA, 20 bp, Artificial
  CRISPR gRNA sequence
attagatagtcttttaaata

SEQ ID NO: 244587 - DNA, 20 bp, Artificial
  CRISPR gRNA sequence
ttagatagtcttttaaataa

SEQ ID NO: 244588 - DNA, 20 bp, Artificial
  CRISPR gRNA sequence
gatagtcttttaaataaaaa

SEQ ID NO: 244589 - DNA, 20 bp, Artificial
  CRISPR gRNA sequence
ttaaataaaaacgttgataa

SEQ ID NO: 244590 - DNA, 20 bp, Artificial
  CRISPR gRNA sequence
taaataaaaacgttgataaa

SEQ ID NO: 244591 - DNA, 20 bp, Artificial
  CRISPR gRNA sequence
aaataaaaacgttgataaag

SEQ ID NO: 244592 - DNA, 20 bp, Artificial
  CRISPR gRNA sequence
aataaaaacgttgataaaga

SEQ ID NO: 244593 - DNA, 20 bp, Artificial
  CRISPR gRNA sequence
ataaagatcactctccaagt

SEQ ID NO: 244594 - DNA, 20 bp, Artificial
  CRISPR gRNA sequence
tccaagtcctaccacacaca

SEQ ID NO: 244595 - DNA, 20 bp, Artificial
  CRISPR gRNA sequence
caagtcctaccacacacagg

SEQ ID NO: 244596 - DNA, 20 bp, Artificial
  CRISPR gRNA sequence
ccacacacagggcacatgta

SEQ ID NO: 244597 - DNA, 20 bp, Artificial
  CRISPR gRNA sequence
ccctagctgcggtgggcacc

SEQ ID NO: 244598 - DNA, 20 bp, Artificial
  CRISPR gRNA sequence
gctgcggtgggcacctctca

SEQ ID NO: 244599 - DNA, 20 bp, Artificial
  CRISPR gRNA sequence
cggtgggcacctctcaccca

SEQ ID NO: 244600 - DNA, 20 bp, Artificial
  CRISPR gRNA sequence
tcacccacagatggaaacat

SEQ ID NO: 244601 - DNA, 20 bp, Artificial
  CRISPR gRNA sequence
acccacagatggaaacatct

SEQ ID NO: 244602 - DNA, 20 bp, Artificial
  CRISPR gRNA sequence
cctgtgggggaagatgccca

SEQ ID NO: 244603 - DNA, 20 bp, Artificial
  CRISPR gRNA sequence
ctgtgggggaagatgcccac

SEQ ID NO: 244604 - DNA, 20 bp, Artificial
  CRISPR gRNA sequence
tgggggaagatgcccacttt

SEQ ID NO: 244605 - DNA, 20 bp, Artificial
  CRISPR gRNA sequence
tatagtcatccgcccctcac

SEQ ID NO: 244606 - DNA, 20 bp, Artificial
  CRISPR gRNA sequence
atagtcatccgcccctcaca

SEQ ID NO: 244607 - DNA, 20 bp, Artificial
  CRISPR gRNA sequence
tagtcatccgcccctcacat

SEQ ID NO: 244608 - DNA, 20 bp, Artificial
  CRISPR gRNA sequence
acatcaaaactttccgtcag

SEQ ID NO: 244609 - DNA, 20 bp, Artificial
  CRISPR gRNA sequence
tccgtcagagtgatatcttc

SEQ ID NO: 244610 - DNA, 20 bp, Artificial
  CRISPR gRNA sequence
ccgtcagagtgatatcttcc

SEQ ID NO: 244611 - DNA, 20 bp, Artificial
  CRISPR gRNA sequence
cgtcagagtgatatcttcca

SEQ ID NO: 244612 - DNA, 20 bp, Artificial
  CRISPR gRNA sequence
ccactaaagaaaaaaaatta

SEQ ID NO: 244613 - DNA, 20 bp, Artificial
  CRISPR gRNA sequence
cactaaagaaaaaaaattaa

SEQ ID NO: 244614 - DNA, 20 bp, Artificial
  CRISPR gRNA sequence
aagaaaaaaaattaaaactt

SEQ ID NO: 244615 - DNA, 20 bp, Artificial
  CRISPR gRNA sequence
aaactttcttctgaaaaaaa

SEQ ID NO: 244616 - DNA, 20 bp, Artificial
  CRISPR gRNA sequence
tcttctgaaaaaaacctgag

SEQ ID NO: 244617 - DNA, 20 bp, Artificial
  CRISPR gRNA sequence
cttctgaaaaaaacctgagc

SEQ ID NO: 244618 - DNA, 20 bp, Artificial
  CRISPR gRNA sequence
ttctgaaaaaaacctgagct

SEQ ID NO: 244619 - DNA, 20 bp, Artificial
  CRISPR gRNA sequence
ctgaaaaaaacctgagcttg

SEQ ID NO: 244620 - DNA, 20 bp, Artificial
  CRISPR gRNA sequence
tgaaaaaaacctgagcttgt

SEQ ID NO: 244621 - DNA, 20 bp, Artificial
  CRISPR gRNA sequence
aaaaaaacctgagcttgttt

SEQ ID NO: 244622 - DNA, 20 bp, Artificial
  CRISPR gRNA sequence
agcttgtttttagcatttag

SEQ ID NO: 244623 - DNA, 20 bp, Artificial
  CRISPR gRNA sequence
gtttttagcatttagaaaat

SEQ ID NO: 244624 - DNA, 20 bp, Artificial
  CRISPR gRNA sequence
tttttagcatttagaaaatg

SEQ ID NO: 244625 - DNA, 20 bp, Artificial
  CRISPR gRNA sequence
ttagcatttagaaaatgatt

SEQ ID NO: 244626 - DNA, 20 bp, Artificial
  CRISPR gRNA sequence
tagcatttagaaaatgattt

SEQ ID NO: 244627 - DNA, 20 bp, Artificial
  CRISPR gRNA sequence
agcatttagaaaatgattta

SEQ ID NO: 244628 - DNA, 20 bp, Artificial
  CRISPR gRNA sequence
gcatttagaaaatgatttat

SEQ ID NO: 244629 - DNA, 20 bp, Artificial
  CRISPR gRNA sequence
agaaaatgatttataatttg

SEQ ID NO: 244630 - DNA, 20 bp, Artificial
  CRISPR gRNA sequence
gaaaatgatttataatttgt

SEQ ID NO: 244631 - DNA, 20 bp, Artificial
  CRISPR gRNA sequence
ataatttgtgtatccctaaa

SEQ ID NO: 244632 - DNA, 20 bp, Artificial
  CRISPR gRNA sequence
taatttgtgtatccctaaat

SEQ ID NO: 244633 - DNA, 20 bp, Artificial
  CRISPR gRNA sequence
gtgtatccctaaatgtgcta

SEQ ID NO: 244634 - DNA, 20 bp, Artificial
  CRISPR gRNA sequence
tgtatccctaaatgtgctaa

SEQ ID NO: 244635 - DNA, 20 bp, Artificial
  CRISPR gRNA sequence
aatgtgctaatttattttta

SEQ ID NO: 244636 - DNA, 20 bp, Artificial
  CRISPR gRNA sequence
atttatttttaatcatagaa

SEQ ID NO: 244637 - DNA, 20 bp, Artificial
  CRISPR gRNA sequence
atttttaatcatagaaattt

SEQ ID NO: 244638 - DNA, 20 bp, Artificial
  CRISPR gRNA sequence
tttttaatcatagaaattta

SEQ ID NO: 244639 - DNA, 20 bp, Artificial
  CRISPR gRNA sequence
ttaatcatagaaatttacat

SEQ ID NO: 244640 - DNA, 20 bp, Artificial
  CRISPR gRNA sequence
taatcatagaaatttacatt

SEQ ID NO: 244641 - DNA, 20 bp, Artificial
  CRISPR gRNA sequence
aatcatagaaatttacattt

SEQ ID NO: 244642 - DNA, 20 bp, Artificial
  CRISPR gRNA sequence
atcatagaaatttacattta

SEQ ID NO: 244643 - DNA, 20 bp, Artificial
  CRISPR gRNA sequence
acatttatttctattaaacc

SEQ ID NO: 244644 - DNA, 20 bp, Artificial
  CRISPR gRNA sequence
catttatttctattaaacct

SEQ ID NO: 244645 - DNA, 20 bp, Artificial
  CRISPR gRNA sequence
atttctattaaacctaatta

SEQ ID NO: 244646 - DNA, 20 bp, Artificial
  CRISPR gRNA sequence
tttctattaaacctaattat

SEQ ID NO: 244647 - DNA, 20 bp, Artificial
  CRISPR gRNA sequence
ctattaaacctaattatgga

SEQ ID NO: 244648 - DNA, 20 bp, Artificial
  CRISPR gRNA sequence
tattaaacctaattatggaa

SEQ ID NO: 244649 - DNA, 20 bp, Artificial
  CRISPR gRNA sequence
ttaaacctaattatggaact

SEQ ID NO: 244650 - DNA, 20 bp, Artificial
  CRISPR gRNA sequence
aacctaattatggaactttc

SEQ ID NO: 244651 - DNA, 20 bp, Artificial
  CRISPR gRNA sequence
attatggaactttctaaatt

SEQ ID NO: 244652 - DNA, 20 bp, Artificial
  CRISPR gRNA sequence
tggaactttctaaattaaac

SEQ ID NO: 244653 - DNA, 20 bp, Artificial
  CRISPR gRNA sequence
tctaaattaaacccagaagg

SEQ ID NO: 244654 - DNA, 20 bp, Artificial
  CRISPR gRNA sequence
ctaaattaaacccagaaggg

SEQ ID NO: 244655 - DNA, 20 bp, Artificial
  CRISPR gRNA sequence
taaattaaacccagaagggg

SEQ ID NO: 244656 - DNA, 20 bp, Artificial
  CRISPR gRNA sequence
aattaaacccagaaggggat

SEQ ID NO: 244657 - DNA, 20 bp, Artificial
  CRISPR gRNA sequence
aacccagaaggggatcattt

SEQ ID NO: 244658 - DNA, 20 bp, Artificial
  CRISPR gRNA sequence
tattctgtctcaatgttcct

SEQ ID NO: 244659 - DNA, 20 bp, Artificial
  CRISPR gRNA sequence
attctgtctcaatgttcctt

SEQ ID NO: 244660 - DNA, 20 bp, Artificial
  CRISPR gRNA sequence
ttctgtctcaatgttccttc

SEQ ID NO: 244661 - DNA, 20 bp, Artificial
  CRISPR gRNA sequence
tgtctcaatgttccttcctt

SEQ ID NO: 244662 - DNA, 20 bp, Artificial
  CRISPR gRNA sequence
tctcaatgttccttccttat

SEQ ID NO: 244663 - DNA, 20 bp, Artificial
  CRISPR gRNA sequence
aatgttccttccttattaat

SEQ ID NO: 244664 - DNA, 20 bp, Artificial
  CRISPR gRNA sequence
cttccttattaattgtcatt

SEQ ID NO: 244665 - DNA, 20 bp, Artificial
  CRISPR gRNA sequence
ccttattaattgtcatttag

SEQ ID NO: 244666 - DNA, 20 bp, Artificial
  CRISPR gRNA sequence
cttattaattgtcatttagg

SEQ ID NO: 244667 - DNA, 20 bp, Artificial
  CRISPR gRNA sequence
attaattgtcatttaggggg

SEQ ID NO: 244668 - DNA, 20 bp, Artificial
  CRISPR gRNA sequence
ttaattgtcatttaggggga

SEQ ID NO: 244669 - DNA, 20 bp, Artificial
  CRISPR gRNA sequence
attgtcatttagggggagca

SEQ ID NO: 244670 - DNA, 20 bp, Artificial
  CRISPR gRNA sequence
tcatttagggggagcaatga

SEQ ID NO: 244671 - DNA, 20 bp, Artificial
  CRISPR gRNA sequence
agggggagcaatgactcaca

SEQ ID NO: 244672 - DNA, 20 bp, Artificial
  CRISPR gRNA sequence
gggggagcaatgactcacat

SEQ ID NO: 244673 - DNA, 20 bp, Artificial
  CRISPR gRNA sequence
acatgccaagttcctgtgtt

SEQ ID NO: 244674 - DNA, 20 bp, Artificial
  CRISPR gRNA sequence
ctgtgtttttcatttatagc

SEQ ID NO: 244675 - DNA, 20 bp, Artificial
  CRISPR gRNA sequence
tgtttttcatttatagcttt

SEQ ID NO: 244676 - DNA, 20 bp, Artificial
  CRISPR gRNA sequence
ttcatttatagcttttgcac

SEQ ID NO: 244677 - DNA, 20 bp, Artificial
  CRISPR gRNA sequence
tcatttatagcttttgcaca

SEQ ID NO: 244678 - DNA, 20 bp, Artificial
  CRISPR gRNA sequence
catttatagcttttgcacat

SEQ ID NO: 244679 - DNA, 20 bp, Artificial
  CRISPR gRNA sequence
atttatagcttttgcacatg

SEQ ID NO: 244680 - DNA, 20 bp, Artificial
  CRISPR gRNA sequence
atagcttttgcacatgatac

SEQ ID NO: 244681 - DNA, 20 bp, Artificial
  CRISPR gRNA sequence
tagcttttgcacatgatacc

SEQ ID NO: 244682 - DNA, 20 bp, Artificial
  CRISPR gRNA sequence
ttgcacatgataccagaata

SEQ ID NO: 244683 - DNA, 20 bp, Artificial
  CRISPR gRNA sequence
tgcacatgataccagaatag

SEQ ID NO: 244684 - DNA, 20 bp, Artificial
  CRISPR gRNA sequence
gcacatgataccagaatagg

SEQ ID NO: 244685 - DNA, 20 bp, Artificial
  CRISPR gRNA sequence
cacatgataccagaataggc

SEQ ID NO: 244686 - DNA, 20 bp, Artificial
  CRISPR gRNA sequence
tgataaaaatatcacagtct

SEQ ID NO: 244687 - DNA, 20 bp, Artificial
  CRISPR gRNA sequence
tatcataaacatagcctcct

SEQ ID NO: 244688 - DNA, 20 bp, Artificial
  CRISPR gRNA sequence
ctttcttcacagaataaact

SEQ ID NO: 244689 - DNA, 20 bp, Artificial
  CRISPR gRNA sequence
tcttcacagaataaactgtg

SEQ ID NO: 244690 - DNA, 20 bp, Artificial
  CRISPR gRNA sequence
cttcacagaataaactgtgg

SEQ ID NO: 244691 - DNA, 20 bp, Artificial
  CRISPR gRNA sequence
ttcacagaataaactgtgga

SEQ ID NO: 244692 - DNA, 20 bp, Artificial
  CRISPR gRNA sequence
cacagaataaactgtggatt

SEQ ID NO: 244693 - DNA, 20 bp, Artificial
  CRISPR gRNA sequence
acagaataaactgtggattt

SEQ ID NO: 244694 - DNA, 20 bp, Artificial
  CRISPR gRNA sequence
tggattttcggtgtgtaacc

SEQ ID NO: 244695 - DNA, 20 bp, Artificial
  CRISPR gRNA sequence
tcggtgtgtaacctaggaca

SEQ ID NO: 244696 - DNA, 20 bp, Artificial
  CRISPR gRNA sequence
cggtgtgtaacctaggacac

SEQ ID NO: 244697 - DNA, 20 bp, Artificial
  CRISPR gRNA sequence
ggtgtgtaacctaggacaca

SEQ ID NO: 244698 - DNA, 20 bp, Artificial
  CRISPR gRNA sequence
ggacacatgagagcctcgct

SEQ ID NO: 244699 - DNA, 20 bp, Artificial
  CRISPR gRNA sequence
gctccattatcttggatacc

SEQ ID NO: 244700 - DNA, 20 bp, Artificial
  CRISPR gRNA sequence
cattatcttggataccccaa

SEQ ID NO: 244701 - DNA, 20 bp, Artificial
  CRISPR gRNA sequence
tcttggataccccaaccctg

SEQ ID NO: 244702 - DNA, 20 bp, Artificial
  CRISPR gRNA sequence
ggataccccaaccctgtggg

SEQ ID NO: 244703 - DNA, 20 bp, Artificial
  CRISPR gRNA sequence
gataccccaaccctgtgggg

SEQ ID NO: 244704 - DNA, 20 bp, Artificial
  CRISPR gRNA sequence
tggggcatgaccagtctctt

SEQ ID NO: 244705 - DNA, 20 bp, Artificial
  CRISPR gRNA sequence
tttctgtttgtggatagtca

SEQ ID NO: 244706 - DNA, 20 bp, Artificial
  CRISPR gRNA sequence
tctgtttgtggatagtcagc

SEQ ID NO: 244707 - DNA, 20 bp, Artificial
  CRISPR gRNA sequence
ctgtttgtggatagtcagca

SEQ ID NO: 244708 - DNA, 20 bp, Artificial
  CRISPR gRNA sequence
tgtttgtggatagtcagcag

SEQ ID NO: 244709 - DNA, 20 bp, Artificial
  CRISPR gRNA sequence
tttgtggatagtcagcagta

SEQ ID NO: 244710 - DNA, 20 bp, Artificial
  CRISPR gRNA sequence
gtggatagtcagcagtaggt

SEQ ID NO: 244711 - DNA, 20 bp, Artificial
  CRISPR gRNA sequence
tggatagtcagcagtaggta

SEQ ID NO: 244712 - DNA, 20 bp, Artificial
  CRISPR gRNA sequence
aacaccatgtgtccaaagcc

SEQ ID NO: 244713 - DNA, 20 bp, Artificial
  CRISPR gRNA sequence
tagaacttacagcatcatga

SEQ ID NO: 244714 - DNA, 20 bp, Artificial
  CRISPR gRNA sequence
agaacttacagcatcatgat

SEQ ID NO: 244715 - DNA, 20 bp, Artificial
  CRISPR gRNA sequence
gaacttacagcatcatgatt

SEQ ID NO: 244716 - DNA, 20 bp, Artificial
  CRISPR gRNA sequence
acagcatcatgattcagaaa

SEQ ID NO: 244717 - DNA, 20 bp, Artificial
  CRISPR gRNA sequence
cagcatcatgattcagaaag

SEQ ID NO: 244718 - DNA, 20 bp, Artificial
  CRISPR gRNA sequence
agaaagacaaaaatattcgc

SEQ ID NO: 244719 - DNA, 20 bp, Artificial
  CRISPR gRNA sequence
gcacctagctttgttcctga

SEQ ID NO: 244720 - DNA, 20 bp, Artificial
  CRISPR gRNA sequence
gctttgttcctgaaatggca

SEQ ID NO: 244721 - DNA, 20 bp, Artificial
  CRISPR gRNA sequence
tgttcctgaaatggcaccag

SEQ ID NO: 244722 - DNA, 20 bp, Artificial
  CRISPR gRNA sequence
gttcctgaaatggcaccagt

SEQ ID NO: 244723 - DNA, 20 bp, Artificial
  CRISPR gRNA sequence
ttcctgaaatggcaccagta

SEQ ID NO: 244724 - DNA, 20 bp, Artificial
  CRISPR gRNA sequence
ctgaaatggcaccagtatac

SEQ ID NO: 244725 - DNA, 20 bp, Artificial
  CRISPR gRNA sequence
aaatggcaccagtatacttc

SEQ ID NO: 244726 - DNA, 20 bp, Artificial
  CRISPR gRNA sequence
cctaagctttgctttgccta

SEQ ID NO: 244727 - DNA, 20 bp, Artificial
  CRISPR gRNA sequence
ctaagctttgctttgcctac

SEQ ID NO: 244728 - DNA, 20 bp, Artificial
  CRISPR gRNA sequence
agctttgctttgcctactat

SEQ ID NO: 244729 - DNA, 20 bp, Artificial
  CRISPR gRNA sequence
tgctttgcctactatttggc

SEQ ID NO: 244730 - DNA, 20 bp, Artificial
  CRISPR gRNA sequence
gctttgcctactatttggca

SEQ ID NO: 244731 - DNA, 20 bp, Artificial
  CRISPR gRNA sequence
ctttgcctactatttggcaa

SEQ ID NO: 244732 - DNA, 20 bp, Artificial
  CRISPR gRNA sequence
tgcctactatttggcaagaa

SEQ ID NO: 244733 - DNA, 20 bp, Artificial
  CRISPR gRNA sequence
gcctactatttggcaagaat

SEQ ID NO: 244734 - DNA, 20 bp, Artificial
  CRISPR gRNA sequence
cctactatttggcaagaatt

SEQ ID NO: 244735 - DNA, 20 bp, Artificial
  CRISPR gRNA sequence
ctatttggcaagaattgtac

SEQ ID NO: 244736 - DNA, 20 bp, Artificial
  CRISPR gRNA sequence
tttggcaagaattgtacagc

SEQ ID NO: 244737 - DNA, 20 bp, Artificial
  CRISPR gRNA sequence
ggcaagaattgtacagccaa

SEQ ID NO: 244738 - DNA, 20 bp, Artificial
  CRISPR gRNA sequence
gcaagaattgtacagccaat

SEQ ID NO: 244739 - DNA, 20 bp, Artificial
  CRISPR gRNA sequence
tacagccaataattgttctc

SEQ ID NO: 244740 - DNA, 20 bp, Artificial
  CRISPR gRNA sequence
ttctcttattcttattggaa

SEQ ID NO: 244741 - DNA, 20 bp, Artificial
  CRISPR gRNA sequence
tcttattcttattggaacac

SEQ ID NO: 244742 - DNA, 20 bp, Artificial
  CRISPR gRNA sequence
ttattcttattggaacacca

SEQ ID NO: 244743 - DNA, 20 bp, Artificial
  CRISPR gRNA sequence
attcttattggaacaccaga

SEQ ID NO: 244744 - DNA, 20 bp, Artificial
  CRISPR gRNA sequence
ttcttattggaacaccagat

SEQ ID NO: 244745 - DNA, 20 bp, Artificial
  CRISPR gRNA sequence
ttattggaacaccagatgac

SEQ ID NO: 244746 - DNA, 20 bp, Artificial
  CRISPR gRNA sequence
attggaacaccagatgactc

SEQ ID NO: 244747 - DNA, 20 bp, Artificial
  CRISPR gRNA sequence
ttggaacaccagatgactca

SEQ ID NO: 244748 - DNA, 20 bp, Artificial
  CRISPR gRNA sequence
gaacaccagatgactcaatt

SEQ ID NO: 244749 - DNA, 20 bp, Artificial
  CRISPR gRNA sequence
aattctgtaaaattatcaac

SEQ ID NO: 244750 - DNA, 20 bp, Artificial
  CRISPR gRNA sequence
tgtaaaattatcaactctcc

SEQ ID NO: 244751 - DNA, 20 bp, Artificial
  CRISPR gRNA sequence
taaaattatcaactctccct

SEQ ID NO: 244752 - DNA, 20 bp, Artificial
  CRISPR gRNA sequence
tcaactctccctaaattgac

SEQ ID NO: 244753 - DNA, 20 bp, Artificial
  CRISPR gRNA sequence
tccctaaattgacctgtaga

SEQ ID NO: 244754 - DNA, 20 bp, Artificial
  CRISPR gRNA sequence
cctaaattgacctgtagatt

SEQ ID NO: 244755 - DNA, 20 bp, Artificial
  CRISPR gRNA sequence
aattgacctgtagatttaat

SEQ ID NO: 244756 - DNA, 20 bp, Artificial
  CRISPR gRNA sequence
acctgtagatttaatgaaat

SEQ ID NO: 244757 - DNA, 20 bp, Artificial
  CRISPR gRNA sequence
tagatttaatgaaattccaa

SEQ ID NO: 244758 - DNA, 20 bp, Artificial
  CRISPR gRNA sequence
aatgaaattccaatccaaat

SEQ ID NO: 244759 - DNA, 20 bp, Artificial
  CRISPR gRNA sequence
atgaaattccaatccaaatc

SEQ ID NO: 244760 - DNA, 20 bp, Artificial
  CRISPR gRNA sequence
caatccaaatcttttcaaat

SEQ ID NO: 244761 - DNA, 20 bp, Artificial
  CRISPR gRNA sequence
ttcaaattcagcttctaaaa

SEQ ID NO: 244762 - DNA, 20 bp, Artificial
  CRISPR gRNA sequence
tcaaattcagcttctaaaat

SEQ ID NO: 244763 - DNA, 20 bp, Artificial
  CRISPR gRNA sequence
caaattcagcttctaaaatt

SEQ ID NO: 244764 - DNA, 20 bp, Artificial
  CRISPR gRNA sequence
aaattcagcttctaaaattt

SEQ ID NO: 244765 - DNA, 20 bp, Artificial
  CRISPR gRNA sequence
agcttctaaaatttatattg

SEQ ID NO: 244766 - DNA, 20 bp, Artificial
  CRISPR gRNA sequence
ctaaaatttatattgaataa

SEQ ID NO: 244767 - DNA, 20 bp, Artificial
  CRISPR gRNA sequence
taaaatttatattgaataat

SEQ ID NO: 244768 - DNA, 20 bp, Artificial
  CRISPR gRNA sequence
aaatttatattgaataataa

SEQ ID NO: 244769 - DNA, 20 bp, Artificial
  CRISPR gRNA sequence
atattgaataataaagaacc

SEQ ID NO: 244770 - DNA, 20 bp, Artificial
  CRISPR gRNA sequence
tattgaataataaagaacca

SEQ ID NO: 244771 - DNA, 20 bp, Artificial
  CRISPR gRNA sequence
aataataaagaaccaagaat

SEQ ID NO: 244772 - DNA, 20 bp, Artificial
  CRISPR gRNA sequence
ttttcttttttttcctgaga

SEQ ID NO: 244773 - DNA, 20 bp, Artificial
  CRISPR gRNA sequence
ttcttttttttcctgagaca

SEQ ID NO: 244774 - DNA, 20 bp, Artificial
  CRISPR gRNA sequence
tcttttttttcctgagacag

SEQ ID NO: 244775 - DNA, 20 bp, Artificial
  CRISPR gRNA sequence
cttttttttcctgagacaga

SEQ ID NO: 244776 - DNA, 20 bp, Artificial
  CRISPR gRNA sequence
ttttttttcctgagacagag

SEQ ID NO: 244777 - DNA, 20 bp, Artificial
  CRISPR gRNA sequence
ttttttcctgagacagagtt

SEQ ID NO: 244778 - DNA, 20 bp, Artificial
  CRISPR gRNA sequence
tttttcctgagacagagttt

SEQ ID NO: 244779 - DNA, 20 bp, Artificial
  CRISPR gRNA sequence
ttttcctgagacagagtttc

SEQ ID NO: 244780 - DNA, 20 bp, Artificial
  CRISPR gRNA sequence
tttcctgagacagagtttcg

SEQ ID NO: 244781 - DNA, 20 bp, Artificial
  CRISPR gRNA sequence
ttcctgagacagagtttcgc

SEQ ID NO: 244782 - DNA, 20 bp, Artificial
  CRISPR gRNA sequence
tcctgagacagagtttcgct

SEQ ID NO: 244783 - DNA, 20 bp, Artificial
  CRISPR gRNA sequence
cctgagacagagtttcgctc

SEQ ID NO: 244784 - DNA, 20 bp, Artificial
  CRISPR gRNA sequence
ctgagacagagtttcgctct

SEQ ID NO: 244785 - DNA, 20 bp, Artificial
  CRISPR gRNA sequence
agacagagtttcgctctgtc

SEQ ID NO: 244786 - DNA, 20 bp, Artificial
  CRISPR gRNA sequence
cgctctgtcacccaggctgg

SEQ ID NO: 244787 - DNA, 20 bp, Artificial
  CRISPR gRNA sequence
gctctgtcacccaggctgga

SEQ ID NO: 244788 - DNA, 20 bp, Artificial
  CRISPR gRNA sequence
tgtcacccaggctggagtgc

SEQ ID NO: 244789 - DNA, 20 bp, Artificial
  CRISPR gRNA sequence
tcacccaggctggagtgcaa

SEQ ID NO: 244790 - DNA, 20 bp, Artificial
  CRISPR gRNA sequence
gagtgcaatggtacgatctc

SEQ ID NO: 244791 - DNA, 20 bp, Artificial
  CRISPR gRNA sequence
ggctcactgcaacctccgcc

SEQ ID NO: 244792 - DNA, 20 bp, Artificial
  CRISPR gRNA sequence
actgcaacctccgccccccg

SEQ ID NO: 244793 - DNA, 20 bp, Artificial
  CRISPR gRNA sequence
caacctccgccccccgggtt

SEQ ID NO: 244794 - DNA, 20 bp, Artificial
  CRISPR gRNA sequence
cgccccccgggttcaagcaa

SEQ ID NO: 244795 - DNA, 20 bp, Artificial
  CRISPR gRNA sequence
aagcaattctccggcctcag

SEQ ID NO: 244796 - DNA, 20 bp, Artificial
  CRISPR gRNA sequence
tccggcctcagcctcccaaa

SEQ ID NO: 244797 - DNA, 20 bp, Artificial
  CRISPR gRNA sequence
cggcctcagcctcccaaata

SEQ ID NO: 244798 - DNA, 20 bp, Artificial
  CRISPR gRNA sequence
agcctcccaaatagctggga

SEQ ID NO: 244799 - DNA, 20 bp, Artificial
  CRISPR gRNA sequence
ccaaatagctgggattacag

SEQ ID NO: 244800 - DNA, 20 bp, Artificial
  CRISPR gRNA sequence
ggattacaggcacatgccac

SEQ ID NO: 244801 - DNA, 20 bp, Artificial
  CRISPR gRNA sequence
caggcacatgccaccatgcc

SEQ ID NO: 244802 - DNA, 20 bp, Artificial
  CRISPR gRNA sequence
actaatttttgtatttttta

SEQ ID NO: 244803 - DNA, 20 bp, Artificial
  CRISPR gRNA sequence
atttttgtattttttagtag

SEQ ID NO: 244804 - DNA, 20 bp, Artificial
  CRISPR gRNA sequence
ttgtattttttagtagagat

SEQ ID NO: 244805 - DNA, 20 bp, Artificial
  CRISPR gRNA sequence
tgtattttttagtagagatg

SEQ ID NO: 244806 - DNA, 20 bp, Artificial
  CRISPR gRNA sequence
gtattttttagtagagatgg

SEQ ID NO: 244807 - DNA, 20 bp, Artificial
  CRISPR gRNA sequence
tattttttagtagagatggg

SEQ ID NO: 244808 - DNA, 20 bp, Artificial
  CRISPR gRNA sequence
tttagtagagatggggtttc

SEQ ID NO: 244809 - DNA, 20 bp, Artificial
  CRISPR gRNA sequence
ttagtagagatggggtttca

SEQ ID NO: 244810 - DNA, 20 bp, Artificial
  CRISPR gRNA sequence
tagtagagatggggtttcac

SEQ ID NO: 244811 - DNA, 20 bp, Artificial
  CRISPR gRNA sequence
agtagagatggggtttcacc

SEQ ID NO: 244812 - DNA, 20 bp, Artificial
  CRISPR gRNA sequence
gtagagatggggtttcacca

SEQ ID NO: 244813 - DNA, 20 bp, Artificial
  CRISPR gRNA sequence
caccatgttggccaggctgt

SEQ ID NO: 244814 - DNA, 20 bp, Artificial
  CRISPR gRNA sequence
accatgttggccaggctgtc

SEQ ID NO: 244815 - DNA, 20 bp, Artificial
  CRISPR gRNA sequence
gccaggctgtctcaaaactc

SEQ ID NO: 244816 - DNA, 20 bp, Artificial
  CRISPR gRNA sequence
tctcaaaactcctgacctca

SEQ ID NO: 244817 - DNA, 20 bp, Artificial
  CRISPR gRNA sequence
aaaactcctgacctcaggtg

SEQ ID NO: 244818 - DNA, 20 bp, Artificial
  CRISPR gRNA sequence
ctgacctcaggtgatccatc

SEQ ID NO: 244819 - DNA, 20 bp, Artificial
  CRISPR gRNA sequence
acctcaggtgatccatccgc

SEQ ID NO: 244820 - DNA, 20 bp, Artificial
  CRISPR gRNA sequence
aggtgatccatccgcgtcgg

SEQ ID NO: 244821 - DNA, 20 bp, Artificial
  CRISPR gRNA sequence
ccaaagtgctgggattacag

SEQ ID NO: 244822 - DNA, 20 bp, Artificial
  CRISPR gRNA sequence
ggattacaggcgtgagccac

SEQ ID NO: 244823 - DNA, 20 bp, Artificial
  CRISPR gRNA sequence
caggcgtgagccaccgtgcc

SEQ ID NO: 244824 - DNA, 20 bp, Artificial
  CRISPR gRNA sequence
acctagctaagacacttctg

SEQ ID NO: 244825 - DNA, 20 bp, Artificial
  CRISPR gRNA sequence
gctaagacacttctgaagta

SEQ ID NO: 244826 - DNA, 20 bp, Artificial
  CRISPR gRNA sequence
agacacttctgaagtagaaa

SEQ ID NO: 244827 - DNA, 20 bp, Artificial
  CRISPR gRNA sequence
ctgaagtagaaaaagaaggt

SEQ ID NO: 244828 - DNA, 20 bp, Artificial
  CRISPR gRNA sequence
tgaagtagaaaaagaaggtg

SEQ ID NO: 244829 - DNA, 20 bp, Artificial
  CRISPR gRNA sequence
aagtagaaaaagaaggtgga

SEQ ID NO: 244830 - DNA, 20 bp, Artificial
  CRISPR gRNA sequence
ccggatatcgagagctgtta

SEQ ID NO: 244831 - DNA, 20 bp, Artificial
  CRISPR gRNA sequence
ttacaaagctattgtaataa

SEQ ID NO: 244832 - DNA, 20 bp, Artificial
  CRISPR gRNA sequence
caaagctattgtaataaaca

SEQ ID NO: 244833 - DNA, 20 bp, Artificial
  CRISPR gRNA sequence
ttgtaataaacacagtgtga

SEQ ID NO: 244834 - DNA, 20 bp, Artificial
  CRISPR gRNA sequence
taataaacacagtgtgatac

SEQ ID NO: 244835 - DNA, 20 bp, Artificial
  CRISPR gRNA sequence
gcacaggatagacaaattga

SEQ ID NO: 244836 - DNA, 20 bp, Artificial
  CRISPR gRNA sequence
acaatggaacagaacaggga

SEQ ID NO: 244837 - DNA, 20 bp, Artificial
  CRISPR gRNA sequence
tggaaacttgatggatggta

SEQ ID NO: 244838 - DNA, 20 bp, Artificial
  CRISPR gRNA sequence
gatggatggtaggtgagatt

SEQ ID NO: 244839 - DNA, 20 bp, Artificial
  CRISPR gRNA sequence
atggatggtaggtgagattg

SEQ ID NO: 244840 - DNA, 20 bp, Artificial
  CRISPR gRNA sequence
cagacccgcaggagaaagac

SEQ ID NO: 244841 - DNA, 20 bp, Artificial
  CRISPR gRNA sequence
aatacatggcgcagggacca

SEQ ID NO: 244842 - DNA, 20 bp, Artificial
  CRISPR gRNA sequence
cctacatgcaagacatggaa

SEQ ID NO: 244843 - DNA, 20 bp, Artificial
  CRISPR gRNA sequence
catgcaagacatggaattgg

SEQ ID NO: 244844 - DNA, 20 bp, Artificial
  CRISPR gRNA sequence
gatcactacctcccaacagg

SEQ ID NO: 244845 - DNA, 20 bp, Artificial
  CRISPR gRNA sequence
cctcccaacaggcacaaaag

SEQ ID NO: 244846 - DNA, 20 bp, Artificial
  CRISPR gRNA sequence
ccaacaggcacaaaagccag

SEQ ID NO: 244847 - DNA, 20 bp, Artificial
  CRISPR gRNA sequence
ctgatacattagacttcaag

SEQ ID NO: 244848 - DNA, 20 bp, Artificial
  CRISPR gRNA sequence
atacattagacttcaagatg

SEQ ID NO: 244849 - DNA, 20 bp, Artificial
  CRISPR gRNA sequence
gacttcaagatgaaagacaa

SEQ ID NO: 244850 - DNA, 20 bp, Artificial
  CRISPR gRNA sequence
caagatgaaagacaaaactt

SEQ ID NO: 244851 - DNA, 20 bp, Artificial
  CRISPR gRNA sequence
aagatgaaagacaaaactta

SEQ ID NO: 244852 - DNA, 20 bp, Artificial
  CRISPR gRNA sequence
aaaacttttggaataaaatg

SEQ ID NO: 244853 - DNA, 20 bp, Artificial
  CRISPR gRNA sequence
aaacttttggaataaaatgt

SEQ ID NO: 244854 - DNA, 20 bp, Artificial
  CRISPR gRNA sequence
ttggaataaaatgtgggcaa

SEQ ID NO: 244855 - DNA, 20 bp, Artificial
  CRISPR gRNA sequence
tggaataaaatgtgggcaaa

SEQ ID NO: 244856 - DNA, 20 bp, Artificial
  CRISPR gRNA sequence
ggaataaaatgtgggcaaac

SEQ ID NO: 244857 - DNA, 20 bp, Artificial
  CRISPR gRNA sequence
gaataaaatgtgggcaaacc

SEQ ID NO: 244858 - DNA, 20 bp, Artificial
  CRISPR gRNA sequence
tttatagtattgggcagaaa

SEQ ID NO: 244859 - DNA, 20 bp, Artificial
  CRISPR gRNA sequence
tatagtattgggcagaaaag

SEQ ID NO: 244860 - DNA, 20 bp, Artificial
  CRISPR gRNA sequence
atagtattgggcagaaaagg

SEQ ID NO: 244861 - DNA, 20 bp, Artificial
  CRISPR gRNA sequence
tagtattgggcagaaaagga

SEQ ID NO: 244862 - DNA, 20 bp, Artificial
  CRISPR gRNA sequence
ggcagaaaaggatttcttta

SEQ ID NO: 244863 - DNA, 20 bp, Artificial
  CRISPR gRNA sequence
ctttagccaggcaagaaaaa

SEQ ID NO: 244864 - DNA, 20 bp, Artificial
  CRISPR gRNA sequence
tttagccaggcaagaaaaaa

SEQ ID NO: 244865 - DNA, 20 bp, Artificial
  CRISPR gRNA sequence
tagccaggcaagaaaaaatg

SEQ ID NO: 244866 - DNA, 20 bp, Artificial
  CRISPR gRNA sequence
agccaggcaagaaaaaatgt

SEQ ID NO: 244867 - DNA, 20 bp, Artificial
  CRISPR gRNA sequence
gccaggcaagaaaaaatgtt

SEQ ID NO: 244868 - DNA, 20 bp, Artificial
  CRISPR gRNA sequence
accatatgagaaaacagtta

SEQ ID NO: 244869 - DNA, 20 bp, Artificial
  CRISPR gRNA sequence
taaatttaaccaaatcaaat

SEQ ID NO: 244870 - DNA, 20 bp, Artificial
  CRISPR gRNA sequence
aaccaaatcaaatgaagaac

SEQ ID NO: 244871 - DNA, 20 bp, Artificial
  CRISPR gRNA sequence
accaaatcaaatgaagaact

SEQ ID NO: 244872 - DNA, 20 bp, Artificial
  CRISPR gRNA sequence
tttgcttattaccagaaaga

SEQ ID NO: 244873 - DNA, 20 bp, Artificial
  CRISPR gRNA sequence
ttgcttattaccagaaagac

SEQ ID NO: 244874 - DNA, 20 bp, Artificial
  CRISPR gRNA sequence
tgcttattaccagaaagaca

SEQ ID NO: 244875 - DNA, 20 bp, Artificial
  CRISPR gRNA sequence
gcttattaccagaaagacaa

SEQ ID NO: 244876 - DNA, 20 bp, Artificial
  CRISPR gRNA sequence
cttattaccagaaagacaaa

SEQ ID NO: 244877 - DNA, 20 bp, Artificial
  CRISPR gRNA sequence
attaccagaaagacaaagaa

SEQ ID NO: 244878 - DNA, 20 bp, Artificial
  CRISPR gRNA sequence
ttaccagaaagacaaagaaa

SEQ ID NO: 244879 - DNA, 20 bp, Artificial
  CRISPR gRNA sequence
ccagaaagacaaagaaagac

SEQ ID NO: 244880 - DNA, 20 bp, Artificial
  CRISPR gRNA sequence
attagagaaaaacaggaggg

SEQ ID NO: 244881 - DNA, 20 bp, Artificial
  CRISPR gRNA sequence
gagaaaaacaggaggggcgc

SEQ ID NO: 244882 - DNA, 20 bp, Artificial
  CRISPR gRNA sequence
atgtctgcaattccagcact

SEQ ID NO: 244883 - DNA, 20 bp, Artificial
  CRISPR gRNA sequence
caattccagcactttggaag

SEQ ID NO: 244884 - DNA, 20 bp, Artificial
  CRISPR gRNA sequence
cagcactttggaaggctgag

SEQ ID NO: 244885 - DNA, 20 bp, Artificial
  CRISPR gRNA sequence
tggaaggctgaggtgggagg

SEQ ID NO: 244886 - DNA, 20 bp, Artificial
  CRISPR gRNA sequence
ggaaggctgaggtgggagga

SEQ ID NO: 244887 - DNA, 20 bp, Artificial
  CRISPR gRNA sequence
gaaggctgaggtgggaggat

SEQ ID NO: 244888 - DNA, 20 bp, Artificial
  CRISPR gRNA sequence
aggtgggaggatcacttgag

SEQ ID NO: 244889 - DNA, 20 bp, Artificial
  CRISPR gRNA sequence
gagctcaggagttcaagacc

SEQ ID NO: 244890 - DNA, 20 bp, Artificial
  CRISPR gRNA sequence
agctcaggagttcaagacca

SEQ ID NO: 244891 - DNA, 20 bp, Artificial
  CRISPR gRNA sequence
aggagttcaagaccagcctg

SEQ ID NO: 244892 - DNA, 20 bp, Artificial
  CRISPR gRNA sequence
aagaccagcctgggcaacat

SEQ ID NO: 244893 - DNA, 20 bp, Artificial
  CRISPR gRNA sequence
ggcaacataatgaaacctca

SEQ ID NO: 244894 - DNA, 20 bp, Artificial
  CRISPR gRNA sequence
agaaacctcacctctgctaa

SEQ ID NO: 244895 - DNA, 20 bp, Artificial
  CRISPR gRNA sequence
acctctgctaaaaataaaaa

SEQ ID NO: 244896 - DNA, 20 bp, Artificial
  CRISPR gRNA sequence
tgctaaaaataaaaataaaa

SEQ ID NO: 244897 - DNA, 20 bp, Artificial
  CRISPR gRNA sequence
ctaaaaataaaaataaaaaa

SEQ ID NO: 244898 - DNA, 20 bp, Artificial
  CRISPR gRNA sequence
aaaataaaaataaaaaagaa

SEQ ID NO: 244899 - DNA, 20 bp, Artificial
  CRISPR gRNA sequence
tataaaaaattttaaaaagg

SEQ ID NO: 244900 - DNA, 20 bp, Artificial
  CRISPR gRNA sequence
ataaaaaattttaaaaaggg

SEQ ID NO: 244901 - DNA, 20 bp, Artificial
  CRISPR gRNA sequence
taaaaaattttaaaaaggga

SEQ ID NO: 244902 - DNA, 20 bp, Artificial
  CRISPR gRNA sequence
taaaaagggaaaaataaatt

SEQ ID NO: 244903 - DNA, 20 bp, Artificial
  CRISPR gRNA sequence
aaaaagggaaaaataaatta

SEQ ID NO: 244904 - DNA, 20 bp, Artificial
  CRISPR gRNA sequence
aaaagggaaaaataaattac

SEQ ID NO: 244905 - DNA, 20 bp, Artificial
  CRISPR gRNA sequence
caaaggatatatatatatat

SEQ ID NO: 244906 - DNA, 20 bp, Artificial
  CRISPR gRNA sequence
cactcttgtcacccagtctg

SEQ ID NO: 244907 - DNA, 20 bp, Artificial
  CRISPR gRNA sequence
actcttgtcacccagtctgg

SEQ ID NO: 244908 - DNA, 20 bp, Artificial
  CRISPR gRNA sequence
ttgtcacccagtctggagtg

SEQ ID NO: 244909 - DNA, 20 bp, Artificial
  CRISPR gRNA sequence
gtcacccagtctggagtgca

SEQ ID NO: 244910 - DNA, 20 bp, Artificial
  CRISPR gRNA sequence
tcacccagtctggagtgcaa

SEQ ID NO: 244911 - DNA, 20 bp, Artificial
  CRISPR gRNA sequence
gagtgcaatggcacaatctt

SEQ ID NO: 244912 - DNA, 20 bp, Artificial
  CRISPR gRNA sequence
ggctcgctgcaacctctgcc

SEQ ID NO: 244913 - DNA, 20 bp, Artificial
  CRISPR gRNA sequence
gctcgctgcaacctctgcct

SEQ ID NO: 244914 - DNA, 20 bp, Artificial
  CRISPR gRNA sequence
gctgcaacctctgcctcctg

SEQ ID NO: 244915 - DNA, 20 bp, Artificial
  CRISPR gRNA sequence
caacctctgcctcctgggtt

SEQ ID NO: 244916 - DNA, 20 bp, Artificial
  CRISPR gRNA sequence
tgcctcctgggttcaagcga

SEQ ID NO: 244917 - DNA, 20 bp, Artificial
  CRISPR gRNA sequence
cctcctgggttcaagcgatt

SEQ ID NO: 244918 - DNA, 20 bp, Artificial
  CRISPR gRNA sequence
ctgggttcaagcgattcttc

SEQ ID NO: 244919 - DNA, 20 bp, Artificial
  CRISPR gRNA sequence
ggttcaagcgattcttctgc

SEQ ID NO: 244920 - DNA, 20 bp, Artificial
  CRISPR gRNA sequence
aagcgattcttctgccacag

SEQ ID NO: 244921 - DNA, 20 bp, Artificial
  CRISPR gRNA sequence
ttctgccacagcctctggag

SEQ ID NO: 244922 - DNA, 20 bp, Artificial
  CRISPR gRNA sequence
ctgccacagcctctggagca

SEQ ID NO: 244923 - DNA, 20 bp, Artificial
  CRISPR gRNA sequence
tgccacagcctctggagcag

SEQ ID NO: 244924 - DNA, 20 bp, Artificial
  CRISPR gRNA sequence
ccacagcctctggagcagct

SEQ ID NO: 244925 - DNA, 20 bp, Artificial
  CRISPR gRNA sequence
tggagcagctggggttacag

SEQ ID NO: 244926 - DNA, 20 bp, Artificial
  CRISPR gRNA sequence
gagcagctggggttacaggc

SEQ ID NO: 244927 - DNA, 20 bp, Artificial
  CRISPR gRNA sequence
gggttacaggcacccgccac

SEQ ID NO: 244928 - DNA, 20 bp, Artificial
  CRISPR gRNA sequence
caggcacccgccaccatacc

SEQ ID NO: 244929 - DNA, 20 bp, Artificial
  CRISPR gRNA sequence
agttttgtacatgtttagta

SEQ ID NO: 244930 - DNA, 20 bp, Artificial
  CRISPR gRNA sequence
tgtacatgtttagtagagat

SEQ ID NO: 244931 - DNA, 20 bp, Artificial
  CRISPR gRNA sequence
gtacatgtttagtagagatg

SEQ ID NO: 244932 - DNA, 20 bp, Artificial
  CRISPR gRNA sequence
tacatgtttagtagagatgg

SEQ ID NO: 244933 - DNA, 20 bp, Artificial
  CRISPR gRNA sequence
agtagagatggggtttcact

SEQ ID NO: 244934 - DNA, 20 bp, Artificial
  CRISPR gRNA sequence
gtagagatggggtttcactg

SEQ ID NO: 244935 - DNA, 20 bp, Artificial
  CRISPR gRNA sequence
cactgtgttggccaggctga

SEQ ID NO: 244936 - DNA, 20 bp, Artificial
  CRISPR gRNA sequence
actgtgttggccaggctgat

SEQ ID NO: 244937 - DNA, 20 bp, Artificial
  CRISPR gRNA sequence
tgttggccaggctgatcttg

SEQ ID NO: 244938 - DNA, 20 bp, Artificial
  CRISPR gRNA sequence
gccaggctgatcttgaactc

SEQ ID NO: 244939 - DNA, 20 bp, Artificial
  CRISPR gRNA sequence
atcttgaactcttgacctca

SEQ ID NO: 244940 - DNA, 20 bp, Artificial
  CRISPR gRNA sequence
gaactcttgacctcagatga

SEQ ID NO: 244941 - DNA, 20 bp, Artificial
  CRISPR gRNA sequence
aactcttgacctcagatgat

SEQ ID NO: 244942 - DNA, 20 bp, Artificial
  CRISPR gRNA sequence
ttgacctcagatgatccacc

SEQ ID NO: 244943 - DNA, 20 bp, Artificial
  CRISPR gRNA sequence
gacctcagatgatccaccca

SEQ ID NO: 244944 - DNA, 20 bp, Artificial
  CRISPR gRNA sequence
acctcagatgatccacccac

SEQ ID NO: 244945 - DNA, 20 bp, Artificial
  CRISPR gRNA sequence
agatgatccacccacctcag

SEQ ID NO: 244946 - DNA, 20 bp, Artificial
  CRISPR gRNA sequence
agccccgcaaagtgctggga

SEQ ID NO: 244947 - DNA, 20 bp, Artificial
  CRISPR gRNA sequence
ggattacaggtgtgagctac

SEQ ID NO: 244948 - DNA, 20 bp, Artificial
  CRISPR gRNA sequence
caggtgtgagctaccgtgcc

SEQ ID NO: 244949 - DNA, 20 bp, Artificial
  CRISPR gRNA sequence
ccgtgcctggccacaaagaa

SEQ ID NO: 244950 - DNA, 20 bp, Artificial
  CRISPR gRNA sequence
gccacaaagaagatattttt

SEQ ID NO: 244951 - DNA, 20 bp, Artificial
  CRISPR gRNA sequence
tttaacacatataactgacc

SEQ ID NO: 244952 - DNA, 20 bp, Artificial
  CRISPR gRNA sequence
ttaacacatataactgacca

SEQ ID NO: 244953 - DNA, 20 bp, Artificial
  CRISPR gRNA sequence
taacacatataactgaccaa

SEQ ID NO: 244954 - DNA, 20 bp, Artificial
  CRISPR gRNA sequence
aacacatataactgaccaaa

SEQ ID NO: 244955 - DNA, 20 bp, Artificial
  CRISPR gRNA sequence
acacatataactgaccaaag

SEQ ID NO: 244956 - DNA, 20 bp, Artificial
  CRISPR gRNA sequence
accaaagattattatctaga

SEQ ID NO: 244957 - DNA, 20 bp, Artificial
  CRISPR gRNA sequence
ttatctagaatacataaaga

SEQ ID NO: 244958 - DNA, 20 bp, Artificial
  CRISPR gRNA sequence
tctagaatacataaagacct

SEQ ID NO: 244959 - DNA, 20 bp, Artificial
  CRISPR gRNA sequence
gaatacataaagacctttta

SEQ ID NO: 244960 - DNA, 20 bp, Artificial
  CRISPR gRNA sequence
ttaggaatcaggacaaacaa

SEQ ID NO: 244961 - DNA, 20 bp, Artificial
  CRISPR gRNA sequence
taggaatcaggacaaacaac

SEQ ID NO: 244962 - DNA, 20 bp, Artificial
  CRISPR gRNA sequence
aggaatcaggacaaacaacc

SEQ ID NO: 244963 - DNA, 20 bp, Artificial
  CRISPR gRNA sequence
ggaatcaggacaaacaacca

SEQ ID NO: 244964 - DNA, 20 bp, Artificial
  CRISPR gRNA sequence
gggtttgtttgtttctgaga

SEQ ID NO: 244965 - DNA, 20 bp, Artificial
  CRISPR gRNA sequence
ggtttgtttgtttctgagaa

SEQ ID NO: 244966 - DNA, 20 bp, Artificial
  CRISPR gRNA sequence
gtttgtttctgagaaaaggt

SEQ ID NO: 244967 - DNA, 20 bp, Artificial
  CRISPR gRNA sequence
tttgtttctgagaaaaggtt

SEQ ID NO: 244968 - DNA, 20 bp, Artificial
  CRISPR gRNA sequence
gtttctgagaaaaggttttt

SEQ ID NO: 244969 - DNA, 20 bp, Artificial
  CRISPR gRNA sequence
tttctgagaaaaggtttttc

SEQ ID NO: 244970 - DNA, 20 bp, Artificial
  CRISPR gRNA sequence
ctgagaaaaggtttttctct

SEQ ID NO: 244971 - DNA, 20 bp, Artificial
  CRISPR gRNA sequence
tgagaaaaggtttttctctg

SEQ ID NO: 244972 - DNA, 20 bp, Artificial
  CRISPR gRNA sequence
agaaaaggtttttctctgtt

SEQ ID NO: 244973 - DNA, 20 bp, Artificial
  CRISPR gRNA sequence
ttctctgttgcccaggctga

SEQ ID NO: 244974 - DNA, 20 bp, Artificial
  CRISPR gRNA sequence
tctctgttgcccaggctgaa

SEQ ID NO: 244975 - DNA, 20 bp, Artificial
  CRISPR gRNA sequence
ctctgttgcccaggctgaag

SEQ ID NO: 244976 - DNA, 20 bp, Artificial
  CRISPR gRNA sequence
tctgttgcccaggctgaagt

SEQ ID NO: 244977 - DNA, 20 bp, Artificial
  CRISPR gRNA sequence
tgttgcccaggctgaagtgt

SEQ ID NO: 244978 - DNA, 20 bp, Artificial
  CRISPR gRNA sequence
ttgcccaggctgaagtgtag

SEQ ID NO: 244979 - DNA, 20 bp, Artificial
  CRISPR gRNA sequence
cccaggctgaagtgtagtga

SEQ ID NO: 244980 - DNA, 20 bp, Artificial
  CRISPR gRNA sequence
aagtgtagtgatgcggtccc

SEQ ID NO: 244981 - DNA, 20 bp, Artificial
  CRISPR gRNA sequence
actgcaacctctgcctccca

SEQ ID NO: 244982 - DNA, 20 bp, Artificial
  CRISPR gRNA sequence
caacctctgcctcccaggct

SEQ ID NO: 244983 - DNA, 20 bp, Artificial
  CRISPR gRNA sequence
tgcctcccaggctcaaagcg

SEQ ID NO: 244984 - DNA, 20 bp, Artificial
  CRISPR gRNA sequence
cctcccaggctcaaagcgaa

SEQ ID NO: 244985 - DNA, 20 bp, Artificial
  CRISPR gRNA sequence
ccaggctcaaagcgaaccta

SEQ ID NO: 244986 - DNA, 20 bp, Artificial
  CRISPR gRNA sequence
aaagcgaacctactgagtag

SEQ ID NO: 244987 - DNA, 20 bp, Artificial
  CRISPR gRNA sequence
ctgagtagctgggacttcag

SEQ ID NO: 244988 - DNA, 20 bp, Artificial
  CRISPR gRNA sequence
agtagctgggacttcaggtg

SEQ ID NO: 244989 - DNA, 20 bp, Artificial
  CRISPR gRNA sequence
ggacttcaggtgcacaccac

SEQ ID NO: 244990 - DNA, 20 bp, Artificial
  CRISPR gRNA sequence
caggtgcacaccaccacacc

SEQ ID NO: 244991 - DNA, 20 bp, Artificial
  CRISPR gRNA sequence
aggtgcacaccaccacaccc

SEQ ID NO: 244992 - DNA, 20 bp, Artificial
  CRISPR gRNA sequence
atttttgtattttttgtaaa

SEQ ID NO: 244993 - DNA, 20 bp, Artificial
  CRISPR gRNA sequence
ttgtattttttgtaaagaca

SEQ ID NO: 244994 - DNA, 20 bp, Artificial
  CRISPR gRNA sequence
tgtattttttgtaaagacag

SEQ ID NO: 244995 - DNA, 20 bp, Artificial
  CRISPR gRNA sequence
gtattttttgtaaagacagg

SEQ ID NO: 244996 - DNA, 20 bp, Artificial
  CRISPR gRNA sequence
tattttttgtaaagacaggg

SEQ ID NO: 244997 - DNA, 20 bp, Artificial
  CRISPR gRNA sequence
tttgtaaagacagggtttcg

SEQ ID NO: 244998 - DNA, 20 bp, Artificial
  CRISPR gRNA sequence
ttgtaaagacagggtttcgc

SEQ ID NO: 244999 - DNA, 20 bp, Artificial
  CRISPR gRNA sequence
tgtaaagacagggtttcgcc

SEQ ID NO: 245000 - DNA, 20 bp, Artificial
  CRISPR gRNA sequence
gtaaagacagggtttcgcca

SEQ ID NO: 245001 - DNA, 20 bp, Artificial
  CRISPR gRNA sequence
taaagacagggtttcgccat

SEQ ID NO: 245002 - DNA, 20 bp, Artificial
  CRISPR gRNA sequence
cgccatgttgccaaggctgg

SEQ ID NO: 245003 - DNA, 20 bp, Artificial
  CRISPR gRNA sequence
gccatgttgccaaggctggt

SEQ ID NO: 245004 - DNA, 20 bp, Artificial
  CRISPR gRNA sequence
ccaaggctggtctcgaactc

SEQ ID NO: 245005 - DNA, 20 bp, Artificial
  CRISPR gRNA sequence
gtctcgaactcctgggctca

SEQ ID NO: 245006 - DNA, 20 bp, Artificial
  CRISPR gRNA sequence
gaactcctgggctcaagcga

SEQ ID NO: 245007 - DNA, 20 bp, Artificial
  CRISPR gRNA sequence
ctgggctcaagcgatctgcc

SEQ ID NO: 245008 - DNA, 20 bp, Artificial
  CRISPR gRNA sequence
ggctcaagcgatctgcccac

SEQ ID NO: 245009 - DNA, 20 bp, Artificial
  CRISPR gRNA sequence
aagcgatctgcccaccttgg

SEQ ID NO: 245010 - DNA, 20 bp, Artificial
  CRISPR gRNA sequence
cccaccttggcctcccaaag

SEQ ID NO: 245011 - DNA, 20 bp, Artificial
  CRISPR gRNA sequence
ggcctcccaaagagctggga

SEQ ID NO: 245012 - DNA, 20 bp, Artificial
  CRISPR gRNA sequence
gcctcccaaagagctgggac

SEQ ID NO: 245013 - DNA, 20 bp, Artificial
  CRISPR gRNA sequence
ccaaagagctgggactacag

SEQ ID NO: 245014 - DNA, 20 bp, Artificial
  CRISPR gRNA sequence
ggactacaggcatgagccac

SEQ ID NO: 245015 - DNA, 20 bp, Artificial
  CRISPR gRNA sequence
caggcatgagccactgcacc

SEQ ID NO: 245016 - DNA, 20 bp, Artificial
  CRISPR gRNA sequence
cacccggccccaagtttttt

SEQ ID NO: 245017 - DNA, 20 bp, Artificial
  CRISPR gRNA sequence
ttttgcaaatgggcaaaaaa

SEQ ID NO: 245018 - DNA, 20 bp, Artificial
  CRISPR gRNA sequence
tttgcaaatgggcaaaaaag

SEQ ID NO: 245019 - DNA, 20 bp, Artificial
  CRISPR gRNA sequence
ttgcaaatgggcaaaaaagc

SEQ ID NO: 245020 - DNA, 20 bp, Artificial
  CRISPR gRNA sequence
tgcaaatgggcaaaaaagca

SEQ ID NO: 245021 - DNA, 20 bp, Artificial
  CRISPR gRNA sequence
gcaaatgggcaaaaaagcat

SEQ ID NO: 245022 - DNA, 20 bp, Artificial
  CRISPR gRNA sequence
caaatgggcaaaaaagcatg

SEQ ID NO: 245023 - DNA, 20 bp, Artificial
  CRISPR gRNA sequence
tatttaaaaaaataaacaca

SEQ ID NO: 245024 - DNA, 20 bp, Artificial
  CRISPR gRNA sequence
atttaaaaaaataaacacaa

SEQ ID NO: 245025 - DNA, 20 bp, Artificial
  CRISPR gRNA sequence
tttaaaaaaataaacacaaa

SEQ ID NO: 245026 - DNA, 20 bp, Artificial
  CRISPR gRNA sequence
aaaaaaataaacacaaatgg

SEQ ID NO: 245027 - DNA, 20 bp, Artificial
  CRISPR gRNA sequence
aaaaaataaacacaaatggt

SEQ ID NO: 245028 - DNA, 20 bp, Artificial
  CRISPR gRNA sequence
gacaaggtgctcatcagtaa

SEQ ID NO: 245029 - DNA, 20 bp, Artificial
  CRISPR gRNA sequence
acaaggtgctcatcagtaac

SEQ ID NO: 245030 - DNA, 20 bp, Artificial
  CRISPR gRNA sequence
atcagtaaccaagcaaatgc

SEQ ID NO: 245031 - DNA, 20 bp, Artificial
  CRISPR gRNA sequence
agaccacagtgagatctcat

SEQ ID NO: 245032 - DNA, 20 bp, Artificial
  CRISPR gRNA sequence
attctatacccactggcttg

SEQ ID NO: 245033 - DNA, 20 bp, Artificial
  CRISPR gRNA sequence
tatacccactggcttggcaa

SEQ ID NO: 245034 - DNA, 20 bp, Artificial
  CRISPR gRNA sequence
tacccactggcttggcaaaa

SEQ ID NO: 245035 - DNA, 20 bp, Artificial
  CRISPR gRNA sequence
gcttggcaaaattaagggca

SEQ ID NO: 245036 - DNA, 20 bp, Artificial
  CRISPR gRNA sequence
ggcaaaattaagggcacctg

SEQ ID NO: 245037 - DNA, 20 bp, Artificial
  CRISPR gRNA sequence
gcaaaattaagggcacctga

SEQ ID NO: 245038 - DNA, 20 bp, Artificial
  CRISPR gRNA sequence
agggcacctgatagtaccag

SEQ ID NO: 245039 - DNA, 20 bp, Artificial
  CRISPR gRNA sequence
atagtaccagagggtagcaa

SEQ ID NO: 245040 - DNA, 20 bp, Artificial
  CRISPR gRNA sequence
acatgacacttatatgactg

SEQ ID NO: 245041 - DNA, 20 bp, Artificial
  CRISPR gRNA sequence
catgacacttatatgactga

SEQ ID NO: 245042 - DNA, 20 bp, Artificial
  CRISPR gRNA sequence
atatgactgacgggagtaca

SEQ ID NO: 245043 - DNA, 20 bp, Artificial
  CRISPR gRNA sequence
tatgactgacgggagtacat

SEQ ID NO: 245044 - DNA, 20 bp, Artificial
  CRISPR gRNA sequence
acgggagtacattagaacag

SEQ ID NO: 245045 - DNA, 20 bp, Artificial
  CRISPR gRNA sequence
gaacagccactttgaaaagc

SEQ ID NO: 245046 - DNA, 20 bp, Artificial
  CRISPR gRNA sequence
tgaaaagcaatttggtactg

SEQ ID NO: 245047 - DNA, 20 bp, Artificial
  CRISPR gRNA sequence
gaaaagcaatttggtactgc

SEQ ID NO: 245048 - DNA, 20 bp, Artificial
  CRISPR gRNA sequence
aaaagcaatttggtactgca

SEQ ID NO: 245049 - DNA, 20 bp, Artificial
  CRISPR gRNA sequence
ggtactgcagtagactattg

SEQ ID NO: 245050 - DNA, 20 bp, Artificial
  CRISPR gRNA sequence
gtactgcagtagactattgt

SEQ ID NO: 245051 - DNA, 20 bp, Artificial
  CRISPR gRNA sequence
cagtagactattgttcagaa

SEQ ID NO: 245052 - DNA, 20 bp, Artificial
  CRISPR gRNA sequence
ttgttcagaaatatcttctc

SEQ ID NO: 245053 - DNA, 20 bp, Artificial
  CRISPR gRNA sequence
ttcagaaatatcttctcctc

SEQ ID NO: 245054 - DNA, 20 bp, Artificial
  CRISPR gRNA sequence
agaaatatcttctcctcacc

SEQ ID NO: 245055 - DNA, 20 bp, Artificial
  CRISPR gRNA sequence
ctcctcacccctatttacag

SEQ ID NO: 245056 - DNA, 20 bp, Artificial
  CRISPR gRNA sequence
tcctcacccctatttacaga

SEQ ID NO: 245057 - DNA, 20 bp, Artificial
  CRISPR gRNA sequence
ctcacccctatttacagaat

SEQ ID NO: 245058 - DNA, 20 bp, Artificial
  CRISPR gRNA sequence
acccctatttacagaatata

SEQ ID NO: 245059 - DNA, 20 bp, Artificial
  CRISPR gRNA sequence
tttacagaatatacttttct

SEQ ID NO: 245060 - DNA, 20 bp, Artificial
  CRISPR gRNA sequence
acagaatatacttttctgcc

SEQ ID NO: 245061 - DNA, 20 bp, Artificial
  CRISPR gRNA sequence
cagaatatacttttctgccc

SEQ ID NO: 245062 - DNA, 20 bp, Artificial
  CRISPR gRNA sequence
ttctgccctattgatgcctg

SEQ ID NO: 245063 - DNA, 20 bp, Artificial
  CRISPR gRNA sequence
tctgccctattgatgcctgg

SEQ ID NO: 245064 - DNA, 20 bp, Artificial
  CRISPR gRNA sequence
ctgccctattgatgcctggc

SEQ ID NO: 245065 - DNA, 20 bp, Artificial
  CRISPR gRNA sequence
tgccctattgatgcctggct

SEQ ID NO: 245066 - DNA, 20 bp, Artificial
  CRISPR gRNA sequence
ccctattgatgcctggcttg

SEQ ID NO: 245067 - DNA, 20 bp, Artificial
  CRISPR gRNA sequence
ttgatgcctggcttggctgc

SEQ ID NO: 245068 - DNA, 20 bp, Artificial
  CRISPR gRNA sequence
atgcctggcttggctgcagg

SEQ ID NO: 245069 - DNA, 20 bp, Artificial
  CRISPR gRNA sequence
gcttggctgcaggatttgct

SEQ ID NO: 245070 - DNA, 20 bp, Artificial
  CRISPR gRNA sequence
ggctgcaggatttgctctaa

SEQ ID NO: 245071 - DNA, 20 bp, Artificial
  CRISPR gRNA sequence
gctgcaggatttgctctaaa

SEQ ID NO: 245072 - DNA, 20 bp, Artificial
  CRISPR gRNA sequence
caggatttgctctaaaggtt

SEQ ID NO: 245073 - DNA, 20 bp, Artificial
  CRISPR gRNA sequence
gctctaaaggttatagtaga

SEQ ID NO: 245074 - DNA, 20 bp, Artificial
  CRISPR gRNA sequence
ctctaaaggttatagtagaa

SEQ ID NO: 245075 - DNA, 20 bp, Artificial
  CRISPR gRNA sequence
taaaggttatagtagaacca

SEQ ID NO: 245076 - DNA, 20 bp, Artificial
  CRISPR gRNA sequence
aaggttatagtagaaccaac

SEQ ID NO: 245077 - DNA, 20 bp, Artificial
  CRISPR gRNA sequence
tagtagaaccaactaaatag

SEQ ID NO: 245078 - DNA, 20 bp, Artificial
  CRISPR gRNA sequence
aataggagcagaagtgacag

SEQ ID NO: 245079 - DNA, 20 bp, Artificial
  CRISPR gRNA sequence
gccatgcgatggccaatgtt

SEQ ID NO: 245080 - DNA, 20 bp, Artificial
  CRISPR gRNA sequence
ccatgcgatggccaatgttc

SEQ ID NO: 245081 - DNA, 20 bp, Artificial
  CRISPR gRNA sequence
caaatagaagctgctccctc

SEQ ID NO: 245082 - DNA, 20 bp, Artificial
  CRISPR gRNA sequence
ctccctccacctaaatccca

SEQ ID NO: 245083 - DNA, 20 bp, Artificial
  CRISPR gRNA sequence
cctccacctaaatcccagag

SEQ ID NO: 245084 - DNA, 20 bp, Artificial
  CRISPR gRNA sequence
cacctaaatcccagagtaaa

SEQ ID NO: 245085 - DNA, 20 bp, Artificial
  CRISPR gRNA sequence
aatcccagagtaaaataaca

SEQ ID NO: 245086 - DNA, 20 bp, Artificial
  CRISPR gRNA sequence
gcaataggcatgtcatacaa

SEQ ID NO: 245087 - DNA, 20 bp, Artificial
  CRISPR gRNA sequence
caataggcatgtcatacaaa

SEQ ID NO: 245088 - DNA, 20 bp, Artificial
  CRISPR gRNA sequence
atgcctgtaatcccagcact

SEQ ID NO: 245089 - DNA, 20 bp, Artificial
  CRISPR gRNA sequence
taatcccagcactttgggag

SEQ ID NO: 245090 - DNA, 20 bp, Artificial
  CRISPR gRNA sequence
tgggaggcagaggtgggcag

SEQ ID NO: 245091 - DNA, 20 bp, Artificial
  CRISPR gRNA sequence
gggaggcagaggtgggcaga

SEQ ID NO: 245092 - DNA, 20 bp, Artificial
  CRISPR gRNA sequence
ggaggcagaggtgggcagat

SEQ ID NO: 245093 - DNA, 20 bp, Artificial
  CRISPR gRNA sequence
aggtcaggagtttgagacca

SEQ ID NO: 245094 - DNA, 20 bp, Artificial
  CRISPR gRNA sequence
gagaccagcctggacaacat

SEQ ID NO: 245095 - DNA, 20 bp, Artificial
  CRISPR gRNA sequence
agaccagcctggacaacatg

SEQ ID NO: 245096 - DNA, 20 bp, Artificial
  CRISPR gRNA sequence
gacaacatggtgaaaccccg

SEQ ID NO: 245097 - DNA, 20 bp, Artificial
  CRISPR gRNA sequence
tactaaaaatataaaaatta

SEQ ID NO: 245098 - DNA, 20 bp, Artificial
  CRISPR gRNA sequence
ctaaaaatataaaaattagc

SEQ ID NO: 245099 - DNA, 20 bp, Artificial
  CRISPR gRNA sequence
aaaatataaaaattagccag

SEQ ID NO: 245100 - DNA, 20 bp, Artificial
  CRISPR gRNA sequence
gccaggcgtggtggcacata

SEQ ID NO: 245101 - DNA, 20 bp, Artificial
  CRISPR gRNA sequence
tagtcccagctacttaggag

SEQ ID NO: 245102 - DNA, 20 bp, Artificial
  CRISPR gRNA sequence
cttaggaggctgaggcaggg

SEQ ID NO: 245103 - DNA, 20 bp, Artificial
  CRISPR gRNA sequence
aggaggctgaggcagggaga

SEQ ID NO: 245104 - DNA, 20 bp, Artificial
  CRISPR gRNA sequence
ggaggctgaggcagggagat

SEQ ID NO: 245105 - DNA, 20 bp, Artificial
  CRISPR gRNA sequence
aggcagggagatcacttgaa

SEQ ID NO: 245106 - DNA, 20 bp, Artificial
  CRISPR gRNA sequence
gaaactgggaggcggtgatc

SEQ ID NO: 245107 - DNA, 20 bp, Artificial
  CRISPR gRNA sequence
aaactgggaggcggtgatcc

SEQ ID NO: 245108 - DNA, 20 bp, Artificial
  CRISPR gRNA sequence
ggaggcggtgatccaagatt

SEQ ID NO: 245109 - DNA, 20 bp, Artificial
  CRISPR gRNA sequence
taccactgtactccagcctg

SEQ ID NO: 245110 - DNA, 20 bp, Artificial
  CRISPR gRNA sequence
tactccagcctgggagacag

SEQ ID NO: 245111 - DNA, 20 bp, Artificial
  CRISPR gRNA sequence
cagcctgggagacagagtga

SEQ ID NO: 245112 - DNA, 20 bp, Artificial
  CRISPR gRNA sequence
ggagacagagtgagacactg

SEQ ID NO: 245113 - DNA, 20 bp, Artificial
  CRISPR gRNA sequence
tctcaaaaaaaaataaaatg

SEQ ID NO: 245114 - DNA, 20 bp, Artificial
  CRISPR gRNA sequence
aaaaaaaaataaaatgaata

SEQ ID NO: 245115 - DNA, 20 bp, Artificial
  CRISPR gRNA sequence
aaaaagctatccttagatca

SEQ ID NO: 245116 - DNA, 20 bp, Artificial
  CRISPR gRNA sequence
aaaagctatccttagatcat

SEQ ID NO: 245117 - DNA, 20 bp, Artificial
  CRISPR gRNA sequence
tccttagatcataagccaaa

SEQ ID NO: 245118 - DNA, 20 bp, Artificial
  CRISPR gRNA sequence
agatcataagccaaacaatg

SEQ ID NO: 245119 - DNA, 20 bp, Artificial
  CRISPR gRNA sequence
gatcataagccaaacaatgg

SEQ ID NO: 245120 - DNA, 20 bp, Artificial
  CRISPR gRNA sequence
gcacctgtaatcccagctac

SEQ ID NO: 245121 - DNA, 20 bp, Artificial
  CRISPR gRNA sequence
cacctgtaatcccagctact

SEQ ID NO: 245122 - DNA, 20 bp, Artificial
  CRISPR gRNA sequence
taatcccagctacttgggag

SEQ ID NO: 245123 - DNA, 20 bp, Artificial
  CRISPR gRNA sequence
cttgggagactgaggcgggt

SEQ ID NO: 245124 - DNA, 20 bp, Artificial
  CRISPR gRNA sequence
gggagactgaggcgggtgga

SEQ ID NO: 245125 - DNA, 20 bp, Artificial
  CRISPR gRNA sequence
ggagactgaggcgggtggat

SEQ ID NO: 245126 - DNA, 20 bp, Artificial
  CRISPR gRNA sequence
aggcgggtggatcacttgag

SEQ ID NO: 245127 - DNA, 20 bp, Artificial
  CRISPR gRNA sequence
gagcccaggagtttaaggct

SEQ ID NO: 245128 - DNA, 20 bp, Artificial
  CRISPR gRNA sequence
agcccaggagtttaaggcta

SEQ ID NO: 245129 - DNA, 20 bp, Artificial
  CRISPR gRNA sequence
aaggctaaagtgtgctatga

SEQ ID NO: 245130 - DNA, 20 bp, Artificial
  CRISPR gRNA sequence
aggctaaagtgtgctatgat

SEQ ID NO: 245131 - DNA, 20 bp, Artificial
  CRISPR gRNA sequence
aagtgtgctatgattgtgcc

SEQ ID NO: 245132 - DNA, 20 bp, Artificial
  CRISPR gRNA sequence
tgattgtgcctgtgaatagc

SEQ ID NO: 245133 - DNA, 20 bp, Artificial
  CRISPR gRNA sequence
tgcctgtgaatagccactcc

SEQ ID NO: 245134 - DNA, 20 bp, Artificial
  CRISPR gRNA sequence
tgaatagccactccattcca

SEQ ID NO: 245135 - DNA, 20 bp, Artificial
  CRISPR gRNA sequence
cattccagcctgggcaacag

SEQ ID NO: 245136 - DNA, 20 bp, Artificial
  CRISPR gRNA sequence
cagcctgggcaacagagcaa

SEQ ID NO: 245137 - DNA, 20 bp, Artificial
  CRISPR gRNA sequence
ggcaacagagcaagactgtc

SEQ ID NO: 245138 - DNA, 20 bp, Artificial
  CRISPR gRNA sequence
tctcaagcaaaccaacagac

SEQ ID NO: 245139 - DNA, 20 bp, Artificial
  CRISPR gRNA sequence
aagcaaaccaacagacaaac

SEQ ID NO: 245140 - DNA, 20 bp, Artificial
  CRISPR gRNA sequence
ggccatgggagtttggcggc

SEQ ID NO: 245141 - DNA, 20 bp, Artificial
  CRISPR gRNA sequence
gccatgggagtttggcggcc

SEQ ID NO: 245142 - DNA, 20 bp, Artificial
  CRISPR gRNA sequence
ggcggcccccactctagtgc

SEQ ID NO: 245143 - DNA, 20 bp, Artificial
  CRISPR gRNA sequence
gcggcccccactctagtgct

SEQ ID NO: 245144 - DNA, 20 bp, Artificial
  CRISPR gRNA sequence
tagtgctgtggtaggacaat

SEQ ID NO: 245145 - DNA, 20 bp, Artificial
  CRISPR gRNA sequence
gtgctgtggtaggacaatga

SEQ ID NO: 245146 - DNA, 20 bp, Artificial
  CRISPR gRNA sequence
tggtaggacaatgagctcac

SEQ ID NO: 245147 - DNA, 20 bp, Artificial
  CRISPR gRNA sequence
acaggtgttaattttctcac

SEQ ID NO: 245148 - DNA, 20 bp, Artificial
  CRISPR gRNA sequence
attttctcactgtacttcat

SEQ ID NO: 245149 - DNA, 20 bp, Artificial
  CRISPR gRNA sequence
tctcactgtacttcatacct

SEQ ID NO: 245150 - DNA, 20 bp, Artificial
  CRISPR gRNA sequence
ctcactgtacttcataccta

SEQ ID NO: 245151 - DNA, 20 bp, Artificial
  CRISPR gRNA sequence
tcactgtacttcatacctat

SEQ ID NO: 245152 - DNA, 20 bp, Artificial
  CRISPR gRNA sequence
actgtacttcatacctatca

SEQ ID NO: 245153 - DNA, 20 bp, Artificial
  CRISPR gRNA sequence
tacttcatacctatcatatg

SEQ ID NO: 245154 - DNA, 20 bp, Artificial
  CRISPR gRNA sequence
catacctatcatatgcagtt

SEQ ID NO: 245155 - DNA, 20 bp, Artificial
  CRISPR gRNA sequence
atacctatcatatgcagttc

SEQ ID NO: 245156 - DNA, 20 bp, Artificial
  CRISPR gRNA sequence
tcatatgcagttcatttatt

SEQ ID NO: 245157 - DNA, 20 bp, Artificial
  CRISPR gRNA sequence
atttattggctttggtataa

SEQ ID NO: 245158 - DNA, 20 bp, Artificial
  CRISPR gRNA sequence
attggctttggtataaaata

SEQ ID NO: 245159 - DNA, 20 bp, Artificial
  CRISPR gRNA sequence
ttggctttggtataaaatat

SEQ ID NO: 245160 - DNA, 20 bp, Artificial
  CRISPR gRNA sequence
gctttggtataaaatattat

SEQ ID NO: 245161 - DNA, 20 bp, Artificial
  CRISPR gRNA sequence
tggtataaaatattatgtta

SEQ ID NO: 245162 - DNA, 20 bp, Artificial
  CRISPR gRNA sequence
ggtataaaatattatgttaa

SEQ ID NO: 245163 - DNA, 20 bp, Artificial
  CRISPR gRNA sequence
gtataaaatattatgttaaa

SEQ ID NO: 245164 - DNA, 20 bp, Artificial
  CRISPR gRNA sequence
tgttaaaagttaagaatttt

SEQ ID NO: 245165 - DNA, 20 bp, Artificial
  CRISPR gRNA sequence
aaagttaagaatttttagaa

SEQ ID NO: 245166 - DNA, 20 bp, Artificial
  CRISPR gRNA sequence
agaatttttagaatgtaacc

SEQ ID NO: 245167 - DNA, 20 bp, Artificial
  CRISPR gRNA sequence
ttagaatgtaacctggctta

SEQ ID NO: 245168 - DNA, 20 bp, Artificial
  CRISPR gRNA sequence
tagaatgtaacctggcttaa

SEQ ID NO: 245169 - DNA, 20 bp, Artificial
  CRISPR gRNA sequence
agaatgtaacctggcttaaa

SEQ ID NO: 245170 - DNA, 20 bp, Artificial
  CRISPR gRNA sequence
gaatgtaacctggcttaaaa

SEQ ID NO: 245171 - DNA, 20 bp, Artificial
  CRISPR gRNA sequence
gcttaaaagggagcaggaca

SEQ ID NO: 245172 - DNA, 20 bp, Artificial
  CRISPR gRNA sequence
aaaagggagcaggacaaagg

SEQ ID NO: 245173 - DNA, 20 bp, Artificial
  CRISPR gRNA sequence
aaagggagcaggacaaaggc

SEQ ID NO: 245174 - DNA, 20 bp, Artificial
  CRISPR gRNA sequence
gaactctttccaaaacttcc

SEQ ID NO: 245175 - DNA, 20 bp, Artificial
  CRISPR gRNA sequence
aactctttccaaaacttcct

SEQ ID NO: 245176 - DNA, 20 bp, Artificial
  CRISPR gRNA sequence
tttccaaaacttcctccagg

SEQ ID NO: 245177 - DNA, 20 bp, Artificial
  CRISPR gRNA sequence
tccaaaacttcctccaggcc

SEQ ID NO: 245178 - DNA, 20 bp, Artificial
  CRISPR gRNA sequence
ccaaaacttcctccaggcct

SEQ ID NO: 245179 - DNA, 20 bp, Artificial
  CRISPR gRNA sequence
caaaacttcctccaggcctg

SEQ ID NO: 245180 - DNA, 20 bp, Artificial
  CRISPR gRNA sequence
cctccaggcctgaggttttt

SEQ ID NO: 245181 - DNA, 20 bp, Artificial
  CRISPR gRNA sequence
ctccaggcctgaggtttttt

SEQ ID NO: 245182 - DNA, 20 bp, Artificial
  CRISPR gRNA sequence
caggcctgaggttttttgtc

SEQ ID NO: 245183 - DNA, 20 bp, Artificial
  CRISPR gRNA sequence
aggttttttgtccttgaccc

SEQ ID NO: 245184 - DNA, 20 bp, Artificial
  CRISPR gRNA sequence
tttgtccttgaccctaaact

SEQ ID NO: 245185 - DNA, 20 bp, Artificial
  CRISPR gRNA sequence
ttgtccttgaccctaaactc

SEQ ID NO: 245186 - DNA, 20 bp, Artificial
  CRISPR gRNA sequence
tgtccttgaccctaaactca

SEQ ID NO: 245187 - DNA, 20 bp, Artificial
  CRISPR gRNA sequence
gtccttgaccctaaactcag

SEQ ID NO: 245188 - DNA, 20 bp, Artificial
  CRISPR gRNA sequence
tccttgaccctaaactcagg

SEQ ID NO: 245189 - DNA, 20 bp, Artificial
  CRISPR gRNA sequence
gaccctaaactcaggcactc

SEQ ID NO: 245190 - DNA, 20 bp, Artificial
  CRISPR gRNA sequence
accctaaactcaggcactct

SEQ ID NO: 245191 - DNA, 20 bp, Artificial
  CRISPR gRNA sequence
aactcaggcactctgctcat

SEQ ID NO: 245192 - DNA, 20 bp, Artificial
  CRISPR gRNA sequence
aggcactctgctcatactcc

SEQ ID NO: 245193 - DNA, 20 bp, Artificial
  CRISPR gRNA sequence
tgctcatactcccccctgac

SEQ ID NO: 245194 - DNA, 20 bp, Artificial
  CRISPR gRNA sequence
ctcatactcccccctgacgg

SEQ ID NO: 245195 - DNA, 20 bp, Artificial
  CRISPR gRNA sequence
atactcccccctgacggtgg

SEQ ID NO: 245196 - DNA, 20 bp, Artificial
  CRISPR gRNA sequence
ccccctgacggtggagcatg

SEQ ID NO: 245197 - DNA, 20 bp, Artificial
  CRISPR gRNA sequence
acggtggagcatgtcgtgtt

SEQ ID NO: 245198 - DNA, 20 bp, Artificial
  CRISPR gRNA sequence
catgacagaacccacggaaa

SEQ ID NO: 245199 - DNA, 20 bp, Artificial
  CRISPR gRNA sequence
tagtcgggtacttactgcac

SEQ ID NO: 245200 - DNA, 20 bp, Artificial
  CRISPR gRNA sequence
agtcgggtacttactgcacc

SEQ ID NO: 245201 - DNA, 20 bp, Artificial
  CRISPR gRNA sequence
gtcgggtacttactgcacct

SEQ ID NO: 245202 - DNA, 20 bp, Artificial
  CRISPR gRNA sequence
actgcacctcgtggcttatt

SEQ ID NO: 245203 - DNA, 20 bp, Artificial
  CRISPR gRNA sequence
ctgcacctcgtggcttattg

SEQ ID NO: 245204 - DNA, 20 bp, Artificial
  CRISPR gRNA sequence
cacctcgtggcttattgtca

SEQ ID NO: 245205 - DNA, 20 bp, Artificial
  CRISPR gRNA sequence
gtggcttattgtcatatgtc

SEQ ID NO: 245206 - DNA, 20 bp, Artificial
  CRISPR gRNA sequence
attgtcatatgtcatattag

SEQ ID NO: 245207 - DNA, 20 bp, Artificial
  CRISPR gRNA sequence
ttgtcatatgtcatattagc

SEQ ID NO: 245208 - DNA, 20 bp, Artificial
  CRISPR gRNA sequence
tcatatgtcatattagcacc

SEQ ID NO: 245209 - DNA, 20 bp, Artificial
  CRISPR gRNA sequence
gcaccaaaaaacaaacctgc

SEQ ID NO: 245210 - DNA, 20 bp, Artificial
  CRISPR gRNA sequence
cattgattttgattataatt

SEQ ID NO: 245211 - DNA, 20 bp, Artificial
  CRISPR gRNA sequence
attttgattataattatagt

SEQ ID NO: 245212 - DNA, 20 bp, Artificial
  CRISPR gRNA sequence
tgattataattatagttgga

SEQ ID NO: 245213 - DNA, 20 bp, Artificial
  CRISPR gRNA sequence
gattataattatagttggac

SEQ ID NO: 245214 - DNA, 20 bp, Artificial
  CRISPR gRNA sequence
attataattatagttggacc

SEQ ID NO: 245215 - DNA, 20 bp, Artificial
  CRISPR gRNA sequence
taattatagttggaccactg

SEQ ID NO: 245216 - DNA, 20 bp, Artificial
  CRISPR gRNA sequence
tagttggaccactggactat

SEQ ID NO: 245217 - DNA, 20 bp, Artificial
  CRISPR gRNA sequence
gaccactggactatgtaatt

SEQ ID NO: 245218 - DNA, 20 bp, Artificial
  CRISPR gRNA sequence
gactatgtaattgaatttaa

SEQ ID NO: 245219 - DNA, 20 bp, Artificial
  CRISPR gRNA sequence
tgtaattgaatttaaactat

SEQ ID NO: 245220 - DNA, 20 bp, Artificial
  CRISPR gRNA sequence
aatttaaactataattttct

SEQ ID NO: 245221 - DNA, 20 bp, Artificial
  CRISPR gRNA sequence
aaactataattttctttgga

SEQ ID NO: 245222 - DNA, 20 bp, Artificial
  CRISPR gRNA sequence
aactataattttctttggat

SEQ ID NO: 245223 - DNA, 20 bp, Artificial
  CRISPR gRNA sequence
taattttctttggatttcaa

SEQ ID NO: 245224 - DNA, 20 bp, Artificial
  CRISPR gRNA sequence
tctttggatttcaaaaaaac

SEQ ID NO: 245225 - DNA, 20 bp, Artificial
  CRISPR gRNA sequence
ctttggatttcaaaaaaact

SEQ ID NO: 245226 - DNA, 20 bp, Artificial
  CRISPR gRNA sequence
tttggatttcaaaaaaacta

SEQ ID NO: 245227 - DNA, 20 bp, Artificial
  CRISPR gRNA sequence
tggatttcaaaaaaactagc

SEQ ID NO: 245228 - DNA, 20 bp, Artificial
  CRISPR gRNA sequence
ggatttcaaaaaaactagct

SEQ ID NO: 245229 - DNA, 20 bp, Artificial
  CRISPR gRNA sequence
gatttcaaaaaaactagctc

SEQ ID NO: 245230 - DNA, 20 bp, Artificial
  CRISPR gRNA sequence
caaaaaaactagctcaaacc

SEQ ID NO: 245231 - DNA, 20 bp, Artificial
  CRISPR gRNA sequence
aaaaaaactagctcaaacct

SEQ ID NO: 245232 - DNA, 20 bp, Artificial
  CRISPR gRNA sequence
gctcaaacctgttaagtggt

SEQ ID NO: 245233 - DNA, 20 bp, Artificial
  CRISPR gRNA sequence
aaacctgttaagtggtatct

SEQ ID NO: 245234 - DNA, 20 bp, Artificial
  CRISPR gRNA sequence
ttaagtggtatctagaaaat

SEQ ID NO: 245235 - DNA, 20 bp, Artificial
  CRISPR gRNA sequence
agtggtatctagaaaatgct

SEQ ID NO: 245236 - DNA, 20 bp, Artificial
  CRISPR gRNA sequence
gaaaatgctttttttttttt

SEQ ID NO: 245237 - DNA, 20 bp, Artificial
  CRISPR gRNA sequence
ttttttttttttttttatca

SEQ ID NO: 245238 - DNA, 20 bp, Artificial
  CRISPR gRNA sequence
tttttttttttttttatcac

SEQ ID NO: 245239 - DNA, 20 bp, Artificial
  CRISPR gRNA sequence
ttttttttttttttatcacc

SEQ ID NO: 245240 - DNA, 20 bp, Artificial
  CRISPR gRNA sequence
tttttttttttttatcacca

SEQ ID NO: 245241 - DNA, 20 bp, Artificial
  CRISPR gRNA sequence
ttttttttttttatcaccag

SEQ ID NO: 245242 - DNA, 20 bp, Artificial
  CRISPR gRNA sequence
tttttttttttatcaccagc

SEQ ID NO: 245243 - DNA, 20 bp, Artificial
  CRISPR gRNA sequence
ttttttttttatcaccagct

SEQ ID NO: 245244 - DNA, 20 bp, Artificial
  CRISPR gRNA sequence
tttttttttatcaccagctc

SEQ ID NO: 245245 - DNA, 20 bp, Artificial
  CRISPR gRNA sequence
ttttttttatcaccagctct

SEQ ID NO: 245246 - DNA, 20 bp, Artificial
  CRISPR gRNA sequence
tttttttatcaccagctctg

SEQ ID NO: 245247 - DNA, 20 bp, Artificial
  CRISPR gRNA sequence
ttttttatcaccagctctgt

SEQ ID NO: 245248 - DNA, 20 bp, Artificial
  CRISPR gRNA sequence
tttttatcaccagctctgtc

SEQ ID NO: 245249 - DNA, 20 bp, Artificial
  CRISPR gRNA sequence
ttttatcaccagctctgtcc

SEQ ID NO: 245250 - DNA, 20 bp, Artificial
  CRISPR gRNA sequence
tttatcaccagctctgtcct

SEQ ID NO: 245251 - DNA, 20 bp, Artificial
  CRISPR gRNA sequence
ttatcaccagctctgtcctc

SEQ ID NO: 245252 - DNA, 20 bp, Artificial
  CRISPR gRNA sequence
tatcaccagctctgtcctca

SEQ ID NO: 245253 - DNA, 20 bp, Artificial
  CRISPR gRNA sequence
atcaccagctctgtcctcat

SEQ ID NO: 245254 - DNA, 20 bp, Artificial
  CRISPR gRNA sequence
tcaccagctctgtcctcatc

SEQ ID NO: 245255 - DNA, 20 bp, Artificial
  CRISPR gRNA sequence
tgtcctcatctgtctgttct

SEQ ID NO: 245256 - DNA, 20 bp, Artificial
  CRISPR gRNA sequence
tcctcatctgtctgttctgt

SEQ ID NO: 245257 - DNA, 20 bp, Artificial
  CRISPR gRNA sequence
atctgtctgttctgttaaaa

SEQ ID NO: 245258 - DNA, 20 bp, Artificial
  CRISPR gRNA sequence
tctgttctgttaaaagtggt

SEQ ID NO: 245259 - DNA, 20 bp, Artificial
  CRISPR gRNA sequence
ttctgttaaaagtggtgcat

SEQ ID NO: 245260 - DNA, 20 bp, Artificial
  CRISPR gRNA sequence
tgttaaaagtggtgcattat

SEQ ID NO: 245261 - DNA, 20 bp, Artificial
  CRISPR gRNA sequence
ttaaaagtggtgcattattt

SEQ ID NO: 245262 - DNA, 20 bp, Artificial
  CRISPR gRNA sequence
aaagtggtgcattattttgg

SEQ ID NO: 245263 - DNA, 20 bp, Artificial
  CRISPR gRNA sequence
ttttggccgggcctggcagt

SEQ ID NO: 245264 - DNA, 20 bp, Artificial
  CRISPR gRNA sequence
tggccgggcctggcagttca

SEQ ID NO: 245265 - DNA, 20 bp, Artificial
  CRISPR gRNA sequence
ggccgggcctggcagttcat

SEQ ID NO: 245266 - DNA, 20 bp, Artificial
  CRISPR gRNA sequence
gccgggcctggcagttcatg

SEQ ID NO: 245267 - DNA, 20 bp, Artificial
  CRISPR gRNA sequence
gcagttcatgtctgtaatcc

SEQ ID NO: 245268 - DNA, 20 bp, Artificial
  CRISPR gRNA sequence
atgtctgtaatcccagcact

SEQ ID NO: 245269 - DNA, 20 bp, Artificial
  CRISPR gRNA sequence
taatcccagcactttgggag

SEQ ID NO: 245270 - DNA, 20 bp, Artificial
  CRISPR gRNA sequence
tgggaggccaaagtgaacct

SEQ ID NO: 245271 - DNA, 20 bp, Artificial
  CRISPR gRNA sequence
gggaggccaaagtgaaccta

SEQ ID NO: 245272 - DNA, 20 bp, Artificial
  CRISPR gRNA sequence
ggaggccaaagtgaacctag

SEQ ID NO: 245273 - DNA, 20 bp, Artificial
  CRISPR gRNA sequence
ggagtttgagaccagcctgt

SEQ ID NO: 245274 - DNA, 20 bp, Artificial
  CRISPR gRNA sequence
gagaccagcctgtacaacat

SEQ ID NO: 245275 - DNA, 20 bp, Artificial
  CRISPR gRNA sequence
agaccagcctgtacaacatg

SEQ ID NO: 245276 - DNA, 20 bp, Artificial
  CRISPR gRNA sequence
tacaacatggtgaaatgcca

SEQ ID NO: 245277 - DNA, 20 bp, Artificial
  CRISPR gRNA sequence
taccaaacaaaaaacaaaaa

SEQ ID NO: 245278 - DNA, 20 bp, Artificial
  CRISPR gRNA sequence
accaaacaaaaaacaaaaaa

SEQ ID NO: 245279 - DNA, 20 bp, Artificial
  CRISPR gRNA sequence
ccaaacaaaaaacaaaaaag

SEQ ID NO: 245280 - DNA, 20 bp, Artificial
  CRISPR gRNA sequence
gtcaggtgtggtggcccttc

SEQ ID NO: 245281 - DNA, 20 bp, Artificial
  CRISPR gRNA sequence
ccttgtagttccagctactc

SEQ ID NO: 245282 - DNA, 20 bp, Artificial
  CRISPR gRNA sequence
cttgtagttccagctactca

SEQ ID NO: 245283 - DNA, 20 bp, Artificial
  CRISPR gRNA sequence
gtagttccagctactcagga

SEQ ID NO: 245284 - DNA, 20 bp, Artificial
  CRISPR gRNA sequence
tagttccagctactcaggag

SEQ ID NO: 245285 - DNA, 20 bp, Artificial
  CRISPR gRNA sequence
cagctactcaggagactgag

SEQ ID NO: 245286 - DNA, 20 bp, Artificial
  CRISPR gRNA sequence
ctcaggagactgaggcagga

SEQ ID NO: 245287 - DNA, 20 bp, Artificial
  CRISPR gRNA sequence
aggagactgaggcaggagga

SEQ ID NO: 245288 - DNA, 20 bp, Artificial
  CRISPR gRNA sequence
aggcaggaggatcacttgag

SEQ ID NO: 245289 - DNA, 20 bp, Artificial
  CRISPR gRNA sequence
gagctcccagaggtcaaggc

SEQ ID NO: 245290 - DNA, 20 bp, Artificial
  CRISPR gRNA sequence
agctcccagaggtcaaggct

SEQ ID NO: 245291 - DNA, 20 bp, Artificial
  CRISPR gRNA sequence
ccagaggtcaaggctgcaga

SEQ ID NO: 245292 - DNA, 20 bp, Artificial
  CRISPR gRNA sequence
cagagagccatggtggtgcc

SEQ ID NO: 245293 - DNA, 20 bp, Artificial
  CRISPR gRNA sequence
cactccagcctgggtgacag

SEQ ID NO: 245294 - DNA, 20 bp, Artificial
  CRISPR gRNA sequence
cagcctgggtgacagagtga

SEQ ID NO: 245295 - DNA, 20 bp, Artificial
  CRISPR gRNA sequence
ggtgacagagtgagaccctg

SEQ ID NO: 245296 - DNA, 20 bp, Artificial
  CRISPR gRNA sequence
tcaaaaaaaaaaaaaaagtg

SEQ ID NO: 245297 - DNA, 20 bp, Artificial
  CRISPR gRNA sequence
ttaaaggccaactcattggc

SEQ ID NO: 245298 - DNA, 20 bp, Artificial
  CRISPR gRNA sequence
taaaggccaactcattggca

SEQ ID NO: 245299 - DNA, 20 bp, Artificial
  CRISPR gRNA sequence
aaaggccaactcattggcat

SEQ ID NO: 245300 - DNA, 20 bp, Artificial
  CRISPR gRNA sequence
aaggccaactcattggcatt

SEQ ID NO: 245301 - DNA, 20 bp, Artificial
  CRISPR gRNA sequence
attggcatttagaaaagaac

SEQ ID NO: 245302 - DNA, 20 bp, Artificial
  CRISPR gRNA sequence
gcatttagaaaagaacgtgt

SEQ ID NO: 245303 - DNA, 20 bp, Artificial
  CRISPR gRNA sequence
agaaaagaacgtgtgttggg

SEQ ID NO: 245304 - DNA, 20 bp, Artificial
  CRISPR gRNA sequence
gaaaagaacgtgtgttgggg

SEQ ID NO: 245305 - DNA, 20 bp, Artificial
  CRISPR gRNA sequence
ggggaatcctgggtattatg

SEQ ID NO: 245306 - DNA, 20 bp, Artificial
  CRISPR gRNA sequence
ggtattatgtaggatggtgt

SEQ ID NO: 245307 - DNA, 20 bp, Artificial
  CRISPR gRNA sequence
tgtaggatggtgttcttgct

SEQ ID NO: 245308 - DNA, 20 bp, Artificial
  CRISPR gRNA sequence
ttgcttttgaaagctgtgat

SEQ ID NO: 245309 - DNA, 20 bp, Artificial
  CRISPR gRNA sequence
gcttttgaaagctgtgatag

SEQ ID NO: 245310 - DNA, 20 bp, Artificial
  CRISPR gRNA sequence
cttttgaaagctgtgatagc

SEQ ID NO: 245311 - DNA, 20 bp, Artificial
  CRISPR gRNA sequence
ttgaaagctgtgatagcgga

SEQ ID NO: 245312 - DNA, 20 bp, Artificial
  CRISPR gRNA sequence
tgaaagctgtgatagcggat

SEQ ID NO: 245313 - DNA, 20 bp, Artificial
  CRISPR gRNA sequence
gaaagctgtgatagcggatg

SEQ ID NO: 245314 - DNA, 20 bp, Artificial
  CRISPR gRNA sequence
aaagctgtgatagcggatga

SEQ ID NO: 245315 - DNA, 20 bp, Artificial
  CRISPR gRNA sequence
tgatagcggatgactcatat

SEQ ID NO: 245316 - DNA, 20 bp, Artificial
  CRISPR gRNA sequence
atatttccttgcttcttttc

SEQ ID NO: 245317 - DNA, 20 bp, Artificial
  CRISPR gRNA sequence
ccttgcttcttttcaagaaa

SEQ ID NO: 245318 - DNA, 20 bp, Artificial
  CRISPR gRNA sequence
cttgcttcttttcaagaaag

SEQ ID NO: 245319 - DNA, 20 bp, Artificial
  CRISPR gRNA sequence
gcttcttttcaagaaagtcc

SEQ ID NO: 245320 - DNA, 20 bp, Artificial
  CRISPR gRNA sequence
cttcttttcaagaaagtccc

SEQ ID NO: 245321 - DNA, 20 bp, Artificial
  CRISPR gRNA sequence
cttttcaagaaagtcccaac

SEQ ID NO: 245322 - DNA, 20 bp, Artificial
  CRISPR gRNA sequence
ttttcaagaaagtcccaaca

SEQ ID NO: 245323 - DNA, 20 bp, Artificial
  CRISPR gRNA sequence
ttcaagaaagtcccaacagc

SEQ ID NO: 245324 - DNA, 20 bp, Artificial
  CRISPR gRNA sequence
tcaagaaagtcccaacagcc

SEQ ID NO: 245325 - DNA, 20 bp, Artificial
  CRISPR gRNA sequence
caagaaagtcccaacagccc

SEQ ID NO: 245326 - DNA, 20 bp, Artificial
  CRISPR gRNA sequence
aagaaagtcccaacagccct

SEQ ID NO: 245327 - DNA, 20 bp, Artificial
  CRISPR gRNA sequence
ttgacttccatttcacagtt

SEQ ID NO: 245328 - DNA, 20 bp, Artificial
  CRISPR gRNA sequence
acttccatttcacagttcac

SEQ ID NO: 245329 - DNA, 20 bp, Artificial
  CRISPR gRNA sequence
ccatttcacagttcacatcc

SEQ ID NO: 245330 - DNA, 20 bp, Artificial
  CRISPR gRNA sequence
catttcacagttcacatcct

SEQ ID NO: 245331 - DNA, 20 bp, Artificial
  CRISPR gRNA sequence
cacagttcacatcctccttc

SEQ ID NO: 245332 - DNA, 20 bp, Artificial
  CRISPR gRNA sequence
acagttcacatcctccttct

SEQ ID NO: 245333 - DNA, 20 bp, Artificial
  CRISPR gRNA sequence
acatcctccttcttcttctt

SEQ ID NO: 245334 - DNA, 20 bp, Artificial
  CRISPR gRNA sequence
cttcttcttcttctggaaat

SEQ ID NO: 245335 - DNA, 20 bp, Artificial
  CRISPR gRNA sequence
cttcttcttctggaaatcgg

SEQ ID NO: 245336 - DNA, 20 bp, Artificial
  CRISPR gRNA sequence
ttcttcttctggaaatcggc

SEQ ID NO: 245337 - DNA, 20 bp, Artificial
  CRISPR gRNA sequence
cttcttctggaaatcggcag

SEQ ID NO: 245338 - DNA, 20 bp, Artificial
  CRISPR gRNA sequence
ttcttctggaaatcggcagc

SEQ ID NO: 245339 - DNA, 20 bp, Artificial
  CRISPR gRNA sequence
cttctggaaatcggcagcta

SEQ ID NO: 245340 - DNA, 20 bp, Artificial
  CRISPR gRNA sequence
ttctggaaatcggcagctac

SEQ ID NO: 245341 - DNA, 20 bp, Artificial
  CRISPR gRNA sequence
ctggaaatcggcagctacag

SEQ ID NO: 245342 - DNA, 20 bp, Artificial
  CRISPR gRNA sequence
tggaaatcggcagctacagc

SEQ ID NO: 245343 - DNA, 20 bp, Artificial
  CRISPR gRNA sequence
gaaatcggcagctacagcca

SEQ ID NO: 245344 - DNA, 20 bp, Artificial
  CRISPR gRNA sequence
cagccatcttcctcttgagt

SEQ ID NO: 245345 - DNA, 20 bp, Artificial
  CRISPR gRNA sequence
cctcttgagtagtttgtact

SEQ ID NO: 245346 - DNA, 20 bp, Artificial
  CRISPR gRNA sequence
ctcttgagtagtttgtactg

SEQ ID NO: 245347 - DNA, 20 bp, Artificial
  CRISPR gRNA sequence
ttgagtagtttgtactggtc

SEQ ID NO: 245348 - DNA, 20 bp, Artificial
  CRISPR gRNA sequence
gagtagtttgtactggtctc

SEQ ID NO: 245349 - DNA, 20 bp, Artificial
  CRISPR gRNA sequence
agtagtttgtactggtctca

SEQ ID NO: 245350 - DNA, 20 bp, Artificial
  CRISPR gRNA sequence
gtactggtctcataaatgct

SEQ ID NO: 245351 - DNA, 20 bp, Artificial
  CRISPR gRNA sequence
tactggtctcataaatgcta

SEQ ID NO: 245352 - DNA, 20 bp, Artificial
  CRISPR gRNA sequence
gtctcataaatgctaaaaaa

SEQ ID NO: 245353 - DNA, 20 bp, Artificial
  CRISPR gRNA sequence
ataaatgctaaaaaaaaaat

SEQ ID NO: 245354 - DNA, 20 bp, Artificial
  CRISPR gRNA sequence
aaaaaaaaattttaagatac

SEQ ID NO: 245355 - DNA, 20 bp, Artificial
  CRISPR gRNA sequence
taagatacgtatattttgtt

SEQ ID NO: 245356 - DNA, 20 bp, Artificial
  CRISPR gRNA sequence
aagatacgtatattttgttg

SEQ ID NO: 245357 - DNA, 20 bp, Artificial
  CRISPR gRNA sequence
agatacgtatattttgttgt

SEQ ID NO: 245358 - DNA, 20 bp, Artificial
  CRISPR gRNA sequence
tgttgtctatttgaatcatt

SEQ ID NO: 245359 - DNA, 20 bp, Artificial
  CRISPR gRNA sequence
gttgtctatttgaatcattt

SEQ ID NO: 245360 - DNA, 20 bp, Artificial
  CRISPR gRNA sequence
ttgtctatttgaatcattta

SEQ ID NO: 245361 - DNA, 20 bp, Artificial
  CRISPR gRNA sequence
tctatttgaatcatttaaca

SEQ ID NO: 245362 - DNA, 20 bp, Artificial
  CRISPR gRNA sequence
tttgaatcatttaacactta

SEQ ID NO: 245363 - DNA, 20 bp, Artificial
  CRISPR gRNA sequence
gaatcatttaacacttattt

SEQ ID NO: 245364 - DNA, 20 bp, Artificial
  CRISPR gRNA sequence
aatcatttaacacttatttt

SEQ ID NO: 245365 - DNA, 20 bp, Artificial
  CRISPR gRNA sequence
aacacttattttccataaat

SEQ ID NO: 245366 - DNA, 20 bp, Artificial
  CRISPR gRNA sequence
acacttattttccataaatt

SEQ ID NO: 245367 - DNA, 20 bp, Artificial
  CRISPR gRNA sequence
attttccataaattatagct

SEQ ID NO: 245368 - DNA, 20 bp, Artificial
  CRISPR gRNA sequence
ttttccataaattatagctg

SEQ ID NO: 245369 - DNA, 20 bp, Artificial
  CRISPR gRNA sequence
tccataaattatagctgcag

SEQ ID NO: 245370 - DNA, 20 bp, Artificial
  CRISPR gRNA sequence
ccataaattatagctgcaga

SEQ ID NO: 245371 - DNA, 20 bp, Artificial
  CRISPR gRNA sequence
cataaattatagctgcagaa

SEQ ID NO: 245372 - DNA, 20 bp, Artificial
  CRISPR gRNA sequence
tagctgcagaacatctctaa

SEQ ID NO: 245373 - DNA, 20 bp, Artificial
  CRISPR gRNA sequence
cagaacatctctaagcagca

SEQ ID NO: 245374 - DNA, 20 bp, Artificial
  CRISPR gRNA sequence
taagcagcaaacattctccc

SEQ ID NO: 245375 - DNA, 20 bp, Artificial
  CRISPR gRNA sequence
agcagcaaacattctcccct

SEQ ID NO: 245376 - DNA, 20 bp, Artificial
  CRISPR gRNA sequence
tcccctttaattttaacaaa

SEQ ID NO: 245377 - DNA, 20 bp, Artificial
  CRISPR gRNA sequence
ccctttaattttaacaaact

SEQ ID NO: 245378 - DNA, 20 bp, Artificial
  CRISPR gRNA sequence
taattttaacaaactcagcc

SEQ ID NO: 245379 - DNA, 20 bp, Artificial
  CRISPR gRNA sequence
aattttaacaaactcagcca

SEQ ID NO: 245380 - DNA, 20 bp, Artificial
  CRISPR gRNA sequence
attttaacaaactcagccag

SEQ ID NO: 245381 - DNA, 20 bp, Artificial
  CRISPR gRNA sequence
taacaaactcagccaggcgt

SEQ ID NO: 245382 - DNA, 20 bp, Artificial
  CRISPR gRNA sequence
aacaaactcagccaggcgtg

SEQ ID NO: 245383 - DNA, 20 bp, Artificial
  CRISPR gRNA sequence
acaaactcagccaggcgtgg

SEQ ID NO: 245384 - DNA, 20 bp, Artificial
  CRISPR gRNA sequence
agccaggcgtggtggctcat

SEQ ID NO: 245385 - DNA, 20 bp, Artificial
  CRISPR gRNA sequence
atgcctgtaaccccagcact

SEQ ID NO: 245386 - DNA, 20 bp, Artificial
  CRISPR gRNA sequence
taaccccagcactttggaag

SEQ ID NO: 245387 - DNA, 20 bp, Artificial
  CRISPR gRNA sequence
tggaaggccgaggtgggcag

SEQ ID NO: 245388 - DNA, 20 bp, Artificial
  CRISPR gRNA sequence
ggaaggccgaggtgggcaga

SEQ ID NO: 245389 - DNA, 20 bp, Artificial
  CRISPR gRNA sequence
gaaggccgaggtgggcagat

SEQ ID NO: 245390 - DNA, 20 bp, Artificial
  CRISPR gRNA sequence
gaggtcaggagttcaagacc

SEQ ID NO: 245391 - DNA, 20 bp, Artificial
  CRISPR gRNA sequence
aggtcaggagttcaagacca

SEQ ID NO: 245392 - DNA, 20 bp, Artificial
  CRISPR gRNA sequence
aagaccagcgtggccaacat

SEQ ID NO: 245393 - DNA, 20 bp, Artificial
  CRISPR gRNA sequence
ctaaaaatacaaaaattagc

SEQ ID NO: 245394 - DNA, 20 bp, Artificial
  CRISPR gRNA sequence
aaaatacaaaaattagccgg

SEQ ID NO: 245395 - DNA, 20 bp, Artificial
  CRISPR gRNA sequence
gccgggcgtggtggcaggtg

SEQ ID NO: 245396 - DNA, 20 bp, Artificial
  CRISPR gRNA sequence
taatcccagctactcaggag

SEQ ID NO: 245397 - DNA, 20 bp, Artificial
  CRISPR gRNA sequence
ctcaggaggctgaggcagga

SEQ ID NO: 245398 - DNA, 20 bp, Artificial
  CRISPR gRNA sequence
aggaggctgaggcaggacaa

SEQ ID NO: 245399 - DNA, 20 bp, Artificial
  CRISPR gRNA sequence
aggcaggacaattgcttgaa

SEQ ID NO: 245400 - DNA, 20 bp, Artificial
  CRISPR gRNA sequence
cttgaacccaggagacagag

SEQ ID NO: 245401 - DNA, 20 bp, Artificial
  CRISPR gRNA sequence
gaacccaggagacagagatt

SEQ ID NO: 245402 - DNA, 20 bp, Artificial
  CRISPR gRNA sequence
aacccaggagacagagattg

SEQ ID NO: 245403 - DNA, 20 bp, Artificial
  CRISPR gRNA sequence
cagtgacttgagatggcgcc

SEQ ID NO: 245404 - DNA, 20 bp, Artificial
  CRISPR gRNA sequence
gagatggcgccattgcactc

SEQ ID NO: 245405 - DNA, 20 bp, Artificial
  CRISPR gRNA sequence
agatggcgccattgcactcc

SEQ ID NO: 245406 - DNA, 20 bp, Artificial
  CRISPR gRNA sequence
cactccagcctgggtgacaa

SEQ ID NO: 245407 - DNA, 20 bp, Artificial
  CRISPR gRNA sequence
cagcctgggtgacaacagcg

SEQ ID NO: 245408 - DNA, 20 bp, Artificial
  CRISPR gRNA sequence
ggtgacaacagcgaaactct

SEQ ID NO: 245409 - DNA, 20 bp, Artificial
  CRISPR gRNA sequence
tgtctcaaaaaacaaaacaa

SEQ ID NO: 245410 - DNA, 20 bp, Artificial
  CRISPR gRNA sequence
tctcaaaaaacaaaacaaaa

SEQ ID NO: 245411 - DNA, 20 bp, Artificial
  CRISPR gRNA sequence
aaaaaacaaaacaaaacaaa

SEQ ID NO: 245412 - DNA, 20 bp, Artificial
  CRISPR gRNA sequence
atgcctgtaatcccagcact

SEQ ID NO: 245413 - DNA, 20 bp, Artificial
  CRISPR gRNA sequence
taatcccagcactttgggag

SEQ ID NO: 245414 - DNA, 20 bp, Artificial
  CRISPR gRNA sequence
tgggaggctgaggccggtgg

SEQ ID NO: 245415 - DNA, 20 bp, Artificial
  CRISPR gRNA sequence
gggaggctgaggccggtgga

SEQ ID NO: 245416 - DNA, 20 bp, Artificial
  CRISPR gRNA sequence
ggaggctgaggccggtggat

SEQ ID NO: 245417 - DNA, 20 bp, Artificial
  CRISPR gRNA sequence
aggccggtggatcacaaggt

SEQ ID NO: 245418 - DNA, 20 bp, Artificial
  CRISPR gRNA sequence
aagaccagcctggccaagat

SEQ ID NO: 245419 - DNA, 20 bp, Artificial
  CRISPR gRNA sequence
gccaagatggtgaaaccccg

SEQ ID NO: 245420 - DNA, 20 bp, Artificial
  CRISPR gRNA sequence
tactaaaaataccaaaaaaa

SEQ ID NO: 245421 - DNA, 20 bp, Artificial
  CRISPR gRNA sequence
ctaaaaataccaaaaaaatt

SEQ ID NO: 245422 - DNA, 20 bp, Artificial
  CRISPR gRNA sequence
aaaataccaaaaaaattagc

SEQ ID NO: 245423 - DNA, 20 bp, Artificial
  CRISPR gRNA sequence
gctgggcgtggtggtgggcg

SEQ ID NO: 245424 - DNA, 20 bp, Artificial
  CRISPR gRNA sequence
ggcgtggtggtgggcgcctg

SEQ ID NO: 245425 - DNA, 20 bp, Artificial
  CRISPR gRNA sequence
taatcccagctactcgggag

SEQ ID NO: 245426 - DNA, 20 bp, Artificial
  CRISPR gRNA sequence
ctcgggaggctgaggcagag

SEQ ID NO: 245427 - DNA, 20 bp, Artificial
  CRISPR gRNA sequence
gggaggctgaggcagagaat

SEQ ID NO: 245428 - DNA, 20 bp, Artificial
  CRISPR gRNA sequence
aggcagagaatcgcctgaac

SEQ ID NO: 245429 - DNA, 20 bp, Artificial
  CRISPR gRNA sequence
aacctgggaggtggaggttg

SEQ ID NO: 245430 - DNA, 20 bp, Artificial
  CRISPR gRNA sequence
ggaggtggaggttgcagtga

SEQ ID NO: 245431 - DNA, 20 bp, Artificial
  CRISPR gRNA sequence
cagtgagctgagattgcgcc

SEQ ID NO: 245432 - DNA, 20 bp, Artificial
  CRISPR gRNA sequence
agattgcgccactgcactcc

SEQ ID NO: 245433 - DNA, 20 bp, Artificial
  CRISPR gRNA sequence
cgccactgcactccagcctg

SEQ ID NO: 245434 - DNA, 20 bp, Artificial
  CRISPR gRNA sequence
cactccagcctgggtgacag

SEQ ID NO: 245435 - DNA, 20 bp, Artificial
  CRISPR gRNA sequence
cagcctgggtgacagagtga

SEQ ID NO: 245436 - DNA, 20 bp, Artificial
  CRISPR gRNA sequence
ggtgacagagtgagactcca

SEQ ID NO: 245437 - DNA, 20 bp, Artificial
  CRISPR gRNA sequence
catctaaaaaaaattataat

SEQ ID NO: 245438 - DNA, 20 bp, Artificial
  CRISPR gRNA sequence
aaaaaaattataataataat

SEQ ID NO: 245439 - DNA, 20 bp, Artificial
  CRISPR gRNA sequence
taataataatagtaataata

SEQ ID NO: 245440 - DNA, 20 bp, Artificial
  CRISPR gRNA sequence
taacaaactcatccacaaga

SEQ ID NO: 245441 - DNA, 20 bp, Artificial
  CRISPR gRNA sequence
aacaaactcatccacaagag

SEQ ID NO: 245442 - DNA, 20 bp, Artificial
  CRISPR gRNA sequence
acaaactcatccacaagaga

SEQ ID NO: 245443 - DNA, 20 bp, Artificial
  CRISPR gRNA sequence
atccacaagagaggtaacag

SEQ ID NO: 245444 - DNA, 20 bp, Artificial
  CRISPR gRNA sequence
cctctagagattatttgaaa

SEQ ID NO: 245445 - DNA, 20 bp, Artificial
  CRISPR gRNA sequence
ctctagagattatttgaaat

SEQ ID NO: 245446 - DNA, 20 bp, Artificial
  CRISPR gRNA sequence
tagagattatttgaaatttg

SEQ ID NO: 245447 - DNA, 20 bp, Artificial
  CRISPR gRNA sequence
gagattatttgaaatttgtt

SEQ ID NO: 245448 - DNA, 20 bp, Artificial
  CRISPR gRNA sequence
tttgaaatttgtttcctctt

SEQ ID NO: 245449 - DNA, 20 bp, Artificial
  CRISPR gRNA sequence
gaaatttgtttcctcttacc

SEQ ID NO: 245450 - DNA, 20 bp, Artificial
  CRISPR gRNA sequence
aaatttgtttcctcttacca

SEQ ID NO: 245451 - DNA, 20 bp, Artificial
  CRISPR gRNA sequence
gtttcctcttaccaaatatt

SEQ ID NO: 245452 - DNA, 20 bp, Artificial
  CRISPR gRNA sequence
tttcctcttaccaaatattt

SEQ ID NO: 245453 - DNA, 20 bp, Artificial
  CRISPR gRNA sequence
cctcttaccaaatatttgta

SEQ ID NO: 245454 - DNA, 20 bp, Artificial
  CRISPR gRNA sequence
ctcttaccaaatatttgtat

SEQ ID NO: 245455 - DNA, 20 bp, Artificial
  CRISPR gRNA sequence
ttaccaaatatttgtattgg

SEQ ID NO: 245456 - DNA, 20 bp, Artificial
  CRISPR gRNA sequence
accaaatatttgtattggtc

SEQ ID NO: 245457 - DNA, 20 bp, Artificial
  CRISPR gRNA sequence
ccaaatatttgtattggtct

SEQ ID NO: 245458 - DNA, 20 bp, Artificial
  CRISPR gRNA sequence
gtattggtctttaagaacta

SEQ ID NO: 245459 - DNA, 20 bp, Artificial
  CRISPR gRNA sequence
tattggtctttaagaactat

SEQ ID NO: 245460 - DNA, 20 bp, Artificial
  CRISPR gRNA sequence
gtctttaagaactattttct

SEQ ID NO: 245461 - DNA, 20 bp, Artificial
  CRISPR gRNA sequence
taagaactattttctttatt

SEQ ID NO: 245462 - DNA, 20 bp, Artificial
  CRISPR gRNA sequence
aagaactattttctttattt

SEQ ID NO: 245463 - DNA, 20 bp, Artificial
  CRISPR gRNA sequence
agaactattttctttatttt

SEQ ID NO: 245464 - DNA, 20 bp, Artificial
  CRISPR gRNA sequence
ttttctttattttctacatt

SEQ ID NO: 245465 - DNA, 20 bp, Artificial
  CRISPR gRNA sequence
tctttattttctacattagc

SEQ ID NO: 245466 - DNA, 20 bp, Artificial
  CRISPR gRNA sequence
ctttattttctacattagct

SEQ ID NO: 245467 - DNA, 20 bp, Artificial
  CRISPR gRNA sequence
tttattttctacattagcta

SEQ ID NO: 245468 - DNA, 20 bp, Artificial
  CRISPR gRNA sequence
tattttctacattagctaaa

SEQ ID NO: 245469 - DNA, 20 bp, Artificial
  CRISPR gRNA sequence
attttctacattagctaaaa

SEQ ID NO: 245470 - DNA, 20 bp, Artificial
  CRISPR gRNA sequence
ttttctacattagctaaaaa

SEQ ID NO: 245471 - DNA, 20 bp, Artificial
  CRISPR gRNA sequence
tctacattagctaaaaaagc

SEQ ID NO: 245472 - DNA, 20 bp, Artificial
  CRISPR gRNA sequence
ctacattagctaaaaaagca

SEQ ID NO: 245473 - DNA, 20 bp, Artificial
  CRISPR gRNA sequence
tacattagctaaaaaagcat

SEQ ID NO: 245474 - DNA, 20 bp, Artificial
  CRISPR gRNA sequence
cattagctaaaaaagcatga

SEQ ID NO: 245475 - DNA, 20 bp, Artificial
  CRISPR gRNA sequence
gctaaaaaagcatgaatctt

SEQ ID NO: 245476 - DNA, 20 bp, Artificial
  CRISPR gRNA sequence
aaaaagcatgaatcttaagc

SEQ ID NO: 245477 - DNA, 20 bp, Artificial
  CRISPR gRNA sequence
aagcatgaatcactaaacca

SEQ ID NO: 245478 - DNA, 20 bp, Artificial
  CRISPR gRNA sequence
agcatgaatcactaaaccat

SEQ ID NO: 245479 - DNA, 20 bp, Artificial
  CRISPR gRNA sequence
aaccataaaatattagccat

SEQ ID NO: 245480 - DNA, 20 bp, Artificial
  CRISPR gRNA sequence
gccatatcccaatcatagct

SEQ ID NO: 245481 - DNA, 20 bp, Artificial
  CRISPR gRNA sequence
tagtttcaattcagcagcac

SEQ ID NO: 245482 - DNA, 20 bp, Artificial
  CRISPR gRNA sequence
gtttcaattcagcagcactt

SEQ ID NO: 245483 - DNA, 20 bp, Artificial
  CRISPR gRNA sequence
caattcagcagcacttattt

SEQ ID NO: 245484 - DNA, 20 bp, Artificial
  CRISPR gRNA sequence
aattcagcagcacttatttt

SEQ ID NO: 245485 - DNA, 20 bp, Artificial
  CRISPR gRNA sequence
agcagcacttattttcgtct

SEQ ID NO: 245486 - DNA, 20 bp, Artificial
  CRISPR gRNA sequence
attttcgtcttgagggttac

SEQ ID NO: 245487 - DNA, 20 bp, Artificial
  CRISPR gRNA sequence
ttttcgtcttgagggttact

SEQ ID NO: 245488 - DNA, 20 bp, Artificial
  CRISPR gRNA sequence
tcgtcttgagggttactgag

SEQ ID NO: 245489 - DNA, 20 bp, Artificial
  CRISPR gRNA sequence
cgtcttgagggttactgaga

SEQ ID NO: 245490 - DNA, 20 bp, Artificial
  CRISPR gRNA sequence
gtcttgagggttactgagat

SEQ ID NO: 245491 - DNA, 20 bp, Artificial
  CRISPR gRNA sequence
gagggttactgagattcgag

SEQ ID NO: 245492 - DNA, 20 bp, Artificial
  CRISPR gRNA sequence
agggttactgagattcgaga

SEQ ID NO: 245493 - DNA, 20 bp, Artificial
  CRISPR gRNA sequence
ctgagattcgagatccgatg

SEQ ID NO: 245494 - DNA, 20 bp, Artificial
  CRISPR gRNA sequence
agattcgagatccgatggtt

SEQ ID NO: 245495 - DNA, 20 bp, Artificial
  CRISPR gRNA sequence
gagatccgatggtttccttg

SEQ ID NO: 245496 - DNA, 20 bp, Artificial
  CRISPR gRNA sequence
ccttggaatgcagtgttatg

SEQ ID NO: 245497 - DNA, 20 bp, Artificial
  CRISPR gRNA sequence
cttggaatgcagtgttatga

SEQ ID NO: 245498 - DNA, 20 bp, Artificial
  CRISPR gRNA sequence
ggaatgcagtgttatgactc

SEQ ID NO: 245499 - DNA, 20 bp, Artificial
  CRISPR gRNA sequence
gaatgcagtgttatgactcc

SEQ ID NO: 245500 - DNA, 20 bp, Artificial
  CRISPR gRNA sequence
tgactccaggattgtgaagg

SEQ ID NO: 245501 - DNA, 20 bp, Artificial
  CRISPR gRNA sequence
caggattgtgaaggtatccc

SEQ ID NO: 245502 - DNA, 20 bp, Artificial
  CRISPR gRNA sequence
tgaaggtatccccactgctt

SEQ ID NO: 245503 - DNA, 20 bp, Artificial
  CRISPR gRNA sequence
cttccatctgttaggaacca

SEQ ID NO: 245504 - DNA, 20 bp, Artificial
  CRISPR gRNA sequence
ccatctgttaggaaccaaga

SEQ ID NO: 245505 - DNA, 20 bp, Artificial
  CRISPR gRNA sequence
catctgttaggaaccaagaa

SEQ ID NO: 245506 - DNA, 20 bp, Artificial
  CRISPR gRNA sequence
ttaggaaccaagaaccgatc

SEQ ID NO: 245507 - DNA, 20 bp, Artificial
  CRISPR gRNA sequence
ggaaccaagaaccgatctgt

SEQ ID NO: 245508 - DNA, 20 bp, Artificial
  CRISPR gRNA sequence
tgcgtgagctgccaggcttt

SEQ ID NO: 245509 - DNA, 20 bp, Artificial
  CRISPR gRNA sequence
ccaggctttcttttacatgt

SEQ ID NO: 245510 - DNA, 20 bp, Artificial
  CRISPR gRNA sequence
tcttttacatgttagtgaag

SEQ ID NO: 245511 - DNA, 20 bp, Artificial
  CRISPR gRNA sequence
cttttacatgttagtgaagt

SEQ ID NO: 245512 - DNA, 20 bp, Artificial
  CRISPR gRNA sequence
ttttacatgttagtgaagta

SEQ ID NO: 245513 - DNA, 20 bp, Artificial
  CRISPR gRNA sequence
ttacatgttagtgaagtatt

SEQ ID NO: 245514 - DNA, 20 bp, Artificial
  CRISPR gRNA sequence
tacatgttagtgaagtattt

SEQ ID NO: 245515 - DNA, 20 bp, Artificial
  CRISPR gRNA sequence
acatgttagtgaagtatttg

SEQ ID NO: 245516 - DNA, 20 bp, Artificial
  CRISPR gRNA sequence
catgttagtgaagtatttgt

SEQ ID NO: 245517 - DNA, 20 bp, Artificial
  CRISPR gRNA sequence
gtgaagtatttgtgttactg

SEQ ID NO: 245518 - DNA, 20 bp, Artificial
  CRISPR gRNA sequence
gtgttactgctccgcaaatt

SEQ ID NO: 245519 - DNA, 20 bp, Artificial
  CRISPR gRNA sequence
tgttactgctccgcaaattt

SEQ ID NO: 245520 - DNA, 20 bp, Artificial
  CRISPR gRNA sequence
ctgctccgcaaatttcaatc

SEQ ID NO: 245521 - DNA, 20 bp, Artificial
  CRISPR gRNA sequence
ctccgcaaatttcaatccta

SEQ ID NO: 245522 - DNA, 20 bp, Artificial
  CRISPR gRNA sequence
cgcaaatttcaatcctaagc

SEQ ID NO: 245523 - DNA, 20 bp, Artificial
  CRISPR gRNA sequence
caatcctaagcagatattta

SEQ ID NO: 245524 - DNA, 20 bp, Artificial
  CRISPR gRNA sequence
aatcctaagcagatatttat

SEQ ID NO: 245525 - DNA, 20 bp, Artificial
  CRISPR gRNA sequence
agcagatatttatttacaga

SEQ ID NO: 245526 - DNA, 20 bp, Artificial
  CRISPR gRNA sequence
atttacagactggcaaggca

SEQ ID NO: 245527 - DNA, 20 bp, Artificial
  CRISPR gRNA sequence
tttacagactggcaaggcaa

SEQ ID NO: 245528 - DNA, 20 bp, Artificial
  CRISPR gRNA sequence
acagactggcaaggcaaaaa

SEQ ID NO: 245529 - DNA, 20 bp, Artificial
  CRISPR gRNA sequence
cagactggcaaggcaaaaag

SEQ ID NO: 245530 - DNA, 20 bp, Artificial
  CRISPR gRNA sequence
gcaaggcaaaaagtcctacc

SEQ ID NO: 245531 - DNA, 20 bp, Artificial
  CRISPR gRNA sequence
ccccgatttcatatgcttgt

SEQ ID NO: 245532 - DNA, 20 bp, Artificial
  CRISPR gRNA sequence
catatgcttgttgctataaa

SEQ ID NO: 245533 - DNA, 20 bp, Artificial
  CRISPR gRNA sequence
atatgcttgttgctataaaa

SEQ ID NO: 245534 - DNA, 20 bp, Artificial
  CRISPR gRNA sequence
gttgctataaaaaataacca

SEQ ID NO: 245535 - DNA, 20 bp, Artificial
  CRISPR gRNA sequence
ttgctataaaaaataaccac

SEQ ID NO: 245536 - DNA, 20 bp, Artificial
  CRISPR gRNA sequence
ctataaaaaataaccacacc

SEQ ID NO: 245537 - DNA, 20 bp, Artificial
  CRISPR gRNA sequence
taaaaaataaccacaccatc

SEQ ID NO: 245538 - DNA, 20 bp, Artificial
  CRISPR gRNA sequence
ctagaacttatgaaaaactg

SEQ ID NO: 245539 - DNA, 20 bp, Artificial
  CRISPR gRNA sequence
gaacttatgaaaaactggca

SEQ ID NO: 245540 - DNA, 20 bp, Artificial
  CRISPR gRNA sequence
atgaaaaactggcaagatgt

SEQ ID NO: 245541 - DNA, 20 bp, Artificial
  CRISPR gRNA sequence
tgaaaaactggcaagatgtt

SEQ ID NO: 245542 - DNA, 20 bp, Artificial
  CRISPR gRNA sequence
gcaagatgttcagaaatacc

SEQ ID NO: 245543 - DNA, 20 bp, Artificial
  CRISPR gRNA sequence
agaaataccaacgggatgtc

SEQ ID NO: 245544 - DNA, 20 bp, Artificial
  CRISPR gRNA sequence
ttgaaattgttcccaggttg

SEQ ID NO: 245545 - DNA, 20 bp, Artificial
  CRISPR gRNA sequence
tgaaattgttcccaggttga

SEQ ID NO: 245546 - DNA, 20 bp, Artificial
  CRISPR gRNA sequence
gaaattgttcccaggttgaa

SEQ ID NO: 245547 - DNA, 20 bp, Artificial
  CRISPR gRNA sequence
aaattgttcccaggttgaat

SEQ ID NO: 245548 - DNA, 20 bp, Artificial
  CRISPR gRNA sequence
ttcccaggttgaatttcaaa

SEQ ID NO: 245549 - DNA, 20 bp, Artificial
  CRISPR gRNA sequence
ccaggttgaatttcaaaatg

SEQ ID NO: 245550 - DNA, 20 bp, Artificial
  CRISPR gRNA sequence
aatttcaaaatggagatctc

SEQ ID NO: 245551 - DNA, 20 bp, Artificial
  CRISPR gRNA sequence
caaaatggagatctcttctg

SEQ ID NO: 245552 - DNA, 20 bp, Artificial
  CRISPR gRNA sequence
aaaatggagatctcttctgg

SEQ ID NO: 245553 - DNA, 20 bp, Artificial
  CRISPR gRNA sequence
ttctggaaagattgagatgt

SEQ ID NO: 245554 - DNA, 20 bp, Artificial
  CRISPR gRNA sequence
ctggaaagattgagatgtca

SEQ ID NO: 245555 - DNA, 20 bp, Artificial
  CRISPR gRNA sequence
tggaaagattgagatgtcat

SEQ ID NO: 245556 - DNA, 20 bp, Artificial
  CRISPR gRNA sequence
gaaagattgagatgtcatgt

SEQ ID NO: 245557 - DNA, 20 bp, Artificial
  CRISPR gRNA sequence
agatgtcatgttttccgtat

SEQ ID NO: 245558 - DNA, 20 bp, Artificial
  CRISPR gRNA sequence
tccgtatttgtcctgctgag

SEQ ID NO: 245559 - DNA, 20 bp, Artificial
  CRISPR gRNA sequence
ccgtatttgtcctgctgagt

SEQ ID NO: 245560 - DNA, 20 bp, Artificial
  CRISPR gRNA sequence
cgtatttgtcctgctgagta

SEQ ID NO: 245561 - DNA, 20 bp, Artificial
  CRISPR gRNA sequence
gtcctgctgagtactgctga

SEQ ID NO: 245562 - DNA, 20 bp, Artificial
  CRISPR gRNA sequence
tcctgctgagtactgctgaa

SEQ ID NO: 245563 - DNA, 20 bp, Artificial
  CRISPR gRNA sequence
ctgagtactgctgaaaacct

SEQ ID NO: 245564 - DNA, 20 bp, Artificial
  CRISPR gRNA sequence
agtactgctgaaaacctctc

SEQ ID NO: 245565 - DNA, 20 bp, Artificial
  CRISPR gRNA sequence
ctgaaaacctctcagaaagg

SEQ ID NO: 245566 - DNA, 20 bp, Artificial
  CRISPR gRNA sequence
aaaacctctcagaaaggcag

SEQ ID NO: 245567 - DNA, 20 bp, Artificial
  CRISPR gRNA sequence
tcagaaaggcagagagagga

SEQ ID NO: 245568 - DNA, 20 bp, Artificial
  CRISPR gRNA sequence
agaaaggcagagagaggaag

SEQ ID NO: 245569 - DNA, 20 bp, Artificial
  CRISPR gRNA sequence
ggtcaggatctccagaccca

SEQ ID NO: 245570 - DNA, 20 bp, Artificial
  CRISPR gRNA sequence
cagacccaagaaacaacatg

SEQ ID NO: 245571 - DNA, 20 bp, Artificial
  CRISPR gRNA sequence
ctttctgcctcatttccctc

SEQ ID NO: 245572 - DNA, 20 bp, Artificial
  CRISPR gRNA sequence
tttctgcctcatttccctct

SEQ ID NO: 245573 - DNA, 20 bp, Artificial
  CRISPR gRNA sequence
tctgcctcatttccctctga

SEQ ID NO: 245574 - DNA, 20 bp, Artificial
  CRISPR gRNA sequence
ctgcctcatttccctctgac

SEQ ID NO: 245575 - DNA, 20 bp, Artificial
  CRISPR gRNA sequence
tgcctcatttccctctgact

SEQ ID NO: 245576 - DNA, 20 bp, Artificial
  CRISPR gRNA sequence
cctcatttccctctgactgg

SEQ ID NO: 245577 - DNA, 20 bp, Artificial
  CRISPR gRNA sequence
atttccctctgactgggaac

SEQ ID NO: 245578 - DNA, 20 bp, Artificial
  CRISPR gRNA sequence
ccctctgactgggaactaga

SEQ ID NO: 245579 - DNA, 20 bp, Artificial
  CRISPR gRNA sequence
cctctgactgggaactagag

SEQ ID NO: 245580 - DNA, 20 bp, Artificial
  CRISPR gRNA sequence
tgactgggaactagagaagc

SEQ ID NO: 245581 - DNA, 20 bp, Artificial
  CRISPR gRNA sequence
actgggaactagagaagcag

SEQ ID NO: 245582 - DNA, 20 bp, Artificial
  CRISPR gRNA sequence
ggaactagagaagcagcact

SEQ ID NO: 245583 - DNA, 20 bp, Artificial
  CRISPR gRNA sequence
gagaagcagcactctaaaaa

SEQ ID NO: 245584 - DNA, 20 bp, Artificial
  CRISPR gRNA sequence
taaaaatgccaatagcgtgg

SEQ ID NO: 245585 - DNA, 20 bp, Artificial
  CRISPR gRNA sequence
aaaatgccaatagcgtggac

SEQ ID NO: 245586 - DNA, 20 bp, Artificial
  CRISPR gRNA sequence
acatctgtaatcccagcact

SEQ ID NO: 245587 - DNA, 20 bp, Artificial
  CRISPR gRNA sequence
taatcccagcactttgggaa

SEQ ID NO: 245588 - DNA, 20 bp, Artificial
  CRISPR gRNA sequence
tgggaagccaaagcaagcag

SEQ ID NO: 245589 - DNA, 20 bp, Artificial
  CRISPR gRNA sequence
gggaagccaaagcaagcaga

SEQ ID NO: 245590 - DNA, 20 bp, Artificial
  CRISPR gRNA sequence
ggaagccaaagcaagcagat

SEQ ID NO: 245591 - DNA, 20 bp, Artificial
  CRISPR gRNA sequence
aggtcaggatttcgagacca

SEQ ID NO: 245592 - DNA, 20 bp, Artificial
  CRISPR gRNA sequence
cgagaccagcctggccaaca

SEQ ID NO: 245593 - DNA, 20 bp, Artificial
  CRISPR gRNA sequence
gagaccagcctggccaacat

SEQ ID NO: 245594 - DNA, 20 bp, Artificial
  CRISPR gRNA sequence
gccaacatggcgaaaccctg

SEQ ID NO: 245595 - DNA, 20 bp, Artificial
  CRISPR gRNA sequence
tctctactaaaaacacaaaa

SEQ ID NO: 245596 - DNA, 20 bp, Artificial
  CRISPR gRNA sequence
tactaaaaacacaaaaatta

SEQ ID NO: 245597 - DNA, 20 bp, Artificial
  CRISPR gRNA sequence
ctaaaaacacaaaaattagc

SEQ ID NO: 245598 - DNA, 20 bp, Artificial
  CRISPR gRNA sequence
aaaacacaaaaattagctgg

SEQ ID NO: 245599 - DNA, 20 bp, Artificial
  CRISPR gRNA sequence
gctgggcatggtggcgctca

SEQ ID NO: 245600 - DNA, 20 bp, Artificial
  CRISPR gRNA sequence
ggcatggtggcgctcacctg

SEQ ID NO: 245601 - DNA, 20 bp, Artificial
  CRISPR gRNA sequence
acctgtaatcttagctattc

SEQ ID NO: 245602 - DNA, 20 bp, Artificial
  CRISPR gRNA sequence
taatcttagctattcgggag

SEQ ID NO: 245603 - DNA, 20 bp, Artificial
  CRISPR gRNA sequence
agctattcgggagtctgagg

SEQ ID NO: 245604 - DNA, 20 bp, Artificial
  CRISPR gRNA sequence
gctattcgggagtctgaggc

SEQ ID NO: 245605 - DNA, 20 bp, Artificial
  CRISPR gRNA sequence
ttcgggagtctgaggcagga

SEQ ID NO: 245606 - DNA, 20 bp, Artificial
  CRISPR gRNA sequence
gggagtctgaggcaggacaa

SEQ ID NO: 245607 - DNA, 20 bp, Artificial
  CRISPR gRNA sequence
aggcaggacaatggcttaaa

SEQ ID NO: 245608 - DNA, 20 bp, Artificial
  CRISPR gRNA sequence
aaacccaggaggcagaggtt

SEQ ID NO: 245609 - DNA, 20 bp, Artificial
  CRISPR gRNA sequence
aacccaggaggcagaggttg

SEQ ID NO: 245610 - DNA, 20 bp, Artificial
  CRISPR gRNA sequence
cagagagctgagattacacc

SEQ ID NO: 245611 - DNA, 20 bp, Artificial
  CRISPR gRNA sequence
agattacaccactgcactcc

SEQ ID NO: 245612 - DNA, 20 bp, Artificial
  CRISPR gRNA sequence
caccactgcactccagcctg

SEQ ID NO: 245613 - DNA, 20 bp, Artificial
  CRISPR gRNA sequence
cactccagcctgggcaacag

SEQ ID NO: 245614 - DNA, 20 bp, Artificial
  CRISPR gRNA sequence
cagcctgggcaacagagcaa

SEQ ID NO: 245615 - DNA, 20 bp, Artificial
  CRISPR gRNA sequence
ggcaacagagcaagactcca

SEQ ID NO: 245616 - DNA, 20 bp, Artificial
  CRISPR gRNA sequence
catctcaaaaaaacacataa

SEQ ID NO: 245617 - DNA, 20 bp, Artificial
  CRISPR gRNA sequence
aaaaaaacacataaaaaact

SEQ ID NO: 245618 - DNA, 20 bp, Artificial
  CRISPR gRNA sequence
agaggagcttgtactctcta

SEQ ID NO: 245619 - DNA, 20 bp, Artificial
  CRISPR gRNA sequence
gtactctctagttatgagac

SEQ ID NO: 245620 - DNA, 20 bp, Artificial
  CRISPR gRNA sequence
tactctctagttatgagacc

SEQ ID NO: 245621 - DNA, 20 bp, Artificial
  CRISPR gRNA sequence
tctagttatgagaccaggaa

SEQ ID NO: 245622 - DNA, 20 bp, Artificial
  CRISPR gRNA sequence
tagttatgagaccaggaaag

SEQ ID NO: 245623 - DNA, 20 bp, Artificial
  CRISPR gRNA sequence
gttatgagaccaggaaaggg

SEQ ID NO: 245624 - DNA, 20 bp, Artificial
  CRISPR gRNA sequence
tgagaccaggaaaggggcag

SEQ ID NO: 245625 - DNA, 20 bp, Artificial
  CRISPR gRNA sequence
caaacttcttttttttttct

SEQ ID NO: 245626 - DNA, 20 bp, Artificial
  CRISPR gRNA sequence
cttttttttttctttttttt

SEQ ID NO: 245627 - DNA, 20 bp, Artificial
  CRISPR gRNA sequence
ttttttttttcttttttttt

SEQ ID NO: 245628 - DNA, 20 bp, Artificial
  CRISPR gRNA sequence
ttttttttcttttttttttt

SEQ ID NO: 245629 - DNA, 20 bp, Artificial
  CRISPR gRNA sequence
tttttttctttttttttttt

SEQ ID NO: 245630 - DNA, 20 bp, Artificial
  CRISPR gRNA sequence
ttttttcttttttttttttg

SEQ ID NO: 245631 - DNA, 20 bp, Artificial
  CRISPR gRNA sequence
tttttcttttttttttttga

SEQ ID NO: 245632 - DNA, 20 bp, Artificial
  CRISPR gRNA sequence
ttttcttttttttttttgag

SEQ ID NO: 245633 - DNA, 20 bp, Artificial
  CRISPR gRNA sequence
tttcttttttttttttgaga

SEQ ID NO: 245634 - DNA, 20 bp, Artificial
  CRISPR gRNA sequence
ttcttttttttttttgagat

SEQ ID NO: 245635 - DNA, 20 bp, Artificial
  CRISPR gRNA sequence
tcttttttttttttgagatg

SEQ ID NO: 245636 - DNA, 20 bp, Artificial
  CRISPR gRNA sequence
cttttttttttttgagatgg

SEQ ID NO: 245637 - DNA, 20 bp, Artificial
  CRISPR gRNA sequence
ttttttttttttgagatgga

SEQ ID NO: 245638 - DNA, 20 bp, Artificial
  CRISPR gRNA sequence
ttttttttttgagatggagt

SEQ ID NO: 245639 - DNA, 20 bp, Artificial
  CRISPR gRNA sequence
tttttttttgagatggagtc

SEQ ID NO: 245640 - DNA, 20 bp, Artificial
  CRISPR gRNA sequence
ttttttttgagatggagtct

SEQ ID NO: 245641 - DNA, 20 bp, Artificial
  CRISPR gRNA sequence
tttttttgagatggagtctc

SEQ ID NO: 245642 - DNA, 20 bp, Artificial
  CRISPR gRNA sequence
ttttttgagatggagtctca

SEQ ID NO: 245643 - DNA, 20 bp, Artificial
  CRISPR gRNA sequence
tttttgagatggagtctcac

SEQ ID NO: 245644 - DNA, 20 bp, Artificial
  CRISPR gRNA sequence
ttttgagatggagtctcact

SEQ ID NO: 245645 - DNA, 20 bp, Artificial
  CRISPR gRNA sequence
tttgagatggagtctcactc

SEQ ID NO: 245646 - DNA, 20 bp, Artificial
  CRISPR gRNA sequence
ttgagatggagtctcactct

SEQ ID NO: 245647 - DNA, 20 bp, Artificial
  CRISPR gRNA sequence
tgagatggagtctcactctg

SEQ ID NO: 245648 - DNA, 20 bp, Artificial
  CRISPR gRNA sequence
gagatggagtctcactctgt

SEQ ID NO: 245649 - DNA, 20 bp, Artificial
  CRISPR gRNA sequence
agatggagtctcactctgtt

SEQ ID NO: 245650 - DNA, 20 bp, Artificial
  CRISPR gRNA sequence
actctgttgcccaggctgga

SEQ ID NO: 245651 - DNA, 20 bp, Artificial
  CRISPR gRNA sequence
tgttgcccaggctggagtgc

SEQ ID NO: 245652 - DNA, 20 bp, Artificial
  CRISPR gRNA sequence
ttgcccaggctggagtgcaa

SEQ ID NO: 245653 - DNA, 20 bp, Artificial
  CRISPR gRNA sequence
cccaggctggagtgcaatgg

SEQ ID NO: 245654 - DNA, 20 bp, Artificial
  CRISPR gRNA sequence
gagtgcaatggcgtgatctc

SEQ ID NO: 245655 - DNA, 20 bp, Artificial
  CRISPR gRNA sequence
agctcactgcaacctccgcc

SEQ ID NO: 245656 - DNA, 20 bp, Artificial
  CRISPR gRNA sequence
actgcaacctccgcctcttg

SEQ ID NO: 245657 - DNA, 20 bp, Artificial
  CRISPR gRNA sequence
caacctccgcctcttgggtt

SEQ ID NO: 245658 - DNA, 20 bp, Artificial
  CRISPR gRNA sequence
cgcctcttgggttcaagcgg

SEQ ID NO: 245659 - DNA, 20 bp, Artificial
  CRISPR gRNA sequence
ttgggttcaagcggttctct

SEQ ID NO: 245660 - DNA, 20 bp, Artificial
  CRISPR gRNA sequence
gggttcaagcggttctcttg

SEQ ID NO: 245661 - DNA, 20 bp, Artificial
  CRISPR gRNA sequence
ggttcaagcggttctcttgc

SEQ ID NO: 245662 - DNA, 20 bp, Artificial
  CRISPR gRNA sequence
aagcggttctcttgcctcag

SEQ ID NO: 245663 - DNA, 20 bp, Artificial
  CRISPR gRNA sequence
tcttgcctcagtctcctgag

SEQ ID NO: 245664 - DNA, 20 bp, Artificial
  CRISPR gRNA sequence
ttgcctcagtctcctgagta

SEQ ID NO: 245665 - DNA, 20 bp, Artificial
  CRISPR gRNA sequence
gcctcagtctcctgagtagc

SEQ ID NO: 245666 - DNA, 20 bp, Artificial
  CRISPR gRNA sequence
cctcagtctcctgagtagct

SEQ ID NO: 245667 - DNA, 20 bp, Artificial
  CRISPR gRNA sequence
agtctcctgagtagctggga

SEQ ID NO: 245668 - DNA, 20 bp, Artificial
  CRISPR gRNA sequence
ctgagtagctgggactacag

SEQ ID NO: 245669 - DNA, 20 bp, Artificial
  CRISPR gRNA sequence
agtagctgggactacaggtg

SEQ ID NO: 245670 - DNA, 20 bp, Artificial
  CRISPR gRNA sequence
ggactacaggtgcccgccac

SEQ ID NO: 245671 - DNA, 20 bp, Artificial
  CRISPR gRNA sequence
caggtgcccgccaccaggcc

SEQ ID NO: 245672 - DNA, 20 bp, Artificial
  CRISPR gRNA sequence
atttttgtgtttttagtaga

SEQ ID NO: 245673 - DNA, 20 bp, Artificial
  CRISPR gRNA sequence
ttgtgtttttagtagagatg

SEQ ID NO: 245674 - DNA, 20 bp, Artificial
  CRISPR gRNA sequence
tgtgtttttagtagagatgg

SEQ ID NO: 245675 - DNA, 20 bp, Artificial
  CRISPR gRNA sequence
gtgtttttagtagagatggg

SEQ ID NO: 245676 - DNA, 20 bp, Artificial
  CRISPR gRNA sequence
tgtttttagtagagatgggg

SEQ ID NO: 245677 - DNA, 20 bp, Artificial
  CRISPR gRNA sequence
ttagtagagatggggtttca

SEQ ID NO: 245678 - DNA, 20 bp, Artificial
  CRISPR gRNA sequence
tagtagagatggggtttcac

SEQ ID NO: 245679 - DNA, 20 bp, Artificial
  CRISPR gRNA sequence
agtagagatggggtttcacc

SEQ ID NO: 245680 - DNA, 20 bp, Artificial
  CRISPR gRNA sequence
gtagagatggggtttcacca

SEQ ID NO: 245681 - DNA, 20 bp, Artificial
  CRISPR gRNA sequence
caccatattggccaggctgg

SEQ ID NO: 245682 - DNA, 20 bp, Artificial
  CRISPR gRNA sequence
accatattggccaggctggt

SEQ ID NO: 245683 - DNA, 20 bp, Artificial
  CRISPR gRNA sequence
gccaggctggtctcaaactc

SEQ ID NO: 245684 - DNA, 20 bp, Artificial
  CRISPR gRNA sequence
gtctcaaactcctgacctta

SEQ ID NO: 245685 - DNA, 20 bp, Artificial
  CRISPR gRNA sequence
aaactcctgaccttatgatc

SEQ ID NO: 245686 - DNA, 20 bp, Artificial
  CRISPR gRNA sequence
ctgaccttatgatccgccca

SEQ ID NO: 245687 - DNA, 20 bp, Artificial
  CRISPR gRNA sequence
accttatgatccgcccatct

SEQ ID NO: 245688 - DNA, 20 bp, Artificial
  CRISPR gRNA sequence
atgatccgcccatctgggcc

SEQ ID NO: 245689 - DNA, 20 bp, Artificial
  CRISPR gRNA sequence
tgatccgcccatctgggcct

SEQ ID NO: 245690 - DNA, 20 bp, Artificial
  CRISPR gRNA sequence
ggcctcccaaagtgctggga

SEQ ID NO: 245691 - DNA, 20 bp, Artificial
  CRISPR gRNA sequence
ccaaagtgctgggattacag

SEQ ID NO: 245692 - DNA, 20 bp, Artificial
  CRISPR gRNA sequence
ggattacaggcgtgagccac

SEQ ID NO: 245693 - DNA, 20 bp, Artificial
  CRISPR gRNA sequence
caggcgtgagccaccacacc

SEQ ID NO: 245694 - DNA, 20 bp, Artificial
  CRISPR gRNA sequence
gtccaaaaacttctagacaa

SEQ ID NO: 245695 - DNA, 20 bp, Artificial
  CRISPR gRNA sequence
ctagacaataaccactcaat

SEQ ID NO: 245696 - DNA, 20 bp, Artificial
  CRISPR gRNA sequence
tagacaataaccactcaatt

SEQ ID NO: 245697 - DNA, 20 bp, Artificial
  CRISPR gRNA sequence
gacaataaccactcaattct

SEQ ID NO: 245698 - DNA, 20 bp, Artificial
  CRISPR gRNA sequence
aattctaacaaaacaccaca

SEQ ID NO: 245699 - DNA, 20 bp, Artificial
  CRISPR gRNA sequence
taacaaaacaccacaaaaaa

SEQ ID NO: 245700 - DNA, 20 bp, Artificial
  CRISPR gRNA sequence
acaaaacaccacaaaaaaca

SEQ ID NO: 245701 - DNA, 20 bp, Artificial
  CRISPR gRNA sequence
cgcctgcaagcccaccagga

SEQ ID NO: 245702 - DNA, 20 bp, Artificial
  CRISPR gRNA sequence
caagcccaccaggaaggact

SEQ ID NO: 245703 - DNA, 20 bp, Artificial
  CRISPR gRNA sequence
agtagagagcctggacttcc

SEQ ID NO: 245704 - DNA, 20 bp, Artificial
  CRISPR gRNA sequence
gacttccaccctcacggctg

SEQ ID NO: 245705 - DNA, 20 bp, Artificial
  CRISPR gRNA sequence
ccaccctcacggctgattaa

SEQ ID NO: 245706 - DNA, 20 bp, Artificial
  CRISPR gRNA sequence
caccctcacggctgattaag

SEQ ID NO: 245707 - DNA, 20 bp, Artificial
  CRISPR gRNA sequence
acggctgattaaggctcatc

SEQ ID NO: 245708 - DNA, 20 bp, Artificial
  CRISPR gRNA sequence
attaaggctcatctccccct

SEQ ID NO: 245709 - DNA, 20 bp, Artificial
  CRISPR gRNA sequence
aggctcatctccccctccct

SEQ ID NO: 245710 - DNA, 20 bp, Artificial
  CRISPR gRNA sequence
atctccccctccctcctggg

SEQ ID NO: 245711 - DNA, 20 bp, Artificial
  CRISPR gRNA sequence
cccctccctcctggggtagt

SEQ ID NO: 245712 - DNA, 20 bp, Artificial
  CRISPR gRNA sequence
cctcctggggtagtgtcaga

SEQ ID NO: 245713 - DNA, 20 bp, Artificial
  CRISPR gRNA sequence
ctggggtagtgtcagaggag

SEQ ID NO: 245714 - DNA, 20 bp, Artificial
  CRISPR gRNA sequence
gggtagtgtcagaggaggcc

SEQ ID NO: 245715 - DNA, 20 bp, Artificial
  CRISPR gRNA sequence
gtgggagctagaactcccac

SEQ ID NO: 245716 - DNA, 20 bp, Artificial
  CRISPR gRNA sequence
gaactcccacgtgtctagca

SEQ ID NO: 245717 - DNA, 20 bp, Artificial
  CRISPR gRNA sequence
ccacgtgtctagcagtaaaa

SEQ ID NO: 245718 - DNA, 20 bp, Artificial
  CRISPR gRNA sequence
gcagtaaaaaggagaccctc

SEQ ID NO: 245719 - DNA, 20 bp, Artificial
  CRISPR gRNA sequence
accctccaggaggtatagca

SEQ ID NO: 245720 - DNA, 20 bp, Artificial
  CRISPR gRNA sequence
caggaggtatagcatagaac

SEQ ID NO: 245721 - DNA, 20 bp, Artificial
  CRISPR gRNA sequence
cctccacccctgcctggccg

SEQ ID NO: 245722 - DNA, 20 bp, Artificial
  CRISPR gRNA sequence
ctccacccctgcctggccgt

SEQ ID NO: 245723 - DNA, 20 bp, Artificial
  CRISPR gRNA sequence
cacccctgcctggccgtaac

SEQ ID NO: 245724 - DNA, 20 bp, Artificial
  CRISPR gRNA sequence
cctggccgtaacgagctgcc

SEQ ID NO: 245725 - DNA, 20 bp, Artificial
  CRISPR gRNA sequence
gccgtaacgagctgcccatc

SEQ ID NO: 245726 - DNA, 20 bp, Artificial
  CRISPR gRNA sequence
cccatcctccttccttccct

SEQ ID NO: 245727 - DNA, 20 bp, Artificial
  CRISPR gRNA sequence
cttccttccctagagtgatg

SEQ ID NO: 245728 - DNA, 20 bp, Artificial
  CRISPR gRNA sequence
ccttccctagagtgatgtca

SEQ ID NO: 245729 - DNA, 20 bp, Artificial
  CRISPR gRNA sequence
cttccctagagtgatgtcag

SEQ ID NO: 245730 - DNA, 20 bp, Artificial
  CRISPR gRNA sequence
ccctagagtgatgtcagagg

SEQ ID NO: 245731 - DNA, 20 bp, Artificial
  CRISPR gRNA sequence
cctagagtgatgtcagagga

SEQ ID NO: 245732 - DNA, 20 bp, Artificial
  CRISPR gRNA sequence
gagtgatgtcagaggaaccc

SEQ ID NO: 245733 - DNA, 20 bp, Artificial
  CRISPR gRNA sequence
agaaaatacaagatctaaat

SEQ ID NO: 245734 - DNA, 20 bp, Artificial
  CRISPR gRNA sequence
aattagatccagaaactggg

SEQ ID NO: 245735 - DNA, 20 bp, Artificial
  CRISPR gRNA sequence
gatccagaaactgggtgtgg

SEQ ID NO: 245736 - DNA, 20 bp, Artificial
  CRISPR gRNA sequence
ggtgtgggggctcacgcctg

SEQ ID NO: 245737 - DNA, 20 bp, Artificial
  CRISPR gRNA sequence
acgcctgtaatcccaatact

SEQ ID NO: 245738 - DNA, 20 bp, Artificial
  CRISPR gRNA sequence
taatcccaatactatggggg

SEQ ID NO: 245739 - DNA, 20 bp, Artificial
  CRISPR gRNA sequence
tgggggccaaggcaggagga

SEQ ID NO: 245740 - DNA, 20 bp, Artificial
  CRISPR gRNA sequence
gagtccaggagttctagacc

SEQ ID NO: 245741 - DNA, 20 bp, Artificial
  CRISPR gRNA sequence
agtccaggagttctagacca

SEQ ID NO: 245742 - DNA, 20 bp, Artificial
  CRISPR gRNA sequence
tagaccagcttgggtaacag

SEQ ID NO: 245743 - DNA, 20 bp, Artificial
  CRISPR gRNA sequence
gaccagcttgggtaacagag

SEQ ID NO: 245744 - DNA, 20 bp, Artificial
  CRISPR gRNA sequence
gggtaacagagcaagaccct

SEQ ID NO: 245745 - DNA, 20 bp, Artificial
  CRISPR gRNA sequence
ggtaacagagcaagaccctg

SEQ ID NO: 245746 - DNA, 20 bp, Artificial
  CRISPR gRNA sequence
tctctacaaaacatttaaaa

SEQ ID NO: 245747 - DNA, 20 bp, Artificial
  CRISPR gRNA sequence
tacaaaacatttaaaaatta

SEQ ID NO: 245748 - DNA, 20 bp, Artificial
  CRISPR gRNA sequence
caaaacatttaaaaattagc

SEQ ID NO: 245749 - DNA, 20 bp, Artificial
  CRISPR gRNA sequence
aaaaattagccaggggtggt

SEQ ID NO: 245750 - DNA, 20 bp, Artificial
  CRISPR gRNA sequence
aaaattagccaggggtggtg

SEQ ID NO: 245751 - DNA, 20 bp, Artificial
  CRISPR gRNA sequence
gccaggggtggtggcacatg

SEQ ID NO: 245752 - DNA, 20 bp, Artificial
  CRISPR gRNA sequence
tagtctcagctactctggag

SEQ ID NO: 245753 - DNA, 20 bp, Artificial
  CRISPR gRNA sequence
agctactctggaggctgagg

SEQ ID NO: 245754 - DNA, 20 bp, Artificial
  CRISPR gRNA sequence
ctctggaggctgaggtggga

SEQ ID NO: 245755 - DNA, 20 bp, Artificial
  CRISPR gRNA sequence
tggaggctgaggtgggagga

SEQ ID NO: 245756 - DNA, 20 bp, Artificial
  CRISPR gRNA sequence
gaggctgaggtgggaggatc

SEQ ID NO: 245757 - DNA, 20 bp, Artificial
  CRISPR gRNA sequence
aggtgggaggatcacttgag

SEQ ID NO: 245758 - DNA, 20 bp, Artificial
  CRISPR gRNA sequence
gagcccaggaagttgaggct

SEQ ID NO: 245759 - DNA, 20 bp, Artificial
  CRISPR gRNA sequence
agcccaggaagttgaggctg

SEQ ID NO: 245760 - DNA, 20 bp, Artificial
  CRISPR gRNA sequence
aggctgcattgaggcgtgat

SEQ ID NO: 245761 - DNA, 20 bp, Artificial
  CRISPR gRNA sequence
cattgaggcgtgatcatgcc

SEQ ID NO: 245762 - DNA, 20 bp, Artificial
  CRISPR gRNA sequence
aggcgtgatcatgccactgc

SEQ ID NO: 245763 - DNA, 20 bp, Artificial
  CRISPR gRNA sequence
cactcccgcctgggtaatag

SEQ ID NO: 245764 - DNA, 20 bp, Artificial
  CRISPR gRNA sequence
ccgcctgggtaatagagcaa

SEQ ID NO: 245765 - DNA, 20 bp, Artificial
  CRISPR gRNA sequence
ggtaatagagcaagcaagac

SEQ ID NO: 245766 - DNA, 20 bp, Artificial
  CRISPR gRNA sequence
acttctaaaaaatttttttt

SEQ ID NO: 245767 - DNA, 20 bp, Artificial
  CRISPR gRNA sequence
ctaaaaaattttttttttac

SEQ ID NO: 245768 - DNA, 20 bp, Artificial
  CRISPR gRNA sequence
taaaaaattttttttttact

SEQ ID NO: 245769 - DNA, 20 bp, Artificial
  CRISPR gRNA sequence
aaaaattttttttttactta

SEQ ID NO: 245770 - DNA, 20 bp, Artificial
  CRISPR gRNA sequence
tttttttacttaggcctaaa

SEQ ID NO: 245771 - DNA, 20 bp, Artificial
  CRISPR gRNA sequence
ttttttacttaggcctaaat

SEQ ID NO: 245772 - DNA, 20 bp, Artificial
  CRISPR gRNA sequence
tttttacttaggcctaaatc

SEQ ID NO: 245773 - DNA, 20 bp, Artificial
  CRISPR gRNA sequence
ttttacttaggcctaaatct

SEQ ID NO: 245774 - DNA, 20 bp, Artificial
  CRISPR gRNA sequence
tttacttaggcctaaatcta

SEQ ID NO: 245775 - DNA, 20 bp, Artificial
  CRISPR gRNA sequence
ttacttaggcctaaatctaa

SEQ ID NO: 245776 - DNA, 20 bp, Artificial
  CRISPR gRNA sequence
tacttaggcctaaatctaac

SEQ ID NO: 245777 - DNA, 20 bp, Artificial
  CRISPR gRNA sequence
acttaggcctaaatctaaca

SEQ ID NO: 245778 - DNA, 20 bp, Artificial
  CRISPR gRNA sequence
cttaggcctaaatctaacaa

SEQ ID NO: 245779 - DNA, 20 bp, Artificial
  CRISPR gRNA sequence
aggcctaaatctaacaaaac

SEQ ID NO: 245780 - DNA, 20 bp, Artificial
  CRISPR gRNA sequence
ggcctaaatctaacaaaaca

SEQ ID NO: 245781 - DNA, 20 bp, Artificial
  CRISPR gRNA sequence
aatctaacaaaacacataca

SEQ ID NO: 245782 - DNA, 20 bp, Artificial
  CRISPR gRNA sequence
acaaaacacatacagaactt

SEQ ID NO: 245783 - DNA, 20 bp, Artificial
  CRISPR gRNA sequence
gtatagtgaaaactacaaaa

SEQ ID NO: 245784 - DNA, 20 bp, Artificial
  CRISPR gRNA sequence
tatagtgaaaactacaaaat

SEQ ID NO: 245785 - DNA, 20 bp, Artificial
  CRISPR gRNA sequence
caaaatgctggtgaaataaa

SEQ ID NO: 245786 - DNA, 20 bp, Artificial
  CRISPR gRNA sequence
gtgaaataaattttaaaatg

SEQ ID NO: 245787 - DNA, 20 bp, Artificial
  CRISPR gRNA sequence
taaaatgtataaatgaagag

SEQ ID NO: 245788 - DNA, 20 bp, Artificial
  CRISPR gRNA sequence
aaaatgtataaatgaagaga

SEQ ID NO: 245789 - DNA, 20 bp, Artificial
  CRISPR gRNA sequence
aaatgtataaatgaagagac

SEQ ID NO: 245790 - DNA, 20 bp, Artificial
  CRISPR gRNA sequence
tgttcctgcattagaataca

SEQ ID NO: 245791 - DNA, 20 bp, Artificial
  CRISPR gRNA sequence
ctgcattagaatacagtcat

SEQ ID NO: 245792 - DNA, 20 bp, Artificial
  CRISPR gRNA sequence
cattagaatacagtcataca

SEQ ID NO: 245793 - DNA, 20 bp, Artificial
  CRISPR gRNA sequence
gaatacagtcatacagcgta

SEQ ID NO: 245794 - DNA, 20 bp, Artificial
  CRISPR gRNA sequence
tggtcaaaaacagactgcat

SEQ ID NO: 245795 - DNA, 20 bp, Artificial
  CRISPR gRNA sequence
ggtcaaaaacagactgcata

SEQ ID NO: 245796 - DNA, 20 bp, Artificial
  CRISPR gRNA sequence
gtcaaaaacagactgcatat

SEQ ID NO: 245797 - DNA, 20 bp, Artificial
  CRISPR gRNA sequence
catatatgatcgtggtccca

SEQ ID NO: 245798 - DNA, 20 bp, Artificial
  CRISPR gRNA sequence
tagtggagctgaaaagttcc

SEQ ID NO: 245799 - DNA, 20 bp, Artificial
  CRISPR gRNA sequence
aaaagttcctattgcctcgt

SEQ ID NO: 245800 - DNA, 20 bp, Artificial
  CRISPR gRNA sequence
ctattgcctcgtgatgtcca

SEQ ID NO: 245801 - DNA, 20 bp, Artificial
  CRISPR gRNA sequence
ttgcctcgtgatgtccaacc

SEQ ID NO: 245802 - DNA, 20 bp, Artificial
  CRISPR gRNA sequence
cctcgtgatgtccaaccatc

SEQ ID NO: 245803 - DNA, 20 bp, Artificial
  CRISPR gRNA sequence
gtgatgtccaaccatcataa

SEQ ID NO: 245804 - DNA, 20 bp, Artificial
  CRISPR gRNA sequence
cagcacagctcattgctcac

SEQ ID NO: 245805 - DNA, 20 bp, Artificial
  CRISPR gRNA sequence
attgctcacgtttgtggtga

SEQ ID NO: 245806 - DNA, 20 bp, Artificial
  CRISPR gRNA sequence
ctcacgtttgtggtgatact

SEQ ID NO: 245807 - DNA, 20 bp, Artificial
  CRISPR gRNA sequence
acgtttgtggtgatactgat

SEQ ID NO: 245808 - DNA, 20 bp, Artificial
  CRISPR gRNA sequence
gtggtgatactgatgtaaaa

SEQ ID NO: 245809 - DNA, 20 bp, Artificial
  CRISPR gRNA sequence
tggtgatactgatgtaaaaa

SEQ ID NO: 245810 - DNA, 20 bp, Artificial
  CRISPR gRNA sequence
atgtaaaaaacctactgagc

SEQ ID NO: 245811 - DNA, 20 bp, Artificial
  CRISPR gRNA sequence
ctgagctgccagttgtgtaa

SEQ ID NO: 245812 - DNA, 20 bp, Artificial
  CRISPR gRNA sequence
agctgccagttgtgtaaagt

SEQ ID NO: 245813 - DNA, 20 bp, Artificial
  CRISPR gRNA sequence
ccagttgtgtaaagtgtagc

SEQ ID NO: 245814 - DNA, 20 bp, Artificial
  CRISPR gRNA sequence
tgtaaagtgtagcatatgca

SEQ ID NO: 245815 - DNA, 20 bp, Artificial
  CRISPR gRNA sequence
tgtacagcacataatccttg

SEQ ID NO: 245816 - DNA, 20 bp, Artificial
  CRISPR gRNA sequence
gacaatgacaataaatgact

SEQ ID NO: 245817 - DNA, 20 bp, Artificial
  CRISPR gRNA sequence
acaatgacaataaatgacta

SEQ ID NO: 245818 - DNA, 20 bp, Artificial
  CRISPR gRNA sequence
tgttagtagtttatggactt

SEQ ID NO: 245819 - DNA, 20 bp, Artificial
  CRISPR gRNA sequence
gtagtttatggacttactat

SEQ ID NO: 245820 - DNA, 20 bp, Artificial
  CRISPR gRNA sequence
atggacttactataccatac

SEQ ID NO: 245821 - DNA, 20 bp, Artificial
  CRISPR gRNA sequence
tggacttactataccatact

SEQ ID NO: 245822 - DNA, 20 bp, Artificial
  CRISPR gRNA sequence
actataccatactttttata

SEQ ID NO: 245823 - DNA, 20 bp, Artificial
  CRISPR gRNA sequence
ctataccatactttttatag

SEQ ID NO: 245824 - DNA, 20 bp, Artificial
  CRISPR gRNA sequence
taccatactttttatagtta

SEQ ID NO: 245825 - DNA, 20 bp, Artificial
  CRISPR gRNA sequence
tttatagttatttcatagta

SEQ ID NO: 245826 - DNA, 20 bp, Artificial
  CRISPR gRNA sequence
ttatagttatttcatagtat

SEQ ID NO: 245827 - DNA, 20 bp, Artificial
  CRISPR gRNA sequence
tatagttatttcatagtata

SEQ ID NO: 245828 - DNA, 20 bp, Artificial
  CRISPR gRNA sequence
atagttatttcatagtatat

SEQ ID NO: 245829 - DNA, 20 bp, Artificial
  CRISPR gRNA sequence
tagttatttcatagtatatt

SEQ ID NO: 245830 - DNA, 20 bp, Artificial
  CRISPR gRNA sequence
tttcatagtatattccatat

SEQ ID NO: 245831 - DNA, 20 bp, Artificial
  CRISPR gRNA sequence
catagtatattccatatata

SEQ ID NO: 245832 - DNA, 20 bp, Artificial
  CRISPR gRNA sequence
atagtatattccatatatat

SEQ ID NO: 245833 - DNA, 20 bp, Artificial
  CRISPR gRNA sequence
catatatatatatatatata

SEQ ID NO: 245834 - DNA, 20 bp, Artificial
  CRISPR gRNA sequence
aggccgggtgttgtggctca

SEQ ID NO: 245835 - DNA, 20 bp, Artificial
  CRISPR gRNA sequence
tggctcacacctgtaatccc

SEQ ID NO: 245836 - DNA, 20 bp, Artificial
  CRISPR gRNA sequence
acacctgtaatcccagcact

SEQ ID NO: 245837 - DNA, 20 bp, Artificial
  CRISPR gRNA sequence
taatcccagcactttgggag

SEQ ID NO: 245838 - DNA, 20 bp, Artificial
  CRISPR gRNA sequence
tgggaggccaaggcaggtgg

SEQ ID NO: 245839 - DNA, 20 bp, Artificial
  CRISPR gRNA sequence
gggaggccaaggcaggtgga

SEQ ID NO: 245840 - DNA, 20 bp, Artificial
  CRISPR gRNA sequence
ggaggccaaggcaggtggat

SEQ ID NO: 245841 - DNA, 20 bp, Artificial
  CRISPR gRNA sequence
cctgagctcaggagtttgag

SEQ ID NO: 245842 - DNA, 20 bp, Artificial
  CRISPR gRNA sequence
agctcaggagtttgagacta

SEQ ID NO: 245843 - DNA, 20 bp, Artificial
  CRISPR gRNA sequence
aggagtttgagactagcctg

SEQ ID NO: 245844 - DNA, 20 bp, Artificial
  CRISPR gRNA sequence
gagactagcctgggcaattt

SEQ ID NO: 245845 - DNA, 20 bp, Artificial
  CRISPR gRNA sequence
agactagcctgggcaatttg

SEQ ID NO: 245846 - DNA, 20 bp, Artificial
  CRISPR gRNA sequence
gcctgggcaatttggtgaaa

SEQ ID NO: 245847 - DNA, 20 bp, Artificial
  CRISPR gRNA sequence
ggcaatttggtgaaaccctg

SEQ ID NO: 245848 - DNA, 20 bp, Artificial
  CRISPR gRNA sequence
ggtgaaaccctgtctctact

SEQ ID NO: 245849 - DNA, 20 bp, Artificial
  CRISPR gRNA sequence
gtgaaaccctgtctctacta

SEQ ID NO: 245850 - DNA, 20 bp, Artificial
  CRISPR gRNA sequence
tctctactaaagtacaaaaa

SEQ ID NO: 245851 - DNA, 20 bp, Artificial
  CRISPR gRNA sequence
tactaaagtacaaaaaatta

SEQ ID NO: 245852 - DNA, 20 bp, Artificial
  CRISPR gRNA sequence
ctaaagtacaaaaaattagc

SEQ ID NO: 245853 - DNA, 20 bp, Artificial
  CRISPR gRNA sequence
aagtacaaaaaattagccag

SEQ ID NO: 245854 - DNA, 20 bp, Artificial
  CRISPR gRNA sequence
gccaggcatggcggcatgca

SEQ ID NO: 245855 - DNA, 20 bp, Artificial
  CRISPR gRNA sequence
taatcccagctactcgggag

SEQ ID NO: 245856 - DNA, 20 bp, Artificial
  CRISPR gRNA sequence
ctcgggaggctgagacagga

SEQ ID NO: 245857 - DNA, 20 bp, Artificial
  CRISPR gRNA sequence
gggaggctgagacaggagaa

SEQ ID NO: 245858 - DNA, 20 bp, Artificial
  CRISPR gRNA sequence
agacaggagaatcccttgaa

SEQ ID NO: 245859 - DNA, 20 bp, Artificial
  CRISPR gRNA sequence
gaacccgggaggcagaggtt

SEQ ID NO: 245860 - DNA, 20 bp, Artificial
  CRISPR gRNA sequence
aacccgggaggcagaggttg

SEQ ID NO: 245861 - DNA, 20 bp, Artificial
  CRISPR gRNA sequence
cagggagccgagaccgcccc

SEQ ID NO: 245862 - DNA, 20 bp, Artificial
  CRISPR gRNA sequence
cactccagcctgggcaacag

SEQ ID NO: 245863 - DNA, 20 bp, Artificial
  CRISPR gRNA sequence
cagcctgggcaacagagcaa

SEQ ID NO: 245864 - DNA, 20 bp, Artificial
  CRISPR gRNA sequence
ggcaacagagcaagactcct

SEQ ID NO: 245865 - DNA, 20 bp, Artificial
  CRISPR gRNA sequence
ctctcaaacaaaaaacaaac

SEQ ID NO: 245866 - DNA, 20 bp, Artificial
  CRISPR gRNA sequence
tcaaacaaaaaacaaacaaa

SEQ ID NO: 245867 - DNA, 20 bp, Artificial
  CRISPR gRNA sequence
aaacaaaaaacaaacaaaca

SEQ ID NO: 245868 - DNA, 20 bp, Artificial
  CRISPR gRNA sequence
attgtaaaacagcctcaggc

SEQ ID NO: 245869 - DNA, 20 bp, Artificial
  CRISPR gRNA sequence
taaaacagcctcaggcaggt

SEQ ID NO: 245870 - DNA, 20 bp, Artificial
  CRISPR gRNA sequence
aggcaggtcctttgggaggt

SEQ ID NO: 245871 - DNA, 20 bp, Artificial
  CRISPR gRNA sequence
tgggaggtattccagaagaa

SEQ ID NO: 245872 - DNA, 20 bp, Artificial
  CRISPR gRNA sequence
gggaggtattccagaagaag

SEQ ID NO: 245873 - DNA, 20 bp, Artificial
  CRISPR gRNA sequence
ggaggtattccagaagaaga

SEQ ID NO: 245874 - DNA, 20 bp, Artificial
  CRISPR gRNA sequence
cagaagaagacattgttctc

SEQ ID NO: 245875 - DNA, 20 bp, Artificial
  CRISPR gRNA sequence
ttctcataggagatgacagc

SEQ ID NO: 245876 - DNA, 20 bp, Artificial
  CRISPR gRNA sequence
tcataggagatgacagctac

SEQ ID NO: 245877 - DNA, 20 bp, Artificial
  CRISPR gRNA sequence
ataggagatgacagctacat

SEQ ID NO: 245878 - DNA, 20 bp, Artificial
  CRISPR gRNA sequence
catgcatgtttttgccccaa

SEQ ID NO: 245879 - DNA, 20 bp, Artificial
  CRISPR gRNA sequence
ttgccccaaagatcttccag

SEQ ID NO: 245880 - DNA, 20 bp, Artificial
  CRISPR gRNA sequence
tgccccaaagatcttccagt

SEQ ID NO: 245881 - DNA, 20 bp, Artificial
  CRISPR gRNA sequence
gccccaaagatcttccagtg

SEQ ID NO: 245882 - DNA, 20 bp, Artificial
  CRISPR gRNA sequence
ccccaaagatcttccagtgg

SEQ ID NO: 245883 - DNA, 20 bp, Artificial
  CRISPR gRNA sequence
ccagtgggacaagatgtgga

SEQ ID NO: 245884 - DNA, 20 bp, Artificial
  CRISPR gRNA sequence
cagtgggacaagatgtggag

SEQ ID NO: 245885 - DNA, 20 bp, Artificial
  CRISPR gRNA sequence
tgtgtgggtctaggctaata

SEQ ID NO: 245886 - DNA, 20 bp, Artificial
  CRISPR gRNA sequence
tgtgggtctaggctaataag

SEQ ID NO: 245887 - DNA, 20 bp, Artificial
  CRISPR gRNA sequence
ggctaataagtgtgttcgtg

SEQ ID NO: 245888 - DNA, 20 bp, Artificial
  CRISPR gRNA sequence
ataagtgtgttcgtgtctta

SEQ ID NO: 245889 - DNA, 20 bp, Artificial
  CRISPR gRNA sequence
gtgtcttagtttttcacaaa

SEQ ID NO: 245890 - DNA, 20 bp, Artificial
  CRISPR gRNA sequence
agtttttcacaaaaaaagtt

SEQ ID NO: 245891 - DNA, 20 bp, Artificial
  CRISPR gRNA sequence
gtttttcacaaaaaaagttt

SEQ ID NO: 245892 - DNA, 20 bp, Artificial
  CRISPR gRNA sequence
ttcacaaaaaaagtttaaaa

SEQ ID NO: 245893 - DNA, 20 bp, Artificial
  CRISPR gRNA sequence
tcacaaaaaaagtttaaaaa

SEQ ID NO: 245894 - DNA, 20 bp, Artificial
  CRISPR gRNA sequence
cacaaaaaaagtttaaaaag

SEQ ID NO: 245895 - DNA, 20 bp, Artificial
  CRISPR gRNA sequence
acaaaaaaagtttaaaaagt

SEQ ID NO: 245896 - DNA, 20 bp, Artificial
  CRISPR gRNA sequence
aaaaagtaaaaagcaattta

SEQ ID NO: 245897 - DNA, 20 bp, Artificial
  CRISPR gRNA sequence
aaaagtaaaaagcaatttaa

SEQ ID NO: 245898 - DNA, 20 bp, Artificial
  CRISPR gRNA sequence
aaaaacttttaaatagataa

SEQ ID NO: 245899 - DNA, 20 bp, Artificial
  CRISPR gRNA sequence
aaaacttttaaatagataaa

SEQ ID NO: 245900 - DNA, 20 bp, Artificial
  CRISPR gRNA sequence
ttaaatagataaaagcttat

SEQ ID NO: 245901 - DNA, 20 bp, Artificial
  CRISPR gRNA sequence
taaatagataaaagcttata

SEQ ID NO: 245902 - DNA, 20 bp, Artificial
  CRISPR gRNA sequence
aaatagataaaagcttatag

SEQ ID NO: 245903 - DNA, 20 bp, Artificial
  CRISPR gRNA sequence
aatagataaaagcttataga

SEQ ID NO: 245904 - DNA, 20 bp, Artificial
  CRISPR gRNA sequence
atagaataaggaaataaaga

SEQ ID NO: 245905 - DNA, 20 bp, Artificial
  CRISPR gRNA sequence
tagaataaggaaataaagag

SEQ ID NO: 245906 - DNA, 20 bp, Artificial
  CRISPR gRNA sequence
ttgtacagctgtacaatgtg

SEQ ID NO: 245907 - DNA, 20 bp, Artificial
  CRISPR gRNA sequence
tgtacagctgtacaatgtgc

SEQ ID NO: 245908 - DNA, 20 bp, Artificial
  CRISPR gRNA sequence
gtacagctgtacaatgtgct

SEQ ID NO: 245909 - DNA, 20 bp, Artificial
  CRISPR gRNA sequence
tacagctgtacaatgtgctt

SEQ ID NO: 245910 - DNA, 20 bp, Artificial
  CRISPR gRNA sequence
tacaatgtgcttgtgtttta

SEQ ID NO: 245911 - DNA, 20 bp, Artificial
  CRISPR gRNA sequence
gtgttttaagctaagagtta

SEQ ID NO: 245912 - DNA, 20 bp, Artificial
  CRISPR gRNA sequence
tgttttaagctaagagttat

SEQ ID NO: 245913 - DNA, 20 bp, Artificial
  CRISPR gRNA sequence
taagctaagagttattacaa

SEQ ID NO: 245914 - DNA, 20 bp, Artificial
  CRISPR gRNA sequence
aagctaagagttattacaaa

SEQ ID NO: 245915 - DNA, 20 bp, Artificial
  CRISPR gRNA sequence
agctaagagttattacaaaa

SEQ ID NO: 245916 - DNA, 20 bp, Artificial
  CRISPR gRNA sequence
agagttattacaaaagagtc

SEQ ID NO: 245917 - DNA, 20 bp, Artificial
  CRISPR gRNA sequence
ttacaaaagagtcaaaaagt

SEQ ID NO: 245918 - DNA, 20 bp, Artificial
  CRISPR gRNA sequence
caaaagagtcaaaaagttaa

SEQ ID NO: 245919 - DNA, 20 bp, Artificial
  CRISPR gRNA sequence
aaaaaaattttttttaagtt

SEQ ID NO: 245920 - DNA, 20 bp, Artificial
  CRISPR gRNA sequence
tttttaagtttataggctgg

SEQ ID NO: 245921 - DNA, 20 bp, Artificial
  CRISPR gRNA sequence
ttttaagtttataggctggg

SEQ ID NO: 245922 - DNA, 20 bp, Artificial
  CRISPR gRNA sequence
tttaagtttataggctgggt

SEQ ID NO: 245923 - DNA, 20 bp, Artificial
  CRISPR gRNA sequence
ttaagtttataggctgggtg

SEQ ID NO: 245924 - DNA, 20 bp, Artificial
  CRISPR gRNA sequence
taagtttataggctgggtgc

SEQ ID NO: 245925 - DNA, 20 bp, Artificial
  CRISPR gRNA sequence
aagtttataggctgggtgcg

SEQ ID NO: 245926 - DNA, 20 bp, Artificial
  CRISPR gRNA sequence
agtttataggctgggtgcgg

SEQ ID NO: 245927 - DNA, 20 bp, Artificial
  CRISPR gRNA sequence
ataggctgggtgcggtggct

SEQ ID NO: 245928 - DNA, 20 bp, Artificial
  CRISPR gRNA sequence
taggctgggtgcggtggctc

SEQ ID NO: 245929 - DNA, 20 bp, Artificial
  CRISPR gRNA sequence
ggtgcggtggctcatgcctg

SEQ ID NO: 245930 - DNA, 20 bp, Artificial
  CRISPR gRNA sequence
atgcctgtaatcccagcact

SEQ ID NO: 245931 - DNA, 20 bp, Artificial
  CRISPR gRNA sequence
taatcccagcactttgggag

SEQ ID NO: 245932 - DNA, 20 bp, Artificial
  CRISPR gRNA sequence
tgggaggccgaggtgggcag

SEQ ID NO: 245933 - DNA, 20 bp, Artificial
  CRISPR gRNA sequence
gggaggccgaggtgggcaga

SEQ ID NO: 245934 - DNA, 20 bp, Artificial
  CRISPR gRNA sequence
ggaggccgaggtgggcagat

SEQ ID NO: 245935 - DNA, 20 bp, Artificial
  CRISPR gRNA sequence
ccggagctcaggagttcgag

SEQ ID NO: 245936 - DNA, 20 bp, Artificial
  CRISPR gRNA sequence
aggagttcgagaccagccta

SEQ ID NO: 245937 - DNA, 20 bp, Artificial
  CRISPR gRNA sequence
gagaccagcctagccaacat

SEQ ID NO: 245938 - DNA, 20 bp, Artificial
  CRISPR gRNA sequence
gccaacatggtgaaacccca

SEQ ID NO: 245939 - DNA, 20 bp, Artificial
  CRISPR gRNA sequence
taatacaaaaattagccagg

SEQ ID NO: 245940 - DNA, 20 bp, Artificial
  CRISPR gRNA sequence
atacaaaaattagccaggcg

SEQ ID NO: 245941 - DNA, 20 bp, Artificial
  CRISPR gRNA sequence
gccaggcgtggtggcagctg

SEQ ID NO: 245942 - DNA, 20 bp, Artificial
  CRISPR gRNA sequence
cctgtagtcccagctacttg

SEQ ID NO: 245943 - DNA, 20 bp, Artificial
  CRISPR gRNA sequence
tagtcccagctacttggggg

SEQ ID NO: 245944 - DNA, 20 bp, Artificial
  CRISPR gRNA sequence
cttggggggctgaggcagga

SEQ ID NO: 245945 - DNA, 20 bp, Artificial
  CRISPR gRNA sequence
ggggggctgaggcaggagaa

SEQ ID NO: 245946 - DNA, 20 bp, Artificial
  CRISPR gRNA sequence
gggggctgaggcaggagaat

SEQ ID NO: 245947 - DNA, 20 bp, Artificial
  CRISPR gRNA sequence
aggcaggagaatcacttgaa

SEQ ID NO: 245948 - DNA, 20 bp, Artificial
  CRISPR gRNA sequence
gaacctgggaggtgcaggct

SEQ ID NO: 245949 - DNA, 20 bp, Artificial
  CRISPR gRNA sequence
aacctgggaggtgcaggctg

SEQ ID NO: 245950 - DNA, 20 bp, Artificial
  CRISPR gRNA sequence
ggaggtgcaggctgcagtga

SEQ ID NO: 245951 - DNA, 20 bp, Artificial
  CRISPR gRNA sequence
cagtgagccaagatctcgcc

SEQ ID NO: 245952 - DNA, 20 bp, Artificial
  CRISPR gRNA sequence
gccactgcattccagcctgg

SEQ ID NO: 245953 - DNA, 20 bp, Artificial
  CRISPR gRNA sequence
cattccagcctgggcagcaa

SEQ ID NO: 245954 - DNA, 20 bp, Artificial
  CRISPR gRNA sequence
cagcctgggcagcaagaccc

SEQ ID NO: 245955 - DNA, 20 bp, Artificial
  CRISPR gRNA sequence
ggcagcaagaccctgcctca

SEQ ID NO: 245956 - DNA, 20 bp, Artificial
  CRISPR gRNA sequence
cctcaaaaaaaaaaaaatta

SEQ ID NO: 245957 - DNA, 20 bp, Artificial
  CRISPR gRNA sequence
aaaaaaaaaaaaattaaagt

SEQ ID NO: 245958 - DNA, 20 bp, Artificial
  CRISPR gRNA sequence
aagtttatgaagtaaaaagt

SEQ ID NO: 245959 - DNA, 20 bp, Artificial
  CRISPR gRNA sequence
atgaagtaaaaagtcacagt

SEQ ID NO: 245960 - DNA, 20 bp, Artificial
  CRISPR gRNA sequence
tgaagtaaaaagtcacagta

SEQ ID NO: 245961 - DNA, 20 bp, Artificial
  CRISPR gRNA sequence
aggttaatttattattgaag

SEQ ID NO: 245962 - DNA, 20 bp, Artificial
  CRISPR gRNA sequence
atttattattgaagaaagag

SEQ ID NO: 245963 - DNA, 20 bp, Artificial
  CRISPR gRNA sequence
attattgaagaaagagaaca

SEQ ID NO: 245964 - DNA, 20 bp, Artificial
  CRISPR gRNA sequence
ttattgaagaaagagaacat

SEQ ID NO: 245965 - DNA, 20 bp, Artificial
  CRISPR gRNA sequence
ttgaagaaagagaacatttt

SEQ ID NO: 245966 - DNA, 20 bp, Artificial
  CRISPR gRNA sequence
aagaaagagaacattttaaa

SEQ ID NO: 245967 - DNA, 20 bp, Artificial
  CRISPR gRNA sequence
taaataaatttaggttagct

SEQ ID NO: 245968 - DNA, 20 bp, Artificial
  CRISPR gRNA sequence
aaataaatttaggttagctt

SEQ ID NO: 245969 - DNA, 20 bp, Artificial
  CRISPR gRNA sequence
aataaatttaggttagctta

SEQ ID NO: 245970 - DNA, 20 bp, Artificial
  CRISPR gRNA sequence
aggttagcttaagtgtacag

SEQ ID NO: 245971 - DNA, 20 bp, Artificial
  CRISPR gRNA sequence
ggttagcttaagtgtacagt

SEQ ID NO: 245972 - DNA, 20 bp, Artificial
  CRISPR gRNA sequence
gcttaagtgtacagtgttta

SEQ ID NO: 245973 - DNA, 20 bp, Artificial
  CRISPR gRNA sequence
aagtgtacagtgtttataag

SEQ ID NO: 245974 - DNA, 20 bp, Artificial
  CRISPR gRNA sequence
agtgtacagtgtttataaga

SEQ ID NO: 245975 - DNA, 20 bp, Artificial
  CRISPR gRNA sequence
ataagactacagtgatatac

SEQ ID NO: 245976 - DNA, 20 bp, Artificial
  CRISPR gRNA sequence
taagactacagtgatataca

SEQ ID NO: 245977 - DNA, 20 bp, Artificial
  CRISPR gRNA sequence
cagtgatatacagcagaggt

SEQ ID NO: 245978 - DNA, 20 bp, Artificial
  CRISPR gRNA sequence
tttggcaagagggaccagtt

SEQ ID NO: 245979 - DNA, 20 bp, Artificial
  CRISPR gRNA sequence
ttggcaagagggaccagttt

SEQ ID NO: 245980 - DNA, 20 bp, Artificial
  CRISPR gRNA sequence
tggcaagagggaccagtttt

SEQ ID NO: 245981 - DNA, 20 bp, Artificial
  CRISPR gRNA sequence
ggcaagagggaccagttttg

SEQ ID NO: 245982 - DNA, 20 bp, Artificial
  CRISPR gRNA sequence
gcaagagggaccagttttgt

SEQ ID NO: 245983 - DNA, 20 bp, Artificial
  CRISPR gRNA sequence
tgtggaagacaatttttcca

SEQ ID NO: 245984 - DNA, 20 bp, Artificial
  CRISPR gRNA sequence
gtggaagacaatttttccac

SEQ ID NO: 245985 - DNA, 20 bp, Artificial
  CRISPR gRNA sequence
tggaagacaatttttccacg

SEQ ID NO: 245986 - DNA, 20 bp, Artificial
  CRISPR gRNA sequence
ttccacggactgggtgggtg

SEQ ID NO: 245987 - DNA, 20 bp, Artificial
  CRISPR gRNA sequence
tccacggactgggtgggtgg

SEQ ID NO: 245988 - DNA, 20 bp, Artificial
  CRISPR gRNA sequence
ccacggactgggtgggtggg

SEQ ID NO: 245989 - DNA, 20 bp, Artificial
  CRISPR gRNA sequence
cacggactgggtgggtgggg

SEQ ID NO: 245990 - DNA, 20 bp, Artificial
  CRISPR gRNA sequence
ggtgggtggggggatggttt

SEQ ID NO: 245991 - DNA, 20 bp, Artificial
  CRISPR gRNA sequence
caggatgattcaagcacatt

SEQ ID NO: 245992 - DNA, 20 bp, Artificial
  CRISPR gRNA sequence
aggatgattcaagcacatta

SEQ ID NO: 245993 - DNA, 20 bp, Artificial
  CRISPR gRNA sequence
aagcacattacatttattgt

SEQ ID NO: 245994 - DNA, 20 bp, Artificial
  CRISPR gRNA sequence
catttattgtgcactttatt

SEQ ID NO: 245995 - DNA, 20 bp, Artificial
  CRISPR gRNA sequence
attgtgcactttatttctat

SEQ ID NO: 245996 - DNA, 20 bp, Artificial
  CRISPR gRNA sequence
ttgtgcactttatttctatt

SEQ ID NO: 245997 - DNA, 20 bp, Artificial
  CRISPR gRNA sequence
tgcactttatttctattatt

SEQ ID NO: 245998 - DNA, 20 bp, Artificial
  CRISPR gRNA sequence
tatttctattattattactt

SEQ ID NO: 245999 - DNA, 20 bp, Artificial
  CRISPR gRNA sequence
atttctattattattacttt

SEQ ID NO: 246000 - DNA, 20 bp, Artificial
  CRISPR gRNA sequence
tttctattattattactttg

SEQ ID NO: 246001 - DNA, 20 bp, Artificial
  CRISPR gRNA sequence
ctattattattactttgtaa

SEQ ID NO: 246002 - DNA, 20 bp, Artificial
  CRISPR gRNA sequence
tattattattactttgtaat

SEQ ID NO: 246003 - DNA, 20 bp, Artificial
  CRISPR gRNA sequence
ttattattactttgtaatat

SEQ ID NO: 246004 - DNA, 20 bp, Artificial
  CRISPR gRNA sequence
ttattactttgtaatatata

SEQ ID NO: 246005 - DNA, 20 bp, Artificial
  CRISPR gRNA sequence
ttactttgtaatatataatg

SEQ ID NO: 246006 - DNA, 20 bp, Artificial
  CRISPR gRNA sequence
ctttgtaatatataatgaaa

SEQ ID NO: 246007 - DNA, 20 bp, Artificial
  CRISPR gRNA sequence
tgtaatatataatgaaataa

SEQ ID NO: 246008 - DNA, 20 bp, Artificial
  CRISPR gRNA sequence
gtaatatataatgaaataat

SEQ ID NO: 246009 - DNA, 20 bp, Artificial
  CRISPR gRNA sequence
taatatataatgaaataatt

SEQ ID NO: 246010 - DNA, 20 bp, Artificial
  CRISPR gRNA sequence
tacaactccctgtaatgtag

SEQ ID NO: 246011 - DNA, 20 bp, Artificial
  CRISPR gRNA sequence
cctgtaatgtagaatcagtg

SEQ ID NO: 246012 - DNA, 20 bp, Artificial
  CRISPR gRNA sequence
taatgtagaatcagtgggag

SEQ ID NO: 246013 - DNA, 20 bp, Artificial
  CRISPR gRNA sequence
agcttgttttcctacaacta

SEQ ID NO: 246014 - DNA, 20 bp, Artificial
  CRISPR gRNA sequence
gttttcctacaactagacag

SEQ ID NO: 246015 - DNA, 20 bp, Artificial
  CRISPR gRNA sequence
ttttcctacaactagacagt

SEQ ID NO: 246016 - DNA, 20 bp, Artificial
  CRISPR gRNA sequence
tcctacaactagacagtccc

SEQ ID NO: 246017 - DNA, 20 bp, Artificial
  CRISPR gRNA sequence
cctacaactagacagtccca

SEQ ID NO: 246018 - DNA, 20 bp, Artificial
  CRISPR gRNA sequence
ctacaactagacagtcccat

SEQ ID NO: 246019 - DNA, 20 bp, Artificial
  CRISPR gRNA sequence
caactagacagtcccatctg

SEQ ID NO: 246020 - DNA, 20 bp, Artificial
  CRISPR gRNA sequence
gacagtcccatctgggggtg

SEQ ID NO: 246021 - DNA, 20 bp, Artificial
  CRISPR gRNA sequence
ggggtgatggggaacagtga

SEQ ID NO: 246022 - DNA, 20 bp, Artificial
  CRISPR gRNA sequence
gattctcataaggagcgtgc

SEQ ID NO: 246023 - DNA, 20 bp, Artificial
  CRISPR gRNA sequence
tcataaggagcgtgcaacct

SEQ ID NO: 246024 - DNA, 20 bp, Artificial
  CRISPR gRNA sequence
ataaggagcgtgcaacctcg

SEQ ID NO: 246025 - DNA, 20 bp, Artificial
  CRISPR gRNA sequence
gatccctcgtatgcgcagtt

SEQ ID NO: 246026 - DNA, 20 bp, Artificial
  CRISPR gRNA sequence
gtatgcgcagttcacaatag

SEQ ID NO: 246027 - DNA, 20 bp, Artificial
  CRISPR gRNA sequence
acaataggattcatgctcct

SEQ ID NO: 246028 - DNA, 20 bp, Artificial
  CRISPR gRNA sequence
atgctcctatgagaatctaa

SEQ ID NO: 246029 - DNA, 20 bp, Artificial
  CRISPR gRNA sequence
ctatgagaatctaatgccgc

SEQ ID NO: 246030 - DNA, 20 bp, Artificial
  CRISPR gRNA sequence
tgagaatctaatgccgctgc

SEQ ID NO: 246031 - DNA, 20 bp, Artificial
  CRISPR gRNA sequence
atgccgctgctgatctgatg

SEQ ID NO: 246032 - DNA, 20 bp, Artificial
  CRISPR gRNA sequence
ctgatctgatgggagatgga

SEQ ID NO: 246033 - DNA, 20 bp, Artificial
  CRISPR gRNA sequence
atctgatgggagatggagat

SEQ ID NO: 246034 - DNA, 20 bp, Artificial
  CRISPR gRNA sequence
atgggagatggagataaggc

SEQ ID NO: 246035 - DNA, 20 bp, Artificial
  CRISPR gRNA sequence
taaatacagaggaagcttca

SEQ ID NO: 246036 - DNA, 20 bp, Artificial
  CRISPR gRNA sequence
cacgtgcttgcccaccactc

SEQ ID NO: 246037 - DNA, 20 bp, Artificial
  CRISPR gRNA sequence
acgtgcttgcccaccactct

SEQ ID NO: 246038 - DNA, 20 bp, Artificial
  CRISPR gRNA sequence
gcccaccactctcctcctgc

SEQ ID NO: 246039 - DNA, 20 bp, Artificial
  CRISPR gRNA sequence
cccaccactctcctcctgct

SEQ ID NO: 246040 - DNA, 20 bp, Artificial
  CRISPR gRNA sequence
tcctcctgctgggtggcctg

SEQ ID NO: 246041 - DNA, 20 bp, Artificial
  CRISPR gRNA sequence
ctcctgctgggtggcctggt

SEQ ID NO: 246042 - DNA, 20 bp, Artificial
  CRISPR gRNA sequence
ctgctgggtggcctggtttc

SEQ ID NO: 246043 - DNA, 20 bp, Artificial
  CRISPR gRNA sequence
ctgggtggcctggtttctaa

SEQ ID NO: 246044 - DNA, 20 bp, Artificial
  CRISPR gRNA sequence
ggtggcctggtttctaatgg

SEQ ID NO: 246045 - DNA, 20 bp, Artificial
  CRISPR gRNA sequence
gtttctaatggcgtctcact

SEQ ID NO: 246046 - DNA, 20 bp, Artificial
  CRISPR gRNA sequence
ctaatggcgtctcactctgt

SEQ ID NO: 246047 - DNA, 20 bp, Artificial
  CRISPR gRNA sequence
taatggcgtctcactctgtt

SEQ ID NO: 246048 - DNA, 20 bp, Artificial
  CRISPR gRNA sequence
atggcgtctcactctgttgc

SEQ ID NO: 246049 - DNA, 20 bp, Artificial
  CRISPR gRNA sequence
actctgttgcccagccagga

SEQ ID NO: 246050 - DNA, 20 bp, Artificial
  CRISPR gRNA sequence
tgttgcccagccaggagtgc

SEQ ID NO: 246051 - DNA, 20 bp, Artificial
  CRISPR gRNA sequence
ttgcccagccaggagtgcag

SEQ ID NO: 246052 - DNA, 20 bp, Artificial
  CRISPR gRNA sequence
cccagccaggagtgcagtga

SEQ ID NO: 246053 - DNA, 20 bp, Artificial
  CRISPR gRNA sequence
ggctcactgcaacctctgcc

SEQ ID NO: 246054 - DNA, 20 bp, Artificial
  CRISPR gRNA sequence
actgcaacctctgcctgtca

SEQ ID NO: 246055 - DNA, 20 bp, Artificial
  CRISPR gRNA sequence
caacctctgcctgtcaggtt

SEQ ID NO: 246056 - DNA, 20 bp, Artificial
  CRISPR gRNA sequence
tgcctgtcaggttcaaggga

SEQ ID NO: 246057 - DNA, 20 bp, Artificial
  CRISPR gRNA sequence
cctgtcaggttcaagggatt

SEQ ID NO: 246058 - DNA, 20 bp, Artificial
  CRISPR gRNA sequence
tcaggttcaagggattctcc

SEQ ID NO: 246059 - DNA, 20 bp, Artificial
  CRISPR gRNA sequence
aagggattctcccacctcag

SEQ ID NO: 246060 - DNA, 20 bp, Artificial
  CRISPR gRNA sequence
tcccacctcagcctcccaag

SEQ ID NO: 246061 - DNA, 20 bp, Artificial
  CRISPR gRNA sequence
ccacctcagcctcccaagtg

SEQ ID NO: 246062 - DNA, 20 bp, Artificial
  CRISPR gRNA sequence
agcctcccaagtggctggaa

SEQ ID NO: 246063 - DNA, 20 bp, Artificial
  CRISPR gRNA sequence
ccaagtggctggaattacag

SEQ ID NO: 246064 - DNA, 20 bp, Artificial
  CRISPR gRNA sequence
gaattacaggcatgcgccac

SEQ ID NO: 246065 - DNA, 20 bp, Artificial
  CRISPR gRNA sequence
caggcatgcgccaccacacc

SEQ ID NO: 246066 - DNA, 20 bp, Artificial
  CRISPR gRNA sequence
atttttgtatttttagtaga

SEQ ID NO: 246067 - DNA, 20 bp, Artificial
  CRISPR gRNA sequence
ttgtatttttagtagaaaca

SEQ ID NO: 246068 - DNA, 20 bp, Artificial
  CRISPR gRNA sequence
tgtatttttagtagaaacag

SEQ ID NO: 246069 - DNA, 20 bp, Artificial
  CRISPR gRNA sequence
gtatttttagtagaaacagg

SEQ ID NO: 246070 - DNA, 20 bp, Artificial
  CRISPR gRNA sequence
tatttttagtagaaacaggg

SEQ ID NO: 246071 - DNA, 20 bp, Artificial
  CRISPR gRNA sequence
ttagtagaaacagggtttca

SEQ ID NO: 246072 - DNA, 20 bp, Artificial
  CRISPR gRNA sequence
tagtagaaacagggtttcac

SEQ ID NO: 246073 - DNA, 20 bp, Artificial
  CRISPR gRNA sequence
agtagaaacagggtttcacc

SEQ ID NO: 246074 - DNA, 20 bp, Artificial
  CRISPR gRNA sequence
gtagaaacagggtttcacca

SEQ ID NO: 246075 - DNA, 20 bp, Artificial
  CRISPR gRNA sequence
caccatgttggccaggctag

SEQ ID NO: 246076 - DNA, 20 bp, Artificial
  CRISPR gRNA sequence
accatgttggccaggctagt

SEQ ID NO: 246077 - DNA, 20 bp, Artificial
  CRISPR gRNA sequence
gccaggctagtctcgaactc

SEQ ID NO: 246078 - DNA, 20 bp, Artificial
  CRISPR gRNA sequence
gtctcgaactcctgacctca

SEQ ID NO: 246079 - DNA, 20 bp, Artificial
  CRISPR gRNA sequence
gaactcctgacctcaggtga

SEQ ID NO: 246080 - DNA, 20 bp, Artificial
  CRISPR gRNA sequence
ctgacctcaggtgatctgcc

SEQ ID NO: 246081 - DNA, 20 bp, Artificial
  CRISPR gRNA sequence
acctcaggtgatctgcccac

SEQ ID NO: 246082 - DNA, 20 bp, Artificial
  CRISPR gRNA sequence
aggtgatctgcccaccttgg

SEQ ID NO: 246083 - DNA, 20 bp, Artificial
  CRISPR gRNA sequence
cccaccttggtctcccaaag

SEQ ID NO: 246084 - DNA, 20 bp, Artificial
  CRISPR gRNA sequence
ggtctcccaaagtgttggga

SEQ ID NO: 246085 - DNA, 20 bp, Artificial
  CRISPR gRNA sequence
gtctcccaaagtgttgggat

SEQ ID NO: 246086 - DNA, 20 bp, Artificial
  CRISPR gRNA sequence
ccaaagtgttgggattacag

SEQ ID NO: 246087 - DNA, 20 bp, Artificial
  CRISPR gRNA sequence
ggattacagacatgagccac

SEQ ID NO: 246088 - DNA, 20 bp, Artificial
  CRISPR gRNA sequence
cagacatgagccactgcgcc

SEQ ID NO: 246089 - DNA, 20 bp, Artificial
  CRISPR gRNA sequence
cgcctggcaaagatcatatt

SEQ ID NO: 246090 - DNA, 20 bp, Artificial
  CRISPR gRNA sequence
gcaaagatcatattattttc

SEQ ID NO: 246091 - DNA, 20 bp, Artificial
  CRISPR gRNA sequence
ttttcacggtacctcttcta

SEQ ID NO: 246092 - DNA, 20 bp, Artificial
  CRISPR gRNA sequence
tcacggtacctcttctatgt

SEQ ID NO: 246093 - DNA, 20 bp, Artificial
  CRISPR gRNA sequence
cacggtacctcttctatgtt

SEQ ID NO: 246094 - DNA, 20 bp, Artificial
  CRISPR gRNA sequence
acggtacctcttctatgttt

SEQ ID NO: 246095 - DNA, 20 bp, Artificial
  CRISPR gRNA sequence
ttctatgtttagatatgttt

SEQ ID NO: 246096 - DNA, 20 bp, Artificial
  CRISPR gRNA sequence
ctatgtttagatatgtttag

SEQ ID NO: 246097 - DNA, 20 bp, Artificial
  CRISPR gRNA sequence
tatgtttagatatgtttagc

SEQ ID NO: 246098 - DNA, 20 bp, Artificial
  CRISPR gRNA sequence
tgtttagatatgtttagcta

SEQ ID NO: 246099 - DNA, 20 bp, Artificial
  CRISPR gRNA sequence
agatatgtttagctacacaa

SEQ ID NO: 246100 - DNA, 20 bp, Artificial
  CRISPR gRNA sequence
gatatgtttagctacacaaa

SEQ ID NO: 246101 - DNA, 20 bp, Artificial
  CRISPR gRNA sequence
agctacacaaataccattat

SEQ ID NO: 246102 - DNA, 20 bp, Artificial
  CRISPR gRNA sequence
gctacacaaataccattatg

SEQ ID NO: 246103 - DNA, 20 bp, Artificial
  CRISPR gRNA sequence
cacaaataccattatgttac

SEQ ID NO: 246104 - DNA, 20 bp, Artificial
  CRISPR gRNA sequence
tgttacagttgcctatggta

SEQ ID NO: 246105 - DNA, 20 bp, Artificial
  CRISPR gRNA sequence
cagttgcctatggtattcgg

SEQ ID NO: 246106 - DNA, 20 bp, Artificial
  CRISPR gRNA sequence
cctatggtattcggtacagt

SEQ ID NO: 246107 - DNA, 20 bp, Artificial
  CRISPR gRNA sequence
tggtattcggtacagtcaca

SEQ ID NO: 246108 - DNA, 20 bp, Artificial
  CRISPR gRNA sequence
ggtacagtcacatgcctgac

SEQ ID NO: 246109 - DNA, 20 bp, Artificial
  CRISPR gRNA sequence
acaggtttgtagtataggag

SEQ ID NO: 246110 - DNA, 20 bp, Artificial
  CRISPR gRNA sequence
gtagtataggagggataggc

SEQ ID NO: 246111 - DNA, 20 bp, Artificial
  CRISPR gRNA sequence
tagtataggagggataggct

SEQ ID NO: 246112 - DNA, 20 bp, Artificial
  CRISPR gRNA sequence
taccatccagcctaggtgta

SEQ ID NO: 246113 - DNA, 20 bp, Artificial
  CRISPR gRNA sequence
ggtgtatagtaggctgtacc

SEQ ID NO: 246114 - DNA, 20 bp, Artificial
  CRISPR gRNA sequence
taccatctaggtttgcataa

SEQ ID NO: 246115 - DNA, 20 bp, Artificial
  CRISPR gRNA sequence
ggtttgcataagtgccctct

SEQ ID NO: 246116 - DNA, 20 bp, Artificial
  CRISPR gRNA sequence
gcataagtgccctctatgat

SEQ ID NO: 246117 - DNA, 20 bp, Artificial
  CRISPR gRNA sequence
cataagtgccctctatgatg

SEQ ID NO: 246118 - DNA, 20 bp, Artificial
  CRISPR gRNA sequence
tatgatgttcacacaacaac

SEQ ID NO: 246119 - DNA, 20 bp, Artificial
  CRISPR gRNA sequence
tgatgttcacacaacaacga

SEQ ID NO: 246120 - DNA, 20 bp, Artificial
  CRISPR gRNA sequence
acacaacaacgaaatcactt

SEQ ID NO: 246121 - DNA, 20 bp, Artificial
  CRISPR gRNA sequence
aacaacacatttctcagaac

SEQ ID NO: 246122 - DNA, 20 bp, Artificial
  CRISPR gRNA sequence
acaacacatttctcagaact

SEQ ID NO: 246123 - DNA, 20 bp, Artificial
  CRISPR gRNA sequence
ctcagaactacccctgtcat

SEQ ID NO: 246124 - DNA, 20 bp, Artificial
  CRISPR gRNA sequence
tcagaactacccctgtcatt

SEQ ID NO: 246125 - DNA, 20 bp, Artificial
  CRISPR gRNA sequence
agaactacccctgtcattaa

SEQ ID NO: 246126 - DNA, 20 bp, Artificial
  CRISPR gRNA sequence
cccctgtcattaagtgatat

SEQ ID NO: 246127 - DNA, 20 bp, Artificial
  CRISPR gRNA sequence
tcattaagtgatatgtgact

SEQ ID NO: 246128 - DNA, 20 bp, Artificial
  CRISPR gRNA sequence
agtgatatgtgactgtactt

SEQ ID NO: 246129 - DNA, 20 bp, Artificial
  CRISPR gRNA sequence
tacttcacatagtaaagatg

SEQ ID NO: 246130 - DNA, 20 bp, Artificial
  CRISPR gRNA sequence
cacatagtaaagatgtcaat

SEQ ID NO: 246131 - DNA, 20 bp, Artificial
  CRISPR gRNA sequence
acatagtaaagatgtcaatt

SEQ ID NO: 246132 - DNA, 20 bp, Artificial
  CRISPR gRNA sequence
gcccgaaactgatatgcaga

SEQ ID NO: 246133 - DNA, 20 bp, Artificial
  CRISPR gRNA sequence
cccgaaactgatatgcagat

SEQ ID NO: 246134 - DNA, 20 bp, Artificial
  CRISPR gRNA sequence
atatgcagatttaacacaat

SEQ ID NO: 246135 - DNA, 20 bp, Artificial
  CRISPR gRNA sequence
aacacaattgttatcagaat

SEQ ID NO: 246136 - DNA, 20 bp, Artificial
  CRISPR gRNA sequence
acacaattgttatcagaatc

SEQ ID NO: 246137 - DNA, 20 bp, Artificial
  CRISPR gRNA sequence
ttatcagaatcccagccggc

SEQ ID NO: 246138 - DNA, 20 bp, Artificial
  CRISPR gRNA sequence
tcagaatcccagccggcttt

SEQ ID NO: 246139 - DNA, 20 bp, Artificial
  CRISPR gRNA sequence
tttgtagatatagatattat

SEQ ID NO: 246140 - DNA, 20 bp, Artificial
  CRISPR gRNA sequence
ttgtagatatagatattatc

SEQ ID NO: 246141 - DNA, 20 bp, Artificial
  CRISPR gRNA sequence
tgtagatatagatattatcc

SEQ ID NO: 246142 - DNA, 20 bp, Artificial
  CRISPR gRNA sequence
gtagatatagatattatcct

SEQ ID NO: 246143 - DNA, 20 bp, Artificial
  CRISPR gRNA sequence
tagatatagatattatccta

SEQ ID NO: 246144 - DNA, 20 bp, Artificial
  CRISPR gRNA sequence
tcctaaaatgtatgtggaaa

SEQ ID NO: 246145 - DNA, 20 bp, Artificial
  CRISPR gRNA sequence
aaatgtatgtggaaatgcaa

SEQ ID NO: 246146 - DNA, 20 bp, Artificial
  CRISPR gRNA sequence
gaatagataaaacaattttg

SEQ ID NO: 246147 - DNA, 20 bp, Artificial
  CRISPR gRNA sequence
tgaaatgaaataataaagtg

SEQ ID NO: 246148 - DNA, 20 bp, Artificial
  CRISPR gRNA sequence
gaaatgaaataataaagtgg

SEQ ID NO: 246149 - DNA, 20 bp, Artificial
  CRISPR gRNA sequence
aaatgaaataataaagtggg

SEQ ID NO: 246150 - DNA, 20 bp, Artificial
  CRISPR gRNA sequence
ccaccctctacccaatttca

SEQ ID NO: 246151 - DNA, 20 bp, Artificial
  CRISPR gRNA sequence
tacccaatttcagtatttat

SEQ ID NO: 246152 - DNA, 20 bp, Artificial
  CRISPR gRNA sequence
cccaatttcagtatttatgt

SEQ ID NO: 246153 - DNA, 20 bp, Artificial
  CRISPR gRNA sequence
cagtatttatgtataactac

SEQ ID NO: 246154 - DNA, 20 bp, Artificial
  CRISPR gRNA sequence
agtatttatgtataactaca

SEQ ID NO: 246155 - DNA, 20 bp, Artificial
  CRISPR gRNA sequence
atgtataactacagtaatca

SEQ ID NO: 246156 - DNA, 20 bp, Artificial
  CRISPR gRNA sequence
tgtataactacagtaatcaa

SEQ ID NO: 246157 - DNA, 20 bp, Artificial
  CRISPR gRNA sequence
cagtaatcaaggctgtgtgg

SEQ ID NO: 246158 - DNA, 20 bp, Artificial
  CRISPR gRNA sequence
tgtggtattggcagaagaag

SEQ ID NO: 246159 - DNA, 20 bp, Artificial
  CRISPR gRNA sequence
gcagaagaagaaacacatgg

SEQ ID NO: 246160 - DNA, 20 bp, Artificial
  CRISPR gRNA sequence
cagccaactgactttgacaa

SEQ ID NO: 246161 - DNA, 20 bp, Artificial
  CRISPR gRNA sequence
actttgacaaaggtacaatg

SEQ ID NO: 246162 - DNA, 20 bp, Artificial
  CRISPR gRNA sequence
tgacaaaggtacaatgaagg

SEQ ID NO: 246163 - DNA, 20 bp, Artificial
  CRISPR gRNA sequence
gacaaaggtacaatgaagga

SEQ ID NO: 246164 - DNA, 20 bp, Artificial
  CRISPR gRNA sequence
acaaaggtacaatgaaggat

SEQ ID NO: 246165 - DNA, 20 bp, Artificial
  CRISPR gRNA sequence
atgttttccactagtggtgc

SEQ ID NO: 246166 - DNA, 20 bp, Artificial
  CRISPR gRNA sequence
tccactagtggtgctagagc

SEQ ID NO: 246167 - DNA, 20 bp, Artificial
  CRISPR gRNA sequence
ccactagtggtgctagagca

SEQ ID NO: 246168 - DNA, 20 bp, Artificial
  CRISPR gRNA sequence
cactagtggtgctagagcaa

SEQ ID NO: 246169 - DNA, 20 bp, Artificial
  CRISPR gRNA sequence
gtggtgctagagcaattgga

SEQ ID NO: 246170 - DNA, 20 bp, Artificial
  CRISPR gRNA sequence
gagcaattggacgtccatag

SEQ ID NO: 246171 - DNA, 20 bp, Artificial
  CRISPR gRNA sequence
gacgtccatagtccaacaac

SEQ ID NO: 246172 - DNA, 20 bp, Artificial
  CRISPR gRNA sequence
ggctaaaacctctcacacct

SEQ ID NO: 246173 - DNA, 20 bp, Artificial
  CRISPR gRNA sequence
gctaaaacctctcacacctt

SEQ ID NO: 246174 - DNA, 20 bp, Artificial
  CRISPR gRNA sequence
aaacctctcacaccttatac

SEQ ID NO: 246175 - DNA, 20 bp, Artificial
  CRISPR gRNA sequence
tcacaccttatacgaaaaat

SEQ ID NO: 246176 - DNA, 20 bp, Artificial
  CRISPR gRNA sequence
acaccttatacgaaaaattt

SEQ ID NO: 246177 - DNA, 20 bp, Artificial
  CRISPR gRNA sequence
atacgaaaaatttaaaacga

SEQ ID NO: 246178 - DNA, 20 bp, Artificial
  CRISPR gRNA sequence
tacgaaaaatttaaaacgaa

SEQ ID NO: 246179 - DNA, 20 bp, Artificial
  CRISPR gRNA sequence
aaaacgaatcaagcatgggc

SEQ ID NO: 246180 - DNA, 20 bp, Artificial
  CRISPR gRNA sequence
aaacgaatcaagcatgggca

SEQ ID NO: 246181 - DNA, 20 bp, Artificial
  CRISPR gRNA sequence
acacctgtaatcccagcact

SEQ ID NO: 246182 - DNA, 20 bp, Artificial
  CRISPR gRNA sequence
taatcccagcactttgggag

SEQ ID NO: 246183 - DNA, 20 bp, Artificial
  CRISPR gRNA sequence
tgggaggccaaggcaggagg

SEQ ID NO: 246184 - DNA, 20 bp, Artificial
  CRISPR gRNA sequence
gggaggccaaggcaggagga

SEQ ID NO: 246185 - DNA, 20 bp, Artificial
  CRISPR gRNA sequence
ggaggccaaggcaggaggat

SEQ ID NO: 246186 - DNA, 20 bp, Artificial
  CRISPR gRNA sequence
tttaaggccaggagttcaag

SEQ ID NO: 246187 - DNA, 20 bp, Artificial
  CRISPR gRNA sequence
aaggccaggagttcaagacc

SEQ ID NO: 246188 - DNA, 20 bp, Artificial
  CRISPR gRNA sequence
aggccaggagttcaagacca

SEQ ID NO: 246189 - DNA, 20 bp, Artificial
  CRISPR gRNA sequence
aagaccagcctgagcaacat

SEQ ID NO: 246190 - DNA, 20 bp, Artificial
  CRISPR gRNA sequence
agcaacatggtgagactctg

SEQ ID NO: 246191 - DNA, 20 bp, Artificial
  CRISPR gRNA sequence
tgtctcaaaataaaaaaaaa

SEQ ID NO: 246192 - DNA, 20 bp, Artificial
  CRISPR gRNA sequence
tctcaaaataaaaaaaaaaa

SEQ ID NO: 246193 - DNA, 20 bp, Artificial
  CRISPR gRNA sequence
aaaataaaaaaaaaaattac

SEQ ID NO: 246194 - DNA, 20 bp, Artificial
  CRISPR gRNA sequence
cccaggcatgcagagagcca

SEQ ID NO: 246195 - DNA, 20 bp, Artificial
  CRISPR gRNA sequence
aacattccactggaggctat

SEQ ID NO: 246196 - DNA, 20 bp, Artificial
  CRISPR gRNA sequence
cactggaggctatatgatca

SEQ ID NO: 246197 - DNA, 20 bp, Artificial
  CRISPR gRNA sequence
gaggctatatgatcaaacag

SEQ ID NO: 246198 - DNA, 20 bp, Artificial
  CRISPR gRNA sequence
tatgatcaaacagcaaagtg

SEQ ID NO: 246199 - DNA, 20 bp, Artificial
  CRISPR gRNA sequence
atcacgaatgcaagatgtga

SEQ ID NO: 246200 - DNA, 20 bp, Artificial
  CRISPR gRNA sequence
acactgccctgccaccaaaa

SEQ ID NO: 246201 - DNA, 20 bp, Artificial
  CRISPR gRNA sequence
ccctgccaccaaaaagtttg

SEQ ID NO: 246202 - DNA, 20 bp, Artificial
  CRISPR gRNA sequence
ccaccaaaaagtttgctgag

SEQ ID NO: 246203 - DNA, 20 bp, Artificial
  CRISPR gRNA sequence
gctgagggacgctactccct

SEQ ID NO: 246204 - DNA, 20 bp, Artificial
  CRISPR gRNA sequence
ctgagggacgctactccctg

SEQ ID NO: 246205 - DNA, 20 bp, Artificial
  CRISPR gRNA sequence
agggacgctactccctggct

SEQ ID NO: 246206 - DNA, 20 bp, Artificial
  CRISPR gRNA sequence
ctccctggctccttgaagtt

SEQ ID NO: 246207 - DNA, 20 bp, Artificial
  CRISPR gRNA sequence
cctggctccttgaagttatc

SEQ ID NO: 246208 - DNA, 20 bp, Artificial
  CRISPR gRNA sequence
gctccttgaagttatctatt

SEQ ID NO: 246209 - DNA, 20 bp, Artificial
  CRISPR gRNA sequence
cttgaagttatctattgaga

SEQ ID NO: 246210 - DNA, 20 bp, Artificial
  CRISPR gRNA sequence
gaagttatctattgagaaat

SEQ ID NO: 246211 - DNA, 20 bp, Artificial
  CRISPR gRNA sequence
aagttatctattgagaaatc

SEQ ID NO: 246212 - DNA, 20 bp, Artificial
  CRISPR gRNA sequence
tctattgagaaatctagcac

SEQ ID NO: 246213 - DNA, 20 bp, Artificial
  CRISPR gRNA sequence
ttgagaaatctagcacctat

SEQ ID NO: 246214 - DNA, 20 bp, Artificial
  CRISPR gRNA sequence
agaaatctagcacctattgt

SEQ ID NO: 246215 - DNA, 20 bp, Artificial
  CRISPR gRNA sequence
gcacctattgttcaaaggat

SEQ ID NO: 246216 - DNA, 20 bp, Artificial
  CRISPR gRNA sequence
ttgttcaaaggatgcagtct

SEQ ID NO: 246217 - DNA, 20 bp, Artificial
  CRISPR gRNA sequence
ttcaaaggatgcagtctcac

SEQ ID NO: 246218 - DNA, 20 bp, Artificial
  CRISPR gRNA sequence
aaaggatgcagtctcacaag

SEQ ID NO: 246219 - DNA, 20 bp, Artificial
  CRISPR gRNA sequence
acaagcctgctgtgaaccaa

SEQ ID NO: 246220 - DNA, 20 bp, Artificial
  CRISPR gRNA sequence
ctgtgaaccaaacaccaaac

SEQ ID NO: 246221 - DNA, 20 bp, Artificial
  CRISPR gRNA sequence
tgaaccaaacaccaaacggc

SEQ ID NO: 246222 - DNA, 20 bp, Artificial
  CRISPR gRNA sequence
actgacaattacccgacaat

SEQ ID NO: 246223 - DNA, 20 bp, Artificial
  CRISPR gRNA sequence
acaattacccgacaatcatc

SEQ ID NO: 246224 - DNA, 20 bp, Artificial
  CRISPR gRNA sequence
cccgacaatcatccccgctt

SEQ ID NO: 246225 - DNA, 20 bp, Artificial
  CRISPR gRNA sequence
tctcactatctcttttgcct

SEQ ID NO: 246226 - DNA, 20 bp, Artificial
  CRISPR gRNA sequence
ctcactatctcttttgccta

SEQ ID NO: 246227 - DNA, 20 bp, Artificial
  CRISPR gRNA sequence
tcactatctcttttgcctaa

SEQ ID NO: 246228 - DNA, 20 bp, Artificial
  CRISPR gRNA sequence
actatctcttttgcctaata

SEQ ID NO: 246229 - DNA, 20 bp, Artificial
  CRISPR gRNA sequence
tctcttttgcctaataaata

SEQ ID NO: 246230 - DNA, 20 bp, Artificial
  CRISPR gRNA sequence
ttttgcctaataaatacgga

SEQ ID NO: 246231 - DNA, 20 bp, Artificial
  CRISPR gRNA sequence
ttgcctaataaatacggagg

SEQ ID NO: 246232 - DNA, 20 bp, Artificial
  CRISPR gRNA sequence
tgcctaataaatacggaggg

SEQ ID NO: 246233 - DNA, 20 bp, Artificial
  CRISPR gRNA sequence
gcctaataaatacggagggc

SEQ ID NO: 246234 - DNA, 20 bp, Artificial
  CRISPR gRNA sequence
cctaataaatacggagggct

SEQ ID NO: 246235 - DNA, 20 bp, Artificial
  CRISPR gRNA sequence
ataaatacggagggctgtgt

SEQ ID NO: 246236 - DNA, 20 bp, Artificial
  CRISPR gRNA sequence
tgtaaagctcagggcccttg

SEQ ID NO: 246237 - DNA, 20 bp, Artificial
  CRISPR gRNA sequence
agggcccttgtccactagag

SEQ ID NO: 246238 - DNA, 20 bp, Artificial
  CRISPR gRNA sequence
gtccactagaggcaaggtgc

SEQ ID NO: 246239 - DNA, 20 bp, Artificial
  CRISPR gRNA sequence
tccactagaggcaaggtgcc

SEQ ID NO: 246240 - DNA, 20 bp, Artificial
  CRISPR gRNA sequence
gaggcaaggtgccccctgac

SEQ ID NO: 246241 - DNA, 20 bp, Artificial
  CRISPR gRNA sequence
accccttcttccaaatatac

SEQ ID NO: 246242 - DNA, 20 bp, Artificial
  CRISPR gRNA sequence
cttccaaatatactcttttg

SEQ ID NO: 246243 - DNA, 20 bp, Artificial
  CRISPR gRNA sequence
ttccaaatatactcttttgt

SEQ ID NO: 246244 - DNA, 20 bp, Artificial
  CRISPR gRNA sequence
ccaaatatactcttttgtct

SEQ ID NO: 246245 - DNA, 20 bp, Artificial
  CRISPR gRNA sequence
caaatatactcttttgtctc

SEQ ID NO: 246246 - DNA, 20 bp, Artificial
  CRISPR gRNA sequence
ttttgtctcgtcttttattc

SEQ ID NO: 246247 - DNA, 20 bp, Artificial
  CRISPR gRNA sequence
ttgtctcgtcttttattccc

SEQ ID NO: 246248 - DNA, 20 bp, Artificial
  CRISPR gRNA sequence
tgtctcgtcttttattcccg

SEQ ID NO: 246249 - DNA, 20 bp, Artificial
  CRISPR gRNA sequence
gtctcgtcttttattcccgc

SEQ ID NO: 246250 - DNA, 20 bp, Artificial
  CRISPR gRNA sequence
tctcgtcttttattcccgct

SEQ ID NO: 246251 - DNA, 20 bp, Artificial
  CRISPR gRNA sequence
gtcttttattcccgcttttg

SEQ ID NO: 246252 - DNA, 20 bp, Artificial
  CRISPR gRNA sequence
ttattcccgcttttgccccc

SEQ ID NO: 246253 - DNA, 20 bp, Artificial
  CRISPR gRNA sequence
tattcccgcttttgcccccc

SEQ ID NO: 246254 - DNA, 20 bp, Artificial
  CRISPR gRNA sequence
attcccgcttttgcccccct

SEQ ID NO: 246255 - DNA, 20 bp, Artificial
  CRISPR gRNA sequence
ttcccgcttttgcccccctt

SEQ ID NO: 246256 - DNA, 20 bp, Artificial
  CRISPR gRNA sequence
ccgcttttgcccccctttgt

SEQ ID NO: 246257 - DNA, 20 bp, Artificial
  CRISPR gRNA sequence
ttgcccccctttgttcagtc

SEQ ID NO: 246258 - DNA, 20 bp, Artificial
  CRISPR gRNA sequence
tgcccccctttgttcagtcc

SEQ ID NO: 246259 - DNA, 20 bp, Artificial
  CRISPR gRNA sequence
gcccccctttgttcagtcca

SEQ ID NO: 246260 - DNA, 20 bp, Artificial
  CRISPR gRNA sequence
cccccctttgttcagtccaa

SEQ ID NO: 246261 - DNA, 20 bp, Artificial
  CRISPR gRNA sequence
tgttcagtccaataggtcca

SEQ ID NO: 246262 - DNA, 20 bp, Artificial
  CRISPR gRNA sequence
gttcagtccaataggtccac

SEQ ID NO: 246263 - DNA, 20 bp, Artificial
  CRISPR gRNA sequence
ttcagtccaataggtccaca

SEQ ID NO: 246264 - DNA, 20 bp, Artificial
  CRISPR gRNA sequence
agtccaataggtccacagca

SEQ ID NO: 246265 - DNA, 20 bp, Artificial
  CRISPR gRNA sequence
gcacactcctgtagtcccag

SEQ ID NO: 246266 - DNA, 20 bp, Artificial
  CRISPR gRNA sequence
ctgtagtcccagctacttgg

SEQ ID NO: 246267 - DNA, 20 bp, Artificial
  CRISPR gRNA sequence
tagtcccagctacttgggag

SEQ ID NO: 246268 - DNA, 20 bp, Artificial
  CRISPR gRNA sequence
cttgggaggccaaggaggga

SEQ ID NO: 246269 - DNA, 20 bp, Artificial
  CRISPR gRNA sequence
gggaggccaaggagggagga

SEQ ID NO: 246270 - DNA, 20 bp, Artificial
  CRISPR gRNA sequence
ggaggccaaggagggaggat

SEQ ID NO: 246271 - DNA, 20 bp, Artificial
  CRISPR gRNA sequence
gagcccaggaggtggaggct

SEQ ID NO: 246272 - DNA, 20 bp, Artificial
  CRISPR gRNA sequence
agcccaggaggtggaggctg

SEQ ID NO: 246273 - DNA, 20 bp, Artificial
  CRISPR gRNA sequence
cagtaagccatgatcacacc

SEQ ID NO: 246274 - DNA, 20 bp, Artificial
  CRISPR gRNA sequence
cactccagcctgggtgacaa

SEQ ID NO: 246275 - DNA, 20 bp, Artificial
  CRISPR gRNA sequence
cagcctgggtgacaaagcag

SEQ ID NO: 246276 - DNA, 20 bp, Artificial
  CRISPR gRNA sequence
ggtgacaaagcagagaccct

SEQ ID NO: 246277 - DNA, 20 bp, Artificial
  CRISPR gRNA sequence
tctcagaaaaaaaaaatcaa

SEQ ID NO: 246278 - DNA, 20 bp, Artificial
  CRISPR gRNA sequence
agaaaaaaaaaatcaagatt

SEQ ID NO: 246279 - DNA, 20 bp, Artificial
  CRISPR gRNA sequence
aaatatgaaatagaaaactg

SEQ ID NO: 246280 - DNA, 20 bp, Artificial
  CRISPR gRNA sequence
aatatgaaatagaaaactgt

SEQ ID NO: 246281 - DNA, 20 bp, Artificial
  CRISPR gRNA sequence
taaaagttataagagataga

SEQ ID NO: 246282 - DNA, 20 bp, Artificial
  CRISPR gRNA sequence
taagagatagaggaaaaaaa

SEQ ID NO: 246283 - DNA, 20 bp, Artificial
  CRISPR gRNA sequence
aatctttgagacccaggact

SEQ ID NO: 246284 - DNA, 20 bp, Artificial
  CRISPR gRNA sequence
tgagacccaggactcagtga

SEQ ID NO: 246285 - DNA, 20 bp, Artificial
  CRISPR gRNA sequence
gagacccaggactcagtgaa

SEQ ID NO: 246286 - DNA, 20 bp, Artificial
  CRISPR gRNA sequence
agacccaggactcagtgaag

SEQ ID NO: 246287 - DNA, 20 bp, Artificial
  CRISPR gRNA sequence
agtgaagaattcttagacat

SEQ ID NO: 246288 - DNA, 20 bp, Artificial
  CRISPR gRNA sequence
ttagacatgactccataaat

SEQ ID NO: 246289 - DNA, 20 bp, Artificial
  CRISPR gRNA sequence
agacatgactccataaatga

SEQ ID NO: 246290 - DNA, 20 bp, Artificial
  CRISPR gRNA sequence
gacatgactccataaatgaa

SEQ ID NO: 246291 - DNA, 20 bp, Artificial
  CRISPR gRNA sequence
cataaatgaaaaaatccata

SEQ ID NO: 246292 - DNA, 20 bp, Artificial
  CRISPR gRNA sequence
gacttcagcaaaattaaata

SEQ ID NO: 246293 - DNA, 20 bp, Artificial
  CRISPR gRNA sequence
cagcaaaattaaatagcttt

SEQ ID NO: 246294 - DNA, 20 bp, Artificial
  CRISPR gRNA sequence
agcaaaattaaatagctttt

SEQ ID NO: 246295 - DNA, 20 bp, Artificial
  CRISPR gRNA sequence
aatagcttttctctgtggaa

SEQ ID NO: 246296 - DNA, 20 bp, Artificial
  CRISPR gRNA sequence
ttctctgtggaagagcctga

SEQ ID NO: 246297 - DNA, 20 bp, Artificial
  CRISPR gRNA sequence
tctctgtggaagagcctgag

SEQ ID NO: 246298 - DNA, 20 bp, Artificial
  CRISPR gRNA sequence
ctctgtggaagagcctgaga

SEQ ID NO: 246299 - DNA, 20 bp, Artificial
  CRISPR gRNA sequence
tctgtggaagagcctgagaa

SEQ ID NO: 246300 - DNA, 20 bp, Artificial
  CRISPR gRNA sequence
tgtggaagagcctgagaaga

SEQ ID NO: 246301 - DNA, 20 bp, Artificial
  CRISPR gRNA sequence
tggaagagcctgagaagagg

SEQ ID NO: 246302 - DNA, 20 bp, Artificial
  CRISPR gRNA sequence
agaagaggatgaaaaggcaa

SEQ ID NO: 246303 - DNA, 20 bp, Artificial
  CRISPR gRNA sequence
ctgactgggagaaaatattt

SEQ ID NO: 246304 - DNA, 20 bp, Artificial
  CRISPR gRNA sequence
actgggagaaaatatttata

SEQ ID NO: 246305 - DNA, 20 bp, Artificial
  CRISPR gRNA sequence
ggagaaaatatttataaacc

SEQ ID NO: 246306 - DNA, 20 bp, Artificial
  CRISPR gRNA sequence
ataaaccatatatatgccaa

SEQ ID NO: 246307 - DNA, 20 bp, Artificial
  CRISPR gRNA sequence
taaaccatatatatgccaaa

SEQ ID NO: 246308 - DNA, 20 bp, Artificial
  CRISPR gRNA sequence
ctatctgggaaatacgaaga

SEQ ID NO: 246309 - DNA, 20 bp, Artificial
  CRISPR gRNA sequence
tctgggaaatacgaagaact

SEQ ID NO: 246310 - DNA, 20 bp, Artificial
  CRISPR gRNA sequence
ggaaatacgaagaactcttg

SEQ ID NO: 246311 - DNA, 20 bp, Artificial
  CRISPR gRNA sequence
ttgaatctcaacagtaaaac

SEQ ID NO: 246312 - DNA, 20 bp, Artificial
  CRISPR gRNA sequence
gaatctcaacagtaaaacaa

SEQ ID NO: 246313 - DNA, 20 bp, Artificial
  CRISPR gRNA sequence
aatctcaacagtaaaacaaa

SEQ ID NO: 246314 - DNA, 20 bp, Artificial
  CRISPR gRNA sequence
aacagtaaaacaaacaaata

SEQ ID NO: 246315 - DNA, 20 bp, Artificial
  CRISPR gRNA sequence
gaaaataggtgaaagacctg

SEQ ID NO: 246316 - DNA, 20 bp, Artificial
  CRISPR gRNA sequence
aacaacacttcactgaagaa

SEQ ID NO: 246317 - DNA, 20 bp, Artificial
  CRISPR gRNA sequence
cactgaagaagatataaaga

SEQ ID NO: 246318 - DNA, 20 bp, Artificial
  CRISPR gRNA sequence
actgaagaagatataaagat

SEQ ID NO: 246319 - DNA, 20 bp, Artificial
  CRISPR gRNA sequence
aagaagatataaagatggaa

SEQ ID NO: 246320 - DNA, 20 bp, Artificial
  CRISPR gRNA sequence
aagccccaatgagatgtcac

SEQ ID NO: 246321 - DNA, 20 bp, Artificial
  CRISPR gRNA sequence
catacctattagaacagctg

SEQ ID NO: 246322 - DNA, 20 bp, Artificial
  CRISPR gRNA sequence
ttagaacagctgaaataaaa

SEQ ID NO: 246323 - DNA, 20 bp, Artificial
  CRISPR gRNA sequence
gaacagctgaaataaaaatt

SEQ ID NO: 246324 - DNA, 20 bp, Artificial
  CRISPR gRNA sequence
aaataaaaattgtggcaatg

SEQ ID NO: 246325 - DNA, 20 bp, Artificial
  CRISPR gRNA sequence
tggcaatgcaaaatgcaagc

SEQ ID NO: 246326 - DNA, 20 bp, Artificial
  CRISPR gRNA sequence
cgatgagaatgtaaaatgat

SEQ ID NO: 246327 - DNA, 20 bp, Artificial
  CRISPR gRNA sequence
cctctggaaaatagttcgac

SEQ ID NO: 246328 - DNA, 20 bp, Artificial
  CRISPR gRNA sequence
ctctggaaaatagttcgaca

SEQ ID NO: 246329 - DNA, 20 bp, Artificial
  CRISPR gRNA sequence
tggaaaatagttcgacaact

SEQ ID NO: 246330 - DNA, 20 bp, Artificial
  CRISPR gRNA sequence
gaaaatagttcgacaacttc

SEQ ID NO: 246331 - DNA, 20 bp, Artificial
  CRISPR gRNA sequence
gacaacttcttaaaaactaa

SEQ ID NO: 246332 - DNA, 20 bp, Artificial
  CRISPR gRNA sequence
cttaaaaactaaacaagcac

SEQ ID NO: 246333 - DNA, 20 bp, Artificial
  CRISPR gRNA sequence
ttaaaaactaaacaagcacc

SEQ ID NO: 246334 - DNA, 20 bp, Artificial
  CRISPR gRNA sequence
aaaaactaaacaagcaccaa

SEQ ID NO: 246335 - DNA, 20 bp, Artificial
  CRISPR gRNA sequence
aaaactaaacaagcaccaaa

SEQ ID NO: 246336 - DNA, 20 bp, Artificial
  CRISPR gRNA sequence
aacaagcaccaaacatatag

SEQ ID NO: 246337 - DNA, 20 bp, Artificial
  CRISPR gRNA sequence
cactcctgagcatttatcat

SEQ ID NO: 246338 - DNA, 20 bp, Artificial
  CRISPR gRNA sequence
ctgagcatttatcatagaga

SEQ ID NO: 246339 - DNA, 20 bp, Artificial
  CRISPR gRNA sequence
agcatttatcatagagatac

SEQ ID NO: 246340 - DNA, 20 bp, Artificial
  CRISPR gRNA sequence
atcatagagatacaaaaata

SEQ ID NO: 246341 - DNA, 20 bp, Artificial
  CRISPR gRNA sequence
tcatagagatacaaaaatac

SEQ ID NO: 246342 - DNA, 20 bp, Artificial
  CRISPR gRNA sequence
tacataattattcctcgcag

SEQ ID NO: 246343 - DNA, 20 bp, Artificial
  CRISPR gRNA sequence
ttcctcgcagctttatatgt

SEQ ID NO: 246344 - DNA, 20 bp, Artificial
  CRISPR gRNA sequence
ctcgcagctttatatgtaat

SEQ ID NO: 246345 - DNA, 20 bp, Artificial
  CRISPR gRNA sequence
gcagctttatatgtaatagt

SEQ ID NO: 246346 - DNA, 20 bp, Artificial
  CRISPR gRNA sequence
tatatgtaatagtcaaaaca

SEQ ID NO: 246347 - DNA, 20 bp, Artificial
  CRISPR gRNA sequence
atatgtaatagtcaaaacag

SEQ ID NO: 246348 - DNA, 20 bp, Artificial
  CRISPR gRNA sequence
tatgtaatagtcaaaacagg

SEQ ID NO: 246349 - DNA, 20 bp, Artificial
  CRISPR gRNA sequence
ttaatgggtgcatggtaaaa

SEQ ID NO: 246350 - DNA, 20 bp, Artificial
  CRISPR gRNA sequence
taatgggtgcatggtaaaac

SEQ ID NO: 246351 - DNA, 20 bp, Artificial
  CRISPR gRNA sequence
aatgggtgcatggtaaaaca

SEQ ID NO: 246352 - DNA, 20 bp, Artificial
  CRISPR gRNA sequence
atgggtgcatggtaaaacaa

SEQ ID NO: 246353 - DNA, 20 bp, Artificial
  CRISPR gRNA sequence
tggcacaagcatatcgtgga

SEQ ID NO: 246354 - DNA, 20 bp, Artificial
  CRISPR gRNA sequence
ttcagcaaggaaaaagaatt

SEQ ID NO: 246355 - DNA, 20 bp, Artificial
  CRISPR gRNA sequence
agcaaggaaaaagaattaac

SEQ ID NO: 246356 - DNA, 20 bp, Artificial
  CRISPR gRNA sequence
accattgaaacacacagcaa

SEQ ID NO: 246357 - DNA, 20 bp, Artificial
  CRISPR gRNA sequence
aaacacacagcaacttggat

SEQ ID NO: 246358 - DNA, 20 bp, Artificial
  CRISPR gRNA sequence
ggatggatatcaagggcatt

SEQ ID NO: 246359 - DNA, 20 bp, Artificial
  CRISPR gRNA sequence
gatggatatcaagggcattg

SEQ ID NO: 246360 - DNA, 20 bp, Artificial
  CRISPR gRNA sequence
tgctgagtgaaaaagcaaaa

SEQ ID NO: 246361 - DNA, 20 bp, Artificial
  CRISPR gRNA sequence
agtgaaaaagcaaaatctta

SEQ ID NO: 246362 - DNA, 20 bp, Artificial
  CRISPR gRNA sequence
aaaaaaagttcacgtttgtg

SEQ ID NO: 246363 - DNA, 20 bp, Artificial
  CRISPR gRNA sequence
aaaaaagttcacgtttgtga

SEQ ID NO: 246364 - DNA, 20 bp, Artificial
  CRISPR gRNA sequence
acgtttgtgaaagttgtcag

SEQ ID NO: 246365 - DNA, 20 bp, Artificial
  CRISPR gRNA sequence
gtgaaagttgtcagaatcaa

SEQ ID NO: 246366 - DNA, 20 bp, Artificial
  CRISPR gRNA sequence
tgaaagttgtcagaatcaaa

SEQ ID NO: 246367 - DNA, 20 bp, Artificial
  CRISPR gRNA sequence
tcagaatcaaaatggagtaa

SEQ ID NO: 246368 - DNA, 20 bp, Artificial
  CRISPR gRNA sequence
gtgtcaaaaccctgacaaat

SEQ ID NO: 246369 - DNA, 20 bp, Artificial
  CRISPR gRNA sequence
tgtcaaaaccctgacaaatg

SEQ ID NO: 246370 - DNA, 20 bp, Artificial
  CRISPR gRNA sequence
acaaatgggccgggcatggt

SEQ ID NO: 246371 - DNA, 20 bp, Artificial
  CRISPR gRNA sequence
atgcctgtaatcccagcact

SEQ ID NO: 246372 - DNA, 20 bp, Artificial
  CRISPR gRNA sequence
taatcccagcactttgggag

SEQ ID NO: 246373 - DNA, 20 bp, Artificial
  CRISPR gRNA sequence
tgggagactgaggcaggcag

SEQ ID NO: 246374 - DNA, 20 bp, Artificial
  CRISPR gRNA sequence
gggagactgaggcaggcaga

SEQ ID NO: 246375 - DNA, 20 bp, Artificial
  CRISPR gRNA sequence
ggagactgaggcaggcagat

SEQ ID NO: 246376 - DNA, 20 bp, Artificial
  CRISPR gRNA sequence
aggcaggcagatcacatgag

SEQ ID NO: 246377 - DNA, 20 bp, Artificial
  CRISPR gRNA sequence
aagaccagcctggccaacgt

SEQ ID NO: 246378 - DNA, 20 bp, Artificial
  CRISPR gRNA sequence
gccaacgtggcaaaaccccg

SEQ ID NO: 246379 - DNA, 20 bp, Artificial
  CRISPR gRNA sequence
tactatagccgggcatggtg

SEQ ID NO: 246380 - DNA, 20 bp, Artificial
  CRISPR gRNA sequence
ctatagccgggcatggtggc

SEQ ID NO: 246381 - DNA, 20 bp, Artificial
  CRISPR gRNA sequence
tagccgggcatggtggcagc

SEQ ID NO: 246382 - DNA, 20 bp, Artificial
  CRISPR gRNA sequence
cctgtaatcccagctactca

SEQ ID NO: 246383 - DNA, 20 bp, Artificial
  CRISPR gRNA sequence
taatcccagctactcaggag

SEQ ID NO: 246384 - DNA, 20 bp, Artificial
  CRISPR gRNA sequence
ctcaggaggctgaggcacga

SEQ ID NO: 246385 - DNA, 20 bp, Artificial
  CRISPR gRNA sequence
aggaggctgaggcacgaaaa

SEQ ID NO: 246386 - DNA, 20 bp, Artificial
  CRISPR gRNA sequence
aggcacgaaaatcgctggaa

SEQ ID NO: 246387 - DNA, 20 bp, Artificial
  CRISPR gRNA sequence
gaacccaggaggcggaggtt

SEQ ID NO: 246388 - DNA, 20 bp, Artificial
  CRISPR gRNA sequence
cagcgagtggagatcacgcc

SEQ ID NO: 246389 - DNA, 20 bp, Artificial
  CRISPR gRNA sequence
cactccagcctgaatgacac

SEQ ID NO: 246390 - DNA, 20 bp, Artificial
  CRISPR gRNA sequence
cagcctgaatgacacaggga

SEQ ID NO: 246391 - DNA, 20 bp, Artificial
  CRISPR gRNA sequence
aatgacacagggagatcctg

SEQ ID NO: 246392 - DNA, 20 bp, Artificial
  CRISPR gRNA sequence
tctcaaaaacaaacaacaac

SEQ ID NO: 246393 - DNA, 20 bp, Artificial
  CRISPR gRNA sequence
aaaaacaaacaacaacaata

SEQ ID NO: 246394 - DNA, 20 bp, Artificial
  CRISPR gRNA sequence
acaaatggagccagggaagg

SEQ ID NO: 246395 - DNA, 20 bp, Artificial
  CRISPR gRNA sequence
cttatgcatgcatgcctgat

SEQ ID NO: 246396 - DNA, 20 bp, Artificial
  CRISPR gRNA sequence
ttatgcatgcatgcctgata

SEQ ID NO: 246397 - DNA, 20 bp, Artificial
  CRISPR gRNA sequence
atgcatgcatgcctgataaa

SEQ ID NO: 246398 - DNA, 20 bp, Artificial
  CRISPR gRNA sequence
tgcatgcatgcctgataaaa

SEQ ID NO: 246399 - DNA, 20 bp, Artificial
  CRISPR gRNA sequence
ataaaaacaactatcacaaa

SEQ ID NO: 246400 - DNA, 20 bp, Artificial
  CRISPR gRNA sequence
tcacaaaagatggcagaaac

SEQ ID NO: 246401 - DNA, 20 bp, Artificial
  CRISPR gRNA sequence
gcaccaaggctactgtatct

SEQ ID NO: 246402 - DNA, 20 bp, Artificial
  CRISPR gRNA sequence
caccaaggctactgtatctt

SEQ ID NO: 246403 - DNA, 20 bp, Artificial
  CRISPR gRNA sequence
ctgtatcttaacaaaaaaat

SEQ ID NO: 246404 - DNA, 20 bp, Artificial
  CRISPR gRNA sequence
tatcttaacaaaaaaatact

SEQ ID NO: 246405 - DNA, 20 bp, Artificial
  CRISPR gRNA sequence
aacaaaaaaatacttctgcc

SEQ ID NO: 246406 - DNA, 20 bp, Artificial
  CRISPR gRNA sequence
acaaaaaaatacttctgccg

SEQ ID NO: 246407 - DNA, 20 bp, Artificial
  CRISPR gRNA sequence
ctgccggtattgatctttgt

SEQ ID NO: 246408 - DNA, 20 bp, Artificial
  CRISPR gRNA sequence
tgccggtattgatctttgta

SEQ ID NO: 246409 - DNA, 20 bp, Artificial
  CRISPR gRNA sequence
ccggtattgatctttgtagc

SEQ ID NO: 246410 - DNA, 20 bp, Artificial
  CRISPR gRNA sequence
atctttgtagcaaaggataa

SEQ ID NO: 246411 - DNA, 20 bp, Artificial
  CRISPR gRNA sequence
tgtagcaaaggataattgtt

SEQ ID NO: 246412 - DNA, 20 bp, Artificial
  CRISPR gRNA sequence
gtagcaaaggataattgttt

SEQ ID NO: 246413 - DNA, 20 bp, Artificial
  CRISPR gRNA sequence
tagcaaaggataattgtttc

SEQ ID NO: 246414 - DNA, 20 bp, Artificial
  CRISPR gRNA sequence
tttcaaaataacttacataa

SEQ ID NO: 246415 - DNA, 20 bp, Artificial
  CRISPR gRNA sequence
caaaataacttacataaccc

SEQ ID NO: 246416 - DNA, 20 bp, Artificial
  CRISPR gRNA sequence
aaaataacttacataaccct

SEQ ID NO: 246417 - DNA, 20 bp, Artificial
  CRISPR gRNA sequence
acataaccctcctcagtttt

SEQ ID NO: 246418 - DNA, 20 bp, Artificial
  CRISPR gRNA sequence
cataaccctcctcagttttt

SEQ ID NO: 246419 - DNA, 20 bp, Artificial
  CRISPR gRNA sequence
ctcagtttttcttttttttc

SEQ ID NO: 246420 - DNA, 20 bp, Artificial
  CRISPR gRNA sequence
agtttttcttttttttcttt

SEQ ID NO: 246421 - DNA, 20 bp, Artificial
  CRISPR gRNA sequence
ttcttttttttctttttcct

SEQ ID NO: 246422 - DNA, 20 bp, Artificial
  CRISPR gRNA sequence
tcttttttttctttttcctt

SEQ ID NO: 246423 - DNA, 20 bp, Artificial
  CRISPR gRNA sequence
cttttttttctttttccttt

SEQ ID NO: 246424 - DNA, 20 bp, Artificial
  CRISPR gRNA sequence
ttttttttctttttcctttt

SEQ ID NO: 246425 - DNA, 20 bp, Artificial
  CRISPR gRNA sequence
ttttttctttttcctttttt

SEQ ID NO: 246426 - DNA, 20 bp, Artificial
  CRISPR gRNA sequence
tttttctttttccttttttt

SEQ ID NO: 246427 - DNA, 20 bp, Artificial
  CRISPR gRNA sequence
ttttctttttcctttttttt

SEQ ID NO: 246428 - DNA, 20 bp, Artificial
  CRISPR gRNA sequence
tttctttttccttttttttt

SEQ ID NO: 246429 - DNA, 20 bp, Artificial
  CRISPR gRNA sequence
ttctttttcctttttttttt

SEQ ID NO: 246430 - DNA, 20 bp, Artificial
  CRISPR gRNA sequence
tctttttccttttttttttt

SEQ ID NO: 246431 - DNA, 20 bp, Artificial
  CRISPR gRNA sequence
ctttttcctttttttttttt

SEQ ID NO: 246432 - DNA, 20 bp, Artificial
  CRISPR gRNA sequence
tttttccttttttttttttt

SEQ ID NO: 246433 - DNA, 20 bp, Artificial
  CRISPR gRNA sequence
tttccttttttttttttttt

SEQ ID NO: 246434 - DNA, 20 bp, Artificial
  CRISPR gRNA sequence
ttcctttttttttttttttt

SEQ ID NO: 246435 - DNA, 20 bp, Artificial
  CRISPR gRNA sequence
tccttttttttttttttttt

SEQ ID NO: 246436 - DNA, 20 bp, Artificial
  CRISPR gRNA sequence
cctttttttttttttttttt

SEQ ID NO: 246437 - DNA, 20 bp, Artificial
  CRISPR gRNA sequence
cttttttttttttttttttt

SEQ ID NO: 246438 - DNA, 20 bp, Artificial
  CRISPR gRNA sequence
tttttttttttttttttttg

SEQ ID NO: 246439 - DNA, 20 bp, Artificial
  CRISPR gRNA sequence
ttttttttttttttttttga

SEQ ID NO: 246440 - DNA, 20 bp, Artificial
  CRISPR gRNA sequence
tttttttttttttttttgag

SEQ ID NO: 246441 - DNA, 20 bp, Artificial
  CRISPR gRNA sequence
ttttttttttttttttgaga

SEQ ID NO: 246442 - DNA, 20 bp, Artificial
  CRISPR gRNA sequence
tttttttttttttttgagac

SEQ ID NO: 246443 - DNA, 20 bp, Artificial
  CRISPR gRNA sequence
ttttttttttttttgagaca

SEQ ID NO: 246444 - DNA, 20 bp, Artificial
  CRISPR gRNA sequence
tttttttttttttgagacag

SEQ ID NO: 246445 - DNA, 20 bp, Artificial
  CRISPR gRNA sequence
ttttttttttttgagacaga

SEQ ID NO: 246446 - DNA, 20 bp, Artificial
  CRISPR gRNA sequence
tttttttttttgagacagag

SEQ ID NO: 246447 - DNA, 20 bp, Artificial
  CRISPR gRNA sequence
ttttttttttgagacagagt

SEQ ID NO: 246448 - DNA, 20 bp, Artificial
  CRISPR gRNA sequence
tttttttttgagacagagtc

SEQ ID NO: 246449 - DNA, 20 bp, Artificial
  CRISPR gRNA sequence
ttttttttgagacagagtct

SEQ ID NO: 246450 - DNA, 20 bp, Artificial
  CRISPR gRNA sequence
tttttttgagacagagtctt

SEQ ID NO: 246451 - DNA, 20 bp, Artificial
  CRISPR gRNA sequence
ttttttgagacagagtcttg

SEQ ID NO: 246452 - DNA, 20 bp, Artificial
  CRISPR gRNA sequence
tttttgagacagagtcttgc

SEQ ID NO: 246453 - DNA, 20 bp, Artificial
  CRISPR gRNA sequence
ttttgagacagagtcttgct

SEQ ID NO: 246454 - DNA, 20 bp, Artificial
  CRISPR gRNA sequence
tttgagacagagtcttgctc

SEQ ID NO: 246455 - DNA, 20 bp, Artificial
  CRISPR gRNA sequence
ttgagacagagtcttgctct

SEQ ID NO: 246456 - DNA, 20 bp, Artificial
  CRISPR gRNA sequence
tgagacagagtcttgctctg

SEQ ID NO: 246457 - DNA, 20 bp, Artificial
  CRISPR gRNA sequence
gagacagagtcttgctctgt

SEQ ID NO: 246458 - DNA, 20 bp, Artificial
  CRISPR gRNA sequence
agacagagtcttgctctgtc

SEQ ID NO: 246459 - DNA, 20 bp, Artificial
  CRISPR gRNA sequence
gctctgtcgcccaggctgga

SEQ ID NO: 246460 - DNA, 20 bp, Artificial
  CRISPR gRNA sequence
ctctgtcgcccaggctggag

SEQ ID NO: 246461 - DNA, 20 bp, Artificial
  CRISPR gRNA sequence
tgtcgcccaggctggagtga

SEQ ID NO: 246462 - DNA, 20 bp, Artificial
  CRISPR gRNA sequence
tcgcccaggctggagtgaag

SEQ ID NO: 246463 - DNA, 20 bp, Artificial
  CRISPR gRNA sequence
gagtgaagtgcaggatgcga

SEQ ID NO: 246464 - DNA, 20 bp, Artificial
  CRISPR gRNA sequence
actgcaacctccgcctccca

SEQ ID NO: 246465 - DNA, 20 bp, Artificial
  CRISPR gRNA sequence
caacctccgcctcccaggtt

SEQ ID NO: 246466 - DNA, 20 bp, Artificial
  CRISPR gRNA sequence
cgcctcccaggttcaagtaa

SEQ ID NO: 246467 - DNA, 20 bp, Artificial
  CRISPR gRNA sequence
ccaggttcaagtaattcttg

SEQ ID NO: 246468 - DNA, 20 bp, Artificial
  CRISPR gRNA sequence
aagtaattcttgtgcctcag

SEQ ID NO: 246469 - DNA, 20 bp, Artificial
  CRISPR gRNA sequence
ttgtgcctcagcctcccaag

SEQ ID NO: 246470 - DNA, 20 bp, Artificial
  CRISPR gRNA sequence
gtgcctcagcctcccaagta

SEQ ID NO: 246471 - DNA, 20 bp, Artificial
  CRISPR gRNA sequence
tgcctcagcctcccaagtat

SEQ ID NO: 246472 - DNA, 20 bp, Artificial
  CRISPR gRNA sequence
agcctcccaagtatctggga

SEQ ID NO: 246473 - DNA, 20 bp, Artificial
  CRISPR gRNA sequence
ccaagtatctgggattacag

SEQ ID NO: 246474 - DNA, 20 bp, Artificial
  CRISPR gRNA sequence
ggattacaggcacgtgccac

SEQ ID NO: 246475 - DNA, 20 bp, Artificial
  CRISPR gRNA sequence
caggcacgtgccaccatgca

SEQ ID NO: 246476 - DNA, 20 bp, Artificial
  CRISPR gRNA sequence
actttttgtatttttagtag

SEQ ID NO: 246477 - DNA, 20 bp, Artificial
  CRISPR gRNA sequence
tttgtatttttagtagagat

SEQ ID NO: 246478 - DNA, 20 bp, Artificial
  CRISPR gRNA sequence
ttgtatttttagtagagatg

SEQ ID NO: 246479 - DNA, 20 bp, Artificial
  CRISPR gRNA sequence
tgtatttttagtagagatgg

SEQ ID NO: 246480 - DNA, 20 bp, Artificial
  CRISPR gRNA sequence
gtatttttagtagagatggg

SEQ ID NO: 246481 - DNA, 20 bp, Artificial
  CRISPR gRNA sequence
tatttttagtagagatgggg

SEQ ID NO: 246482 - DNA, 20 bp, Artificial
  CRISPR gRNA sequence
ttagtagagatggggtttca

SEQ ID NO: 246483 - DNA, 20 bp, Artificial
  CRISPR gRNA sequence
tagtagagatggggtttcac

SEQ ID NO: 246484 - DNA, 20 bp, Artificial
  CRISPR gRNA sequence
agtagagatggggtttcacc

SEQ ID NO: 246485 - DNA, 20 bp, Artificial
  CRISPR gRNA sequence
gtagagatggggtttcacca

SEQ ID NO: 246486 - DNA, 20 bp, Artificial
  CRISPR gRNA sequence
caccatgttggccaggctgg

SEQ ID NO: 246487 - DNA, 20 bp, Artificial
  CRISPR gRNA sequence
accatgttggccaggctggt

SEQ ID NO: 246488 - DNA, 20 bp, Artificial
  CRISPR gRNA sequence
gccaggctggtctcgaactc

SEQ ID NO: 246489 - DNA, 20 bp, Artificial
  CRISPR gRNA sequence
gtctcgaactcctgacctca

SEQ ID NO: 246490 - DNA, 20 bp, Artificial
  CRISPR gRNA sequence
gaactcctgacctcaggtga

SEQ ID NO: 246491 - DNA, 20 bp, Artificial
  CRISPR gRNA sequence
ctgacctcaggtgatccatc

SEQ ID NO: 246492 - DNA, 20 bp, Artificial
  CRISPR gRNA sequence
acctcaggtgatccatccgc

SEQ ID NO: 246493 - DNA, 20 bp, Artificial
  CRISPR gRNA sequence
aggtgatccatccgcctcag

SEQ ID NO: 246494 - DNA, 20 bp, Artificial
  CRISPR gRNA sequence
agcctcccaaagcgctggga

SEQ ID NO: 246495 - DNA, 20 bp, Artificial
  CRISPR gRNA sequence
ccaaagcgctgggattatag

SEQ ID NO: 246496 - DNA, 20 bp, Artificial
  CRISPR gRNA sequence
ggattataggcatgagccac

SEQ ID NO: 246497 - DNA, 20 bp, Artificial
  CRISPR gRNA sequence
taggcatgagccactgtgcc

SEQ ID NO: 246498 - DNA, 20 bp, Artificial
  CRISPR gRNA sequence
tgccccgcccctcatttttt

SEQ ID NO: 246499 - DNA, 20 bp, Artificial
  CRISPR gRNA sequence
attttttcttttaaaaactc

SEQ ID NO: 246500 - DNA, 20 bp, Artificial
  CRISPR gRNA sequence
tttcttttaaaaactcgcat

SEQ ID NO: 246501 - DNA, 20 bp, Artificial
  CRISPR gRNA sequence
ttcttttaaaaactcgcatc

SEQ ID NO: 246502 - DNA, 20 bp, Artificial
  CRISPR gRNA sequence
tcttttaaaaactcgcatca

SEQ ID NO: 246503 - DNA, 20 bp, Artificial
  CRISPR gRNA sequence
cttttaaaaactcgcatcac

SEQ ID NO: 246504 - DNA, 20 bp, Artificial
  CRISPR gRNA sequence
ttttaaaaactcgcatcacc

SEQ ID NO: 246505 - DNA, 20 bp, Artificial
  CRISPR gRNA sequence
ttaaaaactcgcatcacctt

SEQ ID NO: 246506 - DNA, 20 bp, Artificial
  CRISPR gRNA sequence
taaaaactcgcatcaccttt

SEQ ID NO: 246507 - DNA, 20 bp, Artificial
  CRISPR gRNA sequence
aaaaactcgcatcaccttta

SEQ ID NO: 246508 - DNA, 20 bp, Artificial
  CRISPR gRNA sequence
aaaactcgcatcacctttac

SEQ ID NO: 246509 - DNA, 20 bp, Artificial
  CRISPR gRNA sequence
gcatcacctttacatccctg

SEQ ID NO: 246510 - DNA, 20 bp, Artificial
  CRISPR gRNA sequence
tacatccctgaatacaccca

SEQ ID NO: 246511 - DNA, 20 bp, Artificial
  CRISPR gRNA sequence
acatccctgaatacacccac

SEQ ID NO: 246512 - DNA, 20 bp, Artificial
  CRISPR gRNA sequence
catccctgaatacacccacc

SEQ ID NO: 246513 - DNA, 20 bp, Artificial
  CRISPR gRNA sequence
aatacacccaccgtattccc

SEQ ID NO: 246514 - DNA, 20 bp, Artificial
  CRISPR gRNA sequence
ccactgcaatgctactcctg

SEQ ID NO: 246515 - DNA, 20 bp, Artificial
  CRISPR gRNA sequence
caatgctactcctgaaaaaa

SEQ ID NO: 246516 - DNA, 20 bp, Artificial
  CRISPR gRNA sequence
ctcctgaaaaaatataatct

SEQ ID NO: 246517 - DNA, 20 bp, Artificial
  CRISPR gRNA sequence
ctgaaaaaatataatctttt

SEQ ID NO: 246518 - DNA, 20 bp, Artificial
  CRISPR gRNA sequence
aaaaaatataatcttttaga

SEQ ID NO: 246519 - DNA, 20 bp, Artificial
  CRISPR gRNA sequence
ttagagaggctctctctatc

SEQ ID NO: 246520 - DNA, 20 bp, Artificial
  CRISPR gRNA sequence
tagagaggctctctctatct

SEQ ID NO: 246521 - DNA, 20 bp, Artificial
  CRISPR gRNA sequence
agagaggctctctctatcta

SEQ ID NO: 246522 - DNA, 20 bp, Artificial
  CRISPR gRNA sequence
gagaggctctctctatctat

SEQ ID NO: 246523 - DNA, 20 bp, Artificial
  CRISPR gRNA sequence
tctctatctatgatttagct

SEQ ID NO: 246524 - DNA, 20 bp, Artificial
  CRISPR gRNA sequence
tctatctatgatttagcttg

SEQ ID NO: 246525 - DNA, 20 bp, Artificial
  CRISPR gRNA sequence
tatctatgatttagcttgac

SEQ ID NO: 246526 - DNA, 20 bp, Artificial
  CRISPR gRNA sequence
tctatgatttagcttgacac

SEQ ID NO: 246527 - DNA, 20 bp, Artificial
  CRISPR gRNA sequence
tgatttagcttgacacatac

SEQ ID NO: 246528 - DNA, 20 bp, Artificial
  CRISPR gRNA sequence
agcttgacacataccatatg

SEQ ID NO: 246529 - DNA, 20 bp, Artificial
  CRISPR gRNA sequence
gcttgacacataccatatga

SEQ ID NO: 246530 - DNA, 20 bp, Artificial
  CRISPR gRNA sequence
gacacataccatatgattct

SEQ ID NO: 246531 - DNA, 20 bp, Artificial
  CRISPR gRNA sequence
acacataccatatgattcta

SEQ ID NO: 246532 - DNA, 20 bp, Artificial
  CRISPR gRNA sequence
tatttataccatattcctta

SEQ ID NO: 246533 - DNA, 20 bp, Artificial
  CRISPR gRNA sequence
tttataccatattccttaaa

SEQ ID NO: 246534 - DNA, 20 bp, Artificial
  CRISPR gRNA sequence
ataccatattccttaaataa

SEQ ID NO: 246535 - DNA, 20 bp, Artificial
  CRISPR gRNA sequence
taccatattccttaaataac

SEQ ID NO: 246536 - DNA, 20 bp, Artificial
  CRISPR gRNA sequence
cttaaataacaaaagtatag

SEQ ID NO: 246537 - DNA, 20 bp, Artificial
  CRISPR gRNA sequence
aaataacaaaagtatagaga

SEQ ID NO: 246538 - DNA, 20 bp, Artificial
  CRISPR gRNA sequence
aataacaaaagtatagagat

SEQ ID NO: 246539 - DNA, 20 bp, Artificial
  CRISPR gRNA sequence
ccaggggatggtggggagag

SEQ ID NO: 246540 - DNA, 20 bp, Artificial
  CRISPR gRNA sequence
actagaaaggaatagtggaa

SEQ ID NO: 246541 - DNA, 20 bp, Artificial
  CRISPR gRNA sequence
gaaaggaatagtggaaggag

SEQ ID NO: 246542 - DNA, 20 bp, Artificial
  CRISPR gRNA sequence
tgtggtgatggatagttctg

SEQ ID NO: 246543 - DNA, 20 bp, Artificial
  CRISPR gRNA sequence
tggtgatggatagttctgat

SEQ ID NO: 246544 - DNA, 20 bp, Artificial
  CRISPR gRNA sequence
tgattttattgtgctggttg

SEQ ID NO: 246545 - DNA, 20 bp, Artificial
  CRISPR gRNA sequence
attttattgtgctggttgtt

SEQ ID NO: 246546 - DNA, 20 bp, Artificial
  CRISPR gRNA sequence
tattgtgctggttgttatac

SEQ ID NO: 246547 - DNA, 20 bp, Artificial
  CRISPR gRNA sequence
attgtgctggttgttataca

SEQ ID NO: 246548 - DNA, 20 bp, Artificial
  CRISPR gRNA sequence
ttgtgctggttgttatacaa

SEQ ID NO: 246549 - DNA, 20 bp, Artificial
  CRISPR gRNA sequence
tgctggttgttatacaactc

SEQ ID NO: 246550 - DNA, 20 bp, Artificial
  CRISPR gRNA sequence
gttgttatacaactccacat

SEQ ID NO: 246551 - DNA, 20 bp, Artificial
  CRISPR gRNA sequence
ttatacaactccacatgtgt

SEQ ID NO: 246552 - DNA, 20 bp, Artificial
  CRISPR gRNA sequence
tacaactccacatgtgtgat

SEQ ID NO: 246553 - DNA, 20 bp, Artificial
  CRISPR gRNA sequence
cacatgtgtgataaagggac

SEQ ID NO: 246554 - DNA, 20 bp, Artificial
  CRISPR gRNA sequence
cacacgcacactgtgccaat

SEQ ID NO: 246555 - DNA, 20 bp, Artificial
  CRISPR gRNA sequence
tgccaatgtcaatttcctgc

SEQ ID NO: 246556 - DNA, 20 bp, Artificial
  CRISPR gRNA sequence
cctgctttgccattgtactg

SEQ ID NO: 246557 - DNA, 20 bp, Artificial
  CRISPR gRNA sequence
ctgctttgccattgtactgg

SEQ ID NO: 246558 - DNA, 20 bp, Artificial
  CRISPR gRNA sequence
ctttgccattgtactggaga

SEQ ID NO: 246559 - DNA, 20 bp, Artificial
  CRISPR gRNA sequence
tgccattgtactggagaatg

SEQ ID NO: 246560 - DNA, 20 bp, Artificial
  CRISPR gRNA sequence
gccattgtactggagaatgg

SEQ ID NO: 246561 - DNA, 20 bp, Artificial
  CRISPR gRNA sequence
ccattgtactggagaatgga

SEQ ID NO: 246562 - DNA, 20 bp, Artificial
  CRISPR gRNA sequence
tactggagaatggaacccag

SEQ ID NO: 246563 - DNA, 20 bp, Artificial
  CRISPR gRNA sequence
gagaatggaacccagaaacc

SEQ ID NO: 246564 - DNA, 20 bp, Artificial
  CRISPR gRNA sequence
ctgtcttggcaaattcctgt

SEQ ID NO: 246565 - DNA, 20 bp, Artificial
  CRISPR gRNA sequence
tcttggcaaattcctgtgaa

SEQ ID NO: 246566 - DNA, 20 bp, Artificial
  CRISPR gRNA sequence
ggcaaattcctgtgaatcta

SEQ ID NO: 246567 - DNA, 20 bp, Artificial
  CRISPR gRNA sequence
gcaaattcctgtgaatctat

SEQ ID NO: 246568 - DNA, 20 bp, Artificial
  CRISPR gRNA sequence
ctgtgaatctataattacgt

SEQ ID NO: 246569 - DNA, 20 bp, Artificial
  CRISPR gRNA sequence
tgaatctataattacgtcaa

SEQ ID NO: 246570 - DNA, 20 bp, Artificial
  CRISPR gRNA sequence
taattacgtcaaaattgaaa

SEQ ID NO: 246571 - DNA, 20 bp, Artificial
  CRISPR gRNA sequence
cgtcaaaattgaaagttctt

SEQ ID NO: 246572 - DNA, 20 bp, Artificial
  CRISPR gRNA sequence
aaagttcttttgaacgacct

SEQ ID NO: 246573 - DNA, 20 bp, Artificial
  CRISPR gRNA sequence
ttttgaacgacctaaaacct

SEQ ID NO: 246574 - DNA, 20 bp, Artificial
  CRISPR gRNA sequence
ttgaacgacctaaaaccttt

SEQ ID NO: 246575 - DNA, 20 bp, Artificial
  CRISPR gRNA sequence
tgaacgacctaaaacctttt

SEQ ID NO: 246576 - DNA, 20 bp, Artificial
  CRISPR gRNA sequence
gaacgacctaaaaccttttt

SEQ ID NO: 246577 - DNA, 20 bp, Artificial
  CRISPR gRNA sequence
aacgacctaaaacctttttt

SEQ ID NO: 246578 - DNA, 20 bp, Artificial
  CRISPR gRNA sequence
aaaccttttttttttttttt

SEQ ID NO: 246579 - DNA, 20 bp, Artificial
  CRISPR gRNA sequence
tttttttttttttttttgag

SEQ ID NO: 246580 - DNA, 20 bp, Artificial
  CRISPR gRNA sequence
ttttttttttttttttgaga

SEQ ID NO: 246581 - DNA, 20 bp, Artificial
  CRISPR gRNA sequence
tttttttttttttttgagac

SEQ ID NO: 246582 - DNA, 20 bp, Artificial
  CRISPR gRNA sequence
ttttttttttttttgagacg

SEQ ID NO: 246583 - DNA, 20 bp, Artificial
  CRISPR gRNA sequence
tttttttttttttgagacgg

SEQ ID NO: 246584 - DNA, 20 bp, Artificial
  CRISPR gRNA sequence
ttttttttttttgagacgga

SEQ ID NO: 246585 - DNA, 20 bp, Artificial
  CRISPR gRNA sequence
tttttttttttgagacggag

SEQ ID NO: 246586 - DNA, 20 bp, Artificial
  CRISPR gRNA sequence
ttttttttttgagacggagt

SEQ ID NO: 246587 - DNA, 20 bp, Artificial
  CRISPR gRNA sequence
tttttttttgagacggagtt

SEQ ID NO: 246588 - DNA, 20 bp, Artificial
  CRISPR gRNA sequence
ttttttttgagacggagttt

SEQ ID NO: 246589 - DNA, 20 bp, Artificial
  CRISPR gRNA sequence
tttttttgagacggagtttc

SEQ ID NO: 246590 - DNA, 20 bp, Artificial
  CRISPR gRNA sequence
ttttttgagacggagtttcg

SEQ ID NO: 246591 - DNA, 20 bp, Artificial
  CRISPR gRNA sequence
tttttgagacggagtttcgc

SEQ ID NO: 246592 - DNA, 20 bp, Artificial
  CRISPR gRNA sequence
ttttgagacggagtttcgct

SEQ ID NO: 246593 - DNA, 20 bp, Artificial
  CRISPR gRNA sequence
tttgagacggagtttcgctt

SEQ ID NO: 246594 - DNA, 20 bp, Artificial
  CRISPR gRNA sequence
ttgagacggagtttcgcttt

SEQ ID NO: 246595 - DNA, 20 bp, Artificial
  CRISPR gRNA sequence
tgagacggagtttcgctttt

SEQ ID NO: 246596 - DNA, 20 bp, Artificial
  CRISPR gRNA sequence
gagacggagtttcgcttttg

SEQ ID NO: 246597 - DNA, 20 bp, Artificial
  CRISPR gRNA sequence
agacggagtttcgcttttgt

SEQ ID NO: 246598 - DNA, 20 bp, Artificial
  CRISPR gRNA sequence
cgcttttgttgcccaggctg

SEQ ID NO: 246599 - DNA, 20 bp, Artificial
  CRISPR gRNA sequence
gcttttgttgcccaggctgg

SEQ ID NO: 246600 - DNA, 20 bp, Artificial
  CRISPR gRNA sequence
ttgttgcccaggctggagtg

SEQ ID NO: 246601 - DNA, 20 bp, Artificial
  CRISPR gRNA sequence
tgttgcccaggctggagtgc

SEQ ID NO: 246602 - DNA, 20 bp, Artificial
  CRISPR gRNA sequence
gttgcccaggctggagtgca

SEQ ID NO: 246603 - DNA, 20 bp, Artificial
  CRISPR gRNA sequence
ttgcccaggctggagtgcaa

SEQ ID NO: 246604 - DNA, 20 bp, Artificial
  CRISPR gRNA sequence
cccaggctggagtgcaatgg

SEQ ID NO: 246605 - DNA, 20 bp, Artificial
  CRISPR gRNA sequence
gagtgcaatggcacgatctc

SEQ ID NO: 246606 - DNA, 20 bp, Artificial
  CRISPR gRNA sequence
agttcactgcaacctccacc

SEQ ID NO: 246607 - DNA, 20 bp, Artificial
  CRISPR gRNA sequence
actgcaacctccacctcccg

SEQ ID NO: 246608 - DNA, 20 bp, Artificial
  CRISPR gRNA sequence
caacctccacctcccgggtt

SEQ ID NO: 246609 - DNA, 20 bp, Artificial
  CRISPR gRNA sequence
cacctcccgggttcaagcga

SEQ ID NO: 246610 - DNA, 20 bp, Artificial
  CRISPR gRNA sequence
ccgggttcaagcgattctcc

SEQ ID NO: 246611 - DNA, 20 bp, Artificial
  CRISPR gRNA sequence
aagcgattctcctgtctcag

SEQ ID NO: 246612 - DNA, 20 bp, Artificial
  CRISPR gRNA sequence
tcctgtctcagcctcctgag

SEQ ID NO: 246613 - DNA, 20 bp, Artificial
  CRISPR gRNA sequence
ctgtctcagcctcctgagta

SEQ ID NO: 246614 - DNA, 20 bp, Artificial
  CRISPR gRNA sequence
tctcagcctcctgagtagct

SEQ ID NO: 246615 - DNA, 20 bp, Artificial
  CRISPR gRNA sequence
agcctcctgagtagctggga

SEQ ID NO: 246616 - DNA, 20 bp, Artificial
  CRISPR gRNA sequence
ctgagtagctgggattacag

SEQ ID NO: 246617 - DNA, 20 bp, Artificial
  CRISPR gRNA sequence
agtagctgggattacaggca

SEQ ID NO: 246618 - DNA, 20 bp, Artificial
  CRISPR gRNA sequence
ggattacaggcatgcaccac

SEQ ID NO: 246619 - DNA, 20 bp, Artificial
  CRISPR gRNA sequence
caggcatgcaccaccacgcc

SEQ ID NO: 246620 - DNA, 20 bp, Artificial
  CRISPR gRNA sequence
gctaattttttgtattttta

SEQ ID NO: 246621 - DNA, 20 bp, Artificial
  CRISPR gRNA sequence
attttttgtatttttagtag

SEQ ID NO: 246622 - DNA, 20 bp, Artificial
  CRISPR gRNA sequence
tttgtatttttagtagagac

SEQ ID NO: 246623 - DNA, 20 bp, Artificial
  CRISPR gRNA sequence
ttgtatttttagtagagacg

SEQ ID NO: 246624 - DNA, 20 bp, Artificial
  CRISPR gRNA sequence
tgtatttttagtagagacgg

SEQ ID NO: 246625 - DNA, 20 bp, Artificial
  CRISPR gRNA sequence
gtatttttagtagagacggg

SEQ ID NO: 246626 - DNA, 20 bp, Artificial
  CRISPR gRNA sequence
tatttttagtagagacgggg

SEQ ID NO: 246627 - DNA, 20 bp, Artificial
  CRISPR gRNA sequence
ttagtagagacggggtttca

SEQ ID NO: 246628 - DNA, 20 bp, Artificial
  CRISPR gRNA sequence
tagtagagacggggtttcac

SEQ ID NO: 246629 - DNA, 20 bp, Artificial
  CRISPR gRNA sequence
agtagagacggggtttcacc

SEQ ID NO: 246630 - DNA, 20 bp, Artificial
  CRISPR gRNA sequence
gtagagacggggtttcacca

SEQ ID NO: 246631 - DNA, 20 bp, Artificial
  CRISPR gRNA sequence
caccatggccaggctggtgt

SEQ ID NO: 246632 - DNA, 20 bp, Artificial
  CRISPR gRNA sequence
accatggccaggctggtgtt

SEQ ID NO: 246633 - DNA, 20 bp, Artificial
  CRISPR gRNA sequence
gtgttgaactcctaacctca

SEQ ID NO: 246634 - DNA, 20 bp, Artificial
  CRISPR gRNA sequence
aactcctaacctcaggtgat

SEQ ID NO: 246635 - DNA, 20 bp, Artificial
  CRISPR gRNA sequence
ctaacctcaggtgatctgcc

SEQ ID NO: 246636 - DNA, 20 bp, Artificial
  CRISPR gRNA sequence
acctcaggtgatctgcccgc

SEQ ID NO: 246637 - DNA, 20 bp, Artificial
  CRISPR gRNA sequence
aggtgatctgcccgcctcag

SEQ ID NO: 246638 - DNA, 20 bp, Artificial
  CRISPR gRNA sequence
cccgcctcagccccccagaa

SEQ ID NO: 246639 - DNA, 20 bp, Artificial
  CRISPR gRNA sequence
agccccccagaatgctagga

SEQ ID NO: 246640 - DNA, 20 bp, Artificial
  CRISPR gRNA sequence
ggattacaggcgtgagccac

SEQ ID NO: 246641 - DNA, 20 bp, Artificial
  CRISPR gRNA sequence
caggcgtgagccacagcgcc

SEQ ID NO: 246642 - DNA, 20 bp, Artificial
  CRISPR gRNA sequence
ccctgaccaggaatcgaacc

SEQ ID NO: 246643 - DNA, 20 bp, Artificial
  CRISPR gRNA sequence
cctgaccaggaatcgaaccc

SEQ ID NO: 246644 - DNA, 20 bp, Artificial
  CRISPR gRNA sequence
accaggaatcgaacccgggt

SEQ ID NO: 246645 - DNA, 20 bp, Artificial
  CRISPR gRNA sequence
accactagactaccagggag

SEQ ID NO: 246646 - DNA, 20 bp, Artificial
  CRISPR gRNA sequence
gactaccagggagtgtccta

SEQ ID NO: 246647 - DNA, 20 bp, Artificial
  CRISPR gRNA sequence
ccagggagtgtcctaaaaac

SEQ ID NO: 246648 - DNA, 20 bp, Artificial
  CRISPR gRNA sequence
aaaacttttaaaaaatggat

SEQ ID NO: 246649 - DNA, 20 bp, Artificial
  CRISPR gRNA sequence
ttaaaaaatggattacagtt

SEQ ID NO: 246650 - DNA, 20 bp, Artificial
  CRISPR gRNA sequence
taaaaaatggattacagttc

SEQ ID NO: 246651 - DNA, 20 bp, Artificial
  CRISPR gRNA sequence
aaaaaatggattacagttcc

SEQ ID NO: 246652 - DNA, 20 bp, Artificial
  CRISPR gRNA sequence
aaaaatggattacagttcca

SEQ ID NO: 246653 - DNA, 20 bp, Artificial
  CRISPR gRNA sequence
cagttccattgaaactcact

SEQ ID NO: 246654 - DNA, 20 bp, Artificial
  CRISPR gRNA sequence
cattgaaactcactaattac

SEQ ID NO: 246655 - DNA, 20 bp, Artificial
  CRISPR gRNA sequence
aaactcactaattactcata

SEQ ID NO: 246656 - DNA, 20 bp, Artificial
  CRISPR gRNA sequence
actaattactcataaatact

SEQ ID NO: 246657 - DNA, 20 bp, Artificial
  CRISPR gRNA sequence
attactcataaatacttttg

SEQ ID NO: 246658 - DNA, 20 bp, Artificial
  CRISPR gRNA sequence
ctcataaatacttttgaaaa

SEQ ID NO: 246659 - DNA, 20 bp, Artificial
  CRISPR gRNA sequence
ataaatacttttgaaaagca

SEQ ID NO: 246660 - DNA, 20 bp, Artificial
  CRISPR gRNA sequence
ttgaaaagcattttataacg

SEQ ID NO: 246661 - DNA, 20 bp, Artificial
  CRISPR gRNA sequence
tgaaaagcattttataacga

SEQ ID NO: 246662 - DNA, 20 bp, Artificial
  CRISPR gRNA sequence
gaaaagcattttataacgaa

SEQ ID NO: 246663 - DNA, 20 bp, Artificial
  CRISPR gRNA sequence
aaaagcattttataacgaac

SEQ ID NO: 246664 - DNA, 20 bp, Artificial
  CRISPR gRNA sequence
tataacgaactttgttgcag

SEQ ID NO: 246665 - DNA, 20 bp, Artificial
  CRISPR gRNA sequence
ataacgaactttgttgcagt

SEQ ID NO: 246666 - DNA, 20 bp, Artificial
  CRISPR gRNA sequence
taacgaactttgttgcagtc

SEQ ID NO: 246667 - DNA, 20 bp, Artificial
  CRISPR gRNA sequence
tgttgcagtctggggtgtgg

SEQ ID NO: 246668 - DNA, 20 bp, Artificial
  CRISPR gRNA sequence
gttgcagtctggggtgtgga

SEQ ID NO: 246669 - DNA, 20 bp, Artificial
  CRISPR gRNA sequence
ttgcagtctggggtgtggat

SEQ ID NO: 246670 - DNA, 20 bp, Artificial
  CRISPR gRNA sequence
cagtctggggtgtggatgga

SEQ ID NO: 246671 - DNA, 20 bp, Artificial
  CRISPR gRNA sequence
gggtgtggatggaactttgt

SEQ ID NO: 246672 - DNA, 20 bp, Artificial
  CRISPR gRNA sequence
tgttgcagagatactccttt

SEQ ID NO: 246673 - DNA, 20 bp, Artificial
  CRISPR gRNA sequence
gttgcagagatactccttta

SEQ ID NO: 246674 - DNA, 20 bp, Artificial
  CRISPR gRNA sequence
ttgcagagatactcctttaa

SEQ ID NO: 246675 - DNA, 20 bp, Artificial
  CRISPR gRNA sequence
cagagatactcctttaaatc

SEQ ID NO: 246676 - DNA, 20 bp, Artificial
  CRISPR gRNA sequence
ctttaaatcaggattaagtc

SEQ ID NO: 246677 - DNA, 20 bp, Artificial
  CRISPR gRNA sequence
taaatcaggattaagtccag

SEQ ID NO: 246678 - DNA, 20 bp, Artificial
  CRISPR gRNA sequence
aaatcaggattaagtccagc

SEQ ID NO: 246679 - DNA, 20 bp, Artificial
  CRISPR gRNA sequence
aatcaggattaagtccagca

SEQ ID NO: 246680 - DNA, 20 bp, Artificial
  CRISPR gRNA sequence
agtccagcactttgggaaac

SEQ ID NO: 246681 - DNA, 20 bp, Artificial
  CRISPR gRNA sequence
tgggaaaccgaggtgggagg

SEQ ID NO: 246682 - DNA, 20 bp, Artificial
  CRISPR gRNA sequence
gggaaaccgaggtgggagga

SEQ ID NO: 246683 - DNA, 20 bp, Artificial
  CRISPR gRNA sequence
ggaaaccgaggtgggaggat

SEQ ID NO: 246684 - DNA, 20 bp, Artificial
  CRISPR gRNA sequence
gagcccaggagtttaagact

SEQ ID NO: 246685 - DNA, 20 bp, Artificial
  CRISPR gRNA sequence
agcccaggagtttaagactg

SEQ ID NO: 246686 - DNA, 20 bp, Artificial
  CRISPR gRNA sequence
aagactggcctggacaacac

SEQ ID NO: 246687 - DNA, 20 bp, Artificial
  CRISPR gRNA sequence
agactggcctggacaacacc

SEQ ID NO: 246688 - DNA, 20 bp, Artificial
  CRISPR gRNA sequence
gcctggacaacaccgtgaat

SEQ ID NO: 246689 - DNA, 20 bp, Artificial
  CRISPR gRNA sequence
gacaacaccgtgaatcccag

SEQ ID NO: 246690 - DNA, 20 bp, Artificial
  CRISPR gRNA sequence
tacaaaaacactaaaaatca

SEQ ID NO: 246691 - DNA, 20 bp, Artificial
  CRISPR gRNA sequence
caaaaacactaaaaatcaat

SEQ ID NO: 246692 - DNA, 20 bp, Artificial
  CRISPR gRNA sequence
aaaatcaattaaaaattagc

SEQ ID NO: 246693 - DNA, 20 bp, Artificial
  CRISPR gRNA sequence
aaaattagctgagtgtggtg

SEQ ID NO: 246694 - DNA, 20 bp, Artificial
  CRISPR gRNA sequence
gctgagtgtggtggtatgca

SEQ ID NO: 246695 - DNA, 20 bp, Artificial
  CRISPR gRNA sequence
agtgtggtggtatgcaccta

SEQ ID NO: 246696 - DNA, 20 bp, Artificial
  CRISPR gRNA sequence
tagtcccagctatttagtag

SEQ ID NO: 246697 - DNA, 20 bp, Artificial
  CRISPR gRNA sequence
tttagtaggctgaggcagga

SEQ ID NO: 246698 - DNA, 20 bp, Artificial
  CRISPR gRNA sequence
agtaggctgaggcaggagga

SEQ ID NO: 246699 - DNA, 20 bp, Artificial
  CRISPR gRNA sequence
gtaggctgaggcaggaggat

SEQ ID NO: 246700 - DNA, 20 bp, Artificial
  CRISPR gRNA sequence
aggcaggaggattgctcgag

SEQ ID NO: 246701 - DNA, 20 bp, Artificial
  CRISPR gRNA sequence
ctcgagctctggagttcgag

SEQ ID NO: 246702 - DNA, 20 bp, Artificial
  CRISPR gRNA sequence
gagctctggagttcgaggct

SEQ ID NO: 246703 - DNA, 20 bp, Artificial
  CRISPR gRNA sequence
tggagttcgaggctacagtg

SEQ ID NO: 246704 - DNA, 20 bp, Artificial
  CRISPR gRNA sequence
gagttcgaggctacagtgag

SEQ ID NO: 246705 - DNA, 20 bp, Artificial
  CRISPR gRNA sequence
gaggctacagtgagctgtga

SEQ ID NO: 246706 - DNA, 20 bp, Artificial
  CRISPR gRNA sequence
cagtgagctgtgatcgcacc

SEQ ID NO: 246707 - DNA, 20 bp, Artificial
  CRISPR gRNA sequence
tgatcgcaccattgcacttc

SEQ ID NO: 246708 - DNA, 20 bp, Artificial
  CRISPR gRNA sequence
cacttcagcctgggtgacac

SEQ ID NO: 246709 - DNA, 20 bp, Artificial
  CRISPR gRNA sequence
cagcctgggtgacacagtga

SEQ ID NO: 246710 - DNA, 20 bp, Artificial
  CRISPR gRNA sequence
agcctgggtgacacagtgaa

SEQ ID NO: 246711 - DNA, 20 bp, Artificial
  CRISPR gRNA sequence
ggtgacacagtgaaactctg

SEQ ID NO: 246712 - DNA, 20 bp, Artificial
  CRISPR gRNA sequence
tgtctcaaaaaaacaaaaga

SEQ ID NO: 246713 - DNA, 20 bp, Artificial
  CRISPR gRNA sequence
tctcaaaaaaacaaaagaca

SEQ ID NO: 246714 - DNA, 20 bp, Artificial
  CRISPR gRNA sequence
aaaaaaacaaaagacaaaac

SEQ ID NO: 246715 - DNA, 20 bp, Artificial
  CRISPR gRNA sequence
aaatcaggtttaagtgagaa

SEQ ID NO: 246716 - DNA, 20 bp, Artificial
  CRISPR gRNA sequence
aagtgagaacgcagaggttt

SEQ ID NO: 246717 - DNA, 20 bp, Artificial
  CRISPR gRNA sequence
agtgagaacgcagaggttta

SEQ ID NO: 246718 - DNA, 20 bp, Artificial
  CRISPR gRNA sequence
aaactggaggtgtagacctc

SEQ ID NO: 246719 - DNA, 20 bp, Artificial
  CRISPR gRNA sequence
aactggaggtgtagacctca

SEQ ID NO: 246720 - DNA, 20 bp, Artificial
  CRISPR gRNA sequence
gaggtgtagacctcaaaaaa

SEQ ID NO: 246721 - DNA, 20 bp, Artificial
  CRISPR gRNA sequence
aaaaaaagaatgaaagagca

SEQ ID NO: 246722 - DNA, 20 bp, Artificial
  CRISPR gRNA sequence
gcagctcatgaacagcagac

SEQ ID NO: 246723 - DNA, 20 bp, Artificial
  CRISPR gRNA sequence
cagctcatgaacagcagact

SEQ ID NO: 246724 - DNA, 20 bp, Artificial
  CRISPR gRNA sequence
atgaacagcagactaaaaac

SEQ ID NO: 246725 - DNA, 20 bp, Artificial
  CRISPR gRNA sequence
aaaacttcctatacgttagt

SEQ ID NO: 246726 - DNA, 20 bp, Artificial
  CRISPR gRNA sequence
cctatacgttagtaagaaaa

SEQ ID NO: 246727 - DNA, 20 bp, Artificial
  CRISPR gRNA sequence
ctatacgttagtaagaaaag

SEQ ID NO: 246728 - DNA, 20 bp, Artificial
  CRISPR gRNA sequence
tacgttagtaagaaaaggac

SEQ ID NO: 246729 - DNA, 20 bp, Artificial
  CRISPR gRNA sequence
gtaagaaaaggacagacaat

SEQ ID NO: 246730 - DNA, 20 bp, Artificial
  CRISPR gRNA sequence
tgagaaaatactcaaaagac

SEQ ID NO: 246731 - DNA, 20 bp, Artificial
  CRISPR gRNA sequence
aaaagacttgatcaggccct

SEQ ID NO: 246732 - DNA, 20 bp, Artificial
  CRISPR gRNA sequence
gatcaggcccttcactaaag

SEQ ID NO: 246733 - DNA, 20 bp, Artificial
  CRISPR gRNA sequence
atcaggcccttcactaaaga

SEQ ID NO: 246734 - DNA, 20 bp, Artificial
  CRISPR gRNA sequence
cactaaagaggaaatccaaa

SEQ ID NO: 246735 - DNA, 20 bp, Artificial
  CRISPR gRNA sequence
actaaagaggaaatccaaat

SEQ ID NO: 246736 - DNA, 20 bp, Artificial
  CRISPR gRNA sequence
aagaggaaatccaaatagcc

SEQ ID NO: 246737 - DNA, 20 bp, Artificial
  CRISPR gRNA sequence
acctcactagcaaccaggaa

SEQ ID NO: 246738 - DNA, 20 bp, Artificial
  CRISPR gRNA sequence
actagcaaccaggaagtgta

SEQ ID NO: 246739 - DNA, 20 bp, Artificial
  CRISPR gRNA sequence
gcaaccaggaagtgtaagtt

SEQ ID NO: 246740 - DNA, 20 bp, Artificial
  CRISPR gRNA sequence
aaaccacaatgagatacaac

SEQ ID NO: 246741 - DNA, 20 bp, Artificial
  CRISPR gRNA sequence
tccacccaccatatcgataa

SEQ ID NO: 246742 - DNA, 20 bp, Artificial
  CRISPR gRNA sequence
atgataccaagagttatcag

SEQ ID NO: 246743 - DNA, 20 bp, Artificial
  CRISPR gRNA sequence
tcaggggatgtggagtaaca

SEQ ID NO: 246744 - DNA, 20 bp, Artificial
  CRISPR gRNA sequence
attaccgccaggggagtgta

SEQ ID NO: 246745 - DNA, 20 bp, Artificial
  CRISPR gRNA sequence
ccgccaggggagtgtaaatg

SEQ ID NO: 246746 - DNA, 20 bp, Artificial
  CRISPR gRNA sequence
aggaaaacagtttggcatat

SEQ ID NO: 246747 - DNA, 20 bp, Artificial
  CRISPR gRNA sequence
ggaaaacagtttggcatatt

SEQ ID NO: 246748 - DNA, 20 bp, Artificial
  CRISPR gRNA sequence
ggcatattcacgaccaagat

SEQ ID NO: 246749 - DNA, 20 bp, Artificial
  CRISPR gRNA sequence
gcatattcacgaccaagata

SEQ ID NO: 246750 - DNA, 20 bp, Artificial
  CRISPR gRNA sequence
acgaccaagatacacatgtt

SEQ ID NO: 246751 - DNA, 20 bp, Artificial
  CRISPR gRNA sequence
cttgtagctcagcaacgtta

SEQ ID NO: 246752 - DNA, 20 bp, Artificial
  CRISPR gRNA sequence
gtagctcagcaacgttattt

SEQ ID NO: 246753 - DNA, 20 bp, Artificial
  CRISPR gRNA sequence
tagctcagcaacgttatttc

SEQ ID NO: 246754 - DNA, 20 bp, Artificial
  CRISPR gRNA sequence
agcaacgttatttctaggtt

SEQ ID NO: 246755 - DNA, 20 bp, Artificial
  CRISPR gRNA sequence
tttctaggttaaaaaacaaa

SEQ ID NO: 246756 - DNA, 20 bp, Artificial
  CRISPR gRNA sequence
ctaggttaaaaaacaaaacc

SEQ ID NO: 246757 - DNA, 20 bp, Artificial
  CRISPR gRNA sequence
taggttaaaaaacaaaacca

SEQ ID NO: 246758 - DNA, 20 bp, Artificial
  CRISPR gRNA sequence
ggttaaaaaacaaaaccaag

SEQ ID NO: 246759 - DNA, 20 bp, Artificial
  CRISPR gRNA sequence
aaaaacaaaaccaagccaga

SEQ ID NO: 246760 - DNA, 20 bp, Artificial
  CRISPR gRNA sequence
acgtgtgctgagatacacgg

SEQ ID NO: 246761 - DNA, 20 bp, Artificial
  CRISPR gRNA sequence
cgtgtgctgagatacacgga

SEQ ID NO: 246762 - DNA, 20 bp, Artificial
  CRISPR gRNA sequence
agatacacggacaaaaatat

SEQ ID NO: 246763 - DNA, 20 bp, Artificial
  CRISPR gRNA sequence
aaacgtcattacatgtaata

SEQ ID NO: 246764 - DNA, 20 bp, Artificial
  CRISPR gRNA sequence
catgtaataaccccaagctg

SEQ ID NO: 246765 - DNA, 20 bp, Artificial
  CRISPR gRNA sequence
gaaatgatcccgctgtccat

SEQ ID NO: 246766 - DNA, 20 bp, Artificial
  CRISPR gRNA sequence
tccatcagtactagaatagg

SEQ ID NO: 246767 - DNA, 20 bp, Artificial
  CRISPR gRNA sequence
gaataggtgaacaatgatgt

SEQ ID NO: 246768 - DNA, 20 bp, Artificial
  CRISPR gRNA sequence
aacaagagtgtgcaacagtg

SEQ ID NO: 246769 - DNA, 20 bp, Artificial
  CRISPR gRNA sequence
aagatgaactcaacatggat

SEQ ID NO: 246770 - DNA, 20 bp, Artificial
  CRISPR gRNA sequence
aacatggatgaatcttcatg

SEQ ID NO: 246771 - DNA, 20 bp, Artificial
  CRISPR gRNA sequence
catgatacaacgttgaaaga

SEQ ID NO: 246772 - DNA, 20 bp, Artificial
  CRISPR gRNA sequence
atgatacaacgttgaaagaa

SEQ ID NO: 246773 - DNA, 20 bp, Artificial
  CRISPR gRNA sequence
aaagaagaagcaagatacag

SEQ ID NO: 246774 - DNA, 20 bp, Artificial
  CRISPR gRNA sequence
tatttgtatgaagttcacaa

SEQ ID NO: 246775 - DNA, 20 bp, Artificial
  CRISPR gRNA sequence
tttgtatgaagttcacaagc

SEQ ID NO: 246776 - DNA, 20 bp, Artificial
  CRISPR gRNA sequence
gtatgaagttcacaagcagc

SEQ ID NO: 246777 - DNA, 20 bp, Artificial
  CRISPR gRNA sequence
tatgaagttcacaagcagcc

SEQ ID NO: 246778 - DNA, 20 bp, Artificial
  CRISPR gRNA sequence
acaagcagcccaataaaact

SEQ ID NO: 246779 - DNA, 20 bp, Artificial
  CRISPR gRNA sequence
tgttattaggtagcaaaact

SEQ ID NO: 246780 - DNA, 20 bp, Artificial
  CRISPR gRNA sequence
ttaggtagcaaaactacagc

SEQ ID NO: 246781 - DNA, 20 bp, Artificial
  CRISPR gRNA sequence
ggtagcaaaactacagcaaa

SEQ ID NO: 246782 - DNA, 20 bp, Artificial
  CRISPR gRNA sequence
cagcaaaaggaagttaatac

SEQ ID NO: 246783 - DNA, 20 bp, Artificial
  CRISPR gRNA sequence
ataccatacaagtctagatg

SEQ ID NO: 246784 - DNA, 20 bp, Artificial
  CRISPR gRNA sequence
gatgtggttagcagtagtgg

SEQ ID NO: 246785 - DNA, 20 bp, Artificial
  CRISPR gRNA sequence
gcagtagtgggcaaagaggg

SEQ ID NO: 246786 - DNA, 20 bp, Artificial
  CRISPR gRNA sequence
tgatctagaaagggcatgcc

SEQ ID NO: 246787 - DNA, 20 bp, Artificial
  CRISPR gRNA sequence
gaaagggcatgccaagggct

SEQ ID NO: 246788 - DNA, 20 bp, Artificial
  CRISPR gRNA sequence
cgggaatgagttatgttcca

SEQ ID NO: 246789 - DNA, 20 bp, Artificial
  CRISPR gRNA sequence
gggaatgagttatgttccac

SEQ ID NO: 246790 - DNA, 20 bp, Artificial
  CRISPR gRNA sequence
tgttccacttctttaccctg

SEQ ID NO: 246791 - DNA, 20 bp, Artificial
  CRISPR gRNA sequence
cacttctttaccctggtaga

SEQ ID NO: 246792 - DNA, 20 bp, Artificial
  CRISPR gRNA sequence
ctttaccctggtagagttat

SEQ ID NO: 246793 - DNA, 20 bp, Artificial
  CRISPR gRNA sequence
tttaccctggtagagttatt

SEQ ID NO: 246794 - DNA, 20 bp, Artificial
  CRISPR gRNA sequence
taccctggtagagttatttg

SEQ ID NO: 246795 - DNA, 20 bp, Artificial
  CRISPR gRNA sequence
accctggtagagttatttga

SEQ ID NO: 246796 - DNA, 20 bp, Artificial
  CRISPR gRNA sequence
ccctggtagagttatttgaa

SEQ ID NO: 246797 - DNA, 20 bp, Artificial
  CRISPR gRNA sequence
gtagagttatttgaatgttt

SEQ ID NO: 246798 - DNA, 20 bp, Artificial
  CRISPR gRNA sequence
tttgaatgtttgtttacaac

SEQ ID NO: 246799 - DNA, 20 bp, Artificial
  CRISPR gRNA sequence
gaatgtttgtttacaacaat

SEQ ID NO: 246800 - DNA, 20 bp, Artificial
  CRISPR gRNA sequence
aatgtttgtttacaacaatt

SEQ ID NO: 246801 - DNA, 20 bp, Artificial
  CRISPR gRNA sequence
gtttacaacaatttgttaaa

SEQ ID NO: 246802 - DNA, 20 bp, Artificial
  CRISPR gRNA sequence
tttacaacaatttgttaaac

SEQ ID NO: 246803 - DNA, 20 bp, Artificial
  CRISPR gRNA sequence
acaacaatttgttaaacttt

SEQ ID NO: 246804 - DNA, 20 bp, Artificial
  CRISPR gRNA sequence
caacaatttgttaaacttta

SEQ ID NO: 246805 - DNA, 20 bp, Artificial
  CRISPR gRNA sequence
gttaaactttacatttatgc

SEQ ID NO: 246806 - DNA, 20 bp, Artificial
  CRISPR gRNA sequence
ttaaactttacatttatgca

SEQ ID NO: 246807 - DNA, 20 bp, Artificial
  CRISPR gRNA sequence
aactttacatttatgcattt

SEQ ID NO: 246808 - DNA, 20 bp, Artificial
  CRISPR gRNA sequence
tacatttatgcatttttctg

SEQ ID NO: 246809 - DNA, 20 bp, Artificial
  CRISPR gRNA sequence
acatttatgcatttttctgt

SEQ ID NO: 246810 - DNA, 20 bp, Artificial
  CRISPR gRNA sequence
catttatgcatttttctgta

SEQ ID NO: 246811 - DNA, 20 bp, Artificial
  CRISPR gRNA sequence
atgcatttttctgtataggt

SEQ ID NO: 246812 - DNA, 20 bp, Artificial
  CRISPR gRNA sequence
tgcatttttctgtataggtc

SEQ ID NO: 246813 - DNA, 20 bp, Artificial
  CRISPR gRNA sequence
ttctgtataggtcacaatgt

SEQ ID NO: 246814 - DNA, 20 bp, Artificial
  CRISPR gRNA sequence
tctgtataggtcacaatgta

SEQ ID NO: 246815 - DNA, 20 bp, Artificial
  CRISPR gRNA sequence
ctgtataggtcacaatgtat

SEQ ID NO: 246816 - DNA, 20 bp, Artificial
  CRISPR gRNA sequence
tgtataggtcacaatgtata

SEQ ID NO: 246817 - DNA, 20 bp, Artificial
  CRISPR gRNA sequence
tataggtcacaatgtataaa

SEQ ID NO: 246818 - DNA, 20 bp, Artificial
  CRISPR gRNA sequence
tatattgctttaaaaagagc

SEQ ID NO: 246819 - DNA, 20 bp, Artificial
  CRISPR gRNA sequence
tattgctttaaaaagagcct

SEQ ID NO: 246820 - DNA, 20 bp, Artificial
  CRISPR gRNA sequence
ctttaaaaagagcctttaaa

SEQ ID NO: 246821 - DNA, 20 bp, Artificial
  CRISPR gRNA sequence
taaaaagagcctttaaatac

SEQ ID NO: 246822 - DNA, 20 bp, Artificial
  CRISPR gRNA sequence
aaaaagagcctttaaataca

SEQ ID NO: 246823 - DNA, 20 bp, Artificial
  CRISPR gRNA sequence
aaaagagcctttaaatacat

SEQ ID NO: 246824 - DNA, 20 bp, Artificial
  CRISPR gRNA sequence
taaatacattagcataattt

SEQ ID NO: 246825 - DNA, 20 bp, Artificial
  CRISPR gRNA sequence
aaatacattagcataattta

SEQ ID NO: 246826 - DNA, 20 bp, Artificial
  CRISPR gRNA sequence
aatacattagcataatttat

SEQ ID NO: 246827 - DNA, 20 bp, Artificial
  CRISPR gRNA sequence
gcataatttattagataaga

SEQ ID NO: 246828 - DNA, 20 bp, Artificial
  CRISPR gRNA sequence
attagataagactttactgg

SEQ ID NO: 246829 - DNA, 20 bp, Artificial
  CRISPR gRNA sequence
ttagataagactttactggc

SEQ ID NO: 246830 - DNA, 20 bp, Artificial
  CRISPR gRNA sequence
gataagactttactggctga

SEQ ID NO: 246831 - DNA, 20 bp, Artificial
  CRISPR gRNA sequence
tactggctgagcgcagtggc

SEQ ID NO: 246832 - DNA, 20 bp, Artificial
  CRISPR gRNA sequence
actggctgagcgcagtggct

SEQ ID NO: 246833 - DNA, 20 bp, Artificial
  CRISPR gRNA sequence
ctggctgagcgcagtggctc

SEQ ID NO: 246834 - DNA, 20 bp, Artificial
  CRISPR gRNA sequence
gctgagcgcagtggctcacg

SEQ ID NO: 246835 - DNA, 20 bp, Artificial
  CRISPR gRNA sequence
agcgcagtggctcacgcctg

SEQ ID NO: 246836 - DNA, 20 bp, Artificial
  CRISPR gRNA sequence
acgcctgtaatcccaacact

SEQ ID NO: 246837 - DNA, 20 bp, Artificial
  CRISPR gRNA sequence
taatcccaacactttgggag

SEQ ID NO: 246838 - DNA, 20 bp, Artificial
  CRISPR gRNA sequence
tgggaggctgaggcgggcgg

SEQ ID NO: 246839 - DNA, 20 bp, Artificial
  CRISPR gRNA sequence
gggaggctgaggcgggcgga

SEQ ID NO: 246840 - DNA, 20 bp, Artificial
  CRISPR gRNA sequence
ggaggctgaggcgggcggat

SEQ ID NO: 246841 - DNA, 20 bp, Artificial
  CRISPR gRNA sequence
aggcgggcggatcacctgag

SEQ ID NO: 246842 - DNA, 20 bp, Artificial
  CRISPR gRNA sequence
aggttgggagttcaagacca

SEQ ID NO: 246843 - DNA, 20 bp, Artificial
  CRISPR gRNA sequence
ggagttcaagaccagcctgg

SEQ ID NO: 246844 - DNA, 20 bp, Artificial
  CRISPR gRNA sequence
aagaccagcctggccaacat

SEQ ID NO: 246845 - DNA, 20 bp, Artificial
  CRISPR gRNA sequence
gccaacatggagaaaccccg

SEQ ID NO: 246846 - DNA, 20 bp, Artificial
  CRISPR gRNA sequence
tactaaaaatgcaaaattag

SEQ ID NO: 246847 - DNA, 20 bp, Artificial
  CRISPR gRNA sequence
ctaaaaatgcaaaattagct

SEQ ID NO: 246848 - DNA, 20 bp, Artificial
  CRISPR gRNA sequence
aaaatgcaaaattagctggg

SEQ ID NO: 246849 - DNA, 20 bp, Artificial
  CRISPR gRNA sequence
gctgggtgtggtggcgcatg

SEQ ID NO: 246850 - DNA, 20 bp, Artificial
  CRISPR gRNA sequence
ggtgtggtggcgcatgcctg

SEQ ID NO: 246851 - DNA, 20 bp, Artificial
  CRISPR gRNA sequence
taatgcctcgggagcctgag

SEQ ID NO: 246852 - DNA, 20 bp, Artificial
  CRISPR gRNA sequence
gggagcctgaggcaggagaa

SEQ ID NO: 246853 - DNA, 20 bp, Artificial
  CRISPR gRNA sequence
aggcaggagaatcgcttgaa

SEQ ID NO: 246854 - DNA, 20 bp, Artificial
  CRISPR gRNA sequence
gaacccggaaggaggaggtt

SEQ ID NO: 246855 - DNA, 20 bp, Artificial
  CRISPR gRNA sequence
aacccggaaggaggaggttg

SEQ ID NO: 246856 - DNA, 20 bp, Artificial
  CRISPR gRNA sequence
cggtaagccgggatcacgcc

SEQ ID NO: 246857 - DNA, 20 bp, Artificial
  CRISPR gRNA sequence
cactccagcctgggcaacaa

SEQ ID NO: 246858 - DNA, 20 bp, Artificial
  CRISPR gRNA sequence
cagcctgggcaacaagagtg

SEQ ID NO: 246859 - DNA, 20 bp, Artificial
  CRISPR gRNA sequence
ggcaacaagagtgaaactct

SEQ ID NO: 246860 - DNA, 20 bp, Artificial
  CRISPR gRNA sequence
tgtctcaaaaaagaaaaaaa

SEQ ID NO: 246861 - DNA, 20 bp, Artificial
  CRISPR gRNA sequence
tctcaaaaaagaaaaaaaaa

SEQ ID NO: 246862 - DNA, 20 bp, Artificial
  CRISPR gRNA sequence
aaaaaagaaaaaaaaagact

SEQ ID NO: 246863 - DNA, 20 bp, Artificial
  CRISPR gRNA sequence
tactaatgctgttcctgcat

SEQ ID NO: 246864 - DNA, 20 bp, Artificial
  CRISPR gRNA sequence
actaatgctgttcctgcata

SEQ ID NO: 246865 - DNA, 20 bp, Artificial
  CRISPR gRNA sequence
ctaatgctgttcctgcatat

SEQ ID NO: 246866 - DNA, 20 bp, Artificial
  CRISPR gRNA sequence
atgctgttcctgcatatata

SEQ ID NO: 246867 - DNA, 20 bp, Artificial
  CRISPR gRNA sequence
ttcctgcatatatattttta

SEQ ID NO: 246868 - DNA, 20 bp, Artificial
  CRISPR gRNA sequence
ctgcatatatatttttaaca

SEQ ID NO: 246869 - DNA, 20 bp, Artificial
  CRISPR gRNA sequence
catatatatttttaacaatc

SEQ ID NO: 246870 - DNA, 20 bp, Artificial
  CRISPR gRNA sequence
ttaacaatctccaaataggc

SEQ ID NO: 246871 - DNA, 20 bp, Artificial
  CRISPR gRNA sequence
taacaatctccaaataggca

SEQ ID NO: 246872 - DNA, 20 bp, Artificial
  CRISPR gRNA sequence
aacaatctccaaataggcac

SEQ ID NO: 246873 - DNA, 20 bp, Artificial
  CRISPR gRNA sequence
acaatctccaaataggcaca

SEQ ID NO: 246874 - DNA, 20 bp, Artificial
  CRISPR gRNA sequence
caaataggcacattctggtc

SEQ ID NO: 246875 - DNA, 20 bp, Artificial
  CRISPR gRNA sequence
tggtcttacatggtgctttg

SEQ ID NO: 246876 - DNA, 20 bp, Artificial
  CRISPR gRNA sequence
gtcttacatggtgctttggg

SEQ ID NO: 246877 - DNA, 20 bp, Artificial
  CRISPR gRNA sequence
acatggtgctttgggttaaa

SEQ ID NO: 246878 - DNA, 20 bp, Artificial
  CRISPR gRNA sequence
catggtgctttgggttaaaa

SEQ ID NO: 246879 - DNA, 20 bp, Artificial
  CRISPR gRNA sequence
tgggttaaaattttgctctc

SEQ ID NO: 246880 - DNA, 20 bp, Artificial
  CRISPR gRNA sequence
gggttaaaattttgctctca

SEQ ID NO: 246881 - DNA, 20 bp, Artificial
  CRISPR gRNA sequence
ggttaaaattttgctctcaa

SEQ ID NO: 246882 - DNA, 20 bp, Artificial
  CRISPR gRNA sequence
aaattttgctctcaaaaagc

SEQ ID NO: 246883 - DNA, 20 bp, Artificial
  CRISPR gRNA sequence
tgctctcaaaaagctccttt

SEQ ID NO: 246884 - DNA, 20 bp, Artificial
  CRISPR gRNA sequence
gctctcaaaaagctcctttt

SEQ ID NO: 246885 - DNA, 20 bp, Artificial
  CRISPR gRNA sequence
ctctcaaaaagctcctttta

SEQ ID NO: 246886 - DNA, 20 bp, Artificial
  CRISPR gRNA sequence
tcaaaaagctccttttatta

SEQ ID NO: 246887 - DNA, 20 bp, Artificial
  CRISPR gRNA sequence
aaaaagctccttttattata

SEQ ID NO: 246888 - DNA, 20 bp, Artificial
  CRISPR gRNA sequence
cttttattatatccctctta

SEQ ID NO: 246889 - DNA, 20 bp, Artificial
  CRISPR gRNA sequence
ttattatatccctcttatta

SEQ ID NO: 246890 - DNA, 20 bp, Artificial
  CRISPR gRNA sequence
tattatatccctcttattaa

SEQ ID NO: 246891 - DNA, 20 bp, Artificial
  CRISPR gRNA sequence
attatatccctcttattaag

SEQ ID NO: 246892 - DNA, 20 bp, Artificial
  CRISPR gRNA sequence
ttatatccctcttattaagt

SEQ ID NO: 246893 - DNA, 20 bp, Artificial
  CRISPR gRNA sequence
tatccctcttattaagtctt

SEQ ID NO: 246894 - DNA, 20 bp, Artificial
  CRISPR gRNA sequence
ttattaagtcttattaagcc

SEQ ID NO: 246895 - DNA, 20 bp, Artificial
  CRISPR gRNA sequence
attaagtcttattaagcctg

SEQ ID NO: 246896 - DNA, 20 bp, Artificial
  CRISPR gRNA sequence
ttaagtcttattaagcctgt

SEQ ID NO: 246897 - DNA, 20 bp, Artificial
  CRISPR gRNA sequence
agtcttattaagcctgttat

SEQ ID NO: 246898 - DNA, 20 bp, Artificial
  CRISPR gRNA sequence
attaagcctgttatgtctca

SEQ ID NO: 246899 - DNA, 20 bp, Artificial
  CRISPR gRNA sequence
ttaagcctgttatgtctcat

SEQ ID NO: 246900 - DNA, 20 bp, Artificial
  CRISPR gRNA sequence
agcctgttatgtctcatcct

SEQ ID NO: 246901 - DNA, 20 bp, Artificial
  CRISPR gRNA sequence
ttatgtctcatcctaatgtc

SEQ ID NO: 246902 - DNA, 20 bp, Artificial
  CRISPR gRNA sequence
tgtctcatcctaatgtccat

SEQ ID NO: 246903 - DNA, 20 bp, Artificial
  CRISPR gRNA sequence
atcctaatgtccatgaagac

SEQ ID NO: 246904 - DNA, 20 bp, Artificial
  CRISPR gRNA sequence
atgtccatgaagacaaaaaa

SEQ ID NO: 246905 - DNA, 20 bp, Artificial
  CRISPR gRNA sequence
ccttccatctatatactttt

SEQ ID NO: 246906 - DNA, 20 bp, Artificial
  CRISPR gRNA sequence
ccatctatatactttttcaa

SEQ ID NO: 246907 - DNA, 20 bp, Artificial
  CRISPR gRNA sequence
catctatatactttttcaaa

SEQ ID NO: 246908 - DNA, 20 bp, Artificial
  CRISPR gRNA sequence
tatactttttcaaataaata

SEQ ID NO: 246909 - DNA, 20 bp, Artificial
  CRISPR gRNA sequence
tttcaaataaatatcaatgg

SEQ ID NO: 246910 - DNA, 20 bp, Artificial
  CRISPR gRNA sequence
ttcaaataaatatcaatggc

SEQ ID NO: 246911 - DNA, 20 bp, Artificial
  CRISPR gRNA sequence
tcaaataaatatcaatggct

SEQ ID NO: 246912 - DNA, 20 bp, Artificial
  CRISPR gRNA sequence
caaataaatatcaatggctt

SEQ ID NO: 246913 - DNA, 20 bp, Artificial
  CRISPR gRNA sequence
aaataaatatcaatggcttt

SEQ ID NO: 246914 - DNA, 20 bp, Artificial
  CRISPR gRNA sequence
ttgtctagtggatgctgact

SEQ ID NO: 246915 - DNA, 20 bp, Artificial
  CRISPR gRNA sequence
tgtctagtggatgctgactc

SEQ ID NO: 246916 - DNA, 20 bp, Artificial
  CRISPR gRNA sequence
gtctagtggatgctgactca

SEQ ID NO: 246917 - DNA, 20 bp, Artificial
  CRISPR gRNA sequence
tctagtggatgctgactcag

SEQ ID NO: 246918 - DNA, 20 bp, Artificial
  CRISPR gRNA sequence
gtggatgctgactcagtgcc

SEQ ID NO: 246919 - DNA, 20 bp, Artificial
  CRISPR gRNA sequence
actcagtgccaggcacttgc

SEQ ID NO: 246920 - DNA, 20 bp, Artificial
  CRISPR gRNA sequence
agtgccaggcacttgctgag

SEQ ID NO: 246921 - DNA, 20 bp, Artificial
  CRISPR gRNA sequence
gctgagtaccttacagaaat

SEQ ID NO: 246922 - DNA, 20 bp, Artificial
  CRISPR gRNA sequence
ctgagtaccttacagaaata

SEQ ID NO: 246923 - DNA, 20 bp, Artificial
  CRISPR gRNA sequence
agtaccttacagaaataatt

SEQ ID NO: 246924 - DNA, 20 bp, Artificial
  CRISPR gRNA sequence
acagaaataattgttgaaca

SEQ ID NO: 246925 - DNA, 20 bp, Artificial
  CRISPR gRNA sequence
cagaaataattgttgaacaa

SEQ ID NO: 246926 - DNA, 20 bp, Artificial
  CRISPR gRNA sequence
ttgaacaagtgaatgaatga

SEQ ID NO: 246927 - DNA, 20 bp, Artificial
  CRISPR gRNA sequence
aacaagtgaatgaatgaaat

SEQ ID NO: 246928 - DNA, 20 bp, Artificial
  CRISPR gRNA sequence
attattgaaatttttcatgt

SEQ ID NO: 246929 - DNA, 20 bp, Artificial
  CRISPR gRNA sequence
ttgaaatttttcatgtaatc

SEQ ID NO: 246930 - DNA, 20 bp, Artificial
  CRISPR gRNA sequence
aaatttttcatgtaatccat

SEQ ID NO: 246931 - DNA, 20 bp, Artificial
  CRISPR gRNA sequence
ttcatgtaatccatactggt

SEQ ID NO: 246932 - DNA, 20 bp, Artificial
  CRISPR gRNA sequence
tcatgtaatccatactggtg

SEQ ID NO: 246933 - DNA, 20 bp, Artificial
  CRISPR gRNA sequence
catgtaatccatactggtgc

SEQ ID NO: 246934 - DNA, 20 bp, Artificial
  CRISPR gRNA sequence
atgtaatccatactggtgct

SEQ ID NO: 246935 - DNA, 20 bp, Artificial
  CRISPR gRNA sequence
gtgctgtaataattcatttg

SEQ ID NO: 246936 - DNA, 20 bp, Artificial
  CRISPR gRNA sequence
taataattcatttgttaaac

SEQ ID NO: 246937 - DNA, 20 bp, Artificial
  CRISPR gRNA sequence
atttgttaaacccccttcaa

SEQ ID NO: 246938 - DNA, 20 bp, Artificial
  CRISPR gRNA sequence
gttaaacccccttcaagctc

SEQ ID NO: 246939 - DNA, 20 bp, Artificial
  CRISPR gRNA sequence
ttaaacccccttcaagctcc

SEQ ID NO: 246940 - DNA, 20 bp, Artificial
  CRISPR gRNA sequence
aacccccttcaagctccctc

SEQ ID NO: 246941 - DNA, 20 bp, Artificial
  CRISPR gRNA sequence
caagctccctctttgttctc

SEQ ID NO: 246942 - DNA, 20 bp, Artificial
  CRISPR gRNA sequence
aagctccctctttgttctcc

SEQ ID NO: 246943 - DNA, 20 bp, Artificial
  CRISPR gRNA sequence
cctctttgttctccttgcct

SEQ ID NO: 246944 - DNA, 20 bp, Artificial
  CRISPR gRNA sequence
tttgttctccttgccttcct

SEQ ID NO: 246945 - DNA, 20 bp, Artificial
  CRISPR gRNA sequence
tgttctccttgccttcctca

SEQ ID NO: 246946 - DNA, 20 bp, Artificial
  CRISPR gRNA sequence
gttctccttgccttcctcaa

SEQ ID NO: 246947 - DNA, 20 bp, Artificial
  CRISPR gRNA sequence
ttctccttgccttcctcaaa

SEQ ID NO: 246948 - DNA, 20 bp, Artificial
  CRISPR gRNA sequence
tccttgccttcctcaaatat

SEQ ID NO: 246949 - DNA, 20 bp, Artificial
  CRISPR gRNA sequence
cttgccttcctcaaatatgg

SEQ ID NO: 246950 - DNA, 20 bp, Artificial
  CRISPR gRNA sequence
gccttcctcaaatatgggtc

SEQ ID NO: 246951 - DNA, 20 bp, Artificial
  CRISPR gRNA sequence
ccttcctcaaatatgggtct

SEQ ID NO: 246952 - DNA, 20 bp, Artificial
  CRISPR gRNA sequence
cctcaaatatgggtctaaac

SEQ ID NO: 246953 - DNA, 20 bp, Artificial
  CRISPR gRNA sequence
ctcaaatatgggtctaaact

SEQ ID NO: 246954 - DNA, 20 bp, Artificial
  CRISPR gRNA sequence
aaatatgggtctaaactcat

SEQ ID NO: 246955 - DNA, 20 bp, Artificial
  CRISPR gRNA sequence
aactcattttaagccagttt

SEQ ID NO: 246956 - DNA, 20 bp, Artificial
  CRISPR gRNA sequence
attttaagccagtttatcaa

SEQ ID NO: 246957 - DNA, 20 bp, Artificial
  CRISPR gRNA sequence
taagccagtttatcaaccag

SEQ ID NO: 246958 - DNA, 20 bp, Artificial
  CRISPR gRNA sequence
aagccagtttatcaaccaga

SEQ ID NO: 246959 - DNA, 20 bp, Artificial
  CRISPR gRNA sequence
agccagtttatcaaccagag

SEQ ID NO: 246960 - DNA, 20 bp, Artificial
  CRISPR gRNA sequence
atcaaccagagggacataga

SEQ ID NO: 246961 - DNA, 20 bp, Artificial
  CRISPR gRNA sequence
tcaaccagagggacatagag

SEQ ID NO: 246962 - DNA, 20 bp, Artificial
  CRISPR gRNA sequence
tctgattcttctttgccagt

SEQ ID NO: 246963 - DNA, 20 bp, Artificial
  CRISPR gRNA sequence
ctgattcttctttgccagtg

SEQ ID NO: 246964 - DNA, 20 bp, Artificial
  CRISPR gRNA sequence
tgattcttctttgccagtgt

SEQ ID NO: 246965 - DNA, 20 bp, Artificial
  CRISPR gRNA sequence
attcttctttgccagtgtcc

SEQ ID NO: 246966 - DNA, 20 bp, Artificial
  CRISPR gRNA sequence
ttctttgccagtgtcctcca

SEQ ID NO: 246967 - DNA, 20 bp, Artificial
  CRISPR gRNA sequence
ctttgccagtgtcctccaca

SEQ ID NO: 246968 - DNA, 20 bp, Artificial
  CRISPR gRNA sequence
tttgccagtgtcctccacac

SEQ ID NO: 246969 - DNA, 20 bp, Artificial
  CRISPR gRNA sequence
tgccagtgtcctccacacgc

SEQ ID NO: 246970 - DNA, 20 bp, Artificial
  CRISPR gRNA sequence
gccagtgtcctccacacgca

SEQ ID NO: 246971 - DNA, 20 bp, Artificial
  CRISPR gRNA sequence
ccagtgtcctccacacgcac

SEQ ID NO: 246972 - DNA, 20 bp, Artificial
  CRISPR gRNA sequence
cacacgcacacacacacata

SEQ ID NO: 246973 - DNA, 20 bp, Artificial
  CRISPR gRNA sequence
cagcatatttaaatctgtca

SEQ ID NO: 246974 - DNA, 20 bp, Artificial
  CRISPR gRNA sequence
aaatctgtcatttttctaga

SEQ ID NO: 246975 - DNA, 20 bp, Artificial
  CRISPR gRNA sequence
aatctgtcatttttctagaa

SEQ ID NO: 246976 - DNA, 20 bp, Artificial
  CRISPR gRNA sequence
tcatttttctagaaccgagg

SEQ ID NO: 246977 - DNA, 20 bp, Artificial
  CRISPR gRNA sequence
ttctagaaccgaggtgtgct

SEQ ID NO: 246978 - DNA, 20 bp, Artificial
  CRISPR gRNA sequence
tctagaaccgaggtgtgctc

SEQ ID NO: 246979 - DNA, 20 bp, Artificial
  CRISPR gRNA sequence
ctagaaccgaggtgtgctct

SEQ ID NO: 246980 - DNA, 20 bp, Artificial
  CRISPR gRNA sequence
tagaaccgaggtgtgctctt

SEQ ID NO: 246981 - DNA, 20 bp, Artificial
  CRISPR gRNA sequence
gaaccgaggtgtgctcttct

SEQ ID NO: 246982 - DNA, 20 bp, Artificial
  CRISPR gRNA sequence
ttctatatgcaagctttctc

SEQ ID NO: 246983 - DNA, 20 bp, Artificial
  CRISPR gRNA sequence
ctatatgcaagctttctcca

SEQ ID NO: 246984 - DNA, 20 bp, Artificial
  CRISPR gRNA sequence
tatatgcaagctttctccac

SEQ ID NO: 246985 - DNA, 20 bp, Artificial
  CRISPR gRNA sequence
tatgcaagctttctccacct

SEQ ID NO: 246986 - DNA, 20 bp, Artificial
  CRISPR gRNA sequence
tctccacctcagcactattg

SEQ ID NO: 246987 - DNA, 20 bp, Artificial
  CRISPR gRNA sequence
ctccacctcagcactattga

SEQ ID NO: 246988 - DNA, 20 bp, Artificial
  CRISPR gRNA sequence
tccacctcagcactattgac

SEQ ID NO: 246989 - DNA, 20 bp, Artificial
  CRISPR gRNA sequence
cacctcagcactattgacat

SEQ ID NO: 246990 - DNA, 20 bp, Artificial
  CRISPR gRNA sequence
agcactattgacatttgggg

SEQ ID NO: 246991 - DNA, 20 bp, Artificial
  CRISPR gRNA sequence
ttgacatttggggcagcatc

SEQ ID NO: 246992 - DNA, 20 bp, Artificial
  CRISPR gRNA sequence
acatttggggcagcatcatt

SEQ ID NO: 246993 - DNA, 20 bp, Artificial
  CRISPR gRNA sequence
ggggcagcatcattctttgc

SEQ ID NO: 246994 - DNA, 20 bp, Artificial
  CRISPR gRNA sequence
gggcagcatcattctttgct

SEQ ID NO: 246995 - DNA, 20 bp, Artificial
  CRISPR gRNA sequence
tttgctgggaggctgtcccg

SEQ ID NO: 246996 - DNA, 20 bp, Artificial
  CRISPR gRNA sequence
tgctgggaggctgtcccgtg

SEQ ID NO: 246997 - DNA, 20 bp, Artificial
  CRISPR gRNA sequence
gctgggaggctgtcccgtgc

SEQ ID NO: 246998 - DNA, 20 bp, Artificial
  CRISPR gRNA sequence
ctgggaggctgtcccgtgca

SEQ ID NO: 246999 - DNA, 20 bp, Artificial
  CRISPR gRNA sequence
ggaggctgtcccgtgcacgg

SEQ ID NO: 247000 - DNA, 20 bp, Artificial
  CRISPR gRNA sequence
tcccgtgcacggtaggagtt

SEQ ID NO: 247001 - DNA, 20 bp, Artificial
  CRISPR gRNA sequence
agcagcattgctgacctcta

SEQ ID NO: 247002 - DNA, 20 bp, Artificial
  CRISPR gRNA sequence
ctgacctctactcactagat

SEQ ID NO: 247003 - DNA, 20 bp, Artificial
  CRISPR gRNA sequence
acctctactcactagatgca

SEQ ID NO: 247004 - DNA, 20 bp, Artificial
  CRISPR gRNA sequence
tactcactagatgcaatagc

SEQ ID NO: 247005 - DNA, 20 bp, Artificial
  CRISPR gRNA sequence
ctcactagatgcaatagccc

SEQ ID NO: 247006 - DNA, 20 bp, Artificial
  CRISPR gRNA sequence
actagatgcaatagccccta

SEQ ID NO: 247007 - DNA, 20 bp, Artificial
  CRISPR gRNA sequence
gatgcaatagcccctaatca

SEQ ID NO: 247008 - DNA, 20 bp, Artificial
  CRISPR gRNA sequence
atcaccaccatcaccaccga

SEQ ID NO: 247009 - DNA, 20 bp, Artificial
  CRISPR gRNA sequence
caactgtctccagacactgc

SEQ ID NO: 247010 - DNA, 20 bp, Artificial
  CRISPR gRNA sequence
tctccagacactgcaaatat

SEQ ID NO: 247011 - DNA, 20 bp, Artificial
  CRISPR gRNA sequence
cagacactgcaaatattccc

SEQ ID NO: 247012 - DNA, 20 bp, Artificial
  CRISPR gRNA sequence
caaatattcccagggacgaa

SEQ ID NO: 247013 - DNA, 20 bp, Artificial
  CRISPR gRNA sequence
ccagggacgaaattgcccct

SEQ ID NO: 247014 - DNA, 20 bp, Artificial
  CRISPR gRNA sequence
cccctgcgtgatagccacgg

SEQ ID NO: 247015 - DNA, 20 bp, Artificial
  CRISPR gRNA sequence
cgtgatagccacggggctat

SEQ ID NO: 247016 - DNA, 20 bp, Artificial
  CRISPR gRNA sequence
tatgaacctcatttctagaa

SEQ ID NO: 247017 - DNA, 20 bp, Artificial
  CRISPR gRNA sequence
atttctagaattttttttaa

SEQ ID NO: 247018 - DNA, 20 bp, Artificial
  CRISPR gRNA sequence
ctagaattttttttaaaatc

SEQ ID NO: 247019 - DNA, 20 bp, Artificial
  CRISPR gRNA sequence
tagaattttttttaaaatca

SEQ ID NO: 247020 - DNA, 20 bp, Artificial
  CRISPR gRNA sequence
gaattttttttaaaatcata

SEQ ID NO: 247021 - DNA, 20 bp, Artificial
  CRISPR gRNA sequence
tttttaaaatcatattttcc

SEQ ID NO: 247022 - DNA, 20 bp, Artificial
  CRISPR gRNA sequence
ttttaaaatcatattttcct

SEQ ID NO: 247023 - DNA, 20 bp, Artificial
  CRISPR gRNA sequence
tttaaaatcatattttcctt

SEQ ID NO: 247024 - DNA, 20 bp, Artificial
  CRISPR gRNA sequence
ttaaaatcatattttccttt

SEQ ID NO: 247025 - DNA, 20 bp, Artificial
  CRISPR gRNA sequence
taaaatcatattttcctttc

SEQ ID NO: 247026 - DNA, 20 bp, Artificial
  CRISPR gRNA sequence
aaaatcatattttcctttct

SEQ ID NO: 247027 - DNA, 20 bp, Artificial
  CRISPR gRNA sequence
aaatcatattttcctttcta

SEQ ID NO: 247028 - DNA, 20 bp, Artificial
  CRISPR gRNA sequence
tcctttctattataaaaagc

SEQ ID NO: 247029 - DNA, 20 bp, Artificial
  CRISPR gRNA sequence
cctttctattataaaaagcc

SEQ ID NO: 247030 - DNA, 20 bp, Artificial
  CRISPR gRNA sequence
ctttctattataaaaagcct

SEQ ID NO: 247031 - DNA, 20 bp, Artificial
  CRISPR gRNA sequence
tctattataaaaagccttgc

SEQ ID NO: 247032 - DNA, 20 bp, Artificial
  CRISPR gRNA sequence
ctattataaaaagccttgcc

SEQ ID NO: 247033 - DNA, 20 bp, Artificial
  CRISPR gRNA sequence
tattataaaaagccttgcct

SEQ ID NO: 247034 - DNA, 20 bp, Artificial
  CRISPR gRNA sequence
ttataaaaagccttgccttg

SEQ ID NO: 247035 - DNA, 20 bp, Artificial
  CRISPR gRNA sequence
taaaaagccttgccttgcca

SEQ ID NO: 247036 - DNA, 20 bp, Artificial
  CRISPR gRNA sequence
gccttgccagagctgtaata

SEQ ID NO: 247037 - DNA, 20 bp, Artificial
  CRISPR gRNA sequence
ccttgccagagctgtaatat

SEQ ID NO: 247038 - DNA, 20 bp, Artificial
  CRISPR gRNA sequence
gccagagctgtaatatgatt

SEQ ID NO: 247039 - DNA, 20 bp, Artificial
  CRISPR gRNA sequence
ccagagctgtaatatgatta

SEQ ID NO: 247040 - DNA, 20 bp, Artificial
  CRISPR gRNA sequence
taatatgattatgttaatct

SEQ ID NO: 247041 - DNA, 20 bp, Artificial
  CRISPR gRNA sequence
tgttaatcttacgttgtttg

SEQ ID NO: 247042 - DNA, 20 bp, Artificial
  CRISPR gRNA sequence
atcttacgttgtttgaatat

SEQ ID NO: 247043 - DNA, 20 bp, Artificial
  CRISPR gRNA sequence
acgttgtttgaatatataca

SEQ ID NO: 247044 - DNA, 20 bp, Artificial
  CRISPR gRNA sequence
cgttgtttgaatatatacag

SEQ ID NO: 247045 - DNA, 20 bp, Artificial
  CRISPR gRNA sequence
tttgaatatatacaggagtt

SEQ ID NO: 247046 - DNA, 20 bp, Artificial
  CRISPR gRNA sequence
gaatatatacaggagtttct

SEQ ID NO: 247047 - DNA, 20 bp, Artificial
  CRISPR gRNA sequence
aatatatacaggagtttctt

SEQ ID NO: 247048 - DNA, 20 bp, Artificial
  CRISPR gRNA sequence
ctttctgccccgtttaacaa

SEQ ID NO: 247049 - DNA, 20 bp, Artificial
  CRISPR gRNA sequence
tttctgccccgtttaacaac

SEQ ID NO: 247050 - DNA, 20 bp, Artificial
  CRISPR gRNA sequence
tctgccccgtttaacaacag

SEQ ID NO: 247051 - DNA, 20 bp, Artificial
  CRISPR gRNA sequence
ctgccccgtttaacaacaga

SEQ ID NO: 247052 - DNA, 20 bp, Artificial
  CRISPR gRNA sequence
tgccccgtttaacaacagag

SEQ ID NO: 247053 - DNA, 20 bp, Artificial
  CRISPR gRNA sequence
ccccgtttaacaacagagaa

SEQ ID NO: 247054 - DNA, 20 bp, Artificial
  CRISPR gRNA sequence
aacaacagagaaacggagcg

SEQ ID NO: 247055 - DNA, 20 bp, Artificial
  CRISPR gRNA sequence
acaacagagaaacggagcgt

SEQ ID NO: 247056 - DNA, 20 bp, Artificial
  CRISPR gRNA sequence
cggagagtgtcctgcaaaac

SEQ ID NO: 247057 - DNA, 20 bp, Artificial
  CRISPR gRNA sequence
caaaacacagcaaaaggaga

SEQ ID NO: 247058 - DNA, 20 bp, Artificial
  CRISPR gRNA sequence
acactcatacacccatgtat

SEQ ID NO: 247059 - DNA, 20 bp, Artificial
  CRISPR gRNA sequence
atacacccatgtatatattt

SEQ ID NO: 247060 - DNA, 20 bp, Artificial
  CRISPR gRNA sequence
acattggtaaatttctaagc

SEQ ID NO: 247061 - DNA, 20 bp, Artificial
  CRISPR gRNA sequence
cattggtaaatttctaagca

SEQ ID NO: 247062 - DNA, 20 bp, Artificial
  CRISPR gRNA sequence
gtaaatttctaagcatgaga

SEQ ID NO: 247063 - DNA, 20 bp, Artificial
  CRISPR gRNA sequence
ctaagcatgagaagaatcac

SEQ ID NO: 247064 - DNA, 20 bp, Artificial
  CRISPR gRNA sequence
taagcatgagaagaatcaca

SEQ ID NO: 247065 - DNA, 20 bp, Artificial
  CRISPR gRNA sequence
agcatgagaagaatcacagc

SEQ ID NO: 247066 - DNA, 20 bp, Artificial
  CRISPR gRNA sequence
gggcatctccaacctgctaa

SEQ ID NO: 247067 - DNA, 20 bp, Artificial
  CRISPR gRNA sequence
ggcatctccaacctgctaat

SEQ ID NO: 247068 - DNA, 20 bp, Artificial
  CRISPR gRNA sequence
caacctgctaatggagtaaa

SEQ ID NO: 247069 - DNA, 20 bp, Artificial
  CRISPR gRNA sequence
ctaatggagtaaacttagaa

SEQ ID NO: 247070 - DNA, 20 bp, Artificial
  CRISPR gRNA sequence
atggagtaaacttagaaaac

SEQ ID NO: 247071 - DNA, 20 bp, Artificial
  CRISPR gRNA sequence
agaaaacttttaaagaggcc

SEQ ID NO: 247072 - DNA, 20 bp, Artificial
  CRISPR gRNA sequence
gaaaacttttaaagaggcca

SEQ ID NO: 247073 - DNA, 20 bp, Artificial
  CRISPR gRNA sequence
ttaaagaggccagacatggt

SEQ ID NO: 247074 - DNA, 20 bp, Artificial
  CRISPR gRNA sequence
taaagaggccagacatggtg

SEQ ID NO: 247075 - DNA, 20 bp, Artificial
  CRISPR gRNA sequence
aaagaggccagacatggtgg

SEQ ID NO: 247076 - DNA, 20 bp, Artificial
  CRISPR gRNA sequence
aagaggccagacatggtggc

SEQ ID NO: 247077 - DNA, 20 bp, Artificial
  CRISPR gRNA sequence
acgcctgtaatcccaacact

SEQ ID NO: 247078 - DNA, 20 bp, Artificial
  CRISPR gRNA sequence
taatcccaacactttggaag

SEQ ID NO: 247079 - DNA, 20 bp, Artificial
  CRISPR gRNA sequence
tggaaggccgaggcaggagg

SEQ ID NO: 247080 - DNA, 20 bp, Artificial
  CRISPR gRNA sequence
ggaaggccgaggcaggagga

SEQ ID NO: 247081 - DNA, 20 bp, Artificial
  CRISPR gRNA sequence
gaaggccgaggcaggaggat

SEQ ID NO: 247082 - DNA, 20 bp, Artificial
  CRISPR gRNA sequence
agagtcaggagttcaagacc

SEQ ID NO: 247083 - DNA, 20 bp, Artificial
  CRISPR gRNA sequence
gagtcaggagttcaagacca

SEQ ID NO: 247084 - DNA, 20 bp, Artificial
  CRISPR gRNA sequence
aagaccagcctggccaacat

SEQ ID NO: 247085 - DNA, 20 bp, Artificial
  CRISPR gRNA sequence
gccaacatagtggtggcagg

SEQ ID NO: 247086 - DNA, 20 bp, Artificial
  CRISPR gRNA sequence
gtaatcccagctacttggca

SEQ ID NO: 247087 - DNA, 20 bp, Artificial
  CRISPR gRNA sequence
taatcccagctacttggcag

SEQ ID NO: 247088 - DNA, 20 bp, Artificial
  CRISPR gRNA sequence
cttggcaggatgaggcagga

SEQ ID NO: 247089 - DNA, 20 bp, Artificial
  CRISPR gRNA sequence
ggcaggatgaggcaggagaa

SEQ ID NO: 247090 - DNA, 20 bp, Artificial
  CRISPR gRNA sequence
gcaggatgaggcaggagaat

SEQ ID NO: 247091 - DNA, 20 bp, Artificial
  CRISPR gRNA sequence
gaacccgggaggcggaggtt

SEQ ID NO: 247092 - DNA, 20 bp, Artificial
  CRISPR gRNA sequence
aacccgggaggcggaggttg

SEQ ID NO: 247093 - DNA, 20 bp, Artificial
  CRISPR gRNA sequence
cagtgagctaagatggtgcc

SEQ ID NO: 247094 - DNA, 20 bp, Artificial
  CRISPR gRNA sequence
agatggtgccactgcactcc

SEQ ID NO: 247095 - DNA, 20 bp, Artificial
  CRISPR gRNA sequence
cactccaacctgggcaacag

SEQ ID NO: 247096 - DNA, 20 bp, Artificial
  CRISPR gRNA sequence
caacctgggcaacagagtga

SEQ ID NO: 247097 - DNA, 20 bp, Artificial
  CRISPR gRNA sequence
ggcaacagagtgagactcca

SEQ ID NO: 247098 - DNA, 20 bp, Artificial
  CRISPR gRNA sequence
catctcaaaaaaaagaaaag

SEQ ID NO: 247099 - DNA, 20 bp, Artificial
  CRISPR gRNA sequence
aaaaaaaagaaaagaaagaa

SEQ ID NO: 247100 - DNA, 20 bp, Artificial
  CRISPR gRNA sequence
aatggcagggagcggtggct

SEQ ID NO: 247101 - DNA, 20 bp, Artificial
  CRISPR gRNA sequence
atggcagggagcggtggctc

SEQ ID NO: 247102 - DNA, 20 bp, Artificial
  CRISPR gRNA sequence
acacctgtaatcctagcact

SEQ ID NO: 247103 - DNA, 20 bp, Artificial
  CRISPR gRNA sequence
taatcctagcactttgggag

SEQ ID NO: 247104 - DNA, 20 bp, Artificial
  CRISPR gRNA sequence
gcactttgggaggccaaggt

SEQ ID NO: 247105 - DNA, 20 bp, Artificial
  CRISPR gRNA sequence
tgggaggccaaggtgggcag

SEQ ID NO: 247106 - DNA, 20 bp, Artificial
  CRISPR gRNA sequence
gggaggccaaggtgggcaga

SEQ ID NO: 247107 - DNA, 20 bp, Artificial
  CRISPR gRNA sequence
ggaggccaaggtgggcagat

SEQ ID NO: 247108 - DNA, 20 bp, Artificial
  CRISPR gRNA sequence
aggtcaagagtttgaaacca

SEQ ID NO: 247109 - DNA, 20 bp, Artificial
  CRISPR gRNA sequence
gaaaccagcctggccaacat

SEQ ID NO: 247110 - DNA, 20 bp, Artificial
  CRISPR gRNA sequence
aaaccagcctggccaacatg

SEQ ID NO: 247111 - DNA, 20 bp, Artificial
  CRISPR gRNA sequence
gccaacatggagaaactcca

SEQ ID NO: 247112 - DNA, 20 bp, Artificial
  CRISPR gRNA sequence
catctctactaaaaatacaa

SEQ ID NO: 247113 - DNA, 20 bp, Artificial
  CRISPR gRNA sequence
tactaaaaatacaaaaatta

SEQ ID NO: 247114 - DNA, 20 bp, Artificial
  CRISPR gRNA sequence
ctaaaaatacaaaaattagc

SEQ ID NO: 247115 - DNA, 20 bp, Artificial
  CRISPR gRNA sequence
aaaatacaaaaattagctgg

SEQ ID NO: 247116 - DNA, 20 bp, Artificial
  CRISPR gRNA sequence
gctgggtgccgtggtgggcg

SEQ ID NO: 247117 - DNA, 20 bp, Artificial
  CRISPR gRNA sequence
ggtgccgtggtgggcgcctg

SEQ ID NO: 247118 - DNA, 20 bp, Artificial
  CRISPR gRNA sequence
taatcccagctactcaggag

SEQ ID NO: 247119 - DNA, 20 bp, Artificial
  CRISPR gRNA sequence
ctcaggaggctgagtcagga

SEQ ID NO: 247120 - DNA, 20 bp, Artificial
  CRISPR gRNA sequence
aggaggctgagtcaggagaa

SEQ ID NO: 247121 - DNA, 20 bp, Artificial
  CRISPR gRNA sequence
agtcaggagaatcgcttgaa

SEQ ID NO: 247122 - DNA, 20 bp, Artificial
  CRISPR gRNA sequence
gaacctgggaggtagaggtt

SEQ ID NO: 247123 - DNA, 20 bp, Artificial
  CRISPR gRNA sequence
aacctgggaggtagaggttg

SEQ ID NO: 247124 - DNA, 20 bp, Artificial
  CRISPR gRNA sequence
ggaggtagaggttgcagtga

SEQ ID NO: 247125 - DNA, 20 bp, Artificial
  CRISPR gRNA sequence
cagtgagccgagattgcgcc

SEQ ID NO: 247126 - DNA, 20 bp, Artificial
  CRISPR gRNA sequence
cgccattgcactccagcctg

SEQ ID NO: 247127 - DNA, 20 bp, Artificial
  CRISPR gRNA sequence
cactccagcctgggtgacag

SEQ ID NO: 247128 - DNA, 20 bp, Artificial
  CRISPR gRNA sequence
cagcctgggtgacagagaga

SEQ ID NO: 247129 - DNA, 20 bp, Artificial
  CRISPR gRNA sequence
ggtgacagagagagactctg

SEQ ID NO: 247130 - DNA, 20 bp, Artificial
  CRISPR gRNA sequence
tgtccacccccccaaaaaaa

SEQ ID NO: 247131 - DNA, 20 bp, Artificial
  CRISPR gRNA sequence
tccacccccccaaaaaaata

SEQ ID NO: 247132 - DNA, 20 bp, Artificial
  CRISPR gRNA sequence
aataattgagcagtttatcc

SEQ ID NO: 247133 - DNA, 20 bp, Artificial
  CRISPR gRNA sequence
ataattgagcagtttatcct

SEQ ID NO: 247134 - DNA, 20 bp, Artificial
  CRISPR gRNA sequence
agcagtttatcctttctagc

SEQ ID NO: 247135 - DNA, 20 bp, Artificial
  CRISPR gRNA sequence
atcctttctagcacatagaa

SEQ ID NO: 247136 - DNA, 20 bp, Artificial
  CRISPR gRNA sequence
tcctttctagcacatagaaa

SEQ ID NO: 247137 - DNA, 20 bp, Artificial
  CRISPR gRNA sequence
tctagcacatagaaaatatg

SEQ ID NO: 247138 - DNA, 20 bp, Artificial
  CRISPR gRNA sequence
ctagcacatagaaaatatgg

SEQ ID NO: 247139 - DNA, 20 bp, Artificial
  CRISPR gRNA sequence
tagcacatagaaaatatggg

SEQ ID NO: 247140 - DNA, 20 bp, Artificial
  CRISPR gRNA sequence
gcacatagaaaatatgggac

SEQ ID NO: 247141 - DNA, 20 bp, Artificial
  CRISPR gRNA sequence
gggaccaggcgtggcggctt

SEQ ID NO: 247142 - DNA, 20 bp, Artificial
  CRISPR gRNA sequence
atgcctgtaatcccaacact

SEQ ID NO: 247143 - DNA, 20 bp, Artificial
  CRISPR gRNA sequence
tgcctgtaatcccaacactt

SEQ ID NO: 247144 - DNA, 20 bp, Artificial
  CRISPR gRNA sequence
taatcccaacactttgggag

SEQ ID NO: 247145 - DNA, 20 bp, Artificial
  CRISPR gRNA sequence
tgggagcccaaggcaggagg

SEQ ID NO: 247146 - DNA, 20 bp, Artificial
  CRISPR gRNA sequence
gggagcccaaggcaggagga

SEQ ID NO: 247147 - DNA, 20 bp, Artificial
  CRISPR gRNA sequence
ggagcccaaggcaggaggat

SEQ ID NO: 247148 - DNA, 20 bp, Artificial
  CRISPR gRNA sequence
cttgagcccaagagtttgag

SEQ ID NO: 247149 - DNA, 20 bp, Artificial
  CRISPR gRNA sequence
gagcccaagagtttgagagc

SEQ ID NO: 247150 - DNA, 20 bp, Artificial
  CRISPR gRNA sequence
agcccaagagtttgagagca

SEQ ID NO: 247151 - DNA, 20 bp, Artificial
  CRISPR gRNA sequence
gagagcagcctgagcaacat

SEQ ID NO: 247152 - DNA, 20 bp, Artificial
  CRISPR gRNA sequence
agagcagcctgagcaacata

SEQ ID NO: 247153 - DNA, 20 bp, Artificial
  CRISPR gRNA sequence
agcaacatagcaagaccccg

SEQ ID NO: 247154 - DNA, 20 bp, Artificial
  CRISPR gRNA sequence
tgccaaaaaaataaaaaatt

SEQ ID NO: 247155 - DNA, 20 bp, Artificial
  CRISPR gRNA sequence
ccaaaaaaataaaaaattag

SEQ ID NO: 247156 - DNA, 20 bp, Artificial
  CRISPR gRNA sequence
gccaggtgtagtggtgagtg

SEQ ID NO: 247157 - DNA, 20 bp, Artificial
  CRISPR gRNA sequence
tagtcccagctactggggag

SEQ ID NO: 247158 - DNA, 20 bp, Artificial
  CRISPR gRNA sequence
ctggggaggctgaggtggga

SEQ ID NO: 247159 - DNA, 20 bp, Artificial
  CRISPR gRNA sequence
gggaggctgaggtgggagga

SEQ ID NO: 247160 - DNA, 20 bp, Artificial
  CRISPR gRNA sequence
aggtgggaggattggttgag

SEQ ID NO: 247161 - DNA, 20 bp, Artificial
  CRISPR gRNA sequence
gttgagcacaggaggtggag

SEQ ID NO: 247162 - DNA, 20 bp, Artificial
  CRISPR gRNA sequence
agcacaggaggtggaggttg

SEQ ID NO: 247163 - DNA, 20 bp, Artificial
  CRISPR gRNA sequence
cagtgagccaatatcaagcc

SEQ ID NO: 247164 - DNA, 20 bp, Artificial
  CRISPR gRNA sequence
cactccagcctggcacagaa

SEQ ID NO: 247165 - DNA, 20 bp, Artificial
  CRISPR gRNA sequence
cagcctggcacagaacaagg

SEQ ID NO: 247166 - DNA, 20 bp, Artificial
  CRISPR gRNA sequence
gcacagaacaaggcactctc

SEQ ID NO: 247167 - DNA, 20 bp, Artificial
  CRISPR gRNA sequence
tcgggggaaaaaaaaagcga

SEQ ID NO: 247168 - DNA, 20 bp, Artificial
  CRISPR gRNA sequence
gggggaaaaaaaaagcgaga

SEQ ID NO: 247169 - DNA, 20 bp, Artificial
  CRISPR gRNA sequence
gacgggcgtggtggctcaca

SEQ ID NO: 247170 - DNA, 20 bp, Artificial
  CRISPR gRNA sequence
acacctgtaatcccagcact

SEQ ID NO: 247171 - DNA, 20 bp, Artificial
  CRISPR gRNA sequence
taatcccagcactttgggag

SEQ ID NO: 247172 - DNA, 20 bp, Artificial
  CRISPR gRNA sequence
tgggaggccgaggtgggcgg

SEQ ID NO: 247173 - DNA, 20 bp, Artificial
  CRISPR gRNA sequence
gggaggccgaggtgggcgga

SEQ ID NO: 247174 - DNA, 20 bp, Artificial
  CRISPR gRNA sequence
ggaggccgaggtgggcggat

SEQ ID NO: 247175 - DNA, 20 bp, Artificial
  CRISPR gRNA sequence
aagaccagactggccagcat

SEQ ID NO: 247176 - DNA, 20 bp, Artificial
  CRISPR gRNA sequence
gccagcatggtgaaacctca

SEQ ID NO: 247177 - DNA, 20 bp, Artificial
  CRISPR gRNA sequence
atctctactaaaaatacaaa

SEQ ID NO: 247178 - DNA, 20 bp, Artificial
  CRISPR gRNA sequence
tactaaaaatacaaaaatta

SEQ ID NO: 247179 - DNA, 20 bp, Artificial
  CRISPR gRNA sequence
ctaaaaatacaaaaattagc

SEQ ID NO: 247180 - DNA, 20 bp, Artificial
  CRISPR gRNA sequence
aaaatacaaaaattagccgg

SEQ ID NO: 247181 - DNA, 20 bp, Artificial
  CRISPR gRNA sequence
gccgggcgtggtggtgcatg

SEQ ID NO: 247182 - DNA, 20 bp, Artificial
  CRISPR gRNA sequence
taatcccagctacttgggag

SEQ ID NO: 247183 - DNA, 20 bp, Artificial
  CRISPR gRNA sequence
cttgggaggctgaggcagga

SEQ ID NO: 247184 - DNA, 20 bp, Artificial
  CRISPR gRNA sequence
gggaggctgaggcaggagaa

SEQ ID NO: 247185 - DNA, 20 bp, Artificial
  CRISPR gRNA sequence
ggaggctgaggcaggagaat

SEQ ID NO: 247186 - DNA, 20 bp, Artificial
  CRISPR gRNA sequence
aggcaggagaatcacttgaa

SEQ ID NO: 247187 - DNA, 20 bp, Artificial
  CRISPR gRNA sequence
gaacccaggaggtggagatt

SEQ ID NO: 247188 - DNA, 20 bp, Artificial
  CRISPR gRNA sequence
aacccaggaggtggagattg

SEQ ID NO: 247189 - DNA, 20 bp, Artificial
  CRISPR gRNA sequence
cagtgagctgagactgcacc

SEQ ID NO: 247190 - DNA, 20 bp, Artificial
  CRISPR gRNA sequence
agactgcaccactgcactcc

SEQ ID NO: 247191 - DNA, 20 bp, Artificial
  CRISPR gRNA sequence
caccactgcactccagcctg

SEQ ID NO: 247192 - DNA, 20 bp, Artificial
  CRISPR gRNA sequence
cactccagcctggcacagag

SEQ ID NO: 247193 - DNA, 20 bp, Artificial
  CRISPR gRNA sequence
cagcctggcacagagcaaga

SEQ ID NO: 247194 - DNA, 20 bp, Artificial
  CRISPR gRNA sequence
gcacagagcaagacactctc

SEQ ID NO: 247195 - DNA, 20 bp, Artificial
  CRISPR gRNA sequence
tcttaaaaacaaaaaaaaag

SEQ ID NO: 247196 - DNA, 20 bp, Artificial
  CRISPR gRNA sequence
ttaaaaacaaaaaaaaagaa

SEQ ID NO: 247197 - DNA, 20 bp, Artificial
  CRISPR gRNA sequence
aaaaacaaaaaaaaagaaaa

SEQ ID NO: 247198 - DNA, 20 bp, Artificial
  CRISPR gRNA sequence
aaaacaaaaaaaaagaaaag

SEQ ID NO: 247199 - DNA, 20 bp, Artificial
  CRISPR gRNA sequence
taatcccctttccttggcat

SEQ ID NO: 247200 - DNA, 20 bp, Artificial
  CRISPR gRNA sequence
tccttggcattgataaagat

SEQ ID NO: 247201 - DNA, 20 bp, Artificial
  CRISPR gRNA sequence
ccttggcattgataaagata

SEQ ID NO: 247202 - DNA, 20 bp, Artificial
  CRISPR gRNA sequence
cttggcattgataaagatat

SEQ ID NO: 247203 - DNA, 20 bp, Artificial
  CRISPR gRNA sequence
ggcattgataaagatataga

SEQ ID NO: 247204 - DNA, 20 bp, Artificial
  CRISPR gRNA sequence
gcattgataaagatatagac

SEQ ID NO: 247205 - DNA, 20 bp, Artificial
  CRISPR gRNA sequence
ataaagatatagactctgtt

SEQ ID NO: 247206 - DNA, 20 bp, Artificial
  CRISPR gRNA sequence
tgtttgggtgaagtgtcctc

SEQ ID NO: 247207 - DNA, 20 bp, Artificial
  CRISPR gRNA sequence
tttgggtgaagtgtcctctg

SEQ ID NO: 247208 - DNA, 20 bp, Artificial
  CRISPR gRNA sequence
gggtgaagtgtcctctggca

SEQ ID NO: 247209 - DNA, 20 bp, Artificial
  CRISPR gRNA sequence
ggtgaagtgtcctctggcac

SEQ ID NO: 247210 - DNA, 20 bp, Artificial
  CRISPR gRNA sequence
tggcaccgcttacaaatgtg

SEQ ID NO: 247211 - DNA, 20 bp, Artificial
  CRISPR gRNA sequence
gcaccgcttacaaatgtgta

SEQ ID NO: 247212 - DNA, 20 bp, Artificial
  CRISPR gRNA sequence
acaaatgtgtatctcagact

SEQ ID NO: 247213 - DNA, 20 bp, Artificial
  CRISPR gRNA sequence
caaatgtgtatctcagactg

SEQ ID NO: 247214 - DNA, 20 bp, Artificial
  CRISPR gRNA sequence
agactgaataacaaatgcct

SEQ ID NO: 247215 - DNA, 20 bp, Artificial
  CRISPR gRNA sequence
aataacaaatgcctgggaag

SEQ ID NO: 247216 - DNA, 20 bp, Artificial
  CRISPR gRNA sequence
ggaagaaaactgctgggtcc

SEQ ID NO: 247217 - DNA, 20 bp, Artificial
  CRISPR gRNA sequence
ctgggtccctgagggcagga

SEQ ID NO: 247218 - DNA, 20 bp, Artificial
  CRISPR gRNA sequence
ggtccctgagggcaggattc

SEQ ID NO: 247219 - DNA, 20 bp, Artificial
  CRISPR gRNA sequence
agggcaggattcaggaagaa

SEQ ID NO: 247220 - DNA, 20 bp, Artificial
  CRISPR gRNA sequence
aggaagaatgcacgtgggag

SEQ ID NO: 247221 - DNA, 20 bp, Artificial
  CRISPR gRNA sequence
atatgagatatcatgatatt

SEQ ID NO: 247222 - DNA, 20 bp, Artificial
  CRISPR gRNA sequence
gggcaatttagatacaatct

SEQ ID NO: 247223 - DNA, 20 bp, Artificial
  CRISPR gRNA sequence
agatacaatctggaatcacc

SEQ ID NO: 247224 - DNA, 20 bp, Artificial
  CRISPR gRNA sequence
gatacaatctggaatcacca

SEQ ID NO: 247225 - DNA, 20 bp, Artificial
  CRISPR gRNA sequence
gaatcaccataagatacgca

SEQ ID NO: 247226 - DNA, 20 bp, Artificial
  CRISPR gRNA sequence
tggcgtaaaggcatagccca

SEQ ID NO: 247227 - DNA, 20 bp, Artificial
  CRISPR gRNA sequence
ggcgtaaaggcatagcccag

SEQ ID NO: 247228 - DNA, 20 bp, Artificial
  CRISPR gRNA sequence
gcgtaaaggcatagcccagt

SEQ ID NO: 247229 - DNA, 20 bp, Artificial
  CRISPR gRNA sequence
cctggctctctcgcaggggc

SEQ ID NO: 247230 - DNA, 20 bp, Artificial
  CRISPR gRNA sequence
gctctctcgcaggggcaggc

SEQ ID NO: 247231 - DNA, 20 bp, Artificial
  CRISPR gRNA sequence
tctcgcaggggcaggcgggg

SEQ ID NO: 247232 - DNA, 20 bp, Artificial
  CRISPR gRNA sequence
tcgcaggggcaggcggggtc

SEQ ID NO: 247233 - DNA, 20 bp, Artificial
  CRISPR gRNA sequence
gcaggggcaggcggggtcac

SEQ ID NO: 247234 - DNA, 20 bp, Artificial
  CRISPR gRNA sequence
ccggagagaggtcggctgga

SEQ ID NO: 247235 - DNA, 20 bp, Artificial
  CRISPR gRNA sequence
gagatggtccacagaccacg

SEQ ID NO: 247236 - DNA, 20 bp, Artificial
  CRISPR gRNA sequence
tccttcgtcccattcacaag

SEQ ID NO: 247237 - DNA, 20 bp, Artificial
  CRISPR gRNA sequence
cttcgtcccattcacaagca

SEQ ID NO: 247238 - DNA, 20 bp, Artificial
  CRISPR gRNA sequence
cgtcccattcacaagcacag

SEQ ID NO: 247239 - DNA, 20 bp, Artificial
  CRISPR gRNA sequence
gtcccattcacaagcacaga

SEQ ID NO: 247240 - DNA, 20 bp, Artificial
  CRISPR gRNA sequence
acaagcacagactttccatc

SEQ ID NO: 247241 - DNA, 20 bp, Artificial
  CRISPR gRNA sequence
tccatccaaagaacagctta

SEQ ID NO: 247242 - DNA, 20 bp, Artificial
  CRISPR gRNA sequence
ccatccaaagaacagcttag

SEQ ID NO: 247243 - DNA, 20 bp, Artificial
  CRISPR gRNA sequence
catccaaagaacagcttaga

SEQ ID NO: 247244 - DNA, 20 bp, Artificial
  CRISPR gRNA sequence
agacagttcaatgaaaataa

SEQ ID NO: 247245 - DNA, 20 bp, Artificial
  CRISPR gRNA sequence
gacagttcaatgaaaataat

SEQ ID NO: 247246 - DNA, 20 bp, Artificial
  CRISPR gRNA sequence
aatgaaaataatttaaataa

SEQ ID NO: 247247 - DNA, 20 bp, Artificial
  CRISPR gRNA sequence
aaataattaacttaggtcca

SEQ ID NO: 247248 - DNA, 20 bp, Artificial
  CRISPR gRNA sequence
aataattaacttaggtccag

SEQ ID NO: 247249 - DNA, 20 bp, Artificial
  CRISPR gRNA sequence
acttaggtccagaagattct

SEQ ID NO: 247250 - DNA, 20 bp, Artificial
  CRISPR gRNA sequence
aggtccagaagattctggtt

SEQ ID NO: 247251 - DNA, 20 bp, Artificial
  CRISPR gRNA sequence
ggtccagaagattctggttt

SEQ ID NO: 247252 - DNA, 20 bp, Artificial
  CRISPR gRNA sequence
tggtttaaaactttgtcatt

SEQ ID NO: 247253 - DNA, 20 bp, Artificial
  CRISPR gRNA sequence
gtttaaaactttgtcatttt

SEQ ID NO: 247254 - DNA, 20 bp, Artificial
  CRISPR gRNA sequence
aaaactttgtcatttttcac

SEQ ID NO: 247255 - DNA, 20 bp, Artificial
  CRISPR gRNA sequence
aaactttgtcatttttcacc

SEQ ID NO: 247256 - DNA, 20 bp, Artificial
  CRISPR gRNA sequence
tgtcatttttcacccaatga

SEQ ID NO: 247257 - DNA, 20 bp, Artificial
  CRISPR gRNA sequence
gtcatttttcacccaatgaa

SEQ ID NO: 247258 - DNA, 20 bp, Artificial
  CRISPR gRNA sequence
tcatttttcacccaatgaag

SEQ ID NO: 247259 - DNA, 20 bp, Artificial
  CRISPR gRNA sequence
ttcacccaatgaagtagcct

SEQ ID NO: 247260 - DNA, 20 bp, Artificial
  CRISPR gRNA sequence
tcacccaatgaagtagccta

SEQ ID NO: 247261 - DNA, 20 bp, Artificial
  CRISPR gRNA sequence
cacccaatgaagtagcctag

SEQ ID NO: 247262 - DNA, 20 bp, Artificial
  CRISPR gRNA sequence
acccaatgaagtagcctagt

SEQ ID NO: 247263 - DNA, 20 bp, Artificial
  CRISPR gRNA sequence
gtgaaaaagatatatgggtc

SEQ ID NO: 247264 - DNA, 20 bp, Artificial
  CRISPR gRNA sequence
ggttcgaaagcgatgcaaag

SEQ ID NO: 247265 - DNA, 20 bp, Artificial
  CRISPR gRNA sequence
gaaagcgatgcaaagatatt

SEQ ID NO: 247266 - DNA, 20 bp, Artificial
  CRISPR gRNA sequence
tgaaaaacttccacttgacc

SEQ ID NO: 247267 - DNA, 20 bp, Artificial
  CRISPR gRNA sequence
gaaaaacttccacttgacca

SEQ ID NO: 247268 - DNA, 20 bp, Artificial
  CRISPR gRNA sequence
aaaaacttccacttgaccat

SEQ ID NO: 247269 - DNA, 20 bp, Artificial
  CRISPR gRNA sequence
ccacttgaccatctggctcc

SEQ ID NO: 247270 - DNA, 20 bp, Artificial
  CRISPR gRNA sequence
cacttgaccatctggctccc

SEQ ID NO: 247271 - DNA, 20 bp, Artificial
  CRISPR gRNA sequence
gaccatctggctccctgcag

SEQ ID NO: 247272 - DNA, 20 bp, Artificial
  CRISPR gRNA sequence
accatctggctccctgcagc

SEQ ID NO: 247273 - DNA, 20 bp, Artificial
  CRISPR gRNA sequence
gctccctgcagctttccatg

SEQ ID NO: 247274 - DNA, 20 bp, Artificial
  CRISPR gRNA sequence
cctgcagctttccatggctt

SEQ ID NO: 247275 - DNA, 20 bp, Artificial
  CRISPR gRNA sequence
cagctttccatggcttcctt

SEQ ID NO: 247276 - DNA, 20 bp, Artificial
  CRISPR gRNA sequence
tccatggcttccttctgttc

SEQ ID NO: 247277 - DNA, 20 bp, Artificial
  CRISPR gRNA sequence
ccatggcttccttctgttca

SEQ ID NO: 247278 - DNA, 20 bp, Artificial
  CRISPR gRNA sequence
catggcttccttctgttcag

SEQ ID NO: 247279 - DNA, 20 bp, Artificial
  CRISPR gRNA sequence
ccttctgttcagtgacagct

SEQ ID NO: 247280 - DNA, 20 bp, Artificial
  CRISPR gRNA sequence
cttctgttcagtgacagctt

SEQ ID NO: 247281 - DNA, 20 bp, Artificial
  CRISPR gRNA sequence
ctgttcagtgacagcttagt

SEQ ID NO: 247282 - DNA, 20 bp, Artificial
  CRISPR gRNA sequence
tgttcagtgacagcttagtt

SEQ ID NO: 247283 - DNA, 20 bp, Artificial
  CRISPR gRNA sequence
ttcagtgacagcttagttca

SEQ ID NO: 247284 - DNA, 20 bp, Artificial
  CRISPR gRNA sequence
agtgacagcttagttcagtc

SEQ ID NO: 247285 - DNA, 20 bp, Artificial
  CRISPR gRNA sequence
agttcagtctgtcttgcctg

SEQ ID NO: 247286 - DNA, 20 bp, Artificial
  CRISPR gRNA sequence
gttcagtctgtcttgcctgc

SEQ ID NO: 247287 - DNA, 20 bp, Artificial
  CRISPR gRNA sequence
agtctgtcttgcctgcttag

SEQ ID NO: 247288 - DNA, 20 bp, Artificial
  CRISPR gRNA sequence
tcttgcctgcttagtctctc

SEQ ID NO: 247289 - DNA, 20 bp, Artificial
  CRISPR gRNA sequence
gcctgcttagtctctcaccc

SEQ ID NO: 247290 - DNA, 20 bp, Artificial
  CRISPR gRNA sequence
cctgcttagtctctcacccc

SEQ ID NO: 247291 - DNA, 20 bp, Artificial
  CRISPR gRNA sequence
cttagtctctcacccccagt

SEQ ID NO: 247292 - DNA, 20 bp, Artificial
  CRISPR gRNA sequence
agtctctcacccccagtttc

SEQ ID NO: 247293 - DNA, 20 bp, Artificial
  CRISPR gRNA sequence
gtctctcacccccagtttct

SEQ ID NO: 247294 - DNA, 20 bp, Artificial
  CRISPR gRNA sequence
tcacccccagtttcttaatc

SEQ ID NO: 247295 - DNA, 20 bp, Artificial
  CRISPR gRNA sequence
acccccagtttcttaatcgg

SEQ ID NO: 247296 - DNA, 20 bp, Artificial
  CRISPR gRNA sequence
cttaatcggacttgaccatc

SEQ ID NO: 247297 - DNA, 20 bp, Artificial
  CRISPR gRNA sequence
ttaatcggacttgaccatct

SEQ ID NO: 247298 - DNA, 20 bp, Artificial
  CRISPR gRNA sequence
aatcggacttgaccatctcc

SEQ ID NO: 247299 - DNA, 20 bp, Artificial
  CRISPR gRNA sequence
atcggacttgaccatctccg

SEQ ID NO: 247300 - DNA, 20 bp, Artificial
  CRISPR gRNA sequence
gaccatctccggcacagatg

SEQ ID NO: 247301 - DNA, 20 bp, Artificial
  CRISPR gRNA sequence
accatctccggcacagatga

SEQ ID NO: 247302 - DNA, 20 bp, Artificial
  CRISPR gRNA sequence
cggcacagatgaaggctagc

SEQ ID NO: 247303 - DNA, 20 bp, Artificial
  CRISPR gRNA sequence
gcatagggttaggaggtcca

SEQ ID NO: 247304 - DNA, 20 bp, Artificial
  CRISPR gRNA sequence
ggaggtccagcactagcatc

SEQ ID NO: 247305 - DNA, 20 bp, Artificial
  CRISPR gRNA sequence
gcatcaggcaaaccagggtt

SEQ ID NO: 247306 - DNA, 20 bp, Artificial
  CRISPR gRNA sequence
gagccctgggtctgctgctt

SEQ ID NO: 247307 - DNA, 20 bp, Artificial
  CRISPR gRNA sequence
agccctgggtctgctgcttt

SEQ ID NO: 247308 - DNA, 20 bp, Artificial
  CRISPR gRNA sequence
ggtctgctgctttccagaat

SEQ ID NO: 247309 - DNA, 20 bp, Artificial
  CRISPR gRNA sequence
ctgctttccagaatgacttt

SEQ ID NO: 247310 - DNA, 20 bp, Artificial
  CRISPR gRNA sequence
ctttccagaatgactttggg

SEQ ID NO: 247311 - DNA, 20 bp, Artificial
  CRISPR gRNA sequence
tccagaatgactttgggcaa

SEQ ID NO: 247312 - DNA, 20 bp, Artificial
  CRISPR gRNA sequence
ccagaatgactttgggcaag

SEQ ID NO: 247313 - DNA, 20 bp, Artificial
  CRISPR gRNA sequence
cagaatgactttgggcaagt

SEQ ID NO: 247314 - DNA, 20 bp, Artificial
  CRISPR gRNA sequence
tgggcaagtcaagaaatctc

SEQ ID NO: 247315 - DNA, 20 bp, Artificial
  CRISPR gRNA sequence
gggcaagtcaagaaatctct

SEQ ID NO: 247316 - DNA, 20 bp, Artificial
  CRISPR gRNA sequence
ggcaagtcaagaaatctctg

SEQ ID NO: 247317 - DNA, 20 bp, Artificial
  CRISPR gRNA sequence
tgtaaccccagcatggtggc

SEQ ID NO: 247318 - DNA, 20 bp, Artificial
  CRISPR gRNA sequence
taaccccagcatggtggctc

SEQ ID NO: 247319 - DNA, 20 bp, Artificial
  CRISPR gRNA sequence
acgcctataatctcaacact

SEQ ID NO: 247320 - DNA, 20 bp, Artificial
  CRISPR gRNA sequence
taatctcaacactttggtag

SEQ ID NO: 247321 - DNA, 20 bp, Artificial
  CRISPR gRNA sequence
aacactttggtaggctgagg

SEQ ID NO: 247322 - DNA, 20 bp, Artificial
  CRISPR gRNA sequence
tggtaggctgaggccagagg

SEQ ID NO: 247323 - DNA, 20 bp, Artificial
  CRISPR gRNA sequence
ggtaggctgaggccagagga

SEQ ID NO: 247324 - DNA, 20 bp, Artificial
  CRISPR gRNA sequence
gtaggctgaggccagaggat

SEQ ID NO: 247325 - DNA, 20 bp, Artificial
  CRISPR gRNA sequence
aggccagaggatcacttgag

SEQ ID NO: 247326 - DNA, 20 bp, Artificial
  CRISPR gRNA sequence
gagaccaggcgttggagacc

SEQ ID NO: 247327 - DNA, 20 bp, Artificial
  CRISPR gRNA sequence
agaccaggcgttggagacca

SEQ ID NO: 247328 - DNA, 20 bp, Artificial
  CRISPR gRNA sequence
gagaccagcctgagcaacat

SEQ ID NO: 247329 - DNA, 20 bp, Artificial
  CRISPR gRNA sequence
agcaacatagcaagacccca

SEQ ID NO: 247330 - DNA, 20 bp, Artificial
  CRISPR gRNA sequence
tacaaaaattaaaagacaaa

SEQ ID NO: 247331 - DNA, 20 bp, Artificial
  CRISPR gRNA sequence
caaaaattaaaagacaaaca

SEQ ID NO: 247332 - DNA, 20 bp, Artificial
  CRISPR gRNA sequence
aaagacaaacaaaaattaac

SEQ ID NO: 247333 - DNA, 20 bp, Artificial
  CRISPR gRNA sequence
actgatggtgcatgcctgtg

SEQ ID NO: 247334 - DNA, 20 bp, Artificial
  CRISPR gRNA sequence
atggtgcatgcctgtggccc

SEQ ID NO: 247335 - DNA, 20 bp, Artificial
  CRISPR gRNA sequence
tggccccagctactcgggag

SEQ ID NO: 247336 - DNA, 20 bp, Artificial
  CRISPR gRNA sequence
ctcgggagactgaggtggga

SEQ ID NO: 247337 - DNA, 20 bp, Artificial
  CRISPR gRNA sequence
gggagactgaggtgggagga

SEQ ID NO: 247338 - DNA, 20 bp, Artificial
  CRISPR gRNA sequence
aggtgggaggatcacttgaa

SEQ ID NO: 247339 - DNA, 20 bp, Artificial
  CRISPR gRNA sequence
gaacccaggagtttgaggct

SEQ ID NO: 247340 - DNA, 20 bp, Artificial
  CRISPR gRNA sequence
aacccaggagtttgaggctg

SEQ ID NO: 247341 - DNA, 20 bp, Artificial
  CRISPR gRNA sequence
gaggctgatcacttgaaccc

SEQ ID NO: 247342 - DNA, 20 bp, Artificial
  CRISPR gRNA sequence
aggctgatcacttgaaccca

SEQ ID NO: 247343 - DNA, 20 bp, Artificial
  CRISPR gRNA sequence
atcacttgaacccaggagtt

SEQ ID NO: 247344 - DNA, 20 bp, Artificial
  CRISPR gRNA sequence
gaacccaggagtttgacgct

SEQ ID NO: 247345 - DNA, 20 bp, Artificial
  CRISPR gRNA sequence
aacccaggagtttgacgctg

SEQ ID NO: 247346 - DNA, 20 bp, Artificial
  CRISPR gRNA sequence
gacgctgtctcagaaagaaa

SEQ ID NO: 247347 - DNA, 20 bp, Artificial
  CRISPR gRNA sequence
acgctgtctcagaaagaaaa

SEQ ID NO: 247348 - DNA, 20 bp, Artificial
  CRISPR gRNA sequence
tctcagaaagaaaagaaaaa

SEQ ID NO: 247349 - DNA, 20 bp, Artificial
  CRISPR gRNA sequence
agaaagaaaagaaaaaagaa

SEQ ID NO: 247350 - DNA, 20 bp, Artificial
  CRISPR gRNA sequence
cctaagcctcagttttctca

SEQ ID NO: 247351 - DNA, 20 bp, Artificial
  CRISPR gRNA sequence
agcctcagttttctcatctg

SEQ ID NO: 247352 - DNA, 20 bp, Artificial
  CRISPR gRNA sequence
agttttctcatctgcaaaat

SEQ ID NO: 247353 - DNA, 20 bp, Artificial
  CRISPR gRNA sequence
tctcatctgcaaaattagga

SEQ ID NO: 247354 - DNA, 20 bp, Artificial
  CRISPR gRNA sequence
ctcatctgcaaaattaggat

SEQ ID NO: 247355 - DNA, 20 bp, Artificial
  CRISPR gRNA sequence
tcatctgcaaaattaggatt

SEQ ID NO: 247356 - DNA, 20 bp, Artificial
  CRISPR gRNA sequence
atctgcaaaattaggattgt

SEQ ID NO: 247357 - DNA, 20 bp, Artificial
  CRISPR gRNA sequence
caaaattaggattgtatgtg

SEQ ID NO: 247358 - DNA, 20 bp, Artificial
  CRISPR gRNA sequence
ggattgtatgtgctgccaga

SEQ ID NO: 247359 - DNA, 20 bp, Artificial
  CRISPR gRNA sequence
tatgtgctgccagaactgtt

SEQ ID NO: 247360 - DNA, 20 bp, Artificial
  CRISPR gRNA sequence
ccagaactgtttcaaagaac

SEQ ID NO: 247361 - DNA, 20 bp, Artificial
  CRISPR gRNA sequence
tttcaaagaacaaacgagtg

SEQ ID NO: 247362 - DNA, 20 bp, Artificial
  CRISPR gRNA sequence
caaagaacaaacgagtgaga

SEQ ID NO: 247363 - DNA, 20 bp, Artificial
  CRISPR gRNA sequence
aaagaacaaacgagtgagag

SEQ ID NO: 247364 - DNA, 20 bp, Artificial
  CRISPR gRNA sequence
ttgcacatctgacacgctga

SEQ ID NO: 247365 - DNA, 20 bp, Artificial
  CRISPR gRNA sequence
gcacatctgacacgctgagt

SEQ ID NO: 247366 - DNA, 20 bp, Artificial
  CRISPR gRNA sequence
cacatctgacacgctgagta

SEQ ID NO: 247367 - DNA, 20 bp, Artificial
  CRISPR gRNA sequence
acacgctgagtaaatggtag

SEQ ID NO: 247368 - DNA, 20 bp, Artificial
  CRISPR gRNA sequence
agtaaatggtagctatcatt

SEQ ID NO: 247369 - DNA, 20 bp, Artificial
  CRISPR gRNA sequence
tcattatcaccatcatcgcc

SEQ ID NO: 247370 - DNA, 20 bp, Artificial
  CRISPR gRNA sequence
tcaccatcatcgccatcatt

SEQ ID NO: 247371 - DNA, 20 bp, Artificial
  CRISPR gRNA sequence
ttgctgttgttgtgacacct

SEQ ID NO: 247372 - DNA, 20 bp, Artificial
  CRISPR gRNA sequence
ctgttgttgtgacacctttc

SEQ ID NO: 247373 - DNA, 20 bp, Artificial
  CRISPR gRNA sequence
ttgttgtgacacctttccct

SEQ ID NO: 247374 - DNA, 20 bp, Artificial
  CRISPR gRNA sequence
ttgtgacacctttcccttgt

SEQ ID NO: 247375 - DNA, 20 bp, Artificial
  CRISPR gRNA sequence
tgacacctttcccttgtccc

SEQ ID NO: 247376 - DNA, 20 bp, Artificial
  CRISPR gRNA sequence
tcccttgtccctttacctac

SEQ ID NO: 247377 - DNA, 20 bp, Artificial
  CRISPR gRNA sequence
cccttgtccctttacctacc

SEQ ID NO: 247378 - DNA, 20 bp, Artificial
  CRISPR gRNA sequence
ccttgtccctttacctaccc

SEQ ID NO: 247379 - DNA, 20 bp, Artificial
  CRISPR gRNA sequence
gtccctttacctaccccaaa

SEQ ID NO: 247380 - DNA, 20 bp, Artificial
  CRISPR gRNA sequence
tccctttacctaccccaaat

SEQ ID NO: 247381 - DNA, 20 bp, Artificial
  CRISPR gRNA sequence
tacctaccccaaatccgccc

SEQ ID NO: 247382 - DNA, 20 bp, Artificial
  CRISPR gRNA sequence
acctaccccaaatccgcccg

SEQ ID NO: 247383 - DNA, 20 bp, Artificial
  CRISPR gRNA sequence
cctaccccaaatccgcccgt

SEQ ID NO: 247384 - DNA, 20 bp, Artificial
  CRISPR gRNA sequence
ccccaaatccgcccgtcctc

SEQ ID NO: 247385 - DNA, 20 bp, Artificial
  CRISPR gRNA sequence
cagagcccagttcaaaccca

SEQ ID NO: 247386 - DNA, 20 bp, Artificial
  CRISPR gRNA sequence
aaacccatttttccatgcag

SEQ ID NO: 247387 - DNA, 20 bp, Artificial
  CRISPR gRNA sequence
ttccatgcagactcacttaa

SEQ ID NO: 247388 - DNA, 20 bp, Artificial
  CRISPR gRNA sequence
tccatgcagactcacttaac

SEQ ID NO: 247389 - DNA, 20 bp, Artificial
  CRISPR gRNA sequence
ccatgcagactcacttaaca

SEQ ID NO: 247390 - DNA, 20 bp, Artificial
  CRISPR gRNA sequence
catgcagactcacttaacaa

SEQ ID NO: 247391 - DNA, 20 bp, Artificial
  CRISPR gRNA sequence
acttaacaactctgaaaaat

SEQ ID NO: 247392 - DNA, 20 bp, Artificial
  CRISPR gRNA sequence
aacaactctgaaaaatttgt

SEQ ID NO: 247393 - DNA, 20 bp, Artificial
  CRISPR gRNA sequence
acaactctgaaaaatttgta

SEQ ID NO: 247394 - DNA, 20 bp, Artificial
  CRISPR gRNA sequence
tgaaaaatttgtattgaaag

SEQ ID NO: 247395 - DNA, 20 bp, Artificial
  CRISPR gRNA sequence
aaaaatttgtattgaaagac

SEQ ID NO: 247396 - DNA, 20 bp, Artificial
  CRISPR gRNA sequence
gtattgaaagacctttttta

SEQ ID NO: 247397 - DNA, 20 bp, Artificial
  CRISPR gRNA sequence
tattgaaagaccttttttaa

SEQ ID NO: 247398 - DNA, 20 bp, Artificial
  CRISPR gRNA sequence
aaagaccttttttaaaaagc

SEQ ID NO: 247399 - DNA, 20 bp, Artificial
  CRISPR gRNA sequence
ttttaaaaagccactttcca

SEQ ID NO: 247400 - DNA, 20 bp, Artificial
  CRISPR gRNA sequence
tttaaaaagccactttccag

SEQ ID NO: 247401 - DNA, 20 bp, Artificial
  CRISPR gRNA sequence
ttaaaaagccactttccagc

SEQ ID NO: 247402 - DNA, 20 bp, Artificial
  CRISPR gRNA sequence
taaaaagccactttccagct

SEQ ID NO: 247403 - DNA, 20 bp, Artificial
  CRISPR gRNA sequence
aaaaagccactttccagctg

SEQ ID NO: 247404 - DNA, 20 bp, Artificial
  CRISPR gRNA sequence
aaaagccactttccagctgg

SEQ ID NO: 247405 - DNA, 20 bp, Artificial
  CRISPR gRNA sequence
tccagctgggcacagtggct

SEQ ID NO: 247406 - DNA, 20 bp, Artificial
  CRISPR gRNA sequence
ccagctgggcacagtggctc

SEQ ID NO: 247407 - DNA, 20 bp, Artificial
  CRISPR gRNA sequence
cagctgggcacagtggctca

SEQ ID NO: 247408 - DNA, 20 bp, Artificial
  CRISPR gRNA sequence
ggcacagtggctcacacctg

SEQ ID NO: 247409 - DNA, 20 bp, Artificial
  CRISPR gRNA sequence
acacctgtaatcccagcact

SEQ ID NO: 247410 - DNA, 20 bp, Artificial
  CRISPR gRNA sequence
taatcccagcactttgggag

SEQ ID NO: 247411 - DNA, 20 bp, Artificial
  CRISPR gRNA sequence
tgggaggccaaggcaagcgg

SEQ ID NO: 247412 - DNA, 20 bp, Artificial
  CRISPR gRNA sequence
gggaggccaaggcaagcgga

SEQ ID NO: 247413 - DNA, 20 bp, Artificial
  CRISPR gRNA sequence
ggaggccaaggcaagcggat

SEQ ID NO: 247414 - DNA, 20 bp, Artificial
  CRISPR gRNA sequence
gaggtcaggagtgcgagacc

SEQ ID NO: 247415 - DNA, 20 bp, Artificial
  CRISPR gRNA sequence
aggtcaggagtgcgagacca

SEQ ID NO: 247416 - DNA, 20 bp, Artificial
  CRISPR gRNA sequence
gctaacatggtgaaagccca

SEQ ID NO: 247417 - DNA, 20 bp, Artificial
  CRISPR gRNA sequence
acatggtgaaagcccatctc

SEQ ID NO: 247418 - DNA, 20 bp, Artificial
  CRISPR gRNA sequence
tactaaaaatacaaaagcac

SEQ ID NO: 247419 - DNA, 20 bp, Artificial
  CRISPR gRNA sequence
ctaaaaatacaaaagcacta

SEQ ID NO: 247420 - DNA, 20 bp, Artificial
  CRISPR gRNA sequence
aaaatacaaaagcactagcc

SEQ ID NO: 247421 - DNA, 20 bp, Artificial
  CRISPR gRNA sequence
gccaggcgtggttgtgtgca

SEQ ID NO: 247422 - DNA, 20 bp, Artificial
  CRISPR gRNA sequence
tgtgcacctgtaatcccagc

SEQ ID NO: 247423 - DNA, 20 bp, Artificial
  CRISPR gRNA sequence
taatcccagctactaggagg

SEQ ID NO: 247424 - DNA, 20 bp, Artificial
  CRISPR gRNA sequence
ctaggaggccgaggcaggag

SEQ ID NO: 247425 - DNA, 20 bp, Artificial
  CRISPR gRNA sequence
ggaggccgaggcaggagaat

SEQ ID NO: 247426 - DNA, 20 bp, Artificial
  CRISPR gRNA sequence
ttgaacccaggaggcagagt

SEQ ID NO: 247427 - DNA, 20 bp, Artificial
  CRISPR gRNA sequence
gaacccaggaggcagagttt

SEQ ID NO: 247428 - DNA, 20 bp, Artificial
  CRISPR gRNA sequence
aacccaggaggcagagtttg

SEQ ID NO: 247429 - DNA, 20 bp, Artificial
  CRISPR gRNA sequence
gcagtgaggcgagaccgtgc

SEQ ID NO: 247430 - DNA, 20 bp, Artificial
  CRISPR gRNA sequence
cagtgaggcgagaccgtgcc

SEQ ID NO: 247431 - DNA, 20 bp, Artificial
  CRISPR gRNA sequence
cactccagcctgggcaagaa

SEQ ID NO: 247432 - DNA, 20 bp, Artificial
  CRISPR gRNA sequence
cagcctgggcaagaagagcg

SEQ ID NO: 247433 - DNA, 20 bp, Artificial
  CRISPR gRNA sequence
ggcaagaagagcgaaactcc

SEQ ID NO: 247434 - DNA, 20 bp, Artificial
  CRISPR gRNA sequence
catctcaaaacaaacaaaca

SEQ ID NO: 247435 - DNA, 20 bp, Artificial
  CRISPR gRNA sequence
aaaacaaacaaacaaacaaa

SEQ ID NO: 247436 - DNA, 20 bp, Artificial
  CRISPR gRNA sequence
tttaaaaaagccactttcca

SEQ ID NO: 247437 - DNA, 20 bp, Artificial
  CRISPR gRNA sequence
ttaaaaaagccactttccaa

SEQ ID NO: 247438 - DNA, 20 bp, Artificial
  CRISPR gRNA sequence
taaaaaagccactttccaaa

SEQ ID NO: 247439 - DNA, 20 bp, Artificial
  CRISPR gRNA sequence
aaaaaagccactttccaaag

SEQ ID NO: 247440 - DNA, 20 bp, Artificial
  CRISPR gRNA sequence
aaaaagccactttccaaaga

SEQ ID NO: 247441 - DNA, 20 bp, Artificial
  CRISPR gRNA sequence
tccaaagacagaattcagct

SEQ ID NO: 247442 - DNA, 20 bp, Artificial
  CRISPR gRNA sequence
ccaaagacagaattcagcta

SEQ ID NO: 247443 - DNA, 20 bp, Artificial
  CRISPR gRNA sequence
caaagacagaattcagctaa

SEQ ID NO: 247444 - DNA, 20 bp, Artificial
  CRISPR gRNA sequence
agctaagtccgagaaaatag

SEQ ID NO: 247445 - DNA, 20 bp, Artificial
  CRISPR gRNA sequence
agtccgagaaaatagtcaat

SEQ ID NO: 247446 - DNA, 20 bp, Artificial
  CRISPR gRNA sequence
ttcttgtgaatcatgattcc

SEQ ID NO: 247447 - DNA, 20 bp, Artificial
  CRISPR gRNA sequence
tcttgtgaatcatgattcca

SEQ ID NO: 247448 - DNA, 20 bp, Artificial
  CRISPR gRNA sequence
cttgtgaatcatgattccat

SEQ ID NO: 247449 - DNA, 20 bp, Artificial
  CRISPR gRNA sequence
ttgtgaatcatgattccatt

SEQ ID NO: 247450 - DNA, 20 bp, Artificial
  CRISPR gRNA sequence
gtgaatcatgattccattcg

SEQ ID NO: 247451 - DNA, 20 bp, Artificial
  CRISPR gRNA sequence
tgaatcatgattccattcgt

SEQ ID NO: 247452 - DNA, 20 bp, Artificial
  CRISPR gRNA sequence
cattcgtcagccactctgat

SEQ ID NO: 247453 - DNA, 20 bp, Artificial
  CRISPR gRNA sequence
gtcagccactctgatgctga

SEQ ID NO: 247454 - DNA, 20 bp, Artificial
  CRISPR gRNA sequence
tgatgctgataaattataaa

SEQ ID NO: 247455 - DNA, 20 bp, Artificial
  CRISPR gRNA sequence
atgctgataaattataaatg

SEQ ID NO: 247456 - DNA, 20 bp, Artificial
  CRISPR gRNA sequence
ataaattataaatgacaaaa

SEQ ID NO: 247457 - DNA, 20 bp, Artificial
  CRISPR gRNA sequence
taaatgacaaaagcagagag

SEQ ID NO: 247458 - DNA, 20 bp, Artificial
  CRISPR gRNA sequence
ctgtttcaaaacactttatt

SEQ ID NO: 247459 - DNA, 20 bp, Artificial
  CRISPR gRNA sequence
tttcaaaacactttattttc

SEQ ID NO: 247460 - DNA, 20 bp, Artificial
  CRISPR gRNA sequence
caaaacactttattttctct

SEQ ID NO: 247461 - DNA, 20 bp, Artificial
  CRISPR gRNA sequence
aaaacactttattttctctc

SEQ ID NO: 247462 - DNA, 20 bp, Artificial
  CRISPR gRNA sequence
tattttctctcaaaaaagtc

SEQ ID NO: 247463 - DNA, 20 bp, Artificial
  CRISPR gRNA sequence
attttctctcaaaaaagtca

SEQ ID NO: 247464 - DNA, 20 bp, Artificial
  CRISPR gRNA sequence
ttttctctcaaaaaagtcac

SEQ ID NO: 247465 - DNA, 20 bp, Artificial
  CRISPR gRNA sequence
tctctcaaaaaagtcacttt

SEQ ID NO: 247466 - DNA, 20 bp, Artificial
  CRISPR gRNA sequence
ctctcaaaaaagtcactttc

SEQ ID NO: 247467 - DNA, 20 bp, Artificial
  CRISPR gRNA sequence
tctcaaaaaagtcactttcc

SEQ ID NO: 247468 - DNA, 20 bp, Artificial
  CRISPR gRNA sequence
tcaaaaaagtcactttccag

SEQ ID NO: 247469 - DNA, 20 bp, Artificial
  CRISPR gRNA sequence
aaaaaagtcactttccagtc

SEQ ID NO: 247470 - DNA, 20 bp, Artificial
  CRISPR gRNA sequence
tccagtctgttacaaaccaa

SEQ ID NO: 247471 - DNA, 20 bp, Artificial
  CRISPR gRNA sequence
ccagtctgttacaaaccaat

SEQ ID NO: 247472 - DNA, 20 bp, Artificial
  CRISPR gRNA sequence
cagtctgttacaaaccaata

SEQ ID NO: 247473 - DNA, 20 bp, Artificial
  CRISPR gRNA sequence
ttacaaaccaatacactttt

SEQ ID NO: 247474 - DNA, 20 bp, Artificial
  CRISPR gRNA sequence
caaaccaatacacttttgaa

SEQ ID NO: 247475 - DNA, 20 bp, Artificial
  CRISPR gRNA sequence
ttgaaatacaataaaaatgt

SEQ ID NO: 247476 - DNA, 20 bp, Artificial
  CRISPR gRNA sequence
tgaaatacaataaaaatgta

SEQ ID NO: 247477 - DNA, 20 bp, Artificial
  CRISPR gRNA sequence
gaaatacaataaaaatgtaa

SEQ ID NO: 247478 - DNA, 20 bp, Artificial
  CRISPR gRNA sequence
aaatacaataaaaatgtaaa

SEQ ID NO: 247479 - DNA, 20 bp, Artificial
  CRISPR gRNA sequence
tctagtaagaaaatgaaacg

SEQ ID NO: 247480 - DNA, 20 bp, Artificial
  CRISPR gRNA sequence
ctagtaagaaaatgaaacgg

SEQ ID NO: 247481 - DNA, 20 bp, Artificial
  CRISPR gRNA sequence
tagtaagaaaatgaaacgga

SEQ ID NO: 247482 - DNA, 20 bp, Artificial
  CRISPR gRNA sequence
gtaagaaaatgaaacggaaa

SEQ ID NO: 247483 - DNA, 20 bp, Artificial
  CRISPR gRNA sequence
ttattcttagtcaacagacc

SEQ ID NO: 247484 - DNA, 20 bp, Artificial
  CRISPR gRNA sequence
tattcttagtcaacagacca

SEQ ID NO: 247485 - DNA, 20 bp, Artificial
  CRISPR gRNA sequence
attcttagtcaacagaccac

SEQ ID NO: 247486 - DNA, 20 bp, Artificial
  CRISPR gRNA sequence
ttcttagtcaacagaccaca

SEQ ID NO: 247487 - DNA, 20 bp, Artificial
  CRISPR gRNA sequence
ttagtcaacagaccacatta

SEQ ID NO: 247488 - DNA, 20 bp, Artificial
  CRISPR gRNA sequence
agtcaacagaccacattact

SEQ ID NO: 247489 - DNA, 20 bp, Artificial
  CRISPR gRNA sequence
gtcaacagaccacattactc

SEQ ID NO: 247490 - DNA, 20 bp, Artificial
  CRISPR gRNA sequence
ctctgccaatttgccttaaa

SEQ ID NO: 247491 - DNA, 20 bp, Artificial
  CRISPR gRNA sequence
tgccaatttgccttaaaagt

SEQ ID NO: 247492 - DNA, 20 bp, Artificial
  CRISPR gRNA sequence
ccaatttgccttaaaagttt

SEQ ID NO: 247493 - DNA, 20 bp, Artificial
  CRISPR gRNA sequence
gccttaaaagtttctaaatg

SEQ ID NO: 247494 - DNA, 20 bp, Artificial
  CRISPR gRNA sequence
ccttaaaagtttctaaatgt

SEQ ID NO: 247495 - DNA, 20 bp, Artificial
  CRISPR gRNA sequence
aaaagtttctaaatgtttac

SEQ ID NO: 247496 - DNA, 20 bp, Artificial
  CRISPR gRNA sequence
aaagtttctaaatgtttact

SEQ ID NO: 247497 - DNA, 20 bp, Artificial
  CRISPR gRNA sequence
ctaaatgtttactctctaac

SEQ ID NO: 247498 - DNA, 20 bp, Artificial
  CRISPR gRNA sequence
taaatgtttactctctaacc

SEQ ID NO: 247499 - DNA, 20 bp, Artificial
  CRISPR gRNA sequence
aatgtttactctctaaccct

SEQ ID NO: 247500 - DNA, 20 bp, Artificial
  CRISPR gRNA sequence
actctctaaccctacaccac

SEQ ID NO: 247501 - DNA, 20 bp, Artificial
  CRISPR gRNA sequence
ctctctaaccctacaccact

SEQ ID NO: 247502 - DNA, 20 bp, Artificial
  CRISPR gRNA sequence
tctaaccctacaccactgtc

SEQ ID NO: 247503 - DNA, 20 bp, Artificial
  CRISPR gRNA sequence
taaccctacaccactgtcga

SEQ ID NO: 247504 - DNA, 20 bp, Artificial
  CRISPR gRNA sequence
accctacaccactgtcgatg

SEQ ID NO: 247505 - DNA, 20 bp, Artificial
  CRISPR gRNA sequence
caccactgtcgatggggaca

SEQ ID NO: 247506 - DNA, 20 bp, Artificial
  CRISPR gRNA sequence
tcgatggggacacaggacaa

SEQ ID NO: 247507 - DNA, 20 bp, Artificial
  CRISPR gRNA sequence
gtggaccagcacccatccac

SEQ ID NO: 247508 - DNA, 20 bp, Artificial
  CRISPR gRNA sequence
tggaccagcacccatccaca

SEQ ID NO: 247509 - DNA, 20 bp, Artificial
  CRISPR gRNA sequence
tggttccacaaaacaacagt

SEQ ID NO: 247510 - DNA, 20 bp, Artificial
  CRISPR gRNA sequence
gttccacaaaacaacagtca

SEQ ID NO: 247511 - DNA, 20 bp, Artificial
  CRISPR gRNA sequence
cacaaaacaacagtcacatt

SEQ ID NO: 247512 - DNA, 20 bp, Artificial
  CRISPR gRNA sequence
tctcgtatactattggcttt

SEQ ID NO: 247513 - DNA, 20 bp, Artificial
  CRISPR gRNA sequence
tcgtatactattggcttttt

SEQ ID NO: 247514 - DNA, 20 bp, Artificial
  CRISPR gRNA sequence
gtatactattggctttttac

SEQ ID NO: 247515 - DNA, 20 bp, Artificial
  CRISPR gRNA sequence
ttggctttttaccacctgtg

SEQ ID NO: 247516 - DNA, 20 bp, Artificial
  CRISPR gRNA sequence
gctttttaccacctgtgatg

SEQ ID NO: 247517 - DNA, 20 bp, Artificial
  CRISPR gRNA sequence
tttaccacctgtgatggcct

SEQ ID NO: 247518 - DNA, 20 bp, Artificial
  CRISPR gRNA sequence
ttaccacctgtgatggcctt

SEQ ID NO: 247519 - DNA, 20 bp, Artificial
  CRISPR gRNA sequence
taccacctgtgatggccttg

SEQ ID NO: 247520 - DNA, 20 bp, Artificial
  CRISPR gRNA sequence
accacctgtgatggccttgt

SEQ ID NO: 247521 - DNA, 20 bp, Artificial
  CRISPR gRNA sequence
ccacctgtgatggccttgtg

SEQ ID NO: 247522 - DNA, 20 bp, Artificial
  CRISPR gRNA sequence
tgatggccttgtgtgcccaa

SEQ ID NO: 247523 - DNA, 20 bp, Artificial
  CRISPR gRNA sequence
gtgtgcccaagtctgtgcca

SEQ ID NO: 247524 - DNA, 20 bp, Artificial
  CRISPR gRNA sequence
tgtgcccaagtctgtgccac

SEQ ID NO: 247525 - DNA, 20 bp, Artificial
  CRISPR gRNA sequence
tgccacattttggagggtaa

SEQ ID NO: 247526 - DNA, 20 bp, Artificial
  CRISPR gRNA sequence
tggagggtaacgagcaattg

SEQ ID NO: 247527 - DNA, 20 bp, Artificial
  CRISPR gRNA sequence
ggagggtaacgagcaattgt

SEQ ID NO: 247528 - DNA, 20 bp, Artificial
  CRISPR gRNA sequence
gagggtaacgagcaattgtt

SEQ ID NO: 247529 - DNA, 20 bp, Artificial
  CRISPR gRNA sequence
ttagtttcttctgtatcatt

SEQ ID NO: 247530 - DNA, 20 bp, Artificial
  CRISPR gRNA sequence
gtttcttctgtatcattcta

SEQ ID NO: 247531 - DNA, 20 bp, Artificial
  CRISPR gRNA sequence
cttctgtatcattctagggg

SEQ ID NO: 247532 - DNA, 20 bp, Artificial
  CRISPR gRNA sequence
ttctgtatcattctaggggc

SEQ ID NO: 247533 - DNA, 20 bp, Artificial
  CRISPR gRNA sequence
ctgtatcattctaggggctg

SEQ ID NO: 247534 - DNA, 20 bp, Artificial
  CRISPR gRNA sequence
tgtatcattctaggggctgg

SEQ ID NO: 247535 - DNA, 20 bp, Artificial
  CRISPR gRNA sequence
tatcattctaggggctggca

SEQ ID NO: 247536 - DNA, 20 bp, Artificial
  CRISPR gRNA sequence
taggggctggcattgaacac

SEQ ID NO: 247537 - DNA, 20 bp, Artificial
  CRISPR gRNA sequence
ggggctggcattgaacacat

SEQ ID NO: 247538 - DNA, 20 bp, Artificial
  CRISPR gRNA sequence
gcattgaacacatggagaca

SEQ ID NO: 247539 - DNA, 20 bp, Artificial
  CRISPR gRNA sequence
aacacatggagacaggctga

SEQ ID NO: 247540 - DNA, 20 bp, Artificial
  CRISPR gRNA sequence
atcaatgagagaagataaga

SEQ ID NO: 247541 - DNA, 20 bp, Artificial
  CRISPR gRNA sequence
cactggcaattcttttcctt

SEQ ID NO: 247542 - DNA, 20 bp, Artificial
  CRISPR gRNA sequence
gcaattcttttcctttcttt

SEQ ID NO: 247543 - DNA, 20 bp, Artificial
  CRISPR gRNA sequence
ttttcctttcttttgagaca

SEQ ID NO: 247544 - DNA, 20 bp, Artificial
  CRISPR gRNA sequence
ttcctttcttttgagacagg

SEQ ID NO: 247545 - DNA, 20 bp, Artificial
  CRISPR gRNA sequence
tcctttcttttgagacaggc

SEQ ID NO: 247546 - DNA, 20 bp, Artificial
  CRISPR gRNA sequence
cctttcttttgagacaggct

SEQ ID NO: 247547 - DNA, 20 bp, Artificial
  CRISPR gRNA sequence
ctttcttttgagacaggctc

SEQ ID NO: 247548 - DNA, 20 bp, Artificial
  CRISPR gRNA sequence
tcttttgagacaggctctct

SEQ ID NO: 247549 - DNA, 20 bp, Artificial
  CRISPR gRNA sequence
cttttgagacaggctctctg

SEQ ID NO: 247550 - DNA, 20 bp, Artificial
  CRISPR gRNA sequence
ttttgagacaggctctctgc

SEQ ID NO: 247551 - DNA, 20 bp, Artificial
  CRISPR gRNA sequence
ttgagacaggctctctgctc

SEQ ID NO: 247552 - DNA, 20 bp, Artificial
  CRISPR gRNA sequence
tgagacaggctctctgctct

SEQ ID NO: 247553 - DNA, 20 bp, Artificial
  CRISPR gRNA sequence
gagacaggctctctgctctg

SEQ ID NO: 247554 - DNA, 20 bp, Artificial
  CRISPR gRNA sequence
agacaggctctctgctctgg

SEQ ID NO: 247555 - DNA, 20 bp, Artificial
  CRISPR gRNA sequence
tctgctctggagtgcgatgg

SEQ ID NO: 247556 - DNA, 20 bp, Artificial
  CRISPR gRNA sequence
tgctctggagtgcgatggtg

SEQ ID NO: 247557 - DNA, 20 bp, Artificial
  CRISPR gRNA sequence
ctctggagtgcgatggtgcg

SEQ ID NO: 247558 - DNA, 20 bp, Artificial
  CRISPR gRNA sequence
tggagtgcgatggtgcgatc

SEQ ID NO: 247559 - DNA, 20 bp, Artificial
  CRISPR gRNA sequence
gagtgcgatggtgcgatcat

SEQ ID NO: 247560 - DNA, 20 bp, Artificial
  CRISPR gRNA sequence
attgcagcctcaacctccca

SEQ ID NO: 247561 - DNA, 20 bp, Artificial
  CRISPR gRNA sequence
cagcctcaacctcccagact

SEQ ID NO: 247562 - DNA, 20 bp, Artificial
  CRISPR gRNA sequence
aacctcccagactcaggtga

SEQ ID NO: 247563 - DNA, 20 bp, Artificial
  CRISPR gRNA sequence
ccagactcaggtgatcctcc

SEQ ID NO: 247564 - DNA, 20 bp, Artificial
  CRISPR gRNA sequence
aggtgatcctcctgcctcat

SEQ ID NO: 247565 - DNA, 20 bp, Artificial
  CRISPR gRNA sequence
ctgcctcatcagccttccct

SEQ ID NO: 247566 - DNA, 20 bp, Artificial
  CRISPR gRNA sequence
cctcatcagccttccctata

SEQ ID NO: 247567 - DNA, 20 bp, Artificial
  CRISPR gRNA sequence
atcagccttccctatagctg

SEQ ID NO: 247568 - DNA, 20 bp, Artificial
  CRISPR gRNA sequence
ccctatagctgggaccacag

SEQ ID NO: 247569 - DNA, 20 bp, Artificial
  CRISPR gRNA sequence
cctatagctgggaccacagg

SEQ ID NO: 247570 - DNA, 20 bp, Artificial
  CRISPR gRNA sequence
tagctgggaccacaggcatg

SEQ ID NO: 247571 - DNA, 20 bp, Artificial
  CRISPR gRNA sequence
ggaccacaggcatgtgccat

SEQ ID NO: 247572 - DNA, 20 bp, Artificial
  CRISPR gRNA sequence
tgcctggctaattttttgat

SEQ ID NO: 247573 - DNA, 20 bp, Artificial
  CRISPR gRNA sequence
gctaattttttgattttttg

SEQ ID NO: 247574 - DNA, 20 bp, Artificial
  CRISPR gRNA sequence
attttttgattttttgtaga

SEQ ID NO: 247575 - DNA, 20 bp, Artificial
  CRISPR gRNA sequence
tttgattttttgtagagaca

SEQ ID NO: 247576 - DNA, 20 bp, Artificial
  CRISPR gRNA sequence
ttgattttttgtagagacag

SEQ ID NO: 247577 - DNA, 20 bp, Artificial
  CRISPR gRNA sequence
tgattttttgtagagacagg

SEQ ID NO: 247578 - DNA, 20 bp, Artificial
  CRISPR gRNA sequence
gattttttgtagagacaggg

SEQ ID NO: 247579 - DNA, 20 bp, Artificial
  CRISPR gRNA sequence
attttttgtagagacagggt

SEQ ID NO: 247580 - DNA, 20 bp, Artificial
  CRISPR gRNA sequence
tttgtagagacagggtctca

SEQ ID NO: 247581 - DNA, 20 bp, Artificial
  CRISPR gRNA sequence
ttgtagagacagggtctcac

SEQ ID NO: 247582 - DNA, 20 bp, Artificial
  CRISPR gRNA sequence
tgtagagacagggtctcacc

SEQ ID NO: 247583 - DNA, 20 bp, Artificial
  CRISPR gRNA sequence
gtagagacagggtctcaccc

SEQ ID NO: 247584 - DNA, 20 bp, Artificial
  CRISPR gRNA sequence
tagagacagggtctcaccca

SEQ ID NO: 247585 - DNA, 20 bp, Artificial
  CRISPR gRNA sequence
acccaggctggttttgaact

SEQ ID NO: 247586 - DNA, 20 bp, Artificial
  CRISPR gRNA sequence
gttttgaactcctgggctca

SEQ ID NO: 247587 - DNA, 20 bp, Artificial
  CRISPR gRNA sequence
tgaactcctgggctcaagga

SEQ ID NO: 247588 - DNA, 20 bp, Artificial
  CRISPR gRNA sequence
gaactcctgggctcaaggag

SEQ ID NO: 247589 - DNA, 20 bp, Artificial
  CRISPR gRNA sequence
aactcctgggctcaaggagt

SEQ ID NO: 247590 - DNA, 20 bp, Artificial
  CRISPR gRNA sequence
ctgggctcaaggagtcctcc

SEQ ID NO: 247591 - DNA, 20 bp, Artificial
  CRISPR gRNA sequence
ggctcaaggagtcctcctgt

SEQ ID NO: 247592 - DNA, 20 bp, Artificial
  CRISPR gRNA sequence
aaggagtcctcctgtctcag

SEQ ID NO: 247593 - DNA, 20 bp, Artificial
  CRISPR gRNA sequence
ctgtctcagcctcccaaagt

SEQ ID NO: 247594 - DNA, 20 bp, Artificial
  CRISPR gRNA sequence
tctcagcctcccaaagtgct

SEQ ID NO: 247595 - DNA, 20 bp, Artificial
  CRISPR gRNA sequence
agcctcccaaagtgctggga

SEQ ID NO: 247596 - DNA, 20 bp, Artificial
  CRISPR gRNA sequence
ccaaagtgctgggattacag

SEQ ID NO: 247597 - DNA, 20 bp, Artificial
  CRISPR gRNA sequence
ggattacaggcgtgaaccac

SEQ ID NO: 247598 - DNA, 20 bp, Artificial
  CRISPR gRNA sequence
caggcgtgaaccactgcacg

SEQ ID NO: 247599 - DNA, 20 bp, Artificial
  CRISPR gRNA sequence
cacgtgcccagcctccactg

SEQ ID NO: 247600 - DNA, 20 bp, Artificial
  CRISPR gRNA sequence
cactggcaattctgatctag

SEQ ID NO: 247601 - DNA, 20 bp, Artificial
  CRISPR gRNA sequence
gcaattctgatctagatgtt

SEQ ID NO: 247602 - DNA, 20 bp, Artificial
  CRISPR gRNA sequence
tgatctagatgttccaggca

SEQ ID NO: 247603 - DNA, 20 bp, Artificial
  CRISPR gRNA sequence
atctagatgttccaggcact

SEQ ID NO: 247604 - DNA, 20 bp, Artificial
  CRISPR gRNA sequence
gatgttccaggcactatttc

SEQ ID NO: 247605 - DNA, 20 bp, Artificial
  CRISPR gRNA sequence
caggcactatttctggagaa

SEQ ID NO: 247606 - DNA, 20 bp, Artificial
  CRISPR gRNA sequence
tttctggagaaaatgcccac

SEQ ID NO: 247607 - DNA, 20 bp, Artificial
  CRISPR gRNA sequence
ctggagaaaatgcccacttt

SEQ ID NO: 247608 - DNA, 20 bp, Artificial
  CRISPR gRNA sequence
tggagaaaatgcccactttg

SEQ ID NO: 247609 - DNA, 20 bp, Artificial
  CRISPR gRNA sequence
gagaaaatgcccactttgcc

SEQ ID NO: 247610 - DNA, 20 bp, Artificial
  CRISPR gRNA sequence
tgcctattgagttgctacga

SEQ ID NO: 247611 - DNA, 20 bp, Artificial
  CRISPR gRNA sequence
gcctattgagttgctacgac

SEQ ID NO: 247612 - DNA, 20 bp, Artificial
  CRISPR gRNA sequence
cctattgagttgctacgacc

SEQ ID NO: 247613 - DNA, 20 bp, Artificial
  CRISPR gRNA sequence
ttgagttgctacgacctcac

SEQ ID NO: 247614 - DNA, 20 bp, Artificial
  CRISPR gRNA sequence
agttgctacgacctcacagt

SEQ ID NO: 247615 - DNA, 20 bp, Artificial
  CRISPR gRNA sequence
ctacgacctcacagtgttcc

SEQ ID NO: 247616 - DNA, 20 bp, Artificial
  CRISPR gRNA sequence
cgacctcacagtgttcccac

SEQ ID NO: 247617 - DNA, 20 bp, Artificial
  CRISPR gRNA sequence
acagtgttcccacgctgcct

SEQ ID NO: 247618 - DNA, 20 bp, Artificial
  CRISPR gRNA sequence
ccacgctgcctattagtatg

SEQ ID NO: 247619 - DNA, 20 bp, Artificial
  CRISPR gRNA sequence
cctattagtatgttacattc

SEQ ID NO: 247620 - DNA, 20 bp, Artificial
  CRISPR gRNA sequence
ttagtatgttacattctgtc

SEQ ID NO: 247621 - DNA, 20 bp, Artificial
  CRISPR gRNA sequence
gtatgttacattctgtctac

SEQ ID NO: 247622 - DNA, 20 bp, Artificial
  CRISPR gRNA sequence
cattctgtctacacttgatg

SEQ ID NO: 247623 - DNA, 20 bp, Artificial
  CRISPR gRNA sequence
tgtctacacttgatgggtgc

SEQ ID NO: 247624 - DNA, 20 bp, Artificial
  CRISPR gRNA sequence
tctacacttgatgggtgcaa

SEQ ID NO: 247625 - DNA, 20 bp, Artificial
  CRISPR gRNA sequence
cacttgatgggtgcaaaaaa

SEQ ID NO: 247626 - DNA, 20 bp, Artificial
  CRISPR gRNA sequence
gatgggtgcaaaaaagcttc

SEQ ID NO: 247627 - DNA, 20 bp, Artificial
  CRISPR gRNA sequence
atgggtgcaaaaaagcttca

SEQ ID NO: 247628 - DNA, 20 bp, Artificial
  CRISPR gRNA sequence
caatgatagcattccttatc

SEQ ID NO: 247629 - DNA, 20 bp, Artificial
  CRISPR gRNA sequence
aatgatagcattccttatct

SEQ ID NO: 247630 - DNA, 20 bp, Artificial
  CRISPR gRNA sequence
cttatcttccaaaaaattta

SEQ ID NO: 247631 - DNA, 20 bp, Artificial
  CRISPR gRNA sequence
atcttccaaaaaatttaacc

SEQ ID NO: 247632 - DNA, 20 bp, Artificial
  CRISPR gRNA sequence
tcttccaaaaaatttaaccc

SEQ ID NO: 247633 - DNA, 20 bp, Artificial
  CRISPR gRNA sequence
ccaaaaaatttaacccagat

SEQ ID NO: 247634 - DNA, 20 bp, Artificial
  CRISPR gRNA sequence
caaaaaatttaacccagatt

SEQ ID NO: 247635 - DNA, 20 bp, Artificial
  CRISPR gRNA sequence
aacccagattctttattcca

SEQ ID NO: 247636 - DNA, 20 bp, Artificial
  CRISPR gRNA sequence
acccagattctttattccat

SEQ ID NO: 247637 - DNA, 20 bp, Artificial
  CRISPR gRNA sequence
tttattccataaactaaagg

SEQ ID NO: 247638 - DNA, 20 bp, Artificial
  CRISPR gRNA sequence
tattccataaactaaaggaa

SEQ ID NO: 247639 - DNA, 20 bp, Artificial
  CRISPR gRNA sequence
attccataaactaaaggaaa

SEQ ID NO: 247640 - DNA, 20 bp, Artificial
  CRISPR gRNA sequence
ttccataaactaaaggaaat

SEQ ID NO: 247641 - DNA, 20 bp, Artificial
  CRISPR gRNA sequence
cataaactaaaggaaattat

SEQ ID NO: 247642 - DNA, 20 bp, Artificial
  CRISPR gRNA sequence
aaggaaattatacgtacttt

SEQ ID NO: 247643 - DNA, 20 bp, Artificial
  CRISPR gRNA sequence
tacgtactttgtccagggtc

SEQ ID NO: 247644 - DNA, 20 bp, Artificial
  CRISPR gRNA sequence
tgtccagggtcgacagatgc

SEQ ID NO: 247645 - DNA, 20 bp, Artificial
  CRISPR gRNA sequence
gtccagggtcgacagatgcc

SEQ ID NO: 247646 - DNA, 20 bp, Artificial
  CRISPR gRNA sequence
tccagggtcgacagatgcca

SEQ ID NO: 247647 - DNA, 20 bp, Artificial
  CRISPR gRNA sequence
ctgatcgttaaatgtcccaa

SEQ ID NO: 247648 - DNA, 20 bp, Artificial
  CRISPR gRNA sequence
tgatcgttaaatgtcccaaa

SEQ ID NO: 247649 - DNA, 20 bp, Artificial
  CRISPR gRNA sequence
atcgttaaatgtcccaaagc

SEQ ID NO: 247650 - DNA, 20 bp, Artificial
  CRISPR gRNA sequence
aatgtcccaaagcaacagtc

SEQ ID NO: 247651 - DNA, 20 bp, Artificial
  CRISPR gRNA sequence
tacaaccttgtattaaaaat

SEQ ID NO: 247652 - DNA, 20 bp, Artificial
  CRISPR gRNA sequence
acaaccttgtattaaaaatg

SEQ ID NO: 247653 - DNA, 20 bp, Artificial
  CRISPR gRNA sequence
caaccttgtattaaaaatga

SEQ ID NO: 247654 - DNA, 20 bp, Artificial
  CRISPR gRNA sequence
gtattaaaaatgaaagcaat

SEQ ID NO: 247655 - DNA, 20 bp, Artificial
  CRISPR gRNA sequence
tattaaaaatgaaagcaata

SEQ ID NO: 247656 - DNA, 20 bp, Artificial
  CRISPR gRNA sequence
aaaatgaaagcaataataaa

SEQ ID NO: 247657 - DNA, 20 bp, Artificial
  CRISPR gRNA sequence
tcatcattttgtaacttttc

SEQ ID NO: 247658 - DNA, 20 bp, Artificial
  CRISPR gRNA sequence
catcattttgtaacttttcc

SEQ ID NO: 247659 - DNA, 20 bp, Artificial
  CRISPR gRNA sequence
atcattttgtaacttttcct

SEQ ID NO: 247660 - DNA, 20 bp, Artificial
  CRISPR gRNA sequence
tgtaacttttcctgtgatga

SEQ ID NO: 247661 - DNA, 20 bp, Artificial
  CRISPR gRNA sequence
gtaacttttcctgtgatgaa

SEQ ID NO: 247662 - DNA, 20 bp, Artificial
  CRISPR gRNA sequence
taacttttcctgtgatgaac

SEQ ID NO: 247663 - DNA, 20 bp, Artificial
  CRISPR gRNA sequence
ttcctgtgatgaacttaata

SEQ ID NO: 247664 - DNA, 20 bp, Artificial
  CRISPR gRNA sequence
tcctgtgatgaacttaatat

SEQ ID NO: 247665 - DNA, 20 bp, Artificial
  CRISPR gRNA sequence
cctgtgatgaacttaatata

SEQ ID NO: 247666 - DNA, 20 bp, Artificial
  CRISPR gRNA sequence
ctgtgatgaacttaatataa

SEQ ID NO: 247667 - DNA, 20 bp, Artificial
  CRISPR gRNA sequence
tgatgaacttaatataagtc

SEQ ID NO: 247668 - DNA, 20 bp, Artificial
  CRISPR gRNA sequence
aatataagtcattaccataa

SEQ ID NO: 247669 - DNA, 20 bp, Artificial
  CRISPR gRNA sequence
atataagtcattaccataat

SEQ ID NO: 247670 - DNA, 20 bp, Artificial
  CRISPR gRNA sequence
ccataatgcaatctgcacaa

SEQ ID NO: 247671 - DNA, 20 bp, Artificial
  CRISPR gRNA sequence
cacaaattgttcaataattc

SEQ ID NO: 247672 - DNA, 20 bp, Artificial
  CRISPR gRNA sequence
ttcaataattcttgaaacaa

SEQ ID NO: 247673 - DNA, 20 bp, Artificial
  CRISPR gRNA sequence
aataattcttgaaacaacac

SEQ ID NO: 247674 - DNA, 20 bp, Artificial
  CRISPR gRNA sequence
ttgaaacaacaccctaagat

SEQ ID NO: 247675 - DNA, 20 bp, Artificial
  CRISPR gRNA sequence
gaaacaacaccctaagatgg

SEQ ID NO: 247676 - DNA, 20 bp, Artificial
  CRISPR gRNA sequence
aaacaacaccctaagatggc

SEQ ID NO: 247677 - DNA, 20 bp, Artificial
  CRISPR gRNA sequence
agatggctagtttttatttt

SEQ ID NO: 247678 - DNA, 20 bp, Artificial
  CRISPR gRNA sequence
gtttttattttaattgtaca

SEQ ID NO: 247679 - DNA, 20 bp, Artificial
  CRISPR gRNA sequence
ttattttaattgtacataaa

SEQ ID NO: 247680 - DNA, 20 bp, Artificial
  CRISPR gRNA sequence
tattttaattgtacataaag

SEQ ID NO: 247681 - DNA, 20 bp, Artificial
  CRISPR gRNA sequence
attttaattgtacataaagt

SEQ ID NO: 247682 - DNA, 20 bp, Artificial
  CRISPR gRNA sequence
ttttaattgtacataaagta

SEQ ID NO: 247683 - DNA, 20 bp, Artificial
  CRISPR gRNA sequence
taattgtacataaagtattg

SEQ ID NO: 247684 - DNA, 20 bp, Artificial
  CRISPR gRNA sequence
aattgtacataaagtattgt

SEQ ID NO: 247685 - DNA, 20 bp, Artificial
  CRISPR gRNA sequence
attgtacataaagtattgta

SEQ ID NO: 247686 - DNA, 20 bp, Artificial
  CRISPR gRNA sequence
tacataaagtattgtatatg

SEQ ID NO: 247687 - DNA, 20 bp, Artificial
  CRISPR gRNA sequence
tatatgtctggaacatgtga

SEQ ID NO: 247688 - DNA, 20 bp, Artificial
  CRISPR gRNA sequence
gaacatgtgaagattaatgg

SEQ ID NO: 247689 - DNA, 20 bp, Artificial
  CRISPR gRNA sequence
atggttctggcaattaacaa

SEQ ID NO: 247690 - DNA, 20 bp, Artificial
  CRISPR gRNA sequence
tggcaattaacaaatgttct

SEQ ID NO: 247691 - DNA, 20 bp, Artificial
  CRISPR gRNA sequence
gcaattaacaaatgttctga

SEQ ID NO: 247692 - DNA, 20 bp, Artificial
  CRISPR gRNA sequence
acaaatgttctgatttcaaa

SEQ ID NO: 247693 - DNA, 20 bp, Artificial
  CRISPR gRNA sequence
tgatttcaaattatttccat

SEQ ID NO: 247694 - DNA, 20 bp, Artificial
  CRISPR gRNA sequence
atttcaaattatttccattt

SEQ ID NO: 247695 - DNA, 20 bp, Artificial
  CRISPR gRNA sequence
caaattatttccatttatga

SEQ ID NO: 247696 - DNA, 20 bp, Artificial
  CRISPR gRNA sequence
aaattatttccatttatgaa

SEQ ID NO: 247697 - DNA, 20 bp, Artificial
  CRISPR gRNA sequence
tttccatttatgaagaaata

SEQ ID NO: 247698 - DNA, 20 bp, Artificial
  CRISPR gRNA sequence
ccatttatgaagaaataacg

SEQ ID NO: 247699 - DNA, 20 bp, Artificial
  CRISPR gRNA sequence
catttatgaagaaataacgg

SEQ ID NO: 247700 - DNA, 20 bp, Artificial
  CRISPR gRNA sequence
atgaagaaataacggaaata

SEQ ID NO: 247701 - DNA, 20 bp, Artificial
  CRISPR gRNA sequence
tgaagaaataacggaaatat

SEQ ID NO: 247702 - DNA, 20 bp, Artificial
  CRISPR gRNA sequence
tattaattgaaatattttat

SEQ ID NO: 247703 - DNA, 20 bp, Artificial
  CRISPR gRNA sequence
attaattgaaatattttatt

SEQ ID NO: 247704 - DNA, 20 bp, Artificial
  CRISPR gRNA sequence
ttaattgaaatattttatta

SEQ ID NO: 247705 - DNA, 20 bp, Artificial
  CRISPR gRNA sequence
attgaaatattttattaatt

SEQ ID NO: 247706 - DNA, 20 bp, Artificial
  CRISPR gRNA sequence
aaatattttattaattaaaa

SEQ ID NO: 247707 - DNA, 20 bp, Artificial
  CRISPR gRNA sequence
tattaattaaaatatgatat

SEQ ID NO: 247708 - DNA, 20 bp, Artificial
  CRISPR gRNA sequence
attaattaaaatatgatata

SEQ ID NO: 247709 - DNA, 20 bp, Artificial
  CRISPR gRNA sequence
ttaattaaaatatgatatat

SEQ ID NO: 247710 - DNA, 20 bp, Artificial
  CRISPR gRNA sequence
attaaaatatgatatatcat

SEQ ID NO: 247711 - DNA, 20 bp, Artificial
  CRISPR gRNA sequence
aaatatgatatatcatatac

SEQ ID NO: 247712 - DNA, 20 bp, Artificial
  CRISPR gRNA sequence
ccttgttactttaaggttct

SEQ ID NO: 247713 - DNA, 20 bp, Artificial
  CRISPR gRNA sequence
gttactttaaggttctacaa

SEQ ID NO: 247714 - DNA, 20 bp, Artificial
  CRISPR gRNA sequence
ttactttaaggttctacaaa

SEQ ID NO: 247715 - DNA, 20 bp, Artificial
  CRISPR gRNA sequence
ctttaaggttctacaaatct

SEQ ID NO: 247716 - DNA, 20 bp, Artificial
  CRISPR gRNA sequence
taaggttctacaaatctgtt

SEQ ID NO: 247717 - DNA, 20 bp, Artificial
  CRISPR gRNA sequence
aaggttctacaaatctgttt

SEQ ID NO: 247718 - DNA, 20 bp, Artificial
  CRISPR gRNA sequence
aggttctacaaatctgtttg

SEQ ID NO: 247719 - DNA, 20 bp, Artificial
  CRISPR gRNA sequence
tacaaatctgtttgtttatt

SEQ ID NO: 247720 - DNA, 20 bp, Artificial
  CRISPR gRNA sequence
caaatctgtttgtttatttt

SEQ ID NO: 247721 - DNA, 20 bp, Artificial
  CRISPR gRNA sequence
tttgtttattttcaaaggat

SEQ ID NO: 247722 - DNA, 20 bp, Artificial
  CRISPR gRNA sequence
gtttattttcaaaggatcaa

SEQ ID NO: 247723 - DNA, 20 bp, Artificial
  CRISPR gRNA sequence
tttattttcaaaggatcaag

SEQ ID NO: 247724 - DNA, 20 bp, Artificial
  CRISPR gRNA sequence
attttcaaaggatcaagatc

SEQ ID NO: 247725 - DNA, 20 bp, Artificial
  CRISPR gRNA sequence
ttttcaaaggatcaagatca

SEQ ID NO: 247726 - DNA, 20 bp, Artificial
  CRISPR gRNA sequence
tcaaaggatcaagatcaaag

SEQ ID NO: 247727 - DNA, 20 bp, Artificial
  CRISPR gRNA sequence
caaaggatcaagatcaaagc

SEQ ID NO: 247728 - DNA, 20 bp, Artificial
  CRISPR gRNA sequence
aaaggatcaagatcaaagct

SEQ ID NO: 247729 - DNA, 20 bp, Artificial
  CRISPR gRNA sequence
agtttgtctatgtcacaaaa

SEQ ID NO: 247730 - DNA, 20 bp, Artificial
  CRISPR gRNA sequence
gtctatgtcacaaaactaca

SEQ ID NO: 247731 - DNA, 20 bp, Artificial
  CRISPR gRNA sequence
tctatgtcacaaaactacac

SEQ ID NO: 247732 - DNA, 20 bp, Artificial
  CRISPR gRNA sequence
tgtcacaaaactacactaga

SEQ ID NO: 247733 - DNA, 20 bp, Artificial
  CRISPR gRNA sequence
cactagatcaaagaaacgca

SEQ ID NO: 247734 - DNA, 20 bp, Artificial
  CRISPR gRNA sequence
gatcaaagaaacgcaaacgt

SEQ ID NO: 247735 - DNA, 20 bp, Artificial
  CRISPR gRNA sequence
tttttgtcagttcttgacct

SEQ ID NO: 247736 - DNA, 20 bp, Artificial
  CRISPR gRNA sequence
ttttgtcagttcttgacctt

SEQ ID NO: 247737 - DNA, 20 bp, Artificial
  CRISPR gRNA sequence
tttgtcagttcttgaccttg

SEQ ID NO: 247738 - DNA, 20 bp, Artificial
  CRISPR gRNA sequence
ttgtcagttcttgaccttgt

SEQ ID NO: 247739 - DNA, 20 bp, Artificial
  CRISPR gRNA sequence
tgtcagttcttgaccttgtt

SEQ ID NO: 247740 - DNA, 20 bp, Artificial
  CRISPR gRNA sequence
gtcagttcttgaccttgttt

SEQ ID NO: 247741 - DNA, 20 bp, Artificial
  CRISPR gRNA sequence
tcagttcttgaccttgttta

SEQ ID NO: 247742 - DNA, 20 bp, Artificial
  CRISPR gRNA sequence
ttgaccttgtttacaatcct

SEQ ID NO: 247743 - DNA, 20 bp, Artificial
  CRISPR gRNA sequence
gaccttgtttacaatcctgt

SEQ ID NO: 247744 - DNA, 20 bp, Artificial
  CRISPR gRNA sequence
accttgtttacaatcctgtt

SEQ ID NO: 247745 - DNA, 20 bp, Artificial
  CRISPR gRNA sequence
gtttacaatcctgttcacac

SEQ ID NO: 247746 - DNA, 20 bp, Artificial
  CRISPR gRNA sequence
tttacaatcctgttcacaca

SEQ ID NO: 247747 - DNA, 20 bp, Artificial
  CRISPR gRNA sequence
acaatcctgttcacacatgc

SEQ ID NO: 247748 - DNA, 20 bp, Artificial
  CRISPR gRNA sequence
caatcctgttcacacatgct

SEQ ID NO: 247749 - DNA, 20 bp, Artificial
  CRISPR gRNA sequence
ttcacacatgctgcatcctg

SEQ ID NO: 247750 - DNA, 20 bp, Artificial
  CRISPR gRNA sequence
acacatgctgcatcctgccc

SEQ ID NO: 247751 - DNA, 20 bp, Artificial
  CRISPR gRNA sequence
catcctgcccccaggcagtg

SEQ ID NO: 247752 - DNA, 20 bp, Artificial
  CRISPR gRNA sequence
cccccaggcagtgaaaccct

SEQ ID NO: 247753 - DNA, 20 bp, Artificial
  CRISPR gRNA sequence
gagtgcagtcacactctgca

SEQ ID NO: 247754 - DNA, 20 bp, Artificial
  CRISPR gRNA sequence
tgcattgctggtggaggaac

SEQ ID NO: 247755 - DNA, 20 bp, Artificial
  CRISPR gRNA sequence
cattgctggtggaggaacac

SEQ ID NO: 247756 - DNA, 20 bp, Artificial
  CRISPR gRNA sequence
ctggtggaggaacactcctt

SEQ ID NO: 247757 - DNA, 20 bp, Artificial
  CRISPR gRNA sequence
gtggaggaacactccttcct

SEQ ID NO: 247758 - DNA, 20 bp, Artificial
  CRISPR gRNA sequence
cttcctggtcctgaaaacac

SEQ ID NO: 247759 - DNA, 20 bp, Artificial
  CRISPR gRNA sequence
cctggtcctgaaaacaccta

SEQ ID NO: 247760 - DNA, 20 bp, Artificial
  CRISPR gRNA sequence
ctggtcctgaaaacacctac

SEQ ID NO: 247761 - DNA, 20 bp, Artificial
  CRISPR gRNA sequence
gtcctgaaaacacctacaaa

SEQ ID NO: 247762 - DNA, 20 bp, Artificial
  CRISPR gRNA sequence
aaaacacctacaaagtcccc

SEQ ID NO: 247763 - DNA, 20 bp, Artificial
  CRISPR gRNA sequence
caaagtccccccagccccca

SEQ ID NO: 247764 - DNA, 20 bp, Artificial
  CRISPR gRNA sequence
tattacacttgacctccaaa

SEQ ID NO: 247765 - DNA, 20 bp, Artificial
  CRISPR gRNA sequence
attacacttgacctccaaat

SEQ ID NO: 247766 - DNA, 20 bp, Artificial
  CRISPR gRNA sequence
ttacacttgacctccaaatc

SEQ ID NO: 247767 - DNA, 20 bp, Artificial
  CRISPR gRNA sequence
cacttgacctccaaatccag

SEQ ID NO: 247768 - DNA, 20 bp, Artificial
  CRISPR gRNA sequence
gacctccaaatccaggaagc

SEQ ID NO: 247769 - DNA, 20 bp, Artificial
  CRISPR gRNA sequence
acctccaaatccaggaagcg

SEQ ID NO: 247770 - DNA, 20 bp, Artificial
  CRISPR gRNA sequence
caaatccaggaagcgaattt

SEQ ID NO: 247771 - DNA, 20 bp, Artificial
  CRISPR gRNA sequence
atgctctgcagtaaaaatca

SEQ ID NO: 247772 - DNA, 20 bp, Artificial
  CRISPR gRNA sequence
tgctctgcagtaaaaatcat

SEQ ID NO: 247773 - DNA, 20 bp, Artificial
  CRISPR gRNA sequence
tgcagtaaaaatcatgctca

SEQ ID NO: 247774 - DNA, 20 bp, Artificial
  CRISPR gRNA sequence
cagtaaaaatcatgctcact

SEQ ID NO: 247775 - DNA, 20 bp, Artificial
  CRISPR gRNA sequence
actctacttatagtgttccc

SEQ ID NO: 247776 - DNA, 20 bp, Artificial
  CRISPR gRNA sequence
tacttatagtgttcccagta

SEQ ID NO: 247777 - DNA, 20 bp, Artificial
  CRISPR gRNA sequence
cttatagtgttcccagtaat

SEQ ID NO: 247778 - DNA, 20 bp, Artificial
  CRISPR gRNA sequence
atagtgttcccagtaatttt

SEQ ID NO: 247779 - DNA, 20 bp, Artificial
  CRISPR gRNA sequence
tagtgttcccagtaatttta

SEQ ID NO: 247780 - DNA, 20 bp, Artificial
  CRISPR gRNA sequence
ccagtaattttaaagtttac

SEQ ID NO: 247781 - DNA, 20 bp, Artificial
  CRISPR gRNA sequence
taaagtttacttttaaatct

SEQ ID NO: 247782 - DNA, 20 bp, Artificial
  CRISPR gRNA sequence
aaagtttacttttaaatctc

SEQ ID NO: 247783 - DNA, 20 bp, Artificial
  CRISPR gRNA sequence
aagtttacttttaaatctcc

SEQ ID NO: 247784 - DNA, 20 bp, Artificial
  CRISPR gRNA sequence
acttttaaatctccataaag

SEQ ID NO: 247785 - DNA, 20 bp, Artificial
  CRISPR gRNA sequence
cttttaaatctccataaaga

SEQ ID NO: 247786 - DNA, 20 bp, Artificial
  CRISPR gRNA sequence
ttaaatctccataaagacat

SEQ ID NO: 247787 - DNA, 20 bp, Artificial
  CRISPR gRNA sequence
taaatctccataaagacatt

SEQ ID NO: 247788 - DNA, 20 bp, Artificial
  CRISPR gRNA sequence
aaatctccataaagacattt

SEQ ID NO: 247789 - DNA, 20 bp, Artificial
  CRISPR gRNA sequence
aatctccataaagacatttt

SEQ ID NO: 247790 - DNA, 20 bp, Artificial
  CRISPR gRNA sequence
cataaagacatttttacatt

SEQ ID NO: 247791 - DNA, 20 bp, Artificial
  CRISPR gRNA sequence
ttacatttaggtaagtaaaa

SEQ ID NO: 247792 - DNA, 20 bp, Artificial
  CRISPR gRNA sequence
tacatttaggtaagtaaaaa

SEQ ID NO: 247793 - DNA, 20 bp, Artificial
  CRISPR gRNA sequence
acatttaggtaagtaaaaac

SEQ ID NO: 247794 - DNA, 20 bp, Artificial
  CRISPR gRNA sequence
catttaggtaagtaaaaact

SEQ ID NO: 247795 - DNA, 20 bp, Artificial
  CRISPR gRNA sequence
aggtaagtaaaaacttctct

SEQ ID NO: 247796 - DNA, 20 bp, Artificial
  CRISPR gRNA sequence
ggtaagtaaaaacttctctc

SEQ ID NO: 247797 - DNA, 20 bp, Artificial
  CRISPR gRNA sequence
ctctcttgtcaaatgaatgt

SEQ ID NO: 247798 - DNA, 20 bp, Artificial
  CRISPR gRNA sequence
tctcttgtcaaatgaatgtt

SEQ ID NO: 247799 - DNA, 20 bp, Artificial
  CRISPR gRNA sequence
tcttgtcaaatgaatgtttc

SEQ ID NO: 247800 - DNA, 20 bp, Artificial
  CRISPR gRNA sequence
ttgtcaaatgaatgtttcct

SEQ ID NO: 247801 - DNA, 20 bp, Artificial
  CRISPR gRNA sequence
gtcaaatgaatgtttcctct

SEQ ID NO: 247802 - DNA, 20 bp, Artificial
  CRISPR gRNA sequence
tcaaatgaatgtttcctcta

SEQ ID NO: 247803 - DNA, 20 bp, Artificial
  CRISPR gRNA sequence
cctctaatatttagaaagct

SEQ ID NO: 247804 - DNA, 20 bp, Artificial
  CRISPR gRNA sequence
ctctaatatttagaaagctc

SEQ ID NO: 247805 - DNA, 20 bp, Artificial
  CRISPR gRNA sequence
taatatttagaaagctcagt

SEQ ID NO: 247806 - DNA, 20 bp, Artificial
  CRISPR gRNA sequence
atatttagaaagctcagtcc

SEQ ID NO: 247807 - DNA, 20 bp, Artificial
  CRISPR gRNA sequence
agaaagctcagtccacaaat

SEQ ID NO: 247808 - DNA, 20 bp, Artificial
  CRISPR gRNA sequence
gaaagctcagtccacaaata

SEQ ID NO: 247809 - DNA, 20 bp, Artificial
  CRISPR gRNA sequence
agtccacaaataattgctgt

SEQ ID NO: 247810 - DNA, 20 bp, Artificial
  CRISPR gRNA sequence
ctgtcactggatattattgt

SEQ ID NO: 247811 - DNA, 20 bp, Artificial
  CRISPR gRNA sequence
tcactggatattattgtcct

SEQ ID NO: 247812 - DNA, 20 bp, Artificial
  CRISPR gRNA sequence
gatattattgtcctagacct

SEQ ID NO: 247813 - DNA, 20 bp, Artificial
  CRISPR gRNA sequence
ttgtcctagacctgctggtt

SEQ ID NO: 247814 - DNA, 20 bp, Artificial
  CRISPR gRNA sequence
tcctagacctgctggttggc

SEQ ID NO: 247815 - DNA, 20 bp, Artificial
  CRISPR gRNA sequence
gacctgctggttggcagaag

SEQ ID NO: 247816 - DNA, 20 bp, Artificial
  CRISPR gRNA sequence
ctggttggcagaagaatcag

SEQ ID NO: 247817 - DNA, 20 bp, Artificial
  CRISPR gRNA sequence
gttggcagaagaatcagtct

SEQ ID NO: 247818 - DNA, 20 bp, Artificial
  CRISPR gRNA sequence
gcagaagaatcagtctttga

SEQ ID NO: 247819 - DNA, 20 bp, Artificial
  CRISPR gRNA sequence
tgacacttgagattttcaaa

SEQ ID NO: 247820 - DNA, 20 bp, Artificial
  CRISPR gRNA sequence
gacacttgagattttcaaaa

SEQ ID NO: 247821 - DNA, 20 bp, Artificial
  CRISPR gRNA sequence
acacttgagattttcaaaag

SEQ ID NO: 247822 - DNA, 20 bp, Artificial
  CRISPR gRNA sequence
gagattttcaaaagagagca

SEQ ID NO: 247823 - DNA, 20 bp, Artificial
  CRISPR gRNA sequence
agattttcaaaagagagcag

SEQ ID NO: 247824 - DNA, 20 bp, Artificial
  CRISPR gRNA sequence
tcaaaagagagcagttagta

SEQ ID NO: 247825 - DNA, 20 bp, Artificial
  CRISPR gRNA sequence
caaaagagagcagttagtaa

SEQ ID NO: 247826 - DNA, 20 bp, Artificial
  CRISPR gRNA sequence
aaaagagagcagttagtaaa

SEQ ID NO: 247827 - DNA, 20 bp, Artificial
  CRISPR gRNA sequence
gtaaatgggaaagaaaagct

SEQ ID NO: 247828 - DNA, 20 bp, Artificial
  CRISPR gRNA sequence
atcttcccaactatcttcta

SEQ ID NO: 247829 - DNA, 20 bp, Artificial
  CRISPR gRNA sequence
tcttcccaactatcttctag

SEQ ID NO: 247830 - DNA, 20 bp, Artificial
  CRISPR gRNA sequence
cccaactatcttctagaaga

SEQ ID NO: 247831 - DNA, 20 bp, Artificial
  CRISPR gRNA sequence
ccaactatcttctagaagaa

SEQ ID NO: 247832 - DNA, 20 bp, Artificial
  CRISPR gRNA sequence
tcttctagaagaagaaaata

SEQ ID NO: 247833 - DNA, 20 bp, Artificial
  CRISPR gRNA sequence
ctagaagaagaaaatatctt

SEQ ID NO: 247834 - DNA, 20 bp, Artificial
  CRISPR gRNA sequence
tagaagaagaaaatatcttt

SEQ ID NO: 247835 - DNA, 20 bp, Artificial
  CRISPR gRNA sequence
gaagaagaaaatatctttga

SEQ ID NO: 247836 - DNA, 20 bp, Artificial
  CRISPR gRNA sequence
tgaactcatacctttacact

SEQ ID NO: 247837 - DNA, 20 bp, Artificial
  CRISPR gRNA sequence
gaactcatacctttacactg

SEQ ID NO: 247838 - DNA, 20 bp, Artificial
  CRISPR gRNA sequence
aactcatacctttacactgc

SEQ ID NO: 247839 - DNA, 20 bp, Artificial
  CRISPR gRNA sequence
atacctttacactgcctgca

SEQ ID NO: 247840 - DNA, 20 bp, Artificial
  CRISPR gRNA sequence
tacactgcctgcatatgtca

SEQ ID NO: 247841 - DNA, 20 bp, Artificial
  CRISPR gRNA sequence
acactgcctgcatatgtcac

SEQ ID NO: 247842 - DNA, 20 bp, Artificial
  CRISPR gRNA sequence
cactgcctgcatatgtcaca

SEQ ID NO: 247843 - DNA, 20 bp, Artificial
  CRISPR gRNA sequence
cctgcatatgtcacaggtcc

SEQ ID NO: 247844 - DNA, 20 bp, Artificial
  CRISPR gRNA sequence
catatgtcacaggtcctttg

SEQ ID NO: 247845 - DNA, 20 bp, Artificial
  CRISPR gRNA sequence
tgtccacctgcgctggagaa

SEQ ID NO: 247846 - DNA, 20 bp, Artificial
  CRISPR gRNA sequence
gtccacctgcgctggagaaa

SEQ ID NO: 247847 - DNA, 20 bp, Artificial
  CRISPR gRNA sequence
tccacctgcgctggagaaac

SEQ ID NO: 247848 - DNA, 20 bp, Artificial
  CRISPR gRNA sequence
cgctggagaaactatttgga

SEQ ID NO: 247849 - DNA, 20 bp, Artificial
  CRISPR gRNA sequence
gagaaactatttggaggaca

SEQ ID NO: 247850 - DNA, 20 bp, Artificial
  CRISPR gRNA sequence
tttggaggacagggactgca

SEQ ID NO: 247851 - DNA, 20 bp, Artificial
  CRISPR gRNA sequence
ggaggacagggactgcaaat

SEQ ID NO: 247852 - DNA, 20 bp, Artificial
  CRISPR gRNA sequence
gaggacagggactgcaaatc

SEQ ID NO: 247853 - DNA, 20 bp, Artificial
  CRISPR gRNA sequence
caaatctgattcctgttatt

SEQ ID NO: 247854 - DNA, 20 bp, Artificial
  CRISPR gRNA sequence
attcctgttattatcacaga

SEQ ID NO: 247855 - DNA, 20 bp, Artificial
  CRISPR gRNA sequence
ctgttattatcacagaatgt

SEQ ID NO: 247856 - DNA, 20 bp, Artificial
  CRISPR gRNA sequence
ttattatcacagaatgtacc

SEQ ID NO: 247857 - DNA, 20 bp, Artificial
  CRISPR gRNA sequence
ttatcacagaatgtacctaa

SEQ ID NO: 247858 - DNA, 20 bp, Artificial
  CRISPR gRNA sequence
tcacagaatgtacctaagaa

SEQ ID NO: 247859 - DNA, 20 bp, Artificial
  CRISPR gRNA sequence
agaaaggcagacaatagtgg

SEQ ID NO: 247860 - DNA, 20 bp, Artificial
  CRISPR gRNA sequence
gacaatgggcaatcgtcacc

SEQ ID NO: 247861 - DNA, 20 bp, Artificial
  CRISPR gRNA sequence
acaatgggcaatcgtcaccc

SEQ ID NO: 247862 - DNA, 20 bp, Artificial
  CRISPR gRNA sequence
cgaagtttacaataaaataa

SEQ ID NO: 247863 - DNA, 20 bp, Artificial
  CRISPR gRNA sequence
acaataaaataagattataa

SEQ ID NO: 247864 - DNA, 20 bp, Artificial
  CRISPR gRNA sequence
caataaaataagattataaa

SEQ ID NO: 247865 - DNA, 20 bp, Artificial
  CRISPR gRNA sequence
taaaagaatgatgagttttc

SEQ ID NO: 247866 - DNA, 20 bp, Artificial
  CRISPR gRNA sequence
tctagatgccacagtggtgg

SEQ ID NO: 247867 - DNA, 20 bp, Artificial
  CRISPR gRNA sequence
ctagatgccacagtggtgga

SEQ ID NO: 247868 - DNA, 20 bp, Artificial
  CRISPR gRNA sequence
tagatgccacagtggtggac

SEQ ID NO: 247869 - DNA, 20 bp, Artificial
  CRISPR gRNA sequence
gatgccacagtggtggacat

SEQ ID NO: 247870 - DNA, 20 bp, Artificial
  CRISPR gRNA sequence
gtttgattgacttcctaaaa

SEQ ID NO: 247871 - DNA, 20 bp, Artificial
  CRISPR gRNA sequence
gattgacttcctaaaacaat

SEQ ID NO: 247872 - DNA, 20 bp, Artificial
  CRISPR gRNA sequence
attgacttcctaaaacaata

SEQ ID NO: 247873 - DNA, 20 bp, Artificial
  CRISPR gRNA sequence
acttcctaaaacaatacatt

SEQ ID NO: 247874 - DNA, 20 bp, Artificial
  CRISPR gRNA sequence
cctaaaacaatacatttgca

SEQ ID NO: 247875 - DNA, 20 bp, Artificial
  CRISPR gRNA sequence
ctaaaacaatacatttgcaa

SEQ ID NO: 247876 - DNA, 20 bp, Artificial
  CRISPR gRNA sequence
aaacaatacatttgcaagat

SEQ ID NO: 247877 - DNA, 20 bp, Artificial
  CRISPR gRNA sequence
gcaagattattctttgtgta

SEQ ID NO: 247878 - DNA, 20 bp, Artificial
  CRISPR gRNA sequence
caagattattctttgtgtaa

SEQ ID NO: 247879 - DNA, 20 bp, Artificial
  CRISPR gRNA sequence
ttctttgtgtaatcacagaa

SEQ ID NO: 247880 - DNA, 20 bp, Artificial
  CRISPR gRNA sequence
tttgtgtaatcacagaatta

SEQ ID NO: 247881 - DNA, 20 bp, Artificial
  CRISPR gRNA sequence
tgtgtaatcacagaattaga

SEQ ID NO: 247882 - DNA, 20 bp, Artificial
  CRISPR gRNA sequence
gtgtaatcacagaattagaa

SEQ ID NO: 247883 - DNA, 20 bp, Artificial
  CRISPR gRNA sequence
tgtaatcacagaattagaaa

SEQ ID NO: 247884 - DNA, 20 bp, Artificial
  CRISPR gRNA sequence
gaaataacaaaatacaggcc

SEQ ID NO: 247885 - DNA, 20 bp, Artificial
  CRISPR gRNA sequence
acgcctgtaatcacagcact

SEQ ID NO: 247886 - DNA, 20 bp, Artificial
  CRISPR gRNA sequence
taatcacagcactttgggag

SEQ ID NO: 247887 - DNA, 20 bp, Artificial
  CRISPR gRNA sequence
tgggaggccgaagcgggcag

SEQ ID NO: 247888 - DNA, 20 bp, Artificial
  CRISPR gRNA sequence
gggaggccgaagcgggcaga

SEQ ID NO: 247889 - DNA, 20 bp, Artificial
  CRISPR gRNA sequence
ggaggccgaagcgggcagat

SEQ ID NO: 247890 - DNA, 20 bp, Artificial
  CRISPR gRNA sequence
aggtcagcagttcaagacca

SEQ ID NO: 247891 - DNA, 20 bp, Artificial
  CRISPR gRNA sequence
aagaccagcttggccaacat

SEQ ID NO: 247892 - DNA, 20 bp, Artificial
  CRISPR gRNA sequence
ggccaacatggtgaaatcct

SEQ ID NO: 247893 - DNA, 20 bp, Artificial
  CRISPR gRNA sequence
gccaacatggtgaaatcctg

SEQ ID NO: 247894 - DNA, 20 bp, Artificial
  CRISPR gRNA sequence
tctctactaaaaatacaaaa

SEQ ID NO: 247895 - DNA, 20 bp, Artificial
  CRISPR gRNA sequence
tactaaaaatacaaaaatta

SEQ ID NO: 247896 - DNA, 20 bp, Artificial
  CRISPR gRNA sequence
ctaaaaatacaaaaattagc

SEQ ID NO: 247897 - DNA, 20 bp, Artificial
  CRISPR gRNA sequence
aaaatacaaaaattagccag

SEQ ID NO: 247898 - DNA, 20 bp, Artificial
  CRISPR gRNA sequence
gccaggcgcagtggtgcaca

SEQ ID NO: 247899 - DNA, 20 bp, Artificial
  CRISPR gRNA sequence
taatcccagctactcgggag

SEQ ID NO: 247900 - DNA, 20 bp, Artificial
  CRISPR gRNA sequence
ctcgggaggctgaggcagga

SEQ ID NO: 247901 - DNA, 20 bp, Artificial
  CRISPR gRNA sequence
gggaggctgaggcaggagaa

SEQ ID NO: 247902 - DNA, 20 bp, Artificial
  CRISPR gRNA sequence
aggcaggagaattgcttgaa

SEQ ID NO: 247903 - DNA, 20 bp, Artificial
  CRISPR gRNA sequence
cttgaacctgggaggccaag

SEQ ID NO: 247904 - DNA, 20 bp, Artificial
  CRISPR gRNA sequence
gaacctgggaggccaaggtt

SEQ ID NO: 247905 - DNA, 20 bp, Artificial
  CRISPR gRNA sequence
aacctgggaggccaaggttg

SEQ ID NO: 247906 - DNA, 20 bp, Artificial
  CRISPR gRNA sequence
ggaggccaaggttgcagtga

SEQ ID NO: 247907 - DNA, 20 bp, Artificial
  CRISPR gRNA sequence
cagtgagctgagatcgtgcc

SEQ ID NO: 247908 - DNA, 20 bp, Artificial
  CRISPR gRNA sequence
agatcgtgccactgcactcc

SEQ ID NO: 247909 - DNA, 20 bp, Artificial
  CRISPR gRNA sequence
cactccagcctgggcgacag

SEQ ID NO: 247910 - DNA, 20 bp, Artificial
  CRISPR gRNA sequence
cagcctgggcgacagagtga

SEQ ID NO: 247911 - DNA, 20 bp, Artificial
  CRISPR gRNA sequence
ggcgacagagtgagactgtg

SEQ ID NO: 247912 - DNA, 20 bp, Artificial
  CRISPR gRNA sequence
tgtctcaaaaaaaaaaaaaa

SEQ ID NO: 247913 - DNA, 20 bp, Artificial
  CRISPR gRNA sequence
aaaaaaaaaaaaaaaaacat

SEQ ID NO: 247914 - DNA, 20 bp, Artificial
  CRISPR gRNA sequence
taacaaataaatcaacagaa

SEQ ID NO: 247915 - DNA, 20 bp, Artificial
  CRISPR gRNA sequence
tatctattgaataaaacaaa

SEQ ID NO: 247916 - DNA, 20 bp, Artificial
  CRISPR gRNA sequence
atctattgaataaaacaaaa

SEQ ID NO: 247917 - DNA, 20 bp, Artificial
  CRISPR gRNA sequence
tctattgaataaaacaaaat

SEQ ID NO: 247918 - DNA, 20 bp, Artificial
  CRISPR gRNA sequence
ttgaataaaacaaaatgatt

SEQ ID NO: 247919 - DNA, 20 bp, Artificial
  CRISPR gRNA sequence
aataaaacaaaatgattatc

SEQ ID NO: 247920 - DNA, 20 bp, Artificial
  CRISPR gRNA sequence
tcttgattgatgtaggagat

SEQ ID NO: 247921 - DNA, 20 bp, Artificial
  CRISPR gRNA sequence
gattgatgtaggagatgaat

SEQ ID NO: 247922 - DNA, 20 bp, Artificial
  CRISPR gRNA sequence
attgatgtaggagatgaata

SEQ ID NO: 247923 - DNA, 20 bp, Artificial
  CRISPR gRNA sequence
atgtaggagatgaatatgac

SEQ ID NO: 247924 - DNA, 20 bp, Artificial
  CRISPR gRNA sequence
gatccaggaggacatcaatg

SEQ ID NO: 247925 - DNA, 20 bp, Artificial
  CRISPR gRNA sequence
cactaaaatttaaatgcgac

SEQ ID NO: 247926 - DNA, 20 bp, Artificial
  CRISPR gRNA sequence
aaatttaaatgcgactgacc

SEQ ID NO: 247927 - DNA, 20 bp, Artificial
  CRISPR gRNA sequence
aaatgcgactgaccgtcccc

SEQ ID NO: 247928 - DNA, 20 bp, Artificial
  CRISPR gRNA sequence
aatgcgactgaccgtcccca

SEQ ID NO: 247929 - DNA, 20 bp, Artificial
  CRISPR gRNA sequence
accgtccccactctgttaag

SEQ ID NO: 247930 - DNA, 20 bp, Artificial
  CRISPR gRNA sequence
tgttaagccctttactacgc

SEQ ID NO: 247931 - DNA, 20 bp, Artificial
  CRISPR gRNA sequence
ttaagccctttactacgcgc

SEQ ID NO: 247932 - DNA, 20 bp, Artificial
  CRISPR gRNA sequence
agccctttactacgcgctta

SEQ ID NO: 247933 - DNA, 20 bp, Artificial
  CRISPR gRNA sequence
tactacgcgcttactcgctg

SEQ ID NO: 247934 - DNA, 20 bp, Artificial
  CRISPR gRNA sequence
actacgcgcttactcgctgc

SEQ ID NO: 247935 - DNA, 20 bp, Artificial
  CRISPR gRNA sequence
ctacgcgcttactcgctgct

SEQ ID NO: 247936 - DNA, 20 bp, Artificial
  CRISPR gRNA sequence
cgcgcttactcgctgctatg

SEQ ID NO: 247937 - DNA, 20 bp, Artificial
  CRISPR gRNA sequence
actcgctgctatgcccccag

SEQ ID NO: 247938 - DNA, 20 bp, Artificial
  CRISPR gRNA sequence
ctcgctgctatgcccccagt

SEQ ID NO: 247939 - DNA, 20 bp, Artificial
  CRISPR gRNA sequence
gctgctatgcccccagtcgg

SEQ ID NO: 247940 - DNA, 20 bp, Artificial
  CRISPR gRNA sequence
ctatgcccccagtcggagca

SEQ ID NO: 247941 - DNA, 20 bp, Artificial
  CRISPR gRNA sequence
tgcccccagtcggagcacaa

SEQ ID NO: 247942 - DNA, 20 bp, Artificial
  CRISPR gRNA sequence
cacacaaaactaacatttat

SEQ ID NO: 247943 - DNA, 20 bp, Artificial
  CRISPR gRNA sequence
acatttattgaagtcttgcc

SEQ ID NO: 247944 - DNA, 20 bp, Artificial
  CRISPR gRNA sequence
attgaagtcttgccttgtgc

SEQ ID NO: 247945 - DNA, 20 bp, Artificial
  CRISPR gRNA sequence
ttgaagtcttgccttgtgcc

SEQ ID NO: 247946 - DNA, 20 bp, Artificial
  CRISPR gRNA sequence
aagtcttgccttgtgccatg

SEQ ID NO: 247947 - DNA, 20 bp, Artificial
  CRISPR gRNA sequence
gccttgtgccatgcactgtt

SEQ ID NO: 247948 - DNA, 20 bp, Artificial
  CRISPR gRNA sequence
ccttgtgccatgcactgttc

SEQ ID NO: 247949 - DNA, 20 bp, Artificial
  CRISPR gRNA sequence
gtgccatgcactgttctaag

SEQ ID NO: 247950 - DNA, 20 bp, Artificial
  CRISPR gRNA sequence
tgccatgcactgttctaagc

SEQ ID NO: 247951 - DNA, 20 bp, Artificial
  CRISPR gRNA sequence
ttctaagcccttcatttgat

SEQ ID NO: 247952 - DNA, 20 bp, Artificial
  CRISPR gRNA sequence
taagcccttcatttgatcct

SEQ ID NO: 247953 - DNA, 20 bp, Artificial
  CRISPR gRNA sequence
agcccttcatttgatcctcc

SEQ ID NO: 247954 - DNA, 20 bp, Artificial
  CRISPR gRNA sequence
catttgatcctcccagccat

SEQ ID NO: 247955 - DNA, 20 bp, Artificial
  CRISPR gRNA sequence
atttgatcctcccagccatc

SEQ ID NO: 247956 - DNA, 20 bp, Artificial
  CRISPR gRNA sequence
gatcctcccagccatcctat

SEQ ID NO: 247957 - DNA, 20 bp, Artificial
  CRISPR gRNA sequence
atcctcccagccatcctata

SEQ ID NO: 247958 - DNA, 20 bp, Artificial
  CRISPR gRNA sequence
ccagccatcctataaaacag

SEQ ID NO: 247959 - DNA, 20 bp, Artificial
  CRISPR gRNA sequence
taaaacaggttctcttatta

SEQ ID NO: 247960 - DNA, 20 bp, Artificial
  CRISPR gRNA sequence
tcttattatccccagatgag

SEQ ID NO: 247961 - DNA, 20 bp, Artificial
  CRISPR gRNA sequence
ttattatccccagatgagaa

SEQ ID NO: 247962 - DNA, 20 bp, Artificial
  CRISPR gRNA sequence
attatccccagatgagaaag

SEQ ID NO: 247963 - DNA, 20 bp, Artificial
  CRISPR gRNA sequence
ttatccccagatgagaaagt

SEQ ID NO: 247964 - DNA, 20 bp, Artificial
  CRISPR gRNA sequence
tccccagatgagaaagtcaa

SEQ ID NO: 247965 - DNA, 20 bp, Artificial
  CRISPR gRNA sequence
aatgactttgctgtgttcac

SEQ ID NO: 247966 - DNA, 20 bp, Artificial
  CRISPR gRNA sequence
tgctgtgttcacacagctag

SEQ ID NO: 247967 - DNA, 20 bp, Artificial
  CRISPR gRNA sequence
gctgtgttcacacagctagg

SEQ ID NO: 247968 - DNA, 20 bp, Artificial
  CRISPR gRNA sequence
ctgtgttcacacagctaggt

SEQ ID NO: 247969 - DNA, 20 bp, Artificial
  CRISPR gRNA sequence
tgttcacacagctaggttgt

SEQ ID NO: 247970 - DNA, 20 bp, Artificial
  CRISPR gRNA sequence
acacagctaggttgtagcat

SEQ ID NO: 247971 - DNA, 20 bp, Artificial
  CRISPR gRNA sequence
ggttgtagcatccaataaac

SEQ ID NO: 247972 - DNA, 20 bp, Artificial
  CRISPR gRNA sequence
tagcatccaataaacatttg

SEQ ID NO: 247973 - DNA, 20 bp, Artificial
  CRISPR gRNA sequence
gtaaatgaatgaattttcat

SEQ ID NO: 247974 - DNA, 20 bp, Artificial
  CRISPR gRNA sequence
taaatgaatgaattttcatt

SEQ ID NO: 247975 - DNA, 20 bp, Artificial
  CRISPR gRNA sequence
tcattttcctttccttaaaa

SEQ ID NO: 247976 - DNA, 20 bp, Artificial
  CRISPR gRNA sequence
cattttcctttccttaaaag

SEQ ID NO: 247977 - DNA, 20 bp, Artificial
  CRISPR gRNA sequence
attttcctttccttaaaagg

SEQ ID NO: 247978 - DNA, 20 bp, Artificial
  CRISPR gRNA sequence
tcctttccttaaaagggagc

SEQ ID NO: 247979 - DNA, 20 bp, Artificial
  CRISPR gRNA sequence
cctttccttaaaagggagct

SEQ ID NO: 247980 - DNA, 20 bp, Artificial
  CRISPR gRNA sequence
ctttccttaaaagggagctc

SEQ ID NO: 247981 - DNA, 20 bp, Artificial
  CRISPR gRNA sequence
tccttaaaagggagctcgtt

SEQ ID NO: 247982 - DNA, 20 bp, Artificial
  CRISPR gRNA sequence
ccttaaaagggagctcgtta

SEQ ID NO: 247983 - DNA, 20 bp, Artificial
  CRISPR gRNA sequence
cttaaaagggagctcgttag

SEQ ID NO: 247984 - DNA, 20 bp, Artificial
  CRISPR gRNA sequence
aaaagggagctcgttagccc

SEQ ID NO: 247985 - DNA, 20 bp, Artificial
  CRISPR gRNA sequence
aaagggagctcgttagccct

SEQ ID NO: 247986 - DNA, 20 bp, Artificial
  CRISPR gRNA sequence
gttagccctgactactagac

SEQ ID NO: 247987 - DNA, 20 bp, Artificial
  CRISPR gRNA sequence
gccctgactactagactaac

SEQ ID NO: 247988 - DNA, 20 bp, Artificial
  CRISPR gRNA sequence
actactagactaactgaacc

SEQ ID NO: 247989 - DNA, 20 bp, Artificial
  CRISPR gRNA sequence
ctagactaactgaaccatac

SEQ ID NO: 247990 - DNA, 20 bp, Artificial
  CRISPR gRNA sequence
gactaactgaaccatacttc

SEQ ID NO: 247991 - DNA, 20 bp, Artificial
  CRISPR gRNA sequence
actgaaccatacttccaaca

SEQ ID NO: 247992 - DNA, 20 bp, Artificial
  CRISPR gRNA sequence
aaccatacttccaacagagc

SEQ ID NO: 247993 - DNA, 20 bp, Artificial
  CRISPR gRNA sequence
ccaacagagcagatcaaatg

SEQ ID NO: 247994 - DNA, 20 bp, Artificial
  CRISPR gRNA sequence
caacagagcagatcaaatgc

SEQ ID NO: 247995 - DNA, 20 bp, Artificial
  CRISPR gRNA sequence
ggtactcaccagctgggcag

SEQ ID NO: 247996 - DNA, 20 bp, Artificial
  CRISPR gRNA sequence
accagctgggcagttactac

SEQ ID NO: 247997 - DNA, 20 bp, Artificial
  CRISPR gRNA sequence
ggcagttactacaaggatcc

SEQ ID NO: 247998 - DNA, 20 bp, Artificial
  CRISPR gRNA sequence
ctacaaggatcctgcaatga

SEQ ID NO: 247999 - DNA, 20 bp, Artificial
  CRISPR gRNA sequence
caaggatcctgcaatgatct

SEQ ID NO: 248000 - DNA, 20 bp, Artificial
  CRISPR gRNA sequence
caatgatcttgtcctctcaa

SEQ ID NO: 248001 - DNA, 20 bp, Artificial
  CRISPR gRNA sequence
gtcctctcaaagttgaggac

SEQ ID NO: 248002 - DNA, 20 bp, Artificial
  CRISPR gRNA sequence
tcctctcaaagttgaggacc

SEQ ID NO: 248003 - DNA, 20 bp, Artificial
  CRISPR gRNA sequence
tcaaagttgaggaccagcaa

SEQ ID NO: 248004 - DNA, 20 bp, Artificial
  CRISPR gRNA sequence
aaagttgaggaccagcaaca

SEQ ID NO: 248005 - DNA, 20 bp, Artificial
  CRISPR gRNA sequence
aggaccagcaacagagtggc

SEQ ID NO: 248006 - DNA, 20 bp, Artificial
  CRISPR gRNA sequence
ctatgttgtaacagctgttt

SEQ ID NO: 248007 - DNA, 20 bp, Artificial
  CRISPR gRNA sequence
tgttgtaacagctgtttccc

SEQ ID NO: 248008 - DNA, 20 bp, Artificial
  CRISPR gRNA sequence
taacagctgtttcccatgat

SEQ ID NO: 248009 - DNA, 20 bp, Artificial
  CRISPR gRNA sequence
tttcccatgatgaaatctgg

SEQ ID NO: 248010 - DNA, 20 bp, Artificial
  CRISPR gRNA sequence
cccatgatgaaatctggcac

SEQ ID NO: 248011 - DNA, 20 bp, Artificial
  CRISPR gRNA sequence
ccatgatgaaatctggcaca

SEQ ID NO: 248012 - DNA, 20 bp, Artificial
  CRISPR gRNA sequence
gcacaggtatgatactagca

SEQ ID NO: 248013 - DNA, 20 bp, Artificial
  CRISPR gRNA sequence
gcaaagctgattccaagaga

SEQ ID NO: 248014 - DNA, 20 bp, Artificial
  CRISPR gRNA sequence
attccaagagaattttaatc

SEQ ID NO: 248015 - DNA, 20 bp, Artificial
  CRISPR gRNA sequence
caagagaattttaatcaaat

SEQ ID NO: 248016 - DNA, 20 bp, Artificial
  CRISPR gRNA sequence
taatcaaattagctggtctc

SEQ ID NO: 248017 - DNA, 20 bp, Artificial
  CRISPR gRNA sequence
aatcaaattagctggtctca

SEQ ID NO: 248018 - DNA, 20 bp, Artificial
  CRISPR gRNA sequence
atcaaattagctggtctcac

SEQ ID NO: 248019 - DNA, 20 bp, Artificial
  CRISPR gRNA sequence
gctggtctcacaaatgtcac

SEQ ID NO: 248020 - DNA, 20 bp, Artificial
  CRISPR gRNA sequence
gtctcacaaatgtcactctg

SEQ ID NO: 248021 - DNA, 20 bp, Artificial
  CRISPR gRNA sequence
acaaatgtcactctgcaaaa

SEQ ID NO: 248022 - DNA, 20 bp, Artificial
  CRISPR gRNA sequence
tgcaaaagataaacatttcc

SEQ ID NO: 248023 - DNA, 20 bp, Artificial
  CRISPR gRNA sequence
caaaagataaacatttccaa

SEQ ID NO: 248024 - DNA, 20 bp, Artificial
  CRISPR gRNA sequence
ccaaggaaaggtggtttctc

SEQ ID NO: 248025 - DNA, 20 bp, Artificial
  CRISPR gRNA sequence
caaggaaaggtggtttctcc

SEQ ID NO: 248026 - DNA, 20 bp, Artificial
  CRISPR gRNA sequence
ctcctttcaaaattatctat

SEQ ID NO: 248027 - DNA, 20 bp, Artificial
  CRISPR gRNA sequence
tcctttcaaaattatctata

SEQ ID NO: 248028 - DNA, 20 bp, Artificial
  CRISPR gRNA sequence
ctttcaaaattatctatatt

SEQ ID NO: 248029 - DNA, 20 bp, Artificial
  CRISPR gRNA sequence
tcaaaattatctatattgca

SEQ ID NO: 248030 - DNA, 20 bp, Artificial
  CRISPR gRNA sequence
caaaattatctatattgcaa

SEQ ID NO: 248031 - DNA, 20 bp, Artificial
  CRISPR gRNA sequence
aaaattatctatattgcaat

SEQ ID NO: 248032 - DNA, 20 bp, Artificial
  CRISPR gRNA sequence
tctatattgcaatcattact

SEQ ID NO: 248033 - DNA, 20 bp, Artificial
  CRISPR gRNA sequence
tattgcaatcattacttata

SEQ ID NO: 248034 - DNA, 20 bp, Artificial
  CRISPR gRNA sequence
caatcattacttatacaatt

SEQ ID NO: 248035 - DNA, 20 bp, Artificial
  CRISPR gRNA sequence
cttatacaattctataagag

SEQ ID NO: 248036 - DNA, 20 bp, Artificial
  CRISPR gRNA sequence
atacaattctataagaggat

SEQ ID NO: 248037 - DNA, 20 bp, Artificial
  CRISPR gRNA sequence
tacaattctataagaggata

SEQ ID NO: 248038 - DNA, 20 bp, Artificial
  CRISPR gRNA sequence
tataagaggataactcaggg

SEQ ID NO: 248039 - DNA, 20 bp, Artificial
  CRISPR gRNA sequence
taagaggataactcagggtt

SEQ ID NO: 248040 - DNA, 20 bp, Artificial
  CRISPR gRNA sequence
agggtttttcaggaacaatt

SEQ ID NO: 248041 - DNA, 20 bp, Artificial
  CRISPR gRNA sequence
ttcaggaacaattaatgatg

SEQ ID NO: 248042 - DNA, 20 bp, Artificial
  CRISPR gRNA sequence
tcaggaacaattaatgatgc

SEQ ID NO: 248043 - DNA, 20 bp, Artificial
  CRISPR gRNA sequence
caggaacaattaatgatgca

SEQ ID NO: 248044 - DNA, 20 bp, Artificial
  CRISPR gRNA sequence
aggaacaattaatgatgcaa

SEQ ID NO: 248045 - DNA, 20 bp, Artificial
  CRISPR gRNA sequence
atgatgcaatattacggaaa

SEQ ID NO: 248046 - DNA, 20 bp, Artificial
  CRISPR gRNA sequence
cggaaaagtagcagattcat

SEQ ID NO: 248047 - DNA, 20 bp, Artificial
  CRISPR gRNA sequence
atagaaaccactaggacaag

SEQ ID NO: 248048 - DNA, 20 bp, Artificial
  CRISPR gRNA sequence
ggacaaggcaggcgtgatta

SEQ ID NO: 248049 - DNA, 20 bp, Artificial
  CRISPR gRNA sequence
aacacacagctttgtgccgg

SEQ ID NO: 248050 - DNA, 20 bp, Artificial
  CRISPR gRNA sequence
tgtgccggtttgccaaagtt

SEQ ID NO: 248051 - DNA, 20 bp, Artificial
  CRISPR gRNA sequence
gtgccggtttgccaaagttt

SEQ ID NO: 248052 - DNA, 20 bp, Artificial
  CRISPR gRNA sequence
tgccggtttgccaaagtttg

SEQ ID NO: 248053 - DNA, 20 bp, Artificial
  CRISPR gRNA sequence
gccaaagtttgagggtgcat

SEQ ID NO: 248054 - DNA, 20 bp, Artificial
  CRISPR gRNA sequence
ccaaagtttgagggtgcatt

SEQ ID NO: 248055 - DNA, 20 bp, Artificial
  CRISPR gRNA sequence
gagggtgcattttccatcat

SEQ ID NO: 248056 - DNA, 20 bp, Artificial
  CRISPR gRNA sequence
agggtgcattttccatcatg

SEQ ID NO: 248057 - DNA, 20 bp, Artificial
  CRISPR gRNA sequence
tccatcatgttctgccaaaa

SEQ ID NO: 248058 - DNA, 20 bp, Artificial
  CRISPR gRNA sequence
ccatcatgttctgccaaaat

SEQ ID NO: 248059 - DNA, 20 bp, Artificial
  CRISPR gRNA sequence
catcatgttctgccaaaatg

SEQ ID NO: 248060 - DNA, 20 bp, Artificial
  CRISPR gRNA sequence
tgccaaaatgcagaaataac

SEQ ID NO: 248061 - DNA, 20 bp, Artificial
  CRISPR gRNA sequence
ccaaaatgcagaaataacaa

SEQ ID NO: 248062 - DNA, 20 bp, Artificial
  CRISPR gRNA sequence
ttggggactttcataggtac

SEQ ID NO: 248063 - DNA, 20 bp, Artificial
  CRISPR gRNA sequence
tggggactttcataggtact

SEQ ID NO: 248064 - DNA, 20 bp, Artificial
  CRISPR gRNA sequence
ggggactttcataggtactt

SEQ ID NO: 248065 - DNA, 20 bp, Artificial
  CRISPR gRNA sequence
gggactttcataggtacttt

SEQ ID NO: 248066 - DNA, 20 bp, Artificial
  CRISPR gRNA sequence
tcataggtactttgcagtac

SEQ ID NO: 248067 - DNA, 20 bp, Artificial
  CRISPR gRNA sequence
cataggtactttgcagtacc

SEQ ID NO: 248068 - DNA, 20 bp, Artificial
  CRISPR gRNA sequence
ataggtactttgcagtacca

SEQ ID NO: 248069 - DNA, 20 bp, Artificial
  CRISPR gRNA sequence
tgcagtaccaaccagcaata

SEQ ID NO: 248070 - DNA, 20 bp, Artificial
  CRISPR gRNA sequence
gcagtaccaaccagcaataa

SEQ ID NO: 248071 - DNA, 20 bp, Artificial
  CRISPR gRNA sequence
cagtaccaaccagcaataat

SEQ ID NO: 248072 - DNA, 20 bp, Artificial
  CRISPR gRNA sequence
cttattgcccctgaaataaa

SEQ ID NO: 248073 - DNA, 20 bp, Artificial
  CRISPR gRNA sequence
attgcccctgaaataaactc

SEQ ID NO: 248074 - DNA, 20 bp, Artificial
  CRISPR gRNA sequence
ttgcccctgaaataaactcc

SEQ ID NO: 248075 - DNA, 20 bp, Artificial
  CRISPR gRNA sequence
cccctgaaataaactcctta

SEQ ID NO: 248076 - DNA, 20 bp, Artificial
  CRISPR gRNA sequence
aaataaactccttacaaaga

SEQ ID NO: 248077 - DNA, 20 bp, Artificial
  CRISPR gRNA sequence
cttacaaagagaatctgtca

SEQ ID NO: 248078 - DNA, 20 bp, Artificial
  CRISPR gRNA sequence
acaaagagaatctgtcaggg

SEQ ID NO: 248079 - DNA, 20 bp, Artificial
  CRISPR gRNA sequence
caaagagaatctgtcagggg

SEQ ID NO: 248080 - DNA, 20 bp, Artificial
  CRISPR gRNA sequence
tcaggggcatcagacaattc

SEQ ID NO: 248081 - DNA, 20 bp, Artificial
  CRISPR gRNA sequence
agttcaagaagaagctatca

SEQ ID NO: 248082 - DNA, 20 bp, Artificial
  CRISPR gRNA sequence
aagaagaagctatcacataa

SEQ ID NO: 248083 - DNA, 20 bp, Artificial
  CRISPR gRNA sequence
tcacataatcactcttcccc

SEQ ID NO: 248084 - DNA, 20 bp, Artificial
  CRISPR gRNA sequence
ttccccctttagctgaacac

SEQ ID NO: 248085 - DNA, 20 bp, Artificial
  CRISPR gRNA sequence
ccccctttagctgaacacct

SEQ ID NO: 248086 - DNA, 20 bp, Artificial
  CRISPR gRNA sequence
cccctttagctgaacaccta

SEQ ID NO: 248087 - DNA, 20 bp, Artificial
  CRISPR gRNA sequence
tagctgaacacctaactact

SEQ ID NO: 248088 - DNA, 20 bp, Artificial
  CRISPR gRNA sequence
agctgaacacctaactacta

SEQ ID NO: 248089 - DNA, 20 bp, Artificial
  CRISPR gRNA sequence
gctgaacacctaactactaa

SEQ ID NO: 248090 - DNA, 20 bp, Artificial
  CRISPR gRNA sequence
aacacctaactactaacatg

SEQ ID NO: 248091 - DNA, 20 bp, Artificial
  CRISPR gRNA sequence
actactaacatgtggaaaga

SEQ ID NO: 248092 - DNA, 20 bp, Artificial
  CRISPR gRNA sequence
ctaacatgtggaaagacctc

SEQ ID NO: 248093 - DNA, 20 bp, Artificial
  CRISPR gRNA sequence
acatgtggaaagacctccct

SEQ ID NO: 248094 - DNA, 20 bp, Artificial
  CRISPR gRNA sequence
cctgttcaactcactaacac

SEQ ID NO: 248095 - DNA, 20 bp, Artificial
  CRISPR gRNA sequence
ttcaactcactaacacattt

SEQ ID NO: 248096 - DNA, 20 bp, Artificial
  CRISPR gRNA sequence
aactcactaacacattttct

SEQ ID NO: 248097 - DNA, 20 bp, Artificial
  CRISPR gRNA sequence
actaacacattttcttaaac

SEQ ID NO: 248098 - DNA, 20 bp, Artificial
  CRISPR gRNA sequence
acacattttcttaaacagag

SEQ ID NO: 248099 - DNA, 20 bp, Artificial
  CRISPR gRNA sequence
tcttaaacagagacatgttt

SEQ ID NO: 248100 - DNA, 20 bp, Artificial
  CRISPR gRNA sequence
cttaaacagagacatgtttt

SEQ ID NO: 248101 - DNA, 20 bp, Artificial
  CRISPR gRNA sequence
ttaaacagagacatgttttg

SEQ ID NO: 248102 - DNA, 20 bp, Artificial
  CRISPR gRNA sequence
aaacagagacatgttttgag

SEQ ID NO: 248103 - DNA, 20 bp, Artificial
  CRISPR gRNA sequence
aacagagacatgttttgaga

SEQ ID NO: 248104 - DNA, 20 bp, Artificial
  CRISPR gRNA sequence
tgagatgtgaagtttgtatg

SEQ ID NO: 248105 - DNA, 20 bp, Artificial
  CRISPR gRNA sequence
gagatgtgaagtttgtatgg

SEQ ID NO: 248106 - DNA, 20 bp, Artificial
  CRISPR gRNA sequence
agatgtgaagtttgtatggt

SEQ ID NO: 248107 - DNA, 20 bp, Artificial
  CRISPR gRNA sequence
gtatggtaacaaaactaagg

SEQ ID NO: 248108 - DNA, 20 bp, Artificial
  CRISPR gRNA sequence
tatggtaacaaaactaagga

SEQ ID NO: 248109 - DNA, 20 bp, Artificial
  CRISPR gRNA sequence
aggagtgaaaaactcttcag

SEQ ID NO: 248110 - DNA, 20 bp, Artificial
  CRISPR gRNA sequence
ttcaggctaagttattgatg

SEQ ID NO: 248111 - DNA, 20 bp, Artificial
  CRISPR gRNA sequence
caggctaagttattgatgtt

SEQ ID NO: 248112 - DNA, 20 bp, Artificial
  CRISPR gRNA sequence
aggctaagttattgatgttt

SEQ ID NO: 248113 - DNA, 20 bp, Artificial
  CRISPR gRNA sequence
agttattgatgtttatttaa

SEQ ID NO: 248114 - DNA, 20 bp, Artificial
  CRISPR gRNA sequence
ttgatgtttatttaaagggc

SEQ ID NO: 248115 - DNA, 20 bp, Artificial
  CRISPR gRNA sequence
atgtttatttaaagggctat

SEQ ID NO: 248116 - DNA, 20 bp, Artificial
  CRISPR gRNA sequence
atttaaagggctattgaaga

SEQ ID NO: 248117 - DNA, 20 bp, Artificial
  CRISPR gRNA sequence
tttaaagggctattgaagag

SEQ ID NO: 248118 - DNA, 20 bp, Artificial
  CRISPR gRNA sequence
aaagggctattgaagagaag

SEQ ID NO: 248119 - DNA, 20 bp, Artificial
  CRISPR gRNA sequence
aagggctattgaagagaagt

SEQ ID NO: 248120 - DNA, 20 bp, Artificial
  CRISPR gRNA sequence
ttgaagagaagttattacat

SEQ ID NO: 248121 - DNA, 20 bp, Artificial
  CRISPR gRNA sequence
aagagaagttattacatatt

SEQ ID NO: 248122 - DNA, 20 bp, Artificial
  CRISPR gRNA sequence
ttacatattaggagaaaaag

SEQ ID NO: 248123 - DNA, 20 bp, Artificial
  CRISPR gRNA sequence
catattaggagaaaaagtct

SEQ ID NO: 248124 - DNA, 20 bp, Artificial
  CRISPR gRNA sequence
ggagaaaaagtctagaaatg

SEQ ID NO: 248125 - DNA, 20 bp, Artificial
  CRISPR gRNA sequence
gaaatgggcaaagggagcaa

SEQ ID NO: 248126 - DNA, 20 bp, Artificial
  CRISPR gRNA sequence
caatctcaccccttctcagt

SEQ ID NO: 248127 - DNA, 20 bp, Artificial
  CRISPR gRNA sequence
accccttctcagtgccccca

SEQ ID NO: 248128 - DNA, 20 bp, Artificial
  CRISPR gRNA sequence
ctcagtgcccccacccactc

SEQ ID NO: 248129 - DNA, 20 bp, Artificial
  CRISPR gRNA sequence
tcagtgcccccacccactcc

SEQ ID NO: 248130 - DNA, 20 bp, Artificial
  CRISPR gRNA sequence
agtgcccccacccactcccc

SEQ ID NO: 248131 - DNA, 20 bp, Artificial
  CRISPR gRNA sequence
ccccagatggacagaccttg

SEQ ID NO: 248132 - DNA, 20 bp, Artificial
  CRISPR gRNA sequence
gagatctcagggctgccgga

SEQ ID NO: 248133 - DNA, 20 bp, Artificial
  CRISPR gRNA sequence
agatctcagggctgccggag

SEQ ID NO: 248134 - DNA, 20 bp, Artificial
  CRISPR gRNA sequence
agggctgccggagaactttc

SEQ ID NO: 248135 - DNA, 20 bp, Artificial
  CRISPR gRNA sequence
ccggagaactttccactcct

SEQ ID NO: 248136 - DNA, 20 bp, Artificial
  CRISPR gRNA sequence
tccactccttggtcttcagg

SEQ ID NO: 248137 - DNA, 20 bp, Artificial
  CRISPR gRNA sequence
ccactccttggtcttcaggc

SEQ ID NO: 248138 - DNA, 20 bp, Artificial
  CRISPR gRNA sequence
cactccttggtcttcaggct

SEQ ID NO: 248139 - DNA, 20 bp, Artificial
  CRISPR gRNA sequence
cttggtcttcaggcttctgc

SEQ ID NO: 248140 - DNA, 20 bp, Artificial
  CRISPR gRNA sequence
ggtcttcaggcttctgcagc

SEQ ID NO: 248141 - DNA, 20 bp, Artificial
  CRISPR gRNA sequence
gtcttcaggcttctgcagct

SEQ ID NO: 248142 - DNA, 20 bp, Artificial
  CRISPR gRNA sequence
caggcttctgcagctcgaga

SEQ ID NO: 248143 - DNA, 20 bp, Artificial
  CRISPR gRNA sequence
aggcttctgcagctcgagag

SEQ ID NO: 248144 - DNA, 20 bp, Artificial
  CRISPR gRNA sequence
ctgcagctcgagaggacttc

SEQ ID NO: 248145 - DNA, 20 bp, Artificial
  CRISPR gRNA sequence
tgcagctcgagaggacttca

SEQ ID NO: 248146 - DNA, 20 bp, Artificial
  CRISPR gRNA sequence
cagctcgagaggacttcagg

SEQ ID NO: 248147 - DNA, 20 bp, Artificial
  CRISPR gRNA sequence
gagaggacttcaggtcaaac

SEQ ID NO: 248148 - DNA, 20 bp, Artificial
  CRISPR gRNA sequence
caggtcaaacacaggagtgc

SEQ ID NO: 248149 - DNA, 20 bp, Artificial
  CRISPR gRNA sequence
aggtcaaacacaggagtgcg

SEQ ID NO: 248150 - DNA, 20 bp, Artificial
  CRISPR gRNA sequence
agccaggggcggggtctcat

SEQ ID NO: 248151 - DNA, 20 bp, Artificial
  CRISPR gRNA sequence
atgggaaattcccaccacag

SEQ ID NO: 248152 - DNA, 20 bp, Artificial
  CRISPR gRNA sequence
ccaccacagctctgtgacag

SEQ ID NO: 248153 - DNA, 20 bp, Artificial
  CRISPR gRNA sequence
tgtgacagccctatgaaatc

SEQ ID NO: 248154 - DNA, 20 bp, Artificial
  CRISPR gRNA sequence
tgacagccctatgaaatcat

SEQ ID NO: 248155 - DNA, 20 bp, Artificial
  CRISPR gRNA sequence
tgaaatcattcatttcatat

SEQ ID NO: 248156 - DNA, 20 bp, Artificial
  CRISPR gRNA sequence
atttcatatctgctgacccc

SEQ ID NO: 248157 - DNA, 20 bp, Artificial
  CRISPR gRNA sequence
catatctgctgaccccgaaa

SEQ ID NO: 248158 - DNA, 20 bp, Artificial
  CRISPR gRNA sequence
atatctgctgaccccgaaat

SEQ ID NO: 248159 - DNA, 20 bp, Artificial
  CRISPR gRNA sequence
ctgaccccgaaatcccctag

SEQ ID NO: 248160 - DNA, 20 bp, Artificial
  CRISPR gRNA sequence
accccgaaatcccctagagc

SEQ ID NO: 248161 - DNA, 20 bp, Artificial
  CRISPR gRNA sequence
gagcccccgtccctgcctga

SEQ ID NO: 248162 - DNA, 20 bp, Artificial
  CRISPR gRNA sequence
cctgataatggcacttcaaa

SEQ ID NO: 248163 - DNA, 20 bp, Artificial
  CRISPR gRNA sequence
ataatggcacttcaaattgc

SEQ ID NO: 248164 - DNA, 20 bp, Artificial
  CRISPR gRNA sequence
caaattgcttcttggaagca

SEQ ID NO: 248165 - DNA, 20 bp, Artificial
  CRISPR gRNA sequence
aaattgcttcttggaagcag

SEQ ID NO: 248166 - DNA, 20 bp, Artificial
  CRISPR gRNA sequence
cttcttggaagcagctctct

SEQ ID NO: 248167 - DNA, 20 bp, Artificial
  CRISPR gRNA sequence
cttggaagcagctctctact

SEQ ID NO: 248168 - DNA, 20 bp, Artificial
  CRISPR gRNA sequence
ttggaagcagctctctactg

SEQ ID NO: 248169 - DNA, 20 bp, Artificial
  CRISPR gRNA sequence
ggaagcagctctctactgtc

SEQ ID NO: 248170 - DNA, 20 bp, Artificial
  CRISPR gRNA sequence
gaagcagctctctactgtca

SEQ ID NO: 248171 - DNA, 20 bp, Artificial
  CRISPR gRNA sequence
tctactgtcaggatgtgtca

SEQ ID NO: 248172 - DNA, 20 bp, Artificial
  CRISPR gRNA sequence
tactgtcaggatgtgtcaca

SEQ ID NO: 248173 - DNA, 20 bp, Artificial
  CRISPR gRNA sequence
ctgtcaggatgtgtcacaga

SEQ ID NO: 248174 - DNA, 20 bp, Artificial
  CRISPR gRNA sequence
tcaggatgtgtcacagatga

SEQ ID NO: 248175 - DNA, 20 bp, Artificial
  CRISPR gRNA sequence
tcccagcgtcatctgtgaca

SEQ ID NO: 248176 - DNA, 20 bp, Artificial
  CRISPR gRNA sequence
cccagcgtcatctgtgacac

SEQ ID NO: 248177 - DNA, 20 bp, Artificial
  CRISPR gRNA sequence
ccagcgtcatctgtgacaca

SEQ ID NO: 248178 - DNA, 20 bp, Artificial
  CRISPR gRNA sequence
tgacacatcctgacagtaga

SEQ ID NO: 248179 - DNA, 20 bp, Artificial
  CRISPR gRNA sequence
acagtagagagctgcttcca

SEQ ID NO: 248180 - DNA, 20 bp, Artificial
  CRISPR gRNA sequence
cttccaagaagcaatttgaa

SEQ ID NO: 248181 - DNA, 20 bp, Artificial
  CRISPR gRNA sequence
ccaagaagcaatttgaagtg

SEQ ID NO: 248182 - DNA, 20 bp, Artificial
  CRISPR gRNA sequence
caagaagcaatttgaagtgc

SEQ ID NO: 248183 - DNA, 20 bp, Artificial
  CRISPR gRNA sequence
gaagtgccattatcaggcag

SEQ ID NO: 248184 - DNA, 20 bp, Artificial
  CRISPR gRNA sequence
aagtgccattatcaggcagg

SEQ ID NO: 248185 - DNA, 20 bp, Artificial
  CRISPR gRNA sequence
tcaggcagggacgggggctc

SEQ ID NO: 248186 - DNA, 20 bp, Artificial
  CRISPR gRNA sequence
taggggatttcggggtcagc

SEQ ID NO: 248187 - DNA, 20 bp, Artificial
  CRISPR gRNA sequence
ggggatttcggggtcagcag

SEQ ID NO: 248188 - DNA, 20 bp, Artificial
  CRISPR gRNA sequence
cggggtcagcagatatgaaa

SEQ ID NO: 248189 - DNA, 20 bp, Artificial
  CRISPR gRNA sequence
ggggtcagcagatatgaaat

SEQ ID NO: 248190 - DNA, 20 bp, Artificial
  CRISPR gRNA sequence
catagggctgtcacagagct

SEQ ID NO: 248191 - DNA, 20 bp, Artificial
  CRISPR gRNA sequence
atagggctgtcacagagctg

SEQ ID NO: 248192 - DNA, 20 bp, Artificial
  CRISPR gRNA sequence
tcacagagctgtggtgggaa

SEQ ID NO: 248193 - DNA, 20 bp, Artificial
  CRISPR gRNA sequence
tggtgggaatttcccatgag

SEQ ID NO: 248194 - DNA, 20 bp, Artificial
  CRISPR gRNA sequence
cccatgagaccccgcccctg

SEQ ID NO: 248195 - DNA, 20 bp, Artificial
  CRISPR gRNA sequence
ccatgagaccccgcccctgg

SEQ ID NO: 248196 - DNA, 20 bp, Artificial
  CRISPR gRNA sequence
gctgagtcaccgcactcctg

SEQ ID NO: 248197 - DNA, 20 bp, Artificial
  CRISPR gRNA sequence
agtcaccgcactcctgtgtt

SEQ ID NO: 248198 - DNA, 20 bp, Artificial
  CRISPR gRNA sequence
ctgtgtttgacctgaagtcc

SEQ ID NO: 248199 - DNA, 20 bp, Artificial
  CRISPR gRNA sequence
tgtttgacctgaagtcctct

SEQ ID NO: 248200 - DNA, 20 bp, Artificial
  CRISPR gRNA sequence
gacctgaagtcctctcgagc

SEQ ID NO: 248201 - DNA, 20 bp, Artificial
  CRISPR gRNA sequence
acctgaagtcctctcgagct

SEQ ID NO: 248202 - DNA, 20 bp, Artificial
  CRISPR gRNA sequence
aagtcctctcgagctgcaga

SEQ ID NO: 248203 - DNA, 20 bp, Artificial
  CRISPR gRNA sequence
tcgagctgcagaagcctgaa

SEQ ID NO: 248204 - DNA, 20 bp, Artificial
  CRISPR gRNA sequence
gagctgcagaagcctgaaga

SEQ ID NO: 248205 - DNA, 20 bp, Artificial
  CRISPR gRNA sequence
cagaagcctgaagaccaagg

SEQ ID NO: 248206 - DNA, 20 bp, Artificial
  CRISPR gRNA sequence
aagaccaaggagtggaaagt

SEQ ID NO: 248207 - DNA, 20 bp, Artificial
  CRISPR gRNA sequence
tccggcagccctgagatctc

SEQ ID NO: 248208 - DNA, 20 bp, Artificial
  CRISPR gRNA sequence
cggcagccctgagatctcaa

SEQ ID NO: 248209 - DNA, 20 bp, Artificial
  CRISPR gRNA sequence
agatctcaaggtctgtccat

SEQ ID NO: 248210 - DNA, 20 bp, Artificial
  CRISPR gRNA sequence
aaggtctgtccatctggggg

SEQ ID NO: 248211 - DNA, 20 bp, Artificial
  CRISPR gRNA sequence
tccatctgggggagtgggtg

SEQ ID NO: 248212 - DNA, 20 bp, Artificial
  CRISPR gRNA sequence
ggggagtgggtgggggcact

SEQ ID NO: 248213 - DNA, 20 bp, Artificial
  CRISPR gRNA sequence
agaaggggtgagattggaac

SEQ ID NO: 248214 - DNA, 20 bp, Artificial
  CRISPR gRNA sequence
gaacttttgctccctttgcc

SEQ ID NO: 248215 - DNA, 20 bp, Artificial
  CRISPR gRNA sequence
ttgctccctttgcccatttc

SEQ ID NO: 248216 - DNA, 20 bp, Artificial
  CRISPR gRNA sequence
tgctccctttgcccatttct

SEQ ID NO: 248217 - DNA, 20 bp, Artificial
  CRISPR gRNA sequence
gctccctttgcccatttcta

SEQ ID NO: 248218 - DNA, 20 bp, Artificial
  CRISPR gRNA sequence
ctccctttgcccatttctag

SEQ ID NO: 248219 - DNA, 20 bp, Artificial
  CRISPR gRNA sequence
cctttgcccatttctagact

SEQ ID NO: 248220 - DNA, 20 bp, Artificial
  CRISPR gRNA sequence
tgcccatttctagacttttt

SEQ ID NO: 248221 - DNA, 20 bp, Artificial
  CRISPR gRNA sequence
gcccatttctagactttttc

SEQ ID NO: 248222 - DNA, 20 bp, Artificial
  CRISPR gRNA sequence
cccatttctagactttttct

SEQ ID NO: 248223 - DNA, 20 bp, Artificial
  CRISPR gRNA sequence
ctagactttttctcctaata

SEQ ID NO: 248224 - DNA, 20 bp, Artificial
  CRISPR gRNA sequence
tagactttttctcctaatat

SEQ ID NO: 248225 - DNA, 20 bp, Artificial
  CRISPR gRNA sequence
gactttttctcctaatatgt

SEQ ID NO: 248226 - DNA, 20 bp, Artificial
  CRISPR gRNA sequence
tttctcctaatatgtaataa

SEQ ID NO: 248227 - DNA, 20 bp, Artificial
  CRISPR gRNA sequence
ttctcctaatatgtaataac

SEQ ID NO: 248228 - DNA, 20 bp, Artificial
  CRISPR gRNA sequence
tctcctaatatgtaataact

SEQ ID NO: 248229 - DNA, 20 bp, Artificial
  CRISPR gRNA sequence
ctcctaatatgtaataactt

SEQ ID NO: 248230 - DNA, 20 bp, Artificial
  CRISPR gRNA sequence
tcctaatatgtaataacttc

SEQ ID NO: 248231 - DNA, 20 bp, Artificial
  CRISPR gRNA sequence
ctaatatgtaataacttctc

SEQ ID NO: 248232 - DNA, 20 bp, Artificial
  CRISPR gRNA sequence
atatgtaataacttctcttc

SEQ ID NO: 248233 - DNA, 20 bp, Artificial
  CRISPR gRNA sequence
ctcttcaatagccctttaaa

SEQ ID NO: 248234 - DNA, 20 bp, Artificial
  CRISPR gRNA sequence
tcttcaatagccctttaaat

SEQ ID NO: 248235 - DNA, 20 bp, Artificial
  CRISPR gRNA sequence
ttcaatagccctttaaataa

SEQ ID NO: 248236 - DNA, 20 bp, Artificial
  CRISPR gRNA sequence
caatagccctttaaataaac

SEQ ID NO: 248237 - DNA, 20 bp, Artificial
  CRISPR gRNA sequence
aatagccctttaaataaaca

SEQ ID NO: 248238 - DNA, 20 bp, Artificial
  CRISPR gRNA sequence
taaataaacatcaataactt

SEQ ID NO: 248239 - DNA, 20 bp, Artificial
  CRISPR gRNA sequence
aaataaacatcaataactta

SEQ ID NO: 248240 - DNA, 20 bp, Artificial
  CRISPR gRNA sequence
aataaacatcaataacttag

SEQ ID NO: 248241 - DNA, 20 bp, Artificial
  CRISPR gRNA sequence
agcctgaagagtttttcact

SEQ ID NO: 248242 - DNA, 20 bp, Artificial
  CRISPR gRNA sequence
gcctgaagagtttttcactc

SEQ ID NO: 248243 - DNA, 20 bp, Artificial
  CRISPR gRNA sequence
aagagtttttcactccttag

SEQ ID NO: 248244 - DNA, 20 bp, Artificial
  CRISPR gRNA sequence
ttcactccttagttttgtta

SEQ ID NO: 248245 - DNA, 20 bp, Artificial
  CRISPR gRNA sequence
tcactccttagttttgttac

SEQ ID NO: 248246 - DNA, 20 bp, Artificial
  CRISPR gRNA sequence
cactccttagttttgttacc

SEQ ID NO: 248247 - DNA, 20 bp, Artificial
  CRISPR gRNA sequence
actccttagttttgttacca

SEQ ID NO: 248248 - DNA, 20 bp, Artificial
  CRISPR gRNA sequence
cttagttttgttaccataca

SEQ ID NO: 248249 - DNA, 20 bp, Artificial
  CRISPR gRNA sequence
agttttgttaccatacaaac

SEQ ID NO: 248250 - DNA, 20 bp, Artificial
  CRISPR gRNA sequence
gttttgttaccatacaaact

SEQ ID NO: 248251 - DNA, 20 bp, Artificial
  CRISPR gRNA sequence
tgttaccatacaaacttcac

SEQ ID NO: 248252 - DNA, 20 bp, Artificial
  CRISPR gRNA sequence
gttaccatacaaacttcaca

SEQ ID NO: 248253 - DNA, 20 bp, Artificial
  CRISPR gRNA sequence
ttaccatacaaacttcacat

SEQ ID NO: 248254 - DNA, 20 bp, Artificial
  CRISPR gRNA sequence
ccatacaaacttcacatctc

SEQ ID NO: 248255 - DNA, 20 bp, Artificial
  CRISPR gRNA sequence
cacatctcaaaacatgtctc

SEQ ID NO: 248256 - DNA, 20 bp, Artificial
  CRISPR gRNA sequence
acatctcaaaacatgtctct

SEQ ID NO: 248257 - DNA, 20 bp, Artificial
  CRISPR gRNA sequence
aaaacatgtctctgtttaag

SEQ ID NO: 248258 - DNA, 20 bp, Artificial
  CRISPR gRNA sequence
tgtttaagaaaatgtgttag

SEQ ID NO: 248259 - DNA, 20 bp, Artificial
  CRISPR gRNA sequence
tttaagaaaatgtgttagtg

SEQ ID NO: 248260 - DNA, 20 bp, Artificial
  CRISPR gRNA sequence
aagaaaatgtgttagtgagt

SEQ ID NO: 248261 - DNA, 20 bp, Artificial
  CRISPR gRNA sequence
agaaaatgtgttagtgagtt

SEQ ID NO: 248262 - DNA, 20 bp, Artificial
  CRISPR gRNA sequence
gtgagttgaacagggaggtc

SEQ ID NO: 248263 - DNA, 20 bp, Artificial
  CRISPR gRNA sequence
aacagggaggtctttccaca

SEQ ID NO: 248264 - DNA, 20 bp, Artificial
  CRISPR gRNA sequence
tccacatgttagtagttagg

SEQ ID NO: 248265 - DNA, 20 bp, Artificial
  CRISPR gRNA sequence
ccacatgttagtagttaggt

SEQ ID NO: 248266 - DNA, 20 bp, Artificial
  CRISPR gRNA sequence
cacatgttagtagttaggtg

SEQ ID NO: 248267 - DNA, 20 bp, Artificial
  CRISPR gRNA sequence
gtagttaggtgttcagctaa

SEQ ID NO: 248268 - DNA, 20 bp, Artificial
  CRISPR gRNA sequence
ggtgttcagctaaaggggga

SEQ ID NO: 248269 - DNA, 20 bp, Artificial
  CRISPR gRNA sequence
agctaaagggggaagagtga

SEQ ID NO: 248270 - DNA, 20 bp, Artificial
  CRISPR gRNA sequence
aagggggaagagtgattatg

SEQ ID NO: 248271 - DNA, 20 bp, Artificial
  CRISPR gRNA sequence
tgtgatagcttcttcttgaa

SEQ ID NO: 248272 - DNA, 20 bp, Artificial
  CRISPR gRNA sequence
cttcttgaactgaattgtct

SEQ ID NO: 248273 - DNA, 20 bp, Artificial
  CRISPR gRNA sequence
ttcttgaactgaattgtctg

SEQ ID NO: 248274 - DNA, 20 bp, Artificial
  CRISPR gRNA sequence
cttgaactgaattgtctgat

SEQ ID NO: 248275 - DNA, 20 bp, Artificial
  CRISPR gRNA sequence
ttgaactgaattgtctgatg

SEQ ID NO: 248276 - DNA, 20 bp, Artificial
  CRISPR gRNA sequence
gaactgaattgtctgatgcc

SEQ ID NO: 248277 - DNA, 20 bp, Artificial
  CRISPR gRNA sequence
aactgaattgtctgatgccc

SEQ ID NO: 248278 - DNA, 20 bp, Artificial
  CRISPR gRNA sequence
aattgtctgatgcccctgac

SEQ ID NO: 248279 - DNA, 20 bp, Artificial
  CRISPR gRNA sequence
tctgatgcccctgacagatt

SEQ ID NO: 248280 - DNA, 20 bp, Artificial
  CRISPR gRNA sequence
atgcccctgacagattctct

SEQ ID NO: 248281 - DNA, 20 bp, Artificial
  CRISPR gRNA sequence
acagattctctttgtaagga

SEQ ID NO: 248282 - DNA, 20 bp, Artificial
  CRISPR gRNA sequence
tctttgtaaggagtttattt

SEQ ID NO: 248283 - DNA, 20 bp, Artificial
  CRISPR gRNA sequence
tttgtaaggagtttatttca

SEQ ID NO: 248284 - DNA, 20 bp, Artificial
  CRISPR gRNA sequence
tgtaaggagtttatttcagg

SEQ ID NO: 248285 - DNA, 20 bp, Artificial
  CRISPR gRNA sequence
gtaaggagtttatttcaggg

SEQ ID NO: 248286 - DNA, 20 bp, Artificial
  CRISPR gRNA sequence
taaggagtttatttcagggg

SEQ ID NO: 248287 - DNA, 20 bp, Artificial
  CRISPR gRNA sequence
atttcaggggcaataagtaa

SEQ ID NO: 248288 - DNA, 20 bp, Artificial
  CRISPR gRNA sequence
tttcaggggcaataagtaat

SEQ ID NO: 248289 - DNA, 20 bp, Artificial
  CRISPR gRNA sequence
caggggcaataagtaattgg

SEQ ID NO: 248290 - DNA, 20 bp, Artificial
  CRISPR gRNA sequence
aggggcaataagtaattggc

SEQ ID NO: 248291 - DNA, 20 bp, Artificial
  CRISPR gRNA sequence
gcattattgctggttggtac

SEQ ID NO: 248292 - DNA, 20 bp, Artificial
  CRISPR gRNA sequence
ttgctggttggtactgcaaa

SEQ ID NO: 248293 - DNA, 20 bp, Artificial
  CRISPR gRNA sequence
ctggttggtactgcaaagta

SEQ ID NO: 248294 - DNA, 20 bp, Artificial
  CRISPR gRNA sequence
gttggtactgcaaagtacct

SEQ ID NO: 248295 - DNA, 20 bp, Artificial
  CRISPR gRNA sequence
gtactgcaaagtacctatga

SEQ ID NO: 248296 - DNA, 20 bp, Artificial
  CRISPR gRNA sequence
caaagtacctatgaaagtcc

SEQ ID NO: 248297 - DNA, 20 bp, Artificial
  CRISPR gRNA sequence
tgaaagtccccaaaagttct

SEQ ID NO: 248298 - DNA, 20 bp, Artificial
  CRISPR gRNA sequence
ttgctattgttatttctgca

SEQ ID NO: 248299 - DNA, 20 bp, Artificial
  CRISPR gRNA sequence
gctattgttatttctgcatt

SEQ ID NO: 248300 - DNA, 20 bp, Artificial
  CRISPR gRNA sequence
ctattgttatttctgcattt

SEQ ID NO: 248301 - DNA, 20 bp, Artificial
  CRISPR gRNA sequence
ttgttatttctgcattttgg

SEQ ID NO: 248302 - DNA, 20 bp, Artificial
  CRISPR gRNA sequence
ttatttctgcattttggcag

SEQ ID NO: 248303 - DNA, 20 bp, Artificial
  CRISPR gRNA sequence
tttctgcattttggcagaac

SEQ ID NO: 248304 - DNA, 20 bp, Artificial
  CRISPR gRNA sequence
ctgcattttggcagaacatg

SEQ ID NO: 248305 - DNA, 20 bp, Artificial
  CRISPR gRNA sequence
tgcattttggcagaacatga

SEQ ID NO: 248306 - DNA, 20 bp, Artificial
  CRISPR gRNA sequence
cattttggcagaacatgatg

SEQ ID NO: 248307 - DNA, 20 bp, Artificial
  CRISPR gRNA sequence
tggcagaacatgatggaaaa

SEQ ID NO: 248308 - DNA, 20 bp, Artificial
  CRISPR gRNA sequence
ggcagaacatgatggaaaat

SEQ ID NO: 248309 - DNA, 20 bp, Artificial
  CRISPR gRNA sequence
gcagaacatgatggaaaatg

SEQ ID NO: 248310 - DNA, 20 bp, Artificial
  CRISPR gRNA sequence
aaactttggcaaaccggcac

SEQ ID NO: 248311 - DNA, 20 bp, Artificial
  CRISPR gRNA sequence
tggcaaaccggcacaaagct

SEQ ID NO: 248312 - DNA, 20 bp, Artificial
  CRISPR gRNA sequence
ggcaaaccggcacaaagctg

SEQ ID NO: 248313 - DNA, 20 bp, Artificial
  CRISPR gRNA sequence
gcaaaccggcacaaagctgt

SEQ ID NO: 248314 - DNA, 20 bp, Artificial
  CRISPR gRNA sequence
tgtgtttaatcacgcctgcc

SEQ ID NO: 248315 - DNA, 20 bp, Artificial
  CRISPR gRNA sequence
aatcacgcctgccttgtcct

SEQ ID NO: 248316 - DNA, 20 bp, Artificial
  CRISPR gRNA sequence
atcacgcctgccttgtccta

SEQ ID NO: 248317 - DNA, 20 bp, Artificial
  CRISPR gRNA sequence
ccttgtcctagtggtttcta

SEQ ID NO: 248318 - DNA, 20 bp, Artificial
  CRISPR gRNA sequence
gtcctagtggtttctatgaa

SEQ ID NO: 248319 - DNA, 20 bp, Artificial
  CRISPR gRNA sequence
tcctagtggtttctatgaat

SEQ ID NO: 248320 - DNA, 20 bp, Artificial
  CRISPR gRNA sequence
gtggtttctatgaatctgct

SEQ ID NO: 248321 - DNA, 20 bp, Artificial
  CRISPR gRNA sequence
ctatgaatctgctacttttc

SEQ ID NO: 248322 - DNA, 20 bp, Artificial
  CRISPR gRNA sequence
tatgaatctgctacttttcc

SEQ ID NO: 248323 - DNA, 20 bp, Artificial
  CRISPR gRNA sequence
tgaatctgctacttttccgt

SEQ ID NO: 248324 - DNA, 20 bp, Artificial
  CRISPR gRNA sequence
ctacttttccgtaatattgc

SEQ ID NO: 248325 - DNA, 20 bp, Artificial
  CRISPR gRNA sequence
cttttccgtaatattgcatc

SEQ ID NO: 248326 - DNA, 20 bp, Artificial
  CRISPR gRNA sequence
ttccgtaatattgcatcatt

SEQ ID NO: 248327 - DNA, 20 bp, Artificial
  CRISPR gRNA sequence
tccgtaatattgcatcatta

SEQ ID NO: 248328 - DNA, 20 bp, Artificial
  CRISPR gRNA sequence
ccgtaatattgcatcattaa

SEQ ID NO: 248329 - DNA, 20 bp, Artificial
  CRISPR gRNA sequence
cgtaatattgcatcattaat

SEQ ID NO: 248330 - DNA, 20 bp, Artificial
  CRISPR gRNA sequence
catcattaattgttcctgaa

SEQ ID NO: 248331 - DNA, 20 bp, Artificial
  CRISPR gRNA sequence
attgttcctgaaaaaccctg

SEQ ID NO: 248332 - DNA, 20 bp, Artificial
  CRISPR gRNA sequence
ttcctgaaaaaccctgagtt

SEQ ID NO: 248333 - DNA, 20 bp, Artificial
  CRISPR gRNA sequence
ctgaaaaaccctgagttatc

SEQ ID NO: 248334 - DNA, 20 bp, Artificial
  CRISPR gRNA sequence
aaaaaccctgagttatcctc

SEQ ID NO: 248335 - DNA, 20 bp, Artificial
  CRISPR gRNA sequence
agttatcctcttatagaatt

SEQ ID NO: 248336 - DNA, 20 bp, Artificial
  CRISPR gRNA sequence
tcctcttatagaattgtata

SEQ ID NO: 248337 - DNA, 20 bp, Artificial
  CRISPR gRNA sequence
ttatagaattgtataagtaa

SEQ ID NO: 248338 - DNA, 20 bp, Artificial
  CRISPR gRNA sequence
atagaattgtataagtaatg

SEQ ID NO: 248339 - DNA, 20 bp, Artificial
  CRISPR gRNA sequence
tagaattgtataagtaatga

SEQ ID NO: 248340 - DNA, 20 bp, Artificial
  CRISPR gRNA sequence
tataagtaatgattgcaata

SEQ ID NO: 248341 - DNA, 20 bp, Artificial
  CRISPR gRNA sequence
caatatagataattttgaaa

SEQ ID NO: 248342 - DNA, 20 bp, Artificial
  CRISPR gRNA sequence
tgaaaggagaaaccaccttt

SEQ ID NO: 248343 - DNA, 20 bp, Artificial
  CRISPR gRNA sequence
gaaaggagaaaccacctttc

SEQ ID NO: 248344 - DNA, 20 bp, Artificial
  CRISPR gRNA sequence
aaaggagaaaccacctttcc

SEQ ID NO: 248345 - DNA, 20 bp, Artificial
  CRISPR gRNA sequence
tccttggaaatgtttatctt

SEQ ID NO: 248346 - DNA, 20 bp, Artificial
  CRISPR gRNA sequence
ccttggaaatgtttatcttt

SEQ ID NO: 248347 - DNA, 20 bp, Artificial
  CRISPR gRNA sequence
cttggaaatgtttatctttt

SEQ ID NO: 248348 - DNA, 20 bp, Artificial
  CRISPR gRNA sequence
ggaaatgtttatcttttgca

SEQ ID NO: 248349 - DNA, 20 bp, Artificial
  CRISPR gRNA sequence
gaaatgtttatcttttgcag

SEQ ID NO: 248350 - DNA, 20 bp, Artificial
  CRISPR gRNA sequence
atcttttgcagagtgacatt

SEQ ID NO: 248351 - DNA, 20 bp, Artificial
  CRISPR gRNA sequence
tcttttgcagagtgacattt

SEQ ID NO: 248352 - DNA, 20 bp, Artificial
  CRISPR gRNA sequence
ttgcagagtgacatttgtga

SEQ ID NO: 248353 - DNA, 20 bp, Artificial
  CRISPR gRNA sequence
tgcagagtgacatttgtgag

SEQ ID NO: 248354 - DNA, 20 bp, Artificial
  CRISPR gRNA sequence
gcagagtgacatttgtgaga

SEQ ID NO: 248355 - DNA, 20 bp, Artificial
  CRISPR gRNA sequence
cagagtgacatttgtgagac

SEQ ID NO: 248356 - DNA, 20 bp, Artificial
  CRISPR gRNA sequence
gtgagaccagctaatttgat

SEQ ID NO: 248357 - DNA, 20 bp, Artificial
  CRISPR gRNA sequence
tgagaccagctaatttgatt

SEQ ID NO: 248358 - DNA, 20 bp, Artificial
  CRISPR gRNA sequence
atttgattaaaattctcttg

SEQ ID NO: 248359 - DNA, 20 bp, Artificial
  CRISPR gRNA sequence
gattaaaattctcttggaat

SEQ ID NO: 248360 - DNA, 20 bp, Artificial
  CRISPR gRNA sequence
attaaaattctcttggaatc

SEQ ID NO: 248361 - DNA, 20 bp, Artificial
  CRISPR gRNA sequence
aaattctcttggaatcagct

SEQ ID NO: 248362 - DNA, 20 bp, Artificial
  CRISPR gRNA sequence
tcttggaatcagctttgcta

SEQ ID NO: 248363 - DNA, 20 bp, Artificial
  CRISPR gRNA sequence
ttggaatcagctttgctagt

SEQ ID NO: 248364 - DNA, 20 bp, Artificial
  CRISPR gRNA sequence
ggaatcagctttgctagtat

SEQ ID NO: 248365 - DNA, 20 bp, Artificial
  CRISPR gRNA sequence
gaatcagctttgctagtatc

SEQ ID NO: 248366 - DNA, 20 bp, Artificial
  CRISPR gRNA sequence
tgctagtatcatacctgtgc

SEQ ID NO: 248367 - DNA, 20 bp, Artificial
  CRISPR gRNA sequence
gctagtatcatacctgtgcc

SEQ ID NO: 248368 - DNA, 20 bp, Artificial
  CRISPR gRNA sequence
ctagtatcatacctgtgcca

SEQ ID NO: 248369 - DNA, 20 bp, Artificial
  CRISPR gRNA sequence
gtatcatacctgtgccagat

SEQ ID NO: 248370 - DNA, 20 bp, Artificial
  CRISPR gRNA sequence
tgccagatttcatcatggga

SEQ ID NO: 248371 - DNA, 20 bp, Artificial
  CRISPR gRNA sequence
catcatgggaaacagctgtt

SEQ ID NO: 248372 - DNA, 20 bp, Artificial
  CRISPR gRNA sequence
atcatgggaaacagctgtta

SEQ ID NO: 248373 - DNA, 20 bp, Artificial
  CRISPR gRNA sequence
ttacaacatagtagccactc

SEQ ID NO: 248374 - DNA, 20 bp, Artificial
  CRISPR gRNA sequence
caacatagtagccactctgt

SEQ ID NO: 248375 - DNA, 20 bp, Artificial
  CRISPR gRNA sequence
tgttgctggtcctcaacttt

SEQ ID NO: 248376 - DNA, 20 bp, Artificial
  CRISPR gRNA sequence
ttgctggtcctcaactttga

SEQ ID NO: 248377 - DNA, 20 bp, Artificial
  CRISPR gRNA sequence
ctggtcctcaactttgagag

SEQ ID NO: 248378 - DNA, 20 bp, Artificial
  CRISPR gRNA sequence
gtcctcaactttgagaggac

SEQ ID NO: 248379 - DNA, 20 bp, Artificial
  CRISPR gRNA sequence
aactttgagaggacaagatc

SEQ ID NO: 248380 - DNA, 20 bp, Artificial
  CRISPR gRNA sequence
tgagaggacaagatcattgc

SEQ ID NO: 248381 - DNA, 20 bp, Artificial
  CRISPR gRNA sequence
gagaggacaagatcattgca

SEQ ID NO: 248382 - DNA, 20 bp, Artificial
  CRISPR gRNA sequence
agaggacaagatcattgcag

SEQ ID NO: 248383 - DNA, 20 bp, Artificial
  CRISPR gRNA sequence
caggatccttgtagtaactg

SEQ ID NO: 248384 - DNA, 20 bp, Artificial
  CRISPR gRNA sequence
gtagtaactgcccagctggt

SEQ ID NO: 248385 - DNA, 20 bp, Artificial
  CRISPR gRNA sequence
tagtaactgcccagctggtg

SEQ ID NO: 248386 - DNA, 20 bp, Artificial
  CRISPR gRNA sequence
cccagctggtgagtacccag

SEQ ID NO: 248387 - DNA, 20 bp, Artificial
  CRISPR gRNA sequence
gtgagtacccagttatcatg

SEQ ID NO: 248388 - DNA, 20 bp, Artificial
  CRISPR gRNA sequence
tcatgtgcatttgatctgct

SEQ ID NO: 248389 - DNA, 20 bp, Artificial
  CRISPR gRNA sequence
gatctgctctgttggaagta

SEQ ID NO: 248390 - DNA, 20 bp, Artificial
  CRISPR gRNA sequence
atctgctctgttggaagtat

SEQ ID NO: 248391 - DNA, 20 bp, Artificial
  CRISPR gRNA sequence
ctctgttggaagtatggttc

SEQ ID NO: 248392 - DNA, 20 bp, Artificial
  CRISPR gRNA sequence
tgttggaagtatggttcagt

SEQ ID NO: 248393 - DNA, 20 bp, Artificial
  CRISPR gRNA sequence
ttggaagtatggttcagtta

SEQ ID NO: 248394 - DNA, 20 bp, Artificial
  CRISPR gRNA sequence
gaagtatggttcagttagtc

SEQ ID NO: 248395 - DNA, 20 bp, Artificial
  CRISPR gRNA sequence
agttagtctagtagtcaggg

SEQ ID NO: 248396 - DNA, 20 bp, Artificial
  CRISPR gRNA sequence
gtctagtagtcagggctaac

SEQ ID NO: 248397 - DNA, 20 bp, Artificial
  CRISPR gRNA sequence
gtagtcagggctaacgagct

SEQ ID NO: 248398 - DNA, 20 bp, Artificial
  CRISPR gRNA sequence
acgagctcccttttaaggaa

SEQ ID NO: 248399 - DNA, 20 bp, Artificial
  CRISPR gRNA sequence
ccttttaaggaaaggaaaat

SEQ ID NO: 248400 - DNA, 20 bp, Artificial
  CRISPR gRNA sequence
ttaaggaaaggaaaatgaaa

SEQ ID NO: 248401 - DNA, 20 bp, Artificial
  CRISPR gRNA sequence
taaggaaaggaaaatgaaaa

SEQ ID NO: 248402 - DNA, 20 bp, Artificial
  CRISPR gRNA sequence
aaggaaaggaaaatgaaaat

SEQ ID NO: 248403 - DNA, 20 bp, Artificial
  CRISPR gRNA sequence
aggaaaggaaaatgaaaatt

SEQ ID NO: 248404 - DNA, 20 bp, Artificial
  CRISPR gRNA sequence
attcatttacaaatgtttat

SEQ ID NO: 248405 - DNA, 20 bp, Artificial
  CRISPR gRNA sequence
atttacaaatgtttattgga

SEQ ID NO: 248406 - DNA, 20 bp, Artificial
  CRISPR gRNA sequence
acaaatgtttattggatgct

SEQ ID NO: 248407 - DNA, 20 bp, Artificial
  CRISPR gRNA sequence
caaatgtttattggatgcta

SEQ ID NO: 248408 - DNA, 20 bp, Artificial
  CRISPR gRNA sequence
attggatgctacaacctagc

SEQ ID NO: 248409 - DNA, 20 bp, Artificial
  CRISPR gRNA sequence
ttggatgctacaacctagct

SEQ ID NO: 248410 - DNA, 20 bp, Artificial
  CRISPR gRNA sequence
gatgctacaacctagctgtg

SEQ ID NO: 248411 - DNA, 20 bp, Artificial
  CRISPR gRNA sequence
caacctagctgtgtgaacac

SEQ ID NO: 248412 - DNA, 20 bp, Artificial
  CRISPR gRNA sequence
gctgtgtgaacacagcaaag

SEQ ID NO: 248413 - DNA, 20 bp, Artificial
  CRISPR gRNA sequence
tgtgaacacagcaaagtcat

SEQ ID NO: 248414 - DNA, 20 bp, Artificial
  CRISPR gRNA sequence
aacctcttgtgccttgactt

SEQ ID NO: 248415 - DNA, 20 bp, Artificial
  CRISPR gRNA sequence
ttgtgccttgactttctcat

SEQ ID NO: 248416 - DNA, 20 bp, Artificial
  CRISPR gRNA sequence
gtgccttgactttctcatct

SEQ ID NO: 248417 - DNA, 20 bp, Artificial
  CRISPR gRNA sequence
tgccttgactttctcatctg

SEQ ID NO: 248418 - DNA, 20 bp, Artificial
  CRISPR gRNA sequence
gactttctcatctggggata

SEQ ID NO: 248419 - DNA, 20 bp, Artificial
  CRISPR gRNA sequence
actttctcatctggggataa

SEQ ID NO: 248420 - DNA, 20 bp, Artificial
  CRISPR gRNA sequence
tctcatctggggataataag

SEQ ID NO: 248421 - DNA, 20 bp, Artificial
  CRISPR gRNA sequence
ctcatctggggataataaga

SEQ ID NO: 248422 - DNA, 20 bp, Artificial
  CRISPR gRNA sequence
tcatctggggataataagag

SEQ ID NO: 248423 - DNA, 20 bp, Artificial
  CRISPR gRNA sequence
atctggggataataagagaa

SEQ ID NO: 248424 - DNA, 20 bp, Artificial
  CRISPR gRNA sequence
gggataataagagaacctgt

SEQ ID NO: 248425 - DNA, 20 bp, Artificial
  CRISPR gRNA sequence
ttttataggatggctgggag

SEQ ID NO: 248426 - DNA, 20 bp, Artificial
  CRISPR gRNA sequence
tataggatggctgggaggat

SEQ ID NO: 248427 - DNA, 20 bp, Artificial
  CRISPR gRNA sequence
ataggatggctgggaggatc

SEQ ID NO: 248428 - DNA, 20 bp, Artificial
  CRISPR gRNA sequence
taggatggctgggaggatca

SEQ ID NO: 248429 - DNA, 20 bp, Artificial
  CRISPR gRNA sequence
ggaggatcaaatgaagggct

SEQ ID NO: 248430 - DNA, 20 bp, Artificial
  CRISPR gRNA sequence
agaacagtgcatggcacaag

SEQ ID NO: 248431 - DNA, 20 bp, Artificial
  CRISPR gRNA sequence
gaacagtgcatggcacaagg

SEQ ID NO: 248432 - DNA, 20 bp, Artificial
  CRISPR gRNA sequence
caataaatgttagttttgtg

SEQ ID NO: 248433 - DNA, 20 bp, Artificial
  CRISPR gRNA sequence
aataaatgttagttttgtgt

SEQ ID NO: 248434 - DNA, 20 bp, Artificial
  CRISPR gRNA sequence
gttttgtgtgtagggctttg

SEQ ID NO: 248435 - DNA, 20 bp, Artificial
  CRISPR gRNA sequence
tgtgtgtagggctttgtgct

SEQ ID NO: 248436 - DNA, 20 bp, Artificial
  CRISPR gRNA sequence
gtgtgtagggctttgtgctc

SEQ ID NO: 248437 - DNA, 20 bp, Artificial
  CRISPR gRNA sequence
tgtgtagggctttgtgctcc

SEQ ID NO: 248438 - DNA, 20 bp, Artificial
  CRISPR gRNA sequence
tgtgctccgactgggggcat

SEQ ID NO: 248439 - DNA, 20 bp, Artificial
  CRISPR gRNA sequence
gtgctccgactgggggcata

SEQ ID NO: 248440 - DNA, 20 bp, Artificial
  CRISPR gRNA sequence
tgctccgactgggggcatag

SEQ ID NO: 248441 - DNA, 20 bp, Artificial
  CRISPR gRNA sequence
cgactgggggcatagcagcg

SEQ ID NO: 248442 - DNA, 20 bp, Artificial
  CRISPR gRNA sequence
ggggcatagcagcgagtaag

SEQ ID NO: 248443 - DNA, 20 bp, Artificial
  CRISPR gRNA sequence
aacagagtggggacggtcag

SEQ ID NO: 248444 - DNA, 20 bp, Artificial
  CRISPR gRNA sequence
acagagtggggacggtcagt

SEQ ID NO: 248445 - DNA, 20 bp, Artificial
  CRISPR gRNA sequence
aaattttagtgtaggacatt

SEQ ID NO: 248446 - DNA, 20 bp, Artificial
  CRISPR gRNA sequence
aattttagtgtaggacattg

SEQ ID NO: 248447 - DNA, 20 bp, Artificial
  CRISPR gRNA sequence
tagtgtaggacattgatgtc

SEQ ID NO: 248448 - DNA, 20 bp, Artificial
  CRISPR gRNA sequence
agtgtaggacattgatgtcc

SEQ ID NO: 248449 - DNA, 20 bp, Artificial
  CRISPR gRNA sequence
gtgtaggacattgatgtcct

SEQ ID NO: 248450 - DNA, 20 bp, Artificial
  CRISPR gRNA sequence
atgtcctcctggatccagtc

SEQ ID NO: 248451 - DNA, 20 bp, Artificial
  CRISPR gRNA sequence
ctggatccagtcatattcat

SEQ ID NO: 248452 - DNA, 20 bp, Artificial
  CRISPR gRNA sequence
gatccagtcatattcatctc

SEQ ID NO: 248453 - DNA, 20 bp, Artificial
  CRISPR gRNA sequence
atctcctacatcaatcaaga

SEQ ID NO: 248454 - DNA, 20 bp, Artificial
  CRISPR gRNA sequence
ctacatcaatcaagataatc

SEQ ID NO: 248455 - DNA, 20 bp, Artificial
  CRISPR gRNA sequence
catcaatcaagataatcatt

SEQ ID NO: 248456 - DNA, 20 bp, Artificial
  CRISPR gRNA sequence
tgttttattcaatagataaa

SEQ ID NO: 248457 - DNA, 20 bp, Artificial
  CRISPR gRNA sequence
gttttattcaatagataaag

SEQ ID NO: 248458 - DNA, 20 bp, Artificial
  CRISPR gRNA sequence
ttttattcaatagataaagt

SEQ ID NO: 248459 - DNA, 20 bp, Artificial
  CRISPR gRNA sequence
tattcaatagataaagtatt

SEQ ID NO: 248460 - DNA, 20 bp, Artificial
  CRISPR gRNA sequence
attcaatagataaagtattt

SEQ ID NO: 248461 - DNA, 20 bp, Artificial
  CRISPR gRNA sequence
ttcaatagataaagtatttt

SEQ ID NO: 248462 - DNA, 20 bp, Artificial
  CRISPR gRNA sequence
aatagataaagtattttctt

SEQ ID NO: 248463 - DNA, 20 bp, Artificial
  CRISPR gRNA sequence
tctttctgttgatttatttg

SEQ ID NO: 248464 - DNA, 20 bp, Artificial
  CRISPR gRNA sequence
ctttctgttgatttatttgt

SEQ ID NO: 248465 - DNA, 20 bp, Artificial
  CRISPR gRNA sequence
tttctgttgatttatttgtt

SEQ ID NO: 248466 - DNA, 20 bp, Artificial
  CRISPR gRNA sequence
tctgttgatttatttgttac

SEQ ID NO: 248467 - DNA, 20 bp, Artificial
  CRISPR gRNA sequence
ctgttgatttatttgttaca

SEQ ID NO: 248468 - DNA, 20 bp, Artificial
  CRISPR gRNA sequence
tgttgatttatttgttacaa

SEQ ID NO: 248469 - DNA, 20 bp, Artificial
  CRISPR gRNA sequence
ttgatttatttgttacaata

SEQ ID NO: 248470 - DNA, 20 bp, Artificial
  CRISPR gRNA sequence
atttatttgttacaatatct

SEQ ID NO: 248471 - DNA, 20 bp, Artificial
  CRISPR gRNA sequence
atttgttacaatatctggtt

SEQ ID NO: 248472 - DNA, 20 bp, Artificial
  CRISPR gRNA sequence
tttgttacaatatctggttt

SEQ ID NO: 248473 - DNA, 20 bp, Artificial
  CRISPR gRNA sequence
gttacaatatctggtttttt

SEQ ID NO: 248474 - DNA, 20 bp, Artificial
  CRISPR gRNA sequence
ttacaatatctggttttttt

SEQ ID NO: 248475 - DNA, 20 bp, Artificial
  CRISPR gRNA sequence
caatatctggtttttttgtt

SEQ ID NO: 248476 - DNA, 20 bp, Artificial
  CRISPR gRNA sequence
gtttttttgttttttttgtg

SEQ ID NO: 248477 - DNA, 20 bp, Artificial
  CRISPR gRNA sequence
ttttgttttttttgtgtgtg

SEQ ID NO: 248478 - DNA, 20 bp, Artificial
  CRISPR gRNA sequence
tttgttttttttgtgtgtgt

SEQ ID NO: 248479 - DNA, 20 bp, Artificial
  CRISPR gRNA sequence
ttgttttttttgtgtgtgta

SEQ ID NO: 248480 - DNA, 20 bp, Artificial
  CRISPR gRNA sequence
tgttttttttgtgtgtgtat

SEQ ID NO: 248481 - DNA, 20 bp, Artificial
  CRISPR gRNA sequence
gttttttttgtgtgtgtatg

SEQ ID NO: 248482 - DNA, 20 bp, Artificial
  CRISPR gRNA sequence
ttttttttgtgtgtgtatgt

SEQ ID NO: 248483 - DNA, 20 bp, Artificial
  CRISPR gRNA sequence
tttttgtgtgtgtatgtttt

SEQ ID NO: 248484 - DNA, 20 bp, Artificial
  CRISPR gRNA sequence
ttttgtgtgtgtatgttttt

SEQ ID NO: 248485 - DNA, 20 bp, Artificial
  CRISPR gRNA sequence
tttgtgtgtgtatgtttttt

SEQ ID NO: 248486 - DNA, 20 bp, Artificial
  CRISPR gRNA sequence
ttgtgtgtgtatgttttttt

SEQ ID NO: 248487 - DNA, 20 bp, Artificial
  CRISPR gRNA sequence
tgtgtgtgtatgtttttttt

SEQ ID NO: 248488 - DNA, 20 bp, Artificial
  CRISPR gRNA sequence
gtgtgtgtatgttttttttt

SEQ ID NO: 248489 - DNA, 20 bp, Artificial
  CRISPR gRNA sequence
tgtgtgtatgtttttttttt

SEQ ID NO: 248490 - DNA, 20 bp, Artificial
  CRISPR gRNA sequence
ttttttttttttttgagaca

SEQ ID NO: 248491 - DNA, 20 bp, Artificial
  CRISPR gRNA sequence
tttttttttttttgagacac

SEQ ID NO: 248492 - DNA, 20 bp, Artificial
  CRISPR gRNA sequence
ttttttttttttgagacaca

SEQ ID NO: 248493 - DNA, 20 bp, Artificial
  CRISPR gRNA sequence
tttttttttttgagacacag

SEQ ID NO: 248494 - DNA, 20 bp, Artificial
  CRISPR gRNA sequence
ttttttttttgagacacagt

SEQ ID NO: 248495 - DNA, 20 bp, Artificial
  CRISPR gRNA sequence
tttttttttgagacacagtc

SEQ ID NO: 248496 - DNA, 20 bp, Artificial
  CRISPR gRNA sequence
ttttttttgagacacagtct

SEQ ID NO: 248497 - DNA, 20 bp, Artificial
  CRISPR gRNA sequence
tttttttgagacacagtctc

SEQ ID NO: 248498 - DNA, 20 bp, Artificial
  CRISPR gRNA sequence
ttttttgagacacagtctca

SEQ ID NO: 248499 - DNA, 20 bp, Artificial
  CRISPR gRNA sequence
tttttgagacacagtctcac

SEQ ID NO: 248500 - DNA, 20 bp, Artificial
  CRISPR gRNA sequence
ttttgagacacagtctcact

SEQ ID NO: 248501 - DNA, 20 bp, Artificial
  CRISPR gRNA sequence
tttgagacacagtctcactc

SEQ ID NO: 248502 - DNA, 20 bp, Artificial
  CRISPR gRNA sequence
ttgagacacagtctcactct

SEQ ID NO: 248503 - DNA, 20 bp, Artificial
  CRISPR gRNA sequence
tgagacacagtctcactctg

SEQ ID NO: 248504 - DNA, 20 bp, Artificial
  CRISPR gRNA sequence
gagacacagtctcactctgt

SEQ ID NO: 248505 - DNA, 20 bp, Artificial
  CRISPR gRNA sequence
agacacagtctcactctgtc

SEQ ID NO: 248506 - DNA, 20 bp, Artificial
  CRISPR gRNA sequence
actctgtcgcccaggctgga

SEQ ID NO: 248507 - DNA, 20 bp, Artificial
  CRISPR gRNA sequence
tgtcgcccaggctggagtgc

SEQ ID NO: 248508 - DNA, 20 bp, Artificial
  CRISPR gRNA sequence
tcgcccaggctggagtgcag

SEQ ID NO: 248509 - DNA, 20 bp, Artificial
  CRISPR gRNA sequence
gagtgcagtggcacgatctc

SEQ ID NO: 248510 - DNA, 20 bp, Artificial
  CRISPR gRNA sequence
agctcactgcaaccttggcc

SEQ ID NO: 248511 - DNA, 20 bp, Artificial
  CRISPR gRNA sequence
actgcaaccttggcctccca

SEQ ID NO: 248512 - DNA, 20 bp, Artificial
  CRISPR gRNA sequence
caaccttggcctcccaggtt

SEQ ID NO: 248513 - DNA, 20 bp, Artificial
  CRISPR gRNA sequence
ggcctcccaggttcaagcaa

SEQ ID NO: 248514 - DNA, 20 bp, Artificial
  CRISPR gRNA sequence
gcctcccaggttcaagcaat

SEQ ID NO: 248515 - DNA, 20 bp, Artificial
  CRISPR gRNA sequence
ccaggttcaagcaattctcc

SEQ ID NO: 248516 - DNA, 20 bp, Artificial
  CRISPR gRNA sequence
aagcaattctcctgcctcag

SEQ ID NO: 248517 - DNA, 20 bp, Artificial
  CRISPR gRNA sequence
tcctgcctcagcctcccgag

SEQ ID NO: 248518 - DNA, 20 bp, Artificial
  CRISPR gRNA sequence
ctgcctcagcctcccgagta

SEQ ID NO: 248519 - DNA, 20 bp, Artificial
  CRISPR gRNA sequence
cctcagcctcccgagtagct

SEQ ID NO: 248520 - DNA, 20 bp, Artificial
  CRISPR gRNA sequence
agcctcccgagtagctggga

SEQ ID NO: 248521 - DNA, 20 bp, Artificial
  CRISPR gRNA sequence
ccgagtagctgggattacag

SEQ ID NO: 248522 - DNA, 20 bp, Artificial
  CRISPR gRNA sequence
ggattacaggtgtgcaccac

SEQ ID NO: 248523 - DNA, 20 bp, Artificial
  CRISPR gRNA sequence
caggtgtgcaccactgcgcc

SEQ ID NO: 248524 - DNA, 20 bp, Artificial
  CRISPR gRNA sequence
cgcctggctaatttttgtat

SEQ ID NO: 248525 - DNA, 20 bp, Artificial
  CRISPR gRNA sequence
gctaatttttgtatttttag

SEQ ID NO: 248526 - DNA, 20 bp, Artificial
  CRISPR gRNA sequence
atttttgtatttttagtaga

SEQ ID NO: 248527 - DNA, 20 bp, Artificial
  CRISPR gRNA sequence
ttgtatttttagtagagaca

SEQ ID NO: 248528 - DNA, 20 bp, Artificial
  CRISPR gRNA sequence
tgtatttttagtagagacag

SEQ ID NO: 248529 - DNA, 20 bp, Artificial
  CRISPR gRNA sequence
gtatttttagtagagacagg

SEQ ID NO: 248530 - DNA, 20 bp, Artificial
  CRISPR gRNA sequence
tatttttagtagagacagga

SEQ ID NO: 248531 - DNA, 20 bp, Artificial
  CRISPR gRNA sequence
ttagtagagacaggatttca

SEQ ID NO: 248532 - DNA, 20 bp, Artificial
  CRISPR gRNA sequence
tagtagagacaggatttcac

SEQ ID NO: 248533 - DNA, 20 bp, Artificial
  CRISPR gRNA sequence
agtagagacaggatttcacc

SEQ ID NO: 248534 - DNA, 20 bp, Artificial
  CRISPR gRNA sequence
gtagagacaggatttcacca

SEQ ID NO: 248535 - DNA, 20 bp, Artificial
  CRISPR gRNA sequence
caccatgttggccaagctgg

SEQ ID NO: 248536 - DNA, 20 bp, Artificial
  CRISPR gRNA sequence
accatgttggccaagctggt

SEQ ID NO: 248537 - DNA, 20 bp, Artificial
  CRISPR gRNA sequence
gccaagctggtcttgaactg

SEQ ID NO: 248538 - DNA, 20 bp, Artificial
  CRISPR gRNA sequence
gtcttgaactgctgacctca

SEQ ID NO: 248539 - DNA, 20 bp, Artificial
  CRISPR gRNA sequence
gaactgctgacctcaggtga

SEQ ID NO: 248540 - DNA, 20 bp, Artificial
  CRISPR gRNA sequence
aactgctgacctcaggtgat

SEQ ID NO: 248541 - DNA, 20 bp, Artificial
  CRISPR gRNA sequence
ctgacctcaggtgatctgcc

SEQ ID NO: 248542 - DNA, 20 bp, Artificial
  CRISPR gRNA sequence
acctcaggtgatctgcccgc

SEQ ID NO: 248543 - DNA, 20 bp, Artificial
  CRISPR gRNA sequence
aggtgatctgcccgcttcgg

SEQ ID NO: 248544 - DNA, 20 bp, Artificial
  CRISPR gRNA sequence
cccgcttcggcctcccaaag

SEQ ID NO: 248545 - DNA, 20 bp, Artificial
  CRISPR gRNA sequence
cggcctcccaaagtgctgtg

SEQ ID NO: 248546 - DNA, 20 bp, Artificial
  CRISPR gRNA sequence
ggcctcccaaagtgctgtga

SEQ ID NO: 248547 - DNA, 20 bp, Artificial
  CRISPR gRNA sequence
ccaaagtgctgtgattacag

SEQ ID NO: 248548 - DNA, 20 bp, Artificial
  CRISPR gRNA sequence
tgattacaggcgtgagccac

SEQ ID NO: 248549 - DNA, 20 bp, Artificial
  CRISPR gRNA sequence
caggcgtgagccactgcacc

SEQ ID NO: 248550 - DNA, 20 bp, Artificial
  CRISPR gRNA sequence
cacctggcctgtattttgtt

SEQ ID NO: 248551 - DNA, 20 bp, Artificial
  CRISPR gRNA sequence
gcctgtattttgttatttct

SEQ ID NO: 248552 - DNA, 20 bp, Artificial
  CRISPR gRNA sequence
tattttgttatttctaattc

SEQ ID NO: 248553 - DNA, 20 bp, Artificial
  CRISPR gRNA sequence
tgttatttctaattctgtga

SEQ ID NO: 248554 - DNA, 20 bp, Artificial
  CRISPR gRNA sequence
gttatttctaattctgtgat

SEQ ID NO: 248555 - DNA, 20 bp, Artificial
  CRISPR gRNA sequence
ttatttctaattctgtgatt

SEQ ID NO: 248556 - DNA, 20 bp, Artificial
  CRISPR gRNA sequence
tttctaattctgtgattaca

SEQ ID NO: 248557 - DNA, 20 bp, Artificial
  CRISPR gRNA sequence
ctaattctgtgattacacaa

SEQ ID NO: 248558 - DNA, 20 bp, Artificial
  CRISPR gRNA sequence
taattctgtgattacacaaa

SEQ ID NO: 248559 - DNA, 20 bp, Artificial
  CRISPR gRNA sequence
attctgtgattacacaaaga

SEQ ID NO: 248560 - DNA, 20 bp, Artificial
  CRISPR gRNA sequence
tgtgattacacaaagaataa

SEQ ID NO: 248561 - DNA, 20 bp, Artificial
  CRISPR gRNA sequence
tgattacacaaagaataatc

SEQ ID NO: 248562 - DNA, 20 bp, Artificial
  CRISPR gRNA sequence
cacaaagaataatcttgcaa

SEQ ID NO: 248563 - DNA, 20 bp, Artificial
  CRISPR gRNA sequence
gcaaatgtattgttttagga

SEQ ID NO: 248564 - DNA, 20 bp, Artificial
  CRISPR gRNA sequence
caaatgtattgttttaggaa

SEQ ID NO: 248565 - DNA, 20 bp, Artificial
  CRISPR gRNA sequence
ttttaggaagtcaatcaaac

SEQ ID NO: 248566 - DNA, 20 bp, Artificial
  CRISPR gRNA sequence
taggaagtcaatcaaactaa

SEQ ID NO: 248567 - DNA, 20 bp, Artificial
  CRISPR gRNA sequence
aggaagtcaatcaaactaat

SEQ ID NO: 248568 - DNA, 20 bp, Artificial
  CRISPR gRNA sequence
ggaagtcaatcaaactaatg

SEQ ID NO: 248569 - DNA, 20 bp, Artificial
  CRISPR gRNA sequence
atgtccaccactgtggcatc

SEQ ID NO: 248570 - DNA, 20 bp, Artificial
  CRISPR gRNA sequence
tggcatctagaaaactcatc

SEQ ID NO: 248571 - DNA, 20 bp, Artificial
  CRISPR gRNA sequence
gaaaactcatcattctttta

SEQ ID NO: 248572 - DNA, 20 bp, Artificial
  CRISPR gRNA sequence
atcattcttttataatctta

SEQ ID NO: 248573 - DNA, 20 bp, Artificial
  CRISPR gRNA sequence
ttttataatcttattttatt

SEQ ID NO: 248574 - DNA, 20 bp, Artificial
  CRISPR gRNA sequence
ttataatcttattttattgt

SEQ ID NO: 248575 - DNA, 20 bp, Artificial
  CRISPR gRNA sequence
tataatcttattttattgta

SEQ ID NO: 248576 - DNA, 20 bp, Artificial
  CRISPR gRNA sequence
ataatcttattttattgtaa

SEQ ID NO: 248577 - DNA, 20 bp, Artificial
  CRISPR gRNA sequence
taatcttattttattgtaaa

SEQ ID NO: 248578 - DNA, 20 bp, Artificial
  CRISPR gRNA sequence
attttattgtaaacttcgga

SEQ ID NO: 248579 - DNA, 20 bp, Artificial
  CRISPR gRNA sequence
ttttattgtaaacttcggaa

SEQ ID NO: 248580 - DNA, 20 bp, Artificial
  CRISPR gRNA sequence
tattgtaaacttcggaatgc

SEQ ID NO: 248581 - DNA, 20 bp, Artificial
  CRISPR gRNA sequence
attgtaaacttcggaatgcc

SEQ ID NO: 248582 - DNA, 20 bp, Artificial
  CRISPR gRNA sequence
ttgtaaacttcggaatgcct

SEQ ID NO: 248583 - DNA, 20 bp, Artificial
  CRISPR gRNA sequence
taaacttcggaatgccttgg

SEQ ID NO: 248584 - DNA, 20 bp, Artificial
  CRISPR gRNA sequence
cggaatgccttgggtgacga

SEQ ID NO: 248585 - DNA, 20 bp, Artificial
  CRISPR gRNA sequence
ggaatgccttgggtgacgat

SEQ ID NO: 248586 - DNA, 20 bp, Artificial
  CRISPR gRNA sequence
gggtgacgattgcccattgt

SEQ ID NO: 248587 - DNA, 20 bp, Artificial
  CRISPR gRNA sequence
ggtgacgattgcccattgtc

SEQ ID NO: 248588 - DNA, 20 bp, Artificial
  CRISPR gRNA sequence
cccattgtcaaacgtgtacc

SEQ ID NO: 248589 - DNA, 20 bp, Artificial
  CRISPR gRNA sequence
tcaaacgtgtaccactattg

SEQ ID NO: 248590 - DNA, 20 bp, Artificial
  CRISPR gRNA sequence
ttgtctgcctttcttaggta

SEQ ID NO: 248591 - DNA, 20 bp, Artificial
  CRISPR gRNA sequence
tctgcctttcttaggtacat

SEQ ID NO: 248592 - DNA, 20 bp, Artificial
  CRISPR gRNA sequence
cctttcttaggtacattctg

SEQ ID NO: 248593 - DNA, 20 bp, Artificial
  CRISPR gRNA sequence
tcttaggtacattctgtgat

SEQ ID NO: 248594 - DNA, 20 bp, Artificial
  CRISPR gRNA sequence
cttaggtacattctgtgata

SEQ ID NO: 248595 - DNA, 20 bp, Artificial
  CRISPR gRNA sequence
ttaggtacattctgtgataa

SEQ ID NO: 248596 - DNA, 20 bp, Artificial
  CRISPR gRNA sequence
aggtacattctgtgataata

SEQ ID NO: 248597 - DNA, 20 bp, Artificial
  CRISPR gRNA sequence
ggtacattctgtgataataa

SEQ ID NO: 248598 - DNA, 20 bp, Artificial
  CRISPR gRNA sequence
tgtgataataacaggaatca

SEQ ID NO: 248599 - DNA, 20 bp, Artificial
  CRISPR gRNA sequence
tgataataacaggaatcaga

SEQ ID NO: 248600 - DNA, 20 bp, Artificial
  CRISPR gRNA sequence
gcagtccctgtcctccaaat

SEQ ID NO: 248601 - DNA, 20 bp, Artificial
  CRISPR gRNA sequence
cagtccctgtcctccaaata

SEQ ID NO: 248602 - DNA, 20 bp, Artificial
  CRISPR gRNA sequence
tcctccaaatagtttctcca

SEQ ID NO: 248603 - DNA, 20 bp, Artificial
  CRISPR gRNA sequence
caaatagtttctccagcgca

SEQ ID NO: 248604 - DNA, 20 bp, Artificial
  CRISPR gRNA sequence
ctccagcgcaggtggacaaa

SEQ ID NO: 248605 - DNA, 20 bp, Artificial
  CRISPR gRNA sequence
tccagcgcaggtggacaaag

SEQ ID NO: 248606 - DNA, 20 bp, Artificial
  CRISPR gRNA sequence
cagcgcaggtggacaaagga

SEQ ID NO: 248607 - DNA, 20 bp, Artificial
  CRISPR gRNA sequence
tgacatatgcaggcagtgta

SEQ ID NO: 248608 - DNA, 20 bp, Artificial
  CRISPR gRNA sequence
aaagatattttcttcttcta

SEQ ID NO: 248609 - DNA, 20 bp, Artificial
  CRISPR gRNA sequence
tcttcttctagaagatagtt

SEQ ID NO: 248610 - DNA, 20 bp, Artificial
  CRISPR gRNA sequence
cttcttctagaagatagttg

SEQ ID NO: 248611 - DNA, 20 bp, Artificial
  CRISPR gRNA sequence
ttcttctagaagatagttgg

SEQ ID NO: 248612 - DNA, 20 bp, Artificial
  CRISPR gRNA sequence
cttctagaagatagttggga

SEQ ID NO: 248613 - DNA, 20 bp, Artificial
  CRISPR gRNA sequence
ttctagaagatagttgggaa

SEQ ID NO: 248614 - DNA, 20 bp, Artificial
  CRISPR gRNA sequence
ctagaagatagttgggaaga

SEQ ID NO: 248615 - DNA, 20 bp, Artificial
  CRISPR gRNA sequence
tagaagatagttgggaagat

SEQ ID NO: 248616 - DNA, 20 bp, Artificial
  CRISPR gRNA sequence
gaagatagttgggaagataa

SEQ ID NO: 248617 - DNA, 20 bp, Artificial
  CRISPR gRNA sequence
ggaagataagcttttctttc

SEQ ID NO: 248618 - DNA, 20 bp, Artificial
  CRISPR gRNA sequence
ttctttcccatttactaact

SEQ ID NO: 248619 - DNA, 20 bp, Artificial
  CRISPR gRNA sequence
tctttcccatttactaactg

SEQ ID NO: 248620 - DNA, 20 bp, Artificial
  CRISPR gRNA sequence
ctttcccatttactaactgc

SEQ ID NO: 248621 - DNA, 20 bp, Artificial
  CRISPR gRNA sequence
tttcccatttactaactgct

SEQ ID NO: 248622 - DNA, 20 bp, Artificial
  CRISPR gRNA sequence
tcccatttactaactgctct

SEQ ID NO: 248623 - DNA, 20 bp, Artificial
  CRISPR gRNA sequence
cccatttactaactgctctc

SEQ ID NO: 248624 - DNA, 20 bp, Artificial
  CRISPR gRNA sequence
ccatttactaactgctctct

SEQ ID NO: 248625 - DNA, 20 bp, Artificial
  CRISPR gRNA sequence
actaactgctctcttttgaa

SEQ ID NO: 248626 - DNA, 20 bp, Artificial
  CRISPR gRNA sequence
ctaactgctctcttttgaaa

SEQ ID NO: 248627 - DNA, 20 bp, Artificial
  CRISPR gRNA sequence
actgctctcttttgaaaatc

SEQ ID NO: 248628 - DNA, 20 bp, Artificial
  CRISPR gRNA sequence
ctctcttttgaaaatctcaa

SEQ ID NO: 248629 - DNA, 20 bp, Artificial
  CRISPR gRNA sequence
tcttttgaaaatctcaagtg

SEQ ID NO: 248630 - DNA, 20 bp, Artificial
  CRISPR gRNA sequence
ttttgaaaatctcaagtgtc

SEQ ID NO: 248631 - DNA, 20 bp, Artificial
  CRISPR gRNA sequence
ttgaaaatctcaagtgtcaa

SEQ ID NO: 248632 - DNA, 20 bp, Artificial
  CRISPR gRNA sequence
tgaaaatctcaagtgtcaaa

SEQ ID NO: 248633 - DNA, 20 bp, Artificial
  CRISPR gRNA sequence
gaaaatctcaagtgtcaaag

SEQ ID NO: 248634 - DNA, 20 bp, Artificial
  CRISPR gRNA sequence
aaaatctcaagtgtcaaaga

SEQ ID NO: 248635 - DNA, 20 bp, Artificial
  CRISPR gRNA sequence
aagtgtcaaagactgattct

SEQ ID NO: 248636 - DNA, 20 bp, Artificial
  CRISPR gRNA sequence
attcttctgccaaccagcag

SEQ ID NO: 248637 - DNA, 20 bp, Artificial
  CRISPR gRNA sequence
ttctgccaaccagcaggtct

SEQ ID NO: 248638 - DNA, 20 bp, Artificial
  CRISPR gRNA sequence
ctgccaaccagcaggtctag

SEQ ID NO: 248639 - DNA, 20 bp, Artificial
  CRISPR gRNA sequence
tgccaaccagcaggtctagg

SEQ ID NO: 248640 - DNA, 20 bp, Artificial
  CRISPR gRNA sequence
ccaaccagcaggtctaggac

SEQ ID NO: 248641 - DNA, 20 bp, Artificial
  CRISPR gRNA sequence
ggacaataatatccagtgac

SEQ ID NO: 248642 - DNA, 20 bp, Artificial
  CRISPR gRNA sequence
tttgtggactgagctttcta

SEQ ID NO: 248643 - DNA, 20 bp, Artificial
  CRISPR gRNA sequence
gtggactgagctttctaaat

SEQ ID NO: 248644 - DNA, 20 bp, Artificial
  CRISPR gRNA sequence
tggactgagctttctaaata

SEQ ID NO: 248645 - DNA, 20 bp, Artificial
  CRISPR gRNA sequence
agctttctaaatattagagg

SEQ ID NO: 248646 - DNA, 20 bp, Artificial
  CRISPR gRNA sequence
tctaaatattagaggaaaca

SEQ ID NO: 248647 - DNA, 20 bp, Artificial
  CRISPR gRNA sequence
ctaaatattagaggaaacat

SEQ ID NO: 248648 - DNA, 20 bp, Artificial
  CRISPR gRNA sequence
taaatattagaggaaacatt

SEQ ID NO: 248649 - DNA, 20 bp, Artificial
  CRISPR gRNA sequence
aatattagaggaaacattca

SEQ ID NO: 248650 - DNA, 20 bp, Artificial
  CRISPR gRNA sequence
gaggaaacattcatttgaca

SEQ ID NO: 248651 - DNA, 20 bp, Artificial
  CRISPR gRNA sequence
atttgacaagagagaagttt

SEQ ID NO: 248652 - DNA, 20 bp, Artificial
  CRISPR gRNA sequence
gacaagagagaagtttttac

SEQ ID NO: 248653 - DNA, 20 bp, Artificial
  CRISPR gRNA sequence
acaagagagaagtttttact

SEQ ID NO: 248654 - DNA, 20 bp, Artificial
  CRISPR gRNA sequence
ttacttacctaaatgtaaaa

SEQ ID NO: 248655 - DNA, 20 bp, Artificial
  CRISPR gRNA sequence
tacttacctaaatgtaaaaa

SEQ ID NO: 248656 - DNA, 20 bp, Artificial
  CRISPR gRNA sequence
acttacctaaatgtaaaaat

SEQ ID NO: 248657 - DNA, 20 bp, Artificial
  CRISPR gRNA sequence
cttacctaaatgtaaaaatg

SEQ ID NO: 248658 - DNA, 20 bp, Artificial
  CRISPR gRNA sequence
acctaaatgtaaaaatgtct

SEQ ID NO: 248659 - DNA, 20 bp, Artificial
  CRISPR gRNA sequence
cctaaatgtaaaaatgtctt

SEQ ID NO: 248660 - DNA, 20 bp, Artificial
  CRISPR gRNA sequence
aatgtaaaaatgtctttatg

SEQ ID NO: 248661 - DNA, 20 bp, Artificial
  CRISPR gRNA sequence
tatggagatttaaaagtaaa

SEQ ID NO: 248662 - DNA, 20 bp, Artificial
  CRISPR gRNA sequence
atggagatttaaaagtaaac

SEQ ID NO: 248663 - DNA, 20 bp, Artificial
  CRISPR gRNA sequence
tggagatttaaaagtaaact

SEQ ID NO: 248664 - DNA, 20 bp, Artificial
  CRISPR gRNA sequence
aaaagtaaactttaaaatta

SEQ ID NO: 248665 - DNA, 20 bp, Artificial
  CRISPR gRNA sequence
aaagtaaactttaaaattac

SEQ ID NO: 248666 - DNA, 20 bp, Artificial
  CRISPR gRNA sequence
taaaattactgggaacacta

SEQ ID NO: 248667 - DNA, 20 bp, Artificial
  CRISPR gRNA sequence
aaaattactgggaacactat

SEQ ID NO: 248668 - DNA, 20 bp, Artificial
  CRISPR gRNA sequence
aaattactgggaacactata

SEQ ID NO: 248669 - DNA, 20 bp, Artificial
  CRISPR gRNA sequence
ctgggaacactataagtaga

SEQ ID NO: 248670 - DNA, 20 bp, Artificial
  CRISPR gRNA sequence
ggaacactataagtagagtg

SEQ ID NO: 248671 - DNA, 20 bp, Artificial
  CRISPR gRNA sequence
taagtagagtgagcatgatt

SEQ ID NO: 248672 - DNA, 20 bp, Artificial
  CRISPR gRNA sequence
ttactgcagagcataaattc

SEQ ID NO: 248673 - DNA, 20 bp, Artificial
  CRISPR gRNA sequence
tactgcagagcataaattcg

SEQ ID NO: 248674 - DNA, 20 bp, Artificial
  CRISPR gRNA sequence
actgcagagcataaattcgc

SEQ ID NO: 248675 - DNA, 20 bp, Artificial
  CRISPR gRNA sequence
ctgcagagcataaattcgct

SEQ ID NO: 248676 - DNA, 20 bp, Artificial
  CRISPR gRNA sequence
cagagcataaattcgcttcc

SEQ ID NO: 248677 - DNA, 20 bp, Artificial
  CRISPR gRNA sequence
gcttcctggatttggaggtc

SEQ ID NO: 248678 - DNA, 20 bp, Artificial
  CRISPR gRNA sequence
cctggatttggaggtcaagt

SEQ ID NO: 248679 - DNA, 20 bp, Artificial
  CRISPR gRNA sequence
ctggatttggaggtcaagtg

SEQ ID NO: 248680 - DNA, 20 bp, Artificial
  CRISPR gRNA sequence
gatttggaggtcaagtgtaa

SEQ ID NO: 248681 - DNA, 20 bp, Artificial
  CRISPR gRNA sequence
ggaggtcaagtgtaataaaa

SEQ ID NO: 248682 - DNA, 20 bp, Artificial
  CRISPR gRNA sequence
gaggtcaagtgtaataaaat

SEQ ID NO: 248683 - DNA, 20 bp, Artificial
  CRISPR gRNA sequence
ggggctggggggactttgta

SEQ ID NO: 248684 - DNA, 20 bp, Artificial
  CRISPR gRNA sequence
gggggactttgtaggtgttt

SEQ ID NO: 248685 - DNA, 20 bp, Artificial
  CRISPR gRNA sequence
tgtaggtgttttcaggacca

SEQ ID NO: 248686 - DNA, 20 bp, Artificial
  CRISPR gRNA sequence
gtaggtgttttcaggaccag

SEQ ID NO: 248687 - DNA, 20 bp, Artificial
  CRISPR gRNA sequence
taggtgttttcaggaccagg

SEQ ID NO: 248688 - DNA, 20 bp, Artificial
  CRISPR gRNA sequence
tcaggaccaggaaggagtgt

SEQ ID NO: 248689 - DNA, 20 bp, Artificial
  CRISPR gRNA sequence
caggaccaggaaggagtgtt

SEQ ID NO: 248690 - DNA, 20 bp, Artificial
  CRISPR gRNA sequence
aggaccaggaaggagtgttc

SEQ ID NO: 248691 - DNA, 20 bp, Artificial
  CRISPR gRNA sequence
ctccaccagcaatgcagagt

SEQ ID NO: 248692 - DNA, 20 bp, Artificial
  CRISPR gRNA sequence
caccagcaatgcagagtgtg

SEQ ID NO: 248693 - DNA, 20 bp, Artificial
  CRISPR gRNA sequence
cactccagggtttcactgcc

SEQ ID NO: 248694 - DNA, 20 bp, Artificial
  CRISPR gRNA sequence
cagggtttcactgcctgggg

SEQ ID NO: 248695 - DNA, 20 bp, Artificial
  CRISPR gRNA sequence
cactgcctgggggcaggatg

SEQ ID NO: 248696 - DNA, 20 bp, Artificial
  CRISPR gRNA sequence
actgcctgggggcaggatgc

SEQ ID NO: 248697 - DNA, 20 bp, Artificial
  CRISPR gRNA sequence
cctgggggcaggatgcagca

SEQ ID NO: 248698 - DNA, 20 bp, Artificial
  CRISPR gRNA sequence
ggggcaggatgcagcatgtg

SEQ ID NO: 248699 - DNA, 20 bp, Artificial
  CRISPR gRNA sequence
taaacaaggtcaagaactga

SEQ ID NO: 248700 - DNA, 20 bp, Artificial
  CRISPR gRNA sequence
acaaaaaaaggtacgtttgc

SEQ ID NO: 248701 - DNA, 20 bp, Artificial
  CRISPR gRNA sequence
gcgtttctttgatctagtgt

SEQ ID NO: 248702 - DNA, 20 bp, Artificial
  CRISPR gRNA sequence
cgtttctttgatctagtgta

SEQ ID NO: 248703 - DNA, 20 bp, Artificial
  CRISPR gRNA sequence
ctttgatctagtgtagtttt

SEQ ID NO: 248704 - DNA, 20 bp, Artificial
  CRISPR gRNA sequence
tttgatctagtgtagttttg

SEQ ID NO: 248705 - DNA, 20 bp, Artificial
  CRISPR gRNA sequence
tgatctagtgtagttttgtg

SEQ ID NO: 248706 - DNA, 20 bp, Artificial
  CRISPR gRNA sequence
gatctagtgtagttttgtga

SEQ ID NO: 248707 - DNA, 20 bp, Artificial
  CRISPR gRNA sequence
atctagtgtagttttgtgac

SEQ ID NO: 248708 - DNA, 20 bp, Artificial
  CRISPR gRNA sequence
gtgtagttttgtgacataga

SEQ ID NO: 248709 - DNA, 20 bp, Artificial
  CRISPR gRNA sequence
tgtgacatagacaaacttag

SEQ ID NO: 248710 - DNA, 20 bp, Artificial
  CRISPR gRNA sequence
gtgacatagacaaacttagc

SEQ ID NO: 248711 - DNA, 20 bp, Artificial
  CRISPR gRNA sequence
tgacatagacaaacttagct

SEQ ID NO: 248712 - DNA, 20 bp, Artificial
  CRISPR gRNA sequence
agctttgatcttgatccttt

SEQ ID NO: 248713 - DNA, 20 bp, Artificial
  CRISPR gRNA sequence
gctttgatcttgatcctttg

SEQ ID NO: 248714 - DNA, 20 bp, Artificial
  CRISPR gRNA sequence
tgatcttgatcctttgaaaa

SEQ ID NO: 248715 - DNA, 20 bp, Artificial
  CRISPR gRNA sequence
gatcttgatcctttgaaaat

SEQ ID NO: 248716 - DNA, 20 bp, Artificial
  CRISPR gRNA sequence
atcttgatcctttgaaaata

SEQ ID NO: 248717 - DNA, 20 bp, Artificial
  CRISPR gRNA sequence
gatcctttgaaaataaacaa

SEQ ID NO: 248718 - DNA, 20 bp, Artificial
  CRISPR gRNA sequence
atcctttgaaaataaacaaa

SEQ ID NO: 248719 - DNA, 20 bp, Artificial
  CRISPR gRNA sequence
tgaaaataaacaaacagatt

SEQ ID NO: 248720 - DNA, 20 bp, Artificial
  CRISPR gRNA sequence
gaaaataaacaaacagattt

SEQ ID NO: 248721 - DNA, 20 bp, Artificial
  CRISPR gRNA sequence
aaaataaacaaacagatttg

SEQ ID NO: 248722 - DNA, 20 bp, Artificial
  CRISPR gRNA sequence
gtagaaccttaaagtaacaa

SEQ ID NO: 248723 - DNA, 20 bp, Artificial
  CRISPR gRNA sequence
tagaaccttaaagtaacaag

SEQ ID NO: 248724 - DNA, 20 bp, Artificial
  CRISPR gRNA sequence
aaagtaacaagggagtatat

SEQ ID NO: 248725 - DNA, 20 bp, Artificial
  CRISPR gRNA sequence
aagtaacaagggagtatatg

SEQ ID NO: 248726 - DNA, 20 bp, Artificial
  CRISPR gRNA sequence
taattaataaaatatttcaa

SEQ ID NO: 248727 - DNA, 20 bp, Artificial
  CRISPR gRNA sequence
aattaataaaatatttcaat

SEQ ID NO: 248728 - DNA, 20 bp, Artificial
  CRISPR gRNA sequence
attaataaaatatttcaatt

SEQ ID NO: 248729 - DNA, 20 bp, Artificial
  CRISPR gRNA sequence
ataaaatatttcaattaata

SEQ ID NO: 248730 - DNA, 20 bp, Artificial
  CRISPR gRNA sequence
caattaataaaatatttccg

SEQ ID NO: 248731 - DNA, 20 bp, Artificial
  CRISPR gRNA sequence
aattaataaaatatttccgt

SEQ ID NO: 248732 - DNA, 20 bp, Artificial
  CRISPR gRNA sequence
ataaaatatttccgttattt

SEQ ID NO: 248733 - DNA, 20 bp, Artificial
  CRISPR gRNA sequence
ccgttatttcttcataaatg

SEQ ID NO: 248734 - DNA, 20 bp, Artificial
  CRISPR gRNA sequence
cgttatttcttcataaatgg

SEQ ID NO: 248735 - DNA, 20 bp, Artificial
  CRISPR gRNA sequence
tttcttcataaatggaaata

SEQ ID NO: 248736 - DNA, 20 bp, Artificial
  CRISPR gRNA sequence
cttcataaatggaaataatt

SEQ ID NO: 248737 - DNA, 20 bp, Artificial
  CRISPR gRNA sequence
ttcataaatggaaataattt

SEQ ID NO: 248738 - DNA, 20 bp, Artificial
  CRISPR gRNA sequence
cataaatggaaataatttga

SEQ ID NO: 248739 - DNA, 20 bp, Artificial
  CRISPR gRNA sequence
ataaatggaaataatttgaa

SEQ ID NO: 248740 - DNA, 20 bp, Artificial
  CRISPR gRNA sequence
gaaatcagaacatttgttaa

SEQ ID NO: 248741 - DNA, 20 bp, Artificial
  CRISPR gRNA sequence
aaatcagaacatttgttaat

SEQ ID NO: 248742 - DNA, 20 bp, Artificial
  CRISPR gRNA sequence
gttaattgccagaaccatta

SEQ ID NO: 248743 - DNA, 20 bp, Artificial
  CRISPR gRNA sequence
ttaattgccagaaccattaa

SEQ ID NO: 248744 - DNA, 20 bp, Artificial
  CRISPR gRNA sequence
attgccagaaccattaatct

SEQ ID NO: 248745 - DNA, 20 bp, Artificial
  CRISPR gRNA sequence
ccagaaccattaatcttcac

SEQ ID NO: 248746 - DNA, 20 bp, Artificial
  CRISPR gRNA sequence
atcttcacatgttccagaca

SEQ ID NO: 248747 - DNA, 20 bp, Artificial
  CRISPR gRNA sequence
cacatgttccagacatatac

SEQ ID NO: 248748 - DNA, 20 bp, Artificial
  CRISPR gRNA sequence
acatgttccagacatataca

SEQ ID NO: 248749 - DNA, 20 bp, Artificial
  CRISPR gRNA sequence
cagacatatacaatacttta

SEQ ID NO: 248750 - DNA, 20 bp, Artificial
  CRISPR gRNA sequence
tatgtacaattaaaataaaa

SEQ ID NO: 248751 - DNA, 20 bp, Artificial
  CRISPR gRNA sequence
atgtacaattaaaataaaaa

SEQ ID NO: 248752 - DNA, 20 bp, Artificial
  CRISPR gRNA sequence
tgtacaattaaaataaaaac

SEQ ID NO: 248753 - DNA, 20 bp, Artificial
  CRISPR gRNA sequence
aaataaaaactagccatctt

SEQ ID NO: 248754 - DNA, 20 bp, Artificial
  CRISPR gRNA sequence
gccatcttagggtgttgttt

SEQ ID NO: 248755 - DNA, 20 bp, Artificial
  CRISPR gRNA sequence
agggtgttgtttcaagaatt

SEQ ID NO: 248756 - DNA, 20 bp, Artificial
  CRISPR gRNA sequence
gggtgttgtttcaagaatta

SEQ ID NO: 248757 - DNA, 20 bp, Artificial
  CRISPR gRNA sequence
tttcaagaattattgaacaa

SEQ ID NO: 248758 - DNA, 20 bp, Artificial
  CRISPR gRNA sequence
caagaattattgaacaattt

SEQ ID NO: 248759 - DNA, 20 bp, Artificial
  CRISPR gRNA sequence
aagaattattgaacaatttg

SEQ ID NO: 248760 - DNA, 20 bp, Artificial
  CRISPR gRNA sequence
ttgaacaatttgtgcagatt

SEQ ID NO: 248761 - DNA, 20 bp, Artificial
  CRISPR gRNA sequence
aacaatttgtgcagattgca

SEQ ID NO: 248762 - DNA, 20 bp, Artificial
  CRISPR gRNA sequence
gtgcagattgcattatggta

SEQ ID NO: 248763 - DNA, 20 bp, Artificial
  CRISPR gRNA sequence
tgcagattgcattatggtaa

SEQ ID NO: 248764 - DNA, 20 bp, Artificial
  CRISPR gRNA sequence
cattatggtaatgacttata

SEQ ID NO: 248765 - DNA, 20 bp, Artificial
  CRISPR gRNA sequence
tggtaatgacttatattaag

SEQ ID NO: 248766 - DNA, 20 bp, Artificial
  CRISPR gRNA sequence
atattaagttcatcacagga

SEQ ID NO: 248767 - DNA, 20 bp, Artificial
  CRISPR gRNA sequence
tattaagttcatcacaggaa

SEQ ID NO: 248768 - DNA, 20 bp, Artificial
  CRISPR gRNA sequence
agttcatcacaggaaaagtt

SEQ ID NO: 248769 - DNA, 20 bp, Artificial
  CRISPR gRNA sequence
atcacaggaaaagttacaaa

SEQ ID NO: 248770 - DNA, 20 bp, Artificial
  CRISPR gRNA sequence
caaaatgatgaaaatgcttc

SEQ ID NO: 248771 - DNA, 20 bp, Artificial
  CRISPR gRNA sequence
cccttttattattgctttca

SEQ ID NO: 248772 - DNA, 20 bp, Artificial
  CRISPR gRNA sequence
ccttttattattgctttcat

SEQ ID NO: 248773 - DNA, 20 bp, Artificial
  CRISPR gRNA sequence
ttattattgctttcattttt

SEQ ID NO: 248774 - DNA, 20 bp, Artificial
  CRISPR gRNA sequence
tattattgctttcattttta

SEQ ID NO: 248775 - DNA, 20 bp, Artificial
  CRISPR gRNA sequence
attattgctttcatttttaa

SEQ ID NO: 248776 - DNA, 20 bp, Artificial
  CRISPR gRNA sequence
ttattgctttcatttttaat

SEQ ID NO: 248777 - DNA, 20 bp, Artificial
  CRISPR gRNA sequence
ttgctttcatttttaataca

SEQ ID NO: 248778 - DNA, 20 bp, Artificial
  CRISPR gRNA sequence
ctttcatttttaatacaagg

SEQ ID NO: 248779 - DNA, 20 bp, Artificial
  CRISPR gRNA sequence
tcatttttaatacaaggttg

SEQ ID NO: 248780 - DNA, 20 bp, Artificial
  CRISPR gRNA sequence
catttttaatacaaggttgt

SEQ ID NO: 248781 - DNA, 20 bp, Artificial
  CRISPR gRNA sequence
atttttaatacaaggttgta

SEQ ID NO: 248782 - DNA, 20 bp, Artificial
  CRISPR gRNA sequence
ttaatacaaggttgtaaaga

SEQ ID NO: 248783 - DNA, 20 bp, Artificial
  CRISPR gRNA sequence
taatacaaggttgtaaagac

SEQ ID NO: 248784 - DNA, 20 bp, Artificial
  CRISPR gRNA sequence
aatacaaggttgtaaagact

SEQ ID NO: 248785 - DNA, 20 bp, Artificial
  CRISPR gRNA sequence
atacaaggttgtaaagactg

SEQ ID NO: 248786 - DNA, 20 bp, Artificial
  CRISPR gRNA sequence
taaagactgttgctttggga

SEQ ID NO: 248787 - DNA, 20 bp, Artificial
  CRISPR gRNA sequence
ttgctttgggacatttaacg

SEQ ID NO: 248788 - DNA, 20 bp, Artificial
  CRISPR gRNA sequence
ctttgggacatttaacgatc

SEQ ID NO: 248789 - DNA, 20 bp, Artificial
  CRISPR gRNA sequence
tgggacatttaacgatcaga

SEQ ID NO: 248790 - DNA, 20 bp, Artificial
  CRISPR gRNA sequence
gggacatttaacgatcagaa

SEQ ID NO: 248791 - DNA, 20 bp, Artificial
  CRISPR gRNA sequence
ggacatttaacgatcagaaa

SEQ ID NO: 248792 - DNA, 20 bp, Artificial
  CRISPR gRNA sequence
aacgatcagaaacgtggcat

SEQ ID NO: 248793 - DNA, 20 bp, Artificial
  CRISPR gRNA sequence
acgatcagaaacgtggcatc

SEQ ID NO: 248794 - DNA, 20 bp, Artificial
  CRISPR gRNA sequence
tcgaccctggacaaagtacg

SEQ ID NO: 248795 - DNA, 20 bp, Artificial
  CRISPR gRNA sequence
gacaaagtacgtataatttc

SEQ ID NO: 248796 - DNA, 20 bp, Artificial
  CRISPR gRNA sequence
cctttagtttatggaataaa

SEQ ID NO: 248797 - DNA, 20 bp, Artificial
  CRISPR gRNA sequence
ctttagtttatggaataaag

SEQ ID NO: 248798 - DNA, 20 bp, Artificial
  CRISPR gRNA sequence
tagtttatggaataaagaat

SEQ ID NO: 248799 - DNA, 20 bp, Artificial
  CRISPR gRNA sequence
agtttatggaataaagaatc

SEQ ID NO: 248800 - DNA, 20 bp, Artificial
  CRISPR gRNA sequence
gtttatggaataaagaatct

SEQ ID NO: 248801 - DNA, 20 bp, Artificial
  CRISPR gRNA sequence
atggaataaagaatctgggt

SEQ ID NO: 248802 - DNA, 20 bp, Artificial
  CRISPR gRNA sequence
tggaataaagaatctgggtt

SEQ ID NO: 248803 - DNA, 20 bp, Artificial
  CRISPR gRNA sequence
ggttaaattttttggaagat

SEQ ID NO: 248804 - DNA, 20 bp, Artificial
  CRISPR gRNA sequence
aattttttggaagataagga

SEQ ID NO: 248805 - DNA, 20 bp, Artificial
  CRISPR gRNA sequence
tttggaagataaggaatgct

SEQ ID NO: 248806 - DNA, 20 bp, Artificial
  CRISPR gRNA sequence
ttggaagataaggaatgcta

SEQ ID NO: 248807 - DNA, 20 bp, Artificial
  CRISPR gRNA sequence
tggaagataaggaatgctat

SEQ ID NO: 248808 - DNA, 20 bp, Artificial
  CRISPR gRNA sequence
ggaagataaggaatgctatc

SEQ ID NO: 248809 - DNA, 20 bp, Artificial
  CRISPR gRNA sequence
gaagataaggaatgctatca

SEQ ID NO: 248810 - DNA, 20 bp, Artificial
  CRISPR gRNA sequence
tcattgaagcttttttgcac

SEQ ID NO: 248811 - DNA, 20 bp, Artificial
  CRISPR gRNA sequence
aagcttttttgcacccatca

SEQ ID NO: 248812 - DNA, 20 bp, Artificial
  CRISPR gRNA sequence
ttttgcacccatcaagtgta

SEQ ID NO: 248813 - DNA, 20 bp, Artificial
  CRISPR gRNA sequence
tttgcacccatcaagtgtag

SEQ ID NO: 248814 - DNA, 20 bp, Artificial
  CRISPR gRNA sequence
ttgcacccatcaagtgtaga

SEQ ID NO: 248815 - DNA, 20 bp, Artificial
  CRISPR gRNA sequence
tgcacccatcaagtgtagac

SEQ ID NO: 248816 - DNA, 20 bp, Artificial
  CRISPR gRNA sequence
gcacccatcaagtgtagaca

SEQ ID NO: 248817 - DNA, 20 bp, Artificial
  CRISPR gRNA sequence
cacccatcaagtgtagacag

SEQ ID NO: 248818 - DNA, 20 bp, Artificial
  CRISPR gRNA sequence
ataggcagcgtgggaacact

SEQ ID NO: 248819 - DNA, 20 bp, Artificial
  CRISPR gRNA sequence
tgaggtcgtagcaactcaat

SEQ ID NO: 248820 - DNA, 20 bp, Artificial
  CRISPR gRNA sequence
aataggcaaagtgggcattt

SEQ ID NO: 248821 - DNA, 20 bp, Artificial
  CRISPR gRNA sequence
tctccagaaatagtgcctgg

SEQ ID NO: 248822 - DNA, 20 bp, Artificial
  CRISPR gRNA sequence
ctccagaaatagtgcctgga

SEQ ID NO: 248823 - DNA, 20 bp, Artificial
  CRISPR gRNA sequence
tccagaaatagtgcctggaa

SEQ ID NO: 248824 - DNA, 20 bp, Artificial
  CRISPR gRNA sequence
cagaaatagtgcctggaaca

SEQ ID NO: 248825 - DNA, 20 bp, Artificial
  CRISPR gRNA sequence
gaacatctagatcagaattg

SEQ ID NO: 248826 - DNA, 20 bp, Artificial
  CRISPR gRNA sequence
gatcagaattgccagtggag

SEQ ID NO: 248827 - DNA, 20 bp, Artificial
  CRISPR gRNA sequence
ccagtggaggctgggcacgt

SEQ ID NO: 248828 - DNA, 20 bp, Artificial
  CRISPR gRNA sequence
ggcacgtgcagtggttcacg

SEQ ID NO: 248829 - DNA, 20 bp, Artificial
  CRISPR gRNA sequence
acgcctgtaatcccagcact

SEQ ID NO: 248830 - DNA, 20 bp, Artificial
  CRISPR gRNA sequence
taatcccagcactttgggag

SEQ ID NO: 248831 - DNA, 20 bp, Artificial
  CRISPR gRNA sequence
tgggaggctgagacaggagg

SEQ ID NO: 248832 - DNA, 20 bp, Artificial
  CRISPR gRNA sequence
gggaggctgagacaggagga

SEQ ID NO: 248833 - DNA, 20 bp, Artificial
  CRISPR gRNA sequence
ggaggctgagacaggaggac

SEQ ID NO: 248834 - DNA, 20 bp, Artificial
  CRISPR gRNA sequence
agacaggaggactccttgag

SEQ ID NO: 248835 - DNA, 20 bp, Artificial
  CRISPR gRNA sequence
cttgagcccaggagttcaaa

SEQ ID NO: 248836 - DNA, 20 bp, Artificial
  CRISPR gRNA sequence
gagcccaggagttcaaaacc

SEQ ID NO: 248837 - DNA, 20 bp, Artificial
  CRISPR gRNA sequence
agcccaggagttcaaaacca

SEQ ID NO: 248838 - DNA, 20 bp, Artificial
  CRISPR gRNA sequence
aaaaccagcctgggtgagac

SEQ ID NO: 248839 - DNA, 20 bp, Artificial
  CRISPR gRNA sequence
ggtgagaccctgtctctaca

SEQ ID NO: 248840 - DNA, 20 bp, Artificial
  CRISPR gRNA sequence
tctctacaaaaaatcaaaaa

SEQ ID NO: 248841 - DNA, 20 bp, Artificial
  CRISPR gRNA sequence
tacaaaaaatcaaaaaatta

SEQ ID NO: 248842 - DNA, 20 bp, Artificial
  CRISPR gRNA sequence
caaaaaatcaaaaaattagc

SEQ ID NO: 248843 - DNA, 20 bp, Artificial
  CRISPR gRNA sequence
gccaggcataatggcacatg

SEQ ID NO: 248844 - DNA, 20 bp, Artificial
  CRISPR gRNA sequence
tggtcccagctatagggaag

SEQ ID NO: 248845 - DNA, 20 bp, Artificial
  CRISPR gRNA sequence
tagggaaggctgatgaggca

SEQ ID NO: 248846 - DNA, 20 bp, Artificial
  CRISPR gRNA sequence
atgaggcaggaggatcacct

SEQ ID NO: 248847 - DNA, 20 bp, Artificial
  CRISPR gRNA sequence
agtctgggaggttgaggctg

SEQ ID NO: 248848 - DNA, 20 bp, Artificial
  CRISPR gRNA sequence
ggaggttgaggctgcaatga

SEQ ID NO: 248849 - DNA, 20 bp, Artificial
  CRISPR gRNA sequence
aggctgcaatgagctatgat

SEQ ID NO: 248850 - DNA, 20 bp, Artificial
  CRISPR gRNA sequence
caatgagctatgatcgcacc

SEQ ID NO: 248851 - DNA, 20 bp, Artificial
  CRISPR gRNA sequence
tgatcgcaccatcgcactcc

SEQ ID NO: 248852 - DNA, 20 bp, Artificial
  CRISPR gRNA sequence
cagagcagagagcctgtctc

SEQ ID NO: 248853 - DNA, 20 bp, Artificial
  CRISPR gRNA sequence
tctcaaaagaaaggaaaaga

SEQ ID NO: 248854 - DNA, 20 bp, Artificial
  CRISPR gRNA sequence
aaaagaaaggaaaagaattg

SEQ ID NO: 248855 - DNA, 20 bp, Artificial
  CRISPR gRNA sequence
ccagtggaactttgccgctg

SEQ ID NO: 248856 - DNA, 20 bp, Artificial
  CRISPR gRNA sequence
tgccgctgtctgcctctttt

SEQ ID NO: 248857 - DNA, 20 bp, Artificial
  CRISPR gRNA sequence
gccgctgtctgcctcttttc

SEQ ID NO: 248858 - DNA, 20 bp, Artificial
  CRISPR gRNA sequence
ccgctgtctgcctcttttct

SEQ ID NO: 248859 - DNA, 20 bp, Artificial
  CRISPR gRNA sequence
tctgcctcttttctgtttcc

SEQ ID NO: 248860 - DNA, 20 bp, Artificial
  CRISPR gRNA sequence
cctcttttctgtttccttct

SEQ ID NO: 248861 - DNA, 20 bp, Artificial
  CRISPR gRNA sequence
ttttctgtttccttctcatt

SEQ ID NO: 248862 - DNA, 20 bp, Artificial
  CRISPR gRNA sequence
ttctgtttccttctcattcc

SEQ ID NO: 248863 - DNA, 20 bp, Artificial
  CRISPR gRNA sequence
tctgtttccttctcattcct

SEQ ID NO: 248864 - DNA, 20 bp, Artificial
  CRISPR gRNA sequence
ctgtttccttctcattcctt

SEQ ID NO: 248865 - DNA, 20 bp, Artificial
  CRISPR gRNA sequence
tgtttccttctcattccttt

SEQ ID NO: 248866 - DNA, 20 bp, Artificial
  CRISPR gRNA sequence
tttccttctcattcctttgc

SEQ ID NO: 248867 - DNA, 20 bp, Artificial
  CRISPR gRNA sequence
ccttctcattcctttgctgc

SEQ ID NO: 248868 - DNA, 20 bp, Artificial
  CRISPR gRNA sequence
cttctcattcctttgctgcc

SEQ ID NO: 248869 - DNA, 20 bp, Artificial
  CRISPR gRNA sequence
ctcattcctttgctgcctct

SEQ ID NO: 248870 - DNA, 20 bp, Artificial
  CRISPR gRNA sequence
tcattcctttgctgcctctt

SEQ ID NO: 248871 - DNA, 20 bp, Artificial
  CRISPR gRNA sequence
attcctttgctgcctcttat

SEQ ID NO: 248872 - DNA, 20 bp, Artificial
  CRISPR gRNA sequence
ctttgctgcctcttatcttc

SEQ ID NO: 248873 - DNA, 20 bp, Artificial
  CRISPR gRNA sequence
tgctgcctcttatcttctct

SEQ ID NO: 248874 - DNA, 20 bp, Artificial
  CRISPR gRNA sequence
gctgcctcttatcttctctc

SEQ ID NO: 248875 - DNA, 20 bp, Artificial
  CRISPR gRNA sequence
ctgcctcttatcttctctca

SEQ ID NO: 248876 - DNA, 20 bp, Artificial
  CRISPR gRNA sequence
cctcttatcttctctcattg

SEQ ID NO: 248877 - DNA, 20 bp, Artificial
  CRISPR gRNA sequence
ttatcttctctcattgatca

SEQ ID NO: 248878 - DNA, 20 bp, Artificial
  CRISPR gRNA sequence
atcttctctcattgatcagc

SEQ ID NO: 248879 - DNA, 20 bp, Artificial
  CRISPR gRNA sequence
tcttctctcattgatcagcc

SEQ ID NO: 248880 - DNA, 20 bp, Artificial
  CRISPR gRNA sequence
ctctcattgatcagcctgtc

SEQ ID NO: 248881 - DNA, 20 bp, Artificial
  CRISPR gRNA sequence
tctcattgatcagcctgtct

SEQ ID NO: 248882 - DNA, 20 bp, Artificial
  CRISPR gRNA sequence
tcattgatcagcctgtctcc

SEQ ID NO: 248883 - DNA, 20 bp, Artificial
  CRISPR gRNA sequence
attgatcagcctgtctccat

SEQ ID NO: 248884 - DNA, 20 bp, Artificial
  CRISPR gRNA sequence
atcagcctgtctccatgtgt

SEQ ID NO: 248885 - DNA, 20 bp, Artificial
  CRISPR gRNA sequence
tctccatgtgttcaatgcca

SEQ ID NO: 248886 - DNA, 20 bp, Artificial
  CRISPR gRNA sequence
catgtgttcaatgccagccc

SEQ ID NO: 248887 - DNA, 20 bp, Artificial
  CRISPR gRNA sequence
aatgccagcccctagaatga

SEQ ID NO: 248888 - DNA, 20 bp, Artificial
  CRISPR gRNA sequence
gaatgatacagaagaaacta

SEQ ID NO: 248889 - DNA, 20 bp, Artificial
  CRISPR gRNA sequence
acaattgctcgttaccctcc

SEQ ID NO: 248890 - DNA, 20 bp, Artificial
  CRISPR gRNA sequence
ctcgttaccctccaaaatgt

SEQ ID NO: 248891 - DNA, 20 bp, Artificial
  CRISPR gRNA sequence
gttaccctccaaaatgtggc

SEQ ID NO: 248892 - DNA, 20 bp, Artificial
  CRISPR gRNA sequence
ccctccaaaatgtggcacag

SEQ ID NO: 248893 - DNA, 20 bp, Artificial
  CRISPR gRNA sequence
caaaatgtggcacagacttg

SEQ ID NO: 248894 - DNA, 20 bp, Artificial
  CRISPR gRNA sequence
gggcacacaaggccatcaca

SEQ ID NO: 248895 - DNA, 20 bp, Artificial
  CRISPR gRNA sequence
ggcacacaaggccatcacag

SEQ ID NO: 248896 - DNA, 20 bp, Artificial
  CRISPR gRNA sequence
ttgttttgtggaaccagaac

SEQ ID NO: 248897 - DNA, 20 bp, Artificial
  CRISPR gRNA sequence
ttttgtggaaccagaactta

SEQ ID NO: 248898 - DNA, 20 bp, Artificial
  CRISPR gRNA sequence
tgtggaaccagaacttacac

SEQ ID NO: 248899 - DNA, 20 bp, Artificial
  CRISPR gRNA sequence
gtggaaccagaacttacact

SEQ ID NO: 248900 - DNA, 20 bp, Artificial
  CRISPR gRNA sequence
tggaaccagaacttacactg

SEQ ID NO: 248901 - DNA, 20 bp, Artificial
  CRISPR gRNA sequence
acactgtggtctgtggatgg

SEQ ID NO: 248902 - DNA, 20 bp, Artificial
  CRISPR gRNA sequence
cactgtggtctgtggatggg

SEQ ID NO: 248903 - DNA, 20 bp, Artificial
  CRISPR gRNA sequence
tggtctgtggatgggtgctg

SEQ ID NO: 248904 - DNA, 20 bp, Artificial
  CRISPR gRNA sequence
tggatgggtgctggtccaca

SEQ ID NO: 248905 - DNA, 20 bp, Artificial
  CRISPR gRNA sequence
gtccacaaatggcttgtcct

SEQ ID NO: 248906 - DNA, 20 bp, Artificial
  CRISPR gRNA sequence
gtcctgtgtccccatcgaca

SEQ ID NO: 248907 - DNA, 20 bp, Artificial
  CRISPR gRNA sequence
tcctgtgtccccatcgacag

SEQ ID NO: 248908 - DNA, 20 bp, Artificial
  CRISPR gRNA sequence
tgtccccatcgacagtggtg

SEQ ID NO: 248909 - DNA, 20 bp, Artificial
  CRISPR gRNA sequence
gagagtaaacatttagaaac

SEQ ID NO: 248910 - DNA, 20 bp, Artificial
  CRISPR gRNA sequence
agaaacttttaaggcaaatt

SEQ ID NO: 248911 - DNA, 20 bp, Artificial
  CRISPR gRNA sequence
gaaacttttaaggcaaattg

SEQ ID NO: 248912 - DNA, 20 bp, Artificial
  CRISPR gRNA sequence
ttaaggcaaattggcagagt

SEQ ID NO: 248913 - DNA, 20 bp, Artificial
  CRISPR gRNA sequence
taaggcaaattggcagagta

SEQ ID NO: 248914 - DNA, 20 bp, Artificial
  CRISPR gRNA sequence
aaggcaaattggcagagtaa

SEQ ID NO: 248915 - DNA, 20 bp, Artificial
  CRISPR gRNA sequence
aggcaaattggcagagtaat

SEQ ID NO: 248916 - DNA, 20 bp, Artificial
  CRISPR gRNA sequence
gcagagtaatgtggtctgtt

SEQ ID NO: 248917 - DNA, 20 bp, Artificial
  CRISPR gRNA sequence
ttgactaagaataaaaattt

SEQ ID NO: 248918 - DNA, 20 bp, Artificial
  CRISPR gRNA sequence
actaagaataaaaatttggg

SEQ ID NO: 248919 - DNA, 20 bp, Artificial
  CRISPR gRNA sequence
agaataaaaatttgggcgtt

SEQ ID NO: 248920 - DNA, 20 bp, Artificial
  CRISPR gRNA sequence
gggcgttgtattttatatgt

SEQ ID NO: 248921 - DNA, 20 bp, Artificial
  CRISPR gRNA sequence
ggcgttgtattttatatgta

SEQ ID NO: 248922 - DNA, 20 bp, Artificial
  CRISPR gRNA sequence
tattttatatgtatttgttc

SEQ ID NO: 248923 - DNA, 20 bp, Artificial
  CRISPR gRNA sequence
tatatgtatttgttcttttt

SEQ ID NO: 248924 - DNA, 20 bp, Artificial
  CRISPR gRNA sequence
atatgtatttgttctttttc

SEQ ID NO: 248925 - DNA, 20 bp, Artificial
  CRISPR gRNA sequence
tatgtatttgttctttttcc

SEQ ID NO: 248926 - DNA, 20 bp, Artificial
  CRISPR gRNA sequence
gttctttttccgtttcattt

SEQ ID NO: 248927 - DNA, 20 bp, Artificial
  CRISPR gRNA sequence
ttctttttccgtttcatttt

SEQ ID NO: 248928 - DNA, 20 bp, Artificial
  CRISPR gRNA sequence
tttttccgtttcattttctt

SEQ ID NO: 248929 - DNA, 20 bp, Artificial
  CRISPR gRNA sequence
tttccgtttcattttcttac

SEQ ID NO: 248930 - DNA, 20 bp, Artificial
  CRISPR gRNA sequence
ttccgtttcattttcttact

SEQ ID NO: 248931 - DNA, 20 bp, Artificial
  CRISPR gRNA sequence
tccgtttcattttcttacta

SEQ ID NO: 248932 - DNA, 20 bp, Artificial
  CRISPR gRNA sequence
ccgtttcattttcttactag

SEQ ID NO: 248933 - DNA, 20 bp, Artificial
  CRISPR gRNA sequence
cgtttcattttcttactaga

SEQ ID NO: 248934 - DNA, 20 bp, Artificial
  CRISPR gRNA sequence
cattttcttactagaaaatc

SEQ ID NO: 248935 - DNA, 20 bp, Artificial
  CRISPR gRNA sequence
attttcttactagaaaatca

SEQ ID NO: 248936 - DNA, 20 bp, Artificial
  CRISPR gRNA sequence
tcttactagaaaatcatttt

SEQ ID NO: 248937 - DNA, 20 bp, Artificial
  CRISPR gRNA sequence
cttactagaaaatcattttt

SEQ ID NO: 248938 - DNA, 20 bp, Artificial
  CRISPR gRNA sequence
ttactagaaaatcattttta

SEQ ID NO: 248939 - DNA, 20 bp, Artificial
  CRISPR gRNA sequence
actagaaaatcatttttatt

SEQ ID NO: 248940 - DNA, 20 bp, Artificial
  CRISPR gRNA sequence
ctagaaaatcatttttatta

SEQ ID NO: 248941 - DNA, 20 bp, Artificial
  CRISPR gRNA sequence
gaaaatcatttttattattt

SEQ ID NO: 248942 - DNA, 20 bp, Artificial
  CRISPR gRNA sequence
ttattattttacttttacat

SEQ ID NO: 248943 - DNA, 20 bp, Artificial
  CRISPR gRNA sequence
tattattttacttttacatt

SEQ ID NO: 248944 - DNA, 20 bp, Artificial
  CRISPR gRNA sequence
attattttacttttacattt

SEQ ID NO: 248945 - DNA, 20 bp, Artificial
  CRISPR gRNA sequence
ttattttacttttacatttt

SEQ ID NO: 248946 - DNA, 20 bp, Artificial
  CRISPR gRNA sequence
ttttacttttacatttttat

SEQ ID NO: 248947 - DNA, 20 bp, Artificial
  CRISPR gRNA sequence
tacttttacatttttattgt

SEQ ID NO: 248948 - DNA, 20 bp, Artificial
  CRISPR gRNA sequence
acttttacatttttattgta

SEQ ID NO: 248949 - DNA, 20 bp, Artificial
  CRISPR gRNA sequence
cttttacatttttattgtat

SEQ ID NO: 248950 - DNA, 20 bp, Artificial
  CRISPR gRNA sequence
ttacatttttattgtatttc

SEQ ID NO: 248951 - DNA, 20 bp, Artificial
  CRISPR gRNA sequence
tacatttttattgtatttca

SEQ ID NO: 248952 - DNA, 20 bp, Artificial
  CRISPR gRNA sequence
acatttttattgtatttcaa

SEQ ID NO: 248953 - DNA, 20 bp, Artificial
  CRISPR gRNA sequence
catttttattgtatttcaaa

SEQ ID NO: 248954 - DNA, 20 bp, Artificial
  CRISPR gRNA sequence
ttattgtatttcaaaagtgt

SEQ ID NO: 248955 - DNA, 20 bp, Artificial
  CRISPR gRNA sequence
tattgtatttcaaaagtgta

SEQ ID NO: 248956 - DNA, 20 bp, Artificial
  CRISPR gRNA sequence
attgtatttcaaaagtgtat

SEQ ID NO: 248957 - DNA, 20 bp, Artificial
  CRISPR gRNA sequence
ttgtatttcaaaagtgtatt

SEQ ID NO: 248958 - DNA, 20 bp, Artificial
  CRISPR gRNA sequence
tatttcaaaagtgtattggt

SEQ ID NO: 248959 - DNA, 20 bp, Artificial
  CRISPR gRNA sequence
caaaagtgtattggtttgta

SEQ ID NO: 248960 - DNA, 20 bp, Artificial
  CRISPR gRNA sequence
aaaagtgtattggtttgtaa

SEQ ID NO: 248961 - DNA, 20 bp, Artificial
  CRISPR gRNA sequence
gtttgtaacagactggaaag

SEQ ID NO: 248962 - DNA, 20 bp, Artificial
  CRISPR gRNA sequence
gtaacagactggaaagtgac

SEQ ID NO: 248963 - DNA, 20 bp, Artificial
  CRISPR gRNA sequence
taacagactggaaagtgact

SEQ ID NO: 248964 - DNA, 20 bp, Artificial
  CRISPR gRNA sequence
gaaagtgacttttttgagag

SEQ ID NO: 248965 - DNA, 20 bp, Artificial
  CRISPR gRNA sequence
ttttgagagaaaataaagtg

SEQ ID NO: 248966 - DNA, 20 bp, Artificial
  CRISPR gRNA sequence
tttgagagaaaataaagtgt

SEQ ID NO: 248967 - DNA, 20 bp, Artificial
  CRISPR gRNA sequence
ttgagagaaaataaagtgtt

SEQ ID NO: 248968 - DNA, 20 bp, Artificial
  CRISPR gRNA sequence
tgagagaaaataaagtgttt

SEQ ID NO: 248969 - DNA, 20 bp, Artificial
  CRISPR gRNA sequence
gagagaaaataaagtgtttt

SEQ ID NO: 248970 - DNA, 20 bp, Artificial
  CRISPR gRNA sequence
agagaaaataaagtgttttg

SEQ ID NO: 248971 - DNA, 20 bp, Artificial
  CRISPR gRNA sequence
tgaaacaggaatcatggtat

SEQ ID NO: 248972 - DNA, 20 bp, Artificial
  CRISPR gRNA sequence
gaaacaggaatcatggtatc

SEQ ID NO: 248973 - DNA, 20 bp, Artificial
  CRISPR gRNA sequence
aaacaggaatcatggtatct

SEQ ID NO: 248974 - DNA, 20 bp, Artificial
  CRISPR gRNA sequence
tctgcttttgtcatttataa

SEQ ID NO: 248975 - DNA, 20 bp, Artificial
  CRISPR gRNA sequence
tgcttttgtcatttataatt

SEQ ID NO: 248976 - DNA, 20 bp, Artificial
  CRISPR gRNA sequence
cttttgtcatttataattta

SEQ ID NO: 248977 - DNA, 20 bp, Artificial
  CRISPR gRNA sequence
ttgtcatttataatttatca

SEQ ID NO: 248978 - DNA, 20 bp, Artificial
  CRISPR gRNA sequence
tgtcatttataatttatcag

SEQ ID NO: 248979 - DNA, 20 bp, Artificial
  CRISPR gRNA sequence
gtcatttataatttatcagc

SEQ ID NO: 248980 - DNA, 20 bp, Artificial
  CRISPR gRNA sequence
tcatttataatttatcagca

SEQ ID NO: 248981 - DNA, 20 bp, Artificial
  CRISPR gRNA sequence
ataatttatcagcatcagag

SEQ ID NO: 248982 - DNA, 20 bp, Artificial
  CRISPR gRNA sequence
taatttatcagcatcagagt

SEQ ID NO: 248983 - DNA, 20 bp, Artificial
  CRISPR gRNA sequence
atcagcatcagagtggctga

SEQ ID NO: 248984 - DNA, 20 bp, Artificial
  CRISPR gRNA sequence
tcagcatcagagtggctgac

SEQ ID NO: 248985 - DNA, 20 bp, Artificial
  CRISPR gRNA sequence
acgaatggaatcatgattca

SEQ ID NO: 248986 - DNA, 20 bp, Artificial
  CRISPR gRNA sequence
acaagaaaagtattgactat

SEQ ID NO: 248987 - DNA, 20 bp, Artificial
  CRISPR gRNA sequence
actattttctcggacttagc

SEQ ID NO: 248988 - DNA, 20 bp, Artificial
  CRISPR gRNA sequence
ttttctcggacttagctgaa

SEQ ID NO: 248989 - DNA, 20 bp, Artificial
  CRISPR gRNA sequence
tctcggacttagctgaattc

SEQ ID NO: 248990 - DNA, 20 bp, Artificial
  CRISPR gRNA sequence
ctcggacttagctgaattct

SEQ ID NO: 248991 - DNA, 20 bp, Artificial
  CRISPR gRNA sequence
tcggacttagctgaattctg

SEQ ID NO: 248992 - DNA, 20 bp, Artificial
  CRISPR gRNA sequence
ggacttagctgaattctgtc

SEQ ID NO: 248993 - DNA, 20 bp, Artificial
  CRISPR gRNA sequence
agctgaattctgtctttgga

SEQ ID NO: 248994 - DNA, 20 bp, Artificial
  CRISPR gRNA sequence
gctgaattctgtctttggaa

SEQ ID NO: 248995 - DNA, 20 bp, Artificial
  CRISPR gRNA sequence
aattctgtctttggaaagtg

SEQ ID NO: 248996 - DNA, 20 bp, Artificial
  CRISPR gRNA sequence
tgtctttggaaagtggcttt

SEQ ID NO: 248997 - DNA, 20 bp, Artificial
  CRISPR gRNA sequence
tctttggaaagtggcttttt

SEQ ID NO: 248998 - DNA, 20 bp, Artificial
  CRISPR gRNA sequence
tggaaagtggcttttttaaa

SEQ ID NO: 248999 - DNA, 20 bp, Artificial
  CRISPR gRNA sequence
ggaaagtggcttttttaaaa

SEQ ID NO: 249000 - DNA, 20 bp, Artificial
  CRISPR gRNA sequence
gaaagtggcttttttaaaaa

SEQ ID NO: 249001 - DNA, 20 bp, Artificial
  CRISPR gRNA sequence
ttttaaaaaggtctgtttgt

SEQ ID NO: 249002 - DNA, 20 bp, Artificial
  CRISPR gRNA sequence
tttaaaaaggtctgtttgtt

SEQ ID NO: 249003 - DNA, 20 bp, Artificial
  CRISPR gRNA sequence
ttaaaaaggtctgtttgttt

SEQ ID NO: 249004 - DNA, 20 bp, Artificial
  CRISPR gRNA sequence
taaaaaggtctgtttgtttg

SEQ ID NO: 249005 - DNA, 20 bp, Artificial
  CRISPR gRNA sequence
aaaaaggtctgtttgtttgt

SEQ ID NO: 249006 - DNA, 20 bp, Artificial
  CRISPR gRNA sequence
aaaaggtctgtttgtttgtt

SEQ ID NO: 249007 - DNA, 20 bp, Artificial
  CRISPR gRNA sequence
tttgtttgttttgtttgttt

SEQ ID NO: 249008 - DNA, 20 bp, Artificial
  CRISPR gRNA sequence
gtttgttttgtttgtttgtt

SEQ ID NO: 249009 - DNA, 20 bp, Artificial
  CRISPR gRNA sequence
tttgttttgtttgtttgttt

SEQ ID NO: 249010 - DNA, 20 bp, Artificial
  CRISPR gRNA sequence
gttttgtttgtttgtttgtt

SEQ ID NO: 249011 - DNA, 20 bp, Artificial
  CRISPR gRNA sequence
ttttgtttgtttgtttgttt

SEQ ID NO: 249012 - DNA, 20 bp, Artificial
  CRISPR gRNA sequence
tgtttgtttgtttgtttgtt

SEQ ID NO: 249013 - DNA, 20 bp, Artificial
  CRISPR gRNA sequence
gtttgtttgtttgtttgttt

SEQ ID NO: 249014 - DNA, 20 bp, Artificial
  CRISPR gRNA sequence
tttgtttgtttgtttgtttg

SEQ ID NO: 249015 - DNA, 20 bp, Artificial
  CRISPR gRNA sequence
gtttgtttgtttgtttgttt

SEQ ID NO: 249016 - DNA, 20 bp, Artificial
  CRISPR gRNA sequence
tttgtttgtttgtttgtttt

SEQ ID NO: 249017 - DNA, 20 bp, Artificial
  CRISPR gRNA sequence
gtttgtttgtttgttttgag

SEQ ID NO: 249018 - DNA, 20 bp, Artificial
  CRISPR gRNA sequence
tttgtttgtttgttttgaga

SEQ ID NO: 249019 - DNA, 20 bp, Artificial
  CRISPR gRNA sequence
gtttgtttgttttgagatgg

SEQ ID NO: 249020 - DNA, 20 bp, Artificial
  CRISPR gRNA sequence
tttgtttgttttgagatgga

SEQ ID NO: 249021 - DNA, 20 bp, Artificial
  CRISPR gRNA sequence
gtttgttttgagatggagtt

SEQ ID NO: 249022 - DNA, 20 bp, Artificial
  CRISPR gRNA sequence
tttgttttgagatggagttt

SEQ ID NO: 249023 - DNA, 20 bp, Artificial
  CRISPR gRNA sequence
gttttgagatggagtttcgc

SEQ ID NO: 249024 - DNA, 20 bp, Artificial
  CRISPR gRNA sequence
ttttgagatggagtttcgct

SEQ ID NO: 249025 - DNA, 20 bp, Artificial
  CRISPR gRNA sequence
tgagatggagtttcgctctt

SEQ ID NO: 249026 - DNA, 20 bp, Artificial
  CRISPR gRNA sequence
gagatggagtttcgctcttc

SEQ ID NO: 249027 - DNA, 20 bp, Artificial
  CRISPR gRNA sequence
agatggagtttcgctcttct

SEQ ID NO: 249028 - DNA, 20 bp, Artificial
  CRISPR gRNA sequence
cgctcttcttgcccaggctg

SEQ ID NO: 249029 - DNA, 20 bp, Artificial
  CRISPR gRNA sequence
gctcttcttgcccaggctgg

SEQ ID NO: 249030 - DNA, 20 bp, Artificial
  CRISPR gRNA sequence
ttcttgcccaggctggagtg

SEQ ID NO: 249031 - DNA, 20 bp, Artificial
  CRISPR gRNA sequence
cttgcccaggctggagtgca

SEQ ID NO: 249032 - DNA, 20 bp, Artificial
  CRISPR gRNA sequence
ttgcccaggctggagtgcaa

SEQ ID NO: 249033 - DNA, 20 bp, Artificial
  CRISPR gRNA sequence
gcccaggctggagtgcaatg

SEQ ID NO: 249034 - DNA, 20 bp, Artificial
  CRISPR gRNA sequence
cccaggctggagtgcaatgg

SEQ ID NO: 249035 - DNA, 20 bp, Artificial
  CRISPR gRNA sequence
gagtgcaatggcacggtctc

SEQ ID NO: 249036 - DNA, 20 bp, Artificial
  CRISPR gRNA sequence
gcctcactgcaaactctgcc

SEQ ID NO: 249037 - DNA, 20 bp, Artificial
  CRISPR gRNA sequence
actgcaaactctgcctcctg

SEQ ID NO: 249038 - DNA, 20 bp, Artificial
  CRISPR gRNA sequence
caaactctgcctcctgggtt

SEQ ID NO: 249039 - DNA, 20 bp, Artificial
  CRISPR gRNA sequence
tgcctcctgggttcaagaga

SEQ ID NO: 249040 - DNA, 20 bp, Artificial
  CRISPR gRNA sequence
cctcctgggttcaagagatt

SEQ ID NO: 249041 - DNA, 20 bp, Artificial
  CRISPR gRNA sequence
ctgggttcaagagattctcc

SEQ ID NO: 249042 - DNA, 20 bp, Artificial
  CRISPR gRNA sequence
ggttcaagagattctcctgc

SEQ ID NO: 249043 - DNA, 20 bp, Artificial
  CRISPR gRNA sequence
aagagattctcctgcctcgg

SEQ ID NO: 249044 - DNA, 20 bp, Artificial
  CRISPR gRNA sequence
tcctgcctcggcctcctagt

SEQ ID NO: 249045 - DNA, 20 bp, Artificial
  CRISPR gRNA sequence
ctgcctcggcctcctagtag

SEQ ID NO: 249046 - DNA, 20 bp, Artificial
  CRISPR gRNA sequence
cctcggcctcctagtagctg

SEQ ID NO: 249047 - DNA, 20 bp, Artificial
  CRISPR gRNA sequence
ggcctcctagtagctgggat

SEQ ID NO: 249048 - DNA, 20 bp, Artificial
  CRISPR gRNA sequence
ctagtagctgggattacagg

SEQ ID NO: 249049 - DNA, 20 bp, Artificial
  CRISPR gRNA sequence
gtagctgggattacaggtgc

SEQ ID NO: 249050 - DNA, 20 bp, Artificial
  CRISPR gRNA sequence
ggattacaggtgcacacaac

SEQ ID NO: 249051 - DNA, 20 bp, Artificial
  CRISPR gRNA sequence
caggtgcacacaaccacgcc

SEQ ID NO: 249052 - DNA, 20 bp, Artificial
  CRISPR gRNA sequence
gctagtgcttttgtattttt

SEQ ID NO: 249053 - DNA, 20 bp, Artificial
  CRISPR gRNA sequence
gtgcttttgtatttttagta

SEQ ID NO: 249054 - DNA, 20 bp, Artificial
  CRISPR gRNA sequence
ttgtatttttagtagagatg

SEQ ID NO: 249055 - DNA, 20 bp, Artificial
  CRISPR gRNA sequence
tgtatttttagtagagatgg

SEQ ID NO: 249056 - DNA, 20 bp, Artificial
  CRISPR gRNA sequence
gtatttttagtagagatggg

SEQ ID NO: 249057 - DNA, 20 bp, Artificial
  CRISPR gRNA sequence
tatttttagtagagatgggc

SEQ ID NO: 249058 - DNA, 20 bp, Artificial
  CRISPR gRNA sequence
ttagtagagatgggctttca

SEQ ID NO: 249059 - DNA, 20 bp, Artificial
  CRISPR gRNA sequence
tagtagagatgggctttcac

SEQ ID NO: 249060 - DNA, 20 bp, Artificial
  CRISPR gRNA sequence
agtagagatgggctttcacc

SEQ ID NO: 249061 - DNA, 20 bp, Artificial
  CRISPR gRNA sequence
gtagagatgggctttcacca

SEQ ID NO: 249062 - DNA, 20 bp, Artificial
  CRISPR gRNA sequence
tcaccatgttagccaggctg

SEQ ID NO: 249063 - DNA, 20 bp, Artificial
  CRISPR gRNA sequence
caccatgttagccaggctgg

SEQ ID NO: 249064 - DNA, 20 bp, Artificial
  CRISPR gRNA sequence
accatgttagccaggctggt

SEQ ID NO: 249065 - DNA, 20 bp, Artificial
  CRISPR gRNA sequence
gccaggctggtctcgcactc

SEQ ID NO: 249066 - DNA, 20 bp, Artificial
  CRISPR gRNA sequence
gtctcgcactcctgacctca

SEQ ID NO: 249067 - DNA, 20 bp, Artificial
  CRISPR gRNA sequence
gcactcctgacctcaagtga

SEQ ID NO: 249068 - DNA, 20 bp, Artificial
  CRISPR gRNA sequence
ctgacctcaagtgatccgct

SEQ ID NO: 249069 - DNA, 20 bp, Artificial
  CRISPR gRNA sequence
acctcaagtgatccgcttgc

SEQ ID NO: 249070 - DNA, 20 bp, Artificial
  CRISPR gRNA sequence
aagtgatccgcttgccttgg

SEQ ID NO: 249071 - DNA, 20 bp, Artificial
  CRISPR gRNA sequence
gccttggcctcccaaagtgc

SEQ ID NO: 249072 - DNA, 20 bp, Artificial
  CRISPR gRNA sequence
ccttggcctcccaaagtgct

SEQ ID NO: 249073 - DNA, 20 bp, Artificial
  CRISPR gRNA sequence
ggcctcccaaagtgctggga

SEQ ID NO: 249074 - DNA, 20 bp, Artificial
  CRISPR gRNA sequence
gcctcccaaagtgctgggat

SEQ ID NO: 249075 - DNA, 20 bp, Artificial
  CRISPR gRNA sequence
ccaaagtgctgggattacag

SEQ ID NO: 249076 - DNA, 20 bp, Artificial
  CRISPR gRNA sequence
ggattacaggtgtgagccac

SEQ ID NO: 249077 - DNA, 20 bp, Artificial
  CRISPR gRNA sequence
caggtgtgagccactgtgcc

SEQ ID NO: 249078 - DNA, 20 bp, Artificial
  CRISPR gRNA sequence
tgcccagctggaaagtggct

SEQ ID NO: 249079 - DNA, 20 bp, Artificial
  CRISPR gRNA sequence
gaaagtggctttttaaaaaa

SEQ ID NO: 249080 - DNA, 20 bp, Artificial
  CRISPR gRNA sequence
tttaaaaaaggtctttcaat

SEQ ID NO: 249081 - DNA, 20 bp, Artificial
  CRISPR gRNA sequence
ttaaaaaaggtctttcaata

SEQ ID NO: 249082 - DNA, 20 bp, Artificial
  CRISPR gRNA sequence
taaaaaaggtctttcaatac

SEQ ID NO: 249083 - DNA, 20 bp, Artificial
  CRISPR gRNA sequence
aaaaaaggtctttcaataca

SEQ ID NO: 249084 - DNA, 20 bp, Artificial
  CRISPR gRNA sequence
aaaaaggtctttcaatacaa

SEQ ID NO: 249085 - DNA, 20 bp, Artificial
  CRISPR gRNA sequence
tcaatacaaatttttcagag

SEQ ID NO: 249086 - DNA, 20 bp, Artificial
  CRISPR gRNA sequence
caatacaaatttttcagagt

SEQ ID NO: 249087 - DNA, 20 bp, Artificial
  CRISPR gRNA sequence
aatacaaatttttcagagtt

SEQ ID NO: 249088 - DNA, 20 bp, Artificial
  CRISPR gRNA sequence
ttcagagttgttaagtgagt

SEQ ID NO: 249089 - DNA, 20 bp, Artificial
  CRISPR gRNA sequence
tcagagttgttaagtgagtc

SEQ ID NO: 249090 - DNA, 20 bp, Artificial
  CRISPR gRNA sequence
cagagttgttaagtgagtct

SEQ ID NO: 249091 - DNA, 20 bp, Artificial
  CRISPR gRNA sequence
agagttgttaagtgagtctg

SEQ ID NO: 249092 - DNA, 20 bp, Artificial
  CRISPR gRNA sequence
ttaagtgagtctgcatggaa

SEQ ID NO: 249093 - DNA, 20 bp, Artificial
  CRISPR gRNA sequence
agtgagtctgcatggaaaaa

SEQ ID NO: 249094 - DNA, 20 bp, Artificial
  CRISPR gRNA sequence
catggaaaaatgggtttgaa

SEQ ID NO: 249095 - DNA, 20 bp, Artificial
  CRISPR gRNA sequence
gaactgggctctggaggacg

SEQ ID NO: 249096 - DNA, 20 bp, Artificial
  CRISPR gRNA sequence
aactgggctctggaggacgg

SEQ ID NO: 249097 - DNA, 20 bp, Artificial
  CRISPR gRNA sequence
ggctctggaggacgggcgga

SEQ ID NO: 249098 - DNA, 20 bp, Artificial
  CRISPR gRNA sequence
tggaggacgggcggatttgg

SEQ ID NO: 249099 - DNA, 20 bp, Artificial
  CRISPR gRNA sequence
gaggacgggcggatttgggg

SEQ ID NO: 249100 - DNA, 20 bp, Artificial
  CRISPR gRNA sequence
ggggtaggtaaagggacaag

SEQ ID NO: 249101 - DNA, 20 bp, Artificial
  CRISPR gRNA sequence
gggtaggtaaagggacaagg

SEQ ID NO: 249102 - DNA, 20 bp, Artificial
  CRISPR gRNA sequence
ccatttactcagcgtgtcag

SEQ ID NO: 249103 - DNA, 20 bp, Artificial
  CRISPR gRNA sequence
actcagcgtgtcagatgtgc

SEQ ID NO: 249104 - DNA, 20 bp, Artificial
  CRISPR gRNA sequence
ctcagcgtgtcagatgtgca

SEQ ID NO: 249105 - DNA, 20 bp, Artificial
  CRISPR gRNA sequence
agcgtgtcagatgtgcaaga

SEQ ID NO: 249106 - DNA, 20 bp, Artificial
  CRISPR gRNA sequence
actctcactcgtttgttctt

SEQ ID NO: 249107 - DNA, 20 bp, Artificial
  CRISPR gRNA sequence
tcactcgtttgttctttgaa

SEQ ID NO: 249108 - DNA, 20 bp, Artificial
  CRISPR gRNA sequence
actcgtttgttctttgaaac

SEQ ID NO: 249109 - DNA, 20 bp, Artificial
  CRISPR gRNA sequence
gtttgttctttgaaacagtt

SEQ ID NO: 249110 - DNA, 20 bp, Artificial
  CRISPR gRNA sequence
gttctttgaaacagttctgg

SEQ ID NO: 249111 - DNA, 20 bp, Artificial
  CRISPR gRNA sequence
ttctttgaaacagttctggc

SEQ ID NO: 249112 - DNA, 20 bp, Artificial
  CRISPR gRNA sequence
tttgaaacagttctggcagc

SEQ ID NO: 249113 - DNA, 20 bp, Artificial
  CRISPR gRNA sequence
tgaaacagttctggcagcac

SEQ ID NO: 249114 - DNA, 20 bp, Artificial
  CRISPR gRNA sequence
gaaacagttctggcagcaca

SEQ ID NO: 249115 - DNA, 20 bp, Artificial
  CRISPR gRNA sequence
aaacagttctggcagcacat

SEQ ID NO: 249116 - DNA, 20 bp, Artificial
  CRISPR gRNA sequence
tggcagcacatacaatccta

SEQ ID NO: 249117 - DNA, 20 bp, Artificial
  CRISPR gRNA sequence
gcagcacatacaatcctaat

SEQ ID NO: 249118 - DNA, 20 bp, Artificial
  CRISPR gRNA sequence
attttgcagatgagaaaact

SEQ ID NO: 249119 - DNA, 20 bp, Artificial
  CRISPR gRNA sequence
tgcagatgagaaaactgagg

SEQ ID NO: 249120 - DNA, 20 bp, Artificial
  CRISPR gRNA sequence
gcagatgagaaaactgaggc

SEQ ID NO: 249121 - DNA, 20 bp, Artificial
  CRISPR gRNA sequence
cagatgagaaaactgaggct

SEQ ID NO: 249122 - DNA, 20 bp, Artificial
  CRISPR gRNA sequence
aggcttagggaggtttcttt

SEQ ID NO: 249123 - DNA, 20 bp, Artificial
  CRISPR gRNA sequence
agggaggtttcttttttctt

SEQ ID NO: 249124 - DNA, 20 bp, Artificial
  CRISPR gRNA sequence
gggaggtttcttttttcttt

SEQ ID NO: 249125 - DNA, 20 bp, Artificial
  CRISPR gRNA sequence
cttttttcttttctttctga

SEQ ID NO: 249126 - DNA, 20 bp, Artificial
  CRISPR gRNA sequence
ttttttcttttctttctgag

SEQ ID NO: 249127 - DNA, 20 bp, Artificial
  CRISPR gRNA sequence
ttttcttttctttctgagac

SEQ ID NO: 249128 - DNA, 20 bp, Artificial
  CRISPR gRNA sequence
tttcttttctttctgagaca

SEQ ID NO: 249129 - DNA, 20 bp, Artificial
  CRISPR gRNA sequence
ttcttttctttctgagacag

SEQ ID NO: 249130 - DNA, 20 bp, Artificial
  CRISPR gRNA sequence
tcttttctttctgagacagc

SEQ ID NO: 249131 - DNA, 20 bp, Artificial
  CRISPR gRNA sequence
cttttctttctgagacagcg

SEQ ID NO: 249132 - DNA, 20 bp, Artificial
  CRISPR gRNA sequence
ttttctttctgagacagcgt

SEQ ID NO: 249133 - DNA, 20 bp, Artificial
  CRISPR gRNA sequence
ttctttctgagacagcgtca

SEQ ID NO: 249134 - DNA, 20 bp, Artificial
  CRISPR gRNA sequence
tctttctgagacagcgtcaa

SEQ ID NO: 249135 - DNA, 20 bp, Artificial
  CRISPR gRNA sequence
ctttctgagacagcgtcaaa

SEQ ID NO: 249136 - DNA, 20 bp, Artificial
  CRISPR gRNA sequence
tttctgagacagcgtcaaac

SEQ ID NO: 249137 - DNA, 20 bp, Artificial
  CRISPR gRNA sequence
tctgagacagcgtcaaactc

SEQ ID NO: 249138 - DNA, 20 bp, Artificial
  CRISPR gRNA sequence
ctgagacagcgtcaaactcc

SEQ ID NO: 249139 - DNA, 20 bp, Artificial
  CRISPR gRNA sequence
tgagacagcgtcaaactcct

SEQ ID NO: 249140 - DNA, 20 bp, Artificial
  CRISPR gRNA sequence
agacagcgtcaaactcctgg

SEQ ID NO: 249141 - DNA, 20 bp, Artificial
  CRISPR gRNA sequence
ctgggttcaagtgatcagcc

SEQ ID NO: 249142 - DNA, 20 bp, Artificial
  CRISPR gRNA sequence
ggttcaagtgatcagcctca

SEQ ID NO: 249143 - DNA, 20 bp, Artificial
  CRISPR gRNA sequence
aagtgatcagcctcaaactc

SEQ ID NO: 249144 - DNA, 20 bp, Artificial
  CRISPR gRNA sequence
aaactcctgggttcaagtga

SEQ ID NO: 249145 - DNA, 20 bp, Artificial
  CRISPR gRNA sequence
ctgggttcaagtgatcctcc

SEQ ID NO: 249146 - DNA, 20 bp, Artificial
  CRISPR gRNA sequence
ggttcaagtgatcctcccac

SEQ ID NO: 249147 - DNA, 20 bp, Artificial
  CRISPR gRNA sequence
aagtgatcctcccacctcag

SEQ ID NO: 249148 - DNA, 20 bp, Artificial
  CRISPR gRNA sequence
ccacctcagtctcccgagta

SEQ ID NO: 249149 - DNA, 20 bp, Artificial
  CRISPR gRNA sequence
agtctcccgagtagctgggg

SEQ ID NO: 249150 - DNA, 20 bp, Artificial
  CRISPR gRNA sequence
ccgagtagctggggccacag

SEQ ID NO: 249151 - DNA, 20 bp, Artificial
  CRISPR gRNA sequence
gggccacaggcatgcaccat

SEQ ID NO: 249152 - DNA, 20 bp, Artificial
  CRISPR gRNA sequence
atttttgtttgtcttttaat

SEQ ID NO: 249153 - DNA, 20 bp, Artificial
  CRISPR gRNA sequence
ttgtttgtcttttaattttt

SEQ ID NO: 249154 - DNA, 20 bp, Artificial
  CRISPR gRNA sequence
tgtttgtcttttaatttttg

SEQ ID NO: 249155 - DNA, 20 bp, Artificial
  CRISPR gRNA sequence
gtttgtcttttaatttttgt

SEQ ID NO: 249156 - DNA, 20 bp, Artificial
  CRISPR gRNA sequence
tttgtcttttaatttttgta

SEQ ID NO: 249157 - DNA, 20 bp, Artificial
  CRISPR gRNA sequence
gtcttttaatttttgtagag

SEQ ID NO: 249158 - DNA, 20 bp, Artificial
  CRISPR gRNA sequence
tcttttaatttttgtagaga

SEQ ID NO: 249159 - DNA, 20 bp, Artificial
  CRISPR gRNA sequence
ttaatttttgtagagatggg

SEQ ID NO: 249160 - DNA, 20 bp, Artificial
  CRISPR gRNA sequence
taatttttgtagagatgggg

SEQ ID NO: 249161 - DNA, 20 bp, Artificial
  CRISPR gRNA sequence
aatttttgtagagatggggt

SEQ ID NO: 249162 - DNA, 20 bp, Artificial
  CRISPR gRNA sequence
atttttgtagagatggggtc

SEQ ID NO: 249163 - DNA, 20 bp, Artificial
  CRISPR gRNA sequence
ttgtagagatggggtcttgc

SEQ ID NO: 249164 - DNA, 20 bp, Artificial
  CRISPR gRNA sequence
tgtagagatggggtcttgct

SEQ ID NO: 249165 - DNA, 20 bp, Artificial
  CRISPR gRNA sequence
gtagagatggggtcttgcta

SEQ ID NO: 249166 - DNA, 20 bp, Artificial
  CRISPR gRNA sequence
tagagatggggtcttgctat

SEQ ID NO: 249167 - DNA, 20 bp, Artificial
  CRISPR gRNA sequence
gctatgttgctcaggctggt

SEQ ID NO: 249168 - DNA, 20 bp, Artificial
  CRISPR gRNA sequence
ctatgttgctcaggctggtc

SEQ ID NO: 249169 - DNA, 20 bp, Artificial
  CRISPR gRNA sequence
tgttgctcaggctggtctcc

SEQ ID NO: 249170 - DNA, 20 bp, Artificial
  CRISPR gRNA sequence
ctcaggctggtctccaacgc

SEQ ID NO: 249171 - DNA, 20 bp, Artificial
  CRISPR gRNA sequence
aggctggtctccaacgcctg

SEQ ID NO: 249172 - DNA, 20 bp, Artificial
  CRISPR gRNA sequence
gtctccaacgcctggtctca

SEQ ID NO: 249173 - DNA, 20 bp, Artificial
  CRISPR gRNA sequence
caacgcctggtctcaagtga

SEQ ID NO: 249174 - DNA, 20 bp, Artificial
  CRISPR gRNA sequence
gtctcaagtgatcctctggc

SEQ ID NO: 249175 - DNA, 20 bp, Artificial
  CRISPR gRNA sequence
aagtgatcctctggcctcag

SEQ ID NO: 249176 - DNA, 20 bp, Artificial
  CRISPR gRNA sequence
tggcctcagcctaccaaagt

SEQ ID NO: 249177 - DNA, 20 bp, Artificial
  CRISPR gRNA sequence
gcctcagcctaccaaagtgt

SEQ ID NO: 249178 - DNA, 20 bp, Artificial
  CRISPR gRNA sequence
agcctaccaaagtgttgaga

SEQ ID NO: 249179 - DNA, 20 bp, Artificial
  CRISPR gRNA sequence
ccaaagtgttgagattatag

SEQ ID NO: 249180 - DNA, 20 bp, Artificial
  CRISPR gRNA sequence
agattataggcgtgagccac

SEQ ID NO: 249181 - DNA, 20 bp, Artificial
  CRISPR gRNA sequence
taggcgtgagccaccatgct

SEQ ID NO: 249182 - DNA, 20 bp, Artificial
  CRISPR gRNA sequence
gggttacagagatttcttga

SEQ ID NO: 249183 - DNA, 20 bp, Artificial
  CRISPR gRNA sequence
cagagatttcttgacttgcc

SEQ ID NO: 249184 - DNA, 20 bp, Artificial
  CRISPR gRNA sequence
cttgacttgcccaaagtcat

SEQ ID NO: 249185 - DNA, 20 bp, Artificial
  CRISPR gRNA sequence
ttgacttgcccaaagtcatt

SEQ ID NO: 249186 - DNA, 20 bp, Artificial
  CRISPR gRNA sequence
gacttgcccaaagtcattct

SEQ ID NO: 249187 - DNA, 20 bp, Artificial
  CRISPR gRNA sequence
acttgcccaaagtcattctg

SEQ ID NO: 249188 - DNA, 20 bp, Artificial
  CRISPR gRNA sequence
gcccaaagtcattctggaaa

SEQ ID NO: 249189 - DNA, 20 bp, Artificial
  CRISPR gRNA sequence
cccaaagtcattctggaaag

SEQ ID NO: 249190 - DNA, 20 bp, Artificial
  CRISPR gRNA sequence
tggaaagcagcagacccagg

SEQ ID NO: 249191 - DNA, 20 bp, Artificial
  CRISPR gRNA sequence
gaaagcagcagacccagggc

SEQ ID NO: 249192 - DNA, 20 bp, Artificial
  CRISPR gRNA sequence
aaaccctggtttgcctgatg

SEQ ID NO: 249193 - DNA, 20 bp, Artificial
  CRISPR gRNA sequence
gtttgcctgatgctagtgct

SEQ ID NO: 249194 - DNA, 20 bp, Artificial
  CRISPR gRNA sequence
gcctgatgctagtgctggac

SEQ ID NO: 249195 - DNA, 20 bp, Artificial
  CRISPR gRNA sequence
cctgatgctagtgctggacc

SEQ ID NO: 249196 - DNA, 20 bp, Artificial
  CRISPR gRNA sequence
atgctagtgctggacctcct

SEQ ID NO: 249197 - DNA, 20 bp, Artificial
  CRISPR gRNA sequence
gtgctggacctcctaaccct

SEQ ID NO: 249198 - DNA, 20 bp, Artificial
  CRISPR gRNA sequence
gacctcctaaccctatgcta

SEQ ID NO: 249199 - DNA, 20 bp, Artificial
  CRISPR gRNA sequence
ctaaccctatgctagccttc

SEQ ID NO: 249200 - DNA, 20 bp, Artificial
  CRISPR gRNA sequence
accctatgctagccttcatc

SEQ ID NO: 249201 - DNA, 20 bp, Artificial
  CRISPR gRNA sequence
tgctagccttcatctgtgcc

SEQ ID NO: 249202 - DNA, 20 bp, Artificial
  CRISPR gRNA sequence
gccttcatctgtgccggaga

SEQ ID NO: 249203 - DNA, 20 bp, Artificial
  CRISPR gRNA sequence
catctgtgccggagatggtc

SEQ ID NO: 249204 - DNA, 20 bp, Artificial
  CRISPR gRNA sequence
atctgtgccggagatggtca

SEQ ID NO: 249205 - DNA, 20 bp, Artificial
  CRISPR gRNA sequence
tgccggagatggtcaagtcc

SEQ ID NO: 249206 - DNA, 20 bp, Artificial
  CRISPR gRNA sequence
agaaactgggggtgagagac

SEQ ID NO: 249207 - DNA, 20 bp, Artificial
  CRISPR gRNA sequence
ggggtgagagactaagcagg

SEQ ID NO: 249208 - DNA, 20 bp, Artificial
  CRISPR gRNA sequence
agcaggcaagacagactgaa

SEQ ID NO: 249209 - DNA, 20 bp, Artificial
  CRISPR gRNA sequence
aactaagctgtcactgaaca

SEQ ID NO: 249210 - DNA, 20 bp, Artificial
  CRISPR gRNA sequence
agctgtcactgaacagaagg

SEQ ID NO: 249211 - DNA, 20 bp, Artificial
  CRISPR gRNA sequence
tcactgaacagaaggaagcc

SEQ ID NO: 249212 - DNA, 20 bp, Artificial
  CRISPR gRNA sequence
aacagaaggaagccatggaa

SEQ ID NO: 249213 - DNA, 20 bp, Artificial
  CRISPR gRNA sequence
cagggagccagatggtcaag

SEQ ID NO: 249214 - DNA, 20 bp, Artificial
  CRISPR gRNA sequence
ttcaaaatatctttgcatcg

SEQ ID NO: 249215 - DNA, 20 bp, Artificial
  CRISPR gRNA sequence
tcaaaatatctttgcatcgc

SEQ ID NO: 249216 - DNA, 20 bp, Artificial
  CRISPR gRNA sequence
caaaatatctttgcatcgct

SEQ ID NO: 249217 - DNA, 20 bp, Artificial
  CRISPR gRNA sequence
aaaatatctttgcatcgctt

SEQ ID NO: 249218 - DNA, 20 bp, Artificial
  CRISPR gRNA sequence
tgcatcgctttcgaacccag

SEQ ID NO: 249219 - DNA, 20 bp, Artificial
  CRISPR gRNA sequence
gcatcgctttcgaacccaga

SEQ ID NO: 249220 - DNA, 20 bp, Artificial
  CRISPR gRNA sequence
catcgctttcgaacccagac

SEQ ID NO: 249221 - DNA, 20 bp, Artificial
  CRISPR gRNA sequence
tcgaacccagacccatatat

SEQ ID NO: 249222 - DNA, 20 bp, Artificial
  CRISPR gRNA sequence
cgaacccagacccatatatc

SEQ ID NO: 249223 - DNA, 20 bp, Artificial
  CRISPR gRNA sequence
gaacccagacccatatatct

SEQ ID NO: 249224 - DNA, 20 bp, Artificial
  CRISPR gRNA sequence
tttcactaggctacttcatt

SEQ ID NO: 249225 - DNA, 20 bp, Artificial
  CRISPR gRNA sequence
ttcactaggctacttcattg

SEQ ID NO: 249226 - DNA, 20 bp, Artificial
  CRISPR gRNA sequence
tcactaggctacttcattgg

SEQ ID NO: 249227 - DNA, 20 bp, Artificial
  CRISPR gRNA sequence
cactaggctacttcattggg

SEQ ID NO: 249228 - DNA, 20 bp, Artificial
  CRISPR gRNA sequence
actaggctacttcattgggt

SEQ ID NO: 249229 - DNA, 20 bp, Artificial
  CRISPR gRNA sequence
ggctacttcattgggtgaaa

SEQ ID NO: 249230 - DNA, 20 bp, Artificial
  CRISPR gRNA sequence
cttcattgggtgaaaaatga

SEQ ID NO: 249231 - DNA, 20 bp, Artificial
  CRISPR gRNA sequence
cattgggtgaaaaatgacaa

SEQ ID NO: 249232 - DNA, 20 bp, Artificial
  CRISPR gRNA sequence
attgggtgaaaaatgacaaa

SEQ ID NO: 249233 - DNA, 20 bp, Artificial
  CRISPR gRNA sequence
ggtgaaaaatgacaaagttt

SEQ ID NO: 249234 - DNA, 20 bp, Artificial
  CRISPR gRNA sequence
taaaccagaatcttctggac

SEQ ID NO: 249235 - DNA, 20 bp, Artificial
  CRISPR gRNA sequence
aaaccagaatcttctggacc

SEQ ID NO: 249236 - DNA, 20 bp, Artificial
  CRISPR gRNA sequence
aaccagaatcttctggacct

SEQ ID NO: 249237 - DNA, 20 bp, Artificial
  CRISPR gRNA sequence
ctggacctaagttaattatt

SEQ ID NO: 249238 - DNA, 20 bp, Artificial
  CRISPR gRNA sequence
tggacctaagttaattattt

SEQ ID NO: 249239 - DNA, 20 bp, Artificial
  CRISPR gRNA sequence
gacctaagttaattatttaa

SEQ ID NO: 249240 - DNA, 20 bp, Artificial
  CRISPR gRNA sequence
agttaattatttaaattatt

SEQ ID NO: 249241 - DNA, 20 bp, Artificial
  CRISPR gRNA sequence
attatttaaattattttcat

SEQ ID NO: 249242 - DNA, 20 bp, Artificial
  CRISPR gRNA sequence
tttaaattattttcattgaa

SEQ ID NO: 249243 - DNA, 20 bp, Artificial
  CRISPR gRNA sequence
aaattattttcattgaactg

SEQ ID NO: 249244 - DNA, 20 bp, Artificial
  CRISPR gRNA sequence
aattattttcattgaactgt

SEQ ID NO: 249245 - DNA, 20 bp, Artificial
  CRISPR gRNA sequence
ttttcattgaactgtctaag

SEQ ID NO: 249246 - DNA, 20 bp, Artificial
  CRISPR gRNA sequence
tcattgaactgtctaagctg

SEQ ID NO: 249247 - DNA, 20 bp, Artificial
  CRISPR gRNA sequence
cattgaactgtctaagctgt

SEQ ID NO: 249248 - DNA, 20 bp, Artificial
  CRISPR gRNA sequence
attgaactgtctaagctgtt

SEQ ID NO: 249249 - DNA, 20 bp, Artificial
  CRISPR gRNA sequence
aactgtctaagctgttcttt

SEQ ID NO: 249250 - DNA, 20 bp, Artificial
  CRISPR gRNA sequence
tctaagctgttctttggatg

SEQ ID NO: 249251 - DNA, 20 bp, Artificial
  CRISPR gRNA sequence
agctgttctttggatggaaa

SEQ ID NO: 249252 - DNA, 20 bp, Artificial
  CRISPR gRNA sequence
ttctttggatggaaagtctg

SEQ ID NO: 249253 - DNA, 20 bp, Artificial
  CRISPR gRNA sequence
tttggatggaaagtctgtgc

SEQ ID NO: 249254 - DNA, 20 bp, Artificial
  CRISPR gRNA sequence
tggatggaaagtctgtgctt

SEQ ID NO: 249255 - DNA, 20 bp, Artificial
  CRISPR gRNA sequence
ggatggaaagtctgtgcttg

SEQ ID NO: 249256 - DNA, 20 bp, Artificial
  CRISPR gRNA sequence
gatggaaagtctgtgcttgt

SEQ ID NO: 249257 - DNA, 20 bp, Artificial
  CRISPR gRNA sequence
tgcttgtgaatgggacgaag

SEQ ID NO: 249258 - DNA, 20 bp, Artificial
  CRISPR gRNA sequence
gtgaatgggacgaaggagag

SEQ ID NO: 249259 - DNA, 20 bp, Artificial
  CRISPR gRNA sequence
tgaatgggacgaaggagagg

SEQ ID NO: 249260 - DNA, 20 bp, Artificial
  CRISPR gRNA sequence
tggaccatctccagccgacc

SEQ ID NO: 249261 - DNA, 20 bp, Artificial
  CRISPR gRNA sequence
cagccgacctctctccggga

SEQ ID NO: 249262 - DNA, 20 bp, Artificial
  CRISPR gRNA sequence
tctccgggagcatcctctgt

SEQ ID NO: 249263 - DNA, 20 bp, Artificial
  CRISPR gRNA sequence
tccgggagcatcctctgtga

SEQ ID NO: 249264 - DNA, 20 bp, Artificial
  CRISPR gRNA sequence
cgggagcatcctctgtgacc

SEQ ID NO: 249265 - DNA, 20 bp, Artificial
  CRISPR gRNA sequence
tgtgaccccgcctgcccctg

SEQ ID NO: 249266 - DNA, 20 bp, Artificial
  CRISPR gRNA sequence
tgaccccgcctgcccctgcg

SEQ ID NO: 249267 - DNA, 20 bp, Artificial
  CRISPR gRNA sequence
cccctgcgagagagccaggt

SEQ ID NO: 249268 - DNA, 20 bp, Artificial
  CRISPR gRNA sequence
cgagagagccaggtaactgg

SEQ ID NO: 249269 - DNA, 20 bp, Artificial
  CRISPR gRNA sequence
ggctatgcctttacgccaaa

SEQ ID NO: 249270 - DNA, 20 bp, Artificial
  CRISPR gRNA sequence
tgcctttacgccaaagtgcg

SEQ ID NO: 249271 - DNA, 20 bp, Artificial
  CRISPR gRNA sequence
tacgccaaagtgcgtatctt

SEQ ID NO: 249272 - DNA, 20 bp, Artificial
  CRISPR gRNA sequence
acgccaaagtgcgtatctta

SEQ ID NO: 249273 - DNA, 20 bp, Artificial
  CRISPR gRNA sequence
cgccaaagtgcgtatcttat

SEQ ID NO: 249274 - DNA, 20 bp, Artificial
  CRISPR gRNA sequence
atggtgattccagattgtat

SEQ ID NO: 249275 - DNA, 20 bp, Artificial
  CRISPR gRNA sequence
tggtgattccagattgtatc

SEQ ID NO: 249276 - DNA, 20 bp, Artificial
  CRISPR gRNA sequence
cagattgtatctaaattgcc

SEQ ID NO: 249277 - DNA, 20 bp, Artificial
  CRISPR gRNA sequence
tatctaaattgccccaatat

SEQ ID NO: 249278 - DNA, 20 bp, Artificial
  CRISPR gRNA sequence
aattgccccaatatcatgat

SEQ ID NO: 249279 - DNA, 20 bp, Artificial
  CRISPR gRNA sequence
ccccaatatcatgatatctc

SEQ ID NO: 249280 - DNA, 20 bp, Artificial
  CRISPR gRNA sequence
atatcaggcacctcccacgt

SEQ ID NO: 249281 - DNA, 20 bp, Artificial
  CRISPR gRNA sequence
ccacgtgcattcttcctgaa

SEQ ID NO: 249282 - DNA, 20 bp, Artificial
  CRISPR gRNA sequence
ttcctgaatcctgccctcag

SEQ ID NO: 249283 - DNA, 20 bp, Artificial
  CRISPR gRNA sequence
cctgaatcctgccctcaggg

SEQ ID NO: 249284 - DNA, 20 bp, Artificial
  CRISPR gRNA sequence
ctgaatcctgccctcaggga

SEQ ID NO: 249285 - DNA, 20 bp, Artificial
  CRISPR gRNA sequence
aatcctgccctcagggaccc

SEQ ID NO: 249286 - DNA, 20 bp, Artificial
  CRISPR gRNA sequence
ccctcagggacccagcagtt

SEQ ID NO: 249287 - DNA, 20 bp, Artificial
  CRISPR gRNA sequence
agggacccagcagttttctt

SEQ ID NO: 249288 - DNA, 20 bp, Artificial
  CRISPR gRNA sequence
tcttcccaggcatttgttat

SEQ ID NO: 249289 - DNA, 20 bp, Artificial
  CRISPR gRNA sequence
cttcccaggcatttgttatt

SEQ ID NO: 249290 - DNA, 20 bp, Artificial
  CRISPR gRNA sequence
ttcccaggcatttgttattc

SEQ ID NO: 249291 - DNA, 20 bp, Artificial
  CRISPR gRNA sequence
cccaggcatttgttattcag

SEQ ID NO: 249292 - DNA, 20 bp, Artificial
  CRISPR gRNA sequence
ccaggcatttgttattcagt

SEQ ID NO: 249293 - DNA, 20 bp, Artificial
  CRISPR gRNA sequence
gttattcagtctgagataca

SEQ ID NO: 249294 - DNA, 20 bp, Artificial
  CRISPR gRNA sequence
ttattcagtctgagatacac

SEQ ID NO: 249295 - DNA, 20 bp, Artificial
  CRISPR gRNA sequence
ttcagtctgagatacacatt

SEQ ID NO: 249296 - DNA, 20 bp, Artificial
  CRISPR gRNA sequence
agtctgagatacacatttgt

SEQ ID NO: 249297 - DNA, 20 bp, Artificial
  CRISPR gRNA sequence
agatacacatttgtaagcgg

SEQ ID NO: 249298 - DNA, 20 bp, Artificial
  CRISPR gRNA sequence
gtaagcggtgccagaggaca

SEQ ID NO: 249299 - DNA, 20 bp, Artificial
  CRISPR gRNA sequence
taagcggtgccagaggacac

SEQ ID NO: 249300 - DNA, 20 bp, Artificial
  CRISPR gRNA sequence
cacccaaacagagtctatat

SEQ ID NO: 249301 - DNA, 20 bp, Artificial
  CRISPR gRNA sequence
acccaaacagagtctatatc

SEQ ID NO: 249302 - DNA, 20 bp, Artificial
  CRISPR gRNA sequence
tatctttatcaatgccaagg

SEQ ID NO: 249303 - DNA, 20 bp, Artificial
  CRISPR gRNA sequence
tatcaatgccaaggaaaggg

SEQ ID NO: 249304 - DNA, 20 bp, Artificial
  CRISPR gRNA sequence
atcaatgccaaggaaagggg

SEQ ID NO: 249305 - DNA, 20 bp, Artificial
  CRISPR gRNA sequence
tcaatgccaaggaaagggga

SEQ ID NO: 249306 - DNA, 20 bp, Artificial
  CRISPR gRNA sequence
tagggtcccatattttttct

SEQ ID NO: 249307 - DNA, 20 bp, Artificial
  CRISPR gRNA sequence
tttcttttcttttcttttct

SEQ ID NO: 249308 - DNA, 20 bp, Artificial
  CRISPR gRNA sequence
ttcttttcttttcttttctt

SEQ ID NO: 249309 - DNA, 20 bp, Artificial
  CRISPR gRNA sequence
tcttttcttttcttttcttt

SEQ ID NO: 249310 - DNA, 20 bp, Artificial
  CRISPR gRNA sequence
cttttcttttcttttctttt

SEQ ID NO: 249311 - DNA, 20 bp, Artificial
  CRISPR gRNA sequence
ttttcttttcttttcttttt

SEQ ID NO: 249312 - DNA, 20 bp, Artificial
  CRISPR gRNA sequence
ttcttttcttttcttttttt

SEQ ID NO: 249313 - DNA, 20 bp, Artificial
  CRISPR gRNA sequence
tcttttcttttctttttttt

SEQ ID NO: 249314 - DNA, 20 bp, Artificial
  CRISPR gRNA sequence
cttttcttttcttttttttt

SEQ ID NO: 249315 - DNA, 20 bp, Artificial
  CRISPR gRNA sequence
ttttcttttctttttttttg

SEQ ID NO: 249316 - DNA, 20 bp, Artificial
  CRISPR gRNA sequence
ttcttttctttttttttgtt

SEQ ID NO: 249317 - DNA, 20 bp, Artificial
  CRISPR gRNA sequence
tcttttctttttttttgttt

SEQ ID NO: 249318 - DNA, 20 bp, Artificial
  CRISPR gRNA sequence
cttttctttttttttgtttt

SEQ ID NO: 249319 - DNA, 20 bp, Artificial
  CRISPR gRNA sequence
ttttctttttttttgttttt

SEQ ID NO: 249320 - DNA, 20 bp, Artificial
  CRISPR gRNA sequence
ttctttttttttgtttttaa

SEQ ID NO: 249321 - DNA, 20 bp, Artificial
  CRISPR gRNA sequence
tctttttttttgtttttaag

SEQ ID NO: 249322 - DNA, 20 bp, Artificial
  CRISPR gRNA sequence
ctttttttttgtttttaaga

SEQ ID NO: 249323 - DNA, 20 bp, Artificial
  CRISPR gRNA sequence
tttttttttgtttttaagag

SEQ ID NO: 249324 - DNA, 20 bp, Artificial
  CRISPR gRNA sequence
tttttttgtttttaagagag

SEQ ID NO: 249325 - DNA, 20 bp, Artificial
  CRISPR gRNA sequence
ttttttgtttttaagagagt

SEQ ID NO: 249326 - DNA, 20 bp, Artificial
  CRISPR gRNA sequence
tttttgtttttaagagagtg

SEQ ID NO: 249327 - DNA, 20 bp, Artificial
  CRISPR gRNA sequence
ttttgtttttaagagagtgt

SEQ ID NO: 249328 - DNA, 20 bp, Artificial
  CRISPR gRNA sequence
tttgtttttaagagagtgtc

SEQ ID NO: 249329 - DNA, 20 bp, Artificial
  CRISPR gRNA sequence
ttgtttttaagagagtgtct

SEQ ID NO: 249330 - DNA, 20 bp, Artificial
  CRISPR gRNA sequence
tgtttttaagagagtgtctt

SEQ ID NO: 249331 - DNA, 20 bp, Artificial
  CRISPR gRNA sequence
gtttttaagagagtgtcttg

SEQ ID NO: 249332 - DNA, 20 bp, Artificial
  CRISPR gRNA sequence
tttttaagagagtgtcttgc

SEQ ID NO: 249333 - DNA, 20 bp, Artificial
  CRISPR gRNA sequence
ttaagagagtgtcttgctct

SEQ ID NO: 249334 - DNA, 20 bp, Artificial
  CRISPR gRNA sequence
taagagagtgtcttgctctg

SEQ ID NO: 249335 - DNA, 20 bp, Artificial
  CRISPR gRNA sequence
aagagagtgtcttgctctgt

SEQ ID NO: 249336 - DNA, 20 bp, Artificial
  CRISPR gRNA sequence
agagagtgtcttgctctgtg

SEQ ID NO: 249337 - DNA, 20 bp, Artificial
  CRISPR gRNA sequence
gctctgtgccaggctggagt

SEQ ID NO: 249338 - DNA, 20 bp, Artificial
  CRISPR gRNA sequence
ctctgtgccaggctggagtg

SEQ ID NO: 249339 - DNA, 20 bp, Artificial
  CRISPR gRNA sequence
tgtgccaggctggagtgcag

SEQ ID NO: 249340 - DNA, 20 bp, Artificial
  CRISPR gRNA sequence
tgccaggctggagtgcagtg

SEQ ID NO: 249341 - DNA, 20 bp, Artificial
  CRISPR gRNA sequence
gagtgcagtggtgcagtctc

SEQ ID NO: 249342 - DNA, 20 bp, Artificial
  CRISPR gRNA sequence
agctcactgcaatctccacc

SEQ ID NO: 249343 - DNA, 20 bp, Artificial
  CRISPR gRNA sequence
actgcaatctccacctcctg

SEQ ID NO: 249344 - DNA, 20 bp, Artificial
  CRISPR gRNA sequence
caatctccacctcctgggtt

SEQ ID NO: 249345 - DNA, 20 bp, Artificial
  CRISPR gRNA sequence
cacctcctgggttcaagtga

SEQ ID NO: 249346 - DNA, 20 bp, Artificial
  CRISPR gRNA sequence
ctgggttcaagtgattctcc

SEQ ID NO: 249347 - DNA, 20 bp, Artificial
  CRISPR gRNA sequence
ggttcaagtgattctcctgc

SEQ ID NO: 249348 - DNA, 20 bp, Artificial
  CRISPR gRNA sequence
aagtgattctcctgcctcag

SEQ ID NO: 249349 - DNA, 20 bp, Artificial
  CRISPR gRNA sequence
tcctgcctcagcctcccaag

SEQ ID NO: 249350 - DNA, 20 bp, Artificial
  CRISPR gRNA sequence
ctgcctcagcctcccaagta

SEQ ID NO: 249351 - DNA, 20 bp, Artificial
  CRISPR gRNA sequence
cctcagcctcccaagtagct

SEQ ID NO: 249352 - DNA, 20 bp, Artificial
  CRISPR gRNA sequence
agcctcccaagtagctggga

SEQ ID NO: 249353 - DNA, 20 bp, Artificial
  CRISPR gRNA sequence
ccaagtagctgggattatag

SEQ ID NO: 249354 - DNA, 20 bp, Artificial
  CRISPR gRNA sequence
ggattataggcatgcaccac

SEQ ID NO: 249355 - DNA, 20 bp, Artificial
  CRISPR gRNA sequence
taggcatgcaccaccacgcc

SEQ ID NO: 249356 - DNA, 20 bp, Artificial
  CRISPR gRNA sequence
atttttgtatttttagtaga

SEQ ID NO: 249357 - DNA, 20 bp, Artificial
  CRISPR gRNA sequence
ttgtatttttagtagagatg

SEQ ID NO: 249358 - DNA, 20 bp, Artificial
  CRISPR gRNA sequence
tgtatttttagtagagatga

SEQ ID NO: 249359 - DNA, 20 bp, Artificial
  CRISPR gRNA sequence
gtatttttagtagagatgag

SEQ ID NO: 249360 - DNA, 20 bp, Artificial
  CRISPR gRNA sequence
tatttttagtagagatgagg

SEQ ID NO: 249361 - DNA, 20 bp, Artificial
  CRISPR gRNA sequence
ttagtagagatgaggtttca

SEQ ID NO: 249362 - DNA, 20 bp, Artificial
  CRISPR gRNA sequence
tagtagagatgaggtttcac

SEQ ID NO: 249363 - DNA, 20 bp, Artificial
  CRISPR gRNA sequence
agtagagatgaggtttcacc

SEQ ID NO: 249364 - DNA, 20 bp, Artificial
  CRISPR gRNA sequence
gtagagatgaggtttcacca

SEQ ID NO: 249365 - DNA, 20 bp, Artificial
  CRISPR gRNA sequence
caccatgctggccagtctgg

SEQ ID NO: 249366 - DNA, 20 bp, Artificial
  CRISPR gRNA sequence
accatgctggccagtctggt

SEQ ID NO: 249367 - DNA, 20 bp, Artificial
  CRISPR gRNA sequence
gccagtctggtcttgaactc

SEQ ID NO: 249368 - DNA, 20 bp, Artificial
  CRISPR gRNA sequence
gtcttgaactcctgaccgca

SEQ ID NO: 249369 - DNA, 20 bp, Artificial
  CRISPR gRNA sequence
gaactcctgaccgcatgatc

SEQ ID NO: 249370 - DNA, 20 bp, Artificial
  CRISPR gRNA sequence
aactcctgaccgcatgatcc

SEQ ID NO: 249371 - DNA, 20 bp, Artificial
  CRISPR gRNA sequence
ctgaccgcatgatccgccca

SEQ ID NO: 249372 - DNA, 20 bp, Artificial
  CRISPR gRNA sequence
accgcatgatccgcccacct

SEQ ID NO: 249373 - DNA, 20 bp, Artificial
  CRISPR gRNA sequence
ggcctcccaaagtgctggga

SEQ ID NO: 249374 - DNA, 20 bp, Artificial
  CRISPR gRNA sequence
ccaaagtgctgggattacag

SEQ ID NO: 249375 - DNA, 20 bp, Artificial
  CRISPR gRNA sequence
ggattacaggtgtgagccac

SEQ ID NO: 249376 - DNA, 20 bp, Artificial
  CRISPR gRNA sequence
caggtgtgagccaccacgcc

SEQ ID NO: 249377 - DNA, 20 bp, Artificial
  CRISPR gRNA sequence
tcttttcttttttctttctc

SEQ ID NO: 249378 - DNA, 20 bp, Artificial
  CRISPR gRNA sequence
cttttcttttttctttctct

SEQ ID NO: 249379 - DNA, 20 bp, Artificial
  CRISPR gRNA sequence
ttttcttttttctttctctc

SEQ ID NO: 249380 - DNA, 20 bp, Artificial
  CRISPR gRNA sequence
ttcttttttctttctctctc

SEQ ID NO: 249381 - DNA, 20 bp, Artificial
  CRISPR gRNA sequence
tcttttttctttctctctct

SEQ ID NO: 249382 - DNA, 20 bp, Artificial
  CRISPR gRNA sequence
cttttttctttctctctctc

SEQ ID NO: 249383 - DNA, 20 bp, Artificial
  CRISPR gRNA sequence
ttttttctttctctctctcg

SEQ ID NO: 249384 - DNA, 20 bp, Artificial
  CRISPR gRNA sequence
ttttctttctctctctcgct

SEQ ID NO: 249385 - DNA, 20 bp, Artificial
  CRISPR gRNA sequence
tttctttctctctctcgctt

SEQ ID NO: 249386 - DNA, 20 bp, Artificial
  CRISPR gRNA sequence
ttctttctctctctcgcttt

SEQ ID NO: 249387 - DNA, 20 bp, Artificial
  CRISPR gRNA sequence
tctttctctctctcgctttt

SEQ ID NO: 249388 - DNA, 20 bp, Artificial
  CRISPR gRNA sequence
ctttctctctctcgcttttt

SEQ ID NO: 249389 - DNA, 20 bp, Artificial
  CRISPR gRNA sequence
tttctctctctcgctttttt

SEQ ID NO: 249390 - DNA, 20 bp, Artificial
  CRISPR gRNA sequence
tctctctctcgctttttttt

SEQ ID NO: 249391 - DNA, 20 bp, Artificial
  CRISPR gRNA sequence
ctctctctcgcttttttttt

SEQ ID NO: 249392 - DNA, 20 bp, Artificial
  CRISPR gRNA sequence
tctctctcgctttttttttc

SEQ ID NO: 249393 - DNA, 20 bp, Artificial
  CRISPR gRNA sequence
tctctcgctttttttttccc

SEQ ID NO: 249394 - DNA, 20 bp, Artificial
  CRISPR gRNA sequence
tctcgctttttttttccccc

SEQ ID NO: 249395 - DNA, 20 bp, Artificial
  CRISPR gRNA sequence
tcgctttttttttcccccga

SEQ ID NO: 249396 - DNA, 20 bp, Artificial
  CRISPR gRNA sequence
gctttttttttcccccgaga

SEQ ID NO: 249397 - DNA, 20 bp, Artificial
  CRISPR gRNA sequence
tttttttcccccgagagtgc

SEQ ID NO: 249398 - DNA, 20 bp, Artificial
  CRISPR gRNA sequence
ttttttcccccgagagtgcc

SEQ ID NO: 249399 - DNA, 20 bp, Artificial
  CRISPR gRNA sequence
tttttcccccgagagtgcct

SEQ ID NO: 249400 - DNA, 20 bp, Artificial
  CRISPR gRNA sequence
ttttcccccgagagtgcctt

SEQ ID NO: 249401 - DNA, 20 bp, Artificial
  CRISPR gRNA sequence
tttcccccgagagtgccttg

SEQ ID NO: 249402 - DNA, 20 bp, Artificial
  CRISPR gRNA sequence
ttcccccgagagtgccttgt

SEQ ID NO: 249403 - DNA, 20 bp, Artificial
  CRISPR gRNA sequence
tcccccgagagtgccttgtt

SEQ ID NO: 249404 - DNA, 20 bp, Artificial
  CRISPR gRNA sequence
cccccgagagtgccttgttc

SEQ ID NO: 249405 - DNA, 20 bp, Artificial
  CRISPR gRNA sequence
ccccgagagtgccttgttct

SEQ ID NO: 249406 - DNA, 20 bp, Artificial
  CRISPR gRNA sequence
gttctgtgccaggctggagt

SEQ ID NO: 249407 - DNA, 20 bp, Artificial
  CRISPR gRNA sequence
ttctgtgccaggctggagtg

SEQ ID NO: 249408 - DNA, 20 bp, Artificial
  CRISPR gRNA sequence
tgtgccaggctggagtgcag

SEQ ID NO: 249409 - DNA, 20 bp, Artificial
  CRISPR gRNA sequence
tgccaggctggagtgcagtg

SEQ ID NO: 249410 - DNA, 20 bp, Artificial
  CRISPR gRNA sequence
gagtgcagtggcttgatatt

SEQ ID NO: 249411 - DNA, 20 bp, Artificial
  CRISPR gRNA sequence
gatattggctcactgcaacc

SEQ ID NO: 249412 - DNA, 20 bp, Artificial
  CRISPR gRNA sequence
atattggctcactgcaacct

SEQ ID NO: 249413 - DNA, 20 bp, Artificial
  CRISPR gRNA sequence
gctcactgcaacctccacct

SEQ ID NO: 249414 - DNA, 20 bp, Artificial
  CRISPR gRNA sequence
actgcaacctccacctcctg

SEQ ID NO: 249415 - DNA, 20 bp, Artificial
  CRISPR gRNA sequence
caacctccacctcctgtgct

SEQ ID NO: 249416 - DNA, 20 bp, Artificial
  CRISPR gRNA sequence
cacctcctgtgctcaaccaa

SEQ ID NO: 249417 - DNA, 20 bp, Artificial
  CRISPR gRNA sequence
ctgtgctcaaccaatcctcc

SEQ ID NO: 249418 - DNA, 20 bp, Artificial
  CRISPR gRNA sequence
tgctcaaccaatcctcccac

SEQ ID NO: 249419 - DNA, 20 bp, Artificial
  CRISPR gRNA sequence
aaccaatcctcccacctcag

SEQ ID NO: 249420 - DNA, 20 bp, Artificial
  CRISPR gRNA sequence
ccacctcagcctccccagta

SEQ ID NO: 249421 - DNA, 20 bp, Artificial
  CRISPR gRNA sequence
agcctccccagtagctggga

SEQ ID NO: 249422 - DNA, 20 bp, Artificial
  CRISPR gRNA sequence
cccagtagctgggactatag

SEQ ID NO: 249423 - DNA, 20 bp, Artificial
  CRISPR gRNA sequence
ggactataggcactcaccac

SEQ ID NO: 249424 - DNA, 20 bp, Artificial
  CRISPR gRNA sequence
taggcactcaccactacacc

SEQ ID NO: 249425 - DNA, 20 bp, Artificial
  CRISPR gRNA sequence
accactacacctggctaatt

SEQ ID NO: 249426 - DNA, 20 bp, Artificial
  CRISPR gRNA sequence
cacctggctaattttttatt

SEQ ID NO: 249427 - DNA, 20 bp, Artificial
  CRISPR gRNA sequence
gctaattttttatttttttg

SEQ ID NO: 249428 - DNA, 20 bp, Artificial
  CRISPR gRNA sequence
attttttatttttttggcag

SEQ ID NO: 249429 - DNA, 20 bp, Artificial
  CRISPR gRNA sequence
tttatttttttggcagagtc

SEQ ID NO: 249430 - DNA, 20 bp, Artificial
  CRISPR gRNA sequence
ttatttttttggcagagtcg

SEQ ID NO: 249431 - DNA, 20 bp, Artificial
  CRISPR gRNA sequence
tatttttttggcagagtcgg

SEQ ID NO: 249432 - DNA, 20 bp, Artificial
  CRISPR gRNA sequence
atttttttggcagagtcggg

SEQ ID NO: 249433 - DNA, 20 bp, Artificial
  CRISPR gRNA sequence
tttttttggcagagtcgggg

SEQ ID NO: 249434 - DNA, 20 bp, Artificial
  CRISPR gRNA sequence
ttttggcagagtcggggtct

SEQ ID NO: 249435 - DNA, 20 bp, Artificial
  CRISPR gRNA sequence
tttggcagagtcggggtctt

SEQ ID NO: 249436 - DNA, 20 bp, Artificial
  CRISPR gRNA sequence
ttggcagagtcggggtcttg

SEQ ID NO: 249437 - DNA, 20 bp, Artificial
  CRISPR gRNA sequence
tggcagagtcggggtcttgc

SEQ ID NO: 249438 - DNA, 20 bp, Artificial
  CRISPR gRNA sequence
ggcagagtcggggtcttgct

SEQ ID NO: 249439 - DNA, 20 bp, Artificial
  CRISPR gRNA sequence
gcagagtcggggtcttgcta

SEQ ID NO: 249440 - DNA, 20 bp, Artificial
  CRISPR gRNA sequence
gctatgttgctcaggctgct

SEQ ID NO: 249441 - DNA, 20 bp, Artificial
  CRISPR gRNA sequence
ctatgttgctcaggctgctc

SEQ ID NO: 249442 - DNA, 20 bp, Artificial
  CRISPR gRNA sequence
tgttgctcaggctgctctca

SEQ ID NO: 249443 - DNA, 20 bp, Artificial
  CRISPR gRNA sequence
ctcaggctgctctcaaactc

SEQ ID NO: 249444 - DNA, 20 bp, Artificial
  CRISPR gRNA sequence
aggctgctctcaaactcttg

SEQ ID NO: 249445 - DNA, 20 bp, Artificial
  CRISPR gRNA sequence
ctctcaaactcttgggctca

SEQ ID NO: 249446 - DNA, 20 bp, Artificial
  CRISPR gRNA sequence
tcaaactcttgggctcaagc

SEQ ID NO: 249447 - DNA, 20 bp, Artificial
  CRISPR gRNA sequence
aaactcttgggctcaagcaa

SEQ ID NO: 249448 - DNA, 20 bp, Artificial
  CRISPR gRNA sequence
ttgggctcaagcaatcctcc

SEQ ID NO: 249449 - DNA, 20 bp, Artificial
  CRISPR gRNA sequence
gggctcaagcaatcctcctg

SEQ ID NO: 249450 - DNA, 20 bp, Artificial
  CRISPR gRNA sequence
ggctcaagcaatcctcctgc

SEQ ID NO: 249451 - DNA, 20 bp, Artificial
  CRISPR gRNA sequence
aagcaatcctcctgccttgg

SEQ ID NO: 249452 - DNA, 20 bp, Artificial
  CRISPR gRNA sequence
ctgccttgggctcccaaagt

SEQ ID NO: 249453 - DNA, 20 bp, Artificial
  CRISPR gRNA sequence
ccttgggctcccaaagtgtt

SEQ ID NO: 249454 - DNA, 20 bp, Artificial
  CRISPR gRNA sequence
gggctcccaaagtgttggga

SEQ ID NO: 249455 - DNA, 20 bp, Artificial
  CRISPR gRNA sequence
ggctcccaaagtgttgggat

SEQ ID NO: 249456 - DNA, 20 bp, Artificial
  CRISPR gRNA sequence
ccaaagtgttgggattacag

SEQ ID NO: 249457 - DNA, 20 bp, Artificial
  CRISPR gRNA sequence
ggattacaggcataagccgc

SEQ ID NO: 249458 - DNA, 20 bp, Artificial
  CRISPR gRNA sequence
caggcataagccgccacgcc

SEQ ID NO: 249459 - DNA, 20 bp, Artificial
  CRISPR gRNA sequence
gtccccaggtcccatatttt

SEQ ID NO: 249460 - DNA, 20 bp, Artificial
  CRISPR gRNA sequence
tctatgtgctagaaaggata

SEQ ID NO: 249461 - DNA, 20 bp, Artificial
  CRISPR gRNA sequence
ctatgtgctagaaaggataa

SEQ ID NO: 249462 - DNA, 20 bp, Artificial
  CRISPR gRNA sequence
tatgtgctagaaaggataaa

SEQ ID NO: 249463 - DNA, 20 bp, Artificial
  CRISPR gRNA sequence
tgtgctagaaaggataaact

SEQ ID NO: 249464 - DNA, 20 bp, Artificial
  CRISPR gRNA sequence
gaaaggataaactgctcaat

SEQ ID NO: 249465 - DNA, 20 bp, Artificial
  CRISPR gRNA sequence
ctcaattattaagtttcttt

SEQ ID NO: 249466 - DNA, 20 bp, Artificial
  CRISPR gRNA sequence
aattattaagtttcttttat

SEQ ID NO: 249467 - DNA, 20 bp, Artificial
  CRISPR gRNA sequence
ttaagtttcttttatttttt

SEQ ID NO: 249468 - DNA, 20 bp, Artificial
  CRISPR gRNA sequence
agtttcttttatttttttgg

SEQ ID NO: 249469 - DNA, 20 bp, Artificial
  CRISPR gRNA sequence
cttttatttttttggggggg

SEQ ID NO: 249470 - DNA, 20 bp, Artificial
  CRISPR gRNA sequence
ttttatttttttgggggggt

SEQ ID NO: 249471 - DNA, 20 bp, Artificial
  CRISPR gRNA sequence
ttatttttttgggggggtgg

SEQ ID NO: 249472 - DNA, 20 bp, Artificial
  CRISPR gRNA sequence
tatttttttgggggggtgga

SEQ ID NO: 249473 - DNA, 20 bp, Artificial
  CRISPR gRNA sequence
atttttttgggggggtggac

SEQ ID NO: 249474 - DNA, 20 bp, Artificial
  CRISPR gRNA sequence
tttttttgggggggtggaca

SEQ ID NO: 249475 - DNA, 20 bp, Artificial
  CRISPR gRNA sequence
ttttgggggggtggacagag

SEQ ID NO: 249476 - DNA, 20 bp, Artificial
  CRISPR gRNA sequence
tttgggggggtggacagagt

SEQ ID NO: 249477 - DNA, 20 bp, Artificial
  CRISPR gRNA sequence
ttgggggggtggacagagtc

SEQ ID NO: 249478 - DNA, 20 bp, Artificial
  CRISPR gRNA sequence
tgggggggtggacagagtct

SEQ ID NO: 249479 - DNA, 20 bp, Artificial
  CRISPR gRNA sequence
gggggggtggacagagtctc

SEQ ID NO: 249480 - DNA, 20 bp, Artificial
  CRISPR gRNA sequence
ggggggtggacagagtctct

SEQ ID NO: 249481 - DNA, 20 bp, Artificial
  CRISPR gRNA sequence
tctctgtcacccaggctgga

SEQ ID NO: 249482 - DNA, 20 bp, Artificial
  CRISPR gRNA sequence
tctgtcacccaggctggagt

SEQ ID NO: 249483 - DNA, 20 bp, Artificial
  CRISPR gRNA sequence
tgtcacccaggctggagtgc

SEQ ID NO: 249484 - DNA, 20 bp, Artificial
  CRISPR gRNA sequence
tcacccaggctggagtgcaa

SEQ ID NO: 249485 - DNA, 20 bp, Artificial
  CRISPR gRNA sequence
gagtgcaatggcgcaatctc

SEQ ID NO: 249486 - DNA, 20 bp, Artificial
  CRISPR gRNA sequence
ggctcactgcaacctctacc

SEQ ID NO: 249487 - DNA, 20 bp, Artificial
  CRISPR gRNA sequence
actgcaacctctacctccca

SEQ ID NO: 249488 - DNA, 20 bp, Artificial
  CRISPR gRNA sequence
caacctctacctcccaggtt

SEQ ID NO: 249489 - DNA, 20 bp, Artificial
  CRISPR gRNA sequence
tacctcccaggttcaagcga

SEQ ID NO: 249490 - DNA, 20 bp, Artificial
  CRISPR gRNA sequence
cctcccaggttcaagcgatt

SEQ ID NO: 249491 - DNA, 20 bp, Artificial
  CRISPR gRNA sequence
ccaggttcaagcgattctcc

SEQ ID NO: 249492 - DNA, 20 bp, Artificial
  CRISPR gRNA sequence
aagcgattctcctgactcag

SEQ ID NO: 249493 - DNA, 20 bp, Artificial
  CRISPR gRNA sequence
tcctgactcagcctcctgag

SEQ ID NO: 249494 - DNA, 20 bp, Artificial
  CRISPR gRNA sequence
ctgactcagcctcctgagta

SEQ ID NO: 249495 - DNA, 20 bp, Artificial
  CRISPR gRNA sequence
actcagcctcctgagtagct

SEQ ID NO: 249496 - DNA, 20 bp, Artificial
  CRISPR gRNA sequence
agcctcctgagtagctggga

SEQ ID NO: 249497 - DNA, 20 bp, Artificial
  CRISPR gRNA sequence
ctgagtagctgggattacag

SEQ ID NO: 249498 - DNA, 20 bp, Artificial
  CRISPR gRNA sequence
agtagctgggattacaggcg

SEQ ID NO: 249499 - DNA, 20 bp, Artificial
  CRISPR gRNA sequence
ggattacaggcgcccaccac

SEQ ID NO: 249500 - DNA, 20 bp, Artificial
  CRISPR gRNA sequence
caggcgcccaccacggcacc

SEQ ID NO: 249501 - DNA, 20 bp, Artificial
  CRISPR gRNA sequence
atttttgtatttttagtaga

SEQ ID NO: 249502 - DNA, 20 bp, Artificial
  CRISPR gRNA sequence
ttgtatttttagtagagatg

SEQ ID NO: 249503 - DNA, 20 bp, Artificial
  CRISPR gRNA sequence
tgtatttttagtagagatgg

SEQ ID NO: 249504 - DNA, 20 bp, Artificial
  CRISPR gRNA sequence
gtatttttagtagagatgga

SEQ ID NO: 249505 - DNA, 20 bp, Artificial
  CRISPR gRNA sequence
tatttttagtagagatggag

SEQ ID NO: 249506 - DNA, 20 bp, Artificial
  CRISPR gRNA sequence
ttagtagagatggagtttct

SEQ ID NO: 249507 - DNA, 20 bp, Artificial
  CRISPR gRNA sequence
tagtagagatggagtttctc

SEQ ID NO: 249508 - DNA, 20 bp, Artificial
  CRISPR gRNA sequence
agtagagatggagtttctcc

SEQ ID NO: 249509 - DNA, 20 bp, Artificial
  CRISPR gRNA sequence
gtagagatggagtttctcca

SEQ ID NO: 249510 - DNA, 20 bp, Artificial
  CRISPR gRNA sequence
ctccatgttggccaggctgg

SEQ ID NO: 249511 - DNA, 20 bp, Artificial
  CRISPR gRNA sequence
tccatgttggccaggctggt

SEQ ID NO: 249512 - DNA, 20 bp, Artificial
  CRISPR gRNA sequence
catgttggccaggctggttt

SEQ ID NO: 249513 - DNA, 20 bp, Artificial
  CRISPR gRNA sequence
gccaggctggtttcaaactc

SEQ ID NO: 249514 - DNA, 20 bp, Artificial
  CRISPR gRNA sequence
gtttcaaactcttgacctca

SEQ ID NO: 249515 - DNA, 20 bp, Artificial
  CRISPR gRNA sequence
caaactcttgacctcaggtg

SEQ ID NO: 249516 - DNA, 20 bp, Artificial
  CRISPR gRNA sequence
aaactcttgacctcaggtga

SEQ ID NO: 249517 - DNA, 20 bp, Artificial
  CRISPR gRNA sequence
ttgacctcaggtgatctgcc

SEQ ID NO: 249518 - DNA, 20 bp, Artificial
  CRISPR gRNA sequence
gacctcaggtgatctgccca

SEQ ID NO: 249519 - DNA, 20 bp, Artificial
  CRISPR gRNA sequence
acctcaggtgatctgcccac

SEQ ID NO: 249520 - DNA, 20 bp, Artificial
  CRISPR gRNA sequence
aggtgatctgcccaccttgg

SEQ ID NO: 249521 - DNA, 20 bp, Artificial
  CRISPR gRNA sequence
cccaccttggcctcccaaag

SEQ ID NO: 249522 - DNA, 20 bp, Artificial
  CRISPR gRNA sequence
ggcctcccaaagtgctagga

SEQ ID NO: 249523 - DNA, 20 bp, Artificial
  CRISPR gRNA sequence
gcctcccaaagtgctaggat

SEQ ID NO: 249524 - DNA, 20 bp, Artificial
  CRISPR gRNA sequence
ccaaagtgctaggattacag

SEQ ID NO: 249525 - DNA, 20 bp, Artificial
  CRISPR gRNA sequence
ggattacaggtgtgagccac

SEQ ID NO: 249526 - DNA, 20 bp, Artificial
  CRISPR gRNA sequence
caggtgtgagccaccgctcc

SEQ ID NO: 249527 - DNA, 20 bp, Artificial
  CRISPR gRNA sequence
cctgccattaagtttctctt

SEQ ID NO: 249528 - DNA, 20 bp, Artificial
  CRISPR gRNA sequence
ccattaagtttctctttttc

SEQ ID NO: 249529 - DNA, 20 bp, Artificial
  CRISPR gRNA sequence
agtttctctttttcttttct

SEQ ID NO: 249530 - DNA, 20 bp, Artificial
  CRISPR gRNA sequence
ctctttttcttttctttctt

SEQ ID NO: 249531 - DNA, 20 bp, Artificial
  CRISPR gRNA sequence
tctttttcttttctttcttt

SEQ ID NO: 249532 - DNA, 20 bp, Artificial
  CRISPR gRNA sequence
tttttcttttctttcttttc

SEQ ID NO: 249533 - DNA, 20 bp, Artificial
  CRISPR gRNA sequence
tttcttttctttcttttctt

SEQ ID NO: 249534 - DNA, 20 bp, Artificial
  CRISPR gRNA sequence
ttcttttctttcttttcttt

SEQ ID NO: 249535 - DNA, 20 bp, Artificial
  CRISPR gRNA sequence
tcttttctttcttttctttt

SEQ ID NO: 249536 - DNA, 20 bp, Artificial
  CRISPR gRNA sequence
cttttctttcttttcttttt

SEQ ID NO: 249537 - DNA, 20 bp, Artificial
  CRISPR gRNA sequence
ttttctttcttttctttttt

SEQ ID NO: 249538 - DNA, 20 bp, Artificial
  CRISPR gRNA sequence
ttctttcttttctttttttt

SEQ ID NO: 249539 - DNA, 20 bp, Artificial
  CRISPR gRNA sequence
tctttcttttcttttttttg

SEQ ID NO: 249540 - DNA, 20 bp, Artificial
  CRISPR gRNA sequence
ctttcttttcttttttttga

SEQ ID NO: 249541 - DNA, 20 bp, Artificial
  CRISPR gRNA sequence
tttcttttcttttttttgag

SEQ ID NO: 249542 - DNA, 20 bp, Artificial
  CRISPR gRNA sequence
tcttttcttttttttgagat

SEQ ID NO: 249543 - DNA, 20 bp, Artificial
  CRISPR gRNA sequence
cttttcttttttttgagatg

SEQ ID NO: 249544 - DNA, 20 bp, Artificial
  CRISPR gRNA sequence
ttttcttttttttgagatgg

SEQ ID NO: 249545 - DNA, 20 bp, Artificial
  CRISPR gRNA sequence
ttcttttttttgagatggag

SEQ ID NO: 249546 - DNA, 20 bp, Artificial
  CRISPR gRNA sequence
tcttttttttgagatggagt

SEQ ID NO: 249547 - DNA, 20 bp, Artificial
  CRISPR gRNA sequence
cttttttttgagatggagtc

SEQ ID NO: 249548 - DNA, 20 bp, Artificial
  CRISPR gRNA sequence
ttttttttgagatggagtct

SEQ ID NO: 249549 - DNA, 20 bp, Artificial
  CRISPR gRNA sequence
ttttttgagatggagtctca

SEQ ID NO: 249550 - DNA, 20 bp, Artificial
  CRISPR gRNA sequence
tttttgagatggagtctcac

SEQ ID NO: 249551 - DNA, 20 bp, Artificial
  CRISPR gRNA sequence
ttttgagatggagtctcact

SEQ ID NO: 249552 - DNA, 20 bp, Artificial
  CRISPR gRNA sequence
tttgagatggagtctcactc

SEQ ID NO: 249553 - DNA, 20 bp, Artificial
  CRISPR gRNA sequence
ttgagatggagtctcactct

SEQ ID NO: 249554 - DNA, 20 bp, Artificial
  CRISPR gRNA sequence
tgagatggagtctcactctg

SEQ ID NO: 249555 - DNA, 20 bp, Artificial
  CRISPR gRNA sequence
gagatggagtctcactctgt

SEQ ID NO: 249556 - DNA, 20 bp, Artificial
  CRISPR gRNA sequence
agatggagtctcactctgtt

SEQ ID NO: 249557 - DNA, 20 bp, Artificial
  CRISPR gRNA sequence
actctgttgcccaggttgga

SEQ ID NO: 249558 - DNA, 20 bp, Artificial
  CRISPR gRNA sequence
tgttgcccaggttggagtgc

SEQ ID NO: 249559 - DNA, 20 bp, Artificial
  CRISPR gRNA sequence
ttgcccaggttggagtgcag

SEQ ID NO: 249560 - DNA, 20 bp, Artificial
  CRISPR gRNA sequence
cccaggttggagtgcagtgg

SEQ ID NO: 249561 - DNA, 20 bp, Artificial
  CRISPR gRNA sequence
gagtgcagtggcaccatctt

SEQ ID NO: 249562 - DNA, 20 bp, Artificial
  CRISPR gRNA sequence
agctcactgcaacctccgcc

SEQ ID NO: 249563 - DNA, 20 bp, Artificial
  CRISPR gRNA sequence
gctcactgcaacctccgcct

SEQ ID NO: 249564 - DNA, 20 bp, Artificial
  CRISPR gRNA sequence
actgcaacctccgcctcccg

SEQ ID NO: 249565 - DNA, 20 bp, Artificial
  CRISPR gRNA sequence
caacctccgcctcccgggtt

SEQ ID NO: 249566 - DNA, 20 bp, Artificial
  CRISPR gRNA sequence
cgcctcccgggttcaagcca

SEQ ID NO: 249567 - DNA, 20 bp, Artificial
  CRISPR gRNA sequence
ccgggttcaagccattctcc

SEQ ID NO: 249568 - DNA, 20 bp, Artificial
  CRISPR gRNA sequence
aagccattctcctgcctcat

SEQ ID NO: 249569 - DNA, 20 bp, Artificial
  CRISPR gRNA sequence
tcctgcctcatcctgccaag

SEQ ID NO: 249570 - DNA, 20 bp, Artificial
  CRISPR gRNA sequence
ctgcctcatcctgccaagta

SEQ ID NO: 249571 - DNA, 20 bp, Artificial
  CRISPR gRNA sequence
cctcatcctgccaagtagct

SEQ ID NO: 249572 - DNA, 20 bp, Artificial
  CRISPR gRNA sequence
atcctgccaagtagctggga

SEQ ID NO: 249573 - DNA, 20 bp, Artificial
  CRISPR gRNA sequence
ccaagtagctgggattacaa

SEQ ID NO: 249574 - DNA, 20 bp, Artificial
  CRISPR gRNA sequence
ggattacaagttcctgccac

SEQ ID NO: 249575 - DNA, 20 bp, Artificial
  CRISPR gRNA sequence
caagttcctgccaccactat

SEQ ID NO: 249576 - DNA, 20 bp, Artificial
  CRISPR gRNA sequence
ctgccaccactatgttggcc

SEQ ID NO: 249577 - DNA, 20 bp, Artificial
  CRISPR gRNA sequence
ccaccactatgttggccagg

SEQ ID NO: 249578 - DNA, 20 bp, Artificial
  CRISPR gRNA sequence
tgttggccaggctggtcttg

SEQ ID NO: 249579 - DNA, 20 bp, Artificial
  CRISPR gRNA sequence
gccaggctggtcttgaactc

SEQ ID NO: 249580 - DNA, 20 bp, Artificial
  CRISPR gRNA sequence
gtcttgaactcctgactcta

SEQ ID NO: 249581 - DNA, 20 bp, Artificial
  CRISPR gRNA sequence
gaactcctgactctaagtga

SEQ ID NO: 249582 - DNA, 20 bp, Artificial
  CRISPR gRNA sequence
aactcctgactctaagtgat

SEQ ID NO: 249583 - DNA, 20 bp, Artificial
  CRISPR gRNA sequence
ctgactctaagtgatcctcc

SEQ ID NO: 249584 - DNA, 20 bp, Artificial
  CRISPR gRNA sequence
actctaagtgatcctcctgc

SEQ ID NO: 249585 - DNA, 20 bp, Artificial
  CRISPR gRNA sequence
taagtgatcctcctgcctcg

SEQ ID NO: 249586 - DNA, 20 bp, Artificial
  CRISPR gRNA sequence
agtgatcctcctgcctcggc

SEQ ID NO: 249587 - DNA, 20 bp, Artificial
  CRISPR gRNA sequence
ctgcctcggccttccaaagt

SEQ ID NO: 249588 - DNA, 20 bp, Artificial
  CRISPR gRNA sequence
cctcggccttccaaagtgtt

SEQ ID NO: 249589 - DNA, 20 bp, Artificial
  CRISPR gRNA sequence
ggccttccaaagtgttggga

SEQ ID NO: 249590 - DNA, 20 bp, Artificial
  CRISPR gRNA sequence
ccaaagtgttgggattacag

SEQ ID NO: 249591 - DNA, 20 bp, Artificial
  CRISPR gRNA sequence
caaagtgttgggattacagg

SEQ ID NO: 249592 - DNA, 20 bp, Artificial
  CRISPR gRNA sequence
ggattacaggcgtgagccac

SEQ ID NO: 249593 - DNA, 20 bp, Artificial
  CRISPR gRNA sequence
caggcgtgagccaccatgtc

SEQ ID NO: 249594 - DNA, 20 bp, Artificial
  CRISPR gRNA sequence
gcctctttaaaagttttcta

SEQ ID NO: 249595 - DNA, 20 bp, Artificial
  CRISPR gRNA sequence
tttaaaagttttctaagttt

SEQ ID NO: 249596 - DNA, 20 bp, Artificial
  CRISPR gRNA sequence
taaaagttttctaagtttac

SEQ ID NO: 249597 - DNA, 20 bp, Artificial
  CRISPR gRNA sequence
aaaagttttctaagtttact

SEQ ID NO: 249598 - DNA, 20 bp, Artificial
  CRISPR gRNA sequence
aaagttttctaagtttactc

SEQ ID NO: 249599 - DNA, 20 bp, Artificial
  CRISPR gRNA sequence
tctaagtttactccattagc

SEQ ID NO: 249600 - DNA, 20 bp, Artificial
  CRISPR gRNA sequence
ctaagtttactccattagca

SEQ ID NO: 249601 - DNA, 20 bp, Artificial
  CRISPR gRNA sequence
taagtttactccattagcag

SEQ ID NO: 249602 - DNA, 20 bp, Artificial
  CRISPR gRNA sequence
agtttactccattagcaggt

SEQ ID NO: 249603 - DNA, 20 bp, Artificial
  CRISPR gRNA sequence
actccattagcaggttggag

SEQ ID NO: 249604 - DNA, 20 bp, Artificial
  CRISPR gRNA sequence
ctccattagcaggttggaga

SEQ ID NO: 249605 - DNA, 20 bp, Artificial
  CRISPR gRNA sequence
cattagcaggttggagatgc

SEQ ID NO: 249606 - DNA, 20 bp, Artificial
  CRISPR gRNA sequence
gcaggttggagatgcccaag

SEQ ID NO: 249607 - DNA, 20 bp, Artificial
  CRISPR gRNA sequence
gagatgcccaaggctgtgat

SEQ ID NO: 249608 - DNA, 20 bp, Artificial
  CRISPR gRNA sequence
tgattcttctcatgcttaga

SEQ ID NO: 249609 - DNA, 20 bp, Artificial
  CRISPR gRNA sequence
ttctcatgcttagaaattta

SEQ ID NO: 249610 - DNA, 20 bp, Artificial
  CRISPR gRNA sequence
ctcatgcttagaaatttacc

SEQ ID NO: 249611 - DNA, 20 bp, Artificial
  CRISPR gRNA sequence
tcatgcttagaaatttacca

SEQ ID NO: 249612 - DNA, 20 bp, Artificial
  CRISPR gRNA sequence
atgcttagaaatttaccaat

SEQ ID NO: 249613 - DNA, 20 bp, Artificial
  CRISPR gRNA sequence
agaaatttaccaatgtaaat

SEQ ID NO: 249614 - DNA, 20 bp, Artificial
  CRISPR gRNA sequence
gaaatttaccaatgtaaata

SEQ ID NO: 249615 - DNA, 20 bp, Artificial
  CRISPR gRNA sequence
accaatgtaaatatatacat

SEQ ID NO: 249616 - DNA, 20 bp, Artificial
  CRISPR gRNA sequence
ccaatgtaaatatatacatg

SEQ ID NO: 249617 - DNA, 20 bp, Artificial
  CRISPR gRNA sequence
ctgcatgcgtttctcctttt

SEQ ID NO: 249618 - DNA, 20 bp, Artificial
  CRISPR gRNA sequence
tgcatgcgtttctccttttg

SEQ ID NO: 249619 - DNA, 20 bp, Artificial
  CRISPR gRNA sequence
catgcgtttctccttttgct

SEQ ID NO: 249620 - DNA, 20 bp, Artificial
  CRISPR gRNA sequence
ctccttttgctgtgttttgc

SEQ ID NO: 249621 - DNA, 20 bp, Artificial
  CRISPR gRNA sequence
tccttttgctgtgttttgca

SEQ ID NO: 249622 - DNA, 20 bp, Artificial
  CRISPR gRNA sequence
cttttgctgtgttttgcagg

SEQ ID NO: 249623 - DNA, 20 bp, Artificial
  CRISPR gRNA sequence
ttgctgtgttttgcaggaca

SEQ ID NO: 249624 - DNA, 20 bp, Artificial
  CRISPR gRNA sequence
tgctgtgttttgcaggacac

SEQ ID NO: 249625 - DNA, 20 bp, Artificial
  CRISPR gRNA sequence
gctgtgttttgcaggacact

SEQ ID NO: 249626 - DNA, 20 bp, Artificial
  CRISPR gRNA sequence
ctgtgttttgcaggacactc

SEQ ID NO: 249627 - DNA, 20 bp, Artificial
  CRISPR gRNA sequence
tgttttgcaggacactctcc

SEQ ID NO: 249628 - DNA, 20 bp, Artificial
  CRISPR gRNA sequence
tgcaggacactctccgcaga

SEQ ID NO: 249629 - DNA, 20 bp, Artificial
  CRISPR gRNA sequence
gcaggacactctccgcagat

SEQ ID NO: 249630 - DNA, 20 bp, Artificial
  CRISPR gRNA sequence
caggacactctccgcagatc

SEQ ID NO: 249631 - DNA, 20 bp, Artificial
  CRISPR gRNA sequence
tccgcagatcatctccttct

SEQ ID NO: 249632 - DNA, 20 bp, Artificial
  CRISPR gRNA sequence
cgcagatcatctccttcttt

SEQ ID NO: 249633 - DNA, 20 bp, Artificial
  CRISPR gRNA sequence
cttctttcttgcgctgacgt

SEQ ID NO: 249634 - DNA, 20 bp, Artificial
  CRISPR gRNA sequence
ctttcttgcgctgacgtcga

SEQ ID NO: 249635 - DNA, 20 bp, Artificial
  CRISPR gRNA sequence
tttcttgcgctgacgtcgac

SEQ ID NO: 249636 - DNA, 20 bp, Artificial
  CRISPR gRNA sequence
tcttgcgctgacgtcgactg

SEQ ID NO: 249637 - DNA, 20 bp, Artificial
  CRISPR gRNA sequence
cttgcgctgacgtcgactgc

SEQ ID NO: 249638 - DNA, 20 bp, Artificial
  CRISPR gRNA sequence
ttgcgctgacgtcgactgcg

SEQ ID NO: 249639 - DNA, 20 bp, Artificial
  CRISPR gRNA sequence
gcgctgacgtcgactgcgtt

SEQ ID NO: 249640 - DNA, 20 bp, Artificial
  CRISPR gRNA sequence
cgctgacgtcgactgcgttg

SEQ ID NO: 249641 - DNA, 20 bp, Artificial
  CRISPR gRNA sequence
acgtcgactgcgttgctctt

SEQ ID NO: 249642 - DNA, 20 bp, Artificial
  CRISPR gRNA sequence
cgttgctcttcctgctgttc

SEQ ID NO: 249643 - DNA, 20 bp, Artificial
  CRISPR gRNA sequence
ctcttcctgctgttcttcct

SEQ ID NO: 249644 - DNA, 20 bp, Artificial
  CRISPR gRNA sequence
ttcctgctgttcttcctcac

SEQ ID NO: 249645 - DNA, 20 bp, Artificial
  CRISPR gRNA sequence
cctgctgttcttcctcacgc

SEQ ID NO: 249646 - DNA, 20 bp, Artificial
  CRISPR gRNA sequence
ctgctgttcttcctcacgct

SEQ ID NO: 249647 - DNA, 20 bp, Artificial
  CRISPR gRNA sequence
ctgttcttcctcacgctccg

SEQ ID NO: 249648 - DNA, 20 bp, Artificial
  CRISPR gRNA sequence
ttcttcctcacgctccgttt

SEQ ID NO: 249649 - DNA, 20 bp, Artificial
  CRISPR gRNA sequence
ttcctcacgctccgtttctc

SEQ ID NO: 249650 - DNA, 20 bp, Artificial
  CRISPR gRNA sequence
cctcacgctccgtttctctg

SEQ ID NO: 249651 - DNA, 20 bp, Artificial
  CRISPR gRNA sequence
ctcacgctccgtttctctgt

SEQ ID NO: 249652 - DNA, 20 bp, Artificial
  CRISPR gRNA sequence
acgctccgtttctctgttgt

SEQ ID NO: 249653 - DNA, 20 bp, Artificial
  CRISPR gRNA sequence
cgtttctctgttgttaaacg

SEQ ID NO: 249654 - DNA, 20 bp, Artificial
  CRISPR gRNA sequence
ctctgttgttaaacggggca

SEQ ID NO: 249655 - DNA, 20 bp, Artificial
  CRISPR gRNA sequence
tctgttgttaaacggggcag

SEQ ID NO: 249656 - DNA, 20 bp, Artificial
  CRISPR gRNA sequence
tgttgttaaacggggcagaa

SEQ ID NO: 249657 - DNA, 20 bp, Artificial
  CRISPR gRNA sequence
ttgttaaacggggcagaaag

SEQ ID NO: 249658 - DNA, 20 bp, Artificial
  CRISPR gRNA sequence
ttaaacggggcagaaagaaa

SEQ ID NO: 249659 - DNA, 20 bp, Artificial
  CRISPR gRNA sequence
aacggggcagaaagaaactc

SEQ ID NO: 249660 - DNA, 20 bp, Artificial
  CRISPR gRNA sequence
ctgtatatattcaaacaacg

SEQ ID NO: 249661 - DNA, 20 bp, Artificial
  CRISPR gRNA sequence
tatatattcaaacaacgtaa

SEQ ID NO: 249662 - DNA, 20 bp, Artificial
  CRISPR gRNA sequence
aaacaacgtaagattaacat

SEQ ID NO: 249663 - DNA, 20 bp, Artificial
  CRISPR gRNA sequence
acataatcatattacagctc

SEQ ID NO: 249664 - DNA, 20 bp, Artificial
  CRISPR gRNA sequence
cagctctggcaaggcaaggc

SEQ ID NO: 249665 - DNA, 20 bp, Artificial
  CRISPR gRNA sequence
tggcaaggcaaggcttttta

SEQ ID NO: 249666 - DNA, 20 bp, Artificial
  CRISPR gRNA sequence
gcaaggcaaggctttttata

SEQ ID NO: 249667 - DNA, 20 bp, Artificial
  CRISPR gRNA sequence
tttataatagaaaggaaaat

SEQ ID NO: 249668 - DNA, 20 bp, Artificial
  CRISPR gRNA sequence
ttataatagaaaggaaaata

SEQ ID NO: 249669 - DNA, 20 bp, Artificial
  CRISPR gRNA sequence
tataatagaaaggaaaatat

SEQ ID NO: 249670 - DNA, 20 bp, Artificial
  CRISPR gRNA sequence
ataatagaaaggaaaatatg

SEQ ID NO: 249671 - DNA, 20 bp, Artificial
  CRISPR gRNA sequence
taatagaaaggaaaatatga

SEQ ID NO: 249672 - DNA, 20 bp, Artificial
  CRISPR gRNA sequence
taaaaaaaattctagaaatg

SEQ ID NO: 249673 - DNA, 20 bp, Artificial
  CRISPR gRNA sequence
aaaaaaaattctagaaatga

SEQ ID NO: 249674 - DNA, 20 bp, Artificial
  CRISPR gRNA sequence
aaaaaaattctagaaatgag

SEQ ID NO: 249675 - DNA, 20 bp, Artificial
  CRISPR gRNA sequence
tagaaatgaggttcatatag

SEQ ID NO: 249676 - DNA, 20 bp, Artificial
  CRISPR gRNA sequence
gaaatgaggttcatatagcc

SEQ ID NO: 249677 - DNA, 20 bp, Artificial
  CRISPR gRNA sequence
atatagccccgtggctatca

SEQ ID NO: 249678 - DNA, 20 bp, Artificial
  CRISPR gRNA sequence
tcacgcaggggcaatttcgt

SEQ ID NO: 249679 - DNA, 20 bp, Artificial
  CRISPR gRNA sequence
cgtccctgggaatatttgca

SEQ ID NO: 249680 - DNA, 20 bp, Artificial
  CRISPR gRNA sequence
gtccctgggaatatttgcag

SEQ ID NO: 249681 - DNA, 20 bp, Artificial
  CRISPR gRNA sequence
ggaatatttgcagtgtctgg

SEQ ID NO: 249682 - DNA, 20 bp, Artificial
  CRISPR gRNA sequence
gcagtgtctggagacagttg

SEQ ID NO: 249683 - DNA, 20 bp, Artificial
  CRISPR gRNA sequence
cagtgtctggagacagttgc

SEQ ID NO: 249684 - DNA, 20 bp, Artificial
  CRISPR gRNA sequence
gagacagttgcagtgttcac

SEQ ID NO: 249685 - DNA, 20 bp, Artificial
  CRISPR gRNA sequence
cagtgttcaccgctcggtgg

SEQ ID NO: 249686 - DNA, 20 bp, Artificial
  CRISPR gRNA sequence
accgctcggtggtgatggtg

SEQ ID NO: 249687 - DNA, 20 bp, Artificial
  CRISPR gRNA sequence
ggtggtgatggtggtgatta

SEQ ID NO: 249688 - DNA, 20 bp, Artificial
  CRISPR gRNA sequence
ggggctattgcatctagtga

SEQ ID NO: 249689 - DNA, 20 bp, Artificial
  CRISPR gRNA sequence
ttgcatctagtgagtagagg

SEQ ID NO: 249690 - DNA, 20 bp, Artificial
  CRISPR gRNA sequence
catctagtgagtagaggtca

SEQ ID NO: 249691 - DNA, 20 bp, Artificial
  CRISPR gRNA sequence
gtgagtagaggtcagcaatg

SEQ ID NO: 249692 - DNA, 20 bp, Artificial
  CRISPR gRNA sequence
ctcaactcctaccgtgcacg

SEQ ID NO: 249693 - DNA, 20 bp, Artificial
  CRISPR gRNA sequence
aactcctaccgtgcacggga

SEQ ID NO: 249694 - DNA, 20 bp, Artificial
  CRISPR gRNA sequence
ctaccgtgcacgggacagcc

SEQ ID NO: 249695 - DNA, 20 bp, Artificial
  CRISPR gRNA sequence
ccgtgcacgggacagcctcc

SEQ ID NO: 249696 - DNA, 20 bp, Artificial
  CRISPR gRNA sequence
ccagcaaagaatgatgctgc

SEQ ID NO: 249697 - DNA, 20 bp, Artificial
  CRISPR gRNA sequence
ccccaaatgtcaatagtgct

SEQ ID NO: 249698 - DNA, 20 bp, Artificial
  CRISPR gRNA sequence
aggtggagaaagcttgcata

SEQ ID NO: 249699 - DNA, 20 bp, Artificial
  CRISPR gRNA sequence
gcatatagaagagcacacct

SEQ ID NO: 249700 - DNA, 20 bp, Artificial
  CRISPR gRNA sequence
catatagaagagcacacctc

SEQ ID NO: 249701 - DNA, 20 bp, Artificial
  CRISPR gRNA sequence
ggttctagaaaaatgacaga

SEQ ID NO: 249702 - DNA, 20 bp, Artificial
  CRISPR gRNA sequence
tagaaaaatgacagatttaa

SEQ ID NO: 249703 - DNA, 20 bp, Artificial
  CRISPR gRNA sequence
gaaaaatgacagatttaaat

SEQ ID NO: 249704 - DNA, 20 bp, Artificial
  CRISPR gRNA sequence
aaatatgctgcagccttgga

SEQ ID NO: 249705 - DNA, 20 bp, Artificial
  CRISPR gRNA sequence
aatatgctgcagccttggat

SEQ ID NO: 249706 - DNA, 20 bp, Artificial
  CRISPR gRNA sequence
cagccttggattattgcatg

SEQ ID NO: 249707 - DNA, 20 bp, Artificial
  CRISPR gRNA sequence
ggattattgcatgtatgtgt

SEQ ID NO: 249708 - DNA, 20 bp, Artificial
  CRISPR gRNA sequence
gattattgcatgtatgtgta

SEQ ID NO: 249709 - DNA, 20 bp, Artificial
  CRISPR gRNA sequence
ttgcatgtatgtgtatgtgt

SEQ ID NO: 249710 - DNA, 20 bp, Artificial
  CRISPR gRNA sequence
catgtatgtgtatgtgtgtg

SEQ ID NO: 249711 - DNA, 20 bp, Artificial
  CRISPR gRNA sequence
tgtgtgtgtgcgtgtgtgtg

SEQ ID NO: 249712 - DNA, 20 bp, Artificial
  CRISPR gRNA sequence
gcaaagaagaatcagaaaac

SEQ ID NO: 249713 - DNA, 20 bp, Artificial
  CRISPR gRNA sequence
cctctatgtccctctggttg

SEQ ID NO: 249714 - DNA, 20 bp, Artificial
  CRISPR gRNA sequence
tatgtccctctggttgataa

SEQ ID NO: 249715 - DNA, 20 bp, Artificial
  CRISPR gRNA sequence
tgtccctctggttgataaac

SEQ ID NO: 249716 - DNA, 20 bp, Artificial
  CRISPR gRNA sequence
tggttgataaactggcttaa

SEQ ID NO: 249717 - DNA, 20 bp, Artificial
  CRISPR gRNA sequence
gttgataaactggcttaaaa

SEQ ID NO: 249718 - DNA, 20 bp, Artificial
  CRISPR gRNA sequence
ataaactggcttaaaatgag

SEQ ID NO: 249719 - DNA, 20 bp, Artificial
  CRISPR gRNA sequence
gcttaaaatgagtttagacc

SEQ ID NO: 249720 - DNA, 20 bp, Artificial
  CRISPR gRNA sequence
aaaatgagtttagacccata

SEQ ID NO: 249721 - DNA, 20 bp, Artificial
  CRISPR gRNA sequence
aaatgagtttagacccatat

SEQ ID NO: 249722 - DNA, 20 bp, Artificial
  CRISPR gRNA sequence
agacccatatttgaggaagg

SEQ ID NO: 249723 - DNA, 20 bp, Artificial
  CRISPR gRNA sequence
gacccatatttgaggaaggc

SEQ ID NO: 249724 - DNA, 20 bp, Artificial
  CRISPR gRNA sequence
gaggaaggcaaggagaacaa

SEQ ID NO: 249725 - DNA, 20 bp, Artificial
  CRISPR gRNA sequence
aggaaggcaaggagaacaaa

SEQ ID NO: 249726 - DNA, 20 bp, Artificial
  CRISPR gRNA sequence
gaagggggtttaacaaatga

SEQ ID NO: 249727 - DNA, 20 bp, Artificial
  CRISPR gRNA sequence
aagggggtttaacaaatgaa

SEQ ID NO: 249728 - DNA, 20 bp, Artificial
  CRISPR gRNA sequence
aacaaatgaattattacagc

SEQ ID NO: 249729 - DNA, 20 bp, Artificial
  CRISPR gRNA sequence
acaaatgaattattacagca

SEQ ID NO: 249730 - DNA, 20 bp, Artificial
  CRISPR gRNA sequence
ttacagcaccagtatggatt

SEQ ID NO: 249731 - DNA, 20 bp, Artificial
  CRISPR gRNA sequence
cagcaccagtatggattaca

SEQ ID NO: 249732 - DNA, 20 bp, Artificial
  CRISPR gRNA sequence
catgaaaaatttcaataatg

SEQ ID NO: 249733 - DNA, 20 bp, Artificial
  CRISPR gRNA sequence
caataatgaatttcattcat

SEQ ID NO: 249734 - DNA, 20 bp, Artificial
  CRISPR gRNA sequence
aataatgaatttcattcatt

SEQ ID NO: 249735 - DNA, 20 bp, Artificial
  CRISPR gRNA sequence
cattcattcacttgttcaac

SEQ ID NO: 249736 - DNA, 20 bp, Artificial
  CRISPR gRNA sequence
attcattcacttgttcaaca

SEQ ID NO: 249737 - DNA, 20 bp, Artificial
  CRISPR gRNA sequence
attcacttgttcaacaatta

SEQ ID NO: 249738 - DNA, 20 bp, Artificial
  CRISPR gRNA sequence
acttgttcaacaattatttc

SEQ ID NO: 249739 - DNA, 20 bp, Artificial
  CRISPR gRNA sequence
gttcaacaattatttctgta

SEQ ID NO: 249740 - DNA, 20 bp, Artificial
  CRISPR gRNA sequence
ttcaacaattatttctgtaa

SEQ ID NO: 249741 - DNA, 20 bp, Artificial
  CRISPR gRNA sequence
aacaattatttctgtaaggt

SEQ ID NO: 249742 - DNA, 20 bp, Artificial
  CRISPR gRNA sequence
tttctgtaaggtactcagca

SEQ ID NO: 249743 - DNA, 20 bp, Artificial
  CRISPR gRNA sequence
ctgtaaggtactcagcaagt

SEQ ID NO: 249744 - DNA, 20 bp, Artificial
  CRISPR gRNA sequence
tgtaaggtactcagcaagtg

SEQ ID NO: 249745 - DNA, 20 bp, Artificial
  CRISPR gRNA sequence
taaggtactcagcaagtgcc

SEQ ID NO: 249746 - DNA, 20 bp, Artificial
  CRISPR gRNA sequence
agcaagtgcctggcactgag

SEQ ID NO: 249747 - DNA, 20 bp, Artificial
  CRISPR gRNA sequence
gcactgagtcagcatccact

SEQ ID NO: 249748 - DNA, 20 bp, Artificial
  CRISPR gRNA sequence
agtcagcatccactagacaa

SEQ ID NO: 249749 - DNA, 20 bp, Artificial
  CRISPR gRNA sequence
gacaaaagccattgatattt

SEQ ID NO: 249750 - DNA, 20 bp, Artificial
  CRISPR gRNA sequence
atatttatttgaaaaagtat

SEQ ID NO: 249751 - DNA, 20 bp, Artificial
  CRISPR gRNA sequence
atttgaaaaagtatatagat

SEQ ID NO: 249752 - DNA, 20 bp, Artificial
  CRISPR gRNA sequence
tttgaaaaagtatatagatg

SEQ ID NO: 249753 - DNA, 20 bp, Artificial
  CRISPR gRNA sequence
gaaaaagtatatagatggaa

SEQ ID NO: 249754 - DNA, 20 bp, Artificial
  CRISPR gRNA sequence
aaaaagtatatagatggaag

SEQ ID NO: 249755 - DNA, 20 bp, Artificial
  CRISPR gRNA sequence
ttttttgtcttcatggacat

SEQ ID NO: 249756 - DNA, 20 bp, Artificial
  CRISPR gRNA sequence
tttgtcttcatggacattag

SEQ ID NO: 249757 - DNA, 20 bp, Artificial
  CRISPR gRNA sequence
ttgtcttcatggacattagg

SEQ ID NO: 249758 - DNA, 20 bp, Artificial
  CRISPR gRNA sequence
tgtcttcatggacattagga

SEQ ID NO: 249759 - DNA, 20 bp, Artificial
  CRISPR gRNA sequence
gtcttcatggacattaggat

SEQ ID NO: 249760 - DNA, 20 bp, Artificial
  CRISPR gRNA sequence
tcttcatggacattaggatg

SEQ ID NO: 249761 - DNA, 20 bp, Artificial
  CRISPR gRNA sequence
catggacattaggatgagac

SEQ ID NO: 249762 - DNA, 20 bp, Artificial
  CRISPR gRNA sequence
atggacattaggatgagaca

SEQ ID NO: 249763 - DNA, 20 bp, Artificial
  CRISPR gRNA sequence
ggatgagacataacaggctt

SEQ ID NO: 249764 - DNA, 20 bp, Artificial
  CRISPR gRNA sequence
aataagacttaataagaggg

SEQ ID NO: 249765 - DNA, 20 bp, Artificial
  CRISPR gRNA sequence
ataagacttaataagaggga

SEQ ID NO: 249766 - DNA, 20 bp, Artificial
  CRISPR gRNA sequence
aataagagggatataataaa

SEQ ID NO: 249767 - DNA, 20 bp, Artificial
  CRISPR gRNA sequence
ataagagggatataataaaa

SEQ ID NO: 249768 - DNA, 20 bp, Artificial
  CRISPR gRNA sequence
tttgagagcaaaattttaac

SEQ ID NO: 249769 - DNA, 20 bp, Artificial
  CRISPR gRNA sequence
ttgagagcaaaattttaacc

SEQ ID NO: 249770 - DNA, 20 bp, Artificial
  CRISPR gRNA sequence
tgagagcaaaattttaaccc

SEQ ID NO: 249771 - DNA, 20 bp, Artificial
  CRISPR gRNA sequence
gagagcaaaattttaaccca

SEQ ID NO: 249772 - DNA, 20 bp, Artificial
  CRISPR gRNA sequence
agagcaaaattttaacccaa

SEQ ID NO: 249773 - DNA, 20 bp, Artificial
  CRISPR gRNA sequence
taacccaaagcaccatgtaa

SEQ ID NO: 249774 - DNA, 20 bp, Artificial
  CRISPR gRNA sequence
aacccaaagcaccatgtaag

SEQ ID NO: 249775 - DNA, 20 bp, Artificial
  CRISPR gRNA sequence
acccaaagcaccatgtaaga

SEQ ID NO: 249776 - DNA, 20 bp, Artificial
  CRISPR gRNA sequence
tttggagattgttaaaaata

SEQ ID NO: 249777 - DNA, 20 bp, Artificial
  CRISPR gRNA sequence
ggagattgttaaaaatatat

SEQ ID NO: 249778 - DNA, 20 bp, Artificial
  CRISPR gRNA sequence
gagattgttaaaaatatata

SEQ ID NO: 249779 - DNA, 20 bp, Artificial
  CRISPR gRNA sequence
ttaaaaatatatatgcagga

SEQ ID NO: 249780 - DNA, 20 bp, Artificial
  CRISPR gRNA sequence
aaaatatatatgcaggaaca

SEQ ID NO: 249781 - DNA, 20 bp, Artificial
  CRISPR gRNA sequence
gtaaagtctttttttttctt

SEQ ID NO: 249782 - DNA, 20 bp, Artificial
  CRISPR gRNA sequence
tttttttcttttttgagaca

SEQ ID NO: 249783 - DNA, 20 bp, Artificial
  CRISPR gRNA sequence
ttttttcttttttgagacag

SEQ ID NO: 249784 - DNA, 20 bp, Artificial
  CRISPR gRNA sequence
tttttcttttttgagacaga

SEQ ID NO: 249785 - DNA, 20 bp, Artificial
  CRISPR gRNA sequence
ttttcttttttgagacagag

SEQ ID NO: 249786 - DNA, 20 bp, Artificial
  CRISPR gRNA sequence
tttcttttttgagacagagt

SEQ ID NO: 249787 - DNA, 20 bp, Artificial
  CRISPR gRNA sequence
ttcttttttgagacagagtt

SEQ ID NO: 249788 - DNA, 20 bp, Artificial
  CRISPR gRNA sequence
tcttttttgagacagagttt

SEQ ID NO: 249789 - DNA, 20 bp, Artificial
  CRISPR gRNA sequence
cttttttgagacagagtttc

SEQ ID NO: 249790 - DNA, 20 bp, Artificial
  CRISPR gRNA sequence
ttttttgagacagagtttca

SEQ ID NO: 249791 - DNA, 20 bp, Artificial
  CRISPR gRNA sequence
ttttgagacagagtttcact

SEQ ID NO: 249792 - DNA, 20 bp, Artificial
  CRISPR gRNA sequence
tttgagacagagtttcactc

SEQ ID NO: 249793 - DNA, 20 bp, Artificial
  CRISPR gRNA sequence
ttgagacagagtttcactct

SEQ ID NO: 249794 - DNA, 20 bp, Artificial
  CRISPR gRNA sequence
tgagacagagtttcactctt

SEQ ID NO: 249795 - DNA, 20 bp, Artificial
  CRISPR gRNA sequence
gagacagagtttcactcttg

SEQ ID NO: 249796 - DNA, 20 bp, Artificial
  CRISPR gRNA sequence
agacagagtttcactcttgt

SEQ ID NO: 249797 - DNA, 20 bp, Artificial
  CRISPR gRNA sequence
cactcttgttgcccaggctg

SEQ ID NO: 249798 - DNA, 20 bp, Artificial
  CRISPR gRNA sequence
actcttgttgcccaggctgg

SEQ ID NO: 249799 - DNA, 20 bp, Artificial
  CRISPR gRNA sequence
ttgttgcccaggctggagtg

SEQ ID NO: 249800 - DNA, 20 bp, Artificial
  CRISPR gRNA sequence
gttgcccaggctggagtgca

SEQ ID NO: 249801 - DNA, 20 bp, Artificial
  CRISPR gRNA sequence
ttgcccaggctggagtgcaa

SEQ ID NO: 249802 - DNA, 20 bp, Artificial
  CRISPR gRNA sequence
cccaggctggagtgcaatgg

SEQ ID NO: 249803 - DNA, 20 bp, Artificial
  CRISPR gRNA sequence
gagtgcaatggcgtgatccc

SEQ ID NO: 249804 - DNA, 20 bp, Artificial
  CRISPR gRNA sequence
accgcaacctcctccttccg

SEQ ID NO: 249805 - DNA, 20 bp, Artificial
  CRISPR gRNA sequence
ccgcaacctcctccttccgg

SEQ ID NO: 249806 - DNA, 20 bp, Artificial
  CRISPR gRNA sequence
ctccttccgggttcaagcga

SEQ ID NO: 249807 - DNA, 20 bp, Artificial
  CRISPR gRNA sequence
cttccgggttcaagcgattc

SEQ ID NO: 249808 - DNA, 20 bp, Artificial
  CRISPR gRNA sequence
ccgggttcaagcgattctcc

SEQ ID NO: 249809 - DNA, 20 bp, Artificial
  CRISPR gRNA sequence
cgggttcaagcgattctcct

SEQ ID NO: 249810 - DNA, 20 bp, Artificial
  CRISPR gRNA sequence
aagcgattctcctgcctcag

SEQ ID NO: 249811 - DNA, 20 bp, Artificial
  CRISPR gRNA sequence
tcctgcctcaggctcccgag

SEQ ID NO: 249812 - DNA, 20 bp, Artificial
  CRISPR gRNA sequence
ctgcctcaggctcccgaggc

SEQ ID NO: 249813 - DNA, 20 bp, Artificial
  CRISPR gRNA sequence
cctcaggctcccgaggcatt

SEQ ID NO: 249814 - DNA, 20 bp, Artificial
  CRISPR gRNA sequence
aggctcccgaggcattacag

SEQ ID NO: 249815 - DNA, 20 bp, Artificial
  CRISPR gRNA sequence
ccgaggcattacaggcatgc

SEQ ID NO: 249816 - DNA, 20 bp, Artificial
  CRISPR gRNA sequence
caggcatgcgccaccacacc

SEQ ID NO: 249817 - DNA, 20 bp, Artificial
  CRISPR gRNA sequence
attttgcatttttagtagag

SEQ ID NO: 249818 - DNA, 20 bp, Artificial
  CRISPR gRNA sequence
tgcatttttagtagagacgg

SEQ ID NO: 249819 - DNA, 20 bp, Artificial
  CRISPR gRNA sequence
gcatttttagtagagacggg

SEQ ID NO: 249820 - DNA, 20 bp, Artificial
  CRISPR gRNA sequence
catttttagtagagacgggg

SEQ ID NO: 249821 - DNA, 20 bp, Artificial
  CRISPR gRNA sequence
ttagtagagacggggtttct

SEQ ID NO: 249822 - DNA, 20 bp, Artificial
  CRISPR gRNA sequence
tagtagagacggggtttctc

SEQ ID NO: 249823 - DNA, 20 bp, Artificial
  CRISPR gRNA sequence
agtagagacggggtttctcc

SEQ ID NO: 249824 - DNA, 20 bp, Artificial
  CRISPR gRNA sequence
gtagagacggggtttctcca

SEQ ID NO: 249825 - DNA, 20 bp, Artificial
  CRISPR gRNA sequence
ctccatgttggccaggctgg

SEQ ID NO: 249826 - DNA, 20 bp, Artificial
  CRISPR gRNA sequence
tccatgttggccaggctggt

SEQ ID NO: 249827 - DNA, 20 bp, Artificial
  CRISPR gRNA sequence
catgttggccaggctggtct

SEQ ID NO: 249828 - DNA, 20 bp, Artificial
  CRISPR gRNA sequence
gccaggctggtcttgaactc

SEQ ID NO: 249829 - DNA, 20 bp, Artificial
  CRISPR gRNA sequence
gtcttgaactcccaacctca

SEQ ID NO: 249830 - DNA, 20 bp, Artificial
  CRISPR gRNA sequence
gaactcccaacctcaggtga

SEQ ID NO: 249831 - DNA, 20 bp, Artificial
  CRISPR gRNA sequence
aactcccaacctcaggtgat

SEQ ID NO: 249832 - DNA, 20 bp, Artificial
  CRISPR gRNA sequence
ccaacctcaggtgatccgcc

SEQ ID NO: 249833 - DNA, 20 bp, Artificial
  CRISPR gRNA sequence
aggtgatccgcccgcctcag

SEQ ID NO: 249834 - DNA, 20 bp, Artificial
  CRISPR gRNA sequence
agcctcccaaagtgttggga

SEQ ID NO: 249835 - DNA, 20 bp, Artificial
  CRISPR gRNA sequence
ccaaagtgttgggattacag

SEQ ID NO: 249836 - DNA, 20 bp, Artificial
  CRISPR gRNA sequence
ggattacaggcgtgagccac

SEQ ID NO: 249837 - DNA, 20 bp, Artificial
  CRISPR gRNA sequence
caggcgtgagccactgcgct

SEQ ID NO: 249838 - DNA, 20 bp, Artificial
  CRISPR gRNA sequence
cgctcagccagtaaagtctt

SEQ ID NO: 249839 - DNA, 20 bp, Artificial
  CRISPR gRNA sequence
agccagtaaagtcttatcta

SEQ ID NO: 249840 - DNA, 20 bp, Artificial
  CRISPR gRNA sequence
atctaataaattatgctaat

SEQ ID NO: 249841 - DNA, 20 bp, Artificial
  CRISPR gRNA sequence
tctaataaattatgctaatg

SEQ ID NO: 249842 - DNA, 20 bp, Artificial
  CRISPR gRNA sequence
ataaattatgctaatgtatt

SEQ ID NO: 249843 - DNA, 20 bp, Artificial
  CRISPR gRNA sequence
tgctaatgtatttaaaggct

SEQ ID NO: 249844 - DNA, 20 bp, Artificial
  CRISPR gRNA sequence
atgtatttaaaggctctttt

SEQ ID NO: 249845 - DNA, 20 bp, Artificial
  CRISPR gRNA sequence
aaaggctctttttaaagcaa

SEQ ID NO: 249846 - DNA, 20 bp, Artificial
  CRISPR gRNA sequence
aaggctctttttaaagcaat

SEQ ID NO: 249847 - DNA, 20 bp, Artificial
  CRISPR gRNA sequence
tttttaaagcaatatagaac

SEQ ID NO: 249848 - DNA, 20 bp, Artificial
  CRISPR gRNA sequence
tttaaagcaatatagaactt

SEQ ID NO: 249849 - DNA, 20 bp, Artificial
  CRISPR gRNA sequence
ttaaagcaatatagaacttt

SEQ ID NO: 249850 - DNA, 20 bp, Artificial
  CRISPR gRNA sequence
taaagcaatatagaactttt

SEQ ID NO: 249851 - DNA, 20 bp, Artificial
  CRISPR gRNA sequence
aaagcaatatagaactttta

SEQ ID NO: 249852 - DNA, 20 bp, Artificial
  CRISPR gRNA sequence
aagcaatatagaacttttat

SEQ ID NO: 249853 - DNA, 20 bp, Artificial
  CRISPR gRNA sequence
ttatacattgtgacctatac

SEQ ID NO: 249854 - DNA, 20 bp, Artificial
  CRISPR gRNA sequence
tatacattgtgacctataca

SEQ ID NO: 249855 - DNA, 20 bp, Artificial
  CRISPR gRNA sequence
atacattgtgacctatacag

SEQ ID NO: 249856 - DNA, 20 bp, Artificial
  CRISPR gRNA sequence
tacattgtgacctatacaga

SEQ ID NO: 249857 - DNA, 20 bp, Artificial
  CRISPR gRNA sequence
tgacctatacagaaaaatgc

SEQ ID NO: 249858 - DNA, 20 bp, Artificial
  CRISPR gRNA sequence
tacagaaaaatgcataaatg

SEQ ID NO: 249859 - DNA, 20 bp, Artificial
  CRISPR gRNA sequence
aacaaattgttgtaaacaaa

SEQ ID NO: 249860 - DNA, 20 bp, Artificial
  CRISPR gRNA sequence
acaaattgttgtaaacaaac

SEQ ID NO: 249861 - DNA, 20 bp, Artificial
  CRISPR gRNA sequence
ttgtaaacaaacattcaaat

SEQ ID NO: 249862 - DNA, 20 bp, Artificial
  CRISPR gRNA sequence
taaacaaacattcaaataac

SEQ ID NO: 249863 - DNA, 20 bp, Artificial
  CRISPR gRNA sequence
aaataactctaccagggtaa

SEQ ID NO: 249864 - DNA, 20 bp, Artificial
  CRISPR gRNA sequence
taccagggtaaagaagtgga

SEQ ID NO: 249865 - DNA, 20 bp, Artificial
  CRISPR gRNA sequence
ccagggtaaagaagtggaac

SEQ ID NO: 249866 - DNA, 20 bp, Artificial
  CRISPR gRNA sequence
attcccgaagcccttggcat

SEQ ID NO: 249867 - DNA, 20 bp, Artificial
  CRISPR gRNA sequence
ccgaagcccttggcatgccc

SEQ ID NO: 249868 - DNA, 20 bp, Artificial
  CRISPR gRNA sequence
ggcatgccctttctagatca

SEQ ID NO: 249869 - DNA, 20 bp, Artificial
  CRISPR gRNA sequence
gcatgccctttctagatcac

SEQ ID NO: 249870 - DNA, 20 bp, Artificial
  CRISPR gRNA sequence
tctagatcacagccctcttt

SEQ ID NO: 249871 - DNA, 20 bp, Artificial
  CRISPR gRNA sequence
ctagatcacagccctctttg

SEQ ID NO: 249872 - DNA, 20 bp, Artificial
  CRISPR gRNA sequence
tagatcacagccctctttgc

SEQ ID NO: 249873 - DNA, 20 bp, Artificial
  CRISPR gRNA sequence
gatcacagccctctttgccc

SEQ ID NO: 249874 - DNA, 20 bp, Artificial
  CRISPR gRNA sequence
tttgcccactactgctaacc

SEQ ID NO: 249875 - DNA, 20 bp, Artificial
  CRISPR gRNA sequence
tgcccactactgctaaccac

SEQ ID NO: 249876 - DNA, 20 bp, Artificial
  CRISPR gRNA sequence
gcccactactgctaaccaca

SEQ ID NO: 249877 - DNA, 20 bp, Artificial
  CRISPR gRNA sequence
cccactactgctaaccacat

SEQ ID NO: 249878 - DNA, 20 bp, Artificial
  CRISPR gRNA sequence
ctgctaaccacatctagact

SEQ ID NO: 249879 - DNA, 20 bp, Artificial
  CRISPR gRNA sequence
ctaaccacatctagacttgt

SEQ ID NO: 249880 - DNA, 20 bp, Artificial
  CRISPR gRNA sequence
accacatctagacttgtatg

SEQ ID NO: 249881 - DNA, 20 bp, Artificial
  CRISPR gRNA sequence
gacttgtatggtattaactt

SEQ ID NO: 249882 - DNA, 20 bp, Artificial
  CRISPR gRNA sequence
gtatggtattaacttccttt

SEQ ID NO: 249883 - DNA, 20 bp, Artificial
  CRISPR gRNA sequence
tatggtattaacttcctttt

SEQ ID NO: 249884 - DNA, 20 bp, Artificial
  CRISPR gRNA sequence
acttccttttgctgtagttt

SEQ ID NO: 249885 - DNA, 20 bp, Artificial
  CRISPR gRNA sequence
ccttttgctgtagttttgct

SEQ ID NO: 249886 - DNA, 20 bp, Artificial
  CRISPR gRNA sequence
cttttgctgtagttttgcta

SEQ ID NO: 249887 - DNA, 20 bp, Artificial
  CRISPR gRNA sequence
ttgctgtagttttgctacct

SEQ ID NO: 249888 - DNA, 20 bp, Artificial
  CRISPR gRNA sequence
tgctgtagttttgctaccta

SEQ ID NO: 249889 - DNA, 20 bp, Artificial
  CRISPR gRNA sequence
gctgtagttttgctacctaa

SEQ ID NO: 249890 - DNA, 20 bp, Artificial
  CRISPR gRNA sequence
ctgtagttttgctacctaat

SEQ ID NO: 249891 - DNA, 20 bp, Artificial
  CRISPR gRNA sequence
tagttttgctacctaataac

SEQ ID NO: 249892 - DNA, 20 bp, Artificial
  CRISPR gRNA sequence
tgctacctaataacacagtt

SEQ ID NO: 249893 - DNA, 20 bp, Artificial
  CRISPR gRNA sequence
gctacctaataacacagttt

SEQ ID NO: 249894 - DNA, 20 bp, Artificial
  CRISPR gRNA sequence
ctacctaataacacagtttt

SEQ ID NO: 249895 - DNA, 20 bp, Artificial
  CRISPR gRNA sequence
cctaataacacagttttatt

SEQ ID NO: 249896 - DNA, 20 bp, Artificial
  CRISPR gRNA sequence
ataacacagttttattgggc

SEQ ID NO: 249897 - DNA, 20 bp, Artificial
  CRISPR gRNA sequence
tattgggctgcttgtgaact

SEQ ID NO: 249898 - DNA, 20 bp, Artificial
  CRISPR gRNA sequence
attgggctgcttgtgaactt

SEQ ID NO: 249899 - DNA, 20 bp, Artificial
  CRISPR gRNA sequence
ttgggctgcttgtgaacttc

SEQ ID NO: 249900 - DNA, 20 bp, Artificial
  CRISPR gRNA sequence
ggctgcttgtgaacttcata

SEQ ID NO: 249901 - DNA, 20 bp, Artificial
  CRISPR gRNA sequence
cttgtgaacttcatacaaat

SEQ ID NO: 249902 - DNA, 20 bp, Artificial
  CRISPR gRNA sequence
gtgaacttcatacaaataga

SEQ ID NO: 249903 - DNA, 20 bp, Artificial
  CRISPR gRNA sequence
tgaacttcatacaaatagaa

SEQ ID NO: 249904 - DNA, 20 bp, Artificial
  CRISPR gRNA sequence
catacaaatagaatcacact

SEQ ID NO: 249905 - DNA, 20 bp, Artificial
  CRISPR gRNA sequence
atacaaatagaatcacactg

SEQ ID NO: 249906 - DNA, 20 bp, Artificial
  CRISPR gRNA sequence
ttttctgtatcttgcttctt

SEQ ID NO: 249907 - DNA, 20 bp, Artificial
  CRISPR gRNA sequence
tctgtatcttgcttcttctt

SEQ ID NO: 249908 - DNA, 20 bp, Artificial
  CRISPR gRNA sequence
ctgtatcttgcttcttcttt

SEQ ID NO: 249909 - DNA, 20 bp, Artificial
  CRISPR gRNA sequence
tgtatcttgcttcttctttc

SEQ ID NO: 249910 - DNA, 20 bp, Artificial
  CRISPR gRNA sequence
tatcttgcttcttctttcaa

SEQ ID NO: 249911 - DNA, 20 bp, Artificial
  CRISPR gRNA sequence
gcttcttctttcaacgttgt

SEQ ID NO: 249912 - DNA, 20 bp, Artificial
  CRISPR gRNA sequence
cttcttctttcaacgttgta

SEQ ID NO: 249913 - DNA, 20 bp, Artificial
  CRISPR gRNA sequence
cttctttcaacgttgtatca

SEQ ID NO: 249914 - DNA, 20 bp, Artificial
  CRISPR gRNA sequence
ttctttcaacgttgtatcat

SEQ ID NO: 249915 - DNA, 20 bp, Artificial
  CRISPR gRNA sequence
ctttcaacgttgtatcatga

SEQ ID NO: 249916 - DNA, 20 bp, Artificial
  CRISPR gRNA sequence
tttcaacgttgtatcatgaa

SEQ ID NO: 249917 - DNA, 20 bp, Artificial
  CRISPR gRNA sequence
tcaacgttgtatcatgaaga

SEQ ID NO: 249918 - DNA, 20 bp, Artificial
  CRISPR gRNA sequence
caacgttgtatcatgaagat

SEQ ID NO: 249919 - DNA, 20 bp, Artificial
  CRISPR gRNA sequence
aacgttgtatcatgaagatt

SEQ ID NO: 249920 - DNA, 20 bp, Artificial
  CRISPR gRNA sequence
tatcatgaagattcatccat

SEQ ID NO: 249921 - DNA, 20 bp, Artificial
  CRISPR gRNA sequence
atccatgttgagttcatctt

SEQ ID NO: 249922 - DNA, 20 bp, Artificial
  CRISPR gRNA sequence
agttcatctttagttgattt

SEQ ID NO: 249923 - DNA, 20 bp, Artificial
  CRISPR gRNA sequence
atctttagttgatttccact

SEQ ID NO: 249924 - DNA, 20 bp, Artificial
  CRISPR gRNA sequence
tagttgatttccactgttgc

SEQ ID NO: 249925 - DNA, 20 bp, Artificial
  CRISPR gRNA sequence
agttgatttccactgttgca

SEQ ID NO: 249926 - DNA, 20 bp, Artificial
  CRISPR gRNA sequence
gttgatttccactgttgcac

SEQ ID NO: 249927 - DNA, 20 bp, Artificial
  CRISPR gRNA sequence
atttccactgttgcacactc

SEQ ID NO: 249928 - DNA, 20 bp, Artificial
  CRISPR gRNA sequence
ccactgttgcacactcttgt

SEQ ID NO: 249929 - DNA, 20 bp, Artificial
  CRISPR gRNA sequence
cactgttgcacactcttgtt

SEQ ID NO: 249930 - DNA, 20 bp, Artificial
  CRISPR gRNA sequence
ttgcacactcttgttgaatg

SEQ ID NO: 249931 - DNA, 20 bp, Artificial
  CRISPR gRNA sequence
cacactcttgttgaatgatg

SEQ ID NO: 249932 - DNA, 20 bp, Artificial
  CRISPR gRNA sequence
ttgttgaatgatgacatcat

SEQ ID NO: 249933 - DNA, 20 bp, Artificial
  CRISPR gRNA sequence
gttgaatgatgacatcattg

SEQ ID NO: 249934 - DNA, 20 bp, Artificial
  CRISPR gRNA sequence
ttgaatgatgacatcattgt

SEQ ID NO: 249935 - DNA, 20 bp, Artificial
  CRISPR gRNA sequence
aatgatgacatcattgttca

SEQ ID NO: 249936 - DNA, 20 bp, Artificial
  CRISPR gRNA sequence
ttcacctattctagtactga

SEQ ID NO: 249937 - DNA, 20 bp, Artificial
  CRISPR gRNA sequence
acctattctagtactgatgg

SEQ ID NO: 249938 - DNA, 20 bp, Artificial
  CRISPR gRNA sequence
ttctagtactgatggacagc

SEQ ID NO: 249939 - DNA, 20 bp, Artificial
  CRISPR gRNA sequence
tagtactgatggacagcggg

SEQ ID NO: 249940 - DNA, 20 bp, Artificial
  CRISPR gRNA sequence
gtactgatggacagcgggat

SEQ ID NO: 249941 - DNA, 20 bp, Artificial
  CRISPR gRNA sequence
atggacagcgggatcatttc

SEQ ID NO: 249942 - DNA, 20 bp, Artificial
  CRISPR gRNA sequence
ccagcttggggttattacat

SEQ ID NO: 249943 - DNA, 20 bp, Artificial
  CRISPR gRNA sequence
cagcttggggttattacatg

SEQ ID NO: 249944 - DNA, 20 bp, Artificial
  CRISPR gRNA sequence
ggggttattacatgtaatga

SEQ ID NO: 249945 - DNA, 20 bp, Artificial
  CRISPR gRNA sequence
gggttattacatgtaatgac

SEQ ID NO: 249946 - DNA, 20 bp, Artificial
  CRISPR gRNA sequence
ttacatgtaatgacgtttga

SEQ ID NO: 249947 - DNA, 20 bp, Artificial
  CRISPR gRNA sequence
catgtaatgacgtttgaata

SEQ ID NO: 249948 - DNA, 20 bp, Artificial
  CRISPR gRNA sequence
gaatatttttgtccgtgtat

SEQ ID NO: 249949 - DNA, 20 bp, Artificial
  CRISPR gRNA sequence
aatatttttgtccgtgtatc

SEQ ID NO: 249950 - DNA, 20 bp, Artificial
  CRISPR gRNA sequence
ttgtccgtgtatctcagcac

SEQ ID NO: 249951 - DNA, 20 bp, Artificial
  CRISPR gRNA sequence
tgtccgtgtatctcagcaca

SEQ ID NO: 249952 - DNA, 20 bp, Artificial
  CRISPR gRNA sequence
gtccgtgtatctcagcacac

SEQ ID NO: 249953 - DNA, 20 bp, Artificial
  CRISPR gRNA sequence
tccgtgtatctcagcacacg

SEQ ID NO: 249954 - DNA, 20 bp, Artificial
  CRISPR gRNA sequence
agcacacgtaaacacgtgtt

SEQ ID NO: 249955 - DNA, 20 bp, Artificial
  CRISPR gRNA sequence
ctggcttggttttgtttttt

SEQ ID NO: 249956 - DNA, 20 bp, Artificial
  CRISPR gRNA sequence
tggcttggttttgtttttta

SEQ ID NO: 249957 - DNA, 20 bp, Artificial
  CRISPR gRNA sequence
gcttggttttgttttttaac

SEQ ID NO: 249958 - DNA, 20 bp, Artificial
  CRISPR gRNA sequence
ggttttgttttttaacctag

SEQ ID NO: 249959 - DNA, 20 bp, Artificial
  CRISPR gRNA sequence
gttttgttttttaacctaga

SEQ ID NO: 249960 - DNA, 20 bp, Artificial
  CRISPR gRNA sequence
tgttttttaacctagaaata

SEQ ID NO: 249961 - DNA, 20 bp, Artificial
  CRISPR gRNA sequence
gttttttaacctagaaataa

SEQ ID NO: 249962 - DNA, 20 bp, Artificial
  CRISPR gRNA sequence
ttttttaacctagaaataac

SEQ ID NO: 249963 - DNA, 20 bp, Artificial
  CRISPR gRNA sequence
tttaacctagaaataacgtt

SEQ ID NO: 249964 - DNA, 20 bp, Artificial
  CRISPR gRNA sequence
ttaacctagaaataacgttg

SEQ ID NO: 249965 - DNA, 20 bp, Artificial
  CRISPR gRNA sequence
taacctagaaataacgttgc

SEQ ID NO: 249966 - DNA, 20 bp, Artificial
  CRISPR gRNA sequence
aacctagaaataacgttgct

SEQ ID NO: 249967 - DNA, 20 bp, Artificial
  CRISPR gRNA sequence
acctagaaataacgttgctg

SEQ ID NO: 249968 - DNA, 20 bp, Artificial
  CRISPR gRNA sequence
gaaataacgttgctgagcta

SEQ ID NO: 249969 - DNA, 20 bp, Artificial
  CRISPR gRNA sequence
ctgagctacaaggaacatgt

SEQ ID NO: 249970 - DNA, 20 bp, Artificial
  CRISPR gRNA sequence
agctacaaggaacatgtgta

SEQ ID NO: 249971 - DNA, 20 bp, Artificial
  CRISPR gRNA sequence
caaggaacatgtgtatcttg

SEQ ID NO: 249972 - DNA, 20 bp, Artificial
  CRISPR gRNA sequence
ggtcgtgaatatgccaaact

SEQ ID NO: 249973 - DNA, 20 bp, Artificial
  CRISPR gRNA sequence
gtcgtgaatatgccaaactg

SEQ ID NO: 249974 - DNA, 20 bp, Artificial
  CRISPR gRNA sequence
ttttcctaaatgattggacc

SEQ ID NO: 249975 - DNA, 20 bp, Artificial
  CRISPR gRNA sequence
tcctaaatgattggacccca

SEQ ID NO: 249976 - DNA, 20 bp, Artificial
  CRISPR gRNA sequence
cctaaatgattggaccccat

SEQ ID NO: 249977 - DNA, 20 bp, Artificial
  CRISPR gRNA sequence
ctaaatgattggaccccatt

SEQ ID NO: 249978 - DNA, 20 bp, Artificial
  CRISPR gRNA sequence
aatgattggaccccatttac

SEQ ID NO: 249979 - DNA, 20 bp, Artificial
  CRISPR gRNA sequence
gaccccatttacactcccct

SEQ ID NO: 249980 - DNA, 20 bp, Artificial
  CRISPR gRNA sequence
acactcccctggcggtaatg

SEQ ID NO: 249981 - DNA, 20 bp, Artificial
  CRISPR gRNA sequence
cactcccctggcggtaatga

SEQ ID NO: 249982 - DNA, 20 bp, Artificial
  CRISPR gRNA sequence
ccctggcggtaatgagtttc

SEQ ID NO: 249983 - DNA, 20 bp, Artificial
  CRISPR gRNA sequence
gcggtaatgagtttcctgtt

SEQ ID NO: 249984 - DNA, 20 bp, Artificial
  CRISPR gRNA sequence
cctgttactccacatcccct

SEQ ID NO: 249985 - DNA, 20 bp, Artificial
  CRISPR gRNA sequence
ctgttactccacatcccctg

SEQ ID NO: 249986 - DNA, 20 bp, Artificial
  CRISPR gRNA sequence
ttactccacatcccctgata

SEQ ID NO: 249987 - DNA, 20 bp, Artificial
  CRISPR gRNA sequence
ctccacatcccctgataact

SEQ ID NO: 249988 - DNA, 20 bp, Artificial
  CRISPR gRNA sequence
cacatcccctgataactctt

SEQ ID NO: 249989 - DNA, 20 bp, Artificial
  CRISPR gRNA sequence
ataactcttggtatcatcag

SEQ ID NO: 249990 - DNA, 20 bp, Artificial
  CRISPR gRNA sequence
ttggtatcatcagattattt

SEQ ID NO: 249991 - DNA, 20 bp, Artificial
  CRISPR gRNA sequence
ggtatcatcagattattttt

SEQ ID NO: 249992 - DNA, 20 bp, Artificial
  CRISPR gRNA sequence
gtatcatcagattattttta

SEQ ID NO: 249993 - DNA, 20 bp, Artificial
  CRISPR gRNA sequence
tttttatcgatatggtgggt

SEQ ID NO: 249994 - DNA, 20 bp, Artificial
  CRISPR gRNA sequence
ttatcgatatggtgggtgga

SEQ ID NO: 249995 - DNA, 20 bp, Artificial
  CRISPR gRNA sequence
tatcgatatggtgggtggat

SEQ ID NO: 249996 - DNA, 20 bp, Artificial
  CRISPR gRNA sequence
atcgatatggtgggtggata

SEQ ID NO: 249997 - DNA, 20 bp, Artificial
  CRISPR gRNA sequence
tcgatatggtgggtggatag

SEQ ID NO: 249998 - DNA, 20 bp, Artificial
  CRISPR gRNA sequence
tatctcattgtggttttaac

SEQ ID NO: 249999 - DNA, 20 bp, Artificial
  CRISPR gRNA sequence
attgtggttttaacttacac

SEQ ID NO: 250000 - DNA, 20 bp, Artificial
  CRISPR gRNA sequence
tggttttaacttacacttcc

SEQ ID NO: 250001 - DNA, 20 bp, Artificial
  CRISPR gRNA sequence
taacttacacttcctggttg

SEQ ID NO: 250002 - DNA, 20 bp, Artificial
  CRISPR gRNA sequence
aacttacacttcctggttgc

SEQ ID NO: 250003 - DNA, 20 bp, Artificial
  CRISPR gRNA sequence
acttacacttcctggttgct

SEQ ID NO: 250004 - DNA, 20 bp, Artificial
  CRISPR gRNA sequence
acacttcctggttgctagtg

SEQ ID NO: 250005 - DNA, 20 bp, Artificial
  CRISPR gRNA sequence
cacttcctggttgctagtga

SEQ ID NO: 250006 - DNA, 20 bp, Artificial
  CRISPR gRNA sequence
cctggttgctagtgaggtta

SEQ ID NO: 250007 - DNA, 20 bp, Artificial
  CRISPR gRNA sequence
ctggttgctagtgaggttag

SEQ ID NO: 250008 - DNA, 20 bp, Artificial
  CRISPR gRNA sequence
gttgctagtgaggttagacg

SEQ ID NO: 250009 - DNA, 20 bp, Artificial
  CRISPR gRNA sequence
ctagtgaggttagacgcctt

SEQ ID NO: 250010 - DNA, 20 bp, Artificial
  CRISPR gRNA sequence
gtgaggttagacgccttttc

SEQ ID NO: 250011 - DNA, 20 bp, Artificial
  CRISPR gRNA sequence
gacgccttttcatgttattt

SEQ ID NO: 250012 - DNA, 20 bp, Artificial
  CRISPR gRNA sequence
ttcatgttattttggctatt

SEQ ID NO: 250013 - DNA, 20 bp, Artificial
  CRISPR gRNA sequence
tcatgttattttggctattt

SEQ ID NO: 250014 - DNA, 20 bp, Artificial
  CRISPR gRNA sequence
catgttattttggctatttg

SEQ ID NO: 250015 - DNA, 20 bp, Artificial
  CRISPR gRNA sequence
atgttattttggctatttgg

SEQ ID NO: 250016 - DNA, 20 bp, Artificial
  CRISPR gRNA sequence
ttttggctatttggatttcc

SEQ ID NO: 250017 - DNA, 20 bp, Artificial
  CRISPR gRNA sequence
tggctatttggatttcctct

SEQ ID NO: 250018 - DNA, 20 bp, Artificial
  CRISPR gRNA sequence
ggctatttggatttcctctt

SEQ ID NO: 250019 - DNA, 20 bp, Artificial
  CRISPR gRNA sequence
gctatttggatttcctcttt

SEQ ID NO: 250020 - DNA, 20 bp, Artificial
  CRISPR gRNA sequence
tttggatttcctctttagtg

SEQ ID NO: 250021 - DNA, 20 bp, Artificial
  CRISPR gRNA sequence
ggatttcctctttagtgaag

SEQ ID NO: 250022 - DNA, 20 bp, Artificial
  CRISPR gRNA sequence
gatttcctctttagtgaagg

SEQ ID NO: 250023 - DNA, 20 bp, Artificial
  CRISPR gRNA sequence
cctctttagtgaagggcctg

SEQ ID NO: 250024 - DNA, 20 bp, Artificial
  CRISPR gRNA sequence
ctctttagtgaagggcctga

SEQ ID NO: 250025 - DNA, 20 bp, Artificial
  CRISPR gRNA sequence
tttagtgaagggcctgatca

SEQ ID NO: 250026 - DNA, 20 bp, Artificial
  CRISPR gRNA sequence
tagtgaagggcctgatcaag

SEQ ID NO: 250027 - DNA, 20 bp, Artificial
  CRISPR gRNA sequence
agtgaagggcctgatcaagt

SEQ ID NO: 250028 - DNA, 20 bp, Artificial
  CRISPR gRNA sequence
gtgaagggcctgatcaagtc

SEQ ID NO: 250029 - DNA, 20 bp, Artificial
  CRISPR gRNA sequence
atcaagtcttttgagtattt

SEQ ID NO: 250030 - DNA, 20 bp, Artificial
  CRISPR gRNA sequence
ttgagtattttctcatagga

SEQ ID NO: 250031 - DNA, 20 bp, Artificial
  CRISPR gRNA sequence
tgagtattttctcataggat

SEQ ID NO: 250032 - DNA, 20 bp, Artificial
  CRISPR gRNA sequence
gagtattttctcataggatt

SEQ ID NO: 250033 - DNA, 20 bp, Artificial
  CRISPR gRNA sequence
agtattttctcataggattg

SEQ ID NO: 250034 - DNA, 20 bp, Artificial
  CRISPR gRNA sequence
tctcataggattgtctgtcc

SEQ ID NO: 250035 - DNA, 20 bp, Artificial
  CRISPR gRNA sequence
ctcataggattgtctgtcct

SEQ ID NO: 250036 - DNA, 20 bp, Artificial
  CRISPR gRNA sequence
tcataggattgtctgtcctt

SEQ ID NO: 250037 - DNA, 20 bp, Artificial
  CRISPR gRNA sequence
ataggattgtctgtcctttt

SEQ ID NO: 250038 - DNA, 20 bp, Artificial
  CRISPR gRNA sequence
tctgtccttttcttactaac

SEQ ID NO: 250039 - DNA, 20 bp, Artificial
  CRISPR gRNA sequence
tccttttcttactaacgtat

SEQ ID NO: 250040 - DNA, 20 bp, Artificial
  CRISPR gRNA sequence
ttcttactaacgtataggaa

SEQ ID NO: 250041 - DNA, 20 bp, Artificial
  CRISPR gRNA sequence
tcttactaacgtataggaag

SEQ ID NO: 250042 - DNA, 20 bp, Artificial
  CRISPR gRNA sequence
cttactaacgtataggaagt

SEQ ID NO: 250043 - DNA, 20 bp, Artificial
  CRISPR gRNA sequence
ttactaacgtataggaagtt

SEQ ID NO: 250044 - DNA, 20 bp, Artificial
  CRISPR gRNA sequence
actaacgtataggaagtttt

SEQ ID NO: 250045 - DNA, 20 bp, Artificial
  CRISPR gRNA sequence
ctaacgtataggaagttttt

SEQ ID NO: 250046 - DNA, 20 bp, Artificial
  CRISPR gRNA sequence
acgtataggaagtttttagt

SEQ ID NO: 250047 - DNA, 20 bp, Artificial
  CRISPR gRNA sequence
ttagtctgctgttcatgagc

SEQ ID NO: 250048 - DNA, 20 bp, Artificial
  CRISPR gRNA sequence
tagtctgctgttcatgagct

SEQ ID NO: 250049 - DNA, 20 bp, Artificial
  CRISPR gRNA sequence
agtctgctgttcatgagctg

SEQ ID NO: 250050 - DNA, 20 bp, Artificial
  CRISPR gRNA sequence
gtctgctgttcatgagctgc

SEQ ID NO: 250051 - DNA, 20 bp, Artificial
  CRISPR gRNA sequence
ctgttcatgagctgcaaata

SEQ ID NO: 250052 - DNA, 20 bp, Artificial
  CRISPR gRNA sequence
ttcatgagctgcaaatatct

SEQ ID NO: 250053 - DNA, 20 bp, Artificial
  CRISPR gRNA sequence
atgagctgcaaatatctttt

SEQ ID NO: 250054 - DNA, 20 bp, Artificial
  CRISPR gRNA sequence
caaatatcttttcctattct

SEQ ID NO: 250055 - DNA, 20 bp, Artificial
  CRISPR gRNA sequence
ttcctattctgtggtttgct

SEQ ID NO: 250056 - DNA, 20 bp, Artificial
  CRISPR gRNA sequence
tcctattctgtggtttgctc

SEQ ID NO: 250057 - DNA, 20 bp, Artificial
  CRISPR gRNA sequence
cctattctgtggtttgctct

SEQ ID NO: 250058 - DNA, 20 bp, Artificial
  CRISPR gRNA sequence
ctattctgtggtttgctctt

SEQ ID NO: 250059 - DNA, 20 bp, Artificial
  CRISPR gRNA sequence
ttctgtggtttgctctttca

SEQ ID NO: 250060 - DNA, 20 bp, Artificial
  CRISPR gRNA sequence
tgtggtttgctctttcattc

SEQ ID NO: 250061 - DNA, 20 bp, Artificial
  CRISPR gRNA sequence
tggtttgctctttcattctt

SEQ ID NO: 250062 - DNA, 20 bp, Artificial
  CRISPR gRNA sequence
gctctttcattctttttttg

SEQ ID NO: 250063 - DNA, 20 bp, Artificial
  CRISPR gRNA sequence
ctctttcattctttttttga

SEQ ID NO: 250064 - DNA, 20 bp, Artificial
  CRISPR gRNA sequence
tttcattctttttttgaggt

SEQ ID NO: 250065 - DNA, 20 bp, Artificial
  CRISPR gRNA sequence
tcattctttttttgaggtct

SEQ ID NO: 250066 - DNA, 20 bp, Artificial
  CRISPR gRNA sequence
cattctttttttgaggtcta

SEQ ID NO: 250067 - DNA, 20 bp, Artificial
  CRISPR gRNA sequence
attctttttttgaggtctac

SEQ ID NO: 250068 - DNA, 20 bp, Artificial
  CRISPR gRNA sequence
tttttttgaggtctacacct

SEQ ID NO: 250069 - DNA, 20 bp, Artificial
  CRISPR gRNA sequence
tttttgaggtctacacctcc

SEQ ID NO: 250070 - DNA, 20 bp, Artificial
  CRISPR gRNA sequence
ttttgaggtctacacctcca

SEQ ID NO: 250071 - DNA, 20 bp, Artificial
  CRISPR gRNA sequence
tttgaggtctacacctccag

SEQ ID NO: 250072 - DNA, 20 bp, Artificial
  CRISPR gRNA sequence
ttgaggtctacacctccagt

SEQ ID NO: 250073 - DNA, 20 bp, Artificial
  CRISPR gRNA sequence
tgaggtctacacctccagtt

SEQ ID NO: 250074 - DNA, 20 bp, Artificial
  CRISPR gRNA sequence
gaggtctacacctccagttt

SEQ ID NO: 250075 - DNA, 20 bp, Artificial
  CRISPR gRNA sequence
aggtctacacctccagttta

SEQ ID NO: 250076 - DNA, 20 bp, Artificial
  CRISPR gRNA sequence
cacctccagtttaaacctct

SEQ ID NO: 250077 - DNA, 20 bp, Artificial
  CRISPR gRNA sequence
cagtttaaacctctgcgttc

SEQ ID NO: 250078 - DNA, 20 bp, Artificial
  CRISPR gRNA sequence
aaacctctgcgttctcactt

SEQ ID NO: 250079 - DNA, 20 bp, Artificial
  CRISPR gRNA sequence
aacctctgcgttctcactta

SEQ ID NO: 250080 - DNA, 20 bp, Artificial
  CRISPR gRNA sequence
tgcgttctcacttaaacctg

SEQ ID NO: 250081 - DNA, 20 bp, Artificial
  CRISPR gRNA sequence
cgttctcacttaaacctgat

SEQ ID NO: 250082 - DNA, 20 bp, Artificial
  CRISPR gRNA sequence
tcacttaaacctgatttcag

SEQ ID NO: 250083 - DNA, 20 bp, Artificial
  CRISPR gRNA sequence
acttaaacctgatttcagtt

SEQ ID NO: 250084 - DNA, 20 bp, Artificial
  CRISPR gRNA sequence
aaacctgatttcagttttgt

SEQ ID NO: 250085 - DNA, 20 bp, Artificial
  CRISPR gRNA sequence
aacctgatttcagttttgtc

SEQ ID NO: 250086 - DNA, 20 bp, Artificial
  CRISPR gRNA sequence
atttcagttttgtcttttgt

SEQ ID NO: 250087 - DNA, 20 bp, Artificial
  CRISPR gRNA sequence
cagttttgtcttttgttttt

SEQ ID NO: 250088 - DNA, 20 bp, Artificial
  CRISPR gRNA sequence
agttttgtcttttgtttttt

SEQ ID NO: 250089 - DNA, 20 bp, Artificial
  CRISPR gRNA sequence
tgtcttttgtttttttgaga

SEQ ID NO: 250090 - DNA, 20 bp, Artificial
  CRISPR gRNA sequence
gtcttttgtttttttgagac

SEQ ID NO: 250091 - DNA, 20 bp, Artificial
  CRISPR gRNA sequence
tcttttgtttttttgagaca

SEQ ID NO: 250092 - DNA, 20 bp, Artificial
  CRISPR gRNA sequence
ttgtttttttgagacagagt

SEQ ID NO: 250093 - DNA, 20 bp, Artificial
  CRISPR gRNA sequence
tgtttttttgagacagagtt

SEQ ID NO: 250094 - DNA, 20 bp, Artificial
  CRISPR gRNA sequence
gtttttttgagacagagttt

SEQ ID NO: 250095 - DNA, 20 bp, Artificial
  CRISPR gRNA sequence
tttttttgagacagagtttc

SEQ ID NO: 250096 - DNA, 20 bp, Artificial
  CRISPR gRNA sequence
ttttgagacagagtttcact

SEQ ID NO: 250097 - DNA, 20 bp, Artificial
  CRISPR gRNA sequence
tttgagacagagtttcactg

SEQ ID NO: 250098 - DNA, 20 bp, Artificial
  CRISPR gRNA sequence
ttgagacagagtttcactgt

SEQ ID NO: 250099 - DNA, 20 bp, Artificial
  CRISPR gRNA sequence
tgagacagagtttcactgtg

SEQ ID NO: 250100 - DNA, 20 bp, Artificial
  CRISPR gRNA sequence
gagacagagtttcactgtgt

SEQ ID NO: 250101 - DNA, 20 bp, Artificial
  CRISPR gRNA sequence
agacagagtttcactgtgtc

SEQ ID NO: 250102 - DNA, 20 bp, Artificial
  CRISPR gRNA sequence
cactgtgtcacccaggctga

SEQ ID NO: 250103 - DNA, 20 bp, Artificial
  CRISPR gRNA sequence
actgtgtcacccaggctgaa

SEQ ID NO: 250104 - DNA, 20 bp, Artificial
  CRISPR gRNA sequence
tgtcacccaggctgaagtgc

SEQ ID NO: 250105 - DNA, 20 bp, Artificial
  CRISPR gRNA sequence
aagtgcaatggtgcgatcac

SEQ ID NO: 250106 - DNA, 20 bp, Artificial
  CRISPR gRNA sequence
actgtagcctcgaactccag

SEQ ID NO: 250107 - DNA, 20 bp, Artificial
  CRISPR gRNA sequence
tagcctcgaactccagagct

SEQ ID NO: 250108 - DNA, 20 bp, Artificial
  CRISPR gRNA sequence
gaactccagagctcgagcaa

SEQ ID NO: 250109 - DNA, 20 bp, Artificial
  CRISPR gRNA sequence
cagagctcgagcaatcctcc

SEQ ID NO: 250110 - DNA, 20 bp, Artificial
  CRISPR gRNA sequence
gagcaatcctcctgcctcag

SEQ ID NO: 250111 - DNA, 20 bp, Artificial
  CRISPR gRNA sequence
ctgcctcagcctactaaata

SEQ ID NO: 250112 - DNA, 20 bp, Artificial
  CRISPR gRNA sequence
cctcagcctactaaatagct

SEQ ID NO: 250113 - DNA, 20 bp, Artificial
  CRISPR gRNA sequence
agcctactaaatagctggga

SEQ ID NO: 250114 - DNA, 20 bp, Artificial
  CRISPR gRNA sequence
ctaaatagctgggactatag

SEQ ID NO: 250115 - DNA, 20 bp, Artificial
  CRISPR gRNA sequence
aatagctgggactataggtg

SEQ ID NO: 250116 - DNA, 20 bp, Artificial
  CRISPR gRNA sequence
ggactataggtgcataccac

SEQ ID NO: 250117 - DNA, 20 bp, Artificial
  CRISPR gRNA sequence
taggtgcataccaccacact

SEQ ID NO: 250118 - DNA, 20 bp, Artificial
  CRISPR gRNA sequence
agctaatttttaattgattt

SEQ ID NO: 250119 - DNA, 20 bp, Artificial
  CRISPR gRNA sequence
atttttaattgatttttagt

SEQ ID NO: 250120 - DNA, 20 bp, Artificial
  CRISPR gRNA sequence
ttaattgatttttagtgttt

SEQ ID NO: 250121 - DNA, 20 bp, Artificial
  CRISPR gRNA sequence
taattgatttttagtgtttt

SEQ ID NO: 250122 - DNA, 20 bp, Artificial
  CRISPR gRNA sequence
aattgatttttagtgttttt

SEQ ID NO: 250123 - DNA, 20 bp, Artificial
  CRISPR gRNA sequence
attgatttttagtgtttttg

SEQ ID NO: 250124 - DNA, 20 bp, Artificial
  CRISPR gRNA sequence
atttttagtgtttttgtaga

SEQ ID NO: 250125 - DNA, 20 bp, Artificial
  CRISPR gRNA sequence
ttagtgtttttgtagagact

SEQ ID NO: 250126 - DNA, 20 bp, Artificial
  CRISPR gRNA sequence
tagtgtttttgtagagactg

SEQ ID NO: 250127 - DNA, 20 bp, Artificial
  CRISPR gRNA sequence
agtgtttttgtagagactgg

SEQ ID NO: 250128 - DNA, 20 bp, Artificial
  CRISPR gRNA sequence
gtgtttttgtagagactggg

SEQ ID NO: 250129 - DNA, 20 bp, Artificial
  CRISPR gRNA sequence
ttgtagagactgggattcac

SEQ ID NO: 250130 - DNA, 20 bp, Artificial
  CRISPR gRNA sequence
tgtagagactgggattcacg

SEQ ID NO: 250131 - DNA, 20 bp, Artificial
  CRISPR gRNA sequence
gtagagactgggattcacgg

SEQ ID NO: 250132 - DNA, 20 bp, Artificial
  CRISPR gRNA sequence
tagagactgggattcacggt

SEQ ID NO: 250133 - DNA, 20 bp, Artificial
  CRISPR gRNA sequence
ggattcacggtgttgtccag

SEQ ID NO: 250134 - DNA, 20 bp, Artificial
  CRISPR gRNA sequence
acggtgttgtccaggccagt

SEQ ID NO: 250135 - DNA, 20 bp, Artificial
  CRISPR gRNA sequence
tccaggccagtcttaaactc

SEQ ID NO: 250136 - DNA, 20 bp, Artificial
  CRISPR gRNA sequence
aaactcctgggctcaagcga

SEQ ID NO: 250137 - DNA, 20 bp, Artificial
  CRISPR gRNA sequence
aactcctgggctcaagcgat

SEQ ID NO: 250138 - DNA, 20 bp, Artificial
  CRISPR gRNA sequence
ctgggctcaagcgatcctcc

SEQ ID NO: 250139 - DNA, 20 bp, Artificial
  CRISPR gRNA sequence
ggctcaagcgatcctcccac

SEQ ID NO: 250140 - DNA, 20 bp, Artificial
  CRISPR gRNA sequence
aagcgatcctcccacctcgg

SEQ ID NO: 250141 - DNA, 20 bp, Artificial
  CRISPR gRNA sequence
ccacctcggtttcccaaagt

SEQ ID NO: 250142 - DNA, 20 bp, Artificial
  CRISPR gRNA sequence
ggtttcccaaagtgctggac

SEQ ID NO: 250143 - DNA, 20 bp, Artificial
  CRISPR gRNA sequence
cccaaagtgctggacttaat

SEQ ID NO: 250144 - DNA, 20 bp, Artificial
  CRISPR gRNA sequence
ccaaagtgctggacttaatc

SEQ ID NO: 250145 - DNA, 20 bp, Artificial
  CRISPR gRNA sequence
gacttaatcctgatttaaag

SEQ ID NO: 250146 - DNA, 20 bp, Artificial
  CRISPR gRNA sequence
aatcctgatttaaaggagta

SEQ ID NO: 250147 - DNA, 20 bp, Artificial
  CRISPR gRNA sequence
atcctgatttaaaggagtat

SEQ ID NO: 250148 - DNA, 20 bp, Artificial
  CRISPR gRNA sequence
atttaaaggagtatctctgc

SEQ ID NO: 250149 - DNA, 20 bp, Artificial
  CRISPR gRNA sequence
aaaggagtatctctgcaaca

SEQ ID NO: 250150 - DNA, 20 bp, Artificial
  CRISPR gRNA sequence
aaggagtatctctgcaacaa

SEQ ID NO: 250151 - DNA, 20 bp, Artificial
  CRISPR gRNA sequence
tgcaacaaagttccatccac

SEQ ID NO: 250152 - DNA, 20 bp, Artificial
  CRISPR gRNA sequence
caacaaagttccatccacac

SEQ ID NO: 250153 - DNA, 20 bp, Artificial
  CRISPR gRNA sequence
catccacaccccagactgca

SEQ ID NO: 250154 - DNA, 20 bp, Artificial
  CRISPR gRNA sequence
caacaaagttcgttataaaa

SEQ ID NO: 250155 - DNA, 20 bp, Artificial
  CRISPR gRNA sequence
gttataaaatgcttttcaaa

SEQ ID NO: 250156 - DNA, 20 bp, Artificial
  CRISPR gRNA sequence
taaaatgcttttcaaaagta

SEQ ID NO: 250157 - DNA, 20 bp, Artificial
  CRISPR gRNA sequence
ttcaaaagtatttatgagta

SEQ ID NO: 250158 - DNA, 20 bp, Artificial
  CRISPR gRNA sequence
tcaaaagtatttatgagtaa

SEQ ID NO: 250159 - DNA, 20 bp, Artificial
  CRISPR gRNA sequence
caaaagtatttatgagtaat

SEQ ID NO: 250160 - DNA, 20 bp, Artificial
  CRISPR gRNA sequence
aaaagtatttatgagtaatt

SEQ ID NO: 250161 - DNA, 20 bp, Artificial
  CRISPR gRNA sequence
atgagtaattagtgagtttc

SEQ ID NO: 250162 - DNA, 20 bp, Artificial
  CRISPR gRNA sequence
tgagtaattagtgagtttca

SEQ ID NO: 250163 - DNA, 20 bp, Artificial
  CRISPR gRNA sequence
gtgagtttcaatggaactgt

SEQ ID NO: 250164 - DNA, 20 bp, Artificial
  CRISPR gRNA sequence
caatggaactgtaatccatt

SEQ ID NO: 250165 - DNA, 20 bp, Artificial
  CRISPR gRNA sequence
aatggaactgtaatccattt

SEQ ID NO: 250166 - DNA, 20 bp, Artificial
  CRISPR gRNA sequence
taatccattttttaaaagtt

SEQ ID NO: 250167 - DNA, 20 bp, Artificial
  CRISPR gRNA sequence
tttaaaagtttttaggacac

SEQ ID NO: 250168 - DNA, 20 bp, Artificial
  CRISPR gRNA sequence
ttaaaagtttttaggacact

SEQ ID NO: 250169 - DNA, 20 bp, Artificial
  CRISPR gRNA sequence
taaaagtttttaggacactc

SEQ ID NO: 250170 - DNA, 20 bp, Artificial
  CRISPR gRNA sequence
aaaagtttttaggacactcc

SEQ ID NO: 250171 - DNA, 20 bp, Artificial
  CRISPR gRNA sequence
aaagtttttaggacactccc

SEQ ID NO: 250172 - DNA, 20 bp, Artificial
  CRISPR gRNA sequence
ttaggacactccctggtagt

SEQ ID NO: 250173 - DNA, 20 bp, Artificial
  CRISPR gRNA sequence
taggacactccctggtagtc

SEQ ID NO: 250174 - DNA, 20 bp, Artificial
  CRISPR gRNA sequence
aggacactccctggtagtct

SEQ ID NO: 250175 - DNA, 20 bp, Artificial
  CRISPR gRNA sequence
ggacactccctggtagtcta

SEQ ID NO: 250176 - DNA, 20 bp, Artificial
  CRISPR gRNA sequence
cctggtagtctagtggttag

SEQ ID NO: 250177 - DNA, 20 bp, Artificial
  CRISPR gRNA sequence
gtagtctagtggttaggatt

SEQ ID NO: 250178 - DNA, 20 bp, Artificial
  CRISPR gRNA sequence
gtggttaggattccgcgctc

SEQ ID NO: 250179 - DNA, 20 bp, Artificial
  CRISPR gRNA sequence
ggattccgcgctcgccatca

SEQ ID NO: 250180 - DNA, 20 bp, Artificial
  CRISPR gRNA sequence
cgcgctcgccatcacgaccc

SEQ ID NO: 250181 - DNA, 20 bp, Artificial
  CRISPR gRNA sequence
gccatcacgacccgggttcg

SEQ ID NO: 250182 - DNA, 20 bp, Artificial
  CRISPR gRNA sequence
gattcctggtcagggaagcc

SEQ ID NO: 250183 - DNA, 20 bp, Artificial
  CRISPR gRNA sequence
ctggtcagggaagccttcct

SEQ ID NO: 250184 - DNA, 20 bp, Artificial
  CRISPR gRNA sequence
gtcagggaagccttccttct

SEQ ID NO: 250185 - DNA, 20 bp, Artificial
  CRISPR gRNA sequence
ccttctggctgggcgctgtg

SEQ ID NO: 250186 - DNA, 20 bp, Artificial
  CRISPR gRNA sequence
cttctggctgggcgctgtgg

SEQ ID NO: 250187 - DNA, 20 bp, Artificial
  CRISPR gRNA sequence
ctggctgggcgctgtggctc

SEQ ID NO: 250188 - DNA, 20 bp, Artificial
  CRISPR gRNA sequence
tggctgggcgctgtggctca

SEQ ID NO: 250189 - DNA, 20 bp, Artificial
  CRISPR gRNA sequence
gctgggcgctgtggctcacg

SEQ ID NO: 250190 - DNA, 20 bp, Artificial
  CRISPR gRNA sequence
ggcgctgtggctcacgcctg

SEQ ID NO: 250191 - DNA, 20 bp, Artificial
  CRISPR gRNA sequence
tggctcacgcctgtaatcct

SEQ ID NO: 250192 - DNA, 20 bp, Artificial
  CRISPR gRNA sequence
acgcctgtaatcctagcatt

SEQ ID NO: 250193 - DNA, 20 bp, Artificial
  CRISPR gRNA sequence
taatcctagcattctggggg

SEQ ID NO: 250194 - DNA, 20 bp, Artificial
  CRISPR gRNA sequence
gcattctggggggctgaggc

SEQ ID NO: 250195 - DNA, 20 bp, Artificial
  CRISPR gRNA sequence
tggggggctgaggcgggcag

SEQ ID NO: 250196 - DNA, 20 bp, Artificial
  CRISPR gRNA sequence
gggggctgaggcgggcagat

SEQ ID NO: 250197 - DNA, 20 bp, Artificial
  CRISPR gRNA sequence
aggcgggcagatcacctgag

SEQ ID NO: 250198 - DNA, 20 bp, Artificial
  CRISPR gRNA sequence
aggttaggagttcaacacca

SEQ ID NO: 250199 - DNA, 20 bp, Artificial
  CRISPR gRNA sequence
ggagttcaacaccagcctgg

SEQ ID NO: 250200 - DNA, 20 bp, Artificial
  CRISPR gRNA sequence
aacaccagcctggccatggt

SEQ ID NO: 250201 - DNA, 20 bp, Artificial
  CRISPR gRNA sequence
gccatggtgaaaccccgtct

SEQ ID NO: 250202 - DNA, 20 bp, Artificial
  CRISPR gRNA sequence
tactaaaaatacaaaaaatt

SEQ ID NO: 250203 - DNA, 20 bp, Artificial
  CRISPR gRNA sequence
ctaaaaatacaaaaaattag

SEQ ID NO: 250204 - DNA, 20 bp, Artificial
  CRISPR gRNA sequence
aaaatacaaaaaattagcca

SEQ ID NO: 250205 - DNA, 20 bp, Artificial
  CRISPR gRNA sequence
gccaggcgtggtggtgcatg

SEQ ID NO: 250206 - DNA, 20 bp, Artificial
  CRISPR gRNA sequence
taatcccagctactcaggag

SEQ ID NO: 250207 - DNA, 20 bp, Artificial
  CRISPR gRNA sequence
ctcaggaggctgagacagga

SEQ ID NO: 250208 - DNA, 20 bp, Artificial
  CRISPR gRNA sequence
aggaggctgagacaggagaa

SEQ ID NO: 250209 - DNA, 20 bp, Artificial
  CRISPR gRNA sequence
agacaggagaatcgcttgaa

SEQ ID NO: 250210 - DNA, 20 bp, Artificial
  CRISPR gRNA sequence
gaacccgggaggtggaggtt

SEQ ID NO: 250211 - DNA, 20 bp, Artificial
  CRISPR gRNA sequence
aacccgggaggtggaggttg

SEQ ID NO: 250212 - DNA, 20 bp, Artificial
  CRISPR gRNA sequence
cagtgaactgagatcgtgcc

SEQ ID NO: 250213 - DNA, 20 bp, Artificial
  CRISPR gRNA sequence
agatcgtgccattgcactcc

SEQ ID NO: 250214 - DNA, 20 bp, Artificial
  CRISPR gRNA sequence
cactccagcctgggcaacaa

SEQ ID NO: 250215 - DNA, 20 bp, Artificial
  CRISPR gRNA sequence
cagcctgggcaacaaaagcg

SEQ ID NO: 250216 - DNA, 20 bp, Artificial
  CRISPR gRNA sequence
ggcaacaaaagcgaaactcc

SEQ ID NO: 250217 - DNA, 20 bp, Artificial
  CRISPR gRNA sequence
cgtctcaaaaaaaaaaaaaa

SEQ ID NO: 250218 - DNA, 20 bp, Artificial
  CRISPR gRNA sequence
aaaaaaaaaaaaaaaaaaag

SEQ ID NO: 250219 - DNA, 20 bp, Artificial
  CRISPR gRNA sequence
taggtcgttcaaaagaactt

SEQ ID NO: 250220 - DNA, 20 bp, Artificial
  CRISPR gRNA sequence
aggtcgttcaaaagaacttt

SEQ ID NO: 250221 - DNA, 20 bp, Artificial
  CRISPR gRNA sequence
ggtcgttcaaaagaactttc

SEQ ID NO: 250222 - DNA, 20 bp, Artificial
  CRISPR gRNA sequence
aaaagaactttcaattttga

SEQ ID NO: 250223 - DNA, 20 bp, Artificial
  CRISPR gRNA sequence
tcaattttgacgtaattata

SEQ ID NO: 250224 - DNA, 20 bp, Artificial
  CRISPR gRNA sequence
caattttgacgtaattatag

SEQ ID NO: 250225 - DNA, 20 bp, Artificial
  CRISPR gRNA sequence
aattttgacgtaattataga

SEQ ID NO: 250226 - DNA, 20 bp, Artificial
  CRISPR gRNA sequence
tgacgtaattatagattcac

SEQ ID NO: 250227 - DNA, 20 bp, Artificial
  CRISPR gRNA sequence
gacgtaattatagattcaca

SEQ ID NO: 250228 - DNA, 20 bp, Artificial
  CRISPR gRNA sequence
acgtaattatagattcacag

SEQ ID NO: 250229 - DNA, 20 bp, Artificial
  CRISPR gRNA sequence
tagattcacaggaatttgcc

SEQ ID NO: 250230 - DNA, 20 bp, Artificial
  CRISPR gRNA sequence
acaggaatttgccaagacag

SEQ ID NO: 250231 - DNA, 20 bp, Artificial
  CRISPR gRNA sequence
gccaagacaggaacatctct

SEQ ID NO: 250232 - DNA, 20 bp, Artificial
  CRISPR gRNA sequence
ccaagacaggaacatctctc

SEQ ID NO: 250233 - DNA, 20 bp, Artificial
  CRISPR gRNA sequence
tcatgcggtttctgggttcc

SEQ ID NO: 250234 - DNA, 20 bp, Artificial
  CRISPR gRNA sequence
atgcggtttctgggttccat

SEQ ID NO: 250235 - DNA, 20 bp, Artificial
  CRISPR gRNA sequence
ctgggttccattctccagta

SEQ ID NO: 250236 - DNA, 20 bp, Artificial
  CRISPR gRNA sequence
tgggttccattctccagtac

SEQ ID NO: 250237 - DNA, 20 bp, Artificial
  CRISPR gRNA sequence
ggttccattctccagtacaa

SEQ ID NO: 250238 - DNA, 20 bp, Artificial
  CRISPR gRNA sequence
cattctccagtacaatggca

SEQ ID NO: 250239 - DNA, 20 bp, Artificial
  CRISPR gRNA sequence
tccagtacaatggcaaagca

SEQ ID NO: 250240 - DNA, 20 bp, Artificial
  CRISPR gRNA sequence
cagtacaatggcaaagcagg

SEQ ID NO: 250241 - DNA, 20 bp, Artificial
  CRISPR gRNA sequence
acattggcacagtgtgcgtg

SEQ ID NO: 250242 - DNA, 20 bp, Artificial
  CRISPR gRNA sequence
gcacagtgtgcgtgtgtagt

SEQ ID NO: 250243 - DNA, 20 bp, Artificial
  CRISPR gRNA sequence
tttgtccctttatcacacat

SEQ ID NO: 250244 - DNA, 20 bp, Artificial
  CRISPR gRNA sequence
gtccctttatcacacatgtg

SEQ ID NO: 250245 - DNA, 20 bp, Artificial
  CRISPR gRNA sequence
tccctttatcacacatgtgg

SEQ ID NO: 250246 - DNA, 20 bp, Artificial
  CRISPR gRNA sequence
tatcacacatgtggagttgt

SEQ ID NO: 250247 - DNA, 20 bp, Artificial
  CRISPR gRNA sequence
atcacacatgtggagttgta

SEQ ID NO: 250248 - DNA, 20 bp, Artificial
  CRISPR gRNA sequence
tcacacatgtggagttgtat

SEQ ID NO: 250249 - DNA, 20 bp, Artificial
  CRISPR gRNA sequence
tataacaaccagcacaataa

SEQ ID NO: 250250 - DNA, 20 bp, Artificial
  CRISPR gRNA sequence
tccatcaccacagagatctc

SEQ ID NO: 250251 - DNA, 20 bp, Artificial
  CRISPR gRNA sequence
cttccactattcctttctag

SEQ ID NO: 250252 - DNA, 20 bp, Artificial
  CRISPR gRNA sequence
ccactattcctttctagtta

SEQ ID NO: 250253 - DNA, 20 bp, Artificial
  CRISPR gRNA sequence
cactattcctttctagttag

SEQ ID NO: 250254 - DNA, 20 bp, Artificial
  CRISPR gRNA sequence
ttcctttctagttaggtcct

SEQ ID NO: 250255 - DNA, 20 bp, Artificial
  CRISPR gRNA sequence
ctttctagttaggtcctcta

SEQ ID NO: 250256 - DNA, 20 bp, Artificial
  CRISPR gRNA sequence
tctagttaggtcctctacct

SEQ ID NO: 250257 - DNA, 20 bp, Artificial
  CRISPR gRNA sequence
ctagttaggtcctctacctc

SEQ ID NO: 250258 - DNA, 20 bp, Artificial
  CRISPR gRNA sequence
tagttaggtcctctacctct

SEQ ID NO: 250259 - DNA, 20 bp, Artificial
  CRISPR gRNA sequence
gttaggtcctctacctctcc

SEQ ID NO: 250260 - DNA, 20 bp, Artificial
  CRISPR gRNA sequence
ggtcctctacctctccccac

SEQ ID NO: 250261 - DNA, 20 bp, Artificial
  CRISPR gRNA sequence
tacctctccccaccatcccc

SEQ ID NO: 250262 - DNA, 20 bp, Artificial
  CRISPR gRNA sequence
cctctccccaccatcccctg

SEQ ID NO: 250263 - DNA, 20 bp, Artificial
  CRISPR gRNA sequence
tccccaccatcccctggcaa

SEQ ID NO: 250264 - DNA, 20 bp, Artificial
  CRISPR gRNA sequence
cccaccatcccctggcaacc

SEQ ID NO: 250265 - DNA, 20 bp, Artificial
  CRISPR gRNA sequence
gcaaccacttatctgtcttt

SEQ ID NO: 250266 - DNA, 20 bp, Artificial
  CRISPR gRNA sequence
atctgtctttcatctctata

SEQ ID NO: 250267 - DNA, 20 bp, Artificial
  CRISPR gRNA sequence
tctgtctttcatctctatac

SEQ ID NO: 250268 - DNA, 20 bp, Artificial
  CRISPR gRNA sequence
tctttcatctctatactttt

SEQ ID NO: 250269 - DNA, 20 bp, Artificial
  CRISPR gRNA sequence
tcatctctatacttttgtta

SEQ ID NO: 250270 - DNA, 20 bp, Artificial
  CRISPR gRNA sequence
catctctatacttttgttat

SEQ ID NO: 250271 - DNA, 20 bp, Artificial
  CRISPR gRNA sequence
atctctatacttttgttatt

SEQ ID NO: 250272 - DNA, 20 bp, Artificial
  CRISPR gRNA sequence
tatacttttgttatttaagg

SEQ ID NO: 250273 - DNA, 20 bp, Artificial
  CRISPR gRNA sequence
tacttttgttatttaaggaa

SEQ ID NO: 250274 - DNA, 20 bp, Artificial
  CRISPR gRNA sequence
ttgttatttaaggaatatgg

SEQ ID NO: 250275 - DNA, 20 bp, Artificial
  CRISPR gRNA sequence
tgttatttaaggaatatggt

SEQ ID NO: 250276 - DNA, 20 bp, Artificial
  CRISPR gRNA sequence
gttatttaaggaatatggta

SEQ ID NO: 250277 - DNA, 20 bp, Artificial
  CRISPR gRNA sequence
ttatttaaggaatatggtat

SEQ ID NO: 250278 - DNA, 20 bp, Artificial
  CRISPR gRNA sequence
tttaaggaatatggtataaa

SEQ ID NO: 250279 - DNA, 20 bp, Artificial
  CRISPR gRNA sequence
aaggaatatggtataaatag

SEQ ID NO: 250280 - DNA, 20 bp, Artificial
  CRISPR gRNA sequence
aggaatatggtataaataga

SEQ ID NO: 250281 - DNA, 20 bp, Artificial
  CRISPR gRNA sequence
aatcatagatagagagagcc

SEQ ID NO: 250282 - DNA, 20 bp, Artificial
  CRISPR gRNA sequence
tctaaaagattatatttttt

SEQ ID NO: 250283 - DNA, 20 bp, Artificial
  CRISPR gRNA sequence
taaaagattatattttttca

SEQ ID NO: 250284 - DNA, 20 bp, Artificial
  CRISPR gRNA sequence
aaagattatattttttcagg

SEQ ID NO: 250285 - DNA, 20 bp, Artificial
  CRISPR gRNA sequence
tattttttcaggagtagcat

SEQ ID NO: 250286 - DNA, 20 bp, Artificial
  CRISPR gRNA sequence
tttcaggagtagcattgcag

SEQ ID NO: 250287 - DNA, 20 bp, Artificial
  CRISPR gRNA sequence
ttcaggagtagcattgcagt

SEQ ID NO: 250288 - DNA, 20 bp, Artificial
  CRISPR gRNA sequence
tcaggagtagcattgcagtg

SEQ ID NO: 250289 - DNA, 20 bp, Artificial
  CRISPR gRNA sequence
caggagtagcattgcagtgg

SEQ ID NO: 250290 - DNA, 20 bp, Artificial
  CRISPR gRNA sequence
aggagtagcattgcagtggg

SEQ ID NO: 250291 - DNA, 20 bp, Artificial
  CRISPR gRNA sequence
cagtgggaatacggtgggtg

SEQ ID NO: 250292 - DNA, 20 bp, Artificial
  CRISPR gRNA sequence
agggatgtaaaggtgatgcg

SEQ ID NO: 250293 - DNA, 20 bp, Artificial
  CRISPR gRNA sequence
ttaaaagaaaaaatgagggg

SEQ ID NO: 250294 - DNA, 20 bp, Artificial
  CRISPR gRNA sequence
taaaagaaaaaatgaggggc

SEQ ID NO: 250295 - DNA, 20 bp, Artificial
  CRISPR gRNA sequence
aaaagaaaaaatgaggggcg

SEQ ID NO: 250296 - DNA, 20 bp, Artificial
  CRISPR gRNA sequence
aaagaaaaaatgaggggcgg

SEQ ID NO: 250297 - DNA, 20 bp, Artificial
  CRISPR gRNA sequence
atgcctataatcccagcgct

SEQ ID NO: 250298 - DNA, 20 bp, Artificial
  CRISPR gRNA sequence
taatcccagcgctttgggag

SEQ ID NO: 250299 - DNA, 20 bp, Artificial
  CRISPR gRNA sequence
tgggaggctgaggcggatgg

SEQ ID NO: 250300 - DNA, 20 bp, Artificial
  CRISPR gRNA sequence
gggaggctgaggcggatgga

SEQ ID NO: 250301 - DNA, 20 bp, Artificial
  CRISPR gRNA sequence
ggaggctgaggcggatggat

SEQ ID NO: 250302 - DNA, 20 bp, Artificial
  CRISPR gRNA sequence
aggcggatggatcacctgag

SEQ ID NO: 250303 - DNA, 20 bp, Artificial
  CRISPR gRNA sequence
aggtcaggagttcgagacca

SEQ ID NO: 250304 - DNA, 20 bp, Artificial
  CRISPR gRNA sequence
gagaccagcctggccaacat

SEQ ID NO: 250305 - DNA, 20 bp, Artificial
  CRISPR gRNA sequence
gccaacatggtgaaacccca

SEQ ID NO: 250306 - DNA, 20 bp, Artificial
  CRISPR gRNA sequence
tactaaaaatacaaaaagtt

SEQ ID NO: 250307 - DNA, 20 bp, Artificial
  CRISPR gRNA sequence
ctaaaaatacaaaaagttag

SEQ ID NO: 250308 - DNA, 20 bp, Artificial
  CRISPR gRNA sequence
aaaatacaaaaagttagccc

SEQ ID NO: 250309 - DNA, 20 bp, Artificial
  CRISPR gRNA sequence
gccctgcatggtggcacgtg

SEQ ID NO: 250310 - DNA, 20 bp, Artificial
  CRISPR gRNA sequence
catggtggcacgtgcctgta

SEQ ID NO: 250311 - DNA, 20 bp, Artificial
  CRISPR gRNA sequence
taatcccagatacttgggag

SEQ ID NO: 250312 - DNA, 20 bp, Artificial
  CRISPR gRNA sequence
gggaggctgaggcacaagaa

SEQ ID NO: 250313 - DNA, 20 bp, Artificial
  CRISPR gRNA sequence
ggaggctgaggcacaagaat

SEQ ID NO: 250314 - DNA, 20 bp, Artificial
  CRISPR gRNA sequence
aggcacaagaattacttgaa

SEQ ID NO: 250315 - DNA, 20 bp, Artificial
  CRISPR gRNA sequence
cttgaacctgggaggcggag

SEQ ID NO: 250316 - DNA, 20 bp, Artificial
  CRISPR gRNA sequence
gaacctgggaggcggaggtt

SEQ ID NO: 250317 - DNA, 20 bp, Artificial
  CRISPR gRNA sequence
aacctgggaggcggaggttg

SEQ ID NO: 250318 - DNA, 20 bp, Artificial
  CRISPR gRNA sequence
ggaggcggaggttgcagtga

SEQ ID NO: 250319 - DNA, 20 bp, Artificial
  CRISPR gRNA sequence
cagtgagctgatatcgcatc

SEQ ID NO: 250320 - DNA, 20 bp, Artificial
  CRISPR gRNA sequence
atatcgcatcctgcacttca

SEQ ID NO: 250321 - DNA, 20 bp, Artificial
  CRISPR gRNA sequence
cacttcactccagcctgggc

SEQ ID NO: 250322 - DNA, 20 bp, Artificial
  CRISPR gRNA sequence
cactccagcctgggcgacag

SEQ ID NO: 250323 - DNA, 20 bp, Artificial
  CRISPR gRNA sequence
actccagcctgggcgacaga

SEQ ID NO: 250324 - DNA, 20 bp, Artificial
  CRISPR gRNA sequence
cagcctgggcgacagagcaa

SEQ ID NO: 250325 - DNA, 20 bp, Artificial
  CRISPR gRNA sequence
ggcgacagagcaagactctg

SEQ ID NO: 250326 - DNA, 20 bp, Artificial
  CRISPR gRNA sequence
tgtctcaaaaaaaaaaaaaa

SEQ ID NO: 250327 - DNA, 20 bp, Artificial
  CRISPR gRNA sequence
tctcaaaaaaaaaaaaaaaa

SEQ ID NO: 250328 - DNA, 20 bp, Artificial
  CRISPR gRNA sequence
aaaaaaaaaaaaaaaaaaaa

SEQ ID NO: 250329 - DNA, 20 bp, Artificial
  CRISPR gRNA sequence
aggagggttatgtaagttat

SEQ ID NO: 250330 - DNA, 20 bp, Artificial
  CRISPR gRNA sequence
tgtaagttattttgaaacaa

SEQ ID NO: 250331 - DNA, 20 bp, Artificial
  CRISPR gRNA sequence
ttttgaaacaattatccttt

SEQ ID NO: 250332 - DNA, 20 bp, Artificial
  CRISPR gRNA sequence
tgaaacaattatcctttgct

SEQ ID NO: 250333 - DNA, 20 bp, Artificial
  CRISPR gRNA sequence
gaaacaattatcctttgcta

SEQ ID NO: 250334 - DNA, 20 bp, Artificial
  CRISPR gRNA sequence
aaacaattatcctttgctac

SEQ ID NO: 250335 - DNA, 20 bp, Artificial
  CRISPR gRNA sequence
tcctttgctacaaagatcaa

SEQ ID NO: 250336 - DNA, 20 bp, Artificial
  CRISPR gRNA sequence
tgctacaaagatcaataccg

SEQ ID NO: 250337 - DNA, 20 bp, Artificial
  CRISPR gRNA sequence
gctacaaagatcaataccgg

SEQ ID NO: 250338 - DNA, 20 bp, Artificial
  CRISPR gRNA sequence
ctacaaagatcaataccggc

SEQ ID NO: 250339 - DNA, 20 bp, Artificial
  CRISPR gRNA sequence
caaagatcaataccggcaga

SEQ ID NO: 250340 - DNA, 20 bp, Artificial
  CRISPR gRNA sequence
ttttgttaagatacagtagc

SEQ ID NO: 250341 - DNA, 20 bp, Artificial
  CRISPR gRNA sequence
tttgttaagatacagtagcc

SEQ ID NO: 250342 - DNA, 20 bp, Artificial
  CRISPR gRNA sequence
ttgttaagatacagtagcct

SEQ ID NO: 250343 - DNA, 20 bp, Artificial
  CRISPR gRNA sequence
tgttaagatacagtagcctt

SEQ ID NO: 250344 - DNA, 20 bp, Artificial
  CRISPR gRNA sequence
gttaagatacagtagccttg

SEQ ID NO: 250345 - DNA, 20 bp, Artificial
  CRISPR gRNA sequence
ttaagatacagtagccttgg

SEQ ID NO: 250346 - DNA, 20 bp, Artificial
  CRISPR gRNA sequence
agatacagtagccttggtgc

SEQ ID NO: 250347 - DNA, 20 bp, Artificial
  CRISPR gRNA sequence
ggtgcaaggttgtggtttct

SEQ ID NO: 250348 - DNA, 20 bp, Artificial
  CRISPR gRNA sequence
gtgcaaggttgtggtttctg

SEQ ID NO: 250349 - DNA, 20 bp, Artificial
  CRISPR gRNA sequence
tggtttctgccatcttttgt

SEQ ID NO: 250350 - DNA, 20 bp, Artificial
  CRISPR gRNA sequence
ctgccatcttttgtgatagt

SEQ ID NO: 250351 - DNA, 20 bp, Artificial
  CRISPR gRNA sequence
tgccatcttttgtgatagtt

SEQ ID NO: 250352 - DNA, 20 bp, Artificial
  CRISPR gRNA sequence
ccatcttttgtgatagttgt

SEQ ID NO: 250353 - DNA, 20 bp, Artificial
  CRISPR gRNA sequence
ttgtgatagttgtttttatc

SEQ ID NO: 250354 - DNA, 20 bp, Artificial
  CRISPR gRNA sequence
tgtgatagttgtttttatca

SEQ ID NO: 250355 - DNA, 20 bp, Artificial
  CRISPR gRNA sequence
gtgatagttgtttttatcag

SEQ ID NO: 250356 - DNA, 20 bp, Artificial
  CRISPR gRNA sequence
tgatagttgtttttatcagg

SEQ ID NO: 250357 - DNA, 20 bp, Artificial
  CRISPR gRNA sequence
tttttatcaggcatgcatgc

SEQ ID NO: 250358 - DNA, 20 bp, Artificial
  CRISPR gRNA sequence
ttatcaggcatgcatgcata

SEQ ID NO: 250359 - DNA, 20 bp, Artificial
  CRISPR gRNA sequence
tatcaggcatgcatgcataa

SEQ ID NO: 250360 - DNA, 20 bp, Artificial
  CRISPR gRNA sequence
atcaggcatgcatgcataag

SEQ ID NO: 250361 - DNA, 20 bp, Artificial
  CRISPR gRNA sequence
tcaggcatgcatgcataaga

SEQ ID NO: 250362 - DNA, 20 bp, Artificial
  CRISPR gRNA sequence
cacggccttccctggctcca

SEQ ID NO: 250363 - DNA, 20 bp, Artificial
  CRISPR gRNA sequence
acggccttccctggctccat

SEQ ID NO: 250364 - DNA, 20 bp, Artificial
  CRISPR gRNA sequence
ccctggctccatttgtcagg

SEQ ID NO: 250365 - DNA, 20 bp, Artificial
  CRISPR gRNA sequence
cctggctccatttgtcaggg

SEQ ID NO: 250366 - DNA, 20 bp, Artificial
  CRISPR gRNA sequence
gctccatttgtcagggtttt

SEQ ID NO: 250367 - DNA, 20 bp, Artificial
  CRISPR gRNA sequence
catttgtcagggtttttgtt

SEQ ID NO: 250368 - DNA, 20 bp, Artificial
  CRISPR gRNA sequence
gtcagggtttttgtttgttt

SEQ ID NO: 250369 - DNA, 20 bp, Artificial
  CRISPR gRNA sequence
tcagggtttttgtttgtttg

SEQ ID NO: 250370 - DNA, 20 bp, Artificial
  CRISPR gRNA sequence
ttgtttgtttgtttgttttt

SEQ ID NO: 250371 - DNA, 20 bp, Artificial
  CRISPR gRNA sequence
tgtttgtttgtttgtttttt

SEQ ID NO: 250372 - DNA, 20 bp, Artificial
  CRISPR gRNA sequence
gtttgtttgtttgttttttg

SEQ ID NO: 250373 - DNA, 20 bp, Artificial
  CRISPR gRNA sequence
tttgtttgtttgttttttgg

SEQ ID NO: 250374 - DNA, 20 bp, Artificial
  CRISPR gRNA sequence
gtttgtttgttttttggttt

SEQ ID NO: 250375 - DNA, 20 bp, Artificial
  CRISPR gRNA sequence
tttgtttgttttttggtttt

SEQ ID NO: 250376 - DNA, 20 bp, Artificial
  CRISPR gRNA sequence
gtttgttttttggttttttg

SEQ ID NO: 250377 - DNA, 20 bp, Artificial
  CRISPR gRNA sequence
tttgttttttggttttttgt

SEQ ID NO: 250378 - DNA, 20 bp, Artificial
  CRISPR gRNA sequence
gttttttggttttttgttgt

SEQ ID NO: 250379 - DNA, 20 bp, Artificial
  CRISPR gRNA sequence
ttttttggttttttgttgtt

SEQ ID NO: 250380 - DNA, 20 bp, Artificial
  CRISPR gRNA sequence
tttggttttttgttgttatt

SEQ ID NO: 250381 - DNA, 20 bp, Artificial
  CRISPR gRNA sequence
ttggttttttgttgttattg

SEQ ID NO: 250382 - DNA, 20 bp, Artificial
  CRISPR gRNA sequence
tggttttttgttgttattgt

SEQ ID NO: 250383 - DNA, 20 bp, Artificial
  CRISPR gRNA sequence
ggttttttgttgttattgtt

SEQ ID NO: 250384 - DNA, 20 bp, Artificial
  CRISPR gRNA sequence
gttttttgttgttattgttg

SEQ ID NO: 250385 - DNA, 20 bp, Artificial
  CRISPR gRNA sequence
tttgttgttattgttgttgt

SEQ ID NO: 250386 - DNA, 20 bp, Artificial
  CRISPR gRNA sequence
ttgttgttattgttgttgtt

SEQ ID NO: 250387 - DNA, 20 bp, Artificial
  CRISPR gRNA sequence
tgttgttattgttgttgttt

SEQ ID NO: 250388 - DNA, 20 bp, Artificial
  CRISPR gRNA sequence
gttgttattgttgttgtttg

SEQ ID NO: 250389 - DNA, 20 bp, Artificial
  CRISPR gRNA sequence
ttgttattgttgttgtttgt

SEQ ID NO: 250390 - DNA, 20 bp, Artificial
  CRISPR gRNA sequence
ttattgttgttgtttgtttt

SEQ ID NO: 250391 - DNA, 20 bp, Artificial
  CRISPR gRNA sequence
ttgttgttgtttgtttttga

SEQ ID NO: 250392 - DNA, 20 bp, Artificial
  CRISPR gRNA sequence
ttgttgtttgtttttgagac

SEQ ID NO: 250393 - DNA, 20 bp, Artificial
  CRISPR gRNA sequence
ttgtttgtttttgagacagg

SEQ ID NO: 250394 - DNA, 20 bp, Artificial
  CRISPR gRNA sequence
tttgtttttgagacaggatc

SEQ ID NO: 250395 - DNA, 20 bp, Artificial
  CRISPR gRNA sequence
gtttttgagacaggatctcc

SEQ ID NO: 250396 - DNA, 20 bp, Artificial
  CRISPR gRNA sequence
tttttgagacaggatctccc

SEQ ID NO: 250397 - DNA, 20 bp, Artificial
  CRISPR gRNA sequence
ttgagacaggatctccctgt

SEQ ID NO: 250398 - DNA, 20 bp, Artificial
  CRISPR gRNA sequence
tgagacaggatctccctgtg

SEQ ID NO: 250399 - DNA, 20 bp, Artificial
  CRISPR gRNA sequence
gagacaggatctccctgtgt

SEQ ID NO: 250400 - DNA, 20 bp, Artificial
  CRISPR gRNA sequence
agacaggatctccctgtgtc

SEQ ID NO: 250401 - DNA, 20 bp, Artificial
  CRISPR gRNA sequence
cctgtgtcattcaggctgga

SEQ ID NO: 250402 - DNA, 20 bp, Artificial
  CRISPR gRNA sequence
tgtcattcaggctggagtgc

SEQ ID NO: 250403 - DNA, 20 bp, Artificial
  CRISPR gRNA sequence
aggctggagtgcagtggcgt

SEQ ID NO: 250404 - DNA, 20 bp, Artificial
  CRISPR gRNA sequence
gagtgcagtggcgtgatctc

SEQ ID NO: 250405 - DNA, 20 bp, Artificial
  CRISPR gRNA sequence
cactcgctgcaacctccgcc

SEQ ID NO: 250406 - DNA, 20 bp, Artificial
  CRISPR gRNA sequence
gctgcaacctccgcctcctg

SEQ ID NO: 250407 - DNA, 20 bp, Artificial
  CRISPR gRNA sequence
caacctccgcctcctgggtt

SEQ ID NO: 250408 - DNA, 20 bp, Artificial
  CRISPR gRNA sequence
cgcctcctgggttccagcga

SEQ ID NO: 250409 - DNA, 20 bp, Artificial
  CRISPR gRNA sequence
ctgggttccagcgattttcg

SEQ ID NO: 250410 - DNA, 20 bp, Artificial
  CRISPR gRNA sequence
ggttccagcgattttcgtgc

SEQ ID NO: 250411 - DNA, 20 bp, Artificial
  CRISPR gRNA sequence
cagcgattttcgtgcctcag

SEQ ID NO: 250412 - DNA, 20 bp, Artificial
  CRISPR gRNA sequence
tcgtgcctcagcctcctgag

SEQ ID NO: 250413 - DNA, 20 bp, Artificial
  CRISPR gRNA sequence
cgtgcctcagcctcctgagt

SEQ ID NO: 250414 - DNA, 20 bp, Artificial
  CRISPR gRNA sequence
gtgcctcagcctcctgagta

SEQ ID NO: 250415 - DNA, 20 bp, Artificial
  CRISPR gRNA sequence
agcctcctgagtagctggga

SEQ ID NO: 250416 - DNA, 20 bp, Artificial
  CRISPR gRNA sequence
ctgagtagctgggattacag

SEQ ID NO: 250417 - DNA, 20 bp, Artificial
  CRISPR gRNA sequence
agtagctgggattacaggca

SEQ ID NO: 250418 - DNA, 20 bp, Artificial
  CRISPR gRNA sequence
ggattacaggcagctgccac

SEQ ID NO: 250419 - DNA, 20 bp, Artificial
  CRISPR gRNA sequence
caggcagctgccaccatgcc

SEQ ID NO: 250420 - DNA, 20 bp, Artificial
  CRISPR gRNA sequence
ccaccatgcccggctatagt

SEQ ID NO: 250421 - DNA, 20 bp, Artificial
  CRISPR gRNA sequence
tagtagagacggggttttgc

SEQ ID NO: 250422 - DNA, 20 bp, Artificial
  CRISPR gRNA sequence
tgccacgttggccaggctgg

SEQ ID NO: 250423 - DNA, 20 bp, Artificial
  CRISPR gRNA sequence
gccacgttggccaggctggt

SEQ ID NO: 250424 - DNA, 20 bp, Artificial
  CRISPR gRNA sequence
ccacgttggccaggctggtc

SEQ ID NO: 250425 - DNA, 20 bp, Artificial
  CRISPR gRNA sequence
gccaggctggtcttgaactc

SEQ ID NO: 250426 - DNA, 20 bp, Artificial
  CRISPR gRNA sequence
gtcttgaactcctggcctca

SEQ ID NO: 250427 - DNA, 20 bp, Artificial
  CRISPR gRNA sequence
gaactcctggcctcatgtga

SEQ ID NO: 250428 - DNA, 20 bp, Artificial
  CRISPR gRNA sequence
aactcctggcctcatgtgat

SEQ ID NO: 250429 - DNA, 20 bp, Artificial
  CRISPR gRNA sequence
ctggcctcatgtgatctgcc

SEQ ID NO: 250430 - DNA, 20 bp, Artificial
  CRISPR gRNA sequence
gcctcatgtgatctgcctgc

SEQ ID NO: 250431 - DNA, 20 bp, Artificial
  CRISPR gRNA sequence
atgtgatctgcctgcctcag

SEQ ID NO: 250432 - DNA, 20 bp, Artificial
  CRISPR gRNA sequence
cctgcctcagtctcccaaag

SEQ ID NO: 250433 - DNA, 20 bp, Artificial
  CRISPR gRNA sequence
cctcagtctcccaaagtgct

SEQ ID NO: 250434 - DNA, 20 bp, Artificial
  CRISPR gRNA sequence
agtctcccaaagtgctggga

SEQ ID NO: 250435 - DNA, 20 bp, Artificial
  CRISPR gRNA sequence
ccaaagtgctgggattacag

SEQ ID NO: 250436 - DNA, 20 bp, Artificial
  CRISPR gRNA sequence
ggattacaggcatgagccac

SEQ ID NO: 250437 - DNA, 20 bp, Artificial
  CRISPR gRNA sequence
caggcatgagccaccatgcc

SEQ ID NO: 250438 - DNA, 20 bp, Artificial
  CRISPR gRNA sequence
gtcagggttttgacacaagt

SEQ ID NO: 250439 - DNA, 20 bp, Artificial
  CRISPR gRNA sequence
tcagggttttgacacaagtt

SEQ ID NO: 250440 - DNA, 20 bp, Artificial
  CRISPR gRNA sequence
tgacacaagttactccattt

SEQ ID NO: 250441 - DNA, 20 bp, Artificial
  CRISPR gRNA sequence
gacacaagttactccatttt

SEQ ID NO: 250442 - DNA, 20 bp, Artificial
  CRISPR gRNA sequence
acacaagttactccattttg

SEQ ID NO: 250443 - DNA, 20 bp, Artificial
  CRISPR gRNA sequence
ctccattttgattctgacaa

SEQ ID NO: 250444 - DNA, 20 bp, Artificial
  CRISPR gRNA sequence
cattttgattctgacaactt

SEQ ID NO: 250445 - DNA, 20 bp, Artificial
  CRISPR gRNA sequence
tgattctgacaactttcaca

SEQ ID NO: 250446 - DNA, 20 bp, Artificial
  CRISPR gRNA sequence
gattctgacaactttcacaa

SEQ ID NO: 250447 - DNA, 20 bp, Artificial
  CRISPR gRNA sequence
attctgacaactttcacaaa

SEQ ID NO: 250448 - DNA, 20 bp, Artificial
  CRISPR gRNA sequence
tgacaactttcacaaacgtg

SEQ ID NO: 250449 - DNA, 20 bp, Artificial
  CRISPR gRNA sequence
acaactttcacaaacgtgaa

SEQ ID NO: 250450 - DNA, 20 bp, Artificial
  CRISPR gRNA sequence
tcacaaacgtgaactttttt

SEQ ID NO: 250451 - DNA, 20 bp, Artificial
  CRISPR gRNA sequence
cacaaacgtgaacttttttt

SEQ ID NO: 250452 - DNA, 20 bp, Artificial
  CRISPR gRNA sequence
acaaacgtgaacttttttta

SEQ ID NO: 250453 - DNA, 20 bp, Artificial
  CRISPR gRNA sequence
tttttaagattttgcttttt

SEQ ID NO: 250454 - DNA, 20 bp, Artificial
  CRISPR gRNA sequence
ttttaagattttgctttttc

SEQ ID NO: 250455 - DNA, 20 bp, Artificial
  CRISPR gRNA sequence
tttaagattttgctttttca

SEQ ID NO: 250456 - DNA, 20 bp, Artificial
  CRISPR gRNA sequence
ttaagattttgctttttcac

SEQ ID NO: 250457 - DNA, 20 bp, Artificial
  CRISPR gRNA sequence
taagattttgctttttcact

SEQ ID NO: 250458 - DNA, 20 bp, Artificial
  CRISPR gRNA sequence
aagattttgctttttcactc

SEQ ID NO: 250459 - DNA, 20 bp, Artificial
  CRISPR gRNA sequence
agattttgctttttcactca

SEQ ID NO: 250460 - DNA, 20 bp, Artificial
  CRISPR gRNA sequence
tgctttttcactcagcacaa

SEQ ID NO: 250461 - DNA, 20 bp, Artificial
  CRISPR gRNA sequence
gctttttcactcagcacaat

SEQ ID NO: 250462 - DNA, 20 bp, Artificial
  CRISPR gRNA sequence
ctttttcactcagcacaatg

SEQ ID NO: 250463 - DNA, 20 bp, Artificial
  CRISPR gRNA sequence
tttcactcagcacaatgccc

SEQ ID NO: 250464 - DNA, 20 bp, Artificial
  CRISPR gRNA sequence
ttcactcagcacaatgccct

SEQ ID NO: 250465 - DNA, 20 bp, Artificial
  CRISPR gRNA sequence
tcactcagcacaatgccctt

SEQ ID NO: 250466 - DNA, 20 bp, Artificial
  CRISPR gRNA sequence
cactcagcacaatgcccttg

SEQ ID NO: 250467 - DNA, 20 bp, Artificial
  CRISPR gRNA sequence
actcagcacaatgcccttga

SEQ ID NO: 250468 - DNA, 20 bp, Artificial
  CRISPR gRNA sequence
agcacaatgcccttgatatc

SEQ ID NO: 250469 - DNA, 20 bp, Artificial
  CRISPR gRNA sequence
gatatccatccaagttgctg

SEQ ID NO: 250470 - DNA, 20 bp, Artificial
  CRISPR gRNA sequence
atatccatccaagttgctgt

SEQ ID NO: 250471 - DNA, 20 bp, Artificial
  CRISPR gRNA sequence
ctgtgtgtttcaatggttaa

SEQ ID NO: 250472 - DNA, 20 bp, Artificial
  CRISPR gRNA sequence
tgtgtttcaatggttaattc

SEQ ID NO: 250473 - DNA, 20 bp, Artificial
  CRISPR gRNA sequence
caatggttaattctttttcc

SEQ ID NO: 250474 - DNA, 20 bp, Artificial
  CRISPR gRNA sequence
aatggttaattctttttcct

SEQ ID NO: 250475 - DNA, 20 bp, Artificial
  CRISPR gRNA sequence
attctttttccttgctgaat

SEQ ID NO: 250476 - DNA, 20 bp, Artificial
  CRISPR gRNA sequence
tttttccttgctgaatagta

SEQ ID NO: 250477 - DNA, 20 bp, Artificial
  CRISPR gRNA sequence
tttccttgctgaatagtatt

SEQ ID NO: 250478 - DNA, 20 bp, Artificial
  CRISPR gRNA sequence
ttccttgctgaatagtattc

SEQ ID NO: 250479 - DNA, 20 bp, Artificial
  CRISPR gRNA sequence
tccttgctgaatagtattcc

SEQ ID NO: 250480 - DNA, 20 bp, Artificial
  CRISPR gRNA sequence
ccttgctgaatagtattcca

SEQ ID NO: 250481 - DNA, 20 bp, Artificial
  CRISPR gRNA sequence
cttgctgaatagtattccac

SEQ ID NO: 250482 - DNA, 20 bp, Artificial
  CRISPR gRNA sequence
gctgaatagtattccacgat

SEQ ID NO: 250483 - DNA, 20 bp, Artificial
  CRISPR gRNA sequence
ctgaatagtattccacgata

SEQ ID NO: 250484 - DNA, 20 bp, Artificial
  CRISPR gRNA sequence
aatagtattccacgatatgc

SEQ ID NO: 250485 - DNA, 20 bp, Artificial
  CRISPR gRNA sequence
cacgatatgcttgtgccaca

SEQ ID NO: 250486 - DNA, 20 bp, Artificial
  CRISPR gRNA sequence
gtgccacagtttgttttacc

SEQ ID NO: 250487 - DNA, 20 bp, Artificial
  CRISPR gRNA sequence
tgccacagtttgttttacca

SEQ ID NO: 250488 - DNA, 20 bp, Artificial
  CRISPR gRNA sequence
gttttaccatgcacccatta

SEQ ID NO: 250489 - DNA, 20 bp, Artificial
  CRISPR gRNA sequence
ttttaccatgcacccattaa

SEQ ID NO: 250490 - DNA, 20 bp, Artificial
  CRISPR gRNA sequence
taccatgcacccattaaaag

SEQ ID NO: 250491 - DNA, 20 bp, Artificial
  CRISPR gRNA sequence
accatgcacccattaaaaga

SEQ ID NO: 250492 - DNA, 20 bp, Artificial
  CRISPR gRNA sequence
ccatgcacccattaaaagat

SEQ ID NO: 250493 - DNA, 20 bp, Artificial
  CRISPR gRNA sequence
aaagatattttgtttgcttc

SEQ ID NO: 250494 - DNA, 20 bp, Artificial
  CRISPR gRNA sequence
tgtttgcttcctgttttgac

SEQ ID NO: 250495 - DNA, 20 bp, Artificial
  CRISPR gRNA sequence
gtttgcttcctgttttgact

SEQ ID NO: 250496 - DNA, 20 bp, Artificial
  CRISPR gRNA sequence
tttgcttcctgttttgacta

SEQ ID NO: 250497 - DNA, 20 bp, Artificial
  CRISPR gRNA sequence
gcttcctgttttgactatta

SEQ ID NO: 250498 - DNA, 20 bp, Artificial
  CRISPR gRNA sequence
cttcctgttttgactattac

SEQ ID NO: 250499 - DNA, 20 bp, Artificial
  CRISPR gRNA sequence
cctgttttgactattacata

SEQ ID NO: 250500 - DNA, 20 bp, Artificial
  CRISPR gRNA sequence
ctgttttgactattacatat

SEQ ID NO: 250501 - DNA, 20 bp, Artificial
  CRISPR gRNA sequence
ttttgactattacatataaa

SEQ ID NO: 250502 - DNA, 20 bp, Artificial
  CRISPR gRNA sequence
tgactattacatataaagct

SEQ ID NO: 250503 - DNA, 20 bp, Artificial
  CRISPR gRNA sequence
gactattacatataaagctg

SEQ ID NO: 250504 - DNA, 20 bp, Artificial
  CRISPR gRNA sequence
actattacatataaagctgc

SEQ ID NO: 250505 - DNA, 20 bp, Artificial
  CRISPR gRNA sequence
ttacatataaagctgcgagg

SEQ ID NO: 250506 - DNA, 20 bp, Artificial
  CRISPR gRNA sequence
catataaagctgcgaggaat

SEQ ID NO: 250507 - DNA, 20 bp, Artificial
  CRISPR gRNA sequence
cgaggaataattatgtacag

SEQ ID NO: 250508 - DNA, 20 bp, Artificial
  CRISPR gRNA sequence
tgtacaggttttgtgtggac

SEQ ID NO: 250509 - DNA, 20 bp, Artificial
  CRISPR gRNA sequence
tgtgtggacatgtatttttg

SEQ ID NO: 250510 - DNA, 20 bp, Artificial
  CRISPR gRNA sequence
gtgtggacatgtatttttgt

SEQ ID NO: 250511 - DNA, 20 bp, Artificial
  CRISPR gRNA sequence
tgtggacatgtatttttgta

SEQ ID NO: 250512 - DNA, 20 bp, Artificial
  CRISPR gRNA sequence
ttgtatctctatgataaatg

SEQ ID NO: 250513 - DNA, 20 bp, Artificial
  CRISPR gRNA sequence
tgtatctctatgataaatgc

SEQ ID NO: 250514 - DNA, 20 bp, Artificial
  CRISPR gRNA sequence
gtatctctatgataaatgct

SEQ ID NO: 250515 - DNA, 20 bp, Artificial
  CRISPR gRNA sequence
tatctctatgataaatgctc

SEQ ID NO: 250516 - DNA, 20 bp, Artificial
  CRISPR gRNA sequence
tatgataaatgctcaggagt

SEQ ID NO: 250517 - DNA, 20 bp, Artificial
  CRISPR gRNA sequence
tgataaatgctcaggagtgc

SEQ ID NO: 250518 - DNA, 20 bp, Artificial
  CRISPR gRNA sequence
aggagtgcaattgctgggct

SEQ ID NO: 250519 - DNA, 20 bp, Artificial
  CRISPR gRNA sequence
ctgggctatatgtttggtgc

SEQ ID NO: 250520 - DNA, 20 bp, Artificial
  CRISPR gRNA sequence
ggctatatgtttggtgcttg

SEQ ID NO: 250521 - DNA, 20 bp, Artificial
  CRISPR gRNA sequence
tatgtttggtgcttgtttag

SEQ ID NO: 250522 - DNA, 20 bp, Artificial
  CRISPR gRNA sequence
ggtgcttgtttagtttttaa

SEQ ID NO: 250523 - DNA, 20 bp, Artificial
  CRISPR gRNA sequence
gtgcttgtttagtttttaag

SEQ ID NO: 250524 - DNA, 20 bp, Artificial
  CRISPR gRNA sequence
gtttagtttttaagaagttg

SEQ ID NO: 250525 - DNA, 20 bp, Artificial
  CRISPR gRNA sequence
tttagtttttaagaagttgt

SEQ ID NO: 250526 - DNA, 20 bp, Artificial
  CRISPR gRNA sequence
agtttttaagaagttgtcga

SEQ ID NO: 250527 - DNA, 20 bp, Artificial
  CRISPR gRNA sequence
gtttttaagaagttgtcgaa

SEQ ID NO: 250528 - DNA, 20 bp, Artificial
  CRISPR gRNA sequence
ttaagaagttgtcgaactat

SEQ ID NO: 250529 - DNA, 20 bp, Artificial
  CRISPR gRNA sequence
taagaagttgtcgaactatt

SEQ ID NO: 250530 - DNA, 20 bp, Artificial
  CRISPR gRNA sequence
aagaagttgtcgaactattt

SEQ ID NO: 250531 - DNA, 20 bp, Artificial
  CRISPR gRNA sequence
agaagttgtcgaactatttt

SEQ ID NO: 250532 - DNA, 20 bp, Artificial
  CRISPR gRNA sequence
tcgaactattttccagagga

SEQ ID NO: 250533 - DNA, 20 bp, Artificial
  CRISPR gRNA sequence
ttttccagaggaagtgtatc

SEQ ID NO: 250534 - DNA, 20 bp, Artificial
  CRISPR gRNA sequence
tccagaggaagtgtatcatt

SEQ ID NO: 250535 - DNA, 20 bp, Artificial
  CRISPR gRNA sequence
ccagaggaagtgtatcattt

SEQ ID NO: 250536 - DNA, 20 bp, Artificial
  CRISPR gRNA sequence
cagaggaagtgtatcatttt

SEQ ID NO: 250537 - DNA, 20 bp, Artificial
  CRISPR gRNA sequence
tacattctcatcggagtttc

SEQ ID NO: 250538 - DNA, 20 bp, Artificial
  CRISPR gRNA sequence
acattctcatcggagtttct

SEQ ID NO: 250539 - DNA, 20 bp, Artificial
  CRISPR gRNA sequence
cattctcatcggagtttctc

SEQ ID NO: 250540 - DNA, 20 bp, Artificial
  CRISPR gRNA sequence
tcatcggagtttctctgcat

SEQ ID NO: 250541 - DNA, 20 bp, Artificial
  CRISPR gRNA sequence
atcggagtttctctgcatcc

SEQ ID NO: 250542 - DNA, 20 bp, Artificial
  CRISPR gRNA sequence
ctctgcatccttgcttgcat

SEQ ID NO: 250543 - DNA, 20 bp, Artificial
  CRISPR gRNA sequence
tctgcatccttgcttgcatt

SEQ ID NO: 250544 - DNA, 20 bp, Artificial
  CRISPR gRNA sequence
tgcatccttgcttgcatttt

SEQ ID NO: 250545 - DNA, 20 bp, Artificial
  CRISPR gRNA sequence
catccttgcttgcattttgc

SEQ ID NO: 250546 - DNA, 20 bp, Artificial
  CRISPR gRNA sequence
gcttgcattttgcattgcca

SEQ ID NO: 250547 - DNA, 20 bp, Artificial
  CRISPR gRNA sequence
cttgcattttgcattgccac

SEQ ID NO: 250548 - DNA, 20 bp, Artificial
  CRISPR gRNA sequence
gcattttgcattgccacaat

SEQ ID NO: 250549 - DNA, 20 bp, Artificial
  CRISPR gRNA sequence
cattttgcattgccacaatt

SEQ ID NO: 250550 - DNA, 20 bp, Artificial
  CRISPR gRNA sequence
tgcattgccacaatttttat

SEQ ID NO: 250551 - DNA, 20 bp, Artificial
  CRISPR gRNA sequence
gcattgccacaatttttatt

SEQ ID NO: 250552 - DNA, 20 bp, Artificial
  CRISPR gRNA sequence
cattgccacaatttttattt

SEQ ID NO: 250553 - DNA, 20 bp, Artificial
  CRISPR gRNA sequence
ccacaatttttatttcagct

SEQ ID NO: 250554 - DNA, 20 bp, Artificial
  CRISPR gRNA sequence
ttatttcagctgttctaata

SEQ ID NO: 250555 - DNA, 20 bp, Artificial
  CRISPR gRNA sequence
tatttcagctgttctaatag

SEQ ID NO: 250556 - DNA, 20 bp, Artificial
  CRISPR gRNA sequence
atttcagctgttctaatagg

SEQ ID NO: 250557 - DNA, 20 bp, Artificial
  CRISPR gRNA sequence
tttcagctgttctaataggt

SEQ ID NO: 250558 - DNA, 20 bp, Artificial
  CRISPR gRNA sequence
cagctgttctaataggtatg

SEQ ID NO: 250559 - DNA, 20 bp, Artificial
  CRISPR gRNA sequence
agctgttctaataggtatgt

SEQ ID NO: 250560 - DNA, 20 bp, Artificial
  CRISPR gRNA sequence
ttctaataggtatgtagtga

SEQ ID NO: 250561 - DNA, 20 bp, Artificial
  CRISPR gRNA sequence
taataggtatgtagtgacat

SEQ ID NO: 250562 - DNA, 20 bp, Artificial
  CRISPR gRNA sequence
ataggtatgtagtgacatct

SEQ ID NO: 250563 - DNA, 20 bp, Artificial
  CRISPR gRNA sequence
attggggctttaatttgcac

SEQ ID NO: 250564 - DNA, 20 bp, Artificial
  CRISPR gRNA sequence
gggctttaatttgcacttcc

SEQ ID NO: 250565 - DNA, 20 bp, Artificial
  CRISPR gRNA sequence
taatttgcacttcccttatg

SEQ ID NO: 250566 - DNA, 20 bp, Artificial
  CRISPR gRNA sequence
aatttgcacttcccttatgg

SEQ ID NO: 250567 - DNA, 20 bp, Artificial
  CRISPR gRNA sequence
atttgcacttcccttatggg

SEQ ID NO: 250568 - DNA, 20 bp, Artificial
  CRISPR gRNA sequence
gcacttcccttatgggtgga

SEQ ID NO: 250569 - DNA, 20 bp, Artificial
  CRISPR gRNA sequence
cacttcccttatgggtggac

SEQ ID NO: 250570 - DNA, 20 bp, Artificial
  CRISPR gRNA sequence
cccttatgggtggacatctt

SEQ ID NO: 250571 - DNA, 20 bp, Artificial
  CRISPR gRNA sequence
ccttatgggtggacatcttt

SEQ ID NO: 250572 - DNA, 20 bp, Artificial
  CRISPR gRNA sequence
atgggtggacatcttttcat

SEQ ID NO: 250573 - DNA, 20 bp, Artificial
  CRISPR gRNA sequence
tgggtggacatcttttcatg

SEQ ID NO: 250574 - DNA, 20 bp, Artificial
  CRISPR gRNA sequence
ttcatgtgcttattttccat

SEQ ID NO: 250575 - DNA, 20 bp, Artificial
  CRISPR gRNA sequence
tcatgtgcttattttccatc

SEQ ID NO: 250576 - DNA, 20 bp, Artificial
  CRISPR gRNA sequence
catgtgcttattttccatct

SEQ ID NO: 250577 - DNA, 20 bp, Artificial
  CRISPR gRNA sequence
atgtgcttattttccatctt

SEQ ID NO: 250578 - DNA, 20 bp, Artificial
  CRISPR gRNA sequence
attttccatctttatatctt

SEQ ID NO: 250579 - DNA, 20 bp, Artificial
  CRISPR gRNA sequence
ttttccatctttatatcttc

SEQ ID NO: 250580 - DNA, 20 bp, Artificial
  CRISPR gRNA sequence
tccatctttatatcttcttc

SEQ ID NO: 250581 - DNA, 20 bp, Artificial
  CRISPR gRNA sequence
ccatctttatatcttcttca

SEQ ID NO: 250582 - DNA, 20 bp, Artificial
  CRISPR gRNA sequence
catctttatatcttcttcag

SEQ ID NO: 250583 - DNA, 20 bp, Artificial
  CRISPR gRNA sequence
tatatcttcttcagtgaagt

SEQ ID NO: 250584 - DNA, 20 bp, Artificial
  CRISPR gRNA sequence
atatcttcttcagtgaagtg

SEQ ID NO: 250585 - DNA, 20 bp, Artificial
  CRISPR gRNA sequence
tatcttcttcagtgaagtgt

SEQ ID NO: 250586 - DNA, 20 bp, Artificial
  CRISPR gRNA sequence
cttcagtgaagtgttgttca

SEQ ID NO: 250587 - DNA, 20 bp, Artificial
  CRISPR gRNA sequence
ttcagtgaagtgttgttcag

SEQ ID NO: 250588 - DNA, 20 bp, Artificial
  CRISPR gRNA sequence
cagtgaagtgttgttcaggt

SEQ ID NO: 250589 - DNA, 20 bp, Artificial
  CRISPR gRNA sequence
agtgaagtgttgttcaggtc

SEQ ID NO: 250590 - DNA, 20 bp, Artificial
  CRISPR gRNA sequence
ttcaggtctttcacctattt

SEQ ID NO: 250591 - DNA, 20 bp, Artificial
  CRISPR gRNA sequence
aggtctttcacctattttct

SEQ ID NO: 250592 - DNA, 20 bp, Artificial
  CRISPR gRNA sequence
tcacctattttctagttgga

SEQ ID NO: 250593 - DNA, 20 bp, Artificial
  CRISPR gRNA sequence
cacctattttctagttggat

SEQ ID NO: 250594 - DNA, 20 bp, Artificial
  CRISPR gRNA sequence
acctattttctagttggatt

SEQ ID NO: 250595 - DNA, 20 bp, Artificial
  CRISPR gRNA sequence
ttttctagttggattatttg

SEQ ID NO: 250596 - DNA, 20 bp, Artificial
  CRISPR gRNA sequence
tctagttggattatttgttt

SEQ ID NO: 250597 - DNA, 20 bp, Artificial
  CRISPR gRNA sequence
ctagttggattatttgtttg

SEQ ID NO: 250598 - DNA, 20 bp, Artificial
  CRISPR gRNA sequence
tagttggattatttgtttgt

SEQ ID NO: 250599 - DNA, 20 bp, Artificial
  CRISPR gRNA sequence
gttggattatttgtttgttt

SEQ ID NO: 250600 - DNA, 20 bp, Artificial
  CRISPR gRNA sequence
gattatttgtttgttttact

SEQ ID NO: 250601 - DNA, 20 bp, Artificial
  CRISPR gRNA sequence
tttgtttgttttactgttga

SEQ ID NO: 250602 - DNA, 20 bp, Artificial
  CRISPR gRNA sequence
gtttgttttactgttgagat

SEQ ID NO: 250603 - DNA, 20 bp, Artificial
  CRISPR gRNA sequence
tttgttttactgttgagatt

SEQ ID NO: 250604 - DNA, 20 bp, Artificial
  CRISPR gRNA sequence
gttttactgttgagattcaa

SEQ ID NO: 250605 - DNA, 20 bp, Artificial
  CRISPR gRNA sequence
ttttactgttgagattcaag

SEQ ID NO: 250606 - DNA, 20 bp, Artificial
  CRISPR gRNA sequence
tactgttgagattcaagagt

SEQ ID NO: 250607 - DNA, 20 bp, Artificial
  CRISPR gRNA sequence
actgttgagattcaagagtt

SEQ ID NO: 250608 - DNA, 20 bp, Artificial
  CRISPR gRNA sequence
ctgttgagattcaagagttc

SEQ ID NO: 250609 - DNA, 20 bp, Artificial
  CRISPR gRNA sequence
ttgagattcaagagttcttc

SEQ ID NO: 250610 - DNA, 20 bp, Artificial
  CRISPR gRNA sequence
agattcaagagttcttcgta

SEQ ID NO: 250611 - DNA, 20 bp, Artificial
  CRISPR gRNA sequence
aagagttcttcgtatttccc

SEQ ID NO: 250612 - DNA, 20 bp, Artificial
  CRISPR gRNA sequence
ttcgtatttcccagatagga

SEQ ID NO: 250613 - DNA, 20 bp, Artificial
  CRISPR gRNA sequence
cgtatttcccagataggagt

SEQ ID NO: 250614 - DNA, 20 bp, Artificial
  CRISPR gRNA sequence
gtatttcccagataggagtc

SEQ ID NO: 250615 - DNA, 20 bp, Artificial
  CRISPR gRNA sequence
cccagataggagtcctttgg

SEQ ID NO: 250616 - DNA, 20 bp, Artificial
  CRISPR gRNA sequence
ccagataggagtcctttggc

SEQ ID NO: 250617 - DNA, 20 bp, Artificial
  CRISPR gRNA sequence
tggcatatatatggtttata

SEQ ID NO: 250618 - DNA, 20 bp, Artificial
  CRISPR gRNA sequence
ggcatatatatggtttataa

SEQ ID NO: 250619 - DNA, 20 bp, Artificial
  CRISPR gRNA sequence
gcatatatatggtttataaa

SEQ ID NO: 250620 - DNA, 20 bp, Artificial
  CRISPR gRNA sequence
ataaatattttctcccagtc

SEQ ID NO: 250621 - DNA, 20 bp, Artificial
  CRISPR gRNA sequence
taaatattttctcccagtca

SEQ ID NO: 250622 - DNA, 20 bp, Artificial
  CRISPR gRNA sequence
tctcccagtcagtagcttgc

SEQ ID NO: 250623 - DNA, 20 bp, Artificial
  CRISPR gRNA sequence
ctcccagtcagtagcttgcc

SEQ ID NO: 250624 - DNA, 20 bp, Artificial
  CRISPR gRNA sequence
tcccagtcagtagcttgcct

SEQ ID NO: 250625 - DNA, 20 bp, Artificial
  CRISPR gRNA sequence
ccagtcagtagcttgccttt

SEQ ID NO: 250626 - DNA, 20 bp, Artificial
  CRISPR gRNA sequence
gccttttcatcctcttctca

SEQ ID NO: 250627 - DNA, 20 bp, Artificial
  CRISPR gRNA sequence
ccttttcatcctcttctcag

SEQ ID NO: 250628 - DNA, 20 bp, Artificial
  CRISPR gRNA sequence
ttcatcctcttctcaggctc

SEQ ID NO: 250629 - DNA, 20 bp, Artificial
  CRISPR gRNA sequence
tcatcctcttctcaggctct

SEQ ID NO: 250630 - DNA, 20 bp, Artificial
  CRISPR gRNA sequence
catcctcttctcaggctctt

SEQ ID NO: 250631 - DNA, 20 bp, Artificial
  CRISPR gRNA sequence
atcctcttctcaggctcttc

SEQ ID NO: 250632 - DNA, 20 bp, Artificial
  CRISPR gRNA sequence
ttctcaggctcttccacaga

SEQ ID NO: 250633 - DNA, 20 bp, Artificial
  CRISPR gRNA sequence
ctcaggctcttccacagaga

SEQ ID NO: 250634 - DNA, 20 bp, Artificial
  CRISPR gRNA sequence
tcaggctcttccacagagaa

SEQ ID NO: 250635 - DNA, 20 bp, Artificial
  CRISPR gRNA sequence
aggctcttccacagagaaaa

SEQ ID NO: 250636 - DNA, 20 bp, Artificial
  CRISPR gRNA sequence
ttccacagagaaaagctatt

SEQ ID NO: 250637 - DNA, 20 bp, Artificial
  CRISPR gRNA sequence
ccacagagaaaagctattta

SEQ ID NO: 250638 - DNA, 20 bp, Artificial
  CRISPR gRNA sequence
cacagagaaaagctatttaa

SEQ ID NO: 250639 - DNA, 20 bp, Artificial
  CRISPR gRNA sequence
tttaattttgctgaagtcca

SEQ ID NO: 250640 - DNA, 20 bp, Artificial
  CRISPR gRNA sequence
aattttgctgaagtccagtt

SEQ ID NO: 250641 - DNA, 20 bp, Artificial
  CRISPR gRNA sequence
attttgctgaagtccagttt

SEQ ID NO: 250642 - DNA, 20 bp, Artificial
  CRISPR gRNA sequence
tgctgaagtccagtttatgg

SEQ ID NO: 250643 - DNA, 20 bp, Artificial
  CRISPR gRNA sequence
gctgaagtccagtttatgga

SEQ ID NO: 250644 - DNA, 20 bp, Artificial
  CRISPR gRNA sequence
ctgaagtccagtttatggat

SEQ ID NO: 250645 - DNA, 20 bp, Artificial
  CRISPR gRNA sequence
aagtccagtttatggatttt

SEQ ID NO: 250646 - DNA, 20 bp, Artificial
  CRISPR gRNA sequence
atggattttttcatttatgg

SEQ ID NO: 250647 - DNA, 20 bp, Artificial
  CRISPR gRNA sequence
tggattttttcatttatgga

SEQ ID NO: 250648 - DNA, 20 bp, Artificial
  CRISPR gRNA sequence
tttcatttatggagtcatgt

SEQ ID NO: 250649 - DNA, 20 bp, Artificial
  CRISPR gRNA sequence
ttcatttatggagtcatgtc

SEQ ID NO: 250650 - DNA, 20 bp, Artificial
  CRISPR gRNA sequence
tcatttatggagtcatgtct

SEQ ID NO: 250651 - DNA, 20 bp, Artificial
  CRISPR gRNA sequence
catttatggagtcatgtcta

SEQ ID NO: 250652 - DNA, 20 bp, Artificial
  CRISPR gRNA sequence
atttatggagtcatgtctaa

SEQ ID NO: 250653 - DNA, 20 bp, Artificial
  CRISPR gRNA sequence
atggagtcatgtctaagaat

SEQ ID NO: 250654 - DNA, 20 bp, Artificial
  CRISPR gRNA sequence
tggagtcatgtctaagaatt

SEQ ID NO: 250655 - DNA, 20 bp, Artificial
  CRISPR gRNA sequence
agaattcttcactgagtcct

SEQ ID NO: 250656 - DNA, 20 bp, Artificial
  CRISPR gRNA sequence
ttcactgagtcctgggtctc

SEQ ID NO: 250657 - DNA, 20 bp, Artificial
  CRISPR gRNA sequence
cactgagtcctgggtctcaa

SEQ ID NO: 250658 - DNA, 20 bp, Artificial
  CRISPR gRNA sequence
actgagtcctgggtctcaaa

SEQ ID NO: 250659 - DNA, 20 bp, Artificial
  CRISPR gRNA sequence
agtcctgggtctcaaagatt

SEQ ID NO: 250660 - DNA, 20 bp, Artificial
  CRISPR gRNA sequence
ggtctcaaagatttagggtt

SEQ ID NO: 250661 - DNA, 20 bp, Artificial
  CRISPR gRNA sequence
aaagatttagggtttttttt

SEQ ID NO: 250662 - DNA, 20 bp, Artificial
  CRISPR gRNA sequence
agggtttttttttttcctct

SEQ ID NO: 250663 - DNA, 20 bp, Artificial
  CRISPR gRNA sequence
gggtttttttttttcctcta

SEQ ID NO: 250664 - DNA, 20 bp, Artificial
  CRISPR gRNA sequence
ttttttttcctctatctctt

SEQ ID NO: 250665 - DNA, 20 bp, Artificial
  CRISPR gRNA sequence
tttttttcctctatctctta

SEQ ID NO: 250666 - DNA, 20 bp, Artificial
  CRISPR gRNA sequence
ttttttcctctatctcttat

SEQ ID NO: 250667 - DNA, 20 bp, Artificial
  CRISPR gRNA sequence
tttttcctctatctcttata

SEQ ID NO: 250668 - DNA, 20 bp, Artificial
  CRISPR gRNA sequence
ttttcctctatctcttataa

SEQ ID NO: 250669 - DNA, 20 bp, Artificial
  CRISPR gRNA sequence
tttcctctatctcttataac

SEQ ID NO: 250670 - DNA, 20 bp, Artificial
  CRISPR gRNA sequence
ttcctctatctcttataact

SEQ ID NO: 250671 - DNA, 20 bp, Artificial
  CRISPR gRNA sequence
tcctctatctcttataactt

SEQ ID NO: 250672 - DNA, 20 bp, Artificial
  CRISPR gRNA sequence
cctctatctcttataacttt

SEQ ID NO: 250673 - DNA, 20 bp, Artificial
  CRISPR gRNA sequence
ctctatctcttataactttt

SEQ ID NO: 250674 - DNA, 20 bp, Artificial
  CRISPR gRNA sequence
tatctcttataacttttaca

SEQ ID NO: 250675 - DNA, 20 bp, Artificial
  CRISPR gRNA sequence
tctcttataacttttacagt

SEQ ID NO: 250676 - DNA, 20 bp, Artificial
  CRISPR gRNA sequence
ttataacttttacagttttc

SEQ ID NO: 250677 - DNA, 20 bp, Artificial
  CRISPR gRNA sequence
ataacttttacagttttcta

SEQ ID NO: 250678 - DNA, 20 bp, Artificial
  CRISPR gRNA sequence
taacttttacagttttctat

SEQ ID NO: 250679 - DNA, 20 bp, Artificial
  CRISPR gRNA sequence
ttacagttttctatttcata

SEQ ID NO: 250680 - DNA, 20 bp, Artificial
  CRISPR gRNA sequence
tacagttttctatttcatat

SEQ ID NO: 250681 - DNA, 20 bp, Artificial
  CRISPR gRNA sequence
acagttttctatttcatatt

SEQ ID NO: 250682 - DNA, 20 bp, Artificial
  CRISPR gRNA sequence
cagttttctatttcatattt

SEQ ID NO: 250683 - DNA, 20 bp, Artificial
  CRISPR gRNA sequence
tctatttcatatttaaatct

SEQ ID NO: 250684 - DNA, 20 bp, Artificial
  CRISPR gRNA sequence
ctatttcatatttaaatctt

SEQ ID NO: 250685 - DNA, 20 bp, Artificial
  CRISPR gRNA sequence
tatttcatatttaaatcttg

SEQ ID NO: 250686 - DNA, 20 bp, Artificial
  CRISPR gRNA sequence
tttcatatttaaatcttgat

SEQ ID NO: 250687 - DNA, 20 bp, Artificial
  CRISPR gRNA sequence
catatttaaatcttgatttt

SEQ ID NO: 250688 - DNA, 20 bp, Artificial
  CRISPR gRNA sequence
atatttaaatcttgattttt

SEQ ID NO: 250689 - DNA, 20 bp, Artificial
  CRISPR gRNA sequence
aaatcttgattttttttttc

SEQ ID NO: 250690 - DNA, 20 bp, Artificial
  CRISPR gRNA sequence
aatcttgattttttttttct

SEQ ID NO: 250691 - DNA, 20 bp, Artificial
  CRISPR gRNA sequence
gattttttttttctgagaca

SEQ ID NO: 250692 - DNA, 20 bp, Artificial
  CRISPR gRNA sequence
attttttttttctgagacag

SEQ ID NO: 250693 - DNA, 20 bp, Artificial
  CRISPR gRNA sequence
tttttttctgagacagggtc

SEQ ID NO: 250694 - DNA, 20 bp, Artificial
  CRISPR gRNA sequence
ttttttctgagacagggtct

SEQ ID NO: 250695 - DNA, 20 bp, Artificial
  CRISPR gRNA sequence
tttttctgagacagggtctc

SEQ ID NO: 250696 - DNA, 20 bp, Artificial
  CRISPR gRNA sequence
ttttctgagacagggtctct

SEQ ID NO: 250697 - DNA, 20 bp, Artificial
  CRISPR gRNA sequence
tttctgagacagggtctctg

SEQ ID NO: 250698 - DNA, 20 bp, Artificial
  CRISPR gRNA sequence
ttctgagacagggtctctgc

SEQ ID NO: 250699 - DNA, 20 bp, Artificial
  CRISPR gRNA sequence
tctgagacagggtctctgct

SEQ ID NO: 250700 - DNA, 20 bp, Artificial
  CRISPR gRNA sequence
ctgagacagggtctctgctt

SEQ ID NO: 250701 - DNA, 20 bp, Artificial
  CRISPR gRNA sequence
tgagacagggtctctgcttt

SEQ ID NO: 250702 - DNA, 20 bp, Artificial
  CRISPR gRNA sequence
agacagggtctctgctttgt

SEQ ID NO: 250703 - DNA, 20 bp, Artificial
  CRISPR gRNA sequence
tgctttgtcacccaggctgg

SEQ ID NO: 250704 - DNA, 20 bp, Artificial
  CRISPR gRNA sequence
ctttgtcacccaggctggag

SEQ ID NO: 250705 - DNA, 20 bp, Artificial
  CRISPR gRNA sequence
tgtcacccaggctggagtgc

SEQ ID NO: 250706 - DNA, 20 bp, Artificial
  CRISPR gRNA sequence
gtcacccaggctggagtgca

SEQ ID NO: 250707 - DNA, 20 bp, Artificial
  CRISPR gRNA sequence
tcacccaggctggagtgcag

SEQ ID NO: 250708 - DNA, 20 bp, Artificial
  CRISPR gRNA sequence
gagtgcagtggtgtgatcat

SEQ ID NO: 250709 - DNA, 20 bp, Artificial
  CRISPR gRNA sequence
actgcagcctccacctcctg

SEQ ID NO: 250710 - DNA, 20 bp, Artificial
  CRISPR gRNA sequence
ctgcagcctccacctcctgg

SEQ ID NO: 250711 - DNA, 20 bp, Artificial
  CRISPR gRNA sequence
cagcctccacctcctgggct

SEQ ID NO: 250712 - DNA, 20 bp, Artificial
  CRISPR gRNA sequence
cacctcctgggctcaagtga

SEQ ID NO: 250713 - DNA, 20 bp, Artificial
  CRISPR gRNA sequence
ctgggctcaagtgatcctcc

SEQ ID NO: 250714 - DNA, 20 bp, Artificial
  CRISPR gRNA sequence
ggctcaagtgatcctccctc

SEQ ID NO: 250715 - DNA, 20 bp, Artificial
  CRISPR gRNA sequence
aagtgatcctccctccttgg

SEQ ID NO: 250716 - DNA, 20 bp, Artificial
  CRISPR gRNA sequence
cctccttggcctcccaagta

SEQ ID NO: 250717 - DNA, 20 bp, Artificial
  CRISPR gRNA sequence
cttggcctcccaagtagctg

SEQ ID NO: 250718 - DNA, 20 bp, Artificial
  CRISPR gRNA sequence
ggcctcccaagtagctggga

SEQ ID NO: 250719 - DNA, 20 bp, Artificial
  CRISPR gRNA sequence
gcctcccaagtagctgggac

SEQ ID NO: 250720 - DNA, 20 bp, Artificial
  CRISPR gRNA sequence
ccaagtagctgggactacag

SEQ ID NO: 250721 - DNA, 20 bp, Artificial
  CRISPR gRNA sequence
ggactacaggagtgtgccag

SEQ ID NO: 250722 - DNA, 20 bp, Artificial
  CRISPR gRNA sequence
caggagtgtgccagcacttg

SEQ ID NO: 250723 - DNA, 20 bp, Artificial
  CRISPR gRNA sequence
gctgtggacctattggactg

SEQ ID NO: 250724 - DNA, 20 bp, Artificial
  CRISPR gRNA sequence
ctgtggacctattggactga

SEQ ID NO: 250725 - DNA, 20 bp, Artificial
  CRISPR gRNA sequence
tggacctattggactgaaca

SEQ ID NO: 250726 - DNA, 20 bp, Artificial
  CRISPR gRNA sequence
ttggactgaacaaagggggg

SEQ ID NO: 250727 - DNA, 20 bp, Artificial
  CRISPR gRNA sequence
gactgaacaaaggggggcaa

SEQ ID NO: 250728 - DNA, 20 bp, Artificial
  CRISPR gRNA sequence
aacaaaggggggcaaaagcg

SEQ ID NO: 250729 - DNA, 20 bp, Artificial
  CRISPR gRNA sequence
ggaagaaggggtcagggggc

SEQ ID NO: 250730 - DNA, 20 bp, Artificial
  CRISPR gRNA sequence
gaagaaggggtcagggggca

SEQ ID NO: 250731 - DNA, 20 bp, Artificial
  CRISPR gRNA sequence
gcctctagtggacaagggcc

SEQ ID NO: 250732 - DNA, 20 bp, Artificial
  CRISPR gRNA sequence
cctctagtggacaagggccc

SEQ ID NO: 250733 - DNA, 20 bp, Artificial
  CRISPR gRNA sequence
tagtggacaagggccctgag

SEQ ID NO: 250734 - DNA, 20 bp, Artificial
  CRISPR gRNA sequence
gtggacaagggccctgagct

SEQ ID NO: 250735 - DNA, 20 bp, Artificial
  CRISPR gRNA sequence
agctttacacagccctccgt

SEQ ID NO: 250736 - DNA, 20 bp, Artificial
  CRISPR gRNA sequence
tacacagccctccgtattta

SEQ ID NO: 250737 - DNA, 20 bp, Artificial
  CRISPR gRNA sequence
acacagccctccgtatttat

SEQ ID NO: 250738 - DNA, 20 bp, Artificial
  CRISPR gRNA sequence
cacagccctccgtatttatt

SEQ ID NO: 250739 - DNA, 20 bp, Artificial
  CRISPR gRNA sequence
cgtatttattaggcaaaaga

SEQ ID NO: 250740 - DNA, 20 bp, Artificial
  CRISPR gRNA sequence
attaggcaaaagagatagtg

SEQ ID NO: 250741 - DNA, 20 bp, Artificial
  CRISPR gRNA sequence
ttaggcaaaagagatagtga

SEQ ID NO: 250742 - DNA, 20 bp, Artificial
  CRISPR gRNA sequence
ggcaaaagagatagtgagaa

SEQ ID NO: 250743 - DNA, 20 bp, Artificial
  CRISPR gRNA sequence
tcgggtaattgtcagttagc

SEQ ID NO: 250744 - DNA, 20 bp, Artificial
  CRISPR gRNA sequence
tcagttagccgtttggtgtt

SEQ ID NO: 250745 - DNA, 20 bp, Artificial
  CRISPR gRNA sequence
gccgtttggtgtttggttca

SEQ ID NO: 250746 - DNA, 20 bp, Artificial
  CRISPR gRNA sequence
ggtgtttggttcacagcagg

SEQ ID NO: 250747 - DNA, 20 bp, Artificial
  CRISPR gRNA sequence
gtgtttggttcacagcaggc

SEQ ID NO: 250748 - DNA, 20 bp, Artificial
  CRISPR gRNA sequence
ggttcacagcaggcttgtga

SEQ ID NO: 250749 - DNA, 20 bp, Artificial
  CRISPR gRNA sequence
gttcacagcaggcttgtgag

SEQ ID NO: 250750 - DNA, 20 bp, Artificial
  CRISPR gRNA sequence
acagcaggcttgtgagactg

SEQ ID NO: 250751 - DNA, 20 bp, Artificial
  CRISPR gRNA sequence
gtgagactgcatcctttgaa

SEQ ID NO: 250752 - DNA, 20 bp, Artificial
  CRISPR gRNA sequence
tgagactgcatcctttgaac

SEQ ID NO: 250753 - DNA, 20 bp, Artificial
  CRISPR gRNA sequence
catcctttgaacaataggtg

SEQ ID NO: 250754 - DNA, 20 bp, Artificial
  CRISPR gRNA sequence
tgaacaataggtgctagatt

SEQ ID NO: 250755 - DNA, 20 bp, Artificial
  CRISPR gRNA sequence
gaacaataggtgctagattt

SEQ ID NO: 250756 - DNA, 20 bp, Artificial
  CRISPR gRNA sequence
aacaataggtgctagatttc

SEQ ID NO: 250757 - DNA, 20 bp, Artificial
  CRISPR gRNA sequence
gatttctcaatagataactt

SEQ ID NO: 250758 - DNA, 20 bp, Artificial
  CRISPR gRNA sequence
ctcaatagataacttcaagg

SEQ ID NO: 250759 - DNA, 20 bp, Artificial
  CRISPR gRNA sequence
tcaatagataacttcaagga

SEQ ID NO: 250760 - DNA, 20 bp, Artificial
  CRISPR gRNA sequence
aatagataacttcaaggagc

SEQ ID NO: 250761 - DNA, 20 bp, Artificial
  CRISPR gRNA sequence
caaggagccagggagtagcg

SEQ ID NO: 250762 - DNA, 20 bp, Artificial
  CRISPR gRNA sequence
aaggagccagggagtagcgt

SEQ ID NO: 250763 - DNA, 20 bp, Artificial
  CRISPR gRNA sequence
agcaaactttttggtggcag

SEQ ID NO: 250764 - DNA, 20 bp, Artificial
  CRISPR gRNA sequence
tttggtggcagggcagtgtg

SEQ ID NO: 250765 - DNA, 20 bp, Artificial
  CRISPR gRNA sequence
ttggtggcagggcagtgtga

SEQ ID NO: 250766 - DNA, 20 bp, Artificial
  CRISPR gRNA sequence
tggtggcagggcagtgtgag

SEQ ID NO: 250767 - DNA, 20 bp, Artificial
  CRISPR gRNA sequence
ggtggcagggcagtgtgagt

SEQ ID NO: 250768 - DNA, 20 bp, Artificial
  CRISPR gRNA sequence
gtggcagggcagtgtgagtt

SEQ ID NO: 250769 - DNA, 20 bp, Artificial
  CRISPR gRNA sequence
gctcacatcttgcattcgtg

SEQ ID NO: 250770 - DNA, 20 bp, Artificial
  CRISPR gRNA sequence
ctcacatcttgcattcgtga

SEQ ID NO: 250771 - DNA, 20 bp, Artificial
  CRISPR gRNA sequence
acatcttgcattcgtgatga

SEQ ID NO: 250772 - DNA, 20 bp, Artificial
  CRISPR gRNA sequence
gcattcgtgatgaacacttt

SEQ ID NO: 250773 - DNA, 20 bp, Artificial
  CRISPR gRNA sequence
cattcgtgatgaacactttg

SEQ ID NO: 250774 - DNA, 20 bp, Artificial
  CRISPR gRNA sequence
gtgatgaacactttgctgtt

SEQ ID NO: 250775 - DNA, 20 bp, Artificial
  CRISPR gRNA sequence
tgctgtttgatcatatagcc

SEQ ID NO: 250776 - DNA, 20 bp, Artificial
  CRISPR gRNA sequence
gctgtttgatcatatagcct

SEQ ID NO: 250777 - DNA, 20 bp, Artificial
  CRISPR gRNA sequence
ctgtttgatcatatagcctc

SEQ ID NO: 250778 - DNA, 20 bp, Artificial
  CRISPR gRNA sequence
tttgatcatatagcctccag

SEQ ID NO: 250779 - DNA, 20 bp, Artificial
  CRISPR gRNA sequence
gatcatatagcctccagtgg

SEQ ID NO: 250780 - DNA, 20 bp, Artificial
  CRISPR gRNA sequence
atcatatagcctccagtgga

SEQ ID NO: 250781 - DNA, 20 bp, Artificial
  CRISPR gRNA sequence
cagtggaatgttgagttggt

SEQ ID NO: 250782 - DNA, 20 bp, Artificial
  CRISPR gRNA sequence
agttggtcacgtctcacggg

SEQ ID NO: 250783 - DNA, 20 bp, Artificial
  CRISPR gRNA sequence
gtcacgtctcacgggctttg

SEQ ID NO: 250784 - DNA, 20 bp, Artificial
  CRISPR gRNA sequence
acgggctttggctctctgca

SEQ ID NO: 250785 - DNA, 20 bp, Artificial
  CRISPR gRNA sequence
tggctctctgcatgcctggg

SEQ ID NO: 250786 - DNA, 20 bp, Artificial
  CRISPR gRNA sequence
ggctctctgcatgcctgggt

SEQ ID NO: 250787 - DNA, 20 bp, Artificial
  CRISPR gRNA sequence
gctctctgcatgcctgggta

SEQ ID NO: 250788 - DNA, 20 bp, Artificial
  CRISPR gRNA sequence
tctgcatgcctgggtaattt

SEQ ID NO: 250789 - DNA, 20 bp, Artificial
  CRISPR gRNA sequence
tgcatgcctgggtaattttt

SEQ ID NO: 250790 - DNA, 20 bp, Artificial
  CRISPR gRNA sequence
catgcctgggtaattttttt

SEQ ID NO: 250791 - DNA, 20 bp, Artificial
  CRISPR gRNA sequence
ggtaatttttttttttattt

SEQ ID NO: 250792 - DNA, 20 bp, Artificial
  CRISPR gRNA sequence
ttttttttattttgagacag

SEQ ID NO: 250793 - DNA, 20 bp, Artificial
  CRISPR gRNA sequence
tttttttattttgagacaga

SEQ ID NO: 250794 - DNA, 20 bp, Artificial
  CRISPR gRNA sequence
ttttttattttgagacagag

SEQ ID NO: 250795 - DNA, 20 bp, Artificial
  CRISPR gRNA sequence
tttttattttgagacagagt

SEQ ID NO: 250796 - DNA, 20 bp, Artificial
  CRISPR gRNA sequence
ttttattttgagacagagtc

SEQ ID NO: 250797 - DNA, 20 bp, Artificial
  CRISPR gRNA sequence
tttattttgagacagagtct

SEQ ID NO: 250798 - DNA, 20 bp, Artificial
  CRISPR gRNA sequence
ttattttgagacagagtctc

SEQ ID NO: 250799 - DNA, 20 bp, Artificial
  CRISPR gRNA sequence
tattttgagacagagtctca

SEQ ID NO: 250800 - DNA, 20 bp, Artificial
  CRISPR gRNA sequence
attttgagacagagtctcac

SEQ ID NO: 250801 - DNA, 20 bp, Artificial
  CRISPR gRNA sequence
ttttgagacagagtctcacc

SEQ ID NO: 250802 - DNA, 20 bp, Artificial
  CRISPR gRNA sequence
tgagacagagtctcaccatg

SEQ ID NO: 250803 - DNA, 20 bp, Artificial
  CRISPR gRNA sequence
gagacagagtctcaccatgt

SEQ ID NO: 250804 - DNA, 20 bp, Artificial
  CRISPR gRNA sequence
agacagagtctcaccatgtt

SEQ ID NO: 250805 - DNA, 20 bp, Artificial
  CRISPR gRNA sequence
accatgttgctcaggctggt

SEQ ID NO: 250806 - DNA, 20 bp, Artificial
  CRISPR gRNA sequence
ctcaggctggtcttgaactc

SEQ ID NO: 250807 - DNA, 20 bp, Artificial
  CRISPR gRNA sequence
aggctggtcttgaactcctg

SEQ ID NO: 250808 - DNA, 20 bp, Artificial
  CRISPR gRNA sequence
gtcttgaactcctggcctta

SEQ ID NO: 250809 - DNA, 20 bp, Artificial
  CRISPR gRNA sequence
gaactcctggccttaaacaa

SEQ ID NO: 250810 - DNA, 20 bp, Artificial
  CRISPR gRNA sequence
aactcctggccttaaacaat

SEQ ID NO: 250811 - DNA, 20 bp, Artificial
  CRISPR gRNA sequence
ctggccttaaacaatcctcc

SEQ ID NO: 250812 - DNA, 20 bp, Artificial
  CRISPR gRNA sequence
gccttaaacaatcctcctgc

SEQ ID NO: 250813 - DNA, 20 bp, Artificial
  CRISPR gRNA sequence
aaacaatcctcctgccttgg

SEQ ID NO: 250814 - DNA, 20 bp, Artificial
  CRISPR gRNA sequence
aacaatcctcctgccttggc

SEQ ID NO: 250815 - DNA, 20 bp, Artificial
  CRISPR gRNA sequence
ctgccttggcctcccaaagt

SEQ ID NO: 250816 - DNA, 20 bp, Artificial
  CRISPR gRNA sequence
ccttggcctcccaaagtgct

SEQ ID NO: 250817 - DNA, 20 bp, Artificial
  CRISPR gRNA sequence
ggcctcccaaagtgctggga

SEQ ID NO: 250818 - DNA, 20 bp, Artificial
  CRISPR gRNA sequence
gcctcccaaagtgctgggat

SEQ ID NO: 250819 - DNA, 20 bp, Artificial
  CRISPR gRNA sequence
ccaaagtgctgggattacag

SEQ ID NO: 250820 - DNA, 20 bp, Artificial
  CRISPR gRNA sequence
ggattacaggtgtgagccac

SEQ ID NO: 250821 - DNA, 20 bp, Artificial
  CRISPR gRNA sequence
caggtgtgagccactgtgcc

SEQ ID NO: 250822 - DNA, 20 bp, Artificial
  CRISPR gRNA sequence
tgcccatgcttgattcgttt

SEQ ID NO: 250823 - DNA, 20 bp, Artificial
  CRISPR gRNA sequence
gattcgttttaaatttttcg

SEQ ID NO: 250824 - DNA, 20 bp, Artificial
  CRISPR gRNA sequence
attcgttttaaatttttcgt

SEQ ID NO: 250825 - DNA, 20 bp, Artificial
  CRISPR gRNA sequence
gttttaaatttttcgtataa

SEQ ID NO: 250826 - DNA, 20 bp, Artificial
  CRISPR gRNA sequence
taaatttttcgtataaggtg

SEQ ID NO: 250827 - DNA, 20 bp, Artificial
  CRISPR gRNA sequence
aaatttttcgtataaggtgt

SEQ ID NO: 250828 - DNA, 20 bp, Artificial
  CRISPR gRNA sequence
aatttttcgtataaggtgtg

SEQ ID NO: 250829 - DNA, 20 bp, Artificial
  CRISPR gRNA sequence
ttcgtataaggtgtgagagg

SEQ ID NO: 250830 - DNA, 20 bp, Artificial
  CRISPR gRNA sequence
tcgtataaggtgtgagaggt

SEQ ID NO: 250831 - DNA, 20 bp, Artificial
  CRISPR gRNA sequence
cgtataaggtgtgagaggtt

SEQ ID NO: 250832 - DNA, 20 bp, Artificial
  CRISPR gRNA sequence
gtataaggtgtgagaggttt

SEQ ID NO: 250833 - DNA, 20 bp, Artificial
  CRISPR gRNA sequence
tagccaagttttttgttgtt

SEQ ID NO: 250834 - DNA, 20 bp, Artificial
  CRISPR gRNA sequence
agccaagttttttgttgttg

SEQ ID NO: 250835 - DNA, 20 bp, Artificial
  CRISPR gRNA sequence
gccaagttttttgttgttgt

SEQ ID NO: 250836 - DNA, 20 bp, Artificial
  CRISPR gRNA sequence
tttgttgttgtttttgttgt

SEQ ID NO: 250837 - DNA, 20 bp, Artificial
  CRISPR gRNA sequence
ttgttgttgtttttgttgtt

SEQ ID NO: 250838 - DNA, 20 bp, Artificial
  CRISPR gRNA sequence
tgttgttgtttttgttgttg

SEQ ID NO: 250839 - DNA, 20 bp, Artificial
  CRISPR gRNA sequence
gttgttgtttttgttgttgg

SEQ ID NO: 250840 - DNA, 20 bp, Artificial
  CRISPR gRNA sequence
ttgttgtttttgttgttgga

SEQ ID NO: 250841 - DNA, 20 bp, Artificial
  CRISPR gRNA sequence
ttgtttttgttgttggacta

SEQ ID NO: 250842 - DNA, 20 bp, Artificial
  CRISPR gRNA sequence
tttttgttgttggactatgg

SEQ ID NO: 250843 - DNA, 20 bp, Artificial
  CRISPR gRNA sequence
ttgttgttggactatggacg

SEQ ID NO: 250844 - DNA, 20 bp, Artificial
  CRISPR gRNA sequence
tgttgttggactatggacgt

SEQ ID NO: 250845 - DNA, 20 bp, Artificial
  CRISPR gRNA sequence
gttgttggactatggacgtc

SEQ ID NO: 250846 - DNA, 20 bp, Artificial
  CRISPR gRNA sequence
ttgttggactatggacgtcc

SEQ ID NO: 250847 - DNA, 20 bp, Artificial
  CRISPR gRNA sequence
ttggactatggacgtccaat

SEQ ID NO: 250848 - DNA, 20 bp, Artificial
  CRISPR gRNA sequence
gactatggacgtccaattgc

SEQ ID NO: 250849 - DNA, 20 bp, Artificial
  CRISPR gRNA sequence
tggacgtccaattgctctag

SEQ ID NO: 250850 - DNA, 20 bp, Artificial
  CRISPR gRNA sequence
ctctagcaccactagtggaa

SEQ ID NO: 250851 - DNA, 20 bp, Artificial
  CRISPR gRNA sequence
tagcaccactagtggaaaac

SEQ ID NO: 250852 - DNA, 20 bp, Artificial
  CRISPR gRNA sequence
gcaccactagtggaaaacat

SEQ ID NO: 250853 - DNA, 20 bp, Artificial
  CRISPR gRNA sequence
gtggaaaacattagtcatcc

SEQ ID NO: 250854 - DNA, 20 bp, Artificial
  CRISPR gRNA sequence
gtcatccttcattgtacctt

SEQ ID NO: 250855 - DNA, 20 bp, Artificial
  CRISPR gRNA sequence
cattgtacctttgtcaaagt

SEQ ID NO: 250856 - DNA, 20 bp, Artificial
  CRISPR gRNA sequence
attgtacctttgtcaaagtc

SEQ ID NO: 250857 - DNA, 20 bp, Artificial
  CRISPR gRNA sequence
tacctttgtcaaagtcagtt

SEQ ID NO: 250858 - DNA, 20 bp, Artificial
  CRISPR gRNA sequence
tgtcaaagtcagttggctgc

SEQ ID NO: 250859 - DNA, 20 bp, Artificial
  CRISPR gRNA sequence
gtcaaagtcagttggctgca

SEQ ID NO: 250860 - DNA, 20 bp, Artificial
  CRISPR gRNA sequence
tcaaagtcagttggctgcaa

SEQ ID NO: 250861 - DNA, 20 bp, Artificial
  CRISPR gRNA sequence
gctgcaattacgtggggcta

SEQ ID NO: 250862 - DNA, 20 bp, Artificial
  CRISPR gRNA sequence
caattacgtggggctatctg

SEQ ID NO: 250863 - DNA, 20 bp, Artificial
  CRISPR gRNA sequence
cgtggggctatctggtttcc

SEQ ID NO: 250864 - DNA, 20 bp, Artificial
  CRISPR gRNA sequence
tctggtttccctcttctgtt

SEQ ID NO: 250865 - DNA, 20 bp, Artificial
  CRISPR gRNA sequence
gtttccctcttctgttccat

SEQ ID NO: 250866 - DNA, 20 bp, Artificial
  CRISPR gRNA sequence
ccctcttctgttccattgat

SEQ ID NO: 250867 - DNA, 20 bp, Artificial
  CRISPR gRNA sequence
cctcttctgttccattgatc

SEQ ID NO: 250868 - DNA, 20 bp, Artificial
  CRISPR gRNA sequence
ttctgttccattgatccatg

SEQ ID NO: 250869 - DNA, 20 bp, Artificial
  CRISPR gRNA sequence
ctgttccattgatccatgtg

SEQ ID NO: 250870 - DNA, 20 bp, Artificial
  CRISPR gRNA sequence
tgttccattgatccatgtgt

SEQ ID NO: 250871 - DNA, 20 bp, Artificial
  CRISPR gRNA sequence
ttccattgatccatgtgttt

SEQ ID NO: 250872 - DNA, 20 bp, Artificial
  CRISPR gRNA sequence
cattgatccatgtgtttctt

SEQ ID NO: 250873 - DNA, 20 bp, Artificial
  CRISPR gRNA sequence
atccatgtgtttcttcttct

SEQ ID NO: 250874 - DNA, 20 bp, Artificial
  CRISPR gRNA sequence
cttcttctgccaataccaca

SEQ ID NO: 250875 - DNA, 20 bp, Artificial
  CRISPR gRNA sequence
ttcttctgccaataccacac

SEQ ID NO: 250876 - DNA, 20 bp, Artificial
  CRISPR gRNA sequence
cttctgccaataccacacag

SEQ ID NO: 250877 - DNA, 20 bp, Artificial
  CRISPR gRNA sequence
ttctgccaataccacacagc

SEQ ID NO: 250878 - DNA, 20 bp, Artificial
  CRISPR gRNA sequence
ctgccaataccacacagcct

SEQ ID NO: 250879 - DNA, 20 bp, Artificial
  CRISPR gRNA sequence
tgccaataccacacagcctt

SEQ ID NO: 250880 - DNA, 20 bp, Artificial
  CRISPR gRNA sequence
ccaataccacacagccttga

SEQ ID NO: 250881 - DNA, 20 bp, Artificial
  CRISPR gRNA sequence
gattactgtagttatacata

SEQ ID NO: 250882 - DNA, 20 bp, Artificial
  CRISPR gRNA sequence
attactgtagttatacataa

SEQ ID NO: 250883 - DNA, 20 bp, Artificial
  CRISPR gRNA sequence
ctgtagttatacataaatac

SEQ ID NO: 250884 - DNA, 20 bp, Artificial
  CRISPR gRNA sequence
tagttatacataaatactga

SEQ ID NO: 250885 - DNA, 20 bp, Artificial
  CRISPR gRNA sequence
tacataaatactgaaattgg

SEQ ID NO: 250886 - DNA, 20 bp, Artificial
  CRISPR gRNA sequence
aaattgggtagagggtggta

SEQ ID NO: 250887 - DNA, 20 bp, Artificial
  CRISPR gRNA sequence
ggtagagggtggtagtctct

SEQ ID NO: 250888 - DNA, 20 bp, Artificial
  CRISPR gRNA sequence
tcccactttattatttcatt

SEQ ID NO: 250889 - DNA, 20 bp, Artificial
  CRISPR gRNA sequence
ccactttattatttcatttc

SEQ ID NO: 250890 - DNA, 20 bp, Artificial
  CRISPR gRNA sequence
tattatttcatttcaaaatt

SEQ ID NO: 250891 - DNA, 20 bp, Artificial
  CRISPR gRNA sequence
attatttcatttcaaaattg

SEQ ID NO: 250892 - DNA, 20 bp, Artificial
  CRISPR gRNA sequence
ttatttcatttcaaaattgt

SEQ ID NO: 250893 - DNA, 20 bp, Artificial
  CRISPR gRNA sequence
tttcatttcaaaattgtttt

SEQ ID NO: 250894 - DNA, 20 bp, Artificial
  CRISPR gRNA sequence
catttcaaaattgttttatc

SEQ ID NO: 250895 - DNA, 20 bp, Artificial
  CRISPR gRNA sequence
atttcaaaattgttttatct

SEQ ID NO: 250896 - DNA, 20 bp, Artificial
  CRISPR gRNA sequence
caaaattgttttatctattc

SEQ ID NO: 250897 - DNA, 20 bp, Artificial
  CRISPR gRNA sequence
aaaattgttttatctattct

SEQ ID NO: 250898 - DNA, 20 bp, Artificial
  CRISPR gRNA sequence
ttttatctattctagttcct

SEQ ID NO: 250899 - DNA, 20 bp, Artificial
  CRISPR gRNA sequence
tatctattctagttcctttg

SEQ ID NO: 250900 - DNA, 20 bp, Artificial
  CRISPR gRNA sequence
atctattctagttcctttgc

SEQ ID NO: 250901 - DNA, 20 bp, Artificial
  CRISPR gRNA sequence
tctattctagttcctttgca

SEQ ID NO: 250902 - DNA, 20 bp, Artificial
  CRISPR gRNA sequence
ttctagttcctttgcatttc

SEQ ID NO: 250903 - DNA, 20 bp, Artificial
  CRISPR gRNA sequence
tagttcctttgcatttccac

SEQ ID NO: 250904 - DNA, 20 bp, Artificial
  CRISPR gRNA sequence
gttcctttgcatttccacat

SEQ ID NO: 250905 - DNA, 20 bp, Artificial
  CRISPR gRNA sequence
ctttgcatttccacatacat

SEQ ID NO: 250906 - DNA, 20 bp, Artificial
  CRISPR gRNA sequence
tgcatttccacatacatttt

SEQ ID NO: 250907 - DNA, 20 bp, Artificial
  CRISPR gRNA sequence
gcatttccacatacatttta

SEQ ID NO: 250908 - DNA, 20 bp, Artificial
  CRISPR gRNA sequence
catttccacatacattttag

SEQ ID NO: 250909 - DNA, 20 bp, Artificial
  CRISPR gRNA sequence
ccacatacattttaggataa

SEQ ID NO: 250910 - DNA, 20 bp, Artificial
  CRISPR gRNA sequence
cacatacattttaggataat

SEQ ID NO: 250911 - DNA, 20 bp, Artificial
  CRISPR gRNA sequence
taggataatatctatatcta

SEQ ID NO: 250912 - DNA, 20 bp, Artificial
  CRISPR gRNA sequence
aggataatatctatatctac

SEQ ID NO: 250913 - DNA, 20 bp, Artificial
  CRISPR gRNA sequence
ggataatatctatatctaca

SEQ ID NO: 250914 - DNA, 20 bp, Artificial
  CRISPR gRNA sequence
tatctacaaaaagccggctg

SEQ ID NO: 250915 - DNA, 20 bp, Artificial
  CRISPR gRNA sequence
caaaaagccggctgggattc

SEQ ID NO: 250916 - DNA, 20 bp, Artificial
  CRISPR gRNA sequence
ggattctgataacaattgtg

SEQ ID NO: 250917 - DNA, 20 bp, Artificial
  CRISPR gRNA sequence
tgataacaattgtgttaaat

SEQ ID NO: 250918 - DNA, 20 bp, Artificial
  CRISPR gRNA sequence
ataacaattgtgttaaatct

SEQ ID NO: 250919 - DNA, 20 bp, Artificial
  CRISPR gRNA sequence
tgttaaatctgcatatcagt

SEQ ID NO: 250920 - DNA, 20 bp, Artificial
  CRISPR gRNA sequence
aatctgcatatcagtttcgg

SEQ ID NO: 250921 - DNA, 20 bp, Artificial
  CRISPR gRNA sequence
catatcagtttcgggcaaat

SEQ ID NO: 250922 - DNA, 20 bp, Artificial
  CRISPR gRNA sequence
cgggcaaattgacatcttta

SEQ ID NO: 250923 - DNA, 20 bp, Artificial
  CRISPR gRNA sequence
gggcaaattgacatctttac

SEQ ID NO: 250924 - DNA, 20 bp, Artificial
  CRISPR gRNA sequence
acatctttactatgtgaagt

SEQ ID NO: 250925 - DNA, 20 bp, Artificial
  CRISPR gRNA sequence
tactatgtgaagtacagtca

SEQ ID NO: 250926 - DNA, 20 bp, Artificial
  CRISPR gRNA sequence
actatgtgaagtacagtcac

SEQ ID NO: 250927 - DNA, 20 bp, Artificial
  CRISPR gRNA sequence
ctatgtgaagtacagtcaca

SEQ ID NO: 250928 - DNA, 20 bp, Artificial
  CRISPR gRNA sequence
tgtgaagtacagtcacatat

SEQ ID NO: 250929 - DNA, 20 bp, Artificial
  CRISPR gRNA sequence
aatgacaggggtagttctga

SEQ ID NO: 250930 - DNA, 20 bp, Artificial
  CRISPR gRNA sequence
atgacaggggtagttctgag

SEQ ID NO: 250931 - DNA, 20 bp, Artificial
  CRISPR gRNA sequence
tgagaaatgtgttgttaagt

SEQ ID NO: 250932 - DNA, 20 bp, Artificial
  CRISPR gRNA sequence
agaaatgtgttgttaagtga

SEQ ID NO: 250933 - DNA, 20 bp, Artificial
  CRISPR gRNA sequence
ttaagtgatttcgttgttgt

SEQ ID NO: 250934 - DNA, 20 bp, Artificial
  CRISPR gRNA sequence
agtgatttcgttgttgtgtg

SEQ ID NO: 250935 - DNA, 20 bp, Artificial
  CRISPR gRNA sequence
cgttgttgtgtgaacatcat

SEQ ID NO: 250936 - DNA, 20 bp, Artificial
  CRISPR gRNA sequence
gttgttgtgtgaacatcata

SEQ ID NO: 250937 - DNA, 20 bp, Artificial
  CRISPR gRNA sequence
ttgtgtgaacatcatagagg

SEQ ID NO: 250938 - DNA, 20 bp, Artificial
  CRISPR gRNA sequence
tgtgaacatcatagagggca

SEQ ID NO: 250939 - DNA, 20 bp, Artificial
  CRISPR gRNA sequence
atgcaaacctagatggtaca

SEQ ID NO: 250940 - DNA, 20 bp, Artificial
  CRISPR gRNA sequence
tgcaaacctagatggtacag

SEQ ID NO: 250941 - DNA, 20 bp, Artificial
  CRISPR gRNA sequence
gatggtacagcctactatac

SEQ ID NO: 250942 - DNA, 20 bp, Artificial
  CRISPR gRNA sequence
ctatacacctaggctggatg

SEQ ID NO: 250943 - DNA, 20 bp, Artificial
  CRISPR gRNA sequence
tacacctaggctggatggta

SEQ ID NO: 250944 - DNA, 20 bp, Artificial
  CRISPR gRNA sequence
ggctggatggtatagcctat

SEQ ID NO: 250945 - DNA, 20 bp, Artificial
  CRISPR gRNA sequence
gatggtatagcctatccctc

SEQ ID NO: 250946 - DNA, 20 bp, Artificial
  CRISPR gRNA sequence
tccctcctatactacaaacc

SEQ ID NO: 250947 - DNA, 20 bp, Artificial
  CRISPR gRNA sequence
ctatactacaaacctgtcag

SEQ ID NO: 250948 - DNA, 20 bp, Artificial
  CRISPR gRNA sequence
tactacaaacctgtcaggca

SEQ ID NO: 250949 - DNA, 20 bp, Artificial
  CRISPR gRNA sequence
caaacctgtcaggcatgtga

SEQ ID NO: 250950 - DNA, 20 bp, Artificial
  CRISPR gRNA sequence
tcaggcatgtgactgtaccg

SEQ ID NO: 250951 - DNA, 20 bp, Artificial
  CRISPR gRNA sequence
taccgaataccataggcaac

SEQ ID NO: 250952 - DNA, 20 bp, Artificial
  CRISPR gRNA sequence
taacataatggtatttgtgt

SEQ ID NO: 250953 - DNA, 20 bp, Artificial
  CRISPR gRNA sequence
gtgtagctaaacatatctaa

SEQ ID NO: 250954 - DNA, 20 bp, Artificial
  CRISPR gRNA sequence
tgtagctaaacatatctaaa

SEQ ID NO: 250955 - DNA, 20 bp, Artificial
  CRISPR gRNA sequence
aacatatctaaacatagaag

SEQ ID NO: 250956 - DNA, 20 bp, Artificial
  CRISPR gRNA sequence
aacatagaagaggtaccgtg

SEQ ID NO: 250957 - DNA, 20 bp, Artificial
  CRISPR gRNA sequence
tgccaggcgcagtggctcat

SEQ ID NO: 250958 - DNA, 20 bp, Artificial
  CRISPR gRNA sequence
gccaggcgcagtggctcatg

SEQ ID NO: 250959 - DNA, 20 bp, Artificial
  CRISPR gRNA sequence
ccaggcgcagtggctcatgt

SEQ ID NO: 250960 - DNA, 20 bp, Artificial
  CRISPR gRNA sequence
atgtctgtaatcccaacact

SEQ ID NO: 250961 - DNA, 20 bp, Artificial
  CRISPR gRNA sequence
taatcccaacactttgggag

SEQ ID NO: 250962 - DNA, 20 bp, Artificial
  CRISPR gRNA sequence
tgggagaccaaggtgggcag

SEQ ID NO: 250963 - DNA, 20 bp, Artificial
  CRISPR gRNA sequence
gggagaccaaggtgggcaga

SEQ ID NO: 250964 - DNA, 20 bp, Artificial
  CRISPR gRNA sequence
ggagaccaaggtgggcagat

SEQ ID NO: 250965 - DNA, 20 bp, Artificial
  CRISPR gRNA sequence
aggtcaggagttcgagacta

SEQ ID NO: 250966 - DNA, 20 bp, Artificial
  CRISPR gRNA sequence
gagactagcctggccaacat

SEQ ID NO: 250967 - DNA, 20 bp, Artificial
  CRISPR gRNA sequence
gcctggccaacatggtgaaa

SEQ ID NO: 250968 - DNA, 20 bp, Artificial
  CRISPR gRNA sequence
gccaacatggtgaaaccctg

SEQ ID NO: 250969 - DNA, 20 bp, Artificial
  CRISPR gRNA sequence
tttctactaaaaatacaaaa

SEQ ID NO: 250970 - DNA, 20 bp, Artificial
  CRISPR gRNA sequence
ctactaaaaatacaaaaatt

SEQ ID NO: 250971 - DNA, 20 bp, Artificial
  CRISPR gRNA sequence
tactaaaaatacaaaaatta

SEQ ID NO: 250972 - DNA, 20 bp, Artificial
  CRISPR gRNA sequence
ctaaaaatacaaaaattagc

SEQ ID NO: 250973 - DNA, 20 bp, Artificial
  CRISPR gRNA sequence
aaaatacaaaaattagccgg

SEQ ID NO: 250974 - DNA, 20 bp, Artificial
  CRISPR gRNA sequence
gccgggtgtggtggcgcatg

SEQ ID NO: 250975 - DNA, 20 bp, Artificial
  CRISPR gRNA sequence
taattccagccacttgggag

SEQ ID NO: 250976 - DNA, 20 bp, Artificial
  CRISPR gRNA sequence
cagccacttgggaggctgag

SEQ ID NO: 250977 - DNA, 20 bp, Artificial
  CRISPR gRNA sequence
gggaggctgaggtgggagaa

SEQ ID NO: 250978 - DNA, 20 bp, Artificial
  CRISPR gRNA sequence
ggaggctgaggtgggagaat

SEQ ID NO: 250979 - DNA, 20 bp, Artificial
  CRISPR gRNA sequence
aggtgggagaatcccttgaa

SEQ ID NO: 250980 - DNA, 20 bp, Artificial
  CRISPR gRNA sequence
gaacctgacaggcagaggtt

SEQ ID NO: 250981 - DNA, 20 bp, Artificial
  CRISPR gRNA sequence
aacctgacaggcagaggttg

SEQ ID NO: 250982 - DNA, 20 bp, Artificial
  CRISPR gRNA sequence
acaggcagaggttgcagtga

SEQ ID NO: 250983 - DNA, 20 bp, Artificial
  CRISPR gRNA sequence
cagtgagccgagatcgcatc

SEQ ID NO: 250984 - DNA, 20 bp, Artificial
  CRISPR gRNA sequence
cactcctggctgggcaacag

SEQ ID NO: 250985 - DNA, 20 bp, Artificial
  CRISPR gRNA sequence
ctggctgggcaacagagtga

SEQ ID NO: 250986 - DNA, 20 bp, Artificial
  CRISPR gRNA sequence
gctgggcaacagagtgagac

SEQ ID NO: 250987 - DNA, 20 bp, Artificial
  CRISPR gRNA sequence
ggcaacagagtgagacgcca

SEQ ID NO: 250988 - DNA, 20 bp, Artificial
  CRISPR gRNA sequence
gaaaccaggccacccagcag

SEQ ID NO: 250989 - DNA, 20 bp, Artificial
  CRISPR gRNA sequence
cctctgtatttatagcccct

SEQ ID NO: 250990 - DNA, 20 bp, Artificial
  CRISPR gRNA sequence
ctctgtatttatagcccctc

SEQ ID NO: 250991 - DNA, 20 bp, Artificial
  CRISPR gRNA sequence
tgtatttatagcccctcccc

SEQ ID NO: 250992 - DNA, 20 bp, Artificial
  CRISPR gRNA sequence
tatttatagcccctccccat

SEQ ID NO: 250993 - DNA, 20 bp, Artificial
  CRISPR gRNA sequence
atagcccctccccatgactt

SEQ ID NO: 250994 - DNA, 20 bp, Artificial
  CRISPR gRNA sequence
tagcccctccccatgacttg

SEQ ID NO: 250995 - DNA, 20 bp, Artificial
  CRISPR gRNA sequence
cccatgacttgcattaccgc

SEQ ID NO: 250996 - DNA, 20 bp, Artificial
  CRISPR gRNA sequence
gcattaccgccttatctcca

SEQ ID NO: 250997 - DNA, 20 bp, Artificial
  CRISPR gRNA sequence
cattaccgccttatctccat

SEQ ID NO: 250998 - DNA, 20 bp, Artificial
  CRISPR gRNA sequence
ccgccttatctccatctccc

SEQ ID NO: 250999 - DNA, 20 bp, Artificial
  CRISPR gRNA sequence
atctccatctcccatcagat

SEQ ID NO: 251000 - DNA, 20 bp, Artificial
  CRISPR gRNA sequence
tctccatctcccatcagatc

SEQ ID NO: 251001 - DNA, 20 bp, Artificial
  CRISPR gRNA sequence
catctcccatcagatcagca

SEQ ID NO: 251002 - DNA, 20 bp, Artificial
  CRISPR gRNA sequence
ccatcagatcagcagcggca

SEQ ID NO: 251003 - DNA, 20 bp, Artificial
  CRISPR gRNA sequence
gattctcataggagcatgaa

SEQ ID NO: 251004 - DNA, 20 bp, Artificial
  CRISPR gRNA sequence
tcataggagcatgaatccta

SEQ ID NO: 251005 - DNA, 20 bp, Artificial
  CRISPR gRNA sequence
ataggagcatgaatcctatt

SEQ ID NO: 251006 - DNA, 20 bp, Artificial
  CRISPR gRNA sequence
ttgtgaactgcgcatacgag

SEQ ID NO: 251007 - DNA, 20 bp, Artificial
  CRISPR gRNA sequence
tgaactgcgcatacgaggga

SEQ ID NO: 251008 - DNA, 20 bp, Artificial
  CRISPR gRNA sequence
cgcatacgagggatcgaggt

SEQ ID NO: 251009 - DNA, 20 bp, Artificial
  CRISPR gRNA sequence
cacgctccttatgagaatcc

SEQ ID NO: 251010 - DNA, 20 bp, Artificial
  CRISPR gRNA sequence
cttatgagaatccagtacct

SEQ ID NO: 251011 - DNA, 20 bp, Artificial
  CRISPR gRNA sequence
atgagaatccagtacctgat

SEQ ID NO: 251012 - DNA, 20 bp, Artificial
  CRISPR gRNA sequence
tgagaatccagtacctgatg

SEQ ID NO: 251013 - DNA, 20 bp, Artificial
  CRISPR gRNA sequence
atgatctgtcactgttcccc

SEQ ID NO: 251014 - DNA, 20 bp, Artificial
  CRISPR gRNA sequence
tcactgttccccatcacccc

SEQ ID NO: 251015 - DNA, 20 bp, Artificial
  CRISPR gRNA sequence
ttccccatcacccccagatg

SEQ ID NO: 251016 - DNA, 20 bp, Artificial
  CRISPR gRNA sequence
cccatcacccccagatggga

SEQ ID NO: 251017 - DNA, 20 bp, Artificial
  CRISPR gRNA sequence
tctagttgtaggaaaacaag

SEQ ID NO: 251018 - DNA, 20 bp, Artificial
  CRISPR gRNA sequence
gttgtaggaaaacaagctca

SEQ ID NO: 251019 - DNA, 20 bp, Artificial
  CRISPR gRNA sequence
taggaaaacaagctcagggc

SEQ ID NO: 251020 - DNA, 20 bp, Artificial
  CRISPR gRNA sequence
agggctcccactgattctac

SEQ ID NO: 251021 - DNA, 20 bp, Artificial
  CRISPR gRNA sequence
ccactgattctacattacag

SEQ ID NO: 251022 - DNA, 20 bp, Artificial
  CRISPR gRNA sequence
attctacattacagggagtt

SEQ ID NO: 251023 - DNA, 20 bp, Artificial
  CRISPR gRNA sequence
tacattacagggagttgtat

SEQ ID NO: 251024 - DNA, 20 bp, Artificial
  CRISPR gRNA sequence
cattacagggagttgtataa

SEQ ID NO: 251025 - DNA, 20 bp, Artificial
  CRISPR gRNA sequence
cagggagttgtataattatt

SEQ ID NO: 251026 - DNA, 20 bp, Artificial
  CRISPR gRNA sequence
tataattatttcattatata

SEQ ID NO: 251027 - DNA, 20 bp, Artificial
  CRISPR gRNA sequence
tttcattatatattacaaag

SEQ ID NO: 251028 - DNA, 20 bp, Artificial
  CRISPR gRNA sequence
cattatatattacaaagtaa

SEQ ID NO: 251029 - DNA, 20 bp, Artificial
  CRISPR gRNA sequence
attatatattacaaagtaat

SEQ ID NO: 251030 - DNA, 20 bp, Artificial
  CRISPR gRNA sequence
tatattacaaagtaataata

SEQ ID NO: 251031 - DNA, 20 bp, Artificial
  CRISPR gRNA sequence
caaagtaataataatagaaa

SEQ ID NO: 251032 - DNA, 20 bp, Artificial
  CRISPR gRNA sequence
gaatcatcctgaaaccatcc

SEQ ID NO: 251033 - DNA, 20 bp, Artificial
  CRISPR gRNA sequence
aatcatcctgaaaccatccc

SEQ ID NO: 251034 - DNA, 20 bp, Artificial
  CRISPR gRNA sequence
aaaccatccccccacccacc

SEQ ID NO: 251035 - DNA, 20 bp, Artificial
  CRISPR gRNA sequence
tcttccacaaaactggtccc

SEQ ID NO: 251036 - DNA, 20 bp, Artificial
  CRISPR gRNA sequence
ccacaaaactggtccctctt

SEQ ID NO: 251037 - DNA, 20 bp, Artificial
  CRISPR gRNA sequence
cacaaaactggtccctcttg

SEQ ID NO: 251038 - DNA, 20 bp, Artificial
  CRISPR gRNA sequence
gtccctcttgccaaaaaggt

SEQ ID NO: 251039 - DNA, 20 bp, Artificial
  CRISPR gRNA sequence
ttgccaaaaaggttggggac

SEQ ID NO: 251040 - DNA, 20 bp, Artificial
  CRISPR gRNA sequence
gccaaaaaggttggggacct

SEQ ID NO: 251041 - DNA, 20 bp, Artificial
  CRISPR gRNA sequence
ccaaaaaggttggggacctc

SEQ ID NO: 251042 - DNA, 20 bp, Artificial
  CRISPR gRNA sequence
gggacctctgctgtatatca

SEQ ID NO: 251043 - DNA, 20 bp, Artificial
  CRISPR gRNA sequence
tgctgtatatcactgtagtc

SEQ ID NO: 251044 - DNA, 20 bp, Artificial
  CRISPR gRNA sequence
ctgtatatcactgtagtctt

SEQ ID NO: 251045 - DNA, 20 bp, Artificial
  CRISPR gRNA sequence
tatatcactgtagtcttata

SEQ ID NO: 251046 - DNA, 20 bp, Artificial
  CRISPR gRNA sequence
tagtcttataaacactgtac

SEQ ID NO: 251047 - DNA, 20 bp, Artificial
  CRISPR gRNA sequence
ataaacactgtacacttaag

SEQ ID NO: 251048 - DNA, 20 bp, Artificial
  CRISPR gRNA sequence
taaacactgtacacttaagc

SEQ ID NO: 251049 - DNA, 20 bp, Artificial
  CRISPR gRNA sequence
tacacttaagctaacctaaa

SEQ ID NO: 251050 - DNA, 20 bp, Artificial
  CRISPR gRNA sequence
aagctaacctaaatttattt

SEQ ID NO: 251051 - DNA, 20 bp, Artificial
  CRISPR gRNA sequence
agctaacctaaatttattta

SEQ ID NO: 251052 - DNA, 20 bp, Artificial
  CRISPR gRNA sequence
acctaaatttatttaaaatg

SEQ ID NO: 251053 - DNA, 20 bp, Artificial
  CRISPR gRNA sequence
aatttatttaaaatgttctc

SEQ ID NO: 251054 - DNA, 20 bp, Artificial
  CRISPR gRNA sequence
atttaaaatgttctctttct

SEQ ID NO: 251055 - DNA, 20 bp, Artificial
  CRISPR gRNA sequence
tttaaaatgttctctttctt

SEQ ID NO: 251056 - DNA, 20 bp, Artificial
  CRISPR gRNA sequence
aaaatgttctctttcttcaa

SEQ ID NO: 251057 - DNA, 20 bp, Artificial
  CRISPR gRNA sequence
aaatgttctctttcttcaat

SEQ ID NO: 251058 - DNA, 20 bp, Artificial
  CRISPR gRNA sequence
tctttcttcaataataaatt

SEQ ID NO: 251059 - DNA, 20 bp, Artificial
  CRISPR gRNA sequence
tttcttcaataataaattaa

SEQ ID NO: 251060 - DNA, 20 bp, Artificial
  CRISPR gRNA sequence
tcttcaataataaattaacc

SEQ ID NO: 251061 - DNA, 20 bp, Artificial
  CRISPR gRNA sequence
cttcaataataaattaacct

SEQ ID NO: 251062 - DNA, 20 bp, Artificial
  CRISPR gRNA sequence
ttcaataataaattaacctt

SEQ ID NO: 251063 - DNA, 20 bp, Artificial
  CRISPR gRNA sequence
caataataaattaaccttag

SEQ ID NO: 251064 - DNA, 20 bp, Artificial
  CRISPR gRNA sequence
aataataaattaaccttagc

SEQ ID NO: 251065 - DNA, 20 bp, Artificial
  CRISPR gRNA sequence
accttagcttactgtgactt

SEQ ID NO: 251066 - DNA, 20 bp, Artificial
  CRISPR gRNA sequence
agcttactgtgactttttac

SEQ ID NO: 251067 - DNA, 20 bp, Artificial
  CRISPR gRNA sequence
gcttactgtgactttttact

SEQ ID NO: 251068 - DNA, 20 bp, Artificial
  CRISPR gRNA sequence
actgtgactttttacttcat

SEQ ID NO: 251069 - DNA, 20 bp, Artificial
  CRISPR gRNA sequence
ctgtgactttttacttcata

SEQ ID NO: 251070 - DNA, 20 bp, Artificial
  CRISPR gRNA sequence
tgactttttacttcataaac

SEQ ID NO: 251071 - DNA, 20 bp, Artificial
  CRISPR gRNA sequence
tttacttcataaactttaat

SEQ ID NO: 251072 - DNA, 20 bp, Artificial
  CRISPR gRNA sequence
ttacttcataaactttaatt

SEQ ID NO: 251073 - DNA, 20 bp, Artificial
  CRISPR gRNA sequence
tacttcataaactttaattt

SEQ ID NO: 251074 - DNA, 20 bp, Artificial
  CRISPR gRNA sequence
acttcataaactttaatttt

SEQ ID NO: 251075 - DNA, 20 bp, Artificial
  CRISPR gRNA sequence
cttcataaactttaattttt

SEQ ID NO: 251076 - DNA, 20 bp, Artificial
  CRISPR gRNA sequence
cataaactttaatttttttt

SEQ ID NO: 251077 - DNA, 20 bp, Artificial
  CRISPR gRNA sequence
ataaactttaattttttttt

SEQ ID NO: 251078 - DNA, 20 bp, Artificial
  CRISPR gRNA sequence
taatttttttttttttgagg

SEQ ID NO: 251079 - DNA, 20 bp, Artificial
  CRISPR gRNA sequence
aatttttttttttttgaggc

SEQ ID NO: 251080 - DNA, 20 bp, Artificial
  CRISPR gRNA sequence
atttttttttttttgaggca

SEQ ID NO: 251081 - DNA, 20 bp, Artificial
  CRISPR gRNA sequence
ttttttttttgaggcagggt

SEQ ID NO: 251082 - DNA, 20 bp, Artificial
  CRISPR gRNA sequence
tttttttttgaggcagggtc

SEQ ID NO: 251083 - DNA, 20 bp, Artificial
  CRISPR gRNA sequence
ttttttttgaggcagggtct

SEQ ID NO: 251084 - DNA, 20 bp, Artificial
  CRISPR gRNA sequence
tttttttgaggcagggtctt

SEQ ID NO: 251085 - DNA, 20 bp, Artificial
  CRISPR gRNA sequence
ttttttgaggcagggtcttg

SEQ ID NO: 251086 - DNA, 20 bp, Artificial
  CRISPR gRNA sequence
tttttgaggcagggtcttgc

SEQ ID NO: 251087 - DNA, 20 bp, Artificial
  CRISPR gRNA sequence
ttttgaggcagggtcttgct

SEQ ID NO: 251088 - DNA, 20 bp, Artificial
  CRISPR gRNA sequence
tttgaggcagggtcttgctg

SEQ ID NO: 251089 - DNA, 20 bp, Artificial
  CRISPR gRNA sequence
ttgaggcagggtcttgctgc

SEQ ID NO: 251090 - DNA, 20 bp, Artificial
  CRISPR gRNA sequence
tgaggcagggtcttgctgcc

SEQ ID NO: 251091 - DNA, 20 bp, Artificial
  CRISPR gRNA sequence
gaggcagggtcttgctgccc

SEQ ID NO: 251092 - DNA, 20 bp, Artificial
  CRISPR gRNA sequence
aggcagggtcttgctgccca

SEQ ID NO: 251093 - DNA, 20 bp, Artificial
  CRISPR gRNA sequence
gctgcccaggctggaatgca

SEQ ID NO: 251094 - DNA, 20 bp, Artificial
  CRISPR gRNA sequence
ctgcccaggctggaatgcag

SEQ ID NO: 251095 - DNA, 20 bp, Artificial
  CRISPR gRNA sequence
cccaggctggaatgcagtgg

SEQ ID NO: 251096 - DNA, 20 bp, Artificial
  CRISPR gRNA sequence
gaatgcagtggcgagatctt

SEQ ID NO: 251097 - DNA, 20 bp, Artificial
  CRISPR gRNA sequence
ggctcactgcagcctgcacc

SEQ ID NO: 251098 - DNA, 20 bp, Artificial
  CRISPR gRNA sequence
gctcactgcagcctgcacct

SEQ ID NO: 251099 - DNA, 20 bp, Artificial
  CRISPR gRNA sequence
actgcagcctgcacctccca

SEQ ID NO: 251100 - DNA, 20 bp, Artificial
  CRISPR gRNA sequence
cagcctgcacctcccaggtt

SEQ ID NO: 251101 - DNA, 20 bp, Artificial
  CRISPR gRNA sequence
cacctcccaggttcaagtga

SEQ ID NO: 251102 - DNA, 20 bp, Artificial
  CRISPR gRNA sequence
ccaggttcaagtgattctcc

SEQ ID NO: 251103 - DNA, 20 bp, Artificial
  CRISPR gRNA sequence
aagtgattctcctgcctcag

SEQ ID NO: 251104 - DNA, 20 bp, Artificial
  CRISPR gRNA sequence
tcctgcctcagccccccaag

SEQ ID NO: 251105 - DNA, 20 bp, Artificial
  CRISPR gRNA sequence
ctgcctcagccccccaagta

SEQ ID NO: 251106 - DNA, 20 bp, Artificial
  CRISPR gRNA sequence
cctcagccccccaagtagct

SEQ ID NO: 251107 - DNA, 20 bp, Artificial
  CRISPR gRNA sequence
agccccccaagtagctggga

SEQ ID NO: 251108 - DNA, 20 bp, Artificial
  CRISPR gRNA sequence
ggactacaggcagctgccac

SEQ ID NO: 251109 - DNA, 20 bp, Artificial
  CRISPR gRNA sequence
caggcagctgccaccacgcc

SEQ ID NO: 251110 - DNA, 20 bp, Artificial
  CRISPR gRNA sequence
ccaccacgcctggctaattt

SEQ ID NO: 251111 - DNA, 20 bp, Artificial
  CRISPR gRNA sequence
gctaatttttgtattagaga

SEQ ID NO: 251112 - DNA, 20 bp, Artificial
  CRISPR gRNA sequence
atttttgtattagagatggg

SEQ ID NO: 251113 - DNA, 20 bp, Artificial
  CRISPR gRNA sequence
ttgtattagagatggggttt

SEQ ID NO: 251114 - DNA, 20 bp, Artificial
  CRISPR gRNA sequence
tgtattagagatggggtttc

SEQ ID NO: 251115 - DNA, 20 bp, Artificial
  CRISPR gRNA sequence
gtattagagatggggtttca

SEQ ID NO: 251116 - DNA, 20 bp, Artificial
  CRISPR gRNA sequence
tattagagatggggtttcac

SEQ ID NO: 251117 - DNA, 20 bp, Artificial
  CRISPR gRNA sequence
gagatggggtttcaccatgt

SEQ ID NO: 251118 - DNA, 20 bp, Artificial
  CRISPR gRNA sequence
caccatgttggctaggctgg

SEQ ID NO: 251119 - DNA, 20 bp, Artificial
  CRISPR gRNA sequence
accatgttggctaggctggt

SEQ ID NO: 251120 - DNA, 20 bp, Artificial
  CRISPR gRNA sequence
gctaggctggtctcgaactc

SEQ ID NO: 251121 - DNA, 20 bp, Artificial
  CRISPR gRNA sequence
ggctggtctcgaactcctga

SEQ ID NO: 251122 - DNA, 20 bp, Artificial
  CRISPR gRNA sequence
gtctcgaactcctgagctcc

SEQ ID NO: 251123 - DNA, 20 bp, Artificial
  CRISPR gRNA sequence
gaactcctgagctccggtaa

SEQ ID NO: 251124 - DNA, 20 bp, Artificial
  CRISPR gRNA sequence
ctgagctccggtaatctgcc

SEQ ID NO: 251125 - DNA, 20 bp, Artificial
  CRISPR gRNA sequence
agctccggtaatctgcccac

SEQ ID NO: 251126 - DNA, 20 bp, Artificial
  CRISPR gRNA sequence
cggtaatctgcccacctcgg

SEQ ID NO: 251127 - DNA, 20 bp, Artificial
  CRISPR gRNA sequence
cccacctcggcctcccaaag

SEQ ID NO: 251128 - DNA, 20 bp, Artificial
  CRISPR gRNA sequence
ggcctcccaaagtgctggga

SEQ ID NO: 251129 - DNA, 20 bp, Artificial
  CRISPR gRNA sequence
ccaaagtgctgggattacag

SEQ ID NO: 251130 - DNA, 20 bp, Artificial
  CRISPR gRNA sequence
ggattacaggcatgagccac

SEQ ID NO: 251131 - DNA, 20 bp, Artificial
  CRISPR gRNA sequence
caggcatgagccaccgcacc

SEQ ID NO: 251132 - DNA, 20 bp, Artificial
  CRISPR gRNA sequence
taaacttaaaaaaaattttt

SEQ ID NO: 251133 - DNA, 20 bp, Artificial
  CRISPR gRNA sequence
aaaaaaaattttttttaact

SEQ ID NO: 251134 - DNA, 20 bp, Artificial
  CRISPR gRNA sequence
aaaaaaattttttttaactt

SEQ ID NO: 251135 - DNA, 20 bp, Artificial
  CRISPR gRNA sequence
tttttaactttttgactctt

SEQ ID NO: 251136 - DNA, 20 bp, Artificial
  CRISPR gRNA sequence
ttttaactttttgactcttt

SEQ ID NO: 251137 - DNA, 20 bp, Artificial
  CRISPR gRNA sequence
tttaactttttgactctttt

SEQ ID NO: 251138 - DNA, 20 bp, Artificial
  CRISPR gRNA sequence
ttaactttttgactcttttg

SEQ ID NO: 251139 - DNA, 20 bp, Artificial
  CRISPR gRNA sequence
taactttttgactcttttgt

SEQ ID NO: 251140 - DNA, 20 bp, Artificial
  CRISPR gRNA sequence
aactttttgactcttttgta

SEQ ID NO: 251141 - DNA, 20 bp, Artificial
  CRISPR gRNA sequence
actttttgactcttttgtaa

SEQ ID NO: 251142 - DNA, 20 bp, Artificial
  CRISPR gRNA sequence
tttgactcttttgtaataac

SEQ ID NO: 251143 - DNA, 20 bp, Artificial
  CRISPR gRNA sequence
ttgactcttttgtaataact

SEQ ID NO: 251144 - DNA, 20 bp, Artificial
  CRISPR gRNA sequence
tgactcttttgtaataactc

SEQ ID NO: 251145 - DNA, 20 bp, Artificial
  CRISPR gRNA sequence
gactcttttgtaataactct

SEQ ID NO: 251146 - DNA, 20 bp, Artificial
  CRISPR gRNA sequence
actcttttgtaataactctt

SEQ ID NO: 251147 - DNA, 20 bp, Artificial
  CRISPR gRNA sequence
ttttgtaataactcttagct

SEQ ID NO: 251148 - DNA, 20 bp, Artificial
  CRISPR gRNA sequence
ttgtaataactcttagctta

SEQ ID NO: 251149 - DNA, 20 bp, Artificial
  CRISPR gRNA sequence
tgtaataactcttagcttaa

SEQ ID NO: 251150 - DNA, 20 bp, Artificial
  CRISPR gRNA sequence
gtaataactcttagcttaaa

SEQ ID NO: 251151 - DNA, 20 bp, Artificial
  CRISPR gRNA sequence
taataactcttagcttaaaa

SEQ ID NO: 251152 - DNA, 20 bp, Artificial
  CRISPR gRNA sequence
ttagcttaaaacacaagcac

SEQ ID NO: 251153 - DNA, 20 bp, Artificial
  CRISPR gRNA sequence
agcttaaaacacaagcacat

SEQ ID NO: 251154 - DNA, 20 bp, Artificial
  CRISPR gRNA sequence
gcttaaaacacaagcacatt

SEQ ID NO: 251155 - DNA, 20 bp, Artificial
  CRISPR gRNA sequence
aaaacacaagcacattgtac

SEQ ID NO: 251156 - DNA, 20 bp, Artificial
  CRISPR gRNA sequence
aaacacaagcacattgtaca

SEQ ID NO: 251157 - DNA, 20 bp, Artificial
  CRISPR gRNA sequence
tacagctgtacaaaaatatt

SEQ ID NO: 251158 - DNA, 20 bp, Artificial
  CRISPR gRNA sequence
tacaaaaatattttctcttt

SEQ ID NO: 251159 - DNA, 20 bp, Artificial
  CRISPR gRNA sequence
tctctttatttccttattct

SEQ ID NO: 251160 - DNA, 20 bp, Artificial
  CRISPR gRNA sequence
ctctttatttccttattcta

SEQ ID NO: 251161 - DNA, 20 bp, Artificial
  CRISPR gRNA sequence
tctttatttccttattctat

SEQ ID NO: 251162 - DNA, 20 bp, Artificial
  CRISPR gRNA sequence
tttatttccttattctataa

SEQ ID NO: 251163 - DNA, 20 bp, Artificial
  CRISPR gRNA sequence
tatttccttattctataagc

SEQ ID NO: 251164 - DNA, 20 bp, Artificial
  CRISPR gRNA sequence
atttccttattctataagct

SEQ ID NO: 251165 - DNA, 20 bp, Artificial
  CRISPR gRNA sequence
tttccttattctataagctt

SEQ ID NO: 251166 - DNA, 20 bp, Artificial
  CRISPR gRNA sequence
ccttattctataagctttta

SEQ ID NO: 251167 - DNA, 20 bp, Artificial
  CRISPR gRNA sequence
cttattctataagcttttat

SEQ ID NO: 251168 - DNA, 20 bp, Artificial
  CRISPR gRNA sequence
attctataagcttttatcta

SEQ ID NO: 251169 - DNA, 20 bp, Artificial
  CRISPR gRNA sequence
ttctataagcttttatctat

SEQ ID NO: 251170 - DNA, 20 bp, Artificial
  CRISPR gRNA sequence
tataagcttttatctattta

SEQ ID NO: 251171 - DNA, 20 bp, Artificial
  CRISPR gRNA sequence
taagcttttatctatttaaa

SEQ ID NO: 251172 - DNA, 20 bp, Artificial
  CRISPR gRNA sequence
ttatctatttaaaagttttt

SEQ ID NO: 251173 - DNA, 20 bp, Artificial
  CRISPR gRNA sequence
tatctatttaaaagttttta

SEQ ID NO: 251174 - DNA, 20 bp, Artificial
  CRISPR gRNA sequence
atctatttaaaagtttttaa

SEQ ID NO: 251175 - DNA, 20 bp, Artificial
  CRISPR gRNA sequence
tctatttaaaagtttttaaa

SEQ ID NO: 251176 - DNA, 20 bp, Artificial
  CRISPR gRNA sequence
tttaaaagtttttaaattgc

SEQ ID NO: 251177 - DNA, 20 bp, Artificial
  CRISPR gRNA sequence
aaaagtttttaaattgcttt

SEQ ID NO: 251178 - DNA, 20 bp, Artificial
  CRISPR gRNA sequence
aaagtttttaaattgctttt

SEQ ID NO: 251179 - DNA, 20 bp, Artificial
  CRISPR gRNA sequence
ttaaattgctttttactttt

SEQ ID NO: 251180 - DNA, 20 bp, Artificial
  CRISPR gRNA sequence
taaattgctttttacttttt

SEQ ID NO: 251181 - DNA, 20 bp, Artificial
  CRISPR gRNA sequence
aaattgctttttacttttta

SEQ ID NO: 251182 - DNA, 20 bp, Artificial
  CRISPR gRNA sequence
aattgctttttactttttaa

SEQ ID NO: 251183 - DNA, 20 bp, Artificial
  CRISPR gRNA sequence
ctttttactttttaaacttt

SEQ ID NO: 251184 - DNA, 20 bp, Artificial
  CRISPR gRNA sequence
tttactttttaaactttttt

SEQ ID NO: 251185 - DNA, 20 bp, Artificial
  CRISPR gRNA sequence
ttactttttaaacttttttt

SEQ ID NO: 251186 - DNA, 20 bp, Artificial
  CRISPR gRNA sequence
tactttttaaactttttttg

SEQ ID NO: 251187 - DNA, 20 bp, Artificial
  CRISPR gRNA sequence
actttttaaactttttttgt

SEQ ID NO: 251188 - DNA, 20 bp, Artificial
  CRISPR gRNA sequence
ctttttaaactttttttgtg

SEQ ID NO: 251189 - DNA, 20 bp, Artificial
  CRISPR gRNA sequence
tttaaactttttttgtgaaa

SEQ ID NO: 251190 - DNA, 20 bp, Artificial
  CRISPR gRNA sequence
ttaaactttttttgtgaaaa

SEQ ID NO: 251191 - DNA, 20 bp, Artificial
  CRISPR gRNA sequence
taaactttttttgtgaaaaa

SEQ ID NO: 251192 - DNA, 20 bp, Artificial
  CRISPR gRNA sequence
aaactttttttgtgaaaaac

SEQ ID NO: 251193 - DNA, 20 bp, Artificial
  CRISPR gRNA sequence
aactttttttgtgaaaaact

SEQ ID NO: 251194 - DNA, 20 bp, Artificial
  CRISPR gRNA sequence
tttttgtgaaaaactaagac

SEQ ID NO: 251195 - DNA, 20 bp, Artificial
  CRISPR gRNA sequence
ttttgtgaaaaactaagaca

SEQ ID NO: 251196 - DNA, 20 bp, Artificial
  CRISPR gRNA sequence
tttgtgaaaaactaagacac

SEQ ID NO: 251197 - DNA, 20 bp, Artificial
  CRISPR gRNA sequence
ttgtgaaaaactaagacacg

SEQ ID NO: 251198 - DNA, 20 bp, Artificial
  CRISPR gRNA sequence
tgtgaaaaactaagacacga

SEQ ID NO: 251199 - DNA, 20 bp, Artificial
  CRISPR gRNA sequence
gtgaaaaactaagacacgaa

SEQ ID NO: 251200 - DNA, 20 bp, Artificial
  CRISPR gRNA sequence
tgaaaaactaagacacgaac

SEQ ID NO: 251201 - DNA, 20 bp, Artificial
  CRISPR gRNA sequence
agacacgaacacacttatta

SEQ ID NO: 251202 - DNA, 20 bp, Artificial
  CRISPR gRNA sequence
attagcctagacccacacag

SEQ ID NO: 251203 - DNA, 20 bp, Artificial
  CRISPR gRNA sequence
ttagcctagacccacacaga

SEQ ID NO: 251204 - DNA, 20 bp, Artificial
  CRISPR gRNA sequence
gcctagacccacacagagtt

SEQ ID NO: 251205 - DNA, 20 bp, Artificial
  CRISPR gRNA sequence
gacccacacagagttggtgt

SEQ ID NO: 251206 - DNA, 20 bp, Artificial
  CRISPR gRNA sequence
gtgtctgccacctccacatc

SEQ ID NO: 251207 - DNA, 20 bp, Artificial
  CRISPR gRNA sequence
ccacctccacatcttgtccc

SEQ ID NO: 251208 - DNA, 20 bp, Artificial
  CRISPR gRNA sequence
cacatcttgtcccactggaa

SEQ ID NO: 251209 - DNA, 20 bp, Artificial
  CRISPR gRNA sequence
gtcccactggaagatctttg

SEQ ID NO: 251210 - DNA, 20 bp, Artificial
  CRISPR gRNA sequence
tcccactggaagatctttgg

SEQ ID NO: 251211 - DNA, 20 bp, Artificial
  CRISPR gRNA sequence
gaagatctttggggcaaaaa

SEQ ID NO: 251212 - DNA, 20 bp, Artificial
  CRISPR gRNA sequence
tggggcaaaaacatgcatgt

SEQ ID NO: 251213 - DNA, 20 bp, Artificial
  CRISPR gRNA sequence
ggggcaaaaacatgcatgta

SEQ ID NO: 251214 - DNA, 20 bp, Artificial
  CRISPR gRNA sequence
gggcaaaaacatgcatgtag

SEQ ID NO: 251215 - DNA, 20 bp, Artificial
  CRISPR gRNA sequence
tcatctcctatgagaacaat

SEQ ID NO: 251216 - DNA, 20 bp, Artificial
  CRISPR gRNA sequence
ctatgagaacaatgtcttct

SEQ ID NO: 251217 - DNA, 20 bp, Artificial
  CRISPR gRNA sequence
tgagaacaatgtcttcttct

SEQ ID NO: 251218 - DNA, 20 bp, Artificial
  CRISPR gRNA sequence
cttctggaatacctcccaaa

SEQ ID NO: 251219 - DNA, 20 bp, Artificial
  CRISPR gRNA sequence
ttctggaatacctcccaaag

SEQ ID NO: 251220 - DNA, 20 bp, Artificial
  CRISPR gRNA sequence
ctggaatacctcccaaagga

SEQ ID NO: 251221 - DNA, 20 bp, Artificial
  CRISPR gRNA sequence
tggaatacctcccaaaggac

SEQ ID NO: 251222 - DNA, 20 bp, Artificial
  CRISPR gRNA sequence
gaatacctcccaaaggacct

SEQ ID NO: 251223 - DNA, 20 bp, Artificial
  CRISPR gRNA sequence
ccaaaggacctgcctgaggc

SEQ ID NO: 251224 - DNA, 20 bp, Artificial
  CRISPR gRNA sequence
cctgaggctgttttacaatt

SEQ ID NO: 251225 - DNA, 20 bp, Artificial
  CRISPR gRNA sequence
aggctgttttacaattaact

SEQ ID NO: 251226 - DNA, 20 bp, Artificial
  CRISPR gRNA sequence
ttttacaattaactggtttt

SEQ ID NO: 251227 - DNA, 20 bp, Artificial
  CRISPR gRNA sequence
tacaattaactggtttttgt

SEQ ID NO: 251228 - DNA, 20 bp, Artificial
  CRISPR gRNA sequence
acaattaactggtttttgtt

SEQ ID NO: 251229 - DNA, 20 bp, Artificial
  CRISPR gRNA sequence
caattaactggtttttgttt

SEQ ID NO: 251230 - DNA, 20 bp, Artificial
  CRISPR gRNA sequence
actggtttttgtttgtttgt

SEQ ID NO: 251231 - DNA, 20 bp, Artificial
  CRISPR gRNA sequence
gtttttgtttgtttgtttgt

SEQ ID NO: 251232 - DNA, 20 bp, Artificial
  CRISPR gRNA sequence
ttgtttgtttgtttgtttgt

SEQ ID NO: 251233 - DNA, 20 bp, Artificial
  CRISPR gRNA sequence
tgtttgtttgtttgtttgtt

SEQ ID NO: 251234 - DNA, 20 bp, Artificial
  CRISPR gRNA sequence
gtttgtttgtttgtttgttt

SEQ ID NO: 251235 - DNA, 20 bp, Artificial
  CRISPR gRNA sequence
tttgtttgtttgtttgtttg

SEQ ID NO: 251236 - DNA, 20 bp, Artificial
  CRISPR gRNA sequence
gtttgtttgtttgtttgttt

SEQ ID NO: 251237 - DNA, 20 bp, Artificial
  CRISPR gRNA sequence
tttgtttgtttgtttgtttt

SEQ ID NO: 251238 - DNA, 20 bp, Artificial
  CRISPR gRNA sequence
gtttgtttgtttgttttttg

SEQ ID NO: 251239 - DNA, 20 bp, Artificial
  CRISPR gRNA sequence
tttgtttgtttgttttttgt

SEQ ID NO: 251240 - DNA, 20 bp, Artificial
  CRISPR gRNA sequence
gtttgtttgttttttgtttg

SEQ ID NO: 251241 - DNA, 20 bp, Artificial
  CRISPR gRNA sequence
tttgtttgttttttgtttga

SEQ ID NO: 251242 - DNA, 20 bp, Artificial
  CRISPR gRNA sequence
gtttgttttttgtttgagag

SEQ ID NO: 251243 - DNA, 20 bp, Artificial
  CRISPR gRNA sequence
tttgttttttgtttgagagg

SEQ ID NO: 251244 - DNA, 20 bp, Artificial
  CRISPR gRNA sequence
gttttttgtttgagaggagt

SEQ ID NO: 251245 - DNA, 20 bp, Artificial
  CRISPR gRNA sequence
ttttttgtttgagaggagtc

SEQ ID NO: 251246 - DNA, 20 bp, Artificial
  CRISPR gRNA sequence
tttgtttgagaggagtcttg

SEQ ID NO: 251247 - DNA, 20 bp, Artificial
  CRISPR gRNA sequence
ttgtttgagaggagtcttgc

SEQ ID NO: 251248 - DNA, 20 bp, Artificial
  CRISPR gRNA sequence
tgtttgagaggagtcttgct

SEQ ID NO: 251249 - DNA, 20 bp, Artificial
  CRISPR gRNA sequence
gtttgagaggagtcttgctc

SEQ ID NO: 251250 - DNA, 20 bp, Artificial
  CRISPR gRNA sequence
tttgagaggagtcttgctct

SEQ ID NO: 251251 - DNA, 20 bp, Artificial
  CRISPR gRNA sequence
gagaggagtcttgctctgtt

SEQ ID NO: 251252 - DNA, 20 bp, Artificial
  CRISPR gRNA sequence
agaggagtcttgctctgttg

SEQ ID NO: 251253 - DNA, 20 bp, Artificial
  CRISPR gRNA sequence
gctctgttgcccaggctgga

SEQ ID NO: 251254 - DNA, 20 bp, Artificial
  CRISPR gRNA sequence
ctctgttgcccaggctggag

SEQ ID NO: 251255 - DNA, 20 bp, Artificial
  CRISPR gRNA sequence
tgttgcccaggctggagtgc

SEQ ID NO: 251256 - DNA, 20 bp, Artificial
  CRISPR gRNA sequence
ttgcccaggctggagtgcaa

SEQ ID NO: 251257 - DNA, 20 bp, Artificial
  CRISPR gRNA sequence
cccaggctggagtgcaatgg

SEQ ID NO: 251258 - DNA, 20 bp, Artificial
  CRISPR gRNA sequence
gagtgcaatggggcggtctc

SEQ ID NO: 251259 - DNA, 20 bp, Artificial
  CRISPR gRNA sequence
ggctccctgcaacctctgcc

SEQ ID NO: 251260 - DNA, 20 bp, Artificial
  CRISPR gRNA sequence
cctgcaacctctgcctcccg

SEQ ID NO: 251261 - DNA, 20 bp, Artificial
  CRISPR gRNA sequence
caacctctgcctcccgggtt

SEQ ID NO: 251262 - DNA, 20 bp, Artificial
  CRISPR gRNA sequence
tgcctcccgggttcaaggga

SEQ ID NO: 251263 - DNA, 20 bp, Artificial
  CRISPR gRNA sequence
cctcccgggttcaagggatt

SEQ ID NO: 251264 - DNA, 20 bp, Artificial
  CRISPR gRNA sequence
ccgggttcaagggattctcc

SEQ ID NO: 251265 - DNA, 20 bp, Artificial
  CRISPR gRNA sequence
aagggattctcctgtctcag

SEQ ID NO: 251266 - DNA, 20 bp, Artificial
  CRISPR gRNA sequence
tcctgtctcagcctcccgag

SEQ ID NO: 251267 - DNA, 20 bp, Artificial
  CRISPR gRNA sequence
ctgtctcagcctcccgagta

SEQ ID NO: 251268 - DNA, 20 bp, Artificial
  CRISPR gRNA sequence
tctcagcctcccgagtagct

SEQ ID NO: 251269 - DNA, 20 bp, Artificial
  CRISPR gRNA sequence
agcctcccgagtagctggga

SEQ ID NO: 251270 - DNA, 20 bp, Artificial
  CRISPR gRNA sequence
ccgagtagctgggattacag

SEQ ID NO: 251271 - DNA, 20 bp, Artificial
  CRISPR gRNA sequence
ggattacaggtgcatgccgc

SEQ ID NO: 251272 - DNA, 20 bp, Artificial
  CRISPR gRNA sequence
caggtgcatgccgccatgcc

SEQ ID NO: 251273 - DNA, 20 bp, Artificial
  CRISPR gRNA sequence
gctaattttttgtactttag

SEQ ID NO: 251274 - DNA, 20 bp, Artificial
  CRISPR gRNA sequence
attttttgtactttagtaga

SEQ ID NO: 251275 - DNA, 20 bp, Artificial
  CRISPR gRNA sequence
tttgtactttagtagagaca

SEQ ID NO: 251276 - DNA, 20 bp, Artificial
  CRISPR gRNA sequence
ttgtactttagtagagacag

SEQ ID NO: 251277 - DNA, 20 bp, Artificial
  CRISPR gRNA sequence
tgtactttagtagagacagg

SEQ ID NO: 251278 - DNA, 20 bp, Artificial
  CRISPR gRNA sequence
gtactttagtagagacaggg

SEQ ID NO: 251279 - DNA, 20 bp, Artificial
  CRISPR gRNA sequence
tactttagtagagacagggt

SEQ ID NO: 251280 - DNA, 20 bp, Artificial
  CRISPR gRNA sequence
tagtagagacagggtttcac

SEQ ID NO: 251281 - DNA, 20 bp, Artificial
  CRISPR gRNA sequence
agtagagacagggtttcacc

SEQ ID NO: 251282 - DNA, 20 bp, Artificial
  CRISPR gRNA sequence
gtagagacagggtttcacca

SEQ ID NO: 251283 - DNA, 20 bp, Artificial
  CRISPR gRNA sequence
caccaaattgcccaggctag

SEQ ID NO: 251284 - DNA, 20 bp, Artificial
  CRISPR gRNA sequence
accaaattgcccaggctagt

SEQ ID NO: 251285 - DNA, 20 bp, Artificial
  CRISPR gRNA sequence
cccaggctagtctcaaactc

SEQ ID NO: 251286 - DNA, 20 bp, Artificial
  CRISPR gRNA sequence
gtctcaaactcctgagctca

SEQ ID NO: 251287 - DNA, 20 bp, Artificial
  CRISPR gRNA sequence
aaactcctgagctcaggcaa

SEQ ID NO: 251288 - DNA, 20 bp, Artificial
  CRISPR gRNA sequence
ctgagctcaggcaatccacc

SEQ ID NO: 251289 - DNA, 20 bp, Artificial
  CRISPR gRNA sequence
agctcaggcaatccacctgc

SEQ ID NO: 251290 - DNA, 20 bp, Artificial
  CRISPR gRNA sequence
aggcaatccacctgccttgg

SEQ ID NO: 251291 - DNA, 20 bp, Artificial
  CRISPR gRNA sequence
ccttggcctcccaaagtgct

SEQ ID NO: 251292 - DNA, 20 bp, Artificial
  CRISPR gRNA sequence
ggcctcccaaagtgctggga

SEQ ID NO: 251293 - DNA, 20 bp, Artificial
  CRISPR gRNA sequence
gcctcccaaagtgctgggat

SEQ ID NO: 251294 - DNA, 20 bp, Artificial
  CRISPR gRNA sequence
ccaaagtgctgggattacag

SEQ ID NO: 251295 - DNA, 20 bp, Artificial
  CRISPR gRNA sequence
ggattacaggtgtgagccac

SEQ ID NO: 251296 - DNA, 20 bp, Artificial
  CRISPR gRNA sequence
caggtgtgagccacaacacc

SEQ ID NO: 251297 - DNA, 20 bp, Artificial
  CRISPR gRNA sequence
aactggttatatatatatat

SEQ ID NO: 251298 - DNA, 20 bp, Artificial
  CRISPR gRNA sequence
actggttatatatatatata

SEQ ID NO: 251299 - DNA, 20 bp, Artificial
  CRISPR gRNA sequence
gttatatatatatatatata

SEQ ID NO: 251300 - DNA, 20 bp, Artificial
  CRISPR gRNA sequence
tatatatatatatatatata

SEQ ID NO: 251301 - DNA, 20 bp, Artificial
  CRISPR gRNA sequence
tgaaataactataaaaagta

SEQ ID NO: 251302 - DNA, 20 bp, Artificial
  CRISPR gRNA sequence
taaaaagtatggtatagtaa

SEQ ID NO: 251303 - DNA, 20 bp, Artificial
  CRISPR gRNA sequence
ctaacatagtcatttattgt

SEQ ID NO: 251304 - DNA, 20 bp, Artificial
  CRISPR gRNA sequence
acatagtcatttattgtcat

SEQ ID NO: 251305 - DNA, 20 bp, Artificial
  CRISPR gRNA sequence
attgtcattgtcaaggatta

SEQ ID NO: 251306 - DNA, 20 bp, Artificial
  CRISPR gRNA sequence
ttgtcattgtcaaggattat

SEQ ID NO: 251307 - DNA, 20 bp, Artificial
  CRISPR gRNA sequence
tcattgtcaaggattatgtg

SEQ ID NO: 251308 - DNA, 20 bp, Artificial
  CRISPR gRNA sequence
tcaaggattatgtgctgtac

SEQ ID NO: 251309 - DNA, 20 bp, Artificial
  CRISPR gRNA sequence
tgtgctgtacataattgcat

SEQ ID NO: 251310 - DNA, 20 bp, Artificial
  CRISPR gRNA sequence
tacataattgcatatgctac

SEQ ID NO: 251311 - DNA, 20 bp, Artificial
  CRISPR gRNA sequence
catatgctacactttacaca

SEQ ID NO: 251312 - DNA, 20 bp, Artificial
  CRISPR gRNA sequence
cactttacacaactggcagc

SEQ ID NO: 251313 - DNA, 20 bp, Artificial
  CRISPR gRNA sequence
tacacaactggcagctcagt

SEQ ID NO: 251314 - DNA, 20 bp, Artificial
  CRISPR gRNA sequence
acacaactggcagctcagta

SEQ ID NO: 251315 - DNA, 20 bp, Artificial
  CRISPR gRNA sequence
cacaactggcagctcagtag

SEQ ID NO: 251316 - DNA, 20 bp, Artificial
  CRISPR gRNA sequence
gcagctcagtaggtttttta

SEQ ID NO: 251317 - DNA, 20 bp, Artificial
  CRISPR gRNA sequence
agtaggttttttacatcagt

SEQ ID NO: 251318 - DNA, 20 bp, Artificial
  CRISPR gRNA sequence
tttacatcagtatcaccaca

SEQ ID NO: 251319 - DNA, 20 bp, Artificial
  CRISPR gRNA sequence
ttacatcagtatcaccacaa

SEQ ID NO: 251320 - DNA, 20 bp, Artificial
  CRISPR gRNA sequence
tacatcagtatcaccacaaa

SEQ ID NO: 251321 - DNA, 20 bp, Artificial
  CRISPR gRNA sequence
acatcagtatcaccacaaac

SEQ ID NO: 251322 - DNA, 20 bp, Artificial
  CRISPR gRNA sequence
catcagtatcaccacaaacg

SEQ ID NO: 251323 - DNA, 20 bp, Artificial
  CRISPR gRNA sequence
tgctgcaatgttatgatggt

SEQ ID NO: 251324 - DNA, 20 bp, Artificial
  CRISPR gRNA sequence
caatgttatgatggttggac

SEQ ID NO: 251325 - DNA, 20 bp, Artificial
  CRISPR gRNA sequence
tgatggttggacatcacgag

SEQ ID NO: 251326 - DNA, 20 bp, Artificial
  CRISPR gRNA sequence
gacatcacgaggcaatagga

SEQ ID NO: 251327 - DNA, 20 bp, Artificial
  CRISPR gRNA sequence
ttcagctccactataatctt

SEQ ID NO: 251328 - DNA, 20 bp, Artificial
  CRISPR gRNA sequence
tcagctccactataatctta

SEQ ID NO: 251329 - DNA, 20 bp, Artificial
  CRISPR gRNA sequence
cagctccactataatcttat

SEQ ID NO: 251330 - DNA, 20 bp, Artificial
  CRISPR gRNA sequence
agctccactataatcttatg

SEQ ID NO: 251331 - DNA, 20 bp, Artificial
  CRISPR gRNA sequence
cactataatcttatgggacc

SEQ ID NO: 251332 - DNA, 20 bp, Artificial
  CRISPR gRNA sequence
taatcttatgggaccacgat

SEQ ID NO: 251333 - DNA, 20 bp, Artificial
  CRISPR gRNA sequence
atgggaccacgatcatatat

SEQ ID NO: 251334 - DNA, 20 bp, Artificial
  CRISPR gRNA sequence
tgggaccacgatcatatatg

SEQ ID NO: 251335 - DNA, 20 bp, Artificial
  CRISPR gRNA sequence
tttttgaccaaaacgttgtt

SEQ ID NO: 251336 - DNA, 20 bp, Artificial
  CRISPR gRNA sequence
ttgaccaaaacgttgttgta

SEQ ID NO: 251337 - DNA, 20 bp, Artificial
  CRISPR gRNA sequence
tgaccaaaacgttgttgtac

SEQ ID NO: 251338 - DNA, 20 bp, Artificial
  CRISPR gRNA sequence
gaccaaaacgttgttgtacg

SEQ ID NO: 251339 - DNA, 20 bp, Artificial
  CRISPR gRNA sequence
accaaaacgttgttgtacgc

SEQ ID NO: 251340 - DNA, 20 bp, Artificial
  CRISPR gRNA sequence
ttgtacgctgtatgactgta

SEQ ID NO: 251341 - DNA, 20 bp, Artificial
  CRISPR gRNA sequence
tacgctgtatgactgtattc

SEQ ID NO: 251342 - DNA, 20 bp, Artificial
  CRISPR gRNA sequence
tatgactgtattctaatgca

SEQ ID NO: 251343 - DNA, 20 bp, Artificial
  CRISPR gRNA sequence
tattctaatgcaggaacata

SEQ ID NO: 251344 - DNA, 20 bp, Artificial
  CRISPR gRNA sequence
taatgcaggaacatagtatg

SEQ ID NO: 251345 - DNA, 20 bp, Artificial
  CRISPR gRNA sequence
atgcaggaacatagtatgtc

SEQ ID NO: 251346 - DNA, 20 bp, Artificial
  CRISPR gRNA sequence
ttcatttatacattttaaaa

SEQ ID NO: 251347 - DNA, 20 bp, Artificial
  CRISPR gRNA sequence
catttatacattttaaaatt

SEQ ID NO: 251348 - DNA, 20 bp, Artificial
  CRISPR gRNA sequence
atttatacattttaaaattt

SEQ ID NO: 251349 - DNA, 20 bp, Artificial
  CRISPR gRNA sequence
atacattttaaaatttattt

SEQ ID NO: 251350 - DNA, 20 bp, Artificial
  CRISPR gRNA sequence
tacattttaaaatttatttc

SEQ ID NO: 251351 - DNA, 20 bp, Artificial
  CRISPR gRNA sequence
taaaatttatttcaccagca

SEQ ID NO: 251352 - DNA, 20 bp, Artificial
  CRISPR gRNA sequence
aaaatttatttcaccagcat

SEQ ID NO: 251353 - DNA, 20 bp, Artificial
  CRISPR gRNA sequence
aaatttatttcaccagcatt

SEQ ID NO: 251354 - DNA, 20 bp, Artificial
  CRISPR gRNA sequence
atttcaccagcattttgtag

SEQ ID NO: 251355 - DNA, 20 bp, Artificial
  CRISPR gRNA sequence
tttcaccagcattttgtagt

SEQ ID NO: 251356 - DNA, 20 bp, Artificial
  CRISPR gRNA sequence
caccagcattttgtagtttt

SEQ ID NO: 251357 - DNA, 20 bp, Artificial
  CRISPR gRNA sequence
accagcattttgtagttttc

SEQ ID NO: 251358 - DNA, 20 bp, Artificial
  CRISPR gRNA sequence
tgtagttttcactatacaag

SEQ ID NO: 251359 - DNA, 20 bp, Artificial
  CRISPR gRNA sequence
gtagttttcactatacaagt

SEQ ID NO: 251360 - DNA, 20 bp, Artificial
  CRISPR gRNA sequence
tagttttcactatacaagtt

SEQ ID NO: 251361 - DNA, 20 bp, Artificial
  CRISPR gRNA sequence
tcactatacaagttctgtat

SEQ ID NO: 251362 - DNA, 20 bp, Artificial
  CRISPR gRNA sequence
cactatacaagttctgtatg

SEQ ID NO: 251363 - DNA, 20 bp, Artificial
  CRISPR gRNA sequence
actatacaagttctgtatgt

SEQ ID NO: 251364 - DNA, 20 bp, Artificial
  CRISPR gRNA sequence
tacaagttctgtatgtgttt

SEQ ID NO: 251365 - DNA, 20 bp, Artificial
  CRISPR gRNA sequence
tgtatgtgttttgttagatt

SEQ ID NO: 251366 - DNA, 20 bp, Artificial
  CRISPR gRNA sequence
tatgtgttttgttagattta

SEQ ID NO: 251367 - DNA, 20 bp, Artificial
  CRISPR gRNA sequence
tgttagatttaggcctaagt

SEQ ID NO: 251368 - DNA, 20 bp, Artificial
  CRISPR gRNA sequence
gttagatttaggcctaagta

SEQ ID NO: 251369 - DNA, 20 bp, Artificial
  CRISPR gRNA sequence
ttagatttaggcctaagtaa

SEQ ID NO: 251370 - DNA, 20 bp, Artificial
  CRISPR gRNA sequence
gatttaggcctaagtaaaaa

SEQ ID NO: 251371 - DNA, 20 bp, Artificial
  CRISPR gRNA sequence
aggcctaagtaaaaaaaaaa

SEQ ID NO: 251372 - DNA, 20 bp, Artificial
  CRISPR gRNA sequence
ggcctaagtaaaaaaaaaat

SEQ ID NO: 251373 - DNA, 20 bp, Artificial
  CRISPR gRNA sequence
agtaaaaaaaaaatttttta

SEQ ID NO: 251374 - DNA, 20 bp, Artificial
  CRISPR gRNA sequence
tttagaagtcagggtcttgc

SEQ ID NO: 251375 - DNA, 20 bp, Artificial
  CRISPR gRNA sequence
ttagaagtcagggtcttgct

SEQ ID NO: 251376 - DNA, 20 bp, Artificial
  CRISPR gRNA sequence
tagaagtcagggtcttgctt

SEQ ID NO: 251377 - DNA, 20 bp, Artificial
  CRISPR gRNA sequence
agaagtcagggtcttgcttg

SEQ ID NO: 251378 - DNA, 20 bp, Artificial
  CRISPR gRNA sequence
gaagtcagggtcttgcttgc

SEQ ID NO: 251379 - DNA, 20 bp, Artificial
  CRISPR gRNA sequence
gcttgctctattacccaggc

SEQ ID NO: 251380 - DNA, 20 bp, Artificial
  CRISPR gRNA sequence
cttgctctattacccaggcg

SEQ ID NO: 251381 - DNA, 20 bp, Artificial
  CRISPR gRNA sequence
gctctattacccaggcggga

SEQ ID NO: 251382 - DNA, 20 bp, Artificial
  CRISPR gRNA sequence
ctctattacccaggcgggag

SEQ ID NO: 251383 - DNA, 20 bp, Artificial
  CRISPR gRNA sequence
tattacccaggcgggagtgc

SEQ ID NO: 251384 - DNA, 20 bp, Artificial
  CRISPR gRNA sequence
ttacccaggcgggagtgcag

SEQ ID NO: 251385 - DNA, 20 bp, Artificial
  CRISPR gRNA sequence
cccaggcgggagtgcagtgg

SEQ ID NO: 251386 - DNA, 20 bp, Artificial
  CRISPR gRNA sequence
aatgcagcctcaacttcctg

SEQ ID NO: 251387 - DNA, 20 bp, Artificial
  CRISPR gRNA sequence
aacttcctgggctcaagtga

SEQ ID NO: 251388 - DNA, 20 bp, Artificial
  CRISPR gRNA sequence
cctgggctcaagtgatcctc

SEQ ID NO: 251389 - DNA, 20 bp, Artificial
  CRISPR gRNA sequence
ctgggctcaagtgatcctcc

SEQ ID NO: 251390 - DNA, 20 bp, Artificial
  CRISPR gRNA sequence
ggctcaagtgatcctcccac

SEQ ID NO: 251391 - DNA, 20 bp, Artificial
  CRISPR gRNA sequence
aagtgatcctcccacctcag

SEQ ID NO: 251392 - DNA, 20 bp, Artificial
  CRISPR gRNA sequence
ccacctcagcctccagagta

SEQ ID NO: 251393 - DNA, 20 bp, Artificial
  CRISPR gRNA sequence
agcctccagagtagctgaga

SEQ ID NO: 251394 - DNA, 20 bp, Artificial
  CRISPR gRNA sequence
cagagtagctgagactacag

SEQ ID NO: 251395 - DNA, 20 bp, Artificial
  CRISPR gRNA sequence
agactacagtcatgtgccac

SEQ ID NO: 251396 - DNA, 20 bp, Artificial
  CRISPR gRNA sequence
cagtcatgtgccaccacccc

SEQ ID NO: 251397 - DNA, 20 bp, Artificial
  CRISPR gRNA sequence
gctaatttttaaatgttttg

SEQ ID NO: 251398 - DNA, 20 bp, Artificial
  CRISPR gRNA sequence
atttttaaatgttttgtaga

SEQ ID NO: 251399 - DNA, 20 bp, Artificial
  CRISPR gRNA sequence
ttaaatgttttgtagagaca

SEQ ID NO: 251400 - DNA, 20 bp, Artificial
  CRISPR gRNA sequence
taaatgttttgtagagacag

SEQ ID NO: 251401 - DNA, 20 bp, Artificial
  CRISPR gRNA sequence
aaatgttttgtagagacagg

SEQ ID NO: 251402 - DNA, 20 bp, Artificial
  CRISPR gRNA sequence
aatgttttgtagagacaggg

SEQ ID NO: 251403 - DNA, 20 bp, Artificial
  CRISPR gRNA sequence
tgtagagacagggtcttgct

SEQ ID NO: 251404 - DNA, 20 bp, Artificial
  CRISPR gRNA sequence
gtagagacagggtcttgctc

SEQ ID NO: 251405 - DNA, 20 bp, Artificial
  CRISPR gRNA sequence
tagagacagggtcttgctct

SEQ ID NO: 251406 - DNA, 20 bp, Artificial
  CRISPR gRNA sequence
gctctgttacccaagctggt

SEQ ID NO: 251407 - DNA, 20 bp, Artificial
  CRISPR gRNA sequence
ctctgttacccaagctggtc

SEQ ID NO: 251408 - DNA, 20 bp, Artificial
  CRISPR gRNA sequence
tgttacccaagctggtctag

SEQ ID NO: 251409 - DNA, 20 bp, Artificial
  CRISPR gRNA sequence
ttacccaagctggtctagaa

SEQ ID NO: 251410 - DNA, 20 bp, Artificial
  CRISPR gRNA sequence
cccaagctggtctagaactc

SEQ ID NO: 251411 - DNA, 20 bp, Artificial
  CRISPR gRNA sequence
gtctagaactcctggactca

SEQ ID NO: 251412 - DNA, 20 bp, Artificial
  CRISPR gRNA sequence
gaactcctggactcaagcga

SEQ ID NO: 251413 - DNA, 20 bp, Artificial
  CRISPR gRNA sequence
ctggactcaagcgatcctcc

SEQ ID NO: 251414 - DNA, 20 bp, Artificial
  CRISPR gRNA sequence
gactcaagcgatcctcctgc

SEQ ID NO: 251415 - DNA, 20 bp, Artificial
  CRISPR gRNA sequence
aagcgatcctcctgccttgg

SEQ ID NO: 251416 - DNA, 20 bp, Artificial
  CRISPR gRNA sequence
ctgccttggcccccatagta

SEQ ID NO: 251417 - DNA, 20 bp, Artificial
  CRISPR gRNA sequence
ccttggcccccatagtattg

SEQ ID NO: 251418 - DNA, 20 bp, Artificial
  CRISPR gRNA sequence
ggcccccatagtattgggat

SEQ ID NO: 251419 - DNA, 20 bp, Artificial
  CRISPR gRNA sequence
gcccccatagtattgggatt

SEQ ID NO: 251420 - DNA, 20 bp, Artificial
  CRISPR gRNA sequence
ggattacaggcgtgagcccc

SEQ ID NO: 251421 - DNA, 20 bp, Artificial
  CRISPR gRNA sequence
caggcgtgagcccccacacc

SEQ ID NO: 251422 - DNA, 20 bp, Artificial
  CRISPR gRNA sequence
ctggatctaatttagatctt

SEQ ID NO: 251423 - DNA, 20 bp, Artificial
  CRISPR gRNA sequence
tggatctaatttagatcttg

SEQ ID NO: 251424 - DNA, 20 bp, Artificial
  CRISPR gRNA sequence
gatctaatttagatcttgta

SEQ ID NO: 251425 - DNA, 20 bp, Artificial
  CRISPR gRNA sequence
atttagatcttgtattttct

SEQ ID NO: 251426 - DNA, 20 bp, Artificial
  CRISPR gRNA sequence
agatcttgtattttctcagg

SEQ ID NO: 251427 - DNA, 20 bp, Artificial
  CRISPR gRNA sequence
gatcttgtattttctcaggg

SEQ ID NO: 251428 - DNA, 20 bp, Artificial
  CRISPR gRNA sequence
gtattttctcagggttcctc

SEQ ID NO: 251429 - DNA, 20 bp, Artificial
  CRISPR gRNA sequence
tattttctcagggttcctct

SEQ ID NO: 251430 - DNA, 20 bp, Artificial
  CRISPR gRNA sequence
tctcagggttcctctgacat

SEQ ID NO: 251431 - DNA, 20 bp, Artificial
  CRISPR gRNA sequence
ctcagggttcctctgacatc

SEQ ID NO: 251432 - DNA, 20 bp, Artificial
  CRISPR gRNA sequence
tcagggttcctctgacatca

SEQ ID NO: 251433 - DNA, 20 bp, Artificial
  CRISPR gRNA sequence
agggttcctctgacatcact

SEQ ID NO: 251434 - DNA, 20 bp, Artificial
  CRISPR gRNA sequence
ctctgacatcactctaggga

SEQ ID NO: 251435 - DNA, 20 bp, Artificial
  CRISPR gRNA sequence
tgacatcactctagggaagg

SEQ ID NO: 251436 - DNA, 20 bp, Artificial
  CRISPR gRNA sequence
acatcactctagggaaggaa

SEQ ID NO: 251437 - DNA, 20 bp, Artificial
  CRISPR gRNA sequence
tagggaaggaaggaggatgg

SEQ ID NO: 251438 - DNA, 20 bp, Artificial
  CRISPR gRNA sequence
gggaaggaaggaggatgggc

SEQ ID NO: 251439 - DNA, 20 bp, Artificial
  CRISPR gRNA sequence
gttacggccaggcaggggtg

SEQ ID NO: 251440 - DNA, 20 bp, Artificial
  CRISPR gRNA sequence
cggccaggcaggggtggagg

SEQ ID NO: 251441 - DNA, 20 bp, Artificial
  CRISPR gRNA sequence
gggttctatgctatacctcc

SEQ ID NO: 251442 - DNA, 20 bp, Artificial
  CRISPR gRNA sequence
ggttctatgctatacctcct

SEQ ID NO: 251443 - DNA, 20 bp, Artificial
  CRISPR gRNA sequence
tatgctatacctcctggagg

SEQ ID NO: 251444 - DNA, 20 bp, Artificial
  CRISPR gRNA sequence
tgctatacctcctggagggt

SEQ ID NO: 251445 - DNA, 20 bp, Artificial
  CRISPR gRNA sequence
tacctcctggagggtgaggg

SEQ ID NO: 251446 - DNA, 20 bp, Artificial
  CRISPR gRNA sequence
ctggagggtgagggtctcct

SEQ ID NO: 251447 - DNA, 20 bp, Artificial
  CRISPR gRNA sequence
gagggtgagggtctcctttt

SEQ ID NO: 251448 - DNA, 20 bp, Artificial
  CRISPR gRNA sequence
ctttttactgctagacacgt

SEQ ID NO: 251449 - DNA, 20 bp, Artificial
  CRISPR gRNA sequence
tttactgctagacacgtggg

SEQ ID NO: 251450 - DNA, 20 bp, Artificial
  CRISPR gRNA sequence
ttactgctagacacgtggga

SEQ ID NO: 251451 - DNA, 20 bp, Artificial
  CRISPR gRNA sequence
tactgctagacacgtgggag

SEQ ID NO: 251452 - DNA, 20 bp, Artificial
  CRISPR gRNA sequence
actgctagacacgtgggagt

SEQ ID NO: 251453 - DNA, 20 bp, Artificial
  CRISPR gRNA sequence
ctgctagacacgtgggagtt

SEQ ID NO: 251454 - DNA, 20 bp, Artificial
  CRISPR gRNA sequence
ctagacacgtgggagttcta

SEQ ID NO: 251455 - DNA, 20 bp, Artificial
  CRISPR gRNA sequence
gacacgtgggagttctagct

SEQ ID NO: 251456 - DNA, 20 bp, Artificial
  CRISPR gRNA sequence
tagctcccactaggcctcct

SEQ ID NO: 251457 - DNA, 20 bp, Artificial
  CRISPR gRNA sequence
gctcccactaggcctcctct

SEQ ID NO: 251458 - DNA, 20 bp, Artificial
  CRISPR gRNA sequence
ccactaggcctcctctgaca

SEQ ID NO: 251459 - DNA, 20 bp, Artificial
  CRISPR gRNA sequence
ggcctcctctgacactaccc

SEQ ID NO: 251460 - DNA, 20 bp, Artificial
  CRISPR gRNA sequence
ctctgacactaccccaggag

SEQ ID NO: 251461 - DNA, 20 bp, Artificial
  CRISPR gRNA sequence
tgacactaccccaggaggga

SEQ ID NO: 251462 - DNA, 20 bp, Artificial
  CRISPR gRNA sequence
acactaccccaggagggagg

SEQ ID NO: 251463 - DNA, 20 bp, Artificial
  CRISPR gRNA sequence
ccccaggagggagggggaga

SEQ ID NO: 251464 - DNA, 20 bp, Artificial
  CRISPR gRNA sequence
aatcagccgtgagggtggaa

SEQ ID NO: 251465 - DNA, 20 bp, Artificial
  CRISPR gRNA sequence
atcagccgtgagggtggaag

SEQ ID NO: 251466 - DNA, 20 bp, Artificial
  CRISPR gRNA sequence
tctactcagtccttcctggt

SEQ ID NO: 251467 - DNA, 20 bp, Artificial
  CRISPR gRNA sequence
tactcagtccttcctggtgg

SEQ ID NO: 251468 - DNA, 20 bp, Artificial
  CRISPR gRNA sequence
ctcagtccttcctggtgggc

SEQ ID NO: 251469 - DNA, 20 bp, Artificial
  CRISPR gRNA sequence
agtccttcctggtgggcttg

SEQ ID NO: 251470 - DNA, 20 bp, Artificial
  CRISPR gRNA sequence
cctggtgggcttgcaggcgg

SEQ ID NO: 251471 - DNA, 20 bp, Artificial
  CRISPR gRNA sequence
ctggtgggcttgcaggcgga

SEQ ID NO: 251472 - DNA, 20 bp, Artificial
  CRISPR gRNA sequence
gtgggcttgcaggcggagcc

SEQ ID NO: 251473 - DNA, 20 bp, Artificial
  CRISPR gRNA sequence
gcaggcggagccacggtgtt

SEQ ID NO: 251474 - DNA, 20 bp, Artificial
  CRISPR gRNA sequence
caggcggagccacggtgttt

SEQ ID NO: 251475 - DNA, 20 bp, Artificial
  CRISPR gRNA sequence
tttgtggtgttttgttagaa

SEQ ID NO: 251476 - DNA, 20 bp, Artificial
  CRISPR gRNA sequence
ttgtggtgttttgttagaat

SEQ ID NO: 251477 - DNA, 20 bp, Artificial
  CRISPR gRNA sequence
tgtggtgttttgttagaatt

SEQ ID NO: 251478 - DNA, 20 bp, Artificial
  CRISPR gRNA sequence
gtggtgttttgttagaattg

SEQ ID NO: 251479 - DNA, 20 bp, Artificial
  CRISPR gRNA sequence
tggtgttttgttagaattga

SEQ ID NO: 251480 - DNA, 20 bp, Artificial
  CRISPR gRNA sequence
tgttagaattgagtggttat

SEQ ID NO: 251481 - DNA, 20 bp, Artificial
  CRISPR gRNA sequence
gttagaattgagtggttatt

SEQ ID NO: 251482 - DNA, 20 bp, Artificial
  CRISPR gRNA sequence
ttagaattgagtggttattg

SEQ ID NO: 251483 - DNA, 20 bp, Artificial
  CRISPR gRNA sequence
gaattgagtggttattgtct

SEQ ID NO: 251484 - DNA, 20 bp, Artificial
  CRISPR gRNA sequence
agtggttattgtctagaagt

SEQ ID NO: 251485 - DNA, 20 bp, Artificial
  CRISPR gRNA sequence
ttgtctagaagtttttggac

SEQ ID NO: 251486 - DNA, 20 bp, Artificial
  CRISPR gRNA sequence
tctagaagtttttggaccag

SEQ ID NO: 251487 - DNA, 20 bp, Artificial
  CRISPR gRNA sequence
gaagtttttggaccaggtgt

SEQ ID NO: 251488 - DNA, 20 bp, Artificial
  CRISPR gRNA sequence
ttggaccaggtgtggtggct

SEQ ID NO: 251489 - DNA, 20 bp, Artificial
  CRISPR gRNA sequence
tggaccaggtgtggtggctc

SEQ ID NO: 251490 - DNA, 20 bp, Artificial
  CRISPR gRNA sequence
ggaccaggtgtggtggctca

SEQ ID NO: 251491 - DNA, 20 bp, Artificial
  CRISPR gRNA sequence
gaccaggtgtggtggctcac

SEQ ID NO: 251492 - DNA, 20 bp, Artificial
  CRISPR gRNA sequence
acgcctgtaatcccagcact

SEQ ID NO: 251493 - DNA, 20 bp, Artificial
  CRISPR gRNA sequence
taatcccagcactttgggag

SEQ ID NO: 251494 - DNA, 20 bp, Artificial
  CRISPR gRNA sequence
tgggaggcccagatgggcgg

SEQ ID NO: 251495 - DNA, 20 bp, Artificial
  CRISPR gRNA sequence
gggaggcccagatgggcgga

SEQ ID NO: 251496 - DNA, 20 bp, Artificial
  CRISPR gRNA sequence
ggaggcccagatgggcggat

SEQ ID NO: 251497 - DNA, 20 bp, Artificial
  CRISPR gRNA sequence
gagaccagcctggccaatat

SEQ ID NO: 251498 - DNA, 20 bp, Artificial
  CRISPR gRNA sequence
agaccagcctggccaatatg

SEQ ID NO: 251499 - DNA, 20 bp, Artificial
  CRISPR gRNA sequence
gccaatatggtgaaacccca

SEQ ID NO: 251500 - DNA, 20 bp, Artificial
  CRISPR gRNA sequence
tactaaaaacacaaaaatta

SEQ ID NO: 251501 - DNA, 20 bp, Artificial
  CRISPR gRNA sequence
ctaaaaacacaaaaattagc

SEQ ID NO: 251502 - DNA, 20 bp, Artificial
  CRISPR gRNA sequence
aaaacacaaaaattagccgg

SEQ ID NO: 251503 - DNA, 20 bp, Artificial
  CRISPR gRNA sequence
gccgggcctggtggcgggca

SEQ ID NO: 251504 - DNA, 20 bp, Artificial
  CRISPR gRNA sequence
gtggcgggcacctgtagtcc

SEQ ID NO: 251505 - DNA, 20 bp, Artificial
  CRISPR gRNA sequence
tagtcccagctactcaggag

SEQ ID NO: 251506 - DNA, 20 bp, Artificial
  CRISPR gRNA sequence
ctcaggagactgaggcaaga

SEQ ID NO: 251507 - DNA, 20 bp, Artificial
  CRISPR gRNA sequence
aggagactgaggcaagagaa

SEQ ID NO: 251508 - DNA, 20 bp, Artificial
  CRISPR gRNA sequence
aggcaagagaaccgcttgaa

SEQ ID NO: 251509 - DNA, 20 bp, Artificial
  CRISPR gRNA sequence
gaacccaagaggcggaggtt

SEQ ID NO: 251510 - DNA, 20 bp, Artificial
  CRISPR gRNA sequence
aacccaagaggcggaggttg

SEQ ID NO: 251511 - DNA, 20 bp, Artificial
  CRISPR gRNA sequence
cagtgagctgagatcacgcc

SEQ ID NO: 251512 - DNA, 20 bp, Artificial
  CRISPR gRNA sequence
agatcacgccattgcactcc

SEQ ID NO: 251513 - DNA, 20 bp, Artificial
  CRISPR gRNA sequence
cactccagcctgggcaacag

SEQ ID NO: 251514 - DNA, 20 bp, Artificial
  CRISPR gRNA sequence
cagcctgggcaacagagtga

SEQ ID NO: 251515 - DNA, 20 bp, Artificial
  CRISPR gRNA sequence
ggcaacagagtgagactcca

SEQ ID NO: 251516 - DNA, 20 bp, Artificial
  CRISPR gRNA sequence
catctcaaaaaaaaaaaaga

SEQ ID NO: 251517 - DNA, 20 bp, Artificial
  CRISPR gRNA sequence
aaaaaaaaaaaagaaaaaaa

SEQ ID NO: 251518 - DNA, 20 bp, Artificial
  CRISPR gRNA sequence
gtagtcttgctatgctgccc

SEQ ID NO: 251519 - DNA, 20 bp, Artificial
  CRISPR gRNA sequence
tagtcttgctatgctgcccc

SEQ ID NO: 251520 - DNA, 20 bp, Artificial
  CRISPR gRNA sequence
gctatgctgcccctttcctg

SEQ ID NO: 251521 - DNA, 20 bp, Artificial
  CRISPR gRNA sequence
ctatgctgcccctttcctgg

SEQ ID NO: 251522 - DNA, 20 bp, Artificial
  CRISPR gRNA sequence
tgctgcccctttcctggtct

SEQ ID NO: 251523 - DNA, 20 bp, Artificial
  CRISPR gRNA sequence
cccctttcctggtctcataa

SEQ ID NO: 251524 - DNA, 20 bp, Artificial
  CRISPR gRNA sequence
tcctggtctcataactagag

SEQ ID NO: 251525 - DNA, 20 bp, Artificial
  CRISPR gRNA sequence
cctggtctcataactagaga

SEQ ID NO: 251526 - DNA, 20 bp, Artificial
  CRISPR gRNA sequence
ctggtctcataactagagag

SEQ ID NO: 251527 - DNA, 20 bp, Artificial
  CRISPR gRNA sequence
gtctcataactagagagtac

SEQ ID NO: 251528 - DNA, 20 bp, Artificial
  CRISPR gRNA sequence
ataactagagagtacaagct

SEQ ID NO: 251529 - DNA, 20 bp, Artificial
  CRISPR gRNA sequence
gagagtacaagctcctctta

SEQ ID NO: 251530 - DNA, 20 bp, Artificial
  CRISPR gRNA sequence
ctcttagttttttatgtgtt

SEQ ID NO: 251531 - DNA, 20 bp, Artificial
  CRISPR gRNA sequence
ttagttttttatgtgttttt

SEQ ID NO: 251532 - DNA, 20 bp, Artificial
  CRISPR gRNA sequence
agttttttatgtgttttttt

SEQ ID NO: 251533 - DNA, 20 bp, Artificial
  CRISPR gRNA sequence
gttttttatgtgtttttttg

SEQ ID NO: 251534 - DNA, 20 bp, Artificial
  CRISPR gRNA sequence
tttatgtgtttttttgagat

SEQ ID NO: 251535 - DNA, 20 bp, Artificial
  CRISPR gRNA sequence
ttatgtgtttttttgagatg

SEQ ID NO: 251536 - DNA, 20 bp, Artificial
  CRISPR gRNA sequence
tatgtgtttttttgagatgg

SEQ ID NO: 251537 - DNA, 20 bp, Artificial
  CRISPR gRNA sequence
atgtgtttttttgagatgga

SEQ ID NO: 251538 - DNA, 20 bp, Artificial
  CRISPR gRNA sequence
tgtgtttttttgagatggag

SEQ ID NO: 251539 - DNA, 20 bp, Artificial
  CRISPR gRNA sequence
ttttgagatggagtcttgct

SEQ ID NO: 251540 - DNA, 20 bp, Artificial
  CRISPR gRNA sequence
tttgagatggagtcttgctc

SEQ ID NO: 251541 - DNA, 20 bp, Artificial
  CRISPR gRNA sequence
ttgagatggagtcttgctct

SEQ ID NO: 251542 - DNA, 20 bp, Artificial
  CRISPR gRNA sequence
tgagatggagtcttgctctg

SEQ ID NO: 251543 - DNA, 20 bp, Artificial
  CRISPR gRNA sequence
gagatggagtcttgctctgt

SEQ ID NO: 251544 - DNA, 20 bp, Artificial
  CRISPR gRNA sequence
agatggagtcttgctctgtt

SEQ ID NO: 251545 - DNA, 20 bp, Artificial
  CRISPR gRNA sequence
gctctgttgcccaggctgga

SEQ ID NO: 251546 - DNA, 20 bp, Artificial
  CRISPR gRNA sequence
ctctgttgcccaggctggag

SEQ ID NO: 251547 - DNA, 20 bp, Artificial
  CRISPR gRNA sequence
tgttgcccaggctggagtgc

SEQ ID NO: 251548 - DNA, 20 bp, Artificial
  CRISPR gRNA sequence
ttgcccaggctggagtgcag

SEQ ID NO: 251549 - DNA, 20 bp, Artificial
  CRISPR gRNA sequence
cccaggctggagtgcagtgg

SEQ ID NO: 251550 - DNA, 20 bp, Artificial
  CRISPR gRNA sequence
gagtgcagtggtgtaatctc

SEQ ID NO: 251551 - DNA, 20 bp, Artificial
  CRISPR gRNA sequence
agctctctgcaacctctgcc

SEQ ID NO: 251552 - DNA, 20 bp, Artificial
  CRISPR gRNA sequence
tctgcaacctctgcctcctg

SEQ ID NO: 251553 - DNA, 20 bp, Artificial
  CRISPR gRNA sequence
tgcaacctctgcctcctggg

SEQ ID NO: 251554 - DNA, 20 bp, Artificial
  CRISPR gRNA sequence
caacctctgcctcctgggtt

SEQ ID NO: 251555 - DNA, 20 bp, Artificial
  CRISPR gRNA sequence
tgcctcctgggtttaagcca

SEQ ID NO: 251556 - DNA, 20 bp, Artificial
  CRISPR gRNA sequence
cctcctgggtttaagccatt

SEQ ID NO: 251557 - DNA, 20 bp, Artificial
  CRISPR gRNA sequence
ctgggtttaagccattgtcc

SEQ ID NO: 251558 - DNA, 20 bp, Artificial
  CRISPR gRNA sequence
ggtttaagccattgtcctgc

SEQ ID NO: 251559 - DNA, 20 bp, Artificial
  CRISPR gRNA sequence
aagccattgtcctgcctcag

SEQ ID NO: 251560 - DNA, 20 bp, Artificial
  CRISPR gRNA sequence
agccattgtcctgcctcaga

SEQ ID NO: 251561 - DNA, 20 bp, Artificial
  CRISPR gRNA sequence
tcctgcctcagactcccgaa

SEQ ID NO: 251562 - DNA, 20 bp, Artificial
  CRISPR gRNA sequence
cctcagactcccgaatagct

SEQ ID NO: 251563 - DNA, 20 bp, Artificial
  CRISPR gRNA sequence
agactcccgaatagctaaga

SEQ ID NO: 251564 - DNA, 20 bp, Artificial
  CRISPR gRNA sequence
ccgaatagctaagattacag

SEQ ID NO: 251565 - DNA, 20 bp, Artificial
  CRISPR gRNA sequence
agattacaggtgagcgccac

SEQ ID NO: 251566 - DNA, 20 bp, Artificial
  CRISPR gRNA sequence
caggtgagcgccaccatgcc

SEQ ID NO: 251567 - DNA, 20 bp, Artificial
  CRISPR gRNA sequence
atttttgtgtttttagtaga

SEQ ID NO: 251568 - DNA, 20 bp, Artificial
  CRISPR gRNA sequence
ttgtgtttttagtagagaca

SEQ ID NO: 251569 - DNA, 20 bp, Artificial
  CRISPR gRNA sequence
tgtgtttttagtagagacag

SEQ ID NO: 251570 - DNA, 20 bp, Artificial
  CRISPR gRNA sequence
gtgtttttagtagagacagg

SEQ ID NO: 251571 - DNA, 20 bp, Artificial
  CRISPR gRNA sequence
tgtttttagtagagacaggg

SEQ ID NO: 251572 - DNA, 20 bp, Artificial
  CRISPR gRNA sequence
ttagtagagacagggtttcg

SEQ ID NO: 251573 - DNA, 20 bp, Artificial
  CRISPR gRNA sequence
tagtagagacagggtttcgc

SEQ ID NO: 251574 - DNA, 20 bp, Artificial
  CRISPR gRNA sequence
agtagagacagggtttcgcc

SEQ ID NO: 251575 - DNA, 20 bp, Artificial
  CRISPR gRNA sequence
gtagagacagggtttcgcca

SEQ ID NO: 251576 - DNA, 20 bp, Artificial
  CRISPR gRNA sequence
cgccatgttggccaggctgg

SEQ ID NO: 251577 - DNA, 20 bp, Artificial
  CRISPR gRNA sequence
gccatgttggccaggctggt

SEQ ID NO: 251578 - DNA, 20 bp, Artificial
  CRISPR gRNA sequence
gccaggctggtctcgaaatc

SEQ ID NO: 251579 - DNA, 20 bp, Artificial
  CRISPR gRNA sequence
gtctcgaaatcctgacctca

SEQ ID NO: 251580 - DNA, 20 bp, Artificial
  CRISPR gRNA sequence
gaaatcctgacctcagatga

SEQ ID NO: 251581 - DNA, 20 bp, Artificial
  CRISPR gRNA sequence
acctcagatgatctgcttgc

SEQ ID NO: 251582 - DNA, 20 bp, Artificial
  CRISPR gRNA sequence
agatgatctgcttgctttgg

SEQ ID NO: 251583 - DNA, 20 bp, Artificial
  CRISPR gRNA sequence
cttgctttggcttcccaaag

SEQ ID NO: 251584 - DNA, 20 bp, Artificial
  CRISPR gRNA sequence
gctttggcttcccaaagtgc

SEQ ID NO: 251585 - DNA, 20 bp, Artificial
  CRISPR gRNA sequence
ctttggcttcccaaagtgct

SEQ ID NO: 251586 - DNA, 20 bp, Artificial
  CRISPR gRNA sequence
tggcttcccaaagtgctggg

SEQ ID NO: 251587 - DNA, 20 bp, Artificial
  CRISPR gRNA sequence
ggcttcccaaagtgctggga

SEQ ID NO: 251588 - DNA, 20 bp, Artificial
  CRISPR gRNA sequence
gcttcccaaagtgctgggat

SEQ ID NO: 251589 - DNA, 20 bp, Artificial
  CRISPR gRNA sequence
cccaaagtgctgggattaca

SEQ ID NO: 251590 - DNA, 20 bp, Artificial
  CRISPR gRNA sequence
ccaaagtgctgggattacag

SEQ ID NO: 251591 - DNA, 20 bp, Artificial
  CRISPR gRNA sequence
ggattacagatgtgagtcac

SEQ ID NO: 251592 - DNA, 20 bp, Artificial
  CRISPR gRNA sequence
cagatgtgagtcaccacgcc

SEQ ID NO: 251593 - DNA, 20 bp, Artificial
  CRISPR gRNA sequence
gcctcttcttggtttttgct

SEQ ID NO: 251594 - DNA, 20 bp, Artificial
  CRISPR gRNA sequence
ttcttggtttttgctttgtt

SEQ ID NO: 251595 - DNA, 20 bp, Artificial
  CRISPR gRNA sequence
cttggtttttgctttgtttt

SEQ ID NO: 251596 - DNA, 20 bp, Artificial
  CRISPR gRNA sequence
ttggtttttgctttgttttg

SEQ ID NO: 251597 - DNA, 20 bp, Artificial
  CRISPR gRNA sequence
ggtttttgctttgttttgtc

SEQ ID NO: 251598 - DNA, 20 bp, Artificial
  CRISPR gRNA sequence
gtttttgctttgttttgtcc

SEQ ID NO: 251599 - DNA, 20 bp, Artificial
  CRISPR gRNA sequence
ttgctttgttttgtccacgc

SEQ ID NO: 251600 - DNA, 20 bp, Artificial
  CRISPR gRNA sequence
tgctttgttttgtccacgct

SEQ ID NO: 251601 - DNA, 20 bp, Artificial
  CRISPR gRNA sequence
gctttgttttgtccacgcta

SEQ ID NO: 251602 - DNA, 20 bp, Artificial
  CRISPR gRNA sequence
ctttgttttgtccacgctat

SEQ ID NO: 251603 - DNA, 20 bp, Artificial
  CRISPR gRNA sequence
tgttttgtccacgctattgg

SEQ ID NO: 251604 - DNA, 20 bp, Artificial
  CRISPR gRNA sequence
gttttgtccacgctattggc

SEQ ID NO: 251605 - DNA, 20 bp, Artificial
  CRISPR gRNA sequence
ttttgtccacgctattggca

SEQ ID NO: 251606 - DNA, 20 bp, Artificial
  CRISPR gRNA sequence
tgtccacgctattggcattt

SEQ ID NO: 251607 - DNA, 20 bp, Artificial
  CRISPR gRNA sequence
gtccacgctattggcatttt

SEQ ID NO: 251608 - DNA, 20 bp, Artificial
  CRISPR gRNA sequence
tccacgctattggcattttt

SEQ ID NO: 251609 - DNA, 20 bp, Artificial
  CRISPR gRNA sequence
ttggcatttttagagtgctg

SEQ ID NO: 251610 - DNA, 20 bp, Artificial
  CRISPR gRNA sequence
gcatttttagagtgctgctt

SEQ ID NO: 251611 - DNA, 20 bp, Artificial
  CRISPR gRNA sequence
ttagagtgctgcttctctag

SEQ ID NO: 251612 - DNA, 20 bp, Artificial
  CRISPR gRNA sequence
tagagtgctgcttctctagt

SEQ ID NO: 251613 - DNA, 20 bp, Artificial
  CRISPR gRNA sequence
agagtgctgcttctctagtt

SEQ ID NO: 251614 - DNA, 20 bp, Artificial
  CRISPR gRNA sequence
gagtgctgcttctctagttc

SEQ ID NO: 251615 - DNA, 20 bp, Artificial
  CRISPR gRNA sequence
cttctctagttcccagtcag

SEQ ID NO: 251616 - DNA, 20 bp, Artificial
  CRISPR gRNA sequence
ctctagttcccagtcagagg

SEQ ID NO: 251617 - DNA, 20 bp, Artificial
  CRISPR gRNA sequence
tctagttcccagtcagaggg

SEQ ID NO: 251618 - DNA, 20 bp, Artificial
  CRISPR gRNA sequence
tagttcccagtcagagggaa

SEQ ID NO: 251619 - DNA, 20 bp, Artificial
  CRISPR gRNA sequence
gttcccagtcagagggaaat

SEQ ID NO: 251620 - DNA, 20 bp, Artificial
  CRISPR gRNA sequence
ccagtcagagggaaatgagg

SEQ ID NO: 251621 - DNA, 20 bp, Artificial
  CRISPR gRNA sequence
ccatgttgtttcttgggtct

SEQ ID NO: 251622 - DNA, 20 bp, Artificial
  CRISPR gRNA sequence
tttcttgggtctggagatcc

SEQ ID NO: 251623 - DNA, 20 bp, Artificial
  CRISPR gRNA sequence
cttgggtctggagatcctga

SEQ ID NO: 251624 - DNA, 20 bp, Artificial
  CRISPR gRNA sequence
ttgggtctggagatcctgac

SEQ ID NO: 251625 - DNA, 20 bp, Artificial
  CRISPR gRNA sequence
gggtctggagatcctgaccc

SEQ ID NO: 251626 - DNA, 20 bp, Artificial
  CRISPR gRNA sequence
ggtctggagatcctgaccca

SEQ ID NO: 251627 - DNA, 20 bp, Artificial
  CRISPR gRNA sequence
gagatcctgacccaattggc

SEQ ID NO: 251628 - DNA, 20 bp, Artificial
  CRISPR gRNA sequence
acccaattggccttcctctc

SEQ ID NO: 251629 - DNA, 20 bp, Artificial
  CRISPR gRNA sequence
gccttcctctctctgccttt

SEQ ID NO: 251630 - DNA, 20 bp, Artificial
  CRISPR gRNA sequence
cctctctctgcctttctgag

SEQ ID NO: 251631 - DNA, 20 bp, Artificial
  CRISPR gRNA sequence
ctctctctgcctttctgaga

SEQ ID NO: 251632 - DNA, 20 bp, Artificial
  CRISPR gRNA sequence
tctctgcctttctgagaggt

SEQ ID NO: 251633 - DNA, 20 bp, Artificial
  CRISPR gRNA sequence
tctgcctttctgagaggttt

SEQ ID NO: 251634 - DNA, 20 bp, Artificial
  CRISPR gRNA sequence
tgcctttctgagaggttttc

SEQ ID NO: 251635 - DNA, 20 bp, Artificial
  CRISPR gRNA sequence
cctttctgagaggttttcag

SEQ ID NO: 251636 - DNA, 20 bp, Artificial
  CRISPR gRNA sequence
tctgagaggttttcagcagt

SEQ ID NO: 251637 - DNA, 20 bp, Artificial
  CRISPR gRNA sequence
ctgagaggttttcagcagta

SEQ ID NO: 251638 - DNA, 20 bp, Artificial
  CRISPR gRNA sequence
tgagaggttttcagcagtac

SEQ ID NO: 251639 - DNA, 20 bp, Artificial
  CRISPR gRNA sequence
agaggttttcagcagtactc

SEQ ID NO: 251640 - DNA, 20 bp, Artificial
  CRISPR gRNA sequence
tcagcagtactcagcaggac

SEQ ID NO: 251641 - DNA, 20 bp, Artificial
  CRISPR gRNA sequence
cagcagtactcagcaggaca

SEQ ID NO: 251642 - DNA, 20 bp, Artificial
  CRISPR gRNA sequence
agcagtactcagcaggacaa

SEQ ID NO: 251643 - DNA, 20 bp, Artificial
  CRISPR gRNA sequence
agcaggacaaatacggaaaa

SEQ ID NO: 251644 - DNA, 20 bp, Artificial
  CRISPR gRNA sequence
aatctttccagaagagatct

SEQ ID NO: 251645 - DNA, 20 bp, Artificial
  CRISPR gRNA sequence
tccagaagagatctccattt

SEQ ID NO: 251646 - DNA, 20 bp, Artificial
  CRISPR gRNA sequence
ccagaagagatctccatttt

SEQ ID NO: 251647 - DNA, 20 bp, Artificial
  CRISPR gRNA sequence
cagaagagatctccattttg

SEQ ID NO: 251648 - DNA, 20 bp, Artificial
  CRISPR gRNA sequence
cattttgaaattcaacctgg

SEQ ID NO: 251649 - DNA, 20 bp, Artificial
  CRISPR gRNA sequence
tgaaattcaacctgggaaca

SEQ ID NO: 251650 - DNA, 20 bp, Artificial
  CRISPR gRNA sequence
gaaattcaacctgggaacaa

SEQ ID NO: 251651 - DNA, 20 bp, Artificial
  CRISPR gRNA sequence
aaattcaacctgggaacaat

SEQ ID NO: 251652 - DNA, 20 bp, Artificial
  CRISPR gRNA sequence
aacctgggaacaatttcaaa

SEQ ID NO: 251653 - DNA, 20 bp, Artificial
  CRISPR gRNA sequence
ggaacaatttcaaaagacat

SEQ ID NO: 251654 - DNA, 20 bp, Artificial
  CRISPR gRNA sequence
caaaagacatcccgttggta

SEQ ID NO: 251655 - DNA, 20 bp, Artificial
  CRISPR gRNA sequence
aaaagacatcccgttggtat

SEQ ID NO: 251656 - DNA, 20 bp, Artificial
  CRISPR gRNA sequence
gtatttctgaacatcttgcc

SEQ ID NO: 251657 - DNA, 20 bp, Artificial
  CRISPR gRNA sequence
ctgaacatcttgccagtttt

SEQ ID NO: 251658 - DNA, 20 bp, Artificial
  CRISPR gRNA sequence
tgaacatcttgccagttttt

SEQ ID NO: 251659 - DNA, 20 bp, Artificial
  CRISPR gRNA sequence
aacatcttgccagtttttca

SEQ ID NO: 251660 - DNA, 20 bp, Artificial
  CRISPR gRNA sequence
gccagtttttcataagttct

SEQ ID NO: 251661 - DNA, 20 bp, Artificial
  CRISPR gRNA sequence
ccagtttttcataagttcta

SEQ ID NO: 251662 - DNA, 20 bp, Artificial
  CRISPR gRNA sequence
ttcataagttctaggagatg

SEQ ID NO: 251663 - DNA, 20 bp, Artificial
  CRISPR gRNA sequence
tcataagttctaggagatgg

SEQ ID NO: 251664 - DNA, 20 bp, Artificial
  CRISPR gRNA sequence
cataagttctaggagatggt

SEQ ID NO: 251665 - DNA, 20 bp, Artificial
  CRISPR gRNA sequence
ataagttctaggagatggtg

SEQ ID NO: 251666 - DNA, 20 bp, Artificial
  CRISPR gRNA sequence
taggagatggtgtggttatt

SEQ ID NO: 251667 - DNA, 20 bp, Artificial
  CRISPR gRNA sequence
ggagatggtgtggttatttt

SEQ ID NO: 251668 - DNA, 20 bp, Artificial
  CRISPR gRNA sequence
ttttttatagcaacaagcat

SEQ ID NO: 251669 - DNA, 20 bp, Artificial
  CRISPR gRNA sequence
tttatagcaacaagcatatg

SEQ ID NO: 251670 - DNA, 20 bp, Artificial
  CRISPR gRNA sequence
ttatagcaacaagcatatga

SEQ ID NO: 251671 - DNA, 20 bp, Artificial
  CRISPR gRNA sequence
tatagcaacaagcatatgaa

SEQ ID NO: 251672 - DNA, 20 bp, Artificial
  CRISPR gRNA sequence
atagcaacaagcatatgaaa

SEQ ID NO: 251673 - DNA, 20 bp, Artificial
  CRISPR gRNA sequence
tagcaacaagcatatgaaat

SEQ ID NO: 251674 - DNA, 20 bp, Artificial
  CRISPR gRNA sequence
tttgccttgccagtctgtaa

SEQ ID NO: 251675 - DNA, 20 bp, Artificial
  CRISPR gRNA sequence
ttgccttgccagtctgtaaa

SEQ ID NO: 251676 - DNA, 20 bp, Artificial
  CRISPR gRNA sequence
tgccttgccagtctgtaaat

SEQ ID NO: 251677 - DNA, 20 bp, Artificial
  CRISPR gRNA sequence
gccttgccagtctgtaaata

SEQ ID NO: 251678 - DNA, 20 bp, Artificial
  CRISPR gRNA sequence
ccttgccagtctgtaaataa

SEQ ID NO: 251679 - DNA, 20 bp, Artificial
  CRISPR gRNA sequence
gccagtctgtaaataaatat

SEQ ID NO: 251680 - DNA, 20 bp, Artificial
  CRISPR gRNA sequence
ccagtctgtaaataaatatc

SEQ ID NO: 251681 - DNA, 20 bp, Artificial
  CRISPR gRNA sequence
taaataaatatctgcttagg

SEQ ID NO: 251682 - DNA, 20 bp, Artificial
  CRISPR gRNA sequence
cttaggattgaaatttgcgg

SEQ ID NO: 251683 - DNA, 20 bp, Artificial
  CRISPR gRNA sequence
aggattgaaatttgcggagc

SEQ ID NO: 251684 - DNA, 20 bp, Artificial
  CRISPR gRNA sequence
ggattgaaatttgcggagca

SEQ ID NO: 251685 - DNA, 20 bp, Artificial
  CRISPR gRNA sequence
aaatttgcggagcagtaaca

SEQ ID NO: 251686 - DNA, 20 bp, Artificial
  CRISPR gRNA sequence
gcggagcagtaacacaaata

SEQ ID NO: 251687 - DNA, 20 bp, Artificial
  CRISPR gRNA sequence
cggagcagtaacacaaatac

SEQ ID NO: 251688 - DNA, 20 bp, Artificial
  CRISPR gRNA sequence
cactaacatgtaaaagaaag

SEQ ID NO: 251689 - DNA, 20 bp, Artificial
  CRISPR gRNA sequence
actaacatgtaaaagaaagc

SEQ ID NO: 251690 - DNA, 20 bp, Artificial
  CRISPR gRNA sequence
acatgtaaaagaaagcctgg

SEQ ID NO: 251691 - DNA, 20 bp, Artificial
  CRISPR gRNA sequence
gcagctcacgcacagatcgg

SEQ ID NO: 251692 - DNA, 20 bp, Artificial
  CRISPR gRNA sequence
acgcacagatcggttcttgg

SEQ ID NO: 251693 - DNA, 20 bp, Artificial
  CRISPR gRNA sequence
ttggttcctaacagatggaa

SEQ ID NO: 251694 - DNA, 20 bp, Artificial
  CRISPR gRNA sequence
ggttcctaacagatggaagc

SEQ ID NO: 251695 - DNA, 20 bp, Artificial
  CRISPR gRNA sequence
gttcctaacagatggaagca

SEQ ID NO: 251696 - DNA, 20 bp, Artificial
  CRISPR gRNA sequence
ctaacagatggaagcagtgg

SEQ ID NO: 251697 - DNA, 20 bp, Artificial
  CRISPR gRNA sequence
acagatggaagcagtgggga

SEQ ID NO: 251698 - DNA, 20 bp, Artificial
  CRISPR gRNA sequence
cacaatcctggagtcataac

SEQ ID NO: 251699 - DNA, 20 bp, Artificial
  CRISPR gRNA sequence
acaatcctggagtcataaca

SEQ ID NO: 251700 - DNA, 20 bp, Artificial
  CRISPR gRNA sequence
gagtcataacactgcattcc

SEQ ID NO: 251701 - DNA, 20 bp, Artificial
  CRISPR gRNA sequence
cattccaaggaaaccatcgg

SEQ ID NO: 251702 - DNA, 20 bp, Artificial
  CRISPR gRNA sequence
caaggaaaccatcggatctc

SEQ ID NO: 251703 - DNA, 20 bp, Artificial
  CRISPR gRNA sequence
gaatctcagtaaccctcaag

SEQ ID NO: 251704 - DNA, 20 bp, Artificial
  CRISPR gRNA sequence
agtaaccctcaagacgaaaa

SEQ ID NO: 251705 - DNA, 20 bp, Artificial
  CRISPR gRNA sequence
aagacgaaaataagtgctgc

SEQ ID NO: 251706 - DNA, 20 bp, Artificial
  CRISPR gRNA sequence
ctgaattgaaactagagcta

SEQ ID NO: 251707 - DNA, 20 bp, Artificial
  CRISPR gRNA sequence
aattgaaactagagctatga

SEQ ID NO: 251708 - DNA, 20 bp, Artificial
  CRISPR gRNA sequence
aaactagagctatgattggg

SEQ ID NO: 251709 - DNA, 20 bp, Artificial
  CRISPR gRNA sequence
gagctatgattgggatatgg

SEQ ID NO: 251710 - DNA, 20 bp, Artificial
  CRISPR gRNA sequence
tgattgggatatggctaata

SEQ ID NO: 251711 - DNA, 20 bp, Artificial
  CRISPR gRNA sequence
ggatatggctaatattttat

SEQ ID NO: 251712 - DNA, 20 bp, Artificial
  CRISPR gRNA sequence
atattttatggtttagtgat

SEQ ID NO: 251713 - DNA, 20 bp, Artificial
  CRISPR gRNA sequence
tatggtttagtgattcatgc

SEQ ID NO: 251714 - DNA, 20 bp, Artificial
  CRISPR gRNA sequence
atggtttagtgattcatgct

SEQ ID NO: 251715 - DNA, 20 bp, Artificial
  CRISPR gRNA sequence
tggtttagtgattcatgctt

SEQ ID NO: 251716 - DNA, 20 bp, Artificial
  CRISPR gRNA sequence
agtgattcatgcttaagatt

SEQ ID NO: 251717 - DNA, 20 bp, Artificial
  CRISPR gRNA sequence
gtgattcatgcttaagattc

SEQ ID NO: 251718 - DNA, 20 bp, Artificial
  CRISPR gRNA sequence
atgcttaagattcatgcttt

SEQ ID NO: 251719 - DNA, 20 bp, Artificial
  CRISPR gRNA sequence
aagattcatgcttttttagc

SEQ ID NO: 251720 - DNA, 20 bp, Artificial
  CRISPR gRNA sequence
agattcatgcttttttagct

SEQ ID NO: 251721 - DNA, 20 bp, Artificial
  CRISPR gRNA sequence
atgcttttttagctaatgta

SEQ ID NO: 251722 - DNA, 20 bp, Artificial
  CRISPR gRNA sequence
ttttagctaatgtagaaaat

SEQ ID NO: 251723 - DNA, 20 bp, Artificial
  CRISPR gRNA sequence
tttagctaatgtagaaaata

SEQ ID NO: 251724 - DNA, 20 bp, Artificial
  CRISPR gRNA sequence
ttagctaatgtagaaaataa

SEQ ID NO: 251725 - DNA, 20 bp, Artificial
  CRISPR gRNA sequence
tagctaatgtagaaaataaa

SEQ ID NO: 251726 - DNA, 20 bp, Artificial
  CRISPR gRNA sequence
agctaatgtagaaaataaag

SEQ ID NO: 251727 - DNA, 20 bp, Artificial
  CRISPR gRNA sequence
gctaatgtagaaaataaaga

SEQ ID NO: 251728 - DNA, 20 bp, Artificial
  CRISPR gRNA sequence
atgtagaaaataaagaaaat

SEQ ID NO: 251729 - DNA, 20 bp, Artificial
  CRISPR gRNA sequence
ttaaagaccaatacaaatat

SEQ ID NO: 251730 - DNA, 20 bp, Artificial
  CRISPR gRNA sequence
aaagaccaatacaaatattt

SEQ ID NO: 251731 - DNA, 20 bp, Artificial
  CRISPR gRNA sequence
aagaccaatacaaatatttg

SEQ ID NO: 251732 - DNA, 20 bp, Artificial
  CRISPR gRNA sequence
ggtaagaggaaacaaatttc

SEQ ID NO: 251733 - DNA, 20 bp, Artificial
  CRISPR gRNA sequence
gtaagaggaaacaaatttca

SEQ ID NO: 251734 - DNA, 20 bp, Artificial
  CRISPR gRNA sequence
caaataatctctagaggaag

SEQ ID NO: 251735 - DNA, 20 bp, Artificial
  CRISPR gRNA sequence
aaataatctctagaggaagt

SEQ ID NO: 251736 - DNA, 20 bp, Artificial
  CRISPR gRNA sequence
tagaggaagttcatccttgc

SEQ ID NO: 251737 - DNA, 20 bp, Artificial
  CRISPR gRNA sequence
gaggaagttcatccttgctg

SEQ ID NO: 251738 - DNA, 20 bp, Artificial
  CRISPR gRNA sequence
atccttgctgttacctctct

SEQ ID NO: 251739 - DNA, 20 bp, Artificial
  CRISPR gRNA sequence
gctgttacctctcttgtgga

SEQ ID NO: 251740 - DNA, 20 bp, Artificial
  CRISPR gRNA sequence
ctgttacctctcttgtggat

SEQ ID NO: 251741 - DNA, 20 bp, Artificial
  CRISPR gRNA sequence
ttacctctcttgtggatgag

SEQ ID NO: 251742 - DNA, 20 bp, Artificial
  CRISPR gRNA sequence
cctctcttgtggatgagttt

SEQ ID NO: 251743 - DNA, 20 bp, Artificial
  CRISPR gRNA sequence
tcttgtggatgagtttgtta

SEQ ID NO: 251744 - DNA, 20 bp, Artificial
  CRISPR gRNA sequence
ttgtggatgagtttgttaaa

SEQ ID NO: 251745 - DNA, 20 bp, Artificial
  CRISPR gRNA sequence
gtggatgagtttgttaaaat

SEQ ID NO: 251746 - DNA, 20 bp, Artificial
  CRISPR gRNA sequence
tggatgagtttgttaaaatt

SEQ ID NO: 251747 - DNA, 20 bp, Artificial
  CRISPR gRNA sequence
gttaaaattattattactat

SEQ ID NO: 251748 - DNA, 20 bp, Artificial
  CRISPR gRNA sequence
ttaaaattattattactatt

SEQ ID NO: 251749 - DNA, 20 bp, Artificial
  CRISPR gRNA sequence
aaattattattactattatt

SEQ ID NO: 251750 - DNA, 20 bp, Artificial
  CRISPR gRNA sequence
ttattactattattattata

SEQ ID NO: 251751 - DNA, 20 bp, Artificial
  CRISPR gRNA sequence
ttactattattattataatt

SEQ ID NO: 251752 - DNA, 20 bp, Artificial
  CRISPR gRNA sequence
ctattattattataattttt

SEQ ID NO: 251753 - DNA, 20 bp, Artificial
  CRISPR gRNA sequence
ttattattataatttttttt

SEQ ID NO: 251754 - DNA, 20 bp, Artificial
  CRISPR gRNA sequence
ttattataattttttttaga

SEQ ID NO: 251755 - DNA, 20 bp, Artificial
  CRISPR gRNA sequence
ttataattttttttagatgg

SEQ ID NO: 251756 - DNA, 20 bp, Artificial
  CRISPR gRNA sequence
taattttttttagatggagt

SEQ ID NO: 251757 - DNA, 20 bp, Artificial
  CRISPR gRNA sequence
tttttagatggagtctcact

SEQ ID NO: 251758 - DNA, 20 bp, Artificial
  CRISPR gRNA sequence
ttttagatggagtctcactc

SEQ ID NO: 251759 - DNA, 20 bp, Artificial
  CRISPR gRNA sequence
tttagatggagtctcactct

SEQ ID NO: 251760 - DNA, 20 bp, Artificial
  CRISPR gRNA sequence
ttagatggagtctcactctg

SEQ ID NO: 251761 - DNA, 20 bp, Artificial
  CRISPR gRNA sequence
tagatggagtctcactctgt

SEQ ID NO: 251762 - DNA, 20 bp, Artificial
  CRISPR gRNA sequence
agatggagtctcactctgtc

SEQ ID NO: 251763 - DNA, 20 bp, Artificial
  CRISPR gRNA sequence
gatggagtctcactctgtca

SEQ ID NO: 251764 - DNA, 20 bp, Artificial
  CRISPR gRNA sequence
actctgtcacccaggctgga

SEQ ID NO: 251765 - DNA, 20 bp, Artificial
  CRISPR gRNA sequence
tgtcacccaggctggagtgc

SEQ ID NO: 251766 - DNA, 20 bp, Artificial
  CRISPR gRNA sequence
tcacccaggctggagtgcag

SEQ ID NO: 251767 - DNA, 20 bp, Artificial
  CRISPR gRNA sequence
gagtgcagtggcgcaatctc

SEQ ID NO: 251768 - DNA, 20 bp, Artificial
  CRISPR gRNA sequence
agctcactgcaacctccacc

SEQ ID NO: 251769 - DNA, 20 bp, Artificial
  CRISPR gRNA sequence
actgcaacctccacctccca

SEQ ID NO: 251770 - DNA, 20 bp, Artificial
  CRISPR gRNA sequence
caacctccacctcccaggtt

SEQ ID NO: 251771 - DNA, 20 bp, Artificial
  CRISPR gRNA sequence
cacctcccaggttcaggcga

SEQ ID NO: 251772 - DNA, 20 bp, Artificial
  CRISPR gRNA sequence
ccaggttcaggcgattctct

SEQ ID NO: 251773 - DNA, 20 bp, Artificial
  CRISPR gRNA sequence
aggcgattctctgcctcagc

SEQ ID NO: 251774 - DNA, 20 bp, Artificial
  CRISPR gRNA sequence
tctgcctcagcctcccgagt

SEQ ID NO: 251775 - DNA, 20 bp, Artificial
  CRISPR gRNA sequence
tgcctcagcctcccgagtag

SEQ ID NO: 251776 - DNA, 20 bp, Artificial
  CRISPR gRNA sequence
cctcagcctcccgagtagct

SEQ ID NO: 251777 - DNA, 20 bp, Artificial
  CRISPR gRNA sequence
agcctcccgagtagctggga

SEQ ID NO: 251778 - DNA, 20 bp, Artificial
  CRISPR gRNA sequence
ccgagtagctgggattacag

SEQ ID NO: 251779 - DNA, 20 bp, Artificial
  CRISPR gRNA sequence
ggattacaggcgcccaccac

SEQ ID NO: 251780 - DNA, 20 bp, Artificial
  CRISPR gRNA sequence
caggcgcccaccaccacgcc

SEQ ID NO: 251781 - DNA, 20 bp, Artificial
  CRISPR gRNA sequence
atttttttggtatttttagt

SEQ ID NO: 251782 - DNA, 20 bp, Artificial
  CRISPR gRNA sequence
ttttggtatttttagtagag

SEQ ID NO: 251783 - DNA, 20 bp, Artificial
  CRISPR gRNA sequence
tttggtatttttagtagaga

SEQ ID NO: 251784 - DNA, 20 bp, Artificial
  CRISPR gRNA sequence
ttggtatttttagtagagac

SEQ ID NO: 251785 - DNA, 20 bp, Artificial
  CRISPR gRNA sequence
tggtatttttagtagagacg

SEQ ID NO: 251786 - DNA, 20 bp, Artificial
  CRISPR gRNA sequence
ggtatttttagtagagacgg

SEQ ID NO: 251787 - DNA, 20 bp, Artificial
  CRISPR gRNA sequence
gtatttttagtagagacggg

SEQ ID NO: 251788 - DNA, 20 bp, Artificial
  CRISPR gRNA sequence
ttagtagagacggggtttca

SEQ ID NO: 251789 - DNA, 20 bp, Artificial
  CRISPR gRNA sequence
tagtagagacggggtttcac

SEQ ID NO: 251790 - DNA, 20 bp, Artificial
  CRISPR gRNA sequence
agtagagacggggtttcacc

SEQ ID NO: 251791 - DNA, 20 bp, Artificial
  CRISPR gRNA sequence
gtagagacggggtttcacca

SEQ ID NO: 251792 - DNA, 20 bp, Artificial
  CRISPR gRNA sequence
caccatcttggccaggctgg

SEQ ID NO: 251793 - DNA, 20 bp, Artificial
  CRISPR gRNA sequence
accatcttggccaggctggt

SEQ ID NO: 251794 - DNA, 20 bp, Artificial
  CRISPR gRNA sequence
ggccaggctggtcttgaact

SEQ ID NO: 251795 - DNA, 20 bp, Artificial
  CRISPR gRNA sequence
gccaggctggtcttgaactc

SEQ ID NO: 251796 - DNA, 20 bp, Artificial
  CRISPR gRNA sequence
gtcttgaactcctgaccttg

SEQ ID NO: 251797 - DNA, 20 bp, Artificial
  CRISPR gRNA sequence
gaactcctgaccttgtgatc

SEQ ID NO: 251798 - DNA, 20 bp, Artificial
  CRISPR gRNA sequence
aactcctgaccttgtgatcc

SEQ ID NO: 251799 - DNA, 20 bp, Artificial
  CRISPR gRNA sequence
ctgaccttgtgatccaccgg

SEQ ID NO: 251800 - DNA, 20 bp, Artificial
  CRISPR gRNA sequence
accttgtgatccaccggcct

SEQ ID NO: 251801 - DNA, 20 bp, Artificial
  CRISPR gRNA sequence
gtgatccaccggcctcagcc

SEQ ID NO: 251802 - DNA, 20 bp, Artificial
  CRISPR gRNA sequence
tgatccaccggcctcagcct

SEQ ID NO: 251803 - DNA, 20 bp, Artificial
  CRISPR gRNA sequence
agcctcccaaagtgctggga

SEQ ID NO: 251804 - DNA, 20 bp, Artificial
  CRISPR gRNA sequence
ccaaagtgctgggattacag

SEQ ID NO: 251805 - DNA, 20 bp, Artificial
  CRISPR gRNA sequence
ggattacaggcatgagccac

SEQ ID NO: 251806 - DNA, 20 bp, Artificial
  CRISPR gRNA sequence
caggcatgagccactgcgcc

SEQ ID NO: 251807 - DNA, 20 bp, Artificial
  CRISPR gRNA sequence
cgcccggcctgtttttgttt

SEQ ID NO: 251808 - DNA, 20 bp, Artificial
  CRISPR gRNA sequence
tttttgttttgttttgtttt

SEQ ID NO: 251809 - DNA, 20 bp, Artificial
  CRISPR gRNA sequence
ttgttttgttttgttttgtt

SEQ ID NO: 251810 - DNA, 20 bp, Artificial
  CRISPR gRNA sequence
tgttttgttttgttttgttt

SEQ ID NO: 251811 - DNA, 20 bp, Artificial
  CRISPR gRNA sequence
gttttgttttgttttgtttt

SEQ ID NO: 251812 - DNA, 20 bp, Artificial
  CRISPR gRNA sequence
ttttgttttgttttgttttg

SEQ ID NO: 251813 - DNA, 20 bp, Artificial
  CRISPR gRNA sequence
tgttttgttttgttttgttt

SEQ ID NO: 251814 - DNA, 20 bp, Artificial
  CRISPR gRNA sequence
gttttgttttgttttgtttt

SEQ ID NO: 251815 - DNA, 20 bp, Artificial
  CRISPR gRNA sequence
ttttgttttgttttgttttg

SEQ ID NO: 251816 - DNA, 20 bp, Artificial
  CRISPR gRNA sequence
tgttttgttttgttttgttt

SEQ ID NO: 251817 - DNA, 20 bp, Artificial
  CRISPR gRNA sequence
gttttgttttgttttgtttt

SEQ ID NO: 251818 - DNA, 20 bp, Artificial
  CRISPR gRNA sequence
ttttgttttgttttgttttg

SEQ ID NO: 251819 - DNA, 20 bp, Artificial
  CRISPR gRNA sequence
tgttttgttttgttttgttt

SEQ ID NO: 251820 - DNA, 20 bp, Artificial
  CRISPR gRNA sequence
gttttgttttgttttgtttt

SEQ ID NO: 251821 - DNA, 20 bp, Artificial
  CRISPR gRNA sequence
ttttgttttgttttgttttg

SEQ ID NO: 251822 - DNA, 20 bp, Artificial
  CRISPR gRNA sequence
tgttttgttttgttttgttt

SEQ ID NO: 251823 - DNA, 20 bp, Artificial
  CRISPR gRNA sequence
gttttgttttgttttgtttt

SEQ ID NO: 251824 - DNA, 20 bp, Artificial
  CRISPR gRNA sequence
ttttgttttgttttgttttt

SEQ ID NO: 251825 - DNA, 20 bp, Artificial
  CRISPR gRNA sequence
tgttttgttttgttttttga

SEQ ID NO: 251826 - DNA, 20 bp, Artificial
  CRISPR gRNA sequence
gttttgttttgttttttgag

SEQ ID NO: 251827 - DNA, 20 bp, Artificial
  CRISPR gRNA sequence
ttttgttttgttttttgaga

SEQ ID NO: 251828 - DNA, 20 bp, Artificial
  CRISPR gRNA sequence
tgttttgttttttgagacag

SEQ ID NO: 251829 - DNA, 20 bp, Artificial
  CRISPR gRNA sequence
gttttgttttttgagacaga

SEQ ID NO: 251830 - DNA, 20 bp, Artificial
  CRISPR gRNA sequence
ttttgttttttgagacagag

SEQ ID NO: 251831 - DNA, 20 bp, Artificial
  CRISPR gRNA sequence
tgttttttgagacagagttt

SEQ ID NO: 251832 - DNA, 20 bp, Artificial
  CRISPR gRNA sequence
gttttttgagacagagtttc

SEQ ID NO: 251833 - DNA, 20 bp, Artificial
  CRISPR gRNA sequence
ttttttgagacagagtttcg

SEQ ID NO: 251834 - DNA, 20 bp, Artificial
  CRISPR gRNA sequence
tttgagacagagtttcgctg

SEQ ID NO: 251835 - DNA, 20 bp, Artificial
  CRISPR gRNA sequence
ttgagacagagtttcgctgt

SEQ ID NO: 251836 - DNA, 20 bp, Artificial
  CRISPR gRNA sequence
tgagacagagtttcgctgtt

SEQ ID NO: 251837 - DNA, 20 bp, Artificial
  CRISPR gRNA sequence
gagacagagtttcgctgttg

SEQ ID NO: 251838 - DNA, 20 bp, Artificial
  CRISPR gRNA sequence
agacagagtttcgctgttgt

SEQ ID NO: 251839 - DNA, 20 bp, Artificial
  CRISPR gRNA sequence
cgctgttgtcacccaggctg

SEQ ID NO: 251840 - DNA, 20 bp, Artificial
  CRISPR gRNA sequence
gctgttgtcacccaggctgg

SEQ ID NO: 251841 - DNA, 20 bp, Artificial
  CRISPR gRNA sequence
ttgtcacccaggctggagtg

SEQ ID NO: 251842 - DNA, 20 bp, Artificial
  CRISPR gRNA sequence
tcacccaggctggagtgcaa

SEQ ID NO: 251843 - DNA, 20 bp, Artificial
  CRISPR gRNA sequence
gagtgcaatggcgccatctc

SEQ ID NO: 251844 - DNA, 20 bp, Artificial
  CRISPR gRNA sequence
aagtcactgcaatctctgtc

SEQ ID NO: 251845 - DNA, 20 bp, Artificial
  CRISPR gRNA sequence
caatctctgtctcctgggtt

SEQ ID NO: 251846 - DNA, 20 bp, Artificial
  CRISPR gRNA sequence
tgtctcctgggttcaagcaa

SEQ ID NO: 251847 - DNA, 20 bp, Artificial
  CRISPR gRNA sequence
tctcctgggttcaagcaatt

SEQ ID NO: 251848 - DNA, 20 bp, Artificial
  CRISPR gRNA sequence
ctgggttcaagcaattgtcc

SEQ ID NO: 251849 - DNA, 20 bp, Artificial
  CRISPR gRNA sequence
ggttcaagcaattgtcctgc

SEQ ID NO: 251850 - DNA, 20 bp, Artificial
  CRISPR gRNA sequence
aagcaattgtcctgcctcag

SEQ ID NO: 251851 - DNA, 20 bp, Artificial
  CRISPR gRNA sequence
tcctgcctcagcctcctgag

SEQ ID NO: 251852 - DNA, 20 bp, Artificial
  CRISPR gRNA sequence
cctcagcctcctgagtagct

SEQ ID NO: 251853 - DNA, 20 bp, Artificial
  CRISPR gRNA sequence
agcctcctgagtagctggga

SEQ ID NO: 251854 - DNA, 20 bp, Artificial
  CRISPR gRNA sequence
ctgagtagctgggattacag

SEQ ID NO: 251855 - DNA, 20 bp, Artificial
  CRISPR gRNA sequence
agtagctgggattacaggca

SEQ ID NO: 251856 - DNA, 20 bp, Artificial
  CRISPR gRNA sequence
ggattacaggcacctgccac

SEQ ID NO: 251857 - DNA, 20 bp, Artificial
  CRISPR gRNA sequence
caggcacctgccaccacgcc

SEQ ID NO: 251858 - DNA, 20 bp, Artificial
  CRISPR gRNA sequence
ccaccacgcccggctaattt

SEQ ID NO: 251859 - DNA, 20 bp, Artificial
  CRISPR gRNA sequence
atttttgtatttttagtagg

SEQ ID NO: 251860 - DNA, 20 bp, Artificial
  CRISPR gRNA sequence
ttgtatttttagtagggatg

SEQ ID NO: 251861 - DNA, 20 bp, Artificial
  CRISPR gRNA sequence
tgtatttttagtagggatgg

SEQ ID NO: 251862 - DNA, 20 bp, Artificial
  CRISPR gRNA sequence
gtatttttagtagggatggg

SEQ ID NO: 251863 - DNA, 20 bp, Artificial
  CRISPR gRNA sequence
tatttttagtagggatgggg

SEQ ID NO: 251864 - DNA, 20 bp, Artificial
  CRISPR gRNA sequence
ttagtagggatggggttttg

SEQ ID NO: 251865 - DNA, 20 bp, Artificial
  CRISPR gRNA sequence
tagtagggatggggttttgc

SEQ ID NO: 251866 - DNA, 20 bp, Artificial
  CRISPR gRNA sequence
agtagggatggggttttgct

SEQ ID NO: 251867 - DNA, 20 bp, Artificial
  CRISPR gRNA sequence
gtagggatggggttttgcta

SEQ ID NO: 251868 - DNA, 20 bp, Artificial
  CRISPR gRNA sequence
tgctatgttggccacgctgg

SEQ ID NO: 251869 - DNA, 20 bp, Artificial
  CRISPR gRNA sequence
gctatgttggccacgctggt

SEQ ID NO: 251870 - DNA, 20 bp, Artificial
  CRISPR gRNA sequence
ctatgttggccacgctggtc

SEQ ID NO: 251871 - DNA, 20 bp, Artificial
  CRISPR gRNA sequence
tgttggccacgctggtcttg

SEQ ID NO: 251872 - DNA, 20 bp, Artificial
  CRISPR gRNA sequence
gccacgctggtcttgaactc

SEQ ID NO: 251873 - DNA, 20 bp, Artificial
  CRISPR gRNA sequence
gtcttgaactcctgacctca

SEQ ID NO: 251874 - DNA, 20 bp, Artificial
  CRISPR gRNA sequence
gaactcctgacctcaagtga

SEQ ID NO: 251875 - DNA, 20 bp, Artificial
  CRISPR gRNA sequence
aactcctgacctcaagtgat

SEQ ID NO: 251876 - DNA, 20 bp, Artificial
  CRISPR gRNA sequence
ctgacctcaagtgatctgcc

SEQ ID NO: 251877 - DNA, 20 bp, Artificial
  CRISPR gRNA sequence
acctcaagtgatctgcccac

SEQ ID NO: 251878 - DNA, 20 bp, Artificial
  CRISPR gRNA sequence
aagtgatctgcccacctcgg

SEQ ID NO: 251879 - DNA, 20 bp, Artificial
  CRISPR gRNA sequence
cccacctcggccttccaaag

SEQ ID NO: 251880 - DNA, 20 bp, Artificial
  CRISPR gRNA sequence
ggccttccaaagtgctgggg

SEQ ID NO: 251881 - DNA, 20 bp, Artificial
  CRISPR gRNA sequence
ccaaagtgctggggttacag

SEQ ID NO: 251882 - DNA, 20 bp, Artificial
  CRISPR gRNA sequence
caaagtgctggggttacagg

SEQ ID NO: 251883 - DNA, 20 bp, Artificial
  CRISPR gRNA sequence
gggttacaggcatgagccac

SEQ ID NO: 251884 - DNA, 20 bp, Artificial
  CRISPR gRNA sequence
caggcatgagccaccacgcc

SEQ ID NO: 251885 - DNA, 20 bp, Artificial
  CRISPR gRNA sequence
gctgagtttgttaaaattaa

SEQ ID NO: 251886 - DNA, 20 bp, Artificial
  CRISPR gRNA sequence
agtttgttaaaattaaaggg

SEQ ID NO: 251887 - DNA, 20 bp, Artificial
  CRISPR gRNA sequence
gttaaaattaaaggggagaa

SEQ ID NO: 251888 - DNA, 20 bp, Artificial
  CRISPR gRNA sequence
ttaaaattaaaggggagaat

SEQ ID NO: 251889 - DNA, 20 bp, Artificial
  CRISPR gRNA sequence
aaattaaaggggagaatgtt

SEQ ID NO: 251890 - DNA, 20 bp, Artificial
  CRISPR gRNA sequence
aaggggagaatgtttgctgc

SEQ ID NO: 251891 - DNA, 20 bp, Artificial
  CRISPR gRNA sequence
gctgcttagagatgttctgc

SEQ ID NO: 251892 - DNA, 20 bp, Artificial
  CRISPR gRNA sequence
ctgcttagagatgttctgca

SEQ ID NO: 251893 - DNA, 20 bp, Artificial
  CRISPR gRNA sequence
cttagagatgttctgcagct

SEQ ID NO: 251894 - DNA, 20 bp, Artificial
  CRISPR gRNA sequence
agagatgttctgcagctata

SEQ ID NO: 251895 - DNA, 20 bp, Artificial
  CRISPR gRNA sequence
gagatgttctgcagctataa

SEQ ID NO: 251896 - DNA, 20 bp, Artificial
  CRISPR gRNA sequence
tgcagctataatttatggaa

SEQ ID NO: 251897 - DNA, 20 bp, Artificial
  CRISPR gRNA sequence
cagctataatttatggaaaa

SEQ ID NO: 251898 - DNA, 20 bp, Artificial
  CRISPR gRNA sequence
taatttatggaaaataagtg

SEQ ID NO: 251899 - DNA, 20 bp, Artificial
  CRISPR gRNA sequence
atggaaaataagtgttaaat

SEQ ID NO: 251900 - DNA, 20 bp, Artificial
  CRISPR gRNA sequence
tggaaaataagtgttaaatg

SEQ ID NO: 251901 - DNA, 20 bp, Artificial
  CRISPR gRNA sequence
aatgattcaaatagacaaca

SEQ ID NO: 251902 - DNA, 20 bp, Artificial
  CRISPR gRNA sequence
aaatagacaacaaaatatac

SEQ ID NO: 251903 - DNA, 20 bp, Artificial
  CRISPR gRNA sequence
aaaattttttttttagcatt

SEQ ID NO: 251904 - DNA, 20 bp, Artificial
  CRISPR gRNA sequence
aaattttttttttagcattt

SEQ ID NO: 251905 - DNA, 20 bp, Artificial
  CRISPR gRNA sequence
tttttttagcatttatgaga

SEQ ID NO: 251906 - DNA, 20 bp, Artificial
  CRISPR gRNA sequence
ttttttagcatttatgagac

SEQ ID NO: 251907 - DNA, 20 bp, Artificial
  CRISPR gRNA sequence
tttttagcatttatgagacc

SEQ ID NO: 251908 - DNA, 20 bp, Artificial
  CRISPR gRNA sequence
ttttagcatttatgagacca

SEQ ID NO: 251909 - DNA, 20 bp, Artificial
  CRISPR gRNA sequence
tttagcatttatgagaccag

SEQ ID NO: 251910 - DNA, 20 bp, Artificial
  CRISPR gRNA sequence
ttagcatttatgagaccagt

SEQ ID NO: 251911 - DNA, 20 bp, Artificial
  CRISPR gRNA sequence
tagcatttatgagaccagta

SEQ ID NO: 251912 - DNA, 20 bp, Artificial
  CRISPR gRNA sequence
agcatttatgagaccagtac

SEQ ID NO: 251913 - DNA, 20 bp, Artificial
  CRISPR gRNA sequence
gcatttatgagaccagtaca

SEQ ID NO: 251914 - DNA, 20 bp, Artificial
  CRISPR gRNA sequence
atgagaccagtacaaactac

SEQ ID NO: 251915 - DNA, 20 bp, Artificial
  CRISPR gRNA sequence
tgagaccagtacaaactact

SEQ ID NO: 251916 - DNA, 20 bp, Artificial
  CRISPR gRNA sequence
ctcaagaggaagatggctgt

SEQ ID NO: 251917 - DNA, 20 bp, Artificial
  CRISPR gRNA sequence
aagaggaagatggctgtagc

SEQ ID NO: 251918 - DNA, 20 bp, Artificial
  CRISPR gRNA sequence
tagctgccgatttccagaag

SEQ ID NO: 251919 - DNA, 20 bp, Artificial
  CRISPR gRNA sequence
ccgatttccagaagaagaag

SEQ ID NO: 251920 - DNA, 20 bp, Artificial
  CRISPR gRNA sequence
ccagaagaagaagaaggagg

SEQ ID NO: 251921 - DNA, 20 bp, Artificial
  CRISPR gRNA sequence
cagaagaagaagaaggagga

SEQ ID NO: 251922 - DNA, 20 bp, Artificial
  CRISPR gRNA sequence
tgaaatggaagtcaataggg

SEQ ID NO: 251923 - DNA, 20 bp, Artificial
  CRISPR gRNA sequence
ttgggactttcttgaaaaga

SEQ ID NO: 251924 - DNA, 20 bp, Artificial
  CRISPR gRNA sequence
ggactttcttgaaaagaagc

SEQ ID NO: 251925 - DNA, 20 bp, Artificial
  CRISPR gRNA sequence
tcttgaaaagaagcaaggaa

SEQ ID NO: 251926 - DNA, 20 bp, Artificial
  CRISPR gRNA sequence
cttgaaaagaagcaaggaaa

SEQ ID NO: 251927 - DNA, 20 bp, Artificial
  CRISPR gRNA sequence
ttgaaaagaagcaaggaaat

SEQ ID NO: 251928 - DNA, 20 bp, Artificial
  CRISPR gRNA sequence
gaaaagaagcaaggaaatat

SEQ ID NO: 251929 - DNA, 20 bp, Artificial
  CRISPR gRNA sequence
aaaagaagcaaggaaatatg

SEQ ID NO: 251930 - DNA, 20 bp, Artificial
  CRISPR gRNA sequence
tcacagctttcaaaagcaag

SEQ ID NO: 251931 - DNA, 20 bp, Artificial
  CRISPR gRNA sequence
tcaaaagcaagaacaccatc

SEQ ID NO: 251932 - DNA, 20 bp, Artificial
  CRISPR gRNA sequence
caaaagcaagaacaccatcc

SEQ ID NO: 251933 - DNA, 20 bp, Artificial
  CRISPR gRNA sequence
aaaagcaagaacaccatcct

SEQ ID NO: 251934 - DNA, 20 bp, Artificial
  CRISPR gRNA sequence
cataatacccaggattcccc

SEQ ID NO: 251935 - DNA, 20 bp, Artificial
  CRISPR gRNA sequence
ccccaacacacgttcttttc

SEQ ID NO: 251936 - DNA, 20 bp, Artificial
  CRISPR gRNA sequence
ttttctaaatgccaatgagt

SEQ ID NO: 251937 - DNA, 20 bp, Artificial
  CRISPR gRNA sequence
ttctaaatgccaatgagttg

SEQ ID NO: 251938 - DNA, 20 bp, Artificial
  CRISPR gRNA sequence
tctaaatgccaatgagttgg

SEQ ID NO: 251939 - DNA, 20 bp, Artificial
  CRISPR gRNA sequence
ctaaatgccaatgagttggc

SEQ ID NO: 251940 - DNA, 20 bp, Artificial
  CRISPR gRNA sequence
taaatgccaatgagttggcc

SEQ ID NO: 251941 - DNA, 20 bp, Artificial
  CRISPR gRNA sequence
aatgccaatgagttggcctt

SEQ ID NO: 251942 - DNA, 20 bp, Artificial
  CRISPR gRNA sequence
gcctttaaaaatgcaccact

SEQ ID NO: 251943 - DNA, 20 bp, Artificial
  CRISPR gRNA sequence
taaaaatgcaccactttttt

SEQ ID NO: 251944 - DNA, 20 bp, Artificial
  CRISPR gRNA sequence
aaaaatgcaccacttttttt

SEQ ID NO: 251945 - DNA, 20 bp, Artificial
  CRISPR gRNA sequence
aaaatgcaccactttttttt

SEQ ID NO: 251946 - DNA, 20 bp, Artificial
  CRISPR gRNA sequence
tttttttttttttgacaggg

SEQ ID NO: 251947 - DNA, 20 bp, Artificial
  CRISPR gRNA sequence
ttttttttttttgacagggt

SEQ ID NO: 251948 - DNA, 20 bp, Artificial
  CRISPR gRNA sequence
tttttttttttgacagggtc

SEQ ID NO: 251949 - DNA, 20 bp, Artificial
  CRISPR gRNA sequence
ttttttttttgacagggtct

SEQ ID NO: 251950 - DNA, 20 bp, Artificial
  CRISPR gRNA sequence
tttttttttgacagggtctc

SEQ ID NO: 251951 - DNA, 20 bp, Artificial
  CRISPR gRNA sequence
ttttttttgacagggtctca

SEQ ID NO: 251952 - DNA, 20 bp, Artificial
  CRISPR gRNA sequence
tttttttgacagggtctcac

SEQ ID NO: 251953 - DNA, 20 bp, Artificial
  CRISPR gRNA sequence
ttttttgacagggtctcact

SEQ ID NO: 251954 - DNA, 20 bp, Artificial
  CRISPR gRNA sequence
tttttgacagggtctcactc

SEQ ID NO: 251955 - DNA, 20 bp, Artificial
  CRISPR gRNA sequence
ttttgacagggtctcactct

SEQ ID NO: 251956 - DNA, 20 bp, Artificial
  CRISPR gRNA sequence
tttgacagggtctcactctg

SEQ ID NO: 251957 - DNA, 20 bp, Artificial
  CRISPR gRNA sequence
ttgacagggtctcactctgt

SEQ ID NO: 251958 - DNA, 20 bp, Artificial
  CRISPR gRNA sequence
tgacagggtctcactctgtc

SEQ ID NO: 251959 - DNA, 20 bp, Artificial
  CRISPR gRNA sequence
gacagggtctcactctgtca

SEQ ID NO: 251960 - DNA, 20 bp, Artificial
  CRISPR gRNA sequence
acagggtctcactctgtcac

SEQ ID NO: 251961 - DNA, 20 bp, Artificial
  CRISPR gRNA sequence
actctgtcacccaggctgga

SEQ ID NO: 251962 - DNA, 20 bp, Artificial
  CRISPR gRNA sequence
tgtcacccaggctggagtgc

SEQ ID NO: 251963 - DNA, 20 bp, Artificial
  CRISPR gRNA sequence
tcacccaggctggagtgcag

SEQ ID NO: 251964 - DNA, 20 bp, Artificial
  CRISPR gRNA sequence
gagtgcagtggcaccaccat

SEQ ID NO: 251965 - DNA, 20 bp, Artificial
  CRISPR gRNA sequence
tctgcagccttgacctctgg

SEQ ID NO: 251966 - DNA, 20 bp, Artificial
  CRISPR gRNA sequence
tgcagccttgacctctggga

SEQ ID NO: 251967 - DNA, 20 bp, Artificial
  CRISPR gRNA sequence
cagccttgacctctgggagc

SEQ ID NO: 251968 - DNA, 20 bp, Artificial
  CRISPR gRNA sequence
gacctctgggagctcaagtg

SEQ ID NO: 251969 - DNA, 20 bp, Artificial
  CRISPR gRNA sequence
acctctgggagctcaagtga

SEQ ID NO: 251970 - DNA, 20 bp, Artificial
  CRISPR gRNA sequence
tgggagctcaagtgatcctc

SEQ ID NO: 251971 - DNA, 20 bp, Artificial
  CRISPR gRNA sequence
ggagctcaagtgatcctcct

SEQ ID NO: 251972 - DNA, 20 bp, Artificial
  CRISPR gRNA sequence
aagtgatcctcctgcctcag

SEQ ID NO: 251973 - DNA, 20 bp, Artificial
  CRISPR gRNA sequence
ctgcctcagtctcctgagta

SEQ ID NO: 251974 - DNA, 20 bp, Artificial
  CRISPR gRNA sequence
cctcagtctcctgagtagct

SEQ ID NO: 251975 - DNA, 20 bp, Artificial
  CRISPR gRNA sequence
agtctcctgagtagctggaa

SEQ ID NO: 251976 - DNA, 20 bp, Artificial
  CRISPR gRNA sequence
ctgagtagctggaactacaa

SEQ ID NO: 251977 - DNA, 20 bp, Artificial
  CRISPR gRNA sequence
agtagctggaactacaagga

SEQ ID NO: 251978 - DNA, 20 bp, Artificial
  CRISPR gRNA sequence
gaactacaaggaagggccac

SEQ ID NO: 251979 - DNA, 20 bp, Artificial
  CRISPR gRNA sequence
caaggaagggccaccacacc

SEQ ID NO: 251980 - DNA, 20 bp, Artificial
  CRISPR gRNA sequence
actaacttttttgttttttg

SEQ ID NO: 251981 - DNA, 20 bp, Artificial
  CRISPR gRNA sequence
acttttttgttttttgtttg

SEQ ID NO: 251982 - DNA, 20 bp, Artificial
  CRISPR gRNA sequence
ttttgttttttgtttggtaa

SEQ ID NO: 251983 - DNA, 20 bp, Artificial
  CRISPR gRNA sequence
tttgttttttgtttggtaaa

SEQ ID NO: 251984 - DNA, 20 bp, Artificial
  CRISPR gRNA sequence
ttgttttttgtttggtaaag

SEQ ID NO: 251985 - DNA, 20 bp, Artificial
  CRISPR gRNA sequence
tgttttttgtttggtaaaga

SEQ ID NO: 251986 - DNA, 20 bp, Artificial
  CRISPR gRNA sequence
gttttttgtttggtaaagat

SEQ ID NO: 251987 - DNA, 20 bp, Artificial
  CRISPR gRNA sequence
ttttttgtttggtaaagatg

SEQ ID NO: 251988 - DNA, 20 bp, Artificial
  CRISPR gRNA sequence
tttgtttggtaaagatggca

SEQ ID NO: 251989 - DNA, 20 bp, Artificial
  CRISPR gRNA sequence
ttgtttggtaaagatggcat

SEQ ID NO: 251990 - DNA, 20 bp, Artificial
  CRISPR gRNA sequence
tgtttggtaaagatggcatt

SEQ ID NO: 251991 - DNA, 20 bp, Artificial
  CRISPR gRNA sequence
gtttggtaaagatggcattt

SEQ ID NO: 251992 - DNA, 20 bp, Artificial
  CRISPR gRNA sequence
tttggtaaagatggcatttc

SEQ ID NO: 251993 - DNA, 20 bp, Artificial
  CRISPR gRNA sequence
ggtaaagatggcatttcacc

SEQ ID NO: 251994 - DNA, 20 bp, Artificial
  CRISPR gRNA sequence
gtaaagatggcatttcacca

SEQ ID NO: 251995 - DNA, 20 bp, Artificial
  CRISPR gRNA sequence
caccatgttgtacaggctgg

SEQ ID NO: 251996 - DNA, 20 bp, Artificial
  CRISPR gRNA sequence
accatgttgtacaggctggt

SEQ ID NO: 251997 - DNA, 20 bp, Artificial
  CRISPR gRNA sequence
tacaggctggtctcaaactc

SEQ ID NO: 251998 - DNA, 20 bp, Artificial
  CRISPR gRNA sequence
gtctcaaactcctaggttca

SEQ ID NO: 251999 - DNA, 20 bp, Artificial
  CRISPR gRNA sequence
aaactcctaggttcactttg

SEQ ID NO: 252000 - DNA, 20 bp, Artificial
  CRISPR gRNA sequence
ctaggttcactttggcctcc

SEQ ID NO: 252001 - DNA, 20 bp, Artificial
  CRISPR gRNA sequence
ggttcactttggcctcccaa

SEQ ID NO: 252002 - DNA, 20 bp, Artificial
  CRISPR gRNA sequence
actttggcctcccaaagtgc

SEQ ID NO: 252003 - DNA, 20 bp, Artificial
  CRISPR gRNA sequence
tggcctcccaaagtgctggg

SEQ ID NO: 252004 - DNA, 20 bp, Artificial
  CRISPR gRNA sequence
ggcctcccaaagtgctggga

SEQ ID NO: 252005 - DNA, 20 bp, Artificial
  CRISPR gRNA sequence
gcctcccaaagtgctgggat

SEQ ID NO: 252006 - DNA, 20 bp, Artificial
  CRISPR gRNA sequence
ccaaagtgctgggattacag

SEQ ID NO: 252007 - DNA, 20 bp, Artificial
  CRISPR gRNA sequence
ggattacagacatgaactgc

SEQ ID NO: 252008 - DNA, 20 bp, Artificial
  CRISPR gRNA sequence
cagacatgaactgccaggcc

SEQ ID NO: 252009 - DNA, 20 bp, Artificial
  CRISPR gRNA sequence
ccaggcccggccaaaataat

SEQ ID NO: 252010 - DNA, 20 bp, Artificial
  CRISPR gRNA sequence
ttaacagaacagacagatga

SEQ ID NO: 252011 - DNA, 20 bp, Artificial
  CRISPR gRNA sequence
taacagaacagacagatgag

SEQ ID NO: 252012 - DNA, 20 bp, Artificial
  CRISPR gRNA sequence
aacagaacagacagatgagg

SEQ ID NO: 252013 - DNA, 20 bp, Artificial
  CRISPR gRNA sequence
acagaacagacagatgagga

SEQ ID NO: 252014 - DNA, 20 bp, Artificial
  CRISPR gRNA sequence
gtgataaaaaaaaaaaaaaa

SEQ ID NO: 252015 - DNA, 20 bp, Artificial
  CRISPR gRNA sequence
tctagataccacttaacagg

SEQ ID NO: 252016 - DNA, 20 bp, Artificial
  CRISPR gRNA sequence
ctagataccacttaacaggt

SEQ ID NO: 252017 - DNA, 20 bp, Artificial
  CRISPR gRNA sequence
tagataccacttaacaggtt

SEQ ID NO: 252018 - DNA, 20 bp, Artificial
  CRISPR gRNA sequence
gataccacttaacaggtttg

SEQ ID NO: 252019 - DNA, 20 bp, Artificial
  CRISPR gRNA sequence
aacaggtttgagctagtttt

SEQ ID NO: 252020 - DNA, 20 bp, Artificial
  CRISPR gRNA sequence
acaggtttgagctagttttt

SEQ ID NO: 252021 - DNA, 20 bp, Artificial
  CRISPR gRNA sequence
gagctagtttttttgaaatc

SEQ ID NO: 252022 - DNA, 20 bp, Artificial
  CRISPR gRNA sequence
agctagtttttttgaaatcc

SEQ ID NO: 252023 - DNA, 20 bp, Artificial
  CRISPR gRNA sequence
gtttttttgaaatccaaaga

SEQ ID NO: 252024 - DNA, 20 bp, Artificial
  CRISPR gRNA sequence
ttttgaaatccaaagaaaat

SEQ ID NO: 252025 - DNA, 20 bp, Artificial
  CRISPR gRNA sequence
tttgaaatccaaagaaaatt

SEQ ID NO: 252026 - DNA, 20 bp, Artificial
  CRISPR gRNA sequence
ttgaaatccaaagaaaatta

SEQ ID NO: 252027 - DNA, 20 bp, Artificial
  CRISPR gRNA sequence
tgaaatccaaagaaaattat

SEQ ID NO: 252028 - DNA, 20 bp, Artificial
  CRISPR gRNA sequence
gaaatccaaagaaaattata

SEQ ID NO: 252029 - DNA, 20 bp, Artificial
  CRISPR gRNA sequence
aaatccaaagaaaattatag

SEQ ID NO: 252030 - DNA, 20 bp, Artificial
  CRISPR gRNA sequence
tagtttaaattcaattacat

SEQ ID NO: 252031 - DNA, 20 bp, Artificial
  CRISPR gRNA sequence
aaattcaattacatagtcca

SEQ ID NO: 252032 - DNA, 20 bp, Artificial
  CRISPR gRNA sequence
aattcaattacatagtccag

SEQ ID NO: 252033 - DNA, 20 bp, Artificial
  CRISPR gRNA sequence
aattacatagtccagtggtc

SEQ ID NO: 252034 - DNA, 20 bp, Artificial
  CRISPR gRNA sequence
catagtccagtggtccaact

SEQ ID NO: 252035 - DNA, 20 bp, Artificial
  CRISPR gRNA sequence
taattataatcaaaatcaat

SEQ ID NO: 252036 - DNA, 20 bp, Artificial
  CRISPR gRNA sequence
taatcaaaatcaatgcaggt

SEQ ID NO: 252037 - DNA, 20 bp, Artificial
  CRISPR gRNA sequence
gttttttggtgctaatatga

SEQ ID NO: 252038 - DNA, 20 bp, Artificial
  CRISPR gRNA sequence
ttttttggtgctaatatgac

SEQ ID NO: 252039 - DNA, 20 bp, Artificial
  CRISPR gRNA sequence
tttggtgctaatatgacata

SEQ ID NO: 252040 - DNA, 20 bp, Artificial
  CRISPR gRNA sequence
ttggtgctaatatgacatat

SEQ ID NO: 252041 - DNA, 20 bp, Artificial
  CRISPR gRNA sequence
tggtgctaatatgacatatg

SEQ ID NO: 252042 - DNA, 20 bp, Artificial
  CRISPR gRNA sequence
ggtgctaatatgacatatga

SEQ ID NO: 252043 - DNA, 20 bp, Artificial
  CRISPR gRNA sequence
gtgctaatatgacatatgac

SEQ ID NO: 252044 - DNA, 20 bp, Artificial
  CRISPR gRNA sequence
atatgacatatgacaataag

SEQ ID NO: 252045 - DNA, 20 bp, Artificial
  CRISPR gRNA sequence
aagtttccgtgggttctgtc

SEQ ID NO: 252046 - DNA, 20 bp, Artificial
  CRISPR gRNA sequence
ccgtgggttctgtcatgtaa

SEQ ID NO: 252047 - DNA, 20 bp, Artificial
  CRISPR gRNA sequence
cgtgggttctgtcatgtaac

SEQ ID NO: 252048 - DNA, 20 bp, Artificial
  CRISPR gRNA sequence
tgtcatgtaacacgacatgc

SEQ ID NO: 252049 - DNA, 20 bp, Artificial
  CRISPR gRNA sequence
tcatgtaacacgacatgctc

SEQ ID NO: 252050 - DNA, 20 bp, Artificial
  CRISPR gRNA sequence
caccgtcaggggggagtatg

SEQ ID NO: 252051 - DNA, 20 bp, Artificial
  CRISPR gRNA sequence
agtttagggtcaaggacaaa

SEQ ID NO: 252052 - DNA, 20 bp, Artificial
  CRISPR gRNA sequence
agggtcaaggacaaaaaacc

SEQ ID NO: 252053 - DNA, 20 bp, Artificial
  CRISPR gRNA sequence
gggtcaaggacaaaaaacct

SEQ ID NO: 252054 - DNA, 20 bp, Artificial
  CRISPR gRNA sequence
aggcctggaggaagttttgg

SEQ ID NO: 252055 - DNA, 20 bp, Artificial
  CRISPR gRNA sequence
gaggaagttttggaaagagt

SEQ ID NO: 252056 - DNA, 20 bp, Artificial
  CRISPR gRNA sequence
tggaaagagttcaagtgtct

SEQ ID NO: 252057 - DNA, 20 bp, Artificial
  CRISPR gRNA sequence
ggaaagagttcaagtgtctg

SEQ ID NO: 252058 - DNA, 20 bp, Artificial
  CRISPR gRNA sequence
gaaagagttcaagtgtctgt

SEQ ID NO: 252059 - DNA, 20 bp, Artificial
  CRISPR gRNA sequence
aagtgtctgtatatcctatg

SEQ ID NO: 252060 - DNA, 20 bp, Artificial
  CRISPR gRNA sequence
tatatcctatggtcttctcc

SEQ ID NO: 252061 - DNA, 20 bp, Artificial
  CRISPR gRNA sequence
tggtcttctccatcctcaca

SEQ ID NO: 252062 - DNA, 20 bp, Artificial
  CRISPR gRNA sequence
ctccatcctcacaccttctg

SEQ ID NO: 252063 - DNA, 20 bp, Artificial
  CRISPR gRNA sequence
tccatcctcacaccttctgc

SEQ ID NO: 252064 - DNA, 20 bp, Artificial
  CRISPR gRNA sequence
catcctcacaccttctgcct

SEQ ID NO: 252065 - DNA, 20 bp, Artificial
  CRISPR gRNA sequence
acaccttctgcctttgtcct

SEQ ID NO: 252066 - DNA, 20 bp, Artificial
  CRISPR gRNA sequence
ctgcctttgtcctgctccct

SEQ ID NO: 252067 - DNA, 20 bp, Artificial
  CRISPR gRNA sequence
tgcctttgtcctgctccctt

SEQ ID NO: 252068 - DNA, 20 bp, Artificial
  CRISPR gRNA sequence
cctttgtcctgctccctttt

SEQ ID NO: 252069 - DNA, 20 bp, Artificial
  CRISPR gRNA sequence
tgtcctgctcccttttaagc

SEQ ID NO: 252070 - DNA, 20 bp, Artificial
  CRISPR gRNA sequence
gtcctgctcccttttaagcc

SEQ ID NO: 252071 - DNA, 20 bp, Artificial
  CRISPR gRNA sequence
tcctgctcccttttaagcca

SEQ ID NO: 252072 - DNA, 20 bp, Artificial
  CRISPR gRNA sequence
ctcccttttaagccaggtta

SEQ ID NO: 252073 - DNA, 20 bp, Artificial
  CRISPR gRNA sequence
ccttttaagccaggttacat

SEQ ID NO: 252074 - DNA, 20 bp, Artificial
  CRISPR gRNA sequence
ttaagccaggttacattcta

SEQ ID NO: 252075 - DNA, 20 bp, Artificial
  CRISPR gRNA sequence
taagccaggttacattctaa

SEQ ID NO: 252076 - DNA, 20 bp, Artificial
  CRISPR gRNA sequence
aagccaggttacattctaaa

SEQ ID NO: 252077 - DNA, 20 bp, Artificial
  CRISPR gRNA sequence
agccaggttacattctaaaa

SEQ ID NO: 252078 - DNA, 20 bp, Artificial
  CRISPR gRNA sequence
cattctaaaaattcttaact

SEQ ID NO: 252079 - DNA, 20 bp, Artificial
  CRISPR gRNA sequence
taaaaattcttaacttttaa

SEQ ID NO: 252080 - DNA, 20 bp, Artificial
  CRISPR gRNA sequence
aaaattcttaacttttaaca

SEQ ID NO: 252081 - DNA, 20 bp, Artificial
  CRISPR gRNA sequence
ttaacttttaacataatatt

SEQ ID NO: 252082 - DNA, 20 bp, Artificial
  CRISPR gRNA sequence
aacttttaacataatatttt

SEQ ID NO: 252083 - DNA, 20 bp, Artificial
  CRISPR gRNA sequence
acttttaacataatatttta

SEQ ID NO: 252084 - DNA, 20 bp, Artificial
  CRISPR gRNA sequence
ttaacataatattttatacc

SEQ ID NO: 252085 - DNA, 20 bp, Artificial
  CRISPR gRNA sequence
taacataatattttatacca

SEQ ID NO: 252086 - DNA, 20 bp, Artificial
  CRISPR gRNA sequence
aacataatattttataccaa

SEQ ID NO: 252087 - DNA, 20 bp, Artificial
  CRISPR gRNA sequence
acataatattttataccaaa

SEQ ID NO: 252088 - DNA, 20 bp, Artificial
  CRISPR gRNA sequence
tataccaaagccaataaatg

SEQ ID NO: 252089 - DNA, 20 bp, Artificial
  CRISPR gRNA sequence
ataccaaagccaataaatga

SEQ ID NO: 252090 - DNA, 20 bp, Artificial
  CRISPR gRNA sequence
taccaaagccaataaatgaa

SEQ ID NO: 252091 - DNA, 20 bp, Artificial
  CRISPR gRNA sequence
catatgataggtatgaagta

SEQ ID NO: 252092 - DNA, 20 bp, Artificial
  CRISPR gRNA sequence
acacctgtgagctcattgtc

SEQ ID NO: 252093 - DNA, 20 bp, Artificial
  CRISPR gRNA sequence
tgagctcattgtcctaccac

SEQ ID NO: 252094 - DNA, 20 bp, Artificial
  CRISPR gRNA sequence
attgtcctaccacagcacta

SEQ ID NO: 252095 - DNA, 20 bp, Artificial
  CRISPR gRNA sequence
tcctaccacagcactagagt

SEQ ID NO: 252096 - DNA, 20 bp, Artificial
  CRISPR gRNA sequence
ccacagcactagagtggggg

SEQ ID NO: 252097 - DNA, 20 bp, Artificial
  CRISPR gRNA sequence
gagtgggggccgccaaactc

SEQ ID NO: 252098 - DNA, 20 bp, Artificial
  CRISPR gRNA sequence
ccatggccaaacctggtgca

SEQ ID NO: 252099 - DNA, 20 bp, Artificial
  CRISPR gRNA sequence
gtgcaccatttgcctttgtt

SEQ ID NO: 252100 - DNA, 20 bp, Artificial
  CRISPR gRNA sequence
gcctttgtttgtctgttggt

SEQ ID NO: 252101 - DNA, 20 bp, Artificial
  CRISPR gRNA sequence
cctttgtttgtctgttggtt

SEQ ID NO: 252102 - DNA, 20 bp, Artificial
  CRISPR gRNA sequence
tgtttgtctgttggtttgct

SEQ ID NO: 252103 - DNA, 20 bp, Artificial
  CRISPR gRNA sequence
gtttgtctgttggtttgctt

SEQ ID NO: 252104 - DNA, 20 bp, Artificial
  CRISPR gRNA sequence
tttgtctgttggtttgcttg

SEQ ID NO: 252105 - DNA, 20 bp, Artificial
  CRISPR gRNA sequence
gtctgttggtttgcttgaga

SEQ ID NO: 252106 - DNA, 20 bp, Artificial
  CRISPR gRNA sequence
tctgttggtttgcttgagac

SEQ ID NO: 252107 - DNA, 20 bp, Artificial
  CRISPR gRNA sequence
ttggtttgcttgagacagtc

SEQ ID NO: 252108 - DNA, 20 bp, Artificial
  CRISPR gRNA sequence
gtttgcttgagacagtcttg

SEQ ID NO: 252109 - DNA, 20 bp, Artificial
  CRISPR gRNA sequence
gcttgagacagtcttgctct

SEQ ID NO: 252110 - DNA, 20 bp, Artificial
  CRISPR gRNA sequence
cttgagacagtcttgctctg

SEQ ID NO: 252111 - DNA, 20 bp, Artificial
  CRISPR gRNA sequence
gagacagtcttgctctgttg

SEQ ID NO: 252112 - DNA, 20 bp, Artificial
  CRISPR gRNA sequence
agacagtcttgctctgttgc

SEQ ID NO: 252113 - DNA, 20 bp, Artificial
  CRISPR gRNA sequence
gctctgttgcccaggctgga

SEQ ID NO: 252114 - DNA, 20 bp, Artificial
  CRISPR gRNA sequence
ctctgttgcccaggctggaa

SEQ ID NO: 252115 - DNA, 20 bp, Artificial
  CRISPR gRNA sequence
tgttgcccaggctggaatgg

SEQ ID NO: 252116 - DNA, 20 bp, Artificial
  CRISPR gRNA sequence
ttgcccaggctggaatggag

SEQ ID NO: 252117 - DNA, 20 bp, Artificial
  CRISPR gRNA sequence
cccaggctggaatggagtgg

SEQ ID NO: 252118 - DNA, 20 bp, Artificial
  CRISPR gRNA sequence
gaatggagtggctattcaca

SEQ ID NO: 252119 - DNA, 20 bp, Artificial
  CRISPR gRNA sequence
ttcacaggcacaatcatagc

SEQ ID NO: 252120 - DNA, 20 bp, Artificial
  CRISPR gRNA sequence
acaggcacaatcatagcaca

SEQ ID NO: 252121 - DNA, 20 bp, Artificial
  CRISPR gRNA sequence
tagccttaaactcctgggct

SEQ ID NO: 252122 - DNA, 20 bp, Artificial
  CRISPR gRNA sequence
agccttaaactcctgggctc

SEQ ID NO: 252123 - DNA, 20 bp, Artificial
  CRISPR gRNA sequence
gccttaaactcctgggctca

SEQ ID NO: 252124 - DNA, 20 bp, Artificial
  CRISPR gRNA sequence
aaactcctgggctcaagtga

SEQ ID NO: 252125 - DNA, 20 bp, Artificial
  CRISPR gRNA sequence
aactcctgggctcaagtgat

SEQ ID NO: 252126 - DNA, 20 bp, Artificial
  CRISPR gRNA sequence
ctgggctcaagtgatccacc

SEQ ID NO: 252127 - DNA, 20 bp, Artificial
  CRISPR gRNA sequence
ggctcaagtgatccacccgc

SEQ ID NO: 252128 - DNA, 20 bp, Artificial
  CRISPR gRNA sequence
aagtgatccacccgcctcag

SEQ ID NO: 252129 - DNA, 20 bp, Artificial
  CRISPR gRNA sequence
agtctcccaagtagctggga

SEQ ID NO: 252130 - DNA, 20 bp, Artificial
  CRISPR gRNA sequence
ccaagtagctgggattacag

SEQ ID NO: 252131 - DNA, 20 bp, Artificial
  CRISPR gRNA sequence
ggattacaggtgcaaacctg

SEQ ID NO: 252132 - DNA, 20 bp, Artificial
  CRISPR gRNA sequence
caggtgcaaacctggcatgc

SEQ ID NO: 252133 - DNA, 20 bp, Artificial
  CRISPR gRNA sequence
gcatgcctgccattgtttgg

SEQ ID NO: 252134 - DNA, 20 bp, Artificial
  CRISPR gRNA sequence
ccattgtttggcttatgatc

SEQ ID NO: 252135 - DNA, 20 bp, Artificial
  CRISPR gRNA sequence
tttggcttatgatctaagga

SEQ ID NO: 252136 - DNA, 20 bp, Artificial
  CRISPR gRNA sequence
ggcttatgatctaaggatag

SEQ ID NO: 252137 - DNA, 20 bp, Artificial
  CRISPR gRNA sequence
gcttatgatctaaggatagc

SEQ ID NO: 252138 - DNA, 20 bp, Artificial
  CRISPR gRNA sequence
atgatctaaggatagctttt

SEQ ID NO: 252139 - DNA, 20 bp, Artificial
  CRISPR gRNA sequence
tgatctaaggatagcttttt

SEQ ID NO: 252140 - DNA, 20 bp, Artificial
  CRISPR gRNA sequence
aggatagctttttaaatttt

SEQ ID NO: 252141 - DNA, 20 bp, Artificial
  CRISPR gRNA sequence
tttaaattttattcatttta

SEQ ID NO: 252142 - DNA, 20 bp, Artificial
  CRISPR gRNA sequence
ttaaattttattcattttat

SEQ ID NO: 252143 - DNA, 20 bp, Artificial
  CRISPR gRNA sequence
taaattttattcattttatt

SEQ ID NO: 252144 - DNA, 20 bp, Artificial
  CRISPR gRNA sequence
aaattttattcattttattt

SEQ ID NO: 252145 - DNA, 20 bp, Artificial
  CRISPR gRNA sequence
aattttattcattttatttt

SEQ ID NO: 252146 - DNA, 20 bp, Artificial
  CRISPR gRNA sequence
tattcattttattttttttt

SEQ ID NO: 252147 - DNA, 20 bp, Artificial
  CRISPR gRNA sequence
attcattttatttttttttg

SEQ ID NO: 252148 - DNA, 20 bp, Artificial
  CRISPR gRNA sequence
ttcattttatttttttttga

SEQ ID NO: 252149 - DNA, 20 bp, Artificial
  CRISPR gRNA sequence
attttatttttttttgagac

SEQ ID NO: 252150 - DNA, 20 bp, Artificial
  CRISPR gRNA sequence
tatttttttttgagacagtg

SEQ ID NO: 252151 - DNA, 20 bp, Artificial
  CRISPR gRNA sequence
atttttttttgagacagtgt

SEQ ID NO: 252152 - DNA, 20 bp, Artificial
  CRISPR gRNA sequence
tttttttttgagacagtgtc

SEQ ID NO: 252153 - DNA, 20 bp, Artificial
  CRISPR gRNA sequence
ttttttgagacagtgtctca

SEQ ID NO: 252154 - DNA, 20 bp, Artificial
  CRISPR gRNA sequence
tttttgagacagtgtctcac

SEQ ID NO: 252155 - DNA, 20 bp, Artificial
  CRISPR gRNA sequence
ttttgagacagtgtctcact

SEQ ID NO: 252156 - DNA, 20 bp, Artificial
  CRISPR gRNA sequence
tttgagacagtgtctcactc

SEQ ID NO: 252157 - DNA, 20 bp, Artificial
  CRISPR gRNA sequence
ttgagacagtgtctcactct

SEQ ID NO: 252158 - DNA, 20 bp, Artificial
  CRISPR gRNA sequence
tgagacagtgtctcactctg

SEQ ID NO: 252159 - DNA, 20 bp, Artificial
  CRISPR gRNA sequence
gagacagtgtctcactctgt

SEQ ID NO: 252160 - DNA, 20 bp, Artificial
  CRISPR gRNA sequence
agacagtgtctcactctgtc

SEQ ID NO: 252161 - DNA, 20 bp, Artificial
  CRISPR gRNA sequence
actctgtctcccaggctgga

SEQ ID NO: 252162 - DNA, 20 bp, Artificial
  CRISPR gRNA sequence
tgtctcccaggctggagtac

SEQ ID NO: 252163 - DNA, 20 bp, Artificial
  CRISPR gRNA sequence
tctcccaggctggagtacag

SEQ ID NO: 252164 - DNA, 20 bp, Artificial
  CRISPR gRNA sequence
ccaggctggagtacagtggt

SEQ ID NO: 252165 - DNA, 20 bp, Artificial
  CRISPR gRNA sequence
gagtacagtggtacaatctt

SEQ ID NO: 252166 - DNA, 20 bp, Artificial
  CRISPR gRNA sequence
ggatcaccgcctcccagttt

SEQ ID NO: 252167 - DNA, 20 bp, Artificial
  CRISPR gRNA sequence
gatcaccgcctcccagtttc

SEQ ID NO: 252168 - DNA, 20 bp, Artificial
  CRISPR gRNA sequence
ccagtttcaagtgatctccc

SEQ ID NO: 252169 - DNA, 20 bp, Artificial
  CRISPR gRNA sequence
caagtgatctccctgcctca

SEQ ID NO: 252170 - DNA, 20 bp, Artificial
  CRISPR gRNA sequence
aagtgatctccctgcctcag

SEQ ID NO: 252171 - DNA, 20 bp, Artificial
  CRISPR gRNA sequence
cctgcctcagcctcctaagt

SEQ ID NO: 252172 - DNA, 20 bp, Artificial
  CRISPR gRNA sequence
cctcagcctcctaagtagct

SEQ ID NO: 252173 - DNA, 20 bp, Artificial
  CRISPR gRNA sequence
agcctcctaagtagctggga

SEQ ID NO: 252174 - DNA, 20 bp, Artificial
  CRISPR gRNA sequence
ctaagtagctgggactacag

SEQ ID NO: 252175 - DNA, 20 bp, Artificial
  CRISPR gRNA sequence
agtagctgggactacaggta

SEQ ID NO: 252176 - DNA, 20 bp, Artificial
  CRISPR gRNA sequence
ggactacaggtatgtgccac

SEQ ID NO: 252177 - DNA, 20 bp, Artificial
  CRISPR gRNA sequence
caggtatgtgccaccacgcc

SEQ ID NO: 252178 - DNA, 20 bp, Artificial
  CRISPR gRNA sequence
gctaatttttatatttttag

SEQ ID NO: 252179 - DNA, 20 bp, Artificial
  CRISPR gRNA sequence
atttttatatttttagtaga

SEQ ID NO: 252180 - DNA, 20 bp, Artificial
  CRISPR gRNA sequence
ttatatttttagtagagacg

SEQ ID NO: 252181 - DNA, 20 bp, Artificial
  CRISPR gRNA sequence
tatatttttagtagagacgg

SEQ ID NO: 252182 - DNA, 20 bp, Artificial
  CRISPR gRNA sequence
atatttttagtagagacggg

SEQ ID NO: 252183 - DNA, 20 bp, Artificial
  CRISPR gRNA sequence
tatttttagtagagacgggg

SEQ ID NO: 252184 - DNA, 20 bp, Artificial
  CRISPR gRNA sequence
ttagtagagacggggtttca

SEQ ID NO: 252185 - DNA, 20 bp, Artificial
  CRISPR gRNA sequence
tagtagagacggggtttcac

SEQ ID NO: 252186 - DNA, 20 bp, Artificial
  CRISPR gRNA sequence
agtagagacggggtttcacc

SEQ ID NO: 252187 - DNA, 20 bp, Artificial
  CRISPR gRNA sequence
gtagagacggggtttcacca

SEQ ID NO: 252188 - DNA, 20 bp, Artificial
  CRISPR gRNA sequence
caccatgttgtccaggctgg

SEQ ID NO: 252189 - DNA, 20 bp, Artificial
  CRISPR gRNA sequence
accatgttgtccaggctggt

SEQ ID NO: 252190 - DNA, 20 bp, Artificial
  CRISPR gRNA sequence
tccaggctggtctcaaactc

SEQ ID NO: 252191 - DNA, 20 bp, Artificial
  CRISPR gRNA sequence
gtctcaaactcctgacctca

SEQ ID NO: 252192 - DNA, 20 bp, Artificial
  CRISPR gRNA sequence
aaactcctgacctcaggtga

SEQ ID NO: 252193 - DNA, 20 bp, Artificial
  CRISPR gRNA sequence
ctgacctcaggtgatctgcc

SEQ ID NO: 252194 - DNA, 20 bp, Artificial
  CRISPR gRNA sequence
acctcaggtgatctgcccac

SEQ ID NO: 252195 - DNA, 20 bp, Artificial
  CRISPR gRNA sequence
aggtgatctgcccacctctg

SEQ ID NO: 252196 - DNA, 20 bp, Artificial
  CRISPR gRNA sequence
cccacctctgcctcccaaag

SEQ ID NO: 252197 - DNA, 20 bp, Artificial
  CRISPR gRNA sequence
tgcctcccaaagtgctggga

SEQ ID NO: 252198 - DNA, 20 bp, Artificial
  CRISPR gRNA sequence
cctcccaaagtgctgggatt

SEQ ID NO: 252199 - DNA, 20 bp, Artificial
  CRISPR gRNA sequence
ccaaagtgctgggattacag

SEQ ID NO: 252200 - DNA, 20 bp, Artificial
  CRISPR gRNA sequence
ggattacaggcatgagccac

SEQ ID NO: 252201 - DNA, 20 bp, Artificial
  CRISPR gRNA sequence
caggcatgagccaccatgcc

SEQ ID NO: 252202 - DNA, 20 bp, Artificial
  CRISPR gRNA sequence
gccatttcttacacttttgt

SEQ ID NO: 252203 - DNA, 20 bp, Artificial
  CRISPR gRNA sequence
cttacacttttgtatgacat

SEQ ID NO: 252204 - DNA, 20 bp, Artificial
  CRISPR gRNA sequence
ttacacttttgtatgacatg

SEQ ID NO: 252205 - DNA, 20 bp, Artificial
  CRISPR gRNA sequence
acacttttgtatgacatgcc

SEQ ID NO: 252206 - DNA, 20 bp, Artificial
  CRISPR gRNA sequence
cacttttgtatgacatgcct

SEQ ID NO: 252207 - DNA, 20 bp, Artificial
  CRISPR gRNA sequence
ttgtatgacatgcctattgc

SEQ ID NO: 252208 - DNA, 20 bp, Artificial
  CRISPR gRNA sequence
tgtatgacatgcctattgca

SEQ ID NO: 252209 - DNA, 20 bp, Artificial
  CRISPR gRNA sequence
gtatgacatgcctattgcaa

SEQ ID NO: 252210 - DNA, 20 bp, Artificial
  CRISPR gRNA sequence
tatgacatgcctattgcaag

SEQ ID NO: 252211 - DNA, 20 bp, Artificial
  CRISPR gRNA sequence
ttgcaagcttgcgtgcctct

SEQ ID NO: 252212 - DNA, 20 bp, Artificial
  CRISPR gRNA sequence
caagcttgcgtgcctctgtc

SEQ ID NO: 252213 - DNA, 20 bp, Artificial
  CRISPR gRNA sequence
gcgtgcctctgtcccatgtt

SEQ ID NO: 252214 - DNA, 20 bp, Artificial
  CRISPR gRNA sequence
cgtgcctctgtcccatgtta

SEQ ID NO: 252215 - DNA, 20 bp, Artificial
  CRISPR gRNA sequence
tgtcccatgttattttactc

SEQ ID NO: 252216 - DNA, 20 bp, Artificial
  CRISPR gRNA sequence
tcccatgttattttactctg

SEQ ID NO: 252217 - DNA, 20 bp, Artificial
  CRISPR gRNA sequence
ttttactctgggatttaggt

SEQ ID NO: 252218 - DNA, 20 bp, Artificial
  CRISPR gRNA sequence
tactctgggatttaggtgga

SEQ ID NO: 252219 - DNA, 20 bp, Artificial
  CRISPR gRNA sequence
actctgggatttaggtggag

SEQ ID NO: 252220 - DNA, 20 bp, Artificial
  CRISPR gRNA sequence
ctctgggatttaggtggagg

SEQ ID NO: 252221 - DNA, 20 bp, Artificial
  CRISPR gRNA sequence
tgggatttaggtggagggag

SEQ ID NO: 252222 - DNA, 20 bp, Artificial
  CRISPR gRNA sequence
ggatttaggtggagggagca

SEQ ID NO: 252223 - DNA, 20 bp, Artificial
  CRISPR gRNA sequence
aggtggagggagcagcttct

SEQ ID NO: 252224 - DNA, 20 bp, Artificial
  CRISPR gRNA sequence
ggtggagggagcagcttcta

SEQ ID NO: 252225 - DNA, 20 bp, Artificial
  CRISPR gRNA sequence
ctatttggaacattggccat

SEQ ID NO: 252226 - DNA, 20 bp, Artificial
  CRISPR gRNA sequence
tatttggaacattggccatc

SEQ ID NO: 252227 - DNA, 20 bp, Artificial
  CRISPR gRNA sequence
tttggaacattggccatcgc

SEQ ID NO: 252228 - DNA, 20 bp, Artificial
  CRISPR gRNA sequence
ggaacattggccatcgcatg

SEQ ID NO: 252229 - DNA, 20 bp, Artificial
  CRISPR gRNA sequence
gaacattggccatcgcatgg

SEQ ID NO: 252230 - DNA, 20 bp, Artificial
  CRISPR gRNA sequence
gccatcgcatggcaaatggg

SEQ ID NO: 252231 - DNA, 20 bp, Artificial
  CRISPR gRNA sequence
tcacttctgctcctatttag

SEQ ID NO: 252232 - DNA, 20 bp, Artificial
  CRISPR gRNA sequence
ctgctcctatttagttggtt

SEQ ID NO: 252233 - DNA, 20 bp, Artificial
  CRISPR gRNA sequence
tgctcctatttagttggttc

SEQ ID NO: 252234 - DNA, 20 bp, Artificial
  CRISPR gRNA sequence
ctcctatttagttggttcta

SEQ ID NO: 252235 - DNA, 20 bp, Artificial
  CRISPR gRNA sequence
ctatttagttggttctacta

SEQ ID NO: 252236 - DNA, 20 bp, Artificial
  CRISPR gRNA sequence
tttagttggttctactataa

SEQ ID NO: 252237 - DNA, 20 bp, Artificial
  CRISPR gRNA sequence
agttggttctactataacct

SEQ ID NO: 252238 - DNA, 20 bp, Artificial
  CRISPR gRNA sequence
gttggttctactataacctt

SEQ ID NO: 252239 - DNA, 20 bp, Artificial
  CRISPR gRNA sequence
gttctactataacctttaga

SEQ ID NO: 252240 - DNA, 20 bp, Artificial
  CRISPR gRNA sequence
tactataacctttagagcaa

SEQ ID NO: 252241 - DNA, 20 bp, Artificial
  CRISPR gRNA sequence
ctataacctttagagcaaat

SEQ ID NO: 252242 - DNA, 20 bp, Artificial
  CRISPR gRNA sequence
taacctttagagcaaatcct

SEQ ID NO: 252243 - DNA, 20 bp, Artificial
  CRISPR gRNA sequence
tagagcaaatcctgcagcca

SEQ ID NO: 252244 - DNA, 20 bp, Artificial
  CRISPR gRNA sequence
agagcaaatcctgcagccaa

SEQ ID NO: 252245 - DNA, 20 bp, Artificial
  CRISPR gRNA sequence
gagcaaatcctgcagccaag

SEQ ID NO: 252246 - DNA, 20 bp, Artificial
  CRISPR gRNA sequence
cagccaagccaggcatcaat

SEQ ID NO: 252247 - DNA, 20 bp, Artificial
  CRISPR gRNA sequence
tgtaaataggggtgaggaga

SEQ ID NO: 252248 - DNA, 20 bp, Artificial
  CRISPR gRNA sequence
taaataggggtgaggagaag

SEQ ID NO: 252249 - DNA, 20 bp, Artificial
  CRISPR gRNA sequence
ctgaacaatagtctactgca

SEQ ID NO: 252250 - DNA, 20 bp, Artificial
  CRISPR gRNA sequence
tgaacaatagtctactgcag

SEQ ID NO: 252251 - DNA, 20 bp, Artificial
  CRISPR gRNA sequence
aacaatagtctactgcagta

SEQ ID NO: 252252 - DNA, 20 bp, Artificial
  CRISPR gRNA sequence
ctgcagtaccaaattgcttt

SEQ ID NO: 252253 - DNA, 20 bp, Artificial
  CRISPR gRNA sequence
cagtaccaaattgcttttca

SEQ ID NO: 252254 - DNA, 20 bp, Artificial
  CRISPR gRNA sequence
cttttcaaagtggctgttct

SEQ ID NO: 252255 - DNA, 20 bp, Artificial
  CRISPR gRNA sequence
ttcaaagtggctgttctaat

SEQ ID NO: 252256 - DNA, 20 bp, Artificial
  CRISPR gRNA sequence
tcaaagtggctgttctaatg

SEQ ID NO: 252257 - DNA, 20 bp, Artificial
  CRISPR gRNA sequence
caaagtggctgttctaatgt

SEQ ID NO: 252258 - DNA, 20 bp, Artificial
  CRISPR gRNA sequence
aaagtggctgttctaatgta

SEQ ID NO: 252259 - DNA, 20 bp, Artificial
  CRISPR gRNA sequence
ttctaatgtactcccgtcag

SEQ ID NO: 252260 - DNA, 20 bp, Artificial
  CRISPR gRNA sequence
taatgtactcccgtcagtca

SEQ ID NO: 252261 - DNA, 20 bp, Artificial
  CRISPR gRNA sequence
atgtactcccgtcagtcata

SEQ ID NO: 252262 - DNA, 20 bp, Artificial
  CRISPR gRNA sequence
ccgtcagtcatataagtgtc

SEQ ID NO: 252263 - DNA, 20 bp, Artificial
  CRISPR gRNA sequence
atccacatccttgctaccct

SEQ ID NO: 252264 - DNA, 20 bp, Artificial
  CRISPR gRNA sequence
gctaccctctggtactatca

SEQ ID NO: 252265 - DNA, 20 bp, Artificial
  CRISPR gRNA sequence
ctaccctctggtactatcag

SEQ ID NO: 252266 - DNA, 20 bp, Artificial
  CRISPR gRNA sequence
ccctctggtactatcaggtg

SEQ ID NO: 252267 - DNA, 20 bp, Artificial
  CRISPR gRNA sequence
tggtactatcaggtgccctt

SEQ ID NO: 252268 - DNA, 20 bp, Artificial
  CRISPR gRNA sequence
gtactatcaggtgcccttaa

SEQ ID NO: 252269 - DNA, 20 bp, Artificial
  CRISPR gRNA sequence
tcaggtgcccttaattttgc

SEQ ID NO: 252270 - DNA, 20 bp, Artificial
  CRISPR gRNA sequence
aattttgccaagccagtggg

SEQ ID NO: 252271 - DNA, 20 bp, Artificial
  CRISPR gRNA sequence
attttgccaagccagtgggt

SEQ ID NO: 252272 - DNA, 20 bp, Artificial
  CRISPR gRNA sequence
tgccaagccagtgggtatag

SEQ ID NO: 252273 - DNA, 20 bp, Artificial
  CRISPR gRNA sequence
gccaagccagtgggtataga

SEQ ID NO: 252274 - DNA, 20 bp, Artificial
  CRISPR gRNA sequence
ccaagccagtgggtatagaa

SEQ ID NO: 252275 - DNA, 20 bp, Artificial
  CRISPR gRNA sequence
actgtggtcttagtttgcat

SEQ ID NO: 252276 - DNA, 20 bp, Artificial
  CRISPR gRNA sequence
tggtcttagtttgcatttgc

SEQ ID NO: 252277 - DNA, 20 bp, Artificial
  CRISPR gRNA sequence
agtttgcatttgcttggtta

SEQ ID NO: 252278 - DNA, 20 bp, Artificial
  CRISPR gRNA sequence
gtttgcatttgcttggttac

SEQ ID NO: 252279 - DNA, 20 bp, Artificial
  CRISPR gRNA sequence
gcatttgcttggttactgat

SEQ ID NO: 252280 - DNA, 20 bp, Artificial
  CRISPR gRNA sequence
catttgcttggttactgatg

SEQ ID NO: 252281 - DNA, 20 bp, Artificial
  CRISPR gRNA sequence
gcttggttactgatgagcac

SEQ ID NO: 252282 - DNA, 20 bp, Artificial
  CRISPR gRNA sequence
cttggttactgatgagcacc

SEQ ID NO: 252283 - DNA, 20 bp, Artificial
  CRISPR gRNA sequence
ggttactgatgagcaccttg

SEQ ID NO: 252284 - DNA, 20 bp, Artificial
  CRISPR gRNA sequence
gttactgatgagcaccttgt

SEQ ID NO: 252285 - DNA, 20 bp, Artificial
  CRISPR gRNA sequence
ctgatgagcaccttgtcaaa

SEQ ID NO: 252286 - DNA, 20 bp, Artificial
  CRISPR gRNA sequence
atgagcaccttgtcaaatat

SEQ ID NO: 252287 - DNA, 20 bp, Artificial
  CRISPR gRNA sequence
gtcaaatatttatataccat

SEQ ID NO: 252288 - DNA, 20 bp, Artificial
  CRISPR gRNA sequence
tcaaatatttatataccatt

SEQ ID NO: 252289 - DNA, 20 bp, Artificial
  CRISPR gRNA sequence
atataccatttgtgtttatt

SEQ ID NO: 252290 - DNA, 20 bp, Artificial
  CRISPR gRNA sequence
tataccatttgtgtttattt

SEQ ID NO: 252291 - DNA, 20 bp, Artificial
  CRISPR gRNA sequence
gtgtttatttttttaaataa

SEQ ID NO: 252292 - DNA, 20 bp, Artificial
  CRISPR gRNA sequence
tgtttatttttttaaataaa

SEQ ID NO: 252293 - DNA, 20 bp, Artificial
  CRISPR gRNA sequence
atttttttaaataaaatgct

SEQ ID NO: 252294 - DNA, 20 bp, Artificial
  CRISPR gRNA sequence
tttttttaaataaaatgctt

SEQ ID NO: 252295 - DNA, 20 bp, Artificial
  CRISPR gRNA sequence
ttttaaataaaatgcttgct

SEQ ID NO: 252296 - DNA, 20 bp, Artificial
  CRISPR gRNA sequence
tttaaataaaatgcttgctc

SEQ ID NO: 252297 - DNA, 20 bp, Artificial
  CRISPR gRNA sequence
ttaaataaaatgcttgctca

SEQ ID NO: 252298 - DNA, 20 bp, Artificial
  CRISPR gRNA sequence
taaataaaatgcttgctcat

SEQ ID NO: 252299 - DNA, 20 bp, Artificial
  CRISPR gRNA sequence
aaataaaatgcttgctcatg

SEQ ID NO: 252300 - DNA, 20 bp, Artificial
  CRISPR gRNA sequence
aataaaatgcttgctcatgc

SEQ ID NO: 252301 - DNA, 20 bp, Artificial
  CRISPR gRNA sequence
gctcatgcttttttgcccat

SEQ ID NO: 252302 - DNA, 20 bp, Artificial
  CRISPR gRNA sequence
ctcatgcttttttgcccatt

SEQ ID NO: 252303 - DNA, 20 bp, Artificial
  CRISPR gRNA sequence
atgcttttttgcccatttgc

SEQ ID NO: 252304 - DNA, 20 bp, Artificial
  CRISPR gRNA sequence
ttttgcccatttgcaaaaaa

SEQ ID NO: 252305 - DNA, 20 bp, Artificial
  CRISPR gRNA sequence
tttgcccatttgcaaaaaaa

SEQ ID NO: 252306 - DNA, 20 bp, Artificial
  CRISPR gRNA sequence
ttgcccatttgcaaaaaaac

SEQ ID NO: 252307 - DNA, 20 bp, Artificial
  CRISPR gRNA sequence
tgcccatttgcaaaaaaact

SEQ ID NO: 252308 - DNA, 20 bp, Artificial
  CRISPR gRNA sequence
gcccatttgcaaaaaaactt

SEQ ID NO: 252309 - DNA, 20 bp, Artificial
  CRISPR gRNA sequence
cccatttgcaaaaaaacttg

SEQ ID NO: 252310 - DNA, 20 bp, Artificial
  CRISPR gRNA sequence
gcaaaaaaacttggggccgg

SEQ ID NO: 252311 - DNA, 20 bp, Artificial
  CRISPR gRNA sequence
caaaaaaacttggggccggg

SEQ ID NO: 252312 - DNA, 20 bp, Artificial
  CRISPR gRNA sequence
ggggccgggtgcagtggctc

SEQ ID NO: 252313 - DNA, 20 bp, Artificial
  CRISPR gRNA sequence
gggccgggtgcagtggctca

SEQ ID NO: 252314 - DNA, 20 bp, Artificial
  CRISPR gRNA sequence
atgcctgtagtcccagctct

SEQ ID NO: 252315 - DNA, 20 bp, Artificial
  CRISPR gRNA sequence
tagtcccagctctttgggag

SEQ ID NO: 252316 - DNA, 20 bp, Artificial
  CRISPR gRNA sequence
tttgggaggccaaggtgggc

SEQ ID NO: 252317 - DNA, 20 bp, Artificial
  CRISPR gRNA sequence
tgggaggccaaggtgggcag

SEQ ID NO: 252318 - DNA, 20 bp, Artificial
  CRISPR gRNA sequence
gggaggccaaggtgggcaga

SEQ ID NO: 252319 - DNA, 20 bp, Artificial
  CRISPR gRNA sequence
ggaggccaaggtgggcagat

SEQ ID NO: 252320 - DNA, 20 bp, Artificial
  CRISPR gRNA sequence
gagcccaggagttcgagacc

SEQ ID NO: 252321 - DNA, 20 bp, Artificial
  CRISPR gRNA sequence
agcccaggagttcgagacca

SEQ ID NO: 252322 - DNA, 20 bp, Artificial
  CRISPR gRNA sequence
gagaccagccttggcaacat

SEQ ID NO: 252323 - DNA, 20 bp, Artificial
  CRISPR gRNA sequence
ggcaacatggcgaaaccctg

SEQ ID NO: 252324 - DNA, 20 bp, Artificial
  CRISPR gRNA sequence
gcaacatggcgaaaccctgt

SEQ ID NO: 252325 - DNA, 20 bp, Artificial
  CRISPR gRNA sequence
tctttacaaaaaatacaaaa

SEQ ID NO: 252326 - DNA, 20 bp, Artificial
  CRISPR gRNA sequence
tacaaaaaatacaaaaatta

SEQ ID NO: 252327 - DNA, 20 bp, Artificial
  CRISPR gRNA sequence
acaaaaaatacaaaaattag

SEQ ID NO: 252328 - DNA, 20 bp, Artificial
  CRISPR gRNA sequence
caaaaaatacaaaaattagc

SEQ ID NO: 252329 - DNA, 20 bp, Artificial
  CRISPR gRNA sequence
gccgggtgtggtggtgtgca

SEQ ID NO: 252330 - DNA, 20 bp, Artificial
  CRISPR gRNA sequence
aagtcccagctactcagtag

SEQ ID NO: 252331 - DNA, 20 bp, Artificial
  CRISPR gRNA sequence
ctcagtaggttcgctttgag

SEQ ID NO: 252332 - DNA, 20 bp, Artificial
  CRISPR gRNA sequence
agtaggttcgctttgagcct

SEQ ID NO: 252333 - DNA, 20 bp, Artificial
  CRISPR gRNA sequence
gctttgagcctgggaggcag

SEQ ID NO: 252334 - DNA, 20 bp, Artificial
  CRISPR gRNA sequence
tgagcctgggaggcagaggt

SEQ ID NO: 252335 - DNA, 20 bp, Artificial
  CRISPR gRNA sequence
gagcctgggaggcagaggtt

SEQ ID NO: 252336 - DNA, 20 bp, Artificial
  CRISPR gRNA sequence
agcctgggaggcagaggttg

SEQ ID NO: 252337 - DNA, 20 bp, Artificial
  CRISPR gRNA sequence
ggaggcagaggttgcagtga

SEQ ID NO: 252338 - DNA, 20 bp, Artificial
  CRISPR gRNA sequence
cagtgagctgggaccgcatc

SEQ ID NO: 252339 - DNA, 20 bp, Artificial
  CRISPR gRNA sequence
ggaccgcatcactacacttc

SEQ ID NO: 252340 - DNA, 20 bp, Artificial
  CRISPR gRNA sequence
cacttcagcctgggcaacag

SEQ ID NO: 252341 - DNA, 20 bp, Artificial
  CRISPR gRNA sequence
cagcctgggcaacagagaaa

SEQ ID NO: 252342 - DNA, 20 bp, Artificial
  CRISPR gRNA sequence
agcctgggcaacagagaaaa

SEQ ID NO: 252343 - DNA, 20 bp, Artificial
  CRISPR gRNA sequence
ggcaacagagaaaaaccttt

SEQ ID NO: 252344 - DNA, 20 bp, Artificial
  CRISPR gRNA sequence
ttctcagaaacaaacaaacc

SEQ ID NO: 252345 - DNA, 20 bp, Artificial
  CRISPR gRNA sequence
tctcagaaacaaacaaaccc

SEQ ID NO: 252346 - DNA, 20 bp, Artificial
  CRISPR gRNA sequence
ctcagaaacaaacaaaccca

SEQ ID NO: 252347 - DNA, 20 bp, Artificial
  CRISPR gRNA sequence
tcagaaacaaacaaacccaa

SEQ ID NO: 252348 - DNA, 20 bp, Artificial
  CRISPR gRNA sequence
agaaacaaacaaacccaaat

SEQ ID NO: 252349 - DNA, 20 bp, Artificial
  CRISPR gRNA sequence
tttgtcctgattcctaaaag

SEQ ID NO: 252350 - DNA, 20 bp, Artificial
  CRISPR gRNA sequence
gtcctgattcctaaaaggtc

SEQ ID NO: 252351 - DNA, 20 bp, Artificial
  CRISPR gRNA sequence
tcctgattcctaaaaggtct

SEQ ID NO: 252352 - DNA, 20 bp, Artificial
  CRISPR gRNA sequence
attcctaaaaggtctttatg

SEQ ID NO: 252353 - DNA, 20 bp, Artificial
  CRISPR gRNA sequence
ctaaaaggtctttatgtatt

SEQ ID NO: 252354 - DNA, 20 bp, Artificial
  CRISPR gRNA sequence
aaaggtctttatgtattcta

SEQ ID NO: 252355 - DNA, 20 bp, Artificial
  CRISPR gRNA sequence
tatgtattctagataataat

SEQ ID NO: 252356 - DNA, 20 bp, Artificial
  CRISPR gRNA sequence
atgtattctagataataatc

SEQ ID NO: 252357 - DNA, 20 bp, Artificial
  CRISPR gRNA sequence
tgtattctagataataatct

SEQ ID NO: 252358 - DNA, 20 bp, Artificial
  CRISPR gRNA sequence
tagataataatctttggtca

SEQ ID NO: 252359 - DNA, 20 bp, Artificial
  CRISPR gRNA sequence
gataataatctttggtcagt

SEQ ID NO: 252360 - DNA, 20 bp, Artificial
  CRISPR gRNA sequence
tggtcagttatatgtgttaa

SEQ ID NO: 252361 - DNA, 20 bp, Artificial
  CRISPR gRNA sequence
ggtcagttatatgtgttaaa

SEQ ID NO: 252362 - DNA, 20 bp, Artificial
  CRISPR gRNA sequence
gtcagttatatgtgttaaaa

SEQ ID NO: 252363 - DNA, 20 bp, Artificial
  CRISPR gRNA sequence
tatgtgttaaaaaatatctt

SEQ ID NO: 252364 - DNA, 20 bp, Artificial
  CRISPR gRNA sequence
aaaaatatcttctttgtggc

SEQ ID NO: 252365 - DNA, 20 bp, Artificial
  CRISPR gRNA sequence
ctttgtggccaggcacggta

SEQ ID NO: 252366 - DNA, 20 bp, Artificial
  CRISPR gRNA sequence
tttgtggccaggcacggtag

SEQ ID NO: 252367 - DNA, 20 bp, Artificial
  CRISPR gRNA sequence
tgtggccaggcacggtagct

SEQ ID NO: 252368 - DNA, 20 bp, Artificial
  CRISPR gRNA sequence
gtggccaggcacggtagctc

SEQ ID NO: 252369 - DNA, 20 bp, Artificial
  CRISPR gRNA sequence
tggccaggcacggtagctca

SEQ ID NO: 252370 - DNA, 20 bp, Artificial
  CRISPR gRNA sequence
acacctgtaatcccagcact

SEQ ID NO: 252371 - DNA, 20 bp, Artificial
  CRISPR gRNA sequence
taatcccagcactttgcggg

SEQ ID NO: 252372 - DNA, 20 bp, Artificial
  CRISPR gRNA sequence
tgcggggctgaggtgggtgg

SEQ ID NO: 252373 - DNA, 20 bp, Artificial
  CRISPR gRNA sequence
gcggggctgaggtgggtgga

SEQ ID NO: 252374 - DNA, 20 bp, Artificial
  CRISPR gRNA sequence
cggggctgaggtgggtggat

SEQ ID NO: 252375 - DNA, 20 bp, Artificial
  CRISPR gRNA sequence
aggtgggtggatcatctgag

SEQ ID NO: 252376 - DNA, 20 bp, Artificial
  CRISPR gRNA sequence
aggtcaagagttcaagatca

SEQ ID NO: 252377 - DNA, 20 bp, Artificial
  CRISPR gRNA sequence
aagatcagcctggccaacac

SEQ ID NO: 252378 - DNA, 20 bp, Artificial
  CRISPR gRNA sequence
gccaacacagtgaaacccca

SEQ ID NO: 252379 - DNA, 20 bp, Artificial
  CRISPR gRNA sequence
tactaaacatgtacaaaact

SEQ ID NO: 252380 - DNA, 20 bp, Artificial
  CRISPR gRNA sequence
ctaaacatgtacaaaactta

SEQ ID NO: 252381 - DNA, 20 bp, Artificial
  CRISPR gRNA sequence
aacatgtacaaaacttagct

SEQ ID NO: 252382 - DNA, 20 bp, Artificial
  CRISPR gRNA sequence
agctgggtatggtggcgggt

SEQ ID NO: 252383 - DNA, 20 bp, Artificial
  CRISPR gRNA sequence
gctgggtatggtggcgggtg

SEQ ID NO: 252384 - DNA, 20 bp, Artificial
  CRISPR gRNA sequence
ggtatggtggcgggtgcctg

SEQ ID NO: 252385 - DNA, 20 bp, Artificial
  CRISPR gRNA sequence
taaccccagctgctccagag

SEQ ID NO: 252386 - DNA, 20 bp, Artificial
  CRISPR gRNA sequence
ctccagaggctgtggcagaa

SEQ ID NO: 252387 - DNA, 20 bp, Artificial
  CRISPR gRNA sequence
cagaggctgtggcagaagaa

SEQ ID NO: 252388 - DNA, 20 bp, Artificial
  CRISPR gRNA sequence
tggcagaagaatcgcttgaa

SEQ ID NO: 252389 - DNA, 20 bp, Artificial
  CRISPR gRNA sequence
gaacccaggaggcagaggtt

SEQ ID NO: 252390 - DNA, 20 bp, Artificial
  CRISPR gRNA sequence
aacccaggaggcagaggttg

SEQ ID NO: 252391 - DNA, 20 bp, Artificial
  CRISPR gRNA sequence
cagcgagccaagattgtgcc

SEQ ID NO: 252392 - DNA, 20 bp, Artificial
  CRISPR gRNA sequence
tgccattgcactccagactg

SEQ ID NO: 252393 - DNA, 20 bp, Artificial
  CRISPR gRNA sequence
cactccagactgggtgacaa

SEQ ID NO: 252394 - DNA, 20 bp, Artificial
  CRISPR gRNA sequence
cagactgggtgacaagagtg

SEQ ID NO: 252395 - DNA, 20 bp, Artificial
  CRISPR gRNA sequence
ggtgacaagagtgaaattct

SEQ ID NO: 252396 - DNA, 20 bp, Artificial
  CRISPR gRNA sequence
tgcctatctatctatctatc

SEQ ID NO: 252397 - DNA, 20 bp, Artificial
  CRISPR gRNA sequence
cctatctatctatctatcta

SEQ ID NO: 252398 - DNA, 20 bp, Artificial
  CRISPR gRNA sequence
tctatctatctatctatcta

SEQ ID NO: 252399 - DNA, 20 bp, Artificial
  CRISPR gRNA sequence
tctatctatctatctatatc

SEQ ID NO: 252400 - DNA, 20 bp, Artificial
  CRISPR gRNA sequence
tctatctatctatatctata

SEQ ID NO: 252401 - DNA, 20 bp, Artificial
  CRISPR gRNA sequence
tctatctatatctatatata

SEQ ID NO: 252402 - DNA, 20 bp, Artificial
  CRISPR gRNA sequence
tctatatctatatatatata

SEQ ID NO: 252403 - DNA, 20 bp, Artificial
  CRISPR gRNA sequence
tatctatatatatatatata

SEQ ID NO: 252404 - DNA, 20 bp, Artificial
  CRISPR gRNA sequence
tatatatatatatatatatc

SEQ ID NO: 252405 - DNA, 20 bp, Artificial
  CRISPR gRNA sequence
tgtaatttatttttcccttt

SEQ ID NO: 252406 - DNA, 20 bp, Artificial
  CRISPR gRNA sequence
gtaatttatttttccctttt

SEQ ID NO: 252407 - DNA, 20 bp, Artificial
  CRISPR gRNA sequence
taatttatttttcccttttt

SEQ ID NO: 252408 - DNA, 20 bp, Artificial
  CRISPR gRNA sequence
atttttccctttttaaaatt

SEQ ID NO: 252409 - DNA, 20 bp, Artificial
  CRISPR gRNA sequence
tttttccctttttaaaattt

SEQ ID NO: 252410 - DNA, 20 bp, Artificial
  CRISPR gRNA sequence
ttccctttttaaaatttttt

SEQ ID NO: 252411 - DNA, 20 bp, Artificial
  CRISPR gRNA sequence
tccctttttaaaatttttta

SEQ ID NO: 252412 - DNA, 20 bp, Artificial
  CRISPR gRNA sequence
ccctttttaaaattttttat

SEQ ID NO: 252413 - DNA, 20 bp, Artificial
  CRISPR gRNA sequence
cctttttaaaattttttata

SEQ ID NO: 252414 - DNA, 20 bp, Artificial
  CRISPR gRNA sequence
tttaaaattttttataaaat

SEQ ID NO: 252415 - DNA, 20 bp, Artificial
  CRISPR gRNA sequence
ttaaaattttttataaaatt

SEQ ID NO: 252416 - DNA, 20 bp, Artificial
  CRISPR gRNA sequence
taaaattttttataaaattc

SEQ ID NO: 252417 - DNA, 20 bp, Artificial
  CRISPR gRNA sequence
aaaattttttataaaattct

SEQ ID NO: 252418 - DNA, 20 bp, Artificial
  CRISPR gRNA sequence
aaattttttataaaattctt

SEQ ID NO: 252419 - DNA, 20 bp, Artificial
  CRISPR gRNA sequence
tttataaaattcttttttat

SEQ ID NO: 252420 - DNA, 20 bp, Artificial
  CRISPR gRNA sequence
ttataaaattcttttttatt

SEQ ID NO: 252421 - DNA, 20 bp, Artificial
  CRISPR gRNA sequence
tataaaattcttttttattt

SEQ ID NO: 252422 - DNA, 20 bp, Artificial
  CRISPR gRNA sequence
ataaaattcttttttatttt

SEQ ID NO: 252423 - DNA, 20 bp, Artificial
  CRISPR gRNA sequence
taaaattcttttttattttt

SEQ ID NO: 252424 - DNA, 20 bp, Artificial
  CRISPR gRNA sequence
ttttttatttttatttttag

SEQ ID NO: 252425 - DNA, 20 bp, Artificial
  CRISPR gRNA sequence
ttttatttttatttttagca

SEQ ID NO: 252426 - DNA, 20 bp, Artificial
  CRISPR gRNA sequence
tttatttttatttttagcag

SEQ ID NO: 252427 - DNA, 20 bp, Artificial
  CRISPR gRNA sequence
ttatttttatttttagcaga

SEQ ID NO: 252428 - DNA, 20 bp, Artificial
  CRISPR gRNA sequence
tatttttatttttagcagag

SEQ ID NO: 252429 - DNA, 20 bp, Artificial
  CRISPR gRNA sequence
atttttatttttagcagagg

SEQ ID NO: 252430 - DNA, 20 bp, Artificial
  CRISPR gRNA sequence
tttttatttttagcagaggt

SEQ ID NO: 252431 - DNA, 20 bp, Artificial
  CRISPR gRNA sequence
ttatttttagcagaggtgag

SEQ ID NO: 252432 - DNA, 20 bp, Artificial
  CRISPR gRNA sequence
tatttttagcagaggtgagg

SEQ ID NO: 252433 - DNA, 20 bp, Artificial
  CRISPR gRNA sequence
atttttagcagaggtgaggt

SEQ ID NO: 252434 - DNA, 20 bp, Artificial
  CRISPR gRNA sequence
tttttagcagaggtgaggtt

SEQ ID NO: 252435 - DNA, 20 bp, Artificial
  CRISPR gRNA sequence
ttagcagaggtgaggtttct

SEQ ID NO: 252436 - DNA, 20 bp, Artificial
  CRISPR gRNA sequence
tagcagaggtgaggtttctg

SEQ ID NO: 252437 - DNA, 20 bp, Artificial
  CRISPR gRNA sequence
agcagaggtgaggtttctga

SEQ ID NO: 252438 - DNA, 20 bp, Artificial
  CRISPR gRNA sequence
gcagaggtgaggtttctgag

SEQ ID NO: 252439 - DNA, 20 bp, Artificial
  CRISPR gRNA sequence
ctgaggtttcattatgttgc

SEQ ID NO: 252440 - DNA, 20 bp, Artificial
  CRISPR gRNA sequence
tgaggtttcattatgttgcc

SEQ ID NO: 252441 - DNA, 20 bp, Artificial
  CRISPR gRNA sequence
aggtttcattatgttgccca

SEQ ID NO: 252442 - DNA, 20 bp, Artificial
  CRISPR gRNA sequence
cattatgttgcccaggctgg

SEQ ID NO: 252443 - DNA, 20 bp, Artificial
  CRISPR gRNA sequence
attatgttgcccaggctggt

SEQ ID NO: 252444 - DNA, 20 bp, Artificial
  CRISPR gRNA sequence
tgttgcccaggctggtcttg

SEQ ID NO: 252445 - DNA, 20 bp, Artificial
  CRISPR gRNA sequence
cccaggctggtcttgaactc

SEQ ID NO: 252446 - DNA, 20 bp, Artificial
  CRISPR gRNA sequence
gtcttgaactcctgagctca

SEQ ID NO: 252447 - DNA, 20 bp, Artificial
  CRISPR gRNA sequence
gaactcctgagctcaagtga

SEQ ID NO: 252448 - DNA, 20 bp, Artificial
  CRISPR gRNA sequence
aactcctgagctcaagtgat

SEQ ID NO: 252449 - DNA, 20 bp, Artificial
  CRISPR gRNA sequence
ctgagctcaagtgatcctcc

SEQ ID NO: 252450 - DNA, 20 bp, Artificial
  CRISPR gRNA sequence
agctcaagtgatcctcccac

SEQ ID NO: 252451 - DNA, 20 bp, Artificial
  CRISPR gRNA sequence
aagtgatcctcccacctcag

SEQ ID NO: 252452 - DNA, 20 bp, Artificial
  CRISPR gRNA sequence
ccacctcagccttccaaagt

SEQ ID NO: 252453 - DNA, 20 bp, Artificial
  CRISPR gRNA sequence
agccttccaaagtgctggaa

SEQ ID NO: 252454 - DNA, 20 bp, Artificial
  CRISPR gRNA sequence
ccaaagtgctggaattgcag

SEQ ID NO: 252455 - DNA, 20 bp, Artificial
  CRISPR gRNA sequence
caaagtgctggaattgcaga

SEQ ID NO: 252456 - DNA, 20 bp, Artificial
  CRISPR gRNA sequence
gaattgcagacatgagccac

SEQ ID NO: 252457 - DNA, 20 bp, Artificial
  CRISPR gRNA sequence
cagacatgagccaccgcgcc

SEQ ID NO: 252458 - DNA, 20 bp, Artificial
  CRISPR gRNA sequence
ctgtttttctctaattaatg

SEQ ID NO: 252459 - DNA, 20 bp, Artificial
  CRISPR gRNA sequence
tttttctctaattaatggtg

SEQ ID NO: 252460 - DNA, 20 bp, Artificial
  CRISPR gRNA sequence
ttctctaattaatggtgtct

SEQ ID NO: 252461 - DNA, 20 bp, Artificial
  CRISPR gRNA sequence
tctctaattaatggtgtctt

SEQ ID NO: 252462 - DNA, 20 bp, Artificial
  CRISPR gRNA sequence
ctctaattaatggtgtcttt

SEQ ID NO: 252463 - DNA, 20 bp, Artificial
  CRISPR gRNA sequence
tctaattaatggtgtctttc

SEQ ID NO: 252464 - DNA, 20 bp, Artificial
  CRISPR gRNA sequence
taattaatggtgtctttctt

SEQ ID NO: 252465 - DNA, 20 bp, Artificial
  CRISPR gRNA sequence
attaatggtgtctttctttg

SEQ ID NO: 252466 - DNA, 20 bp, Artificial
  CRISPR gRNA sequence
atggtgtctttctttgtctt

SEQ ID NO: 252467 - DNA, 20 bp, Artificial
  CRISPR gRNA sequence
tctttgtctttctggtaata

SEQ ID NO: 252468 - DNA, 20 bp, Artificial
  CRISPR gRNA sequence
ctttgtctttctggtaataa

SEQ ID NO: 252469 - DNA, 20 bp, Artificial
  CRISPR gRNA sequence
tttgtctttctggtaataag

SEQ ID NO: 252470 - DNA, 20 bp, Artificial
  CRISPR gRNA sequence
tgtctttctggtaataagca

SEQ ID NO: 252471 - DNA, 20 bp, Artificial
  CRISPR gRNA sequence
gtctttctggtaataagcaa

SEQ ID NO: 252472 - DNA, 20 bp, Artificial
  CRISPR gRNA sequence
tctttctggtaataagcaaa

SEQ ID NO: 252473 - DNA, 20 bp, Artificial
  CRISPR gRNA sequence
tctggtaataagcaaaaagt

SEQ ID NO: 252474 - DNA, 20 bp, Artificial
  CRISPR gRNA sequence
ctggtaataagcaaaaagtt

SEQ ID NO: 252475 - DNA, 20 bp, Artificial
  CRISPR gRNA sequence
tggtaataagcaaaaagttc

SEQ ID NO: 252476 - DNA, 20 bp, Artificial
  CRISPR gRNA sequence
gtaataagcaaaaagttctt

SEQ ID NO: 252477 - DNA, 20 bp, Artificial
  CRISPR gRNA sequence
ttcatttgatttggttaaat

SEQ ID NO: 252478 - DNA, 20 bp, Artificial
  CRISPR gRNA sequence
catttgatttggttaaattt

SEQ ID NO: 252479 - DNA, 20 bp, Artificial
  CRISPR gRNA sequence
atttgatttggttaaattta

SEQ ID NO: 252480 - DNA, 20 bp, Artificial
  CRISPR gRNA sequence
gatttggttaaatttataac

SEQ ID NO: 252481 - DNA, 20 bp, Artificial
  CRISPR gRNA sequence
atttggttaaatttataact

SEQ ID NO: 252482 - DNA, 20 bp, Artificial
  CRISPR gRNA sequence
ggttaaatttataactgttt

SEQ ID NO: 252483 - DNA, 20 bp, Artificial
  CRISPR gRNA sequence
gttaaatttataactgtttt

SEQ ID NO: 252484 - DNA, 20 bp, Artificial
  CRISPR gRNA sequence
aatttataactgttttctca

SEQ ID NO: 252485 - DNA, 20 bp, Artificial
  CRISPR gRNA sequence
ataactgttttctcatatgg

SEQ ID NO: 252486 - DNA, 20 bp, Artificial
  CRISPR gRNA sequence
taactgttttctcatatggt

SEQ ID NO: 252487 - DNA, 20 bp, Artificial
  CRISPR gRNA sequence
ttttctcatatggttaacat

SEQ ID NO: 252488 - DNA, 20 bp, Artificial
  CRISPR gRNA sequence
tctcatatggttaacatttt

SEQ ID NO: 252489 - DNA, 20 bp, Artificial
  CRISPR gRNA sequence
ctcatatggttaacattttt

SEQ ID NO: 252490 - DNA, 20 bp, Artificial
  CRISPR gRNA sequence
tcatatggttaacatttttt

SEQ ID NO: 252491 - DNA, 20 bp, Artificial
  CRISPR gRNA sequence
atatggttaacattttttct

SEQ ID NO: 252492 - DNA, 20 bp, Artificial
  CRISPR gRNA sequence
acattttttcttgcctggct

SEQ ID NO: 252493 - DNA, 20 bp, Artificial
  CRISPR gRNA sequence
tttcttgcctggctaaagaa

SEQ ID NO: 252494 - DNA, 20 bp, Artificial
  CRISPR gRNA sequence
ttcttgcctggctaaagaaa

SEQ ID NO: 252495 - DNA, 20 bp, Artificial
  CRISPR gRNA sequence
tcttgcctggctaaagaaat

SEQ ID NO: 252496 - DNA, 20 bp, Artificial
  CRISPR gRNA sequence
cttgcctggctaaagaaatc

SEQ ID NO: 252497 - DNA, 20 bp, Artificial
  CRISPR gRNA sequence
ttgcctggctaaagaaatcc

SEQ ID NO: 252498 - DNA, 20 bp, Artificial
  CRISPR gRNA sequence
gcctggctaaagaaatcctt

SEQ ID NO: 252499 - DNA, 20 bp, Artificial
  CRISPR gRNA sequence
cctggctaaagaaatccttt

SEQ ID NO: 252500 - DNA, 20 bp, Artificial
  CRISPR gRNA sequence
gctaaagaaatccttttctg

SEQ ID NO: 252501 - DNA, 20 bp, Artificial
  CRISPR gRNA sequence
aagaaatccttttctgccca

SEQ ID NO: 252502 - DNA, 20 bp, Artificial
  CRISPR gRNA sequence
ttctgcccaatactataaag

SEQ ID NO: 252503 - DNA, 20 bp, Artificial
  CRISPR gRNA sequence
tctgcccaatactataaaga

SEQ ID NO: 252504 - DNA, 20 bp, Artificial
  CRISPR gRNA sequence
ctgcccaatactataaagag

SEQ ID NO: 252505 - DNA, 20 bp, Artificial
  CRISPR gRNA sequence
tgcccaatactataaagagg

SEQ ID NO: 252506 - DNA, 20 bp, Artificial
  CRISPR gRNA sequence
cccaatactataaagaggtt

SEQ ID NO: 252507 - DNA, 20 bp, Artificial
  CRISPR gRNA sequence
taaagaggtttgcccacatt

SEQ ID NO: 252508 - DNA, 20 bp, Artificial
  CRISPR gRNA sequence
gcccacattttattccaaaa

SEQ ID NO: 252509 - DNA, 20 bp, Artificial
  CRISPR gRNA sequence
cccacattttattccaaaag

SEQ ID NO: 252510 - DNA, 20 bp, Artificial
  CRISPR gRNA sequence
tattccaaaagttttaagtt

SEQ ID NO: 252511 - DNA, 20 bp, Artificial
  CRISPR gRNA sequence
attccaaaagttttaagttt

SEQ ID NO: 252512 - DNA, 20 bp, Artificial
  CRISPR gRNA sequence
ttccaaaagttttaagtttt

SEQ ID NO: 252513 - DNA, 20 bp, Artificial
  CRISPR gRNA sequence
caaaagttttaagttttgtc

SEQ ID NO: 252514 - DNA, 20 bp, Artificial
  CRISPR gRNA sequence
taagttttgtctttcatctt

SEQ ID NO: 252515 - DNA, 20 bp, Artificial
  CRISPR gRNA sequence
aagttttgtctttcatcttg

SEQ ID NO: 252516 - DNA, 20 bp, Artificial
  CRISPR gRNA sequence
agttttgtctttcatcttga

SEQ ID NO: 252517 - DNA, 20 bp, Artificial
  CRISPR gRNA sequence
tgtctttcatcttgaagtct

SEQ ID NO: 252518 - DNA, 20 bp, Artificial
  CRISPR gRNA sequence
gtctttcatcttgaagtcta

SEQ ID NO: 252519 - DNA, 20 bp, Artificial
  CRISPR gRNA sequence
tctttcatcttgaagtctaa

SEQ ID NO: 252520 - DNA, 20 bp, Artificial
  CRISPR gRNA sequence
tcatcttgaagtctaatgta

SEQ ID NO: 252521 - DNA, 20 bp, Artificial
  CRISPR gRNA sequence
catcttgaagtctaatgtat

SEQ ID NO: 252522 - DNA, 20 bp, Artificial
  CRISPR gRNA sequence
atcttgaagtctaatgtatc

SEQ ID NO: 252523 - DNA, 20 bp, Artificial
  CRISPR gRNA sequence
gaagtctaatgtatcaggaa

SEQ ID NO: 252524 - DNA, 20 bp, Artificial
  CRISPR gRNA sequence
aagtctaatgtatcaggaac

SEQ ID NO: 252525 - DNA, 20 bp, Artificial
  CRISPR gRNA sequence
atgtatcaggaactggcttt

SEQ ID NO: 252526 - DNA, 20 bp, Artificial
  CRISPR gRNA sequence
gcttttgtgcctgttgggag

SEQ ID NO: 252527 - DNA, 20 bp, Artificial
  CRISPR gRNA sequence
ttgtgcctgttgggaggtag

SEQ ID NO: 252528 - DNA, 20 bp, Artificial
  CRISPR gRNA sequence
tgtgcctgttgggaggtagt

SEQ ID NO: 252529 - DNA, 20 bp, Artificial
  CRISPR gRNA sequence
gtgcctgttgggaggtagtg

SEQ ID NO: 252530 - DNA, 20 bp, Artificial
  CRISPR gRNA sequence
tgcctgttgggaggtagtga

SEQ ID NO: 252531 - DNA, 20 bp, Artificial
  CRISPR gRNA sequence
ttgggaggtagtgatccaat

SEQ ID NO: 252532 - DNA, 20 bp, Artificial
  CRISPR gRNA sequence
ggaggtagtgatccaattcc

SEQ ID NO: 252533 - DNA, 20 bp, Artificial
  CRISPR gRNA sequence
catgtcttgcatgtaggtaa

SEQ ID NO: 252534 - DNA, 20 bp, Artificial
  CRISPR gRNA sequence
gcatgtaggtaaccactggt

SEQ ID NO: 252535 - DNA, 20 bp, Artificial
  CRISPR gRNA sequence
catgtaggtaaccactggtc

SEQ ID NO: 252536 - DNA, 20 bp, Artificial
  CRISPR gRNA sequence
gtccctgcgccatgtattca

SEQ ID NO: 252537 - DNA, 20 bp, Artificial
  CRISPR gRNA sequence
cgccatgtattcaatacgtc

SEQ ID NO: 252538 - DNA, 20 bp, Artificial
  CRISPR gRNA sequence
aatacgtcgtctttctcctg

SEQ ID NO: 252539 - DNA, 20 bp, Artificial
  CRISPR gRNA sequence
tctcctgcgggtctgcaatc

SEQ ID NO: 252540 - DNA, 20 bp, Artificial
  CRISPR gRNA sequence
ctcctgcgggtctgcaatct

SEQ ID NO: 252541 - DNA, 20 bp, Artificial
  CRISPR gRNA sequence
tcctgcgggtctgcaatctc

SEQ ID NO: 252542 - DNA, 20 bp, Artificial
  CRISPR gRNA sequence
ctgcgggtctgcaatctcac

SEQ ID NO: 252543 - DNA, 20 bp, Artificial
  CRISPR gRNA sequence
cgggtctgcaatctcaccta

SEQ ID NO: 252544 - DNA, 20 bp, Artificial
  CRISPR gRNA sequence
caatctcacctaccatccat

SEQ ID NO: 252545 - DNA, 20 bp, Artificial
  CRISPR gRNA sequence
acctaccatccatcaagttt

SEQ ID NO: 252546 - DNA, 20 bp, Artificial
  CRISPR gRNA sequence
ccatccatcaagtttccata

SEQ ID NO: 252547 - DNA, 20 bp, Artificial
  CRISPR gRNA sequence
ccatagggccatgggtctgc

SEQ ID NO: 252548 - DNA, 20 bp, Artificial
  CRISPR gRNA sequence
catagggccatgggtctgct

SEQ ID NO: 252549 - DNA, 20 bp, Artificial
  CRISPR gRNA sequence
cttctgggctccctgttctg

SEQ ID NO: 252550 - DNA, 20 bp, Artificial
  CRISPR gRNA sequence
ctgggctccctgttctgttc

SEQ ID NO: 252551 - DNA, 20 bp, Artificial
  CRISPR gRNA sequence
tgggctccctgttctgttcc

SEQ ID NO: 252552 - DNA, 20 bp, Artificial
  CRISPR gRNA sequence
ggctccctgttctgttccat

SEQ ID NO: 252553 - DNA, 20 bp, Artificial
  CRISPR gRNA sequence
cctgttctgttccattgtca

SEQ ID NO: 252554 - DNA, 20 bp, Artificial
  CRISPR gRNA sequence
ttctgttccattgtcaattt

SEQ ID NO: 252555 - DNA, 20 bp, Artificial
  CRISPR gRNA sequence
tgttccattgtcaatttgtc

SEQ ID NO: 252556 - DNA, 20 bp, Artificial
  CRISPR gRNA sequence
ttccattgtcaatttgtcta

SEQ ID NO: 252557 - DNA, 20 bp, Artificial
  CRISPR gRNA sequence
cattgtcaatttgtctatcc

SEQ ID NO: 252558 - DNA, 20 bp, Artificial
  CRISPR gRNA sequence
tcaatttgtctatcctgtgc

SEQ ID NO: 252559 - DNA, 20 bp, Artificial
  CRISPR gRNA sequence
gtctatcctgtgccagtatc

SEQ ID NO: 252560 - DNA, 20 bp, Artificial
  CRISPR gRNA sequence
tctatcctgtgccagtatca

SEQ ID NO: 252561 - DNA, 20 bp, Artificial
  CRISPR gRNA sequence
tcctgtgccagtatcacact

SEQ ID NO: 252562 - DNA, 20 bp, Artificial
  CRISPR gRNA sequence
tgccagtatcacactgtgtt

SEQ ID NO: 252563 - DNA, 20 bp, Artificial
  CRISPR gRNA sequence
tgtttattacaatagctttg

SEQ ID NO: 252564 - DNA, 20 bp, Artificial
  CRISPR gRNA sequence
attacaatagctttgtaaca

SEQ ID NO: 252565 - DNA, 20 bp, Artificial
  CRISPR gRNA sequence
ttacaatagctttgtaacag

SEQ ID NO: 252566 - DNA, 20 bp, Artificial
  CRISPR gRNA sequence
caatagctttgtaacagctc

SEQ ID NO: 252567 - DNA, 20 bp, Artificial
  CRISPR gRNA sequence
tgtaacagctctcgatatcc

SEQ ID NO: 252568 - DNA, 20 bp, Artificial
  CRISPR gRNA sequence
gtaacagctctcgatatccg

SEQ ID NO: 252569 - DNA, 20 bp, Artificial
  CRISPR gRNA sequence
taacagctctcgatatccgg

SEQ ID NO: 252570 - DNA, 20 bp, Artificial
  CRISPR gRNA sequence
tcgatatccggtaggacatc

SEQ ID NO: 252571 - DNA, 20 bp, Artificial
  CRISPR gRNA sequence
gatatccggtaggacatctc

SEQ ID NO: 252572 - DNA, 20 bp, Artificial
  CRISPR gRNA sequence
cctccaccttctttttctac

SEQ ID NO: 252573 - DNA, 20 bp, Artificial
  CRISPR gRNA sequence
caccttctttttctacttca

SEQ ID NO: 252574 - DNA, 20 bp, Artificial
  CRISPR gRNA sequence
ctttttctacttcagaagtg

SEQ ID NO: 252575 - DNA, 20 bp, Artificial
  CRISPR gRNA sequence
tttttctacttcagaagtgt

SEQ ID NO: 252576 - DNA, 20 bp, Artificial
  CRISPR gRNA sequence
tttctacttcagaagtgtct

SEQ ID NO: 252577 - DNA, 20 bp, Artificial
  CRISPR gRNA sequence
ttctacttcagaagtgtctt

SEQ ID NO: 252578 - DNA, 20 bp, Artificial
  CRISPR gRNA sequence
tctacttcagaagtgtctta

SEQ ID NO: 252579 - DNA, 20 bp, Artificial
  CRISPR gRNA sequence
ctacttcagaagtgtcttag

SEQ ID NO: 252580 - DNA, 20 bp, Artificial
  CRISPR gRNA sequence
tacttcagaagtgtcttagc

SEQ ID NO: 252581 - DNA, 20 bp, Artificial
  CRISPR gRNA sequence
cttcagaagtgtcttagcta

SEQ ID NO: 252582 - DNA, 20 bp, Artificial
  CRISPR gRNA sequence
cagaagtgtcttagctaggt

SEQ ID NO: 252583 - DNA, 20 bp, Artificial
  CRISPR gRNA sequence
agaagtgtcttagctaggtc

SEQ ID NO: 252584 - DNA, 20 bp, Artificial
  CRISPR gRNA sequence
agctaggtcaggcacggtgg

SEQ ID NO: 252585 - DNA, 20 bp, Artificial
  CRISPR gRNA sequence
gctaggtcaggcacggtggc

SEQ ID NO: 252586 - DNA, 20 bp, Artificial
  CRISPR gRNA sequence
ggtcaggcacggtggctcac

SEQ ID NO: 252587 - DNA, 20 bp, Artificial
  CRISPR gRNA sequence
acgcctgtaatcccagcact

SEQ ID NO: 252588 - DNA, 20 bp, Artificial
  CRISPR gRNA sequence
taatcccagcactttgggag

SEQ ID NO: 252589 - DNA, 20 bp, Artificial
  CRISPR gRNA sequence
tgggaggccgacgcggatgg

SEQ ID NO: 252590 - DNA, 20 bp, Artificial
  CRISPR gRNA sequence
gggaggccgacgcggatgga

SEQ ID NO: 252591 - DNA, 20 bp, Artificial
  CRISPR gRNA sequence
ggaggccgacgcggatggat

SEQ ID NO: 252592 - DNA, 20 bp, Artificial
  CRISPR gRNA sequence
aggtcaggagttttgagaca

SEQ ID NO: 252593 - DNA, 20 bp, Artificial
  CRISPR gRNA sequence
tgagacagcctggccaacat

SEQ ID NO: 252594 - DNA, 20 bp, Artificial
  CRISPR gRNA sequence
gagacagcctggccaacatg

SEQ ID NO: 252595 - DNA, 20 bp, Artificial
  CRISPR gRNA sequence
agacagcctggccaacatgg

SEQ ID NO: 252596 - DNA, 20 bp, Artificial
  CRISPR gRNA sequence
gccaacatggtgaaacccca

SEQ ID NO: 252597 - DNA, 20 bp, Artificial
  CRISPR gRNA sequence
tactaaaaaatacaaaaatt

SEQ ID NO: 252598 - DNA, 20 bp, Artificial
  CRISPR gRNA sequence
ctaaaaaatacaaaaattag

SEQ ID NO: 252599 - DNA, 20 bp, Artificial
  CRISPR gRNA sequence
aaaaatacaaaaattagtca

SEQ ID NO: 252600 - DNA, 20 bp, Artificial
  CRISPR gRNA sequence
gtcaggcatggtggcatgtg

SEQ ID NO: 252601 - DNA, 20 bp, Artificial
  CRISPR gRNA sequence
taatcccagctatttgggag

SEQ ID NO: 252602 - DNA, 20 bp, Artificial
  CRISPR gRNA sequence
tttgggaggctgaggccgga

SEQ ID NO: 252603 - DNA, 20 bp, Artificial
  CRISPR gRNA sequence
gggaggctgaggccggagaa

SEQ ID NO: 252604 - DNA, 20 bp, Artificial
  CRISPR gRNA sequence
ggaggctgaggccggagaat

SEQ ID NO: 252605 - DNA, 20 bp, Artificial
  CRISPR gRNA sequence
aggccggagaattgcttgaa

SEQ ID NO: 252606 - DNA, 20 bp, Artificial
  CRISPR gRNA sequence
cttgaacccggggggcggag

SEQ ID NO: 252607 - DNA, 20 bp, Artificial
  CRISPR gRNA sequence
gaacccggggggcggaggtt

SEQ ID NO: 252608 - DNA, 20 bp, Artificial
  CRISPR gRNA sequence
aacccggggggcggaggttg

SEQ ID NO: 252609 - DNA, 20 bp, Artificial
  CRISPR gRNA sequence
cagtgagccgagatcgtacc

SEQ ID NO: 252610 - DNA, 20 bp, Artificial
  CRISPR gRNA sequence
cactccagcctgggtgacag

SEQ ID NO: 252611 - DNA, 20 bp, Artificial
  CRISPR gRNA sequence
cagcctgggtgacagagcga

SEQ ID NO: 252612 - DNA, 20 bp, Artificial
  CRISPR gRNA sequence
ggtgacagagcgaaactctg

SEQ ID NO: 252613 - DNA, 20 bp, Artificial
  CRISPR gRNA sequence
tgtctcaggaaaaaaaagaa

SEQ ID NO: 252614 - DNA, 20 bp, Artificial
  CRISPR gRNA sequence
tctcaggaaaaaaaagaaaa

SEQ ID NO: 252615 - DNA, 20 bp, Artificial
  CRISPR gRNA sequence
aggaaaaaaaagaaaagaga

SEQ ID NO: 252616 - DNA, 20 bp, Artificial
  CRISPR gRNA sequence
ggttattcttggttctttat

SEQ ID NO: 252617 - DNA, 20 bp, Artificial
  CRISPR gRNA sequence
gttattcttggttctttatt

SEQ ID NO: 252618 - DNA, 20 bp, Artificial
  CRISPR gRNA sequence
ttcttggttctttattattc

SEQ ID NO: 252619 - DNA, 20 bp, Artificial
  CRISPR gRNA sequence
ttggttctttattattcaat

SEQ ID NO: 252620 - DNA, 20 bp, Artificial
  CRISPR gRNA sequence
ggttctttattattcaatat

SEQ ID NO: 252621 - DNA, 20 bp, Artificial
  CRISPR gRNA sequence
gttctttattattcaatata

SEQ ID NO: 252622 - DNA, 20 bp, Artificial
  CRISPR gRNA sequence
tttattattcaatataaatt

SEQ ID NO: 252623 - DNA, 20 bp, Artificial
  CRISPR gRNA sequence
tattattcaatataaatttt

SEQ ID NO: 252624 - DNA, 20 bp, Artificial
  CRISPR gRNA sequence
attattcaatataaatttta

SEQ ID NO: 252625 - DNA, 20 bp, Artificial
  CRISPR gRNA sequence
ttattcaatataaattttag

SEQ ID NO: 252626 - DNA, 20 bp, Artificial
  CRISPR gRNA sequence
ttcaatataaattttagaag

SEQ ID NO: 252627 - DNA, 20 bp, Artificial
  CRISPR gRNA sequence
aatataaattttagaagctg

SEQ ID NO: 252628 - DNA, 20 bp, Artificial
  CRISPR gRNA sequence
tagaagctgaatttgaaaag

SEQ ID NO: 252629 - DNA, 20 bp, Artificial
  CRISPR gRNA sequence
agaagctgaatttgaaaaga

SEQ ID NO: 252630 - DNA, 20 bp, Artificial
  CRISPR gRNA sequence
gaagctgaatttgaaaagat

SEQ ID NO: 252631 - DNA, 20 bp, Artificial
  CRISPR gRNA sequence
aatttgaaaagatttggatt

SEQ ID NO: 252632 - DNA, 20 bp, Artificial
  CRISPR gRNA sequence
gaaaagatttggattggaat

SEQ ID NO: 252633 - DNA, 20 bp, Artificial
  CRISPR gRNA sequence
aaaagatttggattggaatt

SEQ ID NO: 252634 - DNA, 20 bp, Artificial
  CRISPR gRNA sequence
ggattggaatttcattaaat

SEQ ID NO: 252635 - DNA, 20 bp, Artificial
  CRISPR gRNA sequence
gattggaatttcattaaatc

SEQ ID NO: 252636 - DNA, 20 bp, Artificial
  CRISPR gRNA sequence
gaatttcattaaatctacag

SEQ ID NO: 252637 - DNA, 20 bp, Artificial
  CRISPR gRNA sequence
cattaaatctacaggtcaat

SEQ ID NO: 252638 - DNA, 20 bp, Artificial
  CRISPR gRNA sequence
attaaatctacaggtcaatt

SEQ ID NO: 252639 - DNA, 20 bp, Artificial
  CRISPR gRNA sequence
aatctacaggtcaatttagg

SEQ ID NO: 252640 - DNA, 20 bp, Artificial
  CRISPR gRNA sequence
caggtcaatttagggagagt

SEQ ID NO: 252641 - DNA, 20 bp, Artificial
  CRISPR gRNA sequence
agggagagttgataatttta

SEQ ID NO: 252642 - DNA, 20 bp, Artificial
  CRISPR gRNA sequence
gggagagttgataattttac

SEQ ID NO: 252643 - DNA, 20 bp, Artificial
  CRISPR gRNA sequence
ataattttacagaattgagt

SEQ ID NO: 252644 - DNA, 20 bp, Artificial
  CRISPR gRNA sequence
tacagaattgagtcatctgg

SEQ ID NO: 252645 - DNA, 20 bp, Artificial
  CRISPR gRNA sequence
acagaattgagtcatctggt

SEQ ID NO: 252646 - DNA, 20 bp, Artificial
  CRISPR gRNA sequence
cagaattgagtcatctggtg

SEQ ID NO: 252647 - DNA, 20 bp, Artificial
  CRISPR gRNA sequence
agtcatctggtgttccaata

SEQ ID NO: 252648 - DNA, 20 bp, Artificial
  CRISPR gRNA sequence
gtgttccaataagaataaga

SEQ ID NO: 252649 - DNA, 20 bp, Artificial
  CRISPR gRNA sequence
caataagaataagagaacaa

SEQ ID NO: 252650 - DNA, 20 bp, Artificial
  CRISPR gRNA sequence
ttggctgtacaattcttgcc

SEQ ID NO: 252651 - DNA, 20 bp, Artificial
  CRISPR gRNA sequence
gctgtacaattcttgccaaa

SEQ ID NO: 252652 - DNA, 20 bp, Artificial
  CRISPR gRNA sequence
tacaattcttgccaaatagt

SEQ ID NO: 252653 - DNA, 20 bp, Artificial
  CRISPR gRNA sequence
ttgccaaatagtaggcaaag

SEQ ID NO: 252654 - DNA, 20 bp, Artificial
  CRISPR gRNA sequence
gccaaatagtaggcaaagca

SEQ ID NO: 252655 - DNA, 20 bp, Artificial
  CRISPR gRNA sequence
ccaaatagtaggcaaagcaa

SEQ ID NO: 252656 - DNA, 20 bp, Artificial
  CRISPR gRNA sequence
aggaagtatactggtgccat

SEQ ID NO: 252657 - DNA, 20 bp, Artificial
  CRISPR gRNA sequence
ggaagtatactggtgccatt

SEQ ID NO: 252658 - DNA, 20 bp, Artificial
  CRISPR gRNA sequence
gtgccatttcaggaacaaag

SEQ ID NO: 252659 - DNA, 20 bp, Artificial
  CRISPR gRNA sequence
caggaacaaagctaggtgcg

SEQ ID NO: 252660 - DNA, 20 bp, Artificial
  CRISPR gRNA sequence
aggaacaaagctaggtgcga

SEQ ID NO: 252661 - DNA, 20 bp, Artificial
  CRISPR gRNA sequence
ggtgcgaatatttttgtctt

SEQ ID NO: 252662 - DNA, 20 bp, Artificial
  CRISPR gRNA sequence
ttgtctttctgaatcatgat

SEQ ID NO: 252663 - DNA, 20 bp, Artificial
  CRISPR gRNA sequence
tgtctttctgaatcatgatg

SEQ ID NO: 252664 - DNA, 20 bp, Artificial
  CRISPR gRNA sequence
gtctttctgaatcatgatgc

SEQ ID NO: 252665 - DNA, 20 bp, Artificial
  CRISPR gRNA sequence
tctttctgaatcatgatgct

SEQ ID NO: 252666 - DNA, 20 bp, Artificial
  CRISPR gRNA sequence
tctgaatcatgatgctgtaa

SEQ ID NO: 252667 - DNA, 20 bp, Artificial
  CRISPR gRNA sequence
ctgaatcatgatgctgtaag

SEQ ID NO: 252668 - DNA, 20 bp, Artificial
  CRISPR gRNA sequence
tgaatcatgatgctgtaagt

SEQ ID NO: 252669 - DNA, 20 bp, Artificial
  CRISPR gRNA sequence
aatcatgatgctgtaagttc

SEQ ID NO: 252670 - DNA, 20 bp, Artificial
  CRISPR gRNA sequence
taagttctaaagtgatttct

SEQ ID NO: 252671 - DNA, 20 bp, Artificial
  CRISPR gRNA sequence
taaagtgatttctcctcttg

SEQ ID NO: 252672 - DNA, 20 bp, Artificial
  CRISPR gRNA sequence
aagtgatttctcctcttggc

SEQ ID NO: 252673 - DNA, 20 bp, Artificial
  CRISPR gRNA sequence
ctcctcttggctttggacac

SEQ ID NO: 252674 - DNA, 20 bp, Artificial
  CRISPR gRNA sequence
tcctcttggctttggacaca

SEQ ID NO: 252675 - DNA, 20 bp, Artificial
  CRISPR gRNA sequence
ctcttggctttggacacatg

SEQ ID NO: 252676 - DNA, 20 bp, Artificial
  CRISPR gRNA sequence
ttggctttggacacatggtg

SEQ ID NO: 252677 - DNA, 20 bp, Artificial
  CRISPR gRNA sequence
ggctttggacacatggtgtt

SEQ ID NO: 252678 - DNA, 20 bp, Artificial
  CRISPR gRNA sequence
gctttggacacatggtgttt

SEQ ID NO: 252679 - DNA, 20 bp, Artificial
  CRISPR gRNA sequence
tggacacatggtgtttaatt

SEQ ID NO: 252680 - DNA, 20 bp, Artificial
  CRISPR gRNA sequence
ggacacatggtgtttaatta

SEQ ID NO: 252681 - DNA, 20 bp, Artificial
  CRISPR gRNA sequence
gacacatggtgtttaattac

SEQ ID NO: 252682 - DNA, 20 bp, Artificial
  CRISPR gRNA sequence
aattacctactgctgactat

SEQ ID NO: 252683 - DNA, 20 bp, Artificial
  CRISPR gRNA sequence
attacctactgctgactatc

SEQ ID NO: 252684 - DNA, 20 bp, Artificial
  CRISPR gRNA sequence
cctactgctgactatccaca

SEQ ID NO: 252685 - DNA, 20 bp, Artificial
  CRISPR gRNA sequence
ctgctgactatccacaaaca

SEQ ID NO: 252686 - DNA, 20 bp, Artificial
  CRISPR gRNA sequence
ctgactatccacaaacagaa

SEQ ID NO: 252687 - DNA, 20 bp, Artificial
  CRISPR gRNA sequence
actatccacaaacagaaaga

SEQ ID NO: 252688 - DNA, 20 bp, Artificial
  CRISPR gRNA sequence
tccacaaacagaaagagact

SEQ ID NO: 252689 - DNA, 20 bp, Artificial
  CRISPR gRNA sequence
gtcatgccccacagggttgg

SEQ ID NO: 252690 - DNA, 20 bp, Artificial
  CRISPR gRNA sequence
gggtatccaagataatggag

SEQ ID NO: 252691 - DNA, 20 bp, Artificial
  CRISPR gRNA sequence
tcatgtgtcctaggttacac

SEQ ID NO: 252692 - DNA, 20 bp, Artificial
  CRISPR gRNA sequence
atgtgtcctaggttacacac

SEQ ID NO: 252693 - DNA, 20 bp, Artificial
  CRISPR gRNA sequence
ggttacacaccgaaaatcca

SEQ ID NO: 252694 - DNA, 20 bp, Artificial
  CRISPR gRNA sequence
cacaccgaaaatccacagtt

SEQ ID NO: 252695 - DNA, 20 bp, Artificial
  CRISPR gRNA sequence
attctgtgaagaaaggaggc

SEQ ID NO: 252696 - DNA, 20 bp, Artificial
  CRISPR gRNA sequence
ttctgtgaagaaaggaggct

SEQ ID NO: 252697 - DNA, 20 bp, Artificial
  CRISPR gRNA sequence
tgtgaagaaaggaggctatg

SEQ ID NO: 252698 - DNA, 20 bp, Artificial
  CRISPR gRNA sequence
tgaagaaaggaggctatgtt

SEQ ID NO: 252699 - DNA, 20 bp, Artificial
  CRISPR gRNA sequence
tgtttatgatacagactgtg

SEQ ID NO: 252700 - DNA, 20 bp, Artificial
  CRISPR gRNA sequence
atgatacagactgtgatatt

SEQ ID NO: 252701 - DNA, 20 bp, Artificial
  CRISPR gRNA sequence
tgatacagactgtgatattt

SEQ ID NO: 252702 - DNA, 20 bp, Artificial
  CRISPR gRNA sequence
tgatatttttatcatagcct

SEQ ID NO: 252703 - DNA, 20 bp, Artificial
  CRISPR gRNA sequence
ttatcatagcctattctggt

SEQ ID NO: 252704 - DNA, 20 bp, Artificial
  CRISPR gRNA sequence
tatcatagcctattctggta

SEQ ID NO: 252705 - DNA, 20 bp, Artificial
  CRISPR gRNA sequence
atcatagcctattctggtat

SEQ ID NO: 252706 - DNA, 20 bp, Artificial
  CRISPR gRNA sequence
tcatagcctattctggtatc

SEQ ID NO: 252707 - DNA, 20 bp, Artificial
  CRISPR gRNA sequence
ttctggtatcatgtgcaaaa

SEQ ID NO: 252708 - DNA, 20 bp, Artificial
  CRISPR gRNA sequence
tggtatcatgtgcaaaagct

SEQ ID NO: 252709 - DNA, 20 bp, Artificial
  CRISPR gRNA sequence
gtatcatgtgcaaaagctat

SEQ ID NO: 252710 - DNA, 20 bp, Artificial
  CRISPR gRNA sequence
taaatgaaaaacacaggaac

SEQ ID NO: 252711 - DNA, 20 bp, Artificial
  CRISPR gRNA sequence
ggcatgtgagtcattgctcc

SEQ ID NO: 252712 - DNA, 20 bp, Artificial
  CRISPR gRNA sequence
gcatgtgagtcattgctccc

SEQ ID NO: 252713 - DNA, 20 bp, Artificial
  CRISPR gRNA sequence
ctccccctaaatgacaatta

SEQ ID NO: 252714 - DNA, 20 bp, Artificial
  CRISPR gRNA sequence
cccctaaatgacaattaata

SEQ ID NO: 252715 - DNA, 20 bp, Artificial
  CRISPR gRNA sequence
aatgacaattaataaggaag

SEQ ID NO: 252716 - DNA, 20 bp, Artificial
  CRISPR gRNA sequence
ataaggaaggaacattgaga

SEQ ID NO: 252717 - DNA, 20 bp, Artificial
  CRISPR gRNA sequence
agacagaataaaatgatccc

SEQ ID NO: 252718 - DNA, 20 bp, Artificial
  CRISPR gRNA sequence
ctgggtttaatttagaaagt

SEQ ID NO: 252719 - DNA, 20 bp, Artificial
  CRISPR gRNA sequence
tgggtttaatttagaaagtt

SEQ ID NO: 252720 - DNA, 20 bp, Artificial
  CRISPR gRNA sequence
ggtttaatttagaaagttcc

SEQ ID NO: 252721 - DNA, 20 bp, Artificial
  CRISPR gRNA sequence
aatttagaaagttccataat

SEQ ID NO: 252722 - DNA, 20 bp, Artificial
  CRISPR gRNA sequence
atttagaaagttccataatt

SEQ ID NO: 252723 - DNA, 20 bp, Artificial
  CRISPR gRNA sequence
agaaagttccataattaggt

SEQ ID NO: 252724 - DNA, 20 bp, Artificial
  CRISPR gRNA sequence
gaaagttccataattaggtt

SEQ ID NO: 252725 - DNA, 20 bp, Artificial
  CRISPR gRNA sequence
cataattaggtttaatagaa

SEQ ID NO: 252726 - DNA, 20 bp, Artificial
  CRISPR gRNA sequence
ggtttaatagaaataaatgt

SEQ ID NO: 252727 - DNA, 20 bp, Artificial
  CRISPR gRNA sequence
aatagaaataaatgtaaatt

SEQ ID NO: 252728 - DNA, 20 bp, Artificial
  CRISPR gRNA sequence
atagaaataaatgtaaattt

SEQ ID NO: 252729 - DNA, 20 bp, Artificial
  CRISPR gRNA sequence
ctatgattaaaaataaatta

SEQ ID NO: 252730 - DNA, 20 bp, Artificial
  CRISPR gRNA sequence
tatgattaaaaataaattag

SEQ ID NO: 252731 - DNA, 20 bp, Artificial
  CRISPR gRNA sequence
tgattaaaaataaattagca

SEQ ID NO: 252732 - DNA, 20 bp, Artificial
  CRISPR gRNA sequence
aaaataaattagcacattta

SEQ ID NO: 252733 - DNA, 20 bp, Artificial
  CRISPR gRNA sequence
gcacatttagggatacacaa

SEQ ID NO: 252734 - DNA, 20 bp, Artificial
  CRISPR gRNA sequence
agggatacacaaattataaa

SEQ ID NO: 252735 - DNA, 20 bp, Artificial
  CRISPR gRNA sequence
gggatacacaaattataaat

SEQ ID NO: 252736 - DNA, 20 bp, Artificial
  CRISPR gRNA sequence
taaatcattttctaaatgct

SEQ ID NO: 252737 - DNA, 20 bp, Artificial
  CRISPR gRNA sequence
tctaaatgctaaaaacaagc

SEQ ID NO: 252738 - DNA, 20 bp, Artificial
  CRISPR gRNA sequence
ctaaatgctaaaaacaagct

SEQ ID NO: 252739 - DNA, 20 bp, Artificial
  CRISPR gRNA sequence
taaatgctaaaaacaagctc

SEQ ID NO: 252740 - DNA, 20 bp, Artificial
  CRISPR gRNA sequence
aatgctaaaaacaagctcag

SEQ ID NO: 252741 - DNA, 20 bp, Artificial
  CRISPR gRNA sequence
aaaacaagctcaggtttttt

SEQ ID NO: 252742 - DNA, 20 bp, Artificial
  CRISPR gRNA sequence
aggtttttttcagaagaaag

SEQ ID NO: 252743 - DNA, 20 bp, Artificial
  CRISPR gRNA sequence
ttttcagaagaaagttttaa

SEQ ID NO: 252744 - DNA, 20 bp, Artificial
  CRISPR gRNA sequence
tttcagaagaaagttttaat

SEQ ID NO: 252745 - DNA, 20 bp, Artificial
  CRISPR gRNA sequence
ttcagaagaaagttttaatt

SEQ ID NO: 252746 - DNA, 20 bp, Artificial
  CRISPR gRNA sequence
tcagaagaaagttttaattt

SEQ ID NO: 252747 - DNA, 20 bp, Artificial
  CRISPR gRNA sequence
cagaagaaagttttaatttt

SEQ ID NO: 252748 - DNA, 20 bp, Artificial
  CRISPR gRNA sequence
agaagaaagttttaattttt

SEQ ID NO: 252749 - DNA, 20 bp, Artificial
  CRISPR gRNA sequence
taattttttttctttagtgg

SEQ ID NO: 252750 - DNA, 20 bp, Artificial
  CRISPR gRNA sequence
aattttttttctttagtgga

SEQ ID NO: 252751 - DNA, 20 bp, Artificial
  CRISPR gRNA sequence
attttttttctttagtggaa

SEQ ID NO: 252752 - DNA, 20 bp, Artificial
  CRISPR gRNA sequence
tttttctttagtggaagata

SEQ ID NO: 252753 - DNA, 20 bp, Artificial
  CRISPR gRNA sequence
ttttctttagtggaagatat

SEQ ID NO: 252754 - DNA, 20 bp, Artificial
  CRISPR gRNA sequence
tttctttagtggaagatatc

SEQ ID NO: 252755 - DNA, 20 bp, Artificial
  CRISPR gRNA sequence
ttctttagtggaagatatca

SEQ ID NO: 252756 - DNA, 20 bp, Artificial
  CRISPR gRNA sequence
tctttagtggaagatatcac

SEQ ID NO: 252757 - DNA, 20 bp, Artificial
  CRISPR gRNA sequence
ctttagtggaagatatcact

SEQ ID NO: 252758 - DNA, 20 bp, Artificial
  CRISPR gRNA sequence
tttagtggaagatatcactc

SEQ ID NO: 252759 - DNA, 20 bp, Artificial
  CRISPR gRNA sequence
tagtggaagatatcactctg

SEQ ID NO: 252760 - DNA, 20 bp, Artificial
  CRISPR gRNA sequence
agtggaagatatcactctga

SEQ ID NO: 252761 - DNA, 20 bp, Artificial
  CRISPR gRNA sequence
gtggaagatatcactctgac

SEQ ID NO: 252762 - DNA, 20 bp, Artificial
  CRISPR gRNA sequence
tgacggaaagttttgatgtg

SEQ ID NO: 252763 - DNA, 20 bp, Artificial
  CRISPR gRNA sequence
acggaaagttttgatgtgag

SEQ ID NO: 252764 - DNA, 20 bp, Artificial
  CRISPR gRNA sequence
tgatgtgaggggcggatgac

SEQ ID NO: 252765 - DNA, 20 bp, Artificial
  CRISPR gRNA sequence
gatgtgaggggcggatgact

SEQ ID NO: 252766 - DNA, 20 bp, Artificial
  CRISPR gRNA sequence
atgtgaggggcggatgacta

SEQ ID NO: 252767 - DNA, 20 bp, Artificial
  CRISPR gRNA sequence
taaagtgggcatcttccccc

SEQ ID NO: 252768 - DNA, 20 bp, Artificial
  CRISPR gRNA sequence
cccccacaggaagatgtttc

SEQ ID NO: 252769 - DNA, 20 bp, Artificial
  CRISPR gRNA sequence
ccccacaggaagatgtttcc

SEQ ID NO: 252770 - DNA, 20 bp, Artificial
  CRISPR gRNA sequence
ccatctgtgggtgagaggtg

SEQ ID NO: 252771 - DNA, 20 bp, Artificial
  CRISPR gRNA sequence
catctgtgggtgagaggtgc

SEQ ID NO: 252772 - DNA, 20 bp, Artificial
  CRISPR gRNA sequence
tgggtgagaggtgcccaccg

SEQ ID NO: 252773 - DNA, 20 bp, Artificial
  CRISPR gRNA sequence
gggcaggttacatgtgccct

SEQ ID NO: 252774 - DNA, 20 bp, Artificial
  CRISPR gRNA sequence
catgtgccctgtgtgtggta

SEQ ID NO: 252775 - DNA, 20 bp, Artificial
  CRISPR gRNA sequence
tgtgtggtaggacttggaga

SEQ ID NO: 252776 - DNA, 20 bp, Artificial
  CRISPR gRNA sequence
ggagagtgatctttatcaac

SEQ ID NO: 252777 - DNA, 20 bp, Artificial
  CRISPR gRNA sequence
gagagtgatctttatcaacg

SEQ ID NO: 252778 - DNA, 20 bp, Artificial
  CRISPR gRNA sequence
tatcaacgtttttatttaaa

SEQ ID NO: 252779 - DNA, 20 bp, Artificial
  CRISPR gRNA sequence
atcaacgtttttatttaaaa

SEQ ID NO: 252780 - DNA, 20 bp, Artificial
  CRISPR gRNA sequence
tcaacgtttttatttaaaag

SEQ ID NO: 252781 - DNA, 20 bp, Artificial
  CRISPR gRNA sequence
ttatttaaaagactatctaa

SEQ ID NO: 252782 - DNA, 20 bp, Artificial
  CRISPR gRNA sequence
tatttaaaagactatctaat

SEQ ID NO: 252783 - DNA, 20 bp, Artificial
  CRISPR gRNA sequence
atttaaaagactatctaata

SEQ ID NO: 252784 - DNA, 20 bp, Artificial
  CRISPR gRNA sequence
tttaaaagactatctaataa

SEQ ID NO: 252785 - DNA, 20 bp, Artificial
  CRISPR gRNA sequence
aaaagactatctaataaaac

SEQ ID NO: 252786 - DNA, 20 bp, Artificial
  CRISPR gRNA sequence
aaagactatctaataaaaca

SEQ ID NO: 252787 - DNA, 20 bp, Artificial
  CRISPR gRNA sequence
tctaataaaacacaaaacta

SEQ ID NO: 252788 - DNA, 20 bp, Artificial
  CRISPR gRNA sequence
ataaaacacaaaactatgat

SEQ ID NO: 252789 - DNA, 20 bp, Artificial
  CRISPR gRNA sequence
tgatgttcacaggaaaaaaa

SEQ ID NO: 252790 - DNA, 20 bp, Artificial
  CRISPR gRNA sequence
acaggaaaaaaagaataaga

SEQ ID NO: 252791 - DNA, 20 bp, Artificial
  CRISPR gRNA sequence
attttaaaaagctttttata

SEQ ID NO: 252792 - DNA, 20 bp, Artificial
  CRISPR gRNA sequence
ttttaaaaagctttttataa

SEQ ID NO: 252793 - DNA, 20 bp, Artificial
  CRISPR gRNA sequence
taaaaagctttttataactg

SEQ ID NO: 252794 - DNA, 20 bp, Artificial
  CRISPR gRNA sequence
aaaaagctttttataactgt

SEQ ID NO: 252795 - DNA, 20 bp, Artificial
  CRISPR gRNA sequence
aaaagctttttataactgtt

SEQ ID NO: 252796 - DNA, 20 bp, Artificial
  CRISPR gRNA sequence
tttataactgttgcaacatc

SEQ ID NO: 252797 - DNA, 20 bp, Artificial
  CRISPR gRNA sequence
ttataactgttgcaacatca

SEQ ID NO: 252798 - DNA, 20 bp, Artificial
  CRISPR gRNA sequence
tataactgttgcaacatcat

SEQ ID NO: 252799 - DNA, 20 bp, Artificial
  CRISPR gRNA sequence
ataactgttgcaacatcata

SEQ ID NO: 252800 - DNA, 20 bp, Artificial
  CRISPR gRNA sequence
taactgttgcaacatcatat

SEQ ID NO: 252801 - DNA, 20 bp, Artificial
  CRISPR gRNA sequence
ttgcaacatcatatcataaa

SEQ ID NO: 252802 - DNA, 20 bp, Artificial
  CRISPR gRNA sequence
caacatcatatcataaaggg

SEQ ID NO: 252803 - DNA, 20 bp, Artificial
  CRISPR gRNA sequence
tttgtaaactttggctttta

SEQ ID NO: 252804 - DNA, 20 bp, Artificial
  CRISPR gRNA sequence
tgtaaactttggcttttagt

SEQ ID NO: 252805 - DNA, 20 bp, Artificial
  CRISPR gRNA sequence
gtaaactttggcttttagtg

SEQ ID NO: 252806 - DNA, 20 bp, Artificial
  CRISPR gRNA sequence
taaactttggcttttagtgc

SEQ ID NO: 252807 - DNA, 20 bp, Artificial
  CRISPR gRNA sequence
caataaagaataattcccat

SEQ ID NO: 252808 - DNA, 20 bp, Artificial
  CRISPR gRNA sequence
attcccataagcccatcatg

SEQ ID NO: 252809 - DNA, 20 bp, Artificial
  CRISPR gRNA sequence
tgtagtgaccgactattttt

SEQ ID NO: 252810 - DNA, 20 bp, Artificial
  CRISPR gRNA sequence
atttttcagtgacaaaaaaa

SEQ ID NO: 252811 - DNA, 20 bp, Artificial
  CRISPR gRNA sequence
aaaaaaaaagtctttaaaaa

SEQ ID NO: 252812 - DNA, 20 bp, Artificial
  CRISPR gRNA sequence
aaaaaagtctttaaaaatag

SEQ ID NO: 252813 - DNA, 20 bp, Artificial
  CRISPR gRNA sequence
gtctttaaaaatagaagtaa

SEQ ID NO: 252814 - DNA, 20 bp, Artificial
  CRISPR gRNA sequence
aaaatagaagtaaaagtcta

SEQ ID NO: 252815 - DNA, 20 bp, Artificial
  CRISPR gRNA sequence
atatcctgtgtgaaatgctg

SEQ ID NO: 252816 - DNA, 20 bp, Artificial
  CRISPR gRNA sequence
cctgtgtgaaatgctgcagt

SEQ ID NO: 252817 - DNA, 20 bp, Artificial
  CRISPR gRNA sequence
ctgtgtgaaatgctgcagtc

SEQ ID NO: 252818 - DNA, 20 bp, Artificial
  CRISPR gRNA sequence
gctgcagtcaggatgccttg

SEQ ID NO: 252819 - DNA, 20 bp, Artificial
  CRISPR gRNA sequence
gtcaggatgccttgtggttt

SEQ ID NO: 252820 - DNA, 20 bp, Artificial
  CRISPR gRNA sequence
tggtttgagttgccctatta

SEQ ID NO: 252821 - DNA, 20 bp, Artificial
  CRISPR gRNA sequence
gccctattacagcaaaacta

SEQ ID NO: 252822 - DNA, 20 bp, Artificial
  CRISPR gRNA sequence
ccctattacagcaaaactac

SEQ ID NO: 252823 - DNA, 20 bp, Artificial
  CRISPR gRNA sequence
cctattacagcaaaactacg

SEQ ID NO: 252824 - DNA, 20 bp, Artificial
  CRISPR gRNA sequence
ttacagcaaaactacgggga

SEQ ID NO: 252825 - DNA, 20 bp, Artificial
  CRISPR gRNA sequence
cagcaaaactacggggatgg

SEQ ID NO: 252826 - DNA, 20 bp, Artificial
  CRISPR gRNA sequence
caaaactacggggatggtgg

SEQ ID NO: 252827 - DNA, 20 bp, Artificial
  CRISPR gRNA sequence
aactacggggatggtggcgg

SEQ ID NO: 252828 - DNA, 20 bp, Artificial
  CRISPR gRNA sequence
tacggggatggtggcggtgg

SEQ ID NO: 252829 - DNA, 20 bp, Artificial
  CRISPR gRNA sequence
ggggatggtggcggtggtgg

SEQ ID NO: 252830 - DNA, 20 bp, Artificial
  CRISPR gRNA sequence
ggtggcggtggtggtggccg

SEQ ID NO: 252831 - DNA, 20 bp, Artificial
  CRISPR gRNA sequence
gtggtggtggccgtggatga

SEQ ID NO: 252832 - DNA, 20 bp, Artificial
  CRISPR gRNA sequence
ggtggtggccgtggatgacg

SEQ ID NO: 252833 - DNA, 20 bp, Artificial
  CRISPR gRNA sequence
ccgtggatgacggagactct

SEQ ID NO: 252834 - DNA, 20 bp, Artificial
  CRISPR gRNA sequence
cgtggatgacggagactctc

SEQ ID NO: 252835 - DNA, 20 bp, Artificial
  CRISPR gRNA sequence
tgacggagactctcaggcct

SEQ ID NO: 252836 - DNA, 20 bp, Artificial
  CRISPR gRNA sequence
cggagactctcaggccttgg

SEQ ID NO: 252837 - DNA, 20 bp, Artificial
  CRISPR gRNA sequence
ggagactctcaggccttggc

SEQ ID NO: 252838 - DNA, 20 bp, Artificial
  CRISPR gRNA sequence
gccttggcaggtgcgtcttt

SEQ ID NO: 252839 - DNA, 20 bp, Artificial
  CRISPR gRNA sequence
tttcagttcccctcacactt

SEQ ID NO: 252840 - DNA, 20 bp, Artificial
  CRISPR gRNA sequence
ttcagttcccctcacacttc

SEQ ID NO: 252841 - DNA, 20 bp, Artificial
  CRISPR gRNA sequence
ccctcacacttcgggttcct

SEQ ID NO: 252842 - DNA, 20 bp, Artificial
  CRISPR gRNA sequence
cctcacacttcgggttcctc

SEQ ID NO: 252843 - DNA, 20 bp, Artificial
  CRISPR gRNA sequence
ctcacacttcgggttcctcg

SEQ ID NO: 252844 - DNA, 20 bp, Artificial
  CRISPR gRNA sequence
cacacttcgggttcctcggg

SEQ ID NO: 252845 - DNA, 20 bp, Artificial
  CRISPR gRNA sequence
acacttcgggttcctcgggg

SEQ ID NO: 252846 - DNA, 20 bp, Artificial
  CRISPR gRNA sequence
acttcgggttcctcggggag

SEQ ID NO: 252847 - DNA, 20 bp, Artificial
  CRISPR gRNA sequence
cttcgggttcctcggggagg

SEQ ID NO: 252848 - DNA, 20 bp, Artificial
  CRISPR gRNA sequence
ttcgggttcctcggggagga

SEQ ID NO: 252849 - DNA, 20 bp, Artificial
  CRISPR gRNA sequence
tcgggttcctcggggaggag

SEQ ID NO: 252850 - DNA, 20 bp, Artificial
  CRISPR gRNA sequence
gttcctcggggaggaggggc

SEQ ID NO: 252851 - DNA, 20 bp, Artificial
  CRISPR gRNA sequence
gggaggaggggctggaaccc

SEQ ID NO: 252852 - DNA, 20 bp, Artificial
  CRISPR gRNA sequence
ctggaaccctagcccatcgt

SEQ ID NO: 252853 - DNA, 20 bp, Artificial
  CRISPR gRNA sequence
tggaaccctagcccatcgtc

SEQ ID NO: 252854 - DNA, 20 bp, Artificial
  CRISPR gRNA sequence
cctagcccatcgtcaggaca

SEQ ID NO: 252855 - DNA, 20 bp, Artificial
  CRISPR gRNA sequence
atcgtcaggacaaagatgct

SEQ ID NO: 252856 - DNA, 20 bp, Artificial
  CRISPR gRNA sequence
tcgtcaggacaaagatgctc

SEQ ID NO: 252857 - DNA, 20 bp, Artificial
  CRISPR gRNA sequence
aaagatgctcaggctgctct

SEQ ID NO: 252858 - DNA, 20 bp, Artificial
  CRISPR gRNA sequence
caacttattcccttcaattc

SEQ ID NO: 252859 - DNA, 20 bp, Artificial
  CRISPR gRNA sequence
attcccttcaattcaagtaa

SEQ ID NO: 252860 - DNA, 20 bp, Artificial
  CRISPR gRNA sequence
ttcccttcaattcaagtaac

SEQ ID NO: 252861 - DNA, 20 bp, Artificial
  CRISPR gRNA sequence
tctttctgtaaatatttttt

SEQ ID NO: 252862 - DNA, 20 bp, Artificial
  CRISPR gRNA sequence
ctttctgtaaatattttttg

SEQ ID NO: 252863 - DNA, 20 bp, Artificial
  CRISPR gRNA sequence
attttttgaggtcttccaat

SEQ ID NO: 252864 - DNA, 20 bp, Artificial
  CRISPR gRNA sequence
ttgaggtcttccaattggct

SEQ ID NO: 252865 - DNA, 20 bp, Artificial
  CRISPR gRNA sequence
gtgtgaaatttgaacatttg

SEQ ID NO: 252866 - DNA, 20 bp, Artificial
  CRISPR gRNA sequence
aaatttgaacatttgaagtg

SEQ ID NO: 252867 - DNA, 20 bp, Artificial
  CRISPR gRNA sequence
gaagtgtagttttgctgtaa

SEQ ID NO: 252868 - DNA, 20 bp, Artificial
  CRISPR gRNA sequence
aagtgtagttttgctgtaat

SEQ ID NO: 252869 - DNA, 20 bp, Artificial
  CRISPR gRNA sequence
agtgtagttttgctgtaata

SEQ ID NO: 252870 - DNA, 20 bp, Artificial
  CRISPR gRNA sequence
ttttgaaaatcattgattct

SEQ ID NO: 252871 - DNA, 20 bp, Artificial
  CRISPR gRNA sequence
ttgattctcagactacaata

SEQ ID NO: 252872 - DNA, 20 bp, Artificial
  CRISPR gRNA sequence
acaatatagtatcttaacaa

SEQ ID NO: 252873 - DNA, 20 bp, Artificial
  CRISPR gRNA sequence
gtatcttaacaaaagtccct

SEQ ID NO: 252874 - DNA, 20 bp, Artificial
  CRISPR gRNA sequence
cccttggaaataaattttct

SEQ ID NO: 252875 - DNA, 20 bp, Artificial
  CRISPR gRNA sequence
aaataaattttctaagctat

SEQ ID NO: 252876 - DNA, 20 bp, Artificial
  CRISPR gRNA sequence
ttctaagctattagtttctc

SEQ ID NO: 252877 - DNA, 20 bp, Artificial
  CRISPR gRNA sequence
ctattagtttctctagctat

SEQ ID NO: 252878 - DNA, 20 bp, Artificial
  CRISPR gRNA sequence
tttctctagctattagttga

SEQ ID NO: 252879 - DNA, 20 bp, Artificial
  CRISPR gRNA sequence
ctattagttgatagtgtccc

SEQ ID NO: 252880 - DNA, 20 bp, Artificial
  CRISPR gRNA sequence
tattattattattttaaatt

SEQ ID NO: 252881 - DNA, 20 bp, Artificial
  CRISPR gRNA sequence
attattattttaaattgaga

SEQ ID NO: 252882 - DNA, 20 bp, Artificial
  CRISPR gRNA sequence
ttattattttaaattgagat

SEQ ID NO: 252883 - DNA, 20 bp, Artificial
  CRISPR gRNA sequence
tattattttaaattgagatg

SEQ ID NO: 252884 - DNA, 20 bp, Artificial
  CRISPR gRNA sequence
tggggtttcactatgttgcc

SEQ ID NO: 252885 - DNA, 20 bp, Artificial
  CRISPR gRNA sequence
ggggtttcactatgttgccc

SEQ ID NO: 252886 - DNA, 20 bp, Artificial
  CRISPR gRNA sequence
tttcactatgttgcccaggc

SEQ ID NO: 252887 - DNA, 20 bp, Artificial
  CRISPR gRNA sequence
caggctggtctcaaacttct

SEQ ID NO: 252888 - DNA, 20 bp, Artificial
  CRISPR gRNA sequence
ggtctcaaacttctgagctc

SEQ ID NO: 252889 - DNA, 20 bp, Artificial
  CRISPR gRNA sequence
ccacctgcctctgcctccca

SEQ ID NO: 252890 - DNA, 20 bp, Artificial
  CRISPR gRNA sequence
gcctctgcctcccaaagtgc

SEQ ID NO: 252891 - DNA, 20 bp, Artificial
  CRISPR gRNA sequence
cctctgcctcccaaagtgct

SEQ ID NO: 252892 - DNA, 20 bp, Artificial
  CRISPR gRNA sequence
ctctgcctcccaaagtgcta

SEQ ID NO: 252893 - DNA, 20 bp, Artificial
  CRISPR gRNA sequence
ctcccaaagtgctagggtta

SEQ ID NO: 252894 - DNA, 20 bp, Artificial
  CRISPR gRNA sequence
tcccaaagtgctagggttac

SEQ ID NO: 252895 - DNA, 20 bp, Artificial
  CRISPR gRNA sequence
agtgctagggttacaggcat

SEQ ID NO: 252896 - DNA, 20 bp, Artificial
  CRISPR gRNA sequence
caggcatgagctaccatgcc

SEQ ID NO: 252897 - DNA, 20 bp, Artificial
  CRISPR gRNA sequence
tttctttttttttttaattt

SEQ ID NO: 252898 - DNA, 20 bp, Artificial
  CRISPR gRNA sequence
tttttttttttaatttaaga

SEQ ID NO: 252899 - DNA, 20 bp, Artificial
  CRISPR gRNA sequence
taatttaagaaagctgctgt

SEQ ID NO: 252900 - DNA, 20 bp, Artificial
  CRISPR gRNA sequence
tttaagaaagctgctgtaag

SEQ ID NO: 252901 - DNA, 20 bp, Artificial
  CRISPR gRNA sequence
gaaagctgctgtaagtagat

SEQ ID NO: 252902 - DNA, 20 bp, Artificial
  CRISPR gRNA sequence
tgctgtaagtagattggctc

SEQ ID NO: 252903 - DNA, 20 bp, Artificial
  CRISPR gRNA sequence
tgtaagtagattggctctgg

SEQ ID NO: 252904 - DNA, 20 bp, Artificial
  CRISPR gRNA sequence
ggctctggaagctctgaatt

SEQ ID NO: 252905 - DNA, 20 bp, Artificial
  CRISPR gRNA sequence
gctctggaagctctgaattt

SEQ ID NO: 252906 - DNA, 20 bp, Artificial
  CRISPR gRNA sequence
ggttgcctatgttcctaaca

SEQ ID NO: 252907 - DNA, 20 bp, Artificial
  CRISPR gRNA sequence
gttgcctatgttcctaacac

SEQ ID NO: 252908 - DNA, 20 bp, Artificial
  CRISPR gRNA sequence
aacacaggtccaattctcac

SEQ ID NO: 252909 - DNA, 20 bp, Artificial
  CRISPR gRNA sequence
acacaggtccaattctcact

SEQ ID NO: 252910 - DNA, 20 bp, Artificial
  CRISPR gRNA sequence
aggtccaattctcactaggt

SEQ ID NO: 252911 - DNA, 20 bp, Artificial
  CRISPR gRNA sequence
caattctcactaggtaagct

SEQ ID NO: 252912 - DNA, 20 bp, Artificial
  CRISPR gRNA sequence
aattctcactaggtaagctt

SEQ ID NO: 252913 - DNA, 20 bp, Artificial
  CRISPR gRNA sequence
tcactaggtaagcttaggct

SEQ ID NO: 252914 - DNA, 20 bp, Artificial
  CRISPR gRNA sequence
tatttaaactctccaaacct

SEQ ID NO: 252915 - DNA, 20 bp, Artificial
  CRISPR gRNA sequence
cctcagtttccttaactgta

SEQ ID NO: 252916 - DNA, 20 bp, Artificial
  CRISPR gRNA sequence
cagtttccttaactgtaaag

SEQ ID NO: 252917 - DNA, 20 bp, Artificial
  CRISPR gRNA sequence
agtttccttaactgtaaagt

SEQ ID NO: 252918 - DNA, 20 bp, Artificial
  CRISPR gRNA sequence
ataataataaacctcacctc

SEQ ID NO: 252919 - DNA, 20 bp, Artificial
  CRISPR gRNA sequence
taataataaacctcacctca

SEQ ID NO: 252920 - DNA, 20 bp, Artificial
  CRISPR gRNA sequence
cctcacctcaaggtcattgt

SEQ ID NO: 252921 - DNA, 20 bp, Artificial
  CRISPR gRNA sequence
ctcacctcaaggtcattgtg

SEQ ID NO: 252922 - DNA, 20 bp, Artificial
  CRISPR gRNA sequence
aaaatgaaataatccatgcg

SEQ ID NO: 252923 - DNA, 20 bp, Artificial
  CRISPR gRNA sequence
aaatgaaataatccatgcga

SEQ ID NO: 252924 - DNA, 20 bp, Artificial
  CRISPR gRNA sequence
aatgaaataatccatgcgaa

SEQ ID NO: 252925 - DNA, 20 bp, Artificial
  CRISPR gRNA sequence
aataatccatgcgaagggct

SEQ ID NO: 252926 - DNA, 20 bp, Artificial
  CRISPR gRNA sequence
tccatgcgaagggcttagct

SEQ ID NO: 252927 - DNA, 20 bp, Artificial
  CRISPR gRNA sequence
tgcgaagggcttagctcagt

SEQ ID NO: 252928 - DNA, 20 bp, Artificial
  CRISPR gRNA sequence
gcgaagggcttagctcagtc

SEQ ID NO: 252929 - DNA, 20 bp, Artificial
  CRISPR gRNA sequence
gcttagctcagtcaggcttc

SEQ ID NO: 252930 - DNA, 20 bp, Artificial
  CRISPR gRNA sequence
tctatctacctgaattgaat

SEQ ID NO: 252931 - DNA, 20 bp, Artificial
  CRISPR gRNA sequence
atgagttccaacatgaattc

SEQ ID NO: 252932 - DNA, 20 bp, Artificial
  CRISPR gRNA sequence
gagttccaacatgaattctg

SEQ ID NO: 252933 - DNA, 20 bp, Artificial
  CRISPR gRNA sequence
catgaattctggagtcacca

SEQ ID NO: 252934 - DNA, 20 bp, Artificial
  CRISPR gRNA sequence
gaattctggagtcaccacag

SEQ ID NO: 252935 - DNA, 20 bp, Artificial
  CRISPR gRNA sequence
caacaccaatattaataaat

SEQ ID NO: 252936 - DNA, 20 bp, Artificial
  CRISPR gRNA sequence
aattagttttcttttacaat

SEQ ID NO: 252937 - DNA, 20 bp, Artificial
  CRISPR gRNA sequence
tcggccaaaatgtattttct

SEQ ID NO: 252938 - DNA, 20 bp, Artificial
  CRISPR gRNA sequence
ttcttagattaaaattcttt

SEQ ID NO: 252939 - DNA, 20 bp, Artificial
  CRISPR gRNA sequence
aagttcccaatgacgatgat

SEQ ID NO: 252940 - DNA, 20 bp, Artificial
  CRISPR gRNA sequence
agttcccaatgacgatgatg

SEQ ID NO: 252941 - DNA, 20 bp, Artificial
  CRISPR gRNA sequence
ttcccaatgacgatgatgag

SEQ ID NO: 252942 - DNA, 20 bp, Artificial
  CRISPR gRNA sequence
tcccaatgacgatgatgagg

SEQ ID NO: 252943 - DNA, 20 bp, Artificial
  CRISPR gRNA sequence
gatgaggaggataatacatc

SEQ ID NO: 252944 - DNA, 20 bp, Artificial
  CRISPR gRNA sequence
gataatacatctagcacttt

SEQ ID NO: 252945 - DNA, 20 bp, Artificial
  CRISPR gRNA sequence
aatacatctagcactttgag

SEQ ID NO: 252946 - DNA, 20 bp, Artificial
  CRISPR gRNA sequence
ctagcactttgagcagcaca

SEQ ID NO: 252947 - DNA, 20 bp, Artificial
  CRISPR gRNA sequence
cagcacacagttctcgtaac

SEQ ID NO: 252948 - DNA, 20 bp, Artificial
  CRISPR gRNA sequence
cacacagttctcgtaactag

SEQ ID NO: 252949 - DNA, 20 bp, Artificial
  CRISPR gRNA sequence
acacagttctcgtaactaga

SEQ ID NO: 252950 - DNA, 20 bp, Artificial
  CRISPR gRNA sequence
cagttctcgtaactagaagg

SEQ ID NO: 252951 - DNA, 20 bp, Artificial
  CRISPR gRNA sequence
agttctcgtaactagaaggt

SEQ ID NO: 252952 - DNA, 20 bp, Artificial
  CRISPR gRNA sequence
taactagaaggtaggtatta

SEQ ID NO: 252953 - DNA, 20 bp, Artificial
  CRISPR gRNA sequence
tattacagttaacttcattt

SEQ ID NO: 252954 - DNA, 20 bp, Artificial
  CRISPR gRNA sequence
agttaacttcatttcagatg

SEQ ID NO: 252955 - DNA, 20 bp, Artificial
  CRISPR gRNA sequence
ttaacttcatttcagatgaa

SEQ ID NO: 252956 - DNA, 20 bp, Artificial
  CRISPR gRNA sequence
tcatttcagatgaagagact

SEQ ID NO: 252957 - DNA, 20 bp, Artificial
  CRISPR gRNA sequence
catttcagatgaagagactg

SEQ ID NO: 252958 - DNA, 20 bp, Artificial
  CRISPR gRNA sequence
atttcagatgaagagactga

SEQ ID NO: 252959 - DNA, 20 bp, Artificial
  CRISPR gRNA sequence
tttcagatgaagagactgag

SEQ ID NO: 252960 - DNA, 20 bp, Artificial
  CRISPR gRNA sequence
cagatgaagagactgagggg

SEQ ID NO: 252961 - DNA, 20 bp, Artificial
  CRISPR gRNA sequence
agatgaagagactgaggggt

SEQ ID NO: 252962 - DNA, 20 bp, Artificial
  CRISPR gRNA sequence
gactgaggggtaggcacatt

SEQ ID NO: 252963 - DNA, 20 bp, Artificial
  CRISPR gRNA sequence
actgaggggtaggcacatta

SEQ ID NO: 252964 - DNA, 20 bp, Artificial
  CRISPR gRNA sequence
ctgaggggtaggcacattaa

SEQ ID NO: 252965 - DNA, 20 bp, Artificial
  CRISPR gRNA sequence
gcacattaagggatttgccc

SEQ ID NO: 252966 - DNA, 20 bp, Artificial
  CRISPR gRNA sequence
cacattaagggatttgccca

SEQ ID NO: 252967 - DNA, 20 bp, Artificial
  CRISPR gRNA sequence
gggatttgcccaaggatgta

SEQ ID NO: 252968 - DNA, 20 bp, Artificial
  CRISPR gRNA sequence
ggatttgcccaaggatgtac

SEQ ID NO: 252969 - DNA, 20 bp, Artificial
  CRISPR gRNA sequence
tttgcccaaggatgtacagg

SEQ ID NO: 252970 - DNA, 20 bp, Artificial
  CRISPR gRNA sequence
gcccaaggatgtacaggtgg

SEQ ID NO: 252971 - DNA, 20 bp, Artificial
  CRISPR gRNA sequence
ggatgtacaggtggcagcta

SEQ ID NO: 252972 - DNA, 20 bp, Artificial
  CRISPR gRNA sequence
gatgtacaggtggcagctat

SEQ ID NO: 252973 - DNA, 20 bp, Artificial
  CRISPR gRNA sequence
tgtacaggtggcagctatag

SEQ ID NO: 252974 - DNA, 20 bp, Artificial
  CRISPR gRNA sequence
gtacaggtggcagctatagg

SEQ ID NO: 252975 - DNA, 20 bp, Artificial
  CRISPR gRNA sequence
caggtggcagctataggagg

SEQ ID NO: 252976 - DNA, 20 bp, Artificial
  CRISPR gRNA sequence
aggtggcagctataggaggc

SEQ ID NO: 252977 - DNA, 20 bp, Artificial
  CRISPR gRNA sequence
ggtggcagctataggaggca

SEQ ID NO: 252978 - DNA, 20 bp, Artificial
  CRISPR gRNA sequence
aggcagggtctgaaccacct

SEQ ID NO: 252979 - DNA, 20 bp, Artificial
  CRISPR gRNA sequence
gaaccaccttagtctgactc

SEQ ID NO: 252980 - DNA, 20 bp, Artificial
  CRISPR gRNA sequence
ccttagtctgactccagtgc

SEQ ID NO: 252981 - DNA, 20 bp, Artificial
  CRISPR gRNA sequence
ttatgctattccatctaaca

SEQ ID NO: 252982 - DNA, 20 bp, Artificial
  CRISPR gRNA sequence
tggtgtgatttgtaatttca

SEQ ID NO: 252983 - DNA, 20 bp, Artificial
  CRISPR gRNA sequence
gatttgtaatttcatggact

SEQ ID NO: 252984 - DNA, 20 bp, Artificial
  CRISPR gRNA sequence
atttgtaatttcatggactc

SEQ ID NO: 252985 - DNA, 20 bp, Artificial
  CRISPR gRNA sequence
ttcatggactcaggtaaatc

SEQ ID NO: 252986 - DNA, 20 bp, Artificial
  CRISPR gRNA sequence
tcatggactcaggtaaatcc

SEQ ID NO: 252987 - DNA, 20 bp, Artificial
  CRISPR gRNA sequence
catggactcaggtaaatcca

SEQ ID NO: 252988 - DNA, 20 bp, Artificial
  CRISPR gRNA sequence
atccagggttaaattaactt

SEQ ID NO: 252989 - DNA, 20 bp, Artificial
  CRISPR gRNA sequence
aattaacttcggaaaatcac

SEQ ID NO: 252990 - DNA, 20 bp, Artificial
  CRISPR gRNA sequence
atcacaagcacaattcctaa

SEQ ID NO: 252991 - DNA, 20 bp, Artificial
  CRISPR gRNA sequence
caagcacaattcctaacaga

SEQ ID NO: 252992 - DNA, 20 bp, Artificial
  CRISPR gRNA sequence
aacagaaagaatttgttact

SEQ ID NO: 252993 - DNA, 20 bp, Artificial
  CRISPR gRNA sequence
acagaaagaatttgttactt

SEQ ID NO: 252994 - DNA, 20 bp, Artificial
  CRISPR gRNA sequence
gaaagaatttgttacttggg

SEQ ID NO: 252995 - DNA, 20 bp, Artificial
  CRISPR gRNA sequence
aaagaatttgttacttgggt

SEQ ID NO: 252996 - DNA, 20 bp, Artificial
  CRISPR gRNA sequence
aatttgttacttgggtgggc

SEQ ID NO: 252997 - DNA, 20 bp, Artificial
  CRISPR gRNA sequence
tttgttacttgggtgggctg

SEQ ID NO: 252998 - DNA, 20 bp, Artificial
  CRISPR gRNA sequence
ttacttgggtgggctggagt

SEQ ID NO: 252999 - DNA, 20 bp, Artificial
  CRISPR gRNA sequence
atgctcattcaacgtgttct

SEQ ID NO: 253000 - DNA, 20 bp, Artificial
  CRISPR gRNA sequence
gctcattcaacgtgttctca

SEQ ID NO: 253001 - DNA, 20 bp, Artificial
  CRISPR gRNA sequence
attcaacgtgttctcagagt

SEQ ID NO: 253002 - DNA, 20 bp, Artificial
  CRISPR gRNA sequence
cgtgttctcagagttagaaa

SEQ ID NO: 253003 - DNA, 20 bp, Artificial
  CRISPR gRNA sequence
gtgttctcagagttagaaaa

SEQ ID NO: 253004 - DNA, 20 bp, Artificial
  CRISPR gRNA sequence
gttagaaaaaggcccccgct

SEQ ID NO: 253005 - DNA, 20 bp, Artificial
  CRISPR gRNA sequence
cccccgcttggttcaaaaac

SEQ ID NO: 253006 - DNA, 20 bp, Artificial
  CRISPR gRNA sequence
tggttcaaaaactggactga

SEQ ID NO: 253007 - DNA, 20 bp, Artificial
  CRISPR gRNA sequence
ggttcaaaaactggactgat

SEQ ID NO: 253008 - DNA, 20 bp, Artificial
  CRISPR gRNA sequence
gttcaaaaactggactgata

SEQ ID NO: 253009 - DNA, 20 bp, Artificial
  CRISPR gRNA sequence
ttcaaaaactggactgatag

SEQ ID NO: 253010 - DNA, 20 bp, Artificial
  CRISPR gRNA sequence
actggactgataggggtcaa

SEQ ID NO: 253011 - DNA, 20 bp, Artificial
  CRISPR gRNA sequence
gtcaacagtcatgcttaaat

SEQ ID NO: 253012 - DNA, 20 bp, Artificial
  CRISPR gRNA sequence
tcaacagtcatgcttaaata

SEQ ID NO: 253013 - DNA, 20 bp, Artificial
  CRISPR gRNA sequence
cagtcatgcttaaataagga

SEQ ID NO: 253014 - DNA, 20 bp, Artificial
  CRISPR gRNA sequence
ggacagttatttttccctga

SEQ ID NO: 253015 - DNA, 20 bp, Artificial
  CRISPR gRNA sequence
tccctgaaagatacattgaa

SEQ ID NO: 253016 - DNA, 20 bp, Artificial
  CRISPR gRNA sequence
tgaaagatacattgaaaagc

SEQ ID NO: 253017 - DNA, 20 bp, Artificial
  CRISPR gRNA sequence
ctcaattttctttcttattt

SEQ ID NO: 253018 - DNA, 20 bp, Artificial
  CRISPR gRNA sequence
aattttctttcttattttgg

SEQ ID NO: 253019 - DNA, 20 bp, Artificial
  CRISPR gRNA sequence
tctttcttattttggcagta

SEQ ID NO: 253020 - DNA, 20 bp, Artificial
  CRISPR gRNA sequence
tttcttattttggcagtaca

SEQ ID NO: 253021 - DNA, 20 bp, Artificial
  CRISPR gRNA sequence
tgttgttattcttaaacatt

SEQ ID NO: 253022 - DNA, 20 bp, Artificial
  CRISPR gRNA sequence
tcttaaacattaagtgtaca

SEQ ID NO: 253023 - DNA, 20 bp, Artificial
  CRISPR gRNA sequence
cattaagtgtacatagccca

SEQ ID NO: 253024 - DNA, 20 bp, Artificial
  CRISPR gRNA sequence
ttaagtgtacatagcccaaa

SEQ ID NO: 253025 - DNA, 20 bp, Artificial
  CRISPR gRNA sequence
gagtataatttcccaatctg

SEQ ID NO: 253026 - DNA, 20 bp, Artificial
  CRISPR gRNA sequence
gtataatttcccaatctgca

SEQ ID NO: 253027 - DNA, 20 bp, Artificial
  CRISPR gRNA sequence
tataatttcccaatctgcag

SEQ ID NO: 253028 - DNA, 20 bp, Artificial
  CRISPR gRNA sequence
tttcccaatctgcagaggta

SEQ ID NO: 253029 - DNA, 20 bp, Artificial
  CRISPR gRNA sequence
cccaatctgcagaggtacag

SEQ ID NO: 253030 - DNA, 20 bp, Artificial
  CRISPR gRNA sequence
atatatacccgtttatttta

SEQ ID NO: 253031 - DNA, 20 bp, Artificial
  CRISPR gRNA sequence
tattttatggtctgacgtac

SEQ ID NO: 253032 - DNA, 20 bp, Artificial
  CRISPR gRNA sequence
ttatggtctgacgtaccagt

SEQ ID NO: 253033 - DNA, 20 bp, Artificial
  CRISPR gRNA sequence
aaaacgtgttgatataatga

SEQ ID NO: 253034 - DNA, 20 bp, Artificial
  CRISPR gRNA sequence
gttgatataatgaaagacat

SEQ ID NO: 253035 - DNA, 20 bp, Artificial
  CRISPR gRNA sequence
atataatgaaagacatgagt

SEQ ID NO: 253036 - DNA, 20 bp, Artificial
  CRISPR gRNA sequence
gaaagacatgagttggcaat

SEQ ID NO: 253037 - DNA, 20 bp, Artificial
  CRISPR gRNA sequence
catgagttggcaatgagatc

SEQ ID NO: 253038 - DNA, 20 bp, Artificial
  CRISPR gRNA sequence
tggcaatgagatctggtacc

SEQ ID NO: 253039 - DNA, 20 bp, Artificial
  CRISPR gRNA sequence
gatctggtaccaagcgttta

SEQ ID NO: 253040 - DNA, 20 bp, Artificial
  CRISPR gRNA sequence
agctaccaaatatattctac

SEQ ID NO: 253041 - DNA, 20 bp, Artificial
  CRISPR gRNA sequence
tctttaacatttattttaaa

SEQ ID NO: 253042 - DNA, 20 bp, Artificial
  CRISPR gRNA sequence
ctttaacatttattttaaaa

SEQ ID NO: 253043 - DNA, 20 bp, Artificial
  CRISPR gRNA sequence
aaaggtcaaaccttattttt

SEQ ID NO: 253044 - DNA, 20 bp, Artificial
  CRISPR gRNA sequence
aggtcaaaccttatttttaa

SEQ ID NO: 253045 - DNA, 20 bp, Artificial
  CRISPR gRNA sequence
taagagatctctcaaactta

SEQ ID NO: 253046 - DNA, 20 bp, Artificial
  CRISPR gRNA sequence
tttaaaattacttaatttgt

SEQ ID NO: 253047 - DNA, 20 bp, Artificial
  CRISPR gRNA sequence
aaattacttaatttgttaga

SEQ ID NO: 253048 - DNA, 20 bp, Artificial
  CRISPR gRNA sequence
acttaatttgttagacagtc

SEQ ID NO: 253049 - DNA, 20 bp, Artificial
  CRISPR gRNA sequence
cttaatttgttagacagtca

SEQ ID NO: 253050 - DNA, 20 bp, Artificial
  CRISPR gRNA sequence
ttaatttgttagacagtcaa

SEQ ID NO: 253051 - DNA, 20 bp, Artificial
  CRISPR gRNA sequence
atttgttagacagtcaaggg

SEQ ID NO: 253052 - DNA, 20 bp, Artificial
  CRISPR gRNA sequence
gactgaaaactatttaaaat

SEQ ID NO: 253053 - DNA, 20 bp, Artificial
  CRISPR gRNA sequence
tacttttctgatgtgctttg

SEQ ID NO: 253054 - DNA, 20 bp, Artificial
  CRISPR gRNA sequence
aacttattcactctcttttg

SEQ ID NO: 253055 - DNA, 20 bp, Artificial
  CRISPR gRNA sequence
cttattcactctcttttgaa

SEQ ID NO: 253056 - DNA, 20 bp, Artificial
  CRISPR gRNA sequence
actctcttttgaagagtttt

SEQ ID NO: 253057 - DNA, 20 bp, Artificial
  CRISPR gRNA sequence
tcttttgaagagtttttggt

SEQ ID NO: 253058 - DNA, 20 bp, Artificial
  CRISPR gRNA sequence
aaaactttgtatgttttctt

SEQ ID NO: 253059 - DNA, 20 bp, Artificial
  CRISPR gRNA sequence
ttctttagaacatttattaa

SEQ ID NO: 253060 - DNA, 20 bp, Artificial
  CRISPR gRNA sequence
tctttagaacatttattaaa

SEQ ID NO: 253061 - DNA, 20 bp, Artificial
  CRISPR gRNA sequence
ctttagaacatttattaaaa

SEQ ID NO: 253062 - DNA, 20 bp, Artificial
  CRISPR gRNA sequence
tttagaacatttattaaaag

SEQ ID NO: 253063 - DNA, 20 bp, Artificial
  CRISPR gRNA sequence
aacatttattaaaaggggac

SEQ ID NO: 253064 - DNA, 20 bp, Artificial
  CRISPR gRNA sequence
tttattaaaaggggactagc

SEQ ID NO: 253065 - DNA, 20 bp, Artificial
  CRISPR gRNA sequence
taaaaggggactagctagat

SEQ ID NO: 253066 - DNA, 20 bp, Artificial
  CRISPR gRNA sequence
aaggggactagctagataag

SEQ ID NO: 253067 - DNA, 20 bp, Artificial
  CRISPR gRNA sequence
ggactagctagataagtggt

SEQ ID NO: 253068 - DNA, 20 bp, Artificial
  CRISPR gRNA sequence
actagctagataagtggttg

SEQ ID NO: 253069 - DNA, 20 bp, Artificial
  CRISPR gRNA sequence
tagctagataagtggttgga

SEQ ID NO: 253070 - DNA, 20 bp, Artificial
  CRISPR gRNA sequence
ggttggagagttcacacaca

SEQ ID NO: 253071 - DNA, 20 bp, Artificial
  CRISPR gRNA sequence
gttggagagttcacacacat

SEQ ID NO: 253072 - DNA, 20 bp, Artificial
  CRISPR gRNA sequence
ttggagagttcacacacata

SEQ ID NO: 253073 - DNA, 20 bp, Artificial
  CRISPR gRNA sequence
caaatgccaattcacttttc

SEQ ID NO: 253074 - DNA, 20 bp, Artificial
  CRISPR gRNA sequence
ttcacttttctagtaacttt

SEQ ID NO: 253075 - DNA, 20 bp, Artificial
  CRISPR gRNA sequence
aacttttagcatttgatact

SEQ ID NO: 253076 - DNA, 20 bp, Artificial
  CRISPR gRNA sequence
ttttagcatttgatactgag

SEQ ID NO: 253077 - DNA, 20 bp, Artificial
  CRISPR gRNA sequence
tactgagtggctatctaatg

SEQ ID NO: 253078 - DNA, 20 bp, Artificial
  CRISPR gRNA sequence
tgagtggctatctaatgaag

SEQ ID NO: 253079 - DNA, 20 bp, Artificial
  CRISPR gRNA sequence
gagtggctatctaatgaaga

SEQ ID NO: 253080 - DNA, 20 bp, Artificial
  CRISPR gRNA sequence
ggctatctaatgaagaagga

SEQ ID NO: 253081 - DNA, 20 bp, Artificial
  CRISPR gRNA sequence
ctatctaatgaagaaggaaa

SEQ ID NO: 253082 - DNA, 20 bp, Artificial
  CRISPR gRNA sequence
ctaatgaagaaggaaagaga

SEQ ID NO: 253083 - DNA, 20 bp, Artificial
  CRISPR gRNA sequence
taatgaagaaggaaagagat

SEQ ID NO: 253084 - DNA, 20 bp, Artificial
  CRISPR gRNA sequence
atgaagaaggaaagagatgg

SEQ ID NO: 253085 - DNA, 20 bp, Artificial
  CRISPR gRNA sequence
gaaggaaagagatgggagtg

SEQ ID NO: 253086 - DNA, 20 bp, Artificial
  CRISPR gRNA sequence
aaggaaagagatgggagtga

SEQ ID NO: 253087 - DNA, 20 bp, Artificial
  CRISPR gRNA sequence
aggaaagagatgggagtgaa

SEQ ID NO: 253088 - DNA, 20 bp, Artificial
  CRISPR gRNA sequence
ggaaagagatgggagtgaag

SEQ ID NO: 253089 - DNA, 20 bp, Artificial
  CRISPR gRNA sequence
gagtgaaggggacactttta

SEQ ID NO: 253090 - DNA, 20 bp, Artificial
  CRISPR gRNA sequence
gacacttttacagtcttttc

SEQ ID NO: 253091 - DNA, 20 bp, Artificial
  CRISPR gRNA sequence
cttttacagtcttttccagt

SEQ ID NO: 253092 - DNA, 20 bp, Artificial
  CRISPR gRNA sequence
tttccagtaagaaaacttac

SEQ ID NO: 253093 - DNA, 20 bp, Artificial
  CRISPR gRNA sequence
cagtaagaaaacttacgagc

SEQ ID NO: 253094 - DNA, 20 bp, Artificial
  CRISPR gRNA sequence
agaaaacttacgagcaagaa

SEQ ID NO: 253095 - DNA, 20 bp, Artificial
  CRISPR gRNA sequence
cacataaaaaatgtatgatt

SEQ ID NO: 253096 - DNA, 20 bp, Artificial
  CRISPR gRNA sequence
aaaaaatgtatgatttggcc

SEQ ID NO: 253097 - DNA, 20 bp, Artificial
  CRISPR gRNA sequence
atgtatgatttggcctggtg

SEQ ID NO: 253098 - DNA, 20 bp, Artificial
  CRISPR gRNA sequence
tatgatttggcctggtgtgg

SEQ ID NO: 253099 - DNA, 20 bp, Artificial
  CRISPR gRNA sequence
gtggctcacgcctgtaatcg

SEQ ID NO: 253100 - DNA, 20 bp, Artificial
  CRISPR gRNA sequence
tggctcacgcctgtaatcgt

SEQ ID NO: 253101 - DNA, 20 bp, Artificial
  CRISPR gRNA sequence
gcctgtaatcgtgggacgct

SEQ ID NO: 253102 - DNA, 20 bp, Artificial
  CRISPR gRNA sequence
cctgtaatcgtgggacgctg

SEQ ID NO: 253103 - DNA, 20 bp, Artificial
  CRISPR gRNA sequence
gtaatcgtgggacgctgagg

SEQ ID NO: 253104 - DNA, 20 bp, Artificial
  CRISPR gRNA sequence
taatcgtgggacgctgaggc

SEQ ID NO: 253105 - DNA, 20 bp, Artificial
  CRISPR gRNA sequence
tcgtgggacgctgaggcggg

SEQ ID NO: 253106 - DNA, 20 bp, Artificial
  CRISPR gRNA sequence
ctgaggcgggtggatcactt

SEQ ID NO: 253107 - DNA, 20 bp, Artificial
  CRISPR gRNA sequence
tgaggcgggtggatcacttg

SEQ ID NO: 253108 - DNA, 20 bp, Artificial
  CRISPR gRNA sequence
gcgggtggatcacttgaggt

SEQ ID NO: 253109 - DNA, 20 bp, Artificial
  CRISPR gRNA sequence
cgggtggatcacttgaggtc

SEQ ID NO: 253110 - DNA, 20 bp, Artificial
  CRISPR gRNA sequence
ggtggatcacttgaggtcag

SEQ ID NO: 253111 - DNA, 20 bp, Artificial
  CRISPR gRNA sequence
gatcacttgaggtcaggagt

SEQ ID NO: 253112 - DNA, 20 bp, Artificial
  CRISPR gRNA sequence
tcacttgaggtcaggagttg

SEQ ID NO: 253113 - DNA, 20 bp, Artificial
  CRISPR gRNA sequence
gtcaggagttggagacccgt

SEQ ID NO: 253114 - DNA, 20 bp, Artificial
  CRISPR gRNA sequence
tcaggagttggagacccgtc

SEQ ID NO: 253115 - DNA, 20 bp, Artificial
  CRISPR gRNA sequence
ggagacccgtcgggctaaca

SEQ ID NO: 253116 - DNA, 20 bp, Artificial
  CRISPR gRNA sequence
tactaaaaatacaaaaaaat

SEQ ID NO: 253117 - DNA, 20 bp, Artificial
  CRISPR gRNA sequence
taaaaatacaaaaaaattag

SEQ ID NO: 253118 - DNA, 20 bp, Artificial
  CRISPR gRNA sequence
aaaaatacaaaaaaattagc

SEQ ID NO: 253119 - DNA, 20 bp, Artificial
  CRISPR gRNA sequence
aaaatacaaaaaaattagca

SEQ ID NO: 253120 - DNA, 20 bp, Artificial
  CRISPR gRNA sequence
acaaaaaaattagcagggtg

SEQ ID NO: 253121 - DNA, 20 bp, Artificial
  CRISPR gRNA sequence
aaaaaattagcagggtgtgg

SEQ ID NO: 253122 - DNA, 20 bp, Artificial
  CRISPR gRNA sequence
gtggcatgcgcctgtaatcc

SEQ ID NO: 253123 - DNA, 20 bp, Artificial
  CRISPR gRNA sequence
ctgtaatcccagctacttgt

SEQ ID NO: 253124 - DNA, 20 bp, Artificial
  CRISPR gRNA sequence
tgtaatcccagctacttgtg

SEQ ID NO: 253125 - DNA, 20 bp, Artificial
  CRISPR gRNA sequence
tcccagctacttgtgaggct

SEQ ID NO: 253126 - DNA, 20 bp, Artificial
  CRISPR gRNA sequence
cccagctacttgtgaggctt

SEQ ID NO: 253127 - DNA, 20 bp, Artificial
  CRISPR gRNA sequence
agctacttgtgaggcttagg

SEQ ID NO: 253128 - DNA, 20 bp, Artificial
  CRISPR gRNA sequence
gctacttgtgaggcttaggc

SEQ ID NO: 253129 - DNA, 20 bp, Artificial
  CRISPR gRNA sequence
tacttgtgaggcttaggcag

SEQ ID NO: 253130 - DNA, 20 bp, Artificial
  CRISPR gRNA sequence
gcaggagaattgcttaaacc

SEQ ID NO: 253131 - DNA, 20 bp, Artificial
  CRISPR gRNA sequence
caggagaattgcttaaaccc

SEQ ID NO: 253132 - DNA, 20 bp, Artificial
  CRISPR gRNA sequence
aattgcttaaacccgggacg

SEQ ID NO: 253133 - DNA, 20 bp, Artificial
  CRISPR gRNA sequence
ttgcttaaacccgggacgcg

SEQ ID NO: 253134 - DNA, 20 bp, Artificial
  CRISPR gRNA sequence
tgcttaaacccgggacgcgg

SEQ ID NO: 253135 - DNA, 20 bp, Artificial
  CRISPR gRNA sequence
cgcggaggttgctgtgaact

SEQ ID NO: 253136 - DNA, 20 bp, Artificial
  CRISPR gRNA sequence
tagattgcacccctgcactc

SEQ ID NO: 253137 - DNA, 20 bp, Artificial
  CRISPR gRNA sequence
tgcacccctgcactccagcc

SEQ ID NO: 253138 - DNA, 20 bp, Artificial
  CRISPR gRNA sequence
gcacccctgcactccagcct

SEQ ID NO: 253139 - DNA, 20 bp, Artificial
  CRISPR gRNA sequence
ctgcactccagcctgggaaa

SEQ ID NO: 253140 - DNA, 20 bp, Artificial
  CRISPR gRNA sequence
tatgctgcattctaatcaaa

SEQ ID NO: 253141 - DNA, 20 bp, Artificial
  CRISPR gRNA sequence
cattctaatcaaatagtgca

SEQ ID NO: 253142 - DNA, 20 bp, Artificial
  CRISPR gRNA sequence
ctctgtacacaccttccatt

SEQ ID NO: 253143 - DNA, 20 bp, Artificial
  CRISPR gRNA sequence
caccttccattaagaaatta

SEQ ID NO: 253144 - DNA, 20 bp, Artificial
  CRISPR gRNA sequence
ttccattaagaaattataga

SEQ ID NO: 253145 - DNA, 20 bp, Artificial
  CRISPR gRNA sequence
tccattaagaaattatagat

SEQ ID NO: 253146 - DNA, 20 bp, Artificial
  CRISPR gRNA sequence
ccattaagaaattatagata

SEQ ID NO: 253147 - DNA, 20 bp, Artificial
  CRISPR gRNA sequence
ttatagatagggaaattctc

SEQ ID NO: 253148 - DNA, 20 bp, Artificial
  CRISPR gRNA sequence
atagggaaattctctggtca

SEQ ID NO: 253149 - DNA, 20 bp, Artificial
  CRISPR gRNA sequence
caaagtgtaactgtccttcc

SEQ ID NO: 253150 - DNA, 20 bp, Artificial
  CRISPR gRNA sequence
aaagtgtaactgtccttcct

SEQ ID NO: 253151 - DNA, 20 bp, Artificial
  CRISPR gRNA sequence
taactgtccttcctaggtct

SEQ ID NO: 253152 - DNA, 20 bp, Artificial
  CRISPR gRNA sequence
accactgttatgcctgtgtt

SEQ ID NO: 253153 - DNA, 20 bp, Artificial
  CRISPR gRNA sequence
tgtgtgtatgtatgtatatg

SEQ ID NO: 253154 - DNA, 20 bp, Artificial
  CRISPR gRNA sequence
gtatgtatgtatatgaagaa

SEQ ID NO: 253155 - DNA, 20 bp, Artificial
  CRISPR gRNA sequence
tgtgtgtatgtatgtatatg

SEQ ID NO: 253156 - DNA, 20 bp, Artificial
  CRISPR gRNA sequence
gtatgtatgtatatgaagaa

SEQ ID NO: 253157 - DNA, 20 bp, Artificial
  CRISPR gRNA sequence
taatgtaacttatttgttta

SEQ ID NO: 253158 - DNA, 20 bp, Artificial
  CRISPR gRNA sequence
taacttatttgtttacagca

SEQ ID NO: 253159 - DNA, 20 bp, Artificial
  CRISPR gRNA sequence
cttaaaatatttattctata

SEQ ID NO: 253160 - DNA, 20 bp, Artificial
  CRISPR gRNA sequence
ttaaaatatttattctataa

SEQ ID NO: 253161 - DNA, 20 bp, Artificial
  CRISPR gRNA sequence
atatttattctataaaggtt

SEQ ID NO: 253162 - DNA, 20 bp, Artificial
  CRISPR gRNA sequence
agtctaacctgattccttat

SEQ ID NO: 253163 - DNA, 20 bp, Artificial
  CRISPR gRNA sequence
taacctgattccttatgagt

SEQ ID NO: 253164 - DNA, 20 bp, Artificial
  CRISPR gRNA sequence
attccttatgagttggatga

SEQ ID NO: 253165 - DNA, 20 bp, Artificial
  CRISPR gRNA sequence
ttatgagttggatgacagtg

SEQ ID NO: 253166 - DNA, 20 bp, Artificial
  CRISPR gRNA sequence
atgagttggatgacagtgta

SEQ ID NO: 253167 - DNA, 20 bp, Artificial
  CRISPR gRNA sequence
gagttggatgacagtgtaga

SEQ ID NO: 253168 - DNA, 20 bp, Artificial
  CRISPR gRNA sequence
acagtgtagagagatattta

SEQ ID NO: 253169 - DNA, 20 bp, Artificial
  CRISPR gRNA sequence
gtagagagatatttatggct

SEQ ID NO: 253170 - DNA, 20 bp, Artificial
  CRISPR gRNA sequence
agatatttatggctaagtta

SEQ ID NO: 253171 - DNA, 20 bp, Artificial
  CRISPR gRNA sequence
tatttatggctaagttaaag

SEQ ID NO: 253172 - DNA, 20 bp, Artificial
  CRISPR gRNA sequence
taagttaaagaagtgtgatt

SEQ ID NO: 253173 - DNA, 20 bp, Artificial
  CRISPR gRNA sequence
aagttaaagaagtgtgattt

SEQ ID NO: 253174 - DNA, 20 bp, Artificial
  CRISPR gRNA sequence
ttaaagaagtgtgatttagg

SEQ ID NO: 253175 - DNA, 20 bp, Artificial
  CRISPR gRNA sequence
aaagaagtgtgatttaggaa

SEQ ID NO: 253176 - DNA, 20 bp, Artificial
  CRISPR gRNA sequence
aagtgtgatttaggaagagt

SEQ ID NO: 253177 - DNA, 20 bp, Artificial
  CRISPR gRNA sequence
agtgtgatttaggaagagtg

SEQ ID NO: 253178 - DNA, 20 bp, Artificial
  CRISPR gRNA sequence
agagtgaggaaaccttaact

SEQ ID NO: 253179 - DNA, 20 bp, Artificial
  CRISPR gRNA sequence
gaggaaaccttaacttagat

SEQ ID NO: 253180 - DNA, 20 bp, Artificial
  CRISPR gRNA sequence
gccctttgcatgttttctac

SEQ ID NO: 253181 - DNA, 20 bp, Artificial
  CRISPR gRNA sequence
tgcatgttttctactagact

SEQ ID NO: 253182 - DNA, 20 bp, Artificial
  CRISPR gRNA sequence
actcggataattgtgcaact

SEQ ID NO: 253183 - DNA, 20 bp, Artificial
  CRISPR gRNA sequence
aattgtgcaactgagatcca

SEQ ID NO: 253184 - DNA, 20 bp, Artificial
  CRISPR gRNA sequence
ttgtgcaactgagatccaca

SEQ ID NO: 253185 - DNA, 20 bp, Artificial
  CRISPR gRNA sequence
gtgcaactgagatccacaga

SEQ ID NO: 253186 - DNA, 20 bp, Artificial
  CRISPR gRNA sequence
atccacagagagtattttgc

SEQ ID NO: 253187 - DNA, 20 bp, Artificial
  CRISPR gRNA sequence
gagagtattttgctggactt

SEQ ID NO: 253188 - DNA, 20 bp, Artificial
  CRISPR gRNA sequence
agagtattttgctggacttt

SEQ ID NO: 253189 - DNA, 20 bp, Artificial
  CRISPR gRNA sequence
tattttgctggactttggga

SEQ ID NO: 253190 - DNA, 20 bp, Artificial
  CRISPR gRNA sequence
attttgctggactttgggat

SEQ ID NO: 253191 - DNA, 20 bp, Artificial
  CRISPR gRNA sequence
tttgctggactttgggatag

SEQ ID NO: 253192 - DNA, 20 bp, Artificial
  CRISPR gRNA sequence
tggactttgggataggagtc

SEQ ID NO: 253193 - DNA, 20 bp, Artificial
  CRISPR gRNA sequence
tttgggataggagtccagcc

SEQ ID NO: 253194 - DNA, 20 bp, Artificial
  CRISPR gRNA sequence
aggagtccagcccagaacta

SEQ ID NO: 253195 - DNA, 20 bp, Artificial
  CRISPR gRNA sequence
gagtccagcccagaactaca

SEQ ID NO: 253196 - DNA, 20 bp, Artificial
  CRISPR gRNA sequence
gcccagaactacagagcctt

SEQ ID NO: 253197 - DNA, 20 bp, Artificial
  CRISPR gRNA sequence
ccagaactacagagccttaa

SEQ ID NO: 253198 - DNA, 20 bp, Artificial
  CRISPR gRNA sequence
cagaactacagagccttaag

SEQ ID NO: 253199 - DNA, 20 bp, Artificial
  CRISPR gRNA sequence
agaactacagagccttaaga

SEQ ID NO: 253200 - DNA, 20 bp, Artificial
  CRISPR gRNA sequence
gccttaagagggaaatgctc

SEQ ID NO: 253201 - DNA, 20 bp, Artificial
  CRISPR gRNA sequence
ccttaagagggaaatgctct

SEQ ID NO: 253202 - DNA, 20 bp, Artificial
  CRISPR gRNA sequence
aaatgctctgggattgatga

SEQ ID NO: 253203 - DNA, 20 bp, Artificial
  CRISPR gRNA sequence
tgctctgggattgatgatag

SEQ ID NO: 253204 - DNA, 20 bp, Artificial
  CRISPR gRNA sequence
gctctgggattgatgataga

SEQ ID NO: 253205 - DNA, 20 bp, Artificial
  CRISPR gRNA sequence
tgggattgatgatagaagga

SEQ ID NO: 253206 - DNA, 20 bp, Artificial
  CRISPR gRNA sequence
atgcacaaaatacttgacat

SEQ ID NO: 253207 - DNA, 20 bp, Artificial
  CRISPR gRNA sequence
ttgacattggtcacatgttt

SEQ ID NO: 253208 - DNA, 20 bp, Artificial
  CRISPR gRNA sequence
tgacattggtcacatgtttc

SEQ ID NO: 253209 - DNA, 20 bp, Artificial
  CRISPR gRNA sequence
aggccatatttgctattttt

SEQ ID NO: 253210 - DNA, 20 bp, Artificial
  CRISPR gRNA sequence
catatttgctattttttagc

SEQ ID NO: 253211 - DNA, 20 bp, Artificial
  CRISPR gRNA sequence
ttttagcaagcctaatcatc

SEQ ID NO: 253212 - DNA, 20 bp, Artificial
  CRISPR gRNA sequence
aagcctaatcatccagtgtg

SEQ ID NO: 253213 - DNA, 20 bp, Artificial
  CRISPR gRNA sequence
gcctaatcatccagtgtgaa

SEQ ID NO: 253214 - DNA, 20 bp, Artificial
  CRISPR gRNA sequence
tccagtgtgaagagaaaaat

SEQ ID NO: 253215 - DNA, 20 bp, Artificial
  CRISPR gRNA sequence
attaccacttatttttccat

SEQ ID NO: 253216 - DNA, 20 bp, Artificial
  CRISPR gRNA sequence
cttttcacttctccaaaact

SEQ ID NO: 253217 - DNA, 20 bp, Artificial
  CRISPR gRNA sequence
ttttcacttctccaaaactt

SEQ ID NO: 253218 - DNA, 20 bp, Artificial
  CRISPR gRNA sequence
tgggcaaaaaactgtcaaaa

SEQ ID NO: 253219 - DNA, 20 bp, Artificial
  CRISPR gRNA sequence
caaaaaactgtcaaaatggc

SEQ ID NO: 253220 - DNA, 20 bp, Artificial
  CRISPR gRNA sequence
aactgtcaaaatggccagtt

SEQ ID NO: 253221 - DNA, 20 bp, Artificial
  CRISPR gRNA sequence
caaaatggccagtttggaca

SEQ ID NO: 253222 - DNA, 20 bp, Artificial
  CRISPR gRNA sequence
ttggacaaagctaatttctc

SEQ ID NO: 253223 - DNA, 20 bp, Artificial
  CRISPR gRNA sequence
atttctccagcgccttccct

SEQ ID NO: 253224 - DNA, 20 bp, Artificial
  CRISPR gRNA sequence
cccttagcgcttatttttct

SEQ ID NO: 253225 - DNA, 20 bp, Artificial
  CRISPR gRNA sequence
cttagcgcttatttttctga

SEQ ID NO: 253226 - DNA, 20 bp, Artificial
  CRISPR gRNA sequence
tagcgcttatttttctgaga

SEQ ID NO: 253227 - DNA, 20 bp, Artificial
  CRISPR gRNA sequence
agcgcttatttttctgagag

SEQ ID NO: 253228 - DNA, 20 bp, Artificial
  CRISPR gRNA sequence
ttatttttctgagagaggca

SEQ ID NO: 253229 - DNA, 20 bp, Artificial
  CRISPR gRNA sequence
ttttctgagagaggcatgga

SEQ ID NO: 253230 - DNA, 20 bp, Artificial
  CRISPR gRNA sequence
tctgagagaggcatggaaag

SEQ ID NO: 253231 - DNA, 20 bp, Artificial
  CRISPR gRNA sequence
ctgagagaggcatggaaagc

SEQ ID NO: 253232 - DNA, 20 bp, Artificial
  CRISPR gRNA sequence
aataactgacatttaataaa

SEQ ID NO: 253233 - DNA, 20 bp, Artificial
  CRISPR gRNA sequence
gacatttaataaaaagtcat

SEQ ID NO: 253234 - DNA, 20 bp, Artificial
  CRISPR gRNA sequence
ttaataaaaagtcatcagca

SEQ ID NO: 253235 - DNA, 20 bp, Artificial
  CRISPR gRNA sequence
taaaaattttatttgtactc

SEQ ID NO: 253236 - DNA, 20 bp, Artificial
  CRISPR gRNA sequence
tttatttgtactctagtctt

SEQ ID NO: 253237 - DNA, 20 bp, Artificial
  CRISPR gRNA sequence
cttcagccaatgactcccct

SEQ ID NO: 253238 - DNA, 20 bp, Artificial
  CRISPR gRNA sequence
agccaatgactcccctgagc

SEQ ID NO: 253239 - DNA, 20 bp, Artificial
  CRISPR gRNA sequence
tcccctgagctggttgtata

SEQ ID NO: 253240 - DNA, 20 bp, Artificial
  CRISPR gRNA sequence
ctgagctggttgtatacgga

SEQ ID NO: 253241 - DNA, 20 bp, Artificial
  CRISPR gRNA sequence
agctggttgtatacggaaag

SEQ ID NO: 253242 - DNA, 20 bp, Artificial
  CRISPR gRNA sequence
aagaagtaatttgtttctca

SEQ ID NO: 253243 - DNA, 20 bp, Artificial
  CRISPR gRNA sequence
gtaatttgtttctcacagtt

SEQ ID NO: 253244 - DNA, 20 bp, Artificial
  CRISPR gRNA sequence
tcacagttaagtgttgctct

SEQ ID NO: 253245 - DNA, 20 bp, Artificial
  CRISPR gRNA sequence
gttaagtgttgctctgagac

SEQ ID NO: 253246 - DNA, 20 bp, Artificial
  CRISPR gRNA sequence
ttaagtgttgctctgagact

SEQ ID NO: 253247 - DNA, 20 bp, Artificial
  CRISPR gRNA sequence
tgttgctctgagactgggct

SEQ ID NO: 253248 - DNA, 20 bp, Artificial
  CRISPR gRNA sequence
gttgctctgagactgggctt

SEQ ID NO: 253249 - DNA, 20 bp, Artificial
  CRISPR gRNA sequence
ctctgagactgggcttggga

SEQ ID NO: 253250 - DNA, 20 bp, Artificial
  CRISPR gRNA sequence
gagactgggcttgggaaagt

SEQ ID NO: 253251 - DNA, 20 bp, Artificial
  CRISPR gRNA sequence
agactgggcttgggaaagta

SEQ ID NO: 253252 - DNA, 20 bp, Artificial
  CRISPR gRNA sequence
gcttgggaaagtaaggtgaa

SEQ ID NO: 253253 - DNA, 20 bp, Artificial
  CRISPR gRNA sequence
gatgaatgtcaaaaaatcaa

SEQ ID NO: 253254 - DNA, 20 bp, Artificial
  CRISPR gRNA sequence
acatgacttccaatatgctg

SEQ ID NO: 253255 - DNA, 20 bp, Artificial
  CRISPR gRNA sequence
gacttccaatatgctgtggc

SEQ ID NO: 253256 - DNA, 20 bp, Artificial
  CRISPR gRNA sequence
gtggccagtttttctgttaa

SEQ ID NO: 253257 - DNA, 20 bp, Artificial
  CRISPR gRNA sequence
ttctgttaaaagaaattgac

SEQ ID NO: 253258 - DNA, 20 bp, Artificial
  CRISPR gRNA sequence
ctggatgtttttgtcatttc

SEQ ID NO: 253259 - DNA, 20 bp, Artificial
  CRISPR gRNA sequence
gtcatttcaagtaaatttga

SEQ ID NO: 253260 - DNA, 20 bp, Artificial
  CRISPR gRNA sequence
aaatttgatggatatttcaa

SEQ ID NO: 253261 - DNA, 20 bp, Artificial
  CRISPR gRNA sequence
tgatggatatttcaaaagta

SEQ ID NO: 253262 - DNA, 20 bp, Artificial
  CRISPR gRNA sequence
gatggatatttcaaaagtat

SEQ ID NO: 253263 - DNA, 20 bp, Artificial
  CRISPR gRNA sequence
caaaagtataggcattgctt

SEQ ID NO: 253264 - DNA, 20 bp, Artificial
  CRISPR gRNA sequence
aaaagtataggcattgctta

SEQ ID NO: 253265 - DNA, 20 bp, Artificial
  CRISPR gRNA sequence
tttactctactaccgtgccc

SEQ ID NO: 253266 - DNA, 20 bp, Artificial
  CRISPR gRNA sequence
gttaacacattgtgtttttt

SEQ ID NO: 253267 - DNA, 20 bp, Artificial
  CRISPR gRNA sequence
ttaacacattgtgtttttta

SEQ ID NO: 253268 - DNA, 20 bp, Artificial
  CRISPR gRNA sequence
tgttttttaaggcaaccatc

SEQ ID NO: 253269 - DNA, 20 bp, Artificial
  CRISPR gRNA sequence
ttttaaggcaaccatccagc

SEQ ID NO: 253270 - DNA, 20 bp, Artificial
  CRISPR gRNA sequence
tttaaggcaaccatccagca

SEQ ID NO: 253271 - DNA, 20 bp, Artificial
  CRISPR gRNA sequence
ccatccagcaaggacgttta

SEQ ID NO: 253272 - DNA, 20 bp, Artificial
  CRISPR gRNA sequence
ccagcaaggacgtttacagc

SEQ ID NO: 253273 - DNA, 20 bp, Artificial
  CRISPR gRNA sequence
cagcaaggacgtttacagca

SEQ ID NO: 253274 - DNA, 20 bp, Artificial
  CRISPR gRNA sequence
taatatcaatatatcaatac

SEQ ID NO: 253275 - DNA, 20 bp, Artificial
  CRISPR gRNA sequence
aatatcaatatatcaatacc

SEQ ID NO: 253276 - DNA, 20 bp, Artificial
  CRISPR gRNA sequence
aatatatcaataccaggaaa

SEQ ID NO: 253277 - DNA, 20 bp, Artificial
  CRISPR gRNA sequence
tcaataccaggaaatggaat

SEQ ID NO: 253278 - DNA, 20 bp, Artificial
  CRISPR gRNA sequence
aatggaatgagtcattgcca

SEQ ID NO: 253279 - DNA, 20 bp, Artificial
  CRISPR gRNA sequence
gaatgagtcattgccacaga

SEQ ID NO: 253280 - DNA, 20 bp, Artificial
  CRISPR gRNA sequence
agtcattgccacagatagat

SEQ ID NO: 253281 - DNA, 20 bp, Artificial
  CRISPR gRNA sequence
tgccacagatagattagaaa

SEQ ID NO: 253282 - DNA, 20 bp, Artificial
  CRISPR gRNA sequence
aatctgtgattgtaactcca

SEQ ID NO: 253283 - DNA, 20 bp, Artificial
  CRISPR gRNA sequence
tcacattcaaacttttacta

SEQ ID NO: 253284 - DNA, 20 bp, Artificial
  CRISPR gRNA sequence
cacattcaaacttttactat

SEQ ID NO: 253285 - DNA, 20 bp, Artificial
  CRISPR gRNA sequence
attcaaacttttactatggg

SEQ ID NO: 253286 - DNA, 20 bp, Artificial
  CRISPR gRNA sequence
ttcaaacttttactatgggt

SEQ ID NO: 253287 - DNA, 20 bp, Artificial
  CRISPR gRNA sequence
tcaaacttttactatgggtg

SEQ ID NO: 253288 - DNA, 20 bp, Artificial
  CRISPR gRNA sequence
aaacttttactatgggtggg

SEQ ID NO: 253289 - DNA, 20 bp, Artificial
  CRISPR gRNA sequence
acttttactatgggtgggga

SEQ ID NO: 253290 - DNA, 20 bp, Artificial
  CRISPR gRNA sequence
cttttactatgggtggggag

SEQ ID NO: 253291 - DNA, 20 bp, Artificial
  CRISPR gRNA sequence
ctcgctgcctccccttcttt

SEQ ID NO: 253292 - DNA, 20 bp, Artificial
  CRISPR gRNA sequence
gcctccccttctttaagaca

SEQ ID NO: 253293 - DNA, 20 bp, Artificial
  CRISPR gRNA sequence
aacgtcttatgccttttttc

SEQ ID NO: 253294 - DNA, 20 bp, Artificial
  CRISPR gRNA sequence
acgtcttatgccttttttca

SEQ ID NO: 253295 - DNA, 20 bp, Artificial
  CRISPR gRNA sequence
cgtcttatgccttttttcaa

SEQ ID NO: 253296 - DNA, 20 bp, Artificial
  CRISPR gRNA sequence
cttatgccttttttcaaggg

SEQ ID NO: 253297 - DNA, 20 bp, Artificial
  CRISPR gRNA sequence
tatgccttttttcaagggtg

SEQ ID NO: 253298 - DNA, 20 bp, Artificial
  CRISPR gRNA sequence
aatgccatatgattaccatt

SEQ ID NO: 253299 - DNA, 20 bp, Artificial
  CRISPR gRNA sequence
catttggcttttatcttgtg

SEQ ID NO: 253300 - DNA, 20 bp, Artificial
  CRISPR gRNA sequence
ttgtgtggatatcttcctcc

SEQ ID NO: 253301 - DNA, 20 bp, Artificial
  CRISPR gRNA sequence
ttcctccaagtatttcctgc

SEQ ID NO: 253302 - DNA, 20 bp, Artificial
  CRISPR gRNA sequence
ctccaagtatttcctgcaag

SEQ ID NO: 253303 - DNA, 20 bp, Artificial
  CRISPR gRNA sequence
cagtgtgctgacatttacaa

SEQ ID NO: 253304 - DNA, 20 bp, Artificial
  CRISPR gRNA sequence
agtgtgctgacatttacaaa

SEQ ID NO: 253305 - DNA, 20 bp, Artificial
  CRISPR gRNA sequence
tttttatgccaccaacatcc

SEQ ID NO: 253306 - DNA, 20 bp, Artificial
  CRISPR gRNA sequence
ttatgccaccaacatcccag

SEQ ID NO: 253307 - DNA, 20 bp, Artificial
  CRISPR gRNA sequence
tcccagaagaaaatttgttg

SEQ ID NO: 253308 - DNA, 20 bp, Artificial
  CRISPR gRNA sequence
gtttatcatctctaacacaa

SEQ ID NO: 253309 - DNA, 20 bp, Artificial
  CRISPR gRNA sequence
cacaaaagccctttattaac

SEQ ID NO: 253310 - DNA, 20 bp, Artificial
  CRISPR gRNA sequence
aagccctttattaactagtg

SEQ ID NO: 253311 - DNA, 20 bp, Artificial
  CRISPR gRNA sequence
agccctttattaactagtgt

SEQ ID NO: 253312 - DNA, 20 bp, Artificial
  CRISPR gRNA sequence
taactagtgtaggcattgat

SEQ ID NO: 253313 - DNA, 20 bp, Artificial
  CRISPR gRNA sequence
aactagtgtaggcattgatg

SEQ ID NO: 253314 - DNA, 20 bp, Artificial
  CRISPR gRNA sequence
tgaggatacgcaattcatgt

SEQ ID NO: 253315 - DNA, 20 bp, Artificial
  CRISPR gRNA sequence
tacgcaattcatgtcagact

SEQ ID NO: 253316 - DNA, 20 bp, Artificial
  CRISPR gRNA sequence
agacttggttgtctaaaaat

SEQ ID NO: 253317 - DNA, 20 bp, Artificial
  CRISPR gRNA sequence
acttggttgtctaaaaatca

SEQ ID NO: 253318 - DNA, 20 bp, Artificial
  CRISPR gRNA sequence
cttggttgtctaaaaatcag

SEQ ID NO: 253319 - DNA, 20 bp, Artificial
  CRISPR gRNA sequence
gttgtctaaaaatcagagga

SEQ ID NO: 253320 - DNA, 20 bp, Artificial
  CRISPR gRNA sequence
agaggacggacactccttca

SEQ ID NO: 253321 - DNA, 20 bp, Artificial
  CRISPR gRNA sequence
ttcaaagcacaattgtttcc

SEQ ID NO: 253322 - DNA, 20 bp, Artificial
  CRISPR gRNA sequence
aaagcacaattgtttcccag

SEQ ID NO: 253323 - DNA, 20 bp, Artificial
  CRISPR gRNA sequence
aagcacaattgtttcccagc

SEQ ID NO: 253324 - DNA, 20 bp, Artificial
  CRISPR gRNA sequence
aattgtttcccagcaggtca

SEQ ID NO: 253325 - DNA, 20 bp, Artificial
  CRISPR gRNA sequence
gtttcccagcaggtcatggc

SEQ ID NO: 253326 - DNA, 20 bp, Artificial
  CRISPR gRNA sequence
tttcccagcaggtcatggca

SEQ ID NO: 253327 - DNA, 20 bp, Artificial
  CRISPR gRNA sequence
ttcccagcaggtcatggcaa

SEQ ID NO: 253328 - DNA, 20 bp, Artificial
  CRISPR gRNA sequence
cagcaggtcatggcaaggga

SEQ ID NO: 253329 - DNA, 20 bp, Artificial
  CRISPR gRNA sequence
tcttcttctctttctcatgt

SEQ ID NO: 253330 - DNA, 20 bp, Artificial
  CRISPR gRNA sequence
ttttgtttgcctttttcttc

SEQ ID NO: 253331 - DNA, 20 bp, Artificial
  CRISPR gRNA sequence
ttcaagaaatttattattta

SEQ ID NO: 253332 - DNA, 20 bp, Artificial
  CRISPR gRNA sequence
ttattatttatggaacttca

SEQ ID NO: 253333 - DNA, 20 bp, Artificial
  CRISPR gRNA sequence
attatttatggaacttcaca

SEQ ID NO: 253334 - DNA, 20 bp, Artificial
  CRISPR gRNA sequence
ttatttatggaacttcacag

SEQ ID NO: 253335 - DNA, 20 bp, Artificial
  CRISPR gRNA sequence
ttatggaacttcacagaggc

SEQ ID NO: 253336 - DNA, 20 bp, Artificial
  CRISPR gRNA sequence
gaggctggaacttttcttct

SEQ ID NO: 253337 - DNA, 20 bp, Artificial
  CRISPR gRNA sequence
gaacttttcttctcagtaca

SEQ ID NO: 253338 - DNA, 20 bp, Artificial
  CRISPR gRNA sequence
tttcttctcagtacatagtt

SEQ ID NO: 253339 - DNA, 20 bp, Artificial
  CRISPR gRNA sequence
tctcagtacatagttgagct

SEQ ID NO: 253340 - DNA, 20 bp, Artificial
  CRISPR gRNA sequence
acatagttgagctgagcatc

SEQ ID NO: 253341 - DNA, 20 bp, Artificial
  CRISPR gRNA sequence
gcatctggaaaaattacatc

SEQ ID NO: 253342 - DNA, 20 bp, Artificial
  CRISPR gRNA sequence
catctggaaaaattacatct

SEQ ID NO: 253343 - DNA, 20 bp, Artificial
  CRISPR gRNA sequence
ctggaaaaattacatctggg

SEQ ID NO: 253344 - DNA, 20 bp, Artificial
  CRISPR gRNA sequence
tggttttgtgactgactgaa

SEQ ID NO: 253345 - DNA, 20 bp, Artificial
  CRISPR gRNA sequence
tgactgactgaatggctctc

SEQ ID NO: 253346 - DNA, 20 bp, Artificial
  CRISPR gRNA sequence
gactgaatggctctctggtt

SEQ ID NO: 253347 - DNA, 20 bp, Artificial
  CRISPR gRNA sequence
ctctctggttaagctgtgtt

SEQ ID NO: 253348 - DNA, 20 bp, Artificial
  CRISPR gRNA sequence
agatatctgtgtctctttta

SEQ ID NO: 253349 - DNA, 20 bp, Artificial
  CRISPR gRNA sequence
ctcttttacggtgatttatt

SEQ ID NO: 253350 - DNA, 20 bp, Artificial
  CRISPR gRNA sequence
gtgatttatttggccgtttt

SEQ ID NO: 253351 - DNA, 20 bp, Artificial
  CRISPR gRNA sequence
tggccgtttttggccaatga

SEQ ID NO: 253352 - DNA, 20 bp, Artificial
  CRISPR gRNA sequence
ggccgtttttggccaatgac

SEQ ID NO: 253353 - DNA, 20 bp, Artificial
  CRISPR gRNA sequence
gccgtttttggccaatgaca

SEQ ID NO: 253354 - DNA, 20 bp, Artificial
  CRISPR gRNA sequence
tttggccaatgacagggtgt

SEQ ID NO: 253355 - DNA, 20 bp, Artificial
  CRISPR gRNA sequence
aacccaaaaccaaaaaaacc

SEQ ID NO: 253356 - DNA, 20 bp, Artificial
  CRISPR gRNA sequence
aaaaaccaagacaattcact

SEQ ID NO: 253357 - DNA, 20 bp, Artificial
  CRISPR gRNA sequence
aaaccaagacaattcactca

SEQ ID NO: 253358 - DNA, 20 bp, Artificial
  CRISPR gRNA sequence
gacaattcactcagagcttt

SEQ ID NO: 253359 - DNA, 20 bp, Artificial
  CRISPR gRNA sequence
agctttgagcctgataatta

SEQ ID NO: 253360 - DNA, 20 bp, Artificial
  CRISPR gRNA sequence
gagcctgataattatagcat

SEQ ID NO: 253361 - DNA, 20 bp, Artificial
  CRISPR gRNA sequence
gataattatagcatgagaat

SEQ ID NO: 253362 - DNA, 20 bp, Artificial
  CRISPR gRNA sequence
agcatgagaattggtgcctg

SEQ ID NO: 253363 - DNA, 20 bp, Artificial
  CRISPR gRNA sequence
tgagaattggtgcctgaagc

SEQ ID NO: 253364 - DNA, 20 bp, Artificial
  CRISPR gRNA sequence
gagaattggtgcctgaagct

SEQ ID NO: 253365 - DNA, 20 bp, Artificial
  CRISPR gRNA sequence
agaattggtgcctgaagctg

SEQ ID NO: 253366 - DNA, 20 bp, Artificial
  CRISPR gRNA sequence
gaattggtgcctgaagctgg

SEQ ID NO: 253367 - DNA, 20 bp, Artificial
  CRISPR gRNA sequence
aattggtgcctgaagctggg

SEQ ID NO: 253368 - DNA, 20 bp, Artificial
  CRISPR gRNA sequence
tggtgcctgaagctgggggg

SEQ ID NO: 253369 - DNA, 20 bp, Artificial
  CRISPR gRNA sequence
ggtgcctgaagctgggggga

SEQ ID NO: 253370 - DNA, 20 bp, Artificial
  CRISPR gRNA sequence
aagctggggggaaggtaacc

SEQ ID NO: 253371 - DNA, 20 bp, Artificial
  CRISPR gRNA sequence
agctggggggaaggtaaccc

SEQ ID NO: 253372 - DNA, 20 bp, Artificial
  CRISPR gRNA sequence
ggaaggtaacccaggcccca

SEQ ID NO: 253373 - DNA, 20 bp, Artificial
  CRISPR gRNA sequence
ggtaacccaggccccacaga

SEQ ID NO: 253374 - DNA, 20 bp, Artificial
  CRISPR gRNA sequence
gtaacccaggccccacagaa

SEQ ID NO: 253375 - DNA, 20 bp, Artificial
  CRISPR gRNA sequence
acccaggccccacagaaagg

SEQ ID NO: 253376 - DNA, 20 bp, Artificial
  CRISPR gRNA sequence
acagaaaggtggttgcatgc

SEQ ID NO: 253377 - DNA, 20 bp, Artificial
  CRISPR gRNA sequence
ttccttgttaatctcatttt

SEQ ID NO: 253378 - DNA, 20 bp, Artificial
  CRISPR gRNA sequence
tccttgttaatctcattttg

SEQ ID NO: 253379 - DNA, 20 bp, Artificial
  CRISPR gRNA sequence
attttgaggactccaaacac

SEQ ID NO: 253380 - DNA, 20 bp, Artificial
  CRISPR gRNA sequence
ttgaggactccaaacactag

SEQ ID NO: 253381 - DNA, 20 bp, Artificial
  CRISPR gRNA sequence
gaggactccaaacactagaa

SEQ ID NO: 253382 - DNA, 20 bp, Artificial
  CRISPR gRNA sequence
gactccaaacactagaagag

SEQ ID NO: 253383 - DNA, 20 bp, Artificial
  CRISPR gRNA sequence
acactagaagagaagtgcac

SEQ ID NO: 253384 - DNA, 20 bp, Artificial
  CRISPR gRNA sequence
tagaagagaagtgcactgga

SEQ ID NO: 253385 - DNA, 20 bp, Artificial
  CRISPR gRNA sequence
agaagagaagtgcactggat

SEQ ID NO: 253386 - DNA, 20 bp, Artificial
  CRISPR gRNA sequence
gaagtgcactggataggatc

SEQ ID NO: 253387 - DNA, 20 bp, Artificial
  CRISPR gRNA sequence
ggataggatcaagaactact

SEQ ID NO: 253388 - DNA, 20 bp, Artificial
  CRISPR gRNA sequence
tcaagaactactcagtcatt

SEQ ID NO: 253389 - DNA, 20 bp, Artificial
  CRISPR gRNA sequence
agaactactcagtcatttgg

SEQ ID NO: 253390 - DNA, 20 bp, Artificial
  CRISPR gRNA sequence
aactactcagtcatttggta

SEQ ID NO: 253391 - DNA, 20 bp, Artificial
  CRISPR gRNA sequence
actactcagtcatttggtag

SEQ ID NO: 253392 - DNA, 20 bp, Artificial
  CRISPR gRNA sequence
tcagtcatttggtagaggct

SEQ ID NO: 253393 - DNA, 20 bp, Artificial
  CRISPR gRNA sequence
tttggtagaggcttggaaaa

SEQ ID NO: 253394 - DNA, 20 bp, Artificial
  CRISPR gRNA sequence
tggtagaggcttggaaaaaa

SEQ ID NO: 253395 - DNA, 20 bp, Artificial
  CRISPR gRNA sequence
gaggcttggaaaaaagagtt

SEQ ID NO: 253396 - DNA, 20 bp, Artificial
  CRISPR gRNA sequence
ctatttcaatgttaatttca

SEQ ID NO: 253397 - DNA, 20 bp, Artificial
  CRISPR gRNA sequence
tatttcaatgttaatttcaa

SEQ ID NO: 253398 - DNA, 20 bp, Artificial
  CRISPR gRNA sequence
atttcaaaggcatgtttatt

SEQ ID NO: 253399 - DNA, 20 bp, Artificial
  CRISPR gRNA sequence
tttagtctcgtgtcaccatg

SEQ ID NO: 253400 - DNA, 20 bp, Artificial
  CRISPR gRNA sequence
ttagtctcgtgtcaccatgc

SEQ ID NO: 253401 - DNA, 20 bp, Artificial
  CRISPR gRNA sequence
tgtgcttctgttttcattgc

SEQ ID NO: 253402 - DNA, 20 bp, Artificial
  CRISPR gRNA sequence
gcttctgttttcattgctgg

SEQ ID NO: 253403 - DNA, 20 bp, Artificial
  CRISPR gRNA sequence
ttctgttttcattgctggaa

SEQ ID NO: 253404 - DNA, 20 bp, Artificial
  CRISPR gRNA sequence
attgctggaagagaacctgc

SEQ ID NO: 253405 - DNA, 20 bp, Artificial
  CRISPR gRNA sequence
ttgctggaagagaacctgca

SEQ ID NO: 253406 - DNA, 20 bp, Artificial
  CRISPR gRNA sequence
ctggaagagaacctgcaagg

SEQ ID NO: 253407 - DNA, 20 bp, Artificial
  CRISPR gRNA sequence
gaagagaacctgcaaggtgg

SEQ ID NO: 253408 - DNA, 20 bp, Artificial
  CRISPR gRNA sequence
agagaacctgcaaggtggtg

SEQ ID NO: 253409 - DNA, 20 bp, Artificial
  CRISPR gRNA sequence
gaacctgcaaggtggtggag

SEQ ID NO: 253410 - DNA, 20 bp, Artificial
  CRISPR gRNA sequence
agaagttcttacttaacttt

SEQ ID NO: 253411 - DNA, 20 bp, Artificial
  CRISPR gRNA sequence
tgtcatcatcttcattatct

SEQ ID NO: 253412 - DNA, 20 bp, Artificial
  CRISPR gRNA sequence
gtcatcatcttcattatctt

SEQ ID NO: 253413 - DNA, 20 bp, Artificial
  CRISPR gRNA sequence
cttcattatcttgggtattg

SEQ ID NO: 253414 - DNA, 20 bp, Artificial
  CRISPR gRNA sequence
attgtggctgacaatataac

SEQ ID NO: 253415 - DNA, 20 bp, Artificial
  CRISPR gRNA sequence
ttgtggctgacaatataacc

SEQ ID NO: 253416 - DNA, 20 bp, Artificial
  CRISPR gRNA sequence
tgacaatataaccaggttaa

SEQ ID NO: 253417 - DNA, 20 bp, Artificial
  CRISPR gRNA sequence
accaggttaatggttcctga

SEQ ID NO: 253418 - DNA, 20 bp, Artificial
  CRISPR gRNA sequence
tggttcctgatggtatcatt

SEQ ID NO: 253419 - DNA, 20 bp, Artificial
  CRISPR gRNA sequence
cattcagaattactcactca

SEQ ID NO: 253420 - DNA, 20 bp, Artificial
  CRISPR gRNA sequence
tactcactcatagttcactt

SEQ ID NO: 253421 - DNA, 20 bp, Artificial
  CRISPR gRNA sequence
ttggcctctgatctaattgt

SEQ ID NO: 253422 - DNA, 20 bp, Artificial
  CRISPR gRNA sequence
caatatctgaatcacctcat

SEQ ID NO: 253423 - DNA, 20 bp, Artificial
  CRISPR gRNA sequence
aatctacttgtctttcatgt

SEQ ID NO: 253424 - DNA, 20 bp, Artificial
  CRISPR gRNA sequence
tcatgttagacttttcgtga

SEQ ID NO: 253425 - DNA, 20 bp, Artificial
  CRISPR gRNA sequence
gtgaaagatccacctcctcg

SEQ ID NO: 253426 - DNA, 20 bp, Artificial
  CRISPR gRNA sequence
aaagatccacctcctcgaag

SEQ ID NO: 253427 - DNA, 20 bp, Artificial
  CRISPR gRNA sequence
cacctcctcgaagaagcttc

SEQ ID NO: 253428 - DNA, 20 bp, Artificial
  CRISPR gRNA sequence
gaagaagcttctggatactt

SEQ ID NO: 253429 - DNA, 20 bp, Artificial
  CRISPR gRNA sequence
ggatacttcagcctttattg

SEQ ID NO: 253430 - DNA, 20 bp, Artificial
  CRISPR gRNA sequence
ttcagcctttattgtggtct

SEQ ID NO: 253431 - DNA, 20 bp, Artificial
  CRISPR gRNA sequence
agcctttattgtggtcttgg

SEQ ID NO: 253432 - DNA, 20 bp, Artificial
  CRISPR gRNA sequence
cctttattgtggtcttggaa

SEQ ID NO: 253433 - DNA, 20 bp, Artificial
  CRISPR gRNA sequence
ctttattgtggtcttggaag

SEQ ID NO: 253434 - DNA, 20 bp, Artificial
  CRISPR gRNA sequence
ttattgtggtcttggaagag

SEQ ID NO: 253435 - DNA, 20 bp, Artificial
  CRISPR gRNA sequence
tcttggaagaggagttctga

SEQ ID NO: 253436 - DNA, 20 bp, Artificial
  CRISPR gRNA sequence
tggaagaggagttctgatgg

SEQ ID NO: 253437 - DNA, 20 bp, Artificial
  CRISPR gRNA sequence
tctcatattttaatctccat

SEQ ID NO: 253438 - DNA, 20 bp, Artificial
  CRISPR gRNA sequence
tcatattttaatctccatca

SEQ ID NO: 253439 - DNA, 20 bp, Artificial
  CRISPR gRNA sequence
tttaatctccatcagagttt

SEQ ID NO: 253440 - DNA, 20 bp, Artificial
  CRISPR gRNA sequence
taatctccatcagagtttca

SEQ ID NO: 253441 - DNA, 20 bp, Artificial
  CRISPR gRNA sequence
agagtttcagagaatataaa

SEQ ID NO: 253442 - DNA, 20 bp, Artificial
  CRISPR gRNA sequence
agagaatataaaaagaaata

SEQ ID NO: 253443 - DNA, 20 bp, Artificial
  CRISPR gRNA sequence
gagaatataaaaagaaatat

SEQ ID NO: 253444 - DNA, 20 bp, Artificial
  CRISPR gRNA sequence
atataaaaagaaatataggc

SEQ ID NO: 253445 - DNA, 20 bp, Artificial
  CRISPR gRNA sequence
aaagaaatataggccggata

SEQ ID NO: 253446 - DNA, 20 bp, Artificial
  CRISPR gRNA sequence
gtgcctcacacctgtaaccc

SEQ ID NO: 253447 - DNA, 20 bp, Artificial
  CRISPR gRNA sequence
cacctgtaaccccagcactt

SEQ ID NO: 253448 - DNA, 20 bp, Artificial
  CRISPR gRNA sequence
acctgtaaccccagcacttt

SEQ ID NO: 253449 - DNA, 20 bp, Artificial
  CRISPR gRNA sequence
ctgtaaccccagcactttgg

SEQ ID NO: 253450 - DNA, 20 bp, Artificial
  CRISPR gRNA sequence
ccccagcactttgggagacc

SEQ ID NO: 253451 - DNA, 20 bp, Artificial
  CRISPR gRNA sequence
cccagcactttgggagacca

SEQ ID NO: 253452 - DNA, 20 bp, Artificial
  CRISPR gRNA sequence
agcactttgggagaccaagg

SEQ ID NO: 253453 - DNA, 20 bp, Artificial
  CRISPR gRNA sequence
gcactttgggagaccaaggc

SEQ ID NO: 253454 - DNA, 20 bp, Artificial
  CRISPR gRNA sequence
ctttgggagaccaaggcagg

SEQ ID NO: 253455 - DNA, 20 bp, Artificial
  CRISPR gRNA sequence
ccaaggcaggcagatcacct

SEQ ID NO: 253456 - DNA, 20 bp, Artificial
  CRISPR gRNA sequence
caaggcaggcagatcacctg

SEQ ID NO: 253457 - DNA, 20 bp, Artificial
  CRISPR gRNA sequence
gcaggcagatcacctgaggt

SEQ ID NO: 253458 - DNA, 20 bp, Artificial
  CRISPR gRNA sequence
ggcagatcacctgaggtcag

SEQ ID NO: 253459 - DNA, 20 bp, Artificial
  CRISPR gRNA sequence
tcacctgaggtcagaagttt

SEQ ID NO: 253460 - DNA, 20 bp, Artificial
  CRISPR gRNA sequence
tgaggtcagaagtttgagac

SEQ ID NO: 253461 - DNA, 20 bp, Artificial
  CRISPR gRNA sequence
tcagaagtttgagaccagtc

SEQ ID NO: 253462 - DNA, 20 bp, Artificial
  CRISPR gRNA sequence
tgagaccagtctggccaata

SEQ ID NO: 253463 - DNA, 20 bp, Artificial
  CRISPR gRNA sequence
tctactaaaaatacaaaaat

SEQ ID NO: 253464 - DNA, 20 bp, Artificial
  CRISPR gRNA sequence
ctaaaaatacaaaaattagc

SEQ ID NO: 253465 - DNA, 20 bp, Artificial
  CRISPR gRNA sequence
taaaaatacaaaaattagcc

SEQ ID NO: 253466 - DNA, 20 bp, Artificial
  CRISPR gRNA sequence
atacaaaaattagccaggcg

SEQ ID NO: 253467 - DNA, 20 bp, Artificial
  CRISPR gRNA sequence
caaaaattagccaggcgtgg

SEQ ID NO: 253468 - DNA, 20 bp, Artificial
  CRISPR gRNA sequence
ggcgtggtggtacacacctg

SEQ ID NO: 253469 - DNA, 20 bp, Artificial
  CRISPR gRNA sequence
gtggtacacacctgtagtcc

SEQ ID NO: 253470 - DNA, 20 bp, Artificial
  CRISPR gRNA sequence
acacctgtagtcccagctac

SEQ ID NO: 253471 - DNA, 20 bp, Artificial
  CRISPR gRNA sequence
cacctgtagtcccagctact

SEQ ID NO: 253472 - DNA, 20 bp, Artificial
  CRISPR gRNA sequence
acctgtagtcccagctactg

SEQ ID NO: 253473 - DNA, 20 bp, Artificial
  CRISPR gRNA sequence
ctgtagtcccagctactggg

SEQ ID NO: 253474 - DNA, 20 bp, Artificial
  CRISPR gRNA sequence
tgtagtcccagctactgggg

SEQ ID NO: 253475 - DNA, 20 bp, Artificial
  CRISPR gRNA sequence
tcccagctactggggaggct

SEQ ID NO: 253476 - DNA, 20 bp, Artificial
  CRISPR gRNA sequence
cccagctactggggaggctg

SEQ ID NO: 253477 - DNA, 20 bp, Artificial
  CRISPR gRNA sequence
agctactggggaggctgagg

SEQ ID NO: 253478 - DNA, 20 bp, Artificial
  CRISPR gRNA sequence
gctactggggaggctgaggt

SEQ ID NO: 253479 - DNA, 20 bp, Artificial
  CRISPR gRNA sequence
tactggggaggctgaggtag

SEQ ID NO: 253480 - DNA, 20 bp, Artificial
  CRISPR gRNA sequence
gtaggagaattgcttgaacc

SEQ ID NO: 253481 - DNA, 20 bp, Artificial
  CRISPR gRNA sequence
taggagaattgcttgaacct

SEQ ID NO: 253482 - DNA, 20 bp, Artificial
  CRISPR gRNA sequence
ggagaattgcttgaacctag

SEQ ID NO: 253483 - DNA, 20 bp, Artificial
  CRISPR gRNA sequence
gagaattgcttgaacctagg

SEQ ID NO: 253484 - DNA, 20 bp, Artificial
  CRISPR gRNA sequence
aattgcttgaacctaggagg

SEQ ID NO: 253485 - DNA, 20 bp, Artificial
  CRISPR gRNA sequence
ttgcttgaacctaggaggca

SEQ ID NO: 253486 - DNA, 20 bp, Artificial
  CRISPR gRNA sequence
tgcttgaacctaggaggcag

SEQ ID NO: 253487 - DNA, 20 bp, Artificial
  CRISPR gRNA sequence
aacctaggaggcagaggttg

SEQ ID NO: 253488 - DNA, 20 bp, Artificial
  CRISPR gRNA sequence
taggaggcagaggttgcagt

SEQ ID NO: 253489 - DNA, 20 bp, Artificial
  CRISPR gRNA sequence
gaggcagaggttgcagtgag

SEQ ID NO: 253490 - DNA, 20 bp, Artificial
  CRISPR gRNA sequence
ggcagaggttgcagtgagca

SEQ ID NO: 253491 - DNA, 20 bp, Artificial
  CRISPR gRNA sequence
gagattgtgtcaatgcactc

SEQ ID NO: 253492 - DNA, 20 bp, Artificial
  CRISPR gRNA sequence
tgtgtcaatgcactccagcc

SEQ ID NO: 253493 - DNA, 20 bp, Artificial
  CRISPR gRNA sequence
gtgtcaatgcactccagcct

SEQ ID NO: 253494 - DNA, 20 bp, Artificial
  CRISPR gRNA sequence
atgcactccagcctgggtga

SEQ ID NO: 253495 - DNA, 20 bp, Artificial
  CRISPR gRNA sequence
gcactccagcctgggtgaca

SEQ ID NO: 253496 - DNA, 20 bp, Artificial
  CRISPR gRNA sequence
tccagcctgggtgacagagc

SEQ ID NO: 253497 - DNA, 20 bp, Artificial
  CRISPR gRNA sequence
gtctcaacaacaacaaaaaa

SEQ ID NO: 253498 - DNA, 20 bp, Artificial
  CRISPR gRNA sequence
aaaaaaaagaaatataaaat

SEQ ID NO: 253499 - DNA, 20 bp, Artificial
  CRISPR gRNA sequence
gaaatataaaatcagtacac

SEQ ID NO: 253500 - DNA, 20 bp, Artificial
  CRISPR gRNA sequence
atcagtacacaagtattgtg

SEQ ID NO: 253501 - DNA, 20 bp, Artificial
  CRISPR gRNA sequence
acacaagtattgtgtagtac

SEQ ID NO: 253502 - DNA, 20 bp, Artificial
  CRISPR gRNA sequence
tattgtgtagtacaagtaat

SEQ ID NO: 253503 - DNA, 20 bp, Artificial
  CRISPR gRNA sequence
attgtgtagtacaagtaatt

SEQ ID NO: 253504 - DNA, 20 bp, Artificial
  CRISPR gRNA sequence
gtgtagtacaagtaattagg

SEQ ID NO: 253505 - DNA, 20 bp, Artificial
  CRISPR gRNA sequence
aagtaattaggtagttaact

SEQ ID NO: 253506 - DNA, 20 bp, Artificial
  CRISPR gRNA sequence
ctgagttctctctgctttta

SEQ ID NO: 253507 - DNA, 20 bp, Artificial
  CRISPR gRNA sequence
cttttacagcccctatgatt

SEQ ID NO: 253508 - DNA, 20 bp, Artificial
  CRISPR gRNA sequence
acagcccctatgatttagtt

SEQ ID NO: 253509 - DNA, 20 bp, Artificial
  CRISPR gRNA sequence
gcccctatgatttagttgag

SEQ ID NO: 253510 - DNA, 20 bp, Artificial
  CRISPR gRNA sequence
cccctatgatttagttgagt

SEQ ID NO: 253511 - DNA, 20 bp, Artificial
  CRISPR gRNA sequence
gttgagtaggttatatataa

SEQ ID NO: 253512 - DNA, 20 bp, Artificial
  CRISPR gRNA sequence
ttgagtaggttatatataat

SEQ ID NO: 253513 - DNA, 20 bp, Artificial
  CRISPR gRNA sequence
gagtaggttatatataatag

SEQ ID NO: 253514 - DNA, 20 bp, Artificial
  CRISPR gRNA sequence
agtaggttatatataatagg

SEQ ID NO: 253515 - DNA, 20 bp, Artificial
  CRISPR gRNA sequence
taataggaggatgtaacatc

SEQ ID NO: 253516 - DNA, 20 bp, Artificial
  CRISPR gRNA sequence
gaggatgtaacatctggaaa

SEQ ID NO: 253517 - DNA, 20 bp, Artificial
  CRISPR gRNA sequence
ggaaacagataaataacact

SEQ ID NO: 253518 - DNA, 20 bp, Artificial
  CRISPR gRNA sequence
aacagataaataacacttgg

SEQ ID NO: 253519 - DNA, 20 bp, Artificial
  CRISPR gRNA sequence
accatgctatttgatgacta

SEQ ID NO: 253520 - DNA, 20 bp, Artificial
  CRISPR gRNA sequence
ccatgctatttgatgactaa

SEQ ID NO: 253521 - DNA, 20 bp, Artificial
  CRISPR gRNA sequence
atttgatgactaaaggactt

SEQ ID NO: 253522 - DNA, 20 bp, Artificial
  CRISPR gRNA sequence
tcctctacacctctcacctg

SEQ ID NO: 253523 - DNA, 20 bp, Artificial
  CRISPR gRNA sequence
tctacacctctcacctgaag

SEQ ID NO: 253524 - DNA, 20 bp, Artificial
  CRISPR gRNA sequence
cacctgaagaagccttctct

SEQ ID NO: 253525 - DNA, 20 bp, Artificial
  CRISPR gRNA sequence
gccttctctgagaccccaaa

SEQ ID NO: 253526 - DNA, 20 bp, Artificial
  CRISPR gRNA sequence
ctctgagaccccaaatggca

SEQ ID NO: 253527 - DNA, 20 bp, Artificial
  CRISPR gRNA sequence
ctgagaccccaaatggcaaa

SEQ ID NO: 253528 - DNA, 20 bp, Artificial
  CRISPR gRNA sequence
gagaccccaaatggcaaaga

SEQ ID NO: 253529 - DNA, 20 bp, Artificial
  CRISPR gRNA sequence
agaccccaaatggcaaagag

SEQ ID NO: 253530 - DNA, 20 bp, Artificial
  CRISPR gRNA sequence
gaccccaaatggcaaagaga

SEQ ID NO: 253531 - DNA, 20 bp, Artificial
  CRISPR gRNA sequence
gagggacttccttccctctc

SEQ ID NO: 253532 - DNA, 20 bp, Artificial
  CRISPR gRNA sequence
acatttattttcttttccac

SEQ ID NO: 253533 - DNA, 20 bp, Artificial
  CRISPR gRNA sequence
cactagactatgaactcctt

SEQ ID NO: 253534 - DNA, 20 bp, Artificial
  CRISPR gRNA sequence
actagactatgaactccttg

SEQ ID NO: 253535 - DNA, 20 bp, Artificial
  CRISPR gRNA sequence
ctagactatgaactccttga

SEQ ID NO: 253536 - DNA, 20 bp, Artificial
  CRISPR gRNA sequence
gactatgaactccttgaggg

SEQ ID NO: 253537 - DNA, 20 bp, Artificial
  CRISPR gRNA sequence
catccttctaacctctgtat

SEQ ID NO: 253538 - DNA, 20 bp, Artificial
  CRISPR gRNA sequence
atccttctaacctctgtatt

SEQ ID NO: 253539 - DNA, 20 bp, Artificial
  CRISPR gRNA sequence
tgtattaggcacaatgctgt

SEQ ID NO: 253540 - DNA, 20 bp, Artificial
  CRISPR gRNA sequence
ggcacaatgctgtaagcata

SEQ ID NO: 253541 - DNA, 20 bp, Artificial
  CRISPR gRNA sequence
tactcaataaatatttgttg

SEQ ID NO: 253542 - DNA, 20 bp, Artificial
  CRISPR gRNA sequence
caataaatatttgttgaaga

SEQ ID NO: 253543 - DNA, 20 bp, Artificial
  CRISPR gRNA sequence
gaagaaagaaatgaatgaat

SEQ ID NO: 253544 - DNA, 20 bp, Artificial
  CRISPR gRNA sequence
gaatgaattagtaacaaaat

SEQ ID NO: 253545 - DNA, 20 bp, Artificial
  CRISPR gRNA sequence
aatgaattagtaacaaaatg

SEQ ID NO: 253546 - DNA, 20 bp, Artificial
  CRISPR gRNA sequence
gaattagtaacaaaatgagg

SEQ ID NO: 253547 - DNA, 20 bp, Artificial
  CRISPR gRNA sequence
agcataaaataaatactcgt

SEQ ID NO: 253548 - DNA, 20 bp, Artificial
  CRISPR gRNA sequence
aaatactcgtaagattaatg

SEQ ID NO: 253549 - DNA, 20 bp, Artificial
  CRISPR gRNA sequence
actcgtaagattaatgtaga

SEQ ID NO: 253550 - DNA, 20 bp, Artificial
  CRISPR gRNA sequence
ctcgtaagattaatgtagaa

SEQ ID NO: 253551 - DNA, 20 bp, Artificial
  CRISPR gRNA sequence
taagattaatgtagaaaggt

SEQ ID NO: 253552 - DNA, 20 bp, Artificial
  CRISPR gRNA sequence
tgtagaaaggtaagccttta

SEQ ID NO: 253553 - DNA, 20 bp, Artificial
  CRISPR gRNA sequence
tagaaaggtaagcctttatg

SEQ ID NO: 253554 - DNA, 20 bp, Artificial
  CRISPR gRNA sequence
gaaaggtaagcctttatgga

SEQ ID NO: 253555 - DNA, 20 bp, Artificial
  CRISPR gRNA sequence
ggtaagcctttatggagagt

SEQ ID NO: 253556 - DNA, 20 bp, Artificial
  CRISPR gRNA sequence
gtaagcctttatggagagtt

SEQ ID NO: 253557 - DNA, 20 bp, Artificial
  CRISPR gRNA sequence
ctttatggagagttgggaat

SEQ ID NO: 253558 - DNA, 20 bp, Artificial
  CRISPR gRNA sequence
tggagagttgggaattagac

SEQ ID NO: 253559 - DNA, 20 bp, Artificial
  CRISPR gRNA sequence
gagttgggaattagactgga

SEQ ID NO: 253560 - DNA, 20 bp, Artificial
  CRISPR gRNA sequence
ttgggaattagactggacag

SEQ ID NO: 253561 - DNA, 20 bp, Artificial
  CRISPR gRNA sequence
aattagactggacagtagac

SEQ ID NO: 253562 - DNA, 20 bp, Artificial
  CRISPR gRNA sequence
ttgttattaataataattgc

SEQ ID NO: 253563 - DNA, 20 bp, Artificial
  CRISPR gRNA sequence
attttgcacttataatgtgc

SEQ ID NO: 253564 - DNA, 20 bp, Artificial
  CRISPR gRNA sequence
ttttgcacttataatgtgcc

SEQ ID NO: 253565 - DNA, 20 bp, Artificial
  CRISPR gRNA sequence
tgcacttataatgtgccagg

SEQ ID NO: 253566 - DNA, 20 bp, Artificial
  CRISPR gRNA sequence
gtgccaggtagtgttctgcc

SEQ ID NO: 253567 - DNA, 20 bp, Artificial
  CRISPR gRNA sequence
tgcctggctttccctgtatt

SEQ ID NO: 253568 - DNA, 20 bp, Artificial
  CRISPR gRNA sequence
tattaagtcatctaatctcc

SEQ ID NO: 253569 - DNA, 20 bp, Artificial
  CRISPR gRNA sequence
atctaatctccaagtcctat

SEQ ID NO: 253570 - DNA, 20 bp, Artificial
  CRISPR gRNA sequence
tctaatctccaagtcctatg

SEQ ID NO: 253571 - DNA, 20 bp, Artificial
  CRISPR gRNA sequence
aatctccaagtcctatgagg

SEQ ID NO: 253572 - DNA, 20 bp, Artificial
  CRISPR gRNA sequence
gctatgattatactatttca

SEQ ID NO: 253573 - DNA, 20 bp, Artificial
  CRISPR gRNA sequence
tgattatactatttcataga

SEQ ID NO: 253574 - DNA, 20 bp, Artificial
  CRISPR gRNA sequence
gattatactatttcatagat

SEQ ID NO: 253575 - DNA, 20 bp, Artificial
  CRISPR gRNA sequence
attatactatttcatagatg

SEQ ID NO: 253576 - DNA, 20 bp, Artificial
  CRISPR gRNA sequence
tttcatagatggggaaactg

SEQ ID NO: 253577 - DNA, 20 bp, Artificial
  CRISPR gRNA sequence
tagatggggaaactgaagca

SEQ ID NO: 253578 - DNA, 20 bp, Artificial
  CRISPR gRNA sequence
gatggggaaactgaagcaca

SEQ ID NO: 253579 - DNA, 20 bp, Artificial
  CRISPR gRNA sequence
ggggaaactgaagcacagag

SEQ ID NO: 253580 - DNA, 20 bp, Artificial
  CRISPR gRNA sequence
gggaaactgaagcacagagt

SEQ ID NO: 253581 - DNA, 20 bp, Artificial
  CRISPR gRNA sequence
aaactgaagcacagagtggg

SEQ ID NO: 253582 - DNA, 20 bp, Artificial
  CRISPR gRNA sequence
actgaagcacagagtgggta

SEQ ID NO: 253583 - DNA, 20 bp, Artificial
  CRISPR gRNA sequence
tgggtagagcatcttgctta

SEQ ID NO: 253584 - DNA, 20 bp, Artificial
  CRISPR gRNA sequence
gcatcttgcttatggtcaca

SEQ ID NO: 253585 - DNA, 20 bp, Artificial
  CRISPR gRNA sequence
cttatggtcacaaagctact

SEQ ID NO: 253586 - DNA, 20 bp, Artificial
  CRISPR gRNA sequence
agctactaagtatgtaaatc

SEQ ID NO: 253587 - DNA, 20 bp, Artificial
  CRISPR gRNA sequence
actaagtatgtaaatccaga

SEQ ID NO: 253588 - DNA, 20 bp, Artificial
  CRISPR gRNA sequence
aaatccagatggtcttgctc

SEQ ID NO: 253589 - DNA, 20 bp, Artificial
  CRISPR gRNA sequence
aatccagatggtcttgctct

SEQ ID NO: 253590 - DNA, 20 bp, Artificial
  CRISPR gRNA sequence
atccagatggtcttgctctg

SEQ ID NO: 253591 - DNA, 20 bp, Artificial
  CRISPR gRNA sequence
ttaccaatgctgtgttgtct

SEQ ID NO: 253592 - DNA, 20 bp, Artificial
  CRISPR gRNA sequence
taccaatgctgtgttgtctc

SEQ ID NO: 253593 - DNA, 20 bp, Artificial
  CRISPR gRNA sequence
caatgctgtgttgtctcagg

SEQ ID NO: 253594 - DNA, 20 bp, Artificial
  CRISPR gRNA sequence
aatgctgtgttgtctcagga

SEQ ID NO: 253595 - DNA, 20 bp, Artificial
  CRISPR gRNA sequence
tgtgttgtctcaggaaggaa

SEQ ID NO: 253596 - DNA, 20 bp, Artificial
  CRISPR gRNA sequence
gtgttgtctcaggaaggaaa

SEQ ID NO: 253597 - DNA, 20 bp, Artificial
  CRISPR gRNA sequence
ttgtctcaggaaggaaaagg

SEQ ID NO: 253598 - DNA, 20 bp, Artificial
  CRISPR gRNA sequence
aaggaaaaggtggattaata

SEQ ID NO: 253599 - DNA, 20 bp, Artificial
  CRISPR gRNA sequence
gattaataaagaaattaaac

SEQ ID NO: 253600 - DNA, 20 bp, Artificial
  CRISPR gRNA sequence
attaataaagaaattaaacc

SEQ ID NO: 253601 - DNA, 20 bp, Artificial
  CRISPR gRNA sequence
ggaatactgtttcatgttct

SEQ ID NO: 253602 - DNA, 20 bp, Artificial
  CRISPR gRNA sequence
actgtttcatgttctcagaa

SEQ ID NO: 253603 - DNA, 20 bp, Artificial
  CRISPR gRNA sequence
tttcatgttctcagaacaga

SEQ ID NO: 253604 - DNA, 20 bp, Artificial
  CRISPR gRNA sequence
gatggcaactctgaatgtgt

SEQ ID NO: 253605 - DNA, 20 bp, Artificial
  CRISPR gRNA sequence
atggcaactctgaatgtgtg

SEQ ID NO: 253606 - DNA, 20 bp, Artificial
  CRISPR gRNA sequence
actctgaatgtgtgaggtta

SEQ ID NO: 253607 - DNA, 20 bp, Artificial
  CRISPR gRNA sequence
gaatgtgtgaggttatggtg

SEQ ID NO: 253608 - DNA, 20 bp, Artificial
  CRISPR gRNA sequence
tgtgtgaggttatggtgaag

SEQ ID NO: 253609 - DNA, 20 bp, Artificial
  CRISPR gRNA sequence
gtgaggttatggtgaagcag

SEQ ID NO: 253610 - DNA, 20 bp, Artificial
  CRISPR gRNA sequence
gaggttatggtgaagcagcg

SEQ ID NO: 253611 - DNA, 20 bp, Artificial
  CRISPR gRNA sequence
tggtgaagcagcggagaatc

SEQ ID NO: 253612 - DNA, 20 bp, Artificial
  CRISPR gRNA sequence
aagcagcggagaatccagct

SEQ ID NO: 253613 - DNA, 20 bp, Artificial
  CRISPR gRNA sequence
gcggagaatccagctaagca

SEQ ID NO: 253614 - DNA, 20 bp, Artificial
  CRISPR gRNA sequence
cggagaatccagctaagcaa

SEQ ID NO: 253615 - DNA, 20 bp, Artificial
  CRISPR gRNA sequence
gaatccagctaagcaaagga

SEQ ID NO: 253616 - DNA, 20 bp, Artificial
  CRISPR gRNA sequence
ctaagcaaaggatagaatac

SEQ ID NO: 253617 - DNA, 20 bp, Artificial
  CRISPR gRNA sequence
aaaggatagaatactggtaa

SEQ ID NO: 253618 - DNA, 20 bp, Artificial
  CRISPR gRNA sequence
gaaattcaaactttattttc

SEQ ID NO: 253619 - DNA, 20 bp, Artificial
  CRISPR gRNA sequence
tttattttcaagtcattttg

SEQ ID NO: 253620 - DNA, 20 bp, Artificial
  CRISPR gRNA sequence
ttcaagtcattttgaagtaa

SEQ ID NO: 253621 - DNA, 20 bp, Artificial
  CRISPR gRNA sequence
gtcattttgaagtaatggcc

SEQ ID NO: 253622 - DNA, 20 bp, Artificial
  CRISPR gRNA sequence
tcattttgaagtaatggcct

SEQ ID NO: 253623 - DNA, 20 bp, Artificial
  CRISPR gRNA sequence
tttgaagtaatggcctgggt

SEQ ID NO: 253624 - DNA, 20 bp, Artificial
  CRISPR gRNA sequence
gaagtaatggcctgggtaag

SEQ ID NO: 253625 - DNA, 20 bp, Artificial
  CRISPR gRNA sequence
tgggtaagaagaaaatattt

SEQ ID NO: 253626 - DNA, 20 bp, Artificial
  CRISPR gRNA sequence
tatttcagaatccttatctt

SEQ ID NO: 253627 - DNA, 20 bp, Artificial
  CRISPR gRNA sequence
gaatccttatctttggaatg

SEQ ID NO: 253628 - DNA, 20 bp, Artificial
  CRISPR gRNA sequence
ccttatctttggaatgaagc

SEQ ID NO: 253629 - DNA, 20 bp, Artificial
  CRISPR gRNA sequence
ttatctttggaatgaagctg

SEQ ID NO: 253630 - DNA, 20 bp, Artificial
  CRISPR gRNA sequence
ttggaatgaagctggagtta

SEQ ID NO: 253631 - DNA, 20 bp, Artificial
  CRISPR gRNA sequence
tggaatgaagctggagttat

SEQ ID NO: 253632 - DNA, 20 bp, Artificial
  CRISPR gRNA sequence
tgaagctggagttatgggaa

SEQ ID NO: 253633 - DNA, 20 bp, Artificial
  CRISPR gRNA sequence
gctggagttatgggaatgga

SEQ ID NO: 253634 - DNA, 20 bp, Artificial
  CRISPR gRNA sequence
gagttatgggaatggatggc

SEQ ID NO: 253635 - DNA, 20 bp, Artificial
  CRISPR gRNA sequence
gggaatggatggctagtcga

SEQ ID NO: 253636 - DNA, 20 bp, Artificial
  CRISPR gRNA sequence
ggaatggatggctagtcgaa

SEQ ID NO: 253637 - DNA, 20 bp, Artificial
  CRISPR gRNA sequence
aatggatggctagtcgaaag

SEQ ID NO: 253638 - DNA, 20 bp, Artificial
  CRISPR gRNA sequence
tggatggctagtcgaaagga

SEQ ID NO: 253639 - DNA, 20 bp, Artificial
  CRISPR gRNA sequence
ggatggctagtcgaaaggag

SEQ ID NO: 253640 - DNA, 20 bp, Artificial
  CRISPR gRNA sequence
gatggctagtcgaaaggaga

SEQ ID NO: 253641 - DNA, 20 bp, Artificial
  CRISPR gRNA sequence
gaaaggagagggcataactg

SEQ ID NO: 253642 - DNA, 20 bp, Artificial
  CRISPR gRNA sequence
agggcataactgtagaaaaa

SEQ ID NO: 253643 - DNA, 20 bp, Artificial
  CRISPR gRNA sequence
ggcataactgtagaaaaaca

SEQ ID NO: 253644 - DNA, 20 bp, Artificial
  CRISPR gRNA sequence
cataactgtagaaaaacaga

SEQ ID NO: 253645 - DNA, 20 bp, Artificial
  CRISPR gRNA sequence
aactgtagaaaaacagagag

SEQ ID NO: 253646 - DNA, 20 bp, Artificial
  CRISPR gRNA sequence
ctgtagaaaaacagagagtg

SEQ ID NO: 253647 - DNA, 20 bp, Artificial
  CRISPR gRNA sequence
acagagagtggagctgaatc

SEQ ID NO: 253648 - DNA, 20 bp, Artificial
  CRISPR gRNA sequence
agctgaatctggaaactaac

SEQ ID NO: 253649 - DNA, 20 bp, Artificial
  CRISPR gRNA sequence
tggaaactaactggctctga

SEQ ID NO: 253650 - DNA, 20 bp, Artificial
  CRISPR gRNA sequence
ggaaactaactggctctgat

SEQ ID NO: 253651 - DNA, 20 bp, Artificial
  CRISPR gRNA sequence
aaactaactggctctgatgg

SEQ ID NO: 253652 - DNA, 20 bp, Artificial
  CRISPR gRNA sequence
taactggctctgatgggagt

SEQ ID NO: 253653 - DNA, 20 bp, Artificial
  CRISPR gRNA sequence
tctgatgggagtcagctgaa

SEQ ID NO: 253654 - DNA, 20 bp, Artificial
  CRISPR gRNA sequence
ctgatgggagtcagctgaaa

SEQ ID NO: 253655 - DNA, 20 bp, Artificial
  CRISPR gRNA sequence
tgggagtcagctgaaaagga

SEQ ID NO: 253656 - DNA, 20 bp, Artificial
  CRISPR gRNA sequence
agtcagctgaaaaggatggt

SEQ ID NO: 253657 - DNA, 20 bp, Artificial
  CRISPR gRNA sequence
agctgaaaaggatggttagc

SEQ ID NO: 253658 - DNA, 20 bp, Artificial
  CRISPR gRNA sequence
aaaaggatggttagctagtg

SEQ ID NO: 253659 - DNA, 20 bp, Artificial
  CRISPR gRNA sequence
aaaggatggttagctagtga

SEQ ID NO: 253660 - DNA, 20 bp, Artificial
  CRISPR gRNA sequence
aggatggttagctagtgaag

SEQ ID NO: 253661 - DNA, 20 bp, Artificial
  CRISPR gRNA sequence
gttagctagtgaaggagaca

SEQ ID NO: 253662 - DNA, 20 bp, Artificial
  CRISPR gRNA sequence
gctagtgaaggagacaaaga

SEQ ID NO: 253663 - DNA, 20 bp, Artificial
  CRISPR gRNA sequence
agtgaaggagacaaagaaag

SEQ ID NO: 253664 - DNA, 20 bp, Artificial
  CRISPR gRNA sequence
aaggagacaaagaaagtggt

SEQ ID NO: 253665 - DNA, 20 bp, Artificial
  CRISPR gRNA sequence
ggagacaaagaaagtggtga

SEQ ID NO: 253666 - DNA, 20 bp, Artificial
  CRISPR gRNA sequence
agacaaagaaagtggtgaga

SEQ ID NO: 253667 - DNA, 20 bp, Artificial
  CRISPR gRNA sequence
gacaaagaaagtggtgagag

SEQ ID NO: 253668 - DNA, 20 bp, Artificial
  CRISPR gRNA sequence
aaagaaagtggtgagagagg

SEQ ID NO: 253669 - DNA, 20 bp, Artificial
  CRISPR gRNA sequence
aagaaagtggtgagagaggc

SEQ ID NO: 253670 - DNA, 20 bp, Artificial
  CRISPR gRNA sequence
agaaagtggtgagagaggca

SEQ ID NO: 253671 - DNA, 20 bp, Artificial
  CRISPR gRNA sequence
gaaagtggtgagagaggcag

SEQ ID NO: 253672 - DNA, 20 bp, Artificial
  CRISPR gRNA sequence
aaagtggtgagagaggcagg

SEQ ID NO: 253673 - DNA, 20 bp, Artificial
  CRISPR gRNA sequence
gtgagagaggcagggggaca

SEQ ID NO: 253674 - DNA, 20 bp, Artificial
  CRISPR gRNA sequence
gagaggcagggggacacagt

SEQ ID NO: 253675 - DNA, 20 bp, Artificial
  CRISPR gRNA sequence
agaggcagggggacacagtg

SEQ ID NO: 253676 - DNA, 20 bp, Artificial
  CRISPR gRNA sequence
gcagggggacacagtgaggc

SEQ ID NO: 253677 - DNA, 20 bp, Artificial
  CRISPR gRNA sequence
gggggacacagtgaggctag

SEQ ID NO: 253678 - DNA, 20 bp, Artificial
  CRISPR gRNA sequence
gaggctagtggaatgccact

SEQ ID NO: 253679 - DNA, 20 bp, Artificial
  CRISPR gRNA sequence
tggaatgccactaagccaat

SEQ ID NO: 253680 - DNA, 20 bp, Artificial
  CRISPR gRNA sequence
ggaatgccactaagccaatg

SEQ ID NO: 253681 - DNA, 20 bp, Artificial
  CRISPR gRNA sequence
gaatgccactaagccaatga

SEQ ID NO: 253682 - DNA, 20 bp, Artificial
  CRISPR gRNA sequence
gccactaagccaatgaggga

SEQ ID NO: 253683 - DNA, 20 bp, Artificial
  CRISPR gRNA sequence
cactaagccaatgagggaaa

SEQ ID NO: 253684 - DNA, 20 bp, Artificial
  CRISPR gRNA sequence
atgagggaaagagtttcaaa

SEQ ID NO: 253685 - DNA, 20 bp, Artificial
  CRISPR gRNA sequence
gggaaagagtttcaaaaaga

SEQ ID NO: 253686 - DNA, 20 bp, Artificial
  CRISPR gRNA sequence
aaagagtttcaaaaagatag

SEQ ID NO: 253687 - DNA, 20 bp, Artificial
  CRISPR gRNA sequence
ttcaaaaagatagtggttaa

SEQ ID NO: 253688 - DNA, 20 bp, Artificial
  CRISPR gRNA sequence
tggttaatagcattaaacat

SEQ ID NO: 253689 - DNA, 20 bp, Artificial
  CRISPR gRNA sequence
gttaatagcattaaacataa

SEQ ID NO: 253690 - DNA, 20 bp, Artificial
  CRISPR gRNA sequence
ttaatagcattaaacataag

SEQ ID NO: 253691 - DNA, 20 bp, Artificial
  CRISPR gRNA sequence
taatagcattaaacataaga

SEQ ID NO: 253692 - DNA, 20 bp, Artificial
  CRISPR gRNA sequence
agcattaaacataagaggga

SEQ ID NO: 253693 - DNA, 20 bp, Artificial
  CRISPR gRNA sequence
gcattaaacataagagggaa

SEQ ID NO: 253694 - DNA, 20 bp, Artificial
  CRISPR gRNA sequence
attaaacataagagggaaag

SEQ ID NO: 253695 - DNA, 20 bp, Artificial
  CRISPR gRNA sequence
agagggaaaggagtgaataa

SEQ ID NO: 253696 - DNA, 20 bp, Artificial
  CRISPR gRNA sequence
gaaaggagtgaataatggct

SEQ ID NO: 253697 - DNA, 20 bp, Artificial
  CRISPR gRNA sequence
aaaggagtgaataatggctt

SEQ ID NO: 253698 - DNA, 20 bp, Artificial
  CRISPR gRNA sequence
gtgaataatggcttgggatt

SEQ ID NO: 253699 - DNA, 20 bp, Artificial
  CRISPR gRNA sequence
gatttggctgaaacgccacc

SEQ ID NO: 253700 - DNA, 20 bp, Artificial
  CRISPR gRNA sequence
atttggctgaaacgccacct

SEQ ID NO: 253701 - DNA, 20 bp, Artificial
  CRISPR gRNA sequence
aaacgccacctgggactttt

SEQ ID NO: 253702 - DNA, 20 bp, Artificial
  CRISPR gRNA sequence
ccacctgggacttttgagtt

SEQ ID NO: 253703 - DNA, 20 bp, Artificial
  CRISPR gRNA sequence
cacctgggacttttgagttt

SEQ ID NO: 253704 - DNA, 20 bp, Artificial
  CRISPR gRNA sequence
ctgggacttttgagtttagg

SEQ ID NO: 253705 - DNA, 20 bp, Artificial
  CRISPR gRNA sequence
gggacttttgagtttaggca

SEQ ID NO: 253706 - DNA, 20 bp, Artificial
  CRISPR gRNA sequence
tttgagtttaggcagagaca

SEQ ID NO: 253707 - DNA, 20 bp, Artificial
  CRISPR gRNA sequence
tgagtttaggcagagacatg

SEQ ID NO: 253708 - DNA, 20 bp, Artificial
  CRISPR gRNA sequence
gtttaggcagagacatggag

SEQ ID NO: 253709 - DNA, 20 bp, Artificial
  CRISPR gRNA sequence
tttaggcagagacatggaga

SEQ ID NO: 253710 - DNA, 20 bp, Artificial
  CRISPR gRNA sequence
aggcagagacatggagaagg

SEQ ID NO: 253711 - DNA, 20 bp, Artificial
  CRISPR gRNA sequence
gagacatggagaaggaagat

SEQ ID NO: 253712 - DNA, 20 bp, Artificial
  CRISPR gRNA sequence
agaaggaagataagacttca

SEQ ID NO: 253713 - DNA, 20 bp, Artificial
  CRISPR gRNA sequence
gaaggaagataagacttcac

SEQ ID NO: 253714 - DNA, 20 bp, Artificial
  CRISPR gRNA sequence
agataagacttcacaggatt

SEQ ID NO: 253715 - DNA, 20 bp, Artificial
  CRISPR gRNA sequence
gacttcacaggattaagaaa

SEQ ID NO: 253716 - DNA, 20 bp, Artificial
  CRISPR gRNA sequence
ttcacaggattaagaaaaag

SEQ ID NO: 253717 - DNA, 20 bp, Artificial
  CRISPR gRNA sequence
cacaggattaagaaaaagtg

SEQ ID NO: 253718 - DNA, 20 bp, Artificial
  CRISPR gRNA sequence
acaggattaagaaaaagtgg

SEQ ID NO: 253719 - DNA, 20 bp, Artificial
  CRISPR gRNA sequence
caggattaagaaaaagtgga

SEQ ID NO: 253720 - DNA, 20 bp, Artificial
  CRISPR gRNA sequence
aggattaagaaaaagtggag

SEQ ID NO: 253721 - DNA, 20 bp, Artificial
  CRISPR gRNA sequence
ggattaagaaaaagtggagg

SEQ ID NO: 253722 - DNA, 20 bp, Artificial
  CRISPR gRNA sequence
aaaagtggagggggacaaaa

SEQ ID NO: 253723 - DNA, 20 bp, Artificial
  CRISPR gRNA sequence
aagtggagggggacaaaaca

SEQ ID NO: 253724 - DNA, 20 bp, Artificial
  CRISPR gRNA sequence
ggagggggacaaaacagaga

SEQ ID NO: 253725 - DNA, 20 bp, Artificial
  CRISPR gRNA sequence
gacaaaacagagacagtgaa

SEQ ID NO: 253726 - DNA, 20 bp, Artificial
  CRISPR gRNA sequence
acaaaacagagacagtgaaa

SEQ ID NO: 253727 - DNA, 20 bp, Artificial
  CRISPR gRNA sequence
aaaacagagacagtgaaaag

SEQ ID NO: 253728 - DNA, 20 bp, Artificial
  CRISPR gRNA sequence
aacagagacagtgaaaagga

SEQ ID NO: 253729 - DNA, 20 bp, Artificial
  CRISPR gRNA sequence
acagagacagtgaaaaggag

SEQ ID NO: 253730 - DNA, 20 bp, Artificial
  CRISPR gRNA sequence
acagtgaaaaggagaggaaa

SEQ ID NO: 253731 - DNA, 20 bp, Artificial
  CRISPR gRNA sequence
gaaaaggagaggaaatagat

SEQ ID NO: 253732 - DNA, 20 bp, Artificial
  CRISPR gRNA sequence
aaaaggagaggaaatagata

SEQ ID NO: 253733 - DNA, 20 bp, Artificial
  CRISPR gRNA sequence
gagaggaaatagataaggta

SEQ ID NO: 253734 - DNA, 20 bp, Artificial
  CRISPR gRNA sequence
atagataaggtaaagacaat

SEQ ID NO: 253735 - DNA, 20 bp, Artificial
  CRISPR gRNA sequence
tagataaggtaaagacaatt

SEQ ID NO: 253736 - DNA, 20 bp, Artificial
  CRISPR gRNA sequence
atcacctaaaatgtctacca

SEQ ID NO: 253737 - DNA, 20 bp, Artificial
  CRISPR gRNA sequence
taataataaatgtttgcaaa

SEQ ID NO: 253738 - DNA, 20 bp, Artificial
  CRISPR gRNA sequence
ataaatgtttgcaaatggct

SEQ ID NO: 253739 - DNA, 20 bp, Artificial
  CRISPR gRNA sequence
tgcaaatggctgagtgactt

SEQ ID NO: 253740 - DNA, 20 bp, Artificial
  CRISPR gRNA sequence
acttaagtatgtttgacatg

SEQ ID NO: 253741 - DNA, 20 bp, Artificial
  CRISPR gRNA sequence
taagtatgtttgacatgtgg

SEQ ID NO: 253742 - DNA, 20 bp, Artificial
  CRISPR gRNA sequence
aagtatgtttgacatgtgga

SEQ ID NO: 253743 - DNA, 20 bp, Artificial
  CRISPR gRNA sequence
gtatgtttgacatgtggaag

SEQ ID NO: 253744 - DNA, 20 bp, Artificial
  CRISPR gRNA sequence
tttgacatgtggaaggagcc

SEQ ID NO: 253745 - DNA, 20 bp, Artificial
  CRISPR gRNA sequence
atgtggaaggagccaagtgc

SEQ ID NO: 253746 - DNA, 20 bp, Artificial
  CRISPR gRNA sequence
aggagccaagtgctggacct

SEQ ID NO: 253747 - DNA, 20 bp, Artificial
  CRISPR gRNA sequence
gagccaagtgctggacctga

SEQ ID NO: 253748 - DNA, 20 bp, Artificial
  CRISPR gRNA sequence
gccaagtgctggacctgaga

SEQ ID NO: 253749 - DNA, 20 bp, Artificial
  CRISPR gRNA sequence
caagtgctggacctgagaga

SEQ ID NO: 253750 - DNA, 20 bp, Artificial
  CRISPR gRNA sequence
agtgctggacctgagagaga

SEQ ID NO: 253751 - DNA, 20 bp, Artificial
  CRISPR gRNA sequence
tgctggacctgagagagaga

SEQ ID NO: 253752 - DNA, 20 bp, Artificial
  CRISPR gRNA sequence
ctggacctgagagagagaga

SEQ ID NO: 253753 - DNA, 20 bp, Artificial
  CRISPR gRNA sequence
ggacctgagagagagagaga

SEQ ID NO: 253754 - DNA, 20 bp, Artificial
  CRISPR gRNA sequence
gacctgagagagagagagag

SEQ ID NO: 253755 - DNA, 20 bp, Artificial
  CRISPR gRNA sequence
acctgagagagagagagaga

SEQ ID NO: 253756 - DNA, 20 bp, Artificial
  CRISPR gRNA sequence
ctgagagagagagagagagg

SEQ ID NO: 253757 - DNA, 20 bp, Artificial
  CRISPR gRNA sequence
gagagagagagagagaggga

SEQ ID NO: 253758 - DNA, 20 bp, Artificial
  CRISPR gRNA sequence
gagagagagagagagggaga

SEQ ID NO: 253759 - DNA, 20 bp, Artificial
  CRISPR gRNA sequence
gagagagagagagggagaga

SEQ ID NO: 253760 - DNA, 20 bp, Artificial
  CRISPR gRNA sequence
gagagagagagggagagaga

SEQ ID NO: 253761 - DNA, 20 bp, Artificial
  CRISPR gRNA sequence
gagagagagggagagagaga

SEQ ID NO: 253762 - DNA, 20 bp, Artificial
  CRISPR gRNA sequence
gagagagggagagagagaga

SEQ ID NO: 253763 - DNA, 20 bp, Artificial
  CRISPR gRNA sequence
gagagggagagagagagaga

SEQ ID NO: 253764 - DNA, 20 bp, Artificial
  CRISPR gRNA sequence
gagggagagagagagagaga

SEQ ID NO: 253765 - DNA, 20 bp, Artificial
  CRISPR gRNA sequence
gggagagagagagagagaga

SEQ ID NO: 253766 - DNA, 20 bp, Artificial
  CRISPR gRNA sequence
gagagagagagagagagaga

SEQ ID NO: 253767 - DNA, 20 bp, Artificial
  CRISPR gRNA sequence
gagagagagagagagagaga

SEQ ID NO: 253768 - DNA, 20 bp, Artificial
  CRISPR gRNA sequence
gagagagagagagagagaca

SEQ ID NO: 253769 - DNA, 20 bp, Artificial
  CRISPR gRNA sequence
gagagagagagagagacaga

SEQ ID NO: 253770 - DNA, 20 bp, Artificial
  CRISPR gRNA sequence
gagagagagagagacagaga

SEQ ID NO: 253771 - DNA, 20 bp, Artificial
  CRISPR gRNA sequence
gagagagagagacagagaga

SEQ ID NO: 253772 - DNA, 20 bp, Artificial
  CRISPR gRNA sequence
gagagagagacagagagaga

SEQ ID NO: 253773 - DNA, 20 bp, Artificial
  CRISPR gRNA sequence
agagtgtgtgtgtgtgtgtg

SEQ ID NO: 253774 - DNA, 20 bp, Artificial
  CRISPR gRNA sequence
tgtgtgtgtgtgtagcattg

SEQ ID NO: 253775 - DNA, 20 bp, Artificial
  CRISPR gRNA sequence
gtgtgtgtgtgtagcattgc

SEQ ID NO: 253776 - DNA, 20 bp, Artificial
  CRISPR gRNA sequence
tgtgtgtgtgtagcattgca

SEQ ID NO: 253777 - DNA, 20 bp, Artificial
  CRISPR gRNA sequence
tgtgtagcattgcagggctt

SEQ ID NO: 253778 - DNA, 20 bp, Artificial
  CRISPR gRNA sequence
gtgtagcattgcagggcttg

SEQ ID NO: 253779 - DNA, 20 bp, Artificial
  CRISPR gRNA sequence
tgtagcattgcagggcttga

SEQ ID NO: 253780 - DNA, 20 bp, Artificial
  CRISPR gRNA sequence
agcattgcagggcttgaggg

SEQ ID NO: 253781 - DNA, 20 bp, Artificial
  CRISPR gRNA sequence
cattgcagggcttgagggta

SEQ ID NO: 253782 - DNA, 20 bp, Artificial
  CRISPR gRNA sequence
tgcagggcttgagggtagag

SEQ ID NO: 253783 - DNA, 20 bp, Artificial
  CRISPR gRNA sequence
gcagggcttgagggtagaga

SEQ ID NO: 253784 - DNA, 20 bp, Artificial
  CRISPR gRNA sequence
cagggcttgagggtagagaa

SEQ ID NO: 253785 - DNA, 20 bp, Artificial
  CRISPR gRNA sequence
agggtagagaagggtattat

SEQ ID NO: 253786 - DNA, 20 bp, Artificial
  CRISPR gRNA sequence
gggtagagaagggtattatt

SEQ ID NO: 253787 - DNA, 20 bp, Artificial
  CRISPR gRNA sequence
agagaagggtattattagga

SEQ ID NO: 253788 - DNA, 20 bp, Artificial
  CRISPR gRNA sequence
aagggtattattaggaaaga

SEQ ID NO: 253789 - DNA, 20 bp, Artificial
  CRISPR gRNA sequence
agggtattattaggaaagaa

SEQ ID NO: 253790 - DNA, 20 bp, Artificial
  CRISPR gRNA sequence
ggtattattaggaaagaaag

SEQ ID NO: 253791 - DNA, 20 bp, Artificial
  CRISPR gRNA sequence
gtattattaggaaagaaagg

SEQ ID NO: 253792 - DNA, 20 bp, Artificial
  CRISPR gRNA sequence
attattaggaaagaaaggag

SEQ ID NO: 253793 - DNA, 20 bp, Artificial
  CRISPR gRNA sequence
ttattaggaaagaaaggagg

SEQ ID NO: 253794 - DNA, 20 bp, Artificial
  CRISPR gRNA sequence
attaggaaagaaaggaggag

SEQ ID NO: 253795 - DNA, 20 bp, Artificial
  CRISPR gRNA sequence
ttaggaaagaaaggaggagg

SEQ ID NO: 253796 - DNA, 20 bp, Artificial
  CRISPR gRNA sequence
taggaaagaaaggaggagga

SEQ ID NO: 253797 - DNA, 20 bp, Artificial
  CRISPR gRNA sequence
ggaaagaaaggaggaggagg

SEQ ID NO: 253798 - DNA, 20 bp, Artificial
  CRISPR gRNA sequence
aaagaaaggaggaggaggga

SEQ ID NO: 253799 - DNA, 20 bp, Artificial
  CRISPR gRNA sequence
aagaaaggaggaggagggag

SEQ ID NO: 253800 - DNA, 20 bp, Artificial
  CRISPR gRNA sequence
aggaggagggagaggaaaaa

SEQ ID NO: 253801 - DNA, 20 bp, Artificial
  CRISPR gRNA sequence
gaggagggagaggaaaaaaa

SEQ ID NO: 253802 - DNA, 20 bp, Artificial
  CRISPR gRNA sequence
aggagggagaggaaaaaaag

SEQ ID NO: 253803 - DNA, 20 bp, Artificial
  CRISPR gRNA sequence
ggagggagaggaaaaaaaga

SEQ ID NO: 253804 - DNA, 20 bp, Artificial
  CRISPR gRNA sequence
gggagaggaaaaaaagaggg

SEQ ID NO: 253805 - DNA, 20 bp, Artificial
  CRISPR gRNA sequence
ggagaggaaaaaaagagggt

SEQ ID NO: 253806 - DNA, 20 bp, Artificial
  CRISPR gRNA sequence
gagaggaaaaaaagagggtg

SEQ ID NO: 253807 - DNA, 20 bp, Artificial
  CRISPR gRNA sequence
ggaaaaaaagagggtgggga

SEQ ID NO: 253808 - DNA, 20 bp, Artificial
  CRISPR gRNA sequence
agggtggggatagttttctc

SEQ ID NO: 253809 - DNA, 20 bp, Artificial
  CRISPR gRNA sequence
gggtggggatagttttctca

SEQ ID NO: 253810 - DNA, 20 bp, Artificial
  CRISPR gRNA sequence
gtggggatagttttctcaag

SEQ ID NO: 253811 - DNA, 20 bp, Artificial
  CRISPR gRNA sequence
ggatagttttctcaaggaga

SEQ ID NO: 253812 - DNA, 20 bp, Artificial
  CRISPR gRNA sequence
gatagttttctcaaggagat

SEQ ID NO: 253813 - DNA, 20 bp, Artificial
  CRISPR gRNA sequence
atagttttctcaaggagata

SEQ ID NO: 253814 - DNA, 20 bp, Artificial
  CRISPR gRNA sequence
agttttctcaaggagatagg

SEQ ID NO: 253815 - DNA, 20 bp, Artificial
  CRISPR gRNA sequence
gttttctcaaggagataggg

SEQ ID NO: 253816 - DNA, 20 bp, Artificial
  CRISPR gRNA sequence
ttttctcaaggagataggga

SEQ ID NO: 253817 - DNA, 20 bp, Artificial
  CRISPR gRNA sequence
ttctcaaggagatagggagg

SEQ ID NO: 253818 - DNA, 20 bp, Artificial
  CRISPR gRNA sequence
agggagggagatttgttgca

SEQ ID NO: 253819 - DNA, 20 bp, Artificial
  CRISPR gRNA sequence
gggagggagatttgttgcat

SEQ ID NO: 253820 - DNA, 20 bp, Artificial
  CRISPR gRNA sequence
gagggagatttgttgcatag

SEQ ID NO: 253821 - DNA, 20 bp, Artificial
  CRISPR gRNA sequence
agatttgttgcataggagat

SEQ ID NO: 253822 - DNA, 20 bp, Artificial
  CRISPR gRNA sequence
tgcataggagatgagtgtat

SEQ ID NO: 253823 - DNA, 20 bp, Artificial
  CRISPR gRNA sequence
cataggagatgagtgtatta

SEQ ID NO: 253824 - DNA, 20 bp, Artificial
  CRISPR gRNA sequence
taggagatgagtgtattaga

SEQ ID NO: 253825 - DNA, 20 bp, Artificial
  CRISPR gRNA sequence
ggagatgagtgtattagaga

SEQ ID NO: 253826 - DNA, 20 bp, Artificial
  CRISPR gRNA sequence
gagatgagtgtattagagag

SEQ ID NO: 253827 - DNA, 20 bp, Artificial
  CRISPR gRNA sequence
gatgagtgtattagagagag

SEQ ID NO: 253828 - DNA, 20 bp, Artificial
  CRISPR gRNA sequence
atgagtgtattagagagagg

SEQ ID NO: 253829 - DNA, 20 bp, Artificial
  CRISPR gRNA sequence
agagaggaggacaaatctct

SEQ ID NO: 253830 - DNA, 20 bp, Artificial
  CRISPR gRNA sequence
gaggaggacaaatctctaag

SEQ ID NO: 253831 - DNA, 20 bp, Artificial
  CRISPR gRNA sequence
aggacaaatctctaagaaga

SEQ ID NO: 253832 - DNA, 20 bp, Artificial
  CRISPR gRNA sequence
ggacaaatctctaagaagat

SEQ ID NO: 253833 - DNA, 20 bp, Artificial
  CRISPR gRNA sequence
gacaaatctctaagaagata

SEQ ID NO: 253834 - DNA, 20 bp, Artificial
  CRISPR gRNA sequence
caaatctctaagaagatagg

SEQ ID NO: 253835 - DNA, 20 bp, Artificial
  CRISPR gRNA sequence
aaatctctaagaagataggg

SEQ ID NO: 253836 - DNA, 20 bp, Artificial
  CRISPR gRNA sequence
tctctaagaagatagggagg

SEQ ID NO: 253837 - DNA, 20 bp, Artificial
  CRISPR gRNA sequence
tctaagaagatagggaggaa

SEQ ID NO: 253838 - DNA, 20 bp, Artificial
  CRISPR gRNA sequence
aagaagatagggaggaagag

SEQ ID NO: 253839 - DNA, 20 bp, Artificial
  CRISPR gRNA sequence
gaagatagggaggaagagaa

SEQ ID NO: 253840 - DNA, 20 bp, Artificial
  CRISPR gRNA sequence
ggaggaagagaagagactta

SEQ ID NO: 253841 - DNA, 20 bp, Artificial
  CRISPR gRNA sequence
gaggaagagaagagacttat

SEQ ID NO: 253842 - DNA, 20 bp, Artificial
  CRISPR gRNA sequence
aggaagagaagagacttata

SEQ ID NO: 253843 - DNA, 20 bp, Artificial
  CRISPR gRNA sequence
ggaagagaagagacttatag

SEQ ID NO: 253844 - DNA, 20 bp, Artificial
  CRISPR gRNA sequence
agagaagagacttatagggg

SEQ ID NO: 253845 - DNA, 20 bp, Artificial
  CRISPR gRNA sequence
agaagagacttataggggta

SEQ ID NO: 253846 - DNA, 20 bp, Artificial
  CRISPR gRNA sequence
agacttataggggtagagat

SEQ ID NO: 253847 - DNA, 20 bp, Artificial
  CRISPR gRNA sequence
ttataggggtagagataagt

SEQ ID NO: 253848 - DNA, 20 bp, Artificial
  CRISPR gRNA sequence
ggtagagataagttagaatg

SEQ ID NO: 253849 - DNA, 20 bp, Artificial
  CRISPR gRNA sequence
gataagttagaatgaagcta

SEQ ID NO: 253850 - DNA, 20 bp, Artificial
  CRISPR gRNA sequence
aagttagaatgaagctatgg

SEQ ID NO: 253851 - DNA, 20 bp, Artificial
  CRISPR gRNA sequence
agaatgaagctatggtagat

SEQ ID NO: 253852 - DNA, 20 bp, Artificial
  CRISPR gRNA sequence
gtagatgagtgattctatac

SEQ ID NO: 253853 - DNA, 20 bp, Artificial
  CRISPR gRNA sequence
gattctatactggtgaacct

SEQ ID NO: 253854 - DNA, 20 bp, Artificial
  CRISPR gRNA sequence
attctatactggtgaacctg

SEQ ID NO: 253855 - DNA, 20 bp, Artificial
  CRISPR gRNA sequence
ttaaaaacaaacaaatctct

SEQ ID NO: 253856 - DNA, 20 bp, Artificial
  CRISPR gRNA sequence
aaaaacaaacaaatctctca

SEQ ID NO: 253857 - DNA, 20 bp, Artificial
  CRISPR gRNA sequence
aacaaacaaatctctcagag

SEQ ID NO: 253858 - DNA, 20 bp, Artificial
  CRISPR gRNA sequence
acaaacaaatctctcagagt

SEQ ID NO: 253859 - DNA, 20 bp, Artificial
  CRISPR gRNA sequence
gatgttaaacctatatcaac

SEQ ID NO: 253860 - DNA, 20 bp, Artificial
  CRISPR gRNA sequence
atgttaaacctatatcaaca

SEQ ID NO: 253861 - DNA, 20 bp, Artificial
  CRISPR gRNA sequence
tgttaaacctatatcaacaa

SEQ ID NO: 253862 - DNA, 20 bp, Artificial
  CRISPR gRNA sequence
cctatatcaacaagggctac

SEQ ID NO: 253863 - DNA, 20 bp, Artificial
  CRISPR gRNA sequence
ctatatcaacaagggctact

SEQ ID NO: 253864 - DNA, 20 bp, Artificial
  CRISPR gRNA sequence
taatacatgccttctctctg

SEQ ID NO: 253865 - DNA, 20 bp, Artificial
  CRISPR gRNA sequence
tgtactttaaattcttgctt

SEQ ID NO: 253866 - DNA, 20 bp, Artificial
  CRISPR gRNA sequence
gtcctcaacaatgcacacta

SEQ ID NO: 253867 - DNA, 20 bp, Artificial
  CRISPR gRNA sequence
tcaacaatgcacactatggc

SEQ ID NO: 253868 - DNA, 20 bp, Artificial
  CRISPR gRNA sequence
caacaatgcacactatggct

SEQ ID NO: 253869 - DNA, 20 bp, Artificial
  CRISPR gRNA sequence
actatggctaggcttgacct

SEQ ID NO: 253870 - DNA, 20 bp, Artificial
  CRISPR gRNA sequence
ctaggcttgacctcagctca

SEQ ID NO: 253871 - DNA, 20 bp, Artificial
  CRISPR gRNA sequence
cttgacctcagctcacggct

SEQ ID NO: 253872 - DNA, 20 bp, Artificial
  CRISPR gRNA sequence
tcagctcacggctgagatca

SEQ ID NO: 253873 - DNA, 20 bp, Artificial
  CRISPR gRNA sequence
cagctcacggctgagatcac

SEQ ID NO: 253874 - DNA, 20 bp, Artificial
  CRISPR gRNA sequence
agctcacggctgagatcaca

SEQ ID NO: 253875 - DNA, 20 bp, Artificial
  CRISPR gRNA sequence
cggctgagatcacagggtca

SEQ ID NO: 253876 - DNA, 20 bp, Artificial
  CRISPR gRNA sequence
ggctgagatcacagggtcac

SEQ ID NO: 253877 - DNA, 20 bp, Artificial
  CRISPR gRNA sequence
gctgagatcacagggtcaca

SEQ ID NO: 253878 - DNA, 20 bp, Artificial
  CRISPR gRNA sequence
accaaccctgcccaacatta

SEQ ID NO: 253879 - DNA, 20 bp, Artificial
  CRISPR gRNA sequence
ccaaccctgcccaacattat

SEQ ID NO: 253880 - DNA, 20 bp, Artificial
  CRISPR gRNA sequence
accctgcccaacattatggg

SEQ ID NO: 253881 - DNA, 20 bp, Artificial
  CRISPR gRNA sequence
ccctgcccaacattatgggc

SEQ ID NO: 253882 - DNA, 20 bp, Artificial
  CRISPR gRNA sequence
caacattatgggcgggactc

SEQ ID NO: 253883 - DNA, 20 bp, Artificial
  CRISPR gRNA sequence
atgggcgggactctagtttc

SEQ ID NO: 253884 - DNA, 20 bp, Artificial
  CRISPR gRNA sequence
gcgggactctagtttccagt

SEQ ID NO: 253885 - DNA, 20 bp, Artificial
  CRISPR gRNA sequence
cgggactctagtttccagtc

SEQ ID NO: 253886 - DNA, 20 bp, Artificial
  CRISPR gRNA sequence
gggactctagtttccagtca

SEQ ID NO: 253887 - DNA, 20 bp, Artificial
  CRISPR gRNA sequence
ccagtcagggatgttaatct

SEQ ID NO: 253888 - DNA, 20 bp, Artificial
  CRISPR gRNA sequence
tagcatttccctgtgtgttt

SEQ ID NO: 253889 - DNA, 20 bp, Artificial
  CRISPR gRNA sequence
ttccctgtgtgttttggaac

SEQ ID NO: 253890 - DNA, 20 bp, Artificial
  CRISPR gRNA sequence
tccctgtgtgttttggaaca

SEQ ID NO: 253891 - DNA, 20 bp, Artificial
  CRISPR gRNA sequence
tgtgttttggaacaaggata

SEQ ID NO: 253892 - DNA, 20 bp, Artificial
  CRISPR gRNA sequence
aggatatggttgcttgacct

SEQ ID NO: 253893 - DNA, 20 bp, Artificial
  CRISPR gRNA sequence
atggttgcttgaccttggct

SEQ ID NO: 253894 - DNA, 20 bp, Artificial
  CRISPR gRNA sequence
tggttgcttgaccttggctt

SEQ ID NO: 253895 - DNA, 20 bp, Artificial
  CRISPR gRNA sequence
ggttgcttgaccttggcttg

SEQ ID NO: 253896 - DNA, 20 bp, Artificial
  CRISPR gRNA sequence
ttgcttgaccttggcttggg

SEQ ID NO: 253897 - DNA, 20 bp, Artificial
  CRISPR gRNA sequence
tgcttgaccttggcttgggg

SEQ ID NO: 253898 - DNA, 20 bp, Artificial
  CRISPR gRNA sequence
tgaccttggcttggggaggc

SEQ ID NO: 253899 - DNA, 20 bp, Artificial
  CRISPR gRNA sequence
ctctcttttttcaaactcaa

SEQ ID NO: 253900 - DNA, 20 bp, Artificial
  CRISPR gRNA sequence
caaactcaaaagctaatccc

SEQ ID NO: 253901 - DNA, 20 bp, Artificial
  CRISPR gRNA sequence
aaactcaaaagctaatccca

SEQ ID NO: 253902 - DNA, 20 bp, Artificial
  CRISPR gRNA sequence
gctaatcccaaggatttctc

SEQ ID NO: 253903 - DNA, 20 bp, Artificial
  CRISPR gRNA sequence
ctaatcccaaggatttctca

SEQ ID NO: 253904 - DNA, 20 bp, Artificial
  CRISPR gRNA sequence
atcccaaggatttctcaagg

SEQ ID NO: 253905 - DNA, 20 bp, Artificial
  CRISPR gRNA sequence
tcccaaggatttctcaaggt

SEQ ID NO: 253906 - DNA, 20 bp, Artificial
  CRISPR gRNA sequence
cccaaggatttctcaaggtg

SEQ ID NO: 253907 - DNA, 20 bp, Artificial
  CRISPR gRNA sequence
ccaaggatttctcaaggtgg

SEQ ID NO: 253908 - DNA, 20 bp, Artificial
  CRISPR gRNA sequence
ctcaaggtgggggatgtgat

SEQ ID NO: 253909 - DNA, 20 bp, Artificial
  CRISPR gRNA sequence
tcaaggtgggggatgtgatt

SEQ ID NO: 253910 - DNA, 20 bp, Artificial
  CRISPR gRNA sequence
aaggtgggggatgtgattag

SEQ ID NO: 253911 - DNA, 20 bp, Artificial
  CRISPR gRNA sequence
ggggatgtgattaggagtat

SEQ ID NO: 253912 - DNA, 20 bp, Artificial
  CRISPR gRNA sequence
attagtctatcatactgtga

SEQ ID NO: 253913 - DNA, 20 bp, Artificial
  CRISPR gRNA sequence
atactgtgacagaacttttc

SEQ ID NO: 253914 - DNA, 20 bp, Artificial
  CRISPR gRNA sequence
tactgtgacagaacttttct

SEQ ID NO: 253915 - DNA, 20 bp, Artificial
  CRISPR gRNA sequence
gacagaacttttctaggcct

SEQ ID NO: 253916 - DNA, 20 bp, Artificial
  CRISPR gRNA sequence
gtttcttcatctgatacatg

SEQ ID NO: 253917 - DNA, 20 bp, Artificial
  CRISPR gRNA sequence
ttcttcatctgatacatgaa

SEQ ID NO: 253918 - DNA, 20 bp, Artificial
  CRISPR gRNA sequence
catctgatacatgaagagtt

SEQ ID NO: 253919 - DNA, 20 bp, Artificial
  CRISPR gRNA sequence
atctgatacatgaagagttt

SEQ ID NO: 253920 - DNA, 20 bp, Artificial
  CRISPR gRNA sequence
gatacatgaagagtttgggc

SEQ ID NO: 253921 - DNA, 20 bp, Artificial
  CRISPR gRNA sequence
tacatgaagagtttgggctg

SEQ ID NO: 253922 - DNA, 20 bp, Artificial
  CRISPR gRNA sequence
acatgaagagtttgggctgg

SEQ ID NO: 253923 - DNA, 20 bp, Artificial
  CRISPR gRNA sequence
gtttgggctggaggatatct

SEQ ID NO: 253924 - DNA, 20 bp, Artificial
  CRISPR gRNA sequence
tttgggctggaggatatctc

SEQ ID NO: 253925 - DNA, 20 bp, Artificial
  CRISPR gRNA sequence
gatatctcaggtctactttc

SEQ ID NO: 253926 - DNA, 20 bp, Artificial
  CRISPR gRNA sequence
aggtctactttctggcttaa

SEQ ID NO: 253927 - DNA, 20 bp, Artificial
  CRISPR gRNA sequence
ctggcttaaaagtgcttctg

SEQ ID NO: 253928 - DNA, 20 bp, Artificial
  CRISPR gRNA sequence
gcttaaaagtgcttctgaag

SEQ ID NO: 253929 - DNA, 20 bp, Artificial
  CRISPR gRNA sequence
ctgaagtggaattttttaaa

SEQ ID NO: 253930 - DNA, 20 bp, Artificial
  CRISPR gRNA sequence
tttaaaaagctaacttttgt

SEQ ID NO: 253931 - DNA, 20 bp, Artificial
  CRISPR gRNA sequence
ttaaaaagctaacttttgtc

SEQ ID NO: 253932 - DNA, 20 bp, Artificial
  CRISPR gRNA sequence
taacttttgtcgggtctaac

SEQ ID NO: 253933 - DNA, 20 bp, Artificial
  CRISPR gRNA sequence
aacttttgtcgggtctaaca

SEQ ID NO: 253934 - DNA, 20 bp, Artificial
  CRISPR gRNA sequence
ttttgtcgggtctaacaagg

SEQ ID NO: 253935 - DNA, 20 bp, Artificial
  CRISPR gRNA sequence
tcaactaccccatccccttg

SEQ ID NO: 253936 - DNA, 20 bp, Artificial
  CRISPR gRNA sequence
tggatgctcttatgacctga

SEQ ID NO: 253937 - DNA, 20 bp, Artificial
  CRISPR gRNA sequence
gatgctcttatgacctgata

SEQ ID NO: 253938 - DNA, 20 bp, Artificial
  CRISPR gRNA sequence
tgacctgatagagcaaatac

SEQ ID NO: 253939 - DNA, 20 bp, Artificial
  CRISPR gRNA sequence
atagagcaaatacaagaaat

SEQ ID NO: 253940 - DNA, 20 bp, Artificial
  CRISPR gRNA sequence
aaatacaagaaattagaaac

SEQ ID NO: 253941 - DNA, 20 bp, Artificial
  CRISPR gRNA sequence
gccatctctgaaatcccttg

SEQ ID NO: 253942 - DNA, 20 bp, Artificial
  CRISPR gRNA sequence
ccatctctgaaatcccttgc

SEQ ID NO: 253943 - DNA, 20 bp, Artificial
  CRISPR gRNA sequence
catctctgaaatcccttgca

SEQ ID NO: 253944 - DNA, 20 bp, Artificial
  CRISPR gRNA sequence
cccttgcagggattgctaac

SEQ ID NO: 253945 - DNA, 20 bp, Artificial
  CRISPR gRNA sequence
ccttgcagggattgctaacc

SEQ ID NO: 253946 - DNA, 20 bp, Artificial
  CRISPR gRNA sequence
ctaaatgctgctaatgtgct

SEQ ID NO: 253947 - DNA, 20 bp, Artificial
  CRISPR gRNA sequence
atgtgcttagaaatgactgc

SEQ ID NO: 253948 - DNA, 20 bp, Artificial
  CRISPR gRNA sequence
agaaatgactgctggacttt

SEQ ID NO: 253949 - DNA, 20 bp, Artificial
  CRISPR gRNA sequence
gaaatgactgctggactttg

SEQ ID NO: 253950 - DNA, 20 bp, Artificial
  CRISPR gRNA sequence
aaatgactgctggactttga

SEQ ID NO: 253951 - DNA, 20 bp, Artificial
  CRISPR gRNA sequence
aatgactgctggactttgag

SEQ ID NO: 253952 - DNA, 20 bp, Artificial
  CRISPR gRNA sequence
atgactgctggactttgagg

SEQ ID NO: 253953 - DNA, 20 bp, Artificial
  CRISPR gRNA sequence
ctgttttcctatgcaatgtt

SEQ ID NO: 253954 - DNA, 20 bp, Artificial
  CRISPR gRNA sequence
tgttttcctatgcaatgtta

SEQ ID NO: 253955 - DNA, 20 bp, Artificial
  CRISPR gRNA sequence
tgcaatgttaaggtccaaca

SEQ ID NO: 253956 - DNA, 20 bp, Artificial
  CRISPR gRNA sequence
acagtaattatttaaacttc

SEQ ID NO: 253957 - DNA, 20 bp, Artificial
  CRISPR gRNA sequence
cagtaattatttaaacttct

SEQ ID NO: 253958 - DNA, 20 bp, Artificial
  CRISPR gRNA sequence
tctgggccatgacatttacc

SEQ ID NO: 253959 - DNA, 20 bp, Artificial
  CRISPR gRNA sequence
tgggccatgacatttacctg

SEQ ID NO: 253960 - DNA, 20 bp, Artificial
  CRISPR gRNA sequence
gggccatgacatttacctgg

SEQ ID NO: 253961 - DNA, 20 bp, Artificial
  CRISPR gRNA sequence
ctggaggttctgtatatgac

SEQ ID NO: 253962 - DNA, 20 bp, Artificial
  CRISPR gRNA sequence
tggaggttctgtatatgaca

SEQ ID NO: 253963 - DNA, 20 bp, Artificial
  CRISPR gRNA sequence
gtatatgacaaggtgatcct

SEQ ID NO: 253964 - DNA, 20 bp, Artificial
  CRISPR gRNA sequence
tatgacaaggtgatcctgag

SEQ ID NO: 253965 - DNA, 20 bp, Artificial
  CRISPR gRNA sequence
gtgatcctgagcagattctt

SEQ ID NO: 253966 - DNA, 20 bp, Artificial
  CRISPR gRNA sequence
gatcctgagcagattcttca

SEQ ID NO: 253967 - DNA, 20 bp, Artificial
  CRISPR gRNA sequence
atcctgagcagattcttcag

SEQ ID NO: 253968 - DNA, 20 bp, Artificial
  CRISPR gRNA sequence
ttcttcagaggtatgtgatt

SEQ ID NO: 253969 - DNA, 20 bp, Artificial
  CRISPR gRNA sequence
tcttcagaggtatgtgattt

SEQ ID NO: 253970 - DNA, 20 bp, Artificial
  CRISPR gRNA sequence
tcagaggtatgtgatttagg

SEQ ID NO: 253971 - DNA, 20 bp, Artificial
  CRISPR gRNA sequence
ggtatgtgatttaggcagaa

SEQ ID NO: 253972 - DNA, 20 bp, Artificial
  CRISPR gRNA sequence
gtgatttaggcagaatggaa

SEQ ID NO: 253973 - DNA, 20 bp, Artificial
  CRISPR gRNA sequence
tttaggcagaatggaacaga

SEQ ID NO: 253974 - DNA, 20 bp, Artificial
  CRISPR gRNA sequence
ttaggcagaatggaacagac

SEQ ID NO: 253975 - DNA, 20 bp, Artificial
  CRISPR gRNA sequence
atgtactgttgtcttcatca

SEQ ID NO: 253976 - DNA, 20 bp, Artificial
  CRISPR gRNA sequence
gtactgttgtcttcatcaca

SEQ ID NO: 253977 - DNA, 20 bp, Artificial
  CRISPR gRNA sequence
atcacagagttgttttgaat

SEQ ID NO: 253978 - DNA, 20 bp, Artificial
  CRISPR gRNA sequence
tcacagagttgttttgaatg

SEQ ID NO: 253979 - DNA, 20 bp, Artificial
  CRISPR gRNA sequence
cacagagttgttttgaatga

SEQ ID NO: 253980 - DNA, 20 bp, Artificial
  CRISPR gRNA sequence
agttgttttgaatgagggat

SEQ ID NO: 253981 - DNA, 20 bp, Artificial
  CRISPR gRNA sequence
gttgttttgaatgagggatc

SEQ ID NO: 253982 - DNA, 20 bp, Artificial
  CRISPR gRNA sequence
atgagggatcaggataattg

SEQ ID NO: 253983 - DNA, 20 bp, Artificial
  CRISPR gRNA sequence
ggatcaggataattgtggct

SEQ ID NO: 253984 - DNA, 20 bp, Artificial
  CRISPR gRNA sequence
gatcaggataattgtggctc

SEQ ID NO: 253985 - DNA, 20 bp, Artificial
  CRISPR gRNA sequence
tcaggataattgtggctcag

SEQ ID NO: 253986 - DNA, 20 bp, Artificial
  CRISPR gRNA sequence
caggataattgtggctcagg

SEQ ID NO: 253987 - DNA, 20 bp, Artificial
  CRISPR gRNA sequence
tgtggctcaggaggaaaata

SEQ ID NO: 253988 - DNA, 20 bp, Artificial
  CRISPR gRNA sequence
gaaaatatggctctcaaatt

SEQ ID NO: 253989 - DNA, 20 bp, Artificial
  CRISPR gRNA sequence
tggctctcaaatttggttac

SEQ ID NO: 253990 - DNA, 20 bp, Artificial
  CRISPR gRNA sequence
actagattaaaacatatatt

SEQ ID NO: 253991 - DNA, 20 bp, Artificial
  CRISPR gRNA sequence
tttagaaaataataaattaa

SEQ ID NO: 253992 - DNA, 20 bp, Artificial
  CRISPR gRNA sequence
tagaaaataataaattaata

SEQ ID NO: 253993 - DNA, 20 bp, Artificial
  CRISPR gRNA sequence
agaaaataataaattaatag

SEQ ID NO: 253994 - DNA, 20 bp, Artificial
  CRISPR gRNA sequence
aaaataataaattaatagag

SEQ ID NO: 253995 - DNA, 20 bp, Artificial
  CRISPR gRNA sequence
aaataataaattaatagagg

SEQ ID NO: 253996 - DNA, 20 bp, Artificial
  CRISPR gRNA sequence
aggaggtctctttatacctg

SEQ ID NO: 253997 - DNA, 20 bp, Artificial
  CRISPR gRNA sequence
ggaggtctctttatacctgt

SEQ ID NO: 253998 - DNA, 20 bp, Artificial
  CRISPR gRNA sequence
actataataatatatatgta

SEQ ID NO: 253999 - DNA, 20 bp, Artificial
  CRISPR gRNA sequence
taataatatatatgtacaga

SEQ ID NO: 254000 - DNA, 20 bp, Artificial
  CRISPR gRNA sequence
tacagaaagctataattccc

SEQ ID NO: 254001 - DNA, 20 bp, Artificial
  CRISPR gRNA sequence
ttccctggttacctcctatt

SEQ ID NO: 254002 - DNA, 20 bp, Artificial
  CRISPR gRNA sequence
gttacctcctatttagacta

SEQ ID NO: 254003 - DNA, 20 bp, Artificial
  CRISPR gRNA sequence
ttacctcctatttagactac

SEQ ID NO: 254004 - DNA, 20 bp, Artificial
  CRISPR gRNA sequence
ttagactacaggcaaccttt

SEQ ID NO: 254005 - DNA, 20 bp, Artificial
  CRISPR gRNA sequence
ctacaggcaaccttttagaa

SEQ ID NO: 254006 - DNA, 20 bp, Artificial
  CRISPR gRNA sequence
aggcaaccttttagaatagt

SEQ ID NO: 254007 - DNA, 20 bp, Artificial
  CRISPR gRNA sequence
agaatagtgagatttgattt

SEQ ID NO: 254008 - DNA, 20 bp, Artificial
  CRISPR gRNA sequence
gaatagtgagatttgatttt

SEQ ID NO: 254009 - DNA, 20 bp, Artificial
  CRISPR gRNA sequence
aatagtgagatttgattttg

SEQ ID NO: 254010 - DNA, 20 bp, Artificial
  CRISPR gRNA sequence
tagtgagatttgattttggg

SEQ ID NO: 254011 - DNA, 20 bp, Artificial
  CRISPR gRNA sequence
tttgattttggggagttgtc

SEQ ID NO: 254012 - DNA, 20 bp, Artificial
  CRISPR gRNA sequence
gattttggggagttgtctgg

SEQ ID NO: 254013 - DNA, 20 bp, Artificial
  CRISPR gRNA sequence
gggagttgtctggtggctct

SEQ ID NO: 254014 - DNA, 20 bp, Artificial
  CRISPR gRNA sequence
ttgtctggtggctcttggta

SEQ ID NO: 254015 - DNA, 20 bp, Artificial
  CRISPR gRNA sequence
tgtctggtggctcttggtat

SEQ ID NO: 254016 - DNA, 20 bp, Artificial
  CRISPR gRNA sequence
tatgggttccactttcatgt

SEQ ID NO: 254017 - DNA, 20 bp, Artificial
  CRISPR gRNA sequence
gttccactttcatgtaagtt

SEQ ID NO: 254018 - DNA, 20 bp, Artificial
  CRISPR gRNA sequence
ttccactttcatgtaagtta

SEQ ID NO: 254019 - DNA, 20 bp, Artificial
  CRISPR gRNA sequence
ctcttgctatgttgtcccct

SEQ ID NO: 254020 - DNA, 20 bp, Artificial
  CRISPR gRNA sequence
ttagattgtctttctaacat

SEQ ID NO: 254021 - DNA, 20 bp, Artificial
  CRISPR gRNA sequence
tagattgtctttctaacatt

SEQ ID NO: 254022 - DNA, 20 bp, Artificial
  CRISPR gRNA sequence
gattgtctttctaacattag

SEQ ID NO: 254023 - DNA, 20 bp, Artificial
  CRISPR gRNA sequence
tctttctaacattaggagat

SEQ ID NO: 254024 - DNA, 20 bp, Artificial
  CRISPR gRNA sequence
tttctaacattaggagatca

SEQ ID NO: 254025 - DNA, 20 bp, Artificial
  CRISPR gRNA sequence
ttctaacattaggagatcag

SEQ ID NO: 254026 - DNA, 20 bp, Artificial
  CRISPR gRNA sequence
aggagatcagaggaaaattg

SEQ ID NO: 254027 - DNA, 20 bp, Artificial
  CRISPR gRNA sequence
ttgcagacctgacctgtgaa

SEQ ID NO: 254028 - DNA, 20 bp, Artificial
  CRISPR gRNA sequence
cagacctgacctgtgaacgg

SEQ ID NO: 254029 - DNA, 20 bp, Artificial
  CRISPR gRNA sequence
agacctgacctgtgaacggt

SEQ ID NO: 254030 - DNA, 20 bp, Artificial
  CRISPR gRNA sequence
gacctgacctgtgaacggta

SEQ ID NO: 254031 - DNA, 20 bp, Artificial
  CRISPR gRNA sequence
gacctgtgaacggtagggat

SEQ ID NO: 254032 - DNA, 20 bp, Artificial
  CRISPR gRNA sequence
acctgtgaacggtagggatt

SEQ ID NO: 254033 - DNA, 20 bp, Artificial
  CRISPR gRNA sequence
gattgggtcacactgcatct

SEQ ID NO: 254034 - DNA, 20 bp, Artificial
  CRISPR gRNA sequence
catctgagtttatgttgctt

SEQ ID NO: 254035 - DNA, 20 bp, Artificial
  CRISPR gRNA sequence
atctgagtttatgttgcttt

SEQ ID NO: 254036 - DNA, 20 bp, Artificial
  CRISPR gRNA sequence
gagtttatgttgctttgggt

SEQ ID NO: 254037 - DNA, 20 bp, Artificial
  CRISPR gRNA sequence
agtttatgttgctttgggtt

SEQ ID NO: 254038 - DNA, 20 bp, Artificial
  CRISPR gRNA sequence
ttatgttgctttgggttagg

SEQ ID NO: 254039 - DNA, 20 bp, Artificial
  CRISPR gRNA sequence
tgctttgggttaggaagttt

SEQ ID NO: 254040 - DNA, 20 bp, Artificial
  CRISPR gRNA sequence
gggttaggaagttttggtcc

SEQ ID NO: 254041 - DNA, 20 bp, Artificial
  CRISPR gRNA sequence
gttaggaagttttggtccca

SEQ ID NO: 254042 - DNA, 20 bp, Artificial
  CRISPR gRNA sequence
tcacatcctgcattgctgtg

SEQ ID NO: 254043 - DNA, 20 bp, Artificial
  CRISPR gRNA sequence
cattgctgtgtggtgtctct

SEQ ID NO: 254044 - DNA, 20 bp, Artificial
  CRISPR gRNA sequence
tgctgtgtggtgtctctgag

SEQ ID NO: 254045 - DNA, 20 bp, Artificial
  CRISPR gRNA sequence
tgtgtggtgtctctgagtgg

SEQ ID NO: 254046 - DNA, 20 bp, Artificial
  CRISPR gRNA sequence
gtgtggtgtctctgagtggt

SEQ ID NO: 254047 - DNA, 20 bp, Artificial
  CRISPR gRNA sequence
tgtggtgtctctgagtggta

SEQ ID NO: 254048 - DNA, 20 bp, Artificial
  CRISPR gRNA sequence
gtgtctctgagtggtaggga

SEQ ID NO: 254049 - DNA, 20 bp, Artificial
  CRISPR gRNA sequence
tgtctctgagtggtagggat

SEQ ID NO: 254050 - DNA, 20 bp, Artificial
  CRISPR gRNA sequence
tgagtggtagggatgggtta

SEQ ID NO: 254051 - DNA, 20 bp, Artificial
  CRISPR gRNA sequence
ggtagggatgggttacagca

SEQ ID NO: 254052 - DNA, 20 bp, Artificial
  CRISPR gRNA sequence
gtagggatgggttacagcac

SEQ ID NO: 254053 - DNA, 20 bp, Artificial
  CRISPR gRNA sequence
atgggttacagcacaggtga

SEQ ID NO: 254054 - DNA, 20 bp, Artificial
  CRISPR gRNA sequence
acagcacaggtgatggtttt

SEQ ID NO: 254055 - DNA, 20 bp, Artificial
  CRISPR gRNA sequence
tgtacatttctatccccaac

SEQ ID NO: 254056 - DNA, 20 bp, Artificial
  CRISPR gRNA sequence
caactggcttcctcgaactc

SEQ ID NO: 254057 - DNA, 20 bp, Artificial
  CRISPR gRNA sequence
cctatacttctaactccttc

SEQ ID NO: 254058 - DNA, 20 bp, Artificial
  CRISPR gRNA sequence
ctccttctggatctttcctc

SEQ ID NO: 254059 - DNA, 20 bp, Artificial
  CRISPR gRNA sequence
tccttctggatctttcctcc

SEQ ID NO: 254060 - DNA, 20 bp, Artificial
  CRISPR gRNA sequence
aacttacctcattttgtcaa

SEQ ID NO: 254061 - DNA, 20 bp, Artificial
  CRISPR gRNA sequence
cctccactcatacccttacc

SEQ ID NO: 254062 - DNA, 20 bp, Artificial
  CRISPR gRNA sequence
cttacccagtgcgtgaactc

SEQ ID NO: 254063 - DNA, 20 bp, Artificial
  CRISPR gRNA sequence
ttacccagtgcgtgaactct

SEQ ID NO: 254064 - DNA, 20 bp, Artificial
  CRISPR gRNA sequence
ccagtgcgtgaactctgggt

SEQ ID NO: 254065 - DNA, 20 bp, Artificial
  CRISPR gRNA sequence
tttccattcctgttcaccat

SEQ ID NO: 254066 - DNA, 20 bp, Artificial
  CRISPR gRNA sequence
caccatcagtctgtaaaact

SEQ ID NO: 254067 - DNA, 20 bp, Artificial
  CRISPR gRNA sequence
cttgtttgaccctttcatac

SEQ ID NO: 254068 - DNA, 20 bp, Artificial
  CRISPR gRNA sequence
cataccagctgccacctcca

SEQ ID NO: 254069 - DNA, 20 bp, Artificial
  CRISPR gRNA sequence
cagctgccacctccacagct

SEQ ID NO: 254070 - DNA, 20 bp, Artificial
  CRISPR gRNA sequence
agctgccacctccacagctc

SEQ ID NO: 254071 - DNA, 20 bp, Artificial
  CRISPR gRNA sequence
caggccttatgaactcacat

SEQ ID NO: 254072 - DNA, 20 bp, Artificial
  CRISPR gRNA sequence
tcacatcagtgctattgcat

SEQ ID NO: 254073 - DNA, 20 bp, Artificial
  CRISPR gRNA sequence
tattgcatcagcctcctgat

SEQ ID NO: 254074 - DNA, 20 bp, Artificial
  CRISPR gRNA sequence
ctcctgattggtctctgcct

SEQ ID NO: 254075 - DNA, 20 bp, Artificial
  CRISPR gRNA sequence
ctcagttcttcccttgctcc

SEQ ID NO: 254076 - DNA, 20 bp, Artificial
  CRISPR gRNA sequence
ttcttcccttgctccaagcc

SEQ ID NO: 254077 - DNA, 20 bp, Artificial
  CRISPR gRNA sequence
tcttcccttgctccaagcca

SEQ ID NO: 254078 - DNA, 20 bp, Artificial
  CRISPR gRNA sequence
cttcccttgctccaagccaa

SEQ ID NO: 254079 - DNA, 20 bp, Artificial
  CRISPR gRNA sequence
cccttgctccaagccaaggg

SEQ ID NO: 254080 - DNA, 20 bp, Artificial
  CRISPR gRNA sequence
gctccaagccaagggcagtc

SEQ ID NO: 254081 - DNA, 20 bp, Artificial
  CRISPR gRNA sequence
gattgcttgctgcactcctc

SEQ ID NO: 254082 - DNA, 20 bp, Artificial
  CRISPR gRNA sequence
attgcttgctgcactcctca

SEQ ID NO: 254083 - DNA, 20 bp, Artificial
  CRISPR gRNA sequence
aggctgtgctaaccttccca

SEQ ID NO: 254084 - DNA, 20 bp, Artificial
  CRISPR gRNA sequence
ctgtgctaaccttcccaaag

SEQ ID NO: 254085 - DNA, 20 bp, Artificial
  CRISPR gRNA sequence
gtaccacaacattctcaact

SEQ ID NO: 254086 - DNA, 20 bp, Artificial
  CRISPR gRNA sequence
attctcaactcagacatctt

SEQ ID NO: 254087 - DNA, 20 bp, Artificial
  CRISPR gRNA sequence
gacatcttcagcatctccca

SEQ ID NO: 254088 - DNA, 20 bp, Artificial
  CRISPR gRNA sequence
agcatctcccatggcctttc

SEQ ID NO: 254089 - DNA, 20 bp, Artificial
  CRISPR gRNA sequence
aaaatctatgtgccttttct

SEQ ID NO: 254090 - DNA, 20 bp, Artificial
  CRISPR gRNA sequence
ttttcttggctccccatgac

SEQ ID NO: 254091 - DNA, 20 bp, Artificial
  CRISPR gRNA sequence
tggctccccatgactggtat

SEQ ID NO: 254092 - DNA, 20 bp, Artificial
  CRISPR gRNA sequence
ctgtttccatcctacataaa

SEQ ID NO: 254093 - DNA, 20 bp, Artificial
  CRISPR gRNA sequence
acataaatggaatactctgc

SEQ ID NO: 254094 - DNA, 20 bp, Artificial
  CRISPR gRNA sequence
tcccaataaactctcacact

SEQ ID NO: 254095 - DNA, 20 bp, Artificial
  CRISPR gRNA sequence
cccaataaactctcacacta

SEQ ID NO: 254096 - DNA, 20 bp, Artificial
  CRISPR gRNA sequence
taaggtcatttccatgatct

SEQ ID NO: 254097 - DNA, 20 bp, Artificial
  CRISPR gRNA sequence
tagcctgtctaaatttgccc

SEQ ID NO: 254098 - DNA, 20 bp, Artificial
  CRISPR gRNA sequence
taaatttgccccagacctta

SEQ ID NO: 254099 - DNA, 20 bp, Artificial
  CRISPR gRNA sequence
ttgccccagaccttatggcc

SEQ ID NO: 254100 - DNA, 20 bp, Artificial
  CRISPR gRNA sequence
ttatggcccagctaaatgtg

SEQ ID NO: 254101 - DNA, 20 bp, Artificial
  CRISPR gRNA sequence
taaatgtgaagtctctacaa

SEQ ID NO: 254102 - DNA, 20 bp, Artificial
  CRISPR gRNA sequence
gaagtctctacaaaagcctc

SEQ ID NO: 254103 - DNA, 20 bp, Artificial
  CRISPR gRNA sequence
gcctccagaatcatcctgtc

SEQ ID NO: 254104 - DNA, 20 bp, Artificial
  CRISPR gRNA sequence
gaatcatcctgtctggaaac

SEQ ID NO: 254105 - DNA, 20 bp, Artificial
  CRISPR gRNA sequence
aatcatcctgtctggaaaca

SEQ ID NO: 254106 - DNA, 20 bp, Artificial
  CRISPR gRNA sequence
tgcctgtcaatgacccttta

SEQ ID NO: 254107 - DNA, 20 bp, Artificial
  CRISPR gRNA sequence
gcctgtcaatgaccctttaa

SEQ ID NO: 254108 - DNA, 20 bp, Artificial
  CRISPR gRNA sequence
cctgtcaatgaccctttaaa

SEQ ID NO: 254109 - DNA, 20 bp, Artificial
  CRISPR gRNA sequence
tttaaagggttcatgtacca

SEQ ID NO: 254110 - DNA, 20 bp, Artificial
  CRISPR gRNA sequence
aagggttcatgtaccacgga

SEQ ID NO: 254111 - DNA, 20 bp, Artificial
  CRISPR gRNA sequence
tcatgtaccacggatggctt

SEQ ID NO: 254112 - DNA, 20 bp, Artificial
  CRISPR gRNA sequence
atgtaccacggatggcttcg

SEQ ID NO: 254113 - DNA, 20 bp, Artificial
  CRISPR gRNA sequence
gtaccacggatggcttcgga

SEQ ID NO: 254114 - DNA, 20 bp, Artificial
  CRISPR gRNA sequence
ccacggatggcttcggagag

SEQ ID NO: 254115 - DNA, 20 bp, Artificial
  CRISPR gRNA sequence
gctgattgtgtacctgcctt

SEQ ID NO: 254116 - DNA, 20 bp, Artificial
  CRISPR gRNA sequence
acctgccttcggatttctcc

SEQ ID NO: 254117 - DNA, 20 bp, Artificial
  CRISPR gRNA sequence
ggatttctcctagaatgaaa

SEQ ID NO: 254118 - DNA, 20 bp, Artificial
  CRISPR gRNA sequence
tttacatcttcccatctcct

SEQ ID NO: 254119 - DNA, 20 bp, Artificial
  CRISPR gRNA sequence
cttcccatctcctaagaatc

SEQ ID NO: 254120 - DNA, 20 bp, Artificial
  CRISPR gRNA sequence
tcctaagaatcaagtacatt

SEQ ID NO: 254121 - DNA, 20 bp, Artificial
  CRISPR gRNA sequence
atgaatgaatgacgctgtca

SEQ ID NO: 254122 - DNA, 20 bp, Artificial
  CRISPR gRNA sequence
aatgaatgacgctgtcacag

SEQ ID NO: 254123 - DNA, 20 bp, Artificial
  CRISPR gRNA sequence
gaatgacgctgtcacagcag

SEQ ID NO: 254124 - DNA, 20 bp, Artificial
  CRISPR gRNA sequence
gacgctgtcacagcagaagt

SEQ ID NO: 254125 - DNA, 20 bp, Artificial
  CRISPR gRNA sequence
cagcagaagtcagaatacca

SEQ ID NO: 254126 - DNA, 20 bp, Artificial
  CRISPR gRNA sequence
agcagaagtcagaataccaa

SEQ ID NO: 254127 - DNA, 20 bp, Artificial
  CRISPR gRNA sequence
gacacatcaaaatttcttct

SEQ ID NO: 254128 - DNA, 20 bp, Artificial
  CRISPR gRNA sequence
catcaaaatttcttctcaga

SEQ ID NO: 254129 - DNA, 20 bp, Artificial
  CRISPR gRNA sequence
cctctcaaaaatgaatgcct

SEQ ID NO: 254130 - DNA, 20 bp, Artificial
  CRISPR gRNA sequence
ctctcaaaaatgaatgcctt

SEQ ID NO: 254131 - DNA, 20 bp, Artificial
  CRISPR gRNA sequence
aaaatgaatgccttaggtct

SEQ ID NO: 254132 - DNA, 20 bp, Artificial
  CRISPR gRNA sequence
cttaggtcttggtgctcata

SEQ ID NO: 254133 - DNA, 20 bp, Artificial
  CRISPR gRNA sequence
ttaggtcttggtgctcatat

SEQ ID NO: 254134 - DNA, 20 bp, Artificial
  CRISPR gRNA sequence
acctttgacttactttctga

SEQ ID NO: 254135 - DNA, 20 bp, Artificial
  CRISPR gRNA sequence
tactttctgacagttacatg

SEQ ID NO: 254136 - DNA, 20 bp, Artificial
  CRISPR gRNA sequence
tgtagcacaataattttttt

SEQ ID NO: 254137 - DNA, 20 bp, Artificial
  CRISPR gRNA sequence
tagcacaataatttttttaa

SEQ ID NO: 254138 - DNA, 20 bp, Artificial
  CRISPR gRNA sequence
agcacaataatttttttaag

SEQ ID NO: 254139 - DNA, 20 bp, Artificial
  CRISPR gRNA sequence
aataatttttttaagaggac

SEQ ID NO: 254140 - DNA, 20 bp, Artificial
  CRISPR gRNA sequence
ttttttaagaggacaagaac

SEQ ID NO: 254141 - DNA, 20 bp, Artificial
  CRISPR gRNA sequence
aacaagtgtcctctacatta

SEQ ID NO: 254142 - DNA, 20 bp, Artificial
  CRISPR gRNA sequence
cattatagtgtctgcctgtg

SEQ ID NO: 254143 - DNA, 20 bp, Artificial
  CRISPR gRNA sequence
attatagtgtctgcctgtgt

SEQ ID NO: 254144 - DNA, 20 bp, Artificial
  CRISPR gRNA sequence
cctgtgtaggaacacaaata

SEQ ID NO: 254145 - DNA, 20 bp, Artificial
  CRISPR gRNA sequence
ctgtgtaggaacacaaataa

SEQ ID NO: 254146 - DNA, 20 bp, Artificial
  CRISPR gRNA sequence
aggaacacaaataaaggtta

SEQ ID NO: 254147 - DNA, 20 bp, Artificial
  CRISPR gRNA sequence
ggaacacaaataaaggttaa

SEQ ID NO: 254148 - DNA, 20 bp, Artificial
  CRISPR gRNA sequence
acacaaataaaggttaaagg

SEQ ID NO: 254149 - DNA, 20 bp, Artificial
  CRISPR gRNA sequence
cacaaataaaggttaaaggt

SEQ ID NO: 254150 - DNA, 20 bp, Artificial
  CRISPR gRNA sequence
acaaataaaggttaaaggtg

SEQ ID NO: 254151 - DNA, 20 bp, Artificial
  CRISPR gRNA sequence
taaaggttaaaggtggggct

SEQ ID NO: 254152 - DNA, 20 bp, Artificial
  CRISPR gRNA sequence
gttaaaggtggggcttagat

SEQ ID NO: 254153 - DNA, 20 bp, Artificial
  CRISPR gRNA sequence
cttagattagtgctgaccaa

SEQ ID NO: 254154 - DNA, 20 bp, Artificial
  CRISPR gRNA sequence
actaaattatttatttattt

SEQ ID NO: 254155 - DNA, 20 bp, Artificial
  CRISPR gRNA sequence
aattatttatttatttgaga

SEQ ID NO: 254156 - DNA, 20 bp, Artificial
  CRISPR gRNA sequence
attatttatttatttgagat

SEQ ID NO: 254157 - DNA, 20 bp, Artificial
  CRISPR gRNA sequence
ttatttatttatttgagatg

SEQ ID NO: 254158 - DNA, 20 bp, Artificial
  CRISPR gRNA sequence
tggggtctcactttgttgct

SEQ ID NO: 254159 - DNA, 20 bp, Artificial
  CRISPR gRNA sequence
ggggtctcactttgttgctc

SEQ ID NO: 254160 - DNA, 20 bp, Artificial
  CRISPR gRNA sequence
tctcactttgttgctcaggc

SEQ ID NO: 254161 - DNA, 20 bp, Artificial
  CRISPR gRNA sequence
tcactttgttgctcaggctg

SEQ ID NO: 254162 - DNA, 20 bp, Artificial
  CRISPR gRNA sequence
ttgttgctcaggctggagtg

SEQ ID NO: 254163 - DNA, 20 bp, Artificial
  CRISPR gRNA sequence
ttgctcaggctggagtgcag

SEQ ID NO: 254164 - DNA, 20 bp, Artificial
  CRISPR gRNA sequence
ggtacaatcaccactcactg

SEQ ID NO: 254165 - DNA, 20 bp, Artificial
  CRISPR gRNA sequence
tcactgcagccttgacctcc

SEQ ID NO: 254166 - DNA, 20 bp, Artificial
  CRISPR gRNA sequence
cactgcagccttgacctcct

SEQ ID NO: 254167 - DNA, 20 bp, Artificial
  CRISPR gRNA sequence
agccttgacctcctgggctc

SEQ ID NO: 254168 - DNA, 20 bp, Artificial
  CRISPR gRNA sequence
ctcaagtgatcctcccacct

SEQ ID NO: 254169 - DNA, 20 bp, Artificial
  CRISPR gRNA sequence
tcctcccacctcagcctccc

SEQ ID NO: 254170 - DNA, 20 bp, Artificial
  CRISPR gRNA sequence
cctcccacctcagcctccca

SEQ ID NO: 254171 - DNA, 20 bp, Artificial
  CRISPR gRNA sequence
tcccacctcagcctcccaag

SEQ ID NO: 254172 - DNA, 20 bp, Artificial
  CRISPR gRNA sequence
acctcagcctcccaaggagc

SEQ ID NO: 254173 - DNA, 20 bp, Artificial
  CRISPR gRNA sequence
cctcagcctcccaaggagct

SEQ ID NO: 254174 - DNA, 20 bp, Artificial
  CRISPR gRNA sequence
ctcccaaggagctgggacta

SEQ ID NO: 254175 - DNA, 20 bp, Artificial
  CRISPR gRNA sequence
tcccaaggagctgggactac

SEQ ID NO: 254176 - DNA, 20 bp, Artificial
  CRISPR gRNA sequence
actacaggcacatgccacca

SEQ ID NO: 254177 - DNA, 20 bp, Artificial
  CRISPR gRNA sequence
caggcacatgccaccacagc

SEQ ID NO: 254178 - DNA, 20 bp, Artificial
  CRISPR gRNA sequence
aggcacatgccaccacagcc

SEQ ID NO: 254179 - DNA, 20 bp, Artificial
  CRISPR gRNA sequence
cagccaggtacccccacacc

SEQ ID NO: 254180 - DNA, 20 bp, Artificial
  CRISPR gRNA sequence
gctaatttttgtattttttg

SEQ ID NO: 254181 - DNA, 20 bp, Artificial
  CRISPR gRNA sequence
ttttgtattttttgtagaaa

SEQ ID NO: 254182 - DNA, 20 bp, Artificial
  CRISPR gRNA sequence
tttgtattttttgtagaaat

SEQ ID NO: 254183 - DNA, 20 bp, Artificial
  CRISPR gRNA sequence
ttgtattttttgtagaaatg

SEQ ID NO: 254184 - DNA, 20 bp, Artificial
  CRISPR gRNA sequence
tggggtctcgccatgttgcc

SEQ ID NO: 254185 - DNA, 20 bp, Artificial
  CRISPR gRNA sequence
ggggtctcgccatgttgccc

SEQ ID NO: 254186 - DNA, 20 bp, Artificial
  CRISPR gRNA sequence
tctcgccatgttgcccaggc

SEQ ID NO: 254187 - DNA, 20 bp, Artificial
  CRISPR gRNA sequence
ccaggctggtttccatctcc

SEQ ID NO: 254188 - DNA, 20 bp, Artificial
  CRISPR gRNA sequence
caggctggtttccatctcct

SEQ ID NO: 254189 - DNA, 20 bp, Artificial
  CRISPR gRNA sequence
ggtttccatctcctgggttc

SEQ ID NO: 254190 - DNA, 20 bp, Artificial
  CRISPR gRNA sequence
ccacctgtgtcatcctccca

SEQ ID NO: 254191 - DNA, 20 bp, Artificial
  CRISPR gRNA sequence
gtgtcatcctcccaaagtgc

SEQ ID NO: 254192 - DNA, 20 bp, Artificial
  CRISPR gRNA sequence
tgtcatcctcccaaagtgct

SEQ ID NO: 254193 - DNA, 20 bp, Artificial
  CRISPR gRNA sequence
tcatcctcccaaagtgctag

SEQ ID NO: 254194 - DNA, 20 bp, Artificial
  CRISPR gRNA sequence
ctcccaaagtgctaggagta

SEQ ID NO: 254195 - DNA, 20 bp, Artificial
  CRISPR gRNA sequence
tcccaaagtgctaggagtac

SEQ ID NO: 254196 - DNA, 20 bp, Artificial
  CRISPR gRNA sequence
acaggtgtaatccactgtgc

SEQ ID NO: 254197 - DNA, 20 bp, Artificial
  CRISPR gRNA sequence
caggtgtaatccactgtgcc

SEQ ID NO: 254198 - DNA, 20 bp, Artificial
  CRISPR gRNA sequence
aatccactgtgccaggcctt

SEQ ID NO: 254199 - DNA, 20 bp, Artificial
  CRISPR gRNA sequence
cctttagtaaatttattaat

SEQ ID NO: 254200 - DNA, 20 bp, Artificial
  CRISPR gRNA sequence
ctttagtaaatttattaatc

SEQ ID NO: 254201 - DNA, 20 bp, Artificial
  CRISPR gRNA sequence
tgttcaaactaaaacctctt

SEQ ID NO: 254202 - DNA, 20 bp, Artificial
  CRISPR gRNA sequence
ttaaaaccatactttctgtc

SEQ ID NO: 254203 - DNA, 20 bp, Artificial
  CRISPR gRNA sequence
accatactttctgtcaagaa

SEQ ID NO: 254204 - DNA, 20 bp, Artificial
  CRISPR gRNA sequence
tcaagaacagttaatgtgct

SEQ ID NO: 254205 - DNA, 20 bp, Artificial
  CRISPR gRNA sequence
aatgtgcttggtataactga

SEQ ID NO: 254206 - DNA, 20 bp, Artificial
  CRISPR gRNA sequence
agttgtgatatacacaatct

SEQ ID NO: 254207 - DNA, 20 bp, Artificial
  CRISPR gRNA sequence
gatatacacaatcttggcca

SEQ ID NO: 254208 - DNA, 20 bp, Artificial
  CRISPR gRNA sequence
tacacaatcttggccaaagc

SEQ ID NO: 254209 - DNA, 20 bp, Artificial
  CRISPR gRNA sequence
cttggccaaagctggttgct

SEQ ID NO: 254210 - DNA, 20 bp, Artificial
  CRISPR gRNA sequence
gcttggtctgcttctcttga

SEQ ID NO: 254211 - DNA, 20 bp, Artificial
  CRISPR gRNA sequence
tggtctgcttctcttgatgg

SEQ ID NO: 254212 - DNA, 20 bp, Artificial
  CRISPR gRNA sequence
ggaagtcattgcttctgtca

SEQ ID NO: 254213 - DNA, 20 bp, Artificial
  CRISPR gRNA sequence
agtcattgcttctgtcatgg

SEQ ID NO: 254214 - DNA, 20 bp, Artificial
  CRISPR gRNA sequence
tacacaactctcttgccttc

SEQ ID NO: 254215 - DNA, 20 bp, Artificial
  CRISPR gRNA sequence
actctcttgccttctggttc

SEQ ID NO: 254216 - DNA, 20 bp, Artificial
  CRISPR gRNA sequence
ctggtaacttcgctgtcccc

SEQ ID NO: 254217 - DNA, 20 bp, Artificial
  CRISPR gRNA sequence
cccctggtctctttcgacct

SEQ ID NO: 254218 - DNA, 20 bp, Artificial
  CRISPR gRNA sequence
ccctggtctctttcgaccta

SEQ ID NO: 254219 - DNA, 20 bp, Artificial
  CRISPR gRNA sequence
cctggtctctttcgacctaa

SEQ ID NO: 254220 - DNA, 20 bp, Artificial
  CRISPR gRNA sequence
ggtctctttcgacctaaggg

SEQ ID NO: 254221 - DNA, 20 bp, Artificial
  CRISPR gRNA sequence
ggtcataattctgctgctgc

SEQ ID NO: 254222 - DNA, 20 bp, Artificial
  CRISPR gRNA sequence
aattctgctgctgcaagtca

SEQ ID NO: 254223 - DNA, 20 bp, Artificial
  CRISPR gRNA sequence
attctgctgctgcaagtcac

SEQ ID NO: 254224 - DNA, 20 bp, Artificial
  CRISPR gRNA sequence
ctgctgcaagtcacaggctc

SEQ ID NO: 254225 - DNA, 20 bp, Artificial
  CRISPR gRNA sequence
ggctctggcactacccctcg

SEQ ID NO: 254226 - DNA, 20 bp, Artificial
  CRISPR gRNA sequence
tcttgccacacctttgccaa

SEQ ID NO: 254227 - DNA, 20 bp, Artificial
  CRISPR gRNA sequence
gtgtgccatctgttttcatt

SEQ ID NO: 254228 - DNA, 20 bp, Artificial
  CRISPR gRNA sequence
tgtgccatctgttttcattt

SEQ ID NO: 254229 - DNA, 20 bp, Artificial
  CRISPR gRNA sequence
atctgttttcatttgggatc

SEQ ID NO: 254230 - DNA, 20 bp, Artificial
  CRISPR gRNA sequence
tttcatttgggatctggaat

SEQ ID NO: 254231 - DNA, 20 bp, Artificial
  CRISPR gRNA sequence
atctggaatgagacaacata

SEQ ID NO: 254232 - DNA, 20 bp, Artificial
  CRISPR gRNA sequence
ggaatgagacaacatatagt

SEQ ID NO: 254233 - DNA, 20 bp, Artificial
  CRISPR gRNA sequence
tagttggcccactgtatcca

SEQ ID NO: 254234 - DNA, 20 bp, Artificial
  CRISPR gRNA sequence
agttggcccactgtatccac

SEQ ID NO: 254235 - DNA, 20 bp, Artificial
  CRISPR gRNA sequence
atccacgggttatgcatctt

SEQ ID NO: 254236 - DNA, 20 bp, Artificial
  CRISPR gRNA sequence
tctttggattcaatgaacca

SEQ ID NO: 254237 - DNA, 20 bp, Artificial
  CRISPR gRNA sequence
aatgaaccatggatcaaaaa

SEQ ID NO: 254238 - DNA, 20 bp, Artificial
  CRISPR gRNA sequence
tggatcaaaaacagtatttg

SEQ ID NO: 254239 - DNA, 20 bp, Artificial
  CRISPR gRNA sequence
ggatcaaaaacagtatttgt

SEQ ID NO: 254240 - DNA, 20 bp, Artificial
  CRISPR gRNA sequence
aaaacagtatttgtgggatg

SEQ ID NO: 254241 - DNA, 20 bp, Artificial
  CRISPR gRNA sequence
tttgtgggatgcagaatcta

SEQ ID NO: 254242 - DNA, 20 bp, Artificial
  CRISPR gRNA sequence
ggatgcagaatctatggata

SEQ ID NO: 254243 - DNA, 20 bp, Artificial
  CRISPR gRNA sequence
atgcagaatctatggataca

SEQ ID NO: 254244 - DNA, 20 bp, Artificial
  CRISPR gRNA sequence
tgcagaatctatggatacag

SEQ ID NO: 254245 - DNA, 20 bp, Artificial
  CRISPR gRNA sequence
gaccaacaattgcatgactt

SEQ ID NO: 254246 - DNA, 20 bp, Artificial
  CRISPR gRNA sequence
ttgcatgacttgagcttcca

SEQ ID NO: 254247 - DNA, 20 bp, Artificial
  CRISPR gRNA sequence
acttgagcttccatggattt

SEQ ID NO: 254248 - DNA, 20 bp, Artificial
  CRISPR gRNA sequence
tccatggattttggtatctg

SEQ ID NO: 254249 - DNA, 20 bp, Artificial
  CRISPR gRNA sequence
ccatggattttggtatctgc

SEQ ID NO: 254250 - DNA, 20 bp, Artificial
  CRISPR gRNA sequence
catggattttggtatctgca

SEQ ID NO: 254251 - DNA, 20 bp, Artificial
  CRISPR gRNA sequence
atggattttggtatctgcag

SEQ ID NO: 254252 - DNA, 20 bp, Artificial
  CRISPR gRNA sequence
tttggtatctgcaggggtcc

SEQ ID NO: 254253 - DNA, 20 bp, Artificial
  CRISPR gRNA sequence
gtcctggaaccaacacccca

SEQ ID NO: 254254 - DNA, 20 bp, Artificial
  CRISPR gRNA sequence
gaaccaacaccccatggatc

SEQ ID NO: 254255 - DNA, 20 bp, Artificial
  CRISPR gRNA sequence
accaacaccccatggatcca

SEQ ID NO: 254256 - DNA, 20 bp, Artificial
  CRISPR gRNA sequence
ccaacaccccatggatccag

SEQ ID NO: 254257 - DNA, 20 bp, Artificial
  CRISPR gRNA sequence
actgtatatgcatgtttatc

SEQ ID NO: 254258 - DNA, 20 bp, Artificial
  CRISPR gRNA sequence
atgtttatcaagcttattca

SEQ ID NO: 254259 - DNA, 20 bp, Artificial
  CRISPR gRNA sequence
aagccccctttttctgtgtg

SEQ ID NO: 254260 - DNA, 20 bp, Artificial
  CRISPR gRNA sequence
gccccctttttctgtgtgaa

SEQ ID NO: 254261 - DNA, 20 bp, Artificial
  CRISPR gRNA sequence
atcttcatttcttgtgaaaa

SEQ ID NO: 254262 - DNA, 20 bp, Artificial
  CRISPR gRNA sequence
tcttcatttcttgtgaaaat

SEQ ID NO: 254263 - DNA, 20 bp, Artificial
  CRISPR gRNA sequence
tcatttcttgtgaaaatggg

SEQ ID NO: 254264 - DNA, 20 bp, Artificial
  CRISPR gRNA sequence
gtgaaaatgggaagactttc

SEQ ID NO: 254265 - DNA, 20 bp, Artificial
  CRISPR gRNA sequence
tgggaagactttcaagataa

SEQ ID NO: 254266 - DNA, 20 bp, Artificial
  CRISPR gRNA sequence
actttcaagataacagtcaa

SEQ ID NO: 254267 - DNA, 20 bp, Artificial
  CRISPR gRNA sequence
gataacagtcaacagaaaac

SEQ ID NO: 254268 - DNA, 20 bp, Artificial
  CRISPR gRNA sequence
aaaactagatgaaatgacca

SEQ ID NO: 254269 - DNA, 20 bp, Artificial
  CRISPR gRNA sequence
ttcattttaacatgaatttc

SEQ ID NO: 254270 - DNA, 20 bp, Artificial
  CRISPR gRNA sequence
tcattttaacatgaatttct

SEQ ID NO: 254271 - DNA, 20 bp, Artificial
  CRISPR gRNA sequence
attttaacatgaatttctgg

SEQ ID NO: 254272 - DNA, 20 bp, Artificial
  CRISPR gRNA sequence
tttaacatgaatttctggga

SEQ ID NO: 254273 - DNA, 20 bp, Artificial
  CRISPR gRNA sequence
taacatgaatttctgggaga

SEQ ID NO: 254274 - DNA, 20 bp, Artificial
  CRISPR gRNA sequence
acatgaatttctgggagaga

SEQ ID NO: 254275 - DNA, 20 bp, Artificial
  CRISPR gRNA sequence
catgaatttctgggagagag

SEQ ID NO: 254276 - DNA, 20 bp, Artificial
  CRISPR gRNA sequence
aatttctgggagagagaggc

SEQ ID NO: 254277 - DNA, 20 bp, Artificial
  CRISPR gRNA sequence
atttctgggagagagaggct

SEQ ID NO: 254278 - DNA, 20 bp, Artificial
  CRISPR gRNA sequence
agagaggctgggtccattca

SEQ ID NO: 254279 - DNA, 20 bp, Artificial
  CRISPR gRNA sequence
ggctgggtccattcaaagca

SEQ ID NO: 254280 - DNA, 20 bp, Artificial
  CRISPR gRNA sequence
tgggtccattcaaagcatgg

SEQ ID NO: 254281 - DNA, 20 bp, Artificial
  CRISPR gRNA sequence
gggtccattcaaagcatggt

SEQ ID NO: 254282 - DNA, 20 bp, Artificial
  CRISPR gRNA sequence
aaagcatggtaggtcatgaa

SEQ ID NO: 254283 - DNA, 20 bp, Artificial
  CRISPR gRNA sequence
ctttgtttttatcttcattg

SEQ ID NO: 254284 - DNA, 20 bp, Artificial
  CRISPR gRNA sequence
tttttatcttcattgcagct

SEQ ID NO: 254285 - DNA, 20 bp, Artificial
  CRISPR gRNA sequence
tttatcttcattgcagctca

SEQ ID NO: 254286 - DNA, 20 bp, Artificial
  CRISPR gRNA sequence
tatcttcattgcagctcaga

SEQ ID NO: 254287 - DNA, 20 bp, Artificial
  CRISPR gRNA sequence
atcttcattgcagctcagag

SEQ ID NO: 254288 - DNA, 20 bp, Artificial
  CRISPR gRNA sequence
tcattgcagctcagagagga

SEQ ID NO: 254289 - DNA, 20 bp, Artificial
  CRISPR gRNA sequence
cagctcagagaggatggtga

SEQ ID NO: 254290 - DNA, 20 bp, Artificial
  CRISPR gRNA sequence
agctcagagaggatggtgaa

SEQ ID NO: 254291 - DNA, 20 bp, Artificial
  CRISPR gRNA sequence
gaggatggtgaaaggtgcta

SEQ ID NO: 254292 - DNA, 20 bp, Artificial
  CRISPR gRNA sequence
tggtgaaaggtgctacagtc

SEQ ID NO: 254293 - DNA, 20 bp, Artificial
  CRISPR gRNA sequence
tgtacttctctttctcttat

SEQ ID NO: 254294 - DNA, 20 bp, Artificial
  CRISPR gRNA sequence
acttctctttctcttatcag

SEQ ID NO: 254295 - DNA, 20 bp, Artificial
  CRISPR gRNA sequence
cttctctttctcttatcaga

SEQ ID NO: 254296 - DNA, 20 bp, Artificial
  CRISPR gRNA sequence
ctctttctcttatcagaagg

SEQ ID NO: 254297 - DNA, 20 bp, Artificial
  CRISPR gRNA sequence
ttctcttatcagaaggaagc

SEQ ID NO: 254298 - DNA, 20 bp, Artificial
  CRISPR gRNA sequence
tctcttatcagaaggaagcc

SEQ ID NO: 254299 - DNA, 20 bp, Artificial
  CRISPR gRNA sequence
tcagaaggaagccaggccac

SEQ ID NO: 254300 - DNA, 20 bp, Artificial
  CRISPR gRNA sequence
aggaagccaggccaccagct

SEQ ID NO: 254301 - DNA, 20 bp, Artificial
  CRISPR gRNA sequence
ggaagccaggccaccagcta

SEQ ID NO: 254302 - DNA, 20 bp, Artificial
  CRISPR gRNA sequence
aggccaccagctaaggttat

SEQ ID NO: 254303 - DNA, 20 bp, Artificial
  CRISPR gRNA sequence
gccaccagctaaggttatca

SEQ ID NO: 254304 - DNA, 20 bp, Artificial
  CRISPR gRNA sequence
agctaaggttatcagagcca

SEQ ID NO: 254305 - DNA, 20 bp, Artificial
  CRISPR gRNA sequence
tatcagagccatagactgtt

SEQ ID NO: 254306 - DNA, 20 bp, Artificial
  CRISPR gRNA sequence
gttgagtccccctttcttct

SEQ ID NO: 254307 - DNA, 20 bp, Artificial
  CRISPR gRNA sequence
ttgagtccccctttcttctc

SEQ ID NO: 254308 - DNA, 20 bp, Artificial
  CRISPR gRNA sequence
tgagtccccctttcttctca

SEQ ID NO: 254309 - DNA, 20 bp, Artificial
  CRISPR gRNA sequence
agtccccctttcttctcagg

SEQ ID NO: 254310 - DNA, 20 bp, Artificial
  CRISPR gRNA sequence
ccctttcttctcagggagca

SEQ ID NO: 254311 - DNA, 20 bp, Artificial
  CRISPR gRNA sequence
agggagcacggtttgtctca

SEQ ID NO: 254312 - DNA, 20 bp, Artificial
  CRISPR gRNA sequence
ggtttgtctcacagtttcct

SEQ ID NO: 254313 - DNA, 20 bp, Artificial
  CRISPR gRNA sequence
acagtttcctgagcaaccac

SEQ ID NO: 254314 - DNA, 20 bp, Artificial
  CRISPR gRNA sequence
cagtttcctgagcaaccacc

SEQ ID NO: 254315 - DNA, 20 bp, Artificial
  CRISPR gRNA sequence
gcaaccaccgggttgtcttg

SEQ ID NO: 254316 - DNA, 20 bp, Artificial
  CRISPR gRNA sequence
caaccaccgggttgtcttgt

SEQ ID NO: 254317 - DNA, 20 bp, Artificial
  CRISPR gRNA sequence
aaccaccgggttgtcttgtg

SEQ ID NO: 254318 - DNA, 20 bp, Artificial
  CRISPR gRNA sequence
accaccgggttgtcttgtgg

SEQ ID NO: 254319 - DNA, 20 bp, Artificial
  CRISPR gRNA sequence
caccgggttgtcttgtgggg

SEQ ID NO: 254320 - DNA, 20 bp, Artificial
  CRISPR gRNA sequence
gtgggggagcctacccctta

SEQ ID NO: 254321 - DNA, 20 bp, Artificial
  CRISPR gRNA sequence
gggggagcctaccccttaca

SEQ ID NO: 254322 - DNA, 20 bp, Artificial
  CRISPR gRNA sequence
taccccttacagagcctgaa

SEQ ID NO: 254323 - DNA, 20 bp, Artificial
  CRISPR gRNA sequence
accccttacagagcctgaaa

SEQ ID NO: 254324 - DNA, 20 bp, Artificial
  CRISPR gRNA sequence
cccttacagagcctgaaaag

SEQ ID NO: 254325 - DNA, 20 bp, Artificial
  CRISPR gRNA sequence
tacagagcctgaaaaggagc

SEQ ID NO: 254326 - DNA, 20 bp, Artificial
  CRISPR gRNA sequence
agagcctgaaaaggagccag

SEQ ID NO: 254327 - DNA, 20 bp, Artificial
  CRISPR gRNA sequence
cctgaaaaggagccagtggt

SEQ ID NO: 254328 - DNA, 20 bp, Artificial
  CRISPR gRNA sequence
aaaaggagccagtggtcaga

SEQ ID NO: 254329 - DNA, 20 bp, Artificial
  CRISPR gRNA sequence
ggtcagatggtcacgtgttg

SEQ ID NO: 254330 - DNA, 20 bp, Artificial
  CRISPR gRNA sequence
gtcagatggtcacgtgttga

SEQ ID NO: 254331 - DNA, 20 bp, Artificial
  CRISPR gRNA sequence
tcagatggtcacgtgttgaa

SEQ ID NO: 254332 - DNA, 20 bp, Artificial
  CRISPR gRNA sequence
tcacgtgttgaagggcatcc

SEQ ID NO: 254333 - DNA, 20 bp, Artificial
  CRISPR gRNA sequence
cacgtgttgaagggcatcct

SEQ ID NO: 254334 - DNA, 20 bp, Artificial
  CRISPR gRNA sequence
aagggcatcctgggcctgaa

SEQ ID NO: 254335 - DNA, 20 bp, Artificial
  CRISPR gRNA sequence
agggcatcctgggcctgaac

SEQ ID NO: 254336 - DNA, 20 bp, Artificial
  CRISPR gRNA sequence
gcctgaacaggaaatatact

SEQ ID NO: 254337 - DNA, 20 bp, Artificial
  CRISPR gRNA sequence
ctgaacaggaaatatactca

SEQ ID NO: 254338 - DNA, 20 bp, Artificial
  CRISPR gRNA sequence
tgaacaggaaatatactcag

SEQ ID NO: 254339 - DNA, 20 bp, Artificial
  CRISPR gRNA sequence
caggaaatatactcagagga

SEQ ID NO: 254340 - DNA, 20 bp, Artificial
  CRISPR gRNA sequence
atatactcagaggaaagtta

SEQ ID NO: 254341 - DNA, 20 bp, Artificial
  CRISPR gRNA sequence
gaaagttacagtaacttaac

SEQ ID NO: 254342 - DNA, 20 bp, Artificial
  CRISPR gRNA sequence
cagtaacttaactagctctg

SEQ ID NO: 254343 - DNA, 20 bp, Artificial
  CRISPR gRNA sequence
aacttaactagctctgtggt

SEQ ID NO: 254344 - DNA, 20 bp, Artificial
  CRISPR gRNA sequence
acttaactagctctgtggtc

SEQ ID NO: 254345 - DNA, 20 bp, Artificial
  CRISPR gRNA sequence
ttaactagctctgtggtcag

SEQ ID NO: 254346 - DNA, 20 bp, Artificial
  CRISPR gRNA sequence
taactagctctgtggtcagg

SEQ ID NO: 254347 - DNA, 20 bp, Artificial
  CRISPR gRNA sequence
aactagctctgtggtcagga

SEQ ID NO: 254348 - DNA, 20 bp, Artificial
  CRISPR gRNA sequence
ctagctctgtggtcaggagg

SEQ ID NO: 254349 - DNA, 20 bp, Artificial
  CRISPR gRNA sequence
tagctctgtggtcaggaggg

SEQ ID NO: 254350 - DNA, 20 bp, Artificial
  CRISPR gRNA sequence
agggaggtgctcttctatgc

SEQ ID NO: 254351 - DNA, 20 bp, Artificial
  CRISPR gRNA sequence
gggaggtgctcttctatgcc

SEQ ID NO: 254352 - DNA, 20 bp, Artificial
  CRISPR gRNA sequence
ggaggtgctcttctatgcca

SEQ ID NO: 254353 - DNA, 20 bp, Artificial
  CRISPR gRNA sequence
ctcttctatgccagggaaat

SEQ ID NO: 254354 - DNA, 20 bp, Artificial
  CRISPR gRNA sequence
ggaaatcagcatcaccttca

SEQ ID NO: 254355 - DNA, 20 bp, Artificial
  CRISPR gRNA sequence
cagtgtgctcacaaatatca

SEQ ID NO: 254356 - DNA, 20 bp, Artificial
  CRISPR gRNA sequence
agtgtgctcacaaatatcac

SEQ ID NO: 254357 - DNA, 20 bp, Artificial
  CRISPR gRNA sequence
gtgtgctcacaaatatcaca

SEQ ID NO: 254358 - DNA, 20 bp, Artificial
  CRISPR gRNA sequence
acaaatatcacagggcaaaa

SEQ ID NO: 254359 - DNA, 20 bp, Artificial
  CRISPR gRNA sequence
tcacagggcaaaatggctga

SEQ ID NO: 254360 - DNA, 20 bp, Artificial
  CRISPR gRNA sequence
cagggcaaaatggctgaaag

SEQ ID NO: 254361 - DNA, 20 bp, Artificial
  CRISPR gRNA sequence
ggcaaaatggctgaaagtag

SEQ ID NO: 254362 - DNA, 20 bp, Artificial
  CRISPR gRNA sequence
gtagaagctttcattgtttt

SEQ ID NO: 254363 - DNA, 20 bp, Artificial
  CRISPR gRNA sequence
ctaacatgtgaaattctgtt

SEQ ID NO: 254364 - DNA, 20 bp, Artificial
  CRISPR gRNA sequence
tgttcagtccgaatttttaa

SEQ ID NO: 254365 - DNA, 20 bp, Artificial
  CRISPR gRNA sequence
gttcagtccgaatttttaaa

SEQ ID NO: 254366 - DNA, 20 bp, Artificial
  CRISPR gRNA sequence
ccgaatttttaaaaggaaac

SEQ ID NO: 254367 - DNA, 20 bp, Artificial
  CRISPR gRNA sequence
ttaaaaggaaacaagataat

SEQ ID NO: 254368 - DNA, 20 bp, Artificial
  CRISPR gRNA sequence
acctgatttttcaactgcaa

SEQ ID NO: 254369 - DNA, 20 bp, Artificial
  CRISPR gRNA sequence
gatttttcaactgcaaaaga

SEQ ID NO: 254370 - DNA, 20 bp, Artificial
  CRISPR gRNA sequence
tttcaactgcaaaagaaagt

SEQ ID NO: 254371 - DNA, 20 bp, Artificial
  CRISPR gRNA sequence
cagactatgatgtgcataaa

SEQ ID NO: 254372 - DNA, 20 bp, Artificial
  CRISPR gRNA sequence
tgcataaatggaacctgata

SEQ ID NO: 254373 - DNA, 20 bp, Artificial
  CRISPR gRNA sequence
ggaacctgataaagttctta

SEQ ID NO: 254374 - DNA, 20 bp, Artificial
  CRISPR gRNA sequence
gataaagttcttaaagattc

SEQ ID NO: 254375 - DNA, 20 bp, Artificial
  CRISPR gRNA sequence
taaagttcttaaagattctg

SEQ ID NO: 254376 - DNA, 20 bp, Artificial
  CRISPR gRNA sequence
aaagttcttaaagattctgg

SEQ ID NO: 254377 - DNA, 20 bp, Artificial
  CRISPR gRNA sequence
tgctaattaatcatgtattc

SEQ ID NO: 254378 - DNA, 20 bp, Artificial
  CRISPR gRNA sequence
cagctctctaactgcttctt

SEQ ID NO: 254379 - DNA, 20 bp, Artificial
  CRISPR gRNA sequence
taactgcttctttagcttcc

SEQ ID NO: 254380 - DNA, 20 bp, Artificial
  CRISPR gRNA sequence
cagtacgttttatttctcta

SEQ ID NO: 254381 - DNA, 20 bp, Artificial
  CRISPR gRNA sequence
ttctctatggtgctacgata

SEQ ID NO: 254382 - DNA, 20 bp, Artificial
  CRISPR gRNA sequence
tatggtgctacgataaagaa

SEQ ID NO: 254383 - DNA, 20 bp, Artificial
  CRISPR gRNA sequence
atggtgctacgataaagaaa

SEQ ID NO: 254384 - DNA, 20 bp, Artificial
  CRISPR gRNA sequence
caaacaaatgtaattcacaa

SEQ ID NO: 254385 - DNA, 20 bp, Artificial
  CRISPR gRNA sequence
tgtaattcacaaaagccctg

SEQ ID NO: 254386 - DNA, 20 bp, Artificial
  CRISPR gRNA sequence
ttcacaaaagccctgaagtt

SEQ ID NO: 254387 - DNA, 20 bp, Artificial
  CRISPR gRNA sequence
tcacaaaagccctgaagtta

SEQ ID NO: 254388 - DNA, 20 bp, Artificial
  CRISPR gRNA sequence
cctgaagttaaggattttcc

SEQ ID NO: 254389 - DNA, 20 bp, Artificial
  CRISPR gRNA sequence
agttaaggattttcctagtg

SEQ ID NO: 254390 - DNA, 20 bp, Artificial
  CRISPR gRNA sequence
aggattttcctagtgaagtt

SEQ ID NO: 254391 - DNA, 20 bp, Artificial
  CRISPR gRNA sequence
ttcaatcccttttgtatact

SEQ ID NO: 254392 - DNA, 20 bp, Artificial
  CRISPR gRNA sequence
tcaatcccttttgtatactt

SEQ ID NO: 254393 - DNA, 20 bp, Artificial
  CRISPR gRNA sequence
tcccttttgtatacttgggt

SEQ ID NO: 254394 - DNA, 20 bp, Artificial
  CRISPR gRNA sequence
ttttgtatacttgggtaagc

SEQ ID NO: 254395 - DNA, 20 bp, Artificial
  CRISPR gRNA sequence
tatacttgggtaagctagaa

SEQ ID NO: 254396 - DNA, 20 bp, Artificial
  CRISPR gRNA sequence
acttgggtaagctagaatgg

SEQ ID NO: 254397 - DNA, 20 bp, Artificial
  CRISPR gRNA sequence
gctagaatggaagatctcaa

SEQ ID NO: 254398 - DNA, 20 bp, Artificial
  CRISPR gRNA sequence
tataattattacttgtgcat

SEQ ID NO: 254399 - DNA, 20 bp, Artificial
  CRISPR gRNA sequence
gtgcatcagaaataatttat

SEQ ID NO: 254400 - DNA, 20 bp, Artificial
  CRISPR gRNA sequence
gatgtgatcatactgtctgt

SEQ ID NO: 254401 - DNA, 20 bp, Artificial
  CRISPR gRNA sequence
tactgtctgtaagccttatc

SEQ ID NO: 254402 - DNA, 20 bp, Artificial
  CRISPR gRNA sequence
actgtctgtaagccttatct

SEQ ID NO: 254403 - DNA, 20 bp, Artificial
  CRISPR gRNA sequence
tgggatccatctatgacctt

SEQ ID NO: 254404 - DNA, 20 bp, Artificial
  CRISPR gRNA sequence
gggatccatctatgaccttc

SEQ ID NO: 254405 - DNA, 20 bp, Artificial
  CRISPR gRNA sequence
caggaaatcttcaaaattgt

SEQ ID NO: 254406 - DNA, 20 bp, Artificial
  CRISPR gRNA sequence
aatgttttgtatatgtgcat

SEQ ID NO: 254407 - DNA, 20 bp, Artificial
  CRISPR gRNA sequence
tgttttgtatatgtgcatta

SEQ ID NO: 254408 - DNA, 20 bp, Artificial
  CRISPR gRNA sequence
gttttgtatatgtgcattag

SEQ ID NO: 254409 - DNA, 20 bp, Artificial
  CRISPR gRNA sequence
tgcattagaggcaaaaaatt

SEQ ID NO: 254410 - DNA, 20 bp, Artificial
  CRISPR gRNA sequence
tttggaaatgtatttttttc

SEQ ID NO: 254411 - DNA, 20 bp, Artificial
  CRISPR gRNA sequence
atgtatttttttctagatat

SEQ ID NO: 254412 - DNA, 20 bp, Artificial
  CRISPR gRNA sequence
atatgagcatgaaataaatt

SEQ ID NO: 254413 - DNA, 20 bp, Artificial
  CRISPR gRNA sequence
tcagtcttgctgaatgaaca

SEQ ID NO: 254414 - DNA, 20 bp, Artificial
  CRISPR gRNA sequence
atgatttaaaacattactcc

SEQ ID NO: 254415 - DNA, 20 bp, Artificial
  CRISPR gRNA sequence
taaataaataaattacatct

SEQ ID NO: 254416 - DNA, 20 bp, Artificial
  CRISPR gRNA sequence
tttgtgtgaccttgtttgaa

SEQ ID NO: 254417 - DNA, 20 bp, Artificial
  CRISPR gRNA sequence
ttctctttttttccccccaa

SEQ ID NO: 254418 - DNA, 20 bp, Artificial
  CRISPR gRNA sequence
aatagcctcttctttaaaat

SEQ ID NO: 254419 - DNA, 20 bp, Artificial
  CRISPR gRNA sequence
atagcctcttctttaaaata

SEQ ID NO: 254420 - DNA, 20 bp, Artificial
  CRISPR gRNA sequence
tcttctttaaaataaggaat

SEQ ID NO: 254421 - DNA, 20 bp, Artificial
  CRISPR gRNA sequence
tttaaaataaggaattggca

SEQ ID NO: 254422 - DNA, 20 bp, Artificial
  CRISPR gRNA sequence
aattggcatagatcatctcc

SEQ ID NO: 254423 - DNA, 20 bp, Artificial
  CRISPR gRNA sequence
atcatctccaagttcccttc

SEQ ID NO: 254424 - DNA, 20 bp, Artificial
  CRISPR gRNA sequence
ctccaagttcccttccagtt

SEQ ID NO: 254425 - DNA, 20 bp, Artificial
  CRISPR gRNA sequence
agttcccttccagttgagtg

SEQ ID NO: 254426 - DNA, 20 bp, Artificial
  CRISPR gRNA sequence
cagttgagtgtggttttttg

SEQ ID NO: 254427 - DNA, 20 bp, Artificial
  CRISPR gRNA sequence
agttgagtgtggttttttgc

SEQ ID NO: 254428 - DNA, 20 bp, Artificial
  CRISPR gRNA sequence
agtgtggttttttgcaggat

SEQ ID NO: 254429 - DNA, 20 bp, Artificial
  CRISPR gRNA sequence
aggataagactctaataaaa

SEQ ID NO: 254430 - DNA, 20 bp, Artificial
  CRISPR gRNA sequence
ataagactctaataaaatag

SEQ ID NO: 254431 - DNA, 20 bp, Artificial
  CRISPR gRNA sequence
taagactctaataaaatagt

SEQ ID NO: 254432 - DNA, 20 bp, Artificial
  CRISPR gRNA sequence
aagactctaataaaatagtg

SEQ ID NO: 254433 - DNA, 20 bp, Artificial
  CRISPR gRNA sequence
aaatgaaatgtattttgttc

SEQ ID NO: 254434 - DNA, 20 bp, Artificial
  CRISPR gRNA sequence
ccattcactcccctacttaa

SEQ ID NO: 254435 - DNA, 20 bp, Artificial
  CRISPR gRNA sequence
ctcctccctaaccctcactc

SEQ ID NO: 254436 - DNA, 20 bp, Artificial
  CRISPR gRNA sequence
taaccctcactccagacatc

SEQ ID NO: 254437 - DNA, 20 bp, Artificial
  CRISPR gRNA sequence
ctggtaccatcctccctatc

SEQ ID NO: 254438 - DNA, 20 bp, Artificial
  CRISPR gRNA sequence
tccctatcaagtccaacttt

SEQ ID NO: 254439 - DNA, 20 bp, Artificial
  CRISPR gRNA sequence
cctatcaagtccaactttga

SEQ ID NO: 254440 - DNA, 20 bp, Artificial
  CRISPR gRNA sequence
ctatcaagtccaactttgag

SEQ ID NO: 254441 - DNA, 20 bp, Artificial
  CRISPR gRNA sequence
agtccaactttgagaggatc

SEQ ID NO: 254442 - DNA, 20 bp, Artificial
  CRISPR gRNA sequence
gttgaaattttgatgcaaca

SEQ ID NO: 254443 - DNA, 20 bp, Artificial
  CRISPR gRNA sequence
gaaattttgatgcaacatgg

SEQ ID NO: 254444 - DNA, 20 bp, Artificial
  CRISPR gRNA sequence
attttgatgcaacatggcag

SEQ ID NO: 254445 - DNA, 20 bp, Artificial
  CRISPR gRNA sequence
ttttgatgcaacatggcaga

SEQ ID NO: 254446 - DNA, 20 bp, Artificial
  CRISPR gRNA sequence
tggcagaaggaaatgaacaa

SEQ ID NO: 254447 - DNA, 20 bp, Artificial
  CRISPR gRNA sequence
gaaggaaatgaacaatagat

SEQ ID NO: 254448 - DNA, 20 bp, Artificial
  CRISPR gRNA sequence
ggaaatgaacaatagattag

SEQ ID NO: 254449 - DNA, 20 bp, Artificial
  CRISPR gRNA sequence
aacaatagattagaagtcat

SEQ ID NO: 254450 - DNA, 20 bp, Artificial
  CRISPR gRNA sequence
gattagaagtcataagttat

SEQ ID NO: 254451 - DNA, 20 bp, Artificial
  CRISPR gRNA sequence
aagttatgagcttaaatttc

SEQ ID NO: 254452 - DNA, 20 bp, Artificial
  CRISPR gRNA sequence
agttatgagcttaaatttca

SEQ ID NO: 254453 - DNA, 20 bp, Artificial
  CRISPR gRNA sequence
acttatgtttcctgtaacct

SEQ ID NO: 254454 - DNA, 20 bp, Artificial
  CRISPR gRNA sequence
ctcatctacctctttgacct

SEQ ID NO: 254455 - DNA, 20 bp, Artificial
  CRISPR gRNA sequence
acctcagtttccccatgtgt

SEQ ID NO: 254456 - DNA, 20 bp, Artificial
  CRISPR gRNA sequence
cagtttccccatgtgtaaga

SEQ ID NO: 254457 - DNA, 20 bp, Artificial
  CRISPR gRNA sequence
agtttccccatgtgtaagat

SEQ ID NO: 254458 - DNA, 20 bp, Artificial
  CRISPR gRNA sequence
ccatgtgtaagatgggcata

SEQ ID NO: 254459 - DNA, 20 bp, Artificial
  CRISPR gRNA sequence
tgtcctgcctatttacttca

SEQ ID NO: 254460 - DNA, 20 bp, Artificial
  CRISPR gRNA sequence
atttacttcacagttgaata

SEQ ID NO: 254461 - DNA, 20 bp, Artificial
  CRISPR gRNA sequence
ttacttcacagttgaatata

SEQ ID NO: 254462 - DNA, 20 bp, Artificial
  CRISPR gRNA sequence
tcacagttgaatatagagtt

SEQ ID NO: 254463 - DNA, 20 bp, Artificial
  CRISPR gRNA sequence
gttgaatatagagttcagat

SEQ ID NO: 254464 - DNA, 20 bp, Artificial
  CRISPR gRNA sequence
atatagagttcagatgagat

SEQ ID NO: 254465 - DNA, 20 bp, Artificial
  CRISPR gRNA sequence
atagagttcagatgagataa

SEQ ID NO: 254466 - DNA, 20 bp, Artificial
  CRISPR gRNA sequence
agttcagatgagataagaga

SEQ ID NO: 254467 - DNA, 20 bp, Artificial
  CRISPR gRNA sequence
agataagagacagcatttta

SEQ ID NO: 254468 - DNA, 20 bp, Artificial
  CRISPR gRNA sequence
ttttatagccctgtgaatgt

SEQ ID NO: 254469 - DNA, 20 bp, Artificial
  CRISPR gRNA sequence
agccctgtgaatgtaagcca

SEQ ID NO: 254470 - DNA, 20 bp, Artificial
  CRISPR gRNA sequence
taagccatagatactaaatt

SEQ ID NO: 254471 - DNA, 20 bp, Artificial
  CRISPR gRNA sequence
gtgtttcccatattgcattt

SEQ ID NO: 254472 - DNA, 20 bp, Artificial
  CRISPR gRNA sequence
tgtttcccatattgcatttt

SEQ ID NO: 254473 - DNA, 20 bp, Artificial
  CRISPR gRNA sequence
attttgggcttcattttctt

SEQ ID NO: 254474 - DNA, 20 bp, Artificial
  CRISPR gRNA sequence
ttcattttctttggaaatct

SEQ ID NO: 254475 - DNA, 20 bp, Artificial
  CRISPR gRNA sequence
tggaaatctaagcattaact

SEQ ID NO: 254476 - DNA, 20 bp, Artificial
  CRISPR gRNA sequence
aatctaagcattaactgagc

SEQ ID NO: 254477 - DNA, 20 bp, Artificial
  CRISPR gRNA sequence
ctaagcattaactgagctgg

SEQ ID NO: 254478 - DNA, 20 bp, Artificial
  CRISPR gRNA sequence
taagcattaactgagctggt

SEQ ID NO: 254479 - DNA, 20 bp, Artificial
  CRISPR gRNA sequence
agcattaactgagctggtgg

SEQ ID NO: 254480 - DNA, 20 bp, Artificial
  CRISPR gRNA sequence
gcattaactgagctggtggg

SEQ ID NO: 254481 - DNA, 20 bp, Artificial
  CRISPR gRNA sequence
cattaactgagctggtggga

SEQ ID NO: 254482 - DNA, 20 bp, Artificial
  CRISPR gRNA sequence
gctggtgggagggtcctttt

SEQ ID NO: 254483 - DNA, 20 bp, Artificial
  CRISPR gRNA sequence
ctggtgggagggtcctttta

SEQ ID NO: 254484 - DNA, 20 bp, Artificial
  CRISPR gRNA sequence
tgggagggtccttttaaggt

SEQ ID NO: 254485 - DNA, 20 bp, Artificial
  CRISPR gRNA sequence
gggagggtccttttaaggtc

SEQ ID NO: 254486 - DNA, 20 bp, Artificial
  CRISPR gRNA sequence
ggagggtccttttaaggtca

SEQ ID NO: 254487 - DNA, 20 bp, Artificial
  CRISPR gRNA sequence
aggtcagggttctttgatgc

SEQ ID NO: 254488 - DNA, 20 bp, Artificial
  CRISPR gRNA sequence
ggtcagggttctttgatgct

SEQ ID NO: 254489 - DNA, 20 bp, Artificial
  CRISPR gRNA sequence
tcagggttctttgatgctgg

SEQ ID NO: 254490 - DNA, 20 bp, Artificial
  CRISPR gRNA sequence
tgatgctgggagccacacct

SEQ ID NO: 254491 - DNA, 20 bp, Artificial
  CRISPR gRNA sequence
atgctgggagccacacctta

SEQ ID NO: 254492 - DNA, 20 bp, Artificial
  CRISPR gRNA sequence
tgctgggagccacaccttag

SEQ ID NO: 254493 - DNA, 20 bp, Artificial
  CRISPR gRNA sequence
tgggagccacaccttagagg

SEQ ID NO: 254494 - DNA, 20 bp, Artificial
  CRISPR gRNA sequence
tggttaccaccccacctatg

SEQ ID NO: 254495 - DNA, 20 bp, Artificial
  CRISPR gRNA sequence
gttaccaccccacctatgca

SEQ ID NO: 254496 - DNA, 20 bp, Artificial
  CRISPR gRNA sequence
ttaccaccccacctatgcag

SEQ ID NO: 254497 - DNA, 20 bp, Artificial
  CRISPR gRNA sequence
taccaccccacctatgcaga

SEQ ID NO: 254498 - DNA, 20 bp, Artificial
  CRISPR gRNA sequence
gttgacctcattactaaata

SEQ ID NO: 254499 - DNA, 20 bp, Artificial
  CRISPR gRNA sequence
ggtaattgacccgtttataa

SEQ ID NO: 254500 - DNA, 20 bp, Artificial
  CRISPR gRNA sequence
gtaattgacccgtttataat

SEQ ID NO: 254501 - DNA, 20 bp, Artificial
  CRISPR gRNA sequence
ccgtttataataggtgtaaa

SEQ ID NO: 254502 - DNA, 20 bp, Artificial
  CRISPR gRNA sequence
ttataataggtgtaaacggc

SEQ ID NO: 254503 - DNA, 20 bp, Artificial
  CRISPR gRNA sequence
ataataggtgtaaacggcaa

SEQ ID NO: 254504 - DNA, 20 bp, Artificial
  CRISPR gRNA sequence
agttgtttttttttgtaacc

SEQ ID NO: 254505 - DNA, 20 bp, Artificial
  CRISPR gRNA sequence
accacccactgccattctca

SEQ ID NO: 254506 - DNA, 20 bp, Artificial
  CRISPR gRNA sequence
acccactgccattctcatgg

SEQ ID NO: 254507 - DNA, 20 bp, Artificial
  CRISPR gRNA sequence
tgccattctcatggaagttc

SEQ ID NO: 254508 - DNA, 20 bp, Artificial
  CRISPR gRNA sequence
agcaactttcaattttcctg

SEQ ID NO: 254509 - DNA, 20 bp, Artificial
  CRISPR gRNA sequence
actttcaattttcctgaagt

SEQ ID NO: 254510 - DNA, 20 bp, Artificial
  CRISPR gRNA sequence
cctgaagtcggctgtttcac

SEQ ID NO: 254511 - DNA, 20 bp, Artificial
  CRISPR gRNA sequence
cggctgtttcacaagattca

SEQ ID NO: 254512 - DNA, 20 bp, Artificial
  CRISPR gRNA sequence
caagattcacagattatctg

SEQ ID NO: 254513 - DNA, 20 bp, Artificial
  CRISPR gRNA sequence
aagattcacagattatctgt

SEQ ID NO: 254514 - DNA, 20 bp, Artificial
  CRISPR gRNA sequence
attatctgtgggaaatcttt

SEQ ID NO: 254515 - DNA, 20 bp, Artificial
  CRISPR gRNA sequence
gtgggaaatcttttagctct

SEQ ID NO: 254516 - DNA, 20 bp, Artificial
  CRISPR gRNA sequence
gctctcagtaccttgctcac

SEQ ID NO: 254517 - DNA, 20 bp, Artificial
  CRISPR gRNA sequence
ctcagtaccttgctcacaag

SEQ ID NO: 254518 - DNA, 20 bp, Artificial
  CRISPR gRNA sequence
agtaccttgctcacaagcag

SEQ ID NO: 254519 - DNA, 20 bp, Artificial
  CRISPR gRNA sequence
cttgctcacaagcagcagat

SEQ ID NO: 254520 - DNA, 20 bp, Artificial
  CRISPR gRNA sequence
tcttcatgttgcctgttgtt

SEQ ID NO: 254521 - DNA, 20 bp, Artificial
  CRISPR gRNA sequence
tcatgttgcctgttgttaag

SEQ ID NO: 254522 - DNA, 20 bp, Artificial
  CRISPR gRNA sequence
catgttgcctgttgttaagc

SEQ ID NO: 254523 - DNA, 20 bp, Artificial
  CRISPR gRNA sequence
tgttgcctgttgttaagcag

SEQ ID NO: 254524 - DNA, 20 bp, Artificial
  CRISPR gRNA sequence
tgttgttaagcaggagctgt

SEQ ID NO: 254525 - DNA, 20 bp, Artificial
  CRISPR gRNA sequence
gttgttaagcaggagctgtg

SEQ ID NO: 254526 - DNA, 20 bp, Artificial
  CRISPR gRNA sequence
ttgttaagcaggagctgtga

SEQ ID NO: 254527 - DNA, 20 bp, Artificial
  CRISPR gRNA sequence
taagcaggagctgtgaggga

SEQ ID NO: 254528 - DNA, 20 bp, Artificial
  CRISPR gRNA sequence
agcaggagctgtgagggaaa

SEQ ID NO: 254529 - DNA, 20 bp, Artificial
  CRISPR gRNA sequence
gcaggagctgtgagggaaag

SEQ ID NO: 254530 - DNA, 20 bp, Artificial
  CRISPR gRNA sequence
gctgtgagggaaagaggttt

SEQ ID NO: 254531 - DNA, 20 bp, Artificial
  CRISPR gRNA sequence
ctgtgagggaaagaggtttg

SEQ ID NO: 254532 - DNA, 20 bp, Artificial
  CRISPR gRNA sequence
gagggaaagaggtttgaggt

SEQ ID NO: 254533 - DNA, 20 bp, Artificial
  CRISPR gRNA sequence
gcttcctgtctccacacctt

SEQ ID NO: 254534 - DNA, 20 bp, Artificial
  CRISPR gRNA sequence
cctgtctccacacctttagc

SEQ ID NO: 254535 - DNA, 20 bp, Artificial
  CRISPR gRNA sequence
ctccacacctttagctggtt

SEQ ID NO: 254536 - DNA, 20 bp, Artificial
  CRISPR gRNA sequence
cctttagctggtttagctgc

SEQ ID NO: 254537 - DNA, 20 bp, Artificial
  CRISPR gRNA sequence
ctttagctggtttagctgct

SEQ ID NO: 254538 - DNA, 20 bp, Artificial
  CRISPR gRNA sequence
agctggtttagctgctagga

SEQ ID NO: 254539 - DNA, 20 bp, Artificial
  CRISPR gRNA sequence
gctggtttagctgctaggaa

SEQ ID NO: 254540 - DNA, 20 bp, Artificial
  CRISPR gRNA sequence
ctgctaggaaaggctttgaa

SEQ ID NO: 254541 - DNA, 20 bp, Artificial
  CRISPR gRNA sequence
aggaaaggctttgaaaagca

SEQ ID NO: 254542 - DNA, 20 bp, Artificial
  CRISPR gRNA sequence
ttcaaaacaacttgtcaatt

SEQ ID NO: 254543 - DNA, 20 bp, Artificial
  CRISPR gRNA sequence
aaacaacttgtcaattcagt

SEQ ID NO: 254544 - DNA, 20 bp, Artificial
  CRISPR gRNA sequence
acaacttgtcaattcagtta

SEQ ID NO: 254545 - DNA, 20 bp, Artificial
  CRISPR gRNA sequence
caattcagttagagaaatgt

SEQ ID NO: 254546 - DNA, 20 bp, Artificial
  CRISPR gRNA sequence
tcagttagagaaatgtcagt

SEQ ID NO: 254547 - DNA, 20 bp, Artificial
  CRISPR gRNA sequence
gaccaatcttttgataacgt

SEQ ID NO: 254548 - DNA, 20 bp, Artificial
  CRISPR gRNA sequence
atcttttgataacgtaagca

SEQ ID NO: 254549 - DNA, 20 bp, Artificial
  CRISPR gRNA sequence
gataacgtaagcaaagaaaa

SEQ ID NO: 254550 - DNA, 20 bp, Artificial
  CRISPR gRNA sequence
acgtaagcaaagaaaatgga

SEQ ID NO: 254551 - DNA, 20 bp, Artificial
  CRISPR gRNA sequence
cgtaagcaaagaaaatggat

SEQ ID NO: 254552 - DNA, 20 bp, Artificial
  CRISPR gRNA sequence
tgacaatgtttcttttaacc

SEQ ID NO: 254553 - DNA, 20 bp, Artificial
  CRISPR gRNA sequence
caatgtttcttttaacctag

SEQ ID NO: 254554 - DNA, 20 bp, Artificial
  CRISPR gRNA sequence
aatgtttcttttaacctagt

SEQ ID NO: 254555 - DNA, 20 bp, Artificial
  CRISPR gRNA sequence
ttaacctagtaggtttgacc

SEQ ID NO: 254556 - DNA, 20 bp, Artificial
  CRISPR gRNA sequence
taacctagtaggtttgacct

SEQ ID NO: 254557 - DNA, 20 bp, Artificial
  CRISPR gRNA sequence
cctagtaggtttgacctagg

SEQ ID NO: 254558 - DNA, 20 bp, Artificial
  CRISPR gRNA sequence
gaccttacctgaacactcac

SEQ ID NO: 254559 - DNA, 20 bp, Artificial
  CRISPR gRNA sequence
cttacctgaacactcacaag

SEQ ID NO: 254560 - DNA, 20 bp, Artificial
  CRISPR gRNA sequence
gaagtaaaatcaaatattca

SEQ ID NO: 254561 - DNA, 20 bp, Artificial
  CRISPR gRNA sequence
aagtaaaatcaaatattcac

SEQ ID NO: 254562 - DNA, 20 bp, Artificial
  CRISPR gRNA sequence
agtaaaatcaaatattcaca

SEQ ID NO: 254563 - DNA, 20 bp, Artificial
  CRISPR gRNA sequence
aaatcaaatattcacaggga

SEQ ID NO: 254564 - DNA, 20 bp, Artificial
  CRISPR gRNA sequence
aatcaaatattcacagggaa

SEQ ID NO: 254565 - DNA, 20 bp, Artificial
  CRISPR gRNA sequence
atcaaatattcacagggaaa

SEQ ID NO: 254566 - DNA, 20 bp, Artificial
  CRISPR gRNA sequence
aatattcacagggaaagggc

SEQ ID NO: 254567 - DNA, 20 bp, Artificial
  CRISPR gRNA sequence
atattcacagggaaagggct

SEQ ID NO: 254568 - DNA, 20 bp, Artificial
  CRISPR gRNA sequence
ggctgggtctcctgataccc

SEQ ID NO: 254569 - DNA, 20 bp, Artificial
  CRISPR gRNA sequence
tgggtctcctgatacccaag

SEQ ID NO: 254570 - DNA, 20 bp, Artificial
  CRISPR gRNA sequence
tcctgatacccaagtagcct

SEQ ID NO: 254571 - DNA, 20 bp, Artificial
  CRISPR gRNA sequence
tgatacccaagtagcctaag

SEQ ID NO: 254572 - DNA, 20 bp, Artificial
  CRISPR gRNA sequence
agaagaatgccttccactcc

SEQ ID NO: 254573 - DNA, 20 bp, Artificial
  CRISPR gRNA sequence
cttccactcctagcatgaac

SEQ ID NO: 254574 - DNA, 20 bp, Artificial
  CRISPR gRNA sequence
cactcctagcatgaactgga

SEQ ID NO: 254575 - DNA, 20 bp, Artificial
  CRISPR gRNA sequence
agcatgaactggaaagcaaa

SEQ ID NO: 254576 - DNA, 20 bp, Artificial
  CRISPR gRNA sequence
agcaaaaagaaatcaaacac

SEQ ID NO: 254577 - DNA, 20 bp, Artificial
  CRISPR gRNA sequence
aaaagaaatcaaacacaagt

SEQ ID NO: 254578 - DNA, 20 bp, Artificial
  CRISPR gRNA sequence
aaagaaatcaaacacaagtt

SEQ ID NO: 254579 - DNA, 20 bp, Artificial
  CRISPR gRNA sequence
aatcaaacacaagttaggac

SEQ ID NO: 254580 - DNA, 20 bp, Artificial
  CRISPR gRNA sequence
atcaaacacaagttaggacg

SEQ ID NO: 254581 - DNA, 20 bp, Artificial
  CRISPR gRNA sequence
tcaaacacaagttaggacga

SEQ ID NO: 254582 - DNA, 20 bp, Artificial
  CRISPR gRNA sequence
aaacacaagttaggacgagg

SEQ ID NO: 254583 - DNA, 20 bp, Artificial
  CRISPR gRNA sequence
ggacgagggagctacatatt

SEQ ID NO: 254584 - DNA, 20 bp, Artificial
  CRISPR gRNA sequence
gacgagggagctacatattt

SEQ ID NO: 254585 - DNA, 20 bp, Artificial
  CRISPR gRNA sequence
tacatatttgggtttcttct

SEQ ID NO: 254586 - DNA, 20 bp, Artificial
  CRISPR gRNA sequence
atttgggtttcttctgagtc

SEQ ID NO: 254587 - DNA, 20 bp, Artificial
  CRISPR gRNA sequence
atatgtccttacattatttg

SEQ ID NO: 254588 - DNA, 20 bp, Artificial
  CRISPR gRNA sequence
ttacattatttgaagtactg

SEQ ID NO: 254589 - DNA, 20 bp, Artificial
  CRISPR gRNA sequence
tttgaagtactgtggatttt

SEQ ID NO: 254590 - DNA, 20 bp, Artificial
  CRISPR gRNA sequence
actgtggattttcagaaact

SEQ ID NO: 254591 - DNA, 20 bp, Artificial
  CRISPR gRNA sequence
tgtggattttcagaaactca

SEQ ID NO: 254592 - DNA, 20 bp, Artificial
  CRISPR gRNA sequence
gagaccgaaaatacatatca

SEQ ID NO: 254593 - DNA, 20 bp, Artificial
  CRISPR gRNA sequence
tcatctgatattctgattat

SEQ ID NO: 254594 - DNA, 20 bp, Artificial
  CRISPR gRNA sequence
ttctccatgtttttacttca

SEQ ID NO: 254595 - DNA, 20 bp, Artificial
  CRISPR gRNA sequence
ctccatgtttttacttcata

SEQ ID NO: 254596 - DNA, 20 bp, Artificial
  CRISPR gRNA sequence
atgtttttacttcatagagc

SEQ ID NO: 254597 - DNA, 20 bp, Artificial
  CRISPR gRNA sequence
tgtttttacttcatagagca

SEQ ID NO: 254598 - DNA, 20 bp, Artificial
  CRISPR gRNA sequence
gtttttacttcatagagcaa

SEQ ID NO: 254599 - DNA, 20 bp, Artificial
  CRISPR gRNA sequence
tttttacttcatagagcaag

SEQ ID NO: 254600 - DNA, 20 bp, Artificial
  CRISPR gRNA sequence
ttacacatgccccattttaa

SEQ ID NO: 254601 - DNA, 20 bp, Artificial
  CRISPR gRNA sequence
gccccattttaaaagaaaat

SEQ ID NO: 254602 - DNA, 20 bp, Artificial
  CRISPR gRNA sequence
cccattttaaaagaaaataa

SEQ ID NO: 254603 - DNA, 20 bp, Artificial
  CRISPR gRNA sequence
taaaagaaaataagagaaat

SEQ ID NO: 254604 - DNA, 20 bp, Artificial
  CRISPR gRNA sequence
agaattattgtgtttactca

SEQ ID NO: 254605 - DNA, 20 bp, Artificial
  CRISPR gRNA sequence
tcacaatgatcacacatatt

SEQ ID NO: 254606 - DNA, 20 bp, Artificial
  CRISPR gRNA sequence
cacacatattcagtatcact

SEQ ID NO: 254607 - DNA, 20 bp, Artificial
  CRISPR gRNA sequence
cacatattcagtatcactta

SEQ ID NO: 254608 - DNA, 20 bp, Artificial
  CRISPR gRNA sequence
tcagtatcacttagagtcac

SEQ ID NO: 254609 - DNA, 20 bp, Artificial
  CRISPR gRNA sequence
agtcactggttatctttttc

SEQ ID NO: 254610 - DNA, 20 bp, Artificial
  CRISPR gRNA sequence
ttatctttttctagcaccaa

SEQ ID NO: 254611 - DNA, 20 bp, Artificial
  CRISPR gRNA sequence
ctctcatttactgtcttgca

SEQ ID NO: 254612 - DNA, 20 bp, Artificial
  CRISPR gRNA sequence
ttactgtcttgcaaagcata

SEQ ID NO: 254613 - DNA, 20 bp, Artificial
  CRISPR gRNA sequence
actgtcttgcaaagcatata

SEQ ID NO: 254614 - DNA, 20 bp, Artificial
  CRISPR gRNA sequence
gcaaagcatatagagatttt

SEQ ID NO: 254615 - DNA, 20 bp, Artificial
  CRISPR gRNA sequence
caaagcatatagagattttg

SEQ ID NO: 254616 - DNA, 20 bp, Artificial
  CRISPR gRNA sequence
tagagattttgaggtcctgt

SEQ ID NO: 254617 - DNA, 20 bp, Artificial
  CRISPR gRNA sequence
gattttgaggtcctgtgaga

SEQ ID NO: 254618 - DNA, 20 bp, Artificial
  CRISPR gRNA sequence
ctgtgagatagtttcctatt

SEQ ID NO: 254619 - DNA, 20 bp, Artificial
  CRISPR gRNA sequence
tgtgagatagtttcctattt

SEQ ID NO: 254620 - DNA, 20 bp, Artificial
  CRISPR gRNA sequence
ctgaattattgacatgaacc

SEQ ID NO: 254621 - DNA, 20 bp, Artificial
  CRISPR gRNA sequence
tgaattattgacatgaacca

SEQ ID NO: 254622 - DNA, 20 bp, Artificial
  CRISPR gRNA sequence
attattgacatgaaccaagg

SEQ ID NO: 254623 - DNA, 20 bp, Artificial
  CRISPR gRNA sequence
ttattgacatgaaccaaggt

SEQ ID NO: 254624 - DNA, 20 bp, Artificial
  CRISPR gRNA sequence
aaggtgggaccaaatgctat

SEQ ID NO: 254625 - DNA, 20 bp, Artificial
  CRISPR gRNA sequence
aggtgggaccaaatgctatg

SEQ ID NO: 254626 - DNA, 20 bp, Artificial
  CRISPR gRNA sequence
gctatgaggatataaatatt

SEQ ID NO: 254627 - DNA, 20 bp, Artificial
  CRISPR gRNA sequence
ggatataaatattgagaaac

SEQ ID NO: 254628 - DNA, 20 bp, Artificial
  CRISPR gRNA sequence
attgagaaacgagattttat

SEQ ID NO: 254629 - DNA, 20 bp, Artificial
  CRISPR gRNA sequence
ttatcagccaaccttgaact

SEQ ID NO: 254630 - DNA, 20 bp, Artificial
  CRISPR gRNA sequence
actcagcttgaactctaaac

SEQ ID NO: 254631 - DNA, 20 bp, Artificial
  CRISPR gRNA sequence
ctcagcttgaactctaaact

SEQ ID NO: 254632 - DNA, 20 bp, Artificial
  CRISPR gRNA sequence
cagcttgaactctaaactag

SEQ ID NO: 254633 - DNA, 20 bp, Artificial
  CRISPR gRNA sequence
agcttgaactctaaactagg

SEQ ID NO: 254634 - DNA, 20 bp, Artificial
  CRISPR gRNA sequence
actctaaactaggaggctgt

SEQ ID NO: 254635 - DNA, 20 bp, Artificial
  CRISPR gRNA sequence
gttagctacatgttaacaca

SEQ ID NO: 254636 - DNA, 20 bp, Artificial
  CRISPR gRNA sequence
gctacatgttaacacatagt

SEQ ID NO: 254637 - DNA, 20 bp, Artificial
  CRISPR gRNA sequence
catagtaagcaaacgatttc

SEQ ID NO: 254638 - DNA, 20 bp, Artificial
  CRISPR gRNA sequence
taagcaaacgatttcaagca

SEQ ID NO: 254639 - DNA, 20 bp, Artificial
  CRISPR gRNA sequence
caagcacagtatctgtgttt

SEQ ID NO: 254640 - DNA, 20 bp, Artificial
  CRISPR gRNA sequence
agcacagtatctgtgtttga

SEQ ID NO: 254641 - DNA, 20 bp, Artificial
  CRISPR gRNA sequence
cagtatctgtgtttgagagc

SEQ ID NO: 254642 - DNA, 20 bp, Artificial
  CRISPR gRNA sequence
aaaaatgatctatgttgaca

SEQ ID NO: 254643 - DNA, 20 bp, Artificial
  CRISPR gRNA sequence
aatgatctatgttgacaaag

SEQ ID NO: 254644 - DNA, 20 bp, Artificial
  CRISPR gRNA sequence
tgatctatgttgacaaagaa

SEQ ID NO: 254645 - DNA, 20 bp, Artificial
  CRISPR gRNA sequence
gatctatgttgacaaagaag

SEQ ID NO: 254646 - DNA, 20 bp, Artificial
  CRISPR gRNA sequence
atctatgttgacaaagaaga

SEQ ID NO: 254647 - DNA, 20 bp, Artificial
  CRISPR gRNA sequence
ctatgttgacaaagaagagg

SEQ ID NO: 254648 - DNA, 20 bp, Artificial
  CRISPR gRNA sequence
tatgttgacaaagaagaggg

SEQ ID NO: 254649 - DNA, 20 bp, Artificial
  CRISPR gRNA sequence
ttgacaaagaagagggagga

SEQ ID NO: 254650 - DNA, 20 bp, Artificial
  CRISPR gRNA sequence
agagggaggaaagtaaacat

SEQ ID NO: 254651 - DNA, 20 bp, Artificial
  CRISPR gRNA sequence
agtaaacatgagcaataaat

SEQ ID NO: 254652 - DNA, 20 bp, Artificial
  CRISPR gRNA sequence
aacatgagcaataaattgga

SEQ ID NO: 254653 - DNA, 20 bp, Artificial
  CRISPR gRNA sequence
ttggatggcttttcctcaaa

SEQ ID NO: 254654 - DNA, 20 bp, Artificial
  CRISPR gRNA sequence
atggccttatcgaaaacaaa

SEQ ID NO: 254655 - DNA, 20 bp, Artificial
  CRISPR gRNA sequence
atcgaaaacaaatagttttc

SEQ ID NO: 254656 - DNA, 20 bp, Artificial
  CRISPR gRNA sequence
atagttttcaagctcttttc

SEQ ID NO: 254657 - DNA, 20 bp, Artificial
  CRISPR gRNA sequence
gctcttttccagcaaaatct

SEQ ID NO: 254658 - DNA, 20 bp, Artificial
  CRISPR gRNA sequence
cttagcacttttctgcataa

SEQ ID NO: 254659 - DNA, 20 bp, Artificial
  CRISPR gRNA sequence
cttttctgcataaaagcctt

SEQ ID NO: 254660 - DNA, 20 bp, Artificial
  CRISPR gRNA sequence
ttctgcataaaagccttcag

SEQ ID NO: 254661 - DNA, 20 bp, Artificial
  CRISPR gRNA sequence
cagtagatcttcatcacctt

SEQ ID NO: 254662 - DNA, 20 bp, Artificial
  CRISPR gRNA sequence
tagatcttcatcaccttcag

SEQ ID NO: 254663 - DNA, 20 bp, Artificial
  CRISPR gRNA sequence
gatcttcatcaccttcagaa

SEQ ID NO: 254664 - DNA, 20 bp, Artificial
  CRISPR gRNA sequence
tcttcatcaccttcagaaga

SEQ ID NO: 254665 - DNA, 20 bp, Artificial
  CRISPR gRNA sequence
tcaccttcagaagagagccc

SEQ ID NO: 254666 - DNA, 20 bp, Artificial
  CRISPR gRNA sequence
agagagcccaagctctctaa

SEQ ID NO: 254667 - DNA, 20 bp, Artificial
  CRISPR gRNA sequence
agagcccaagctctctaatg

SEQ ID NO: 254668 - DNA, 20 bp, Artificial
  CRISPR gRNA sequence
atcttgtcttttgtaactca

SEQ ID NO: 254669 - DNA, 20 bp, Artificial
  CRISPR gRNA sequence
gtcttttgtaactcatggcc

SEQ ID NO: 254670 - DNA, 20 bp, Artificial
  CRISPR gRNA sequence
gtaactcatggcccagcaaa

SEQ ID NO: 254671 - DNA, 20 bp, Artificial
  CRISPR gRNA sequence
actcatggcccagcaaaaag

SEQ ID NO: 254672 - DNA, 20 bp, Artificial
  CRISPR gRNA sequence
ctcatggcccagcaaaaaga

SEQ ID NO: 254673 - DNA, 20 bp, Artificial
  CRISPR gRNA sequence
atggcccagcaaaaagaagg

SEQ ID NO: 254674 - DNA, 20 bp, Artificial
  CRISPR gRNA sequence
gaaggtagctgtaattcccc

SEQ ID NO: 254675 - DNA, 20 bp, Artificial
  CRISPR gRNA sequence
gtagctgtaattccccaagt

SEQ ID NO: 254676 - DNA, 20 bp, Artificial
  CRISPR gRNA sequence
ccctcctcatctcccttgcc

SEQ ID NO: 254677 - DNA, 20 bp, Artificial
  CRISPR gRNA sequence
tctttgtcttatcctcccca

SEQ ID NO: 254678 - DNA, 20 bp, Artificial
  CRISPR gRNA sequence
cacagtcccctaactcaccc

SEQ ID NO: 254679 - DNA, 20 bp, Artificial
  CRISPR gRNA sequence
cacactctcccacctcaccc

SEQ ID NO: 254680 - DNA, 20 bp, Artificial
  CRISPR gRNA sequence
tcaccccagtccccaacaca

SEQ ID NO: 254681 - DNA, 20 bp, Artificial
  CRISPR gRNA sequence
cccaacacaaagacacgtct

SEQ ID NO: 254682 - DNA, 20 bp, Artificial
  CRISPR gRNA sequence
acacaaagacacgtcttagc

SEQ ID NO: 254683 - DNA, 20 bp, Artificial
  CRISPR gRNA sequence
cacaaagacacgtcttagcc

SEQ ID NO: 254684 - DNA, 20 bp, Artificial
  CRISPR gRNA sequence
tagccaggctaacttttact

SEQ ID NO: 254685 - DNA, 20 bp, Artificial
  CRISPR gRNA sequence
ggctaacttttacttagtaa

SEQ ID NO: 254686 - DNA, 20 bp, Artificial
  CRISPR gRNA sequence
aacttttacttagtaaaagt

SEQ ID NO: 254687 - DNA, 20 bp, Artificial
  CRISPR gRNA sequence
tccatgtatgcatactcctt

SEQ ID NO: 254688 - DNA, 20 bp, Artificial
  CRISPR gRNA sequence
ccatgtatgcatactccttc

SEQ ID NO: 254689 - DNA, 20 bp, Artificial
  CRISPR gRNA sequence
atgcatactccttcaggact

SEQ ID NO: 254690 - DNA, 20 bp, Artificial
  CRISPR gRNA sequence
tgcatactccttcaggactc

SEQ ID NO: 254691 - DNA, 20 bp, Artificial
  CRISPR gRNA sequence
tactccttcaggactcaggt

SEQ ID NO: 254692 - DNA, 20 bp, Artificial
  CRISPR gRNA sequence
caggtcagccgtcatctcct

SEQ ID NO: 254693 - DNA, 20 bp, Artificial
  CRISPR gRNA sequence
ccgtcatctcctgagatcct

SEQ ID NO: 254694 - DNA, 20 bp, Artificial
  CRISPR gRNA sequence
catctcctgagatccttagc

SEQ ID NO: 254695 - DNA, 20 bp, Artificial
  CRISPR gRNA sequence
gctggtttccctgttgcccc

SEQ ID NO: 254696 - DNA, 20 bp, Artificial
  CRISPR gRNA sequence
ggtttccctgttgcccccgg

SEQ ID NO: 254697 - DNA, 20 bp, Artificial
  CRISPR gRNA sequence
ttgcccccggaagttttgtg

SEQ ID NO: 254698 - DNA, 20 bp, Artificial
  CRISPR gRNA sequence
tcactgtgtcactatgttta

SEQ ID NO: 254699 - DNA, 20 bp, Artificial
  CRISPR gRNA sequence
ctgtgtcactatgtttaaag

SEQ ID NO: 254700 - DNA, 20 bp, Artificial
  CRISPR gRNA sequence
tgtgtcactatgtttaaagt

SEQ ID NO: 254701 - DNA, 20 bp, Artificial
  CRISPR gRNA sequence
gtgtcactatgtttaaagta

SEQ ID NO: 254702 - DNA, 20 bp, Artificial
  CRISPR gRNA sequence
tttatatctttcttccccat

SEQ ID NO: 254703 - DNA, 20 bp, Artificial
  CRISPR gRNA sequence
tttcttccccatcagatcat

SEQ ID NO: 254704 - DNA, 20 bp, Artificial
  CRISPR gRNA sequence
catcagatcatgagctgccg

SEQ ID NO: 254705 - DNA, 20 bp, Artificial
  CRISPR gRNA sequence
atcagatcatgagctgccgt

SEQ ID NO: 254706 - DNA, 20 bp, Artificial
  CRISPR gRNA sequence
gatcatgagctgccgtagga

SEQ ID NO: 254707 - DNA, 20 bp, Artificial
  CRISPR gRNA sequence
atcatgagctgccgtaggac

SEQ ID NO: 254708 - DNA, 20 bp, Artificial
  CRISPR gRNA sequence
gctgccgtaggacgggaatt

SEQ ID NO: 254709 - DNA, 20 bp, Artificial
  CRISPR gRNA sequence
gccgtaggacgggaattgag

SEQ ID NO: 254710 - DNA, 20 bp, Artificial
  CRISPR gRNA sequence
aattgagtggcattcatttt

SEQ ID NO: 254711 - DNA, 20 bp, Artificial
  CRISPR gRNA sequence
attgagtggcattcattttt

SEQ ID NO: 254712 - DNA, 20 bp, Artificial
  CRISPR gRNA sequence
cttctctcccatgtgcatct

SEQ ID NO: 254713 - DNA, 20 bp, Artificial
  CRISPR gRNA sequence
ttctctcccatgtgcatctt

SEQ ID NO: 254714 - DNA, 20 bp, Artificial
  CRISPR gRNA sequence
ttaggaacatgtcacaccct

SEQ ID NO: 254715 - DNA, 20 bp, Artificial
  CRISPR gRNA sequence
gaacatgtcacaccctgagt

SEQ ID NO: 254716 - DNA, 20 bp, Artificial
  CRISPR gRNA sequence
atgtcacaccctgagttaga

SEQ ID NO: 254717 - DNA, 20 bp, Artificial
  CRISPR gRNA sequence
tgtcacaccctgagttagac

SEQ ID NO: 254718 - DNA, 20 bp, Artificial
  CRISPR gRNA sequence
tgagttagacaggacatatt

SEQ ID NO: 254719 - DNA, 20 bp, Artificial
  CRISPR gRNA sequence
ggacatattcagcaaaccac

SEQ ID NO: 254720 - DNA, 20 bp, Artificial
  CRISPR gRNA sequence
ttcagcaaaccactggactc

SEQ ID NO: 254721 - DNA, 20 bp, Artificial
  CRISPR gRNA sequence
ccactggactctagatgcca

SEQ ID NO: 254722 - DNA, 20 bp, Artificial
  CRISPR gRNA sequence
ctccacctcactgtgtgtgc

SEQ ID NO: 254723 - DNA, 20 bp, Artificial
  CRISPR gRNA sequence
tccacctcactgtgtgtgct

SEQ ID NO: 254724 - DNA, 20 bp, Artificial
  CRISPR gRNA sequence
cacctcactgtgtgtgctgg

SEQ ID NO: 254725 - DNA, 20 bp, Artificial
  CRISPR gRNA sequence
cctcactgtgtgtgctggga

SEQ ID NO: 254726 - DNA, 20 bp, Artificial
  CRISPR gRNA sequence
ctcactgtgtgtgctgggag

SEQ ID NO: 254727 - DNA, 20 bp, Artificial
  CRISPR gRNA sequence
tcactgtgtgtgctgggaga

SEQ ID NO: 254728 - DNA, 20 bp, Artificial
  CRISPR gRNA sequence
actgtgtgtgctgggagagg

SEQ ID NO: 254729 - DNA, 20 bp, Artificial
  CRISPR gRNA sequence
gctgggagagggagtcaaac

SEQ ID NO: 254730 - DNA, 20 bp, Artificial
  CRISPR gRNA sequence
ctgggagagggagtcaaact

SEQ ID NO: 254731 - DNA, 20 bp, Artificial
  CRISPR gRNA sequence
tgggagagggagtcaaactg

SEQ ID NO: 254732 - DNA, 20 bp, Artificial
  CRISPR gRNA sequence
ggagagggagtcaaactggg

SEQ ID NO: 254733 - DNA, 20 bp, Artificial
  CRISPR gRNA sequence
agtcaaactggggagccatc

SEQ ID NO: 254734 - DNA, 20 bp, Artificial
  CRISPR gRNA sequence
gtcaaactggggagccatct

SEQ ID NO: 254735 - DNA, 20 bp, Artificial
  CRISPR gRNA sequence
tcaaactggggagccatctg

SEQ ID NO: 254736 - DNA, 20 bp, Artificial
  CRISPR gRNA sequence
agccatctggggtttctctc

SEQ ID NO: 254737 - DNA, 20 bp, Artificial
  CRISPR gRNA sequence
tccctttttttgtctccaca

SEQ ID NO: 254738 - DNA, 20 bp, Artificial
  CRISPR gRNA sequence
ctttttttgtctccacaaag

SEQ ID NO: 254739 - DNA, 20 bp, Artificial
  CRISPR gRNA sequence
tcccatctttttctttaaat

SEQ ID NO: 254740 - DNA, 20 bp, Artificial
  CRISPR gRNA sequence
tttctttaaatcagctcaca

SEQ ID NO: 254741 - DNA, 20 bp, Artificial
  CRISPR gRNA sequence
ttctttaaatcagctcacaa

SEQ ID NO: 254742 - DNA, 20 bp, Artificial
  CRISPR gRNA sequence
tttaaatcagctcacaaagg

SEQ ID NO: 254743 - DNA, 20 bp, Artificial
  CRISPR gRNA sequence
atcagctcacaaaggcagat

SEQ ID NO: 254744 - DNA, 20 bp, Artificial
  CRISPR gRNA sequence
tcagctcacaaaggcagatc

SEQ ID NO: 254745 - DNA, 20 bp, Artificial
  CRISPR gRNA sequence
gctcacaaaggcagatcagg

SEQ ID NO: 254746 - DNA, 20 bp, Artificial
  CRISPR gRNA sequence
aatttgaatgtgcattaaaa

SEQ ID NO: 254747 - DNA, 20 bp, Artificial
  CRISPR gRNA sequence
taaaacagaatccaaataat

SEQ ID NO: 254748 - DNA, 20 bp, Artificial
  CRISPR gRNA sequence
agaatccaaataattagcaa

SEQ ID NO: 254749 - DNA, 20 bp, Artificial
  CRISPR gRNA sequence
agcaatagaaacacaattcc

SEQ ID NO: 254750 - DNA, 20 bp, Artificial
  CRISPR gRNA sequence
gcaatagaaacacaattccc

SEQ ID NO: 254751 - DNA, 20 bp, Artificial
  CRISPR gRNA sequence
caatagaaacacaattccca

SEQ ID NO: 254752 - DNA, 20 bp, Artificial
  CRISPR gRNA sequence
tagaaacacaattcccaggg

SEQ ID NO: 254753 - DNA, 20 bp, Artificial
  CRISPR gRNA sequence
aacacaattcccagggcggt

SEQ ID NO: 254754 - DNA, 20 bp, Artificial
  CRISPR gRNA sequence
caattcccagggcggtgagc

SEQ ID NO: 254755 - DNA, 20 bp, Artificial
  CRISPR gRNA sequence
ttcccagggcggtgagcaag

SEQ ID NO: 254756 - DNA, 20 bp, Artificial
  CRISPR gRNA sequence
acctgcactcactctctgaa

SEQ ID NO: 254757 - DNA, 20 bp, Artificial
  CRISPR gRNA sequence
cctgcactcactctctgaaa

SEQ ID NO: 254758 - DNA, 20 bp, Artificial
  CRISPR gRNA sequence
tgcactcactctctgaaaag

SEQ ID NO: 254759 - DNA, 20 bp, Artificial
  CRISPR gRNA sequence
gcactcactctctgaaaagg

SEQ ID NO: 254760 - DNA, 20 bp, Artificial
  CRISPR gRNA sequence
actcactctctgaaaaggag

SEQ ID NO: 254761 - DNA, 20 bp, Artificial
  CRISPR gRNA sequence
tcactctctgaaaaggagga

SEQ ID NO: 254762 - DNA, 20 bp, Artificial
  CRISPR gRNA sequence
tctgaaaaggaggagagatg

SEQ ID NO: 254763 - DNA, 20 bp, Artificial
  CRISPR gRNA sequence
ctgaaaaggaggagagatgc

SEQ ID NO: 254764 - DNA, 20 bp, Artificial
  CRISPR gRNA sequence
gagatgcaggcattgcttgc

SEQ ID NO: 254765 - DNA, 20 bp, Artificial
  CRISPR gRNA sequence
gatgcaggcattgcttgctg

SEQ ID NO: 254766 - DNA, 20 bp, Artificial
  CRISPR gRNA sequence
caggcattgcttgctggagt

SEQ ID NO: 254767 - DNA, 20 bp, Artificial
  CRISPR gRNA sequence
gagttggttgctcttccaat

SEQ ID NO: 254768 - DNA, 20 bp, Artificial
  CRISPR gRNA sequence
ctgacctaatgactccttct

SEQ ID NO: 254769 - DNA, 20 bp, Artificial
  CRISPR gRNA sequence
tgactccttctaagtaaaaa

SEQ ID NO: 254770 - DNA, 20 bp, Artificial
  CRISPR gRNA sequence
gactccttctaagtaaaaaa

SEQ ID NO: 254771 - DNA, 20 bp, Artificial
  CRISPR gRNA sequence
tcaaaaacaaaaaaacaaat

SEQ ID NO: 254772 - DNA, 20 bp, Artificial
  CRISPR gRNA sequence
acaaattggatgtttgtatt

SEQ ID NO: 254773 - DNA, 20 bp, Artificial
  CRISPR gRNA sequence
attggatgtttgtattaaga

SEQ ID NO: 254774 - DNA, 20 bp, Artificial
  CRISPR gRNA sequence
ttggatgtttgtattaagac

SEQ ID NO: 254775 - DNA, 20 bp, Artificial
  CRISPR gRNA sequence
ttctttgcatgtttattttt

SEQ ID NO: 254776 - DNA, 20 bp, Artificial
  CRISPR gRNA sequence
gtgcttttgcaaaatatttg

SEQ ID NO: 254777 - DNA, 20 bp, Artificial
  CRISPR gRNA sequence
aatatttgtggaacaaataa

SEQ ID NO: 254778 - DNA, 20 bp, Artificial
  CRISPR gRNA sequence
atatttgtggaacaaataat

SEQ ID NO: 254779 - DNA, 20 bp, Artificial
  CRISPR gRNA sequence
tgtggaacaaataataggtg

SEQ ID NO: 254780 - DNA, 20 bp, Artificial
  CRISPR gRNA sequence
acaaataataggtgaagtta

SEQ ID NO: 254781 - DNA, 20 bp, Artificial
  CRISPR gRNA sequence
tgaagttaaagttgttgaca

SEQ ID NO: 254782 - DNA, 20 bp, Artificial
  CRISPR gRNA sequence
gaagttaaagttgttgacac

SEQ ID NO: 254783 - DNA, 20 bp, Artificial
  CRISPR gRNA sequence
tgttgacacaggtttccaaa

SEQ ID NO: 254784 - DNA, 20 bp, Artificial
  CRISPR gRNA sequence
gttgacacaggtttccaaaa

SEQ ID NO: 254785 - DNA, 20 bp, Artificial
  CRISPR gRNA sequence
gtttccaaaaaggatttaat

SEQ ID NO: 254786 - DNA, 20 bp, Artificial
  CRISPR gRNA sequence
ccaaaaaggatttaatgaga

SEQ ID NO: 254787 - DNA, 20 bp, Artificial
  CRISPR gRNA sequence
aaaaggatttaatgagatgg

SEQ ID NO: 254788 - DNA, 20 bp, Artificial
  CRISPR gRNA sequence
aatgagatggtagtcaaacc

SEQ ID NO: 254789 - DNA, 20 bp, Artificial
  CRISPR gRNA sequence
agctgctgataacaacaata

SEQ ID NO: 254790 - DNA, 20 bp, Artificial
  CRISPR gRNA sequence
tcactccacaattattttat

SEQ ID NO: 254791 - DNA, 20 bp, Artificial
  CRISPR gRNA sequence
actccacaattattttatga

SEQ ID NO: 254792 - DNA, 20 bp, Artificial
  CRISPR gRNA sequence
attattttatgagagtctat

SEQ ID NO: 254793 - DNA, 20 bp, Artificial
  CRISPR gRNA sequence
tagtcatactgtgttatgta

SEQ ID NO: 254794 - DNA, 20 bp, Artificial
  CRISPR gRNA sequence
tcatactgtgttatgtaaag

SEQ ID NO: 254795 - DNA, 20 bp, Artificial
  CRISPR gRNA sequence
atgtaaagaagcataacatg

SEQ ID NO: 254796 - DNA, 20 bp, Artificial
  CRISPR gRNA sequence
aacatgtggtcctttctgtc

SEQ ID NO: 254797 - DNA, 20 bp, Artificial
  CRISPR gRNA sequence
catgtggtcctttctgtcaa

SEQ ID NO: 254798 - DNA, 20 bp, Artificial
  CRISPR gRNA sequence
gtcctttctgtcaagagact

SEQ ID NO: 254799 - DNA, 20 bp, Artificial
  CRISPR gRNA sequence
ctgtcaagagacttggaaac

SEQ ID NO: 254800 - DNA, 20 bp, Artificial
  CRISPR gRNA sequence
tgtcaagagacttggaaacc

SEQ ID NO: 254801 - DNA, 20 bp, Artificial
  CRISPR gRNA sequence
gtcaagagacttggaaacca

SEQ ID NO: 254802 - DNA, 20 bp, Artificial
  CRISPR gRNA sequence
tcaagagacttggaaaccag

SEQ ID NO: 254803 - DNA, 20 bp, Artificial
  CRISPR gRNA sequence
gacttggaaaccaggggcct

SEQ ID NO: 254804 - DNA, 20 bp, Artificial
  CRISPR gRNA sequence
acttggaaaccaggggccta

SEQ ID NO: 254805 - DNA, 20 bp, Artificial
  CRISPR gRNA sequence
cttggaaaccaggggcctaa

SEQ ID NO: 254806 - DNA, 20 bp, Artificial
  CRISPR gRNA sequence
gggaaatgcacatgaatcca

SEQ ID NO: 254807 - DNA, 20 bp, Artificial
  CRISPR gRNA sequence
atgcacatgaatccaaagct

SEQ ID NO: 254808 - DNA, 20 bp, Artificial
  CRISPR gRNA sequence
atccaaagctaagcaaattg

SEQ ID NO: 254809 - DNA, 20 bp, Artificial
  CRISPR gRNA sequence
caaattgaagcatgtgaaac

SEQ ID NO: 254810 - DNA, 20 bp, Artificial
  CRISPR gRNA sequence
aattgaagcatgtgaaacaa

SEQ ID NO: 254811 - DNA, 20 bp, Artificial
  CRISPR gRNA sequence
gtgaaacaagagttgtttaa

SEQ ID NO: 254812 - DNA, 20 bp, Artificial
  CRISPR gRNA sequence
tgaaacaagagttgtttaaa

SEQ ID NO: 254813 - DNA, 20 bp, Artificial
  CRISPR gRNA sequence
aacaagagttgtttaaaagg

SEQ ID NO: 254814 - DNA, 20 bp, Artificial
  CRISPR gRNA sequence
aaaggtagaactcaaatgtc

SEQ ID NO: 254815 - DNA, 20 bp, Artificial
  CRISPR gRNA sequence
gtagaactcaaatgtcaagt

SEQ ID NO: 254816 - DNA, 20 bp, Artificial
  CRISPR gRNA sequence
caaatgtcaagtgagcgata

SEQ ID NO: 254817 - DNA, 20 bp, Artificial
  CRISPR gRNA sequence
tgtcaagtgagcgatacaga

SEQ ID NO: 254818 - DNA, 20 bp, Artificial
  CRISPR gRNA sequence
atacagatagtaatcatttt

SEQ ID NO: 254819 - DNA, 20 bp, Artificial
  CRISPR gRNA sequence
tagtaatcattttgagacct

SEQ ID NO: 254820 - DNA, 20 bp, Artificial
  CRISPR gRNA sequence
taatcattttgagacctgag

SEQ ID NO: 254821 - DNA, 20 bp, Artificial
  CRISPR gRNA sequence
aatcattttgagacctgaga

SEQ ID NO: 254822 - DNA, 20 bp, Artificial
  CRISPR gRNA sequence
atcattttgagacctgagaa

SEQ ID NO: 254823 - DNA, 20 bp, Artificial
  CRISPR gRNA sequence
cattttgagacctgagaagg

SEQ ID NO: 254824 - DNA, 20 bp, Artificial
  CRISPR gRNA sequence
tttgagacctgagaagggag

SEQ ID NO: 254825 - DNA, 20 bp, Artificial
  CRISPR gRNA sequence
agggagtggtgctctgtgcc

SEQ ID NO: 254826 - DNA, 20 bp, Artificial
  CRISPR gRNA sequence
gggagtggtgctctgtgcca

SEQ ID NO: 254827 - DNA, 20 bp, Artificial
  CRISPR gRNA sequence
gagtggtgctctgtgccaag

SEQ ID NO: 254828 - DNA, 20 bp, Artificial
  CRISPR gRNA sequence
ggtgctctgtgccaaggagt

SEQ ID NO: 254829 - DNA, 20 bp, Artificial
  CRISPR gRNA sequence
gctctgtgccaaggagttag

SEQ ID NO: 254830 - DNA, 20 bp, Artificial
  CRISPR gRNA sequence
gtgccaaggagttagtagac

SEQ ID NO: 254831 - DNA, 20 bp, Artificial
  CRISPR gRNA sequence
tgccaaggagttagtagaca

SEQ ID NO: 254832 - DNA, 20 bp, Artificial
  CRISPR gRNA sequence
aggagttagtagacaaggca

SEQ ID NO: 254833 - DNA, 20 bp, Artificial
  CRISPR gRNA sequence
gagttagtagacaaggcatg

SEQ ID NO: 254834 - DNA, 20 bp, Artificial
  CRISPR gRNA sequence
agttagtagacaaggcatgg

SEQ ID NO: 254835 - DNA, 20 bp, Artificial
  CRISPR gRNA sequence
tagtagacaaggcatggagg

SEQ ID NO: 254836 - DNA, 20 bp, Artificial
  CRISPR gRNA sequence
agtagacaaggcatggaggt

SEQ ID NO: 254837 - DNA, 20 bp, Artificial
  CRISPR gRNA sequence
catggaggtaggaatgctca

SEQ ID NO: 254838 - DNA, 20 bp, Artificial
  CRISPR gRNA sequence
gaatgctcacagtctgttct

SEQ ID NO: 254839 - DNA, 20 bp, Artificial
  CRISPR gRNA sequence
aatgctcacagtctgttctt

SEQ ID NO: 254840 - DNA, 20 bp, Artificial
  CRISPR gRNA sequence
acagtctgttcttgggatgt

SEQ ID NO: 254841 - DNA, 20 bp, Artificial
  CRISPR gRNA sequence
tcttgggatgttggcttaaa

SEQ ID NO: 254842 - DNA, 20 bp, Artificial
  CRISPR gRNA sequence
gttggcttaaatggtctaat

SEQ ID NO: 254843 - DNA, 20 bp, Artificial
  CRISPR gRNA sequence
ttggcttaaatggtctaatt

SEQ ID NO: 254844 - DNA, 20 bp, Artificial
  CRISPR gRNA sequence
ggcttaaatggtctaattag

SEQ ID NO: 254845 - DNA, 20 bp, Artificial
  CRISPR gRNA sequence
gcttaaatggtctaattagg

SEQ ID NO: 254846 - DNA, 20 bp, Artificial
  CRISPR gRNA sequence
cttaaatggtctaattagga

SEQ ID NO: 254847 - DNA, 20 bp, Artificial
  CRISPR gRNA sequence
tggtctaattaggagggctt

SEQ ID NO: 254848 - DNA, 20 bp, Artificial
  CRISPR gRNA sequence
aattaggagggcttcggttt

SEQ ID NO: 254849 - DNA, 20 bp, Artificial
  CRISPR gRNA sequence
attaggagggcttcggtttg

SEQ ID NO: 254850 - DNA, 20 bp, Artificial
  CRISPR gRNA sequence
gggcttcggtttgaggaaat

SEQ ID NO: 254851 - DNA, 20 bp, Artificial
  CRISPR gRNA sequence
ggcttcggtttgaggaaatg

SEQ ID NO: 254852 - DNA, 20 bp, Artificial
  CRISPR gRNA sequence
tcggtttgaggaaatgaggt

SEQ ID NO: 254853 - DNA, 20 bp, Artificial
  CRISPR gRNA sequence
aatgaggttggaaaaacctg

SEQ ID NO: 254854 - DNA, 20 bp, Artificial
  CRISPR gRNA sequence
tgaggttggaaaaacctgtg

SEQ ID NO: 254855 - DNA, 20 bp, Artificial
  CRISPR gRNA sequence
gaggttggaaaaacctgtgg

SEQ ID NO: 254856 - DNA, 20 bp, Artificial
  CRISPR gRNA sequence
aaacctgtggaggccgattt

SEQ ID NO: 254857 - DNA, 20 bp, Artificial
  CRISPR gRNA sequence
aacctgtggaggccgatttg

SEQ ID NO: 254858 - DNA, 20 bp, Artificial
  CRISPR gRNA sequence
gtggaggccgatttgaggat

SEQ ID NO: 254859 - DNA, 20 bp, Artificial
  CRISPR gRNA sequence
gaggccgatttgaggataag

SEQ ID NO: 254860 - DNA, 20 bp, Artificial
  CRISPR gRNA sequence
ccgatttgaggataagaagt

SEQ ID NO: 254861 - DNA, 20 bp, Artificial
  CRISPR gRNA sequence
agaagttagttttcctctgt

SEQ ID NO: 254862 - DNA, 20 bp, Artificial
  CRISPR gRNA sequence
gaagttagttttcctctgtt

SEQ ID NO: 254863 - DNA, 20 bp, Artificial
  CRISPR gRNA sequence
gttttcctctgttaggccac

SEQ ID NO: 254864 - DNA, 20 bp, Artificial
  CRISPR gRNA sequence
tctcaaatttgactgccatc

SEQ ID NO: 254865 - DNA, 20 bp, Artificial
  CRISPR gRNA sequence
tgactgccatctagaattac

SEQ ID NO: 254866 - DNA, 20 bp, Artificial
  CRISPR gRNA sequence
actgccatctagaattacta

SEQ ID NO: 254867 - DNA, 20 bp, Artificial
  CRISPR gRNA sequence
agaaacttaaaaaatatgaa

SEQ ID NO: 254868 - DNA, 20 bp, Artificial
  CRISPR gRNA sequence
aaaaaatatgaatggatgcc

SEQ ID NO: 254869 - DNA, 20 bp, Artificial
  CRISPR gRNA sequence
aaaaatatgaatggatgcct

SEQ ID NO: 254870 - DNA, 20 bp, Artificial
  CRISPR gRNA sequence
ggatgcctgggtcctatacc

SEQ ID NO: 254871 - DNA, 20 bp, Artificial
  CRISPR gRNA sequence
atgcctgggtcctataccta

SEQ ID NO: 254872 - DNA, 20 bp, Artificial
  CRISPR gRNA sequence
cctagagattctgatttaat

SEQ ID NO: 254873 - DNA, 20 bp, Artificial
  CRISPR gRNA sequence
gattctgatttaattggcct

SEQ ID NO: 254874 - DNA, 20 bp, Artificial
  CRISPR gRNA sequence
taattggccttggaaaacca

SEQ ID NO: 254875 - DNA, 20 bp, Artificial
  CRISPR gRNA sequence
aattggccttggaaaaccaa

SEQ ID NO: 254876 - DNA, 20 bp, Artificial
  CRISPR gRNA sequence
cttggaaaaccaaaggcttt

SEQ ID NO: 254877 - DNA, 20 bp, Artificial
  CRISPR gRNA sequence
caaaggcttttagatttttc

SEQ ID NO: 254878 - DNA, 20 bp, Artificial
  CRISPR gRNA sequence
aaaggcttttagatttttcc

SEQ ID NO: 254879 - DNA, 20 bp, Artificial
  CRISPR gRNA sequence
ggtgattctaaatatgttgt

SEQ ID NO: 254880 - DNA, 20 bp, Artificial
  CRISPR gRNA sequence
gtgattctaaatatgttgtc

SEQ ID NO: 254881 - DNA, 20 bp, Artificial
  CRISPR gRNA sequence
tgttgtcaggtgaattccac

SEQ ID NO: 254882 - DNA, 20 bp, Artificial
  CRISPR gRNA sequence
gttgtcaggtgaattccact

SEQ ID NO: 254883 - DNA, 20 bp, Artificial
  CRISPR gRNA sequence
aggtgaattccactaggcca

SEQ ID NO: 254884 - DNA, 20 bp, Artificial
  CRISPR gRNA sequence
tgaattccactaggccatag

SEQ ID NO: 254885 - DNA, 20 bp, Artificial
  CRISPR gRNA sequence
ctttcaacccaattgaatat

SEQ ID NO: 254886 - DNA, 20 bp, Artificial
  CRISPR gRNA sequence
cccaattgaatattagaatc

SEQ ID NO: 254887 - DNA, 20 bp, Artificial
  CRISPR gRNA sequence
aattgaatattagaatcaag

SEQ ID NO: 254888 - DNA, 20 bp, Artificial
  CRISPR gRNA sequence
attgaatattagaatcaagt

SEQ ID NO: 254889 - DNA, 20 bp, Artificial
  CRISPR gRNA sequence
ttgaatattagaatcaagtg

SEQ ID NO: 254890 - DNA, 20 bp, Artificial
  CRISPR gRNA sequence
tgaatattagaatcaagtgg

SEQ ID NO: 254891 - DNA, 20 bp, Artificial
  CRISPR gRNA sequence
aatcaagtgggggaactttt

SEQ ID NO: 254892 - DNA, 20 bp, Artificial
  CRISPR gRNA sequence
gaacttttaagataatatga

SEQ ID NO: 254893 - DNA, 20 bp, Artificial
  CRISPR gRNA sequence
ataatatgaaagacaatcca

SEQ ID NO: 254894 - DNA, 20 bp, Artificial
  CRISPR gRNA sequence
tgaaagacaatccacagaat

SEQ ID NO: 254895 - DNA, 20 bp, Artificial
  CRISPR gRNA sequence
aaagacaatccacagaatga

SEQ ID NO: 254896 - DNA, 20 bp, Artificial
  CRISPR gRNA sequence
ttacaaatcacatatctgat

SEQ ID NO: 254897 - DNA, 20 bp, Artificial
  CRISPR gRNA sequence
tctgataagaaacttgtatc

SEQ ID NO: 254898 - DNA, 20 bp, Artificial
  CRISPR gRNA sequence
ctgataagaaacttgtatca

SEQ ID NO: 254899 - DNA, 20 bp, Artificial
  CRISPR gRNA sequence
aagaaacttgtatcaaggct

SEQ ID NO: 254900 - DNA, 20 bp, Artificial
  CRISPR gRNA sequence
agaaacttgtatcaaggctg

SEQ ID NO: 254901 - DNA, 20 bp, Artificial
  CRISPR gRNA sequence
aacttgtatcaaggctgagg

SEQ ID NO: 254902 - DNA, 20 bp, Artificial
  CRISPR gRNA sequence
acttgtatcaaggctgaggc

SEQ ID NO: 254903 - DNA, 20 bp, Artificial
  CRISPR gRNA sequence
tgtatcaaggctgaggcagg

SEQ ID NO: 254904 - DNA, 20 bp, Artificial
  CRISPR gRNA sequence
ctgaggcaggcagatcatct

SEQ ID NO: 254905 - DNA, 20 bp, Artificial
  CRISPR gRNA sequence
tgaggcaggcagatcatctg

SEQ ID NO: 254906 - DNA, 20 bp, Artificial
  CRISPR gRNA sequence
gcaggcagatcatctgaggt

SEQ ID NO: 254907 - DNA, 20 bp, Artificial
  CRISPR gRNA sequence
caggcagatcatctgaggtc

SEQ ID NO: 254908 - DNA, 20 bp, Artificial
  CRISPR gRNA sequence
ggcagatcatctgaggtcag

SEQ ID NO: 254909 - DNA, 20 bp, Artificial
  CRISPR gRNA sequence
tcatctgaggtcaggagttt

SEQ ID NO: 254910 - DNA, 20 bp, Artificial
  CRISPR gRNA sequence
tgaggtcaggagtttgagac

SEQ ID NO: 254911 - DNA, 20 bp, Artificial
  CRISPR gRNA sequence
tcaggagtttgagaccagcc

SEQ ID NO: 254912 - DNA, 20 bp, Artificial
  CRISPR gRNA sequence
tgagaccagcctggcccaca

SEQ ID NO: 254913 - DNA, 20 bp, Artificial
  CRISPR gRNA sequence
agaccagcctggcccacatg

SEQ ID NO: 254914 - DNA, 20 bp, Artificial
  CRISPR gRNA sequence
tctactaaaaatataaaaat

SEQ ID NO: 254915 - DNA, 20 bp, Artificial
  CRISPR gRNA sequence
ctaaaaatataaaaattagc

SEQ ID NO: 254916 - DNA, 20 bp, Artificial
  CRISPR gRNA sequence
taaaaatataaaaattagct

SEQ ID NO: 254917 - DNA, 20 bp, Artificial
  CRISPR gRNA sequence
aaaaatataaaaattagctg

SEQ ID NO: 254918 - DNA, 20 bp, Artificial
  CRISPR gRNA sequence
aaaatataaaaattagctgg

SEQ ID NO: 254919 - DNA, 20 bp, Artificial
  CRISPR gRNA sequence
atataaaaattagctggggg

SEQ ID NO: 254920 - DNA, 20 bp, Artificial
  CRISPR gRNA sequence
taaaaattagctgggggtgg

SEQ ID NO: 254921 - DNA, 20 bp, Artificial
  CRISPR gRNA sequence
aaattagctgggggtggtgg

SEQ ID NO: 254922 - DNA, 20 bp, Artificial
  CRISPR gRNA sequence
gtggtggtcacctccaattc

SEQ ID NO: 254923 - DNA, 20 bp, Artificial
  CRISPR gRNA sequence
cacctccaattccagctact

SEQ ID NO: 254924 - DNA, 20 bp, Artificial
  CRISPR gRNA sequence
acctccaattccagctactc

SEQ ID NO: 254925 - DNA, 20 bp, Artificial
  CRISPR gRNA sequence
ctccaattccagctactcgg

SEQ ID NO: 254926 - DNA, 20 bp, Artificial
  CRISPR gRNA sequence
tccaattccagctactcggg

SEQ ID NO: 254927 - DNA, 20 bp, Artificial
  CRISPR gRNA sequence
ttccagctactcgggaggct

SEQ ID NO: 254928 - DNA, 20 bp, Artificial
  CRISPR gRNA sequence
tccagctactcgggaggctg

SEQ ID NO: 254929 - DNA, 20 bp, Artificial
  CRISPR gRNA sequence
agctactcgggaggctgagg

SEQ ID NO: 254930 - DNA, 20 bp, Artificial
  CRISPR gRNA sequence
gctactcgggaggctgaggc

SEQ ID NO: 254931 - DNA, 20 bp, Artificial
  CRISPR gRNA sequence
tactcgggaggctgaggcag

SEQ ID NO: 254932 - DNA, 20 bp, Artificial
  CRISPR gRNA sequence
actcgggaggctgaggcagg

SEQ ID NO: 254933 - DNA, 20 bp, Artificial
  CRISPR gRNA sequence
gcaggaggattgcttgattc

SEQ ID NO: 254934 - DNA, 20 bp, Artificial
  CRISPR gRNA sequence
caggaggattgcttgattct

SEQ ID NO: 254935 - DNA, 20 bp, Artificial
  CRISPR gRNA sequence
gaggattgcttgattctggg

SEQ ID NO: 254936 - DNA, 20 bp, Artificial
  CRISPR gRNA sequence
gattgcttgattctgggtgg

SEQ ID NO: 254937 - DNA, 20 bp, Artificial
  CRISPR gRNA sequence
ttgcttgattctgggtggca

SEQ ID NO: 254938 - DNA, 20 bp, Artificial
  CRISPR gRNA sequence
tgcttgattctgggtggcag

SEQ ID NO: 254939 - DNA, 20 bp, Artificial
  CRISPR gRNA sequence
attctgggtggcagaggctg

SEQ ID NO: 254940 - DNA, 20 bp, Artificial
  CRISPR gRNA sequence
tgggtggcagaggctgcagt

SEQ ID NO: 254941 - DNA, 20 bp, Artificial
  CRISPR gRNA sequence
ggcagaggctgcagtgagcc

SEQ ID NO: 254942 - DNA, 20 bp, Artificial
  CRISPR gRNA sequence
aagatcatgccactgcactc

SEQ ID NO: 254943 - DNA, 20 bp, Artificial
  CRISPR gRNA sequence
catgccactgcactccagcc

SEQ ID NO: 254944 - DNA, 20 bp, Artificial
  CRISPR gRNA sequence
atgccactgcactccagcct

SEQ ID NO: 254945 - DNA, 20 bp, Artificial
  CRISPR gRNA sequence
ctgcactccagcctgggtga

SEQ ID NO: 254946 - DNA, 20 bp, Artificial
  CRISPR gRNA sequence
gcactccagcctgggtgaca

SEQ ID NO: 254947 - DNA, 20 bp, Artificial
  CRISPR gRNA sequence
tccagcctgggtgacagagt

SEQ ID NO: 254948 - DNA, 20 bp, Artificial
  CRISPR gRNA sequence
ctgtaaaaataaaaaaaaaa

SEQ ID NO: 254949 - DNA, 20 bp, Artificial
  CRISPR gRNA sequence
aaaagtataaaaaatgcata

SEQ ID NO: 254950 - DNA, 20 bp, Artificial
  CRISPR gRNA sequence
tccaataattcaataataaa

SEQ ID NO: 254951 - DNA, 20 bp, Artificial
  CRISPR gRNA sequence
ttcaataataaaaagataaa

SEQ ID NO: 254952 - DNA, 20 bp, Artificial
  CRISPR gRNA sequence
aaaaagataaatagcctaac

SEQ ID NO: 254953 - DNA, 20 bp, Artificial
  CRISPR gRNA sequence
tagcctaaccagttaataaa

SEQ ID NO: 254954 - DNA, 20 bp, Artificial
  CRISPR gRNA sequence
agcctaaccagttaataaat

SEQ ID NO: 254955 - DNA, 20 bp, Artificial
  CRISPR gRNA sequence
aaatgggcaaatgatctgaa

SEQ ID NO: 254956 - DNA, 20 bp, Artificial
  CRISPR gRNA sequence
atgggcaaatgatctgaata

SEQ ID NO: 254957 - DNA, 20 bp, Artificial
  CRISPR gRNA sequence
gggcaaatgatctgaataga

SEQ ID NO: 254958 - DNA, 20 bp, Artificial
  CRISPR gRNA sequence
tgaatagagagttctctaaa

SEQ ID NO: 254959 - DNA, 20 bp, Artificial
  CRISPR gRNA sequence
agagagttctctaaaaagaa

SEQ ID NO: 254960 - DNA, 20 bp, Artificial
  CRISPR gRNA sequence
ctctaaaaagaatagaccaa

SEQ ID NO: 254961 - DNA, 20 bp, Artificial
  CRISPR gRNA sequence
agaatagaccaatggctaat

SEQ ID NO: 254962 - DNA, 20 bp, Artificial
  CRISPR gRNA sequence
atggctaataagcacatgaa

SEQ ID NO: 254963 - DNA, 20 bp, Artificial
  CRISPR gRNA sequence
taagcacatgaaaagatgct

SEQ ID NO: 254964 - DNA, 20 bp, Artificial
  CRISPR gRNA sequence
gaaaagatgcttagcatcat

SEQ ID NO: 254965 - DNA, 20 bp, Artificial
  CRISPR gRNA sequence
tgcttagcatcattagttat

SEQ ID NO: 254966 - DNA, 20 bp, Artificial
  CRISPR gRNA sequence
cttagcatcattagttatta

SEQ ID NO: 254967 - DNA, 20 bp, Artificial
  CRISPR gRNA sequence
atcattagttattagagaaa

SEQ ID NO: 254968 - DNA, 20 bp, Artificial
  CRISPR gRNA sequence
atagcaaatcaaaccatgat

SEQ ID NO: 254969 - DNA, 20 bp, Artificial
  CRISPR gRNA sequence
agatatcacttcacgtccac

SEQ ID NO: 254970 - DNA, 20 bp, Artificial
  CRISPR gRNA sequence
gatatcacttcacgtccacc

SEQ ID NO: 254971 - DNA, 20 bp, Artificial
  CRISPR gRNA sequence
tcacttcacgtccaccagga

SEQ ID NO: 254972 - DNA, 20 bp, Artificial
  CRISPR gRNA sequence
gtccaccaggatggctataa

SEQ ID NO: 254973 - DNA, 20 bp, Artificial
  CRISPR gRNA sequence
ccaggatggctataatagaa

SEQ ID NO: 254974 - DNA, 20 bp, Artificial
  CRISPR gRNA sequence
tagaaaagatgaacaataac

SEQ ID NO: 254975 - DNA, 20 bp, Artificial
  CRISPR gRNA sequence
agatgaacaataacaagtgt

SEQ ID NO: 254976 - DNA, 20 bp, Artificial
  CRISPR gRNA sequence
gaacaataacaagtgtcggc

SEQ ID NO: 254977 - DNA, 20 bp, Artificial
  CRISPR gRNA sequence
aacaataacaagtgtcggca

SEQ ID NO: 254978 - DNA, 20 bp, Artificial
  CRISPR gRNA sequence
acaataacaagtgtcggcaa

SEQ ID NO: 254979 - DNA, 20 bp, Artificial
  CRISPR gRNA sequence
taacaagtgtcggcaagggt

SEQ ID NO: 254980 - DNA, 20 bp, Artificial
  CRISPR gRNA sequence
aacaagtgtcggcaagggtg

SEQ ID NO: 254981 - DNA, 20 bp, Artificial
  CRISPR gRNA sequence
cggcaagggtgaggataaat

SEQ ID NO: 254982 - DNA, 20 bp, Artificial
  CRISPR gRNA sequence
gcaagggtgaggataaattg

SEQ ID NO: 254983 - DNA, 20 bp, Artificial
  CRISPR gRNA sequence
ttggagccctcattcactgc

SEQ ID NO: 254984 - DNA, 20 bp, Artificial
  CRISPR gRNA sequence
agccctcattcactgctggt

SEQ ID NO: 254985 - DNA, 20 bp, Artificial
  CRISPR gRNA sequence
ctgctggtgagaatgtacaa

SEQ ID NO: 254986 - DNA, 20 bp, Artificial
  CRISPR gRNA sequence
ggtgagaatgtacaatggtg

SEQ ID NO: 254987 - DNA, 20 bp, Artificial
  CRISPR gRNA sequence
gtacaatggtgcagttgctt

SEQ ID NO: 254988 - DNA, 20 bp, Artificial
  CRISPR gRNA sequence
tggtgcagttgctttggcaa

SEQ ID NO: 254989 - DNA, 20 bp, Artificial
  CRISPR gRNA sequence
cagtttgacgattcctcaaa

SEQ ID NO: 254990 - DNA, 20 bp, Artificial
  CRISPR gRNA sequence
attcctcaaaaagttaaaca

SEQ ID NO: 254991 - DNA, 20 bp, Artificial
  CRISPR gRNA sequence
tcctcaaaaagttaaacata

SEQ ID NO: 254992 - DNA, 20 bp, Artificial
  CRISPR gRNA sequence
catagagttaccatatgacc

SEQ ID NO: 254993 - DNA, 20 bp, Artificial
  CRISPR gRNA sequence
tgacccagcaattttactgc

SEQ ID NO: 254994 - DNA, 20 bp, Artificial
  CRISPR gRNA sequence
tttactgctggcaaatacct

SEQ ID NO: 254995 - DNA, 20 bp, Artificial
  CRISPR gRNA sequence
tactgctggcaaatacctaa

SEQ ID NO: 254996 - DNA, 20 bp, Artificial
  CRISPR gRNA sequence
ctgctggcaaatacctaaga

SEQ ID NO: 254997 - DNA, 20 bp, Artificial
  CRISPR gRNA sequence
aatctgtatgcaaatgctca

SEQ ID NO: 254998 - DNA, 20 bp, Artificial
  CRISPR gRNA sequence
ctgtatgcaaatgctcatag

SEQ ID NO: 254999 - DNA, 20 bp, Artificial
  CRISPR gRNA sequence
catagtagcattattcataa

SEQ ID NO: 255000 - DNA, 20 bp, Artificial
  CRISPR gRNA sequence
cattattcataatagccaaa

SEQ ID NO: 255001 - DNA, 20 bp, Artificial
  CRISPR gRNA sequence
aatagccaaaaagtgatgaa

SEQ ID NO: 255002 - DNA, 20 bp, Artificial
  CRISPR gRNA sequence
atgaatagaaaaacaaaatg

SEQ ID NO: 255003 - DNA, 20 bp, Artificial
  CRISPR gRNA sequence
tagaaaaacaaaatgtagta

SEQ ID NO: 255004 - DNA, 20 bp, Artificial
  CRISPR gRNA sequence
aatgtagtatagccatacaa

SEQ ID NO: 255005 - DNA, 20 bp, Artificial
  CRISPR gRNA sequence
ccatacaatggaatattatt

SEQ ID NO: 255006 - DNA, 20 bp, Artificial
  CRISPR gRNA sequence
tggaatattatttggccatg

SEQ ID NO: 255007 - DNA, 20 bp, Artificial
  CRISPR gRNA sequence
gaatattatttggccatgaa

SEQ ID NO: 255008 - DNA, 20 bp, Artificial
  CRISPR gRNA sequence
ttatttggccatgaagagtg

SEQ ID NO: 255009 - DNA, 20 bp, Artificial
  CRISPR gRNA sequence
ggccatgaagagtgaagttc

SEQ ID NO: 255010 - DNA, 20 bp, Artificial
  CRISPR gRNA sequence
ttctggtgcatgcaacaaca

SEQ ID NO: 255011 - DNA, 20 bp, Artificial
  CRISPR gRNA sequence
catggatgaaacttgaaaca

SEQ ID NO: 255012 - DNA, 20 bp, Artificial
  CRISPR gRNA sequence
aaacttgaaaacattatgct

SEQ ID NO: 255013 - DNA, 20 bp, Artificial
  CRISPR gRNA sequence
gaaaacattatgctaagtga

SEQ ID NO: 255014 - DNA, 20 bp, Artificial
  CRISPR gRNA sequence
ttatgctaagtgaaagaaac

SEQ ID NO: 255015 - DNA, 20 bp, Artificial
  CRISPR gRNA sequence
tgaaagaaacgagacacaaa

SEQ ID NO: 255016 - DNA, 20 bp, Artificial
  CRISPR gRNA sequence
tatgattctacttataaaaa

SEQ ID NO: 255017 - DNA, 20 bp, Artificial
  CRISPR gRNA sequence
ttctacttataaaaaaagtc

SEQ ID NO: 255018 - DNA, 20 bp, Artificial
  CRISPR gRNA sequence
cttataaaaaaagtccagaa

SEQ ID NO: 255019 - DNA, 20 bp, Artificial
  CRISPR gRNA sequence
ttataaaaaaagtccagaat

SEQ ID NO: 255020 - DNA, 20 bp, Artificial
  CRISPR gRNA sequence
gtccagaataggcaaattca

SEQ ID NO: 255021 - DNA, 20 bp, Artificial
  CRISPR gRNA sequence
tccagaataggcaaattcat

SEQ ID NO: 255022 - DNA, 20 bp, Artificial
  CRISPR gRNA sequence
ccagaataggcaaattcata

SEQ ID NO: 255023 - DNA, 20 bp, Artificial
  CRISPR gRNA sequence
taggcaaattcatagggcca

SEQ ID NO: 255024 - DNA, 20 bp, Artificial
  CRISPR gRNA sequence
gcaaattcatagggccaaag

SEQ ID NO: 255025 - DNA, 20 bp, Artificial
  CRISPR gRNA sequence
ttcatagggccaaagtagat

SEQ ID NO: 255026 - DNA, 20 bp, Artificial
  CRISPR gRNA sequence
atagggccaaagtagatcag

SEQ ID NO: 255027 - DNA, 20 bp, Artificial
  CRISPR gRNA sequence
caaagtagatcagtggtttc

SEQ ID NO: 255028 - DNA, 20 bp, Artificial
  CRISPR gRNA sequence
aaagtagatcagtggtttcc

SEQ ID NO: 255029 - DNA, 20 bp, Artificial
  CRISPR gRNA sequence
aagtagatcagtggtttcca

SEQ ID NO: 255030 - DNA, 20 bp, Artificial
  CRISPR gRNA sequence
tcagtggtttccagggattt

SEQ ID NO: 255031 - DNA, 20 bp, Artificial
  CRISPR gRNA sequence
cagtggtttccagggattta

SEQ ID NO: 255032 - DNA, 20 bp, Artificial
  CRISPR gRNA sequence
agtggtttccagggatttaa

SEQ ID NO: 255033 - DNA, 20 bp, Artificial
  CRISPR gRNA sequence
tggtttccagggatttaagg

SEQ ID NO: 255034 - DNA, 20 bp, Artificial
  CRISPR gRNA sequence
ggtttccagggatttaaggg

SEQ ID NO: 255035 - DNA, 20 bp, Artificial
  CRISPR gRNA sequence
gtttccagggatttaaggga

SEQ ID NO: 255036 - DNA, 20 bp, Artificial
  CRISPR gRNA sequence
ttccagggatttaagggagg

SEQ ID NO: 255037 - DNA, 20 bp, Artificial
  CRISPR gRNA sequence
tccagggatttaagggaggg

SEQ ID NO: 255038 - DNA, 20 bp, Artificial
  CRISPR gRNA sequence
agggatttaagggagggagg

SEQ ID NO: 255039 - DNA, 20 bp, Artificial
  CRISPR gRNA sequence
gatttaagggagggaggaag

SEQ ID NO: 255040 - DNA, 20 bp, Artificial
  CRISPR gRNA sequence
atttaagggagggaggaagc

SEQ ID NO: 255041 - DNA, 20 bp, Artificial
  CRISPR gRNA sequence
tttaagggagggaggaagca

SEQ ID NO: 255042 - DNA, 20 bp, Artificial
  CRISPR gRNA sequence
ggagggaggaagcagggtga

SEQ ID NO: 255043 - DNA, 20 bp, Artificial
  CRISPR gRNA sequence
ggaagcagggtgatggtaaa

SEQ ID NO: 255044 - DNA, 20 bp, Artificial
  CRISPR gRNA sequence
gaagcagggtgatggtaaat

SEQ ID NO: 255045 - DNA, 20 bp, Artificial
  CRISPR gRNA sequence
agggtgatggtaaatgggta

SEQ ID NO: 255046 - DNA, 20 bp, Artificial
  CRISPR gRNA sequence
atgggtatggtatttcttta

SEQ ID NO: 255047 - DNA, 20 bp, Artificial
  CRISPR gRNA sequence
gggtatggtatttctttatg

SEQ ID NO: 255048 - DNA, 20 bp, Artificial
  CRISPR gRNA sequence
atggagtaatgaaaatgttc

SEQ ID NO: 255049 - DNA, 20 bp, Artificial
  CRISPR gRNA sequence
taatgaaaatgttctggaat

SEQ ID NO: 255050 - DNA, 20 bp, Artificial
  CRISPR gRNA sequence
gaaaatgttctggaatcaga

SEQ ID NO: 255051 - DNA, 20 bp, Artificial
  CRISPR gRNA sequence
aatgttctggaatcagatag

SEQ ID NO: 255052 - DNA, 20 bp, Artificial
  CRISPR gRNA sequence
ctgaattttacactttaaaa

SEQ ID NO: 255053 - DNA, 20 bp, Artificial
  CRISPR gRNA sequence
ctttaaaacagcaaacttta

SEQ ID NO: 255054 - DNA, 20 bp, Artificial
  CRISPR gRNA sequence
acctgaattatatctcaata

SEQ ID NO: 255055 - DNA, 20 bp, Artificial
  CRISPR gRNA sequence
taaagttattatctaaaata

SEQ ID NO: 255056 - DNA, 20 bp, Artificial
  CRISPR gRNA sequence
taaaataaagaaaaaaaact

SEQ ID NO: 255057 - DNA, 20 bp, Artificial
  CRISPR gRNA sequence
ttagtatcaatccttccccc

SEQ ID NO: 255058 - DNA, 20 bp, Artificial
  CRISPR gRNA sequence
atcaatccttccccccagcc

SEQ ID NO: 255059 - DNA, 20 bp, Artificial
  CRISPR gRNA sequence
ccagcctagaccaattaaat

SEQ ID NO: 255060 - DNA, 20 bp, Artificial
  CRISPR gRNA sequence
accaattaaatcagaatttc

SEQ ID NO: 255061 - DNA, 20 bp, Artificial
  CRISPR gRNA sequence
aattaaatcagaatttccgg

SEQ ID NO: 255062 - DNA, 20 bp, Artificial
  CRISPR gRNA sequence
taaatcagaatttccggaag

SEQ ID NO: 255063 - DNA, 20 bp, Artificial
  CRISPR gRNA sequence
aaatcagaatttccggaagt

SEQ ID NO: 255064 - DNA, 20 bp, Artificial
  CRISPR gRNA sequence
atcagaatttccggaagtgg

SEQ ID NO: 255065 - DNA, 20 bp, Artificial
  CRISPR gRNA sequence
tcagaatttccggaagtggg

SEQ ID NO: 255066 - DNA, 20 bp, Artificial
  CRISPR gRNA sequence
tttccggaagtgggaggact

SEQ ID NO: 255067 - DNA, 20 bp, Artificial
  CRISPR gRNA sequence
ttccggaagtgggaggactt

SEQ ID NO: 255068 - DNA, 20 bp, Artificial
  CRISPR gRNA sequence
gaagtgggaggacttgggca

SEQ ID NO: 255069 - DNA, 20 bp, Artificial
  CRISPR gRNA sequence
acagatattttttcatttta

SEQ ID NO: 255070 - DNA, 20 bp, Artificial
  CRISPR gRNA sequence
attttaaagttcttgatata

SEQ ID NO: 255071 - DNA, 20 bp, Artificial
  CRISPR gRNA sequence
taaagttcttgatataaagc

SEQ ID NO: 255072 - DNA, 20 bp, Artificial
  CRISPR gRNA sequence
gccagcaatgattttttaaa

SEQ ID NO: 255073 - DNA, 20 bp, Artificial
  CRISPR gRNA sequence
attttttaaaaagaattttg

SEQ ID NO: 255074 - DNA, 20 bp, Artificial
  CRISPR gRNA sequence
tttttaaaaagaattttgta

SEQ ID NO: 255075 - DNA, 20 bp, Artificial
  CRISPR gRNA sequence
taaaaagaattttgtagaga

SEQ ID NO: 255076 - DNA, 20 bp, Artificial
  CRISPR gRNA sequence
aaaaagaattttgtagagat

SEQ ID NO: 255077 - DNA, 20 bp, Artificial
  CRISPR gRNA sequence
tgggttctttctatgttgcc

SEQ ID NO: 255078 - DNA, 20 bp, Artificial
  CRISPR gRNA sequence
gggttctttctatgttgccc

SEQ ID NO: 255079 - DNA, 20 bp, Artificial
  CRISPR gRNA sequence
tctttctatgttgcccaggc

SEQ ID NO: 255080 - DNA, 20 bp, Artificial
  CRISPR gRNA sequence
ccaggctggtcttgaactcc

SEQ ID NO: 255081 - DNA, 20 bp, Artificial
  CRISPR gRNA sequence
caggctggtcttgaactcct

SEQ ID NO: 255082 - DNA, 20 bp, Artificial
  CRISPR gRNA sequence
ggtcttgaactcctgggctc

SEQ ID NO: 255083 - DNA, 20 bp, Artificial
  CRISPR gRNA sequence
ctcaagcattcatcccgcct

SEQ ID NO: 255084 - DNA, 20 bp, Artificial
  CRISPR gRNA sequence
catcccgccttggcctccca

SEQ ID NO: 255085 - DNA, 20 bp, Artificial
  CRISPR gRNA sequence
gccttggcctcccaaagtgc

SEQ ID NO: 255086 - DNA, 20 bp, Artificial
  CRISPR gRNA sequence
ccttggcctcccaaagtgct

SEQ ID NO: 255087 - DNA, 20 bp, Artificial
  CRISPR gRNA sequence
cccaaagtgctaggatcaca

SEQ ID NO: 255088 - DNA, 20 bp, Artificial
  CRISPR gRNA sequence
ccaaagtgctaggatcacaa

SEQ ID NO: 255089 - DNA, 20 bp, Artificial
  CRISPR gRNA sequence
tgctaggatcacaaaggtgt

SEQ ID NO: 255090 - DNA, 20 bp, Artificial
  CRISPR gRNA sequence
aaggtgtgagccatcatccc

SEQ ID NO: 255091 - DNA, 20 bp, Artificial
  CRISPR gRNA sequence
tgtgagccatcatccccagc

SEQ ID NO: 255092 - DNA, 20 bp, Artificial
  CRISPR gRNA sequence
agccagcattattgattata

SEQ ID NO: 255093 - DNA, 20 bp, Artificial
  CRISPR gRNA sequence
gccagcattattgattatat

SEQ ID NO: 255094 - DNA, 20 bp, Artificial
  CRISPR gRNA sequence
cagcattattgattatatag

SEQ ID NO: 255095 - DNA, 20 bp, Artificial
  CRISPR gRNA sequence
ttgattatataggagacaaa

SEQ ID NO: 255096 - DNA, 20 bp, Artificial
  CRISPR gRNA sequence
acaaaaagctactattaatt

SEQ ID NO: 255097 - DNA, 20 bp, Artificial
  CRISPR gRNA sequence
tgtgtatatgaattcaaatt

SEQ ID NO: 255098 - DNA, 20 bp, Artificial
  CRISPR gRNA sequence
aaaatgaatctgattttatt

SEQ ID NO: 255099 - DNA, 20 bp, Artificial
  CRISPR gRNA sequence
tctgattttatttggctctt

SEQ ID NO: 255100 - DNA, 20 bp, Artificial
  CRISPR gRNA sequence
ttttatttggctcttcagtg

SEQ ID NO: 255101 - DNA, 20 bp, Artificial
  CRISPR gRNA sequence
tttatttggctcttcagtgt

SEQ ID NO: 255102 - DNA, 20 bp, Artificial
  CRISPR gRNA sequence
ggctcttcagtgtgggtata

SEQ ID NO: 255103 - DNA, 20 bp, Artificial
  CRISPR gRNA sequence
gctcttcagtgtgggtatac

SEQ ID NO: 255104 - DNA, 20 bp, Artificial
  CRISPR gRNA sequence
gttgcttcaaataaacttaa

SEQ ID NO: 255105 - DNA, 20 bp, Artificial
  CRISPR gRNA sequence
aataaacttaaaagaaatgc

SEQ ID NO: 255106 - DNA, 20 bp, Artificial
  CRISPR gRNA sequence
aaacttaaaagaaatgcaag

SEQ ID NO: 255107 - DNA, 20 bp, Artificial
  CRISPR gRNA sequence
aacttaaaagaaatgcaagt

SEQ ID NO: 255108 - DNA, 20 bp, Artificial
  CRISPR gRNA sequence
ttattaacataccccaaaac

SEQ ID NO: 255109 - DNA, 20 bp, Artificial
  CRISPR gRNA sequence
attaacataccccaaaacaa

SEQ ID NO: 255110 - DNA, 20 bp, Artificial
  CRISPR gRNA sequence
ttgcattgaaatttgaatca

SEQ ID NO: 255111 - DNA, 20 bp, Artificial
  CRISPR gRNA sequence
aaatttgaatcaaagacaca

SEQ ID NO: 255112 - DNA, 20 bp, Artificial
  CRISPR gRNA sequence
tttgaatcaaagacacaaag

SEQ ID NO: 255113 - DNA, 20 bp, Artificial
  CRISPR gRNA sequence
cacaaagtggtttgttgttt

SEQ ID NO: 255114 - DNA, 20 bp, Artificial
  CRISPR gRNA sequence
gttgttttagaaaaattctt

SEQ ID NO: 255115 - DNA, 20 bp, Artificial
  CRISPR gRNA sequence
ttgttttagaaaaattcttg

SEQ ID NO: 255116 - DNA, 20 bp, Artificial
  CRISPR gRNA sequence
tgttttagaaaaattcttga

SEQ ID NO: 255117 - DNA, 20 bp, Artificial
  CRISPR gRNA sequence
ttagaaaaattcttgagggc

SEQ ID NO: 255118 - DNA, 20 bp, Artificial
  CRISPR gRNA sequence
tagaaaaattcttgagggcc

SEQ ID NO: 255119 - DNA, 20 bp, Artificial
  CRISPR gRNA sequence
aaattcttgagggccaggcg

SEQ ID NO: 255120 - DNA, 20 bp, Artificial
  CRISPR gRNA sequence
ttcttgagggccaggcgcag

SEQ ID NO: 255121 - DNA, 20 bp, Artificial
  CRISPR gRNA sequence
gtggctcacacctgtaatcc

SEQ ID NO: 255122 - DNA, 20 bp, Artificial
  CRISPR gRNA sequence
cacctgtaatcccagcactt

SEQ ID NO: 255123 - DNA, 20 bp, Artificial
  CRISPR gRNA sequence
acctgtaatcccagcacttt

SEQ ID NO: 255124 - DNA, 20 bp, Artificial
  CRISPR gRNA sequence
ctgtaatcccagcactttgg

SEQ ID NO: 255125 - DNA, 20 bp, Artificial
  CRISPR gRNA sequence
tgtaatcccagcactttggg

SEQ ID NO: 255126 - DNA, 20 bp, Artificial
  CRISPR gRNA sequence
tcccagcactttgggaggcc

SEQ ID NO: 255127 - DNA, 20 bp, Artificial
  CRISPR gRNA sequence
cccagcactttgggaggccg

SEQ ID NO: 255128 - DNA, 20 bp, Artificial
  CRISPR gRNA sequence
agcactttgggaggccgagg

SEQ ID NO: 255129 - DNA, 20 bp, Artificial
  CRISPR gRNA sequence
actttgggaggccgaggcgg

SEQ ID NO: 255130 - DNA, 20 bp, Artificial
  CRISPR gRNA sequence
gccgaggcggtggatcacct

SEQ ID NO: 255131 - DNA, 20 bp, Artificial
  CRISPR gRNA sequence
ccgaggcggtggatcacctg

SEQ ID NO: 255132 - DNA, 20 bp, Artificial
  CRISPR gRNA sequence
ggcggtggatcacctgaggt

SEQ ID NO: 255133 - DNA, 20 bp, Artificial
  CRISPR gRNA sequence
gcggtggatcacctgaggtt

SEQ ID NO: 255134 - DNA, 20 bp, Artificial
  CRISPR gRNA sequence
ggtggatcacctgaggttgg

SEQ ID NO: 255135 - DNA, 20 bp, Artificial
  CRISPR gRNA sequence
tcacctgaggttgggagttc

SEQ ID NO: 255136 - DNA, 20 bp, Artificial
  CRISPR gRNA sequence
tgaggttgggagttcgagac

SEQ ID NO: 255137 - DNA, 20 bp, Artificial
  CRISPR gRNA sequence
cgagacaagcctgaccaaca

SEQ ID NO: 255138 - DNA, 20 bp, Artificial
  CRISPR gRNA sequence
agacaagcctgaccaacatg

SEQ ID NO: 255139 - DNA, 20 bp, Artificial
  CRISPR gRNA sequence
aaccccgtctctactaaaaa

SEQ ID NO: 255140 - DNA, 20 bp, Artificial
  CRISPR gRNA sequence
ctctactaaaaatagaaaat

SEQ ID NO: 255141 - DNA, 20 bp, Artificial
  CRISPR gRNA sequence
actaaaaatagaaaattagc

SEQ ID NO: 255142 - DNA, 20 bp, Artificial
  CRISPR gRNA sequence
ctaaaaatagaaaattagcc

SEQ ID NO: 255143 - DNA, 20 bp, Artificial
  CRISPR gRNA sequence
aatagaaaattagccgggca

SEQ ID NO: 255144 - DNA, 20 bp, Artificial
  CRISPR gRNA sequence
agaaaattagccgggcatgg

SEQ ID NO: 255145 - DNA, 20 bp, Artificial
  CRISPR gRNA sequence
tggtgcatacctgttaatcc

SEQ ID NO: 255146 - DNA, 20 bp, Artificial
  CRISPR gRNA sequence
acctgttaatcccagctact

SEQ ID NO: 255147 - DNA, 20 bp, Artificial
  CRISPR gRNA sequence
cctgttaatcccagctactc

SEQ ID NO: 255148 - DNA, 20 bp, Artificial
  CRISPR gRNA sequence
tgttaatcccagctactcgg

SEQ ID NO: 255149 - DNA, 20 bp, Artificial
  CRISPR gRNA sequence
gttaatcccagctactcggg

SEQ ID NO: 255150 - DNA, 20 bp, Artificial
  CRISPR gRNA sequence
tcccagctactcgggaggct

SEQ ID NO: 255151 - DNA, 20 bp, Artificial
  CRISPR gRNA sequence
cccagctactcgggaggctg

SEQ ID NO: 255152 - DNA, 20 bp, Artificial
  CRISPR gRNA sequence
agctactcgggaggctgagg

SEQ ID NO: 255153 - DNA, 20 bp, Artificial
  CRISPR gRNA sequence
gctactcgggaggctgaggc

SEQ ID NO: 255154 - DNA, 20 bp, Artificial
  CRISPR gRNA sequence
tactcgggaggctgaggcag

SEQ ID NO: 255155 - DNA, 20 bp, Artificial
  CRISPR gRNA sequence
gcaggagaatcacctgaacc

SEQ ID NO: 255156 - DNA, 20 bp, Artificial
  CRISPR gRNA sequence
aggagaatcacctgaaccca

SEQ ID NO: 255157 - DNA, 20 bp, Artificial
  CRISPR gRNA sequence
ggagaatcacctgaacccag

SEQ ID NO: 255158 - DNA, 20 bp, Artificial
  CRISPR gRNA sequence
gagaatcacctgaacccaga

SEQ ID NO: 255159 - DNA, 20 bp, Artificial
  CRISPR gRNA sequence
aatcacctgaacccagaggg

SEQ ID NO: 255160 - DNA, 20 bp, Artificial
  CRISPR gRNA sequence
tcacctgaacccagagggcg

SEQ ID NO: 255161 - DNA, 20 bp, Artificial
  CRISPR gRNA sequence
cacctgaacccagagggcgg

SEQ ID NO: 255162 - DNA, 20 bp, Artificial
  CRISPR gRNA sequence
aacccagagggcggaggttg

SEQ ID NO: 255163 - DNA, 20 bp, Artificial
  CRISPR gRNA sequence
cagagggcggaggttgcagt

SEQ ID NO: 255164 - DNA, 20 bp, Artificial
  CRISPR gRNA sequence
ggcggaggttgcagtcagct

SEQ ID NO: 255165 - DNA, 20 bp, Artificial
  CRISPR gRNA sequence
gagatcgcaccattgcactc

SEQ ID NO: 255166 - DNA, 20 bp, Artificial
  CRISPR gRNA sequence
cgcaccattgcactccagcc

SEQ ID NO: 255167 - DNA, 20 bp, Artificial
  CRISPR gRNA sequence
gcaccattgcactccagcct

SEQ ID NO: 255168 - DNA, 20 bp, Artificial
  CRISPR gRNA sequence
tgcactccagcctgggcaac

SEQ ID NO: 255169 - DNA, 20 bp, Artificial
  CRISPR gRNA sequence
cactccagcctgggcaacaa

SEQ ID NO: 255170 - DNA, 20 bp, Artificial
  CRISPR gRNA sequence
caagagcgaaactccgtctc

SEQ ID NO: 255171 - DNA, 20 bp, Artificial
  CRISPR gRNA sequence
tctccagaaaaaaaaaaaaa

SEQ ID NO: 255172 - DNA, 20 bp, Artificial
  CRISPR gRNA sequence
aaaaaaaaaaagaaaaattt

SEQ ID NO: 255173 - DNA, 20 bp, Artificial
  CRISPR gRNA sequence
aaaaaaaagaaaaattttgg

SEQ ID NO: 255174 - DNA, 20 bp, Artificial
  CRISPR gRNA sequence
aaaaaaagaaaaattttgga

SEQ ID NO: 255175 - DNA, 20 bp, Artificial
  CRISPR gRNA sequence
aaaaattttggaaggtgtct

SEQ ID NO: 255176 - DNA, 20 bp, Artificial
  CRISPR gRNA sequence
tggaaggtgtcttggttgca

SEQ ID NO: 255177 - DNA, 20 bp, Artificial
  CRISPR gRNA sequence
ttggttgcaaagttgattcc

SEQ ID NO: 255178 - DNA, 20 bp, Artificial
  CRISPR gRNA sequence
aaagttgattcccagtttct

SEQ ID NO: 255179 - DNA, 20 bp, Artificial
  CRISPR gRNA sequence
ttcccagtttctcagtgctt

SEQ ID NO: 255180 - DNA, 20 bp, Artificial
  CRISPR gRNA sequence
ccagtttctcagtgcttcag

SEQ ID NO: 255181 - DNA, 20 bp, Artificial
  CRISPR gRNA sequence
tgcttcagtggtctatttct

SEQ ID NO: 255182 - DNA, 20 bp, Artificial
  CRISPR gRNA sequence
gcttcagtggtctatttctc

SEQ ID NO: 255183 - DNA, 20 bp, Artificial
  CRISPR gRNA sequence
tcagtggtctatttctcagg

SEQ ID NO: 255184 - DNA, 20 bp, Artificial
  CRISPR gRNA sequence
gtctatttctcaggtggtca

SEQ ID NO: 255185 - DNA, 20 bp, Artificial
  CRISPR gRNA sequence
tcaggtggtcatagccaact

SEQ ID NO: 255186 - DNA, 20 bp, Artificial
  CRISPR gRNA sequence
caggtggtcatagccaactt

SEQ ID NO: 255187 - DNA, 20 bp, Artificial
  CRISPR gRNA sequence
gtcatagccaacttgggttt

SEQ ID NO: 255188 - DNA, 20 bp, Artificial
  CRISPR gRNA sequence
gccaacttgggttttagttc

SEQ ID NO: 255189 - DNA, 20 bp, Artificial
  CRISPR gRNA sequence
ggctttgctcaccatttgtt

SEQ ID NO: 255190 - DNA, 20 bp, Artificial
  CRISPR gRNA sequence
caccatttgtttggtgactt

SEQ ID NO: 255191 - DNA, 20 bp, Artificial
  CRISPR gRNA sequence
tttggtgacttcagacaaac

SEQ ID NO: 255192 - DNA, 20 bp, Artificial
  CRISPR gRNA sequence
gacaaaccagctaatgtttc

SEQ ID NO: 255193 - DNA, 20 bp, Artificial
  CRISPR gRNA sequence
acaaaccagctaatgtttct

SEQ ID NO: 255194 - DNA, 20 bp, Artificial
  CRISPR gRNA sequence
tctaggccttatacaatcat

SEQ ID NO: 255195 - DNA, 20 bp, Artificial
  CRISPR gRNA sequence
gccttatacaatcattagaa

SEQ ID NO: 255196 - DNA, 20 bp, Artificial
  CRISPR gRNA sequence
cattagaaaagaaaaaaaaa

SEQ ID NO: 255197 - DNA, 20 bp, Artificial
  CRISPR gRNA sequence
tattgtcctgtgccaacaat

SEQ ID NO: 255198 - DNA, 20 bp, Artificial
  CRISPR gRNA sequence
attgtcctgtgccaacaatg

SEQ ID NO: 255199 - DNA, 20 bp, Artificial
  CRISPR gRNA sequence
tgccaacaatgaggatacca

SEQ ID NO: 255200 - DNA, 20 bp, Artificial
  CRISPR gRNA sequence
gccaacaatgaggataccat

SEQ ID NO: 255201 - DNA, 20 bp, Artificial
  CRISPR gRNA sequence
atgaggataccatgggaaat

SEQ ID NO: 255202 - DNA, 20 bp, Artificial
  CRISPR gRNA sequence
caatgtgttctcttcactta

SEQ ID NO: 255203 - DNA, 20 bp, Artificial
  CRISPR gRNA sequence
atgtgttctcttcacttatg

SEQ ID NO: 255204 - DNA, 20 bp, Artificial
  CRISPR gRNA sequence
cacttatggagttgataaac

SEQ ID NO: 255205 - DNA, 20 bp, Artificial
  CRISPR gRNA sequence
tggagttgataaactagttt

SEQ ID NO: 255206 - DNA, 20 bp, Artificial
  CRISPR gRNA sequence
ggagttgataaactagtttc

SEQ ID NO: 255207 - DNA, 20 bp, Artificial
  CRISPR gRNA sequence
tttcaggttctttgctttta

SEQ ID NO: 255208 - DNA, 20 bp, Artificial
  CRISPR gRNA sequence
agattgaactaaatgctctc

SEQ ID NO: 255209 - DNA, 20 bp, Artificial
  CRISPR gRNA sequence
cagattctttgatcttttat

SEQ ID NO: 255210 - DNA, 20 bp, Artificial
  CRISPR gRNA sequence
agattctttgatcttttatt

SEQ ID NO: 255211 - DNA, 20 bp, Artificial
  CRISPR gRNA sequence
tctttgatcttttattggga

SEQ ID NO: 255212 - DNA, 20 bp, Artificial
  CRISPR gRNA sequence
ttgatcttttattgggatag

SEQ ID NO: 255213 - DNA, 20 bp, Artificial
  CRISPR gRNA sequence
cttttattgggatagcagta

SEQ ID NO: 255214 - DNA, 20 bp, Artificial
  CRISPR gRNA sequence
ttttattgggatagcagtaa

SEQ ID NO: 255215 - DNA, 20 bp, Artificial
  CRISPR gRNA sequence
tattgggatagcagtaaagg

SEQ ID NO: 255216 - DNA, 20 bp, Artificial
  CRISPR gRNA sequence
atagcagtaaaggtagatga

SEQ ID NO: 255217 - DNA, 20 bp, Artificial
  CRISPR gRNA sequence
agtaaaggtagatgatggac

SEQ ID NO: 255218 - DNA, 20 bp, Artificial
  CRISPR gRNA sequence
taaaggtagatgatggacca

SEQ ID NO: 255219 - DNA, 20 bp, Artificial
  CRISPR gRNA sequence
aaggtagatgatggaccaga

SEQ ID NO: 255220 - DNA, 20 bp, Artificial
  CRISPR gRNA sequence
ccagagagataactcccctc

SEQ ID NO: 255221 - DNA, 20 bp, Artificial
  CRISPR gRNA sequence
agagagataactcccctctg

SEQ ID NO: 255222 - DNA, 20 bp, Artificial
  CRISPR gRNA sequence
tctttcacctttcatgatat

SEQ ID NO: 255223 - DNA, 20 bp, Artificial
  CRISPR gRNA sequence
ctttcacctttcatgatata

SEQ ID NO: 255224 - DNA, 20 bp, Artificial
  CRISPR gRNA sequence
tttcacctttcatgatataa

SEQ ID NO: 255225 - DNA, 20 bp, Artificial
  CRISPR gRNA sequence
cctttcatgatataagggaa

SEQ ID NO: 255226 - DNA, 20 bp, Artificial
  CRISPR gRNA sequence
gaatagatctatgaatttct

SEQ ID NO: 255227 - DNA, 20 bp, Artificial
  CRISPR gRNA sequence
aatagatctatgaatttctt

SEQ ID NO: 255228 - DNA, 20 bp, Artificial
  CRISPR gRNA sequence
atagatctatgaatttcttg

SEQ ID NO: 255229 - DNA, 20 bp, Artificial
  CRISPR gRNA sequence
agatctatgaatttcttggg

SEQ ID NO: 255230 - DNA, 20 bp, Artificial
  CRISPR gRNA sequence
gatctatgaatttcttgggg

SEQ ID NO: 255231 - DNA, 20 bp, Artificial
  CRISPR gRNA sequence
gggaggctattctctgaatt

SEQ ID NO: 255232 - DNA, 20 bp, Artificial
  CRISPR gRNA sequence
gctattctctgaatttggtg

SEQ ID NO: 255233 - DNA, 20 bp, Artificial
  CRISPR gRNA sequence
ttggtgcagaaaacacatta

SEQ ID NO: 255234 - DNA, 20 bp, Artificial
  CRISPR gRNA sequence
aacacattaaagcaaactct

SEQ ID NO: 255235 - DNA, 20 bp, Artificial
  CRISPR gRNA sequence
acacattaaagcaaactctt

SEQ ID NO: 255236 - DNA, 20 bp, Artificial
  CRISPR gRNA sequence
tcttcatcccactcttgcaa

SEQ ID NO: 255237 - DNA, 20 bp, Artificial
  CRISPR gRNA sequence
cttcatcccactcttgcaat

SEQ ID NO: 255238 - DNA, 20 bp, Artificial
  CRISPR gRNA sequence
cttgcaatgggcaataaaca

SEQ ID NO: 255239 - DNA, 20 bp, Artificial
  CRISPR gRNA sequence
cttaaaaacaaatctatttg

SEQ ID NO: 255240 - DNA, 20 bp, Artificial
  CRISPR gRNA sequence
ttaaaaacaaatctatttgt

SEQ ID NO: 255241 - DNA, 20 bp, Artificial
  CRISPR gRNA sequence
aaacaaatctatttgtaggt

SEQ ID NO: 255242 - DNA, 20 bp, Artificial
  CRISPR gRNA sequence
aacaaatctatttgtaggtt

SEQ ID NO: 255243 - DNA, 20 bp, Artificial
  CRISPR gRNA sequence
atctatttgtaggttgggca

SEQ ID NO: 255244 - DNA, 20 bp, Artificial
  CRISPR gRNA sequence
tatttgtaggttgggcatgg

SEQ ID NO: 255245 - DNA, 20 bp, Artificial
  CRISPR gRNA sequence
gtggctcatgcttgtaatcc

SEQ ID NO: 255246 - DNA, 20 bp, Artificial
  CRISPR gRNA sequence
tgcttgtaatcccagcactt

SEQ ID NO: 255247 - DNA, 20 bp, Artificial
  CRISPR gRNA sequence
gcttgtaatcccagcacttt

SEQ ID NO: 255248 - DNA, 20 bp, Artificial
  CRISPR gRNA sequence
ttgtaatcccagcactttgg

SEQ ID NO: 255249 - DNA, 20 bp, Artificial
  CRISPR gRNA sequence
tgtaatcccagcactttggg

SEQ ID NO: 255250 - DNA, 20 bp, Artificial
  CRISPR gRNA sequence
tcccagcactttgggaggcc

SEQ ID NO: 255251 - DNA, 20 bp, Artificial
  CRISPR gRNA sequence
cccagcactttgggaggcca

SEQ ID NO: 255252 - DNA, 20 bp, Artificial
  CRISPR gRNA sequence
agcactttgggaggccaagg

SEQ ID NO: 255253 - DNA, 20 bp, Artificial
  CRISPR gRNA sequence
ctttgggaggccaaggtggt

SEQ ID NO: 255254 - DNA, 20 bp, Artificial
  CRISPR gRNA sequence
ccaaggtggtcagatcactt

SEQ ID NO: 255255 - DNA, 20 bp, Artificial
  CRISPR gRNA sequence
caaggtggtcagatcacttg

SEQ ID NO: 255256 - DNA, 20 bp, Artificial
  CRISPR gRNA sequence
gtggtcagatcacttgaggc

SEQ ID NO: 255257 - DNA, 20 bp, Artificial
  CRISPR gRNA sequence
tggtcagatcacttgaggcc

SEQ ID NO: 255258 - DNA, 20 bp, Artificial
  CRISPR gRNA sequence
gtcagatcacttgaggccag

SEQ ID NO: 255259 - DNA, 20 bp, Artificial
  CRISPR gRNA sequence
tcacttgaggccaggagttt

SEQ ID NO: 255260 - DNA, 20 bp, Artificial
  CRISPR gRNA sequence
tgaggccaggagtttgagac

SEQ ID NO: 255261 - DNA, 20 bp, Artificial
  CRISPR gRNA sequence
gaggccaggagtttgagacc

SEQ ID NO: 255262 - DNA, 20 bp, Artificial
  CRISPR gRNA sequence
ccaggagtttgagaccaggc

SEQ ID NO: 255263 - DNA, 20 bp, Artificial
  CRISPR gRNA sequence
tgagaccaggctagccaaca

SEQ ID NO: 255264 - DNA, 20 bp, Artificial
  CRISPR gRNA sequence
ccccgtctatactaaaaaaa

SEQ ID NO: 255265 - DNA, 20 bp, Artificial
  CRISPR gRNA sequence
tactaaaaaaatagaaaaat

SEQ ID NO: 255266 - DNA, 20 bp, Artificial
  CRISPR gRNA sequence
aaaaaaatagaaaaattagc

SEQ ID NO: 255267 - DNA, 20 bp, Artificial
  CRISPR gRNA sequence
aaaaaatagaaaaattagct

SEQ ID NO: 255268 - DNA, 20 bp, Artificial
  CRISPR gRNA sequence
atagaaaaattagctgggcg

SEQ ID NO: 255269 - DNA, 20 bp, Artificial
  CRISPR gRNA sequence
gaaaaattagctgggcgtgg

SEQ ID NO: 255270 - DNA, 20 bp, Artificial
  CRISPR gRNA sequence
gtggtgcatacctgtaatcc

SEQ ID NO: 255271 - DNA, 20 bp, Artificial
  CRISPR gRNA sequence
acctgtaatcccagctactt

SEQ ID NO: 255272 - DNA, 20 bp, Artificial
  CRISPR gRNA sequence
ctgtaatcccagctacttaa

SEQ ID NO: 255273 - DNA, 20 bp, Artificial
  CRISPR gRNA sequence
tcccagctacttaagagact

SEQ ID NO: 255274 - DNA, 20 bp, Artificial
  CRISPR gRNA sequence
cccagctacttaagagactg

SEQ ID NO: 255275 - DNA, 20 bp, Artificial
  CRISPR gRNA sequence
agctacttaagagactgagg

SEQ ID NO: 255276 - DNA, 20 bp, Artificial
  CRISPR gRNA sequence
gctacttaagagactgaggc

SEQ ID NO: 255277 - DNA, 20 bp, Artificial
  CRISPR gRNA sequence
tacttaagagactgaggcag

SEQ ID NO: 255278 - DNA, 20 bp, Artificial
  CRISPR gRNA sequence
gcaggagaattgtttgaact

SEQ ID NO: 255279 - DNA, 20 bp, Artificial
  CRISPR gRNA sequence
ggagaattgtttgaactcgg

SEQ ID NO: 255280 - DNA, 20 bp, Artificial
  CRISPR gRNA sequence
gagaattgtttgaactcggt

SEQ ID NO: 255281 - DNA, 20 bp, Artificial
  CRISPR gRNA sequence
aattgtttgaactcggtggg

SEQ ID NO: 255282 - DNA, 20 bp, Artificial
  CRISPR gRNA sequence
ttgtttgaactcggtgggtg

SEQ ID NO: 255283 - DNA, 20 bp, Artificial
  CRISPR gRNA sequence
tgtttgaactcggtgggtgg

SEQ ID NO: 255284 - DNA, 20 bp, Artificial
  CRISPR gRNA sequence
aactcggtgggtggaggttg

SEQ ID NO: 255285 - DNA, 20 bp, Artificial
  CRISPR gRNA sequence
cggtgggtggaggttgcagt

SEQ ID NO: 255286 - DNA, 20 bp, Artificial
  CRISPR gRNA sequence
ggtggaggttgcagtgagct

SEQ ID NO: 255287 - DNA, 20 bp, Artificial
  CRISPR gRNA sequence
gagattgcaccactgcactt

SEQ ID NO: 255288 - DNA, 20 bp, Artificial
  CRISPR gRNA sequence
tgcaccactgcacttcagcc

SEQ ID NO: 255289 - DNA, 20 bp, Artificial
  CRISPR gRNA sequence
gcaccactgcacttcagcct

SEQ ID NO: 255290 - DNA, 20 bp, Artificial
  CRISPR gRNA sequence
ctgcacttcagcctgggcaa

SEQ ID NO: 255291 - DNA, 20 bp, Artificial
  CRISPR gRNA sequence
gcacttcagcctgggcaaca

SEQ ID NO: 255292 - DNA, 20 bp, Artificial
  CRISPR gRNA sequence
ttcagcctgggcaacagagc

SEQ ID NO: 255293 - DNA, 20 bp, Artificial
  CRISPR gRNA sequence
gtctcaaaaacaaacaaaca

SEQ ID NO: 255294 - DNA, 20 bp, Artificial
  CRISPR gRNA sequence
aaaacaaacaaacaaagaaa

SEQ ID NO: 255295 - DNA, 20 bp, Artificial
  CRISPR gRNA sequence
atctatttttgtgtctgtgt

SEQ ID NO: 255296 - DNA, 20 bp, Artificial
  CRISPR gRNA sequence
tctatttttgtgtctgtgtc

SEQ ID NO: 255297 - DNA, 20 bp, Artificial
  CRISPR gRNA sequence
tgtgtctgtgtcaggcacta

SEQ ID NO: 255298 - DNA, 20 bp, Artificial
  CRISPR gRNA sequence
ccacctccaaatatatcact

SEQ ID NO: 255299 - DNA, 20 bp, Artificial
  CRISPR gRNA sequence
ctccaaatatatcactcagt

SEQ ID NO: 255300 - DNA, 20 bp, Artificial
  CRISPR gRNA sequence
tccaaatatatcactcagtc

SEQ ID NO: 255301 - DNA, 20 bp, Artificial
  CRISPR gRNA sequence
atatcactcagtcaggaaat

SEQ ID NO: 255302 - DNA, 20 bp, Artificial
  CRISPR gRNA sequence
catgattaatattaatgtct

SEQ ID NO: 255303 - DNA, 20 bp, Artificial
  CRISPR gRNA sequence
atgattaatattaatgtctc

SEQ ID NO: 255304 - DNA, 20 bp, Artificial
  CRISPR gRNA sequence
atattaatgtctcaggaata

SEQ ID NO: 255305 - DNA, 20 bp, Artificial
  CRISPR gRNA sequence
aatatagatttaaaaattgt

SEQ ID NO: 255306 - DNA, 20 bp, Artificial
  CRISPR gRNA sequence
atttaaaaattgtgagtgcc

SEQ ID NO: 255307 - DNA, 20 bp, Artificial
  CRISPR gRNA sequence
aaattgtgagtgcctagctg

SEQ ID NO: 255308 - DNA, 20 bp, Artificial
  CRISPR gRNA sequence
gctgtggtgctcaatgctaa

SEQ ID NO: 255309 - DNA, 20 bp, Artificial
  CRISPR gRNA sequence
tggtgctcaatgctaacaga

SEQ ID NO: 255310 - DNA, 20 bp, Artificial
  CRISPR gRNA sequence
gaaagccatgtactgccttc

SEQ ID NO: 255311 - DNA, 20 bp, Artificial
  CRISPR gRNA sequence
aaagccatgtactgccttct

SEQ ID NO: 255312 - DNA, 20 bp, Artificial
  CRISPR gRNA sequence
tgctccattgttccattcaa

SEQ ID NO: 255313 - DNA, 20 bp, Artificial
  CRISPR gRNA sequence
ctccattgttccattcaaaa

SEQ ID NO: 255314 - DNA, 20 bp, Artificial
  CRISPR gRNA sequence
tccattgttccattcaaaag

SEQ ID NO: 255315 - DNA, 20 bp, Artificial
  CRISPR gRNA sequence
aatgttaacttttgaactct

SEQ ID NO: 255316 - DNA, 20 bp, Artificial
  CRISPR gRNA sequence
ctcagtataattatcccctg

SEQ ID NO: 255317 - DNA, 20 bp, Artificial
  CRISPR gRNA sequence
cagtataattatcccctgaa

SEQ ID NO: 255318 - DNA, 20 bp, Artificial
  CRISPR gRNA sequence
agtataattatcccctgaag

SEQ ID NO: 255319 - DNA, 20 bp, Artificial
  CRISPR gRNA sequence
gaggtcctacatcttctgcc

SEQ ID NO: 255320 - DNA, 20 bp, Artificial
  CRISPR gRNA sequence
ggtcctacatcttctgccaa

SEQ ID NO: 255321 - DNA, 20 bp, Artificial
  CRISPR gRNA sequence
tgccaagagaaaacctttgc

SEQ ID NO: 255322 - DNA, 20 bp, Artificial
  CRISPR gRNA sequence
ccaagagaaaacctttgctg

SEQ ID NO: 255323 - DNA, 20 bp, Artificial
  CRISPR gRNA sequence
ttgctggagatctgttcatt

SEQ ID NO: 255324 - DNA, 20 bp, Artificial
  CRISPR gRNA sequence
taattaatatattttgctct

SEQ ID NO: 255325 - DNA, 20 bp, Artificial
  CRISPR gRNA sequence
aattaatatattttgctctc

SEQ ID NO: 255326 - DNA, 20 bp, Artificial
  CRISPR gRNA sequence
taatatattttgctctcagg

SEQ ID NO: 255327 - DNA, 20 bp, Artificial
  CRISPR gRNA sequence
tatccttatattcttgttct

SEQ ID NO: 255328 - DNA, 20 bp, Artificial
  CRISPR gRNA sequence
caaatgatttttttttcccc

SEQ ID NO: 255329 - DNA, 20 bp, Artificial
  CRISPR gRNA sequence
aaatgatttttttttccccc

SEQ ID NO: 255330 - DNA, 20 bp, Artificial
  CRISPR gRNA sequence
ttttttttcccccaggaaac

SEQ ID NO: 255331 - DNA, 20 bp, Artificial
  CRISPR gRNA sequence
tcccccaggaaacaagattt

SEQ ID NO: 255332 - DNA, 20 bp, Artificial
  CRISPR gRNA sequence
caggaaacaagattttggtg

SEQ ID NO: 255333 - DNA, 20 bp, Artificial
  CRISPR gRNA sequence
gaaacaagattttggtgaag

SEQ ID NO: 255334 - DNA, 20 bp, Artificial
  CRISPR gRNA sequence
gaagcagtcgcccatgcttg

SEQ ID NO: 255335 - DNA, 20 bp, Artificial
  CRISPR gRNA sequence
gcttgtagcgtacgacaatg

SEQ ID NO: 255336 - DNA, 20 bp, Artificial
  CRISPR gRNA sequence
tacgacaatgcggtcaacct

SEQ ID NO: 255337 - DNA, 20 bp, Artificial
  CRISPR gRNA sequence
atgcggtcaaccttagctgc

SEQ ID NO: 255338 - DNA, 20 bp, Artificial
  CRISPR gRNA sequence
tattcctacaatctcttctc

SEQ ID NO: 255339 - DNA, 20 bp, Artificial
  CRISPR gRNA sequence
attcctacaatctcttctca

SEQ ID NO: 255340 - DNA, 20 bp, Artificial
  CRISPR gRNA sequence
ttcctacaatctcttctcaa

SEQ ID NO: 255341 - DNA, 20 bp, Artificial
  CRISPR gRNA sequence
cctacaatctcttctcaagg

SEQ ID NO: 255342 - DNA, 20 bp, Artificial
  CRISPR gRNA sequence
atctcttctcaagggagttc

SEQ ID NO: 255343 - DNA, 20 bp, Artificial
  CRISPR gRNA sequence
tctcttctcaagggagttcc

SEQ ID NO: 255344 - DNA, 20 bp, Artificial
  CRISPR gRNA sequence
gttccgggcatcccttcaca

SEQ ID NO: 255345 - DNA, 20 bp, Artificial
  CRISPR gRNA sequence
ttccgggcatcccttcacaa

SEQ ID NO: 255346 - DNA, 20 bp, Artificial
  CRISPR gRNA sequence
ggcatcccttcacaaaggac

SEQ ID NO: 255347 - DNA, 20 bp, Artificial
  CRISPR gRNA sequence
tcccttcacaaaggactgga

SEQ ID NO: 255348 - DNA, 20 bp, Artificial
  CRISPR gRNA sequence
caaaggactggatagtgctg

SEQ ID NO: 255349 - DNA, 20 bp, Artificial
  CRISPR gRNA sequence
aggactggatagtgctgtgg

SEQ ID NO: 255350 - DNA, 20 bp, Artificial
  CRISPR gRNA sequence
gtggaagtctgtgttgtata

SEQ ID NO: 255351 - DNA, 20 bp, Artificial
  CRISPR gRNA sequence
tggaagtctgtgttgtatat

SEQ ID NO: 255352 - DNA, 20 bp, Artificial
  CRISPR gRNA sequence
ttgtatatgggaattactcc

SEQ ID NO: 255353 - DNA, 20 bp, Artificial
  CRISPR gRNA sequence
tatatgggaattactcccag

SEQ ID NO: 255354 - DNA, 20 bp, Artificial
  CRISPR gRNA sequence
ggaattactcccagcagctt

SEQ ID NO: 255355 - DNA, 20 bp, Artificial
  CRISPR gRNA sequence
gaattactcccagcagcttc

SEQ ID NO: 255356 - DNA, 20 bp, Artificial
  CRISPR gRNA sequence
gcttcaggtttactcaaaaa

SEQ ID NO: 255357 - DNA, 20 bp, Artificial
  CRISPR gRNA sequence
cttcaggtttactcaaaaac

SEQ ID NO: 255358 - DNA, 20 bp, Artificial
  CRISPR gRNA sequence
ttcaggtttactcaaaaacg

SEQ ID NO: 255359 - DNA, 20 bp, Artificial
  CRISPR gRNA sequence
aaaacggggttcaactgtga

SEQ ID NO: 255360 - DNA, 20 bp, Artificial
  CRISPR gRNA sequence
aaacggggttcaactgtgat

SEQ ID NO: 255361 - DNA, 20 bp, Artificial
  CRISPR gRNA sequence
gttcaactgtgatgggaaat

SEQ ID NO: 255362 - DNA, 20 bp, Artificial
  CRISPR gRNA sequence
ttcaactgtgatgggaaatt

SEQ ID NO: 255363 - DNA, 20 bp, Artificial
  CRISPR gRNA sequence
tgggaaattgggcaatgaat

SEQ ID NO: 255364 - DNA, 20 bp, Artificial
  CRISPR gRNA sequence
aatcagtgacattctacctc

SEQ ID NO: 255365 - DNA, 20 bp, Artificial
  CRISPR gRNA sequence
gaatttgtatgttaaccaaa

SEQ ID NO: 255366 - DNA, 20 bp, Artificial
  CRISPR gRNA sequence
tatttacttctgcaaaattg

SEQ ID NO: 255367 - DNA, 20 bp, Artificial
  CRISPR gRNA sequence
tatgtatcctcctccttacc

SEQ ID NO: 255368 - DNA, 20 bp, Artificial
  CRISPR gRNA sequence
ctcctccttacctagacaat

SEQ ID NO: 255369 - DNA, 20 bp, Artificial
  CRISPR gRNA sequence
ctccttacctagacaatgag

SEQ ID NO: 255370 - DNA, 20 bp, Artificial
  CRISPR gRNA sequence
ccttacctagacaatgagaa

SEQ ID NO: 255371 - DNA, 20 bp, Artificial
  CRISPR gRNA sequence
ctagacaatgagaagagcaa

SEQ ID NO: 255372 - DNA, 20 bp, Artificial
  CRISPR gRNA sequence
tggaaccattatccatgtga

SEQ ID NO: 255373 - DNA, 20 bp, Artificial
  CRISPR gRNA sequence
ggaaccattatccatgtgaa

SEQ ID NO: 255374 - DNA, 20 bp, Artificial
  CRISPR gRNA sequence
aaggtaacatacaactttac

SEQ ID NO: 255375 - DNA, 20 bp, Artificial
  CRISPR gRNA sequence
tttaccagtgtaccacccta

SEQ ID NO: 255376 - DNA, 20 bp, Artificial
  CRISPR gRNA sequence
agtgtaccaccctaaagtaa

SEQ ID NO: 255377 - DNA, 20 bp, Artificial
  CRISPR gRNA sequence
aaagtaatggttttcaaatg

SEQ ID NO: 255378 - DNA, 20 bp, Artificial
  CRISPR gRNA sequence
tcaaatgcagtcctgaaaac

SEQ ID NO: 255379 - DNA, 20 bp, Artificial
  CRISPR gRNA sequence
caaatgcagtcctgaaaact

SEQ ID NO: 255380 - DNA, 20 bp, Artificial
  CRISPR gRNA sequence
cagtcctgaaaactgggttg

SEQ ID NO: 255381 - DNA, 20 bp, Artificial
  CRISPR gRNA sequence
cctgaaaactgggttgtggt

SEQ ID NO: 255382 - DNA, 20 bp, Artificial
  CRISPR gRNA sequence
gaaaactgggttgtggtcag

SEQ ID NO: 255383 - DNA, 20 bp, Artificial
  CRISPR gRNA sequence
aactgggttgtggtcagtgg

SEQ ID NO: 255384 - DNA, 20 bp, Artificial
  CRISPR gRNA sequence
actgggttgtggtcagtggt

SEQ ID NO: 255385 - DNA, 20 bp, Artificial
  CRISPR gRNA sequence
ctgggttgtggtcagtggtg

SEQ ID NO: 255386 - DNA, 20 bp, Artificial
  CRISPR gRNA sequence
ggtcagtggtggggttgaat

SEQ ID NO: 255387 - DNA, 20 bp, Artificial
  CRISPR gRNA sequence
gtcagtggtggggttgaata

SEQ ID NO: 255388 - DNA, 20 bp, Artificial
  CRISPR gRNA sequence
ggtggggttgaataaggcct

SEQ ID NO: 255389 - DNA, 20 bp, Artificial
  CRISPR gRNA sequence
taagtgatttgatactaaca

SEQ ID NO: 255390 - DNA, 20 bp, Artificial
  CRISPR gRNA sequence
acaaagacaaataatgtttt

SEQ ID NO: 255391 - DNA, 20 bp, Artificial
  CRISPR gRNA sequence
aaaaatttttccctttactg

SEQ ID NO: 255392 - DNA, 20 bp, Artificial
  CRISPR gRNA sequence
aaatttttccctttactgta

SEQ ID NO: 255393 - DNA, 20 bp, Artificial
  CRISPR gRNA sequence
aatttttccctttactgtag

SEQ ID NO: 255394 - DNA, 20 bp, Artificial
  CRISPR gRNA sequence
tttttccctttactgtagag

SEQ ID NO: 255395 - DNA, 20 bp, Artificial
  CRISPR gRNA sequence
ctttactgtagaggagattc

SEQ ID NO: 255396 - DNA, 20 bp, Artificial
  CRISPR gRNA sequence
tttactgtagaggagattca

SEQ ID NO: 255397 - DNA, 20 bp, Artificial
  CRISPR gRNA sequence
tattttcctttgctgacatt

SEQ ID NO: 255398 - DNA, 20 bp, Artificial
  CRISPR gRNA sequence
tttcctttgctgacattgag

SEQ ID NO: 255399 - DNA, 20 bp, Artificial
  CRISPR gRNA sequence
ttcctttgctgacattgagc

SEQ ID NO: 255400 - DNA, 20 bp, Artificial
  CRISPR gRNA sequence
cctttgctgacattgagcgg

SEQ ID NO: 255401 - DNA, 20 bp, Artificial
  CRISPR gRNA sequence
tttgctgacattgagcggga

SEQ ID NO: 255402 - DNA, 20 bp, Artificial
  CRISPR gRNA sequence
ctgacattgagcgggagagt

SEQ ID NO: 255403 - DNA, 20 bp, Artificial
  CRISPR gRNA sequence
gagcgggagagtaagtgatg

SEQ ID NO: 255404 - DNA, 20 bp, Artificial
  CRISPR gRNA sequence
agtgatgaagttaccgcatg

SEQ ID NO: 255405 - DNA, 20 bp, Artificial
  CRISPR gRNA sequence
gtgatgaagttaccgcatgt

SEQ ID NO: 255406 - DNA, 20 bp, Artificial
  CRISPR gRNA sequence
gaagttaccgcatgtgggaa

SEQ ID NO: 255407 - DNA, 20 bp, Artificial
  CRISPR gRNA sequence
cagatcatttttctccattc

SEQ ID NO: 255408 - DNA, 20 bp, Artificial
  CRISPR gRNA sequence
atcatttttctccattccag

SEQ ID NO: 255409 - DNA, 20 bp, Artificial
  CRISPR gRNA sequence
ttctccattccagtggatca

SEQ ID NO: 255410 - DNA, 20 bp, Artificial
  CRISPR gRNA sequence
tccattccagtggatcatgg

SEQ ID NO: 255411 - DNA, 20 bp, Artificial
  CRISPR gRNA sequence
tccagtggatcatggcagaa

SEQ ID NO: 255412 - DNA, 20 bp, Artificial
  CRISPR gRNA sequence
cagtggatcatggcagaaaa

SEQ ID NO: 255413 - DNA, 20 bp, Artificial
  CRISPR gRNA sequence
agtggatcatggcagaaaag

SEQ ID NO: 255414 - DNA, 20 bp, Artificial
  CRISPR gRNA sequence
agaggttaccattaaaatgt

SEQ ID NO: 255415 - DNA, 20 bp, Artificial
  CRISPR gRNA sequence
ttaccattaaaatgtaagcc

SEQ ID NO: 255416 - DNA, 20 bp, Artificial
  CRISPR gRNA sequence
taccattaaaatgtaagccc

SEQ ID NO: 255417 - DNA, 20 bp, Artificial
  CRISPR gRNA sequence
atgtaagcccaggtgccctc

SEQ ID NO: 255418 - DNA, 20 bp, Artificial
  CRISPR gRNA sequence
gcccaggtgccctcaagtaa

SEQ ID NO: 255419 - DNA, 20 bp, Artificial
  CRISPR gRNA sequence
aggtgccctcaagtaacagc

SEQ ID NO: 255420 - DNA, 20 bp, Artificial
  CRISPR gRNA sequence
ggtgccctcaagtaacagct

SEQ ID NO: 255421 - DNA, 20 bp, Artificial
  CRISPR gRNA sequence
caagtaacagctgggtctaa

SEQ ID NO: 255422 - DNA, 20 bp, Artificial
  CRISPR gRNA sequence
aagtaacagctgggtctaat

SEQ ID NO: 255423 - DNA, 20 bp, Artificial
  CRISPR gRNA sequence
acagctgggtctaatgggtt

SEQ ID NO: 255424 - DNA, 20 bp, Artificial
  CRISPR gRNA sequence
gggtctaatgggttaagact

SEQ ID NO: 255425 - DNA, 20 bp, Artificial
  CRISPR gRNA sequence
ggtctaatgggttaagactc

SEQ ID NO: 255426 - DNA, 20 bp, Artificial
  CRISPR gRNA sequence
ctaatgggttaagactcagg

SEQ ID NO: 255427 - DNA, 20 bp, Artificial
  CRISPR gRNA sequence
tccataatcttcctctgtaa

SEQ ID NO: 255428 - DNA, 20 bp, Artificial
  CRISPR gRNA sequence
ttttctttttcttttttttt

SEQ ID NO: 255429 - DNA, 20 bp, Artificial
  CRISPR gRNA sequence
ctttttctttttttttgaga

SEQ ID NO: 255430 - DNA, 20 bp, Artificial
  CRISPR gRNA sequence
cggactctcgctctgtcgcc

SEQ ID NO: 255431 - DNA, 20 bp, Artificial
  CRISPR gRNA sequence
ggactctcgctctgtcgccc

SEQ ID NO: 255432 - DNA, 20 bp, Artificial
  CRISPR gRNA sequence
tctcgctctgtcgcccaggc

SEQ ID NO: 255433 - DNA, 20 bp, Artificial
  CRISPR gRNA sequence
tcgctctgtcgcccaggctg

SEQ ID NO: 255434 - DNA, 20 bp, Artificial
  CRISPR gRNA sequence
ctgtcgcccaggctggagtg

SEQ ID NO: 255435 - DNA, 20 bp, Artificial
  CRISPR gRNA sequence
tcgcccaggctggagtgcag

SEQ ID NO: 255436 - DNA, 20 bp, Artificial
  CRISPR gRNA sequence
cccaggctggagtgcagtgg

SEQ ID NO: 255437 - DNA, 20 bp, Artificial
  CRISPR gRNA sequence
ccaggctggagtgcagtggc

SEQ ID NO: 255438 - DNA, 20 bp, Artificial
  CRISPR gRNA sequence
ggagtgcagtggcgggatct

SEQ ID NO: 255439 - DNA, 20 bp, Artificial
  CRISPR gRNA sequence
gcgggatctcagttcactgc

SEQ ID NO: 255440 - DNA, 20 bp, Artificial
  CRISPR gRNA sequence
tcactgcaagctctgcctcc

SEQ ID NO: 255441 - DNA, 20 bp, Artificial
  CRISPR gRNA sequence
cactgcaagctctgcctccc

SEQ ID NO: 255442 - DNA, 20 bp, Artificial
  CRISPR gRNA sequence
ttcacgtcattctcctgcct

SEQ ID NO: 255443 - DNA, 20 bp, Artificial
  CRISPR gRNA sequence
tcctgcctcagcctcccgat

SEQ ID NO: 255444 - DNA, 20 bp, Artificial
  CRISPR gRNA sequence
gcctcagcctcccgatcagc

SEQ ID NO: 255445 - DNA, 20 bp, Artificial
  CRISPR gRNA sequence
cctcagcctcccgatcagct

SEQ ID NO: 255446 - DNA, 20 bp, Artificial
  CRISPR gRNA sequence
ctcccgatcagctgggacta

SEQ ID NO: 255447 - DNA, 20 bp, Artificial
  CRISPR gRNA sequence
tcccgatcagctgggactac

SEQ ID NO: 255448 - DNA, 20 bp, Artificial
  CRISPR gRNA sequence
cccgatcagctgggactaca

SEQ ID NO: 255449 - DNA, 20 bp, Artificial
  CRISPR gRNA sequence
acagggcccgccaccacgcc

SEQ ID NO: 255450 - DNA, 20 bp, Artificial
  CRISPR gRNA sequence
attaattaattttttttttt

SEQ ID NO: 255451 - DNA, 20 bp, Artificial
  CRISPR gRNA sequence
taattaatttttttttttga

SEQ ID NO: 255452 - DNA, 20 bp, Artificial
  CRISPR gRNA sequence
aattaatttttttttttgag

SEQ ID NO: 255453 - DNA, 20 bp, Artificial
  CRISPR gRNA sequence
attaatttttttttttgaga

SEQ ID NO: 255454 - DNA, 20 bp, Artificial
  CRISPR gRNA sequence
taatttttttttttgagagg

SEQ ID NO: 255455 - DNA, 20 bp, Artificial
  CRISPR gRNA sequence
gggagtcttgctctgtcgcc

SEQ ID NO: 255456 - DNA, 20 bp, Artificial
  CRISPR gRNA sequence
ggagtcttgctctgtcgccc

SEQ ID NO: 255457 - DNA, 20 bp, Artificial
  CRISPR gRNA sequence
tcttgctctgtcgcccaggc

SEQ ID NO: 255458 - DNA, 20 bp, Artificial
  CRISPR gRNA sequence
ctgtcgcccaggctggaatg

SEQ ID NO: 255459 - DNA, 20 bp, Artificial
  CRISPR gRNA sequence
tcgcccaggctggaatgcgg

SEQ ID NO: 255460 - DNA, 20 bp, Artificial
  CRISPR gRNA sequence
ggaatgcggtggcgcgatct

SEQ ID NO: 255461 - DNA, 20 bp, Artificial
  CRISPR gRNA sequence
gcgcgatctcggctcactgc

SEQ ID NO: 255462 - DNA, 20 bp, Artificial
  CRISPR gRNA sequence
tcactgcaagctccgcctcc

SEQ ID NO: 255463 - DNA, 20 bp, Artificial
  CRISPR gRNA sequence
cactgcaagctccgcctccc

SEQ ID NO: 255464 - DNA, 20 bp, Artificial
  CRISPR gRNA sequence
ttcatgccattctcctgcct

SEQ ID NO: 255465 - DNA, 20 bp, Artificial
  CRISPR gRNA sequence
ttctcctgcctcagcctcct

SEQ ID NO: 255466 - DNA, 20 bp, Artificial
  CRISPR gRNA sequence
tcctgcctcagcctcctgag

SEQ ID NO: 255467 - DNA, 20 bp, Artificial
  CRISPR gRNA sequence
gcctcagcctcctgagtagc

SEQ ID NO: 255468 - DNA, 20 bp, Artificial
  CRISPR gRNA sequence
cctcagcctcctgagtagct

SEQ ID NO: 255469 - DNA, 20 bp, Artificial
  CRISPR gRNA sequence
ctcctgagtagctgggacta

SEQ ID NO: 255470 - DNA, 20 bp, Artificial
  CRISPR gRNA sequence
tcctgagtagctgggactac

SEQ ID NO: 255471 - DNA, 20 bp, Artificial
  CRISPR gRNA sequence
caggtacctgccaccatgcc

SEQ ID NO: 255472 - DNA, 20 bp, Artificial
  CRISPR gRNA sequence
cggctaattttttgtatttt

SEQ ID NO: 255473 - DNA, 20 bp, Artificial
  CRISPR gRNA sequence
ctaattttttgtatttttag

SEQ ID NO: 255474 - DNA, 20 bp, Artificial
  CRISPR gRNA sequence
ttttttgtatttttagtaga

SEQ ID NO: 255475 - DNA, 20 bp, Artificial
  CRISPR gRNA sequence
tttttgtatttttagtagac

SEQ ID NO: 255476 - DNA, 20 bp, Artificial
  CRISPR gRNA sequence
ttttgtatttttagtagaca

SEQ ID NO: 255477 - DNA, 20 bp, Artificial
  CRISPR gRNA sequence
tagacagggtttcaccttgt

SEQ ID NO: 255478 - DNA, 20 bp, Artificial
  CRISPR gRNA sequence
cagggtttcaccttgttagc

SEQ ID NO: 255479 - DNA, 20 bp, Artificial
  CRISPR gRNA sequence
agggtttcaccttgttagcc

SEQ ID NO: 255480 - DNA, 20 bp, Artificial
  CRISPR gRNA sequence
tttcaccttgttagccagga

SEQ ID NO: 255481 - DNA, 20 bp, Artificial
  CRISPR gRNA sequence
acctcgtgacccgcccgtgt

SEQ ID NO: 255482 - DNA, 20 bp, Artificial
  CRISPR gRNA sequence
ccgcccgtgttggcctccca

SEQ ID NO: 255483 - DNA, 20 bp, Artificial
  CRISPR gRNA sequence
gtgttggcctcccaaagtgc

SEQ ID NO: 255484 - DNA, 20 bp, Artificial
  CRISPR gRNA sequence
tgttggcctcccaaagtgct

SEQ ID NO: 255485 - DNA, 20 bp, Artificial
  CRISPR gRNA sequence
ctcccaaagtgctgggatta

SEQ ID NO: 255486 - DNA, 20 bp, Artificial
  CRISPR gRNA sequence
tcccaaagtgctgggattac

SEQ ID NO: 255487 - DNA, 20 bp, Artificial
  CRISPR gRNA sequence
agtgctgggattacaggcgt

SEQ ID NO: 255488 - DNA, 20 bp, Artificial
  CRISPR gRNA sequence
caggcgtgagccaccgcgcc

SEQ ID NO: 255489 - DNA, 20 bp, Artificial
  CRISPR gRNA sequence
ccagccattttttgtacttt

SEQ ID NO: 255490 - DNA, 20 bp, Artificial
  CRISPR gRNA sequence
gccattttttgtacttttag

SEQ ID NO: 255491 - DNA, 20 bp, Artificial
  CRISPR gRNA sequence
cattttttgtacttttagta

SEQ ID NO: 255492 - DNA, 20 bp, Artificial
  CRISPR gRNA sequence
ttttgtacttttagtagaga

SEQ ID NO: 255493 - DNA, 20 bp, Artificial
  CRISPR gRNA sequence
tttgtacttttagtagagac

SEQ ID NO: 255494 - DNA, 20 bp, Artificial
  CRISPR gRNA sequence
ttgtacttttagtagagacg

SEQ ID NO: 255495 - DNA, 20 bp, Artificial
  CRISPR gRNA sequence
gagacggggtttcaccgtgt

SEQ ID NO: 255496 - DNA, 20 bp, Artificial
  CRISPR gRNA sequence
cggggtttcaccgtgttagc

SEQ ID NO: 255497 - DNA, 20 bp, Artificial
  CRISPR gRNA sequence
ggggtttcaccgtgttagca

SEQ ID NO: 255498 - DNA, 20 bp, Artificial
  CRISPR gRNA sequence
tttcaccgtgttagcaagga

SEQ ID NO: 255499 - DNA, 20 bp, Artificial
  CRISPR gRNA sequence
gacctcgtgatctgcccacc

SEQ ID NO: 255500 - DNA, 20 bp, Artificial
  CRISPR gRNA sequence
acctcgtgatctgcccacct

SEQ ID NO: 255501 - DNA, 20 bp, Artificial
  CRISPR gRNA sequence
ctgcccacctgggcctccca

SEQ ID NO: 255502 - DNA, 20 bp, Artificial
  CRISPR gRNA sequence
ctcccaaagtgctgtgatta

SEQ ID NO: 255503 - DNA, 20 bp, Artificial
  CRISPR gRNA sequence
tcccaaagtgctgtgattac

SEQ ID NO: 255504 - DNA, 20 bp, Artificial
  CRISPR gRNA sequence
agtgctgtgattacaggcgt

SEQ ID NO: 255505 - DNA, 20 bp, Artificial
  CRISPR gRNA sequence
caggcgtaagccaccgcgcc

SEQ ID NO: 255506 - DNA, 20 bp, Artificial
  CRISPR gRNA sequence
tccattttctaaaatataca

SEQ ID NO: 255507 - DNA, 20 bp, Artificial
  CRISPR gRNA sequence
ctaaaatatacaaagaatgc

SEQ ID NO: 255508 - DNA, 20 bp, Artificial
  CRISPR gRNA sequence
atatacaaagaatgctggac

SEQ ID NO: 255509 - DNA, 20 bp, Artificial
  CRISPR gRNA sequence
aagaatgctggactagaaac

SEQ ID NO: 255510 - DNA, 20 bp, Artificial
  CRISPR gRNA sequence
agaatgctggactagaaacc

SEQ ID NO: 255511 - DNA, 20 bp, Artificial
  CRISPR gRNA sequence
gaatgctggactagaaaccg

SEQ ID NO: 255512 - DNA, 20 bp, Artificial
  CRISPR gRNA sequence
aatgctggactagaaaccgg

SEQ ID NO: 255513 - DNA, 20 bp, Artificial
  CRISPR gRNA sequence
attaatcaactgtgtgatct

SEQ ID NO: 255514 - DNA, 20 bp, Artificial
  CRISPR gRNA sequence
tcaactgtgtgatcttggat

SEQ ID NO: 255515 - DNA, 20 bp, Artificial
  CRISPR gRNA sequence
taagtcacctaactttttca

SEQ ID NO: 255516 - DNA, 20 bp, Artificial
  CRISPR gRNA sequence
ctttttcatagtcaaaaact

SEQ ID NO: 255517 - DNA, 20 bp, Artificial
  CRISPR gRNA sequence
aaaaactcagtacaactgtt

SEQ ID NO: 255518 - DNA, 20 bp, Artificial
  CRISPR gRNA sequence
aactcagtacaactgttaag

SEQ ID NO: 255519 - DNA, 20 bp, Artificial
  CRISPR gRNA sequence
gttaagcagtatttgtgaat

SEQ ID NO: 255520 - DNA, 20 bp, Artificial
  CRISPR gRNA sequence
atttgtgaattagtgaaaat

SEQ ID NO: 255521 - DNA, 20 bp, Artificial
  CRISPR gRNA sequence
gttatgttctgcctaaatgt

SEQ ID NO: 255522 - DNA, 20 bp, Artificial
  CRISPR gRNA sequence
ttatgttctgcctaaatgtt

SEQ ID NO: 255523 - DNA, 20 bp, Artificial
  CRISPR gRNA sequence
tatgttctgcctaaatgtta

SEQ ID NO: 255524 - DNA, 20 bp, Artificial
  CRISPR gRNA sequence
tgttctgcctaaatgttagg

SEQ ID NO: 255525 - DNA, 20 bp, Artificial
  CRISPR gRNA sequence
aaaatcatgattccccaact

SEQ ID NO: 255526 - DNA, 20 bp, Artificial
  CRISPR gRNA sequence
atcatgattccccaactcag

SEQ ID NO: 255527 - DNA, 20 bp, Artificial
  CRISPR gRNA sequence
ttccccaactcagaagaata

SEQ ID NO: 255528 - DNA, 20 bp, Artificial
  CRISPR gRNA sequence
aactcagaagaatacagtat

SEQ ID NO: 255529 - DNA, 20 bp, Artificial
  CRISPR gRNA sequence
tcagaagaatacagtattgg

SEQ ID NO: 255530 - DNA, 20 bp, Artificial
  CRISPR gRNA sequence
aatacagtattggtagcaac

SEQ ID NO: 255531 - DNA, 20 bp, Artificial
  CRISPR gRNA sequence
agtattggtagcaacaagta

SEQ ID NO: 255532 - DNA, 20 bp, Artificial
  CRISPR gRNA sequence
acaagtaaagtttgattttt

SEQ ID NO: 255533 - DNA, 20 bp, Artificial
  CRISPR gRNA sequence
tgattttttggtatactttg

SEQ ID NO: 255534 - DNA, 20 bp, Artificial
  CRISPR gRNA sequence
tatactttgtggatatatca

SEQ ID NO: 255535 - DNA, 20 bp, Artificial
  CRISPR gRNA sequence
atcatagcttttcatttttg

SEQ ID NO: 255536 - DNA, 20 bp, Artificial
  CRISPR gRNA sequence
catttttgtggaatgataat

SEQ ID NO: 255537 - DNA, 20 bp, Artificial
  CRISPR gRNA sequence
taataagaaacacatatgtt

SEQ ID NO: 255538 - DNA, 20 bp, Artificial
  CRISPR gRNA sequence
ttcagttttgtactgaatcc

SEQ ID NO: 255539 - DNA, 20 bp, Artificial
  CRISPR gRNA sequence
cctagcataatgccaatgaa

SEQ ID NO: 255540 - DNA, 20 bp, Artificial
  CRISPR gRNA sequence
gaatggtttttcttcaatgc

SEQ ID NO: 255541 - DNA, 20 bp, Artificial
  CRISPR gRNA sequence
gtttttcttcaatgctggaa

SEQ ID NO: 255542 - DNA, 20 bp, Artificial
  CRISPR gRNA sequence
ttttcttcaatgctggaaca

SEQ ID NO: 255543 - DNA, 20 bp, Artificial
  CRISPR gRNA sequence
agagccatgctgatgaaaaa

SEQ ID NO: 255544 - DNA, 20 bp, Artificial
  CRISPR gRNA sequence
gagccatgctgatgaaaaat

SEQ ID NO: 255545 - DNA, 20 bp, Artificial
  CRISPR gRNA sequence
tgaaaaataggatactaaat

SEQ ID NO: 255546 - DNA, 20 bp, Artificial
  CRISPR gRNA sequence
gaaaaataggatactaaata

SEQ ID NO: 255547 - DNA, 20 bp, Artificial
  CRISPR gRNA sequence
aataggatactaaataagga

SEQ ID NO: 255548 - DNA, 20 bp, Artificial
  CRISPR gRNA sequence
taaggaaagaattgttaatg

SEQ ID NO: 255549 - DNA, 20 bp, Artificial
  CRISPR gRNA sequence
ggaaagaattgttaatgtgg

SEQ ID NO: 255550 - DNA, 20 bp, Artificial
  CRISPR gRNA sequence
gaattgttaatgtggcagat

SEQ ID NO: 255551 - DNA, 20 bp, Artificial
  CRISPR gRNA sequence
gcagataagcttttgtgttc

SEQ ID NO: 255552 - DNA, 20 bp, Artificial
  CRISPR gRNA sequence
gcttttgtgttctggcaaaa

SEQ ID NO: 255553 - DNA, 20 bp, Artificial
  CRISPR gRNA sequence
ttttgtgttctggcaaaata

SEQ ID NO: 255554 - DNA, 20 bp, Artificial
  CRISPR gRNA sequence
gtgtgaatattttgtttgct

SEQ ID NO: 255555 - DNA, 20 bp, Artificial
  CRISPR gRNA sequence
tttgtttgctgagtcctatt

SEQ ID NO: 255556 - DNA, 20 bp, Artificial
  CRISPR gRNA sequence
taatatctgtaatatccaaa

SEQ ID NO: 255557 - DNA, 20 bp, Artificial
  CRISPR gRNA sequence
cagaatattttaattgtatc

SEQ ID NO: 255558 - DNA, 20 bp, Artificial
  CRISPR gRNA sequence
attttaattgtatcaagtca

SEQ ID NO: 255559 - DNA, 20 bp, Artificial
  CRISPR gRNA sequence
ttttaattgtatcaagtcaa

SEQ ID NO: 255560 - DNA, 20 bp, Artificial
  CRISPR gRNA sequence
aaattatgctattttgcttg

SEQ ID NO: 255561 - DNA, 20 bp, Artificial
  CRISPR gRNA sequence
atgctattttgcttgtagct

SEQ ID NO: 255562 - DNA, 20 bp, Artificial
  CRISPR gRNA sequence
gctattttgcttgtagctaa

SEQ ID NO: 255563 - DNA, 20 bp, Artificial
  CRISPR gRNA sequence
aaatattttttcctatatga

SEQ ID NO: 255564 - DNA, 20 bp, Artificial
  CRISPR gRNA sequence
aatattttttcctatatgaa

SEQ ID NO: 255565 - DNA, 20 bp, Artificial
  CRISPR gRNA sequence
atatgaaaggcatgctactt

SEQ ID NO: 255566 - DNA, 20 bp, Artificial
  CRISPR gRNA sequence
tatgaaaggcatgctacttt

SEQ ID NO: 255567 - DNA, 20 bp, Artificial
  CRISPR gRNA sequence
aaaggcatgctactttagga

SEQ ID NO: 255568 - DNA, 20 bp, Artificial
  CRISPR gRNA sequence
tatacacatatcatttatgt

SEQ ID NO: 255569 - DNA, 20 bp, Artificial
  CRISPR gRNA sequence
atatcatttatgttagaact

SEQ ID NO: 255570 - DNA, 20 bp, Artificial
  CRISPR gRNA sequence
tcatttatgttagaactgag

SEQ ID NO: 255571 - DNA, 20 bp, Artificial
  CRISPR gRNA sequence
catttatgttagaactgaga

SEQ ID NO: 255572 - DNA, 20 bp, Artificial
  CRISPR gRNA sequence
gacaccaatgatcctgtact

SEQ ID NO: 255573 - DNA, 20 bp, Artificial
  CRISPR gRNA sequence
tatctgtatattataaatct

SEQ ID NO: 255574 - DNA, 20 bp, Artificial
  CRISPR gRNA sequence
ctgtatattataaatctgag

SEQ ID NO: 255575 - DNA, 20 bp, Artificial
  CRISPR gRNA sequence
tgtatattataaatctgagt

SEQ ID NO: 255576 - DNA, 20 bp, Artificial
  CRISPR gRNA sequence
taaatctgagtaggttttaa

SEQ ID NO: 255577 - DNA, 20 bp, Artificial
  CRISPR gRNA sequence
ttaaaagaaataccaatgcc

SEQ ID NO: 255578 - DNA, 20 bp, Artificial
  CRISPR gRNA sequence
gaaataccaatgcctagttc

SEQ ID NO: 255579 - DNA, 20 bp, Artificial
  CRISPR gRNA sequence
caatgcctagttccagccct

SEQ ID NO: 255580 - DNA, 20 bp, Artificial
  CRISPR gRNA sequence
agattctgatgtaattgata

SEQ ID NO: 255581 - DNA, 20 bp, Artificial
  CRISPR gRNA sequence
gattctgatgtaattgatat

SEQ ID NO: 255582 - DNA, 20 bp, Artificial
  CRISPR gRNA sequence
tgatgtaattgatatgggtt

SEQ ID NO: 255583 - DNA, 20 bp, Artificial
  CRISPR gRNA sequence
gatgtaattgatatgggttg

SEQ ID NO: 255584 - DNA, 20 bp, Artificial
  CRISPR gRNA sequence
gtaattgatatgggttgagg

SEQ ID NO: 255585 - DNA, 20 bp, Artificial
  CRISPR gRNA sequence
taattgatatgggttgagga

SEQ ID NO: 255586 - DNA, 20 bp, Artificial
  CRISPR gRNA sequence
aattgatatgggttgaggaa

SEQ ID NO: 255587 - DNA, 20 bp, Artificial
  CRISPR gRNA sequence
attgatatgggttgaggaag

SEQ ID NO: 255588 - DNA, 20 bp, Artificial
  CRISPR gRNA sequence
atgggttgaggaaggggtgc

SEQ ID NO: 255589 - DNA, 20 bp, Artificial
  CRISPR gRNA sequence
gaggaaggggtgctggacat

SEQ ID NO: 255590 - DNA, 20 bp, Artificial
  CRISPR gRNA sequence
agtatattttcaaactttct

SEQ ID NO: 255591 - DNA, 20 bp, Artificial
  CRISPR gRNA sequence
ttctcggataatttattgtg

SEQ ID NO: 255592 - DNA, 20 bp, Artificial
  CRISPR gRNA sequence
cggataatttattgtgcagc

SEQ ID NO: 255593 - DNA, 20 bp, Artificial
  CRISPR gRNA sequence
ggataatttattgtgcagct

SEQ ID NO: 255594 - DNA, 20 bp, Artificial
  CRISPR gRNA sequence
aatttattgtgcagctagga

SEQ ID NO: 255595 - DNA, 20 bp, Artificial
  CRISPR gRNA sequence
cagctaggatggaaaatcaa

SEQ ID NO: 255596 - DNA, 20 bp, Artificial
  CRISPR gRNA sequence
aggatggaaaatcaatggac

SEQ ID NO: 255597 - DNA, 20 bp, Artificial
  CRISPR gRNA sequence
gatggaaaatcaatggacta

SEQ ID NO: 255598 - DNA, 20 bp, Artificial
  CRISPR gRNA sequence
atggaaaatcaatggactag

SEQ ID NO: 255599 - DNA, 20 bp, Artificial
  CRISPR gRNA sequence
tcaatggactagaggatttt

SEQ ID NO: 255600 - DNA, 20 bp, Artificial
  CRISPR gRNA sequence
aggatttttggtatgctttc

SEQ ID NO: 255601 - DNA, 20 bp, Artificial
  CRISPR gRNA sequence
taattttctctaattttgaa

SEQ ID NO: 255602 - DNA, 20 bp, Artificial
  CRISPR gRNA sequence
taattttgaatagaattcta

SEQ ID NO: 255603 - DNA, 20 bp, Artificial
  CRISPR gRNA sequence
aattttgaatagaattctat

SEQ ID NO: 255604 - DNA, 20 bp, Artificial
  CRISPR gRNA sequence
tcatccccttttgattccta

SEQ ID NO: 255605 - DNA, 20 bp, Artificial
  CRISPR gRNA sequence
ttttgattcctaaagataca

SEQ ID NO: 255606 - DNA, 20 bp, Artificial
  CRISPR gRNA sequence
tttgtcattatataatctat

SEQ ID NO: 255607 - DNA, 20 bp, Artificial
  CRISPR gRNA sequence
tcattatataatctatgaga

SEQ ID NO: 255608 - DNA, 20 bp, Artificial
  CRISPR gRNA sequence
cattatataatctatgagac

SEQ ID NO: 255609 - DNA, 20 bp, Artificial
  CRISPR gRNA sequence
attatataatctatgagaca

SEQ ID NO: 255610 - DNA, 20 bp, Artificial
  CRISPR gRNA sequence
tataatctatgagacagggt

SEQ ID NO: 255611 - DNA, 20 bp, Artificial
  CRISPR gRNA sequence
ctatgagacagggttggaac

SEQ ID NO: 255612 - DNA, 20 bp, Artificial
  CRISPR gRNA sequence
ctagaaatttatcctctgat

SEQ ID NO: 255613 - DNA, 20 bp, Artificial
  CRISPR gRNA sequence
gaaatttatcctctgattag

SEQ ID NO: 255614 - DNA, 20 bp, Artificial
  CRISPR gRNA sequence
ttatcctctgattagcagtc

SEQ ID NO: 255615 - DNA, 20 bp, Artificial
  CRISPR gRNA sequence
cagtgttctgactgccatat

SEQ ID NO: 255616 - DNA, 20 bp, Artificial
  CRISPR gRNA sequence
agtgttctgactgccatatt

SEQ ID NO: 255617 - DNA, 20 bp, Artificial
  CRISPR gRNA sequence
attaggctgatgattttctt

SEQ ID NO: 255618 - DNA, 20 bp, Artificial
  CRISPR gRNA sequence
ttaggctgatgattttctta

SEQ ID NO: 255619 - DNA, 20 bp, Artificial
  CRISPR gRNA sequence
catattatttaacttattcc

SEQ ID NO: 255620 - DNA, 20 bp, Artificial
  CRISPR gRNA sequence
atattatttaacttattcca

SEQ ID NO: 255621 - DNA, 20 bp, Artificial
  CRISPR gRNA sequence
tttaacttattccaaggatg

SEQ ID NO: 255622 - DNA, 20 bp, Artificial
  CRISPR gRNA sequence
cttattccaaggatgcagtt

SEQ ID NO: 255623 - DNA, 20 bp, Artificial
  CRISPR gRNA sequence
ttattccaaggatgcagttt

SEQ ID NO: 255624 - DNA, 20 bp, Artificial
  CRISPR gRNA sequence
tattccaaggatgcagttta

SEQ ID NO: 255625 - DNA, 20 bp, Artificial
  CRISPR gRNA sequence
caaggatgcagtttagggtc

SEQ ID NO: 255626 - DNA, 20 bp, Artificial
  CRISPR gRNA sequence
ctagattaactatcttctga

SEQ ID NO: 255627 - DNA, 20 bp, Artificial
  CRISPR gRNA sequence
tagattaactatcttctgat

SEQ ID NO: 255628 - DNA, 20 bp, Artificial
  CRISPR gRNA sequence
gattaactatcttctgatgg

SEQ ID NO: 255629 - DNA, 20 bp, Artificial
  CRISPR gRNA sequence
ctatcttctgatgggagaaa

SEQ ID NO: 255630 - DNA, 20 bp, Artificial
  CRISPR gRNA sequence
tctgatgggagaaacggata

SEQ ID NO: 255631 - DNA, 20 bp, Artificial
  CRISPR gRNA sequence
atgggagaaacggataaagt

SEQ ID NO: 255632 - DNA, 20 bp, Artificial
  CRISPR gRNA sequence
tgggagaaacggataaagtt

SEQ ID NO: 255633 - DNA, 20 bp, Artificial
  CRISPR gRNA sequence
gaaacggataaagttaggtt

SEQ ID NO: 255634 - DNA, 20 bp, Artificial
  CRISPR gRNA sequence
aaacggataaagttaggtta

SEQ ID NO: 255635 - DNA, 20 bp, Artificial
  CRISPR gRNA sequence
taaagttaggttaaggccat

SEQ ID NO: 255636 - DNA, 20 bp, Artificial
  CRISPR gRNA sequence
agttaggttaaggccattgg

SEQ ID NO: 255637 - DNA, 20 bp, Artificial
  CRISPR gRNA sequence
agtcaccgttttgaatcaca

SEQ ID NO: 255638 - DNA, 20 bp, Artificial
  CRISPR gRNA sequence
caccgttttgaatcacacag

SEQ ID NO: 255639 - DNA, 20 bp, Artificial
  CRISPR gRNA sequence
atcacacagtagaatccaca

SEQ ID NO: 255640 - DNA, 20 bp, Artificial
  CRISPR gRNA sequence
acagtagaatccacaaagtc

SEQ ID NO: 255641 - DNA, 20 bp, Artificial
  CRISPR gRNA sequence
ccacaaagtcaagtgaatac

SEQ ID NO: 255642 - DNA, 20 bp, Artificial
  CRISPR gRNA sequence
tcaagtgaatacaagtctac

SEQ ID NO: 255643 - DNA, 20 bp, Artificial
  CRISPR gRNA sequence
agtgtaccatcctaacgtaa

SEQ ID NO: 255644 - DNA, 20 bp, Artificial
  CRISPR gRNA sequence
aacgtaatggctttcaactg

SEQ ID NO: 255645 - DNA, 20 bp, Artificial
  CRISPR gRNA sequence
ctgtggtcgtgaaaactgac

SEQ ID NO: 255646 - DNA, 20 bp, Artificial
  CRISPR gRNA sequence
cgtgaaaactgaccagatca

SEQ ID NO: 255647 - DNA, 20 bp, Artificial
  CRISPR gRNA sequence
aaaactgaccagatcatggt

SEQ ID NO: 255648 - DNA, 20 bp, Artificial
  CRISPR gRNA sequence
actgaccagatcatggtcag

SEQ ID NO: 255649 - DNA, 20 bp, Artificial
  CRISPR gRNA sequence
gaccagatcatggtcagtgg

SEQ ID NO: 255650 - DNA, 20 bp, Artificial
  CRISPR gRNA sequence
accagatcatggtcagtggt

SEQ ID NO: 255651 - DNA, 20 bp, Artificial
  CRISPR gRNA sequence
ccagatcatggtcagtggtg

SEQ ID NO: 255652 - DNA, 20 bp, Artificial
  CRISPR gRNA sequence
atcatggtcagtggtggggt

SEQ ID NO: 255653 - DNA, 20 bp, Artificial
  CRISPR gRNA sequence
tcatggtcagtggtggggtt

SEQ ID NO: 255654 - DNA, 20 bp, Artificial
  CRISPR gRNA sequence
ggtcagtggtggggttgggt

SEQ ID NO: 255655 - DNA, 20 bp, Artificial
  CRISPR gRNA sequence
gtggggttgggtaagtctca

SEQ ID NO: 255656 - DNA, 20 bp, Artificial
  CRISPR gRNA sequence
ggggttgggtaagtctcaaa

SEQ ID NO: 255657 - DNA, 20 bp, Artificial
  CRISPR gRNA sequence
gggttgggtaagtctcaaag

SEQ ID NO: 255658 - DNA, 20 bp, Artificial
  CRISPR gRNA sequence
agaggaaatctattcactct

SEQ ID NO: 255659 - DNA, 20 bp, Artificial
  CRISPR gRNA sequence
gaaatctattcactctaagc

SEQ ID NO: 255660 - DNA, 20 bp, Artificial
  CRISPR gRNA sequence
catttttctctgatgttcac

SEQ ID NO: 255661 - DNA, 20 bp, Artificial
  CRISPR gRNA sequence
atttttctctgatgttcaca

SEQ ID NO: 255662 - DNA, 20 bp, Artificial
  CRISPR gRNA sequence
tttctctgatgttcacaagg

SEQ ID NO: 255663 - DNA, 20 bp, Artificial
  CRISPR gRNA sequence
ttctctgatgttcacaagga

SEQ ID NO: 255664 - DNA, 20 bp, Artificial
  CRISPR gRNA sequence
atccactctattttgttttt

SEQ ID NO: 255665 - DNA, 20 bp, Artificial
  CRISPR gRNA sequence
tccactctattttgtttttc

SEQ ID NO: 255666 - DNA, 20 bp, Artificial
  CRISPR gRNA sequence
ccactctattttgtttttca

SEQ ID NO: 255667 - DNA, 20 bp, Artificial
  CRISPR gRNA sequence
tcagggaaacacctttgtcc

SEQ ID NO: 255668 - DNA, 20 bp, Artificial
  CRISPR gRNA sequence
tgtccaagtcccctatttcc

SEQ ID NO: 255669 - DNA, 20 bp, Artificial
  CRISPR gRNA sequence
ccctatttcccggaccttct

SEQ ID NO: 255670 - DNA, 20 bp, Artificial
  CRISPR gRNA sequence
ccggaccttctaagcccttt

SEQ ID NO: 255671 - DNA, 20 bp, Artificial
  CRISPR gRNA sequence
cggaccttctaagccctttt

SEQ ID NO: 255672 - DNA, 20 bp, Artificial
  CRISPR gRNA sequence
ttctaagcccttttgggtgc

SEQ ID NO: 255673 - DNA, 20 bp, Artificial
  CRISPR gRNA sequence
taagcccttttgggtgctgg

SEQ ID NO: 255674 - DNA, 20 bp, Artificial
  CRISPR gRNA sequence
gcccttttgggtgctggtgg

SEQ ID NO: 255675 - DNA, 20 bp, Artificial
  CRISPR gRNA sequence
ttttgggtgctggtggtggt

SEQ ID NO: 255676 - DNA, 20 bp, Artificial
  CRISPR gRNA sequence
tgggtgctggtggtggttgg

SEQ ID NO: 255677 - DNA, 20 bp, Artificial
  CRISPR gRNA sequence
ggtgctggtggtggttggtg

SEQ ID NO: 255678 - DNA, 20 bp, Artificial
  CRISPR gRNA sequence
ggtggtggttggtggagtcc

SEQ ID NO: 255679 - DNA, 20 bp, Artificial
  CRISPR gRNA sequence
ggtggagtcctggcttgcta

SEQ ID NO: 255680 - DNA, 20 bp, Artificial
  CRISPR gRNA sequence
cctggcttgctatagcttgc

SEQ ID NO: 255681 - DNA, 20 bp, Artificial
  CRISPR gRNA sequence
ttgctatagcttgctagtaa

SEQ ID NO: 255682 - DNA, 20 bp, Artificial
  CRISPR gRNA sequence
ctatagcttgctagtaacag

SEQ ID NO: 255683 - DNA, 20 bp, Artificial
  CRISPR gRNA sequence
cagtggcctttattattttc

SEQ ID NO: 255684 - DNA, 20 bp, Artificial
  CRISPR gRNA sequence
agtggcctttattattttct

SEQ ID NO: 255685 - DNA, 20 bp, Artificial
  CRISPR gRNA sequence
gcctttattattttctgggt

SEQ ID NO: 255686 - DNA, 20 bp, Artificial
  CRISPR gRNA sequence
ctttattattttctgggtaa

SEQ ID NO: 255687 - DNA, 20 bp, Artificial
  CRISPR gRNA sequence
tattattttctgggtaagag

SEQ ID NO: 255688 - DNA, 20 bp, Artificial
  CRISPR gRNA sequence
tattttctgggtaagagaag

SEQ ID NO: 255689 - DNA, 20 bp, Artificial
  CRISPR gRNA sequence
catgaaatctgaacacattc

SEQ ID NO: 255690 - DNA, 20 bp, Artificial
  CRISPR gRNA sequence
attcaagaattttgcctatg

SEQ ID NO: 255691 - DNA, 20 bp, Artificial
  CRISPR gRNA sequence
ggtttattttctgtttaata

SEQ ID NO: 255692 - DNA, 20 bp, Artificial
  CRISPR gRNA sequence
gtttattttctgtttaatat

SEQ ID NO: 255693 - DNA, 20 bp, Artificial
  CRISPR gRNA sequence
attttcttttccccatgctt

SEQ ID NO: 255694 - DNA, 20 bp, Artificial
  CRISPR gRNA sequence
ttcttttccccatgcttgag

SEQ ID NO: 255695 - DNA, 20 bp, Artificial
  CRISPR gRNA sequence
tcttttccccatgcttgagt

SEQ ID NO: 255696 - DNA, 20 bp, Artificial
  CRISPR gRNA sequence
tgcttgagtaggttctcttt

SEQ ID NO: 255697 - DNA, 20 bp, Artificial
  CRISPR gRNA sequence
tagcttgttcaactctatct

SEQ ID NO: 255698 - DNA, 20 bp, Artificial
  CRISPR gRNA sequence
ctgagataaaaatctgatat

SEQ ID NO: 255699 - DNA, 20 bp, Artificial
  CRISPR gRNA sequence
gataaaaatctgatatgagt

SEQ ID NO: 255700 - DNA, 20 bp, Artificial
  CRISPR gRNA sequence
ctgatatgagttagatttcc

SEQ ID NO: 255701 - DNA, 20 bp, Artificial
  CRISPR gRNA sequence
atatgagttagatttcccag

SEQ ID NO: 255702 - DNA, 20 bp, Artificial
  CRISPR gRNA sequence
tatgagttagatttcccaga

SEQ ID NO: 255703 - DNA, 20 bp, Artificial
  CRISPR gRNA sequence
tagatttcccagaaggcatt

SEQ ID NO: 255704 - DNA, 20 bp, Artificial
  CRISPR gRNA sequence
atttcccagaaggcattgag

SEQ ID NO: 255705 - DNA, 20 bp, Artificial
  CRISPR gRNA sequence
tttcccagaaggcattgagt

SEQ ID NO: 255706 - DNA, 20 bp, Artificial
  CRISPR gRNA sequence
cccagaaggcattgagtagg

SEQ ID NO: 255707 - DNA, 20 bp, Artificial
  CRISPR gRNA sequence
gaaggcattgagtaggtggt

SEQ ID NO: 255708 - DNA, 20 bp, Artificial
  CRISPR gRNA sequence
aaggcattgagtaggtggtg

SEQ ID NO: 255709 - DNA, 20 bp, Artificial
  CRISPR gRNA sequence
agtaggtggtgaggcaaaat

SEQ ID NO: 255710 - DNA, 20 bp, Artificial
  CRISPR gRNA sequence
aggtggtgaggcaaaataag

SEQ ID NO: 255711 - DNA, 20 bp, Artificial
  CRISPR gRNA sequence
aggcaaaataagaagctaaa

SEQ ID NO: 255712 - DNA, 20 bp, Artificial
  CRISPR gRNA sequence
ggcaaaataagaagctaaat

SEQ ID NO: 255713 - DNA, 20 bp, Artificial
  CRISPR gRNA sequence
aagaagctaaatgggtaaat

SEQ ID NO: 255714 - DNA, 20 bp, Artificial
  CRISPR gRNA sequence
agaagctaaatgggtaaatt

SEQ ID NO: 255715 - DNA, 20 bp, Artificial
  CRISPR gRNA sequence
gaagctaaatgggtaaatta

SEQ ID NO: 255716 - DNA, 20 bp, Artificial
  CRISPR gRNA sequence
gctaaatgggtaaattaggg

SEQ ID NO: 255717 - DNA, 20 bp, Artificial
  CRISPR gRNA sequence
taaatgggtaaattagggtg

SEQ ID NO: 255718 - DNA, 20 bp, Artificial
  CRISPR gRNA sequence
aaatgggtaaattagggtgg

SEQ ID NO: 255719 - DNA, 20 bp, Artificial
  CRISPR gRNA sequence
aatgggtaaattagggtgga

SEQ ID NO: 255720 - DNA, 20 bp, Artificial
  CRISPR gRNA sequence
gtaaattagggtggagggat

SEQ ID NO: 255721 - DNA, 20 bp, Artificial
  CRISPR gRNA sequence
taaattagggtggagggatt

SEQ ID NO: 255722 - DNA, 20 bp, Artificial
  CRISPR gRNA sequence
aattagggtggagggattag

SEQ ID NO: 255723 - DNA, 20 bp, Artificial
  CRISPR gRNA sequence
tagggtggagggattaggag

SEQ ID NO: 255724 - DNA, 20 bp, Artificial
  CRISPR gRNA sequence
tataattatgacacataaaa

SEQ ID NO: 255725 - DNA, 20 bp, Artificial
  CRISPR gRNA sequence
cgtatatatgtataaacacc

SEQ ID NO: 255726 - DNA, 20 bp, Artificial
  CRISPR gRNA sequence
gtatatatgtataaacacct

SEQ ID NO: 255727 - DNA, 20 bp, Artificial
  CRISPR gRNA sequence
gtataaacacctaggcaact

SEQ ID NO: 255728 - DNA, 20 bp, Artificial
  CRISPR gRNA sequence
tataaacacctaggcaactt

SEQ ID NO: 255729 - DNA, 20 bp, Artificial
  CRISPR gRNA sequence
aaacacctaggcaacttggg

SEQ ID NO: 255730 - DNA, 20 bp, Artificial
  CRISPR gRNA sequence
acctaggcaacttgggaagc

SEQ ID NO: 255731 - DNA, 20 bp, Artificial
  CRISPR gRNA sequence
cctaggcaacttgggaagct

SEQ ID NO: 255732 - DNA, 20 bp, Artificial
  CRISPR gRNA sequence
cttgggaagctaggcaactg

SEQ ID NO: 255733 - DNA, 20 bp, Artificial
  CRISPR gRNA sequence
agctaggcaactgaagccaa

SEQ ID NO: 255734 - DNA, 20 bp, Artificial
  CRISPR gRNA sequence
ctgaagccaatggacaatgt

SEQ ID NO: 255735 - DNA, 20 bp, Artificial
  CRISPR gRNA sequence
ttggcttgatcaaaaatcat

SEQ ID NO: 255736 - DNA, 20 bp, Artificial
  CRISPR gRNA sequence
atcaaaaatcatgagaaact

SEQ ID NO: 255737 - DNA, 20 bp, Artificial
  CRISPR gRNA sequence
tgaaattgtgtattcaaacc

SEQ ID NO: 255738 - DNA, 20 bp, Artificial
  CRISPR gRNA sequence
ttgtgtattcaaacctagca

SEQ ID NO: 255739 - DNA, 20 bp, Artificial
  CRISPR gRNA sequence
ttcaaacctagcaaagaaac

SEQ ID NO: 255740 - DNA, 20 bp, Artificial
  CRISPR gRNA sequence
gaaactagatctgtttatct

SEQ ID NO: 255741 - DNA, 20 bp, Artificial
  CRISPR gRNA sequence
atatttttttttctcctctg

SEQ ID NO: 255742 - DNA, 20 bp, Artificial
  CRISPR gRNA sequence
tttttttttctcctctgaag

SEQ ID NO: 255743 - DNA, 20 bp, Artificial
  CRISPR gRNA sequence
ctgaagcagttgaattgtgt

SEQ ID NO: 255744 - DNA, 20 bp, Artificial
  CRISPR gRNA sequence
tgaagcagttgaattgtgtg

SEQ ID NO: 255745 - DNA, 20 bp, Artificial
  CRISPR gRNA sequence
cagttgaattgtgtgaggcc

SEQ ID NO: 255746 - DNA, 20 bp, Artificial
  CRISPR gRNA sequence
gaattgtgtgaggccaagta

SEQ ID NO: 255747 - DNA, 20 bp, Artificial
  CRISPR gRNA sequence
ctgtcattatgaaactataa

SEQ ID NO: 255748 - DNA, 20 bp, Artificial
  CRISPR gRNA sequence
tgtcattatgaaactataat

SEQ ID NO: 255749 - DNA, 20 bp, Artificial
  CRISPR gRNA sequence
tcattatgaaactataatgg

SEQ ID NO: 255750 - DNA, 20 bp, Artificial
  CRISPR gRNA sequence
tatgaaactataatgggagt

SEQ ID NO: 255751 - DNA, 20 bp, Artificial
  CRISPR gRNA sequence
aatgggagttagaattttct

SEQ ID NO: 255752 - DNA, 20 bp, Artificial
  CRISPR gRNA sequence
gagctctcaccactgaattg

SEQ ID NO: 255753 - DNA, 20 bp, Artificial
  CRISPR gRNA sequence
aaatgtttacgtaataaatg

SEQ ID NO: 255754 - DNA, 20 bp, Artificial
  CRISPR gRNA sequence
cttcctcaacattgaatttt

SEQ ID NO: 255755 - DNA, 20 bp, Artificial
  CRISPR gRNA sequence
tcaacattgaatttttggcc

SEQ ID NO: 255756 - DNA, 20 bp, Artificial
  CRISPR gRNA sequence
caacattgaatttttggcct

SEQ ID NO: 255757 - DNA, 20 bp, Artificial
  CRISPR gRNA sequence
cattttgatgaacgcaccta

SEQ ID NO: 255758 - DNA, 20 bp, Artificial
  CRISPR gRNA sequence
tgatgaacgcacctacagtt

SEQ ID NO: 255759 - DNA, 20 bp, Artificial
  CRISPR gRNA sequence
acagttaagaacgtacccct

SEQ ID NO: 255760 - DNA, 20 bp, Artificial
  CRISPR gRNA sequence
gagtgacccttgttcttact

SEQ ID NO: 255761 - DNA, 20 bp, Artificial
  CRISPR gRNA sequence
gttcttactcagaaacttct

SEQ ID NO: 255762 - DNA, 20 bp, Artificial
  CRISPR gRNA sequence
ttcttactcagaaacttctt

SEQ ID NO: 255763 - DNA, 20 bp, Artificial
  CRISPR gRNA sequence
tcagaaacttcttaggtaca

SEQ ID NO: 255764 - DNA, 20 bp, Artificial
  CRISPR gRNA sequence
aacttcttaggtacatagta

SEQ ID NO: 255765 - DNA, 20 bp, Artificial
  CRISPR gRNA sequence
cttaggtacatagtatggta

SEQ ID NO: 255766 - DNA, 20 bp, Artificial
  CRISPR gRNA sequence
gttgtctttgaatttttttc

SEQ ID NO: 255767 - DNA, 20 bp, Artificial
  CRISPR gRNA sequence
gtctttgaatttttttctag

SEQ ID NO: 255768 - DNA, 20 bp, Artificial
  CRISPR gRNA sequence
ttttctagaagttacatgca

SEQ ID NO: 255769 - DNA, 20 bp, Artificial
  CRISPR gRNA sequence
tagaagttacatgcatggat

SEQ ID NO: 255770 - DNA, 20 bp, Artificial
  CRISPR gRNA sequence
ggatgagtcatttcttcaat

SEQ ID NO: 255771 - DNA, 20 bp, Artificial
  CRISPR gRNA sequence
aaatgtattctcaaacataa

SEQ ID NO: 255772 - DNA, 20 bp, Artificial
  CRISPR gRNA sequence
taaaagactatttctcttga

SEQ ID NO: 255773 - DNA, 20 bp, Artificial
  CRISPR gRNA sequence
tttctcttgatagtctccaa

SEQ ID NO: 255774 - DNA, 20 bp, Artificial
  CRISPR gRNA sequence
gatattctccatttgatatt

SEQ ID NO: 255775 - DNA, 20 bp, Artificial
  CRISPR gRNA sequence
catttgatattaagtacatt

SEQ ID NO: 255776 - DNA, 20 bp, Artificial
  CRISPR gRNA sequence
ggtgcttaatgaatgcttat

SEQ ID NO: 255777 - DNA, 20 bp, Artificial
  CRISPR gRNA sequence
attgatgaattgataacctc

SEQ ID NO: 255778 - DNA, 20 bp, Artificial
  CRISPR gRNA sequence
tgatgaattgataacctcca

SEQ ID NO: 255779 - DNA, 20 bp, Artificial
  CRISPR gRNA sequence
atgaattgataacctccaga

SEQ ID NO: 255780 - DNA, 20 bp, Artificial
  CRISPR gRNA sequence
tgaattgataacctccagag

SEQ ID NO: 255781 - DNA, 20 bp, Artificial
  CRISPR gRNA sequence
acctccagagaggtcaaatt

SEQ ID NO: 255782 - DNA, 20 bp, Artificial
  CRISPR gRNA sequence
cctccagagaggtcaaatta

SEQ ID NO: 255783 - DNA, 20 bp, Artificial
  CRISPR gRNA sequence
gtcaaattaaggatttaaat

SEQ ID NO: 255784 - DNA, 20 bp, Artificial
  CRISPR gRNA sequence
gatttaaatgagtctgcctg

SEQ ID NO: 255785 - DNA, 20 bp, Artificial
  CRISPR gRNA sequence
gaagtatgatactcatcttt

SEQ ID NO: 255786 - DNA, 20 bp, Artificial
  CRISPR gRNA sequence
aagtatgatactcatcttta

SEQ ID NO: 255787 - DNA, 20 bp, Artificial
  CRISPR gRNA sequence
ctgtatatgtacctaattca

SEQ ID NO: 255788 - DNA, 20 bp, Artificial
  CRISPR gRNA sequence
atatgtacctaattcataga

SEQ ID NO: 255789 - DNA, 20 bp, Artificial
  CRISPR gRNA sequence
tatgtacctaattcatagat

SEQ ID NO: 255790 - DNA, 20 bp, Artificial
  CRISPR gRNA sequence
tacctaattcatagatgggt

SEQ ID NO: 255791 - DNA, 20 bp, Artificial
  CRISPR gRNA sequence
gatgggtcagtgatttctga

SEQ ID NO: 255792 - DNA, 20 bp, Artificial
  CRISPR gRNA sequence
tctgaaagccatatcatatg

SEQ ID NO: 255793 - DNA, 20 bp, Artificial
  CRISPR gRNA sequence
gaagtcattctgtttactgt

SEQ ID NO: 255794 - DNA, 20 bp, Artificial
  CRISPR gRNA sequence
cattctgtttactgtcagct

SEQ ID NO: 255795 - DNA, 20 bp, Artificial
  CRISPR gRNA sequence
tactgtcagcttggtgactg

SEQ ID NO: 255796 - DNA, 20 bp, Artificial
  CRISPR gRNA sequence
actgtcagcttggtgactgc

SEQ ID NO: 255797 - DNA, 20 bp, Artificial
  CRISPR gRNA sequence
cagcttggtgactgcgggta

SEQ ID NO: 255798 - DNA, 20 bp, Artificial
  CRISPR gRNA sequence
ggtgactgcgggtacagacc

SEQ ID NO: 255799 - DNA, 20 bp, Artificial
  CRISPR gRNA sequence
cgggtacagacctggatcca

SEQ ID NO: 255800 - DNA, 20 bp, Artificial
  CRISPR gRNA sequence
agccatgccttcctattatc

SEQ ID NO: 255801 - DNA, 20 bp, Artificial
  CRISPR gRNA sequence
gccttcctattatccagtct

SEQ ID NO: 255802 - DNA, 20 bp, Artificial
  CRISPR gRNA sequence
tatccagtcttagattcttt

SEQ ID NO: 255803 - DNA, 20 bp, Artificial
  CRISPR gRNA sequence
agattcttttagactcttct

SEQ ID NO: 255804 - DNA, 20 bp, Artificial
  CRISPR gRNA sequence
ctcttcttggcctattgcca

SEQ ID NO: 255805 - DNA, 20 bp, Artificial
  CRISPR gRNA sequence
tattgccaaagcttaccttt

SEQ ID NO: 255806 - DNA, 20 bp, Artificial
  CRISPR gRNA sequence
tgttccccacatgctccttg

SEQ ID NO: 255807 - DNA, 20 bp, Artificial
  CRISPR gRNA sequence
cccacatgctccttgcagtt

SEQ ID NO: 255808 - DNA, 20 bp, Artificial
  CRISPR gRNA sequence
acatgctccttgcagttcag

SEQ ID NO: 255809 - DNA, 20 bp, Artificial
  CRISPR gRNA sequence
ccttgcagttcagaagaccc

SEQ ID NO: 255810 - DNA, 20 bp, Artificial
  CRISPR gRNA sequence
cttgcagttcagaagaccct

SEQ ID NO: 255811 - DNA, 20 bp, Artificial
  CRISPR gRNA sequence
ttgcagttcagaagacccta

SEQ ID NO: 255812 - DNA, 20 bp, Artificial
  CRISPR gRNA sequence
gttcagaagaccctagggct

SEQ ID NO: 255813 - DNA, 20 bp, Artificial
  CRISPR gRNA sequence
agaagaccctagggctcaga

SEQ ID NO: 255814 - DNA, 20 bp, Artificial
  CRISPR gRNA sequence
gggctcagatggacatttgt

SEQ ID NO: 255815 - DNA, 20 bp, Artificial
  CRISPR gRNA sequence
ggctcagatggacatttgtc

SEQ ID NO: 255816 - DNA, 20 bp, Artificial
  CRISPR gRNA sequence
tgcttactctgtacttgccg

SEQ ID NO: 255817 - DNA, 20 bp, Artificial
  CRISPR gRNA sequence
gcttactctgtacttgccgc

SEQ ID NO: 255818 - DNA, 20 bp, Artificial
  CRISPR gRNA sequence
cttactctgtacttgccgca

SEQ ID NO: 255819 - DNA, 20 bp, Artificial
  CRISPR gRNA sequence
actctgtacttgccgcaggg

SEQ ID NO: 255820 - DNA, 20 bp, Artificial
  CRISPR gRNA sequence
ctctgtacttgccgcagggt

SEQ ID NO: 255821 - DNA, 20 bp, Artificial
  CRISPR gRNA sequence
ttgccgcagggtaggaaaca

SEQ ID NO: 255822 - DNA, 20 bp, Artificial
  CRISPR gRNA sequence
ccgcagggtaggaaacaaag

SEQ ID NO: 255823 - DNA, 20 bp, Artificial
  CRISPR gRNA sequence
acaaagtggttgcttgttcc

SEQ ID NO: 255824 - DNA, 20 bp, Artificial
  CRISPR gRNA sequence
ttcctggaaattctttatac

SEQ ID NO: 255825 - DNA, 20 bp, Artificial
  CRISPR gRNA sequence
tcctggaaattctttatact

SEQ ID NO: 255826 - DNA, 20 bp, Artificial
  CRISPR gRNA sequence
tttatactaggtatcatctt

SEQ ID NO: 255827 - DNA, 20 bp, Artificial
  CRISPR gRNA sequence
tatcatcttaagaatttgcc

SEQ ID NO: 255828 - DNA, 20 bp, Artificial
  CRISPR gRNA sequence
ttgcctggcttgccttctgc

SEQ ID NO: 255829 - DNA, 20 bp, Artificial
  CRISPR gRNA sequence
ctgcaagttgcccaaccctg

SEQ ID NO: 255830 - DNA, 20 bp, Artificial
  CRISPR gRNA sequence
tgcaagttgcccaaccctga

SEQ ID NO: 255831 - DNA, 20 bp, Artificial
  CRISPR gRNA sequence
aagttgcccaaccctgaagg

SEQ ID NO: 255832 - DNA, 20 bp, Artificial
  CRISPR gRNA sequence
agttgcccaaccctgaaggt

SEQ ID NO: 255833 - DNA, 20 bp, Artificial
  CRISPR gRNA sequence
gttgcccaaccctgaaggtg

SEQ ID NO: 255834 - DNA, 20 bp, Artificial
  CRISPR gRNA sequence
caaccctgaaggtggggctt

SEQ ID NO: 255835 - DNA, 20 bp, Artificial
  CRISPR gRNA sequence
ctgaattctgcctctgatgt

SEQ ID NO: 255836 - DNA, 20 bp, Artificial
  CRISPR gRNA sequence
gttgactactttcacctttc

SEQ ID NO: 255837 - DNA, 20 bp, Artificial
  CRISPR gRNA sequence
actttcacctttccagatct

SEQ ID NO: 255838 - DNA, 20 bp, Artificial
  CRISPR gRNA sequence
accttctaactttgatcctc

SEQ ID NO: 255839 - DNA, 20 bp, Artificial
  CRISPR gRNA sequence
ggtgtttgctgataattttc

SEQ ID NO: 255840 - DNA, 20 bp, Artificial
  CRISPR gRNA sequence
gctgataattttcgagtttt

SEQ ID NO: 255841 - DNA, 20 bp, Artificial
  CRISPR gRNA sequence
tttcgagtttttagaattct

SEQ ID NO: 255842 - DNA, 20 bp, Artificial
  CRISPR gRNA sequence
tcttgtttcttcttaatctc

SEQ ID NO: 255843 - DNA, 20 bp, Artificial
  CRISPR gRNA sequence
tcttcttaatctctggccat

SEQ ID NO: 255844 - DNA, 20 bp, Artificial
  CRISPR gRNA sequence
tggcttttatgcctaccata

SEQ ID NO: 255845 - DNA, 20 bp, Artificial
  CRISPR gRNA sequence
tggcttttcaatcctcttat

SEQ ID NO: 255846 - DNA, 20 bp, Artificial
  CRISPR gRNA sequence
ggcttttcaatcctcttatt

SEQ ID NO: 255847 - DNA, 20 bp, Artificial
  CRISPR gRNA sequence
aatctcaactttctaactta

SEQ ID NO: 255848 - DNA, 20 bp, Artificial
  CRISPR gRNA sequence
atctcaactttctaacttaa

SEQ ID NO: 255849 - DNA, 20 bp, Artificial
  CRISPR gRNA sequence
caactttctaacttaaaggc

SEQ ID NO: 255850 - DNA, 20 bp, Artificial
  CRISPR gRNA sequence
aactttctaacttaaaggcc

SEQ ID NO: 255851 - DNA, 20 bp, Artificial
  CRISPR gRNA sequence
tctaacttaaaggccaggtg

SEQ ID NO: 255852 - DNA, 20 bp, Artificial
  CRISPR gRNA sequence
aacttaaaggccaggtgcag

SEQ ID NO: 255853 - DNA, 20 bp, Artificial
  CRISPR gRNA sequence
ggccaggtgcagtggccctt

SEQ ID NO: 255854 - DNA, 20 bp, Artificial
  CRISPR gRNA sequence
tggccctttggatacccctc

SEQ ID NO: 255855 - DNA, 20 bp, Artificial
  CRISPR gRNA sequence
ggccctttggatacccctcc

SEQ ID NO: 255856 - DNA, 20 bp, Artificial
  CRISPR gRNA sequence
ctttggatacccctccagga

SEQ ID NO: 255857 - DNA, 20 bp, Artificial
  CRISPR gRNA sequence
tttggatacccctccaggaa

SEQ ID NO: 255858 - DNA, 20 bp, Artificial
  CRISPR gRNA sequence
tcccctgtgatatgctgacc

SEQ ID NO: 255859 - DNA, 20 bp, Artificial
  CRISPR gRNA sequence
cccctgtgatatgctgacct

SEQ ID NO: 255860 - DNA, 20 bp, Artificial
  CRISPR gRNA sequence
tgatatgctgacctaggtca

SEQ ID NO: 255861 - DNA, 20 bp, Artificial
  CRISPR gRNA sequence
cctaggtcaaagtaatttac

SEQ ID NO: 255862 - DNA, 20 bp, Artificial
  CRISPR gRNA sequence
aaagtaatttactagctctg

SEQ ID NO: 255863 - DNA, 20 bp, Artificial
  CRISPR gRNA sequence
taatttactagctctgcaga

SEQ ID NO: 255864 - DNA, 20 bp, Artificial
  CRISPR gRNA sequence
tttactagctctgcagaaag

SEQ ID NO: 255865 - DNA, 20 bp, Artificial
  CRISPR gRNA sequence
agctctgcagaaagtagttt

SEQ ID NO: 255866 - DNA, 20 bp, Artificial
  CRISPR gRNA sequence
gctctgcagaaagtagtttt

SEQ ID NO: 255867 - DNA, 20 bp, Artificial
  CRISPR gRNA sequence
ggaattactttaaccttcaa

SEQ ID NO: 255868 - DNA, 20 bp, Artificial
  CRISPR gRNA sequence
ttactttaaccttcaatggc

SEQ ID NO: 255869 - DNA, 20 bp, Artificial
  CRISPR gRNA sequence
actttaaccttcaatggcca

SEQ ID NO: 255870 - DNA, 20 bp, Artificial
  CRISPR gRNA sequence
ctttaaccttcaatggccag

SEQ ID NO: 255871 - DNA, 20 bp, Artificial
  CRISPR gRNA sequence
aacttattataaatattcat

SEQ ID NO: 255872 - DNA, 20 bp, Artificial
  CRISPR gRNA sequence
ataaatattcattagaatgt

SEQ ID NO: 255873 - DNA, 20 bp, Artificial
  CRISPR gRNA sequence
agaatgtcagttactataat

SEQ ID NO: 255874 - DNA, 20 bp, Artificial
  CRISPR gRNA sequence
taatgagacatcaatttgtt

SEQ ID NO: 255875 - DNA, 20 bp, Artificial
  CRISPR gRNA sequence
atcaatttgttgagtgactt

SEQ ID NO: 255876 - DNA, 20 bp, Artificial
  CRISPR gRNA sequence
tgagtgacttgagtcaccca

SEQ ID NO: 255877 - DNA, 20 bp, Artificial
  CRISPR gRNA sequence
gagtgacttgagtcacccaa

SEQ ID NO: 255878 - DNA, 20 bp, Artificial
  CRISPR gRNA sequence
agtgacttgagtcacccaaa

SEQ ID NO: 255879 - DNA, 20 bp, Artificial
  CRISPR gRNA sequence
tgagtcacccaaagggacaa

SEQ ID NO: 255880 - DNA, 20 bp, Artificial
  CRISPR gRNA sequence
gtcacccaaagggacaaaag

SEQ ID NO: 255881 - DNA, 20 bp, Artificial
  CRISPR gRNA sequence
taaaccgttcactttcaact

SEQ ID NO: 255882 - DNA, 20 bp, Artificial
  CRISPR gRNA sequence
ctttcaactcagacacatca

SEQ ID NO: 255883 - DNA, 20 bp, Artificial
  CRISPR gRNA sequence
cagacacatcatagacacac

SEQ ID NO: 255884 - DNA, 20 bp, Artificial
  CRISPR gRNA sequence
agacacatcatagacacact

SEQ ID NO: 255885 - DNA, 20 bp, Artificial
  CRISPR gRNA sequence
agacacactgggtttttcct

SEQ ID NO: 255886 - DNA, 20 bp, Artificial
  CRISPR gRNA sequence
cacactgggtttttccttgg

SEQ ID NO: 255887 - DNA, 20 bp, Artificial
  CRISPR gRNA sequence
ttggcagtactactaattcc

SEQ ID NO: 255888 - DNA, 20 bp, Artificial
  CRISPR gRNA sequence
cagtactactaattcctagt

SEQ ID NO: 255889 - DNA, 20 bp, Artificial
  CRISPR gRNA sequence
ttttgttttactttgtctta

SEQ ID NO: 255890 - DNA, 20 bp, Artificial
  CRISPR gRNA sequence
cttacagaccccctgtgaat

SEQ ID NO: 255891 - DNA, 20 bp, Artificial
  CRISPR gRNA sequence
ttacagaccccctgtgaatt

SEQ ID NO: 255892 - DNA, 20 bp, Artificial
  CRISPR gRNA sequence
cagaccccctgtgaattggg

SEQ ID NO: 255893 - DNA, 20 bp, Artificial
  CRISPR gRNA sequence
ttgggcagtcctgtcatttg

SEQ ID NO: 255894 - DNA, 20 bp, Artificial
  CRISPR gRNA sequence
ctgtcatttgtggcctcttg

SEQ ID NO: 255895 - DNA, 20 bp, Artificial
  CRISPR gRNA sequence
gtggcctcttgtagtcaatt

SEQ ID NO: 255896 - DNA, 20 bp, Artificial
  CRISPR gRNA sequence
acttatctgcatctcaaacc

SEQ ID NO: 255897 - DNA, 20 bp, Artificial
  CRISPR gRNA sequence
cttatctgcatctcaaacct

SEQ ID NO: 255898 - DNA, 20 bp, Artificial
  CRISPR gRNA sequence
tctttgtactctcttaccaa

SEQ ID NO: 255899 - DNA, 20 bp, Artificial
  CRISPR gRNA sequence
tttgtactctcttaccaaaa

SEQ ID NO: 255900 - DNA, 20 bp, Artificial
  CRISPR gRNA sequence
taccaaaagagtataaatac

SEQ ID NO: 255901 - DNA, 20 bp, Artificial
  CRISPR gRNA sequence
acaagtttgtctatatttcg

SEQ ID NO: 255902 - DNA, 20 bp, Artificial
  CRISPR gRNA sequence
ctatatttcgtagaataaca

SEQ ID NO: 255903 - DNA, 20 bp, Artificial
  CRISPR gRNA sequence
ataacatagtatttttactc

SEQ ID NO: 255904 - DNA, 20 bp, Artificial
  CRISPR gRNA sequence
taacatagtatttttactct

SEQ ID NO: 255905 - DNA, 20 bp, Artificial
  CRISPR gRNA sequence
ggctcatcttttcctgctgt

SEQ ID NO: 255906 - DNA, 20 bp, Artificial
  CRISPR gRNA sequence
ttttcctgctgttggtattt

SEQ ID NO: 255907 - DNA, 20 bp, Artificial
  CRISPR gRNA sequence
gctgttggtatttaagcaac

SEQ ID NO: 255908 - DNA, 20 bp, Artificial
  CRISPR gRNA sequence
taagcaacaagtaccttgct

SEQ ID NO: 255909 - DNA, 20 bp, Artificial
  CRISPR gRNA sequence
caacaagtaccttgctgagt

SEQ ID NO: 255910 - DNA, 20 bp, Artificial
  CRISPR gRNA sequence
aacaagtaccttgctgagtt

SEQ ID NO: 255911 - DNA, 20 bp, Artificial
  CRISPR gRNA sequence
accttgctgagttgggcatc

SEQ ID NO: 255912 - DNA, 20 bp, Artificial
  CRISPR gRNA sequence
ccttgctgagttgggcatct

SEQ ID NO: 255913 - DNA, 20 bp, Artificial
  CRISPR gRNA sequence
gttgggcatctaggccatta

SEQ ID NO: 255914 - DNA, 20 bp, Artificial
  CRISPR gRNA sequence
tctaggccattatggatccc

SEQ ID NO: 255915 - DNA, 20 bp, Artificial
  CRISPR gRNA sequence
taggccattatggatccctg

SEQ ID NO: 255916 - DNA, 20 bp, Artificial
  CRISPR gRNA sequence
cattatggatccctggagtt

SEQ ID NO: 255917 - DNA, 20 bp, Artificial
  CRISPR gRNA sequence
cctggagtttagctgtttcc

SEQ ID NO: 255918 - DNA, 20 bp, Artificial
  CRISPR gRNA sequence
ctggagtttagctgtttcct

SEQ ID NO: 255919 - DNA, 20 bp, Artificial
  CRISPR gRNA sequence
tgtttcctgggtaattttct

SEQ ID NO: 255920 - DNA, 20 bp, Artificial
  CRISPR gRNA sequence
attttctgagatcctatttt

SEQ ID NO: 255921 - DNA, 20 bp, Artificial
  CRISPR gRNA sequence
tctgagatcctatttttggc

SEQ ID NO: 255922 - DNA, 20 bp, Artificial
  CRISPR gRNA sequence
tcctatttttggctggtctg

SEQ ID NO: 255923 - DNA, 20 bp, Artificial
  CRISPR gRNA sequence
tctgcagcgtgccttgatgt

SEQ ID NO: 255924 - DNA, 20 bp, Artificial
  CRISPR gRNA sequence
tgatgtaagttgctgttttc

SEQ ID NO: 255925 - DNA, 20 bp, Artificial
  CRISPR gRNA sequence
gctgttttccggaacttcct

SEQ ID NO: 255926 - DNA, 20 bp, Artificial
  CRISPR gRNA sequence
ctgttttccggaacttcctg

SEQ ID NO: 255927 - DNA, 20 bp, Artificial
  CRISPR gRNA sequence
tgttttccggaacttcctga

SEQ ID NO: 255928 - DNA, 20 bp, Artificial
  CRISPR gRNA sequence
gagggcctgatatgctactg

SEQ ID NO: 255929 - DNA, 20 bp, Artificial
  CRISPR gRNA sequence
agggcctgatatgctactgt

SEQ ID NO: 255930 - DNA, 20 bp, Artificial
  CRISPR gRNA sequence
gcctgatatgctactgtagg

SEQ ID NO: 255931 - DNA, 20 bp, Artificial
  CRISPR gRNA sequence
tatgctactgtaggcagttc

SEQ ID NO: 255932 - DNA, 20 bp, Artificial
  CRISPR gRNA sequence
atgctactgtaggcagttct

SEQ ID NO: 255933 - DNA, 20 bp, Artificial
  CRISPR gRNA sequence
actgtaggcagttctgggtt

SEQ ID NO: 255934 - DNA, 20 bp, Artificial
  CRISPR gRNA sequence
gtaggcagttctgggttgag

SEQ ID NO: 255935 - DNA, 20 bp, Artificial
  CRISPR gRNA sequence
taggcagttctgggttgagt

SEQ ID NO: 255936 - DNA, 20 bp, Artificial
  CRISPR gRNA sequence
ttctgggttgagtgggtttc

SEQ ID NO: 255937 - DNA, 20 bp, Artificial
  CRISPR gRNA sequence
tctgggttgagtgggtttct

SEQ ID NO: 255938 - DNA, 20 bp, Artificial
  CRISPR gRNA sequence
gttgagtgggtttctaggct

SEQ ID NO: 255939 - DNA, 20 bp, Artificial
  CRISPR gRNA sequence
gagtgggtttctaggctgag

SEQ ID NO: 255940 - DNA, 20 bp, Artificial
  CRISPR gRNA sequence
agtgggtttctaggctgagc

SEQ ID NO: 255941 - DNA, 20 bp, Artificial
  CRISPR gRNA sequence
ttctaggctgagcgggtttc

SEQ ID NO: 255942 - DNA, 20 bp, Artificial
  CRISPR gRNA sequence
tctaggctgagcgggtttct

SEQ ID NO: 255943 - DNA, 20 bp, Artificial
  CRISPR gRNA sequence
taggctgagcgggtttctgg

SEQ ID NO: 255944 - DNA, 20 bp, Artificial
  CRISPR gRNA sequence
gctgagcgggtttctgggag

SEQ ID NO: 255945 - DNA, 20 bp, Artificial
  CRISPR gRNA sequence
cgggtttctgggagcagctg

SEQ ID NO: 255946 - DNA, 20 bp, Artificial
  CRISPR gRNA sequence
agcagctgcagattctatct

SEQ ID NO: 255947 - DNA, 20 bp, Artificial
  CRISPR gRNA sequence
ttgacctgatgttgacattt

SEQ ID NO: 255948 - DNA, 20 bp, Artificial
  CRISPR gRNA sequence
tgttgacatttgagtaaata

SEQ ID NO: 255949 - DNA, 20 bp, Artificial
  CRISPR gRNA sequence
ttgacatttgagtaaataaa

SEQ ID NO: 255950 - DNA, 20 bp, Artificial
  CRISPR gRNA sequence
agtaaataaagagctccctt

SEQ ID NO: 255951 - DNA, 20 bp, Artificial
  CRISPR gRNA sequence
ataaagagctccctttggtc

SEQ ID NO: 255952 - DNA, 20 bp, Artificial
  CRISPR gRNA sequence
tccctttggtcaagctgtca

SEQ ID NO: 255953 - DNA, 20 bp, Artificial
  CRISPR gRNA sequence
ccctttggtcaagctgtcac

SEQ ID NO: 255954 - DNA, 20 bp, Artificial
  CRISPR gRNA sequence
ttggtcaagctgtcacaggc

SEQ ID NO: 255955 - DNA, 20 bp, Artificial
  CRISPR gRNA sequence
ctttcaattctccattcatg

SEQ ID NO: 255956 - DNA, 20 bp, Artificial
  CRISPR gRNA sequence
ctccattcatgcagctgtgc

SEQ ID NO: 255957 - DNA, 20 bp, Artificial
  CRISPR gRNA sequence
ttcatgcagctgtgctggta

SEQ ID NO: 255958 - DNA, 20 bp, Artificial
  CRISPR gRNA sequence
taaagctgcccgttttccta

SEQ ID NO: 255959 - DNA, 20 bp, Artificial
  CRISPR gRNA sequence
aaacattatgttccccactg

SEQ ID NO: 255960 - DNA, 20 bp, Artificial
  CRISPR gRNA sequence
cccactgcagatcataatgt

SEQ ID NO: 255961 - DNA, 20 bp, Artificial
  CRISPR gRNA sequence
ccactgcagatcataatgtg

SEQ ID NO: 255962 - DNA, 20 bp, Artificial
  CRISPR gRNA sequence
agatcataatgtgaggaatg

SEQ ID NO: 255963 - DNA, 20 bp, Artificial
  CRISPR gRNA sequence
cataatgtgaggaatgtaga

SEQ ID NO: 255964 - DNA, 20 bp, Artificial
  CRISPR gRNA sequence
gaatgtagatagtgtgtgta

SEQ ID NO: 255965 - DNA, 20 bp, Artificial
  CRISPR gRNA sequence
aatgtagatagtgtgtgtac

SEQ ID NO: 255966 - DNA, 20 bp, Artificial
  CRISPR gRNA sequence
gtagatagtgtgtgtacagg

SEQ ID NO: 255967 - DNA, 20 bp, Artificial
  CRISPR gRNA sequence
gtctgctttttataataatc

SEQ ID NO: 255968 - DNA, 20 bp, Artificial
  CRISPR gRNA sequence
tgctttttataataatccag

SEQ ID NO: 255969 - DNA, 20 bp, Artificial
  CRISPR gRNA sequence
aataatccagtagattcttg

SEQ ID NO: 255970 - DNA, 20 bp, Artificial
  CRISPR gRNA sequence
ttcttgaagaccacgtactt

SEQ ID NO: 255971 - DNA, 20 bp, Artificial
  CRISPR gRNA sequence
ttgaagaccacgtacttaag

SEQ ID NO: 255972 - DNA, 20 bp, Artificial
  CRISPR gRNA sequence
ctgtgtattgctgctgttcc

SEQ ID NO: 255973 - DNA, 20 bp, Artificial
  CRISPR gRNA sequence
tgtgtattgctgctgttccc

SEQ ID NO: 255974 - DNA, 20 bp, Artificial
  CRISPR gRNA sequence
tgctgctgttcccaggaaac

SEQ ID NO: 255975 - DNA, 20 bp, Artificial
  CRISPR gRNA sequence
tgctgttcccaggaaacaag

SEQ ID NO: 255976 - DNA, 20 bp, Artificial
  CRISPR gRNA sequence
gctgttcccaggaaacaagt

SEQ ID NO: 255977 - DNA, 20 bp, Artificial
  CRISPR gRNA sequence
ttcccaggaaacaagtgggt

SEQ ID NO: 255978 - DNA, 20 bp, Artificial
  CRISPR gRNA sequence
tcccaggaaacaagtgggta

SEQ ID NO: 255979 - DNA, 20 bp, Artificial
  CRISPR gRNA sequence
aggaaacaagtgggtaaggc

SEQ ID NO: 255980 - DNA, 20 bp, Artificial
  CRISPR gRNA sequence
acaagtgggtaaggctggca

SEQ ID NO: 255981 - DNA, 20 bp, Artificial
  CRISPR gRNA sequence
caagtgggtaaggctggcat

SEQ ID NO: 255982 - DNA, 20 bp, Artificial
  CRISPR gRNA sequence
aagtgggtaaggctggcatg

SEQ ID NO: 255983 - DNA, 20 bp, Artificial
  CRISPR gRNA sequence
gtgggtaaggctggcatggg

SEQ ID NO: 255984 - DNA, 20 bp, Artificial
  CRISPR gRNA sequence
ggtaaggctggcatggggag

SEQ ID NO: 255985 - DNA, 20 bp, Artificial
  CRISPR gRNA sequence
gtaaggctggcatggggaga

SEQ ID NO: 255986 - DNA, 20 bp, Artificial
  CRISPR gRNA sequence
taaggctggcatggggagaa

SEQ ID NO: 255987 - DNA, 20 bp, Artificial
  CRISPR gRNA sequence
ctggcatggggagaagggca

SEQ ID NO: 255988 - DNA, 20 bp, Artificial
  CRISPR gRNA sequence
tggcatggggagaagggcaa

SEQ ID NO: 255989 - DNA, 20 bp, Artificial
  CRISPR gRNA sequence
gcatggggagaagggcaaag

SEQ ID NO: 255990 - DNA, 20 bp, Artificial
  CRISPR gRNA sequence
catggggagaagggcaaagg

SEQ ID NO: 255991 - DNA, 20 bp, Artificial
  CRISPR gRNA sequence
ggagaagggcaaaggaggaa

SEQ ID NO: 255992 - DNA, 20 bp, Artificial
  CRISPR gRNA sequence
agggcaaaggaggaatggtc

SEQ ID NO: 255993 - DNA, 20 bp, Artificial
  CRISPR gRNA sequence
gtccagaaattacatatcat

SEQ ID NO: 255994 - DNA, 20 bp, Artificial
  CRISPR gRNA sequence
ttagctgacattcactgttg

SEQ ID NO: 255995 - DNA, 20 bp, Artificial
  CRISPR gRNA sequence
tagctgacattcactgttga

SEQ ID NO: 255996 - DNA, 20 bp, Artificial
  CRISPR gRNA sequence
agctgacattcactgttgaa

SEQ ID NO: 255997 - DNA, 20 bp, Artificial
  CRISPR gRNA sequence
gctgacattcactgttgaag

SEQ ID NO: 255998 - DNA, 20 bp, Artificial
  CRISPR gRNA sequence
gacattcactgttgaagggg

SEQ ID NO: 255999 - DNA, 20 bp, Artificial
  CRISPR gRNA sequence
cattcactgttgaaggggtg

SEQ ID NO: 256000 - DNA, 20 bp, Artificial
  CRISPR gRNA sequence
ttgaaggggtggagatgaca

SEQ ID NO: 256001 - DNA, 20 bp, Artificial
  CRISPR gRNA sequence
gtggagatgacacagacaca

SEQ ID NO: 256002 - DNA, 20 bp, Artificial
  CRISPR gRNA sequence
tggagatgacacagacacat

SEQ ID NO: 256003 - DNA, 20 bp, Artificial
  CRISPR gRNA sequence
ggagatgacacagacacata

SEQ ID NO: 256004 - DNA, 20 bp, Artificial
  CRISPR gRNA sequence
gatgacacagacacataggg

SEQ ID NO: 256005 - DNA, 20 bp, Artificial
  CRISPR gRNA sequence
atgacacagacacatagggt

SEQ ID NO: 256006 - DNA, 20 bp, Artificial
  CRISPR gRNA sequence
gcacacatactcaatgcaca

SEQ ID NO: 256007 - DNA, 20 bp, Artificial
  CRISPR gRNA sequence
cacacatactcaatgcacat

SEQ ID NO: 256008 - DNA, 20 bp, Artificial
  CRISPR gRNA sequence
ctcaatgcacatgggtgctg

SEQ ID NO: 256009 - DNA, 20 bp, Artificial
  CRISPR gRNA sequence
tcaatgcacatgggtgctgt

SEQ ID NO: 256010 - DNA, 20 bp, Artificial
  CRISPR gRNA sequence
tgggtgctgtaggttctgcg

SEQ ID NO: 256011 - DNA, 20 bp, Artificial
  CRISPR gRNA sequence
ttctgcgtggtgtttgttcc

SEQ ID NO: 256012 - DNA, 20 bp, Artificial
  CRISPR gRNA sequence
tttcatcccactgctgtgtt

SEQ ID NO: 256013 - DNA, 20 bp, Artificial
  CRISPR gRNA sequence
tcatcccactgctgtgttta

SEQ ID NO: 256014 - DNA, 20 bp, Artificial
  CRISPR gRNA sequence
cccactgctgtgtttagagt

SEQ ID NO: 256015 - DNA, 20 bp, Artificial
  CRISPR gRNA sequence
ccactgctgtgtttagagtt

SEQ ID NO: 256016 - DNA, 20 bp, Artificial
  CRISPR gRNA sequence
cactgctgtgtttagagtta

SEQ ID NO: 256017 - DNA, 20 bp, Artificial
  CRISPR gRNA sequence
tttagagttagggtgataat

SEQ ID NO: 256018 - DNA, 20 bp, Artificial
  CRISPR gRNA sequence
gagttagggtgataataagt

SEQ ID NO: 256019 - DNA, 20 bp, Artificial
  CRISPR gRNA sequence
ctgccatctgacaatcactt

SEQ ID NO: 256020 - DNA, 20 bp, Artificial
  CRISPR gRNA sequence
tgccatctgacaatcacttg

SEQ ID NO: 256021 - DNA, 20 bp, Artificial
  CRISPR gRNA sequence
tctgacaatcacttgaggat

SEQ ID NO: 256022 - DNA, 20 bp, Artificial
  CRISPR gRNA sequence
caatcacttgaggataagca

SEQ ID NO: 256023 - DNA, 20 bp, Artificial
  CRISPR gRNA sequence
aatcacttgaggataagcat

SEQ ID NO: 256024 - DNA, 20 bp, Artificial
  CRISPR gRNA sequence
tcacttgaggataagcatgg

SEQ ID NO: 256025 - DNA, 20 bp, Artificial
  CRISPR gRNA sequence
agcatgggagctgactgcaa

SEQ ID NO: 256026 - DNA, 20 bp, Artificial
  CRISPR gRNA sequence
attattttatgtgcaatgta

SEQ ID NO: 256027 - DNA, 20 bp, Artificial
  CRISPR gRNA sequence
atgtgcaatgtaaagaacct

SEQ ID NO: 256028 - DNA, 20 bp, Artificial
  CRISPR gRNA sequence
atgtaaagaacctgagaatc

SEQ ID NO: 256029 - DNA, 20 bp, Artificial
  CRISPR gRNA sequence
tcaagacacctttattgctg

SEQ ID NO: 256030 - DNA, 20 bp, Artificial
  CRISPR gRNA sequence
tattgctgtggcctctctac

SEQ ID NO: 256031 - DNA, 20 bp, Artificial
  CRISPR gRNA sequence
cctctctaccagctatgatt

SEQ ID NO: 256032 - DNA, 20 bp, Artificial
  CRISPR gRNA sequence
ctaccagctatgatttggtt

SEQ ID NO: 256033 - DNA, 20 bp, Artificial
  CRISPR gRNA sequence
taccagctatgatttggttt

SEQ ID NO: 256034 - DNA, 20 bp, Artificial
  CRISPR gRNA sequence
tatgatttggtttgggtgtc

SEQ ID NO: 256035 - DNA, 20 bp, Artificial
  CRISPR gRNA sequence
tgatttggtttgggtgtccg

SEQ ID NO: 256036 - DNA, 20 bp, Artificial
  CRISPR gRNA sequence
gatttggtttgggtgtccgg

SEQ ID NO: 256037 - DNA, 20 bp, Artificial
  CRISPR gRNA sequence
ttggtttgggtgtccggagg

SEQ ID NO: 256038 - DNA, 20 bp, Artificial
  CRISPR gRNA sequence
ggtttgggtgtccggaggca

SEQ ID NO: 256039 - DNA, 20 bp, Artificial
  CRISPR gRNA sequence
gtttgggtgtccggaggcag

SEQ ID NO: 256040 - DNA, 20 bp, Artificial
  CRISPR gRNA sequence
cggaggcagaggctgacact

SEQ ID NO: 256041 - DNA, 20 bp, Artificial
  CRISPR gRNA sequence
gaggcagaggctgacacttg

SEQ ID NO: 256042 - DNA, 20 bp, Artificial
  CRISPR gRNA sequence
aggcagaggctgacacttgg

SEQ ID NO: 256043 - DNA, 20 bp, Artificial
  CRISPR gRNA sequence
gaggctgacacttggaggtt

SEQ ID NO: 256044 - DNA, 20 bp, Artificial
  CRISPR gRNA sequence
tgacacttggaggtttggca

SEQ ID NO: 256045 - DNA, 20 bp, Artificial
  CRISPR gRNA sequence
gacacttggaggtttggcaa

SEQ ID NO: 256046 - DNA, 20 bp, Artificial
  CRISPR gRNA sequence
acacttggaggtttggcaaa

SEQ ID NO: 256047 - DNA, 20 bp, Artificial
  CRISPR gRNA sequence
acttggaggtttggcaaagg

SEQ ID NO: 256048 - DNA, 20 bp, Artificial
  CRISPR gRNA sequence
ggtttggcaaagggagtcct

SEQ ID NO: 256049 - DNA, 20 bp, Artificial
  CRISPR gRNA sequence
gtttggcaaagggagtcctc

SEQ ID NO: 256050 - DNA, 20 bp, Artificial
  CRISPR gRNA sequence
tttggcaaagggagtcctca

SEQ ID NO: 256051 - DNA, 20 bp, Artificial
  CRISPR gRNA sequence
gcaaagggagtcctcagggt

SEQ ID NO: 256052 - DNA, 20 bp, Artificial
  CRISPR gRNA sequence
aaagggagtcctcagggttg

SEQ ID NO: 256053 - DNA, 20 bp, Artificial
  CRISPR gRNA sequence
ggagtcctcagggttggagt

SEQ ID NO: 256054 - DNA, 20 bp, Artificial
  CRISPR gRNA sequence
taagtactaaaaatgcttcc

SEQ ID NO: 256055 - DNA, 20 bp, Artificial
  CRISPR gRNA sequence
aagtactaaaaatgcttccc

SEQ ID NO: 256056 - DNA, 20 bp, Artificial
  CRISPR gRNA sequence
aaaaatgcttcccaggttat

SEQ ID NO: 256057 - DNA, 20 bp, Artificial
  CRISPR gRNA sequence
agctgttttctacactcatc

SEQ ID NO: 256058 - DNA, 20 bp, Artificial
  CRISPR gRNA sequence
gctgttttctacactcatct

SEQ ID NO: 256059 - DNA, 20 bp, Artificial
  CRISPR gRNA sequence
ctgttttctacactcatctg

SEQ ID NO: 256060 - DNA, 20 bp, Artificial
  CRISPR gRNA sequence
tttctacactcatctgggga

SEQ ID NO: 256061 - DNA, 20 bp, Artificial
  CRISPR gRNA sequence
tctggggacagacatttcct

SEQ ID NO: 256062 - DNA, 20 bp, Artificial
  CRISPR gRNA sequence
cctgctgtgatcttgtgctc

SEQ ID NO: 256063 - DNA, 20 bp, Artificial
  CRISPR gRNA sequence
ctgtgatcttgtgctcaaga

SEQ ID NO: 256064 - DNA, 20 bp, Artificial
  CRISPR gRNA sequence
tcttgtgctcaagacagctc

SEQ ID NO: 256065 - DNA, 20 bp, Artificial
  CRISPR gRNA sequence
cagctctagtctttcattta

SEQ ID NO: 256066 - DNA, 20 bp, Artificial
  CRISPR gRNA sequence
tctagtctttcatttacaga

SEQ ID NO: 256067 - DNA, 20 bp, Artificial
  CRISPR gRNA sequence
ctagtctttcatttacagaa

SEQ ID NO: 256068 - DNA, 20 bp, Artificial
  CRISPR gRNA sequence
tttcatttacagaaaggatg

SEQ ID NO: 256069 - DNA, 20 bp, Artificial
  CRISPR gRNA sequence
aacaattcttcattgcattg

SEQ ID NO: 256070 - DNA, 20 bp, Artificial
  CRISPR gRNA sequence
acaattcttcattgcattgt

SEQ ID NO: 256071 - DNA, 20 bp, Artificial
  CRISPR gRNA sequence
tcattgcattgtaggatgtt

SEQ ID NO: 256072 - DNA, 20 bp, Artificial
  CRISPR gRNA sequence
ttgcattgtaggatgtttag

SEQ ID NO: 256073 - DNA, 20 bp, Artificial
  CRISPR gRNA sequence
cagcatctctgacctctacc

SEQ ID NO: 256074 - DNA, 20 bp, Artificial
  CRISPR gRNA sequence
catctctgacctctacccag

SEQ ID NO: 256075 - DNA, 20 bp, Artificial
  CRISPR gRNA sequence
gacctctacccagtagatgc

SEQ ID NO: 256076 - DNA, 20 bp, Artificial
  CRISPR gRNA sequence
ctctacccagtagatgccag

SEQ ID NO: 256077 - DNA, 20 bp, Artificial
  CRISPR gRNA sequence
gtgatgatccaaaatgtttt

SEQ ID NO: 256078 - DNA, 20 bp, Artificial
  CRISPR gRNA sequence
agacttcactaaatgtctcc

SEQ ID NO: 256079 - DNA, 20 bp, Artificial
  CRISPR gRNA sequence
gacttcactaaatgtctcct

SEQ ID NO: 256080 - DNA, 20 bp, Artificial
  CRISPR gRNA sequence
tcactaaatgtctcctggga

SEQ ID NO: 256081 - DNA, 20 bp, Artificial
  CRISPR gRNA sequence
cactaaatgtctcctgggac

SEQ ID NO: 256082 - DNA, 20 bp, Artificial
  CRISPR gRNA sequence
actaaatgtctcctgggaca

SEQ ID NO: 256083 - DNA, 20 bp, Artificial
  CRISPR gRNA sequence
tgtctcctgggacagggatt

SEQ ID NO: 256084 - DNA, 20 bp, Artificial
  CRISPR gRNA sequence
gtctcctgggacagggatta

SEQ ID NO: 256085 - DNA, 20 bp, Artificial
  CRISPR gRNA sequence
tctcctgggacagggattaa

SEQ ID NO: 256086 - DNA, 20 bp, Artificial
  CRISPR gRNA sequence
tcctgggacagggattaagg

SEQ ID NO: 256087 - DNA, 20 bp, Artificial
  CRISPR gRNA sequence
gacagggattaagggagctt

SEQ ID NO: 256088 - DNA, 20 bp, Artificial
  CRISPR gRNA sequence
acagggattaagggagcttg

SEQ ID NO: 256089 - DNA, 20 bp, Artificial
  CRISPR gRNA sequence
ttaagggagcttgaggtgtc

SEQ ID NO: 256090 - DNA, 20 bp, Artificial
  CRISPR gRNA sequence
taagggagcttgaggtgtca

SEQ ID NO: 256091 - DNA, 20 bp, Artificial
  CRISPR gRNA sequence
gagcttgaggtgtcaaggat

SEQ ID NO: 256092 - DNA, 20 bp, Artificial
  CRISPR gRNA sequence
agcttgaggtgtcaaggatg

SEQ ID NO: 256093 - DNA, 20 bp, Artificial
  CRISPR gRNA sequence
tgaggtgtcaaggatgaggt

SEQ ID NO: 256094 - DNA, 20 bp, Artificial
  CRISPR gRNA sequence
gaggtgtcaaggatgaggtt

SEQ ID NO: 256095 - DNA, 20 bp, Artificial
  CRISPR gRNA sequence
ggtgtcaaggatgaggttag

SEQ ID NO: 256096 - DNA, 20 bp, Artificial
  CRISPR gRNA sequence
gtgtcaaggatgaggttagg

SEQ ID NO: 256097 - DNA, 20 bp, Artificial
  CRISPR gRNA sequence
tgaggttaggaggtctgtct

SEQ ID NO: 256098 - DNA, 20 bp, Artificial
  CRISPR gRNA sequence
gaggttaggaggtctgtctt

SEQ ID NO: 256099 - DNA, 20 bp, Artificial
  CRISPR gRNA sequence
gttaggaggtctgtcttggg

SEQ ID NO: 256100 - DNA, 20 bp, Artificial
  CRISPR gRNA sequence
gtcttgggcagctgtatata

SEQ ID NO: 256101 - DNA, 20 bp, Artificial
  CRISPR gRNA sequence
ttgggcagctgtatatatgg

SEQ ID NO: 256102 - DNA, 20 bp, Artificial
  CRISPR gRNA sequence
atatggtagtgtcattcact

SEQ ID NO: 256103 - DNA, 20 bp, Artificial
  CRISPR gRNA sequence
gtagtgtcattcactcagat

SEQ ID NO: 256104 - DNA, 20 bp, Artificial
  CRISPR gRNA sequence
ttcactcagatgagaaacac

SEQ ID NO: 256105 - DNA, 20 bp, Artificial
  CRISPR gRNA sequence
aaacactggtaaaaaaaaaa

SEQ ID NO: 256106 - DNA, 20 bp, Artificial
  CRISPR gRNA sequence
ggtaaaaaaaaaacagcatt

SEQ ID NO: 256107 - DNA, 20 bp, Artificial
  CRISPR gRNA sequence
gtaaaaaaaaaacagcattt

SEQ ID NO: 256108 - DNA, 20 bp, Artificial
  CRISPR gRNA sequence
taaaaaaaaaacagcatttg

SEQ ID NO: 256109 - DNA, 20 bp, Artificial
  CRISPR gRNA sequence
aaaaaaaaaacagcatttgg

SEQ ID NO: 256110 - DNA, 20 bp, Artificial
  CRISPR gRNA sequence
cagcatttgggggaaatctt

SEQ ID NO: 256111 - DNA, 20 bp, Artificial
  CRISPR gRNA sequence
ggaaatcttgagttttattt

SEQ ID NO: 256112 - DNA, 20 bp, Artificial
  CRISPR gRNA sequence
agttttattttagacatgtt

SEQ ID NO: 256113 - DNA, 20 bp, Artificial
  CRISPR gRNA sequence
tattttagacatgttgagtt

SEQ ID NO: 256114 - DNA, 20 bp, Artificial
  CRISPR gRNA sequence
ttttagacatgttgagttta

SEQ ID NO: 256115 - DNA, 20 bp, Artificial
  CRISPR gRNA sequence
tagacatgttgagtttagag

SEQ ID NO: 256116 - DNA, 20 bp, Artificial
  CRISPR gRNA sequence
gttgagtttagagtggcttt

SEQ ID NO: 256117 - DNA, 20 bp, Artificial
  CRISPR gRNA sequence
ttgagtttagagtggctttg

SEQ ID NO: 256118 - DNA, 20 bp, Artificial
  CRISPR gRNA sequence
tttagagtggctttgaggtt

SEQ ID NO: 256119 - DNA, 20 bp, Artificial
  CRISPR gRNA sequence
agtggctttgaggtttagtc

SEQ ID NO: 256120 - DNA, 20 bp, Artificial
  CRISPR gRNA sequence
tggctttgaggtttagtcca

SEQ ID NO: 256121 - DNA, 20 bp, Artificial
  CRISPR gRNA sequence
ttagtccagagatataaatt

SEQ ID NO: 256122 - DNA, 20 bp, Artificial
  CRISPR gRNA sequence
tagtccagagatataaattt

SEQ ID NO: 256123 - DNA, 20 bp, Artificial
  CRISPR gRNA sequence
ccagagatataaatttgggt

SEQ ID NO: 256124 - DNA, 20 bp, Artificial
  CRISPR gRNA sequence
gagatataaatttgggtgag

SEQ ID NO: 256125 - DNA, 20 bp, Artificial
  CRISPR gRNA sequence
agatataaatttgggtgagt

SEQ ID NO: 256126 - DNA, 20 bp, Artificial
  CRISPR gRNA sequence
tataaatttgggtgagtagg

SEQ ID NO: 256127 - DNA, 20 bp, Artificial
  CRISPR gRNA sequence
gggtgagtaggtggtaattg

SEQ ID NO: 256128 - DNA, 20 bp, Artificial
  CRISPR gRNA sequence
ggtaattgaagctgtgaatg

SEQ ID NO: 256129 - DNA, 20 bp, Artificial
  CRISPR gRNA sequence
ttgaagctgtgaatgtggat

SEQ ID NO: 256130 - DNA, 20 bp, Artificial
  CRISPR gRNA sequence
tgaatgtggataagattgcc

SEQ ID NO: 256131 - DNA, 20 bp, Artificial
  CRISPR gRNA sequence
gaatgtggataagattgcct

SEQ ID NO: 256132 - DNA, 20 bp, Artificial
  CRISPR gRNA sequence
aatgtggataagattgccta

SEQ ID NO: 256133 - DNA, 20 bp, Artificial
  CRISPR gRNA sequence
tggataagattgcctaggga

SEQ ID NO: 256134 - DNA, 20 bp, Artificial
  CRISPR gRNA sequence
gataagattgcctagggaaa

SEQ ID NO: 256135 - DNA, 20 bp, Artificial
  CRISPR gRNA sequence
ataagattgcctagggaaag

SEQ ID NO: 256136 - DNA, 20 bp, Artificial
  CRISPR gRNA sequence
gattgcctagggaaagagga

SEQ ID NO: 256137 - DNA, 20 bp, Artificial
  CRISPR gRNA sequence
ttgcctagggaaagaggata

SEQ ID NO: 256138 - DNA, 20 bp, Artificial
  CRISPR gRNA sequence
cctagggaaagaggatagag

SEQ ID NO: 256139 - DNA, 20 bp, Artificial
  CRISPR gRNA sequence
agggaaagaggatagagaag

SEQ ID NO: 256140 - DNA, 20 bp, Artificial
  CRISPR gRNA sequence
gggaaagaggatagagaaga

SEQ ID NO: 256141 - DNA, 20 bp, Artificial
  CRISPR gRNA sequence
agaggatagagaagaaggcc

SEQ ID NO: 256142 - DNA, 20 bp, Artificial
  CRISPR gRNA sequence
gaggatagagaagaaggcct

SEQ ID NO: 256143 - DNA, 20 bp, Artificial
  CRISPR gRNA sequence
agagaagaaggcctaggacc

SEQ ID NO: 256144 - DNA, 20 bp, Artificial
  CRISPR gRNA sequence
gaagaaggcctaggaccaag

SEQ ID NO: 256145 - DNA, 20 bp, Artificial
  CRISPR gRNA sequence
aaggcctaggaccaagcagt

SEQ ID NO: 256146 - DNA, 20 bp, Artificial
  CRISPR gRNA sequence
caagcagtgagaaattctaa

SEQ ID NO: 256147 - DNA, 20 bp, Artificial
  CRISPR gRNA sequence
cagtgagaaattctaacggc

SEQ ID NO: 256148 - DNA, 20 bp, Artificial
  CRISPR gRNA sequence
gagaaattctaacggctggt

SEQ ID NO: 256149 - DNA, 20 bp, Artificial
  CRISPR gRNA sequence
gaaattctaacggctggtta

SEQ ID NO: 256150 - DNA, 20 bp, Artificial
  CRISPR gRNA sequence
attctaacggctggttagag

SEQ ID NO: 256151 - DNA, 20 bp, Artificial
  CRISPR gRNA sequence
ttctaacggctggttagaga

SEQ ID NO: 256152 - DNA, 20 bp, Artificial
  CRISPR gRNA sequence
acggctggttagagaaggat

SEQ ID NO: 256153 - DNA, 20 bp, Artificial
  CRISPR gRNA sequence
tagagaaggatgagcttgca

SEQ ID NO: 256154 - DNA, 20 bp, Artificial
  CRISPR gRNA sequence
agagaaggatgagcttgcaa

SEQ ID NO: 256155 - DNA, 20 bp, Artificial
  CRISPR gRNA sequence
agaaggatgagcttgcaaag

SEQ ID NO: 256156 - DNA, 20 bp, Artificial
  CRISPR gRNA sequence
gaaggatgagcttgcaaagg

SEQ ID NO: 256157 - DNA, 20 bp, Artificial
  CRISPR gRNA sequence
ggatgagcttgcaaaggagg

SEQ ID NO: 256158 - DNA, 20 bp, Artificial
  CRISPR gRNA sequence
gatgagcttgcaaaggaggc

SEQ ID NO: 256159 - DNA, 20 bp, Artificial
  CRISPR gRNA sequence
atgagcttgcaaaggaggca

SEQ ID NO: 256160 - DNA, 20 bp, Artificial
  CRISPR gRNA sequence
agcttgcaaaggaggcaggg

SEQ ID NO: 256161 - DNA, 20 bp, Artificial
  CRISPR gRNA sequence
gcttgcaaaggaggcaggga

SEQ ID NO: 256162 - DNA, 20 bp, Artificial
  CRISPR gRNA sequence
ttgcaaaggaggcagggaag

SEQ ID NO: 256163 - DNA, 20 bp, Artificial
  CRISPR gRNA sequence
ggaggcagggaaggagtgac

SEQ ID NO: 256164 - DNA, 20 bp, Artificial
  CRISPR gRNA sequence
gcagggaaggagtgacaaga

SEQ ID NO: 256165 - DNA, 20 bp, Artificial
  CRISPR gRNA sequence
cagggaaggagtgacaagac

SEQ ID NO: 256166 - DNA, 20 bp, Artificial
  CRISPR gRNA sequence
ggaaggagtgacaagacagg

SEQ ID NO: 256167 - DNA, 20 bp, Artificial
  CRISPR gRNA sequence
gaaggagtgacaagacaggt

SEQ ID NO: 256168 - DNA, 20 bp, Artificial
  CRISPR gRNA sequence
aagacaggtaggataaaaac

SEQ ID NO: 256169 - DNA, 20 bp, Artificial
  CRISPR gRNA sequence
agacaggtaggataaaaact

SEQ ID NO: 256170 - DNA, 20 bp, Artificial
  CRISPR gRNA sequence
ggataaaaactgggatgtca

SEQ ID NO: 256171 - DNA, 20 bp, Artificial
  CRISPR gRNA sequence
aaaaactgggatgtcataga

SEQ ID NO: 256172 - DNA, 20 bp, Artificial
  CRISPR gRNA sequence
ctgggatgtcatagatggca

SEQ ID NO: 256173 - DNA, 20 bp, Artificial
  CRISPR gRNA sequence
gggatgtcatagatggcaaa

SEQ ID NO: 256174 - DNA, 20 bp, Artificial
  CRISPR gRNA sequence
tcatagatggcaaagagaaa

SEQ ID NO: 256175 - DNA, 20 bp, Artificial
  CRISPR gRNA sequence
aagagaaatagtatcacaaa

SEQ ID NO: 256176 - DNA, 20 bp, Artificial
  CRISPR gRNA sequence
agaaatagtatcacaaaaag

SEQ ID NO: 256177 - DNA, 20 bp, Artificial
  CRISPR gRNA sequence
aaatagtatcacaaaaagaa

SEQ ID NO: 256178 - DNA, 20 bp, Artificial
  CRISPR gRNA sequence
atagtatcacaaaaagaaga

SEQ ID NO: 256179 - DNA, 20 bp, Artificial
  CRISPR gRNA sequence
aaaaagaagagagttatcaa

SEQ ID NO: 256180 - DNA, 20 bp, Artificial
  CRISPR gRNA sequence
gaagagagttatcaatagta

SEQ ID NO: 256181 - DNA, 20 bp, Artificial
  CRISPR gRNA sequence
caatagtatagaatactgct

SEQ ID NO: 256182 - DNA, 20 bp, Artificial
  CRISPR gRNA sequence
atagtatagaatactgctga

SEQ ID NO: 256183 - DNA, 20 bp, Artificial
  CRISPR gRNA sequence
tagaatactgctgagagttg

SEQ ID NO: 256184 - DNA, 20 bp, Artificial
  CRISPR gRNA sequence
aatactgctgagagttgaag

SEQ ID NO: 256185 - DNA, 20 bp, Artificial
  CRISPR gRNA sequence
tgctgagagttgaagaagat

SEQ ID NO: 256186 - DNA, 20 bp, Artificial
  CRISPR gRNA sequence
gctgagagttgaagaagatg

SEQ ID NO: 256187 - DNA, 20 bp, Artificial
  CRISPR gRNA sequence
gatgaggacttaaaacatgt

SEQ ID NO: 256188 - DNA, 20 bp, Artificial
  CRISPR gRNA sequence
taaaacatgttagctgtgtt

SEQ ID NO: 256189 - DNA, 20 bp, Artificial
  CRISPR gRNA sequence
gttagctgtgtttagtaaca

SEQ ID NO: 256190 - DNA, 20 bp, Artificial
  CRISPR gRNA sequence
agctgtgtttagtaacatgg

SEQ ID NO: 256191 - DNA, 20 bp, Artificial
  CRISPR gRNA sequence
gtgtttagtaacatggaagt

SEQ ID NO: 256192 - DNA, 20 bp, Artificial
  CRISPR gRNA sequence
gcgtttttcaaacctttctt

SEQ ID NO: 256193 - DNA, 20 bp, Artificial
  CRISPR gRNA sequence
cttactcatgcccctttgac

SEQ ID NO: 256194 - DNA, 20 bp, Artificial
  CRISPR gRNA sequence
ttactcatgcccctttgaca

SEQ ID NO: 256195 - DNA, 20 bp, Artificial
  CRISPR gRNA sequence
ctcatgcccctttgacaagg

SEQ ID NO: 256196 - DNA, 20 bp, Artificial
  CRISPR gRNA sequence
tcatgcccctttgacaagga

SEQ ID NO: 256197 - DNA, 20 bp, Artificial
  CRISPR gRNA sequence
cctttgacaaggaaggtgtg

SEQ ID NO: 256198 - DNA, 20 bp, Artificial
  CRISPR gRNA sequence
caaggaaggtgtgaagtgct

SEQ ID NO: 256199 - DNA, 20 bp, Artificial
  CRISPR gRNA sequence
aaggaaggtgtgaagtgctc

SEQ ID NO: 256200 - DNA, 20 bp, Artificial
  CRISPR gRNA sequence
gaaggtgtgaagtgctcagg

SEQ ID NO: 256201 - DNA, 20 bp, Artificial
  CRISPR gRNA sequence
aaggtgtgaagtgctcaggc

SEQ ID NO: 256202 - DNA, 20 bp, Artificial
  CRISPR gRNA sequence
ggtgtgaagtgctcaggcag

SEQ ID NO: 256203 - DNA, 20 bp, Artificial
  CRISPR gRNA sequence
agtgctcaggcaggagtgta

SEQ ID NO: 256204 - DNA, 20 bp, Artificial
  CRISPR gRNA sequence
ggagtgtatggaaacaaaac

SEQ ID NO: 256205 - DNA, 20 bp, Artificial
  CRISPR gRNA sequence
gagtgtatggaaacaaaacc

SEQ ID NO: 256206 - DNA, 20 bp, Artificial
  CRISPR gRNA sequence
agtgtatggaaacaaaacca

SEQ ID NO: 256207 - DNA, 20 bp, Artificial
  CRISPR gRNA sequence
cattcacttatttattcatt

SEQ ID NO: 256208 - DNA, 20 bp, Artificial
  CRISPR gRNA sequence
attcacttatttattcattc

SEQ ID NO: 256209 - DNA, 20 bp, Artificial
  CRISPR gRNA sequence
ggtatcatgtcattcatgta

SEQ ID NO: 256210 - DNA, 20 bp, Artificial
  CRISPR gRNA sequence
catgtacagcattatctact

SEQ ID NO: 256211 - DNA, 20 bp, Artificial
  CRISPR gRNA sequence
atgtacagcattatctactt

SEQ ID NO: 256212 - DNA, 20 bp, Artificial
  CRISPR gRNA sequence
agcattatctacttaggtat

SEQ ID NO: 256213 - DNA, 20 bp, Artificial
  CRISPR gRNA sequence
ttaggtatcagcctgtgtgc

SEQ ID NO: 256214 - DNA, 20 bp, Artificial
  CRISPR gRNA sequence
taggtatcagcctgtgtgcc

SEQ ID NO: 256215 - DNA, 20 bp, Artificial
  CRISPR gRNA sequence
tcagcctgtgtgccaggaac

SEQ ID NO: 256216 - DNA, 20 bp, Artificial
  CRISPR gRNA sequence
cagcctgtgtgccaggaact

SEQ ID NO: 256217 - DNA, 20 bp, Artificial
  CRISPR gRNA sequence
actaggcacttttttcataa

SEQ ID NO: 256218 - DNA, 20 bp, Artificial
  CRISPR gRNA sequence
taggcacttttttcataata

SEQ ID NO: 256219 - DNA, 20 bp, Artificial
  CRISPR gRNA sequence
ataatagagaattctgaatc

SEQ ID NO: 256220 - DNA, 20 bp, Artificial
  CRISPR gRNA sequence
ttctgaatccagaaatctga

SEQ ID NO: 256221 - DNA, 20 bp, Artificial
  CRISPR gRNA sequence
atctgatggctttctgtttt

SEQ ID NO: 256222 - DNA, 20 bp, Artificial
  CRISPR gRNA sequence
ttctgtttttagatgttttc

SEQ ID NO: 256223 - DNA, 20 bp, Artificial
  CRISPR gRNA sequence
tctgtttttagatgttttct

SEQ ID NO: 256224 - DNA, 20 bp, Artificial
  CRISPR gRNA sequence
tgttttctgggtcatttgtt

SEQ ID NO: 256225 - DNA, 20 bp, Artificial
  CRISPR gRNA sequence
gggtcatttgttaagaaatg

SEQ ID NO: 256226 - DNA, 20 bp, Artificial
  CRISPR gRNA sequence
attttactatcacattgatt

SEQ ID NO: 256227 - DNA, 20 bp, Artificial
  CRISPR gRNA sequence
gaaatgatgttcctaaccct

SEQ ID NO: 256228 - DNA, 20 bp, Artificial
  CRISPR gRNA sequence
ccttagtcaaaaattttgct

SEQ ID NO: 256229 - DNA, 20 bp, Artificial
  CRISPR gRNA sequence
aaaaattttgctaagattca

SEQ ID NO: 256230 - DNA, 20 bp, Artificial
  CRISPR gRNA sequence
aattttgctaagattcatgg

SEQ ID NO: 256231 - DNA, 20 bp, Artificial
  CRISPR gRNA sequence
attttgctaagattcatggt

SEQ ID NO: 256232 - DNA, 20 bp, Artificial
  CRISPR gRNA sequence
gcccttacttccctcacttc

SEQ ID NO: 256233 - DNA, 20 bp, Artificial
  CRISPR gRNA sequence
cttacttccctcacttctgg

SEQ ID NO: 256234 - DNA, 20 bp, Artificial
  CRISPR gRNA sequence
ctggtggaaattcatcctga

SEQ ID NO: 256235 - DNA, 20 bp, Artificial
  CRISPR gRNA sequence
ggtggaaattcatcctgatg

SEQ ID NO: 256236 - DNA, 20 bp, Artificial
  CRISPR gRNA sequence
aaattcatcctgatggagcc

SEQ ID NO: 256237 - DNA, 20 bp, Artificial
  CRISPR gRNA sequence
tgatggagccaagcctatga

SEQ ID NO: 256238 - DNA, 20 bp, Artificial
  CRISPR gRNA sequence
atggagccaagcctatgaaa

SEQ ID NO: 256239 - DNA, 20 bp, Artificial
  CRISPR gRNA sequence
ggagccaagcctatgaaaga

SEQ ID NO: 256240 - DNA, 20 bp, Artificial
  CRISPR gRNA sequence
caagcctatgaaagagagat

SEQ ID NO: 256241 - DNA, 20 bp, Artificial
  CRISPR gRNA sequence
ctatgaaagagagatgagtg

SEQ ID NO: 256242 - DNA, 20 bp, Artificial
  CRISPR gRNA sequence
tgtagaaatacatacccata

SEQ ID NO: 256243 - DNA, 20 bp, Artificial
  CRISPR gRNA sequence
aatacatacccataaagaca

SEQ ID NO: 256244 - DNA, 20 bp, Artificial
  CRISPR gRNA sequence
atacatacccataaagacat

SEQ ID NO: 256245 - DNA, 20 bp, Artificial
  CRISPR gRNA sequence
ataaagacataggaatgtac

SEQ ID NO: 256246 - DNA, 20 bp, Artificial
  CRISPR gRNA sequence
ataggaatgtactagttgtc

SEQ ID NO: 256247 - DNA, 20 bp, Artificial
  CRISPR gRNA sequence
ctagaactgtaaattgccat

SEQ ID NO: 256248 - DNA, 20 bp, Artificial
  CRISPR gRNA sequence
actgtaaattgccattagtt

SEQ ID NO: 256249 - DNA, 20 bp, Artificial
  CRISPR gRNA sequence
ttacaaatttgtgattatta

SEQ ID NO: 256250 - DNA, 20 bp, Artificial
  CRISPR gRNA sequence
tttgtgattattacagactc

SEQ ID NO: 256251 - DNA, 20 bp, Artificial
  CRISPR gRNA sequence
tgtgattattacagactctg

SEQ ID NO: 256252 - DNA, 20 bp, Artificial
  CRISPR gRNA sequence
gtgattattacagactctgg

SEQ ID NO: 256253 - DNA, 20 bp, Artificial
  CRISPR gRNA sequence
gattattacagactctggag

SEQ ID NO: 256254 - DNA, 20 bp, Artificial
  CRISPR gRNA sequence
acagactctggaggagttga

SEQ ID NO: 256255 - DNA, 20 bp, Artificial
  CRISPR gRNA sequence
gaggagttgaaagtcctctt

SEQ ID NO: 256256 - DNA, 20 bp, Artificial
  CRISPR gRNA sequence
aagtcctcttcggttaatta

SEQ ID NO: 256257 - DNA, 20 bp, Artificial
  CRISPR gRNA sequence
ttcggttaattatggaaaaa

SEQ ID NO: 256258 - DNA, 20 bp, Artificial
  CRISPR gRNA sequence
ttatggaaaaacagcttgtt

SEQ ID NO: 256259 - DNA, 20 bp, Artificial
  CRISPR gRNA sequence
tgttaagcaaatgctaatgt

SEQ ID NO: 256260 - DNA, 20 bp, Artificial
  CRISPR gRNA sequence
taagcaaatgctaatgtaag

SEQ ID NO: 256261 - DNA, 20 bp, Artificial
  CRISPR gRNA sequence
aatgtaagaagatcacaatg

SEQ ID NO: 256262 - DNA, 20 bp, Artificial
  CRISPR gRNA sequence
atgtaagaagatcacaatgt

SEQ ID NO: 256263 - DNA, 20 bp, Artificial
  CRISPR gRNA sequence
taagaagatcacaatgtggg

SEQ ID NO: 256264 - DNA, 20 bp, Artificial
  CRISPR gRNA sequence
aagaagatcacaatgtgggt

SEQ ID NO: 256265 - DNA, 20 bp, Artificial
  CRISPR gRNA sequence
caatgtgggtaggcttaacc

SEQ ID NO: 256266 - DNA, 20 bp, Artificial
  CRISPR gRNA sequence
gggtaggcttaacctagtca

SEQ ID NO: 256267 - DNA, 20 bp, Artificial
  CRISPR gRNA sequence
ggtaggcttaacctagtcaa

SEQ ID NO: 256268 - DNA, 20 bp, Artificial
  CRISPR gRNA sequence
taggcttaacctagtcaaag

SEQ ID NO: 256269 - DNA, 20 bp, Artificial
  CRISPR gRNA sequence
aggcttaacctagtcaaagg

SEQ ID NO: 256270 - DNA, 20 bp, Artificial
  CRISPR gRNA sequence
cttaacctagtcaaaggagg

SEQ ID NO: 256271 - DNA, 20 bp, Artificial
  CRISPR gRNA sequence
ttaacctagtcaaaggagga

SEQ ID NO: 256272 - DNA, 20 bp, Artificial
  CRISPR gRNA sequence
taacctagtcaaaggaggaa

SEQ ID NO: 256273 - DNA, 20 bp, Artificial
  CRISPR gRNA sequence
tcaaaggaggaagggccttc

SEQ ID NO: 256274 - DNA, 20 bp, Artificial
  CRISPR gRNA sequence
caagtgtatttacatatcaa

SEQ ID NO: 256275 - DNA, 20 bp, Artificial
  CRISPR gRNA sequence
gtgtatttacatatcaacag

SEQ ID NO: 256276 - DNA, 20 bp, Artificial
  CRISPR gRNA sequence
tcaacagtggatatgttaat

SEQ ID NO: 256277 - DNA, 20 bp, Artificial
  CRISPR gRNA sequence
attagtgtgcatttttaatt

SEQ ID NO: 256278 - DNA, 20 bp, Artificial
  CRISPR gRNA sequence
ttagtgtgcatttttaattc

SEQ ID NO: 256279 - DNA, 20 bp, Artificial
  CRISPR gRNA sequence
tgtgcatttttaattcaggt

SEQ ID NO: 256280 - DNA, 20 bp, Artificial
  CRISPR gRNA sequence
ttttaattcaggtcagatga

SEQ ID NO: 256281 - DNA, 20 bp, Artificial
  CRISPR gRNA sequence
tcaggtcagatgacagcatt

SEQ ID NO: 256282 - DNA, 20 bp, Artificial
  CRISPR gRNA sequence
aggtcagatgacagcattga

SEQ ID NO: 256283 - DNA, 20 bp, Artificial
  CRISPR gRNA sequence
gatgacagcattgagagtaa

SEQ ID NO: 256284 - DNA, 20 bp, Artificial
  CRISPR gRNA sequence
atgacagcattgagagtaac

SEQ ID NO: 256285 - DNA, 20 bp, Artificial
  CRISPR gRNA sequence
tgacagcattgagagtaaca

SEQ ID NO: 256286 - DNA, 20 bp, Artificial
  CRISPR gRNA sequence
ttctctaaaatactttcttt

SEQ ID NO: 256287 - DNA, 20 bp, Artificial
  CRISPR gRNA sequence
tactttctttgagatttttc

SEQ ID NO: 256288 - DNA, 20 bp, Artificial
  CRISPR gRNA sequence
gatttttcaagttcaatgtg

SEQ ID NO: 256289 - DNA, 20 bp, Artificial
  CRISPR gRNA sequence
tttttcaagttcaatgtgaa

SEQ ID NO: 256290 - DNA, 20 bp, Artificial
  CRISPR gRNA sequence
tcaagttcaatgtgaagagt

SEQ ID NO: 256291 - DNA, 20 bp, Artificial
  CRISPR gRNA sequence
agttcaatgtgaagagtcag

SEQ ID NO: 256292 - DNA, 20 bp, Artificial
  CRISPR gRNA sequence
caatgtgaagagtcagtagt

SEQ ID NO: 256293 - DNA, 20 bp, Artificial
  CRISPR gRNA sequence
aatgtgaagagtcagtagtt

SEQ ID NO: 256294 - DNA, 20 bp, Artificial
  CRISPR gRNA sequence
agtcagtagttgggtgtgat

SEQ ID NO: 256295 - DNA, 20 bp, Artificial
  CRISPR gRNA sequence
ggtgtgattagtcattaccc

SEQ ID NO: 256296 - DNA, 20 bp, Artificial
  CRISPR gRNA sequence
attagtcattacccaagtcc

SEQ ID NO: 256297 - DNA, 20 bp, Artificial
  CRISPR gRNA sequence
ttagtcattacccaagtcca

SEQ ID NO: 256298 - DNA, 20 bp, Artificial
  CRISPR gRNA sequence
caagtccaaggtgctcaaaa

SEQ ID NO: 256299 - DNA, 20 bp, Artificial
  CRISPR gRNA sequence
aagtccaaggtgctcaaaaa

SEQ ID NO: 256300 - DNA, 20 bp, Artificial
  CRISPR gRNA sequence
ccaaggtgctcaaaaaaggt

SEQ ID NO: 256301 - DNA, 20 bp, Artificial
  CRISPR gRNA sequence
ctcaaaaaaggttagtgttt

SEQ ID NO: 256302 - DNA, 20 bp, Artificial
  CRISPR gRNA sequence
ttagtgtctctgtcatttga

SEQ ID NO: 256303 - DNA, 20 bp, Artificial
  CRISPR gRNA sequence
ttgacagttaatattatgaa

SEQ ID NO: 256304 - DNA, 20 bp, Artificial
  CRISPR gRNA sequence
attatgaatagttgtgccca

SEQ ID NO: 256305 - DNA, 20 bp, Artificial
  CRISPR gRNA sequence
aatagttgtgcccacagtct

SEQ ID NO: 256306 - DNA, 20 bp, Artificial
  CRISPR gRNA sequence
actgacacttctctttcctg

SEQ ID NO: 256307 - DNA, 20 bp, Artificial
  CRISPR gRNA sequence
ctgacacttctctttcctgc

SEQ ID NO: 256308 - DNA, 20 bp, Artificial
  CRISPR gRNA sequence
cacttctctttcctgcaggt

SEQ ID NO: 256309 - DNA, 20 bp, Artificial
  CRISPR gRNA sequence
acttctctttcctgcaggtg

SEQ ID NO: 256310 - DNA, 20 bp, Artificial
  CRISPR gRNA sequence
ttctctttcctgcaggtgag

SEQ ID NO: 256311 - DNA, 20 bp, Artificial
  CRISPR gRNA sequence
ctttcctgcaggtgaggagt

SEQ ID NO: 256312 - DNA, 20 bp, Artificial
  CRISPR gRNA sequence
ttcctgcaggtgaggagtaa

SEQ ID NO: 256313 - DNA, 20 bp, Artificial
  CRISPR gRNA sequence
tcctgcaggtgaggagtaag

SEQ ID NO: 256314 - DNA, 20 bp, Artificial
  CRISPR gRNA sequence
ctgcaggtgaggagtaagag

SEQ ID NO: 256315 - DNA, 20 bp, Artificial
  CRISPR gRNA sequence
caggtgaggagtaagaggag

SEQ ID NO: 256316 - DNA, 20 bp, Artificial
  CRISPR gRNA sequence
aggtgaggagtaagaggagc

SEQ ID NO: 256317 - DNA, 20 bp, Artificial
  CRISPR gRNA sequence
aagaggagcaggctcctgca

SEQ ID NO: 256318 - DNA, 20 bp, Artificial
  CRISPR gRNA sequence
aacatgactccccgccgccc

SEQ ID NO: 256319 - DNA, 20 bp, Artificial
  CRISPR gRNA sequence
acatgactccccgccgcccc

SEQ ID NO: 256320 - DNA, 20 bp, Artificial
  CRISPR gRNA sequence
gccgccccgggcccacccgc

SEQ ID NO: 256321 - DNA, 20 bp, Artificial
  CRISPR gRNA sequence
ggcccacccgcaagcattac

SEQ ID NO: 256322 - DNA, 20 bp, Artificial
  CRISPR gRNA sequence
tgccccaccacgcgacttcg

SEQ ID NO: 256323 - DNA, 20 bp, Artificial
  CRISPR gRNA sequence
gcagcctatcgctcctgaca

SEQ ID NO: 256324 - DNA, 20 bp, Artificial
  CRISPR gRNA sequence
tcctgacacggacgcctatc

SEQ ID NO: 256325 - DNA, 20 bp, Artificial
  CRISPR gRNA sequence
tgacacggacgcctatccag

SEQ ID NO: 256326 - DNA, 20 bp, Artificial
  CRISPR gRNA sequence
acggacgcctatccagaagc

SEQ ID NO: 256327 - DNA, 20 bp, Artificial
  CRISPR gRNA sequence
acgcctatccagaagccagc

SEQ ID NO: 256328 - DNA, 20 bp, Artificial
  CRISPR gRNA sequence
ctatccagaagccagccggc

SEQ ID NO: 256329 - DNA, 20 bp, Artificial
  CRISPR gRNA sequence
tccagaagccagccggctgg

SEQ ID NO: 256330 - DNA, 20 bp, Artificial
  CRISPR gRNA sequence
tctgctcaatatcactgctc

SEQ ID NO: 256331 - DNA, 20 bp, Artificial
  CRISPR gRNA sequence
ctcaatatcactgctctgga

SEQ ID NO: 256332 - DNA, 20 bp, Artificial
  CRISPR gRNA sequence
tcaatatcactgctctggat

SEQ ID NO: 256333 - DNA, 20 bp, Artificial
  CRISPR gRNA sequence
taggaaatgaccgccatctc

SEQ ID NO: 256334 - DNA, 20 bp, Artificial
  CRISPR gRNA sequence
aaatgaccgccatctccagc

SEQ ID NO: 256335 - DNA, 20 bp, Artificial
  CRISPR gRNA sequence
ccatctccagccggccacct

SEQ ID NO: 256336 - DNA, 20 bp, Artificial
  CRISPR gRNA sequence
catctccagccggccacctc

SEQ ID NO: 256337 - DNA, 20 bp, Artificial
  CRISPR gRNA sequence
cggccacctcaggcccctgt

SEQ ID NO: 256338 - DNA, 20 bp, Artificial
  CRISPR gRNA sequence
ggccacctcaggcccctgtt

SEQ ID NO: 256339 - DNA, 20 bp, Artificial
  CRISPR gRNA sequence
caccaatgccaatttttctc

SEQ ID NO: 256340 - DNA, 20 bp, Artificial
  CRISPR gRNA sequence
gccaatttttctcgagtgac

SEQ ID NO: 256341 - DNA, 20 bp, Artificial
  CRISPR gRNA sequence
gagtgactagaccaaatatc

SEQ ID NO: 256342 - DNA, 20 bp, Artificial
  CRISPR gRNA sequence
ccaaatatcaagatcatttt

SEQ ID NO: 256343 - DNA, 20 bp, Artificial
  CRISPR gRNA sequence
cattttgagactctgaaatg

SEQ ID NO: 256344 - DNA, 20 bp, Artificial
  CRISPR gRNA sequence
gagactctgaaatgaagtaa

SEQ ID NO: 256345 - DNA, 20 bp, Artificial
  CRISPR gRNA sequence
gactctgaaatgaagtaaaa

SEQ ID NO: 256346 - DNA, 20 bp, Artificial
  CRISPR gRNA sequence
gtaaaagagatttcctgtga

SEQ ID NO: 256347 - DNA, 20 bp, Artificial
  CRISPR gRNA sequence
taaaagagatttcctgtgac

SEQ ID NO: 256348 - DNA, 20 bp, Artificial
  CRISPR gRNA sequence
gagatttcctgtgacaggcc

SEQ ID NO: 256349 - DNA, 20 bp, Artificial
  CRISPR gRNA sequence
ctgtgacaggccaagtctta

SEQ ID NO: 256350 - DNA, 20 bp, Artificial
  CRISPR gRNA sequence
ggccaagtcttacagtgcca

SEQ ID NO: 256351 - DNA, 20 bp, Artificial
  CRISPR gRNA sequence
attccaacttaccatgtact

SEQ ID NO: 256352 - DNA, 20 bp, Artificial
  CRISPR gRNA sequence
atgtacttagtgacttgact

SEQ ID NO: 256353 - DNA, 20 bp, Artificial
  CRISPR gRNA sequence
tacttagtgacttgactgag

SEQ ID NO: 256354 - DNA, 20 bp, Artificial
  CRISPR gRNA sequence
tagtgacttgactgagaagt

SEQ ID NO: 256355 - DNA, 20 bp, Artificial
  CRISPR gRNA sequence
agtgacttgactgagaagtt

SEQ ID NO: 256356 - DNA, 20 bp, Artificial
  CRISPR gRNA sequence
gtgacttgactgagaagtta

SEQ ID NO: 256357 - DNA, 20 bp, Artificial
  CRISPR gRNA sequence
acttgactgagaagttaggg

SEQ ID NO: 256358 - DNA, 20 bp, Artificial
  CRISPR gRNA sequence
aagttagggtagaaaacaaa

SEQ ID NO: 256359 - DNA, 20 bp, Artificial
  CRISPR gRNA sequence
agttagggtagaaaacaaaa

SEQ ID NO: 256360 - DNA, 20 bp, Artificial
  CRISPR gRNA sequence
gttagggtagaaaacaaaaa

SEQ ID NO: 256361 - DNA, 20 bp, Artificial
  CRISPR gRNA sequence
tagggtagaaaacaaaaagg

SEQ ID NO: 256362 - DNA, 20 bp, Artificial
  CRISPR gRNA sequence
ggtagaaaacaaaaagggag

SEQ ID NO: 256363 - DNA, 20 bp, Artificial
  CRISPR gRNA sequence
aacaaaaagggagtggattc

SEQ ID NO: 256364 - DNA, 20 bp, Artificial
  CRISPR gRNA sequence
acaaaaagggagtggattct

SEQ ID NO: 256365 - DNA, 20 bp, Artificial
  CRISPR gRNA sequence
aaaaagggagtggattctgg

SEQ ID NO: 256366 - DNA, 20 bp, Artificial
  CRISPR gRNA sequence
tctcactcacctgcacatct

SEQ ID NO: 256367 - DNA, 20 bp, Artificial
  CRISPR gRNA sequence
ctcacctgcacatctcagtc

SEQ ID NO: 256368 - DNA, 20 bp, Artificial
  CRISPR gRNA sequence
ctgcacatctcagtcaagca

SEQ ID NO: 256369 - DNA, 20 bp, Artificial
  CRISPR gRNA sequence
catctcagtcaagcaaagtg

SEQ ID NO: 256370 - DNA, 20 bp, Artificial
  CRISPR gRNA sequence
caagcaaagtgtggtatcca

SEQ ID NO: 256371 - DNA, 20 bp, Artificial
  CRISPR gRNA sequence
tgtggtatccacagacattt

SEQ ID NO: 256372 - DNA, 20 bp, Artificial
  CRISPR gRNA sequence
atccacagacattttagttg

SEQ ID NO: 256373 - DNA, 20 bp, Artificial
  CRISPR gRNA sequence
cacagacattttagttgcag

SEQ ID NO: 256374 - DNA, 20 bp, Artificial
  CRISPR gRNA sequence
gacattttagttgcagaaga

SEQ ID NO: 256375 - DNA, 20 bp, Artificial
  CRISPR gRNA sequence
acattttagttgcagaagaa

SEQ ID NO: 256376 - DNA, 20 bp, Artificial
  CRISPR gRNA sequence
tttagttgcagaagaaaggc

SEQ ID NO: 256377 - DNA, 20 bp, Artificial
  CRISPR gRNA sequence
ttagttgcagaagaaaggct

SEQ ID NO: 256378 - DNA, 20 bp, Artificial
  CRISPR gRNA sequence
ggctaggaaatcattccttt

SEQ ID NO: 256379 - DNA, 20 bp, Artificial
  CRISPR gRNA sequence
aatcattccttttggttaaa

SEQ ID NO: 256380 - DNA, 20 bp, Artificial
  CRISPR gRNA sequence
atcattccttttggttaaat

SEQ ID NO: 256381 - DNA, 20 bp, Artificial
  CRISPR gRNA sequence
taaatgggtgtttaatcttt

SEQ ID NO: 256382 - DNA, 20 bp, Artificial
  CRISPR gRNA sequence
tgggtgtttaatcttttggt

SEQ ID NO: 256383 - DNA, 20 bp, Artificial
  CRISPR gRNA sequence
gtgtttaatcttttggttag

SEQ ID NO: 256384 - DNA, 20 bp, Artificial
  CRISPR gRNA sequence
tgtttaatcttttggttagt

SEQ ID NO: 256385 - DNA, 20 bp, Artificial
  CRISPR gRNA sequence
cttttggttagtgggttaaa

SEQ ID NO: 256386 - DNA, 20 bp, Artificial
  CRISPR gRNA sequence
ttttggttagtgggttaaac

SEQ ID NO: 256387 - DNA, 20 bp, Artificial
  CRISPR gRNA sequence
tttggttagtgggttaaacg

SEQ ID NO: 256388 - DNA, 20 bp, Artificial
  CRISPR gRNA sequence
gttagtgggttaaacggggt

SEQ ID NO: 256389 - DNA, 20 bp, Artificial
  CRISPR gRNA sequence
gtgggttaaacggggtaagt

SEQ ID NO: 256390 - DNA, 20 bp, Artificial
  CRISPR gRNA sequence
gggttaaacggggtaagtta

SEQ ID NO: 256391 - DNA, 20 bp, Artificial
  CRISPR gRNA sequence
ttaaacggggtaagttagag

SEQ ID NO: 256392 - DNA, 20 bp, Artificial
  CRISPR gRNA sequence
taaacggggtaagttagagt

SEQ ID NO: 256393 - DNA, 20 bp, Artificial
  CRISPR gRNA sequence
aaacggggtaagttagagta

SEQ ID NO: 256394 - DNA, 20 bp, Artificial
  CRISPR gRNA sequence
aacggggtaagttagagtag

SEQ ID NO: 256395 - DNA, 20 bp, Artificial
  CRISPR gRNA sequence
acggggtaagttagagtagg

SEQ ID NO: 256396 - DNA, 20 bp, Artificial
  CRISPR gRNA sequence
ggggtaagttagagtagggg

SEQ ID NO: 256397 - DNA, 20 bp, Artificial
  CRISPR gRNA sequence
gggtaagttagagtaggggg

SEQ ID NO: 256398 - DNA, 20 bp, Artificial
  CRISPR gRNA sequence
ggtaagttagagtaggggga

SEQ ID NO: 256399 - DNA, 20 bp, Artificial
  CRISPR gRNA sequence
agttagagtagggggaggga

SEQ ID NO: 256400 - DNA, 20 bp, Artificial
  CRISPR gRNA sequence
gttagagtagggggagggat

SEQ ID NO: 256401 - DNA, 20 bp, Artificial
  CRISPR gRNA sequence
agagtagggggagggatagg

SEQ ID NO: 256402 - DNA, 20 bp, Artificial
  CRISPR gRNA sequence
ctgtctcccactcatgaaat

SEQ ID NO: 256403 - DNA, 20 bp, Artificial
  CRISPR gRNA sequence
cactcatgaaatgagccacg

SEQ ID NO: 256404 - DNA, 20 bp, Artificial
  CRISPR gRNA sequence
tatttaatgctgttttcctt

SEQ ID NO: 256405 - DNA, 20 bp, Artificial
  CRISPR gRNA sequence
aatgctgttttcctttagtt

SEQ ID NO: 256406 - DNA, 20 bp, Artificial
  CRISPR gRNA sequence
tcctttagtttagaaataca

SEQ ID NO: 256407 - DNA, 20 bp, Artificial
  CRISPR gRNA sequence
ttatgaattctgatcatatt

SEQ ID NO: 256408 - DNA, 20 bp, Artificial
  CRISPR gRNA sequence
tttagtcattttgaccaaat

SEQ ID NO: 256409 - DNA, 20 bp, Artificial
  CRISPR gRNA sequence
ttagtcattttgaccaaatg

SEQ ID NO: 256410 - DNA, 20 bp, Artificial
  CRISPR gRNA sequence
tagtcattttgaccaaatga

SEQ ID NO: 256411 - DNA, 20 bp, Artificial
  CRISPR gRNA sequence
ttttgaccaaatgagggatt

SEQ ID NO: 256412 - DNA, 20 bp, Artificial
  CRISPR gRNA sequence
aatgagggatttggtcaaat

SEQ ID NO: 256413 - DNA, 20 bp, Artificial
  CRISPR gRNA sequence
atgagggatttggtcaaatg

SEQ ID NO: 256414 - DNA, 20 bp, Artificial
  CRISPR gRNA sequence
tgagggatttggtcaaatga

SEQ ID NO: 256415 - DNA, 20 bp, Artificial
  CRISPR gRNA sequence
tcaaatgagggattccctca

SEQ ID NO: 256416 - DNA, 20 bp, Artificial
  CRISPR gRNA sequence
ggattccctcaaagcaatat

SEQ ID NO: 256417 - DNA, 20 bp, Artificial
  CRISPR gRNA sequence
gattccctcaaagcaatatc

SEQ ID NO: 256418 - DNA, 20 bp, Artificial
  CRISPR gRNA sequence
aaagcaatatcaggtaaacc

SEQ ID NO: 256419 - DNA, 20 bp, Artificial
  CRISPR gRNA sequence
ctttcctcactccctgtcat

SEQ ID NO: 256420 - DNA, 20 bp, Artificial
  CRISPR gRNA sequence
cactccctgtcatgagactt

SEQ ID NO: 256421 - DNA, 20 bp, Artificial
  CRISPR gRNA sequence
tgttcacaatatactttcga

SEQ ID NO: 256422 - DNA, 20 bp, Artificial
  CRISPR gRNA sequence
atactttcgaaagaataaaa

SEQ ID NO: 256423 - DNA, 20 bp, Artificial
  CRISPR gRNA sequence
taaaatagttctcctacatg

SEQ ID NO: 256424 - DNA, 20 bp, Artificial
  CRISPR gRNA sequence
atagttctcctacatgaaga

SEQ ID NO: 256425 - DNA, 20 bp, Artificial
  CRISPR gRNA sequence
tacatgaagaaagaatatgt

SEQ ID NO: 256426 - DNA, 20 bp, Artificial
  CRISPR gRNA sequence
acatgaagaaagaatatgtc

SEQ ID NO: 256427 - DNA, 20 bp, Artificial
  CRISPR gRNA sequence
gaaagaatatgtcaggaaat

SEQ ID NO: 256428 - DNA, 20 bp, Artificial
  CRISPR gRNA sequence
aaagaatatgtcaggaaata

SEQ ID NO: 256429 - DNA, 20 bp, Artificial
  CRISPR gRNA sequence
actttatgtcaaaattattt

SEQ ID NO: 256430 - DNA, 20 bp, Artificial
  CRISPR gRNA sequence
tcaaaattatttgagtacta

SEQ ID NO: 256431 - DNA, 20 bp, Artificial
  CRISPR gRNA sequence
caaaattatttgagtactat

SEQ ID NO: 256432 - DNA, 20 bp, Artificial
  CRISPR gRNA sequence
tatttgagtactatgggacc

SEQ ID NO: 256433 - DNA, 20 bp, Artificial
  CRISPR gRNA sequence
gagtactatgggacctggcg

SEQ ID NO: 256434 - DNA, 20 bp, Artificial
  CRISPR gRNA sequence
tactatgggacctggcgcag

SEQ ID NO: 256435 - DNA, 20 bp, Artificial
  CRISPR gRNA sequence
gtggctcatgcttgtaatcc

SEQ ID NO: 256436 - DNA, 20 bp, Artificial
  CRISPR gRNA sequence
tgcttgtaatcccagcactt

SEQ ID NO: 256437 - DNA, 20 bp, Artificial
  CRISPR gRNA sequence
gcttgtaatcccagcacttt

SEQ ID NO: 256438 - DNA, 20 bp, Artificial
  CRISPR gRNA sequence
ttgtaatcccagcactttgg

SEQ ID NO: 256439 - DNA, 20 bp, Artificial
  CRISPR gRNA sequence
tgtaatcccagcactttggg

SEQ ID NO: 256440 - DNA, 20 bp, Artificial
  CRISPR gRNA sequence
tcccagcactttgggaggcc

SEQ ID NO: 256441 - DNA, 20 bp, Artificial
  CRISPR gRNA sequence
cccagcactttgggaggccg

SEQ ID NO: 256442 - DNA, 20 bp, Artificial
  CRISPR gRNA sequence
agcactttgggaggccgagg

SEQ ID NO: 256443 - DNA, 20 bp, Artificial
  CRISPR gRNA sequence
gcactttgggaggccgaggt

SEQ ID NO: 256444 - DNA, 20 bp, Artificial
  CRISPR gRNA sequence
ctttgggaggccgaggtggg

SEQ ID NO: 256445 - DNA, 20 bp, Artificial
  CRISPR gRNA sequence
ccgaggtgggcagatcactt

SEQ ID NO: 256446 - DNA, 20 bp, Artificial
  CRISPR gRNA sequence
gtgggcagatcacttgagat

SEQ ID NO: 256447 - DNA, 20 bp, Artificial
  CRISPR gRNA sequence
tgggcagatcacttgagatc

SEQ ID NO: 256448 - DNA, 20 bp, Artificial
  CRISPR gRNA sequence
agatcacttgagatcaggac

SEQ ID NO: 256449 - DNA, 20 bp, Artificial
  CRISPR gRNA sequence
acttgagatcaggaccagcc

SEQ ID NO: 256450 - DNA, 20 bp, Artificial
  CRISPR gRNA sequence
agatcaggaccagcctggtc

SEQ ID NO: 256451 - DNA, 20 bp, Artificial
  CRISPR gRNA sequence
caggaccagcctggtcaaga

SEQ ID NO: 256452 - DNA, 20 bp, Artificial
  CRISPR gRNA sequence
tgtactaaaaatacaaaatt

SEQ ID NO: 256453 - DNA, 20 bp, Artificial
  CRISPR gRNA sequence
taaaaatacaaaatttagct

SEQ ID NO: 256454 - DNA, 20 bp, Artificial
  CRISPR gRNA sequence
atacaaaatttagcttggcc

SEQ ID NO: 256455 - DNA, 20 bp, Artificial
  CRISPR gRNA sequence
caaaatttagcttggcctgg

SEQ ID NO: 256456 - DNA, 20 bp, Artificial
  CRISPR gRNA sequence
aatttagcttggcctggtgg

SEQ ID NO: 256457 - DNA, 20 bp, Artificial
  CRISPR gRNA sequence
atttagcttggcctggtggc

SEQ ID NO: 256458 - DNA, 20 bp, Artificial
  CRISPR gRNA sequence
gtggcaggcacctgtaatcc

SEQ ID NO: 256459 - DNA, 20 bp, Artificial
  CRISPR gRNA sequence
acctgtaatcccagctgccc

SEQ ID NO: 256460 - DNA, 20 bp, Artificial
  CRISPR gRNA sequence
ctgtaatcccagctgcccaa

SEQ ID NO: 256461 - DNA, 20 bp, Artificial
  CRISPR gRNA sequence
tgtaatcccagctgcccaag

SEQ ID NO: 256462 - DNA, 20 bp, Artificial
  CRISPR gRNA sequence
tcccagctgcccaagaggct

SEQ ID NO: 256463 - DNA, 20 bp, Artificial
  CRISPR gRNA sequence
cccagctgcccaagaggctg

SEQ ID NO: 256464 - DNA, 20 bp, Artificial
  CRISPR gRNA sequence
tgcccaagaggctgaggcat

SEQ ID NO: 256465 - DNA, 20 bp, Artificial
  CRISPR gRNA sequence
gcatgagaatcgcttgaacc

SEQ ID NO: 256466 - DNA, 20 bp, Artificial
  CRISPR gRNA sequence
tgagaatcgcttgaacctgg

SEQ ID NO: 256467 - DNA, 20 bp, Artificial
  CRISPR gRNA sequence
gagaatcgcttgaacctggc

SEQ ID NO: 256468 - DNA, 20 bp, Artificial
  CRISPR gRNA sequence
aatcgcttgaacctggcagg

SEQ ID NO: 256469 - DNA, 20 bp, Artificial
  CRISPR gRNA sequence
tcgcttgaacctggcaggcg

SEQ ID NO: 256470 - DNA, 20 bp, Artificial
  CRISPR gRNA sequence
cgcttgaacctggcaggcgg

SEQ ID NO: 256471 - DNA, 20 bp, Artificial
  CRISPR gRNA sequence
aacctggcaggcggaggttg

SEQ ID NO: 256472 - DNA, 20 bp, Artificial
  CRISPR gRNA sequence
tggcaggcggaggttgcagt

SEQ ID NO: 256473 - DNA, 20 bp, Artificial
  CRISPR gRNA sequence
ggcggaggttgcagtgagcc

SEQ ID NO: 256474 - DNA, 20 bp, Artificial
  CRISPR gRNA sequence
gaggttgcagtgagccgaga

SEQ ID NO: 256475 - DNA, 20 bp, Artificial
  CRISPR gRNA sequence
agtgagccgagatagtgcca

SEQ ID NO: 256476 - DNA, 20 bp, Artificial
  CRISPR gRNA sequence
gagatagtgccacagctctc

SEQ ID NO: 256477 - DNA, 20 bp, Artificial
  CRISPR gRNA sequence
agtgccacagctctccagcc

SEQ ID NO: 256478 - DNA, 20 bp, Artificial
  CRISPR gRNA sequence
gtgccacagctctccagcct

SEQ ID NO: 256479 - DNA, 20 bp, Artificial
  CRISPR gRNA sequence
cagctctccagcctgggcga

SEQ ID NO: 256480 - DNA, 20 bp, Artificial
  CRISPR gRNA sequence
gctctccagcctgggcgaca

SEQ ID NO: 256481 - DNA, 20 bp, Artificial
  CRISPR gRNA sequence
tccagcctgggcgacagagt

SEQ ID NO: 256482 - DNA, 20 bp, Artificial
  CRISPR gRNA sequence
aacaaaccacaaaattattt

SEQ ID NO: 256483 - DNA, 20 bp, Artificial
  CRISPR gRNA sequence
aaaattatttgagtactgtg

SEQ ID NO: 256484 - DNA, 20 bp, Artificial
  CRISPR gRNA sequence
aaattatttgagtactgtga

SEQ ID NO: 256485 - DNA, 20 bp, Artificial
  CRISPR gRNA sequence
gtgaaggattatttgtctaa

SEQ ID NO: 256486 - DNA, 20 bp, Artificial
  CRISPR gRNA sequence
gtctaacagttcattccaat

SEQ ID NO: 256487 - DNA, 20 bp, Artificial
  CRISPR gRNA sequence
acagttcattccaatcagac

SEQ ID NO: 256488 - DNA, 20 bp, Artificial
  CRISPR gRNA sequence
cagttcattccaatcagacc

SEQ ID NO: 256489 - DNA, 20 bp, Artificial
  CRISPR gRNA sequence
ttcattccaatcagaccagg

SEQ ID NO: 256490 - DNA, 20 bp, Artificial
  CRISPR gRNA sequence
tcattccaatcagaccaggt

SEQ ID NO: 256491 - DNA, 20 bp, Artificial
  CRISPR gRNA sequence
attccaatcagaccaggtag

SEQ ID NO: 256492 - DNA, 20 bp, Artificial
  CRISPR gRNA sequence
ctttcctgtttcatatgttt

SEQ ID NO: 256493 - DNA, 20 bp, Artificial
  CRISPR gRNA sequence
tttcctgtttcatatgtttc

SEQ ID NO: 256494 - DNA, 20 bp, Artificial
  CRISPR gRNA sequence
ttcctgtttcatatgtttca

SEQ ID NO: 256495 - DNA, 20 bp, Artificial
  CRISPR gRNA sequence
tcatatgtttcagggttgca

SEQ ID NO: 256496 - DNA, 20 bp, Artificial
  CRISPR gRNA sequence
atgtttcagggttgcacagt

SEQ ID NO: 256497 - DNA, 20 bp, Artificial
  CRISPR gRNA sequence
acagttggtctctttaatgt

SEQ ID NO: 256498 - DNA, 20 bp, Artificial
  CRISPR gRNA sequence
tggtctctttaatgtcggtg

SEQ ID NO: 256499 - DNA, 20 bp, Artificial
  CRISPR gRNA sequence
gtctctttaatgtcggtgtg

SEQ ID NO: 256500 - DNA, 20 bp, Artificial
  CRISPR gRNA sequence
aatgtcggtgtggagatcca

SEQ ID NO: 256501 - DNA, 20 bp, Artificial
  CRISPR gRNA sequence
gtcggtgtggagatccaaag

SEQ ID NO: 256502 - DNA, 20 bp, Artificial
  CRISPR gRNA sequence
tcggtgtggagatccaaagt

SEQ ID NO: 256503 - DNA, 20 bp, Artificial
  CRISPR gRNA sequence
tggagatccaaagtgggttg

SEQ ID NO: 256504 - DNA, 20 bp, Artificial
  CRISPR gRNA sequence
gatccaaagtgggttgtgga

SEQ ID NO: 256505 - DNA, 20 bp, Artificial
  CRISPR gRNA sequence
tccaaagtgggttgtggaaa

SEQ ID NO: 256506 - DNA, 20 bp, Artificial
  CRISPR gRNA sequence
ggttgtggaaagagcgtcca

SEQ ID NO: 256507 - DNA, 20 bp, Artificial
  CRISPR gRNA sequence
gttgtggaaagagcgtccat

SEQ ID NO: 256508 - DNA, 20 bp, Artificial
  CRISPR gRNA sequence
tgtggaaagagcgtccatag

SEQ ID NO: 256509 - DNA, 20 bp, Artificial
  CRISPR gRNA sequence
ggaaagagcgtccataggag

SEQ ID NO: 256510 - DNA, 20 bp, Artificial
  CRISPR gRNA sequence
agagcgtccataggagaagt

SEQ ID NO: 256511 - DNA, 20 bp, Artificial
  CRISPR gRNA sequence
gaagtgagaatactgtgaaa

SEQ ID NO: 256512 - DNA, 20 bp, Artificial
  CRISPR gRNA sequence
aagtgagaatactgtgaaaa

SEQ ID NO: 256513 - DNA, 20 bp, Artificial
  CRISPR gRNA sequence
agtgagaatactgtgaaaaa

SEQ ID NO: 256514 - DNA, 20 bp, Artificial
  CRISPR gRNA sequence
atactgtgaaaaagggatgt

SEQ ID NO: 256515 - DNA, 20 bp, Artificial
  CRISPR gRNA sequence
aaagggatgttagcattcat

SEQ ID NO: 256516 - DNA, 20 bp, Artificial
  CRISPR gRNA sequence
agggatgttagcattcatta

SEQ ID NO: 256517 - DNA, 20 bp, Artificial
  CRISPR gRNA sequence
gttagcattcattagagtat

SEQ ID NO: 256518 - DNA, 20 bp, Artificial
  CRISPR gRNA sequence
ttagcattcattagagtatg

SEQ ID NO: 256519 - DNA, 20 bp, Artificial
  CRISPR gRNA sequence
attcattagagtatgaggat

SEQ ID NO: 256520 - DNA, 20 bp, Artificial
  CRISPR gRNA sequence
agagtatgaggatgagtccc

SEQ ID NO: 256521 - DNA, 20 bp, Artificial
  CRISPR gRNA sequence
gtatgaggatgagtcccaag

SEQ ID NO: 256522 - DNA, 20 bp, Artificial
  CRISPR gRNA sequence
tatgaggatgagtcccaaga

SEQ ID NO: 256523 - DNA, 20 bp, Artificial
  CRISPR gRNA sequence
tgagtcccaagaaggttctt

SEQ ID NO: 256524 - DNA, 20 bp, Artificial
  CRISPR gRNA sequence
gtcccaagaaggttctttgg

SEQ ID NO: 256525 - DNA, 20 bp, Artificial
  CRISPR gRNA sequence
tcccaagaaggttctttgga

SEQ ID NO: 256526 - DNA, 20 bp, Artificial
  CRISPR gRNA sequence
ccaagaaggttctttggaag

SEQ ID NO: 256527 - DNA, 20 bp, Artificial
  CRISPR gRNA sequence
caagaaggttctttggaagg

SEQ ID NO: 256528 - DNA, 20 bp, Artificial
  CRISPR gRNA sequence
ttctttggaaggaggacgaa

SEQ ID NO: 256529 - DNA, 20 bp, Artificial
  CRISPR gRNA sequence
tggaaggaggacgaatagaa

SEQ ID NO: 256530 - DNA, 20 bp, Artificial
  CRISPR gRNA sequence
gaaggaggacgaatagaatg

SEQ ID NO: 256531 - DNA, 20 bp, Artificial
  CRISPR gRNA sequence
tgaaattcttgccatgtgct

SEQ ID NO: 256532 - DNA, 20 bp, Artificial
  CRISPR gRNA sequence
gaaattcttgccatgtgctg

SEQ ID NO: 256533 - DNA, 20 bp, Artificial
  CRISPR gRNA sequence
aattcttgccatgtgctgag

SEQ ID NO: 256534 - DNA, 20 bp, Artificial
  CRISPR gRNA sequence
cttgccatgtgctgaggaga

SEQ ID NO: 256535 - DNA, 20 bp, Artificial
  CRISPR gRNA sequence
ccatgtgctgaggagatagc

SEQ ID NO: 256536 - DNA, 20 bp, Artificial
  CRISPR gRNA sequence
gctgaggagatagccagcat

SEQ ID NO: 256537 - DNA, 20 bp, Artificial
  CRISPR gRNA sequence
ctgaggagatagccagcatt

SEQ ID NO: 256538 - DNA, 20 bp, Artificial
  CRISPR gRNA sequence
agcattaggtgacaatcttc

SEQ ID NO: 256539 - DNA, 20 bp, Artificial
  CRISPR gRNA sequence
attaggtgacaatcttccag

SEQ ID NO: 256540 - DNA, 20 bp, Artificial
  CRISPR gRNA sequence
aggtgacaatcttccagaag

SEQ ID NO: 256541 - DNA, 20 bp, Artificial
  CRISPR gRNA sequence
gacaatcttccagaagtggt

SEQ ID NO: 256542 - DNA, 20 bp, Artificial
  CRISPR gRNA sequence
acaatcttccagaagtggtc

SEQ ID NO: 256543 - DNA, 20 bp, Artificial
  CRISPR gRNA sequence
atcttccagaagtggtcagg

SEQ ID NO: 256544 - DNA, 20 bp, Artificial
  CRISPR gRNA sequence
ttccagaagtggtcaggcag

SEQ ID NO: 256545 - DNA, 20 bp, Artificial
  CRISPR gRNA sequence
tccagaagtggtcaggcaga

SEQ ID NO: 256546 - DNA, 20 bp, Artificial
  CRISPR gRNA sequence
tggtcaggcagaaggtgccc

SEQ ID NO: 256547 - DNA, 20 bp, Artificial
  CRISPR gRNA sequence
caggcagaaggtgccctggt

SEQ ID NO: 256548 - DNA, 20 bp, Artificial
  CRISPR gRNA sequence
ggcagaaggtgccctggtga

SEQ ID NO: 256549 - DNA, 20 bp, Artificial
  CRISPR gRNA sequence
ccctggtgagagctccttta

SEQ ID NO: 256550 - DNA, 20 bp, Artificial
  CRISPR gRNA sequence
cctggtgagagctcctttac

SEQ ID NO: 256551 - DNA, 20 bp, Artificial
  CRISPR gRNA sequence
ctggtgagagctcctttaca

SEQ ID NO: 256552 - DNA, 20 bp, Artificial
  CRISPR gRNA sequence
tcctttacagggactttatg

SEQ ID NO: 256553 - DNA, 20 bp, Artificial
  CRISPR gRNA sequence
tacagggactttatgtggtt

SEQ ID NO: 256554 - DNA, 20 bp, Artificial
  CRISPR gRNA sequence
acagggactttatgtggttt

SEQ ID NO: 256555 - DNA, 20 bp, Artificial
  CRISPR gRNA sequence
cagggactttatgtggttta

SEQ ID NO: 256556 - DNA, 20 bp, Artificial
  CRISPR gRNA sequence
actttatgtggtttagggct

SEQ ID NO: 256557 - DNA, 20 bp, Artificial
  CRISPR gRNA sequence
tttatgtggtttagggctca

SEQ ID NO: 256558 - DNA, 20 bp, Artificial
  CRISPR gRNA sequence
ggctcagagctccaaaactc

SEQ ID NO: 256559 - DNA, 20 bp, Artificial
  CRISPR gRNA sequence
gctcagagctccaaaactct

SEQ ID NO: 256560 - DNA, 20 bp, Artificial
  CRISPR gRNA sequence
gagctccaaaactctgggct

SEQ ID NO: 256561 - DNA, 20 bp, Artificial
  CRISPR gRNA sequence
gctcagctgctcctgtacct

SEQ ID NO: 256562 - DNA, 20 bp, Artificial
  CRISPR gRNA sequence
tcagctgctcctgtaccttg

SEQ ID NO: 256563 - DNA, 20 bp, Artificial
  CRISPR gRNA sequence
cagctgctcctgtaccttgg

SEQ ID NO: 256564 - DNA, 20 bp, Artificial
  CRISPR gRNA sequence
accttggaggtccattcaca

SEQ ID NO: 256565 - DNA, 20 bp, Artificial
  CRISPR gRNA sequence
ccttggaggtccattcacat

SEQ ID NO: 256566 - DNA, 20 bp, Artificial
  CRISPR gRNA sequence
ggaggtccattcacatggga

SEQ ID NO: 256567 - DNA, 20 bp, Artificial
  CRISPR gRNA sequence
attcacatgggaaagtattt

SEQ ID NO: 256568 - DNA, 20 bp, Artificial
  CRISPR gRNA sequence
attttggaatgtgtcttttg

SEQ ID NO: 256569 - DNA, 20 bp, Artificial
  CRISPR gRNA sequence
tttggaatgtgtcttttgaa

SEQ ID NO: 256570 - DNA, 20 bp, Artificial
  CRISPR gRNA sequence
tggaatgtgtcttttgaaga

SEQ ID NO: 256571 - DNA, 20 bp, Artificial
  CRISPR gRNA sequence
gtgtcttttgaagagagcat

SEQ ID NO: 256572 - DNA, 20 bp, Artificial
  CRISPR gRNA sequence
gtcttttgaagagagcatca

SEQ ID NO: 256573 - DNA, 20 bp, Artificial
  CRISPR gRNA sequence
aagagagcatcagagttctt

SEQ ID NO: 256574 - DNA, 20 bp, Artificial
  CRISPR gRNA sequence
agagagcatcagagttctta

SEQ ID NO: 256575 - DNA, 20 bp, Artificial
  CRISPR gRNA sequence
gagagcatcagagttcttaa

SEQ ID NO: 256576 - DNA, 20 bp, Artificial
  CRISPR gRNA sequence
catcagagttcttaagggac

SEQ ID NO: 256577 - DNA, 20 bp, Artificial
  CRISPR gRNA sequence
atcagagttcttaagggact

SEQ ID NO: 256578 - DNA, 20 bp, Artificial
  CRISPR gRNA sequence
gagttcttaagggactgggt

SEQ ID NO: 256579 - DNA, 20 bp, Artificial
  CRISPR gRNA sequence
agttcttaagggactgggta

SEQ ID NO: 256580 - DNA, 20 bp, Artificial
  CRISPR gRNA sequence
gcctgaccctgaaatgacca

SEQ ID NO: 256581 - DNA, 20 bp, Artificial
  CRISPR gRNA sequence
catggatatttttctaccta

SEQ ID NO: 256582 - DNA, 20 bp, Artificial
  CRISPR gRNA sequence
tatttttctacctacagttt

SEQ ID NO: 256583 - DNA, 20 bp, Artificial
  CRISPR gRNA sequence
tacctacagtttgagtcaac

SEQ ID NO: 256584 - DNA, 20 bp, Artificial
  CRISPR gRNA sequence
tgagtcaactagaatatgcc

SEQ ID NO: 256585 - DNA, 20 bp, Artificial
  CRISPR gRNA sequence
gagtcaactagaatatgcct

SEQ ID NO: 256586 - DNA, 20 bp, Artificial
  CRISPR gRNA sequence
agtcaactagaatatgcctg

SEQ ID NO: 256587 - DNA, 20 bp, Artificial
  CRISPR gRNA sequence
gaatatgcctggggaccttg

SEQ ID NO: 256588 - DNA, 20 bp, Artificial
  CRISPR gRNA sequence
tgcctggggaccttgaagaa

SEQ ID NO: 256589 - DNA, 20 bp, Artificial
  CRISPR gRNA sequence
gaccttgaagaatggccctt

SEQ ID NO: 256590 - DNA, 20 bp, Artificial
  CRISPR gRNA sequence
cttgaagaatggcccttcag

SEQ ID NO: 256591 - DNA, 20 bp, Artificial
  CRISPR gRNA sequence
ctcaccatttgttcatgctt

SEQ ID NO: 256592 - DNA, 20 bp, Artificial
  CRISPR gRNA sequence
tgttcatgcttcagttaatt

SEQ ID NO: 256593 - DNA, 20 bp, Artificial
  CRISPR gRNA sequence
gttcatgcttcagttaattc

SEQ ID NO: 256594 - DNA, 20 bp, Artificial
  CRISPR gRNA sequence
ttcagttaattcaggtgttg

SEQ ID NO: 256595 - DNA, 20 bp, Artificial
  CRISPR gRNA sequence
tcagttaattcaggtgttga

SEQ ID NO: 256596 - DNA, 20 bp, Artificial
  CRISPR gRNA sequence
agttaattcaggtgttgaag

SEQ ID NO: 256597 - DNA, 20 bp, Artificial
  CRISPR gRNA sequence
attcaggtgttgaaggagct

SEQ ID NO: 256598 - DNA, 20 bp, Artificial
  CRISPR gRNA sequence
ttcaggtgttgaaggagctt

SEQ ID NO: 256599 - DNA, 20 bp, Artificial
  CRISPR gRNA sequence
tgttgaaggagcttaggttt

SEQ ID NO: 256600 - DNA, 20 bp, Artificial
  CRISPR gRNA sequence
ttgaaggagcttaggtttta

SEQ ID NO: 256601 - DNA, 20 bp, Artificial
  CRISPR gRNA sequence
tgaaggagcttaggttttag

SEQ ID NO: 256602 - DNA, 20 bp, Artificial
  CRISPR gRNA sequence
gcttaggttttagaggcacg

SEQ ID NO: 256603 - DNA, 20 bp, Artificial
  CRISPR gRNA sequence
gttttagaggcacgtagact

SEQ ID NO: 256604 - DNA, 20 bp, Artificial
  CRISPR gRNA sequence
gaggcacgtagacttggttc

SEQ ID NO: 256605 - DNA, 20 bp, Artificial
  CRISPR gRNA sequence
agacttggttcaagtctcgt

SEQ ID NO: 256606 - DNA, 20 bp, Artificial
  CRISPR gRNA sequence
cttggttcaagtctcgttag

SEQ ID NO: 256607 - DNA, 20 bp, Artificial
  CRISPR gRNA sequence
aagtctcgttagtagttgaa

SEQ ID NO: 256608 - DNA, 20 bp, Artificial
  CRISPR gRNA sequence
cgttagtagttgaatagcct

SEQ ID NO: 256609 - DNA, 20 bp, Artificial
  CRISPR gRNA sequence
gttagtagttgaatagcctc

SEQ ID NO: 256610 - DNA, 20 bp, Artificial
  CRISPR gRNA sequence
gtagttgaatagcctcaggc

SEQ ID NO: 256611 - DNA, 20 bp, Artificial
  CRISPR gRNA sequence
aggcaagtcactgcccacct

SEQ ID NO: 256612 - DNA, 20 bp, Artificial
  CRISPR gRNA sequence
tcactgcccacctaagatga

SEQ ID NO: 256613 - DNA, 20 bp, Artificial
  CRISPR gRNA sequence
atggttcttcaactataaaa

SEQ ID NO: 256614 - DNA, 20 bp, Artificial
  CRISPR gRNA sequence
ggttcttcaactataaaatg

SEQ ID NO: 256615 - DNA, 20 bp, Artificial
  CRISPR gRNA sequence
caactataaaatggagataa

SEQ ID NO: 256616 - DNA, 20 bp, Artificial
  CRISPR gRNA sequence
gttacaaatgtctcttccta

SEQ ID NO: 256617 - DNA, 20 bp, Artificial
  CRISPR gRNA sequence
tcctatagtataatctccat

SEQ ID NO: 256618 - DNA, 20 bp, Artificial
  CRISPR gRNA sequence
cctatagtataatctccata

SEQ ID NO: 256619 - DNA, 20 bp, Artificial
  CRISPR gRNA sequence
ctatagtataatctccataa

SEQ ID NO: 256620 - DNA, 20 bp, Artificial
  CRISPR gRNA sequence
gtataatctccataagggca

SEQ ID NO: 256621 - DNA, 20 bp, Artificial
  CRISPR gRNA sequence
tctccataagggcatggccc

SEQ ID NO: 256622 - DNA, 20 bp, Artificial
  CRISPR gRNA sequence
ctctgcctatccctgacatt

SEQ ID NO: 256623 - DNA, 20 bp, Artificial
  CRISPR gRNA sequence
tgcctatccctgacatttag

SEQ ID NO: 256624 - DNA, 20 bp, Artificial
  CRISPR gRNA sequence
gcatgcccgacatacaatgt

SEQ ID NO: 256625 - DNA, 20 bp, Artificial
  CRISPR gRNA sequence
cgacatacaatgttagctat

SEQ ID NO: 256626 - DNA, 20 bp, Artificial
  CRISPR gRNA sequence
ctattggtattattgccata

SEQ ID NO: 256627 - DNA, 20 bp, Artificial
  CRISPR gRNA sequence
attatgtataaaaattaaac

SEQ ID NO: 256628 - DNA, 20 bp, Artificial
  CRISPR gRNA sequence
ttatgtataaaaattaaact

SEQ ID NO: 256629 - DNA, 20 bp, Artificial
  CRISPR gRNA sequence
ataaaaattaaactgggcaa

SEQ ID NO: 256630 - DNA, 20 bp, Artificial
  CRISPR gRNA sequence
attaaactgggcaatagcct

SEQ ID NO: 256631 - DNA, 20 bp, Artificial
  CRISPR gRNA sequence
aaactgggcaatagcctaag

SEQ ID NO: 256632 - DNA, 20 bp, Artificial
  CRISPR gRNA sequence
aactgggcaatagcctaaga

SEQ ID NO: 256633 - DNA, 20 bp, Artificial
  CRISPR gRNA sequence
actgggcaatagcctaagaa

SEQ ID NO: 256634 - DNA, 20 bp, Artificial
  CRISPR gRNA sequence
ctgggcaatagcctaagaag

SEQ ID NO: 256635 - DNA, 20 bp, Artificial
  CRISPR gRNA sequence
tgggcaatagcctaagaagg

SEQ ID NO: 256636 - DNA, 20 bp, Artificial
  CRISPR gRNA sequence
gggcaatagcctaagaaggg

SEQ ID NO: 256637 - DNA, 20 bp, Artificial
  CRISPR gRNA sequence
acaaatttaaacccactacg

SEQ ID NO: 256638 - DNA, 20 bp, Artificial
  CRISPR gRNA sequence
caaatttaaacccactacgc

SEQ ID NO: 256639 - DNA, 20 bp, Artificial
  CRISPR gRNA sequence
aaatttaaacccactacgca

SEQ ID NO: 256640 - DNA, 20 bp, Artificial
  CRISPR gRNA sequence
taaacccactacgcagggat

SEQ ID NO: 256641 - DNA, 20 bp, Artificial
  CRISPR gRNA sequence
aaacccactacgcagggatg

SEQ ID NO: 256642 - DNA, 20 bp, Artificial
  CRISPR gRNA sequence
gggatgaggtgctataatat

SEQ ID NO: 256643 - DNA, 20 bp, Artificial
  CRISPR gRNA sequence
ggatgaggtgctataatatg

SEQ ID NO: 256644 - DNA, 20 bp, Artificial
  CRISPR gRNA sequence
cattttcctgtttcttgaaa

SEQ ID NO: 256645 - DNA, 20 bp, Artificial
  CRISPR gRNA sequence
tttatcttgtaatgaaatat

SEQ ID NO: 256646 - DNA, 20 bp, Artificial
  CRISPR gRNA sequence
ttatcttgtaatgaaatata

SEQ ID NO: 256647 - DNA, 20 bp, Artificial
  CRISPR gRNA sequence
gcacctcccacttttatgta

SEQ ID NO: 256648 - DNA, 20 bp, Artificial
  CRISPR gRNA sequence
ctcccacttttatgtataga

SEQ ID NO: 256649 - DNA, 20 bp, Artificial
  CRISPR gRNA sequence
cccacttttatgtatagaaa

SEQ ID NO: 256650 - DNA, 20 bp, Artificial
  CRISPR gRNA sequence
ccacttttatgtatagaaag

SEQ ID NO: 256651 - DNA, 20 bp, Artificial
  CRISPR gRNA sequence
ttttaatttttttttaatgt

SEQ ID NO: 256652 - DNA, 20 bp, Artificial
  CRISPR gRNA sequence
taatttttttttaatgtgag

SEQ ID NO: 256653 - DNA, 20 bp, Artificial
  CRISPR gRNA sequence
aatttttttttaatgtgaga

SEQ ID NO: 256654 - DNA, 20 bp, Artificial
  CRISPR gRNA sequence
ttttttttaatgtgagaagg

SEQ ID NO: 256655 - DNA, 20 bp, Artificial
  CRISPR gRNA sequence
tttttttaatgtgagaagga

SEQ ID NO: 256656 - DNA, 20 bp, Artificial
  CRISPR gRNA sequence
ttttttaatgtgagaaggaa

SEQ ID NO: 256657 - DNA, 20 bp, Artificial
  CRISPR gRNA sequence
ttttaatgtgagaaggaagg

SEQ ID NO: 256658 - DNA, 20 bp, Artificial
  CRISPR gRNA sequence
tttaatgtgagaaggaaggg

SEQ ID NO: 256659 - DNA, 20 bp, Artificial
  CRISPR gRNA sequence
taatgtgagaaggaagggag

SEQ ID NO: 256660 - DNA, 20 bp, Artificial
  CRISPR gRNA sequence
tgtgagaaggaagggaggag

SEQ ID NO: 256661 - DNA, 20 bp, Artificial
  CRISPR gRNA sequence
gtgagaaggaagggaggagt

SEQ ID NO: 256662 - DNA, 20 bp, Artificial
  CRISPR gRNA sequence
aagggaggagtaggaatctt

SEQ ID NO: 256663 - DNA, 20 bp, Artificial
  CRISPR gRNA sequence
gagtaggaatcttgagattc

SEQ ID NO: 256664 - DNA, 20 bp, Artificial
  CRISPR gRNA sequence
agatcgaaaatactgtactt

SEQ ID NO: 256665 - DNA, 20 bp, Artificial
  CRISPR gRNA sequence
ctgtactttggttgattttt

SEQ ID NO: 256666 - DNA, 20 bp, Artificial
  CRISPR gRNA sequence
tactttggttgatttttaag

SEQ ID NO: 256667 - DNA, 20 bp, Artificial
  CRISPR gRNA sequence
actttggttgatttttaagt

SEQ ID NO: 256668 - DNA, 20 bp, Artificial
  CRISPR gRNA sequence
ttaagtgggcttccattcca

SEQ ID NO: 256669 - DNA, 20 bp, Artificial
  CRISPR gRNA sequence
ttccattccatggatttaat

SEQ ID NO: 256670 - DNA, 20 bp, Artificial
  CRISPR gRNA sequence
ccatggatttaatcagtccc

SEQ ID NO: 256671 - DNA, 20 bp, Artificial
  CRISPR gRNA sequence
tggatttaatcagtcccaag

SEQ ID NO: 256672 - DNA, 20 bp, Artificial
  CRISPR gRNA sequence
agtcccaagaagatcaaact

SEQ ID NO: 256673 - DNA, 20 bp, Artificial
  CRISPR gRNA sequence
cccaagaagatcaaactcag

SEQ ID NO: 256674 - DNA, 20 bp, Artificial
  CRISPR gRNA sequence
agatcaaactcagcagtact

SEQ ID NO: 256675 - DNA, 20 bp, Artificial
  CRISPR gRNA sequence
gatcaaactcagcagtactt

SEQ ID NO: 256676 - DNA, 20 bp, Artificial
  CRISPR gRNA sequence
tcagcagtacttgggtgctg

SEQ ID NO: 256677 - DNA, 20 bp, Artificial
  CRISPR gRNA sequence
cttgggtgctgaagaactgt

SEQ ID NO: 256678 - DNA, 20 bp, Artificial
  CRISPR gRNA sequence
aagaactgttggatttaccc

SEQ ID NO: 256679 - DNA, 20 bp, Artificial
  CRISPR gRNA sequence
ctggcacgtgtgccacttgc

SEQ ID NO: 256680 - DNA, 20 bp, Artificial
  CRISPR gRNA sequence
tgtgccacttgccagcttct

SEQ ID NO: 256681 - DNA, 20 bp, Artificial
  CRISPR gRNA sequence
gtgccacttgccagcttctt

SEQ ID NO: 256682 - DNA, 20 bp, Artificial
  CRISPR gRNA sequence
ttgccagcttcttgggcaca

SEQ ID NO: 256683 - DNA, 20 bp, Artificial
  CRISPR gRNA sequence
gccagcttcttgggcacaca

SEQ ID NO: 256684 - DNA, 20 bp, Artificial
  CRISPR gRNA sequence
cacacagagttcttcaatcc

SEQ ID NO: 256685 - DNA, 20 bp, Artificial
  CRISPR gRNA sequence
agttcttcaatccaagttat

SEQ ID NO: 256686 - DNA, 20 bp, Artificial
  CRISPR gRNA sequence
cagattgtatttgaaaatga

SEQ ID NO: 256687 - DNA, 20 bp, Artificial
  CRISPR gRNA sequence
gattgtatttgaaaatgaca

SEQ ID NO: 256688 - DNA, 20 bp, Artificial
  CRISPR gRNA sequence
gtatttgaaaatgacagagc

SEQ ID NO: 256689 - DNA, 20 bp, Artificial
  CRISPR gRNA sequence
atttgaaaatgacagagctg

SEQ ID NO: 256690 - DNA, 20 bp, Artificial
  CRISPR gRNA sequence
ttgaaaatgacagagctgga

SEQ ID NO: 256691 - DNA, 20 bp, Artificial
  CRISPR gRNA sequence
agctggagagttttttgaaa

SEQ ID NO: 256692 - DNA, 20 bp, Artificial
  CRISPR gRNA sequence
tggagagttttttgaaatgg

SEQ ID NO: 256693 - DNA, 20 bp, Artificial
  CRISPR gRNA sequence
agagttttttgaaatggcag

SEQ ID NO: 256694 - DNA, 20 bp, Artificial
  CRISPR gRNA sequence
aataaatacttttttttaaa

SEQ ID NO: 256695 - DNA, 20 bp, Artificial
  CRISPR gRNA sequence
aatacttttttttaaatgga

SEQ ID NO: 256696 - DNA, 20 bp, Artificial
  CRISPR gRNA sequence
aaatggaaagacttgatcta

SEQ ID NO: 256697 - DNA, 20 bp, Artificial
  CRISPR gRNA sequence
aaatgattttgttttctgac

SEQ ID NO: 256698 - DNA, 20 bp, Artificial
  CRISPR gRNA sequence
ttgttttctgactggaaaaa

SEQ ID NO: 256699 - DNA, 20 bp, Artificial
  CRISPR gRNA sequence
tgttttctgactggaaaaat

SEQ ID NO: 256700 - DNA, 20 bp, Artificial
  CRISPR gRNA sequence
ctggaaaaataggcctacta

SEQ ID NO: 256701 - DNA, 20 bp, Artificial
  CRISPR gRNA sequence
actaaagatgaatcacactt

SEQ ID NO: 256702 - DNA, 20 bp, Artificial
  CRISPR gRNA sequence
tgtttcttactcactctgca

SEQ ID NO: 256703 - DNA, 20 bp, Artificial
  CRISPR gRNA sequence
actcactctgcacagaaaca

SEQ ID NO: 256704 - DNA, 20 bp, Artificial
  CRISPR gRNA sequence
cactctgcacagaaacaaag

SEQ ID NO: 256705 - DNA, 20 bp, Artificial
  CRISPR gRNA sequence
aacaaagaagaaatgttata

SEQ ID NO: 256706 - DNA, 20 bp, Artificial
  CRISPR gRNA sequence
acaaagaagaaatgttatac

SEQ ID NO: 256707 - DNA, 20 bp, Artificial
  CRISPR gRNA sequence
caaagaagaaatgttataca

SEQ ID NO: 256708 - DNA, 20 bp, Artificial
  CRISPR gRNA sequence
agaagaaatgttatacaggg

SEQ ID NO: 256709 - DNA, 20 bp, Artificial
  CRISPR gRNA sequence
gggaagtccgttttcactat

SEQ ID NO: 256710 - DNA, 20 bp, Artificial
  CRISPR gRNA sequence
tttcactattagtatgaacc

SEQ ID NO: 256711 - DNA, 20 bp, Artificial
  CRISPR gRNA sequence
tattagtatgaaccaagaaa

SEQ ID NO: 256712 - DNA, 20 bp, Artificial
  CRISPR gRNA sequence
accaagaaatggttcaaaaa

SEQ ID NO: 256713 - DNA, 20 bp, Artificial
  CRISPR gRNA sequence
aagaaatggttcaaaaacag

SEQ ID NO: 256714 - DNA, 20 bp, Artificial
  CRISPR gRNA sequence
aaatggttcaaaaacagtgg

SEQ ID NO: 256715 - DNA, 20 bp, Artificial
  CRISPR gRNA sequence
aatggttcaaaaacagtggt

SEQ ID NO: 256716 - DNA, 20 bp, Artificial
  CRISPR gRNA sequence
tggttcaaaaacagtggtag

SEQ ID NO: 256717 - DNA, 20 bp, Artificial
  CRISPR gRNA sequence
tggtaggagcaatgctttca

SEQ ID NO: 256718 - DNA, 20 bp, Artificial
  CRISPR gRNA sequence
gagcaatgctttcatagttt

SEQ ID NO: 256719 - DNA, 20 bp, Artificial
  CRISPR gRNA sequence
tgctttcatagtttcagata

SEQ ID NO: 256720 - DNA, 20 bp, Artificial
  CRISPR gRNA sequence
tttcatagtttcagatatgg

SEQ ID NO: 256721 - DNA, 20 bp, Artificial
  CRISPR gRNA sequence
tttcagatatggtagttatg

SEQ ID NO: 256722 - DNA, 20 bp, Artificial
  CRISPR gRNA sequence
tcatttgctgctattattgt

SEQ ID NO: 256723 - DNA, 20 bp, Artificial
  CRISPR gRNA sequence
atttgctgctattattgtaa

SEQ ID NO: 256724 - DNA, 20 bp, Artificial
  CRISPR gRNA sequence
tgtaagagtcttataattaa

SEQ ID NO: 256725 - DNA, 20 bp, Artificial
  CRISPR gRNA sequence
ctcctataatttttgattgt

SEQ ID NO: 256726 - DNA, 20 bp, Artificial
  CRISPR gRNA sequence
tgattgtgagctcacctatt

SEQ ID NO: 256727 - DNA, 20 bp, Artificial
  CRISPR gRNA sequence
gattgtgagctcacctattt

SEQ ID NO: 256728 - DNA, 20 bp, Artificial
  CRISPR gRNA sequence
tgagctcacctatttgggtt

SEQ ID NO: 256729 - DNA, 20 bp, Artificial
  CRISPR gRNA sequence
gggttaagcatgccaattta

SEQ ID NO: 256730 - DNA, 20 bp, Artificial
  CRISPR gRNA sequence
gttaagcatgccaatttaaa

SEQ ID NO: 256731 - DNA, 20 bp, Artificial
  CRISPR gRNA sequence
catgccaatttaaagagacc

SEQ ID NO: 256732 - DNA, 20 bp, Artificial
  CRISPR gRNA sequence
tacattatgttctacatatt

SEQ ID NO: 256733 - DNA, 20 bp, Artificial
  CRISPR gRNA sequence
tgtactttaatattgtcttt

SEQ ID NO: 256734 - DNA, 20 bp, Artificial
  CRISPR gRNA sequence
taatattgtcttttggtatt

SEQ ID NO: 256735 - DNA, 20 bp, Artificial
  CRISPR gRNA sequence
attgtcttttggtattaaga

SEQ ID NO: 256736 - DNA, 20 bp, Artificial
  CRISPR gRNA sequence
tattaagaaagatatgcttt

SEQ ID NO: 256737 - DNA, 20 bp, Artificial
  CRISPR gRNA sequence
agaaagatatgctttcagaa

SEQ ID NO: 256738 - DNA, 20 bp, Artificial
  CRISPR gRNA sequence
agaatagatatgcttcgctt

SEQ ID NO: 256739 - DNA, 20 bp, Artificial
  CRISPR gRNA sequence
tagatatgcttcgctttggc

SEQ ID NO: 256740 - DNA, 20 bp, Artificial
  CRISPR gRNA sequence
agatatgcttcgctttggca

SEQ ID NO: 256741 - DNA, 20 bp, Artificial
  CRISPR gRNA sequence
cttcgctttggcaaggaatt

SEQ ID NO: 256742 - DNA, 20 bp, Artificial
  CRISPR gRNA sequence
gctttggcaaggaatttgga

SEQ ID NO: 256743 - DNA, 20 bp, Artificial
  CRISPR gRNA sequence
ggatagaacttgctatttaa

SEQ ID NO: 256744 - DNA, 20 bp, Artificial
  CRISPR gRNA sequence
atagaacttgctatttaaaa

SEQ ID NO: 256745 - DNA, 20 bp, Artificial
  CRISPR gRNA sequence
tagaacttgctatttaaaag

SEQ ID NO: 256746 - DNA, 20 bp, Artificial
  CRISPR gRNA sequence
cttgctatttaaaagaggtg

SEQ ID NO: 256747 - DNA, 20 bp, Artificial
  CRISPR gRNA sequence
ttgctatttaaaagaggtgt

SEQ ID NO: 256748 - DNA, 20 bp, Artificial
  CRISPR gRNA sequence
tgctatttaaaagaggtgtg

SEQ ID NO: 256749 - DNA, 20 bp, Artificial
  CRISPR gRNA sequence
taaatccttgtataaatctc

SEQ ID NO: 256750 - DNA, 20 bp, Artificial
  CRISPR gRNA sequence
ccttgtataaatctccagtt

SEQ ID NO: 256751 - DNA, 20 bp, Artificial
  CRISPR gRNA sequence
cagtttagccttttttgaaa

SEQ ID NO: 256752 - DNA, 20 bp, Artificial
  CRISPR gRNA sequence
ttagccttttttgaaaaagc

SEQ ID NO: 256753 - DNA, 20 bp, Artificial
  CRISPR gRNA sequence
tcaaatactaatttcacttc

SEQ ID NO: 256754 - DNA, 20 bp, Artificial
  CRISPR gRNA sequence
aatactaatttcacttcaag

SEQ ID NO: 256755 - DNA, 20 bp, Artificial
  CRISPR gRNA sequence
atactaatttcacttcaagc

SEQ ID NO: 256756 - DNA, 20 bp, Artificial
  CRISPR gRNA sequence
tactaatttcacttcaagca

SEQ ID NO: 256757 - DNA, 20 bp, Artificial
  CRISPR gRNA sequence
cttcaagcagggtacgtttc

SEQ ID NO: 256758 - DNA, 20 bp, Artificial
  CRISPR gRNA sequence
ctggtttgtttgcttgactt

SEQ ID NO: 256759 - DNA, 20 bp, Artificial
  CRISPR gRNA sequence
cttcagtcacaatttcttat

SEQ ID NO: 256760 - DNA, 20 bp, Artificial
  CRISPR gRNA sequence
acaatttcttatcagaccaa

SEQ ID NO: 256761 - DNA, 20 bp, Artificial
  CRISPR gRNA sequence
gaccaatggctgacctcttt

SEQ ID NO: 256762 - DNA, 20 bp, Artificial
  CRISPR gRNA sequence
ggctgacctctttgagatgt

SEQ ID NO: 256763 - DNA, 20 bp, Artificial
  CRISPR gRNA sequence
gctgacctctttgagatgtc

SEQ ID NO: 256764 - DNA, 20 bp, Artificial
  CRISPR gRNA sequence
acctctttgagatgtcaggc

SEQ ID NO: 256765 - DNA, 20 bp, Artificial
  CRISPR gRNA sequence
cctctttgagatgtcaggct

SEQ ID NO: 256766 - DNA, 20 bp, Artificial
  CRISPR gRNA sequence
ttctgtgtcatgtgaatgct

SEQ ID NO: 256767 - DNA, 20 bp, Artificial
  CRISPR gRNA sequence
tgtgtcatgtgaatgctgag

SEQ ID NO: 256768 - DNA, 20 bp, Artificial
  CRISPR gRNA sequence
gtgaatgctgagaagtttga

SEQ ID NO: 256769 - DNA, 20 bp, Artificial
  CRISPR gRNA sequence
gaatgctgagaagtttgaca

SEQ ID NO: 256770 - DNA, 20 bp, Artificial
  CRISPR gRNA sequence
gtttgacagagatccaactt

SEQ ID NO: 256771 - DNA, 20 bp, Artificial
  CRISPR gRNA sequence
aacttcagccttgaccccat

SEQ ID NO: 256772 - DNA, 20 bp, Artificial
  CRISPR gRNA sequence
ccttgaccccatcagtccct

SEQ ID NO: 256773 - DNA, 20 bp, Artificial
  CRISPR gRNA sequence
cttgaccccatcagtccctc

SEQ ID NO: 256774 - DNA, 20 bp, Artificial
  CRISPR gRNA sequence
gtccctcgggttaactaact

SEQ ID NO: 256775 - DNA, 20 bp, Artificial
  CRISPR gRNA sequence
gggttaactaactgagccac

SEQ ID NO: 256776 - DNA, 20 bp, Artificial
  CRISPR gRNA sequence
aactgagccaccggtcctca

SEQ ID NO: 256777 - DNA, 20 bp, Artificial
  CRISPR gRNA sequence
gtcctcatggctattttaat

SEQ ID NO: 256778 - DNA, 20 bp, Artificial
  CRISPR gRNA sequence
tcctcatggctattttaatg

SEQ ID NO: 256779 - DNA, 20 bp, Artificial
  CRISPR gRNA sequence
cctcatggctattttaatga

SEQ ID NO: 256780 - DNA, 20 bp, Artificial
  CRISPR gRNA sequence
tattttaatgagggtattga

SEQ ID NO: 256781 - DNA, 20 bp, Artificial
  CRISPR gRNA sequence
gcatgtctgatcccttatcc

SEQ ID NO: 256782 - DNA, 20 bp, Artificial
  CRISPR gRNA sequence
atcccagccatttgcactgc

SEQ ID NO: 256783 - DNA, 20 bp, Artificial
  CRISPR gRNA sequence
cagccatttgcactgccagc

SEQ ID NO: 256784 - DNA, 20 bp, Artificial
  CRISPR gRNA sequence
agccatttgcactgccagct

SEQ ID NO: 256785 - DNA, 20 bp, Artificial
  CRISPR gRNA sequence
ctgccagctgggaactatac

SEQ ID NO: 256786 - DNA, 20 bp, Artificial
  CRISPR gRNA sequence
gctgggaactataccagacc

SEQ ID NO: 256787 - DNA, 20 bp, Artificial
  CRISPR gRNA sequence
agacctggatactgatccca

SEQ ID NO: 256788 - DNA, 20 bp, Artificial
  CRISPR gRNA sequence
tgttaaattcaactacatgc

SEQ ID NO: 256789 - DNA, 20 bp, Artificial
  CRISPR gRNA sequence
ttaaattcaactacatgctg

SEQ ID NO: 256790 - DNA, 20 bp, Artificial
  CRISPR gRNA sequence
ttcaactacatgctggagat

SEQ ID NO: 256791 - DNA, 20 bp, Artificial
  CRISPR gRNA sequence
caactacatgctggagatta

SEQ ID NO: 256792 - DNA, 20 bp, Artificial
  CRISPR gRNA sequence
tacatgctggagattagaga

SEQ ID NO: 256793 - DNA, 20 bp, Artificial
  CRISPR gRNA sequence
gattagagatggtgccaata

SEQ ID NO: 256794 - DNA, 20 bp, Artificial
  CRISPR gRNA sequence
attagagatggtgccaataa

SEQ ID NO: 256795 - DNA, 20 bp, Artificial
  CRISPR gRNA sequence
gatggtgccaataaaggacc

SEQ ID NO: 256796 - DNA, 20 bp, Artificial
  CRISPR gRNA sequence
gccaataaaggacccagaac

SEQ ID NO: 256797 - DNA, 20 bp, Artificial
  CRISPR gRNA sequence
ccaataaaggacccagaacc

SEQ ID NO: 256798 - DNA, 20 bp, Artificial
  CRISPR gRNA sequence
aaccaggatcttgattgcta

SEQ ID NO: 256799 - DNA, 20 bp, Artificial
  CRISPR gRNA sequence
ctatagacttattaataatc

SEQ ID NO: 256800 - DNA, 20 bp, Artificial
  CRISPR gRNA sequence
tatagacttattaataatcc

SEQ ID NO: 256801 - DNA, 20 bp, Artificial
  CRISPR gRNA sequence
cttattaataatccaggtca

SEQ ID NO: 256802 - DNA, 20 bp, Artificial
  CRISPR gRNA sequence
tattaataatccaggtcaaa

SEQ ID NO: 256803 - DNA, 20 bp, Artificial
  CRISPR gRNA sequence
ttaataatccaggtcaaaga

SEQ ID NO: 256804 - DNA, 20 bp, Artificial
  CRISPR gRNA sequence
agagtgacacacactctctc

SEQ ID NO: 256805 - DNA, 20 bp, Artificial
  CRISPR gRNA sequence
acacacactctctcaagacc

SEQ ID NO: 256806 - DNA, 20 bp, Artificial
  CRISPR gRNA sequence
cacacactctctcaagacct

SEQ ID NO: 256807 - DNA, 20 bp, Artificial
  CRISPR gRNA sequence
acacactctctcaagacctg

SEQ ID NO: 256808 - DNA, 20 bp, Artificial
  CRISPR gRNA sequence
actctctcaagacctggggt

SEQ ID NO: 256809 - DNA, 20 bp, Artificial
  CRISPR gRNA sequence
ctctctcaagacctggggtg

SEQ ID NO: 256810 - DNA, 20 bp, Artificial
  CRISPR gRNA sequence
tctctcaagacctggggtga

SEQ ID NO: 256811 - DNA, 20 bp, Artificial
  CRISPR gRNA sequence
tctcaagacctggggtgagg

SEQ ID NO: 256812 - DNA, 20 bp, Artificial
  CRISPR gRNA sequence
agggagtctgtgttatctgc

SEQ ID NO: 256813 - DNA, 20 bp, Artificial
  CRISPR gRNA sequence
gggagtctgtgttatctgca

SEQ ID NO: 256814 - DNA, 20 bp, Artificial
  CRISPR gRNA sequence
tgttatctgcaaggccattt

SEQ ID NO: 256815 - DNA, 20 bp, Artificial
  CRISPR gRNA sequence
gttatctgcaaggccatttg

SEQ ID NO: 256816 - DNA, 20 bp, Artificial
  CRISPR gRNA sequence
ctgcaaggccatttgaggct

SEQ ID NO: 256817 - DNA, 20 bp, Artificial
  CRISPR gRNA sequence
aaggccatttgaggctcaga

SEQ ID NO: 256818 - DNA, 20 bp, Artificial
  CRISPR gRNA sequence
cagaaagtctctctttccta

SEQ ID NO: 256819 - DNA, 20 bp, Artificial
  CRISPR gRNA sequence
tatgcatactttctgacata

SEQ ID NO: 256820 - DNA, 20 bp, Artificial
  CRISPR gRNA sequence
atgcatactttctgacatat

SEQ ID NO: 256821 - DNA, 20 bp, Artificial
  CRISPR gRNA sequence
tctgacatataggaatgtat

SEQ ID NO: 256822 - DNA, 20 bp, Artificial
  CRISPR gRNA sequence
ctgacatataggaatgtatc

SEQ ID NO: 256823 - DNA, 20 bp, Artificial
  CRISPR gRNA sequence
tcaggaatactcaaccatca

SEQ ID NO: 256824 - DNA, 20 bp, Artificial
  CRISPR gRNA sequence
caggaatactcaaccatcac

SEQ ID NO: 256825 - DNA, 20 bp, Artificial
  CRISPR gRNA sequence
tcacaggcatgttcctacct

SEQ ID NO: 256826 - DNA, 20 bp, Artificial
  CRISPR gRNA sequence
cacaggcatgttcctacctc

SEQ ID NO: 256827 - DNA, 20 bp, Artificial
  CRISPR gRNA sequence
acaggcatgttcctacctca

SEQ ID NO: 256828 - DNA, 20 bp, Artificial
  CRISPR gRNA sequence
catgtcctgtttactctgtc

SEQ ID NO: 256829 - DNA, 20 bp, Artificial
  CRISPR gRNA sequence
ctgtctagaatgtccttctg

SEQ ID NO: 256830 - DNA, 20 bp, Artificial
  CRISPR gRNA sequence
atgtccttctgtagatgacc

SEQ ID NO: 256831 - DNA, 20 bp, Artificial
  CRISPR gRNA sequence
tggcttgcctcgtcaccctt

SEQ ID NO: 256832 - DNA, 20 bp, Artificial
  CRISPR gRNA sequence
ggcttgcctcgtcacccttc

SEQ ID NO: 256833 - DNA, 20 bp, Artificial
  CRISPR gRNA sequence
cacccttcaggtccttgctc

SEQ ID NO: 256834 - DNA, 20 bp, Artificial
  CRISPR gRNA sequence
tcaagtgtcatcttctcccc

SEQ ID NO: 256835 - DNA, 20 bp, Artificial
  CRISPR gRNA sequence
tccttgcttatttttctcca

SEQ ID NO: 256836 - DNA, 20 bp, Artificial
  CRISPR gRNA sequence
cattttaccatctcttacat

SEQ ID NO: 256837 - DNA, 20 bp, Artificial
  CRISPR gRNA sequence
acatttttcttatttatttg

SEQ ID NO: 256838 - DNA, 20 bp, Artificial
  CRISPR gRNA sequence
cttatttatttgtagtttat

SEQ ID NO: 256839 - DNA, 20 bp, Artificial
  CRISPR gRNA sequence
ttgtagtttataagcttcat

SEQ ID NO: 256840 - DNA, 20 bp, Artificial
  CRISPR gRNA sequence
tgtagtttataagcttcatg

SEQ ID NO: 256841 - DNA, 20 bp, Artificial
  CRISPR gRNA sequence
gtttataagcttcatgaggc

SEQ ID NO: 256842 - DNA, 20 bp, Artificial
  CRISPR gRNA sequence
tttgtttcttgctgtatctc

SEQ ID NO: 256843 - DNA, 20 bp, Artificial
  CRISPR gRNA sequence
cttgctgtatctccagtgcc

SEQ ID NO: 256844 - DNA, 20 bp, Artificial
  CRISPR gRNA sequence
tgctgtatctccagtgccca

SEQ ID NO: 256845 - DNA, 20 bp, Artificial
  CRISPR gRNA sequence
tgtatctccagtgcccagag

SEQ ID NO: 256846 - DNA, 20 bp, Artificial
  CRISPR gRNA sequence
ccagtgcccagagcagtgcc

SEQ ID NO: 256847 - DNA, 20 bp, Artificial
  CRISPR gRNA sequence
ataataaatatttattgact

SEQ ID NO: 256848 - DNA, 20 bp, Artificial
  CRISPR gRNA sequence
tatttattgactgagtgaat

SEQ ID NO: 256849 - DNA, 20 bp, Artificial
  CRISPR gRNA sequence
ctgagtgaatgagttttaca

SEQ ID NO: 256850 - DNA, 20 bp, Artificial
  CRISPR gRNA sequence
tacatggccttatgaattaa

SEQ ID NO: 256851 - DNA, 20 bp, Artificial
  CRISPR gRNA sequence
tggccttatgaattaacggt

SEQ ID NO: 256852 - DNA, 20 bp, Artificial
  CRISPR gRNA sequence
aaatgttataatcatacttt

SEQ ID NO: 256853 - DNA, 20 bp, Artificial
  CRISPR gRNA sequence
atgttataatcatactttga

SEQ ID NO: 256854 - DNA, 20 bp, Artificial
  CRISPR gRNA sequence
tgttataatcatactttgag

SEQ ID NO: 256855 - DNA, 20 bp, Artificial
  CRISPR gRNA sequence
gttataatcatactttgaga

SEQ ID NO: 256856 - DNA, 20 bp, Artificial
  CRISPR gRNA sequence
tataatcatactttgagagg

SEQ ID NO: 256857 - DNA, 20 bp, Artificial
  CRISPR gRNA sequence
atcatactttgagagggaga

SEQ ID NO: 256858 - DNA, 20 bp, Artificial
  CRISPR gRNA sequence
tactttgagagggagaaagc

SEQ ID NO: 256859 - DNA, 20 bp, Artificial
  CRISPR gRNA sequence
ctattttctactttcctctt

SEQ ID NO: 256860 - DNA, 20 bp, Artificial
  CRISPR gRNA sequence
cttaagaggaaagtagaaaa

SEQ ID NO: 256861 - DNA, 20 bp, Artificial
  CRISPR gRNA sequence
aggaaagtagaaaatagaac

SEQ ID NO: 256862 - DNA, 20 bp, Artificial
  CRISPR gRNA sequence
aactggctttctccctctca

SEQ ID NO: 256863 - DNA, 20 bp, Artificial
  CRISPR gRNA sequence
caaagtatgattataacatt

SEQ ID NO: 256864 - DNA, 20 bp, Artificial
  CRISPR gRNA sequence
tagactcaccgttaattcat

SEQ ID NO: 256865 - DNA, 20 bp, Artificial
  CRISPR gRNA sequence
agactcaccgttaattcata

SEQ ID NO: 256866 - DNA, 20 bp, Artificial
  CRISPR gRNA sequence
ccatgtaaaactcattcact

SEQ ID NO: 256867 - DNA, 20 bp, Artificial
  CRISPR gRNA sequence
aataaatatttattatatac

SEQ ID NO: 256868 - DNA, 20 bp, Artificial
  CRISPR gRNA sequence
ataaatatttattatatacc

SEQ ID NO: 256869 - DNA, 20 bp, Artificial
  CRISPR gRNA sequence
ttatataccaggcactgctc

SEQ ID NO: 256870 - DNA, 20 bp, Artificial
  CRISPR gRNA sequence
tatataccaggcactgctct

SEQ ID NO: 256871 - DNA, 20 bp, Artificial
  CRISPR gRNA sequence
ccaggcactgctctgggcac

SEQ ID NO: 256872 - DNA, 20 bp, Artificial
  CRISPR gRNA sequence
aggcactgctctgggcactg

SEQ ID NO: 256873 - DNA, 20 bp, Artificial
  CRISPR gRNA sequence
tgctctgggcactggagata

SEQ ID NO: 256874 - DNA, 20 bp, Artificial
  CRISPR gRNA sequence
ctgggcactggagatacagc

SEQ ID NO: 256875 - DNA, 20 bp, Artificial
  CRISPR gRNA sequence
tggagatacagcaagaaaca

SEQ ID NO: 256876 - DNA, 20 bp, Artificial
  CRISPR gRNA sequence
atacagcaagaaacaaagca

SEQ ID NO: 256877 - DNA, 20 bp, Artificial
  CRISPR gRNA sequence
gcaaagttacttgcctcatg

SEQ ID NO: 256878 - DNA, 20 bp, Artificial
  CRISPR gRNA sequence
cttataaactacaaataaat

SEQ ID NO: 256879 - DNA, 20 bp, Artificial
  CRISPR gRNA sequence
ataagaaaaatgtctaatgt

SEQ ID NO: 256880 - DNA, 20 bp, Artificial
  CRISPR gRNA sequence
aagaaaaatgtctaatgtaa

SEQ ID NO: 256881 - DNA, 20 bp, Artificial
  CRISPR gRNA sequence
aaaatgtctaatgtaagaga

SEQ ID NO: 256882 - DNA, 20 bp, Artificial
  CRISPR gRNA sequence
taagagatggtaaaatgcta

SEQ ID NO: 256883 - DNA, 20 bp, Artificial
  CRISPR gRNA sequence
agagatggtaaaatgctatg

SEQ ID NO: 256884 - DNA, 20 bp, Artificial
  CRISPR gRNA sequence
aaaatgctatggagaaaaat

SEQ ID NO: 256885 - DNA, 20 bp, Artificial
  CRISPR gRNA sequence
tgctatggagaaaaataagc

SEQ ID NO: 256886 - DNA, 20 bp, Artificial
  CRISPR gRNA sequence
gctatggagaaaaataagca

SEQ ID NO: 256887 - DNA, 20 bp, Artificial
  CRISPR gRNA sequence
tggagaaaaataagcaagga

SEQ ID NO: 256888 - DNA, 20 bp, Artificial
  CRISPR gRNA sequence
agaaaaataagcaaggaaag

SEQ ID NO: 256889 - DNA, 20 bp, Artificial
  CRISPR gRNA sequence
aaataagcaaggaaagcaga

SEQ ID NO: 256890 - DNA, 20 bp, Artificial
  CRISPR gRNA sequence
aataagcaaggaaagcagac

SEQ ID NO: 256891 - DNA, 20 bp, Artificial
  CRISPR gRNA sequence
ataagcaaggaaagcagaca

SEQ ID NO: 256892 - DNA, 20 bp, Artificial
  CRISPR gRNA sequence
caaggaaagcagacagggtg

SEQ ID NO: 256893 - DNA, 20 bp, Artificial
  CRISPR gRNA sequence
aaggaaagcagacagggtgt

SEQ ID NO: 256894 - DNA, 20 bp, Artificial
  CRISPR gRNA sequence
aggaaagcagacagggtgtg

SEQ ID NO: 256895 - DNA, 20 bp, Artificial
  CRISPR gRNA sequence
aaagcagacagggtgtgggg

SEQ ID NO: 256896 - DNA, 20 bp, Artificial
  CRISPR gRNA sequence
agggtgtggggtagtttaac

SEQ ID NO: 256897 - DNA, 20 bp, Artificial
  CRISPR gRNA sequence
gggtgtggggtagtttaact

SEQ ID NO: 256898 - DNA, 20 bp, Artificial
  CRISPR gRNA sequence
ggtgtggggtagtttaacta

SEQ ID NO: 256899 - DNA, 20 bp, Artificial
  CRISPR gRNA sequence
gtgtggggtagtttaactag

SEQ ID NO: 256900 - DNA, 20 bp, Artificial
  CRISPR gRNA sequence
gtggggtagtttaactaggg

SEQ ID NO: 256901 - DNA, 20 bp, Artificial
  CRISPR gRNA sequence
gggtagtttaactaggggag

SEQ ID NO: 256902 - DNA, 20 bp, Artificial
  CRISPR gRNA sequence
taggggagaagatgacactt

SEQ ID NO: 256903 - DNA, 20 bp, Artificial
  CRISPR gRNA sequence
ggagaagatgacacttgagc

SEQ ID NO: 256904 - DNA, 20 bp, Artificial
  CRISPR gRNA sequence
gagaagatgacacttgagca

SEQ ID NO: 256905 - DNA, 20 bp, Artificial
  CRISPR gRNA sequence
gacacttgagcaaggacctg

SEQ ID NO: 256906 - DNA, 20 bp, Artificial
  CRISPR gRNA sequence
acacttgagcaaggacctga

SEQ ID NO: 256907 - DNA, 20 bp, Artificial
  CRISPR gRNA sequence
cacttgagcaaggacctgaa

SEQ ID NO: 256908 - DNA, 20 bp, Artificial
  CRISPR gRNA sequence
gcaaggacctgaagggtgac

SEQ ID NO: 256909 - DNA, 20 bp, Artificial
  CRISPR gRNA sequence
caaggacctgaagggtgacg

SEQ ID NO: 256910 - DNA, 20 bp, Artificial
  CRISPR gRNA sequence
gacctgaagggtgacgaggc

SEQ ID NO: 256911 - DNA, 20 bp, Artificial
  CRISPR gRNA sequence
tgaagggtgacgaggcaagc

SEQ ID NO: 256912 - DNA, 20 bp, Artificial
  CRISPR gRNA sequence
gaagggtgacgaggcaagcc

SEQ ID NO: 256913 - DNA, 20 bp, Artificial
  CRISPR gRNA sequence
gaggcaagccaggtcatcta

SEQ ID NO: 256914 - DNA, 20 bp, Artificial
  CRISPR gRNA sequence
gcaagccaggtcatctacag

SEQ ID NO: 256915 - DNA, 20 bp, Artificial
  CRISPR gRNA sequence
caagccaggtcatctacaga

SEQ ID NO: 256916 - DNA, 20 bp, Artificial
  CRISPR gRNA sequence
tcatctacagaaggacattc

SEQ ID NO: 256917 - DNA, 20 bp, Artificial
  CRISPR gRNA sequence
ctacagaaggacattctaga

SEQ ID NO: 256918 - DNA, 20 bp, Artificial
  CRISPR gRNA sequence
acagaaggacattctagaca

SEQ ID NO: 256919 - DNA, 20 bp, Artificial
  CRISPR gRNA sequence
gacattctagacagagtaaa

SEQ ID NO: 256920 - DNA, 20 bp, Artificial
  CRISPR gRNA sequence
acattctagacagagtaaac

SEQ ID NO: 256921 - DNA, 20 bp, Artificial
  CRISPR gRNA sequence
cagagtaaacaggacatgta

SEQ ID NO: 256922 - DNA, 20 bp, Artificial
  CRISPR gRNA sequence
agagtaaacaggacatgtaa

SEQ ID NO: 256923 - DNA, 20 bp, Artificial
  CRISPR gRNA sequence
acaggacatgtaaaggccct

SEQ ID NO: 256924 - DNA, 20 bp, Artificial
  CRISPR gRNA sequence
caggacatgtaaaggccctg

SEQ ID NO: 256925 - DNA, 20 bp, Artificial
  CRISPR gRNA sequence
gacatgtaaaggccctgagg

SEQ ID NO: 256926 - DNA, 20 bp, Artificial
  CRISPR gRNA sequence
acatgtaaaggccctgaggt

SEQ ID NO: 256927 - DNA, 20 bp, Artificial
  CRISPR gRNA sequence
aggtaggaacatgcctgtga

SEQ ID NO: 256928 - DNA, 20 bp, Artificial
  CRISPR gRNA sequence
ggaacatgcctgtgatggtt

SEQ ID NO: 256929 - DNA, 20 bp, Artificial
  CRISPR gRNA sequence
cctgatacattcctatatgt

SEQ ID NO: 256930 - DNA, 20 bp, Artificial
  CRISPR gRNA sequence
atacattcctatatgtcaga

SEQ ID NO: 256931 - DNA, 20 bp, Artificial
  CRISPR gRNA sequence
agaaagtatgcatatatcta

SEQ ID NO: 256932 - DNA, 20 bp, Artificial
  CRISPR gRNA sequence
gaaagtatgcatatatctat

SEQ ID NO: 256933 - DNA, 20 bp, Artificial
  CRISPR gRNA sequence
gtatgcatatatctatagga

SEQ ID NO: 256934 - DNA, 20 bp, Artificial
  CRISPR gRNA sequence
atgcatatatctataggaaa

SEQ ID NO: 256935 - DNA, 20 bp, Artificial
  CRISPR gRNA sequence
gcatatatctataggaaaga

SEQ ID NO: 256936 - DNA, 20 bp, Artificial
  CRISPR gRNA sequence
ataggaaagagagactttct

SEQ ID NO: 256937 - DNA, 20 bp, Artificial
  CRISPR gRNA sequence
gagactttctgagcctcaaa

SEQ ID NO: 256938 - DNA, 20 bp, Artificial
  CRISPR gRNA sequence
ctgagcctcaaatggccttg

SEQ ID NO: 256939 - DNA, 20 bp, Artificial
  CRISPR gRNA sequence
aaatggccttgcagataaca

SEQ ID NO: 256940 - DNA, 20 bp, Artificial
  CRISPR gRNA sequence
taacacagactccctcaccc

SEQ ID NO: 256941 - DNA, 20 bp, Artificial
  CRISPR gRNA sequence
aacacagactccctcacccc

SEQ ID NO: 256942 - DNA, 20 bp, Artificial
  CRISPR gRNA sequence
actccctcaccccaggtctt

SEQ ID NO: 256943 - DNA, 20 bp, Artificial
  CRISPR gRNA sequence
tccctcaccccaggtcttga

SEQ ID NO: 256944 - DNA, 20 bp, Artificial
  CRISPR gRNA sequence
cctcaccccaggtcttgaga

SEQ ID NO: 256945 - DNA, 20 bp, Artificial
  CRISPR gRNA sequence
gtgtgtcactctctttgacc

SEQ ID NO: 256946 - DNA, 20 bp, Artificial
  CRISPR gRNA sequence
ctttgacctggattattaat

SEQ ID NO: 256947 - DNA, 20 bp, Artificial
  CRISPR gRNA sequence
ctggattattaataagtcta

SEQ ID NO: 256948 - DNA, 20 bp, Artificial
  CRISPR gRNA sequence
ttaataagtctatagcaatc

SEQ ID NO: 256949 - DNA, 20 bp, Artificial
  CRISPR gRNA sequence
gtctatagcaatcaagatcc

SEQ ID NO: 256950 - DNA, 20 bp, Artificial
  CRISPR gRNA sequence
agcaatcaagatcctggttc

SEQ ID NO: 256951 - DNA, 20 bp, Artificial
  CRISPR gRNA sequence
gcaatcaagatcctggttct

SEQ ID NO: 256952 - DNA, 20 bp, Artificial
  CRISPR gRNA sequence
cctggttctgggtcctttat

SEQ ID NO: 256953 - DNA, 20 bp, Artificial
  CRISPR gRNA sequence
ttggcaccatctctaatctc

SEQ ID NO: 256954 - DNA, 20 bp, Artificial
  CRISPR gRNA sequence
catctctaatctccagcatg

SEQ ID NO: 256955 - DNA, 20 bp, Artificial
  CRISPR gRNA sequence
tgtagttgaatttaacactt

SEQ ID NO: 256956 - DNA, 20 bp, Artificial
  CRISPR gRNA sequence
gtagttgaatttaacacttt

SEQ ID NO: 256957 - DNA, 20 bp, Artificial
  CRISPR gRNA sequence
tgaatttaacactttgggat

SEQ ID NO: 256958 - DNA, 20 bp, Artificial
  CRISPR gRNA sequence
aacactttgggatcagtatc

SEQ ID NO: 256959 - DNA, 20 bp, Artificial
  CRISPR gRNA sequence
acactttgggatcagtatcc

SEQ ID NO: 256960 - DNA, 20 bp, Artificial
  CRISPR gRNA sequence
ttgggatcagtatccaggtc

SEQ ID NO: 256961 - DNA, 20 bp, Artificial
  CRISPR gRNA sequence
atcagtatccaggtctggta

SEQ ID NO: 256962 - DNA, 20 bp, Artificial
  CRISPR gRNA sequence
tccaggtctggtatagttcc

SEQ ID NO: 256963 - DNA, 20 bp, Artificial
  CRISPR gRNA sequence
ggtctggtatagttcccagc

SEQ ID NO: 256964 - DNA, 20 bp, Artificial
  CRISPR gRNA sequence
ctggtatagttcccagctgg

SEQ ID NO: 256965 - DNA, 20 bp, Artificial
  CRISPR gRNA sequence
ttcccagctggcagtgcaaa

SEQ ID NO: 256966 - DNA, 20 bp, Artificial
  CRISPR gRNA sequence
cagctggcagtgcaaatggc

SEQ ID NO: 256967 - DNA, 20 bp, Artificial
  CRISPR gRNA sequence
agctggcagtgcaaatggct

SEQ ID NO: 256968 - DNA, 20 bp, Artificial
  CRISPR gRNA sequence
gcagtgcaaatggctgggat

SEQ ID NO: 256969 - DNA, 20 bp, Artificial
  CRISPR gRNA sequence
cagtgcaaatggctgggata

SEQ ID NO: 256970 - DNA, 20 bp, Artificial
  CRISPR gRNA sequence
agtgcaaatggctgggataa

SEQ ID NO: 256971 - DNA, 20 bp, Artificial
  CRISPR gRNA sequence
aaatggctgggataagggat

SEQ ID NO: 256972 - DNA, 20 bp, Artificial
  CRISPR gRNA sequence
catcaataccctcattaaaa

SEQ ID NO: 256973 - DNA, 20 bp, Artificial
  CRISPR gRNA sequence
accctcattaaaatagccat

SEQ ID NO: 256974 - DNA, 20 bp, Artificial
  CRISPR gRNA sequence
ccctcattaaaatagccatg

SEQ ID NO: 256975 - DNA, 20 bp, Artificial
  CRISPR gRNA sequence
attaaaatagccatgaggac

SEQ ID NO: 256976 - DNA, 20 bp, Artificial
  CRISPR gRNA sequence
aaaatagccatgaggaccgg

SEQ ID NO: 256977 - DNA, 20 bp, Artificial
  CRISPR gRNA sequence
agccatgaggaccggtggct

SEQ ID NO: 256978 - DNA, 20 bp, Artificial
  CRISPR gRNA sequence
atgaggaccggtggctcagt

SEQ ID NO: 256979 - DNA, 20 bp, Artificial
  CRISPR gRNA sequence
gtggctcagttagttaaccc

SEQ ID NO: 256980 - DNA, 20 bp, Artificial
  CRISPR gRNA sequence
tggctcagttagttaacccg

SEQ ID NO: 256981 - DNA, 20 bp, Artificial
  CRISPR gRNA sequence
ggctcagttagttaacccga

SEQ ID NO: 256982 - DNA, 20 bp, Artificial
  CRISPR gRNA sequence
tagttaacccgagggactga

SEQ ID NO: 256983 - DNA, 20 bp, Artificial
  CRISPR gRNA sequence
agttaacccgagggactgat

SEQ ID NO: 256984 - DNA, 20 bp, Artificial
  CRISPR gRNA sequence
gttaacccgagggactgatg

SEQ ID NO: 256985 - DNA, 20 bp, Artificial
  CRISPR gRNA sequence
cccgagggactgatggggtc

SEQ ID NO: 256986 - DNA, 20 bp, Artificial
  CRISPR gRNA sequence
ccgagggactgatggggtca

SEQ ID NO: 256987 - DNA, 20 bp, Artificial
  CRISPR gRNA sequence
gactgatggggtcaaggctg

SEQ ID NO: 256988 - DNA, 20 bp, Artificial
  CRISPR gRNA sequence
gatggggtcaaggctgaagt

SEQ ID NO: 256989 - DNA, 20 bp, Artificial
  CRISPR gRNA sequence
tggatctctgtcaaacttct

SEQ ID NO: 256990 - DNA, 20 bp, Artificial
  CRISPR gRNA sequence
ttctcagcattcacatgaca

SEQ ID NO: 256991 - DNA, 20 bp, Artificial
  CRISPR gRNA sequence
ttcacatgacacagaacaca

SEQ ID NO: 256992 - DNA, 20 bp, Artificial
  CRISPR gRNA sequence
tcacatgacacagaacacat

SEQ ID NO: 256993 - DNA, 20 bp, Artificial
  CRISPR gRNA sequence
atgacacagaacacataggt

SEQ ID NO: 256994 - DNA, 20 bp, Artificial
  CRISPR gRNA sequence
acagaacacataggtaagcc

SEQ ID NO: 256995 - DNA, 20 bp, Artificial
  CRISPR gRNA sequence
aagcctagcctgacatctca

SEQ ID NO: 256996 - DNA, 20 bp, Artificial
  CRISPR gRNA sequence
gcctagcctgacatctcaaa

SEQ ID NO: 256997 - DNA, 20 bp, Artificial
  CRISPR gRNA sequence
cctagcctgacatctcaaag

SEQ ID NO: 256998 - DNA, 20 bp, Artificial
  CRISPR gRNA sequence
gcctgacatctcaaagaggt

SEQ ID NO: 256999 - DNA, 20 bp, Artificial
  CRISPR gRNA sequence
atctcaaagaggtcagccat

SEQ ID NO: 257000 - DNA, 20 bp, Artificial
  CRISPR gRNA sequence
aggtcagccattggtctgat

SEQ ID NO: 257001 - DNA, 20 bp, Artificial
  CRISPR gRNA sequence
ctgataagaaattgtgactg

SEQ ID NO: 257002 - DNA, 20 bp, Artificial
  CRISPR gRNA sequence
aagaaattgtgactgaagtc

SEQ ID NO: 257003 - DNA, 20 bp, Artificial
  CRISPR gRNA sequence
ctgaagtcaagcaaacaaac

SEQ ID NO: 257004 - DNA, 20 bp, Artificial
  CRISPR gRNA sequence
ccagaaacgtaccctgcttg

SEQ ID NO: 257005 - DNA, 20 bp, Artificial
  CRISPR gRNA sequence
taccctgcttgaagtgaaat

SEQ ID NO: 257006 - DNA, 20 bp, Artificial
  CRISPR gRNA sequence
gaagtgaaattagtatttga

SEQ ID NO: 257007 - DNA, 20 bp, Artificial
  CRISPR gRNA sequence
gaaattagtatttgaaagtc

SEQ ID NO: 257008 - DNA, 20 bp, Artificial
  CRISPR gRNA sequence
aaagtctagctttttcaaaa

SEQ ID NO: 257009 - DNA, 20 bp, Artificial
  CRISPR gRNA sequence
aagtctagctttttcaaaaa

SEQ ID NO: 257010 - DNA, 20 bp, Artificial
  CRISPR gRNA sequence
tttttcaaaaaaggctaaac

SEQ ID NO: 257011 - DNA, 20 bp, Artificial
  CRISPR gRNA sequence
tttcaaaaaaggctaaactg

SEQ ID NO: 257012 - DNA, 20 bp, Artificial
  CRISPR gRNA sequence
gctaaactggagatttatac

SEQ ID NO: 257013 - DNA, 20 bp, Artificial
  CRISPR gRNA sequence
ctaaactggagatttataca

SEQ ID NO: 257014 - DNA, 20 bp, Artificial
  CRISPR gRNA sequence
taccccacacctcttttaaa

SEQ ID NO: 257015 - DNA, 20 bp, Artificial
  CRISPR gRNA sequence
ccacacctcttttaaatagc

SEQ ID NO: 257016 - DNA, 20 bp, Artificial
  CRISPR gRNA sequence
tctatccaaattccttgcca

SEQ ID NO: 257017 - DNA, 20 bp, Artificial
  CRISPR gRNA sequence
ccaaattccttgccaaagcg

SEQ ID NO: 257018 - DNA, 20 bp, Artificial
  CRISPR gRNA sequence
gcgaagcatatctattctga

SEQ ID NO: 257019 - DNA, 20 bp, Artificial
  CRISPR gRNA sequence
catatctttcttaataccaa

SEQ ID NO: 257020 - DNA, 20 bp, Artificial
  CRISPR gRNA sequence
aataccaaaagacaatatta

SEQ ID NO: 257021 - DNA, 20 bp, Artificial
  CRISPR gRNA sequence
aatattaaagtacaaattta

SEQ ID NO: 257022 - DNA, 20 bp, Artificial
  CRISPR gRNA sequence
attaaagtacaaatttaaag

SEQ ID NO: 257023 - DNA, 20 bp, Artificial
  CRISPR gRNA sequence
acaaatttaaagcagacata

SEQ ID NO: 257024 - DNA, 20 bp, Artificial
  CRISPR gRNA sequence
aatttaaagcagacatatag

SEQ ID NO: 257025 - DNA, 20 bp, Artificial
  CRISPR gRNA sequence
aaagcagacatatagtagtt

SEQ ID NO: 257026 - DNA, 20 bp, Artificial
  CRISPR gRNA sequence
taattttatcactgaatatg

SEQ ID NO: 257027 - DNA, 20 bp, Artificial
  CRISPR gRNA sequence
gaacataatgtacatacact

SEQ ID NO: 257028 - DNA, 20 bp, Artificial
  CRISPR gRNA sequence
tacacttggtctctttaaat

SEQ ID NO: 257029 - DNA, 20 bp, Artificial
  CRISPR gRNA sequence
attggcatgcttaacccaaa

SEQ ID NO: 257030 - DNA, 20 bp, Artificial
  CRISPR gRNA sequence
ttggcatgcttaacccaaat

SEQ ID NO: 257031 - DNA, 20 bp, Artificial
  CRISPR gRNA sequence
catgcttaacccaaataggt

SEQ ID NO: 257032 - DNA, 20 bp, Artificial
  CRISPR gRNA sequence
gagctcacaatcaaaaatta

SEQ ID NO: 257033 - DNA, 20 bp, Artificial
  CRISPR gRNA sequence
agctcacaatcaaaaattat

SEQ ID NO: 257034 - DNA, 20 bp, Artificial
  CRISPR gRNA sequence
ctcacaatcaaaaattatag

SEQ ID NO: 257035 - DNA, 20 bp, Artificial
  CRISPR gRNA sequence
ataggagtaccattaattat

SEQ ID NO: 257036 - DNA, 20 bp, Artificial
  CRISPR gRNA sequence
ttataagactcttacaataa

SEQ ID NO: 257037 - DNA, 20 bp, Artificial
  CRISPR gRNA sequence
taagactcttacaataatag

SEQ ID NO: 257038 - DNA, 20 bp, Artificial
  CRISPR gRNA sequence
taccatatctgaaactatga

SEQ ID NO: 257039 - DNA, 20 bp, Artificial
  CRISPR gRNA sequence
actgtttttgaaccatttct

SEQ ID NO: 257040 - DNA, 20 bp, Artificial
  CRISPR gRNA sequence
catttcttggttcatactaa

SEQ ID NO: 257041 - DNA, 20 bp, Artificial
  CRISPR gRNA sequence
gttcatactaatagtgaaaa

SEQ ID NO: 257042 - DNA, 20 bp, Artificial
  CRISPR gRNA sequence
atttcttctttgtttctgtg

SEQ ID NO: 257043 - DNA, 20 bp, Artificial
  CRISPR gRNA sequence
ttcttctttgtttctgtgca

SEQ ID NO: 257044 - DNA, 20 bp, Artificial
  CRISPR gRNA sequence
tctttgtttctgtgcagagt

SEQ ID NO: 257045 - DNA, 20 bp, Artificial
  CRISPR gRNA sequence
tgtttctgtgcagagtgagt

SEQ ID NO: 257046 - DNA, 20 bp, Artificial
  CRISPR gRNA sequence
gagtgagtaagaaacatctc

SEQ ID NO: 257047 - DNA, 20 bp, Artificial
  CRISPR gRNA sequence
tctcaagtgtgattcatctt

SEQ ID NO: 257048 - DNA, 20 bp, Artificial
  CRISPR gRNA sequence
caagtgtgattcatctttag

SEQ ID NO: 257049 - DNA, 20 bp, Artificial
  CRISPR gRNA sequence
aagtgtgattcatctttagt

SEQ ID NO: 257050 - DNA, 20 bp, Artificial
  CRISPR gRNA sequence
ctttagtaggcctatttttc

SEQ ID NO: 257051 - DNA, 20 bp, Artificial
  CRISPR gRNA sequence
agtaggcctatttttccagt

SEQ ID NO: 257052 - DNA, 20 bp, Artificial
  CRISPR gRNA sequence
aacaaaatcatttattacca

SEQ ID NO: 257053 - DNA, 20 bp, Artificial
  CRISPR gRNA sequence
atcatttattaccatagatc

SEQ ID NO: 257054 - DNA, 20 bp, Artificial
  CRISPR gRNA sequence
aagtctttccatttaaaaaa

SEQ ID NO: 257055 - DNA, 20 bp, Artificial
  CRISPR gRNA sequence
tgccatttcaaaaaactctc

SEQ ID NO: 257056 - DNA, 20 bp, Artificial
  CRISPR gRNA sequence
tcaaatacaatctgataact

SEQ ID NO: 257057 - DNA, 20 bp, Artificial
  CRISPR gRNA sequence
caatctgataacttggattg

SEQ ID NO: 257058 - DNA, 20 bp, Artificial
  CRISPR gRNA sequence
ttgaagaactctgtgtgccc

SEQ ID NO: 257059 - DNA, 20 bp, Artificial
  CRISPR gRNA sequence
aagaactctgtgtgcccaag

SEQ ID NO: 257060 - DNA, 20 bp, Artificial
  CRISPR gRNA sequence
actctgtgtgcccaagaagc

SEQ ID NO: 257061 - DNA, 20 bp, Artificial
  CRISPR gRNA sequence
tgtgtgcccaagaagctggc

SEQ ID NO: 257062 - DNA, 20 bp, Artificial
  CRISPR gRNA sequence
gtgcccaagaagctggcaag

SEQ ID NO: 257063 - DNA, 20 bp, Artificial
  CRISPR gRNA sequence
ctggcaagtggcacacgtgc

SEQ ID NO: 257064 - DNA, 20 bp, Artificial
  CRISPR gRNA sequence
tggcaagtggcacacgtgcc

SEQ ID NO: 257065 - DNA, 20 bp, Artificial
  CRISPR gRNA sequence
ggcaagtggcacacgtgcca

SEQ ID NO: 257066 - DNA, 20 bp, Artificial
  CRISPR gRNA sequence
acgtgccagggtaaatccaa

SEQ ID NO: 257067 - DNA, 20 bp, Artificial
  CRISPR gRNA sequence
gggtaaatccaacagttctt

SEQ ID NO: 257068 - DNA, 20 bp, Artificial
  CRISPR gRNA sequence
ccaacagttcttcagcaccc

SEQ ID NO: 257069 - DNA, 20 bp, Artificial
  CRISPR gRNA sequence
ttcagcacccaagtactgct

SEQ ID NO: 257070 - DNA, 20 bp, Artificial
  CRISPR gRNA sequence
actgctgagtttgatcttct

SEQ ID NO: 257071 - DNA, 20 bp, Artificial
  CRISPR gRNA sequence
ctgctgagtttgatcttctt

SEQ ID NO: 257072 - DNA, 20 bp, Artificial
  CRISPR gRNA sequence
cttgggactgattaaatcca

SEQ ID NO: 257073 - DNA, 20 bp, Artificial
  CRISPR gRNA sequence
gactgattaaatccatggaa

SEQ ID NO: 257074 - DNA, 20 bp, Artificial
  CRISPR gRNA sequence
tgattaaatccatggaatgg

SEQ ID NO: 257075 - DNA, 20 bp, Artificial
  CRISPR gRNA sequence
gcccacttaaaaatcaacca

SEQ ID NO: 257076 - DNA, 20 bp, Artificial
  CRISPR gRNA sequence
cttaaaaatcaaccaaagta

SEQ ID NO: 257077 - DNA, 20 bp, Artificial
  CRISPR gRNA sequence
aaagtacagtattttcgatc

SEQ ID NO: 257078 - DNA, 20 bp, Artificial
  CRISPR gRNA sequence
tattttcgatctggaatctc

SEQ ID NO: 257079 - DNA, 20 bp, Artificial
  CRISPR gRNA sequence
tcacattaaaaaaaaattaa

SEQ ID NO: 257080 - DNA, 20 bp, Artificial
  CRISPR gRNA sequence
agacctctttctatacataa

SEQ ID NO: 257081 - DNA, 20 bp, Artificial
  CRISPR gRNA sequence
cctctttctatacataaaag

SEQ ID NO: 257082 - DNA, 20 bp, Artificial
  CRISPR gRNA sequence
ctctttctatacataaaagt

SEQ ID NO: 257083 - DNA, 20 bp, Artificial
  CRISPR gRNA sequence
ctttctatacataaaagtgg

SEQ ID NO: 257084 - DNA, 20 bp, Artificial
  CRISPR gRNA sequence
tttctatacataaaagtggg

SEQ ID NO: 257085 - DNA, 20 bp, Artificial
  CRISPR gRNA sequence
ggtgccttatatttcattac

SEQ ID NO: 257086 - DNA, 20 bp, Artificial
  CRISPR gRNA sequence
attacaagataaactatttc

SEQ ID NO: 257087 - DNA, 20 bp, Artificial
  CRISPR gRNA sequence
agataaactatttcaagaaa

SEQ ID NO: 257088 - DNA, 20 bp, Artificial
  CRISPR gRNA sequence
gataaactatttcaagaaac

SEQ ID NO: 257089 - DNA, 20 bp, Artificial
  CRISPR gRNA sequence
ttcaagaaacaggaaaatga

SEQ ID NO: 257090 - DNA, 20 bp, Artificial
  CRISPR gRNA sequence
aagaaacaggaaaatgatgg

SEQ ID NO: 257091 - DNA, 20 bp, Artificial
  CRISPR gRNA sequence
aggaaaatgatggaagttaa

SEQ ID NO: 257092 - DNA, 20 bp, Artificial
  CRISPR gRNA sequence
ggaaaatgatggaagttaaa

SEQ ID NO: 257093 - DNA, 20 bp, Artificial
  CRISPR gRNA sequence
gttaaaaggtcctcatatta

SEQ ID NO: 257094 - DNA, 20 bp, Artificial
  CRISPR gRNA sequence
tatagcacctcatccctgcg

SEQ ID NO: 257095 - DNA, 20 bp, Artificial
  CRISPR gRNA sequence
agcacctcatccctgcgtag

SEQ ID NO: 257096 - DNA, 20 bp, Artificial
  CRISPR gRNA sequence
gcacctcatccctgcgtagt

SEQ ID NO: 257097 - DNA, 20 bp, Artificial
  CRISPR gRNA sequence
ttacaatattccccccttct

SEQ ID NO: 257098 - DNA, 20 bp, Artificial
  CRISPR gRNA sequence
tacaatattccccccttctt

SEQ ID NO: 257099 - DNA, 20 bp, Artificial
  CRISPR gRNA sequence
ccccttcttaggctattgcc

SEQ ID NO: 257100 - DNA, 20 bp, Artificial
  CRISPR gRNA sequence
ttatacataatttatctata

SEQ ID NO: 257101 - DNA, 20 bp, Artificial
  CRISPR gRNA sequence
ctatatggcaataataccaa

SEQ ID NO: 257102 - DNA, 20 bp, Artificial
  CRISPR gRNA sequence
caatagctaacattgtatgt

SEQ ID NO: 257103 - DNA, 20 bp, Artificial
  CRISPR gRNA sequence
aatagctaacattgtatgtc

SEQ ID NO: 257104 - DNA, 20 bp, Artificial
  CRISPR gRNA sequence
tcgggcatgctactaaatgt

SEQ ID NO: 257105 - DNA, 20 bp, Artificial
  CRISPR gRNA sequence
cgggcatgctactaaatgtc

SEQ ID NO: 257106 - DNA, 20 bp, Artificial
  CRISPR gRNA sequence
gggcatgctactaaatgtca

SEQ ID NO: 257107 - DNA, 20 bp, Artificial
  CRISPR gRNA sequence
atgctactaaatgtcaggga

SEQ ID NO: 257108 - DNA, 20 bp, Artificial
  CRISPR gRNA sequence
tgctactaaatgtcagggat

SEQ ID NO: 257109 - DNA, 20 bp, Artificial
  CRISPR gRNA sequence
tactaaatgtcagggatagg

SEQ ID NO: 257110 - DNA, 20 bp, Artificial
  CRISPR gRNA sequence
ctaaatgtcagggataggca

SEQ ID NO: 257111 - DNA, 20 bp, Artificial
  CRISPR gRNA sequence
gtcagggataggcagagtca

SEQ ID NO: 257112 - DNA, 20 bp, Artificial
  CRISPR gRNA sequence
gggataggcagagtcaaaga

SEQ ID NO: 257113 - DNA, 20 bp, Artificial
  CRISPR gRNA sequence
ggcagagtcaaagacagact

SEQ ID NO: 257114 - DNA, 20 bp, Artificial
  CRISPR gRNA sequence
gcagagtcaaagacagactt

SEQ ID NO: 257115 - DNA, 20 bp, Artificial
  CRISPR gRNA sequence
agacttgggccatgccctta

SEQ ID NO: 257116 - DNA, 20 bp, Artificial
  CRISPR gRNA sequence
acttgggccatgcccttatg

SEQ ID NO: 257117 - DNA, 20 bp, Artificial
  CRISPR gRNA sequence
cccttatggagattatacta

SEQ ID NO: 257118 - DNA, 20 bp, Artificial
  CRISPR gRNA sequence
ccttatggagattatactat

SEQ ID NO: 257119 - DNA, 20 bp, Artificial
  CRISPR gRNA sequence
tatggagattatactatagg

SEQ ID NO: 257120 - DNA, 20 bp, Artificial
  CRISPR gRNA sequence
tggagattatactataggaa

SEQ ID NO: 257121 - DNA, 20 bp, Artificial
  CRISPR gRNA sequence
taaccattatctccatttta

SEQ ID NO: 257122 - DNA, 20 bp, Artificial
  CRISPR gRNA sequence
ttatctccattttatagttg

SEQ ID NO: 257123 - DNA, 20 bp, Artificial
  CRISPR gRNA sequence
tagttgaagaaccatcatct

SEQ ID NO: 257124 - DNA, 20 bp, Artificial
  CRISPR gRNA sequence
agttgaagaaccatcatctt

SEQ ID NO: 257125 - DNA, 20 bp, Artificial
  CRISPR gRNA sequence
tgaagaaccatcatcttagg

SEQ ID NO: 257126 - DNA, 20 bp, Artificial
  CRISPR gRNA sequence
gaagaaccatcatcttaggt

SEQ ID NO: 257127 - DNA, 20 bp, Artificial
  CRISPR gRNA sequence
gaaccatcatcttaggtggg

SEQ ID NO: 257128 - DNA, 20 bp, Artificial
  CRISPR gRNA sequence
aggtgggcagtgacttgcct

SEQ ID NO: 257129 - DNA, 20 bp, Artificial
  CRISPR gRNA sequence
ggtgggcagtgacttgcctg

SEQ ID NO: 257130 - DNA, 20 bp, Artificial
  CRISPR gRNA sequence
gaggctattcaactactaac

SEQ ID NO: 257131 - DNA, 20 bp, Artificial
  CRISPR gRNA sequence
ctactaacgagacttgaacc

SEQ ID NO: 257132 - DNA, 20 bp, Artificial
  CRISPR gRNA sequence
tctacgtgcctctaaaacct

SEQ ID NO: 257133 - DNA, 20 bp, Artificial
  CRISPR gRNA sequence
ttcaacacctgaattaactg

SEQ ID NO: 257134 - DNA, 20 bp, Artificial
  CRISPR gRNA sequence
ttaactgaagcatgaacaaa

SEQ ID NO: 257135 - DNA, 20 bp, Artificial
  CRISPR gRNA sequence
ctgaagcatgaacaaatggt

SEQ ID NO: 257136 - DNA, 20 bp, Artificial
  CRISPR gRNA sequence
tgaagcatgaacaaatggtg

SEQ ID NO: 257137 - DNA, 20 bp, Artificial
  CRISPR gRNA sequence
gaagcatgaacaaatggtga

SEQ ID NO: 257138 - DNA, 20 bp, Artificial
  CRISPR gRNA sequence
acaaatggtgagggccactg

SEQ ID NO: 257139 - DNA, 20 bp, Artificial
  CRISPR gRNA sequence
caaatggtgagggccactga

SEQ ID NO: 257140 - DNA, 20 bp, Artificial
  CRISPR gRNA sequence
aaatggtgagggccactgaa

SEQ ID NO: 257141 - DNA, 20 bp, Artificial
  CRISPR gRNA sequence
ccactgaagggccattcttc

SEQ ID NO: 257142 - DNA, 20 bp, Artificial
  CRISPR gRNA sequence
cactgaagggccattcttca

SEQ ID NO: 257143 - DNA, 20 bp, Artificial
  CRISPR gRNA sequence
gggccattcttcaaggtccc

SEQ ID NO: 257144 - DNA, 20 bp, Artificial
  CRISPR gRNA sequence
ggccattcttcaaggtcccc

SEQ ID NO: 257145 - DNA, 20 bp, Artificial
  CRISPR gRNA sequence
caaggtccccaggcatattc

SEQ ID NO: 257146 - DNA, 20 bp, Artificial
  CRISPR gRNA sequence
attctagttgactcaaactg

SEQ ID NO: 257147 - DNA, 20 bp, Artificial
  CRISPR gRNA sequence
ttctagttgactcaaactgt

SEQ ID NO: 257148 - DNA, 20 bp, Artificial
  CRISPR gRNA sequence
tagttgactcaaactgtagg

SEQ ID NO: 257149 - DNA, 20 bp, Artificial
  CRISPR gRNA sequence
tgtaggtagaaaaatatcca

SEQ ID NO: 257150 - DNA, 20 bp, Artificial
  CRISPR gRNA sequence
aaaaatatccatggtcattt

SEQ ID NO: 257151 - DNA, 20 bp, Artificial
  CRISPR gRNA sequence
aaaatatccatggtcatttc

SEQ ID NO: 257152 - DNA, 20 bp, Artificial
  CRISPR gRNA sequence
aaatatccatggtcatttca

SEQ ID NO: 257153 - DNA, 20 bp, Artificial
  CRISPR gRNA sequence
atccatggtcatttcagggt

SEQ ID NO: 257154 - DNA, 20 bp, Artificial
  CRISPR gRNA sequence
tccatggtcatttcagggtc

SEQ ID NO: 257155 - DNA, 20 bp, Artificial
  CRISPR gRNA sequence
tttcagggtcaggccttacc

SEQ ID NO: 257156 - DNA, 20 bp, Artificial
  CRISPR gRNA sequence
caggccttacccagtccctt

SEQ ID NO: 257157 - DNA, 20 bp, Artificial
  CRISPR gRNA sequence
aactctgatgctctcttcaa

SEQ ID NO: 257158 - DNA, 20 bp, Artificial
  CRISPR gRNA sequence
aaaatactttcccatgtgaa

SEQ ID NO: 257159 - DNA, 20 bp, Artificial
  CRISPR gRNA sequence
tcccatgtgaatggacctcc

SEQ ID NO: 257160 - DNA, 20 bp, Artificial
  CRISPR gRNA sequence
cccatgtgaatggacctcca

SEQ ID NO: 257161 - DNA, 20 bp, Artificial
  CRISPR gRNA sequence
gtgaatggacctccaaggta

SEQ ID NO: 257162 - DNA, 20 bp, Artificial
  CRISPR gRNA sequence
tgaatggacctccaaggtac

SEQ ID NO: 257163 - DNA, 20 bp, Artificial
  CRISPR gRNA sequence
aatggacctccaaggtacag

SEQ ID NO: 257164 - DNA, 20 bp, Artificial
  CRISPR gRNA sequence
ggacctccaaggtacaggag

SEQ ID NO: 257165 - DNA, 20 bp, Artificial
  CRISPR gRNA sequence
tccaaggtacaggagcagct

SEQ ID NO: 257166 - DNA, 20 bp, Artificial
  CRISPR gRNA sequence
ggtacaggagcagctgagcc

SEQ ID NO: 257167 - DNA, 20 bp, Artificial
  CRISPR gRNA sequence
tacaggagcagctgagccca

SEQ ID NO: 257168 - DNA, 20 bp, Artificial
  CRISPR gRNA sequence
agcagctgagcccagagttt

SEQ ID NO: 257169 - DNA, 20 bp, Artificial
  CRISPR gRNA sequence
cagctgagcccagagttttg

SEQ ID NO: 257170 - DNA, 20 bp, Artificial
  CRISPR gRNA sequence
gcccagagttttggagctct

SEQ ID NO: 257171 - DNA, 20 bp, Artificial
  CRISPR gRNA sequence
tctgagccctaaaccacata

SEQ ID NO: 257172 - DNA, 20 bp, Artificial
  CRISPR gRNA sequence
aaccacataaagtccctgta

SEQ ID NO: 257173 - DNA, 20 bp, Artificial
  CRISPR gRNA sequence
accacataaagtccctgtaa

SEQ ID NO: 257174 - DNA, 20 bp, Artificial
  CRISPR gRNA sequence
cacataaagtccctgtaaag

SEQ ID NO: 257175 - DNA, 20 bp, Artificial
  CRISPR gRNA sequence
ccctgtaaaggagctctcac

SEQ ID NO: 257176 - DNA, 20 bp, Artificial
  CRISPR gRNA sequence
cctgtaaaggagctctcacc

SEQ ID NO: 257177 - DNA, 20 bp, Artificial
  CRISPR gRNA sequence
ctgtaaaggagctctcacca

SEQ ID NO: 257178 - DNA, 20 bp, Artificial
  CRISPR gRNA sequence
accttctgcctgaccacttc

SEQ ID NO: 257179 - DNA, 20 bp, Artificial
  CRISPR gRNA sequence
ttctgcctgaccacttctgg

SEQ ID NO: 257180 - DNA, 20 bp, Artificial
  CRISPR gRNA sequence
ggaagattgtcacctaatgc

SEQ ID NO: 257181 - DNA, 20 bp, Artificial
  CRISPR gRNA sequence
cctaatgctggctatctcct

SEQ ID NO: 257182 - DNA, 20 bp, Artificial
  CRISPR gRNA sequence
ctggctatctcctcagcaca

SEQ ID NO: 257183 - DNA, 20 bp, Artificial
  CRISPR gRNA sequence
ctatctcctcagcacatggc

SEQ ID NO: 257184 - DNA, 20 bp, Artificial
  CRISPR gRNA sequence
ttctattcgtcctccttcca

SEQ ID NO: 257185 - DNA, 20 bp, Artificial
  CRISPR gRNA sequence
ctccttccaaagaaccttct

SEQ ID NO: 257186 - DNA, 20 bp, Artificial
  CRISPR gRNA sequence
tccttccaaagaaccttctt

SEQ ID NO: 257187 - DNA, 20 bp, Artificial
  CRISPR gRNA sequence
atgctaacatccctttttca

SEQ ID NO: 257188 - DNA, 20 bp, Artificial
  CRISPR gRNA sequence
cagtattctcacttctccta

SEQ ID NO: 257189 - DNA, 20 bp, Artificial
  CRISPR gRNA sequence
gctctttccacaacccactt

SEQ ID NO: 257190 - DNA, 20 bp, Artificial
  CRISPR gRNA sequence
ggatctccacaccgacatta

SEQ ID NO: 257191 - DNA, 20 bp, Artificial
  CRISPR gRNA sequence
atctccacaccgacattaaa

SEQ ID NO: 257192 - DNA, 20 bp, Artificial
  CRISPR gRNA sequence
caaccctgaaacatatgaaa

SEQ ID NO: 257193 - DNA, 20 bp, Artificial
  CRISPR gRNA sequence
aaccctgaaacatatgaaac

SEQ ID NO: 257194 - DNA, 20 bp, Artificial
  CRISPR gRNA sequence
ctgaaacatatgaaacagga

SEQ ID NO: 257195 - DNA, 20 bp, Artificial
  CRISPR gRNA sequence
gaaacaggaaagctcctacc

SEQ ID NO: 257196 - DNA, 20 bp, Artificial
  CRISPR gRNA sequence
aagctcctacctggtctgat

SEQ ID NO: 257197 - DNA, 20 bp, Artificial
  CRISPR gRNA sequence
gtctgattggaatgaactgt

SEQ ID NO: 257198 - DNA, 20 bp, Artificial
  CRISPR gRNA sequence
gttagacaaataatccttca

SEQ ID NO: 257199 - DNA, 20 bp, Artificial
  CRISPR gRNA sequence
acagtactcaaataattttg

SEQ ID NO: 257200 - DNA, 20 bp, Artificial
  CRISPR gRNA sequence
tgttgttgttgttgttgttt

SEQ ID NO: 257201 - DNA, 20 bp, Artificial
  CRISPR gRNA sequence
gttgttgttgttgtttgaga

SEQ ID NO: 257202 - DNA, 20 bp, Artificial
  CRISPR gRNA sequence
tgttgttgttgtttgagatg

SEQ ID NO: 257203 - DNA, 20 bp, Artificial
  CRISPR gRNA sequence
tggagtctcactctgtcgcc

SEQ ID NO: 257204 - DNA, 20 bp, Artificial
  CRISPR gRNA sequence
ggagtctcactctgtcgccc

SEQ ID NO: 257205 - DNA, 20 bp, Artificial
  CRISPR gRNA sequence
tctcactctgtcgcccaggc

SEQ ID NO: 257206 - DNA, 20 bp, Artificial
  CRISPR gRNA sequence
tcactctgtcgcccaggctg

SEQ ID NO: 257207 - DNA, 20 bp, Artificial
  CRISPR gRNA sequence
actctgtcgcccaggctgga

SEQ ID NO: 257208 - DNA, 20 bp, Artificial
  CRISPR gRNA sequence
tcgcccaggctggagagctg

SEQ ID NO: 257209 - DNA, 20 bp, Artificial
  CRISPR gRNA sequence
ggagagctgtggcactatct

SEQ ID NO: 257210 - DNA, 20 bp, Artificial
  CRISPR gRNA sequence
tcactgcaacctccgcctgc

SEQ ID NO: 257211 - DNA, 20 bp, Artificial
  CRISPR gRNA sequence
cactgcaacctccgcctgcc

SEQ ID NO: 257212 - DNA, 20 bp, Artificial
  CRISPR gRNA sequence
aacctccgcctgccaggttc

SEQ ID NO: 257213 - DNA, 20 bp, Artificial
  CRISPR gRNA sequence
ttcaagcgattctcatgcct

SEQ ID NO: 257214 - DNA, 20 bp, Artificial
  CRISPR gRNA sequence
attctcatgcctcagcctct

SEQ ID NO: 257215 - DNA, 20 bp, Artificial
  CRISPR gRNA sequence
ttctcatgcctcagcctctt

SEQ ID NO: 257216 - DNA, 20 bp, Artificial
  CRISPR gRNA sequence
tcatgcctcagcctcttggg

SEQ ID NO: 257217 - DNA, 20 bp, Artificial
  CRISPR gRNA sequence
gcctcagcctcttgggcagc

SEQ ID NO: 257218 - DNA, 20 bp, Artificial
  CRISPR gRNA sequence
cctcagcctcttgggcagct

SEQ ID NO: 257219 - DNA, 20 bp, Artificial
  CRISPR gRNA sequence
ctcttgggcagctgggatta

SEQ ID NO: 257220 - DNA, 20 bp, Artificial
  CRISPR gRNA sequence
tcttgggcagctgggattac

SEQ ID NO: 257221 - DNA, 20 bp, Artificial
  CRISPR gRNA sequence
ggattacaggtgcctgccac

SEQ ID NO: 257222 - DNA, 20 bp, Artificial
  CRISPR gRNA sequence
gattacaggtgcctgccacc

SEQ ID NO: 257223 - DNA, 20 bp, Artificial
  CRISPR gRNA sequence
caggtgcctgccaccaggcc

SEQ ID NO: 257224 - DNA, 20 bp, Artificial
  CRISPR gRNA sequence
caagctaaattttgtatttt

SEQ ID NO: 257225 - DNA, 20 bp, Artificial
  CRISPR gRNA sequence
taaattttgtatttttagta

SEQ ID NO: 257226 - DNA, 20 bp, Artificial
  CRISPR gRNA sequence
ttttgtatttttagtacaga

SEQ ID NO: 257227 - DNA, 20 bp, Artificial
  CRISPR gRNA sequence
ttgtatttttagtacagacg

SEQ ID NO: 257228 - DNA, 20 bp, Artificial
  CRISPR gRNA sequence
cggagtttcaccatcttgac

SEQ ID NO: 257229 - DNA, 20 bp, Artificial
  CRISPR gRNA sequence
ggagtttcaccatcttgacc

SEQ ID NO: 257230 - DNA, 20 bp, Artificial
  CRISPR gRNA sequence
tttcaccatcttgaccaggc

SEQ ID NO: 257231 - DNA, 20 bp, Artificial
  CRISPR gRNA sequence
accaggctggtcctgatctc

SEQ ID NO: 257232 - DNA, 20 bp, Artificial
  CRISPR gRNA sequence
ctcaagtgatctgcccacct

SEQ ID NO: 257233 - DNA, 20 bp, Artificial
  CRISPR gRNA sequence
ctgcccacctcggcctccca

SEQ ID NO: 257234 - DNA, 20 bp, Artificial
  CRISPR gRNA sequence
acctcggcctcccaaagtgc

SEQ ID NO: 257235 - DNA, 20 bp, Artificial
  CRISPR gRNA sequence
cctcggcctcccaaagtgct

SEQ ID NO: 257236 - DNA, 20 bp, Artificial
  CRISPR gRNA sequence
tcccaaagtgctgggattac

SEQ ID NO: 257237 - DNA, 20 bp, Artificial
  CRISPR gRNA sequence
agtgctgggattacaagcat

SEQ ID NO: 257238 - DNA, 20 bp, Artificial
  CRISPR gRNA sequence
acaagcatgagccactgcgc

SEQ ID NO: 257239 - DNA, 20 bp, Artificial
  CRISPR gRNA sequence
caagcatgagccactgcgcc

SEQ ID NO: 257240 - DNA, 20 bp, Artificial
  CRISPR gRNA sequence
agccactgcgccaggtccca

SEQ ID NO: 257241 - DNA, 20 bp, Artificial
  CRISPR gRNA sequence
actcaaataattttgacata

SEQ ID NO: 257242 - DNA, 20 bp, Artificial
  CRISPR gRNA sequence
tgacatattctttcttcatg

SEQ ID NO: 257243 - DNA, 20 bp, Artificial
  CRISPR gRNA sequence
gacatattctttcttcatgt

SEQ ID NO: 257244 - DNA, 20 bp, Artificial
  CRISPR gRNA sequence
catattctttcttcatgtag

SEQ ID NO: 257245 - DNA, 20 bp, Artificial
  CRISPR gRNA sequence
gaactattttattctttcga

SEQ ID NO: 257246 - DNA, 20 bp, Artificial
  CRISPR gRNA sequence
tattgtgaacattaacactg

SEQ ID NO: 257247 - DNA, 20 bp, Artificial
  CRISPR gRNA sequence
ttaacactgaagtctcatga

SEQ ID NO: 257248 - DNA, 20 bp, Artificial
  CRISPR gRNA sequence
taacactgaagtctcatgac

SEQ ID NO: 257249 - DNA, 20 bp, Artificial
  CRISPR gRNA sequence
aacactgaagtctcatgaca

SEQ ID NO: 257250 - DNA, 20 bp, Artificial
  CRISPR gRNA sequence
cactgaagtctcatgacagg

SEQ ID NO: 257251 - DNA, 20 bp, Artificial
  CRISPR gRNA sequence
gaagtctcatgacagggagt

SEQ ID NO: 257252 - DNA, 20 bp, Artificial
  CRISPR gRNA sequence
aagtctcatgacagggagtg

SEQ ID NO: 257253 - DNA, 20 bp, Artificial
  CRISPR gRNA sequence
ctcatgacagggagtgagga

SEQ ID NO: 257254 - DNA, 20 bp, Artificial
  CRISPR gRNA sequence
agggagtgaggaaagcaact

SEQ ID NO: 257255 - DNA, 20 bp, Artificial
  CRISPR gRNA sequence
ggtttacctgatattgcttt

SEQ ID NO: 257256 - DNA, 20 bp, Artificial
  CRISPR gRNA sequence
gtttacctgatattgctttg

SEQ ID NO: 257257 - DNA, 20 bp, Artificial
  CRISPR gRNA sequence
tttacctgatattgctttga

SEQ ID NO: 257258 - DNA, 20 bp, Artificial
  CRISPR gRNA sequence
atttgaccaaatccctcatt

SEQ ID NO: 257259 - DNA, 20 bp, Artificial
  CRISPR gRNA sequence
tcaaaatgactaaatatgat

SEQ ID NO: 257260 - DNA, 20 bp, Artificial
  CRISPR gRNA sequence
aatatgatcagaattcataa

SEQ ID NO: 257261 - DNA, 20 bp, Artificial
  CRISPR gRNA sequence
gtctatgtatttctaaacta

SEQ ID NO: 257262 - DNA, 20 bp, Artificial
  CRISPR gRNA sequence
tctatgtatttctaaactaa

SEQ ID NO: 257263 - DNA, 20 bp, Artificial
  CRISPR gRNA sequence
atttctaaactaaaggaaaa

SEQ ID NO: 257264 - DNA, 20 bp, Artificial
  CRISPR gRNA sequence
taaaggaaaacagcattaaa

SEQ ID NO: 257265 - DNA, 20 bp, Artificial
  CRISPR gRNA sequence
aaaggaaaacagcattaaat

SEQ ID NO: 257266 - DNA, 20 bp, Artificial
  CRISPR gRNA sequence
agcattaaataggaactacg

SEQ ID NO: 257267 - DNA, 20 bp, Artificial
  CRISPR gRNA sequence
aactacgtggctcatttcat

SEQ ID NO: 257268 - DNA, 20 bp, Artificial
  CRISPR gRNA sequence
tacgtggctcatttcatgag

SEQ ID NO: 257269 - DNA, 20 bp, Artificial
  CRISPR gRNA sequence
acgtggctcatttcatgagt

SEQ ID NO: 257270 - DNA, 20 bp, Artificial
  CRISPR gRNA sequence
gtggctcatttcatgagtgg

SEQ ID NO: 257271 - DNA, 20 bp, Artificial
  CRISPR gRNA sequence
ctcatttcatgagtgggaga

SEQ ID NO: 257272 - DNA, 20 bp, Artificial
  CRISPR gRNA sequence
agtgggagacagtgttttaa

SEQ ID NO: 257273 - DNA, 20 bp, Artificial
  CRISPR gRNA sequence
ccgtttaacccactaaccaa

SEQ ID NO: 257274 - DNA, 20 bp, Artificial
  CRISPR gRNA sequence
ttaaacacccatttaaccaa

SEQ ID NO: 257275 - DNA, 20 bp, Artificial
  CRISPR gRNA sequence
taaacacccatttaaccaaa

SEQ ID NO: 257276 - DNA, 20 bp, Artificial
  CRISPR gRNA sequence
aaccaaaaggaatgatttcc

SEQ ID NO: 257277 - DNA, 20 bp, Artificial
  CRISPR gRNA sequence
ttctgcaactaaaatgtctg

SEQ ID NO: 257278 - DNA, 20 bp, Artificial
  CRISPR gRNA sequence
ataccacactttgcttgact

SEQ ID NO: 257279 - DNA, 20 bp, Artificial
  CRISPR gRNA sequence
ctttgcttgactgagatgtg

SEQ ID NO: 257280 - DNA, 20 bp, Artificial
  CRISPR gRNA sequence
tttgcttgactgagatgtgc

SEQ ID NO: 257281 - DNA, 20 bp, Artificial
  CRISPR gRNA sequence
cttgactgagatgtgcaggt

SEQ ID NO: 257282 - DNA, 20 bp, Artificial
  CRISPR gRNA sequence
actgagatgtgcaggtgagt

SEQ ID NO: 257283 - DNA, 20 bp, Artificial
  CRISPR gRNA sequence
agatgtgcaggtgagtgaga

SEQ ID NO: 257284 - DNA, 20 bp, Artificial
  CRISPR gRNA sequence
gatgtgcaggtgagtgagaa

SEQ ID NO: 257285 - DNA, 20 bp, Artificial
  CRISPR gRNA sequence
atgtgcaggtgagtgagaaa

SEQ ID NO: 257286 - DNA, 20 bp, Artificial
  CRISPR gRNA sequence
tgcaggtgagtgagaaaggg

SEQ ID NO: 257287 - DNA, 20 bp, Artificial
  CRISPR gRNA sequence
caggtgagtgagaaagggaa

SEQ ID NO: 257288 - DNA, 20 bp, Artificial
  CRISPR gRNA sequence
aggtgagtgagaaagggaag

SEQ ID NO: 257289 - DNA, 20 bp, Artificial
  CRISPR gRNA sequence
tgagaaagggaagaggctcc

SEQ ID NO: 257290 - DNA, 20 bp, Artificial
  CRISPR gRNA sequence
tgttttctaccctaacttct

SEQ ID NO: 257291 - DNA, 20 bp, Artificial
  CRISPR gRNA sequence
tctaccctaacttctcagtc

SEQ ID NO: 257292 - DNA, 20 bp, Artificial
  CRISPR gRNA sequence
aacttctcagtcaagtcact

SEQ ID NO: 257293 - DNA, 20 bp, Artificial
  CRISPR gRNA sequence
cagtcaagtcactaagtaca

SEQ ID NO: 257294 - DNA, 20 bp, Artificial
  CRISPR gRNA sequence
caagtcactaagtacatggt

SEQ ID NO: 257295 - DNA, 20 bp, Artificial
  CRISPR gRNA sequence
tcactaagtacatggtaagt

SEQ ID NO: 257296 - DNA, 20 bp, Artificial
  CRISPR gRNA sequence
gtacatggtaagttggaatg

SEQ ID NO: 257297 - DNA, 20 bp, Artificial
  CRISPR gRNA sequence
tacatggtaagttggaatgt

SEQ ID NO: 257298 - DNA, 20 bp, Artificial
  CRISPR gRNA sequence
gtaagttggaatgtgggcca

SEQ ID NO: 257299 - DNA, 20 bp, Artificial
  CRISPR gRNA sequence
aatgtgggccatggcactgt

SEQ ID NO: 257300 - DNA, 20 bp, Artificial
  CRISPR gRNA sequence
ggccatggcactgtaagact

SEQ ID NO: 257301 - DNA, 20 bp, Artificial
  CRISPR gRNA sequence
ctgtaagacttggcctgtca

SEQ ID NO: 257302 - DNA, 20 bp, Artificial
  CRISPR gRNA sequence
tgtaagacttggcctgtcac

SEQ ID NO: 257303 - DNA, 20 bp, Artificial
  CRISPR gRNA sequence
aaatctcttttacttcattt

SEQ ID NO: 257304 - DNA, 20 bp, Artificial
  CRISPR gRNA sequence
atctcttttacttcatttca

SEQ ID NO: 257305 - DNA, 20 bp, Artificial
  CRISPR gRNA sequence
ctcaaaatgatcttgatatt

SEQ ID NO: 257306 - DNA, 20 bp, Artificial
  CRISPR gRNA sequence
aatgatcttgatatttggtc

SEQ ID NO: 257307 - DNA, 20 bp, Artificial
  CRISPR gRNA sequence
gatatttggtctagtcactc

SEQ ID NO: 257308 - DNA, 20 bp, Artificial
  CRISPR gRNA sequence
tctagtcactcgagaaaaat

SEQ ID NO: 257309 - DNA, 20 bp, Artificial
  CRISPR gRNA sequence
cactcgagaaaaattggcat

SEQ ID NO: 257310 - DNA, 20 bp, Artificial
  CRISPR gRNA sequence
tcgagaaaaattggcattgg

SEQ ID NO: 257311 - DNA, 20 bp, Artificial
  CRISPR gRNA sequence
aattggcattggtggcccaa

SEQ ID NO: 257312 - DNA, 20 bp, Artificial
  CRISPR gRNA sequence
attggcattggtggcccaac

SEQ ID NO: 257313 - DNA, 20 bp, Artificial
  CRISPR gRNA sequence
ttggcattggtggcccaaca

SEQ ID NO: 257314 - DNA, 20 bp, Artificial
  CRISPR gRNA sequence
tggcattggtggcccaacag

SEQ ID NO: 257315 - DNA, 20 bp, Artificial
  CRISPR gRNA sequence
tggtggcccaacaggggcct

SEQ ID NO: 257316 - DNA, 20 bp, Artificial
  CRISPR gRNA sequence
ggtggcccaacaggggcctg

SEQ ID NO: 257317 - DNA, 20 bp, Artificial
  CRISPR gRNA sequence
ggcccaacaggggcctgagg

SEQ ID NO: 257318 - DNA, 20 bp, Artificial
  CRISPR gRNA sequence
caacaggggcctgaggtggc

SEQ ID NO: 257319 - DNA, 20 bp, Artificial
  CRISPR gRNA sequence
aggggcctgaggtggccggc

SEQ ID NO: 257320 - DNA, 20 bp, Artificial
  CRISPR gRNA sequence
gggcctgaggtggccggctg

SEQ ID NO: 257321 - DNA, 20 bp, Artificial
  CRISPR gRNA sequence
ctgaggtggccggctggaga

SEQ ID NO: 257322 - DNA, 20 bp, Artificial
  CRISPR gRNA sequence
aggtggccggctggagatgg

SEQ ID NO: 257323 - DNA, 20 bp, Artificial
  CRISPR gRNA sequence
gatggcggtcatttcctatc

SEQ ID NO: 257324 - DNA, 20 bp, Artificial
  CRISPR gRNA sequence
tggcggtcatttcctatcca

SEQ ID NO: 257325 - DNA, 20 bp, Artificial
  CRISPR gRNA sequence
cggtcatttcctatccagag

SEQ ID NO: 257326 - DNA, 20 bp, Artificial
  CRISPR gRNA sequence
ctatccagagcagtgatatt

SEQ ID NO: 257327 - DNA, 20 bp, Artificial
  CRISPR gRNA sequence
tccagagcagtgatattgag

SEQ ID NO: 257328 - DNA, 20 bp, Artificial
  CRISPR gRNA sequence
gagcagtgatattgagcaga

SEQ ID NO: 257329 - DNA, 20 bp, Artificial
  CRISPR gRNA sequence
agcagtgatattgagcagat

SEQ ID NO: 257330 - DNA, 20 bp, Artificial
  CRISPR gRNA sequence
gcagtgatattgagcagatg

SEQ ID NO: 257331 - DNA, 20 bp, Artificial
  CRISPR gRNA sequence
cagtgatattgagcagatgg

SEQ ID NO: 257332 - DNA, 20 bp, Artificial
  CRISPR gRNA sequence
attgagcagatgggggctgc

SEQ ID NO: 257333 - DNA, 20 bp, Artificial
  CRISPR gRNA sequence
agcagatgggggctgccagc

SEQ ID NO: 257334 - DNA, 20 bp, Artificial
  CRISPR gRNA sequence
gatgggggctgccagccggc

SEQ ID NO: 257335 - DNA, 20 bp, Artificial
  CRISPR gRNA sequence
gctgccagccggctggcttc

SEQ ID NO: 257336 - DNA, 20 bp, Artificial
  CRISPR gRNA sequence
ccagccggctggcttctgga

SEQ ID NO: 257337 - DNA, 20 bp, Artificial
  CRISPR gRNA sequence
cagccggctggcttctggat

SEQ ID NO: 257338 - DNA, 20 bp, Artificial
  CRISPR gRNA sequence
ttctggataggcgtccgtgt

SEQ ID NO: 257339 - DNA, 20 bp, Artificial
  CRISPR gRNA sequence
tctggataggcgtccgtgtc

SEQ ID NO: 257340 - DNA, 20 bp, Artificial
  CRISPR gRNA sequence
tggataggcgtccgtgtcag

SEQ ID NO: 257341 - DNA, 20 bp, Artificial
  CRISPR gRNA sequence
ggcgtccgtgtcaggagcga

SEQ ID NO: 257342 - DNA, 20 bp, Artificial
  CRISPR gRNA sequence
gcgtccgtgtcaggagcgat

SEQ ID NO: 257343 - DNA, 20 bp, Artificial
  CRISPR gRNA sequence
gtcaggagcgataggctgcg

SEQ ID NO: 257344 - DNA, 20 bp, Artificial
  CRISPR gRNA sequence
cgataggctgcgaagtcgcg

SEQ ID NO: 257345 - DNA, 20 bp, Artificial
  CRISPR gRNA sequence
taggctgcgaagtcgcgtgg

SEQ ID NO: 257346 - DNA, 20 bp, Artificial
  CRISPR gRNA sequence
aggctgcgaagtcgcgtggt

SEQ ID NO: 257347 - DNA, 20 bp, Artificial
  CRISPR gRNA sequence
ggctgcgaagtcgcgtggtg

SEQ ID NO: 257348 - DNA, 20 bp, Artificial
  CRISPR gRNA sequence
cgaagtcgcgtggtggggca

SEQ ID NO: 257349 - DNA, 20 bp, Artificial
  CRISPR gRNA sequence
gaagtcgcgtggtggggcat

SEQ ID NO: 257350 - DNA, 20 bp, Artificial
  CRISPR gRNA sequence
aagtcgcgtggtggggcata

SEQ ID NO: 257351 - DNA, 20 bp, Artificial
  CRISPR gRNA sequence
cgcgtggtggggcatagggc

SEQ ID NO: 257352 - DNA, 20 bp, Artificial
  CRISPR gRNA sequence
catagggctggtaatgcttg

SEQ ID NO: 257353 - DNA, 20 bp, Artificial
  CRISPR gRNA sequence
atagggctggtaatgcttgc

SEQ ID NO: 257354 - DNA, 20 bp, Artificial
  CRISPR gRNA sequence
gggctggtaatgcttgcggg

SEQ ID NO: 257355 - DNA, 20 bp, Artificial
  CRISPR gRNA sequence
ggctggtaatgcttgcgggt

SEQ ID NO: 257356 - DNA, 20 bp, Artificial
  CRISPR gRNA sequence
gtaatgcttgcgggtgggcc

SEQ ID NO: 257357 - DNA, 20 bp, Artificial
  CRISPR gRNA sequence
taatgcttgcgggtgggccc

SEQ ID NO: 257358 - DNA, 20 bp, Artificial
  CRISPR gRNA sequence
aatgcttgcgggtgggcccg

SEQ ID NO: 257359 - DNA, 20 bp, Artificial
  CRISPR gRNA sequence
gcttgcgggtgggcccgggg

SEQ ID NO: 257360 - DNA, 20 bp, Artificial
  CRISPR gRNA sequence
tgcgggtgggcccggggcgg

SEQ ID NO: 257361 - DNA, 20 bp, Artificial
  CRISPR gRNA sequence
gcgggtgggcccggggcggc

SEQ ID NO: 257362 - DNA, 20 bp, Artificial
  CRISPR gRNA sequence
cgggtgggcccggggcggcg

SEQ ID NO: 257363 - DNA, 20 bp, Artificial
  CRISPR gRNA sequence
ggtgggcccggggcggcggg

SEQ ID NO: 257364 - DNA, 20 bp, Artificial
  CRISPR gRNA sequence
ggcggggagtcatgttcatg

SEQ ID NO: 257365 - DNA, 20 bp, Artificial
  CRISPR gRNA sequence
atgttcatgtagtcactgtg

SEQ ID NO: 257366 - DNA, 20 bp, Artificial
  CRISPR gRNA sequence
tgttcatgtagtcactgtgc

SEQ ID NO: 257367 - DNA, 20 bp, Artificial
  CRISPR gRNA sequence
ttcatgtagtcactgtgcag

SEQ ID NO: 257368 - DNA, 20 bp, Artificial
  CRISPR gRNA sequence
ctcctcttactcctcacctg

SEQ ID NO: 257369 - DNA, 20 bp, Artificial
  CRISPR gRNA sequence
tcctcttactcctcacctgc

SEQ ID NO: 257370 - DNA, 20 bp, Artificial
  CRISPR gRNA sequence
cttactcctcacctgcagga

SEQ ID NO: 257371 - DNA, 20 bp, Artificial
  CRISPR gRNA sequence
tactcctcacctgcaggaaa

SEQ ID NO: 257372 - DNA, 20 bp, Artificial
  CRISPR gRNA sequence
tcctcacctgcaggaaagag

SEQ ID NO: 257373 - DNA, 20 bp, Artificial
  CRISPR gRNA sequence
cctgcaggaaagagaagtgt

SEQ ID NO: 257374 - DNA, 20 bp, Artificial
  CRISPR gRNA sequence
aggaaagagaagtgtcagta

SEQ ID NO: 257375 - DNA, 20 bp, Artificial
  CRISPR gRNA sequence
gaaagagaagtgtcagtatg

SEQ ID NO: 257376 - DNA, 20 bp, Artificial
  CRISPR gRNA sequence
aaagagaagtgtcagtatgg

SEQ ID NO: 257377 - DNA, 20 bp, Artificial
  CRISPR gRNA sequence
aagagaagtgtcagtatgga

SEQ ID NO: 257378 - DNA, 20 bp, Artificial
  CRISPR gRNA sequence
agtatggagggacaatgtca

SEQ ID NO: 257379 - DNA, 20 bp, Artificial
  CRISPR gRNA sequence
atggagggacaatgtcatgg

SEQ ID NO: 257380 - DNA, 20 bp, Artificial
  CRISPR gRNA sequence
tggagggacaatgtcatgga

SEQ ID NO: 257381 - DNA, 20 bp, Artificial
  CRISPR gRNA sequence
gagggacaatgtcatggaag

SEQ ID NO: 257382 - DNA, 20 bp, Artificial
  CRISPR gRNA sequence
aatgtcatggaaggagttct

SEQ ID NO: 257383 - DNA, 20 bp, Artificial
  CRISPR gRNA sequence
tggaaggagttctaagactg

SEQ ID NO: 257384 - DNA, 20 bp, Artificial
  CRISPR gRNA sequence
ggaaggagttctaagactgt

SEQ ID NO: 257385 - DNA, 20 bp, Artificial
  CRISPR gRNA sequence
taatattaactgtcaaatga

SEQ ID NO: 257386 - DNA, 20 bp, Artificial
  CRISPR gRNA sequence
atattaactgtcaaatgaca

SEQ ID NO: 257387 - DNA, 20 bp, Artificial
  CRISPR gRNA sequence
ctaaaacactaacctttttt

SEQ ID NO: 257388 - DNA, 20 bp, Artificial
  CRISPR gRNA sequence
ctaaccttttttgagcacct

SEQ ID NO: 257389 - DNA, 20 bp, Artificial
  CRISPR gRNA sequence
ttttttgagcaccttggact

SEQ ID NO: 257390 - DNA, 20 bp, Artificial
  CRISPR gRNA sequence
tttttgagcaccttggactt

SEQ ID NO: 257391 - DNA, 20 bp, Artificial
  CRISPR gRNA sequence
attgaacttgaaaaatctca

SEQ ID NO: 257392 - DNA, 20 bp, Artificial
  CRISPR gRNA sequence
aacttgaaaaatctcaaaga

SEQ ID NO: 257393 - DNA, 20 bp, Artificial
  CRISPR gRNA sequence
aaatctcaaagaaagtattt

SEQ ID NO: 257394 - DNA, 20 bp, Artificial
  CRISPR gRNA sequence
atctcaaagaaagtatttta

SEQ ID NO: 257395 - DNA, 20 bp, Artificial
  CRISPR gRNA sequence
ttgatatgtaaatacacttg

SEQ ID NO: 257396 - DNA, 20 bp, Artificial
  CRISPR gRNA sequence
tgatatgtaaatacacttga

SEQ ID NO: 257397 - DNA, 20 bp, Artificial
  CRISPR gRNA sequence
aaggcccttcctcctttgac

SEQ ID NO: 257398 - DNA, 20 bp, Artificial
  CRISPR gRNA sequence
aggcccttcctcctttgact

SEQ ID NO: 257399 - DNA, 20 bp, Artificial
  CRISPR gRNA sequence
cttcctcctttgactaggtt

SEQ ID NO: 257400 - DNA, 20 bp, Artificial
  CRISPR gRNA sequence
acattgtgatcttcttacat

SEQ ID NO: 257401 - DNA, 20 bp, Artificial
  CRISPR gRNA sequence
tacattagcatttgcttaac

SEQ ID NO: 257402 - DNA, 20 bp, Artificial
  CRISPR gRNA sequence
tgtttttccataattaaccg

SEQ ID NO: 257403 - DNA, 20 bp, Artificial
  CRISPR gRNA sequence
tttttccataattaaccgaa

SEQ ID NO: 257404 - DNA, 20 bp, Artificial
  CRISPR gRNA sequence
ttttccataattaaccgaag

SEQ ID NO: 257405 - DNA, 20 bp, Artificial
  CRISPR gRNA sequence
aagaggactttcaactcctc

SEQ ID NO: 257406 - DNA, 20 bp, Artificial
  CRISPR gRNA sequence
gaggactttcaactcctcca

SEQ ID NO: 257407 - DNA, 20 bp, Artificial
  CRISPR gRNA sequence
gtaataatcacaaatttgta

SEQ ID NO: 257408 - DNA, 20 bp, Artificial
  CRISPR gRNA sequence
taataatcacaaatttgtaa

SEQ ID NO: 257409 - DNA, 20 bp, Artificial
  CRISPR gRNA sequence
taatcacaaatttgtaaagg

SEQ ID NO: 257410 - DNA, 20 bp, Artificial
  CRISPR gRNA sequence
atcacaaatttgtaaaggtg

SEQ ID NO: 257411 - DNA, 20 bp, Artificial
  CRISPR gRNA sequence
aaaggtggagtccaaactaa

SEQ ID NO: 257412 - DNA, 20 bp, Artificial
  CRISPR gRNA sequence
tccaaactaatggcaattta

SEQ ID NO: 257413 - DNA, 20 bp, Artificial
  CRISPR gRNA sequence
ctaatggcaatttacagttc

SEQ ID NO: 257414 - DNA, 20 bp, Artificial
  CRISPR gRNA sequence
aatttacagttctagacaac

SEQ ID NO: 257415 - DNA, 20 bp, Artificial
  CRISPR gRNA sequence
agtacattcctatgtcttta

SEQ ID NO: 257416 - DNA, 20 bp, Artificial
  CRISPR gRNA sequence
gtacattcctatgtctttat

SEQ ID NO: 257417 - DNA, 20 bp, Artificial
  CRISPR gRNA sequence
ctacactcatctctctttca

SEQ ID NO: 257418 - DNA, 20 bp, Artificial
  CRISPR gRNA sequence
tacactcatctctctttcat

SEQ ID NO: 257419 - DNA, 20 bp, Artificial
  CRISPR gRNA sequence
tcatctctctttcataggct

SEQ ID NO: 257420 - DNA, 20 bp, Artificial
  CRISPR gRNA sequence
tttcataggcttggctccat

SEQ ID NO: 257421 - DNA, 20 bp, Artificial
  CRISPR gRNA sequence
ttcataggcttggctccatc

SEQ ID NO: 257422 - DNA, 20 bp, Artificial
  CRISPR gRNA sequence
ccatcaggatgaatttccac

SEQ ID NO: 257423 - DNA, 20 bp, Artificial
  CRISPR gRNA sequence
tcaggatgaatttccaccag

SEQ ID NO: 257424 - DNA, 20 bp, Artificial
  CRISPR gRNA sequence
gatgaatttccaccagaagt

SEQ ID NO: 257425 - DNA, 20 bp, Artificial
  CRISPR gRNA sequence
atgaatttccaccagaagtg

SEQ ID NO: 257426 - DNA, 20 bp, Artificial
  CRISPR gRNA sequence
tgaatttccaccagaagtga

SEQ ID NO: 257427 - DNA, 20 bp, Artificial
  CRISPR gRNA sequence
atttccaccagaagtgaggg

SEQ ID NO: 257428 - DNA, 20 bp, Artificial
  CRISPR gRNA sequence
ccaccagaagtgagggaagt

SEQ ID NO: 257429 - DNA, 20 bp, Artificial
  CRISPR gRNA sequence
caccagaagtgagggaagta

SEQ ID NO: 257430 - DNA, 20 bp, Artificial
  CRISPR gRNA sequence
accagaagtgagggaagtaa

SEQ ID NO: 257431 - DNA, 20 bp, Artificial
  CRISPR gRNA sequence
agtgagggaagtaagggcaa

SEQ ID NO: 257432 - DNA, 20 bp, Artificial
  CRISPR gRNA sequence
gtttcacccaccatgaatct

SEQ ID NO: 257433 - DNA, 20 bp, Artificial
  CRISPR gRNA sequence
tcttagcaaaatttttgact

SEQ ID NO: 257434 - DNA, 20 bp, Artificial
  CRISPR gRNA sequence
cttagcaaaatttttgacta

SEQ ID NO: 257435 - DNA, 20 bp, Artificial
  CRISPR gRNA sequence
ttagcaaaatttttgactaa

SEQ ID NO: 257436 - DNA, 20 bp, Artificial
  CRISPR gRNA sequence
caaaatttttgactaagggt

SEQ ID NO: 257437 - DNA, 20 bp, Artificial
  CRISPR gRNA sequence
aaaatttttgactaagggtt

SEQ ID NO: 257438 - DNA, 20 bp, Artificial
  CRISPR gRNA sequence
tcatttctgaatcaatgtga

SEQ ID NO: 257439 - DNA, 20 bp, Artificial
  CRISPR gRNA sequence
acatttcttaacaaatgacc

SEQ ID NO: 257440 - DNA, 20 bp, Artificial
  CRISPR gRNA sequence
acccagaaaacatctaaaaa

SEQ ID NO: 257441 - DNA, 20 bp, Artificial
  CRISPR gRNA sequence
agaaaacatctaaaaacaga

SEQ ID NO: 257442 - DNA, 20 bp, Artificial
  CRISPR gRNA sequence
atctaaaaacagaaagccat

SEQ ID NO: 257443 - DNA, 20 bp, Artificial
  CRISPR gRNA sequence
acagaaagccatcagatttc

SEQ ID NO: 257444 - DNA, 20 bp, Artificial
  CRISPR gRNA sequence
agccatcagatttctggatt

SEQ ID NO: 257445 - DNA, 20 bp, Artificial
  CRISPR gRNA sequence
agaattctctattatgaaaa

SEQ ID NO: 257446 - DNA, 20 bp, Artificial
  CRISPR gRNA sequence
tctattatgaaaaaagtgcc

SEQ ID NO: 257447 - DNA, 20 bp, Artificial
  CRISPR gRNA sequence
tgaaaaaagtgcctagttcc

SEQ ID NO: 257448 - DNA, 20 bp, Artificial
  CRISPR gRNA sequence
agtgcctagttcctggcaca

SEQ ID NO: 257449 - DNA, 20 bp, Artificial
  CRISPR gRNA sequence
gtgcctagttcctggcacac

SEQ ID NO: 257450 - DNA, 20 bp, Artificial
  CRISPR gRNA sequence
tggcacacaggctgatacct

SEQ ID NO: 257451 - DNA, 20 bp, Artificial
  CRISPR gRNA sequence
cacacaggctgatacctaag

SEQ ID NO: 257452 - DNA, 20 bp, Artificial
  CRISPR gRNA sequence
tgatacctgaatgaataaat

SEQ ID NO: 257453 - DNA, 20 bp, Artificial
  CRISPR gRNA sequence
aataaataagtgaatgattt

SEQ ID NO: 257454 - DNA, 20 bp, Artificial
  CRISPR gRNA sequence
taagtgaatgatttcagccc

SEQ ID NO: 257455 - DNA, 20 bp, Artificial
  CRISPR gRNA sequence
gtttccatacactcctgcct

SEQ ID NO: 257456 - DNA, 20 bp, Artificial
  CRISPR gRNA sequence
acttcacaccttccttgtca

SEQ ID NO: 257457 - DNA, 20 bp, Artificial
  CRISPR gRNA sequence
cttcacaccttccttgtcaa

SEQ ID NO: 257458 - DNA, 20 bp, Artificial
  CRISPR gRNA sequence
ttcacaccttccttgtcaaa

SEQ ID NO: 257459 - DNA, 20 bp, Artificial
  CRISPR gRNA sequence
tcacaccttccttgtcaaag

SEQ ID NO: 257460 - DNA, 20 bp, Artificial
  CRISPR gRNA sequence
cttccttgtcaaaggggcat

SEQ ID NO: 257461 - DNA, 20 bp, Artificial
  CRISPR gRNA sequence
cttgtcaaaggggcatgagt

SEQ ID NO: 257462 - DNA, 20 bp, Artificial
  CRISPR gRNA sequence
aggggcatgagtaagtgcta

SEQ ID NO: 257463 - DNA, 20 bp, Artificial
  CRISPR gRNA sequence
gcatgagtaagtgctaaaga

SEQ ID NO: 257464 - DNA, 20 bp, Artificial
  CRISPR gRNA sequence
catgagtaagtgctaaagaa

SEQ ID NO: 257465 - DNA, 20 bp, Artificial
  CRISPR gRNA sequence
gacttccatgttactaaaca

SEQ ID NO: 257466 - DNA, 20 bp, Artificial
  CRISPR gRNA sequence
aaacacagctaacatgtttt

SEQ ID NO: 257467 - DNA, 20 bp, Artificial
  CRISPR gRNA sequence
tcctcatcttcttcaactct

SEQ ID NO: 257468 - DNA, 20 bp, Artificial
  CRISPR gRNA sequence
tcatcttcttcaactctcag

SEQ ID NO: 257469 - DNA, 20 bp, Artificial
  CRISPR gRNA sequence
ctttgccatctatgacatcc

SEQ ID NO: 257470 - DNA, 20 bp, Artificial
  CRISPR gRNA sequence
tccttccctgcctcctttgc

SEQ ID NO: 257471 - DNA, 20 bp, Artificial
  CRISPR gRNA sequence
caagctcatccttctctaac

SEQ ID NO: 257472 - DNA, 20 bp, Artificial
  CRISPR gRNA sequence
atccttctctaaccagccgt

SEQ ID NO: 257473 - DNA, 20 bp, Artificial
  CRISPR gRNA sequence
cgttagaatttctcactgct

SEQ ID NO: 257474 - DNA, 20 bp, Artificial
  CRISPR gRNA sequence
aatttctcactgcttggtcc

SEQ ID NO: 257475 - DNA, 20 bp, Artificial
  CRISPR gRNA sequence
atttctcactgcttggtcct

SEQ ID NO: 257476 - DNA, 20 bp, Artificial
  CRISPR gRNA sequence
tcttctctatcctctttccc

SEQ ID NO: 257477 - DNA, 20 bp, Artificial
  CRISPR gRNA sequence
cttctctatcctctttccct

SEQ ID NO: 257478 - DNA, 20 bp, Artificial
  CRISPR gRNA sequence
ggcaatcttatccacattca

SEQ ID NO: 257479 - DNA, 20 bp, Artificial
  CRISPR gRNA sequence
ctcacccaaatttatatctc

SEQ ID NO: 257480 - DNA, 20 bp, Artificial
  CRISPR gRNA sequence
tatctctggactaaacctca

SEQ ID NO: 257481 - DNA, 20 bp, Artificial
  CRISPR gRNA sequence
acatgtctaaaataaaactc

SEQ ID NO: 257482 - DNA, 20 bp, Artificial
  CRISPR gRNA sequence
aaatgctgttttttttttac

SEQ ID NO: 257483 - DNA, 20 bp, Artificial
  CRISPR gRNA sequence
tttaccagtgtttctcatct

SEQ ID NO: 257484 - DNA, 20 bp, Artificial
  CRISPR gRNA sequence
gaatgacactaccatatata

SEQ ID NO: 257485 - DNA, 20 bp, Artificial
  CRISPR gRNA sequence
taccatatatacagctgccc

SEQ ID NO: 257486 - DNA, 20 bp, Artificial
  CRISPR gRNA sequence
atatatacagctgcccaaga

SEQ ID NO: 257487 - DNA, 20 bp, Artificial
  CRISPR gRNA sequence
aacctcatccttgacacctc

SEQ ID NO: 257488 - DNA, 20 bp, Artificial
  CRISPR gRNA sequence
agctcccttaatccctgtcc

SEQ ID NO: 257489 - DNA, 20 bp, Artificial
  CRISPR gRNA sequence
gctcccttaatccctgtccc

SEQ ID NO: 257490 - DNA, 20 bp, Artificial
  CRISPR gRNA sequence
tcccttaatccctgtcccag

SEQ ID NO: 257491 - DNA, 20 bp, Artificial
  CRISPR gRNA sequence
tccctgtcccaggagacatt

SEQ ID NO: 257492 - DNA, 20 bp, Artificial
  CRISPR gRNA sequence
gtcccaggagacatttagtg

SEQ ID NO: 257493 - DNA, 20 bp, Artificial
  CRISPR gRNA sequence
agtgaagtctaaaaacattt

SEQ ID NO: 257494 - DNA, 20 bp, Artificial
  CRISPR gRNA sequence
aacattttggatcatcacaa

SEQ ID NO: 257495 - DNA, 20 bp, Artificial
  CRISPR gRNA sequence
acattttggatcatcacaac

SEQ ID NO: 257496 - DNA, 20 bp, Artificial
  CRISPR gRNA sequence
cattttggatcatcacaacg

SEQ ID NO: 257497 - DNA, 20 bp, Artificial
  CRISPR gRNA sequence
ttttggatcatcacaacggg

SEQ ID NO: 257498 - DNA, 20 bp, Artificial
  CRISPR gRNA sequence
tttggatcatcacaacgggg

SEQ ID NO: 257499 - DNA, 20 bp, Artificial
  CRISPR gRNA sequence
ttggatcatcacaacgggga

SEQ ID NO: 257500 - DNA, 20 bp, Artificial
  CRISPR gRNA sequence
acaacggggagggatgctac

SEQ ID NO: 257501 - DNA, 20 bp, Artificial
  CRISPR gRNA sequence
gggatgctactggcatctac

SEQ ID NO: 257502 - DNA, 20 bp, Artificial
  CRISPR gRNA sequence
ggatgctactggcatctact

SEQ ID NO: 257503 - DNA, 20 bp, Artificial
  CRISPR gRNA sequence
tgctactggcatctactggg

SEQ ID NO: 257504 - DNA, 20 bp, Artificial
  CRISPR gRNA sequence
ctactggcatctactgggta

SEQ ID NO: 257505 - DNA, 20 bp, Artificial
  CRISPR gRNA sequence
tactggcatctactgggtag

SEQ ID NO: 257506 - DNA, 20 bp, Artificial
  CRISPR gRNA sequence
ggcatctactgggtagaggt

SEQ ID NO: 257507 - DNA, 20 bp, Artificial
  CRISPR gRNA sequence
catctactgggtagaggtca

SEQ ID NO: 257508 - DNA, 20 bp, Artificial
  CRISPR gRNA sequence
aaacatcctacaatgcaatg

SEQ ID NO: 257509 - DNA, 20 bp, Artificial
  CRISPR gRNA sequence
aatgcaatgaagaattgttt

SEQ ID NO: 257510 - DNA, 20 bp, Artificial
  CRISPR gRNA sequence
tacatcctttctgtaaatga

SEQ ID NO: 257511 - DNA, 20 bp, Artificial
  CRISPR gRNA sequence
cctttctgtaaatgaaagac

SEQ ID NO: 257512 - DNA, 20 bp, Artificial
  CRISPR gRNA sequence
tttctgtaaatgaaagacta

SEQ ID NO: 257513 - DNA, 20 bp, Artificial
  CRISPR gRNA sequence
tgaaagactagagctgtctt

SEQ ID NO: 257514 - DNA, 20 bp, Artificial
  CRISPR gRNA sequence
actagagctgtcttgagcac

SEQ ID NO: 257515 - DNA, 20 bp, Artificial
  CRISPR gRNA sequence
ctgtcttgagcacaagatca

SEQ ID NO: 257516 - DNA, 20 bp, Artificial
  CRISPR gRNA sequence
tcttgagcacaagatcacag

SEQ ID NO: 257517 - DNA, 20 bp, Artificial
  CRISPR gRNA sequence
cttgagcacaagatcacagc

SEQ ID NO: 257518 - DNA, 20 bp, Artificial
  CRISPR gRNA sequence
ttgagcacaagatcacagca

SEQ ID NO: 257519 - DNA, 20 bp, Artificial
  CRISPR gRNA sequence
agcacaagatcacagcaggg

SEQ ID NO: 257520 - DNA, 20 bp, Artificial
  CRISPR gRNA sequence
gcacaagatcacagcagggc

SEQ ID NO: 257521 - DNA, 20 bp, Artificial
  CRISPR gRNA sequence
cacaagatcacagcagggca

SEQ ID NO: 257522 - DNA, 20 bp, Artificial
  CRISPR gRNA sequence
acaagatcacagcagggcag

SEQ ID NO: 257523 - DNA, 20 bp, Artificial
  CRISPR gRNA sequence
gatcacagcagggcaggggt

SEQ ID NO: 257524 - DNA, 20 bp, Artificial
  CRISPR gRNA sequence
atcacagcagggcaggggtg

SEQ ID NO: 257525 - DNA, 20 bp, Artificial
  CRISPR gRNA sequence
agcagggcaggggtgaggcc

SEQ ID NO: 257526 - DNA, 20 bp, Artificial
  CRISPR gRNA sequence
gcagggcaggggtgaggccg

SEQ ID NO: 257527 - DNA, 20 bp, Artificial
  CRISPR gRNA sequence
gccgaggaaatgtctgtccc

SEQ ID NO: 257528 - DNA, 20 bp, Artificial
  CRISPR gRNA sequence
ggaaatgtctgtccccagat

SEQ ID NO: 257529 - DNA, 20 bp, Artificial
  CRISPR gRNA sequence
tgtctgtccccagatgagtg

SEQ ID NO: 257530 - DNA, 20 bp, Artificial
  CRISPR gRNA sequence
ccccagatgagtgtagaaaa

SEQ ID NO: 257531 - DNA, 20 bp, Artificial
  CRISPR gRNA sequence
gtagaaaacagctgataacc

SEQ ID NO: 257532 - DNA, 20 bp, Artificial
  CRISPR gRNA sequence
tagaaaacagctgataacct

SEQ ID NO: 257533 - DNA, 20 bp, Artificial
  CRISPR gRNA sequence
aaaacagctgataacctggg

SEQ ID NO: 257534 - DNA, 20 bp, Artificial
  CRISPR gRNA sequence
gataacctgggaagcatttt

SEQ ID NO: 257535 - DNA, 20 bp, Artificial
  CRISPR gRNA sequence
ttagtacttactccaaccct

SEQ ID NO: 257536 - DNA, 20 bp, Artificial
  CRISPR gRNA sequence
tagtacttactccaaccctg

SEQ ID NO: 257537 - DNA, 20 bp, Artificial
  CRISPR gRNA sequence
actccctttgccaaacctcc

SEQ ID NO: 257538 - DNA, 20 bp, Artificial
  CRISPR gRNA sequence
tttgccaaacctccaagtgt

SEQ ID NO: 257539 - DNA, 20 bp, Artificial
  CRISPR gRNA sequence
caagtgtcagcctctgcctc

SEQ ID NO: 257540 - DNA, 20 bp, Artificial
  CRISPR gRNA sequence
cggacacccaaaccaaatca

SEQ ID NO: 257541 - DNA, 20 bp, Artificial
  CRISPR gRNA sequence
cacccaaaccaaatcatagc

SEQ ID NO: 257542 - DNA, 20 bp, Artificial
  CRISPR gRNA sequence
ccaaaccaaatcatagctgg

SEQ ID NO: 257543 - DNA, 20 bp, Artificial
  CRISPR gRNA sequence
aaaccaaatcatagctggta

SEQ ID NO: 257544 - DNA, 20 bp, Artificial
  CRISPR gRNA sequence
accaaatcatagctggtaga

SEQ ID NO: 257545 - DNA, 20 bp, Artificial
  CRISPR gRNA sequence
ccaaatcatagctggtagag

SEQ ID NO: 257546 - DNA, 20 bp, Artificial
  CRISPR gRNA sequence
catagctggtagagaggcca

SEQ ID NO: 257547 - DNA, 20 bp, Artificial
  CRISPR gRNA sequence
gtagagaggccacagcaata

SEQ ID NO: 257548 - DNA, 20 bp, Artificial
  CRISPR gRNA sequence
tagagaggccacagcaataa

SEQ ID NO: 257549 - DNA, 20 bp, Artificial
  CRISPR gRNA sequence
aataaaggtgtcttgattct

SEQ ID NO: 257550 - DNA, 20 bp, Artificial
  CRISPR gRNA sequence
ataaaggtgtcttgattctc

SEQ ID NO: 257551 - DNA, 20 bp, Artificial
  CRISPR gRNA sequence
cattgcacataaaataatga

SEQ ID NO: 257552 - DNA, 20 bp, Artificial
  CRISPR gRNA sequence
attgcacataaaataatgaa

SEQ ID NO: 257553 - DNA, 20 bp, Artificial
  CRISPR gRNA sequence
aaataatgaaaggtctgttg

SEQ ID NO: 257554 - DNA, 20 bp, Artificial
  CRISPR gRNA sequence
aatgaaaggtctgttgcagt

SEQ ID NO: 257555 - DNA, 20 bp, Artificial
  CRISPR gRNA sequence
cagctcccatgcttatcctc

SEQ ID NO: 257556 - DNA, 20 bp, Artificial
  CRISPR gRNA sequence
gcttatcctcaagtgattgt

SEQ ID NO: 257557 - DNA, 20 bp, Artificial
  CRISPR gRNA sequence
atcctcaagtgattgtcaga

SEQ ID NO: 257558 - DNA, 20 bp, Artificial
  CRISPR gRNA sequence
ctcaagtgattgtcagatgg

SEQ ID NO: 257559 - DNA, 20 bp, Artificial
  CRISPR gRNA sequence
tatcaccctaactctaaaca

SEQ ID NO: 257560 - DNA, 20 bp, Artificial
  CRISPR gRNA sequence
caccctaactctaaacacag

SEQ ID NO: 257561 - DNA, 20 bp, Artificial
  CRISPR gRNA sequence
cctaactctaaacacagcag

SEQ ID NO: 257562 - DNA, 20 bp, Artificial
  CRISPR gRNA sequence
ctaactctaaacacagcagt

SEQ ID NO: 257563 - DNA, 20 bp, Artificial
  CRISPR gRNA sequence
cagcagtgggatgaaaatga

SEQ ID NO: 257564 - DNA, 20 bp, Artificial
  CRISPR gRNA sequence
ggatgaaaatgacagatgca

SEQ ID NO: 257565 - DNA, 20 bp, Artificial
  CRISPR gRNA sequence
gaaaatgacagatgcatggc

SEQ ID NO: 257566 - DNA, 20 bp, Artificial
  CRISPR gRNA sequence
aaaatgacagatgcatggct

SEQ ID NO: 257567 - DNA, 20 bp, Artificial
  CRISPR gRNA sequence
ggctgggaacaaacaccacg

SEQ ID NO: 257568 - DNA, 20 bp, Artificial
  CRISPR gRNA sequence
caaacaccacgcagaaccta

SEQ ID NO: 257569 - DNA, 20 bp, Artificial
  CRISPR gRNA sequence
ctacagcacccatgtgcatt

SEQ ID NO: 257570 - DNA, 20 bp, Artificial
  CRISPR gRNA sequence
agtatgtgtgcatatgtgtg

SEQ ID NO: 257571 - DNA, 20 bp, Artificial
  CRISPR gRNA sequence
gtatgtgtgcatatgtgtgc

SEQ ID NO: 257572 - DNA, 20 bp, Artificial
  CRISPR gRNA sequence
tgtgtgcatatgtgtgcagg

SEQ ID NO: 257573 - DNA, 20 bp, Artificial
  CRISPR gRNA sequence
tgtcatctccaccccttcaa

SEQ ID NO: 257574 - DNA, 20 bp, Artificial
  CRISPR gRNA sequence
accccttcaacagtgaatgt

SEQ ID NO: 257575 - DNA, 20 bp, Artificial
  CRISPR gRNA sequence
agctaatgatatgtaatttc

SEQ ID NO: 257576 - DNA, 20 bp, Artificial
  CRISPR gRNA sequence
ctttgcccttctccccatgc

SEQ ID NO: 257577 - DNA, 20 bp, Artificial
  CRISPR gRNA sequence
agccttacccacttgtttcc

SEQ ID NO: 257578 - DNA, 20 bp, Artificial
  CRISPR gRNA sequence
gccttacccacttgtttcct

SEQ ID NO: 257579 - DNA, 20 bp, Artificial
  CRISPR gRNA sequence
acccacttgtttcctgggaa

SEQ ID NO: 257580 - DNA, 20 bp, Artificial
  CRISPR gRNA sequence
cacttgtttcctgggaacag

SEQ ID NO: 257581 - DNA, 20 bp, Artificial
  CRISPR gRNA sequence
ctgggaacagcagcaataca

SEQ ID NO: 257582 - DNA, 20 bp, Artificial
  CRISPR gRNA sequence
tgggaacagcagcaatacac

SEQ ID NO: 257583 - DNA, 20 bp, Artificial
  CRISPR gRNA sequence
gggaacagcagcaatacaca

SEQ ID NO: 257584 - DNA, 20 bp, Artificial
  CRISPR gRNA sequence
gcaatacacagggcatatgc

SEQ ID NO: 257585 - DNA, 20 bp, Artificial
  CRISPR gRNA sequence
caatacacagggcatatgca

SEQ ID NO: 257586 - DNA, 20 bp, Artificial
  CRISPR gRNA sequence
atatgcaaggtaatctactt

SEQ ID NO: 257587 - DNA, 20 bp, Artificial
  CRISPR gRNA sequence
aggtaatctacttaagtacg

SEQ ID NO: 257588 - DNA, 20 bp, Artificial
  CRISPR gRNA sequence
tacttaagtacgtggtcttc

SEQ ID NO: 257589 - DNA, 20 bp, Artificial
  CRISPR gRNA sequence
cgtggtcttcaagaatctac

SEQ ID NO: 257590 - DNA, 20 bp, Artificial
  CRISPR gRNA sequence
atctactggattattataaa

SEQ ID NO: 257591 - DNA, 20 bp, Artificial
  CRISPR gRNA sequence
tactggattattataaaaag

SEQ ID NO: 257592 - DNA, 20 bp, Artificial
  CRISPR gRNA sequence
attcctcacattatgatctg

SEQ ID NO: 257593 - DNA, 20 bp, Artificial
  CRISPR gRNA sequence
cctcacattatgatctgcag

SEQ ID NO: 257594 - DNA, 20 bp, Artificial
  CRISPR gRNA sequence
ctcacattatgatctgcagt

SEQ ID NO: 257595 - DNA, 20 bp, Artificial
  CRISPR gRNA sequence
tcacattatgatctgcagtg

SEQ ID NO: 257596 - DNA, 20 bp, Artificial
  CRISPR gRNA sequence
ggaacataatgttttttaaa

SEQ ID NO: 257597 - DNA, 20 bp, Artificial
  CRISPR gRNA sequence
gttttttaaaaagatttctt

SEQ ID NO: 257598 - DNA, 20 bp, Artificial
  CRISPR gRNA sequence
ttttttaaaaagatttcttt

SEQ ID NO: 257599 - DNA, 20 bp, Artificial
  CRISPR gRNA sequence
aaaagatttctttaggaaaa

SEQ ID NO: 257600 - DNA, 20 bp, Artificial
  CRISPR gRNA sequence
aaagatttctttaggaaaac

SEQ ID NO: 257601 - DNA, 20 bp, Artificial
  CRISPR gRNA sequence
gatttctttaggaaaacggg

SEQ ID NO: 257602 - DNA, 20 bp, Artificial
  CRISPR gRNA sequence
aggaaaacgggcagctttac

SEQ ID NO: 257603 - DNA, 20 bp, Artificial
  CRISPR gRNA sequence
aacgggcagctttaccagca

SEQ ID NO: 257604 - DNA, 20 bp, Artificial
  CRISPR gRNA sequence
taccagcacagctgcatgaa

SEQ ID NO: 257605 - DNA, 20 bp, Artificial
  CRISPR gRNA sequence
ccagcacagctgcatgaatg

SEQ ID NO: 257606 - DNA, 20 bp, Artificial
  CRISPR gRNA sequence
ctgcatgaatggagaattga

SEQ ID NO: 257607 - DNA, 20 bp, Artificial
  CRISPR gRNA sequence
atgaatggagaattgaaaga

SEQ ID NO: 257608 - DNA, 20 bp, Artificial
  CRISPR gRNA sequence
ggagaattgaaagacagtga

SEQ ID NO: 257609 - DNA, 20 bp, Artificial
  CRISPR gRNA sequence
gagaattgaaagacagtgac

SEQ ID NO: 257610 - DNA, 20 bp, Artificial
  CRISPR gRNA sequence
tgaaagacagtgacaggtgc

SEQ ID NO: 257611 - DNA, 20 bp, Artificial
  CRISPR gRNA sequence
tgacaggtgctggcctgtga

SEQ ID NO: 257612 - DNA, 20 bp, Artificial
  CRISPR gRNA sequence
ggcctgtgacagcttgacca

SEQ ID NO: 257613 - DNA, 20 bp, Artificial
  CRISPR gRNA sequence
gcctgtgacagcttgaccaa

SEQ ID NO: 257614 - DNA, 20 bp, Artificial
  CRISPR gRNA sequence
cctgtgacagcttgaccaaa

SEQ ID NO: 257615 - DNA, 20 bp, Artificial
  CRISPR gRNA sequence
tgtgacagcttgaccaaagg

SEQ ID NO: 257616 - DNA, 20 bp, Artificial
  CRISPR gRNA sequence
atttactcaaatgtcaacat

SEQ ID NO: 257617 - DNA, 20 bp, Artificial
  CRISPR gRNA sequence
tttactcaaatgtcaacatc

SEQ ID NO: 257618 - DNA, 20 bp, Artificial
  CRISPR gRNA sequence
tcaaatgtcaacatcaggtc

SEQ ID NO: 257619 - DNA, 20 bp, Artificial
  CRISPR gRNA sequence
tcaacatcaggtcaagaact

SEQ ID NO: 257620 - DNA, 20 bp, Artificial
  CRISPR gRNA sequence
catcaggtcaagaactgaga

SEQ ID NO: 257621 - DNA, 20 bp, Artificial
  CRISPR gRNA sequence
aagaactgagatagaatctg

SEQ ID NO: 257622 - DNA, 20 bp, Artificial
  CRISPR gRNA sequence
atagaatctgcagctgctcc

SEQ ID NO: 257623 - DNA, 20 bp, Artificial
  CRISPR gRNA sequence
gctgctcccagaaacccgct

SEQ ID NO: 257624 - DNA, 20 bp, Artificial
  CRISPR gRNA sequence
tcccagaaacccgctcagcc

SEQ ID NO: 257625 - DNA, 20 bp, Artificial
  CRISPR gRNA sequence
gcctagaaacccactcaacc

SEQ ID NO: 257626 - DNA, 20 bp, Artificial
  CRISPR gRNA sequence
actcaacccagaactgccta

SEQ ID NO: 257627 - DNA, 20 bp, Artificial
  CRISPR gRNA sequence
caacccagaactgcctacag

SEQ ID NO: 257628 - DNA, 20 bp, Artificial
  CRISPR gRNA sequence
aactgcctacagtagcatat

SEQ ID NO: 257629 - DNA, 20 bp, Artificial
  CRISPR gRNA sequence
actgcctacagtagcatatc

SEQ ID NO: 257630 - DNA, 20 bp, Artificial
  CRISPR gRNA sequence
acagtagcatatcaggccct

SEQ ID NO: 257631 - DNA, 20 bp, Artificial
  CRISPR gRNA sequence
cagtagcatatcaggccctc

SEQ ID NO: 257632 - DNA, 20 bp, Artificial
  CRISPR gRNA sequence
tagcatatcaggccctcagg

SEQ ID NO: 257633 - DNA, 20 bp, Artificial
  CRISPR gRNA sequence
atcaggccctcaggaagttc

SEQ ID NO: 257634 - DNA, 20 bp, Artificial
  CRISPR gRNA sequence
cctcaggaagttccggaaaa

SEQ ID NO: 257635 - DNA, 20 bp, Artificial
  CRISPR gRNA sequence
ggaaaacagcaacttacatc

SEQ ID NO: 257636 - DNA, 20 bp, Artificial
  CRISPR gRNA sequence
gaaaacagcaacttacatca

SEQ ID NO: 257637 - DNA, 20 bp, Artificial
  CRISPR gRNA sequence
acttacatcaaggcacgctg

SEQ ID NO: 257638 - DNA, 20 bp, Artificial
  CRISPR gRNA sequence
catcaaggcacgctgcagac

SEQ ID NO: 257639 - DNA, 20 bp, Artificial
  CRISPR gRNA sequence
cgctgcagaccagccaaaaa

SEQ ID NO: 257640 - DNA, 20 bp, Artificial
  CRISPR gRNA sequence
gctgcagaccagccaaaaat

SEQ ID NO: 257641 - DNA, 20 bp, Artificial
  CRISPR gRNA sequence
accagccaaaaataggatct

SEQ ID NO: 257642 - DNA, 20 bp, Artificial
  CRISPR gRNA sequence
taggatctcagaaaattacc

SEQ ID NO: 257643 - DNA, 20 bp, Artificial
  CRISPR gRNA sequence
aggatctcagaaaattaccc

SEQ ID NO: 257644 - DNA, 20 bp, Artificial
  CRISPR gRNA sequence
tcagaaaattacccaggaaa

SEQ ID NO: 257645 - DNA, 20 bp, Artificial
  CRISPR gRNA sequence
cccaggaaacagctaaactc

SEQ ID NO: 257646 - DNA, 20 bp, Artificial
  CRISPR gRNA sequence
ccaggaaacagctaaactcc

SEQ ID NO: 257647 - DNA, 20 bp, Artificial
  CRISPR gRNA sequence
caggaaacagctaaactcca

SEQ ID NO: 257648 - DNA, 20 bp, Artificial
  CRISPR gRNA sequence
taaactccagggatccataa

SEQ ID NO: 257649 - DNA, 20 bp, Artificial
  CRISPR gRNA sequence
tccagggatccataatggcc

SEQ ID NO: 257650 - DNA, 20 bp, Artificial
  CRISPR gRNA sequence
aatggcctagatgcccaact

SEQ ID NO: 257651 - DNA, 20 bp, Artificial
  CRISPR gRNA sequence
gcctagatgcccaactcagc

SEQ ID NO: 257652 - DNA, 20 bp, Artificial
  CRISPR gRNA sequence
cctagatgcccaactcagca

SEQ ID NO: 257653 - DNA, 20 bp, Artificial
  CRISPR gRNA sequence
acttgttgcttaaataccaa

SEQ ID NO: 257654 - DNA, 20 bp, Artificial
  CRISPR gRNA sequence
tgttgcttaaataccaacag

SEQ ID NO: 257655 - DNA, 20 bp, Artificial
  CRISPR gRNA sequence
gttgcttaaataccaacagc

SEQ ID NO: 257656 - DNA, 20 bp, Artificial
  CRISPR gRNA sequence
ttaaataccaacagcaggaa

SEQ ID NO: 257657 - DNA, 20 bp, Artificial
  CRISPR gRNA sequence
taccaacagcaggaaaagat

SEQ ID NO: 257658 - DNA, 20 bp, Artificial
  CRISPR gRNA sequence
acagcaggaaaagatgagcc

SEQ ID NO: 257659 - DNA, 20 bp, Artificial
  CRISPR gRNA sequence
agcaggaaaagatgagccca

SEQ ID NO: 257660 - DNA, 20 bp, Artificial
  CRISPR gRNA sequence
ctatgttattctacgaaata

SEQ ID NO: 257661 - DNA, 20 bp, Artificial
  CRISPR gRNA sequence
aacttgtatttatactcttt

SEQ ID NO: 257662 - DNA, 20 bp, Artificial
  CRISPR gRNA sequence
tgtatttatactcttttggt

SEQ ID NO: 257663 - DNA, 20 bp, Artificial
  CRISPR gRNA sequence
tatttatactcttttggtaa

SEQ ID NO: 257664 - DNA, 20 bp, Artificial
  CRISPR gRNA sequence
tttatactcttttggtaaga

SEQ ID NO: 257665 - DNA, 20 bp, Artificial
  CRISPR gRNA sequence
tcttttggtaagagagtaca

SEQ ID NO: 257666 - DNA, 20 bp, Artificial
  CRISPR gRNA sequence
ggtaagagagtacaaagacc

SEQ ID NO: 257667 - DNA, 20 bp, Artificial
  CRISPR gRNA sequence
gtaagagagtacaaagaccc

SEQ ID NO: 257668 - DNA, 20 bp, Artificial
  CRISPR gRNA sequence
gagtacaaagacccaggttt

SEQ ID NO: 257669 - DNA, 20 bp, Artificial
  CRISPR gRNA sequence
aaagacccaggtttgagatg

SEQ ID NO: 257670 - DNA, 20 bp, Artificial
  CRISPR gRNA sequence
cccaggtttgagatgcagat

SEQ ID NO: 257671 - DNA, 20 bp, Artificial
  CRISPR gRNA sequence
aggtttgagatgcagataag

SEQ ID NO: 257672 - DNA, 20 bp, Artificial
  CRISPR gRNA sequence
tttgagatgcagataagtgg

SEQ ID NO: 257673 - DNA, 20 bp, Artificial
  CRISPR gRNA sequence
agataagtggtagtttttat

SEQ ID NO: 257674 - DNA, 20 bp, Artificial
  CRISPR gRNA sequence
gataagtggtagtttttatt

SEQ ID NO: 257675 - DNA, 20 bp, Artificial
  CRISPR gRNA sequence
tgggtaaccgaattgactac

SEQ ID NO: 257676 - DNA, 20 bp, Artificial
  CRISPR gRNA sequence
ggtaaccgaattgactacaa

SEQ ID NO: 257677 - DNA, 20 bp, Artificial
  CRISPR gRNA sequence
gtaaccgaattgactacaag

SEQ ID NO: 257678 - DNA, 20 bp, Artificial
  CRISPR gRNA sequence
ctacaagaggccacaaatga

SEQ ID NO: 257679 - DNA, 20 bp, Artificial
  CRISPR gRNA sequence
tacaagaggccacaaatgac

SEQ ID NO: 257680 - DNA, 20 bp, Artificial
  CRISPR gRNA sequence
tgacaggactgcccaattca

SEQ ID NO: 257681 - DNA, 20 bp, Artificial
  CRISPR gRNA sequence
gacaggactgcccaattcac

SEQ ID NO: 257682 - DNA, 20 bp, Artificial
  CRISPR gRNA sequence
acaggactgcccaattcaca

SEQ ID NO: 257683 - DNA, 20 bp, Artificial
  CRISPR gRNA sequence
caggactgcccaattcacag

SEQ ID NO: 257684 - DNA, 20 bp, Artificial
  CRISPR gRNA sequence
aggactgcccaattcacagg

SEQ ID NO: 257685 - DNA, 20 bp, Artificial
  CRISPR gRNA sequence
ccaattcacagggggtctgt

SEQ ID NO: 257686 - DNA, 20 bp, Artificial
  CRISPR gRNA sequence
cacagggggtctgtaagaca

SEQ ID NO: 257687 - DNA, 20 bp, Artificial
  CRISPR gRNA sequence
aataaaatttttttaaaaca

SEQ ID NO: 257688 - DNA, 20 bp, Artificial
  CRISPR gRNA sequence
aaatttttttaaaacaaagc

SEQ ID NO: 257689 - DNA, 20 bp, Artificial
  CRISPR gRNA sequence
caaagcaagatgaatctcac

SEQ ID NO: 257690 - DNA, 20 bp, Artificial
  CRISPR gRNA sequence
aaagcaagatgaatctcact

SEQ ID NO: 257691 - DNA, 20 bp, Artificial
  CRISPR gRNA sequence
agatgaatctcactaggaat

SEQ ID NO: 257692 - DNA, 20 bp, Artificial
  CRISPR gRNA sequence
tgaatctcactaggaattag

SEQ ID NO: 257693 - DNA, 20 bp, Artificial
  CRISPR gRNA sequence
taggaattagtagtactgcc

SEQ ID NO: 257694 - DNA, 20 bp, Artificial
  CRISPR gRNA sequence
aggaattagtagtactgcca

SEQ ID NO: 257695 - DNA, 20 bp, Artificial
  CRISPR gRNA sequence
agtactgccaaggaaaaacc

SEQ ID NO: 257696 - DNA, 20 bp, Artificial
  CRISPR gRNA sequence
agtgtgtctatgatgtgtct

SEQ ID NO: 257697 - DNA, 20 bp, Artificial
  CRISPR gRNA sequence
ctatgatgtgtctgagttga

SEQ ID NO: 257698 - DNA, 20 bp, Artificial
  CRISPR gRNA sequence
gtgtctgagttgaaagtgaa

SEQ ID NO: 257699 - DNA, 20 bp, Artificial
  CRISPR gRNA sequence
gaacggtttaaattcattga

SEQ ID NO: 257700 - DNA, 20 bp, Artificial
  CRISPR gRNA sequence
ggtttaaattcattgaaagt

SEQ ID NO: 257701 - DNA, 20 bp, Artificial
  CRISPR gRNA sequence
ttaaattcattgaaagtgag

SEQ ID NO: 257702 - DNA, 20 bp, Artificial
  CRISPR gRNA sequence
agaagctgcttttgtccctt

SEQ ID NO: 257703 - DNA, 20 bp, Artificial
  CRISPR gRNA sequence
gaagctgcttttgtcccttt

SEQ ID NO: 257704 - DNA, 20 bp, Artificial
  CRISPR gRNA sequence
tttgtccctttgggtgactc

SEQ ID NO: 257705 - DNA, 20 bp, Artificial
  CRISPR gRNA sequence
aacaaattgatgtctcatta

SEQ ID NO: 257706 - DNA, 20 bp, Artificial
  CRISPR gRNA sequence
ttctaatgaatatttataat

SEQ ID NO: 257707 - DNA, 20 bp, Artificial
  CRISPR gRNA sequence
tataataagttttcaataat

SEQ ID NO: 257708 - DNA, 20 bp, Artificial
  CRISPR gRNA sequence
aataagttttcaataatgag

SEQ ID NO: 257709 - DNA, 20 bp, Artificial
  CRISPR gRNA sequence
caataatgagcagtgtcctc

SEQ ID NO: 257710 - DNA, 20 bp, Artificial
  CRISPR gRNA sequence
gcagtgtcctctggccattg

SEQ ID NO: 257711 - DNA, 20 bp, Artificial
  CRISPR gRNA sequence
cagtgtcctctggccattga

SEQ ID NO: 257712 - DNA, 20 bp, Artificial
  CRISPR gRNA sequence
cctctggccattgaaggtta

SEQ ID NO: 257713 - DNA, 20 bp, Artificial
  CRISPR gRNA sequence
attcccaaaactactttctg

SEQ ID NO: 257714 - DNA, 20 bp, Artificial
  CRISPR gRNA sequence
tcccaaaactactttctgca

SEQ ID NO: 257715 - DNA, 20 bp, Artificial
  CRISPR gRNA sequence
aaaactactttctgcagagc

SEQ ID NO: 257716 - DNA, 20 bp, Artificial
  CRISPR gRNA sequence
gctagtaaattactttgacc

SEQ ID NO: 257717 - DNA, 20 bp, Artificial
  CRISPR gRNA sequence
ctagtaaattactttgacct

SEQ ID NO: 257718 - DNA, 20 bp, Artificial
  CRISPR gRNA sequence
taaattactttgacctaggt

SEQ ID NO: 257719 - DNA, 20 bp, Artificial
  CRISPR gRNA sequence
tgacctaggtcagcatatca

SEQ ID NO: 257720 - DNA, 20 bp, Artificial
  CRISPR gRNA sequence
gacctaggtcagcatatcac

SEQ ID NO: 257721 - DNA, 20 bp, Artificial
  CRISPR gRNA sequence
acctaggtcagcatatcaca

SEQ ID NO: 257722 - DNA, 20 bp, Artificial
  CRISPR gRNA sequence
cctaggtcagcatatcacag

SEQ ID NO: 257723 - DNA, 20 bp, Artificial
  CRISPR gRNA sequence
tcacaggggaatgcctttcc

SEQ ID NO: 257724 - DNA, 20 bp, Artificial
  CRISPR gRNA sequence
acaggggaatgcctttcctg

SEQ ID NO: 257725 - DNA, 20 bp, Artificial
  CRISPR gRNA sequence
caggggaatgcctttcctgg

SEQ ID NO: 257726 - DNA, 20 bp, Artificial
  CRISPR gRNA sequence
aggggaatgcctttcctgga

SEQ ID NO: 257727 - DNA, 20 bp, Artificial
  CRISPR gRNA sequence
ggggaatgcctttcctggag

SEQ ID NO: 257728 - DNA, 20 bp, Artificial
  CRISPR gRNA sequence
ctttcctggaggggtatcca

SEQ ID NO: 257729 - DNA, 20 bp, Artificial
  CRISPR gRNA sequence
tttcctggaggggtatccaa

SEQ ID NO: 257730 - DNA, 20 bp, Artificial
  CRISPR gRNA sequence
ttcctggaggggtatccaaa

SEQ ID NO: 257731 - DNA, 20 bp, Artificial
  CRISPR gRNA sequence
atccaaagggccactgcacc

SEQ ID NO: 257732 - DNA, 20 bp, Artificial
  CRISPR gRNA sequence
ggccactgcacctggccttt

SEQ ID NO: 257733 - DNA, 20 bp, Artificial
  CRISPR gRNA sequence
actgcacctggcctttaagt

SEQ ID NO: 257734 - DNA, 20 bp, Artificial
  CRISPR gRNA sequence
cacctggcctttaagttaga

SEQ ID NO: 257735 - DNA, 20 bp, Artificial
  CRISPR gRNA sequence
ggcctttaagttagaaagtt

SEQ ID NO: 257736 - DNA, 20 bp, Artificial
  CRISPR gRNA sequence
agaaagttgagattcccaat

SEQ ID NO: 257737 - DNA, 20 bp, Artificial
  CRISPR gRNA sequence
aaagttgagattcccaataa

SEQ ID NO: 257738 - DNA, 20 bp, Artificial
  CRISPR gRNA sequence
aagttgagattcccaataag

SEQ ID NO: 257739 - DNA, 20 bp, Artificial
  CRISPR gRNA sequence
ttcccaataagaggattgaa

SEQ ID NO: 257740 - DNA, 20 bp, Artificial
  CRISPR gRNA sequence
aagaggattgaaaagccata

SEQ ID NO: 257741 - DNA, 20 bp, Artificial
  CRISPR gRNA sequence
aggattgaaaagccatatgg

SEQ ID NO: 257742 - DNA, 20 bp, Artificial
  CRISPR gRNA sequence
ggattgaaaagccatatggt

SEQ ID NO: 257743 - DNA, 20 bp, Artificial
  CRISPR gRNA sequence
aagccatatggtaggcataa

SEQ ID NO: 257744 - DNA, 20 bp, Artificial
  CRISPR gRNA sequence
atggtaggcataaaagccaa

SEQ ID NO: 257745 - DNA, 20 bp, Artificial
  CRISPR gRNA sequence
taggcataaaagccaatggc

SEQ ID NO: 257746 - DNA, 20 bp, Artificial
  CRISPR gRNA sequence
ggcataaaagccaatggcca

SEQ ID NO: 257747 - DNA, 20 bp, Artificial
  CRISPR gRNA sequence
aaagccaatggccagagatt

SEQ ID NO: 257748 - DNA, 20 bp, Artificial
  CRISPR gRNA sequence
gccaatggccagagattaag

SEQ ID NO: 257749 - DNA, 20 bp, Artificial
  CRISPR gRNA sequence
gccagagattaagaagaaac

SEQ ID NO: 257750 - DNA, 20 bp, Artificial
  CRISPR gRNA sequence
attaagaagaaacaagaact

SEQ ID NO: 257751 - DNA, 20 bp, Artificial
  CRISPR gRNA sequence
tctaaaaactcgaaaattat

SEQ ID NO: 257752 - DNA, 20 bp, Artificial
  CRISPR gRNA sequence
cgaaaattatcagcaaacac

SEQ ID NO: 257753 - DNA, 20 bp, Artificial
  CRISPR gRNA sequence
aaaattatcagcaaacacca

SEQ ID NO: 257754 - DNA, 20 bp, Artificial
  CRISPR gRNA sequence
aaattatcagcaaacaccag

SEQ ID NO: 257755 - DNA, 20 bp, Artificial
  CRISPR gRNA sequence
cagcaaacaccagaggatca

SEQ ID NO: 257756 - DNA, 20 bp, Artificial
  CRISPR gRNA sequence
aaacaccagaggatcaaagt

SEQ ID NO: 257757 - DNA, 20 bp, Artificial
  CRISPR gRNA sequence
caccagaggatcaaagttag

SEQ ID NO: 257758 - DNA, 20 bp, Artificial
  CRISPR gRNA sequence
accagaggatcaaagttaga

SEQ ID NO: 257759 - DNA, 20 bp, Artificial
  CRISPR gRNA sequence
gaggatcaaagttagaaggt

SEQ ID NO: 257760 - DNA, 20 bp, Artificial
  CRISPR gRNA sequence
atcaaagttagaaggtaagt

SEQ ID NO: 257761 - DNA, 20 bp, Artificial
  CRISPR gRNA sequence
gttagaaggtaagttggatg

SEQ ID NO: 257762 - DNA, 20 bp, Artificial
  CRISPR gRNA sequence
gtaagttggatgaagatacc

SEQ ID NO: 257763 - DNA, 20 bp, Artificial
  CRISPR gRNA sequence
tggatgaagataccaagatc

SEQ ID NO: 257764 - DNA, 20 bp, Artificial
  CRISPR gRNA sequence
tgaagataccaagatctgga

SEQ ID NO: 257765 - DNA, 20 bp, Artificial
  CRISPR gRNA sequence
gaagataccaagatctggaa

SEQ ID NO: 257766 - DNA, 20 bp, Artificial
  CRISPR gRNA sequence
accaagatctggaaaggtga

SEQ ID NO: 257767 - DNA, 20 bp, Artificial
  CRISPR gRNA sequence
aagatctggaaaggtgaaag

SEQ ID NO: 257768 - DNA, 20 bp, Artificial
  CRISPR gRNA sequence
tgaaagtagtcaactaacat

SEQ ID NO: 257769 - DNA, 20 bp, Artificial
  CRISPR gRNA sequence
aaagtagtcaactaacatca

SEQ ID NO: 257770 - DNA, 20 bp, Artificial
  CRISPR gRNA sequence
aagtagtcaactaacatcag

SEQ ID NO: 257771 - DNA, 20 bp, Artificial
  CRISPR gRNA sequence
tagtcaactaacatcagagg

SEQ ID NO: 257772 - DNA, 20 bp, Artificial
  CRISPR gRNA sequence
ctaacatcagaggcagaatt

SEQ ID NO: 257773 - DNA, 20 bp, Artificial
  CRISPR gRNA sequence
taacatcagaggcagaattc

SEQ ID NO: 257774 - DNA, 20 bp, Artificial
  CRISPR gRNA sequence
ggcaacattttacaatacca

SEQ ID NO: 257775 - DNA, 20 bp, Artificial
  CRISPR gRNA sequence
caataccaaagccccacctt

SEQ ID NO: 257776 - DNA, 20 bp, Artificial
  CRISPR gRNA sequence
aataccaaagccccaccttc

SEQ ID NO: 257777 - DNA, 20 bp, Artificial
  CRISPR gRNA sequence
ataccaaagccccaccttca

SEQ ID NO: 257778 - DNA, 20 bp, Artificial
  CRISPR gRNA sequence
caaagccccaccttcagggt

SEQ ID NO: 257779 - DNA, 20 bp, Artificial
  CRISPR gRNA sequence
aaagccccaccttcagggtt

SEQ ID NO: 257780 - DNA, 20 bp, Artificial
  CRISPR gRNA sequence
cttcagggttgggcaacttg

SEQ ID NO: 257781 - DNA, 20 bp, Artificial
  CRISPR gRNA sequence
cagggttgggcaacttgcag

SEQ ID NO: 257782 - DNA, 20 bp, Artificial
  CRISPR gRNA sequence
agggttgggcaacttgcaga

SEQ ID NO: 257783 - DNA, 20 bp, Artificial
  CRISPR gRNA sequence
ttgggcaacttgcagaaggc

SEQ ID NO: 257784 - DNA, 20 bp, Artificial
  CRISPR gRNA sequence
gcaacttgcagaaggcaagc

SEQ ID NO: 257785 - DNA, 20 bp, Artificial
  CRISPR gRNA sequence
caacttgcagaaggcaagcc

SEQ ID NO: 257786 - DNA, 20 bp, Artificial
  CRISPR gRNA sequence
ggcaagccaggcaaattctt

SEQ ID NO: 257787 - DNA, 20 bp, Artificial
  CRISPR gRNA sequence
caaattcttaagatgatacc

SEQ ID NO: 257788 - DNA, 20 bp, Artificial
  CRISPR gRNA sequence
ttaagatgatacctagtata

SEQ ID NO: 257789 - DNA, 20 bp, Artificial
  CRISPR gRNA sequence
tacctagtataaagaatttc

SEQ ID NO: 257790 - DNA, 20 bp, Artificial
  CRISPR gRNA sequence
acctagtataaagaatttcc

SEQ ID NO: 257791 - DNA, 20 bp, Artificial
  CRISPR gRNA sequence
tataaagaatttccaggaac

SEQ ID NO: 257792 - DNA, 20 bp, Artificial
  CRISPR gRNA sequence
ccactttgtttcctaccctg

SEQ ID NO: 257793 - DNA, 20 bp, Artificial
  CRISPR gRNA sequence
tttgtttcctaccctgcggc

SEQ ID NO: 257794 - DNA, 20 bp, Artificial
  CRISPR gRNA sequence
ttcctaccctgcggcaagta

SEQ ID NO: 257795 - DNA, 20 bp, Artificial
  CRISPR gRNA sequence
cctaccctgcggcaagtaca

SEQ ID NO: 257796 - DNA, 20 bp, Artificial
  CRISPR gRNA sequence
ccctgcggcaagtacagagt

SEQ ID NO: 257797 - DNA, 20 bp, Artificial
  CRISPR gRNA sequence
ggcaagtacagagtaagcaa

SEQ ID NO: 257798 - DNA, 20 bp, Artificial
  CRISPR gRNA sequence
gcaagtacagagtaagcaac

SEQ ID NO: 257799 - DNA, 20 bp, Artificial
  CRISPR gRNA sequence
agtacagagtaagcaacagg

SEQ ID NO: 257800 - DNA, 20 bp, Artificial
  CRISPR gRNA sequence
agcctgacaaatgtccatct

SEQ ID NO: 257801 - DNA, 20 bp, Artificial
  CRISPR gRNA sequence
acaaatgtccatctgagccc

SEQ ID NO: 257802 - DNA, 20 bp, Artificial
  CRISPR gRNA sequence
caaatgtccatctgagccct

SEQ ID NO: 257803 - DNA, 20 bp, Artificial
  CRISPR gRNA sequence
aaatgtccatctgagcccta

SEQ ID NO: 257804 - DNA, 20 bp, Artificial
  CRISPR gRNA sequence
cctagggtcttctgaactgc

SEQ ID NO: 257805 - DNA, 20 bp, Artificial
  CRISPR gRNA sequence
ctagggtcttctgaactgca

SEQ ID NO: 257806 - DNA, 20 bp, Artificial
  CRISPR gRNA sequence
agggtcttctgaactgcaag

SEQ ID NO: 257807 - DNA, 20 bp, Artificial
  CRISPR gRNA sequence
tctgaactgcaaggagcatg

SEQ ID NO: 257808 - DNA, 20 bp, Artificial
  CRISPR gRNA sequence
ctgaactgcaaggagcatgt

SEQ ID NO: 257809 - DNA, 20 bp, Artificial
  CRISPR gRNA sequence
tgaactgcaaggagcatgtg

SEQ ID NO: 257810 - DNA, 20 bp, Artificial
  CRISPR gRNA sequence
agcatgtggggaacaactga

SEQ ID NO: 257811 - DNA, 20 bp, Artificial
  CRISPR gRNA sequence
gcatgtggggaacaactgaa

SEQ ID NO: 257812 - DNA, 20 bp, Artificial
  CRISPR gRNA sequence
gtggggaacaactgaaaggt

SEQ ID NO: 257813 - DNA, 20 bp, Artificial
  CRISPR gRNA sequence
aacaactgaaaggtaagctt

SEQ ID NO: 257814 - DNA, 20 bp, Artificial
  CRISPR gRNA sequence
tgaaaggtaagctttggcaa

SEQ ID NO: 257815 - DNA, 20 bp, Artificial
  CRISPR gRNA sequence
gaaaggtaagctttggcaat

SEQ ID NO: 257816 - DNA, 20 bp, Artificial
  CRISPR gRNA sequence
gtaagctttggcaataggcc

SEQ ID NO: 257817 - DNA, 20 bp, Artificial
  CRISPR gRNA sequence
agctttggcaataggccaag

SEQ ID NO: 257818 - DNA, 20 bp, Artificial
  CRISPR gRNA sequence
ctttggcaataggccaagaa

SEQ ID NO: 257819 - DNA, 20 bp, Artificial
  CRISPR gRNA sequence
ataggccaagaagagtctaa

SEQ ID NO: 257820 - DNA, 20 bp, Artificial
  CRISPR gRNA sequence
agaagagtctaaaagaatct

SEQ ID NO: 257821 - DNA, 20 bp, Artificial
  CRISPR gRNA sequence
agtctaaaagaatctaagac

SEQ ID NO: 257822 - DNA, 20 bp, Artificial
  CRISPR gRNA sequence
aagaatctaagactggataa

SEQ ID NO: 257823 - DNA, 20 bp, Artificial
  CRISPR gRNA sequence
agaatctaagactggataat

SEQ ID NO: 257824 - DNA, 20 bp, Artificial
  CRISPR gRNA sequence
atctaagactggataatagg

SEQ ID NO: 257825 - DNA, 20 bp, Artificial
  CRISPR gRNA sequence
tctaagactggataatagga

SEQ ID NO: 257826 - DNA, 20 bp, Artificial
  CRISPR gRNA sequence
gactggataataggaaggca

SEQ ID NO: 257827 - DNA, 20 bp, Artificial
  CRISPR gRNA sequence
ataataggaaggcatggctg

SEQ ID NO: 257828 - DNA, 20 bp, Artificial
  CRISPR gRNA sequence
ggaaggcatggctgtggatc

SEQ ID NO: 257829 - DNA, 20 bp, Artificial
  CRISPR gRNA sequence
gaaggcatggctgtggatcc

SEQ ID NO: 257830 - DNA, 20 bp, Artificial
  CRISPR gRNA sequence
tggatccaggtctgtacccg

SEQ ID NO: 257831 - DNA, 20 bp, Artificial
  CRISPR gRNA sequence
ggtctgtacccgcagtcacc

SEQ ID NO: 257832 - DNA, 20 bp, Artificial
  CRISPR gRNA sequence
acccgcagtcaccaagctga

SEQ ID NO: 257833 - DNA, 20 bp, Artificial
  CRISPR gRNA sequence
gtcaccaagctgacagtaaa

SEQ ID NO: 257834 - DNA, 20 bp, Artificial
  CRISPR gRNA sequence
cagaatgacttcatatgata

SEQ ID NO: 257835 - DNA, 20 bp, Artificial
  CRISPR gRNA sequence
acttcatatgatatggcttt

SEQ ID NO: 257836 - DNA, 20 bp, Artificial
  CRISPR gRNA sequence
tcactgacccatctatgaat

SEQ ID NO: 257837 - DNA, 20 bp, Artificial
  CRISPR gRNA sequence
cactgacccatctatgaatt

SEQ ID NO: 257838 - DNA, 20 bp, Artificial
  CRISPR gRNA sequence
ctatgaattaggtacatata

SEQ ID NO: 257839 - DNA, 20 bp, Artificial
  CRISPR gRNA sequence
catatacagattatgcctta

SEQ ID NO: 257840 - DNA, 20 bp, Artificial
  CRISPR gRNA sequence
acagattatgccttaaagat

SEQ ID NO: 257841 - DNA, 20 bp, Artificial
  CRISPR gRNA sequence
taaagatgagtatcatactt

SEQ ID NO: 257842 - DNA, 20 bp, Artificial
  CRISPR gRNA sequence
aaagatgagtatcatacttc

SEQ ID NO: 257843 - DNA, 20 bp, Artificial
  CRISPR gRNA sequence
gatgagtatcatacttcagg

SEQ ID NO: 257844 - DNA, 20 bp, Artificial
  CRISPR gRNA sequence
aatccttaatttgacctctc

SEQ ID NO: 257845 - DNA, 20 bp, Artificial
  CRISPR gRNA sequence
tccttaatttgacctctctg

SEQ ID NO: 257846 - DNA, 20 bp, Artificial
  CRISPR gRNA sequence
ccttaatttgacctctctgg

SEQ ID NO: 257847 - DNA, 20 bp, Artificial
  CRISPR gRNA sequence
tatcaattcatcaatccaat

SEQ ID NO: 257848 - DNA, 20 bp, Artificial
  CRISPR gRNA sequence
caatccaataagcattcatt

SEQ ID NO: 257849 - DNA, 20 bp, Artificial
  CRISPR gRNA sequence
caaatgtacttaatatcaaa

SEQ ID NO: 257850 - DNA, 20 bp, Artificial
  CRISPR gRNA sequence
aatgtacttaatatcaaatg

SEQ ID NO: 257851 - DNA, 20 bp, Artificial
  CRISPR gRNA sequence
aatatcaaatggagaatatc

SEQ ID NO: 257852 - DNA, 20 bp, Artificial
  CRISPR gRNA sequence
tatcaaatggagaatatcaa

SEQ ID NO: 257853 - DNA, 20 bp, Artificial
  CRISPR gRNA sequence
atggagaatatcaagagaaa

SEQ ID NO: 257854 - DNA, 20 bp, Artificial
  CRISPR gRNA sequence
tatcaagagaaatagtcttt

SEQ ID NO: 257855 - DNA, 20 bp, Artificial
  CRISPR gRNA sequence
tcaagagaaatagtcttttg

SEQ ID NO: 257856 - DNA, 20 bp, Artificial
  CRISPR gRNA sequence
atagtcttttggagactatc

SEQ ID NO: 257857 - DNA, 20 bp, Artificial
  CRISPR gRNA sequence
agtcttttggagactatcaa

SEQ ID NO: 257858 - DNA, 20 bp, Artificial
  CRISPR gRNA sequence
ttggagactatcaagagaaa

SEQ ID NO: 257859 - DNA, 20 bp, Artificial
  CRISPR gRNA sequence
agaaatagtcttttatgttt

SEQ ID NO: 257860 - DNA, 20 bp, Artificial
  CRISPR gRNA sequence
tgagaatacatttctcattg

SEQ ID NO: 257861 - DNA, 20 bp, Artificial
  CRISPR gRNA sequence
tcatccatgcatgtaacttc

SEQ ID NO: 257862 - DNA, 20 bp, Artificial
  CRISPR gRNA sequence
aacttctagaaaaaaattca

SEQ ID NO: 257863 - DNA, 20 bp, Artificial
  CRISPR gRNA sequence
aaaaaaattcaaagacaaca

SEQ ID NO: 257864 - DNA, 20 bp, Artificial
  CRISPR gRNA sequence
aaaaattcaaagacaacatg

SEQ ID NO: 257865 - DNA, 20 bp, Artificial
  CRISPR gRNA sequence
ctgtaccatactatgtacct

SEQ ID NO: 257866 - DNA, 20 bp, Artificial
  CRISPR gRNA sequence
taccatactatgtacctaag

SEQ ID NO: 257867 - DNA, 20 bp, Artificial
  CRISPR gRNA sequence
tatgtacctaagaagtttct

SEQ ID NO: 257868 - DNA, 20 bp, Artificial
  CRISPR gRNA sequence
tacctaagaagtttctgagt

SEQ ID NO: 257869 - DNA, 20 bp, Artificial
  CRISPR gRNA sequence
agaagtttctgagtaagaac

SEQ ID NO: 257870 - DNA, 20 bp, Artificial
  CRISPR gRNA sequence
gaagtttctgagtaagaaca

SEQ ID NO: 257871 - DNA, 20 bp, Artificial
  CRISPR gRNA sequence
aagtttctgagtaagaacaa

SEQ ID NO: 257872 - DNA, 20 bp, Artificial
  CRISPR gRNA sequence
gagtaagaacaagggtcact

SEQ ID NO: 257873 - DNA, 20 bp, Artificial
  CRISPR gRNA sequence
agtaagaacaagggtcactc

SEQ ID NO: 257874 - DNA, 20 bp, Artificial
  CRISPR gRNA sequence
gtaagaacaagggtcactca

SEQ ID NO: 257875 - DNA, 20 bp, Artificial
  CRISPR gRNA sequence
taagaacaagggtcactcag

SEQ ID NO: 257876 - DNA, 20 bp, Artificial
  CRISPR gRNA sequence
caggggtacgttcttaactg

SEQ ID NO: 257877 - DNA, 20 bp, Artificial
  CRISPR gRNA sequence
aggggtacgttcttaactgt

SEQ ID NO: 257878 - DNA, 20 bp, Artificial
  CRISPR gRNA sequence
catcaaaatgtgttcaaacc

SEQ ID NO: 257879 - DNA, 20 bp, Artificial
  CRISPR gRNA sequence
atcaaaatgtgttcaaaccc

SEQ ID NO: 257880 - DNA, 20 bp, Artificial
  CRISPR gRNA sequence
caggccaaaaattcaatgtt

SEQ ID NO: 257881 - DNA, 20 bp, Artificial
  CRISPR gRNA sequence
aggccaaaaattcaatgttg

SEQ ID NO: 257882 - DNA, 20 bp, Artificial
  CRISPR gRNA sequence
ccaaaaattcaatgttgagg

SEQ ID NO: 257883 - DNA, 20 bp, Artificial
  CRISPR gRNA sequence
caaaaattcaatgttgagga

SEQ ID NO: 257884 - DNA, 20 bp, Artificial
  CRISPR gRNA sequence
attcaatgttgaggaaggta

SEQ ID NO: 257885 - DNA, 20 bp, Artificial
  CRISPR gRNA sequence
tattacgtaaacatttgcaa

SEQ ID NO: 257886 - DNA, 20 bp, Artificial
  CRISPR gRNA sequence
acgtaaacatttgcaaaagt

SEQ ID NO: 257887 - DNA, 20 bp, Artificial
  CRISPR gRNA sequence
caaaagttagtacttcaatt

SEQ ID NO: 257888 - DNA, 20 bp, Artificial
  CRISPR gRNA sequence
aagttagtacttcaattcag

SEQ ID NO: 257889 - DNA, 20 bp, Artificial
  CRISPR gRNA sequence
tagtacttcaattcagtggt

SEQ ID NO: 257890 - DNA, 20 bp, Artificial
  CRISPR gRNA sequence
gtacttcaattcagtggtga

SEQ ID NO: 257891 - DNA, 20 bp, Artificial
  CRISPR gRNA sequence
tcaattcagtggtgagagct

SEQ ID NO: 257892 - DNA, 20 bp, Artificial
  CRISPR gRNA sequence
gaaaattctaactcccatta

SEQ ID NO: 257893 - DNA, 20 bp, Artificial
  CRISPR gRNA sequence
ccattatagtttcataatga

SEQ ID NO: 257894 - DNA, 20 bp, Artificial
  CRISPR gRNA sequence
cataatgacagcaccatact

SEQ ID NO: 257895 - DNA, 20 bp, Artificial
  CRISPR gRNA sequence
ctcacacaattcaactgctt

SEQ ID NO: 257896 - DNA, 20 bp, Artificial
  CRISPR gRNA sequence
cacacaattcaactgcttca

SEQ ID NO: 257897 - DNA, 20 bp, Artificial
  CRISPR gRNA sequence
acacaattcaactgcttcag

SEQ ID NO: 257898 - DNA, 20 bp, Artificial
  CRISPR gRNA sequence
acaattcaactgcttcagag

SEQ ID NO: 257899 - DNA, 20 bp, Artificial
  CRISPR gRNA sequence
ggagaaaaaaaaatatgact

SEQ ID NO: 257900 - DNA, 20 bp, Artificial
  CRISPR gRNA sequence
aaaaatatgactcagataaa

SEQ ID NO: 257901 - DNA, 20 bp, Artificial
  CRISPR gRNA sequence
atgactcagataaacagatc

SEQ ID NO: 257902 - DNA, 20 bp, Artificial
  CRISPR gRNA sequence
aacagatctagtttctttgc

SEQ ID NO: 257903 - DNA, 20 bp, Artificial
  CRISPR gRNA sequence
acagatctagtttctttgct

SEQ ID NO: 257904 - DNA, 20 bp, Artificial
  CRISPR gRNA sequence
taggtttgaatacacaattt

SEQ ID NO: 257905 - DNA, 20 bp, Artificial
  CRISPR gRNA sequence
gtttgaatacacaatttcag

SEQ ID NO: 257906 - DNA, 20 bp, Artificial
  CRISPR gRNA sequence
aatacacaatttcagtagcc

SEQ ID NO: 257907 - DNA, 20 bp, Artificial
  CRISPR gRNA sequence
gtttctcatgatttttgatc

SEQ ID NO: 257908 - DNA, 20 bp, Artificial
  CRISPR gRNA sequence
atcaagccaacattgtccat

SEQ ID NO: 257909 - DNA, 20 bp, Artificial
  CRISPR gRNA sequence
ccaacattgtccattggctt

SEQ ID NO: 257910 - DNA, 20 bp, Artificial
  CRISPR gRNA sequence
gtccattggcttcagttgcc

SEQ ID NO: 257911 - DNA, 20 bp, Artificial
  CRISPR gRNA sequence
cttcagttgcctagcttccc

SEQ ID NO: 257912 - DNA, 20 bp, Artificial
  CRISPR gRNA sequence
gcctagcttcccaagttgcc

SEQ ID NO: 257913 - DNA, 20 bp, Artificial
  CRISPR gRNA sequence
cctagcttcccaagttgcct

SEQ ID NO: 257914 - DNA, 20 bp, Artificial
  CRISPR gRNA sequence
gtcataattatattgcaaaa

SEQ ID NO: 257915 - DNA, 20 bp, Artificial
  CRISPR gRNA sequence
tcataattatattgcaaaat

SEQ ID NO: 257916 - DNA, 20 bp, Artificial
  CRISPR gRNA sequence
cataattatattgcaaaatg

SEQ ID NO: 257917 - DNA, 20 bp, Artificial
  CRISPR gRNA sequence
taattatattgcaaaatggg

SEQ ID NO: 257918 - DNA, 20 bp, Artificial
  CRISPR gRNA sequence
ttatattgcaaaatggggag

SEQ ID NO: 257919 - DNA, 20 bp, Artificial
  CRISPR gRNA sequence
attgcaaaatggggagaaga

SEQ ID NO: 257920 - DNA, 20 bp, Artificial
  CRISPR gRNA sequence
ttgcaaaatggggagaagaa

SEQ ID NO: 257921 - DNA, 20 bp, Artificial
  CRISPR gRNA sequence
tccaccctaatttacccatt

SEQ ID NO: 257922 - DNA, 20 bp, Artificial
  CRISPR gRNA sequence
accacctactcaatgccttc

SEQ ID NO: 257923 - DNA, 20 bp, Artificial
  CRISPR gRNA sequence
ccacctactcaatgccttct

SEQ ID NO: 257924 - DNA, 20 bp, Artificial
  CRISPR gRNA sequence
ctgggaaatctaactcatat

SEQ ID NO: 257925 - DNA, 20 bp, Artificial
  CRISPR gRNA sequence
ctcatatcagatttttatct

SEQ ID NO: 257926 - DNA, 20 bp, Artificial
  CRISPR gRNA sequence
tatcagatttttatctcaga

SEQ ID NO: 257927 - DNA, 20 bp, Artificial
  CRISPR gRNA sequence
tcagatttttatctcagata

SEQ ID NO: 257928 - DNA, 20 bp, Artificial
  CRISPR gRNA sequence
tatctcagatagagttgaac

SEQ ID NO: 257929 - DNA, 20 bp, Artificial
  CRISPR gRNA sequence
gatagagttgaacaagctaa

SEQ ID NO: 257930 - DNA, 20 bp, Artificial
  CRISPR gRNA sequence
tagagttgaacaagctaaaa

SEQ ID NO: 257931 - DNA, 20 bp, Artificial
  CRISPR gRNA sequence
agctaaaagagaacctactc

SEQ ID NO: 257932 - DNA, 20 bp, Artificial
  CRISPR gRNA sequence
aaagagaacctactcaagca

SEQ ID NO: 257933 - DNA, 20 bp, Artificial
  CRISPR gRNA sequence
aagagaacctactcaagcat

SEQ ID NO: 257934 - DNA, 20 bp, Artificial
  CRISPR gRNA sequence
agagaacctactcaagcatg

SEQ ID NO: 257935 - DNA, 20 bp, Artificial
  CRISPR gRNA sequence
acctactcaagcatggggaa

SEQ ID NO: 257936 - DNA, 20 bp, Artificial
  CRISPR gRNA sequence
aatcatcatcctatattaaa

SEQ ID NO: 257937 - DNA, 20 bp, Artificial
  CRISPR gRNA sequence
taaacagaaaataaaccaca

SEQ ID NO: 257938 - DNA, 20 bp, Artificial
  CRISPR gRNA sequence
aaacagaaaataaaccacat

SEQ ID NO: 257939 - DNA, 20 bp, Artificial
  CRISPR gRNA sequence
gcaaaattcttgaatgtgtt

SEQ ID NO: 257940 - DNA, 20 bp, Artificial
  CRISPR gRNA sequence
atgtgttcagatttcatgtg

SEQ ID NO: 257941 - DNA, 20 bp, Artificial
  CRISPR gRNA sequence
tgttcagatttcatgtgcag

SEQ ID NO: 257942 - DNA, 20 bp, Artificial
  CRISPR gRNA sequence
agatttcatgtgcagtggaa

SEQ ID NO: 257943 - DNA, 20 bp, Artificial
  CRISPR gRNA sequence
gcagtggaaaagttacataa

SEQ ID NO: 257944 - DNA, 20 bp, Artificial
  CRISPR gRNA sequence
gtggaaaagttacataaaag

SEQ ID NO: 257945 - DNA, 20 bp, Artificial
  CRISPR gRNA sequence
gcagtgctgcttctcttacc

SEQ ID NO: 257946 - DNA, 20 bp, Artificial
  CRISPR gRNA sequence
ctcttacccagaaaataata

SEQ ID NO: 257947 - DNA, 20 bp, Artificial
  CRISPR gRNA sequence
tcttacccagaaaataataa

SEQ ID NO: 257948 - DNA, 20 bp, Artificial
  CRISPR gRNA sequence
ataataaaggccactgttac

SEQ ID NO: 257949 - DNA, 20 bp, Artificial
  CRISPR gRNA sequence
taaaggccactgttactagc

SEQ ID NO: 257950 - DNA, 20 bp, Artificial
  CRISPR gRNA sequence
ccactgttactagcaagcta

SEQ ID NO: 257951 - DNA, 20 bp, Artificial
  CRISPR gRNA sequence
tgttactagcaagctatagc

SEQ ID NO: 257952 - DNA, 20 bp, Artificial
  CRISPR gRNA sequence
actagcaagctatagcaagc

SEQ ID NO: 257953 - DNA, 20 bp, Artificial
  CRISPR gRNA sequence
ctagcaagctatagcaagcc

SEQ ID NO: 257954 - DNA, 20 bp, Artificial
  CRISPR gRNA sequence
aggactccaccaaccaccac

SEQ ID NO: 257955 - DNA, 20 bp, Artificial
  CRISPR gRNA sequence
caaccaccaccagcacccaa

SEQ ID NO: 257956 - DNA, 20 bp, Artificial
  CRISPR gRNA sequence
aaccaccaccagcacccaaa

SEQ ID NO: 257957 - DNA, 20 bp, Artificial
  CRISPR gRNA sequence
accaccaccagcacccaaaa

SEQ ID NO: 257958 - DNA, 20 bp, Artificial
  CRISPR gRNA sequence
caccagcacccaaaagggct

SEQ ID NO: 257959 - DNA, 20 bp, Artificial
  CRISPR gRNA sequence
cagcacccaaaagggcttag

SEQ ID NO: 257960 - DNA, 20 bp, Artificial
  CRISPR gRNA sequence
agcacccaaaagggcttaga

SEQ ID NO: 257961 - DNA, 20 bp, Artificial
  CRISPR gRNA sequence
ccaaaagggcttagaaggtc

SEQ ID NO: 257962 - DNA, 20 bp, Artificial
  CRISPR gRNA sequence
caaaagggcttagaaggtcc

SEQ ID NO: 257963 - DNA, 20 bp, Artificial
  CRISPR gRNA sequence
ggcttagaaggtccgggaaa

SEQ ID NO: 257964 - DNA, 20 bp, Artificial
  CRISPR gRNA sequence
gcttagaaggtccgggaaat

SEQ ID NO: 257965 - DNA, 20 bp, Artificial
  CRISPR gRNA sequence
cttagaaggtccgggaaata

SEQ ID NO: 257966 - DNA, 20 bp, Artificial
  CRISPR gRNA sequence
ttagaaggtccgggaaatag

SEQ ID NO: 257967 - DNA, 20 bp, Artificial
  CRISPR gRNA sequence
ggtccgggaaataggggact

SEQ ID NO: 257968 - DNA, 20 bp, Artificial
  CRISPR gRNA sequence
ggaaataggggacttggaca

SEQ ID NO: 257969 - DNA, 20 bp, Artificial
  CRISPR gRNA sequence
gaaataggggacttggacaa

SEQ ID NO: 257970 - DNA, 20 bp, Artificial
  CRISPR gRNA sequence
tgtttccctgaaaaacaaaa

SEQ ID NO: 257971 - DNA, 20 bp, Artificial
  CRISPR gRNA sequence
tttccctgaaaaacaaaata

SEQ ID NO: 257972 - DNA, 20 bp, Artificial
  CRISPR gRNA sequence
ccctgaaaaacaaaatagag

SEQ ID NO: 257973 - DNA, 20 bp, Artificial
  CRISPR gRNA sequence
atagagtggattaaatgata

SEQ ID NO: 257974 - DNA, 20 bp, Artificial
  CRISPR gRNA sequence
tagagtggattaaatgatac

SEQ ID NO: 257975 - DNA, 20 bp, Artificial
  CRISPR gRNA sequence
tggattaaatgatacaggaa

SEQ ID NO: 257976 - DNA, 20 bp, Artificial
  CRISPR gRNA sequence
atgatacaggaatagcaatt

SEQ ID NO: 257977 - DNA, 20 bp, Artificial
  CRISPR gRNA sequence
atttccttccttgtgaacat

SEQ ID NO: 257978 - DNA, 20 bp, Artificial
  CRISPR gRNA sequence
ttccttccttgtgaacatca

SEQ ID NO: 257979 - DNA, 20 bp, Artificial
  CRISPR gRNA sequence
aacatcagagaaaaatgtga

SEQ ID NO: 257980 - DNA, 20 bp, Artificial
  CRISPR gRNA sequence
aaaaatattaaacatatcac

SEQ ID NO: 257981 - DNA, 20 bp, Artificial
  CRISPR gRNA sequence
tattaaacatatcaccagct

SEQ ID NO: 257982 - DNA, 20 bp, Artificial
  CRISPR gRNA sequence
ttaaacatatcaccagctta

SEQ ID NO: 257983 - DNA, 20 bp, Artificial
  CRISPR gRNA sequence
tatcaccagcttagagtgaa

SEQ ID NO: 257984 - DNA, 20 bp, Artificial
  CRISPR gRNA sequence
agtgaatagatttcctcttt

SEQ ID NO: 257985 - DNA, 20 bp, Artificial
  CRISPR gRNA sequence
ccccaccactgaccatgatc

SEQ ID NO: 257986 - DNA, 20 bp, Artificial
  CRISPR gRNA sequence
accactgaccatgatctggt

SEQ ID NO: 257987 - DNA, 20 bp, Artificial
  CRISPR gRNA sequence
ctggtcagttttcacgacca

SEQ ID NO: 257988 - DNA, 20 bp, Artificial
  CRISPR gRNA sequence
gttttcacgaccacagttga

SEQ ID NO: 257989 - DNA, 20 bp, Artificial
  CRISPR gRNA sequence
acagttgaaagccattacgt

SEQ ID NO: 257990 - DNA, 20 bp, Artificial
  CRISPR gRNA sequence
cagttgaaagccattacgtt

SEQ ID NO: 257991 - DNA, 20 bp, Artificial
  CRISPR gRNA sequence
tgaaagccattacgttagga

SEQ ID NO: 257992 - DNA, 20 bp, Artificial
  CRISPR gRNA sequence
attacgttaggatggtacac

SEQ ID NO: 257993 - DNA, 20 bp, Artificial
  CRISPR gRNA sequence
acgttaggatggtacactgg

SEQ ID NO: 257994 - DNA, 20 bp, Artificial
  CRISPR gRNA sequence
cttgtattcacttgactttg

SEQ ID NO: 257995 - DNA, 20 bp, Artificial
  CRISPR gRNA sequence
ttctactgtgtgattcaaaa

SEQ ID NO: 257996 - DNA, 20 bp, Artificial
  CRISPR gRNA sequence
ttcaaaacggtgacttccaa

SEQ ID NO: 257997 - DNA, 20 bp, Artificial
  CRISPR gRNA sequence
actttatccgtttctcccat

SEQ ID NO: 257998 - DNA, 20 bp, Artificial
  CRISPR gRNA sequence
ttatccgtttctcccatcag

SEQ ID NO: 257999 - DNA, 20 bp, Artificial
  CRISPR gRNA sequence
ccgtttctcccatcagaaga

SEQ ID NO: 258000 - DNA, 20 bp, Artificial
  CRISPR gRNA sequence
ccatcagaagatagttaatc

SEQ ID NO: 258001 - DNA, 20 bp, Artificial
  CRISPR gRNA sequence
tagaccctaaactgcatcct

SEQ ID NO: 258002 - DNA, 20 bp, Artificial
  CRISPR gRNA sequence
ctaaactgcatccttggaat

SEQ ID NO: 258003 - DNA, 20 bp, Artificial
  CRISPR gRNA sequence
taaataatatgcatgttttc

SEQ ID NO: 258004 - DNA, 20 bp, Artificial
  CRISPR gRNA sequence
tatgcatgttttcaagcctt

SEQ ID NO: 258005 - DNA, 20 bp, Artificial
  CRISPR gRNA sequence
tcaagccttaagaaaatcat

SEQ ID NO: 258006 - DNA, 20 bp, Artificial
  CRISPR gRNA sequence
agaaaatcatcagcctaata

SEQ ID NO: 258007 - DNA, 20 bp, Artificial
  CRISPR gRNA sequence
aaatcatcagcctaatatgg

SEQ ID NO: 258008 - DNA, 20 bp, Artificial
  CRISPR gRNA sequence
catcagcctaatatggcagt

SEQ ID NO: 258009 - DNA, 20 bp, Artificial
  CRISPR gRNA sequence
taatatggcagtcagaacac

SEQ ID NO: 258010 - DNA, 20 bp, Artificial
  CRISPR gRNA sequence
cagaacactggactgctaat

SEQ ID NO: 258011 - DNA, 20 bp, Artificial
  CRISPR gRNA sequence
gaacactggactgctaatca

SEQ ID NO: 258012 - DNA, 20 bp, Artificial
  CRISPR gRNA sequence
aacactggactgctaatcag

SEQ ID NO: 258013 - DNA, 20 bp, Artificial
  CRISPR gRNA sequence
ctaatcagaggataaatttc

SEQ ID NO: 258014 - DNA, 20 bp, Artificial
  CRISPR gRNA sequence
ctagttccaaccctgtctca

SEQ ID NO: 258015 - DNA, 20 bp, Artificial
  CRISPR gRNA sequence
aacaaatcactttgtatctt

SEQ ID NO: 258016 - DNA, 20 bp, Artificial
  CRISPR gRNA sequence
acaaatcactttgtatcttt

SEQ ID NO: 258017 - DNA, 20 bp, Artificial
  CRISPR gRNA sequence
tttgtatctttaggaatcaa

SEQ ID NO: 258018 - DNA, 20 bp, Artificial
  CRISPR gRNA sequence
ttgtatctttaggaatcaaa

SEQ ID NO: 258019 - DNA, 20 bp, Artificial
  CRISPR gRNA sequence
tgtatctttaggaatcaaaa

SEQ ID NO: 258020 - DNA, 20 bp, Artificial
  CRISPR gRNA sequence
gtatctttaggaatcaaaag

SEQ ID NO: 258021 - DNA, 20 bp, Artificial
  CRISPR gRNA sequence
tttaggaatcaaaaggggat

SEQ ID NO: 258022 - DNA, 20 bp, Artificial
  CRISPR gRNA sequence
aggaatcaaaaggggatgag

SEQ ID NO: 258023 - DNA, 20 bp, Artificial
  CRISPR gRNA sequence
ggaatcaaaaggggatgaga

SEQ ID NO: 258024 - DNA, 20 bp, Artificial
  CRISPR gRNA sequence
aggggatgagaaggaaccta

SEQ ID NO: 258025 - DNA, 20 bp, Artificial
  CRISPR gRNA sequence
tatagaattctattcaaaat

SEQ ID NO: 258026 - DNA, 20 bp, Artificial
  CRISPR gRNA sequence
tagaattctattcaaaatta

SEQ ID NO: 258027 - DNA, 20 bp, Artificial
  CRISPR gRNA sequence
tattcaaaattagagaaaat

SEQ ID NO: 258028 - DNA, 20 bp, Artificial
  CRISPR gRNA sequence
aaattagagaaaattagaac

SEQ ID NO: 258029 - DNA, 20 bp, Artificial
  CRISPR gRNA sequence
tagagaaaattagaactaga

SEQ ID NO: 258030 - DNA, 20 bp, Artificial
  CRISPR gRNA sequence
aaagcataccaaaaatcctc

SEQ ID NO: 258031 - DNA, 20 bp, Artificial
  CRISPR gRNA sequence
agtccattgattttccatcc

SEQ ID NO: 258032 - DNA, 20 bp, Artificial
  CRISPR gRNA sequence
agctgcacaataaattatcc

SEQ ID NO: 258033 - DNA, 20 bp, Artificial
  CRISPR gRNA sequence
gcacaataaattatccgaga

SEQ ID NO: 258034 - DNA, 20 bp, Artificial
  CRISPR gRNA sequence
tttgaaaatatactgatgtc

SEQ ID NO: 258035 - DNA, 20 bp, Artificial
  CRISPR gRNA sequence
tcaacccatatcaattacat

SEQ ID NO: 258036 - DNA, 20 bp, Artificial
  CRISPR gRNA sequence
tatcaattacatcagaatct

SEQ ID NO: 258037 - DNA, 20 bp, Artificial
  CRISPR gRNA sequence
atcaattacatcagaatctc

SEQ ID NO: 258038 - DNA, 20 bp, Artificial
  CRISPR gRNA sequence
tcaattacatcagaatctca

SEQ ID NO: 258039 - DNA, 20 bp, Artificial
  CRISPR gRNA sequence
ttacatcagaatctcagggc

SEQ ID NO: 258040 - DNA, 20 bp, Artificial
  CRISPR gRNA sequence
cagaatctcagggctggaac

SEQ ID NO: 258041 - DNA, 20 bp, Artificial
  CRISPR gRNA sequence
agaatctcagggctggaact

SEQ ID NO: 258042 - DNA, 20 bp, Artificial
  CRISPR gRNA sequence
tcagggctggaactaggcat

SEQ ID NO: 258043 - DNA, 20 bp, Artificial
  CRISPR gRNA sequence
tatttcttttaaaacctact

SEQ ID NO: 258044 - DNA, 20 bp, Artificial
  CRISPR gRNA sequence
ctactcagatttataatata

SEQ ID NO: 258045 - DNA, 20 bp, Artificial
  CRISPR gRNA sequence
tcagatttataatatacaga

SEQ ID NO: 258046 - DNA, 20 bp, Artificial
  CRISPR gRNA sequence
cagatttataatatacagat

SEQ ID NO: 258047 - DNA, 20 bp, Artificial
  CRISPR gRNA sequence
agataggattgaaaattact

SEQ ID NO: 258048 - DNA, 20 bp, Artificial
  CRISPR gRNA sequence
ggattgaaaattactaagta

SEQ ID NO: 258049 - DNA, 20 bp, Artificial
  CRISPR gRNA sequence
gattgaaaattactaagtac

SEQ ID NO: 258050 - DNA, 20 bp, Artificial
  CRISPR gRNA sequence
attactaagtacaggatcat

SEQ ID NO: 258051 - DNA, 20 bp, Artificial
  CRISPR gRNA sequence
aggatcattggtgtccttct

SEQ ID NO: 258052 - DNA, 20 bp, Artificial
  CRISPR gRNA sequence
atatataaaatactatccta

SEQ ID NO: 258053 - DNA, 20 bp, Artificial
  CRISPR gRNA sequence
tataaaatactatcctaaag

SEQ ID NO: 258054 - DNA, 20 bp, Artificial
  CRISPR gRNA sequence
aaagtagcatgcctttcata

SEQ ID NO: 258055 - DNA, 20 bp, Artificial
  CRISPR gRNA sequence
aagtagcatgcctttcatat

SEQ ID NO: 258056 - DNA, 20 bp, Artificial
  CRISPR gRNA sequence
aggaaaaaatatttcactct

SEQ ID NO: 258057 - DNA, 20 bp, Artificial
  CRISPR gRNA sequence
aatatttcactcttagctac

SEQ ID NO: 258058 - DNA, 20 bp, Artificial
  CRISPR gRNA sequence
actcttagctacaagcaaaa

SEQ ID NO: 258059 - DNA, 20 bp, Artificial
  CRISPR gRNA sequence
tacaattaaaatattctgtt

SEQ ID NO: 258060 - DNA, 20 bp, Artificial
  CRISPR gRNA sequence
aatattctgtttggatatta

SEQ ID NO: 258061 - DNA, 20 bp, Artificial
  CRISPR gRNA sequence
tgtttggatattacagatat

SEQ ID NO: 258062 - DNA, 20 bp, Artificial
  CRISPR gRNA sequence
acagatattagaaatctaaa

SEQ ID NO: 258063 - DNA, 20 bp, Artificial
  CRISPR gRNA sequence
cagatattagaaatctaaat

SEQ ID NO: 258064 - DNA, 20 bp, Artificial
  CRISPR gRNA sequence
ttagaaatctaaataggact

SEQ ID NO: 258065 - DNA, 20 bp, Artificial
  CRISPR gRNA sequence
attaattgtctctattttgc

SEQ ID NO: 258066 - DNA, 20 bp, Artificial
  CRISPR gRNA sequence
tctattttgccagaacacaa

SEQ ID NO: 258067 - DNA, 20 bp, Artificial
  CRISPR gRNA sequence
ttaacaattctttccttatt

SEQ ID NO: 258068 - DNA, 20 bp, Artificial
  CRISPR gRNA sequence
tttagtatcctatttttcat

SEQ ID NO: 258069 - DNA, 20 bp, Artificial
  CRISPR gRNA sequence
tatcctatttttcatcagca

SEQ ID NO: 258070 - DNA, 20 bp, Artificial
  CRISPR gRNA sequence
tcatcagcatggctctgttc

SEQ ID NO: 258071 - DNA, 20 bp, Artificial
  CRISPR gRNA sequence
atggctctgttccagcattg

SEQ ID NO: 258072 - DNA, 20 bp, Artificial
  CRISPR gRNA sequence
attgaagaaaaaccattcat

SEQ ID NO: 258073 - DNA, 20 bp, Artificial
  CRISPR gRNA sequence
accattcattggcattatgc

SEQ ID NO: 258074 - DNA, 20 bp, Artificial
  CRISPR gRNA sequence
ccattcattggcattatgct

SEQ ID NO: 258075 - DNA, 20 bp, Artificial
  CRISPR gRNA sequence
attggcattatgctaggatt

SEQ ID NO: 258076 - DNA, 20 bp, Artificial
  CRISPR gRNA sequence
tatcattccacaaaaatgaa

SEQ ID NO: 258077 - DNA, 20 bp, Artificial
  CRISPR gRNA sequence
aaagctatgatatatccaca

SEQ ID NO: 258078 - DNA, 20 bp, Artificial
  CRISPR gRNA sequence
taccaatactgtattcttct

SEQ ID NO: 258079 - DNA, 20 bp, Artificial
  CRISPR gRNA sequence
aatactgtattcttctgagt

SEQ ID NO: 258080 - DNA, 20 bp, Artificial
  CRISPR gRNA sequence
atactgtattcttctgagtt

SEQ ID NO: 258081 - DNA, 20 bp, Artificial
  CRISPR gRNA sequence
tactgtattcttctgagttg

SEQ ID NO: 258082 - DNA, 20 bp, Artificial
  CRISPR gRNA sequence
tgatttttctccctaacatt

SEQ ID NO: 258083 - DNA, 20 bp, Artificial
  CRISPR gRNA sequence
gatttttctccctaacattt

SEQ ID NO: 258084 - DNA, 20 bp, Artificial
  CRISPR gRNA sequence
ttttctccctaacatttagg

SEQ ID NO: 258085 - DNA, 20 bp, Artificial
  CRISPR gRNA sequence
gcagaacataacatcaacaa

SEQ ID NO: 258086 - DNA, 20 bp, Artificial
  CRISPR gRNA sequence
acataacatcaacaaaagtt

SEQ ID NO: 258087 - DNA, 20 bp, Artificial
  CRISPR gRNA sequence
taacatcaacaaaagttcag

SEQ ID NO: 258088 - DNA, 20 bp, Artificial
  CRISPR gRNA sequence
aattcacaaatactgcttaa

SEQ ID NO: 258089 - DNA, 20 bp, Artificial
  CRISPR gRNA sequence
tactgcttaacagttgtact

SEQ ID NO: 258090 - DNA, 20 bp, Artificial
  CRISPR gRNA sequence
ctgagtttttgactatgaaa

SEQ ID NO: 258091 - DNA, 20 bp, Artificial
  CRISPR gRNA sequence
gtttttgactatgaaaaagt

SEQ ID NO: 258092 - DNA, 20 bp, Artificial
  CRISPR gRNA sequence
tttttgactatgaaaaagtt

SEQ ID NO: 258093 - DNA, 20 bp, Artificial
  CRISPR gRNA sequence
aaaagttaggtgacttatcc

SEQ ID NO: 258094 - DNA, 20 bp, Artificial
  CRISPR gRNA sequence
gtgacttatccaagatcaca

SEQ ID NO: 258095 - DNA, 20 bp, Artificial
  CRISPR gRNA sequence
aagatcacacagttgattaa

SEQ ID NO: 258096 - DNA, 20 bp, Artificial
  CRISPR gRNA sequence
atagcaaattttatgtcccc

SEQ ID NO: 258097 - DNA, 20 bp, Artificial
  CRISPR gRNA sequence
attttatgtcccccggtttc

SEQ ID NO: 258098 - DNA, 20 bp, Artificial
  CRISPR gRNA sequence
atgtcccccggtttctagtc

SEQ ID NO: 258099 - DNA, 20 bp, Artificial
  CRISPR gRNA sequence
ccagcattctttgtatattt

SEQ ID NO: 258100 - DNA, 20 bp, Artificial
  CRISPR gRNA sequence
tctttgtatattttagaaaa

SEQ ID NO: 258101 - DNA, 20 bp, Artificial
  CRISPR gRNA sequence
tgtatattttagaaaatgga

SEQ ID NO: 258102 - DNA, 20 bp, Artificial
  CRISPR gRNA sequence
gtatattttagaaaatggaa

SEQ ID NO: 258103 - DNA, 20 bp, Artificial
  CRISPR gRNA sequence
ttttagaaaatggaaaggta

SEQ ID NO: 258104 - DNA, 20 bp, Artificial
  CRISPR gRNA sequence
tttagaaaatggaaaggtac

SEQ ID NO: 258105 - DNA, 20 bp, Artificial
  CRISPR gRNA sequence
gaaaatggaaaggtacgggc

SEQ ID NO: 258106 - DNA, 20 bp, Artificial
  CRISPR gRNA sequence
aaaatggaaaggtacgggct

SEQ ID NO: 258107 - DNA, 20 bp, Artificial
  CRISPR gRNA sequence
ggaaaggtacgggctgggcg

SEQ ID NO: 258108 - DNA, 20 bp, Artificial
  CRISPR gRNA sequence
aaggtacgggctgggcgcgg

SEQ ID NO: 258109 - DNA, 20 bp, Artificial
  CRISPR gRNA sequence
gtggcttacgcctgtaatca

SEQ ID NO: 258110 - DNA, 20 bp, Artificial
  CRISPR gRNA sequence
cgcctgtaatcacagcactt

SEQ ID NO: 258111 - DNA, 20 bp, Artificial
  CRISPR gRNA sequence
gcctgtaatcacagcacttt

SEQ ID NO: 258112 - DNA, 20 bp, Artificial
  CRISPR gRNA sequence
ctgtaatcacagcactttgg

SEQ ID NO: 258113 - DNA, 20 bp, Artificial
  CRISPR gRNA sequence
tgtaatcacagcactttggg

SEQ ID NO: 258114 - DNA, 20 bp, Artificial
  CRISPR gRNA sequence
tcacagcactttgggaggcc

SEQ ID NO: 258115 - DNA, 20 bp, Artificial
  CRISPR gRNA sequence
cacagcactttgggaggccc

SEQ ID NO: 258116 - DNA, 20 bp, Artificial
  CRISPR gRNA sequence
agcactttgggaggcccagg

SEQ ID NO: 258117 - DNA, 20 bp, Artificial
  CRISPR gRNA sequence
gcactttgggaggcccaggt

SEQ ID NO: 258118 - DNA, 20 bp, Artificial
  CRISPR gRNA sequence
ctttgggaggcccaggtggg

SEQ ID NO: 258119 - DNA, 20 bp, Artificial
  CRISPR gRNA sequence
ggcccaggtgggcagatcac

SEQ ID NO: 258120 - DNA, 20 bp, Artificial
  CRISPR gRNA sequence
gcccaggtgggcagatcacg

SEQ ID NO: 258121 - DNA, 20 bp, Artificial
  CRISPR gRNA sequence
aggtgggcagatcacgaggt

SEQ ID NO: 258122 - DNA, 20 bp, Artificial
  CRISPR gRNA sequence
ggtgggcagatcacgaggtc

SEQ ID NO: 258123 - DNA, 20 bp, Artificial
  CRISPR gRNA sequence
tgggcagatcacgaggtcag

SEQ ID NO: 258124 - DNA, 20 bp, Artificial
  CRISPR gRNA sequence
gatcacgaggtcaggagatt

SEQ ID NO: 258125 - DNA, 20 bp, Artificial
  CRISPR gRNA sequence
tgagaccatccttgctaaca

SEQ ID NO: 258126 - DNA, 20 bp, Artificial
  CRISPR gRNA sequence
tgaaaccccgtctctactaa

SEQ ID NO: 258127 - DNA, 20 bp, Artificial
  CRISPR gRNA sequence
tctactaaaagtacaaaaaa

SEQ ID NO: 258128 - DNA, 20 bp, Artificial
  CRISPR gRNA sequence
ctaaaagtacaaaaaatggc

SEQ ID NO: 258129 - DNA, 20 bp, Artificial
  CRISPR gRNA sequence
taaaagtacaaaaaatggct

SEQ ID NO: 258130 - DNA, 20 bp, Artificial
  CRISPR gRNA sequence
gtacaaaaaatggctgggcg

SEQ ID NO: 258131 - DNA, 20 bp, Artificial
  CRISPR gRNA sequence
caaaaaatggctgggcgcgg

SEQ ID NO: 258132 - DNA, 20 bp, Artificial
  CRISPR gRNA sequence
gtggctcacgcctgtaatcc

SEQ ID NO: 258133 - DNA, 20 bp, Artificial
  CRISPR gRNA sequence
cgcctgtaatcccagcactt

SEQ ID NO: 258134 - DNA, 20 bp, Artificial
  CRISPR gRNA sequence
gcctgtaatcccagcacttt

SEQ ID NO: 258135 - DNA, 20 bp, Artificial
  CRISPR gRNA sequence
ctgtaatcccagcactttgg

SEQ ID NO: 258136 - DNA, 20 bp, Artificial
  CRISPR gRNA sequence
tgtaatcccagcactttggg

SEQ ID NO: 258137 - DNA, 20 bp, Artificial
  CRISPR gRNA sequence
agcactttgggaggccaaca

SEQ ID NO: 258138 - DNA, 20 bp, Artificial
  CRISPR gRNA sequence
gcactttgggaggccaacac

SEQ ID NO: 258139 - DNA, 20 bp, Artificial
  CRISPR gRNA sequence
ctttgggaggccaacacggg

SEQ ID NO: 258140 - DNA, 20 bp, Artificial
  CRISPR gRNA sequence
tttgggaggccaacacgggc

SEQ ID NO: 258141 - DNA, 20 bp, Artificial
  CRISPR gRNA sequence
ggccaacacgggcgggtcac

SEQ ID NO: 258142 - DNA, 20 bp, Artificial
  CRISPR gRNA sequence
gccaacacgggcgggtcacg

SEQ ID NO: 258143 - DNA, 20 bp, Artificial
  CRISPR gRNA sequence
acacgggcgggtcacgaggt

SEQ ID NO: 258144 - DNA, 20 bp, Artificial
  CRISPR gRNA sequence
cacgggcgggtcacgaggtc

SEQ ID NO: 258145 - DNA, 20 bp, Artificial
  CRISPR gRNA sequence
ggtcacgaggtcaggaaatc

SEQ ID NO: 258146 - DNA, 20 bp, Artificial
  CRISPR gRNA sequence
tcaggaaatcgagaccatcc

SEQ ID NO: 258147 - DNA, 20 bp, Artificial
  CRISPR gRNA sequence
tcgagaccatcctggctaac

SEQ ID NO: 258148 - DNA, 20 bp, Artificial
  CRISPR gRNA sequence
cgagaccatcctggctaaca

SEQ ID NO: 258149 - DNA, 20 bp, Artificial
  CRISPR gRNA sequence
ctactaaaaatacaaaaaat

SEQ ID NO: 258150 - DNA, 20 bp, Artificial
  CRISPR gRNA sequence
taaaaatacaaaaaattagc

SEQ ID NO: 258151 - DNA, 20 bp, Artificial
  CRISPR gRNA sequence
aaaaatacaaaaaattagcc

SEQ ID NO: 258152 - DNA, 20 bp, Artificial
  CRISPR gRNA sequence
tacaaaaaattagccgggca

SEQ ID NO: 258153 - DNA, 20 bp, Artificial
  CRISPR gRNA sequence
aaaaaattagccgggcatgg

SEQ ID NO: 258154 - DNA, 20 bp, Artificial
  CRISPR gRNA sequence
aaattagccgggcatggtgg

SEQ ID NO: 258155 - DNA, 20 bp, Artificial
  CRISPR gRNA sequence
aattagccgggcatggtggc

SEQ ID NO: 258156 - DNA, 20 bp, Artificial
  CRISPR gRNA sequence
ggcatggtggcaggtacctg

SEQ ID NO: 258157 - DNA, 20 bp, Artificial
  CRISPR gRNA sequence
gtggcaggtacctgtagtcc

SEQ ID NO: 258158 - DNA, 20 bp, Artificial
  CRISPR gRNA sequence
tacctgtagtcccagctact

SEQ ID NO: 258159 - DNA, 20 bp, Artificial
  CRISPR gRNA sequence
acctgtagtcccagctactc

SEQ ID NO: 258160 - DNA, 20 bp, Artificial
  CRISPR gRNA sequence
ctgtagtcccagctactcag

SEQ ID NO: 258161 - DNA, 20 bp, Artificial
  CRISPR gRNA sequence
tgtagtcccagctactcagg

SEQ ID NO: 258162 - DNA, 20 bp, Artificial
  CRISPR gRNA sequence
tcccagctactcaggaggct

SEQ ID NO: 258163 - DNA, 20 bp, Artificial
  CRISPR gRNA sequence
cccagctactcaggaggctg

SEQ ID NO: 258164 - DNA, 20 bp, Artificial
  CRISPR gRNA sequence
agctactcaggaggctgagg

SEQ ID NO: 258165 - DNA, 20 bp, Artificial
  CRISPR gRNA sequence
gctactcaggaggctgaggc

SEQ ID NO: 258166 - DNA, 20 bp, Artificial
  CRISPR gRNA sequence
tactcaggaggctgaggcag

SEQ ID NO: 258167 - DNA, 20 bp, Artificial
  CRISPR gRNA sequence
aggaggctgaggcaggagaa

SEQ ID NO: 258168 - DNA, 20 bp, Artificial
  CRISPR gRNA sequence
gcaggagaatggcatgaacc

SEQ ID NO: 258169 - DNA, 20 bp, Artificial
  CRISPR gRNA sequence
caggagaatggcatgaacct

SEQ ID NO: 258170 - DNA, 20 bp, Artificial
  CRISPR gRNA sequence
ggagaatggcatgaacctgg

SEQ ID NO: 258171 - DNA, 20 bp, Artificial
  CRISPR gRNA sequence
gagaatggcatgaacctggg

SEQ ID NO: 258172 - DNA, 20 bp, Artificial
  CRISPR gRNA sequence
aatggcatgaacctgggagg

SEQ ID NO: 258173 - DNA, 20 bp, Artificial
  CRISPR gRNA sequence
tggcatgaacctgggaggcg

SEQ ID NO: 258174 - DNA, 20 bp, Artificial
  CRISPR gRNA sequence
aacctgggaggcggagcttg

SEQ ID NO: 258175 - DNA, 20 bp, Artificial
  CRISPR gRNA sequence
tgggaggcggagcttgcagt

SEQ ID NO: 258176 - DNA, 20 bp, Artificial
  CRISPR gRNA sequence
ggcggagcttgcagtgagcc

SEQ ID NO: 258177 - DNA, 20 bp, Artificial
  CRISPR gRNA sequence
gagatcgcgccaccgcattc

SEQ ID NO: 258178 - DNA, 20 bp, Artificial
  CRISPR gRNA sequence
cgcgccaccgcattccagcc

SEQ ID NO: 258179 - DNA, 20 bp, Artificial
  CRISPR gRNA sequence
gcgccaccgcattccagcct

SEQ ID NO: 258180 - DNA, 20 bp, Artificial
  CRISPR gRNA sequence
ccgcattccagcctgggcga

SEQ ID NO: 258181 - DNA, 20 bp, Artificial
  CRISPR gRNA sequence
gcattccagcctgggcgaca

SEQ ID NO: 258182 - DNA, 20 bp, Artificial
  CRISPR gRNA sequence
tccagcctgggcgacagagc

SEQ ID NO: 258183 - DNA, 20 bp, Artificial
  CRISPR gRNA sequence
taaataaatatacaaaaaat

SEQ ID NO: 258184 - DNA, 20 bp, Artificial
  CRISPR gRNA sequence
taaatatacaaaaaataagc

SEQ ID NO: 258185 - DNA, 20 bp, Artificial
  CRISPR gRNA sequence
aaatatacaaaaaataagcc

SEQ ID NO: 258186 - DNA, 20 bp, Artificial
  CRISPR gRNA sequence
tacaaaaaataagccaggcg

SEQ ID NO: 258187 - DNA, 20 bp, Artificial
  CRISPR gRNA sequence
aaaaaataagccaggcgtgg

SEQ ID NO: 258188 - DNA, 20 bp, Artificial
  CRISPR gRNA sequence
aaataagccaggcgtggtgg

SEQ ID NO: 258189 - DNA, 20 bp, Artificial
  CRISPR gRNA sequence
aataagccaggcgtggtggc

SEQ ID NO: 258190 - DNA, 20 bp, Artificial
  CRISPR gRNA sequence
aggcgtggtggcgggccctg

SEQ ID NO: 258191 - DNA, 20 bp, Artificial
  CRISPR gRNA sequence
ggtggcgggccctgtagtcc

SEQ ID NO: 258192 - DNA, 20 bp, Artificial
  CRISPR gRNA sequence
gccctgtagtcccagctgat

SEQ ID NO: 258193 - DNA, 20 bp, Artificial
  CRISPR gRNA sequence
ccctgtagtcccagctgatc

SEQ ID NO: 258194 - DNA, 20 bp, Artificial
  CRISPR gRNA sequence
ctgtagtcccagctgatcgg

SEQ ID NO: 258195 - DNA, 20 bp, Artificial
  CRISPR gRNA sequence
tgtagtcccagctgatcggg

SEQ ID NO: 258196 - DNA, 20 bp, Artificial
  CRISPR gRNA sequence
tcccagctgatcgggaggct

SEQ ID NO: 258197 - DNA, 20 bp, Artificial
  CRISPR gRNA sequence
cccagctgatcgggaggctg

SEQ ID NO: 258198 - DNA, 20 bp, Artificial
  CRISPR gRNA sequence
agctgatcgggaggctgagg

SEQ ID NO: 258199 - DNA, 20 bp, Artificial
  CRISPR gRNA sequence
gctgatcgggaggctgaggc

SEQ ID NO: 258200 - DNA, 20 bp, Artificial
  CRISPR gRNA sequence
tgatcgggaggctgaggcag

SEQ ID NO: 258201 - DNA, 20 bp, Artificial
  CRISPR gRNA sequence
gcaggagaatgacgtgaacc

SEQ ID NO: 258202 - DNA, 20 bp, Artificial
  CRISPR gRNA sequence
caggagaatgacgtgaaccc

SEQ ID NO: 258203 - DNA, 20 bp, Artificial
  CRISPR gRNA sequence
ggagaatgacgtgaacccgg

SEQ ID NO: 258204 - DNA, 20 bp, Artificial
  CRISPR gRNA sequence
gagaatgacgtgaacccggg

SEQ ID NO: 258205 - DNA, 20 bp, Artificial
  CRISPR gRNA sequence
aatgacgtgaacccgggagg

SEQ ID NO: 258206 - DNA, 20 bp, Artificial
  CRISPR gRNA sequence
tgacgtgaacccgggaggca

SEQ ID NO: 258207 - DNA, 20 bp, Artificial
  CRISPR gRNA sequence
aacccgggaggcagagcttg

SEQ ID NO: 258208 - DNA, 20 bp, Artificial
  CRISPR gRNA sequence
ggcagagcttgcagtgaact

SEQ ID NO: 258209 - DNA, 20 bp, Artificial
  CRISPR gRNA sequence
gagatcccgccactgcactc

SEQ ID NO: 258210 - DNA, 20 bp, Artificial
  CRISPR gRNA sequence
cccgccactgcactccagcc

SEQ ID NO: 258211 - DNA, 20 bp, Artificial
  CRISPR gRNA sequence
ccgccactgcactccagcct

SEQ ID NO: 258212 - DNA, 20 bp, Artificial
  CRISPR gRNA sequence
ctgcactccagcctgggcga

SEQ ID NO: 258213 - DNA, 20 bp, Artificial
  CRISPR gRNA sequence
gcactccagcctgggcgaca

SEQ ID NO: 258214 - DNA, 20 bp, Artificial
  CRISPR gRNA sequence
tccagcctgggcgacagagc

SEQ ID NO: 258215 - DNA, 20 bp, Artificial
  CRISPR gRNA sequence
cagcctgggcgacagagcga

SEQ ID NO: 258216 - DNA, 20 bp, Artificial
  CRISPR gRNA sequence
gagagtccgtctcaaaaaaa

SEQ ID NO: 258217 - DNA, 20 bp, Artificial
  CRISPR gRNA sequence
ccgtctcaaaaaaaaagaaa

SEQ ID NO: 258218 - DNA, 20 bp, Artificial
  CRISPR gRNA sequence
caaaaaaaaagaaaaagaaa

SEQ ID NO: 258219 - DNA, 20 bp, Artificial
  CRISPR gRNA sequence
aaaaagaaaaagaaaaagaa

SEQ ID NO: 258220 - DNA, 20 bp, Artificial
  CRISPR gRNA sequence
gaaaaagaaaaagaaaagaa

SEQ ID NO: 258221 - DNA, 20 bp, Artificial
  CRISPR gRNA sequence
aaaaagaaaaagaaaagaaa

SEQ ID NO: 258222 - DNA, 20 bp, Artificial
  CRISPR gRNA sequence
aagaaaaagaaaagaaaagg

SEQ ID NO: 258223 - DNA, 20 bp, Artificial
  CRISPR gRNA sequence
agaaaaagaaaagaaaagga

SEQ ID NO: 258224 - DNA, 20 bp, Artificial
  CRISPR gRNA sequence
aaaagaaaagaaaaggaagg

SEQ ID NO: 258225 - DNA, 20 bp, Artificial
  CRISPR gRNA sequence
aaagaaaagaaaaggaagga

SEQ ID NO: 258226 - DNA, 20 bp, Artificial
  CRISPR gRNA sequence
gaaaagaaaaggaaggaagg

SEQ ID NO: 258227 - DNA, 20 bp, Artificial
  CRISPR gRNA sequence
aaaagaaaaggaaggaagga

SEQ ID NO: 258228 - DNA, 20 bp, Artificial
  CRISPR gRNA sequence
agaaaaggaaggaaggaagg

SEQ ID NO: 258229 - DNA, 20 bp, Artificial
  CRISPR gRNA sequence
gaaaaggaaggaaggaagga

SEQ ID NO: 258230 - DNA, 20 bp, Artificial
  CRISPR gRNA sequence
aaggaaggaaggaaggaagg

SEQ ID NO: 258231 - DNA, 20 bp, Artificial
  CRISPR gRNA sequence
aggaaggaaggaaggaagga

SEQ ID NO: 258232 - DNA, 20 bp, Artificial
  CRISPR gRNA sequence
aaggaaggaaggaaggaagg

SEQ ID NO: 258233 - DNA, 20 bp, Artificial
  CRISPR gRNA sequence
aggaaggaaggaaggaagga

SEQ ID NO: 258234 - DNA, 20 bp, Artificial
  CRISPR gRNA sequence
aaggaaggaaggaaggaagg

SEQ ID NO: 258235 - DNA, 20 bp, Artificial
  CRISPR gRNA sequence
aggaaggaaggaaggaagga

SEQ ID NO: 258236 - DNA, 20 bp, Artificial
  CRISPR gRNA sequence
aaggaaggaaggaaggaagg

SEQ ID NO: 258237 - DNA, 20 bp, Artificial
  CRISPR gRNA sequence
aggaaggaaggaaggaagga

SEQ ID NO: 258238 - DNA, 20 bp, Artificial
  CRISPR gRNA sequence
gaaggaaggaaggaaggaaa

SEQ ID NO: 258239 - DNA, 20 bp, Artificial
  CRISPR gRNA sequence
ggaaggaaggaaaaagaaaa

SEQ ID NO: 258240 - DNA, 20 bp, Artificial
  CRISPR gRNA sequence
ggaaggaaaaagaaaatgga

SEQ ID NO: 258241 - DNA, 20 bp, Artificial
  CRISPR gRNA sequence
gaaggaaaaagaaaatggaa

SEQ ID NO: 258242 - DNA, 20 bp, Artificial
  CRISPR gRNA sequence
aaaatggaaaggtactttta

SEQ ID NO: 258243 - DNA, 20 bp, Artificial
  CRISPR gRNA sequence
aatggaaaggtacttttaca

SEQ ID NO: 258244 - DNA, 20 bp, Artificial
  CRISPR gRNA sequence
atggaaaggtacttttacag

SEQ ID NO: 258245 - DNA, 20 bp, Artificial
  CRISPR gRNA sequence
gaaaggtacttttacagagg

SEQ ID NO: 258246 - DNA, 20 bp, Artificial
  CRISPR gRNA sequence
acttttacagaggaagatta

SEQ ID NO: 258247 - DNA, 20 bp, Artificial
  CRISPR gRNA sequence
ttttacagaggaagattatg

SEQ ID NO: 258248 - DNA, 20 bp, Artificial
  CRISPR gRNA sequence
aagattatggagcacaaaaa

SEQ ID NO: 258249 - DNA, 20 bp, Artificial
  CRISPR gRNA sequence
agcacaaaaaaagaattaat

SEQ ID NO: 258250 - DNA, 20 bp, Artificial
  CRISPR gRNA sequence
aaaaaagaattaattagaaa

SEQ ID NO: 258251 - DNA, 20 bp, Artificial
  CRISPR gRNA sequence
aaagaattaattagaaatag

SEQ ID NO: 258252 - DNA, 20 bp, Artificial
  CRISPR gRNA sequence
aattaattagaaatagaagt

SEQ ID NO: 258253 - DNA, 20 bp, Artificial
  CRISPR gRNA sequence
aaatagaagtgagtcttcct

SEQ ID NO: 258254 - DNA, 20 bp, Artificial
  CRISPR gRNA sequence
cttcctgagtcttaacccat

SEQ ID NO: 258255 - DNA, 20 bp, Artificial
  CRISPR gRNA sequence
gagtcttaacccattagacc

SEQ ID NO: 258256 - DNA, 20 bp, Artificial
  CRISPR gRNA sequence
attagacccagctgttactt

SEQ ID NO: 258257 - DNA, 20 bp, Artificial
  CRISPR gRNA sequence
ttagacccagctgttacttg

SEQ ID NO: 258258 - DNA, 20 bp, Artificial
  CRISPR gRNA sequence
tagacccagctgttacttga

SEQ ID NO: 258259 - DNA, 20 bp, Artificial
  CRISPR gRNA sequence
agctgttacttgagggcacc

SEQ ID NO: 258260 - DNA, 20 bp, Artificial
  CRISPR gRNA sequence
gctgttacttgagggcacct

SEQ ID NO: 258261 - DNA, 20 bp, Artificial
  CRISPR gRNA sequence
cacctgggcttacattttaa

SEQ ID NO: 258262 - DNA, 20 bp, Artificial
  CRISPR gRNA sequence
tcttttctgccatgatccac

SEQ ID NO: 258263 - DNA, 20 bp, Artificial
  CRISPR gRNA sequence
tctgccatgatccactggaa

SEQ ID NO: 258264 - DNA, 20 bp, Artificial
  CRISPR gRNA sequence
tgccatgatccactggaatg

SEQ ID NO: 258265 - DNA, 20 bp, Artificial
  CRISPR gRNA sequence
aaatgatctgttcccacatg

SEQ ID NO: 258266 - DNA, 20 bp, Artificial
  CRISPR gRNA sequence
cttactctcccgctcaatgt

SEQ ID NO: 258267 - DNA, 20 bp, Artificial
  CRISPR gRNA sequence
tctcccgctcaatgtcagca

SEQ ID NO: 258268 - DNA, 20 bp, Artificial
  CRISPR gRNA sequence
ctcccgctcaatgtcagcaa

SEQ ID NO: 258269 - DNA, 20 bp, Artificial
  CRISPR gRNA sequence
aatgtcagcaaaggaaaata

SEQ ID NO: 258270 - DNA, 20 bp, Artificial
  CRISPR gRNA sequence
ataaccttgaatctcctcta

SEQ ID NO: 258271 - DNA, 20 bp, Artificial
  CRISPR gRNA sequence
cttgaatctcctctacagta

SEQ ID NO: 258272 - DNA, 20 bp, Artificial
  CRISPR gRNA sequence
ttgaatctcctctacagtaa

SEQ ID NO: 258273 - DNA, 20 bp, Artificial
  CRISPR gRNA sequence
tgaatctcctctacagtaaa

SEQ ID NO: 258274 - DNA, 20 bp, Artificial
  CRISPR gRNA sequence
aaaacattatttgtctttgt

SEQ ID NO: 258275 - DNA, 20 bp, Artificial
  CRISPR gRNA sequence
tttgttagtatcaaatcact

SEQ ID NO: 258276 - DNA, 20 bp, Artificial
  CRISPR gRNA sequence
ttgttagtatcaaatcactt

SEQ ID NO: 258277 - DNA, 20 bp, Artificial
  CRISPR gRNA sequence
ccccaccactgaccacaacc

SEQ ID NO: 258278 - DNA, 20 bp, Artificial
  CRISPR gRNA sequence
actgaccacaacccagtttt

SEQ ID NO: 258279 - DNA, 20 bp, Artificial
  CRISPR gRNA sequence
ctgaccacaacccagttttc

SEQ ID NO: 258280 - DNA, 20 bp, Artificial
  CRISPR gRNA sequence
gcatttgaaaaccattactt

SEQ ID NO: 258281 - DNA, 20 bp, Artificial
  CRISPR gRNA sequence
catttgaaaaccattacttt

SEQ ID NO: 258282 - DNA, 20 bp, Artificial
  CRISPR gRNA sequence
atttgaaaaccattacttta

SEQ ID NO: 258283 - DNA, 20 bp, Artificial
  CRISPR gRNA sequence
tgaaaaccattactttaggg

SEQ ID NO: 258284 - DNA, 20 bp, Artificial
  CRISPR gRNA sequence
attactttagggtggtacac

SEQ ID NO: 258285 - DNA, 20 bp, Artificial
  CRISPR gRNA sequence
tttagggtggtacactggta

SEQ ID NO: 258286 - DNA, 20 bp, Artificial
  CRISPR gRNA sequence
gttgtatgttacctttcaca

SEQ ID NO: 258287 - DNA, 20 bp, Artificial
  CRISPR gRNA sequence
gttacctttcacatggataa

SEQ ID NO: 258288 - DNA, 20 bp, Artificial
  CRISPR gRNA sequence
ccattgctcttctcattgtc

SEQ ID NO: 258289 - DNA, 20 bp, Artificial
  CRISPR gRNA sequence
cattgctcttctcattgtct

SEQ ID NO: 258290 - DNA, 20 bp, Artificial
  CRISPR gRNA sequence
gctcttctcattgtctaggt

SEQ ID NO: 258291 - DNA, 20 bp, Artificial
  CRISPR gRNA sequence
ctcttctcattgtctaggta

SEQ ID NO: 258292 - DNA, 20 bp, Artificial
  CRISPR gRNA sequence
cttctcattgtctaggtaag

SEQ ID NO: 258293 - DNA, 20 bp, Artificial
  CRISPR gRNA sequence
ttctcattgtctaggtaagg

SEQ ID NO: 258294 - DNA, 20 bp, Artificial
  CRISPR gRNA sequence
ctcattgtctaggtaaggag

SEQ ID NO: 258295 - DNA, 20 bp, Artificial
  CRISPR gRNA sequence
tcattgtctaggtaaggagg

SEQ ID NO: 258296 - DNA, 20 bp, Artificial
  CRISPR gRNA sequence
gatacataacttcaattttg

SEQ ID NO: 258297 - DNA, 20 bp, Artificial
  CRISPR gRNA sequence
acataacttcaattttgcag

SEQ ID NO: 258298 - DNA, 20 bp, Artificial
  CRISPR gRNA sequence
tgcagaagtaaatatctgtt

SEQ ID NO: 258299 - DNA, 20 bp, Artificial
  CRISPR gRNA sequence
tttggttaacatacaaattc

SEQ ID NO: 258300 - DNA, 20 bp, Artificial
  CRISPR gRNA sequence
tggttaacatacaaattctg

SEQ ID NO: 258301 - DNA, 20 bp, Artificial
  CRISPR gRNA sequence
ggttaacatacaaattctgg

SEQ ID NO: 258302 - DNA, 20 bp, Artificial
  CRISPR gRNA sequence
taacatacaaattctggagg

SEQ ID NO: 258303 - DNA, 20 bp, Artificial
  CRISPR gRNA sequence
cattgcccaatttcccatca

SEQ ID NO: 258304 - DNA, 20 bp, Artificial
  CRISPR gRNA sequence
cacagttgaaccccgttttt

SEQ ID NO: 258305 - DNA, 20 bp, Artificial
  CRISPR gRNA sequence
cccgtttttgagtaaacctg

SEQ ID NO: 258306 - DNA, 20 bp, Artificial
  CRISPR gRNA sequence
ttgagtaaacctgaagctgc

SEQ ID NO: 258307 - DNA, 20 bp, Artificial
  CRISPR gRNA sequence
tgagtaaacctgaagctgct

SEQ ID NO: 258308 - DNA, 20 bp, Artificial
  CRISPR gRNA sequence
agtaaacctgaagctgctgg

SEQ ID NO: 258309 - DNA, 20 bp, Artificial
  CRISPR gRNA sequence
agtaattcccatatacaaca

SEQ ID NO: 258310 - DNA, 20 bp, Artificial
  CRISPR gRNA sequence
atatacaacacagacttcca

SEQ ID NO: 258311 - DNA, 20 bp, Artificial
  CRISPR gRNA sequence
cagacttccacagcactatc

SEQ ID NO: 258312 - DNA, 20 bp, Artificial
  CRISPR gRNA sequence
gcactatccagtcctttgtg

SEQ ID NO: 258313 - DNA, 20 bp, Artificial
  CRISPR gRNA sequence
cactatccagtcctttgtga

SEQ ID NO: 258314 - DNA, 20 bp, Artificial
  CRISPR gRNA sequence
actatccagtcctttgtgaa

SEQ ID NO: 258315 - DNA, 20 bp, Artificial
  CRISPR gRNA sequence
gtcctttgtgaagggatgcc

SEQ ID NO: 258316 - DNA, 20 bp, Artificial
  CRISPR gRNA sequence
gggatgcccggaactccctt

SEQ ID NO: 258317 - DNA, 20 bp, Artificial
  CRISPR gRNA sequence
atgcccggaactcccttgag

SEQ ID NO: 258318 - DNA, 20 bp, Artificial
  CRISPR gRNA sequence
gcccggaactcccttgagaa

SEQ ID NO: 258319 - DNA, 20 bp, Artificial
  CRISPR gRNA sequence
actcccttgagaagagattg

SEQ ID NO: 258320 - DNA, 20 bp, Artificial
  CRISPR gRNA sequence
ctcccttgagaagagattgt

SEQ ID NO: 258321 - DNA, 20 bp, Artificial
  CRISPR gRNA sequence
agagattgtaggaatacttg

SEQ ID NO: 258322 - DNA, 20 bp, Artificial
  CRISPR gRNA sequence
ttgtaggaatacttgcagct

SEQ ID NO: 258323 - DNA, 20 bp, Artificial
  CRISPR gRNA sequence
tgtaggaatacttgcagcta

SEQ ID NO: 258324 - DNA, 20 bp, Artificial
  CRISPR gRNA sequence
accgcattgtcgtacgctac

SEQ ID NO: 258325 - DNA, 20 bp, Artificial
  CRISPR gRNA sequence
attgtcgtacgctacaagca

SEQ ID NO: 258326 - DNA, 20 bp, Artificial
  CRISPR gRNA sequence
ttgtcgtacgctacaagcat

SEQ ID NO: 258327 - DNA, 20 bp, Artificial
  CRISPR gRNA sequence
ttcaccaaaatcttgtttcc

SEQ ID NO: 258328 - DNA, 20 bp, Artificial
  CRISPR gRNA sequence
tcaccaaaatcttgtttcct

SEQ ID NO: 258329 - DNA, 20 bp, Artificial
  CRISPR gRNA sequence
caccaaaatcttgtttcctg

SEQ ID NO: 258330 - DNA, 20 bp, Artificial
  CRISPR gRNA sequence
accaaaatcttgtttcctgg

SEQ ID NO: 258331 - DNA, 20 bp, Artificial
  CRISPR gRNA sequence
ggaaaaaaaaatcatttgct

SEQ ID NO: 258332 - DNA, 20 bp, Artificial
  CRISPR gRNA sequence
aaaaatcatttgcttagaac

SEQ ID NO: 258333 - DNA, 20 bp, Artificial
  CRISPR gRNA sequence
tttgcttagaacaagaatat

SEQ ID NO: 258334 - DNA, 20 bp, Artificial
  CRISPR gRNA sequence
ttgcttagaacaagaatata

SEQ ID NO: 258335 - DNA, 20 bp, Artificial
  CRISPR gRNA sequence
taaggataatttttcttcct

SEQ ID NO: 258336 - DNA, 20 bp, Artificial
  CRISPR gRNA sequence
aggataatttttcttcctga

SEQ ID NO: 258337 - DNA, 20 bp, Artificial
  CRISPR gRNA sequence
atattaattaactaaatgaa

SEQ ID NO: 258338 - DNA, 20 bp, Artificial
  CRISPR gRNA sequence
taactaaatgaacagatctc

SEQ ID NO: 258339 - DNA, 20 bp, Artificial
  CRISPR gRNA sequence
aaatgaacagatctccagca

SEQ ID NO: 258340 - DNA, 20 bp, Artificial
  CRISPR gRNA sequence
aatgaacagatctccagcaa

SEQ ID NO: 258341 - DNA, 20 bp, Artificial
  CRISPR gRNA sequence
ctccagcaaaggttttctct

SEQ ID NO: 258342 - DNA, 20 bp, Artificial
  CRISPR gRNA sequence
cagcaaaggttttctcttgg

SEQ ID NO: 258343 - DNA, 20 bp, Artificial
  CRISPR gRNA sequence
caaaggttttctcttggcag

SEQ ID NO: 258344 - DNA, 20 bp, Artificial
  CRISPR gRNA sequence
ttttctcttggcagaagatg

SEQ ID NO: 258345 - DNA, 20 bp, Artificial
  CRISPR gRNA sequence
tttctcttggcagaagatgt

SEQ ID NO: 258346 - DNA, 20 bp, Artificial
  CRISPR gRNA sequence
cagaagatgtaggacctctt

SEQ ID NO: 258347 - DNA, 20 bp, Artificial
  CRISPR gRNA sequence
agaagatgtaggacctcttc

SEQ ID NO: 258348 - DNA, 20 bp, Artificial
  CRISPR gRNA sequence
gaagatgtaggacctcttca

SEQ ID NO: 258349 - DNA, 20 bp, Artificial
  CRISPR gRNA sequence
aagatgtaggacctcttcag

SEQ ID NO: 258350 - DNA, 20 bp, Artificial
  CRISPR gRNA sequence
cttcaggggataattatact

SEQ ID NO: 258351 - DNA, 20 bp, Artificial
  CRISPR gRNA sequence
tcaggggataattatactga

SEQ ID NO: 258352 - DNA, 20 bp, Artificial
  CRISPR gRNA sequence
taattatactgagagttcaa

SEQ ID NO: 258353 - DNA, 20 bp, Artificial
  CRISPR gRNA sequence
tattttcatcctcttttgaa

SEQ ID NO: 258354 - DNA, 20 bp, Artificial
  CRISPR gRNA sequence
tcctcttttgaatggaacaa

SEQ ID NO: 258355 - DNA, 20 bp, Artificial
  CRISPR gRNA sequence
ctcttttgaatggaacaatg

SEQ ID NO: 258356 - DNA, 20 bp, Artificial
  CRISPR gRNA sequence
caatggagcatgttttcacc

SEQ ID NO: 258357 - DNA, 20 bp, Artificial
  CRISPR gRNA sequence
tggagcatgttttcacccag

SEQ ID NO: 258358 - DNA, 20 bp, Artificial
  CRISPR gRNA sequence
ggagcatgttttcacccaga

SEQ ID NO: 258359 - DNA, 20 bp, Artificial
  CRISPR gRNA sequence
gcatgttttcacccagaagg

SEQ ID NO: 258360 - DNA, 20 bp, Artificial
  CRISPR gRNA sequence
ttcacccagaaggcagtaca

SEQ ID NO: 258361 - DNA, 20 bp, Artificial
  CRISPR gRNA sequence
ggcagtacatggctttctgt

SEQ ID NO: 258362 - DNA, 20 bp, Artificial
  CRISPR gRNA sequence
catggctttctgttagcatt

SEQ ID NO: 258363 - DNA, 20 bp, Artificial
  CRISPR gRNA sequence
tctgttagcattgagcacca

SEQ ID NO: 258364 - DNA, 20 bp, Artificial
  CRISPR gRNA sequence
ttagcattgagcaccacagc

SEQ ID NO: 258365 - DNA, 20 bp, Artificial
  CRISPR gRNA sequence
tagcattgagcaccacagct

SEQ ID NO: 258366 - DNA, 20 bp, Artificial
  CRISPR gRNA sequence
atttttaaatctatattcct

SEQ ID NO: 258367 - DNA, 20 bp, Artificial
  CRISPR gRNA sequence
cattaatattaatcatgcat

SEQ ID NO: 258368 - DNA, 20 bp, Artificial
  CRISPR gRNA sequence
attaatattaatcatgcatt

SEQ ID NO: 258369 - DNA, 20 bp, Artificial
  CRISPR gRNA sequence
attgggccaatttcctgact

SEQ ID NO: 258370 - DNA, 20 bp, Artificial
  CRISPR gRNA sequence
tcctgactgagtgatatatt

SEQ ID NO: 258371 - DNA, 20 bp, Artificial
  CRISPR gRNA sequence
ctgactgagtgatatatttg

SEQ ID NO: 258372 - DNA, 20 bp, Artificial
  CRISPR gRNA sequence
tgactgagtgatatatttgg

SEQ ID NO: 258373 - DNA, 20 bp, Artificial
  CRISPR gRNA sequence
ctgagtgatatatttggagg

SEQ ID NO: 258374 - DNA, 20 bp, Artificial
  CRISPR gRNA sequence
gatatatttggaggtggctt

SEQ ID NO: 258375 - DNA, 20 bp, Artificial
  CRISPR gRNA sequence
ggtggctttagtgcctgaca

SEQ ID NO: 258376 - DNA, 20 bp, Artificial
  CRISPR gRNA sequence
gcctgacacagacacaaaaa

SEQ ID NO: 258377 - DNA, 20 bp, Artificial
  CRISPR gRNA sequence
ttctttgtttgtttgttttt

SEQ ID NO: 258378 - DNA, 20 bp, Artificial
  CRISPR gRNA sequence
ttgtttgtttgtttttgaga

SEQ ID NO: 258379 - DNA, 20 bp, Artificial
  CRISPR gRNA sequence
gtttgtttgtttttgagaca

SEQ ID NO: 258380 - DNA, 20 bp, Artificial
  CRISPR gRNA sequence
cagagtcttgctctgttgcc

SEQ ID NO: 258381 - DNA, 20 bp, Artificial
  CRISPR gRNA sequence
agagtcttgctctgttgccc

SEQ ID NO: 258382 - DNA, 20 bp, Artificial
  CRISPR gRNA sequence
ttgctctgttgcccaggctg

SEQ ID NO: 258383 - DNA, 20 bp, Artificial
  CRISPR gRNA sequence
ctgttgcccaggctgaagtg

SEQ ID NO: 258384 - DNA, 20 bp, Artificial
  CRISPR gRNA sequence
ttgcccaggctgaagtgcag

SEQ ID NO: 258385 - DNA, 20 bp, Artificial
  CRISPR gRNA sequence
gaagtgcagtggtgcaatct

SEQ ID NO: 258386 - DNA, 20 bp, Artificial
  CRISPR gRNA sequence
cactgcaacctccacccacc

SEQ ID NO: 258387 - DNA, 20 bp, Artificial
  CRISPR gRNA sequence
ttcaaacaattctcctgcct

SEQ ID NO: 258388 - DNA, 20 bp, Artificial
  CRISPR gRNA sequence
ttctcctgcctcagtctctt

SEQ ID NO: 258389 - DNA, 20 bp, Artificial
  CRISPR gRNA sequence
tcctgcctcagtctcttaag

SEQ ID NO: 258390 - DNA, 20 bp, Artificial
  CRISPR gRNA sequence
gcctcagtctcttaagtagc

SEQ ID NO: 258391 - DNA, 20 bp, Artificial
  CRISPR gRNA sequence
cctcagtctcttaagtagct

SEQ ID NO: 258392 - DNA, 20 bp, Artificial
  CRISPR gRNA sequence
ctcttaagtagctgggatta

SEQ ID NO: 258393 - DNA, 20 bp, Artificial
  CRISPR gRNA sequence
tcttaagtagctgggattac

SEQ ID NO: 258394 - DNA, 20 bp, Artificial
  CRISPR gRNA sequence
caggtatgcaccaccacgcc

SEQ ID NO: 258395 - DNA, 20 bp, Artificial
  CRISPR gRNA sequence
agctaatttttctatttttt

SEQ ID NO: 258396 - DNA, 20 bp, Artificial
  CRISPR gRNA sequence
atttttctatttttttagta

SEQ ID NO: 258397 - DNA, 20 bp, Artificial
  CRISPR gRNA sequence
ttctatttttttagtataga

SEQ ID NO: 258398 - DNA, 20 bp, Artificial
  CRISPR gRNA sequence
tctatttttttagtatagac

SEQ ID NO: 258399 - DNA, 20 bp, Artificial
  CRISPR gRNA sequence
ctatttttttagtatagacg

SEQ ID NO: 258400 - DNA, 20 bp, Artificial
  CRISPR gRNA sequence
tagacggggtttcaccatgt

SEQ ID NO: 258401 - DNA, 20 bp, Artificial
  CRISPR gRNA sequence
cggggtttcaccatgttggc

SEQ ID NO: 258402 - DNA, 20 bp, Artificial
  CRISPR gRNA sequence
tttcaccatgttggctagcc

SEQ ID NO: 258403 - DNA, 20 bp, Artificial
  CRISPR gRNA sequence
ctagcctggtctcaaactcc

SEQ ID NO: 258404 - DNA, 20 bp, Artificial
  CRISPR gRNA sequence
ggtctcaaactcctggcctc

SEQ ID NO: 258405 - DNA, 20 bp, Artificial
  CRISPR gRNA sequence
ctcaagtgatctgaccacct

SEQ ID NO: 258406 - DNA, 20 bp, Artificial
  CRISPR gRNA sequence
ctgaccaccttggcctccca

SEQ ID NO: 258407 - DNA, 20 bp, Artificial
  CRISPR gRNA sequence
accttggcctcccaaagtgc

SEQ ID NO: 258408 - DNA, 20 bp, Artificial
  CRISPR gRNA sequence
ccttggcctcccaaagtgct

SEQ ID NO: 258409 - DNA, 20 bp, Artificial
  CRISPR gRNA sequence
tcccaaagtgctgggattac

SEQ ID NO: 258410 - DNA, 20 bp, Artificial
  CRISPR gRNA sequence
agtgctgggattacaagcat

SEQ ID NO: 258411 - DNA, 20 bp, Artificial
  CRISPR gRNA sequence
caccatgcccaacctacaaa

SEQ ID NO: 258412 - DNA, 20 bp, Artificial
  CRISPR gRNA sequence
ctacaaatagatttgttttt

SEQ ID NO: 258413 - DNA, 20 bp, Artificial
  CRISPR gRNA sequence
tttgtttttaagttgtgata

SEQ ID NO: 258414 - DNA, 20 bp, Artificial
  CRISPR gRNA sequence
ttgtttttaagttgtgatac

SEQ ID NO: 258415 - DNA, 20 bp, Artificial
  CRISPR gRNA sequence
ttgtgatacaggtttttgta

SEQ ID NO: 258416 - DNA, 20 bp, Artificial
  CRISPR gRNA sequence
tgtgatacaggtttttgtaa

SEQ ID NO: 258417 - DNA, 20 bp, Artificial
  CRISPR gRNA sequence
ctttgtttattgcccattgc

SEQ ID NO: 258418 - DNA, 20 bp, Artificial
  CRISPR gRNA sequence
ttgtttattgcccattgcaa

SEQ ID NO: 258419 - DNA, 20 bp, Artificial
  CRISPR gRNA sequence
tttattgcccattgcaagag

SEQ ID NO: 258420 - DNA, 20 bp, Artificial
  CRISPR gRNA sequence
ttattgcccattgcaagagt

SEQ ID NO: 258421 - DNA, 20 bp, Artificial
  CRISPR gRNA sequence
cccattgcaagagtgggatg

SEQ ID NO: 258422 - DNA, 20 bp, Artificial
  CRISPR gRNA sequence
cattgcaagagtgggatgaa

SEQ ID NO: 258423 - DNA, 20 bp, Artificial
  CRISPR gRNA sequence
caagagtgggatgaagagat

SEQ ID NO: 258424 - DNA, 20 bp, Artificial
  CRISPR gRNA sequence
gataagaaaaaatataaccc

SEQ ID NO: 258425 - DNA, 20 bp, Artificial
  CRISPR gRNA sequence
taagaaaaaatataacccaa

SEQ ID NO: 258426 - DNA, 20 bp, Artificial
  CRISPR gRNA sequence
tgtgttttctgcaccaaatt

SEQ ID NO: 258427 - DNA, 20 bp, Artificial
  CRISPR gRNA sequence
tgttttctgcaccaaattca

SEQ ID NO: 258428 - DNA, 20 bp, Artificial
  CRISPR gRNA sequence
tctgcaccaaattcagagaa

SEQ ID NO: 258429 - DNA, 20 bp, Artificial
  CRISPR gRNA sequence
attcagagaatagcctcccc

SEQ ID NO: 258430 - DNA, 20 bp, Artificial
  CRISPR gRNA sequence
tagcctccccaagaaattca

SEQ ID NO: 258431 - DNA, 20 bp, Artificial
  CRISPR gRNA sequence
tctattcccttatatcatga

SEQ ID NO: 258432 - DNA, 20 bp, Artificial
  CRISPR gRNA sequence
ctattcccttatatcatgaa

SEQ ID NO: 258433 - DNA, 20 bp, Artificial
  CRISPR gRNA sequence
ccttatatcatgaaaggtga

SEQ ID NO: 258434 - DNA, 20 bp, Artificial
  CRISPR gRNA sequence
tcatgaaaggtgaaagactc

SEQ ID NO: 258435 - DNA, 20 bp, Artificial
  CRISPR gRNA sequence
atgaaaggtgaaagactcca

SEQ ID NO: 258436 - DNA, 20 bp, Artificial
  CRISPR gRNA sequence
tgaaaggtgaaagactccag

SEQ ID NO: 258437 - DNA, 20 bp, Artificial
  CRISPR gRNA sequence
gaaaggtgaaagactccaga

SEQ ID NO: 258438 - DNA, 20 bp, Artificial
  CRISPR gRNA sequence
aaaggtgaaagactccagag

SEQ ID NO: 258439 - DNA, 20 bp, Artificial
  CRISPR gRNA sequence
aggtgaaagactccagaggg

SEQ ID NO: 258440 - DNA, 20 bp, Artificial
  CRISPR gRNA sequence
ccagaggggagttatctctc

SEQ ID NO: 258441 - DNA, 20 bp, Artificial
  CRISPR gRNA sequence
ctttactgctatcccaataa

SEQ ID NO: 258442 - DNA, 20 bp, Artificial
  CRISPR gRNA sequence
gctatcccaataaaagatca

SEQ ID NO: 258443 - DNA, 20 bp, Artificial
  CRISPR gRNA sequence
caataaaagatcaaagaatc

SEQ ID NO: 258444 - DNA, 20 bp, Artificial
  CRISPR gRNA sequence
ataaaagatcaaagaatctg

SEQ ID NO: 258445 - DNA, 20 bp, Artificial
  CRISPR gRNA sequence
aaaagatcaaagaatctgga

SEQ ID NO: 258446 - DNA, 20 bp, Artificial
  CRISPR gRNA sequence
caaagaatctggagagcatt

SEQ ID NO: 258447 - DNA, 20 bp, Artificial
  CRISPR gRNA sequence
gcatttagttcaatctttaa

SEQ ID NO: 258448 - DNA, 20 bp, Artificial
  CRISPR gRNA sequence
tagttcaatctttaaaagca

SEQ ID NO: 258449 - DNA, 20 bp, Artificial
  CRISPR gRNA sequence
aaaagcaaagaacctgaaac

SEQ ID NO: 258450 - DNA, 20 bp, Artificial
  CRISPR gRNA sequence
aactagtttatcaactccat

SEQ ID NO: 258451 - DNA, 20 bp, Artificial
  CRISPR gRNA sequence
gtttatcaactccataagtg

SEQ ID NO: 258452 - DNA, 20 bp, Artificial
  CRISPR gRNA sequence
ttatcaactccataagtgaa

SEQ ID NO: 258453 - DNA, 20 bp, Artificial
  CRISPR gRNA sequence
cacattgatctcatttccca

SEQ ID NO: 258454 - DNA, 20 bp, Artificial
  CRISPR gRNA sequence
tcccatggtatcctcattgt

SEQ ID NO: 258455 - DNA, 20 bp, Artificial
  CRISPR gRNA sequence
tggtatcctcattgttggca

SEQ ID NO: 258456 - DNA, 20 bp, Artificial
  CRISPR gRNA sequence
ggtatcctcattgttggcac

SEQ ID NO: 258457 - DNA, 20 bp, Artificial
  CRISPR gRNA sequence
ttcttttctaatgattgtat

SEQ ID NO: 258458 - DNA, 20 bp, Artificial
  CRISPR gRNA sequence
tcttttctaatgattgtata

SEQ ID NO: 258459 - DNA, 20 bp, Artificial
  CRISPR gRNA sequence
tctaatgattgtataaggcc

SEQ ID NO: 258460 - DNA, 20 bp, Artificial
  CRISPR gRNA sequence
tgtataaggcctagaaacat

SEQ ID NO: 258461 - DNA, 20 bp, Artificial
  CRISPR gRNA sequence
taaggcctagaaacattagc

SEQ ID NO: 258462 - DNA, 20 bp, Artificial
  CRISPR gRNA sequence
aacattagctggtttgtctg

SEQ ID NO: 258463 - DNA, 20 bp, Artificial
  CRISPR gRNA sequence
gtctgaagtcaccaaacaaa

SEQ ID NO: 258464 - DNA, 20 bp, Artificial
  CRISPR gRNA sequence
gaagtcaccaaacaaatggt

SEQ ID NO: 258465 - DNA, 20 bp, Artificial
  CRISPR gRNA sequence
caccaaacaaatggtgagca

SEQ ID NO: 258466 - DNA, 20 bp, Artificial
  CRISPR gRNA sequence
aaacaaatggtgagcaaagc

SEQ ID NO: 258467 - DNA, 20 bp, Artificial
  CRISPR gRNA sequence
caaagccagaactaaaaccc

SEQ ID NO: 258468 - DNA, 20 bp, Artificial
  CRISPR gRNA sequence
gccagaactaaaacccaagt

SEQ ID NO: 258469 - DNA, 20 bp, Artificial
  CRISPR gRNA sequence
caagttggctatgaccacct

SEQ ID NO: 258470 - DNA, 20 bp, Artificial
  CRISPR gRNA sequence
ggctatgaccacctgagaaa

SEQ ID NO: 258471 - DNA, 20 bp, Artificial
  CRISPR gRNA sequence
acctgagaaatagaccactg

SEQ ID NO: 258472 - DNA, 20 bp, Artificial
  CRISPR gRNA sequence
aaatagaccactgaagcact

SEQ ID NO: 258473 - DNA, 20 bp, Artificial
  CRISPR gRNA sequence
ccactgaagcactgagaaac

SEQ ID NO: 258474 - DNA, 20 bp, Artificial
  CRISPR gRNA sequence
cactgaagcactgagaaact

SEQ ID NO: 258475 - DNA, 20 bp, Artificial
  CRISPR gRNA sequence
tgggaatcaactttgcaacc

SEQ ID NO: 258476 - DNA, 20 bp, Artificial
  CRISPR gRNA sequence
tttctttttttttttttttc

SEQ ID NO: 258477 - DNA, 20 bp, Artificial
  CRISPR gRNA sequence
tctttttttttttttttctg

SEQ ID NO: 258478 - DNA, 20 bp, Artificial
  CRISPR gRNA sequence
tttttttttttttctggaga

SEQ ID NO: 258479 - DNA, 20 bp, Artificial
  CRISPR gRNA sequence
tttttttttttctggagacg

SEQ ID NO: 258480 - DNA, 20 bp, Artificial
  CRISPR gRNA sequence
ggagtttcgctcttgttgcc

SEQ ID NO: 258481 - DNA, 20 bp, Artificial
  CRISPR gRNA sequence
gagtttcgctcttgttgccc

SEQ ID NO: 258482 - DNA, 20 bp, Artificial
  CRISPR gRNA sequence
ttcgctcttgttgcccaggc

SEQ ID NO: 258483 - DNA, 20 bp, Artificial
  CRISPR gRNA sequence
cgctcttgttgcccaggctg

SEQ ID NO: 258484 - DNA, 20 bp, Artificial
  CRISPR gRNA sequence
ttgcccaggctggagtgcaa

SEQ ID NO: 258485 - DNA, 20 bp, Artificial
  CRISPR gRNA sequence
ggagtgcaatggtgcgatct

SEQ ID NO: 258486 - DNA, 20 bp, Artificial
  CRISPR gRNA sequence
tgactgcaacctccgccctc

SEQ ID NO: 258487 - DNA, 20 bp, Artificial
  CRISPR gRNA sequence
gactgcaacctccgccctct

SEQ ID NO: 258488 - DNA, 20 bp, Artificial
  CRISPR gRNA sequence
caacctccgccctctgggtt

SEQ ID NO: 258489 - DNA, 20 bp, Artificial
  CRISPR gRNA sequence
aacctccgccctctgggttc

SEQ ID NO: 258490 - DNA, 20 bp, Artificial
  CRISPR gRNA sequence
ttcaggtgattctcctgcct

SEQ ID NO: 258491 - DNA, 20 bp, Artificial
  CRISPR gRNA sequence
ttctcctgcctcagcctccc

SEQ ID NO: 258492 - DNA, 20 bp, Artificial
  CRISPR gRNA sequence
tcctgcctcagcctcccgag

SEQ ID NO: 258493 - DNA, 20 bp, Artificial
  CRISPR gRNA sequence
gcctcagcctcccgagtagc

SEQ ID NO: 258494 - DNA, 20 bp, Artificial
  CRISPR gRNA sequence
cctcagcctcccgagtagct

SEQ ID NO: 258495 - DNA, 20 bp, Artificial
  CRISPR gRNA sequence
tcccgagtagctgggattaa

SEQ ID NO: 258496 - DNA, 20 bp, Artificial
  CRISPR gRNA sequence
cccgagtagctgggattaac

SEQ ID NO: 258497 - DNA, 20 bp, Artificial
  CRISPR gRNA sequence
caggtatgcaccaccatgcc

SEQ ID NO: 258498 - DNA, 20 bp, Artificial
  CRISPR gRNA sequence
cccggctaattttctatttt

SEQ ID NO: 258499 - DNA, 20 bp, Artificial
  CRISPR gRNA sequence
ggctaattttctatttttag

SEQ ID NO: 258500 - DNA, 20 bp, Artificial
  CRISPR gRNA sequence
ctaattttctatttttagta

SEQ ID NO: 258501 - DNA, 20 bp, Artificial
  CRISPR gRNA sequence
ttttctatttttagtagaga

SEQ ID NO: 258502 - DNA, 20 bp, Artificial
  CRISPR gRNA sequence
tttctatttttagtagagac

SEQ ID NO: 258503 - DNA, 20 bp, Artificial
  CRISPR gRNA sequence
ttctatttttagtagagacg

SEQ ID NO: 258504 - DNA, 20 bp, Artificial
  CRISPR gRNA sequence
gagacggggtttctccatgt

SEQ ID NO: 258505 - DNA, 20 bp, Artificial
  CRISPR gRNA sequence
cggggtttctccatgttggt

SEQ ID NO: 258506 - DNA, 20 bp, Artificial
  CRISPR gRNA sequence
ggggtttctccatgttggtc

SEQ ID NO: 258507 - DNA, 20 bp, Artificial
  CRISPR gRNA sequence
ttgtctcgaactcccaacct

SEQ ID NO: 258508 - DNA, 20 bp, Artificial
  CRISPR gRNA sequence
tgtctcgaactcccaacctc

SEQ ID NO: 258509 - DNA, 20 bp, Artificial
  CRISPR gRNA sequence
cctcaggtgatccaccgcct

SEQ ID NO: 258510 - DNA, 20 bp, Artificial
  CRISPR gRNA sequence
tccaccgcctcggcctccca

SEQ ID NO: 258511 - DNA, 20 bp, Artificial
  CRISPR gRNA sequence
gcctcggcctcccaaagtgc

SEQ ID NO: 258512 - DNA, 20 bp, Artificial
  CRISPR gRNA sequence
cctcggcctcccaaagtgct

SEQ ID NO: 258513 - DNA, 20 bp, Artificial
  CRISPR gRNA sequence
ctcccaaagtgctgggatta

SEQ ID NO: 258514 - DNA, 20 bp, Artificial
  CRISPR gRNA sequence
tcccaaagtgctgggattac

SEQ ID NO: 258515 - DNA, 20 bp, Artificial
  CRISPR gRNA sequence
agtgctgggattacaggtgt

SEQ ID NO: 258516 - DNA, 20 bp, Artificial
  CRISPR gRNA sequence
caggtgtgagccactgcgcc

SEQ ID NO: 258517 - DNA, 20 bp, Artificial
  CRISPR gRNA sequence
agccactgcgcctggccctc

SEQ ID NO: 258518 - DNA, 20 bp, Artificial
  CRISPR gRNA sequence
tcaaatttcaatgcaaacaa

SEQ ID NO: 258519 - DNA, 20 bp, Artificial
  CRISPR gRNA sequence
gcatttttttgctcttgttt

SEQ ID NO: 258520 - DNA, 20 bp, Artificial
  CRISPR gRNA sequence
catttttttgctcttgtttt

SEQ ID NO: 258521 - DNA, 20 bp, Artificial
  CRISPR gRNA sequence
atttttttgctcttgttttg

SEQ ID NO: 258522 - DNA, 20 bp, Artificial
  CRISPR gRNA sequence
tacctacttgcatttctttt

SEQ ID NO: 258523 - DNA, 20 bp, Artificial
  CRISPR gRNA sequence
atttcttttaagtttatttg

SEQ ID NO: 258524 - DNA, 20 bp, Artificial
  CRISPR gRNA sequence
catcccgtatacccacactg

SEQ ID NO: 258525 - DNA, 20 bp, Artificial
  CRISPR gRNA sequence
tcccgtatacccacactgaa

SEQ ID NO: 258526 - DNA, 20 bp, Artificial
  CRISPR gRNA sequence
actgaagagccaaataaaat

SEQ ID NO: 258527 - DNA, 20 bp, Artificial
  CRISPR gRNA sequence
tgaatttgaattcatataca

SEQ ID NO: 258528 - DNA, 20 bp, Artificial
  CRISPR gRNA sequence
gaatttgaattcatatacac

SEQ ID NO: 258529 - DNA, 20 bp, Artificial
  CRISPR gRNA sequence
tatacacaggtgttttgttt

SEQ ID NO: 258530 - DNA, 20 bp, Artificial
  CRISPR gRNA sequence
caggtgttttgttttggttt

SEQ ID NO: 258531 - DNA, 20 bp, Artificial
  CRISPR gRNA sequence
tgttttgttttggttttggt

SEQ ID NO: 258532 - DNA, 20 bp, Artificial
  CRISPR gRNA sequence
tttgttttggttttggtaag

SEQ ID NO: 258533 - DNA, 20 bp, Artificial
  CRISPR gRNA sequence
ttgttttggttttggtaaga

SEQ ID NO: 258534 - DNA, 20 bp, Artificial
  CRISPR gRNA sequence
tggttttggtaagaaggaaa

SEQ ID NO: 258535 - DNA, 20 bp, Artificial
  CRISPR gRNA sequence
ttggtaagaaggaaatggca

SEQ ID NO: 258536 - DNA, 20 bp, Artificial
  CRISPR gRNA sequence
atggcatagaactaaattaa

SEQ ID NO: 258537 - DNA, 20 bp, Artificial
  CRISPR gRNA sequence
gcatagaactaaattaatag

SEQ ID NO: 258538 - DNA, 20 bp, Artificial
  CRISPR gRNA sequence
tcctatataatcaataatgc

SEQ ID NO: 258539 - DNA, 20 bp, Artificial
  CRISPR gRNA sequence
atataatcaataatgctggc

SEQ ID NO: 258540 - DNA, 20 bp, Artificial
  CRISPR gRNA sequence
tataatcaataatgctggct

SEQ ID NO: 258541 - DNA, 20 bp, Artificial
  CRISPR gRNA sequence
ataatcaataatgctggctg

SEQ ID NO: 258542 - DNA, 20 bp, Artificial
  CRISPR gRNA sequence
ataatgctggctggggatga

SEQ ID NO: 258543 - DNA, 20 bp, Artificial
  CRISPR gRNA sequence
ggctcacacctttgtgatcc

SEQ ID NO: 258544 - DNA, 20 bp, Artificial
  CRISPR gRNA sequence
cctttgtgatcctagcactt

SEQ ID NO: 258545 - DNA, 20 bp, Artificial
  CRISPR gRNA sequence
ctttgtgatcctagcacttt

SEQ ID NO: 258546 - DNA, 20 bp, Artificial
  CRISPR gRNA sequence
ttgtgatcctagcactttgg

SEQ ID NO: 258547 - DNA, 20 bp, Artificial
  CRISPR gRNA sequence
tgtgatcctagcactttggg

SEQ ID NO: 258548 - DNA, 20 bp, Artificial
  CRISPR gRNA sequence
tcctagcactttgggaggcc

SEQ ID NO: 258549 - DNA, 20 bp, Artificial
  CRISPR gRNA sequence
cctagcactttgggaggcca

SEQ ID NO: 258550 - DNA, 20 bp, Artificial
  CRISPR gRNA sequence
agcactttgggaggccaagg

SEQ ID NO: 258551 - DNA, 20 bp, Artificial
  CRISPR gRNA sequence
gcactttgggaggccaaggc

SEQ ID NO: 258552 - DNA, 20 bp, Artificial
  CRISPR gRNA sequence
ccaaggcgggatgaatgctt

SEQ ID NO: 258553 - DNA, 20 bp, Artificial
  CRISPR gRNA sequence
gcgggatgaatgcttgagcc

SEQ ID NO: 258554 - DNA, 20 bp, Artificial
  CRISPR gRNA sequence
cgggatgaatgcttgagccc

SEQ ID NO: 258555 - DNA, 20 bp, Artificial
  CRISPR gRNA sequence
ggatgaatgcttgagcccag

SEQ ID NO: 258556 - DNA, 20 bp, Artificial
  CRISPR gRNA sequence
atgcttgagcccaggagttc

SEQ ID NO: 258557 - DNA, 20 bp, Artificial
  CRISPR gRNA sequence
tgagcccaggagttcaagac

SEQ ID NO: 258558 - DNA, 20 bp, Artificial
  CRISPR gRNA sequence
ccaggagttcaagaccagcc

SEQ ID NO: 258559 - DNA, 20 bp, Artificial
  CRISPR gRNA sequence
caggagttcaagaccagcct

SEQ ID NO: 258560 - DNA, 20 bp, Artificial
  CRISPR gRNA sequence
caagaccagcctgggcaaca

SEQ ID NO: 258561 - DNA, 20 bp, Artificial
  CRISPR gRNA sequence
accagcctgggcaacataga

SEQ ID NO: 258562 - DNA, 20 bp, Artificial
  CRISPR gRNA sequence
tctttttaaaaaatcattgc

SEQ ID NO: 258563 - DNA, 20 bp, Artificial
  CRISPR gRNA sequence
atcattgctggctttatatc

SEQ ID NO: 258564 - DNA, 20 bp, Artificial
  CRISPR gRNA sequence
atgaaaaaatatctgtgccc

SEQ ID NO: 258565 - DNA, 20 bp, Artificial
  CRISPR gRNA sequence
tgcccaagtcctcccacttc

SEQ ID NO: 258566 - DNA, 20 bp, Artificial
  CRISPR gRNA sequence
tccggaaattctgatttaat

SEQ ID NO: 258567 - DNA, 20 bp, Artificial
  CRISPR gRNA sequence
aaattctgatttaattggtc

SEQ ID NO: 258568 - DNA, 20 bp, Artificial
  CRISPR gRNA sequence
aattctgatttaattggtct

SEQ ID NO: 258569 - DNA, 20 bp, Artificial
  CRISPR gRNA sequence
ctgatttaattggtctaggc

SEQ ID NO: 258570 - DNA, 20 bp, Artificial
  CRISPR gRNA sequence
tgatttaattggtctaggct

SEQ ID NO: 258571 - DNA, 20 bp, Artificial
  CRISPR gRNA sequence
gatttaattggtctaggctg

SEQ ID NO: 258572 - DNA, 20 bp, Artificial
  CRISPR gRNA sequence
atttaattggtctaggctgg

SEQ ID NO: 258573 - DNA, 20 bp, Artificial
  CRISPR gRNA sequence
tttaattggtctaggctggg

SEQ ID NO: 258574 - DNA, 20 bp, Artificial
  CRISPR gRNA sequence
aattggtctaggctgggggg

SEQ ID NO: 258575 - DNA, 20 bp, Artificial
  CRISPR gRNA sequence
attggtctaggctgggggga

SEQ ID NO: 258576 - DNA, 20 bp, Artificial
  CRISPR gRNA sequence
tggggggaaggattgatact

SEQ ID NO: 258577 - DNA, 20 bp, Artificial
  CRISPR gRNA sequence
taagttttttttctttattt

SEQ ID NO: 258578 - DNA, 20 bp, Artificial
  CRISPR gRNA sequence
ttttagataataactttatt

SEQ ID NO: 258579 - DNA, 20 bp, Artificial
  CRISPR gRNA sequence
aactttattgagatataatt

SEQ ID NO: 258580 - DNA, 20 bp, Artificial
  CRISPR gRNA sequence
actttattgagatataattc

SEQ ID NO: 258581 - DNA, 20 bp, Artificial
  CRISPR gRNA sequence
gatataattcaggtactata

SEQ ID NO: 258582 - DNA, 20 bp, Artificial
  CRISPR gRNA sequence
ctataaagtttgctgtttta

SEQ ID NO: 258583 - DNA, 20 bp, Artificial
  CRISPR gRNA sequence
ctgttttaaagtgtaaaatt

SEQ ID NO: 258584 - DNA, 20 bp, Artificial
  CRISPR gRNA sequence
gttttaaagtgtaaaattca

SEQ ID NO: 258585 - DNA, 20 bp, Artificial
  CRISPR gRNA sequence
tgtaaaattcagagattttt

SEQ ID NO: 258586 - DNA, 20 bp, Artificial
  CRISPR gRNA sequence
gattttttagtatattcaca

SEQ ID NO: 258587 - DNA, 20 bp, Artificial
  CRISPR gRNA sequence
gaatcaccactatctgattc

SEQ ID NO: 258588 - DNA, 20 bp, Artificial
  CRISPR gRNA sequence
aacattttcattactccata

SEQ ID NO: 258589 - DNA, 20 bp, Artificial
  CRISPR gRNA sequence
tcctccctcccttaaatccc

SEQ ID NO: 258590 - DNA, 20 bp, Artificial
  CRISPR gRNA sequence
tggaaaccactgatctactt

SEQ ID NO: 258591 - DNA, 20 bp, Artificial
  CRISPR gRNA sequence
ccctatgaatttgcctattc

SEQ ID NO: 258592 - DNA, 20 bp, Artificial
  CRISPR gRNA sequence
ctattctggactttttttat

SEQ ID NO: 258593 - DNA, 20 bp, Artificial
  CRISPR gRNA sequence
ttctggactttttttataag

SEQ ID NO: 258594 - DNA, 20 bp, Artificial
  CRISPR gRNA sequence
aagtagaatcatacgatatg

SEQ ID NO: 258595 - DNA, 20 bp, Artificial
  CRISPR gRNA sequence
tgtgtctcgtttctttcact

SEQ ID NO: 258596 - DNA, 20 bp, Artificial
  CRISPR gRNA sequence
tcacttagcataatgttttc

SEQ ID NO: 258597 - DNA, 20 bp, Artificial
  CRISPR gRNA sequence
tcaagtttcatccatgtttc

SEQ ID NO: 258598 - DNA, 20 bp, Artificial
  CRISPR gRNA sequence
atccatgttgttgcatgcac

SEQ ID NO: 258599 - DNA, 20 bp, Artificial
  CRISPR gRNA sequence
caccagaacttcactcttca

SEQ ID NO: 258600 - DNA, 20 bp, Artificial
  CRISPR gRNA sequence
ccaaataatattccattgta

SEQ ID NO: 258601 - DNA, 20 bp, Artificial
  CRISPR gRNA sequence
tttttctattcatcactttt

SEQ ID NO: 258602 - DNA, 20 bp, Artificial
  CRISPR gRNA sequence
attatgaataatgctactat

SEQ ID NO: 258603 - DNA, 20 bp, Artificial
  CRISPR gRNA sequence
ctactatgagcatttgcata

SEQ ID NO: 258604 - DNA, 20 bp, Artificial
  CRISPR gRNA sequence
tttgcatacagatttttgtg

SEQ ID NO: 258605 - DNA, 20 bp, Artificial
  CRISPR gRNA sequence
acgtatgttttcaactctct

SEQ ID NO: 258606 - DNA, 20 bp, Artificial
  CRISPR gRNA sequence
cgtatgttttcaactctctt

SEQ ID NO: 258607 - DNA, 20 bp, Artificial
  CRISPR gRNA sequence
caactctcttaggtatttgc

SEQ ID NO: 258608 - DNA, 20 bp, Artificial
  CRISPR gRNA sequence
ctctcttaggtatttgccag

SEQ ID NO: 258609 - DNA, 20 bp, Artificial
  CRISPR gRNA sequence
tttgccagcagtaaaattgc

SEQ ID NO: 258610 - DNA, 20 bp, Artificial
  CRISPR gRNA sequence
ttgccagcagtaaaattgct

SEQ ID NO: 258611 - DNA, 20 bp, Artificial
  CRISPR gRNA sequence
agtaaaattgctgggtcata

SEQ ID NO: 258612 - DNA, 20 bp, Artificial
  CRISPR gRNA sequence
aactctatgtttaacttttt

SEQ ID NO: 258613 - DNA, 20 bp, Artificial
  CRISPR gRNA sequence
actctatgtttaactttttg

SEQ ID NO: 258614 - DNA, 20 bp, Artificial
  CRISPR gRNA sequence
gaatcgtcaaactgttgcca

SEQ ID NO: 258615 - DNA, 20 bp, Artificial
  CRISPR gRNA sequence
gcaccattgtacattctcac

SEQ ID NO: 258616 - DNA, 20 bp, Artificial
  CRISPR gRNA sequence
ccattgtacattctcaccag

SEQ ID NO: 258617 - DNA, 20 bp, Artificial
  CRISPR gRNA sequence
cattctcaccagcagtgaat

SEQ ID NO: 258618 - DNA, 20 bp, Artificial
  CRISPR gRNA sequence
attctcaccagcagtgaatg

SEQ ID NO: 258619 - DNA, 20 bp, Artificial
  CRISPR gRNA sequence
ttctcaccagcagtgaatga

SEQ ID NO: 258620 - DNA, 20 bp, Artificial
  CRISPR gRNA sequence
attgttcatcttttctatta

SEQ ID NO: 258621 - DNA, 20 bp, Artificial
  CRISPR gRNA sequence
cttttctattatagccatcc

SEQ ID NO: 258622 - DNA, 20 bp, Artificial
  CRISPR gRNA sequence
ttctattatagccatcctgg

SEQ ID NO: 258623 - DNA, 20 bp, Artificial
  CRISPR gRNA sequence
tagccatcctggtggacgtg

SEQ ID NO: 258624 - DNA, 20 bp, Artificial
  CRISPR gRNA sequence
cgtgaagtgatatctcatca

SEQ ID NO: 258625 - DNA, 20 bp, Artificial
  CRISPR gRNA sequence
ctctaataactaatgatgct

SEQ ID NO: 258626 - DNA, 20 bp, Artificial
  CRISPR gRNA sequence
gcatcttttcatgtgcttat

SEQ ID NO: 258627 - DNA, 20 bp, Artificial
  CRISPR gRNA sequence
ttcatgtgcttattagccat

SEQ ID NO: 258628 - DNA, 20 bp, Artificial
  CRISPR gRNA sequence
agccattggtctattctttt

SEQ ID NO: 258629 - DNA, 20 bp, Artificial
  CRISPR gRNA sequence
ccattggtctattcttttta

SEQ ID NO: 258630 - DNA, 20 bp, Artificial
  CRISPR gRNA sequence
tttttagagaactctctatt

SEQ ID NO: 258631 - DNA, 20 bp, Artificial
  CRISPR gRNA sequence
tcatttgcccatttattaac

SEQ ID NO: 258632 - DNA, 20 bp, Artificial
  CRISPR gRNA sequence
ttgcccatttattaactggt

SEQ ID NO: 258633 - DNA, 20 bp, Artificial
  CRISPR gRNA sequence
tgcccatttattaactggtt

SEQ ID NO: 258634 - DNA, 20 bp, Artificial
  CRISPR gRNA sequence
tctttttattattgaattat

SEQ ID NO: 258635 - DNA, 20 bp, Artificial
  CRISPR gRNA sequence
tttttattattgaattattg

SEQ ID NO: 258636 - DNA, 20 bp, Artificial
  CRISPR gRNA sequence
cttttttttttttattttta

SEQ ID NO: 258637 - DNA, 20 bp, Artificial
  CRISPR gRNA sequence
tttttttttttatttttaca

SEQ ID NO: 258638 - DNA, 20 bp, Artificial
  CRISPR gRNA sequence
cagagtctcactctgtcacc

SEQ ID NO: 258639 - DNA, 20 bp, Artificial
  CRISPR gRNA sequence
agagtctcactctgtcaccc

SEQ ID NO: 258640 - DNA, 20 bp, Artificial
  CRISPR gRNA sequence
tctcactctgtcacccaggc

SEQ ID NO: 258641 - DNA, 20 bp, Artificial
  CRISPR gRNA sequence
tcactctgtcacccaggctg

SEQ ID NO: 258642 - DNA, 20 bp, Artificial
  CRISPR gRNA sequence
ctgtcacccaggctggagtg

SEQ ID NO: 258643 - DNA, 20 bp, Artificial
  CRISPR gRNA sequence
tcacccaggctggagtgcag

SEQ ID NO: 258644 - DNA, 20 bp, Artificial
  CRISPR gRNA sequence
ggagtgcagtggcatgatct

SEQ ID NO: 258645 - DNA, 20 bp, Artificial
  CRISPR gRNA sequence
ggcatgatcttggctcactg

SEQ ID NO: 258646 - DNA, 20 bp, Artificial
  CRISPR gRNA sequence
tcactgcagcctctgccacc

SEQ ID NO: 258647 - DNA, 20 bp, Artificial
  CRISPR gRNA sequence
agcctctgccacccagaatc

SEQ ID NO: 258648 - DNA, 20 bp, Artificial
  CRISPR gRNA sequence
atcaagcaatcctcctgcct

SEQ ID NO: 258649 - DNA, 20 bp, Artificial
  CRISPR gRNA sequence
tcctcctgcctcagcctccc

SEQ ID NO: 258650 - DNA, 20 bp, Artificial
  CRISPR gRNA sequence
tcctgcctcagcctcccgag

SEQ ID NO: 258651 - DNA, 20 bp, Artificial
  CRISPR gRNA sequence
gcctcagcctcccgagtagc

SEQ ID NO: 258652 - DNA, 20 bp, Artificial
  CRISPR gRNA sequence
gcctcccgagtagctggaat

SEQ ID NO: 258653 - DNA, 20 bp, Artificial
  CRISPR gRNA sequence
ctcccgagtagctggaattg

SEQ ID NO: 258654 - DNA, 20 bp, Artificial
  CRISPR gRNA sequence
tcccgagtagctggaattgg

SEQ ID NO: 258655 - DNA, 20 bp, Artificial
  CRISPR gRNA sequence
gaggtgaccaccaccacccc

SEQ ID NO: 258656 - DNA, 20 bp, Artificial
  CRISPR gRNA sequence
ccagctaatttttatatttt

SEQ ID NO: 258657 - DNA, 20 bp, Artificial
  CRISPR gRNA sequence
gctaatttttatatttttag

SEQ ID NO: 258658 - DNA, 20 bp, Artificial
  CRISPR gRNA sequence
taatttttatatttttagta

SEQ ID NO: 258659 - DNA, 20 bp, Artificial
  CRISPR gRNA sequence
ttttatatttttagtagaga

SEQ ID NO: 258660 - DNA, 20 bp, Artificial
  CRISPR gRNA sequence
tttatatttttagtagagat

SEQ ID NO: 258661 - DNA, 20 bp, Artificial
  CRISPR gRNA sequence
ttatatttttagtagagatg

SEQ ID NO: 258662 - DNA, 20 bp, Artificial
  CRISPR gRNA sequence
agagatggggtttctccatg

SEQ ID NO: 258663 - DNA, 20 bp, Artificial
  CRISPR gRNA sequence
gagatggggtttctccatgt

SEQ ID NO: 258664 - DNA, 20 bp, Artificial
  CRISPR gRNA sequence
tggggtttctccatgtgggc

SEQ ID NO: 258665 - DNA, 20 bp, Artificial
  CRISPR gRNA sequence
ggggtttctccatgtgggcc

SEQ ID NO: 258666 - DNA, 20 bp, Artificial
  CRISPR gRNA sequence
tttctccatgtgggccaggc

SEQ ID NO: 258667 - DNA, 20 bp, Artificial
  CRISPR gRNA sequence
tggtctcaaactcctgacct

SEQ ID NO: 258668 - DNA, 20 bp, Artificial
  CRISPR gRNA sequence
ctcagatgatctgcctgcct

SEQ ID NO: 258669 - DNA, 20 bp, Artificial
  CRISPR gRNA sequence
gcctgcctcagccttgatac

SEQ ID NO: 258670 - DNA, 20 bp, Artificial
  CRISPR gRNA sequence
ccttgatacaagtttcttat

SEQ ID NO: 258671 - DNA, 20 bp, Artificial
  CRISPR gRNA sequence
aaatgttttctctcattctg

SEQ ID NO: 258672 - DNA, 20 bp, Artificial
  CRISPR gRNA sequence
tgtctttcatattatcttaa

SEQ ID NO: 258673 - DNA, 20 bp, Artificial
  CRISPR gRNA sequence
acttgattctaatattcaat

SEQ ID NO: 258674 - DNA, 20 bp, Artificial
  CRISPR gRNA sequence
cttgattctaatattcaatt

SEQ ID NO: 258675 - DNA, 20 bp, Artificial
  CRISPR gRNA sequence
ctaatattcaattgggttga

SEQ ID NO: 258676 - DNA, 20 bp, Artificial
  CRISPR gRNA sequence
aattgggttgaaagccacta

SEQ ID NO: 258677 - DNA, 20 bp, Artificial
  CRISPR gRNA sequence
ggttgaaagccactatggcc

SEQ ID NO: 258678 - DNA, 20 bp, Artificial
  CRISPR gRNA sequence
tgaaagccactatggcctag

SEQ ID NO: 258679 - DNA, 20 bp, Artificial
  CRISPR gRNA sequence
aattcacctgacaacatatt

SEQ ID NO: 258680 - DNA, 20 bp, Artificial
  CRISPR gRNA sequence
acaacatatttagaatcacc

SEQ ID NO: 258681 - DNA, 20 bp, Artificial
  CRISPR gRNA sequence
aatcacctggaaaaatctaa

SEQ ID NO: 258682 - DNA, 20 bp, Artificial
  CRISPR gRNA sequence
tggaaaaatctaaaagcctt

SEQ ID NO: 258683 - DNA, 20 bp, Artificial
  CRISPR gRNA sequence
ctaaaagcctttggttttcc

SEQ ID NO: 258684 - DNA, 20 bp, Artificial
  CRISPR gRNA sequence
taaaagcctttggttttcca

SEQ ID NO: 258685 - DNA, 20 bp, Artificial
  CRISPR gRNA sequence
ttttccaaggccaattaaat

SEQ ID NO: 258686 - DNA, 20 bp, Artificial
  CRISPR gRNA sequence
gccaattaaatcagaatctc

SEQ ID NO: 258687 - DNA, 20 bp, Artificial
  CRISPR gRNA sequence
ccaattaaatcagaatctct

SEQ ID NO: 258688 - DNA, 20 bp, Artificial
  CRISPR gRNA sequence
taaatcagaatctctaggta

SEQ ID NO: 258689 - DNA, 20 bp, Artificial
  CRISPR gRNA sequence
aaatcagaatctctaggtat

SEQ ID NO: 258690 - DNA, 20 bp, Artificial
  CRISPR gRNA sequence
gaatctctaggtataggacc

SEQ ID NO: 258691 - DNA, 20 bp, Artificial
  CRISPR gRNA sequence
aatctctaggtataggaccc

SEQ ID NO: 258692 - DNA, 20 bp, Artificial
  CRISPR gRNA sequence
ggcatccattcatatttttt

SEQ ID NO: 258693 - DNA, 20 bp, Artificial
  CRISPR gRNA sequence
tcatattttttaagtttctc

SEQ ID NO: 258694 - DNA, 20 bp, Artificial
  CRISPR gRNA sequence
ttaagtttctctagtaattc

SEQ ID NO: 258695 - DNA, 20 bp, Artificial
  CRISPR gRNA sequence
gtttctctagtaattctaga

SEQ ID NO: 258696 - DNA, 20 bp, Artificial
  CRISPR gRNA sequence
tctctagtaattctagatgg

SEQ ID NO: 258697 - DNA, 20 bp, Artificial
  CRISPR gRNA sequence
tctagatggcagtcaaattt

SEQ ID NO: 258698 - DNA, 20 bp, Artificial
  CRISPR gRNA sequence
tggcagtcaaatttgagaac

SEQ ID NO: 258699 - DNA, 20 bp, Artificial
  CRISPR gRNA sequence
cagtcaaatttgagaaccag

SEQ ID NO: 258700 - DNA, 20 bp, Artificial
  CRISPR gRNA sequence
tttgagaaccagtggcctaa

SEQ ID NO: 258701 - DNA, 20 bp, Artificial
  CRISPR gRNA sequence
tgagaaccagtggcctaaca

SEQ ID NO: 258702 - DNA, 20 bp, Artificial
  CRISPR gRNA sequence
gagaaccagtggcctaacag

SEQ ID NO: 258703 - DNA, 20 bp, Artificial
  CRISPR gRNA sequence
ctaacttcttatcctcaaat

SEQ ID NO: 258704 - DNA, 20 bp, Artificial
  CRISPR gRNA sequence
tatcctcaaatcggcctcca

SEQ ID NO: 258705 - DNA, 20 bp, Artificial
  CRISPR gRNA sequence
atcctcaaatcggcctccac

SEQ ID NO: 258706 - DNA, 20 bp, Artificial
  CRISPR gRNA sequence
aacctcatttcctcaaaccg

SEQ ID NO: 258707 - DNA, 20 bp, Artificial
  CRISPR gRNA sequence
caaaccgaagccctcctaat

SEQ ID NO: 258708 - DNA, 20 bp, Artificial
  CRISPR gRNA sequence
ccctcctaattagaccattt

SEQ ID NO: 258709 - DNA, 20 bp, Artificial
  CRISPR gRNA sequence
accatttaagccaacatccc

SEQ ID NO: 258710 - DNA, 20 bp, Artificial
  CRISPR gRNA sequence
ttaagccaacatcccaagaa

SEQ ID NO: 258711 - DNA, 20 bp, Artificial
  CRISPR gRNA sequence
acatcccaagaacagactgt

SEQ ID NO: 258712 - DNA, 20 bp, Artificial
  CRISPR gRNA sequence
tgccttgtctactaactcct

SEQ ID NO: 258713 - DNA, 20 bp, Artificial
  CRISPR gRNA sequence
tgtctactaactccttggca

SEQ ID NO: 258714 - DNA, 20 bp, Artificial
  CRISPR gRNA sequence
tctactaactccttggcaca

SEQ ID NO: 258715 - DNA, 20 bp, Artificial
  CRISPR gRNA sequence
acagagcaccactcccttct

SEQ ID NO: 258716 - DNA, 20 bp, Artificial
  CRISPR gRNA sequence
cagagcaccactcccttctc

SEQ ID NO: 258717 - DNA, 20 bp, Artificial
  CRISPR gRNA sequence
gtatcgctcacttgacattt

SEQ ID NO: 258718 - DNA, 20 bp, Artificial
  CRISPR gRNA sequence
ttcacatgcttcaatttgct

SEQ ID NO: 258719 - DNA, 20 bp, Artificial
  CRISPR gRNA sequence
tgcttcaatttgcttagctt

SEQ ID NO: 258720 - DNA, 20 bp, Artificial
  CRISPR gRNA sequence
ggattcatgtgcatttccct

SEQ ID NO: 258721 - DNA, 20 bp, Artificial
  CRISPR gRNA sequence
gattcatgtgcatttccctt

SEQ ID NO: 258722 - DNA, 20 bp, Artificial
  CRISPR gRNA sequence
gtgcatttcccttaggcccc

SEQ ID NO: 258723 - DNA, 20 bp, Artificial
  CRISPR gRNA sequence
cccttaggcccctggtttcc

SEQ ID NO: 258724 - DNA, 20 bp, Artificial
  CRISPR gRNA sequence
ctggtttccaagtctcttga

SEQ ID NO: 258725 - DNA, 20 bp, Artificial
  CRISPR gRNA sequence
tttccaagtctcttgacaga

SEQ ID NO: 258726 - DNA, 20 bp, Artificial
  CRISPR gRNA sequence
ttccaagtctcttgacagaa

SEQ ID NO: 258727 - DNA, 20 bp, Artificial
  CRISPR gRNA sequence
ttatgcttctttacataaca

SEQ ID NO: 258728 - DNA, 20 bp, Artificial
  CRISPR gRNA sequence
acataacacagtatgactaa

SEQ ID NO: 258729 - DNA, 20 bp, Artificial
  CRISPR gRNA sequence
agactctcataaaataattg

SEQ ID NO: 258730 - DNA, 20 bp, Artificial
  CRISPR gRNA sequence
actctcataaaataattgtg

SEQ ID NO: 258731 - DNA, 20 bp, Artificial
  CRISPR gRNA sequence
ataaaataattgtggagtga

SEQ ID NO: 258732 - DNA, 20 bp, Artificial
  CRISPR gRNA sequence
aataattgtggagtgaaaga

SEQ ID NO: 258733 - DNA, 20 bp, Artificial
  CRISPR gRNA sequence
tggagtgaaagatggtgatt

SEQ ID NO: 258734 - DNA, 20 bp, Artificial
  CRISPR gRNA sequence
ttcggctgtattgttgttat

SEQ ID NO: 258735 - DNA, 20 bp, Artificial
  CRISPR gRNA sequence
ggctgtattgttgttatcag

SEQ ID NO: 258736 - DNA, 20 bp, Artificial
  CRISPR gRNA sequence
gtattgttgttatcagcagc

SEQ ID NO: 258737 - DNA, 20 bp, Artificial
  CRISPR gRNA sequence
tattgttgttatcagcagct

SEQ ID NO: 258738 - DNA, 20 bp, Artificial
  CRISPR gRNA sequence
ccatctcattaaatcctttt

SEQ ID NO: 258739 - DNA, 20 bp, Artificial
  CRISPR gRNA sequence
gttccacaaatattttgcaa

SEQ ID NO: 258740 - DNA, 20 bp, Artificial
  CRISPR gRNA sequence
cactgaaaaataaacatgca

SEQ ID NO: 258741 - DNA, 20 bp, Artificial
  CRISPR gRNA sequence
taaacatgcaaagaatcaaa

SEQ ID NO: 258742 - DNA, 20 bp, Artificial
  CRISPR gRNA sequence
gtttgtttcctttttttact

SEQ ID NO: 258743 - DNA, 20 bp, Artificial
  CRISPR gRNA sequence
tgtttcctttttttacttag

SEQ ID NO: 258744 - DNA, 20 bp, Artificial
  CRISPR gRNA sequence
gtttcctttttttacttaga

SEQ ID NO: 258745 - DNA, 20 bp, Artificial
  CRISPR gRNA sequence
ttcctttttttacttagaag

SEQ ID NO: 258746 - DNA, 20 bp, Artificial
  CRISPR gRNA sequence
ttttacttagaaggagtcat

SEQ ID NO: 258747 - DNA, 20 bp, Artificial
  CRISPR gRNA sequence
tttacttagaaggagtcatt

SEQ ID NO: 258748 - DNA, 20 bp, Artificial
  CRISPR gRNA sequence
cttagaaggagtcattaggt

SEQ ID NO: 258749 - DNA, 20 bp, Artificial
  CRISPR gRNA sequence
gtcattaggtcagttctaat

SEQ ID NO: 258750 - DNA, 20 bp, Artificial
  CRISPR gRNA sequence
attaggtcagttctaattgg

SEQ ID NO: 258751 - DNA, 20 bp, Artificial
  CRISPR gRNA sequence
taggtcagttctaattggaa

SEQ ID NO: 258752 - DNA, 20 bp, Artificial
  CRISPR gRNA sequence
attggaagagcaaccaactc

SEQ ID NO: 258753 - DNA, 20 bp, Artificial
  CRISPR gRNA sequence
gaagagcaaccaactccagc

SEQ ID NO: 258754 - DNA, 20 bp, Artificial
  CRISPR gRNA sequence
cctgcatctctcctcctttt

SEQ ID NO: 258755 - DNA, 20 bp, Artificial
  CRISPR gRNA sequence
tgcatctctcctccttttca

SEQ ID NO: 258756 - DNA, 20 bp, Artificial
  CRISPR gRNA sequence
catctctcctccttttcaga

SEQ ID NO: 258757 - DNA, 20 bp, Artificial
  CRISPR gRNA sequence
tctcctccttttcagagagt

SEQ ID NO: 258758 - DNA, 20 bp, Artificial
  CRISPR gRNA sequence
tccttttcagagagtgagtg

SEQ ID NO: 258759 - DNA, 20 bp, Artificial
  CRISPR gRNA sequence
ccttttcagagagtgagtgc

SEQ ID NO: 258760 - DNA, 20 bp, Artificial
  CRISPR gRNA sequence
ttcagagagtgagtgcaggt

SEQ ID NO: 258761 - DNA, 20 bp, Artificial
  CRISPR gRNA sequence
tcagagagtgagtgcaggtt

SEQ ID NO: 258762 - DNA, 20 bp, Artificial
  CRISPR gRNA sequence
attctgcttgctcaccgccc

SEQ ID NO: 258763 - DNA, 20 bp, Artificial
  CRISPR gRNA sequence
ttctgcttgctcaccgccct

SEQ ID NO: 258764 - DNA, 20 bp, Artificial
  CRISPR gRNA sequence
tgtttctattgctaattatt

SEQ ID NO: 258765 - DNA, 20 bp, Artificial
  CRISPR gRNA sequence
tcttcctgatctgcctttgt

SEQ ID NO: 258766 - DNA, 20 bp, Artificial
  CRISPR gRNA sequence
tgcctttgtgagctgattta

SEQ ID NO: 258767 - DNA, 20 bp, Artificial
  CRISPR gRNA sequence
tgtgagctgatttaaagaaa

SEQ ID NO: 258768 - DNA, 20 bp, Artificial
  CRISPR gRNA sequence
agctgatttaaagaaaaaga

SEQ ID NO: 258769 - DNA, 20 bp, Artificial
  CRISPR gRNA sequence
gctgatttaaagaaaaagat

SEQ ID NO: 258770 - DNA, 20 bp, Artificial
  CRISPR gRNA sequence
ttaaagaaaaagatgggaat

SEQ ID NO: 258771 - DNA, 20 bp, Artificial
  CRISPR gRNA sequence
gaaaaagatgggaatgagaa

SEQ ID NO: 258772 - DNA, 20 bp, Artificial
  CRISPR gRNA sequence
aaaaagatgggaatgagaat

SEQ ID NO: 258773 - DNA, 20 bp, Artificial
  CRISPR gRNA sequence
atgagaataggacttctttg

SEQ ID NO: 258774 - DNA, 20 bp, Artificial
  CRISPR gRNA sequence
gagaataggacttctttgtg

SEQ ID NO: 258775 - DNA, 20 bp, Artificial
  CRISPR gRNA sequence
cttctttgtggagacaaaaa

SEQ ID NO: 258776 - DNA, 20 bp, Artificial
  CRISPR gRNA sequence
ttctttgtggagacaaaaaa

SEQ ID NO: 258777 - DNA, 20 bp, Artificial
  CRISPR gRNA sequence
tctttgtggagacaaaaaaa

SEQ ID NO: 258778 - DNA, 20 bp, Artificial
  CRISPR gRNA sequence
tttgtggagacaaaaaaagg

SEQ ID NO: 258779 - DNA, 20 bp, Artificial
  CRISPR gRNA sequence
ggagacaaaaaaagggagtg

SEQ ID NO: 258780 - DNA, 20 bp, Artificial
  CRISPR gRNA sequence
gagacaaaaaaagggagtgt

SEQ ID NO: 258781 - DNA, 20 bp, Artificial
  CRISPR gRNA sequence
acaaaaaaagggagtgtggg

SEQ ID NO: 258782 - DNA, 20 bp, Artificial
  CRISPR gRNA sequence
caaaaaaagggagtgtgggt

SEQ ID NO: 258783 - DNA, 20 bp, Artificial
  CRISPR gRNA sequence
aaaagggagtgtgggtgggc

SEQ ID NO: 258784 - DNA, 20 bp, Artificial
  CRISPR gRNA sequence
aagggagtgtgggtgggctg

SEQ ID NO: 258785 - DNA, 20 bp, Artificial
  CRISPR gRNA sequence
gggagtgtgggtgggctgga

SEQ ID NO: 258786 - DNA, 20 bp, Artificial
  CRISPR gRNA sequence
ggtgggctggagagaaaccc

SEQ ID NO: 258787 - DNA, 20 bp, Artificial
  CRISPR gRNA sequence
ggctggagagaaaccccaga

SEQ ID NO: 258788 - DNA, 20 bp, Artificial
  CRISPR gRNA sequence
agaaaccccagatggctccc

SEQ ID NO: 258789 - DNA, 20 bp, Artificial
  CRISPR gRNA sequence
cccagtttgactccctctcc

SEQ ID NO: 258790 - DNA, 20 bp, Artificial
  CRISPR gRNA sequence
actccctctcccagcacaca

SEQ ID NO: 258791 - DNA, 20 bp, Artificial
  CRISPR gRNA sequence
cctctcccagcacacacagt

SEQ ID NO: 258792 - DNA, 20 bp, Artificial
  CRISPR gRNA sequence
ctctcccagcacacacagtg

SEQ ID NO: 258793 - DNA, 20 bp, Artificial
  CRISPR gRNA sequence
tcccagcacacacagtgagg

SEQ ID NO: 258794 - DNA, 20 bp, Artificial
  CRISPR gRNA sequence
ccagcacacacagtgaggtg

SEQ ID NO: 258795 - DNA, 20 bp, Artificial
  CRISPR gRNA sequence
agcacacacagtgaggtgga

SEQ ID NO: 258796 - DNA, 20 bp, Artificial
  CRISPR gRNA sequence
cacacacagtgaggtggaga

SEQ ID NO: 258797 - DNA, 20 bp, Artificial
  CRISPR gRNA sequence
acacacagtgaggtggagag

SEQ ID NO: 258798 - DNA, 20 bp, Artificial
  CRISPR gRNA sequence
cacacagtgaggtggagaga

SEQ ID NO: 258799 - DNA, 20 bp, Artificial
  CRISPR gRNA sequence
acagtgaggtggagagaggg

SEQ ID NO: 258800 - DNA, 20 bp, Artificial
  CRISPR gRNA sequence
cagtgaggtggagagaggga

SEQ ID NO: 258801 - DNA, 20 bp, Artificial
  CRISPR gRNA sequence
agtgaggtggagagagggaa

SEQ ID NO: 258802 - DNA, 20 bp, Artificial
  CRISPR gRNA sequence
tgaggtggagagagggaagg

SEQ ID NO: 258803 - DNA, 20 bp, Artificial
  CRISPR gRNA sequence
aggtggagagagggaaggga

SEQ ID NO: 258804 - DNA, 20 bp, Artificial
  CRISPR gRNA sequence
gtggagagagggaagggaga

SEQ ID NO: 258805 - DNA, 20 bp, Artificial
  CRISPR gRNA sequence
ggagagagggaagggagaga

SEQ ID NO: 258806 - DNA, 20 bp, Artificial
  CRISPR gRNA sequence
gagagagggaagggagagag

SEQ ID NO: 258807 - DNA, 20 bp, Artificial
  CRISPR gRNA sequence
agagggaagggagagagagg

SEQ ID NO: 258808 - DNA, 20 bp, Artificial
  CRISPR gRNA sequence
gagggaagggagagagagga

SEQ ID NO: 258809 - DNA, 20 bp, Artificial
  CRISPR gRNA sequence
ggaagggagagagaggaagg

SEQ ID NO: 258810 - DNA, 20 bp, Artificial
  CRISPR gRNA sequence
ggagagagaggaaggaagaa

SEQ ID NO: 258811 - DNA, 20 bp, Artificial
  CRISPR gRNA sequence
agaggaaggaagaaaagctg

SEQ ID NO: 258812 - DNA, 20 bp, Artificial
  CRISPR gRNA sequence
ggaagaaaagctgtggcatc

SEQ ID NO: 258813 - DNA, 20 bp, Artificial
  CRISPR gRNA sequence
aagaaaagctgtggcatcta

SEQ ID NO: 258814 - DNA, 20 bp, Artificial
  CRISPR gRNA sequence
aagctgtggcatctagagtc

SEQ ID NO: 258815 - DNA, 20 bp, Artificial
  CRISPR gRNA sequence
ctgtggcatctagagtccag

SEQ ID NO: 258816 - DNA, 20 bp, Artificial
  CRISPR gRNA sequence
tgaatatgtcctgtctaact

SEQ ID NO: 258817 - DNA, 20 bp, Artificial
  CRISPR gRNA sequence
gaatatgtcctgtctaactc

SEQ ID NO: 258818 - DNA, 20 bp, Artificial
  CRISPR gRNA sequence
aatatgtcctgtctaactca

SEQ ID NO: 258819 - DNA, 20 bp, Artificial
  CRISPR gRNA sequence
tcagggtgtgacatgttcct

SEQ ID NO: 258820 - DNA, 20 bp, Artificial
  CRISPR gRNA sequence
acatgttcctaagatgcaca

SEQ ID NO: 258821 - DNA, 20 bp, Artificial
  CRISPR gRNA sequence
catgttcctaagatgcacat

SEQ ID NO: 258822 - DNA, 20 bp, Artificial
  CRISPR gRNA sequence
tgttcctaagatgcacatgg

SEQ ID NO: 258823 - DNA, 20 bp, Artificial
  CRISPR gRNA sequence
ttcctaagatgcacatggga

SEQ ID NO: 258824 - DNA, 20 bp, Artificial
  CRISPR gRNA sequence
ctaagatgcacatgggagag

SEQ ID NO: 258825 - DNA, 20 bp, Artificial
  CRISPR gRNA sequence
gccactcaattcccgtccta

SEQ ID NO: 258826 - DNA, 20 bp, Artificial
  CRISPR gRNA sequence
actcaattcccgtcctacgg

SEQ ID NO: 258827 - DNA, 20 bp, Artificial
  CRISPR gRNA sequence
tacggcagctcatgatctga

SEQ ID NO: 258828 - DNA, 20 bp, Artificial
  CRISPR gRNA sequence
acggcagctcatgatctgat

SEQ ID NO: 258829 - DNA, 20 bp, Artificial
  CRISPR gRNA sequence
cggcagctcatgatctgatg

SEQ ID NO: 258830 - DNA, 20 bp, Artificial
  CRISPR gRNA sequence
cagctcatgatctgatgggg

SEQ ID NO: 258831 - DNA, 20 bp, Artificial
  CRISPR gRNA sequence
tcatgatctgatggggaaga

SEQ ID NO: 258832 - DNA, 20 bp, Artificial
  CRISPR gRNA sequence
atggggaagaaagatataaa

SEQ ID NO: 258833 - DNA, 20 bp, Artificial
  CRISPR gRNA sequence
aatagaccctactttaaaca

SEQ ID NO: 258834 - DNA, 20 bp, Artificial
  CRISPR gRNA sequence
ctactttaaacatagtgaca

SEQ ID NO: 258835 - DNA, 20 bp, Artificial
  CRISPR gRNA sequence
agtgatctgcacaaaacttc

SEQ ID NO: 258836 - DNA, 20 bp, Artificial
  CRISPR gRNA sequence
gtgatctgcacaaaacttcc

SEQ ID NO: 258837 - DNA, 20 bp, Artificial
  CRISPR gRNA sequence
tgatctgcacaaaacttccg

SEQ ID NO: 258838 - DNA, 20 bp, Artificial
  CRISPR gRNA sequence
gatctgcacaaaacttccgg

SEQ ID NO: 258839 - DNA, 20 bp, Artificial
  CRISPR gRNA sequence
cacaaaacttccgggggcaa

SEQ ID NO: 258840 - DNA, 20 bp, Artificial
  CRISPR gRNA sequence
acaaaacttccgggggcaac

SEQ ID NO: 258841 - DNA, 20 bp, Artificial
  CRISPR gRNA sequence
caaaacttccgggggcaaca

SEQ ID NO: 258842 - DNA, 20 bp, Artificial
  CRISPR gRNA sequence
tccgggggcaacagggaaac

SEQ ID NO: 258843 - DNA, 20 bp, Artificial
  CRISPR gRNA sequence
gggcaacagggaaaccagct

SEQ ID NO: 258844 - DNA, 20 bp, Artificial
  CRISPR gRNA sequence
ggcaacagggaaaccagcta

SEQ ID NO: 258845 - DNA, 20 bp, Artificial
  CRISPR gRNA sequence
gggaaaccagctaaggatct

SEQ ID NO: 258846 - DNA, 20 bp, Artificial
  CRISPR gRNA sequence
ggaaaccagctaaggatctc

SEQ ID NO: 258847 - DNA, 20 bp, Artificial
  CRISPR gRNA sequence
aaaccagctaaggatctcag

SEQ ID NO: 258848 - DNA, 20 bp, Artificial
  CRISPR gRNA sequence
ctaaggatctcaggagatga

SEQ ID NO: 258849 - DNA, 20 bp, Artificial
  CRISPR gRNA sequence
caggagatgacggctgacct

SEQ ID NO: 258850 - DNA, 20 bp, Artificial
  CRISPR gRNA sequence
gacggctgacctgagtcctg

SEQ ID NO: 258851 - DNA, 20 bp, Artificial
  CRISPR gRNA sequence
acggctgacctgagtcctga

SEQ ID NO: 258852 - DNA, 20 bp, Artificial
  CRISPR gRNA sequence
ggctgacctgagtcctgaag

SEQ ID NO: 258853 - DNA, 20 bp, Artificial
  CRISPR gRNA sequence
cctgaaggagtatgcataca

SEQ ID NO: 258854 - DNA, 20 bp, Artificial
  CRISPR gRNA sequence
ggatttgaccaacttttact

SEQ ID NO: 258855 - DNA, 20 bp, Artificial
  CRISPR gRNA sequence
gaccaacttttactaagtaa

SEQ ID NO: 258856 - DNA, 20 bp, Artificial
  CRISPR gRNA sequence
aacttttactaagtaaaagt

SEQ ID NO: 258857 - DNA, 20 bp, Artificial
  CRISPR gRNA sequence
ttactaagtaaaagttagcc

SEQ ID NO: 258858 - DNA, 20 bp, Artificial
  CRISPR gRNA sequence
aagtaaaagttagcctggct

SEQ ID NO: 258859 - DNA, 20 bp, Artificial
  CRISPR gRNA sequence
gctaagacgtgtctttgtgt

SEQ ID NO: 258860 - DNA, 20 bp, Artificial
  CRISPR gRNA sequence
ctaagacgtgtctttgtgtt

SEQ ID NO: 258861 - DNA, 20 bp, Artificial
  CRISPR gRNA sequence
taagacgtgtctttgtgttg

SEQ ID NO: 258862 - DNA, 20 bp, Artificial
  CRISPR gRNA sequence
cgtgtctttgtgttggggac

SEQ ID NO: 258863 - DNA, 20 bp, Artificial
  CRISPR gRNA sequence
gtgtctttgtgttggggact

SEQ ID NO: 258864 - DNA, 20 bp, Artificial
  CRISPR gRNA sequence
tgtctttgtgttggggactg

SEQ ID NO: 258865 - DNA, 20 bp, Artificial
  CRISPR gRNA sequence
tttgtgttggggactggggt

SEQ ID NO: 258866 - DNA, 20 bp, Artificial
  CRISPR gRNA sequence
ttgtgttggggactggggtg

SEQ ID NO: 258867 - DNA, 20 bp, Artificial
  CRISPR gRNA sequence
tgttggggactggggtgagg

SEQ ID NO: 258868 - DNA, 20 bp, Artificial
  CRISPR gRNA sequence
gttggggactggggtgaggt

SEQ ID NO: 258869 - DNA, 20 bp, Artificial
  CRISPR gRNA sequence
tggggactggggtgaggtgg

SEQ ID NO: 258870 - DNA, 20 bp, Artificial
  CRISPR gRNA sequence
gggactggggtgaggtggga

SEQ ID NO: 258871 - DNA, 20 bp, Artificial
  CRISPR gRNA sequence
gaggtgggagagtgtgtgtt

SEQ ID NO: 258872 - DNA, 20 bp, Artificial
  CRISPR gRNA sequence
aggtgggagagtgtgtgttt

SEQ ID NO: 258873 - DNA, 20 bp, Artificial
  CRISPR gRNA sequence
gggagagtgtgtgtttgggc

SEQ ID NO: 258874 - DNA, 20 bp, Artificial
  CRISPR gRNA sequence
ggagagtgtgtgtttgggct

SEQ ID NO: 258875 - DNA, 20 bp, Artificial
  CRISPR gRNA sequence
gagagtgtgtgtttgggctg

SEQ ID NO: 258876 - DNA, 20 bp, Artificial
  CRISPR gRNA sequence
gtgtgtgtttgggctggggt

SEQ ID NO: 258877 - DNA, 20 bp, Artificial
  CRISPR gRNA sequence
gtgtttgggctggggtgagt

SEQ ID NO: 258878 - DNA, 20 bp, Artificial
  CRISPR gRNA sequence
tgtttgggctggggtgagtt

SEQ ID NO: 258879 - DNA, 20 bp, Artificial
  CRISPR gRNA sequence
gtttgggctggggtgagtta

SEQ ID NO: 258880 - DNA, 20 bp, Artificial
  CRISPR gRNA sequence
tttgggctggggtgagttag

SEQ ID NO: 258881 - DNA, 20 bp, Artificial
  CRISPR gRNA sequence
tggggtgagttaggggactg

SEQ ID NO: 258882 - DNA, 20 bp, Artificial
  CRISPR gRNA sequence
ggggtgagttaggggactgt

SEQ ID NO: 258883 - DNA, 20 bp, Artificial
  CRISPR gRNA sequence
gggtgagttaggggactgtg

SEQ ID NO: 258884 - DNA, 20 bp, Artificial
  CRISPR gRNA sequence
gtgagttaggggactgtggg

SEQ ID NO: 258885 - DNA, 20 bp, Artificial
  CRISPR gRNA sequence
tgagttaggggactgtgggg

SEQ ID NO: 258886 - DNA, 20 bp, Artificial
  CRISPR gRNA sequence
taggggactgtggggaggat

SEQ ID NO: 258887 - DNA, 20 bp, Artificial
  CRISPR gRNA sequence
actgtggggaggataagaca

SEQ ID NO: 258888 - DNA, 20 bp, Artificial
  CRISPR gRNA sequence
tgtggggaggataagacaaa

SEQ ID NO: 258889 - DNA, 20 bp, Artificial
  CRISPR gRNA sequence
tggggaggataagacaaaga

SEQ ID NO: 258890 - DNA, 20 bp, Artificial
  CRISPR gRNA sequence
ggataagacaaagagagaaa

SEQ ID NO: 258891 - DNA, 20 bp, Artificial
  CRISPR gRNA sequence
ataagacaaagagagaaaaa

SEQ ID NO: 258892 - DNA, 20 bp, Artificial
  CRISPR gRNA sequence
agacaaagagagaaaaagag

SEQ ID NO: 258893 - DNA, 20 bp, Artificial
  CRISPR gRNA sequence
aagagagaaaaagagtagtc

SEQ ID NO: 258894 - DNA, 20 bp, Artificial
  CRISPR gRNA sequence
agagagaaaaagagtagtct

SEQ ID NO: 258895 - DNA, 20 bp, Artificial
  CRISPR gRNA sequence
agaaaaagagtagtctgggc

SEQ ID NO: 258896 - DNA, 20 bp, Artificial
  CRISPR gRNA sequence
gaaaaagagtagtctgggca

SEQ ID NO: 258897 - DNA, 20 bp, Artificial
  CRISPR gRNA sequence
aaaaagagtagtctgggcaa

SEQ ID NO: 258898 - DNA, 20 bp, Artificial
  CRISPR gRNA sequence
aaagagtagtctgggcaagg

SEQ ID NO: 258899 - DNA, 20 bp, Artificial
  CRISPR gRNA sequence
gtagtctgggcaagggagat

SEQ ID NO: 258900 - DNA, 20 bp, Artificial
  CRISPR gRNA sequence
tagtctgggcaagggagatg

SEQ ID NO: 258901 - DNA, 20 bp, Artificial
  CRISPR gRNA sequence
gtctgggcaagggagatgag

SEQ ID NO: 258902 - DNA, 20 bp, Artificial
  CRISPR gRNA sequence
tctgggcaagggagatgagg

SEQ ID NO: 258903 - DNA, 20 bp, Artificial
  CRISPR gRNA sequence
ctgggcaagggagatgagga

SEQ ID NO: 258904 - DNA, 20 bp, Artificial
  CRISPR gRNA sequence
gcaagggagatgaggagggt

SEQ ID NO: 258905 - DNA, 20 bp, Artificial
  CRISPR gRNA sequence
aagggagatgaggagggtaa

SEQ ID NO: 258906 - DNA, 20 bp, Artificial
  CRISPR gRNA sequence
agatgaggagggtaagagtg

SEQ ID NO: 258907 - DNA, 20 bp, Artificial
  CRISPR gRNA sequence
gggtaagagtgtggccgact

SEQ ID NO: 258908 - DNA, 20 bp, Artificial
  CRISPR gRNA sequence
ggtaagagtgtggccgactt

SEQ ID NO: 258909 - DNA, 20 bp, Artificial
  CRISPR gRNA sequence
gtaagagtgtggccgacttg

SEQ ID NO: 258910 - DNA, 20 bp, Artificial
  CRISPR gRNA sequence
gtggccgacttggggaatta

SEQ ID NO: 258911 - DNA, 20 bp, Artificial
  CRISPR gRNA sequence
tacagctaccttctttttgc

SEQ ID NO: 258912 - DNA, 20 bp, Artificial
  CRISPR gRNA sequence
acagctaccttctttttgct

SEQ ID NO: 258913 - DNA, 20 bp, Artificial
  CRISPR gRNA sequence
ccttctttttgctgggccat

SEQ ID NO: 258914 - DNA, 20 bp, Artificial
  CRISPR gRNA sequence
tgctgggccatgagttacaa

SEQ ID NO: 258915 - DNA, 20 bp, Artificial
  CRISPR gRNA sequence
ggccatgagttacaaaagac

SEQ ID NO: 258916 - DNA, 20 bp, Artificial
  CRISPR gRNA sequence
gttacaaaagacaagattgt

SEQ ID NO: 258917 - DNA, 20 bp, Artificial
  CRISPR gRNA sequence
tacaaaagacaagattgtca

SEQ ID NO: 258918 - DNA, 20 bp, Artificial
  CRISPR gRNA sequence
aaagacaagattgtcagagc

SEQ ID NO: 258919 - DNA, 20 bp, Artificial
  CRISPR gRNA sequence
caagattgtcagagcaagca

SEQ ID NO: 258920 - DNA, 20 bp, Artificial
  CRISPR gRNA sequence
gcaagcatagttcactccat

SEQ ID NO: 258921 - DNA, 20 bp, Artificial
  CRISPR gRNA sequence
aagcatagttcactccatta

SEQ ID NO: 258922 - DNA, 20 bp, Artificial
  CRISPR gRNA sequence
gcatagttcactccattaga

SEQ ID NO: 258923 - DNA, 20 bp, Artificial
  CRISPR gRNA sequence
gttcactccattagagagct

SEQ ID NO: 258924 - DNA, 20 bp, Artificial
  CRISPR gRNA sequence
ttcactccattagagagctt

SEQ ID NO: 258925 - DNA, 20 bp, Artificial
  CRISPR gRNA sequence
agagcttgggctctcttctg

SEQ ID NO: 258926 - DNA, 20 bp, Artificial
  CRISPR gRNA sequence
gagcttgggctctcttctga

SEQ ID NO: 258927 - DNA, 20 bp, Artificial
  CRISPR gRNA sequence
gctctcttctgaaggtgatg

SEQ ID NO: 258928 - DNA, 20 bp, Artificial
  CRISPR gRNA sequence
aaggtgatgaagatctactg

SEQ ID NO: 258929 - DNA, 20 bp, Artificial
  CRISPR gRNA sequence
aggtgatgaagatctactga

SEQ ID NO: 258930 - DNA, 20 bp, Artificial
  CRISPR gRNA sequence
atctactgaaggcttttatg

SEQ ID NO: 258931 - DNA, 20 bp, Artificial
  CRISPR gRNA sequence
ctgaaggcttttatgcagaa

SEQ ID NO: 258932 - DNA, 20 bp, Artificial
  CRISPR gRNA sequence
cttttatgcagaaaagtgct

SEQ ID NO: 258933 - DNA, 20 bp, Artificial
  CRISPR gRNA sequence
gaaaagtgctaagattttgc

SEQ ID NO: 258934 - DNA, 20 bp, Artificial
  CRISPR gRNA sequence
gtgctaagattttgctggaa

SEQ ID NO: 258935 - DNA, 20 bp, Artificial
  CRISPR gRNA sequence
gctaagattttgctggaaaa

SEQ ID NO: 258936 - DNA, 20 bp, Artificial
  CRISPR gRNA sequence
gaaaactatttgttttcgat

SEQ ID NO: 258937 - DNA, 20 bp, Artificial
  CRISPR gRNA sequence
aaaactatttgttttcgata

SEQ ID NO: 258938 - DNA, 20 bp, Artificial
  CRISPR gRNA sequence
tgttttcgataaggccattt

SEQ ID NO: 258939 - DNA, 20 bp, Artificial
  CRISPR gRNA sequence
gttttcgataaggccatttg

SEQ ID NO: 258940 - DNA, 20 bp, Artificial
  CRISPR gRNA sequence
cgataaggccatttgaggaa

SEQ ID NO: 258941 - DNA, 20 bp, Artificial
  CRISPR gRNA sequence
ctccctcttctttgtcaaca

SEQ ID NO: 258942 - DNA, 20 bp, Artificial
  CRISPR gRNA sequence
aacatagatcatttttaaat

SEQ ID NO: 258943 - DNA, 20 bp, Artificial
  CRISPR gRNA sequence
tagatcatttttaaattagc

SEQ ID NO: 258944 - DNA, 20 bp, Artificial
  CRISPR gRNA sequence
aattagctggctctcaaaca

SEQ ID NO: 258945 - DNA, 20 bp, Artificial
  CRISPR gRNA sequence
gcttactatgtgttaacatg

SEQ ID NO: 258946 - DNA, 20 bp, Artificial
  CRISPR gRNA sequence
atgtgttaacatgtagctaa

SEQ ID NO: 258947 - DNA, 20 bp, Artificial
  CRISPR gRNA sequence
acatgtagctaacagcctcc

SEQ ID NO: 258948 - DNA, 20 bp, Artificial
  CRISPR gRNA sequence
tagctaacagcctcctagtt

SEQ ID NO: 258949 - DNA, 20 bp, Artificial
  CRISPR gRNA sequence
gctaacagcctcctagttta

SEQ ID NO: 258950 - DNA, 20 bp, Artificial
  CRISPR gRNA sequence
agcctcctagtttagagttc

SEQ ID NO: 258951 - DNA, 20 bp, Artificial
  CRISPR gRNA sequence
cctagtttagagttcaagct

SEQ ID NO: 258952 - DNA, 20 bp, Artificial
  CRISPR gRNA sequence
ttagagttcaagctgagttc

SEQ ID NO: 258953 - DNA, 20 bp, Artificial
  CRISPR gRNA sequence
tagagttcaagctgagttca

SEQ ID NO: 258954 - DNA, 20 bp, Artificial
  CRISPR gRNA sequence
gttcaagctgagttcaaggt

SEQ ID NO: 258955 - DNA, 20 bp, Artificial
  CRISPR gRNA sequence
tctcaatatttatatcctca

SEQ ID NO: 258956 - DNA, 20 bp, Artificial
  CRISPR gRNA sequence
atttatatcctcatagcatt

SEQ ID NO: 258957 - DNA, 20 bp, Artificial
  CRISPR gRNA sequence
catagcatttggtcccacct

SEQ ID NO: 258958 - DNA, 20 bp, Artificial
  CRISPR gRNA sequence
cttggttcatgtcaataatt

SEQ ID NO: 258959 - DNA, 20 bp, Artificial
  CRISPR gRNA sequence
tggttcatgtcaataattca

SEQ ID NO: 258960 - DNA, 20 bp, Artificial
  CRISPR gRNA sequence
ttcatgtcaataattcagag

SEQ ID NO: 258961 - DNA, 20 bp, Artificial
  CRISPR gRNA sequence
ataattcagagaagcctaaa

SEQ ID NO: 258962 - DNA, 20 bp, Artificial
  CRISPR gRNA sequence
taattcagagaagcctaaat

SEQ ID NO: 258963 - DNA, 20 bp, Artificial
  CRISPR gRNA sequence
ctaaataggaaactatctca

SEQ ID NO: 258964 - DNA, 20 bp, Artificial
  CRISPR gRNA sequence
taaataggaaactatctcac

SEQ ID NO: 258965 - DNA, 20 bp, Artificial
  CRISPR gRNA sequence
aaaatctctatatgctttgc

SEQ ID NO: 258966 - DNA, 20 bp, Artificial
  CRISPR gRNA sequence
tctctatatgctttgcaaga

SEQ ID NO: 258967 - DNA, 20 bp, Artificial
  CRISPR gRNA sequence
tgctttgcaagacagtaaat

SEQ ID NO: 258968 - DNA, 20 bp, Artificial
  CRISPR gRNA sequence
ctttgcaagacagtaaatga

SEQ ID NO: 258969 - DNA, 20 bp, Artificial
  CRISPR gRNA sequence
aaatgagagaaatttacttt

SEQ ID NO: 258970 - DNA, 20 bp, Artificial
  CRISPR gRNA sequence
gagaaatttacttttggtgc

SEQ ID NO: 258971 - DNA, 20 bp, Artificial
  CRISPR gRNA sequence
tttacttttggtgctagaaa

SEQ ID NO: 258972 - DNA, 20 bp, Artificial
  CRISPR gRNA sequence
tggtgctagaaaaagataac

SEQ ID NO: 258973 - DNA, 20 bp, Artificial
  CRISPR gRNA sequence
aaaagataaccagtgactct

SEQ ID NO: 258974 - DNA, 20 bp, Artificial
  CRISPR gRNA sequence
tgtgtgatcattgtgacttt

SEQ ID NO: 258975 - DNA, 20 bp, Artificial
  CRISPR gRNA sequence
tctcttattttcttttaaaa

SEQ ID NO: 258976 - DNA, 20 bp, Artificial
  CRISPR gRNA sequence
ctcttattttcttttaaaat

SEQ ID NO: 258977 - DNA, 20 bp, Artificial
  CRISPR gRNA sequence
tcttattttcttttaaaatg

SEQ ID NO: 258978 - DNA, 20 bp, Artificial
  CRISPR gRNA sequence
tgcacaccccttgctctatg

SEQ ID NO: 258979 - DNA, 20 bp, Artificial
  CRISPR gRNA sequence
tgctctatgaagtaaaaaca

SEQ ID NO: 258980 - DNA, 20 bp, Artificial
  CRISPR gRNA sequence
ctctatgaagtaaaaacatg

SEQ ID NO: 258981 - DNA, 20 bp, Artificial
  CRISPR gRNA sequence
gtaaaaacatggagaaatca

SEQ ID NO: 258982 - DNA, 20 bp, Artificial
  CRISPR gRNA sequence
aaaacatggagaaatcaaag

SEQ ID NO: 258983 - DNA, 20 bp, Artificial
  CRISPR gRNA sequence
aaatcaaagtagctgataat

SEQ ID NO: 258984 - DNA, 20 bp, Artificial
  CRISPR gRNA sequence
gtagctgataatcagaatat

SEQ ID NO: 258985 - DNA, 20 bp, Artificial
  CRISPR gRNA sequence
tcagaatatcagatgacatt

SEQ ID NO: 258986 - DNA, 20 bp, Artificial
  CRISPR gRNA sequence
ttggctttgatatgtatttt

SEQ ID NO: 258987 - DNA, 20 bp, Artificial
  CRISPR gRNA sequence
gatatgtattttcggtctct

SEQ ID NO: 258988 - DNA, 20 bp, Artificial
  CRISPR gRNA sequence
tctgagtttctgaaaatcca

SEQ ID NO: 258989 - DNA, 20 bp, Artificial
  CRISPR gRNA sequence
cacagtacttcaaataatgt

SEQ ID NO: 258990 - DNA, 20 bp, Artificial
  CRISPR gRNA sequence
acagtacttcaaataatgta

SEQ ID NO: 258991 - DNA, 20 bp, Artificial
  CRISPR gRNA sequence
taaggacatattacaaatgt

SEQ ID NO: 258992 - DNA, 20 bp, Artificial
  CRISPR gRNA sequence
aaggacatattacaaatgta

SEQ ID NO: 258993 - DNA, 20 bp, Artificial
  CRISPR gRNA sequence
tacaaatgtaaggacatatc

SEQ ID NO: 258994 - DNA, 20 bp, Artificial
  CRISPR gRNA sequence
tgtaaggacatatctagact

SEQ ID NO: 258995 - DNA, 20 bp, Artificial
  CRISPR gRNA sequence
aaggacatatctagactcag

SEQ ID NO: 258996 - DNA, 20 bp, Artificial
  CRISPR gRNA sequence
tcagaagaaacccaaatatg

SEQ ID NO: 258997 - DNA, 20 bp, Artificial
  CRISPR gRNA sequence
tttgatttctttttgctttc

SEQ ID NO: 258998 - DNA, 20 bp, Artificial
  CRISPR gRNA sequence
ttttgctttccagttcatgc

SEQ ID NO: 258999 - DNA, 20 bp, Artificial
  CRISPR gRNA sequence
tttgctttccagttcatgct

SEQ ID NO: 259000 - DNA, 20 bp, Artificial
  CRISPR gRNA sequence
tgctttccagttcatgctag

SEQ ID NO: 259001 - DNA, 20 bp, Artificial
  CRISPR gRNA sequence
tttccagttcatgctaggag

SEQ ID NO: 259002 - DNA, 20 bp, Artificial
  CRISPR gRNA sequence
ccagttcatgctaggagtgg

SEQ ID NO: 259003 - DNA, 20 bp, Artificial
  CRISPR gRNA sequence
cagttcatgctaggagtgga

SEQ ID NO: 259004 - DNA, 20 bp, Artificial
  CRISPR gRNA sequence
ggagtggaaggcattcttct

SEQ ID NO: 259005 - DNA, 20 bp, Artificial
  CRISPR gRNA sequence
gagtggaaggcattcttctt

SEQ ID NO: 259006 - DNA, 20 bp, Artificial
  CRISPR gRNA sequence
ggcattcttcttaggctact

SEQ ID NO: 259007 - DNA, 20 bp, Artificial
  CRISPR gRNA sequence
gcattcttcttaggctactt

SEQ ID NO: 259008 - DNA, 20 bp, Artificial
  CRISPR gRNA sequence
ttcttaggctacttgggtat

SEQ ID NO: 259009 - DNA, 20 bp, Artificial
  CRISPR gRNA sequence
tcttaggctacttgggtatc

SEQ ID NO: 259010 - DNA, 20 bp, Artificial
  CRISPR gRNA sequence
ttaggctacttgggtatcag

SEQ ID NO: 259011 - DNA, 20 bp, Artificial
  CRISPR gRNA sequence
tacttgggtatcaggagacc

SEQ ID NO: 259012 - DNA, 20 bp, Artificial
  CRISPR gRNA sequence
tatttgattttacttcttgt

SEQ ID NO: 259013 - DNA, 20 bp, Artificial
  CRISPR gRNA sequence
ttttacttcttgtgagtgtt

SEQ ID NO: 259014 - DNA, 20 bp, Artificial
  CRISPR gRNA sequence
tttacttcttgtgagtgttc

SEQ ID NO: 259015 - DNA, 20 bp, Artificial
  CRISPR gRNA sequence
cttcttgtgagtgttcaggt

SEQ ID NO: 259016 - DNA, 20 bp, Artificial
  CRISPR gRNA sequence
ttcttgtgagtgttcaggta

SEQ ID NO: 259017 - DNA, 20 bp, Artificial
  CRISPR gRNA sequence
gtgttcaggtaaggtctacc

SEQ ID NO: 259018 - DNA, 20 bp, Artificial
  CRISPR gRNA sequence
tgttcaggtaaggtctacct

SEQ ID NO: 259019 - DNA, 20 bp, Artificial
  CRISPR gRNA sequence
tctacctaggtcaaacctac

SEQ ID NO: 259020 - DNA, 20 bp, Artificial
  CRISPR gRNA sequence
ctacctaggtcaaacctact

SEQ ID NO: 259021 - DNA, 20 bp, Artificial
  CRISPR gRNA sequence
ggtcaaacctactaggttaa

SEQ ID NO: 259022 - DNA, 20 bp, Artificial
  CRISPR gRNA sequence
ttctttgcttacgttatcaa

SEQ ID NO: 259023 - DNA, 20 bp, Artificial
  CRISPR gRNA sequence
tgcttacgttatcaaaagat

SEQ ID NO: 259024 - DNA, 20 bp, Artificial
  CRISPR gRNA sequence
atttctctaactgaattgac

SEQ ID NO: 259025 - DNA, 20 bp, Artificial
  CRISPR gRNA sequence
tgaattgacaagttgttttg

SEQ ID NO: 259026 - DNA, 20 bp, Artificial
  CRISPR gRNA sequence
gaattgacaagttgttttga

SEQ ID NO: 259027 - DNA, 20 bp, Artificial
  CRISPR gRNA sequence
agttgttttgaaggtgaatt

SEQ ID NO: 259028 - DNA, 20 bp, Artificial
  CRISPR gRNA sequence
atttagtgctttgcttttca

SEQ ID NO: 259029 - DNA, 20 bp, Artificial
  CRISPR gRNA sequence
ttgcttttcaaagcctttcc

SEQ ID NO: 259030 - DNA, 20 bp, Artificial
  CRISPR gRNA sequence
cttttcaaagcctttcctag

SEQ ID NO: 259031 - DNA, 20 bp, Artificial
  CRISPR gRNA sequence
gcctttcctagcagctaaac

SEQ ID NO: 259032 - DNA, 20 bp, Artificial
  CRISPR gRNA sequence
cctagcagctaaaccagcta

SEQ ID NO: 259033 - DNA, 20 bp, Artificial
  CRISPR gRNA sequence
ctagcagctaaaccagctaa

SEQ ID NO: 259034 - DNA, 20 bp, Artificial
  CRISPR gRNA sequence
agctaaaccagctaaaggtg

SEQ ID NO: 259035 - DNA, 20 bp, Artificial
  CRISPR gRNA sequence
ctaaaccagctaaaggtgtg

SEQ ID NO: 259036 - DNA, 20 bp, Artificial
  CRISPR gRNA sequence
accagctaaaggtgtggaga

SEQ ID NO: 259037 - DNA, 20 bp, Artificial
  CRISPR gRNA sequence
ccagctaaaggtgtggagac

SEQ ID NO: 259038 - DNA, 20 bp, Artificial
  CRISPR gRNA sequence
gctaaaggtgtggagacagg

SEQ ID NO: 259039 - DNA, 20 bp, Artificial
  CRISPR gRNA sequence
cctcaaacctctttccctca

SEQ ID NO: 259040 - DNA, 20 bp, Artificial
  CRISPR gRNA sequence
tcacagctcctgcttaacaa

SEQ ID NO: 259041 - DNA, 20 bp, Artificial
  CRISPR gRNA sequence
cacagctcctgcttaacaac

SEQ ID NO: 259042 - DNA, 20 bp, Artificial
  CRISPR gRNA sequence
gcttaacaacaggcaacatg

SEQ ID NO: 259043 - DNA, 20 bp, Artificial
  CRISPR gRNA sequence
ttaacaacaggcaacatgaa

SEQ ID NO: 259044 - DNA, 20 bp, Artificial
  CRISPR gRNA sequence
caacaggcaacatgaagagt

SEQ ID NO: 259045 - DNA, 20 bp, Artificial
  CRISPR gRNA sequence
ggcaacatgaagagtgagat

SEQ ID NO: 259046 - DNA, 20 bp, Artificial
  CRISPR gRNA sequence
caacatgaagagtgagattg

SEQ ID NO: 259047 - DNA, 20 bp, Artificial
  CRISPR gRNA sequence
aacatgaagagtgagattgg

SEQ ID NO: 259048 - DNA, 20 bp, Artificial
  CRISPR gRNA sequence
tgaagagtgagattggaggt

SEQ ID NO: 259049 - DNA, 20 bp, Artificial
  CRISPR gRNA sequence
agagtgagattggaggtgag

SEQ ID NO: 259050 - DNA, 20 bp, Artificial
  CRISPR gRNA sequence
gagtgagattggaggtgaga

SEQ ID NO: 259051 - DNA, 20 bp, Artificial
  CRISPR gRNA sequence
ggtacttatctgctgcttgt

SEQ ID NO: 259052 - DNA, 20 bp, Artificial
  CRISPR gRNA sequence
cttatctgctgcttgtgagc

SEQ ID NO: 259053 - DNA, 20 bp, Artificial
  CRISPR gRNA sequence
ttatctgctgcttgtgagca

SEQ ID NO: 259054 - DNA, 20 bp, Artificial
  CRISPR gRNA sequence
ctgcttgtgagcaaggtact

SEQ ID NO: 259055 - DNA, 20 bp, Artificial
  CRISPR gRNA sequence
gcttgtgagcaaggtactga

SEQ ID NO: 259056 - DNA, 20 bp, Artificial
  CRISPR gRNA sequence
agcaaggtactgagagctaa

SEQ ID NO: 259057 - DNA, 20 bp, Artificial
  CRISPR gRNA sequence
gagagctaaaagatttccca

SEQ ID NO: 259058 - DNA, 20 bp, Artificial
  CRISPR gRNA sequence
aatctgtgaatcttgtgaaa

SEQ ID NO: 259059 - DNA, 20 bp, Artificial
  CRISPR gRNA sequence
tcttgtgaaacagccgactt

SEQ ID NO: 259060 - DNA, 20 bp, Artificial
  CRISPR gRNA sequence
cttgtgaaacagccgacttc

SEQ ID NO: 259061 - DNA, 20 bp, Artificial
  CRISPR gRNA sequence
gccgacttcaggaaaattga

SEQ ID NO: 259062 - DNA, 20 bp, Artificial
  CRISPR gRNA sequence
aaagttgcttgaacttccat

SEQ ID NO: 259063 - DNA, 20 bp, Artificial
  CRISPR gRNA sequence
tgcttgaacttccatgagaa

SEQ ID NO: 259064 - DNA, 20 bp, Artificial
  CRISPR gRNA sequence
ttgaacttccatgagaatgg

SEQ ID NO: 259065 - DNA, 20 bp, Artificial
  CRISPR gRNA sequence
aacttccatgagaatggcag

SEQ ID NO: 259066 - DNA, 20 bp, Artificial
  CRISPR gRNA sequence
acttccatgagaatggcagt

SEQ ID NO: 259067 - DNA, 20 bp, Artificial
  CRISPR gRNA sequence
tccatgagaatggcagtggg

SEQ ID NO: 259068 - DNA, 20 bp, Artificial
  CRISPR gRNA sequence
atgagaatggcagtgggtgg

SEQ ID NO: 259069 - DNA, 20 bp, Artificial
  CRISPR gRNA sequence
tgagaatggcagtgggtggt

SEQ ID NO: 259070 - DNA, 20 bp, Artificial
  CRISPR gRNA sequence
gagaatggcagtgggtggtg

SEQ ID NO: 259071 - DNA, 20 bp, Artificial
  CRISPR gRNA sequence
aatggcagtgggtggtgggg

SEQ ID NO: 259072 - DNA, 20 bp, Artificial
  CRISPR gRNA sequence
cagtgggtggtggggaagct

SEQ ID NO: 259073 - DNA, 20 bp, Artificial
  CRISPR gRNA sequence
ccgtttacacctattataaa

SEQ ID NO: 259074 - DNA, 20 bp, Artificial
  CRISPR gRNA sequence
cgtttacacctattataaac

SEQ ID NO: 259075 - DNA, 20 bp, Artificial
  CRISPR gRNA sequence
aacgggtcaattaccatatt

SEQ ID NO: 259076 - DNA, 20 bp, Artificial
  CRISPR gRNA sequence
caattaccatatttagtaat

SEQ ID NO: 259077 - DNA, 20 bp, Artificial
  CRISPR gRNA sequence
aattaccatatttagtaatg

SEQ ID NO: 259078 - DNA, 20 bp, Artificial
  CRISPR gRNA sequence
aatgaggtcaaccctctgca

SEQ ID NO: 259079 - DNA, 20 bp, Artificial
  CRISPR gRNA sequence
atgaggtcaaccctctgcat

SEQ ID NO: 259080 - DNA, 20 bp, Artificial
  CRISPR gRNA sequence
aggtcaaccctctgcatagg

SEQ ID NO: 259081 - DNA, 20 bp, Artificial
  CRISPR gRNA sequence
ggtcaaccctctgcataggt

SEQ ID NO: 259082 - DNA, 20 bp, Artificial
  CRISPR gRNA sequence
gtcaaccctctgcataggtg

SEQ ID NO: 259083 - DNA, 20 bp, Artificial
  CRISPR gRNA sequence
aaccctctgcataggtgggg

SEQ ID NO: 259084 - DNA, 20 bp, Artificial
  CRISPR gRNA sequence
gtggggtggtaaccacctct

SEQ ID NO: 259085 - DNA, 20 bp, Artificial
  CRISPR gRNA sequence
tggggtggtaaccacctcta

SEQ ID NO: 259086 - DNA, 20 bp, Artificial
  CRISPR gRNA sequence
tggtaaccacctctaaggtg

SEQ ID NO: 259087 - DNA, 20 bp, Artificial
  CRISPR gRNA sequence
cacctctaaggtgtggctcc

SEQ ID NO: 259088 - DNA, 20 bp, Artificial
  CRISPR gRNA sequence
aggtgtggctcccagcatca

SEQ ID NO: 259089 - DNA, 20 bp, Artificial
  CRISPR gRNA sequence
tcaaagaaccctgaccttaa

SEQ ID NO: 259090 - DNA, 20 bp, Artificial
  CRISPR gRNA sequence
caaagaaccctgaccttaaa

SEQ ID NO: 259091 - DNA, 20 bp, Artificial
  CRISPR gRNA sequence
ccttaaaaggaccctcccac

SEQ ID NO: 259092 - DNA, 20 bp, Artificial
  CRISPR gRNA sequence
aaaggaccctcccaccagct

SEQ ID NO: 259093 - DNA, 20 bp, Artificial
  CRISPR gRNA sequence
ccaccagctcagttaatgct

SEQ ID NO: 259094 - DNA, 20 bp, Artificial
  CRISPR gRNA sequence
agttaatgcttagatttcca

SEQ ID NO: 259095 - DNA, 20 bp, Artificial
  CRISPR gRNA sequence
ttagatttccaaagaaaatg

SEQ ID NO: 259096 - DNA, 20 bp, Artificial
  CRISPR gRNA sequence
atgaagcccaaaatgcaata

SEQ ID NO: 259097 - DNA, 20 bp, Artificial
  CRISPR gRNA sequence
tgaagcccaaaatgcaatat

SEQ ID NO: 259098 - DNA, 20 bp, Artificial
  CRISPR gRNA sequence
atgcaatatgggaaacacat

SEQ ID NO: 259099 - DNA, 20 bp, Artificial
  CRISPR gRNA sequence
ggaaacacattggcttaatt

SEQ ID NO: 259100 - DNA, 20 bp, Artificial
  CRISPR gRNA sequence
ttggcttaatttagtatcta

SEQ ID NO: 259101 - DNA, 20 bp, Artificial
  CRISPR gRNA sequence
gtatctatggcttacattca

SEQ ID NO: 259102 - DNA, 20 bp, Artificial
  CRISPR gRNA sequence
tatctatggcttacattcac

SEQ ID NO: 259103 - DNA, 20 bp, Artificial
  CRISPR gRNA sequence
atctatggcttacattcaca

SEQ ID NO: 259104 - DNA, 20 bp, Artificial
  CRISPR gRNA sequence
gaactctatattcaactgtg

SEQ ID NO: 259105 - DNA, 20 bp, Artificial
  CRISPR gRNA sequence
atattcaactgtgaagtaaa

SEQ ID NO: 259106 - DNA, 20 bp, Artificial
  CRISPR gRNA sequence
tattcaactgtgaagtaaat

SEQ ID NO: 259107 - DNA, 20 bp, Artificial
  CRISPR gRNA sequence
tcaactgtgaagtaaatagg

SEQ ID NO: 259108 - DNA, 20 bp, Artificial
  CRISPR gRNA sequence
caactgtgaagtaaataggc

SEQ ID NO: 259109 - DNA, 20 bp, Artificial
  CRISPR gRNA sequence
tgtgaagtaaataggcagga

SEQ ID NO: 259110 - DNA, 20 bp, Artificial
  CRISPR gRNA sequence
ctttatgcccatcttacaca

SEQ ID NO: 259111 - DNA, 20 bp, Artificial
  CRISPR gRNA sequence
tttatgcccatcttacacat

SEQ ID NO: 259112 - DNA, 20 bp, Artificial
  CRISPR gRNA sequence
ttatgcccatcttacacatg

SEQ ID NO: 259113 - DNA, 20 bp, Artificial
  CRISPR gRNA sequence
atcttacacatggggaaact

SEQ ID NO: 259114 - DNA, 20 bp, Artificial
  CRISPR gRNA sequence
tcttacacatggggaaactg

SEQ ID NO: 259115 - DNA, 20 bp, Artificial
  CRISPR gRNA sequence
acatggggaaactgaggtca

SEQ ID NO: 259116 - DNA, 20 bp, Artificial
  CRISPR gRNA sequence
atggggaaactgaggtcaaa

SEQ ID NO: 259117 - DNA, 20 bp, Artificial
  CRISPR gRNA sequence
tggggaaactgaggtcaaag

SEQ ID NO: 259118 - DNA, 20 bp, Artificial
  CRISPR gRNA sequence
ggaaactgaggtcaaagagg

SEQ ID NO: 259119 - DNA, 20 bp, Artificial
  CRISPR gRNA sequence
ctgaggtcaaagaggtagat

SEQ ID NO: 259120 - DNA, 20 bp, Artificial
  CRISPR gRNA sequence
aagaggtagatgagttgtcc

SEQ ID NO: 259121 - DNA, 20 bp, Artificial
  CRISPR gRNA sequence
agaggtagatgagttgtcca

SEQ ID NO: 259122 - DNA, 20 bp, Artificial
  CRISPR gRNA sequence
agatgagttgtccaaggtta

SEQ ID NO: 259123 - DNA, 20 bp, Artificial
  CRISPR gRNA sequence
gatgagttgtccaaggttac

SEQ ID NO: 259124 - DNA, 20 bp, Artificial
  CRISPR gRNA sequence
tccaaggttacaggaaacat

SEQ ID NO: 259125 - DNA, 20 bp, Artificial
  CRISPR gRNA sequence
ataagtgatccttgaaattt

SEQ ID NO: 259126 - DNA, 20 bp, Artificial
  CRISPR gRNA sequence
tcaaaatttcaacacaattg

SEQ ID NO: 259127 - DNA, 20 bp, Artificial
  CRISPR gRNA sequence
ttcaacacaattgcagtgat

SEQ ID NO: 259128 - DNA, 20 bp, Artificial
  CRISPR gRNA sequence
acaattgcagtgattggttc

SEQ ID NO: 259129 - DNA, 20 bp, Artificial
  CRISPR gRNA sequence
attggttctagatcctctca

SEQ ID NO: 259130 - DNA, 20 bp, Artificial
  CRISPR gRNA sequence
gttctagatcctctcaaagt

SEQ ID NO: 259131 - DNA, 20 bp, Artificial
  CRISPR gRNA sequence
cctctcaaagttggacttga

SEQ ID NO: 259132 - DNA, 20 bp, Artificial
  CRISPR gRNA sequence
ctctcaaagttggacttgat

SEQ ID NO: 259133 - DNA, 20 bp, Artificial
  CRISPR gRNA sequence
tctcaaagttggacttgata

SEQ ID NO: 259134 - DNA, 20 bp, Artificial
  CRISPR gRNA sequence
tcaaagttggacttgatagg

SEQ ID NO: 259135 - DNA, 20 bp, Artificial
  CRISPR gRNA sequence
caaagttggacttgataggg

SEQ ID NO: 259136 - DNA, 20 bp, Artificial
  CRISPR gRNA sequence
gttggacttgatagggagga

SEQ ID NO: 259137 - DNA, 20 bp, Artificial
  CRISPR gRNA sequence
cttgatagggaggatggtac

SEQ ID NO: 259138 - DNA, 20 bp, Artificial
  CRISPR gRNA sequence
ggaggatggtaccagatgtc

SEQ ID NO: 259139 - DNA, 20 bp, Artificial
  CRISPR gRNA sequence
aggatggtaccagatgtctg

SEQ ID NO: 259140 - DNA, 20 bp, Artificial
  CRISPR gRNA sequence
tggtaccagatgtctggagt

SEQ ID NO: 259141 - DNA, 20 bp, Artificial
  CRISPR gRNA sequence
ggtaccagatgtctggagtg

SEQ ID NO: 259142 - DNA, 20 bp, Artificial
  CRISPR gRNA sequence
gtaccagatgtctggagtga

SEQ ID NO: 259143 - DNA, 20 bp, Artificial
  CRISPR gRNA sequence
cagatgtctggagtgagggt

SEQ ID NO: 259144 - DNA, 20 bp, Artificial
  CRISPR gRNA sequence
agatgtctggagtgagggtt

SEQ ID NO: 259145 - DNA, 20 bp, Artificial
  CRISPR gRNA sequence
gatgtctggagtgagggtta

SEQ ID NO: 259146 - DNA, 20 bp, Artificial
  CRISPR gRNA sequence
tgtctggagtgagggttagg

SEQ ID NO: 259147 - DNA, 20 bp, Artificial
  CRISPR gRNA sequence
gtctggagtgagggttaggg

SEQ ID NO: 259148 - DNA, 20 bp, Artificial
  CRISPR gRNA sequence
ctggagtgagggttagggag

SEQ ID NO: 259149 - DNA, 20 bp, Artificial
  CRISPR gRNA sequence
ttagggaggagattaccatt

SEQ ID NO: 259150 - DNA, 20 bp, Artificial
  CRISPR gRNA sequence
gggaggagattaccattaag

SEQ ID NO: 259151 - DNA, 20 bp, Artificial
  CRISPR gRNA sequence
ggaggagattaccattaagt

SEQ ID NO: 259152 - DNA, 20 bp, Artificial
  CRISPR gRNA sequence
gaggagattaccattaagta

SEQ ID NO: 259153 - DNA, 20 bp, Artificial
  CRISPR gRNA sequence
aggagattaccattaagtag

SEQ ID NO: 259154 - DNA, 20 bp, Artificial
  CRISPR gRNA sequence
gagattaccattaagtaggg

SEQ ID NO: 259155 - DNA, 20 bp, Artificial
  CRISPR gRNA sequence
ccattaagtaggggagtgaa

SEQ ID NO: 259156 - DNA, 20 bp, Artificial
  CRISPR gRNA sequence
aagtaggggagtgaatggaa

SEQ ID NO: 259157 - DNA, 20 bp, Artificial
  CRISPR gRNA sequence
agtaggggagtgaatggaat

SEQ ID NO: 259158 - DNA, 20 bp, Artificial
  CRISPR gRNA sequence
aggggagtgaatggaatggg

SEQ ID NO: 259159 - DNA, 20 bp, Artificial
  CRISPR gRNA sequence
gggagtgaatggaatgggaa

SEQ ID NO: 259160 - DNA, 20 bp, Artificial
  CRISPR gRNA sequence
ggagtgaatggaatgggaag

SEQ ID NO: 259161 - DNA, 20 bp, Artificial
  CRISPR gRNA sequence
gaatggaatgggaagaggac

SEQ ID NO: 259162 - DNA, 20 bp, Artificial
  CRISPR gRNA sequence
cattttccccactattttat

SEQ ID NO: 259163 - DNA, 20 bp, Artificial
  CRISPR gRNA sequence
ttttccccactattttatta

SEQ ID NO: 259164 - DNA, 20 bp, Artificial
  CRISPR gRNA sequence
tgcaaaaaaccacactcaac

SEQ ID NO: 259165 - DNA, 20 bp, Artificial
  CRISPR gRNA sequence
aaaaaaccacactcaactgg

SEQ ID NO: 259166 - DNA, 20 bp, Artificial
  CRISPR gRNA sequence
aaaaaccacactcaactgga

SEQ ID NO: 259167 - DNA, 20 bp, Artificial
  CRISPR gRNA sequence
aaaaccacactcaactggaa

SEQ ID NO: 259168 - DNA, 20 bp, Artificial
  CRISPR gRNA sequence
cactcaactggaagggaact

SEQ ID NO: 259169 - DNA, 20 bp, Artificial
  CRISPR gRNA sequence
ctcaactggaagggaacttg

SEQ ID NO: 259170 - DNA, 20 bp, Artificial
  CRISPR gRNA sequence
tatgccaattccttatttta

SEQ ID NO: 259171 - DNA, 20 bp, Artificial
  CRISPR gRNA sequence
gccaattccttattttaaag

SEQ ID NO: 259172 - DNA, 20 bp, Artificial
  CRISPR gRNA sequence
caattccttattttaaagaa

SEQ ID NO: 259173 - DNA, 20 bp, Artificial
  CRISPR gRNA sequence
aattccttattttaaagaag

SEQ ID NO: 259174 - DNA, 20 bp, Artificial
  CRISPR gRNA sequence
tattttaaagaagaggctat

SEQ ID NO: 259175 - DNA, 20 bp, Artificial
  CRISPR gRNA sequence
attttaaagaagaggctatt

SEQ ID NO: 259176 - DNA, 20 bp, Artificial
  CRISPR gRNA sequence
ttttaaagaagaggctattg

SEQ ID NO: 259177 - DNA, 20 bp, Artificial
  CRISPR gRNA sequence
tttaaagaagaggctattgg

SEQ ID NO: 259178 - DNA, 20 bp, Artificial
  CRISPR gRNA sequence
ttaaagaagaggctattggg

SEQ ID NO: 259179 - DNA, 20 bp, Artificial
  CRISPR gRNA sequence
gaggctattggggggaaaaa

SEQ ID NO: 259180 - DNA, 20 bp, Artificial
  CRISPR gRNA sequence
ggctattggggggaaaaaaa

SEQ ID NO: 259181 - DNA, 20 bp, Artificial
  CRISPR gRNA sequence
tattggggggaaaaaaagag

SEQ ID NO: 259182 - DNA, 20 bp, Artificial
  CRISPR gRNA sequence
tggggggaaaaaaagagaag

SEQ ID NO: 259183 - DNA, 20 bp, Artificial
  CRISPR gRNA sequence
aagtaaatgacttttcaaac

SEQ ID NO: 259184 - DNA, 20 bp, Artificial
  CRISPR gRNA sequence
agtaaatgacttttcaaaca

SEQ ID NO: 259185 - DNA, 20 bp, Artificial
  CRISPR gRNA sequence
aaacaaggtcacacaaataa

SEQ ID NO: 259186 - DNA, 20 bp, Artificial
  CRISPR gRNA sequence
caaggtcacacaaataatgg

SEQ ID NO: 259187 - DNA, 20 bp, Artificial
  CRISPR gRNA sequence
aggtcacacaaataatggaa

SEQ ID NO: 259188 - DNA, 20 bp, Artificial
  CRISPR gRNA sequence
acacaaataatggaagagct

SEQ ID NO: 259189 - DNA, 20 bp, Artificial
  CRISPR gRNA sequence
taagatgtaatttatttatt

SEQ ID NO: 259190 - DNA, 20 bp, Artificial
  CRISPR gRNA sequence
aatttatttatttagacatc

SEQ ID NO: 259191 - DNA, 20 bp, Artificial
  CRISPR gRNA sequence
atttatttatttagacatct

SEQ ID NO: 259192 - DNA, 20 bp, Artificial
  CRISPR gRNA sequence
ttatttatttagacatctag

SEQ ID NO: 259193 - DNA, 20 bp, Artificial
  CRISPR gRNA sequence
gtaatgttttaaatcataaa

SEQ ID NO: 259194 - DNA, 20 bp, Artificial
  CRISPR gRNA sequence
tgttttaaatcataaatgga

SEQ ID NO: 259195 - DNA, 20 bp, Artificial
  CRISPR gRNA sequence
gaaaaacaactttgttcatt

SEQ ID NO: 259196 - DNA, 20 bp, Artificial
  CRISPR gRNA sequence
aacaactttgttcattcagc

SEQ ID NO: 259197 - DNA, 20 bp, Artificial
  CRISPR gRNA sequence
atttatttcatgctcatatc

SEQ ID NO: 259198 - DNA, 20 bp, Artificial
  CRISPR gRNA sequence
acattttgcttacaattttg

SEQ ID NO: 259199 - DNA, 20 bp, Artificial
  CRISPR gRNA sequence
acaattttgaagatttcctg

SEQ ID NO: 259200 - DNA, 20 bp, Artificial
  CRISPR gRNA sequence
caattttgaagatttcctga

SEQ ID NO: 259201 - DNA, 20 bp, Artificial
  CRISPR gRNA sequence
tgaagatttcctgaaggtca

SEQ ID NO: 259202 - DNA, 20 bp, Artificial
  CRISPR gRNA sequence
gatttcctgaaggtcataga

SEQ ID NO: 259203 - DNA, 20 bp, Artificial
  CRISPR gRNA sequence
tgaaggtcatagatggatcc

SEQ ID NO: 259204 - DNA, 20 bp, Artificial
  CRISPR gRNA sequence
gtcatagatggatcccagat

SEQ ID NO: 259205 - DNA, 20 bp, Artificial
  CRISPR gRNA sequence
tcatagatggatcccagata

SEQ ID NO: 259206 - DNA, 20 bp, Artificial
  CRISPR gRNA sequence
tggatcccagataaggctta

SEQ ID NO: 259207 - DNA, 20 bp, Artificial
  CRISPR gRNA sequence
tcccagataaggcttacaga

SEQ ID NO: 259208 - DNA, 20 bp, Artificial
  CRISPR gRNA sequence
ataaattatttctgatgcac

SEQ ID NO: 259209 - DNA, 20 bp, Artificial
  CRISPR gRNA sequence
caagtaataattataccatt

SEQ ID NO: 259210 - DNA, 20 bp, Artificial
  CRISPR gRNA sequence
accattgagatcttccattc

SEQ ID NO: 259211 - DNA, 20 bp, Artificial
  CRISPR gRNA sequence
tcttccattctagcttaccc

SEQ ID NO: 259212 - DNA, 20 bp, Artificial
  CRISPR gRNA sequence
tagcttacccaagtatacaa

SEQ ID NO: 259213 - DNA, 20 bp, Artificial
  CRISPR gRNA sequence
agcttacccaagtatacaaa

SEQ ID NO: 259214 - DNA, 20 bp, Artificial
  CRISPR gRNA sequence
gcttacccaagtatacaaaa

SEQ ID NO: 259215 - DNA, 20 bp, Artificial
  CRISPR gRNA sequence
tatacaaaagggattgaaca

SEQ ID NO: 259216 - DNA, 20 bp, Artificial
  CRISPR gRNA sequence
aagggattgaacatagacat

SEQ ID NO: 259217 - DNA, 20 bp, Artificial
  CRISPR gRNA sequence
caacacatgaaatcacattt

SEQ ID NO: 259218 - DNA, 20 bp, Artificial
  CRISPR gRNA sequence
catttcagtctgaacttcac

SEQ ID NO: 259219 - DNA, 20 bp, Artificial
  CRISPR gRNA sequence
atttcagtctgaacttcact

SEQ ID NO: 259220 - DNA, 20 bp, Artificial
  CRISPR gRNA sequence
actaggaaaatccttaactt

SEQ ID NO: 259221 - DNA, 20 bp, Artificial
  CRISPR gRNA sequence
ctaggaaaatccttaacttc

SEQ ID NO: 259222 - DNA, 20 bp, Artificial
  CRISPR gRNA sequence
taggaaaatccttaacttca

SEQ ID NO: 259223 - DNA, 20 bp, Artificial
  CRISPR gRNA sequence
tgaattacatttgtttgtca

SEQ ID NO: 259224 - DNA, 20 bp, Artificial
  CRISPR gRNA sequence
gtttttccttttctttatcg

SEQ ID NO: 259225 - DNA, 20 bp, Artificial
  CRISPR gRNA sequence
ttttctttatcgtagcacca

SEQ ID NO: 259226 - DNA, 20 bp, Artificial
  CRISPR gRNA sequence
ttctttatcgtagcaccata

SEQ ID NO: 259227 - DNA, 20 bp, Artificial
  CRISPR gRNA sequence
catagagaaataaaacgtac

SEQ ID NO: 259228 - DNA, 20 bp, Artificial
  CRISPR gRNA sequence
atagagaaataaaacgtact

SEQ ID NO: 259229 - DNA, 20 bp, Artificial
  CRISPR gRNA sequence
gagaaataaaacgtactggg

SEQ ID NO: 259230 - DNA, 20 bp, Artificial
  CRISPR gRNA sequence
taaaacgtactgggaagcta

SEQ ID NO: 259231 - DNA, 20 bp, Artificial
  CRISPR gRNA sequence
aacgtactgggaagctaaag

SEQ ID NO: 259232 - DNA, 20 bp, Artificial
  CRISPR gRNA sequence
gtactgggaagctaaagaag

SEQ ID NO: 259233 - DNA, 20 bp, Artificial
  CRISPR gRNA sequence
tgggaagctaaagaagcagt

SEQ ID NO: 259234 - DNA, 20 bp, Artificial
  CRISPR gRNA sequence
ggaagctaaagaagcagtta

SEQ ID NO: 259235 - DNA, 20 bp, Artificial
  CRISPR gRNA sequence
aagctaaagaagcagttaga

SEQ ID NO: 259236 - DNA, 20 bp, Artificial
  CRISPR gRNA sequence
taaagaagcagttagagagc

SEQ ID NO: 259237 - DNA, 20 bp, Artificial
  CRISPR gRNA sequence
agctggaatacatgattaat

SEQ ID NO: 259238 - DNA, 20 bp, Artificial
  CRISPR gRNA sequence
agcaaaatgtgattttcctc

SEQ ID NO: 259239 - DNA, 20 bp, Artificial
  CRISPR gRNA sequence
gattttcctccagaatcttt

SEQ ID NO: 259240 - DNA, 20 bp, Artificial
  CRISPR gRNA sequence
agaatctttaagaactttat

SEQ ID NO: 259241 - DNA, 20 bp, Artificial
  CRISPR gRNA sequence
gaatctttaagaactttatc

SEQ ID NO: 259242 - DNA, 20 bp, Artificial
  CRISPR gRNA sequence
ggttccatttatgcacatca

SEQ ID NO: 259243 - DNA, 20 bp, Artificial
  CRISPR gRNA sequence
catagtctgactttcttttg

SEQ ID NO: 259244 - DNA, 20 bp, Artificial
  CRISPR gRNA sequence
ttcttttgcagttgaaaaat

SEQ ID NO: 259245 - DNA, 20 bp, Artificial
  CRISPR gRNA sequence
tcttttgcagttgaaaaatc

SEQ ID NO: 259246 - DNA, 20 bp, Artificial
  CRISPR gRNA sequence
cagttgaaaaatcaggttgt

SEQ ID NO: 259247 - DNA, 20 bp, Artificial
  CRISPR gRNA sequence
cttgtttccttttaaaaatt

SEQ ID NO: 259248 - DNA, 20 bp, Artificial
  CRISPR gRNA sequence
ttttaaaaattcggactgaa

SEQ ID NO: 259249 - DNA, 20 bp, Artificial
  CRISPR gRNA sequence
ctgaacagaatttcacatgt

SEQ ID NO: 259250 - DNA, 20 bp, Artificial
  CRISPR gRNA sequence
tgaacagaatttcacatgtt

SEQ ID NO: 259251 - DNA, 20 bp, Artificial
  CRISPR gRNA sequence
acagaatttcacatgttagg

SEQ ID NO: 259252 - DNA, 20 bp, Artificial
  CRISPR gRNA sequence
cagaatttcacatgttaggt

SEQ ID NO: 259253 - DNA, 20 bp, Artificial
  CRISPR gRNA sequence
gtaggaaccaaaaacaatga

SEQ ID NO: 259254 - DNA, 20 bp, Artificial
  CRISPR gRNA sequence
acaatgaaagcttctacttt

SEQ ID NO: 259255 - DNA, 20 bp, Artificial
  CRISPR gRNA sequence
ttttgccctgtgatatttgt

SEQ ID NO: 259256 - DNA, 20 bp, Artificial
  CRISPR gRNA sequence
atatttgtgagcacactgtg

SEQ ID NO: 259257 - DNA, 20 bp, Artificial
  CRISPR gRNA sequence
tatttgtgagcacactgtga

SEQ ID NO: 259258 - DNA, 20 bp, Artificial
  CRISPR gRNA sequence
gaaggtgatgctgatttccc

SEQ ID NO: 259259 - DNA, 20 bp, Artificial
  CRISPR gRNA sequence
tgatgctgatttccctggca

SEQ ID NO: 259260 - DNA, 20 bp, Artificial
  CRISPR gRNA sequence
tgctgatttccctggcatag

SEQ ID NO: 259261 - DNA, 20 bp, Artificial
  CRISPR gRNA sequence
ctgatttccctggcatagaa

SEQ ID NO: 259262 - DNA, 20 bp, Artificial
  CRISPR gRNA sequence
gagcacctccctcctgacca

SEQ ID NO: 259263 - DNA, 20 bp, Artificial
  CRISPR gRNA sequence
gcacctccctcctgaccaca

SEQ ID NO: 259264 - DNA, 20 bp, Artificial
  CRISPR gRNA sequence
ctccctcctgaccacagagc

SEQ ID NO: 259265 - DNA, 20 bp, Artificial
  CRISPR gRNA sequence
tcctgaccacagagctagtt

SEQ ID NO: 259266 - DNA, 20 bp, Artificial
  CRISPR gRNA sequence
agttactgtaactttcctct

SEQ ID NO: 259267 - DNA, 20 bp, Artificial
  CRISPR gRNA sequence
ctctgagtatatttcctgtt

SEQ ID NO: 259268 - DNA, 20 bp, Artificial
  CRISPR gRNA sequence
tctgagtatatttcctgttc

SEQ ID NO: 259269 - DNA, 20 bp, Artificial
  CRISPR gRNA sequence
gtatatttcctgttcaggcc

SEQ ID NO: 259270 - DNA, 20 bp, Artificial
  CRISPR gRNA sequence
tatatttcctgttcaggccc

SEQ ID NO: 259271 - DNA, 20 bp, Artificial
  CRISPR gRNA sequence
acacgtgaccatctgaccac

SEQ ID NO: 259272 - DNA, 20 bp, Artificial
  CRISPR gRNA sequence
tctgaccactggctcctttt

SEQ ID NO: 259273 - DNA, 20 bp, Artificial
  CRISPR gRNA sequence
ctgaccactggctccttttc

SEQ ID NO: 259274 - DNA, 20 bp, Artificial
  CRISPR gRNA sequence
ggctccttttcaggctctgt

SEQ ID NO: 259275 - DNA, 20 bp, Artificial
  CRISPR gRNA sequence
gctccttttcaggctctgta

SEQ ID NO: 259276 - DNA, 20 bp, Artificial
  CRISPR gRNA sequence
ctccttttcaggctctgtaa

SEQ ID NO: 259277 - DNA, 20 bp, Artificial
  CRISPR gRNA sequence
tccttttcaggctctgtaag

SEQ ID NO: 259278 - DNA, 20 bp, Artificial
  CRISPR gRNA sequence
ttttcaggctctgtaagggg

SEQ ID NO: 259279 - DNA, 20 bp, Artificial
  CRISPR gRNA sequence
tttcaggctctgtaaggggt

SEQ ID NO: 259280 - DNA, 20 bp, Artificial
  CRISPR gRNA sequence
taaggggtaggctcccccac

SEQ ID NO: 259281 - DNA, 20 bp, Artificial
  CRISPR gRNA sequence
ggctcccccacaagacaacc

SEQ ID NO: 259282 - DNA, 20 bp, Artificial
  CRISPR gRNA sequence
tcccccacaagacaacccgg

SEQ ID NO: 259283 - DNA, 20 bp, Artificial
  CRISPR gRNA sequence
aagacaacccggtggttgct

SEQ ID NO: 259284 - DNA, 20 bp, Artificial
  CRISPR gRNA sequence
agacaacccggtggttgctc

SEQ ID NO: 259285 - DNA, 20 bp, Artificial
  CRISPR gRNA sequence
gtggttgctcaggaaactgt

SEQ ID NO: 259286 - DNA, 20 bp, Artificial
  CRISPR gRNA sequence
tgagacaaaccgtgctccct

SEQ ID NO: 259287 - DNA, 20 bp, Artificial
  CRISPR gRNA sequence
gacaaaccgtgctccctgag

SEQ ID NO: 259288 - DNA, 20 bp, Artificial
  CRISPR gRNA sequence
aaccgtgctccctgagaaga

SEQ ID NO: 259289 - DNA, 20 bp, Artificial
  CRISPR gRNA sequence
accgtgctccctgagaagaa

SEQ ID NO: 259290 - DNA, 20 bp, Artificial
  CRISPR gRNA sequence
ccgtgctccctgagaagaaa

SEQ ID NO: 259291 - DNA, 20 bp, Artificial
  CRISPR gRNA sequence
cgtgctccctgagaagaaag

SEQ ID NO: 259292 - DNA, 20 bp, Artificial
  CRISPR gRNA sequence
gtgctccctgagaagaaagg

SEQ ID NO: 259293 - DNA, 20 bp, Artificial
  CRISPR gRNA sequence
gagaagaaagggggactcaa

SEQ ID NO: 259294 - DNA, 20 bp, Artificial
  CRISPR gRNA sequence
aagggggactcaacagtcta

SEQ ID NO: 259295 - DNA, 20 bp, Artificial
  CRISPR gRNA sequence
gtctatggctctgataacct

SEQ ID NO: 259296 - DNA, 20 bp, Artificial
  CRISPR gRNA sequence
atggctctgataaccttagc

SEQ ID NO: 259297 - DNA, 20 bp, Artificial
  CRISPR gRNA sequence
gctctgataaccttagctgg

SEQ ID NO: 259298 - DNA, 20 bp, Artificial
  CRISPR gRNA sequence
gataaccttagctggtggcc

SEQ ID NO: 259299 - DNA, 20 bp, Artificial
  CRISPR gRNA sequence
tggcctggcttccttctgat

SEQ ID NO: 259300 - DNA, 20 bp, Artificial
  CRISPR gRNA sequence
gcctggcttccttctgataa

SEQ ID NO: 259301 - DNA, 20 bp, Artificial
  CRISPR gRNA sequence
ggcttccttctgataagaga

SEQ ID NO: 259302 - DNA, 20 bp, Artificial
  CRISPR gRNA sequence
cttccttctgataagagaaa

SEQ ID NO: 259303 - DNA, 20 bp, Artificial
  CRISPR gRNA sequence
ccttctgataagagaaagag

SEQ ID NO: 259304 - DNA, 20 bp, Artificial
  CRISPR gRNA sequence
gagaagtacaaaacattcac

SEQ ID NO: 259305 - DNA, 20 bp, Artificial
  CRISPR gRNA sequence
acaaaacattcaccagactg

SEQ ID NO: 259306 - DNA, 20 bp, Artificial
  CRISPR gRNA sequence
cacctttcaccatcctctct

SEQ ID NO: 259307 - DNA, 20 bp, Artificial
  CRISPR gRNA sequence
atcctctctgagctgcaatg

SEQ ID NO: 259308 - DNA, 20 bp, Artificial
  CRISPR gRNA sequence
ctgcaatgaagataaaaaca

SEQ ID NO: 259309 - DNA, 20 bp, Artificial
  CRISPR gRNA sequence
atgacctaccatgctttgaa

SEQ ID NO: 259310 - DNA, 20 bp, Artificial
  CRISPR gRNA sequence
taccatgctttgaatggacc

SEQ ID NO: 259311 - DNA, 20 bp, Artificial
  CRISPR gRNA sequence
tggacccagcctctctctcc

SEQ ID NO: 259312 - DNA, 20 bp, Artificial
  CRISPR gRNA sequence
ttcatgttaaaatgaaaaaa

SEQ ID NO: 259313 - DNA, 20 bp, Artificial
  CRISPR gRNA sequence
aataataatgataataatgc

SEQ ID NO: 259314 - DNA, 20 bp, Artificial
  CRISPR gRNA sequence
aatgataataatgcaagtta

SEQ ID NO: 259315 - DNA, 20 bp, Artificial
  CRISPR gRNA sequence
atggtttaaaaataattctg

SEQ ID NO: 259316 - DNA, 20 bp, Artificial
  CRISPR gRNA sequence
aattctgtggtcatttcatc

SEQ ID NO: 259317 - DNA, 20 bp, Artificial
  CRISPR gRNA sequence
tctgttgactgttatcttga

SEQ ID NO: 259318 - DNA, 20 bp, Artificial
  CRISPR gRNA sequence
gaaagtcttcccattttcac

SEQ ID NO: 259319 - DNA, 20 bp, Artificial
  CRISPR gRNA sequence
tcccattttcacaagaaatg

SEQ ID NO: 259320 - DNA, 20 bp, Artificial
  CRISPR gRNA sequence
ttcacaagaaatgaagattt

SEQ ID NO: 259321 - DNA, 20 bp, Artificial
  CRISPR gRNA sequence
tcacaagaaatgaagattta

SEQ ID NO: 259322 - DNA, 20 bp, Artificial
  CRISPR gRNA sequence
ttaaggaaaatctcttcaca

SEQ ID NO: 259323 - DNA, 20 bp, Artificial
  CRISPR gRNA sequence
aaaatctcttcacacagaaa

SEQ ID NO: 259324 - DNA, 20 bp, Artificial
  CRISPR gRNA sequence
aaatctcttcacacagaaaa

SEQ ID NO: 259325 - DNA, 20 bp, Artificial
  CRISPR gRNA sequence
aatctcttcacacagaaaaa

SEQ ID NO: 259326 - DNA, 20 bp, Artificial
  CRISPR gRNA sequence
atctcttcacacagaaaaag

SEQ ID NO: 259327 - DNA, 20 bp, Artificial
  CRISPR gRNA sequence
tctcttcacacagaaaaagg

SEQ ID NO: 259328 - DNA, 20 bp, Artificial
  CRISPR gRNA sequence
agaaaaagggggctttgaat

SEQ ID NO: 259329 - DNA, 20 bp, Artificial
  CRISPR gRNA sequence
gcttgataaacatgcatata

SEQ ID NO: 259330 - DNA, 20 bp, Artificial
  CRISPR gRNA sequence
tgataaacatgcatatacag

SEQ ID NO: 259331 - DNA, 20 bp, Artificial
  CRISPR gRNA sequence
atgcatatacagtggtcctc

SEQ ID NO: 259332 - DNA, 20 bp, Artificial
  CRISPR gRNA sequence
acagtggtcctctggatcca

SEQ ID NO: 259333 - DNA, 20 bp, Artificial
  CRISPR gRNA sequence
cagtggtcctctggatccat

SEQ ID NO: 259334 - DNA, 20 bp, Artificial
  CRISPR gRNA sequence
agtggtcctctggatccatg

SEQ ID NO: 259335 - DNA, 20 bp, Artificial
  CRISPR gRNA sequence
cctctggatccatggggtgt

SEQ ID NO: 259336 - DNA, 20 bp, Artificial
  CRISPR gRNA sequence
gatccatggggtgttggttc

SEQ ID NO: 259337 - DNA, 20 bp, Artificial
  CRISPR gRNA sequence
atccatggggtgttggttcc

SEQ ID NO: 259338 - DNA, 20 bp, Artificial
  CRISPR gRNA sequence
tgttggttccaggacccctg

SEQ ID NO: 259339 - DNA, 20 bp, Artificial
  CRISPR gRNA sequence
cctgcagataccaaaatcca

SEQ ID NO: 259340 - DNA, 20 bp, Artificial
  CRISPR gRNA sequence
gcagataccaaaatccatgg

SEQ ID NO: 259341 - DNA, 20 bp, Artificial
  CRISPR gRNA sequence
accaaaatccatggaagctc

SEQ ID NO: 259342 - DNA, 20 bp, Artificial
  CRISPR gRNA sequence
agctcaagtcatgcaattgt

SEQ ID NO: 259343 - DNA, 20 bp, Artificial
  CRISPR gRNA sequence
ttgttggtcctctgtatcca

SEQ ID NO: 259344 - DNA, 20 bp, Artificial
  CRISPR gRNA sequence
caaatactgtttttgatcca

SEQ ID NO: 259345 - DNA, 20 bp, Artificial
  CRISPR gRNA sequence
tccatggttcattgaatcca

SEQ ID NO: 259346 - DNA, 20 bp, Artificial
  CRISPR gRNA sequence
atccaaagatgcataacccg

SEQ ID NO: 259347 - DNA, 20 bp, Artificial
  CRISPR gRNA sequence
agatgcataacccgtggata

SEQ ID NO: 259348 - DNA, 20 bp, Artificial
  CRISPR gRNA sequence
tgcataacccgtggatacag

SEQ ID NO: 259349 - DNA, 20 bp, Artificial
  CRISPR gRNA sequence
gcataacccgtggatacagt

SEQ ID NO: 259350 - DNA, 20 bp, Artificial
  CRISPR gRNA sequence
aactatatgttgtctcattc

SEQ ID NO: 259351 - DNA, 20 bp, Artificial
  CRISPR gRNA sequence
ttccagatcccaaatgaaaa

SEQ ID NO: 259352 - DNA, 20 bp, Artificial
  CRISPR gRNA sequence
agatcccaaatgaaaacaga

SEQ ID NO: 259353 - DNA, 20 bp, Artificial
  CRISPR gRNA sequence
acagatggcacacacaaaat

SEQ ID NO: 259354 - DNA, 20 bp, Artificial
  CRISPR gRNA sequence
cagatggcacacacaaaatt

SEQ ID NO: 259355 - DNA, 20 bp, Artificial
  CRISPR gRNA sequence
tggcacacacaaaattgggc

SEQ ID NO: 259356 - DNA, 20 bp, Artificial
  CRISPR gRNA sequence
gcacacacaaaattgggcaa

SEQ ID NO: 259357 - DNA, 20 bp, Artificial
  CRISPR gRNA sequence
cacacaaaattgggcaagag

SEQ ID NO: 259358 - DNA, 20 bp, Artificial
  CRISPR gRNA sequence
acacaaaattgggcaagagt

SEQ ID NO: 259359 - DNA, 20 bp, Artificial
  CRISPR gRNA sequence
caaaattgggcaagagtagg

SEQ ID NO: 259360 - DNA, 20 bp, Artificial
  CRISPR gRNA sequence
aaaattgggcaagagtagga

SEQ ID NO: 259361 - DNA, 20 bp, Artificial
  CRISPR gRNA sequence
agtaggaaggttatttatga

SEQ ID NO: 259362 - DNA, 20 bp, Artificial
  CRISPR gRNA sequence
gtaggaaggttatttatgaa

SEQ ID NO: 259363 - DNA, 20 bp, Artificial
  CRISPR gRNA sequence
gttatttatgaaaggactgt

SEQ ID NO: 259364 - DNA, 20 bp, Artificial
  CRISPR gRNA sequence
ttatgaaaggactgttggca

SEQ ID NO: 259365 - DNA, 20 bp, Artificial
  CRISPR gRNA sequence
tatgaaaggactgttggcaa

SEQ ID NO: 259366 - DNA, 20 bp, Artificial
  CRISPR gRNA sequence
aaggactgttggcaaaggtg

SEQ ID NO: 259367 - DNA, 20 bp, Artificial
  CRISPR gRNA sequence
actgttggcaaaggtgtggc

SEQ ID NO: 259368 - DNA, 20 bp, Artificial
  CRISPR gRNA sequence
tgttggcaaaggtgtggcaa

SEQ ID NO: 259369 - DNA, 20 bp, Artificial
  CRISPR gRNA sequence
tggcaaaggtgtggcaagag

SEQ ID NO: 259370 - DNA, 20 bp, Artificial
  CRISPR gRNA sequence
tgtggcaagagcagaaccac

SEQ ID NO: 259371 - DNA, 20 bp, Artificial
  CRISPR gRNA sequence
gtggcaagagcagaaccacg

SEQ ID NO: 259372 - DNA, 20 bp, Artificial
  CRISPR gRNA sequence
tggcaagagcagaaccacga

SEQ ID NO: 259373 - DNA, 20 bp, Artificial
  CRISPR gRNA sequence
ggcaagagcagaaccacgag

SEQ ID NO: 259374 - DNA, 20 bp, Artificial
  CRISPR gRNA sequence
aagagcagaaccacgagggg

SEQ ID NO: 259375 - DNA, 20 bp, Artificial
  CRISPR gRNA sequence
agaaccacgaggggtagtgc

SEQ ID NO: 259376 - DNA, 20 bp, Artificial
  CRISPR gRNA sequence
aaccacgaggggtagtgcca

SEQ ID NO: 259377 - DNA, 20 bp, Artificial
  CRISPR gRNA sequence
gtgccagagcctgtgacttg

SEQ ID NO: 259378 - DNA, 20 bp, Artificial
  CRISPR gRNA sequence
ccagagcctgtgacttgcag

SEQ ID NO: 259379 - DNA, 20 bp, Artificial
  CRISPR gRNA sequence
gagcctgtgacttgcagcag

SEQ ID NO: 259380 - DNA, 20 bp, Artificial
  CRISPR gRNA sequence
agcagaattatgaccaccct

SEQ ID NO: 259381 - DNA, 20 bp, Artificial
  CRISPR gRNA sequence
gcagaattatgaccaccctt

SEQ ID NO: 259382 - DNA, 20 bp, Artificial
  CRISPR gRNA sequence
tatgaccacccttaggtcga

SEQ ID NO: 259383 - DNA, 20 bp, Artificial
  CRISPR gRNA sequence
tgaccacccttaggtcgaaa

SEQ ID NO: 259384 - DNA, 20 bp, Artificial
  CRISPR gRNA sequence
acccttaggtcgaaagagac

SEQ ID NO: 259385 - DNA, 20 bp, Artificial
  CRISPR gRNA sequence
cccttaggtcgaaagagacc

SEQ ID NO: 259386 - DNA, 20 bp, Artificial
  CRISPR gRNA sequence
ccttaggtcgaaagagacca

SEQ ID NO: 259387 - DNA, 20 bp, Artificial
  CRISPR gRNA sequence
cttaggtcgaaagagaccag

SEQ ID NO: 259388 - DNA, 20 bp, Artificial
  CRISPR gRNA sequence
ggtcgaaagagaccagggga

SEQ ID NO: 259389 - DNA, 20 bp, Artificial
  CRISPR gRNA sequence
aaagagaccaggggacagcg

SEQ ID NO: 259390 - DNA, 20 bp, Artificial
  CRISPR gRNA sequence
ccaggggacagcgaagttac

SEQ ID NO: 259391 - DNA, 20 bp, Artificial
  CRISPR gRNA sequence
gacagcgaagttaccagaac

SEQ ID NO: 259392 - DNA, 20 bp, Artificial
  CRISPR gRNA sequence
agcgaagttaccagaaccag

SEQ ID NO: 259393 - DNA, 20 bp, Artificial
  CRISPR gRNA sequence
gcgaagttaccagaaccaga

SEQ ID NO: 259394 - DNA, 20 bp, Artificial
  CRISPR gRNA sequence
agttaccagaaccagaaggc

SEQ ID NO: 259395 - DNA, 20 bp, Artificial
  CRISPR gRNA sequence
ttaccagaaccagaaggcaa

SEQ ID NO: 259396 - DNA, 20 bp, Artificial
  CRISPR gRNA sequence
accagaaccagaaggcaaga

SEQ ID NO: 259397 - DNA, 20 bp, Artificial
  CRISPR gRNA sequence
cagaaggcaagagagttgtg

SEQ ID NO: 259398 - DNA, 20 bp, Artificial
  CRISPR gRNA sequence
aaggcaagagagttgtgtag

SEQ ID NO: 259399 - DNA, 20 bp, Artificial
  CRISPR gRNA sequence
ggcaagagagttgtgtagtg

SEQ ID NO: 259400 - DNA, 20 bp, Artificial
  CRISPR gRNA sequence
gcaagagagttgtgtagtgg

SEQ ID NO: 259401 - DNA, 20 bp, Artificial
  CRISPR gRNA sequence
tgtagtggaggccaccatga

SEQ ID NO: 259402 - DNA, 20 bp, Artificial
  CRISPR gRNA sequence
agtggaggccaccatgacag

SEQ ID NO: 259403 - DNA, 20 bp, Artificial
  CRISPR gRNA sequence
cagaagcaatgacttccatc

SEQ ID NO: 259404 - DNA, 20 bp, Artificial
  CRISPR gRNA sequence
gaagcaatgacttccatcaa

SEQ ID NO: 259405 - DNA, 20 bp, Artificial
  CRISPR gRNA sequence
gcaatgacttccatcaagag

SEQ ID NO: 259406 - DNA, 20 bp, Artificial
  CRISPR gRNA sequence
atgacttccatcaagagaag

SEQ ID NO: 259407 - DNA, 20 bp, Artificial
  CRISPR gRNA sequence
tccatcaagagaagcagacc

SEQ ID NO: 259408 - DNA, 20 bp, Artificial
  CRISPR gRNA sequence
agagaagcagaccaagcaac

SEQ ID NO: 259409 - DNA, 20 bp, Artificial
  CRISPR gRNA sequence
gcagaccaagcaaccagctt

SEQ ID NO: 259410 - DNA, 20 bp, Artificial
  CRISPR gRNA sequence
ccaagcaaccagctttggcc

SEQ ID NO: 259411 - DNA, 20 bp, Artificial
  CRISPR gRNA sequence
attgtgtatatcacaactat

SEQ ID NO: 259412 - DNA, 20 bp, Artificial
  CRISPR gRNA sequence
tcacaactatcagttatacc

SEQ ID NO: 259413 - DNA, 20 bp, Artificial
  CRISPR gRNA sequence
agcacattaactgttcttga

SEQ ID NO: 259414 - DNA, 20 bp, Artificial
  CRISPR gRNA sequence
cattaactgttcttgacaga

SEQ ID NO: 259415 - DNA, 20 bp, Artificial
  CRISPR gRNA sequence
actgttcttgacagaaagta

SEQ ID NO: 259416 - DNA, 20 bp, Artificial
  CRISPR gRNA sequence
tggttttaaaacaaaatcta

SEQ ID NO: 259417 - DNA, 20 bp, Artificial
  CRISPR gRNA sequence
gttttaaaacaaaatctaaa

SEQ ID NO: 259418 - DNA, 20 bp, Artificial
  CRISPR gRNA sequence
ttttaaaacaaaatctaaag

SEQ ID NO: 259419 - DNA, 20 bp, Artificial
  CRISPR gRNA sequence
aacaaaatctaaagaggttt

SEQ ID NO: 259420 - DNA, 20 bp, Artificial
  CRISPR gRNA sequence
aaagaggttttagtttgaac

SEQ ID NO: 259421 - DNA, 20 bp, Artificial
  CRISPR gRNA sequence
aagaggttttagtttgaaca

SEQ ID NO: 259422 - DNA, 20 bp, Artificial
  CRISPR gRNA sequence
tgaacaaggacaaatgatta

SEQ ID NO: 259423 - DNA, 20 bp, Artificial
  CRISPR gRNA sequence
gaacaaggacaaatgattat

SEQ ID NO: 259424 - DNA, 20 bp, Artificial
  CRISPR gRNA sequence
attataggtaacaatataaa

SEQ ID NO: 259425 - DNA, 20 bp, Artificial
  CRISPR gRNA sequence
ggtaacaatataaatagaaa

SEQ ID NO: 259426 - DNA, 20 bp, Artificial
  CRISPR gRNA sequence
cctgattaataaatttacta

SEQ ID NO: 259427 - DNA, 20 bp, Artificial
  CRISPR gRNA sequence
ctgattaataaatttactaa

SEQ ID NO: 259428 - DNA, 20 bp, Artificial
  CRISPR gRNA sequence
taataaatttactaaaggcc

SEQ ID NO: 259429 - DNA, 20 bp, Artificial
  CRISPR gRNA sequence
aatttactaaaggcctggca

SEQ ID NO: 259430 - DNA, 20 bp, Artificial
  CRISPR gRNA sequence
ttactaaaggcctggcacag

SEQ ID NO: 259431 - DNA, 20 bp, Artificial
  CRISPR gRNA sequence
gtggattacacctgtactcc

SEQ ID NO: 259432 - DNA, 20 bp, Artificial
  CRISPR gRNA sequence
cacctgtactcctagcactt

SEQ ID NO: 259433 - DNA, 20 bp, Artificial
  CRISPR gRNA sequence
acctgtactcctagcacttt

SEQ ID NO: 259434 - DNA, 20 bp, Artificial
  CRISPR gRNA sequence
ctgtactcctagcactttgg

SEQ ID NO: 259435 - DNA, 20 bp, Artificial
  CRISPR gRNA sequence
tgtactcctagcactttggg

SEQ ID NO: 259436 - DNA, 20 bp, Artificial
  CRISPR gRNA sequence
agcactttgggaggatgaca

SEQ ID NO: 259437 - DNA, 20 bp, Artificial
  CRISPR gRNA sequence
gcactttgggaggatgacac

SEQ ID NO: 259438 - DNA, 20 bp, Artificial
  CRISPR gRNA sequence
ctttgggaggatgacacagg

SEQ ID NO: 259439 - DNA, 20 bp, Artificial
  CRISPR gRNA sequence
acaggtggatcgcttgaacc

SEQ ID NO: 259440 - DNA, 20 bp, Artificial
  CRISPR gRNA sequence
caggtggatcgcttgaaccc

SEQ ID NO: 259441 - DNA, 20 bp, Artificial
  CRISPR gRNA sequence
ggtggatcgcttgaacccag

SEQ ID NO: 259442 - DNA, 20 bp, Artificial
  CRISPR gRNA sequence
gatcgcttgaacccaggaga

SEQ ID NO: 259443 - DNA, 20 bp, Artificial
  CRISPR gRNA sequence
tgaacccaggagatggaaac

SEQ ID NO: 259444 - DNA, 20 bp, Artificial
  CRISPR gRNA sequence
ccaggagatggaaaccagcc

SEQ ID NO: 259445 - DNA, 20 bp, Artificial
  CRISPR gRNA sequence
caggagatggaaaccagcct

SEQ ID NO: 259446 - DNA, 20 bp, Artificial
  CRISPR gRNA sequence
ggaaaccagcctgggcaaca

SEQ ID NO: 259447 - DNA, 20 bp, Artificial
  CRISPR gRNA sequence
accagcctgggcaacatggc

SEQ ID NO: 259448 - DNA, 20 bp, Artificial
  CRISPR gRNA sequence
tctacaaaaaatacaaaaat

SEQ ID NO: 259449 - DNA, 20 bp, Artificial
  CRISPR gRNA sequence
caaaaaatacaaaaattagc

SEQ ID NO: 259450 - DNA, 20 bp, Artificial
  CRISPR gRNA sequence
aaaaaatacaaaaattagct

SEQ ID NO: 259451 - DNA, 20 bp, Artificial
  CRISPR gRNA sequence
atacaaaaattagctgggtg

SEQ ID NO: 259452 - DNA, 20 bp, Artificial
  CRISPR gRNA sequence
tacaaaaattagctgggtgt

SEQ ID NO: 259453 - DNA, 20 bp, Artificial
  CRISPR gRNA sequence
acaaaaattagctgggtgtg

SEQ ID NO: 259454 - DNA, 20 bp, Artificial
  CRISPR gRNA sequence
caaaaattagctgggtgtgg

SEQ ID NO: 259455 - DNA, 20 bp, Artificial
  CRISPR gRNA sequence
tagctgggtgtgggggtacc

SEQ ID NO: 259456 - DNA, 20 bp, Artificial
  CRISPR gRNA sequence
ggtgtgggggtacctggctg

SEQ ID NO: 259457 - DNA, 20 bp, Artificial
  CRISPR gRNA sequence
gtgggggtacctggctgtgg

SEQ ID NO: 259458 - DNA, 20 bp, Artificial
  CRISPR gRNA sequence
gctgtggtggcatgtgcctg

SEQ ID NO: 259459 - DNA, 20 bp, Artificial
  CRISPR gRNA sequence
gtggcatgtgcctgtagtcc

SEQ ID NO: 259460 - DNA, 20 bp, Artificial
  CRISPR gRNA sequence
tgcctgtagtcccagctcct

SEQ ID NO: 259461 - DNA, 20 bp, Artificial
  CRISPR gRNA sequence
gcctgtagtcccagctcctt

SEQ ID NO: 259462 - DNA, 20 bp, Artificial
  CRISPR gRNA sequence
ctgtagtcccagctccttgg

SEQ ID NO: 259463 - DNA, 20 bp, Artificial
  CRISPR gRNA sequence
tgtagtcccagctccttggg

SEQ ID NO: 259464 - DNA, 20 bp, Artificial
  CRISPR gRNA sequence
tcccagctccttgggaggct

SEQ ID NO: 259465 - DNA, 20 bp, Artificial
  CRISPR gRNA sequence
cccagctccttgggaggctg

SEQ ID NO: 259466 - DNA, 20 bp, Artificial
  CRISPR gRNA sequence
agctccttgggaggctgagg

SEQ ID NO: 259467 - DNA, 20 bp, Artificial
  CRISPR gRNA sequence
gctccttgggaggctgaggt

SEQ ID NO: 259468 - DNA, 20 bp, Artificial
  CRISPR gRNA sequence
tccttgggaggctgaggtgg

SEQ ID NO: 259469 - DNA, 20 bp, Artificial
  CRISPR gRNA sequence
ccttgggaggctgaggtggg

SEQ ID NO: 259470 - DNA, 20 bp, Artificial
  CRISPR gRNA sequence
ctgaggtgggaggatcactt

SEQ ID NO: 259471 - DNA, 20 bp, Artificial
  CRISPR gRNA sequence
gtgggaggatcacttgagcc

SEQ ID NO: 259472 - DNA, 20 bp, Artificial
  CRISPR gRNA sequence
tgggaggatcacttgagccc

SEQ ID NO: 259473 - DNA, 20 bp, Artificial
  CRISPR gRNA sequence
ggaggatcacttgagcccag

SEQ ID NO: 259474 - DNA, 20 bp, Artificial
  CRISPR gRNA sequence
gaggatcacttgagcccagg

SEQ ID NO: 259475 - DNA, 20 bp, Artificial
  CRISPR gRNA sequence
tcacttgagcccaggaggtc

SEQ ID NO: 259476 - DNA, 20 bp, Artificial
  CRISPR gRNA sequence
cacttgagcccaggaggtca

SEQ ID NO: 259477 - DNA, 20 bp, Artificial
  CRISPR gRNA sequence
agcccaggaggtcaaggctg

SEQ ID NO: 259478 - DNA, 20 bp, Artificial
  CRISPR gRNA sequence
caggaggtcaaggctgcagt

SEQ ID NO: 259479 - DNA, 20 bp, Artificial
  CRISPR gRNA sequence
gaggtcaaggctgcagtgag

SEQ ID NO: 259480 - DNA, 20 bp, Artificial
  CRISPR gRNA sequence
gtgattgtaccactgcactc

SEQ ID NO: 259481 - DNA, 20 bp, Artificial
  CRISPR gRNA sequence
gtaccactgcactccagcct

SEQ ID NO: 259482 - DNA, 20 bp, Artificial
  CRISPR gRNA sequence
gcactccagcctgagcaaca

SEQ ID NO: 259483 - DNA, 20 bp, Artificial
  CRISPR gRNA sequence
tccagcctgagcaacaaagt

SEQ ID NO: 259484 - DNA, 20 bp, Artificial
  CRISPR gRNA sequence
tctcaaataaataaataatt

SEQ ID NO: 259485 - DNA, 20 bp, Artificial
  CRISPR gRNA sequence
aataaataaataatttagta

SEQ ID NO: 259486 - DNA, 20 bp, Artificial
  CRISPR gRNA sequence
aaataaataatttagtaaag

SEQ ID NO: 259487 - DNA, 20 bp, Artificial
  CRISPR gRNA sequence
tttagtaaagaagttgcttt

SEQ ID NO: 259488 - DNA, 20 bp, Artificial
  CRISPR gRNA sequence
gtaaagaagttgcttttggt

SEQ ID NO: 259489 - DNA, 20 bp, Artificial
  CRISPR gRNA sequence
cttttggtcagcactaatct

SEQ ID NO: 259490 - DNA, 20 bp, Artificial
  CRISPR gRNA sequence
cctttatttgtgttcctaca

SEQ ID NO: 259491 - DNA, 20 bp, Artificial
  CRISPR gRNA sequence
ctttatttgtgttcctacac

SEQ ID NO: 259492 - DNA, 20 bp, Artificial
  CRISPR gRNA sequence
tatttgtgttcctacacagg

SEQ ID NO: 259493 - DNA, 20 bp, Artificial
  CRISPR gRNA sequence
cacaggcagacactataatg

SEQ ID NO: 259494 - DNA, 20 bp, Artificial
  CRISPR gRNA sequence
caggcagacactataatgta

SEQ ID NO: 259495 - DNA, 20 bp, Artificial
  CRISPR gRNA sequence
aggcagacactataatgtag

SEQ ID NO: 259496 - DNA, 20 bp, Artificial
  CRISPR gRNA sequence
attgtgctacatgtaactgt

SEQ ID NO: 259497 - DNA, 20 bp, Artificial
  CRISPR gRNA sequence
tgctacatgtaactgtcaga

SEQ ID NO: 259498 - DNA, 20 bp, Artificial
  CRISPR gRNA sequence
acatgtaactgtcagaaagt

SEQ ID NO: 259499 - DNA, 20 bp, Artificial
  CRISPR gRNA sequence
aactgtcagaaagtaagtca

SEQ ID NO: 259500 - DNA, 20 bp, Artificial
  CRISPR gRNA sequence
actgtcagaaagtaagtcaa

SEQ ID NO: 259501 - DNA, 20 bp, Artificial
  CRISPR gRNA sequence
tcagaaagtaagtcaaaggt

SEQ ID NO: 259502 - DNA, 20 bp, Artificial
  CRISPR gRNA sequence
aaagtaagtcaaaggtcaga

SEQ ID NO: 259503 - DNA, 20 bp, Artificial
  CRISPR gRNA sequence
aagtcaaaggtcagatagtt

SEQ ID NO: 259504 - DNA, 20 bp, Artificial
  CRISPR gRNA sequence
tcaaaggtcagatagttcag

SEQ ID NO: 259505 - DNA, 20 bp, Artificial
  CRISPR gRNA sequence
tcagatagttcagtagcaaa

SEQ ID NO: 259506 - DNA, 20 bp, Artificial
  CRISPR gRNA sequence
agtagcaaaaagtcccatat

SEQ ID NO: 259507 - DNA, 20 bp, Artificial
  CRISPR gRNA sequence
aaaagtcccatatgagcacc

SEQ ID NO: 259508 - DNA, 20 bp, Artificial
  CRISPR gRNA sequence
ccatatgagcaccaagacct

SEQ ID NO: 259509 - DNA, 20 bp, Artificial
  CRISPR gRNA sequence
catatgagcaccaagaccta

SEQ ID NO: 259510 - DNA, 20 bp, Artificial
  CRISPR gRNA sequence
gacctaaggcattcattttt

SEQ ID NO: 259511 - DNA, 20 bp, Artificial
  CRISPR gRNA sequence
cctaaggcattcatttttga

SEQ ID NO: 259512 - DNA, 20 bp, Artificial
  CRISPR gRNA sequence
ctaaggcattcatttttgag

SEQ ID NO: 259513 - DNA, 20 bp, Artificial
  CRISPR gRNA sequence
taaggcattcatttttgaga

SEQ ID NO: 259514 - DNA, 20 bp, Artificial
  CRISPR gRNA sequence
cattcatttttgagagggaa

SEQ ID NO: 259515 - DNA, 20 bp, Artificial
  CRISPR gRNA sequence
agttatcaaaaacaatcaat

SEQ ID NO: 259516 - DNA, 20 bp, Artificial
  CRISPR gRNA sequence
acaatcaatgagtactttct

SEQ ID NO: 259517 - DNA, 20 bp, Artificial
  CRISPR gRNA sequence
atcaatgagtactttctgag

SEQ ID NO: 259518 - DNA, 20 bp, Artificial
  CRISPR gRNA sequence
gaagaaattttgatgtgtca

SEQ ID NO: 259519 - DNA, 20 bp, Artificial
  CRISPR gRNA sequence
tgtgtcacagaatcgtcctt

SEQ ID NO: 259520 - DNA, 20 bp, Artificial
  CRISPR gRNA sequence
tattctgacttctgctgtga

SEQ ID NO: 259521 - DNA, 20 bp, Artificial
  CRISPR gRNA sequence
catttattcatcaaataaat

SEQ ID NO: 259522 - DNA, 20 bp, Artificial
  CRISPR gRNA sequence
atttattcatcaaataaata

SEQ ID NO: 259523 - DNA, 20 bp, Artificial
  CRISPR gRNA sequence
tttattcatcaaataaataa

SEQ ID NO: 259524 - DNA, 20 bp, Artificial
  CRISPR gRNA sequence
gacttaatgtacttgattct

SEQ ID NO: 259525 - DNA, 20 bp, Artificial
  CRISPR gRNA sequence
acttaatgtacttgattctt

SEQ ID NO: 259526 - DNA, 20 bp, Artificial
  CRISPR gRNA sequence
ttaatgtacttgattcttag

SEQ ID NO: 259527 - DNA, 20 bp, Artificial
  CRISPR gRNA sequence
tgtacttgattcttaggaga

SEQ ID NO: 259528 - DNA, 20 bp, Artificial
  CRISPR gRNA sequence
gtacttgattcttaggagat

SEQ ID NO: 259529 - DNA, 20 bp, Artificial
  CRISPR gRNA sequence
cttgattcttaggagatggg

SEQ ID NO: 259530 - DNA, 20 bp, Artificial
  CRISPR gRNA sequence
taggagatgggaagatgtaa

SEQ ID NO: 259531 - DNA, 20 bp, Artificial
  CRISPR gRNA sequence
agatgggaagatgtaaaaga

SEQ ID NO: 259532 - DNA, 20 bp, Artificial
  CRISPR gRNA sequence
atgggaagatgtaaaagaca

SEQ ID NO: 259533 - DNA, 20 bp, Artificial
  CRISPR gRNA sequence
aagacagagctgtttcattc

SEQ ID NO: 259534 - DNA, 20 bp, Artificial
  CRISPR gRNA sequence
agacagagctgtttcattct

SEQ ID NO: 259535 - DNA, 20 bp, Artificial
  CRISPR gRNA sequence
acagagctgtttcattctag

SEQ ID NO: 259536 - DNA, 20 bp, Artificial
  CRISPR gRNA sequence
ttcattctaggagaaatccg

SEQ ID NO: 259537 - DNA, 20 bp, Artificial
  CRISPR gRNA sequence
tcattctaggagaaatccga

SEQ ID NO: 259538 - DNA, 20 bp, Artificial
  CRISPR gRNA sequence
ttctaggagaaatccgaagg

SEQ ID NO: 259539 - DNA, 20 bp, Artificial
  CRISPR gRNA sequence
tctaggagaaatccgaaggc

SEQ ID NO: 259540 - DNA, 20 bp, Artificial
  CRISPR gRNA sequence
tccgaaggcaggtacacaat

SEQ ID NO: 259541 - DNA, 20 bp, Artificial
  CRISPR gRNA sequence
acacaatcagctactctccg

SEQ ID NO: 259542 - DNA, 20 bp, Artificial
  CRISPR gRNA sequence
ctactctccgaagccatccg

SEQ ID NO: 259543 - DNA, 20 bp, Artificial
  CRISPR gRNA sequence
cgtggtacatgaacccttta

SEQ ID NO: 259544 - DNA, 20 bp, Artificial
  CRISPR gRNA sequence
gtggtacatgaaccctttaa

SEQ ID NO: 259545 - DNA, 20 bp, Artificial
  CRISPR gRNA sequence
tggtacatgaaccctttaaa

SEQ ID NO: 259546 - DNA, 20 bp, Artificial
  CRISPR gRNA sequence
accctttaaagggtcattga

SEQ ID NO: 259547 - DNA, 20 bp, Artificial
  CRISPR gRNA sequence
ccctttaaagggtcattgac

SEQ ID NO: 259548 - DNA, 20 bp, Artificial
  CRISPR gRNA sequence
ggtcattgacaggcacgcga

SEQ ID NO: 259549 - DNA, 20 bp, Artificial
  CRISPR gRNA sequence
cattgacaggcacgcgaaag

SEQ ID NO: 259550 - DNA, 20 bp, Artificial
  CRISPR gRNA sequence
cgcgaaagaagccttgtttc

SEQ ID NO: 259551 - DNA, 20 bp, Artificial
  CRISPR gRNA sequence
aaagaagccttgtttccaga

SEQ ID NO: 259552 - DNA, 20 bp, Artificial
  CRISPR gRNA sequence
aagaagccttgtttccagac

SEQ ID NO: 259553 - DNA, 20 bp, Artificial
  CRISPR gRNA sequence
gtttccagacaggatgattc

SEQ ID NO: 259554 - DNA, 20 bp, Artificial
  CRISPR gRNA sequence
ttccagacaggatgattctg

SEQ ID NO: 259555 - DNA, 20 bp, Artificial
  CRISPR gRNA sequence
tccagacaggatgattctgg

SEQ ID NO: 259556 - DNA, 20 bp, Artificial
  CRISPR gRNA sequence
gatgattctggaggcttttg

SEQ ID NO: 259557 - DNA, 20 bp, Artificial
  CRISPR gRNA sequence
tgattctggaggcttttgta

SEQ ID NO: 259558 - DNA, 20 bp, Artificial
  CRISPR gRNA sequence
ttttgtagagacttcacatt

SEQ ID NO: 259559 - DNA, 20 bp, Artificial
  CRISPR gRNA sequence
gtagagacttcacatttagc

SEQ ID NO: 259560 - DNA, 20 bp, Artificial
  CRISPR gRNA sequence
tagagacttcacatttagct

SEQ ID NO: 259561 - DNA, 20 bp, Artificial
  CRISPR gRNA sequence
ttcacatttagctgggccat

SEQ ID NO: 259562 - DNA, 20 bp, Artificial
  CRISPR gRNA sequence
tcacatttagctgggccata

SEQ ID NO: 259563 - DNA, 20 bp, Artificial
  CRISPR gRNA sequence
tttagctgggccataaggtc

SEQ ID NO: 259564 - DNA, 20 bp, Artificial
  CRISPR gRNA sequence
ttagctgggccataaggtct

SEQ ID NO: 259565 - DNA, 20 bp, Artificial
  CRISPR gRNA sequence
tagctgggccataaggtctg

SEQ ID NO: 259566 - DNA, 20 bp, Artificial
  CRISPR gRNA sequence
cataaggtctggggcaaatt

SEQ ID NO: 259567 - DNA, 20 bp, Artificial
  CRISPR gRNA sequence
aggtctggggcaaatttaga

SEQ ID NO: 259568 - DNA, 20 bp, Artificial
  CRISPR gRNA sequence
ggtctggggcaaatttagac

SEQ ID NO: 259569 - DNA, 20 bp, Artificial
  CRISPR gRNA sequence
ggggcaaatttagacaggct

SEQ ID NO: 259570 - DNA, 20 bp, Artificial
  CRISPR gRNA sequence
atttagacaggctaagatca

SEQ ID NO: 259571 - DNA, 20 bp, Artificial
  CRISPR gRNA sequence
taagatcatggaaatgacct

SEQ ID NO: 259572 - DNA, 20 bp, Artificial
  CRISPR gRNA sequence
catggaaatgaccttagtgt

SEQ ID NO: 259573 - DNA, 20 bp, Artificial
  CRISPR gRNA sequence
tggaaatgaccttagtgtga

SEQ ID NO: 259574 - DNA, 20 bp, Artificial
  CRISPR gRNA sequence
accttagtgtgagagtttat

SEQ ID NO: 259575 - DNA, 20 bp, Artificial
  CRISPR gRNA sequence
ccttagtgtgagagtttatt

SEQ ID NO: 259576 - DNA, 20 bp, Artificial
  CRISPR gRNA sequence
tgtgagagtttattgggaac

SEQ ID NO: 259577 - DNA, 20 bp, Artificial
  CRISPR gRNA sequence
gagagtttattgggaactgg

SEQ ID NO: 259578 - DNA, 20 bp, Artificial
  CRISPR gRNA sequence
gagtttattgggaactggca

SEQ ID NO: 259579 - DNA, 20 bp, Artificial
  CRISPR gRNA sequence
ggcagagtattccatttatg

SEQ ID NO: 259580 - DNA, 20 bp, Artificial
  CRISPR gRNA sequence
gcagagtattccatttatgt

SEQ ID NO: 259581 - DNA, 20 bp, Artificial
  CRISPR gRNA sequence
agtattccatttatgtagga

SEQ ID NO: 259582 - DNA, 20 bp, Artificial
  CRISPR gRNA sequence
ccatttatgtaggatggaaa

SEQ ID NO: 259583 - DNA, 20 bp, Artificial
  CRISPR gRNA sequence
catttatgtaggatggaaac

SEQ ID NO: 259584 - DNA, 20 bp, Artificial
  CRISPR gRNA sequence
atgtaggatggaaacaggtg

SEQ ID NO: 259585 - DNA, 20 bp, Artificial
  CRISPR gRNA sequence
aggatggaaacaggtgaaga

SEQ ID NO: 259586 - DNA, 20 bp, Artificial
  CRISPR gRNA sequence
caggtgaagatggccaatac

SEQ ID NO: 259587 - DNA, 20 bp, Artificial
  CRISPR gRNA sequence
aagatggccaataccagtca

SEQ ID NO: 259588 - DNA, 20 bp, Artificial
  CRISPR gRNA sequence
agatggccaataccagtcat

SEQ ID NO: 259589 - DNA, 20 bp, Artificial
  CRISPR gRNA sequence
gatggccaataccagtcatg

SEQ ID NO: 259590 - DNA, 20 bp, Artificial
  CRISPR gRNA sequence
tggccaataccagtcatggg

SEQ ID NO: 259591 - DNA, 20 bp, Artificial
  CRISPR gRNA sequence
aataccagtcatggggagcc

SEQ ID NO: 259592 - DNA, 20 bp, Artificial
  CRISPR gRNA sequence
cagtcatggggagccaagaa

SEQ ID NO: 259593 - DNA, 20 bp, Artificial
  CRISPR gRNA sequence
agtcatggggagccaagaaa

SEQ ID NO: 259594 - DNA, 20 bp, Artificial
  CRISPR gRNA sequence
gggagccaagaaaaggcaca

SEQ ID NO: 259595 - DNA, 20 bp, Artificial
  CRISPR gRNA sequence
aaaaggcacatagattttac

SEQ ID NO: 259596 - DNA, 20 bp, Artificial
  CRISPR gRNA sequence
ggcacatagattttaccaga

SEQ ID NO: 259597 - DNA, 20 bp, Artificial
  CRISPR gRNA sequence
gcacatagattttaccagaa

SEQ ID NO: 259598 - DNA, 20 bp, Artificial
  CRISPR gRNA sequence
agattttaccagaaaggcca

SEQ ID NO: 259599 - DNA, 20 bp, Artificial
  CRISPR gRNA sequence
gattttaccagaaaggccat

SEQ ID NO: 259600 - DNA, 20 bp, Artificial
  CRISPR gRNA sequence
ttttaccagaaaggccatgg

SEQ ID NO: 259601 - DNA, 20 bp, Artificial
  CRISPR gRNA sequence
aaaggccatgggagatgctg

SEQ ID NO: 259602 - DNA, 20 bp, Artificial
  CRISPR gRNA sequence
gggagatgctgaagatgtct

SEQ ID NO: 259603 - DNA, 20 bp, Artificial
  CRISPR gRNA sequence
atgctgaagatgtctgagtt

SEQ ID NO: 259604 - DNA, 20 bp, Artificial
  CRISPR gRNA sequence
tgtctgagttgagaatgttg

SEQ ID NO: 259605 - DNA, 20 bp, Artificial
  CRISPR gRNA sequence
tgttgtggtacatgctgctt

SEQ ID NO: 259606 - DNA, 20 bp, Artificial
  CRISPR gRNA sequence
gttgtggtacatgctgcttt

SEQ ID NO: 259607 - DNA, 20 bp, Artificial
  CRISPR gRNA sequence
gtggtacatgctgctttggg

SEQ ID NO: 259608 - DNA, 20 bp, Artificial
  CRISPR gRNA sequence
tggtacatgctgctttggga

SEQ ID NO: 259609 - DNA, 20 bp, Artificial
  CRISPR gRNA sequence
acatgctgctttgggaaggt

SEQ ID NO: 259610 - DNA, 20 bp, Artificial
  CRISPR gRNA sequence
ctgctttgggaaggttagca

SEQ ID NO: 259611 - DNA, 20 bp, Artificial
  CRISPR gRNA sequence
gggaaggttagcacagcctt

SEQ ID NO: 259612 - DNA, 20 bp, Artificial
  CRISPR gRNA sequence
ggaaggttagcacagccttg

SEQ ID NO: 259613 - DNA, 20 bp, Artificial
  CRISPR gRNA sequence
aaggttagcacagccttgag

SEQ ID NO: 259614 - DNA, 20 bp, Artificial
  CRISPR gRNA sequence
tagcacagccttgaggagtg

SEQ ID NO: 259615 - DNA, 20 bp, Artificial
  CRISPR gRNA sequence
acagccttgaggagtgcagc

SEQ ID NO: 259616 - DNA, 20 bp, Artificial
  CRISPR gRNA sequence
caagcaatcttgactgccct

SEQ ID NO: 259617 - DNA, 20 bp, Artificial
  CRISPR gRNA sequence
aatcttgactgcccttggct

SEQ ID NO: 259618 - DNA, 20 bp, Artificial
  CRISPR gRNA sequence
tcttgactgcccttggcttg

SEQ ID NO: 259619 - DNA, 20 bp, Artificial
  CRISPR gRNA sequence
gactgcccttggcttggagc

SEQ ID NO: 259620 - DNA, 20 bp, Artificial
  CRISPR gRNA sequence
actgcccttggcttggagca

SEQ ID NO: 259621 - DNA, 20 bp, Artificial
  CRISPR gRNA sequence
ctgcccttggcttggagcaa

SEQ ID NO: 259622 - DNA, 20 bp, Artificial
  CRISPR gRNA sequence
cccttggcttggagcaaggg

SEQ ID NO: 259623 - DNA, 20 bp, Artificial
  CRISPR gRNA sequence
cttggagcaagggaagaact

SEQ ID NO: 259624 - DNA, 20 bp, Artificial
  CRISPR gRNA sequence
ttggagcaagggaagaactg

SEQ ID NO: 259625 - DNA, 20 bp, Artificial
  CRISPR gRNA sequence
gagcaagggaagaactgagg

SEQ ID NO: 259626 - DNA, 20 bp, Artificial
  CRISPR gRNA sequence
gcaagggaagaactgaggca

SEQ ID NO: 259627 - DNA, 20 bp, Artificial
  CRISPR gRNA sequence
gaactgaggcagagaccaat

SEQ ID NO: 259628 - DNA, 20 bp, Artificial
  CRISPR gRNA sequence
aactgaggcagagaccaatc

SEQ ID NO: 259629 - DNA, 20 bp, Artificial
  CRISPR gRNA sequence
ctgaggcagagaccaatcag

SEQ ID NO: 259630 - DNA, 20 bp, Artificial
  CRISPR gRNA sequence
tgaggcagagaccaatcagg

SEQ ID NO: 259631 - DNA, 20 bp, Artificial
  CRISPR gRNA sequence
caatcaggaggctgatgcaa

SEQ ID NO: 259632 - DNA, 20 bp, Artificial
  CRISPR gRNA sequence
tgatgcaatagcactgatgt

SEQ ID NO: 259633 - DNA, 20 bp, Artificial
  CRISPR gRNA sequence
tagcactgatgtgagttcat

SEQ ID NO: 259634 - DNA, 20 bp, Artificial
  CRISPR gRNA sequence
agcactgatgtgagttcata

SEQ ID NO: 259635 - DNA, 20 bp, Artificial
  CRISPR gRNA sequence
gatgtgagttcataaggcct

SEQ ID NO: 259636 - DNA, 20 bp, Artificial
  CRISPR gRNA sequence
agttcataaggcctgagctg

SEQ ID NO: 259637 - DNA, 20 bp, Artificial
  CRISPR gRNA sequence
ttcataaggcctgagctgtg

SEQ ID NO: 259638 - DNA, 20 bp, Artificial
  CRISPR gRNA sequence
tcataaggcctgagctgtgg

SEQ ID NO: 259639 - DNA, 20 bp, Artificial
  CRISPR gRNA sequence
taaggcctgagctgtggagg

SEQ ID NO: 259640 - DNA, 20 bp, Artificial
  CRISPR gRNA sequence
ggcctgagctgtggaggtgg

SEQ ID NO: 259641 - DNA, 20 bp, Artificial
  CRISPR gRNA sequence
tgagctgtggaggtggcagc

SEQ ID NO: 259642 - DNA, 20 bp, Artificial
  CRISPR gRNA sequence
ggaggtggcagctggtatga

SEQ ID NO: 259643 - DNA, 20 bp, Artificial
  CRISPR gRNA sequence
gaggtggcagctggtatgaa

SEQ ID NO: 259644 - DNA, 20 bp, Artificial
  CRISPR gRNA sequence
aggtggcagctggtatgaaa

SEQ ID NO: 259645 - DNA, 20 bp, Artificial
  CRISPR gRNA sequence
ctggtatgaaagggtcaaac

SEQ ID NO: 259646 - DNA, 20 bp, Artificial
  CRISPR gRNA sequence
tggtatgaaagggtcaaaca

SEQ ID NO: 259647 - DNA, 20 bp, Artificial
  CRISPR gRNA sequence
gaaagggtcaaacaaggcat

SEQ ID NO: 259648 - DNA, 20 bp, Artificial
  CRISPR gRNA sequence
tcaaacaaggcattggtgct

SEQ ID NO: 259649 - DNA, 20 bp, Artificial
  CRISPR gRNA sequence
ggcattggtgctcagtttta

SEQ ID NO: 259650 - DNA, 20 bp, Artificial
  CRISPR gRNA sequence
tgctcagttttacagactga

SEQ ID NO: 259651 - DNA, 20 bp, Artificial
  CRISPR gRNA sequence
ttttacagactgatggtgaa

SEQ ID NO: 259652 - DNA, 20 bp, Artificial
  CRISPR gRNA sequence
tttacagactgatggtgaac

SEQ ID NO: 259653 - DNA, 20 bp, Artificial
  CRISPR gRNA sequence
agactgatggtgaacaggaa

SEQ ID NO: 259654 - DNA, 20 bp, Artificial
  CRISPR gRNA sequence
aacaggaatggaaaccgacc

SEQ ID NO: 259655 - DNA, 20 bp, Artificial
  CRISPR gRNA sequence
caggaatggaaaccgaccca

SEQ ID NO: 259656 - DNA, 20 bp, Artificial
  CRISPR gRNA sequence
ccgacccagagttcacgcac

SEQ ID NO: 259657 - DNA, 20 bp, Artificial
  CRISPR gRNA sequence
cgacccagagttcacgcact

SEQ ID NO: 259658 - DNA, 20 bp, Artificial
  CRISPR gRNA sequence
ccagagttcacgcactgggt

SEQ ID NO: 259659 - DNA, 20 bp, Artificial
  CRISPR gRNA sequence
cagagttcacgcactgggta

SEQ ID NO: 259660 - DNA, 20 bp, Artificial
  CRISPR gRNA sequence
agagttcacgcactgggtaa

SEQ ID NO: 259661 - DNA, 20 bp, Artificial
  CRISPR gRNA sequence
cacgcactgggtaagggtat

SEQ ID NO: 259662 - DNA, 20 bp, Artificial
  CRISPR gRNA sequence
gcactgggtaagggtatgag

SEQ ID NO: 259663 - DNA, 20 bp, Artificial
  CRISPR gRNA sequence
actgggtaagggtatgagtg

SEQ ID NO: 259664 - DNA, 20 bp, Artificial
  CRISPR gRNA sequence
ctgggtaagggtatgagtgg

SEQ ID NO: 259665 - DNA, 20 bp, Artificial
  CRISPR gRNA sequence
ggaggcaccattgacaaaat

SEQ ID NO: 259666 - DNA, 20 bp, Artificial
  CRISPR gRNA sequence
gaggcaccattgacaaaatg

SEQ ID NO: 259667 - DNA, 20 bp, Artificial
  CRISPR gRNA sequence
caccattgacaaaatgaggt

SEQ ID NO: 259668 - DNA, 20 bp, Artificial
  CRISPR gRNA sequence
ttgacaaaatgaggtaagtt

SEQ ID NO: 259669 - DNA, 20 bp, Artificial
  CRISPR gRNA sequence
gacaaaatgaggtaagttaa

SEQ ID NO: 259670 - DNA, 20 bp, Artificial
  CRISPR gRNA sequence
acaaaatgaggtaagttaag

SEQ ID NO: 259671 - DNA, 20 bp, Artificial
  CRISPR gRNA sequence
aagaggaaatttgttcatcc

SEQ ID NO: 259672 - DNA, 20 bp, Artificial
  CRISPR gRNA sequence
gaggaaatttgttcatcctg

SEQ ID NO: 259673 - DNA, 20 bp, Artificial
  CRISPR gRNA sequence
aggaaatttgttcatcctgg

SEQ ID NO: 259674 - DNA, 20 bp, Artificial
  CRISPR gRNA sequence
aatttgttcatcctggagga

SEQ ID NO: 259675 - DNA, 20 bp, Artificial
  CRISPR gRNA sequence
ttcatcctggaggaaagatc

SEQ ID NO: 259676 - DNA, 20 bp, Artificial
  CRISPR gRNA sequence
atcctggaggaaagatccag

SEQ ID NO: 259677 - DNA, 20 bp, Artificial
  CRISPR gRNA sequence
tcctggaggaaagatccaga

SEQ ID NO: 259678 - DNA, 20 bp, Artificial
  CRISPR gRNA sequence
ctggaggaaagatccagaag

SEQ ID NO: 259679 - DNA, 20 bp, Artificial
  CRISPR gRNA sequence
aggaaagatccagaaggagt

SEQ ID NO: 259680 - DNA, 20 bp, Artificial
  CRISPR gRNA sequence
aaagatccagaaggagttag

SEQ ID NO: 259681 - DNA, 20 bp, Artificial
  CRISPR gRNA sequence
tccagaaggagttagaagta

SEQ ID NO: 259682 - DNA, 20 bp, Artificial
  CRISPR gRNA sequence
ccagaaggagttagaagtat

SEQ ID NO: 259683 - DNA, 20 bp, Artificial
  CRISPR gRNA sequence
aggagttagaagtataggac

SEQ ID NO: 259684 - DNA, 20 bp, Artificial
  CRISPR gRNA sequence
gagttagaagtataggacta

SEQ ID NO: 259685 - DNA, 20 bp, Artificial
  CRISPR gRNA sequence
gaagtataggactagagttc

SEQ ID NO: 259686 - DNA, 20 bp, Artificial
  CRISPR gRNA sequence
aagtataggactagagttcg

SEQ ID NO: 259687 - DNA, 20 bp, Artificial
  CRISPR gRNA sequence
tataggactagagttcgagg

SEQ ID NO: 259688 - DNA, 20 bp, Artificial
  CRISPR gRNA sequence
ggactagagttcgaggaagc

SEQ ID NO: 259689 - DNA, 20 bp, Artificial
  CRISPR gRNA sequence
tagagttcgaggaagccagt

SEQ ID NO: 259690 - DNA, 20 bp, Artificial
  CRISPR gRNA sequence
agagttcgaggaagccagtt

SEQ ID NO: 259691 - DNA, 20 bp, Artificial
  CRISPR gRNA sequence
gagttcgaggaagccagttg

SEQ ID NO: 259692 - DNA, 20 bp, Artificial
  CRISPR gRNA sequence
tcgaggaagccagttgggga

SEQ ID NO: 259693 - DNA, 20 bp, Artificial
  CRISPR gRNA sequence
ttggggatagaaatgtacat

SEQ ID NO: 259694 - DNA, 20 bp, Artificial
  CRISPR gRNA sequence
tggggatagaaatgtacatt

SEQ ID NO: 259695 - DNA, 20 bp, Artificial
  CRISPR gRNA sequence
ggatagaaatgtacattagg

SEQ ID NO: 259696 - DNA, 20 bp, Artificial
  CRISPR gRNA sequence
attaggaagttcatatgtat

SEQ ID NO: 259697 - DNA, 20 bp, Artificial
  CRISPR gRNA sequence
ttaggaagttcatatgtatt

SEQ ID NO: 259698 - DNA, 20 bp, Artificial
  CRISPR gRNA sequence
gttcatatgtattaggatga

SEQ ID NO: 259699 - DNA, 20 bp, Artificial
  CRISPR gRNA sequence
tgtaacccatccctaccact

SEQ ID NO: 259700 - DNA, 20 bp, Artificial
  CRISPR gRNA sequence
taacccatccctaccactca

SEQ ID NO: 259701 - DNA, 20 bp, Artificial
  CRISPR gRNA sequence
taccactcagagacaccaca

SEQ ID NO: 259702 - DNA, 20 bp, Artificial
  CRISPR gRNA sequence
agagacaccacacagcaatg

SEQ ID NO: 259703 - DNA, 20 bp, Artificial
  CRISPR gRNA sequence
gagacaccacacagcaatgc

SEQ ID NO: 259704 - DNA, 20 bp, Artificial
  CRISPR gRNA sequence
cacacagcaatgcaggatgt

SEQ ID NO: 259705 - DNA, 20 bp, Artificial
  CRISPR gRNA sequence
aatgcaggatgtgagtgctc

SEQ ID NO: 259706 - DNA, 20 bp, Artificial
  CRISPR gRNA sequence
atgcaggatgtgagtgctct

SEQ ID NO: 259707 - DNA, 20 bp, Artificial
  CRISPR gRNA sequence
gaccaaaacttcctaaccca

SEQ ID NO: 259708 - DNA, 20 bp, Artificial
  CRISPR gRNA sequence
aacccaaagcaacataaact

SEQ ID NO: 259709 - DNA, 20 bp, Artificial
  CRISPR gRNA sequence
aagcaacataaactcagatg

SEQ ID NO: 259710 - DNA, 20 bp, Artificial
  CRISPR gRNA sequence
gacccaatccctaccgttca

SEQ ID NO: 259711 - DNA, 20 bp, Artificial
  CRISPR gRNA sequence
acccaatccctaccgttcac

SEQ ID NO: 259712 - DNA, 20 bp, Artificial
  CRISPR gRNA sequence
aatccctaccgttcacaggt

SEQ ID NO: 259713 - DNA, 20 bp, Artificial
  CRISPR gRNA sequence
atccctaccgttcacaggtc

SEQ ID NO: 259714 - DNA, 20 bp, Artificial
  CRISPR gRNA sequence
ttcctctgatctcctaatgt

SEQ ID NO: 259715 - DNA, 20 bp, Artificial
  CRISPR gRNA sequence
tctgatctcctaatgttaga

SEQ ID NO: 259716 - DNA, 20 bp, Artificial
  CRISPR gRNA sequence
taatgttagaaagacaatct

SEQ ID NO: 259717 - DNA, 20 bp, Artificial
  CRISPR gRNA sequence
aatgttagaaagacaatcta

SEQ ID NO: 259718 - DNA, 20 bp, Artificial
  CRISPR gRNA sequence
atgttagaaagacaatctaa

SEQ ID NO: 259719 - DNA, 20 bp, Artificial
  CRISPR gRNA sequence
tgttagaaagacaatctaag

SEQ ID NO: 259720 - DNA, 20 bp, Artificial
  CRISPR gRNA sequence
gacaatctaaggggacaaca

SEQ ID NO: 259721 - DNA, 20 bp, Artificial
  CRISPR gRNA sequence
atctaaggggacaacatagc

SEQ ID NO: 259722 - DNA, 20 bp, Artificial
  CRISPR gRNA sequence
ctaaggggacaacatagcaa

SEQ ID NO: 259723 - DNA, 20 bp, Artificial
  CRISPR gRNA sequence
gagcaccttaacttacatga

SEQ ID NO: 259724 - DNA, 20 bp, Artificial
  CRISPR gRNA sequence
caccttaacttacatgaaag

SEQ ID NO: 259725 - DNA, 20 bp, Artificial
  CRISPR gRNA sequence
atgaaagtggaacccatacc

SEQ ID NO: 259726 - DNA, 20 bp, Artificial
  CRISPR gRNA sequence
gaaagtggaacccataccaa

SEQ ID NO: 259727 - DNA, 20 bp, Artificial
  CRISPR gRNA sequence
gaacccataccaagagccac

SEQ ID NO: 259728 - DNA, 20 bp, Artificial
  CRISPR gRNA sequence
atcaaatctcactattctaa

SEQ ID NO: 259729 - DNA, 20 bp, Artificial
  CRISPR gRNA sequence
tcaaatctcactattctaaa

SEQ ID NO: 259730 - DNA, 20 bp, Artificial
  CRISPR gRNA sequence
ctattctaaaaggttgcctg

SEQ ID NO: 259731 - DNA, 20 bp, Artificial
  CRISPR gRNA sequence
aaggttgcctgtagtctaaa

SEQ ID NO: 259732 - DNA, 20 bp, Artificial
  CRISPR gRNA sequence
aggttgcctgtagtctaaat

SEQ ID NO: 259733 - DNA, 20 bp, Artificial
  CRISPR gRNA sequence
gttgcctgtagtctaaatag

SEQ ID NO: 259734 - DNA, 20 bp, Artificial
  CRISPR gRNA sequence
ttgcctgtagtctaaatagg

SEQ ID NO: 259735 - DNA, 20 bp, Artificial
  CRISPR gRNA sequence
tagtctaaataggaggtaac

SEQ ID NO: 259736 - DNA, 20 bp, Artificial
  CRISPR gRNA sequence
agtctaaataggaggtaacc

SEQ ID NO: 259737 - DNA, 20 bp, Artificial
  CRISPR gRNA sequence
gtctaaataggaggtaacca

SEQ ID NO: 259738 - DNA, 20 bp, Artificial
  CRISPR gRNA sequence
aggaggtaaccagggaatta

SEQ ID NO: 259739 - DNA, 20 bp, Artificial
  CRISPR gRNA sequence
tctgtacatatatattatta

SEQ ID NO: 259740 - DNA, 20 bp, Artificial
  CRISPR gRNA sequence
tatatattattatagtaatt

SEQ ID NO: 259741 - DNA, 20 bp, Artificial
  CRISPR gRNA sequence
tattatagtaattcagttaa

SEQ ID NO: 259742 - DNA, 20 bp, Artificial
  CRISPR gRNA sequence
taattcagttaacggatcaa

SEQ ID NO: 259743 - DNA, 20 bp, Artificial
  CRISPR gRNA sequence
acggatcaaaagaaaaccca

SEQ ID NO: 259744 - DNA, 20 bp, Artificial
  CRISPR gRNA sequence
cggatcaaaagaaaacccac

SEQ ID NO: 259745 - DNA, 20 bp, Artificial
  CRISPR gRNA sequence
aaagaaaacccacaggtata

SEQ ID NO: 259746 - DNA, 20 bp, Artificial
  CRISPR gRNA sequence
agaaaacccacaggtataaa

SEQ ID NO: 259747 - DNA, 20 bp, Artificial
  CRISPR gRNA sequence
tctaaatatatgttttaatc

SEQ ID NO: 259748 - DNA, 20 bp, Artificial
  CRISPR gRNA sequence
ttaatctagtaaccaaattt

SEQ ID NO: 259749 - DNA, 20 bp, Artificial
  CRISPR gRNA sequence
aatctagtaaccaaatttga

SEQ ID NO: 259750 - DNA, 20 bp, Artificial
  CRISPR gRNA sequence
gagagccatattttcctcct

SEQ ID NO: 259751 - DNA, 20 bp, Artificial
  CRISPR gRNA sequence
ttcaaaacaactctgtgatg

SEQ ID NO: 259752 - DNA, 20 bp, Artificial
  CRISPR gRNA sequence
caactctgtgatgaagacaa

SEQ ID NO: 259753 - DNA, 20 bp, Artificial
  CRISPR gRNA sequence
gcctaaatcacatacctctg

SEQ ID NO: 259754 - DNA, 20 bp, Artificial
  CRISPR gRNA sequence
atacctctgaagaatctgct

SEQ ID NO: 259755 - DNA, 20 bp, Artificial
  CRISPR gRNA sequence
tacctctgaagaatctgctc

SEQ ID NO: 259756 - DNA, 20 bp, Artificial
  CRISPR gRNA sequence
caggatcaccttgtcatata

SEQ ID NO: 259757 - DNA, 20 bp, Artificial
  CRISPR gRNA sequence
cttgtcatatacagaacctc

SEQ ID NO: 259758 - DNA, 20 bp, Artificial
  CRISPR gRNA sequence
ttgtcatatacagaacctcc

SEQ ID NO: 259759 - DNA, 20 bp, Artificial
  CRISPR gRNA sequence
gaacctccaggtaaatgtca

SEQ ID NO: 259760 - DNA, 20 bp, Artificial
  CRISPR gRNA sequence
tccaggtaaatgtcatggcc

SEQ ID NO: 259761 - DNA, 20 bp, Artificial
  CRISPR gRNA sequence
aggtaaatgtcatggcccag

SEQ ID NO: 259762 - DNA, 20 bp, Artificial
  CRISPR gRNA sequence
agtttaaataattactgtgt

SEQ ID NO: 259763 - DNA, 20 bp, Artificial
  CRISPR gRNA sequence
tgttggaccttaacattgca

SEQ ID NO: 259764 - DNA, 20 bp, Artificial
  CRISPR gRNA sequence
gttggaccttaacattgcat

SEQ ID NO: 259765 - DNA, 20 bp, Artificial
  CRISPR gRNA sequence
cttaacattgcataggaaaa

SEQ ID NO: 259766 - DNA, 20 bp, Artificial
  CRISPR gRNA sequence
ttaacattgcataggaaaac

SEQ ID NO: 259767 - DNA, 20 bp, Artificial
  CRISPR gRNA sequence
aacattgcataggaaaacag

SEQ ID NO: 259768 - DNA, 20 bp, Artificial
  CRISPR gRNA sequence
ttgcataggaaaacaggaga

SEQ ID NO: 259769 - DNA, 20 bp, Artificial
  CRISPR gRNA sequence
taggaaaacaggagatagca

SEQ ID NO: 259770 - DNA, 20 bp, Artificial
  CRISPR gRNA sequence
aggaaaacaggagatagcaa

SEQ ID NO: 259771 - DNA, 20 bp, Artificial
  CRISPR gRNA sequence
aaaacaggagatagcaaagg

SEQ ID NO: 259772 - DNA, 20 bp, Artificial
  CRISPR gRNA sequence
aaggcagcattgccccctca

SEQ ID NO: 259773 - DNA, 20 bp, Artificial
  CRISPR gRNA sequence
agcattgccccctcaaagtc

SEQ ID NO: 259774 - DNA, 20 bp, Artificial
  CRISPR gRNA sequence
attgccccctcaaagtccag

SEQ ID NO: 259775 - DNA, 20 bp, Artificial
  CRISPR gRNA sequence
aaagtccagcagtcatttct

SEQ ID NO: 259776 - DNA, 20 bp, Artificial
  CRISPR gRNA sequence
gcagtcatttctaagcacat

SEQ ID NO: 259777 - DNA, 20 bp, Artificial
  CRISPR gRNA sequence
gtcatttctaagcacattag

SEQ ID NO: 259778 - DNA, 20 bp, Artificial
  CRISPR gRNA sequence
ctaagcacattagcagcatt

SEQ ID NO: 259779 - DNA, 20 bp, Artificial
  CRISPR gRNA sequence
taagcacattagcagcattt

SEQ ID NO: 259780 - DNA, 20 bp, Artificial
  CRISPR gRNA sequence
attagcagcatttaggatcc

SEQ ID NO: 259781 - DNA, 20 bp, Artificial
  CRISPR gRNA sequence
gcagcatttaggatcctggt

SEQ ID NO: 259782 - DNA, 20 bp, Artificial
  CRISPR gRNA sequence
tcctggttagcaatccctgc

SEQ ID NO: 259783 - DNA, 20 bp, Artificial
  CRISPR gRNA sequence
cctggttagcaatccctgca

SEQ ID NO: 259784 - DNA, 20 bp, Artificial
  CRISPR gRNA sequence
ctggttagcaatccctgcaa

SEQ ID NO: 259785 - DNA, 20 bp, Artificial
  CRISPR gRNA sequence
gcaatccctgcaagggattt

SEQ ID NO: 259786 - DNA, 20 bp, Artificial
  CRISPR gRNA sequence
aatccctgcaagggatttca

SEQ ID NO: 259787 - DNA, 20 bp, Artificial
  CRISPR gRNA sequence
cctgcaagggatttcagaga

SEQ ID NO: 259788 - DNA, 20 bp, Artificial
  CRISPR gRNA sequence
caagggatttcagagatggc

SEQ ID NO: 259789 - DNA, 20 bp, Artificial
  CRISPR gRNA sequence
atttcttgtatttgctctat

SEQ ID NO: 259790 - DNA, 20 bp, Artificial
  CRISPR gRNA sequence
tttcttgtatttgctctatc

SEQ ID NO: 259791 - DNA, 20 bp, Artificial
  CRISPR gRNA sequence
tatttgctctatcaggtcat

SEQ ID NO: 259792 - DNA, 20 bp, Artificial
  CRISPR gRNA sequence
tttgctctatcaggtcataa

SEQ ID NO: 259793 - DNA, 20 bp, Artificial
  CRISPR gRNA sequence
caggtcataagagcatccac

SEQ ID NO: 259794 - DNA, 20 bp, Artificial
  CRISPR gRNA sequence
aggtcataagagcatccaca

SEQ ID NO: 259795 - DNA, 20 bp, Artificial
  CRISPR gRNA sequence
ggtcataagagcatccacaa

SEQ ID NO: 259796 - DNA, 20 bp, Artificial
  CRISPR gRNA sequence
gtcataagagcatccacaag

SEQ ID NO: 259797 - DNA, 20 bp, Artificial
  CRISPR gRNA sequence
taagagcatccacaagggga

SEQ ID NO: 259798 - DNA, 20 bp, Artificial
  CRISPR gRNA sequence
aagagcatccacaaggggat

SEQ ID NO: 259799 - DNA, 20 bp, Artificial
  CRISPR gRNA sequence
agagcatccacaaggggatg

SEQ ID NO: 259800 - DNA, 20 bp, Artificial
  CRISPR gRNA sequence
gcatccacaaggggatgggg

SEQ ID NO: 259801 - DNA, 20 bp, Artificial
  CRISPR gRNA sequence
cacaaggggatggggtagtt

SEQ ID NO: 259802 - DNA, 20 bp, Artificial
  CRISPR gRNA sequence
gggtagttgagctgccttgt

SEQ ID NO: 259803 - DNA, 20 bp, Artificial
  CRISPR gRNA sequence
tgccttgttagacccgacaa

SEQ ID NO: 259804 - DNA, 20 bp, Artificial
  CRISPR gRNA sequence
ttgttagacccgacaaaagt

SEQ ID NO: 259805 - DNA, 20 bp, Artificial
  CRISPR gRNA sequence
ctttttaaaaaattccactt

SEQ ID NO: 259806 - DNA, 20 bp, Artificial
  CRISPR gRNA sequence
tttaaaaaattccacttcag

SEQ ID NO: 259807 - DNA, 20 bp, Artificial
  CRISPR gRNA sequence
tccacttcagaagcactttt

SEQ ID NO: 259808 - DNA, 20 bp, Artificial
  CRISPR gRNA sequence
cttcagaagcacttttaagc

SEQ ID NO: 259809 - DNA, 20 bp, Artificial
  CRISPR gRNA sequence
agaagcacttttaagccaga

SEQ ID NO: 259810 - DNA, 20 bp, Artificial
  CRISPR gRNA sequence
agcacttttaagccagaaag

SEQ ID NO: 259811 - DNA, 20 bp, Artificial
  CRISPR gRNA sequence
ttaagccagaaagtagacct

SEQ ID NO: 259812 - DNA, 20 bp, Artificial
  CRISPR gRNA sequence
agtagacctgagatatcctc

SEQ ID NO: 259813 - DNA, 20 bp, Artificial
  CRISPR gRNA sequence
agcccaaactcttcatgtat

SEQ ID NO: 259814 - DNA, 20 bp, Artificial
  CRISPR gRNA sequence
aactcttcatgtatcagatg

SEQ ID NO: 259815 - DNA, 20 bp, Artificial
  CRISPR gRNA sequence
atgtatcagatgaagaaacc

SEQ ID NO: 259816 - DNA, 20 bp, Artificial
  CRISPR gRNA sequence
tgtatcagatgaagaaaccg

SEQ ID NO: 259817 - DNA, 20 bp, Artificial
  CRISPR gRNA sequence
cagatgaagaaaccgaggcc

SEQ ID NO: 259818 - DNA, 20 bp, Artificial
  CRISPR gRNA sequence
gaagaaaccgaggcctagaa

SEQ ID NO: 259819 - DNA, 20 bp, Artificial
  CRISPR gRNA sequence
ggcctagaaaagttctgtca

SEQ ID NO: 259820 - DNA, 20 bp, Artificial
  CRISPR gRNA sequence
aaagttctgtcacagtatga

SEQ ID NO: 259821 - DNA, 20 bp, Artificial
  CRISPR gRNA sequence
ctaatcacatcccccacctt

SEQ ID NO: 259822 - DNA, 20 bp, Artificial
  CRISPR gRNA sequence
cccccaccttgagaaatcct

SEQ ID NO: 259823 - DNA, 20 bp, Artificial
  CRISPR gRNA sequence
ccccaccttgagaaatcctt

SEQ ID NO: 259824 - DNA, 20 bp, Artificial
  CRISPR gRNA sequence
ccttgagaaatccttgggat

SEQ ID NO: 259825 - DNA, 20 bp, Artificial
  CRISPR gRNA sequence
aatccttgggattagctttt

SEQ ID NO: 259826 - DNA, 20 bp, Artificial
  CRISPR gRNA sequence
ttagcttttgagtttgaaaa

SEQ ID NO: 259827 - DNA, 20 bp, Artificial
  CRISPR gRNA sequence
agcttttgagtttgaaaaaa

SEQ ID NO: 259828 - DNA, 20 bp, Artificial
  CRISPR gRNA sequence
cttttgagtttgaaaaaaga

SEQ ID NO: 259829 - DNA, 20 bp, Artificial
  CRISPR gRNA sequence
ttttgagtttgaaaaaagag

SEQ ID NO: 259830 - DNA, 20 bp, Artificial
  CRISPR gRNA sequence
tttgagtttgaaaaaagaga

SEQ ID NO: 259831 - DNA, 20 bp, Artificial
  CRISPR gRNA sequence
tttgaaaaaagagagggcaa

SEQ ID NO: 259832 - DNA, 20 bp, Artificial
  CRISPR gRNA sequence
aaaaagagagggcaaaagaa

SEQ ID NO: 259833 - DNA, 20 bp, Artificial
  CRISPR gRNA sequence
aagagagggcaaaagaatag

SEQ ID NO: 259834 - DNA, 20 bp, Artificial
  CRISPR gRNA sequence
agggcaaaagaatagcggac

SEQ ID NO: 259835 - DNA, 20 bp, Artificial
  CRISPR gRNA sequence
aatagcggactggcctcccc

SEQ ID NO: 259836 - DNA, 20 bp, Artificial
  CRISPR gRNA sequence
cggactggcctccccaagcc

SEQ ID NO: 259837 - DNA, 20 bp, Artificial
  CRISPR gRNA sequence
ggactggcctccccaagcca

SEQ ID NO: 259838 - DNA, 20 bp, Artificial
  CRISPR gRNA sequence
ggcctccccaagccaaggtc

SEQ ID NO: 259839 - DNA, 20 bp, Artificial
  CRISPR gRNA sequence
tatccttgttccaaaacaca

SEQ ID NO: 259840 - DNA, 20 bp, Artificial
  CRISPR gRNA sequence
atccttgttccaaaacacac

SEQ ID NO: 259841 - DNA, 20 bp, Artificial
  CRISPR gRNA sequence
tccttgttccaaaacacaca

SEQ ID NO: 259842 - DNA, 20 bp, Artificial
  CRISPR gRNA sequence
aaaacacacagggaaatgct

SEQ ID NO: 259843 - DNA, 20 bp, Artificial
  CRISPR gRNA sequence
ctaagattaacatccctgac

SEQ ID NO: 259844 - DNA, 20 bp, Artificial
  CRISPR gRNA sequence
taacatccctgactggaaac

SEQ ID NO: 259845 - DNA, 20 bp, Artificial
  CRISPR gRNA sequence
acatccctgactggaaacta

SEQ ID NO: 259846 - DNA, 20 bp, Artificial
  CRISPR gRNA sequence
tagagtcccgcccataatgt

SEQ ID NO: 259847 - DNA, 20 bp, Artificial
  CRISPR gRNA sequence
agagtcccgcccataatgtt

SEQ ID NO: 259848 - DNA, 20 bp, Artificial
  CRISPR gRNA sequence
gtcccgcccataatgttggg

SEQ ID NO: 259849 - DNA, 20 bp, Artificial
  CRISPR gRNA sequence
tcccgcccataatgttgggc

SEQ ID NO: 259850 - DNA, 20 bp, Artificial
  CRISPR gRNA sequence
cccgcccataatgttgggca

SEQ ID NO: 259851 - DNA, 20 bp, Artificial
  CRISPR gRNA sequence
cccataatgttgggcagggt

SEQ ID NO: 259852 - DNA, 20 bp, Artificial
  CRISPR gRNA sequence
accctgtgaccctgtgatct

SEQ ID NO: 259853 - DNA, 20 bp, Artificial
  CRISPR gRNA sequence
gaccctgtgatctcagccgt

SEQ ID NO: 259854 - DNA, 20 bp, Artificial
  CRISPR gRNA sequence
tgtgatctcagccgtgagct

SEQ ID NO: 259855 - DNA, 20 bp, Artificial
  CRISPR gRNA sequence
gtgatctcagccgtgagctg

SEQ ID NO: 259856 - DNA, 20 bp, Artificial
  CRISPR gRNA sequence
ctcagccgtgagctgaggtc

SEQ ID NO: 259857 - DNA, 20 bp, Artificial
  CRISPR gRNA sequence
ccgtgagctgaggtcaagcc

SEQ ID NO: 259858 - DNA, 20 bp, Artificial
  CRISPR gRNA sequence
gctgaggtcaagcctagcca

SEQ ID NO: 259859 - DNA, 20 bp, Artificial
  CRISPR gRNA sequence
tagccatagtgtgcattgtt

SEQ ID NO: 259860 - DNA, 20 bp, Artificial
  CRISPR gRNA sequence
agccatagtgtgcattgttg

SEQ ID NO: 259861 - DNA, 20 bp, Artificial
  CRISPR gRNA sequence
gtgtgcattgttgaggactc

SEQ ID NO: 259862 - DNA, 20 bp, Artificial
  CRISPR gRNA sequence
gcattgttgaggactcaagc

SEQ ID NO: 259863 - DNA, 20 bp, Artificial
  CRISPR gRNA sequence
aggactcaagcaagaattta

SEQ ID NO: 259864 - DNA, 20 bp, Artificial
  CRISPR gRNA sequence
gcaagaatttaaagtacaca

SEQ ID NO: 259865 - DNA, 20 bp, Artificial
  CRISPR gRNA sequence
caagaatttaaagtacacat

SEQ ID NO: 259866 - DNA, 20 bp, Artificial
  CRISPR gRNA sequence
atttaaagtacacatgggca

SEQ ID NO: 259867 - DNA, 20 bp, Artificial
  CRISPR gRNA sequence
gtacacatgggcaaagtctt

SEQ ID NO: 259868 - DNA, 20 bp, Artificial
  CRISPR gRNA sequence
acacatgggcaaagtcttca

SEQ ID NO: 259869 - DNA, 20 bp, Artificial
  CRISPR gRNA sequence
acatgggcaaagtcttcaga

SEQ ID NO: 259870 - DNA, 20 bp, Artificial
  CRISPR gRNA sequence
tgggcaaagtcttcagagag

SEQ ID NO: 259871 - DNA, 20 bp, Artificial
  CRISPR gRNA sequence
gggcaaagtcttcagagaga

SEQ ID NO: 259872 - DNA, 20 bp, Artificial
  CRISPR gRNA sequence
gagagaaggcatgtattacc

SEQ ID NO: 259873 - DNA, 20 bp, Artificial
  CRISPR gRNA sequence
agaaggcatgtattacccag

SEQ ID NO: 259874 - DNA, 20 bp, Artificial
  CRISPR gRNA sequence
cccagtagcccttgttgata

SEQ ID NO: 259875 - DNA, 20 bp, Artificial
  CRISPR gRNA sequence
ccagtagcccttgttgatat

SEQ ID NO: 259876 - DNA, 20 bp, Artificial
  CRISPR gRNA sequence
ttaacatcatgacctactct

SEQ ID NO: 259877 - DNA, 20 bp, Artificial
  CRISPR gRNA sequence
aacatcatgacctactctga

SEQ ID NO: 259878 - DNA, 20 bp, Artificial
  CRISPR gRNA sequence
gatttgtttgtttttaacct

SEQ ID NO: 259879 - DNA, 20 bp, Artificial
  CRISPR gRNA sequence
atttgtttgtttttaacctc

SEQ ID NO: 259880 - DNA, 20 bp, Artificial
  CRISPR gRNA sequence
gtttttaacctcaggttcac

SEQ ID NO: 259881 - DNA, 20 bp, Artificial
  CRISPR gRNA sequence
taacctcaggttcaccagta

SEQ ID NO: 259882 - DNA, 20 bp, Artificial
  CRISPR gRNA sequence
atagaatcactcatctacca

SEQ ID NO: 259883 - DNA, 20 bp, Artificial
  CRISPR gRNA sequence
taacttatctctacccctat

SEQ ID NO: 259884 - DNA, 20 bp, Artificial
  CRISPR gRNA sequence
tctcttcctccctatcttct

SEQ ID NO: 259885 - DNA, 20 bp, Artificial
  CRISPR gRNA sequence
tcttcctccctatcttctta

SEQ ID NO: 259886 - DNA, 20 bp, Artificial
  CRISPR gRNA sequence
atctccctccctatctcctt

SEQ ID NO: 259887 - DNA, 20 bp, Artificial
  CRISPR gRNA sequence
taatacccttctctaccctc

SEQ ID NO: 259888 - DNA, 20 bp, Artificial
  CRISPR gRNA sequence
ctccctctctctctctctct

SEQ ID NO: 259889 - DNA, 20 bp, Artificial
  CRISPR gRNA sequence
tccctctctctctctctctc

SEQ ID NO: 259890 - DNA, 20 bp, Artificial
  CRISPR gRNA sequence
ctctctctctctctcaggtc

SEQ ID NO: 259891 - DNA, 20 bp, Artificial
  CRISPR gRNA sequence
tctctctcaggtccagcact

SEQ ID NO: 259892 - DNA, 20 bp, Artificial
  CRISPR gRNA sequence
tccacatgtcaaacatactt

SEQ ID NO: 259893 - DNA, 20 bp, Artificial
  CRISPR gRNA sequence
tcaaacatacttaagtcact

SEQ ID NO: 259894 - DNA, 20 bp, Artificial
  CRISPR gRNA sequence
attacatgcacaaaatacca

SEQ ID NO: 259895 - DNA, 20 bp, Artificial
  CRISPR gRNA sequence
acatgcacaaaataccatgg

SEQ ID NO: 259896 - DNA, 20 bp, Artificial
  CRISPR gRNA sequence
aaataccatggtagacattt

SEQ ID NO: 259897 - DNA, 20 bp, Artificial
  CRISPR gRNA sequence
aataccatggtagacatttt

SEQ ID NO: 259898 - DNA, 20 bp, Artificial
  CRISPR gRNA sequence
gtagacattttaggtgatat

SEQ ID NO: 259899 - DNA, 20 bp, Artificial
  CRISPR gRNA sequence
cactttttcttaatcctgtg

SEQ ID NO: 259900 - DNA, 20 bp, Artificial
  CRISPR gRNA sequence
atgtctctgcctaaactcaa

SEQ ID NO: 259901 - DNA, 20 bp, Artificial
  CRISPR gRNA sequence
ctgcctaaactcaaaagtcc

SEQ ID NO: 259902 - DNA, 20 bp, Artificial
  CRISPR gRNA sequence
tgcctaaactcaaaagtccc

SEQ ID NO: 259903 - DNA, 20 bp, Artificial
  CRISPR gRNA sequence
ctaaactcaaaagtcccagg

SEQ ID NO: 259904 - DNA, 20 bp, Artificial
  CRISPR gRNA sequence
aaaagtcccaggtggcgttt

SEQ ID NO: 259905 - DNA, 20 bp, Artificial
  CRISPR gRNA sequence
tggcgtttcagccaaatccc

SEQ ID NO: 259906 - DNA, 20 bp, Artificial
  CRISPR gRNA sequence
tttgaaactctttccctcat

SEQ ID NO: 259907 - DNA, 20 bp, Artificial
  CRISPR gRNA sequence
aactctttccctcattggct

SEQ ID NO: 259908 - DNA, 20 bp, Artificial
  CRISPR gRNA sequence
tctttccctcattggcttag

SEQ ID NO: 259909 - DNA, 20 bp, Artificial
  CRISPR gRNA sequence
ttggcttagtggcattccac

SEQ ID NO: 259910 - DNA, 20 bp, Artificial
  CRISPR gRNA sequence
actttctttgtctccttcac

SEQ ID NO: 259911 - DNA, 20 bp, Artificial
  CRISPR gRNA sequence
cactagctaaccatcctttt

SEQ ID NO: 259912 - DNA, 20 bp, Artificial
  CRISPR gRNA sequence
ccttttcagctgactcccat

SEQ ID NO: 259913 - DNA, 20 bp, Artificial
  CRISPR gRNA sequence
ttttcagctgactcccatca

SEQ ID NO: 259914 - DNA, 20 bp, Artificial
  CRISPR gRNA sequence
cagctgactcccatcagagc

SEQ ID NO: 259915 - DNA, 20 bp, Artificial
  CRISPR gRNA sequence
tgactcccatcagagccagt

SEQ ID NO: 259916 - DNA, 20 bp, Artificial
  CRISPR gRNA sequence
catcagagccagttagtttc

SEQ ID NO: 259917 - DNA, 20 bp, Artificial
  CRISPR gRNA sequence
agccagttagtttccagatt

SEQ ID NO: 259918 - DNA, 20 bp, Artificial
  CRISPR gRNA sequence
ctccactctctgtttttcta

SEQ ID NO: 259919 - DNA, 20 bp, Artificial
  CRISPR gRNA sequence
ttatgccctctcctttcgac

SEQ ID NO: 259920 - DNA, 20 bp, Artificial
  CRISPR gRNA sequence
gccatccattcccataactc

SEQ ID NO: 259921 - DNA, 20 bp, Artificial
  CRISPR gRNA sequence
ataactccagcttcattcca

SEQ ID NO: 259922 - DNA, 20 bp, Artificial
  CRISPR gRNA sequence
tccagcttcattccaaagat

SEQ ID NO: 259923 - DNA, 20 bp, Artificial
  CRISPR gRNA sequence
ccagcttcattccaaagata

SEQ ID NO: 259924 - DNA, 20 bp, Artificial
  CRISPR gRNA sequence
tgaaatattttcttcttacc

SEQ ID NO: 259925 - DNA, 20 bp, Artificial
  CRISPR gRNA sequence
gaaatattttcttcttaccc

SEQ ID NO: 259926 - DNA, 20 bp, Artificial
  CRISPR gRNA sequence
ttcaaaatgacttgaaaata

SEQ ID NO: 259927 - DNA, 20 bp, Artificial
  CRISPR gRNA sequence
aaagtttgaatttctgttac

SEQ ID NO: 259928 - DNA, 20 bp, Artificial
  CRISPR gRNA sequence
ccagtattctatcctttgct

SEQ ID NO: 259929 - DNA, 20 bp, Artificial
  CRISPR gRNA sequence
tattctatcctttgcttagc

SEQ ID NO: 259930 - DNA, 20 bp, Artificial
  CRISPR gRNA sequence
tcaccataacctcacacatt

SEQ ID NO: 259931 - DNA, 20 bp, Artificial
  CRISPR gRNA sequence
accataacctcacacattca

SEQ ID NO: 259932 - DNA, 20 bp, Artificial
  CRISPR gRNA sequence
tcagagttgccatctgttct

SEQ ID NO: 259933 - DNA, 20 bp, Artificial
  CRISPR gRNA sequence
tctgttctgagaacatgaaa

SEQ ID NO: 259934 - DNA, 20 bp, Artificial
  CRISPR gRNA sequence
agaacatgaaacagtattcc

SEQ ID NO: 259935 - DNA, 20 bp, Artificial
  CRISPR gRNA sequence
taatccaccttttccttcct

SEQ ID NO: 259936 - DNA, 20 bp, Artificial
  CRISPR gRNA sequence
ttttccttcctgagacaaca

SEQ ID NO: 259937 - DNA, 20 bp, Artificial
  CRISPR gRNA sequence
ttcctgagacaacacagcat

SEQ ID NO: 259938 - DNA, 20 bp, Artificial
  CRISPR gRNA sequence
tgagacaacacagcattggt

SEQ ID NO: 259939 - DNA, 20 bp, Artificial
  CRISPR gRNA sequence
attggtaagaacatgaaccc

SEQ ID NO: 259940 - DNA, 20 bp, Artificial
  CRISPR gRNA sequence
tggtaagaacatgaacccca

SEQ ID NO: 259941 - DNA, 20 bp, Artificial
  CRISPR gRNA sequence
aagaacatgaaccccagagc

SEQ ID NO: 259942 - DNA, 20 bp, Artificial
  CRISPR gRNA sequence
aaccccagagcaagaccatc

SEQ ID NO: 259943 - DNA, 20 bp, Artificial
  CRISPR gRNA sequence
accatctggatttacatact

SEQ ID NO: 259944 - DNA, 20 bp, Artificial
  CRISPR gRNA sequence
atctggatttacatacttag

SEQ ID NO: 259945 - DNA, 20 bp, Artificial
  CRISPR gRNA sequence
cttagtagctttgtgaccat

SEQ ID NO: 259946 - DNA, 20 bp, Artificial
  CRISPR gRNA sequence
gtagctttgtgaccataagc

SEQ ID NO: 259947 - DNA, 20 bp, Artificial
  CRISPR gRNA sequence
gctctacccactctgtgctt

SEQ ID NO: 259948 - DNA, 20 bp, Artificial
  CRISPR gRNA sequence
cagtttccccatctatgaaa

SEQ ID NO: 259949 - DNA, 20 bp, Artificial
  CRISPR gRNA sequence
tctatgaaatagtataatca

SEQ ID NO: 259950 - DNA, 20 bp, Artificial
  CRISPR gRNA sequence
tagtataatcatagcaatca

SEQ ID NO: 259951 - DNA, 20 bp, Artificial
  CRISPR gRNA sequence
caatcatagtaactacctca

SEQ ID NO: 259952 - DNA, 20 bp, Artificial
  CRISPR gRNA sequence
aatcatagtaactacctcat

SEQ ID NO: 259953 - DNA, 20 bp, Artificial
  CRISPR gRNA sequence
agtaactacctcataggact

SEQ ID NO: 259954 - DNA, 20 bp, Artificial
  CRISPR gRNA sequence
taactacctcataggacttg

SEQ ID NO: 259955 - DNA, 20 bp, Artificial
  CRISPR gRNA sequence
acctcataggacttggagat

SEQ ID NO: 259956 - DNA, 20 bp, Artificial
  CRISPR gRNA sequence
ggagattagatgacttaata

SEQ ID NO: 259957 - DNA, 20 bp, Artificial
  CRISPR gRNA sequence
gagattagatgacttaatac

SEQ ID NO: 259958 - DNA, 20 bp, Artificial
  CRISPR gRNA sequence
agattagatgacttaataca

SEQ ID NO: 259959 - DNA, 20 bp, Artificial
  CRISPR gRNA sequence
tagatgacttaatacaggga

SEQ ID NO: 259960 - DNA, 20 bp, Artificial
  CRISPR gRNA sequence
tgacttaatacagggaaagc

SEQ ID NO: 259961 - DNA, 20 bp, Artificial
  CRISPR gRNA sequence
gacttaatacagggaaagcc

SEQ ID NO: 259962 - DNA, 20 bp, Artificial
  CRISPR gRNA sequence
ttaatacagggaaagccagg

SEQ ID NO: 259963 - DNA, 20 bp, Artificial
  CRISPR gRNA sequence
aagccaggcagaacactacc

SEQ ID NO: 259964 - DNA, 20 bp, Artificial
  CRISPR gRNA sequence
aacactacctggcacattat

SEQ ID NO: 259965 - DNA, 20 bp, Artificial
  CRISPR gRNA sequence
tataagtgcaaaataaatgt

SEQ ID NO: 259966 - DNA, 20 bp, Artificial
  CRISPR gRNA sequence
agtgcaaaataaatgttagc

SEQ ID NO: 259967 - DNA, 20 bp, Artificial
  CRISPR gRNA sequence
ttcaaatcttgtctactgtc

SEQ ID NO: 259968 - DNA, 20 bp, Artificial
  CRISPR gRNA sequence
ctaattcccaactctccata

SEQ ID NO: 259969 - DNA, 20 bp, Artificial
  CRISPR gRNA sequence
taattcccaactctccataa

SEQ ID NO: 259970 - DNA, 20 bp, Artificial
  CRISPR gRNA sequence
cctttctacattaatcttac

SEQ ID NO: 259971 - DNA, 20 bp, Artificial
  CRISPR gRNA sequence
ttcttcaacaaatatttatt

SEQ ID NO: 259972 - DNA, 20 bp, Artificial
  CRISPR gRNA sequence
attgagtaactatatgctta

SEQ ID NO: 259973 - DNA, 20 bp, Artificial
  CRISPR gRNA sequence
ttacagcattgtgcctaata

SEQ ID NO: 259974 - DNA, 20 bp, Artificial
  CRISPR gRNA sequence
acagcattgtgcctaataca

SEQ ID NO: 259975 - DNA, 20 bp, Artificial
  CRISPR gRNA sequence
cagcattgtgcctaatacag

SEQ ID NO: 259976 - DNA, 20 bp, Artificial
  CRISPR gRNA sequence
attgtgcctaatacagaggt

SEQ ID NO: 259977 - DNA, 20 bp, Artificial
  CRISPR gRNA sequence
gtgcctaatacagaggttag

SEQ ID NO: 259978 - DNA, 20 bp, Artificial
  CRISPR gRNA sequence
tgcctaatacagaggttaga

SEQ ID NO: 259979 - DNA, 20 bp, Artificial
  CRISPR gRNA sequence
cagaggttagaaggatgaat

SEQ ID NO: 259980 - DNA, 20 bp, Artificial
  CRISPR gRNA sequence
taagacatgattctgccctc

SEQ ID NO: 259981 - DNA, 20 bp, Artificial
  CRISPR gRNA sequence
aagacatgattctgccctca

SEQ ID NO: 259982 - DNA, 20 bp, Artificial
  CRISPR gRNA sequence
gacatgattctgccctcaag

SEQ ID NO: 259983 - DNA, 20 bp, Artificial
  CRISPR gRNA sequence
ttctgccctcaaggagttca

SEQ ID NO: 259984 - DNA, 20 bp, Artificial
  CRISPR gRNA sequence
ccctcaaggagttcatagtc

SEQ ID NO: 259985 - DNA, 20 bp, Artificial
  CRISPR gRNA sequence
tcaaggagttcatagtctag

SEQ ID NO: 259986 - DNA, 20 bp, Artificial
  CRISPR gRNA sequence
gagttcatagtctagtggaa

SEQ ID NO: 259987 - DNA, 20 bp, Artificial
  CRISPR gRNA sequence
aaaataaatgtgtcaataca

SEQ ID NO: 259988 - DNA, 20 bp, Artificial
  CRISPR gRNA sequence
gtcaatacacagtaataatt

SEQ ID NO: 259989 - DNA, 20 bp, Artificial
  CRISPR gRNA sequence
caatacacagtaataatttg

SEQ ID NO: 259990 - DNA, 20 bp, Artificial
  CRISPR gRNA sequence
gtaataatttggagaaactt

SEQ ID NO: 259991 - DNA, 20 bp, Artificial
  CRISPR gRNA sequence
aataatttggagaaacttga

SEQ ID NO: 259992 - DNA, 20 bp, Artificial
  CRISPR gRNA sequence
ataatttggagaaacttgag

SEQ ID NO: 259993 - DNA, 20 bp, Artificial
  CRISPR gRNA sequence
taatttggagaaacttgaga

SEQ ID NO: 259994 - DNA, 20 bp, Artificial
  CRISPR gRNA sequence
tttggagaaacttgagaggg

SEQ ID NO: 259995 - DNA, 20 bp, Artificial
  CRISPR gRNA sequence
ttggagaaacttgagaggga

SEQ ID NO: 259996 - DNA, 20 bp, Artificial
  CRISPR gRNA sequence
gagaaacttgagagggaagg

SEQ ID NO: 259997 - DNA, 20 bp, Artificial
  CRISPR gRNA sequence
aagtccctctctttgccatt

SEQ ID NO: 259998 - DNA, 20 bp, Artificial
  CRISPR gRNA sequence
agtccctctctttgccattt

SEQ ID NO: 259999 - DNA, 20 bp, Artificial
  CRISPR gRNA sequence
gtccctctctttgccatttg

SEQ ID NO: 260000 - DNA, 20 bp, Artificial
  CRISPR gRNA sequence
ctctttgccatttggggtct

SEQ ID NO: 260001 - DNA, 20 bp, Artificial
  CRISPR gRNA sequence
ctttgccatttggggtctca

SEQ ID NO: 260002 - DNA, 20 bp, Artificial
  CRISPR gRNA sequence
tgccatttggggtctcagag

SEQ ID NO: 260003 - DNA, 20 bp, Artificial
  CRISPR gRNA sequence
gccatttggggtctcagaga

SEQ ID NO: 260004 - DNA, 20 bp, Artificial
  CRISPR gRNA sequence
ggtctcagagaaggcttctt

SEQ ID NO: 260005 - DNA, 20 bp, Artificial
  CRISPR gRNA sequence
gtctcagagaaggcttcttc

SEQ ID NO: 260006 - DNA, 20 bp, Artificial
  CRISPR gRNA sequence
cagagaaggcttcttcaggt

SEQ ID NO: 260007 - DNA, 20 bp, Artificial
  CRISPR gRNA sequence
gagaaggcttcttcaggtga

SEQ ID NO: 260008 - DNA, 20 bp, Artificial
  CRISPR gRNA sequence
agaaggcttcttcaggtgag

SEQ ID NO: 260009 - DNA, 20 bp, Artificial
  CRISPR gRNA sequence
gcttcttcaggtgagaggtg

SEQ ID NO: 260010 - DNA, 20 bp, Artificial
  CRISPR gRNA sequence
ttcttcaggtgagaggtgta

SEQ ID NO: 260011 - DNA, 20 bp, Artificial
  CRISPR gRNA sequence
tcttcaggtgagaggtgtag

SEQ ID NO: 260012 - DNA, 20 bp, Artificial
  CRISPR gRNA sequence
gagaggtgtagaggacattt

SEQ ID NO: 260013 - DNA, 20 bp, Artificial
  CRISPR gRNA sequence
ttcagattataaaaataatg

SEQ ID NO: 260014 - DNA, 20 bp, Artificial
  CRISPR gRNA sequence
tcagattataaaaataatgt

SEQ ID NO: 260015 - DNA, 20 bp, Artificial
  CRISPR gRNA sequence
aaaataatgtaggcaaacca

SEQ ID NO: 260016 - DNA, 20 bp, Artificial
  CRISPR gRNA sequence
gtaggcaaaccaaagtcctt

SEQ ID NO: 260017 - DNA, 20 bp, Artificial
  CRISPR gRNA sequence
aaagtcctttagtcatcaaa

SEQ ID NO: 260018 - DNA, 20 bp, Artificial
  CRISPR gRNA sequence
cctttagtcatcaaatagca

SEQ ID NO: 260019 - DNA, 20 bp, Artificial
  CRISPR gRNA sequence
tagtcatcaaatagcatggt

SEQ ID NO: 260020 - DNA, 20 bp, Artificial
  CRISPR gRNA sequence
agtcatcaaatagcatggtg

SEQ ID NO: 260021 - DNA, 20 bp, Artificial
  CRISPR gRNA sequence
catcaaatagcatggtgagg

SEQ ID NO: 260022 - DNA, 20 bp, Artificial
  CRISPR gRNA sequence
atggtgaggtagtgactgcc

SEQ ID NO: 260023 - DNA, 20 bp, Artificial
  CRISPR gRNA sequence
aagtgttatttatctgtttc

SEQ ID NO: 260024 - DNA, 20 bp, Artificial
  CRISPR gRNA sequence
taacctactcaactaaatca

SEQ ID NO: 260025 - DNA, 20 bp, Artificial
  CRISPR gRNA sequence
aacctactcaactaaatcat

SEQ ID NO: 260026 - DNA, 20 bp, Artificial
  CRISPR gRNA sequence
acctactcaactaaatcata

SEQ ID NO: 260027 - DNA, 20 bp, Artificial
  CRISPR gRNA sequence
cctactcaactaaatcatag

SEQ ID NO: 260028 - DNA, 20 bp, Artificial
  CRISPR gRNA sequence
ctaaatcataggggctgtaa

SEQ ID NO: 260029 - DNA, 20 bp, Artificial
  CRISPR gRNA sequence
aatcataggggctgtaaaag

SEQ ID NO: 260030 - DNA, 20 bp, Artificial
  CRISPR gRNA sequence
tcataggggctgtaaaagca

SEQ ID NO: 260031 - DNA, 20 bp, Artificial
  CRISPR gRNA sequence
ataggggctgtaaaagcaga

SEQ ID NO: 260032 - DNA, 20 bp, Artificial
  CRISPR gRNA sequence
ctgtaaaagcagagagaact

SEQ ID NO: 260033 - DNA, 20 bp, Artificial
  CRISPR gRNA sequence
ttcttttttttgttgttgtt

SEQ ID NO: 260034 - DNA, 20 bp, Artificial
  CRISPR gRNA sequence
tttttttgttgttgttgaga

SEQ ID NO: 260035 - DNA, 20 bp, Artificial
  CRISPR gRNA sequence
cggaatctcgctctgtcacc

SEQ ID NO: 260036 - DNA, 20 bp, Artificial
  CRISPR gRNA sequence
ggaatctcgctctgtcaccc

SEQ ID NO: 260037 - DNA, 20 bp, Artificial
  CRISPR gRNA sequence
tctcgctctgtcacccaggc

SEQ ID NO: 260038 - DNA, 20 bp, Artificial
  CRISPR gRNA sequence
tcgctctgtcacccaggctg

SEQ ID NO: 260039 - DNA, 20 bp, Artificial
  CRISPR gRNA sequence
tcactgcaacctctgcctcc

SEQ ID NO: 260040 - DNA, 20 bp, Artificial
  CRISPR gRNA sequence
cactgcaacctctgcctcct

SEQ ID NO: 260041 - DNA, 20 bp, Artificial
  CRISPR gRNA sequence
aacctctgcctcctaggttc

SEQ ID NO: 260042 - DNA, 20 bp, Artificial
  CRISPR gRNA sequence
ttcaagcaattctcctacct

SEQ ID NO: 260043 - DNA, 20 bp, Artificial
  CRISPR gRNA sequence
ttctcctacctcagcctccc

SEQ ID NO: 260044 - DNA, 20 bp, Artificial
  CRISPR gRNA sequence
tcctacctcagcctccccag

SEQ ID NO: 260045 - DNA, 20 bp, Artificial
  CRISPR gRNA sequence
acctcagcctccccagtagc

SEQ ID NO: 260046 - DNA, 20 bp, Artificial
  CRISPR gRNA sequence
cctcagcctccccagtagct

SEQ ID NO: 260047 - DNA, 20 bp, Artificial
  CRISPR gRNA sequence
ctccccagtagctgggacta

SEQ ID NO: 260048 - DNA, 20 bp, Artificial
  CRISPR gRNA sequence
tccccagtagctgggactac

SEQ ID NO: 260049 - DNA, 20 bp, Artificial
  CRISPR gRNA sequence
caggtgtgtaccaccacgcc

SEQ ID NO: 260050 - DNA, 20 bp, Artificial
  CRISPR gRNA sequence
ctggctaatttttgtatttt

SEQ ID NO: 260051 - DNA, 20 bp, Artificial
  CRISPR gRNA sequence
gctaatttttgtatttttag

SEQ ID NO: 260052 - DNA, 20 bp, Artificial
  CRISPR gRNA sequence
taatttttgtatttttagta

SEQ ID NO: 260053 - DNA, 20 bp, Artificial
  CRISPR gRNA sequence
ttttgtatttttagtagaga

SEQ ID NO: 260054 - DNA, 20 bp, Artificial
  CRISPR gRNA sequence
tttgtatttttagtagagat

SEQ ID NO: 260055 - DNA, 20 bp, Artificial
  CRISPR gRNA sequence
ttgtatttttagtagagatg

SEQ ID NO: 260056 - DNA, 20 bp, Artificial
  CRISPR gRNA sequence
gagatggggtttcaccatat

SEQ ID NO: 260057 - DNA, 20 bp, Artificial
  CRISPR gRNA sequence
tggggtttcaccatattggc

SEQ ID NO: 260058 - DNA, 20 bp, Artificial
  CRISPR gRNA sequence
tttcaccatattggccagac

SEQ ID NO: 260059 - DNA, 20 bp, Artificial
  CRISPR gRNA sequence
tggtctcaaacttctgacct

SEQ ID NO: 260060 - DNA, 20 bp, Artificial
  CRISPR gRNA sequence
ggtctcaaacttctgacctc

SEQ ID NO: 260061 - DNA, 20 bp, Artificial
  CRISPR gRNA sequence
ctcaggtgatctgcctgcct

SEQ ID NO: 260062 - DNA, 20 bp, Artificial
  CRISPR gRNA sequence
ctgcctgccttggtctccca

SEQ ID NO: 260063 - DNA, 20 bp, Artificial
  CRISPR gRNA sequence
gccttggtctcccaaagtgc

SEQ ID NO: 260064 - DNA, 20 bp, Artificial
  CRISPR gRNA sequence
ccttggtctcccaaagtgct

SEQ ID NO: 260065 - DNA, 20 bp, Artificial
  CRISPR gRNA sequence
cttggtctcccaaagtgctg

SEQ ID NO: 260066 - DNA, 20 bp, Artificial
  CRISPR gRNA sequence
ctcccaaagtgctggggtta

SEQ ID NO: 260067 - DNA, 20 bp, Artificial
  CRISPR gRNA sequence
tcccaaagtgctggggttac

SEQ ID NO: 260068 - DNA, 20 bp, Artificial
  CRISPR gRNA sequence
agtgctggggttacaggtgt

SEQ ID NO: 260069 - DNA, 20 bp, Artificial
  CRISPR gRNA sequence
gtgctggggttacaggtgtg

SEQ ID NO: 260070 - DNA, 20 bp, Artificial
  CRISPR gRNA sequence
caggtgtgaggcaccatatc

SEQ ID NO: 260071 - DNA, 20 bp, Artificial
  CRISPR gRNA sequence
tatattctctgaaactctga

SEQ ID NO: 260072 - DNA, 20 bp, Artificial
  CRISPR gRNA sequence
tattctctgaaactctgatg

SEQ ID NO: 260073 - DNA, 20 bp, Artificial
  CRISPR gRNA sequence
tctgatggagattaaaatat

SEQ ID NO: 260074 - DNA, 20 bp, Artificial
  CRISPR gRNA sequence
tgatggagattaaaatatga

SEQ ID NO: 260075 - DNA, 20 bp, Artificial
  CRISPR gRNA sequence
gatggagattaaaatatgag

SEQ ID NO: 260076 - DNA, 20 bp, Artificial
  CRISPR gRNA sequence
aggtttaataaatatttgtt

SEQ ID NO: 260077 - DNA, 20 bp, Artificial
  CRISPR gRNA sequence
taataaatatttgttaagtt

SEQ ID NO: 260078 - DNA, 20 bp, Artificial
  CRISPR gRNA sequence
aagttgagatacacttccat

SEQ ID NO: 260079 - DNA, 20 bp, Artificial
  CRISPR gRNA sequence
tccatcagaactcctcttcc

SEQ ID NO: 260080 - DNA, 20 bp, Artificial
  CRISPR gRNA sequence
cctcttccaagaccacaata

SEQ ID NO: 260081 - DNA, 20 bp, Artificial
  CRISPR gRNA sequence
ctcttccaagaccacaataa

SEQ ID NO: 260082 - DNA, 20 bp, Artificial
  CRISPR gRNA sequence
caagaccacaataaaggctg

SEQ ID NO: 260083 - DNA, 20 bp, Artificial
  CRISPR gRNA sequence
acaataaaggctgaagtatc

SEQ ID NO: 260084 - DNA, 20 bp, Artificial
  CRISPR gRNA sequence
ataaaggctgaagtatccag

SEQ ID NO: 260085 - DNA, 20 bp, Artificial
  CRISPR gRNA sequence
aagtatccagaagcttcttc

SEQ ID NO: 260086 - DNA, 20 bp, Artificial
  CRISPR gRNA sequence
agtatccagaagcttcttcg

SEQ ID NO: 260087 - DNA, 20 bp, Artificial
  CRISPR gRNA sequence
tatccagaagcttcttcgag

SEQ ID NO: 260088 - DNA, 20 bp, Artificial
  CRISPR gRNA sequence
atccagaagcttcttcgagg

SEQ ID NO: 260089 - DNA, 20 bp, Artificial
  CRISPR gRNA sequence
cagaagcttcttcgaggagg

SEQ ID NO: 260090 - DNA, 20 bp, Artificial
  CRISPR gRNA sequence
ggaggtggatctttcacgaa

SEQ ID NO: 260091 - DNA, 20 bp, Artificial
  CRISPR gRNA sequence
tcacgaaaagtctaacatga

SEQ ID NO: 260092 - DNA, 20 bp, Artificial
  CRISPR gRNA sequence
aaaagtctaacatgaaagac

SEQ ID NO: 260093 - DNA, 20 bp, Artificial
  CRISPR gRNA sequence
agtctaacatgaaagacaag

SEQ ID NO: 260094 - DNA, 20 bp, Artificial
  CRISPR gRNA sequence
tgaaagacaagtagattaca

SEQ ID NO: 260095 - DNA, 20 bp, Artificial
  CRISPR gRNA sequence
aagacaagtagattacatgg

SEQ ID NO: 260096 - DNA, 20 bp, Artificial
  CRISPR gRNA sequence
tagattacatggtggattgt

SEQ ID NO: 260097 - DNA, 20 bp, Artificial
  CRISPR gRNA sequence
atggtggattgtgagccaat

SEQ ID NO: 260098 - DNA, 20 bp, Artificial
  CRISPR gRNA sequence
tggtggattgtgagccaatg

SEQ ID NO: 260099 - DNA, 20 bp, Artificial
  CRISPR gRNA sequence
tgtgagccaatgaggtgatt

SEQ ID NO: 260100 - DNA, 20 bp, Artificial
  CRISPR gRNA sequence
atgaggtgattcagatattg

SEQ ID NO: 260101 - DNA, 20 bp, Artificial
  CRISPR gRNA sequence
ggtgattcagatattgcaga

SEQ ID NO: 260102 - DNA, 20 bp, Artificial
  CRISPR gRNA sequence
gtgattcagatattgcagaa

SEQ ID NO: 260103 - DNA, 20 bp, Artificial
  CRISPR gRNA sequence
tgattcagatattgcagaaa

SEQ ID NO: 260104 - DNA, 20 bp, Artificial
  CRISPR gRNA sequence
gattcagatattgcagaaag

SEQ ID NO: 260105 - DNA, 20 bp, Artificial
  CRISPR gRNA sequence
tgcagaaaggggctcacaat

SEQ ID NO: 260106 - DNA, 20 bp, Artificial
  CRISPR gRNA sequence
aaaggggctcacaattagat

SEQ ID NO: 260107 - DNA, 20 bp, Artificial
  CRISPR gRNA sequence
aggggctcacaattagatca

SEQ ID NO: 260108 - DNA, 20 bp, Artificial
  CRISPR gRNA sequence
ggggctcacaattagatcag

SEQ ID NO: 260109 - DNA, 20 bp, Artificial
  CRISPR gRNA sequence
cacaattagatcagaggcca

SEQ ID NO: 260110 - DNA, 20 bp, Artificial
  CRISPR gRNA sequence
cagaggccaaagtgaactat

SEQ ID NO: 260111 - DNA, 20 bp, Artificial
  CRISPR gRNA sequence
ggccaaagtgaactatgagt

SEQ ID NO: 260112 - DNA, 20 bp, Artificial
  CRISPR gRNA sequence
gtaattctgaatgataccat

SEQ ID NO: 260113 - DNA, 20 bp, Artificial
  CRISPR gRNA sequence
taattctgaatgataccatc

SEQ ID NO: 260114 - DNA, 20 bp, Artificial
  CRISPR gRNA sequence
accatcaggaaccattaacc

SEQ ID NO: 260115 - DNA, 20 bp, Artificial
  CRISPR gRNA sequence
cattaacctggttatattgt

SEQ ID NO: 260116 - DNA, 20 bp, Artificial
  CRISPR gRNA sequence
tattgtcagccacaataccc

SEQ ID NO: 260117 - DNA, 20 bp, Artificial
  CRISPR gRNA sequence
ccacaatacccaagataatg

SEQ ID NO: 260118 - DNA, 20 bp, Artificial
  CRISPR gRNA sequence
agataatgaagatgatgaca

SEQ ID NO: 260119 - DNA, 20 bp, Artificial
  CRISPR gRNA sequence
tgaagatgatgacaaagaaa

SEQ ID NO: 260120 - DNA, 20 bp, Artificial
  CRISPR gRNA sequence
gatgacaaagaaaaagatga

SEQ ID NO: 260121 - DNA, 20 bp, Artificial
  CRISPR gRNA sequence
aaagaaaaagatgacagtaa

SEQ ID NO: 260122 - DNA, 20 bp, Artificial
  CRISPR gRNA sequence
agatgacagtaatggtaatg

SEQ ID NO: 260123 - DNA, 20 bp, Artificial
  CRISPR gRNA sequence
atgacagtaatggtaatgca

SEQ ID NO: 260124 - DNA, 20 bp, Artificial
  CRISPR gRNA sequence
agtaatggtaatgcagagat

SEQ ID NO: 260125 - DNA, 20 bp, Artificial
  CRISPR gRNA sequence
gtaatggtaatgcagagata

SEQ ID NO: 260126 - DNA, 20 bp, Artificial
  CRISPR gRNA sequence
taatggtaatgcagagataa

SEQ ID NO: 260127 - DNA, 20 bp, Artificial
  CRISPR gRNA sequence
atggtaatgcagagataagg

SEQ ID NO: 260128 - DNA, 20 bp, Artificial
  CRISPR gRNA sequence
gtaatgcagagataagggag

SEQ ID NO: 260129 - DNA, 20 bp, Artificial
  CRISPR gRNA sequence
agagataagggagcagctca

SEQ ID NO: 260130 - DNA, 20 bp, Artificial
  CRISPR gRNA sequence
taagggagcagctcaaagtt

SEQ ID NO: 260131 - DNA, 20 bp, Artificial
  CRISPR gRNA sequence
ggagcagctcaaagttaagt

SEQ ID NO: 260132 - DNA, 20 bp, Artificial
  CRISPR gRNA sequence
agaacttctccaccaccttg

SEQ ID NO: 260133 - DNA, 20 bp, Artificial
  CRISPR gRNA sequence
gaacttctccaccaccttgc

SEQ ID NO: 260134 - DNA, 20 bp, Artificial
  CRISPR gRNA sequence
ccaccttgcaggttctcttc

SEQ ID NO: 260135 - DNA, 20 bp, Artificial
  CRISPR gRNA sequence
ttctcttccagcaatgaaaa

SEQ ID NO: 260136 - DNA, 20 bp, Artificial
  CRISPR gRNA sequence
tcttccagcaatgaaaacag

SEQ ID NO: 260137 - DNA, 20 bp, Artificial
  CRISPR gRNA sequence
agaagcacatataacctgca

SEQ ID NO: 260138 - DNA, 20 bp, Artificial
  CRISPR gRNA sequence
tataacctgcatggtgacac

SEQ ID NO: 260139 - DNA, 20 bp, Artificial
  CRISPR gRNA sequence
ctttgaaattaacattgaaa

SEQ ID NO: 260140 - DNA, 20 bp, Artificial
  CRISPR gRNA sequence
gaaattaacattgaaatagt

SEQ ID NO: 260141 - DNA, 20 bp, Artificial
  CRISPR gRNA sequence
attaacattgaaatagtgag

SEQ ID NO: 260142 - DNA, 20 bp, Artificial
  CRISPR gRNA sequence
aagtctaaactcttttttcc

SEQ ID NO: 260143 - DNA, 20 bp, Artificial
  CRISPR gRNA sequence
caagcctctaccaaatgact

SEQ ID NO: 260144 - DNA, 20 bp, Artificial
  CRISPR gRNA sequence
gcctctaccaaatgactgag

SEQ ID NO: 260145 - DNA, 20 bp, Artificial
  CRISPR gRNA sequence
gagtagttcttgatcctatc

SEQ ID NO: 260146 - DNA, 20 bp, Artificial
  CRISPR gRNA sequence
tatccagtgcacttctcttc

SEQ ID NO: 260147 - DNA, 20 bp, Artificial
  CRISPR gRNA sequence
tgcacttctcttctagtgtt

SEQ ID NO: 260148 - DNA, 20 bp, Artificial
  CRISPR gRNA sequence
cacttctcttctagtgtttg

SEQ ID NO: 260149 - DNA, 20 bp, Artificial
  CRISPR gRNA sequence
gtgtttggagtcctcaaaat

SEQ ID NO: 260150 - DNA, 20 bp, Artificial
  CRISPR gRNA sequence
gtcctcaaaatgagattaac

SEQ ID NO: 260151 - DNA, 20 bp, Artificial
  CRISPR gRNA sequence
tcctcaaaatgagattaaca

SEQ ID NO: 260152 - DNA, 20 bp, Artificial
  CRISPR gRNA sequence
aaatgagattaacaaggaaa

SEQ ID NO: 260153 - DNA, 20 bp, Artificial
  CRISPR gRNA sequence
gagattaacaaggaaaaagt

SEQ ID NO: 260154 - DNA, 20 bp, Artificial
  CRISPR gRNA sequence
tgcatgcaaccacctttctg

SEQ ID NO: 260155 - DNA, 20 bp, Artificial
  CRISPR gRNA sequence
gcatgcaaccacctttctgt

SEQ ID NO: 260156 - DNA, 20 bp, Artificial
  CRISPR gRNA sequence
catgcaaccacctttctgtg

SEQ ID NO: 260157 - DNA, 20 bp, Artificial
  CRISPR gRNA sequence
aaccacctttctgtggggcc

SEQ ID NO: 260158 - DNA, 20 bp, Artificial
  CRISPR gRNA sequence
accacctttctgtggggcct

SEQ ID NO: 260159 - DNA, 20 bp, Artificial
  CRISPR gRNA sequence
ggcctgggttaccttccccc

SEQ ID NO: 260160 - DNA, 20 bp, Artificial
  CRISPR gRNA sequence
ggttaccttccccccagctt

SEQ ID NO: 260161 - DNA, 20 bp, Artificial
  CRISPR gRNA sequence
gttaccttccccccagcttc

SEQ ID NO: 260162 - DNA, 20 bp, Artificial
  CRISPR gRNA sequence
aattctcatgctataattat

SEQ ID NO: 260163 - DNA, 20 bp, Artificial
  CRISPR gRNA sequence
attctcatgctataattatc

SEQ ID NO: 260164 - DNA, 20 bp, Artificial
  CRISPR gRNA sequence
tgctataattatcaggctca

SEQ ID NO: 260165 - DNA, 20 bp, Artificial
  CRISPR gRNA sequence
attatcaggctcaaagctct

SEQ ID NO: 260166 - DNA, 20 bp, Artificial
  CRISPR gRNA sequence
aagctctgagtgaattgtct

SEQ ID NO: 260167 - DNA, 20 bp, Artificial
  CRISPR gRNA sequence
gtgaattgtcttggtttttt

SEQ ID NO: 260168 - DNA, 20 bp, Artificial
  CRISPR gRNA sequence
tgtcttggtttttttggttt

SEQ ID NO: 260169 - DNA, 20 bp, Artificial
  CRISPR gRNA sequence
gtcttggtttttttggtttt

SEQ ID NO: 260170 - DNA, 20 bp, Artificial
  CRISPR gRNA sequence
tttttttggttttgggtttt

SEQ ID NO: 260171 - DNA, 20 bp, Artificial
  CRISPR gRNA sequence
tggtgctaacaccctgtcat

SEQ ID NO: 260172 - DNA, 20 bp, Artificial
  CRISPR gRNA sequence
accctgtcattggccaaaaa

SEQ ID NO: 260173 - DNA, 20 bp, Artificial
  CRISPR gRNA sequence
ggccaaataaatcaccgtaa

SEQ ID NO: 260174 - DNA, 20 bp, Artificial
  CRISPR gRNA sequence
ccaaataaatcaccgtaaaa

SEQ ID NO: 260175 - DNA, 20 bp, Artificial
  CRISPR gRNA sequence
aaatcaccgtaaaagagaca

SEQ ID NO: 260176 - DNA, 20 bp, Artificial
  CRISPR gRNA sequence
gagacacagatatcttaaca

SEQ ID NO: 260177 - DNA, 20 bp, Artificial
  CRISPR gRNA sequence
atatcttaacacagcttaac

SEQ ID NO: 260178 - DNA, 20 bp, Artificial
  CRISPR gRNA sequence
atcttaacacagcttaacca

SEQ ID NO: 260179 - DNA, 20 bp, Artificial
  CRISPR gRNA sequence
cttaacacagcttaaccaga

SEQ ID NO: 260180 - DNA, 20 bp, Artificial
  CRISPR gRNA sequence
agcttaaccagagagccatt

SEQ ID NO: 260181 - DNA, 20 bp, Artificial
  CRISPR gRNA sequence
taaccagagagccattcagt

SEQ ID NO: 260182 - DNA, 20 bp, Artificial
  CRISPR gRNA sequence
cagtcagtcacaaaaccacc

SEQ ID NO: 260183 - DNA, 20 bp, Artificial
  CRISPR gRNA sequence
ccacccagatgtaatttttc

SEQ ID NO: 260184 - DNA, 20 bp, Artificial
  CRISPR gRNA sequence
atgtaatttttccagatgct

SEQ ID NO: 260185 - DNA, 20 bp, Artificial
  CRISPR gRNA sequence
gctcagctcaactatgtact

SEQ ID NO: 260186 - DNA, 20 bp, Artificial
  CRISPR gRNA sequence
cagctcaactatgtactgag

SEQ ID NO: 260187 - DNA, 20 bp, Artificial
  CRISPR gRNA sequence
caactatgtactgagaagaa

SEQ ID NO: 260188 - DNA, 20 bp, Artificial
  CRISPR gRNA sequence
tgtactgagaagaaaagttc

SEQ ID NO: 260189 - DNA, 20 bp, Artificial
  CRISPR gRNA sequence
gaaaagttccagcctctgtg

SEQ ID NO: 260190 - DNA, 20 bp, Artificial
  CRISPR gRNA sequence
cataaataataaatttcttg

SEQ ID NO: 260191 - DNA, 20 bp, Artificial
  CRISPR gRNA sequence
taataaatttcttgaagaaa

SEQ ID NO: 260192 - DNA, 20 bp, Artificial
  CRISPR gRNA sequence
aataaatttcttgaagaaaa

SEQ ID NO: 260193 - DNA, 20 bp, Artificial
  CRISPR gRNA sequence
aacaaaaatttaaccaacat

SEQ ID NO: 260194 - DNA, 20 bp, Artificial
  CRISPR gRNA sequence
aaaatttaaccaacatgaga

SEQ ID NO: 260195 - DNA, 20 bp, Artificial
  CRISPR gRNA sequence
aatttaaccaacatgagaaa

SEQ ID NO: 260196 - DNA, 20 bp, Artificial
  CRISPR gRNA sequence
ttaaccaacatgagaaagag

SEQ ID NO: 260197 - DNA, 20 bp, Artificial
  CRISPR gRNA sequence
accaacatgagaaagagaag

SEQ ID NO: 260198 - DNA, 20 bp, Artificial
  CRISPR gRNA sequence
tatcccttgccatgacctgc

SEQ ID NO: 260199 - DNA, 20 bp, Artificial
  CRISPR gRNA sequence
atcccttgccatgacctgct

SEQ ID NO: 260200 - DNA, 20 bp, Artificial
  CRISPR gRNA sequence
tgggaaacaattgtgctttg

SEQ ID NO: 260201 - DNA, 20 bp, Artificial
  CRISPR gRNA sequence
gggaaacaattgtgctttga

SEQ ID NO: 260202 - DNA, 20 bp, Artificial
  CRISPR gRNA sequence
gaaacaattgtgctttgaag

SEQ ID NO: 260203 - DNA, 20 bp, Artificial
  CRISPR gRNA sequence
agtgtccgtcctctgatttt

SEQ ID NO: 260204 - DNA, 20 bp, Artificial
  CRISPR gRNA sequence
cctctgatttttagacaacc

SEQ ID NO: 260205 - DNA, 20 bp, Artificial
  CRISPR gRNA sequence
atcctcatcaatgcctacac

SEQ ID NO: 260206 - DNA, 20 bp, Artificial
  CRISPR gRNA sequence
aatgcctacactagttaata

SEQ ID NO: 260207 - DNA, 20 bp, Artificial
  CRISPR gRNA sequence
atgcctacactagttaataa

SEQ ID NO: 260208 - DNA, 20 bp, Artificial
  CRISPR gRNA sequence
tgcctacactagttaataaa

SEQ ID NO: 260209 - DNA, 20 bp, Artificial
  CRISPR gRNA sequence
ttaataaagggcttttgtgt

SEQ ID NO: 260210 - DNA, 20 bp, Artificial
  CRISPR gRNA sequence
aataaagggcttttgtgtta

SEQ ID NO: 260211 - DNA, 20 bp, Artificial
  CRISPR gRNA sequence
aaccacaacaaattttcttc

SEQ ID NO: 260212 - DNA, 20 bp, Artificial
  CRISPR gRNA sequence
accacaacaaattttcttct

SEQ ID NO: 260213 - DNA, 20 bp, Artificial
  CRISPR gRNA sequence
caaattttcttctgggatgt

SEQ ID NO: 260214 - DNA, 20 bp, Artificial
  CRISPR gRNA sequence
attttcttctgggatgttgg

SEQ ID NO: 260215 - DNA, 20 bp, Artificial
  CRISPR gRNA sequence
aattttccttttgtaaatgt

SEQ ID NO: 260216 - DNA, 20 bp, Artificial
  CRISPR gRNA sequence
aaatgtcagcacactgcttg

SEQ ID NO: 260217 - DNA, 20 bp, Artificial
  CRISPR gRNA sequence
aatgtcagcacactgcttgc

SEQ ID NO: 260218 - DNA, 20 bp, Artificial
  CRISPR gRNA sequence
cactgcttgcaggaaatact

SEQ ID NO: 260219 - DNA, 20 bp, Artificial
  CRISPR gRNA sequence
ctgcttgcaggaaatacttg

SEQ ID NO: 260220 - DNA, 20 bp, Artificial
  CRISPR gRNA sequence
tgcttgcaggaaatacttgg

SEQ ID NO: 260221 - DNA, 20 bp, Artificial
  CRISPR gRNA sequence
ttgcaggaaatacttggagg

SEQ ID NO: 260222 - DNA, 20 bp, Artificial
  CRISPR gRNA sequence
ttggaggaagatatccacac

SEQ ID NO: 260223 - DNA, 20 bp, Artificial
  CRISPR gRNA sequence
aagatatccacacaagataa

SEQ ID NO: 260224 - DNA, 20 bp, Artificial
  CRISPR gRNA sequence
cacacaagataaaagccaaa

SEQ ID NO: 260225 - DNA, 20 bp, Artificial
  CRISPR gRNA sequence
aaagccaaatggtaatcata

SEQ ID NO: 260226 - DNA, 20 bp, Artificial
  CRISPR gRNA sequence
catttctccacccttgaaaa

SEQ ID NO: 260227 - DNA, 20 bp, Artificial
  CRISPR gRNA sequence
atttctccacccttgaaaaa

SEQ ID NO: 260228 - DNA, 20 bp, Artificial
  CRISPR gRNA sequence
ccacccttgaaaaaaggcat

SEQ ID NO: 260229 - DNA, 20 bp, Artificial
  CRISPR gRNA sequence
aaaaggcataagacgttaaa

SEQ ID NO: 260230 - DNA, 20 bp, Artificial
  CRISPR gRNA sequence
aaaggcataagacgttaaaa

SEQ ID NO: 260231 - DNA, 20 bp, Artificial
  CRISPR gRNA sequence
aggcataagacgttaaaaag

SEQ ID NO: 260232 - DNA, 20 bp, Artificial
  CRISPR gRNA sequence
ggcataagacgttaaaaagg

SEQ ID NO: 260233 - DNA, 20 bp, Artificial
  CRISPR gRNA sequence
cataagacgttaaaaaggag

SEQ ID NO: 260234 - DNA, 20 bp, Artificial
  CRISPR gRNA sequence
ataagacgttaaaaaggagg

SEQ ID NO: 260235 - DNA, 20 bp, Artificial
  CRISPR gRNA sequence
taagacgttaaaaaggagga

SEQ ID NO: 260236 - DNA, 20 bp, Artificial
  CRISPR gRNA sequence
ggaggagggtctatgtctta

SEQ ID NO: 260237 - DNA, 20 bp, Artificial
  CRISPR gRNA sequence
ggagggtctatgtcttaaag

SEQ ID NO: 260238 - DNA, 20 bp, Artificial
  CRISPR gRNA sequence
gagggtctatgtcttaaaga

SEQ ID NO: 260239 - DNA, 20 bp, Artificial
  CRISPR gRNA sequence
agggtctatgtcttaaagaa

SEQ ID NO: 260240 - DNA, 20 bp, Artificial
  CRISPR gRNA sequence
gggtctatgtcttaaagaag

SEQ ID NO: 260241 - DNA, 20 bp, Artificial
  CRISPR gRNA sequence
gtctatgtcttaaagaaggg

SEQ ID NO: 260242 - DNA, 20 bp, Artificial
  CRISPR gRNA sequence
tctatgtcttaaagaagggg

SEQ ID NO: 260243 - DNA, 20 bp, Artificial
  CRISPR gRNA sequence
atgtcttaaagaaggggagg

SEQ ID NO: 260244 - DNA, 20 bp, Artificial
  CRISPR gRNA sequence
cttaaagaaggggaggcagc

SEQ ID NO: 260245 - DNA, 20 bp, Artificial
  CRISPR gRNA sequence
cgagatcctctccccaccca

SEQ ID NO: 260246 - DNA, 20 bp, Artificial
  CRISPR gRNA sequence
cctctccccacccatagtaa

SEQ ID NO: 260247 - DNA, 20 bp, Artificial
  CRISPR gRNA sequence
catagtaaaagtttgaatgt

SEQ ID NO: 260248 - DNA, 20 bp, Artificial
  CRISPR gRNA sequence
tagtaaaagtttgaatgtga

SEQ ID NO: 260249 - DNA, 20 bp, Artificial
  CRISPR gRNA sequence
aagtttgaatgtgagagctt

SEQ ID NO: 260250 - DNA, 20 bp, Artificial
  CRISPR gRNA sequence
gtttgaatgtgagagctttg

SEQ ID NO: 260251 - DNA, 20 bp, Artificial
  CRISPR gRNA sequence
gagctttggagttacaatca

SEQ ID NO: 260252 - DNA, 20 bp, Artificial
  CRISPR gRNA sequence
ttctatttctaatctatctg

SEQ ID NO: 260253 - DNA, 20 bp, Artificial
  CRISPR gRNA sequence
caatgactcattccatttcc

SEQ ID NO: 260254 - DNA, 20 bp, Artificial
  CRISPR gRNA sequence
atatattgatattaattttg

SEQ ID NO: 260255 - DNA, 20 bp, Artificial
  CRISPR gRNA sequence
cttgctgtaaacgtccttgc

SEQ ID NO: 260256 - DNA, 20 bp, Artificial
  CRISPR gRNA sequence
ctgtaaacgtccttgctgga

SEQ ID NO: 260257 - DNA, 20 bp, Artificial
  CRISPR gRNA sequence
aaaaaacacaatgtgttaac

SEQ ID NO: 260258 - DNA, 20 bp, Artificial
  CRISPR gRNA sequence
aaaaacacaatgtgttaact

SEQ ID NO: 260259 - DNA, 20 bp, Artificial
  CRISPR gRNA sequence
aaaacacaatgtgttaacta

SEQ ID NO: 260260 - DNA, 20 bp, Artificial
  CRISPR gRNA sequence
acaatgtgttaactagggca

SEQ ID NO: 260261 - DNA, 20 bp, Artificial
  CRISPR gRNA sequence
atgtgttaactagggcacgg

SEQ ID NO: 260262 - DNA, 20 bp, Artificial
  CRISPR gRNA sequence
tgttaactagggcacggtag

SEQ ID NO: 260263 - DNA, 20 bp, Artificial
  CRISPR gRNA sequence
ttaactagggcacggtagta

SEQ ID NO: 260264 - DNA, 20 bp, Artificial
  CRISPR gRNA sequence
gtagagtaaaacaaatcctt

SEQ ID NO: 260265 - DNA, 20 bp, Artificial
  CRISPR gRNA sequence
cttgaaatgacaaaaacatc

SEQ ID NO: 260266 - DNA, 20 bp, Artificial
  CRISPR gRNA sequence
atccagtcaatttcttttaa

SEQ ID NO: 260267 - DNA, 20 bp, Artificial
  CRISPR gRNA sequence
atttcttttaacagaaaaac

SEQ ID NO: 260268 - DNA, 20 bp, Artificial
  CRISPR gRNA sequence
tttaacagaaaaactggcca

SEQ ID NO: 260269 - DNA, 20 bp, Artificial
  CRISPR gRNA sequence
aaaaactggccacagcatat

SEQ ID NO: 260270 - DNA, 20 bp, Artificial
  CRISPR gRNA sequence
aactggccacagcatattgg

SEQ ID NO: 260271 - DNA, 20 bp, Artificial
  CRISPR gRNA sequence
tattggaagtcatgtaaata

SEQ ID NO: 260272 - DNA, 20 bp, Artificial
  CRISPR gRNA sequence
tcttttcaccttactttccc

SEQ ID NO: 260273 - DNA, 20 bp, Artificial
  CRISPR gRNA sequence
tcaccttactttcccaagcc

SEQ ID NO: 260274 - DNA, 20 bp, Artificial
  CRISPR gRNA sequence
tactttcccaagcccagtct

SEQ ID NO: 260275 - DNA, 20 bp, Artificial
  CRISPR gRNA sequence
ctttcccaagcccagtctca

SEQ ID NO: 260276 - DNA, 20 bp, Artificial
  CRISPR gRNA sequence
tcagagcaacacttaactgt

SEQ ID NO: 260277 - DNA, 20 bp, Artificial
  CRISPR gRNA sequence
tacttctttccgtatacaac

SEQ ID NO: 260278 - DNA, 20 bp, Artificial
  CRISPR gRNA sequence
ctttccgtatacaaccagct

SEQ ID NO: 260279 - DNA, 20 bp, Artificial
  CRISPR gRNA sequence
tttccgtatacaaccagctc

SEQ ID NO: 260280 - DNA, 20 bp, Artificial
  CRISPR gRNA sequence
ttccgtatacaaccagctca

SEQ ID NO: 260281 - DNA, 20 bp, Artificial
  CRISPR gRNA sequence
tccgtatacaaccagctcag

SEQ ID NO: 260282 - DNA, 20 bp, Artificial
  CRISPR gRNA sequence
cgtatacaaccagctcaggg

SEQ ID NO: 260283 - DNA, 20 bp, Artificial
  CRISPR gRNA sequence
aaccagctcaggggagtcat

SEQ ID NO: 260284 - DNA, 20 bp, Artificial
  CRISPR gRNA sequence
ctcaggggagtcattggctg

SEQ ID NO: 260285 - DNA, 20 bp, Artificial
  CRISPR gRNA sequence
gggagtcattggctgaagac

SEQ ID NO: 260286 - DNA, 20 bp, Artificial
  CRISPR gRNA sequence
gagtcattggctgaagacta

SEQ ID NO: 260287 - DNA, 20 bp, Artificial
  CRISPR gRNA sequence
gatgactttttattaaatgt

SEQ ID NO: 260288 - DNA, 20 bp, Artificial
  CRISPR gRNA sequence
cctgctttccatgcctctct

SEQ ID NO: 260289 - DNA, 20 bp, Artificial
  CRISPR gRNA sequence
catgcctctctcagaaaaat

SEQ ID NO: 260290 - DNA, 20 bp, Artificial
  CRISPR gRNA sequence
ctctcagaaaaataagcgct

SEQ ID NO: 260291 - DNA, 20 bp, Artificial
  CRISPR gRNA sequence
tctcagaaaaataagcgcta

SEQ ID NO: 260292 - DNA, 20 bp, Artificial
  CRISPR gRNA sequence
ctcagaaaaataagcgctaa

SEQ ID NO: 260293 - DNA, 20 bp, Artificial
  CRISPR gRNA sequence
agaaaaataagcgctaaggg

SEQ ID NO: 260294 - DNA, 20 bp, Artificial
  CRISPR gRNA sequence
gaaaaataagcgctaaggga

SEQ ID NO: 260295 - DNA, 20 bp, Artificial
  CRISPR gRNA sequence
taagcgctaagggaaggcgc

SEQ ID NO: 260296 - DNA, 20 bp, Artificial
  CRISPR gRNA sequence
agcgctaagggaaggcgctg

SEQ ID NO: 260297 - DNA, 20 bp, Artificial
  CRISPR gRNA sequence
agggaaggcgctggagaaat

SEQ ID NO: 260298 - DNA, 20 bp, Artificial
  CRISPR gRNA sequence
gaaattagctttgtccaaac

SEQ ID NO: 260299 - DNA, 20 bp, Artificial
  CRISPR gRNA sequence
gtccaaactggccattttga

SEQ ID NO: 260300 - DNA, 20 bp, Artificial
  CRISPR gRNA sequence
attttgacagttttttgccc

SEQ ID NO: 260301 - DNA, 20 bp, Artificial
  CRISPR gRNA sequence
acagttttttgcccaagttt

SEQ ID NO: 260302 - DNA, 20 bp, Artificial
  CRISPR gRNA sequence
agttttttgcccaagttttg

SEQ ID NO: 260303 - DNA, 20 bp, Artificial
  CRISPR gRNA sequence
tttttgcccaagttttggag

SEQ ID NO: 260304 - DNA, 20 bp, Artificial
  CRISPR gRNA sequence
ccaagttttggagaagtgaa

SEQ ID NO: 260305 - DNA, 20 bp, Artificial
  CRISPR gRNA sequence
caagttttggagaagtgaaa

SEQ ID NO: 260306 - DNA, 20 bp, Artificial
  CRISPR gRNA sequence
agtgaaaaggaatgatctca

SEQ ID NO: 260307 - DNA, 20 bp, Artificial
  CRISPR gRNA sequence
gaatgatctcatggaaaaat

SEQ ID NO: 260308 - DNA, 20 bp, Artificial
  CRISPR gRNA sequence
tgatctcatggaaaaataag

SEQ ID NO: 260309 - DNA, 20 bp, Artificial
  CRISPR gRNA sequence
gctgatttttctcttcacac

SEQ ID NO: 260310 - DNA, 20 bp, Artificial
  CRISPR gRNA sequence
ttctcttcacactggatgat

SEQ ID NO: 260311 - DNA, 20 bp, Artificial
  CRISPR gRNA sequence
tctcttcacactggatgatt

SEQ ID NO: 260312 - DNA, 20 bp, Artificial
  CRISPR gRNA sequence
tgattaggcttgctaaaaaa

SEQ ID NO: 260313 - DNA, 20 bp, Artificial
  CRISPR gRNA sequence
ttgctaaaaaatagcaaata

SEQ ID NO: 260314 - DNA, 20 bp, Artificial
  CRISPR gRNA sequence
tgaaacatgtgaccaatgtc

SEQ ID NO: 260315 - DNA, 20 bp, Artificial
  CRISPR gRNA sequence
catccttctatcatcaatcc

SEQ ID NO: 260316 - DNA, 20 bp, Artificial
  CRISPR gRNA sequence
tccttctatcatcaatccca

SEQ ID NO: 260317 - DNA, 20 bp, Artificial
  CRISPR gRNA sequence
tcccagagcatttccctctt

SEQ ID NO: 260318 - DNA, 20 bp, Artificial
  CRISPR gRNA sequence
cccagagcatttccctctta

SEQ ID NO: 260319 - DNA, 20 bp, Artificial
  CRISPR gRNA sequence
atttccctcttaaggctctg

SEQ ID NO: 260320 - DNA, 20 bp, Artificial
  CRISPR gRNA sequence
ctcttaaggctctgtagttc

SEQ ID NO: 260321 - DNA, 20 bp, Artificial
  CRISPR gRNA sequence
tcttaaggctctgtagttct

SEQ ID NO: 260322 - DNA, 20 bp, Artificial
  CRISPR gRNA sequence
aaggctctgtagttctgggc

SEQ ID NO: 260323 - DNA, 20 bp, Artificial
  CRISPR gRNA sequence
tgggctggactcctatccca

SEQ ID NO: 260324 - DNA, 20 bp, Artificial
  CRISPR gRNA sequence
tggactcctatcccaaagtc

SEQ ID NO: 260325 - DNA, 20 bp, Artificial
  CRISPR gRNA sequence
gtccagcaaaatactctctg

SEQ ID NO: 260326 - DNA, 20 bp, Artificial
  CRISPR gRNA sequence
aaaatactctctgtggatct

SEQ ID NO: 260327 - DNA, 20 bp, Artificial
  CRISPR gRNA sequence
tctcagttgcacaattatcc

SEQ ID NO: 260328 - DNA, 20 bp, Artificial
  CRISPR gRNA sequence
gttgcacaattatccgagtc

SEQ ID NO: 260329 - DNA, 20 bp, Artificial
  CRISPR gRNA sequence
gcacaattatccgagtctag

SEQ ID NO: 260330 - DNA, 20 bp, Artificial
  CRISPR gRNA sequence
agtctagtagaaaacatgca

SEQ ID NO: 260331 - DNA, 20 bp, Artificial
  CRISPR gRNA sequence
gtctagtagaaaacatgcaa

SEQ ID NO: 260332 - DNA, 20 bp, Artificial
  CRISPR gRNA sequence
tctagtagaaaacatgcaaa

SEQ ID NO: 260333 - DNA, 20 bp, Artificial
  CRISPR gRNA sequence
aacatgcaaagggcttatct

SEQ ID NO: 260334 - DNA, 20 bp, Artificial
  CRISPR gRNA sequence
gcaaagggcttatctaagtt

SEQ ID NO: 260335 - DNA, 20 bp, Artificial
  CRISPR gRNA sequence
caaagggcttatctaagtta

SEQ ID NO: 260336 - DNA, 20 bp, Artificial
  CRISPR gRNA sequence
taaatcacacttctttaact

SEQ ID NO: 260337 - DNA, 20 bp, Artificial
  CRISPR gRNA sequence
tacactgtcatccaactcat

SEQ ID NO: 260338 - DNA, 20 bp, Artificial
  CRISPR gRNA sequence
acactgtcatccaactcata

SEQ ID NO: 260339 - DNA, 20 bp, Artificial
  CRISPR gRNA sequence
tcatccaactcataaggaat

SEQ ID NO: 260340 - DNA, 20 bp, Artificial
  CRISPR gRNA sequence
catccaactcataaggaatc

SEQ ID NO: 260341 - DNA, 20 bp, Artificial
  CRISPR gRNA sequence
caactcataaggaatcaggt

SEQ ID NO: 260342 - DNA, 20 bp, Artificial
  CRISPR gRNA sequence
caggttagacttaaccttta

SEQ ID NO: 260343 - DNA, 20 bp, Artificial
  CRISPR gRNA sequence
ctttatagaataaatatttt

SEQ ID NO: 260344 - DNA, 20 bp, Artificial
  CRISPR gRNA sequence
aagctatgctgtaaacaaat

SEQ ID NO: 260345 - DNA, 20 bp, Artificial
  CRISPR gRNA sequence
aagttacattattaaattaa

SEQ ID NO: 260346 - DNA, 20 bp, Artificial
  CRISPR gRNA sequence
attattaaattaatggaaaa

SEQ ID NO: 260347 - DNA, 20 bp, Artificial
  CRISPR gRNA sequence
cacacacattattaaattaa

SEQ ID NO: 260348 - DNA, 20 bp, Artificial
  CRISPR gRNA sequence
attattaaattaatggaaaa

SEQ ID NO: 260349 - DNA, 20 bp, Artificial
  CRISPR gRNA sequence
tacacacacatgcacgcaca

SEQ ID NO: 260350 - DNA, 20 bp, Artificial
  CRISPR gRNA sequence
cacagatacacatctcaaca

SEQ ID NO: 260351 - DNA, 20 bp, Artificial
  CRISPR gRNA sequence
acagatacacatctcaacac

SEQ ID NO: 260352 - DNA, 20 bp, Artificial
  CRISPR gRNA sequence
acatctcaacacaggcataa

SEQ ID NO: 260353 - DNA, 20 bp, Artificial
  CRISPR gRNA sequence
tctcaacacaggcataacag

SEQ ID NO: 260354 - DNA, 20 bp, Artificial
  CRISPR gRNA sequence
caggcataacagtggtttct

SEQ ID NO: 260355 - DNA, 20 bp, Artificial
  CRISPR gRNA sequence
taacagtggtttctcagacc

SEQ ID NO: 260356 - DNA, 20 bp, Artificial
  CRISPR gRNA sequence
aacagtggtttctcagacct

SEQ ID NO: 260357 - DNA, 20 bp, Artificial
  CRISPR gRNA sequence
agtggtttctcagacctagg

SEQ ID NO: 260358 - DNA, 20 bp, Artificial
  CRISPR gRNA sequence
gtggtttctcagacctagga

SEQ ID NO: 260359 - DNA, 20 bp, Artificial
  CRISPR gRNA sequence
tttctcagacctaggaagga

SEQ ID NO: 260360 - DNA, 20 bp, Artificial
  CRISPR gRNA sequence
aaggacagttacactttgac

SEQ ID NO: 260361 - DNA, 20 bp, Artificial
  CRISPR gRNA sequence
ggacagttacactttgacca

SEQ ID NO: 260362 - DNA, 20 bp, Artificial
  CRISPR gRNA sequence
ccctatctataatttcttaa

SEQ ID NO: 260363 - DNA, 20 bp, Artificial
  CRISPR gRNA sequence
tatctataatttcttaatgg

SEQ ID NO: 260364 - DNA, 20 bp, Artificial
  CRISPR gRNA sequence
atctataatttcttaatgga

SEQ ID NO: 260365 - DNA, 20 bp, Artificial
  CRISPR gRNA sequence
ttcttaatggaaggtgtgta

SEQ ID NO: 260366 - DNA, 20 bp, Artificial
  CRISPR gRNA sequence
cttaatggaaggtgtgtaca

SEQ ID NO: 260367 - DNA, 20 bp, Artificial
  CRISPR gRNA sequence
atggaaggtgtgtacagaga

SEQ ID NO: 260368 - DNA, 20 bp, Artificial
  CRISPR gRNA sequence
tggaaggtgtgtacagagaa

SEQ ID NO: 260369 - DNA, 20 bp, Artificial
  CRISPR gRNA sequence
ggtgtgtacagagaaaggca

SEQ ID NO: 260370 - DNA, 20 bp, Artificial
  CRISPR gRNA sequence
cagagaaaggcaaagcacac

SEQ ID NO: 260371 - DNA, 20 bp, Artificial
  CRISPR gRNA sequence
agaaaggcaaagcacacaag

SEQ ID NO: 260372 - DNA, 20 bp, Artificial
  CRISPR gRNA sequence
gaagctttgcactatttgat

SEQ ID NO: 260373 - DNA, 20 bp, Artificial
  CRISPR gRNA sequence
tgcactatttgattagaatg

SEQ ID NO: 260374 - DNA, 20 bp, Artificial
  CRISPR gRNA sequence
cataattttttttttttttt

SEQ ID NO: 260375 - DNA, 20 bp, Artificial
  CRISPR gRNA sequence
ttttttttgagactgtttcc

SEQ ID NO: 260376 - DNA, 20 bp, Artificial
  CRISPR gRNA sequence
tttttttgagactgtttccc

SEQ ID NO: 260377 - DNA, 20 bp, Artificial
  CRISPR gRNA sequence
tttgagactgtttcccaggc

SEQ ID NO: 260378 - DNA, 20 bp, Artificial
  CRISPR gRNA sequence
tgagactgtttcccaggctg

SEQ ID NO: 260379 - DNA, 20 bp, Artificial
  CRISPR gRNA sequence
ctgtttcccaggctggagtg

SEQ ID NO: 260380 - DNA, 20 bp, Artificial
  CRISPR gRNA sequence
tgtttcccaggctggagtgc

SEQ ID NO: 260381 - DNA, 20 bp, Artificial
  CRISPR gRNA sequence
gtttcccaggctggagtgca

SEQ ID NO: 260382 - DNA, 20 bp, Artificial
  CRISPR gRNA sequence
tttcccaggctggagtgcag

SEQ ID NO: 260383 - DNA, 20 bp, Artificial
  CRISPR gRNA sequence
ggagtgcaggggtgcaatct

SEQ ID NO: 260384 - DNA, 20 bp, Artificial
  CRISPR gRNA sequence
aggggtgcaatctaagttca

SEQ ID NO: 260385 - DNA, 20 bp, Artificial
  CRISPR gRNA sequence
tcacagcaacctccgcgtcc

SEQ ID NO: 260386 - DNA, 20 bp, Artificial
  CRISPR gRNA sequence
cacagcaacctccgcgtccc

SEQ ID NO: 260387 - DNA, 20 bp, Artificial
  CRISPR gRNA sequence
aacctccgcgtcccgggttt

SEQ ID NO: 260388 - DNA, 20 bp, Artificial
  CRISPR gRNA sequence
tttaagcaattctcctgcct

SEQ ID NO: 260389 - DNA, 20 bp, Artificial
  CRISPR gRNA sequence
ttctcctgcctaagcctcac

SEQ ID NO: 260390 - DNA, 20 bp, Artificial
  CRISPR gRNA sequence
tcctgcctaagcctcacaag

SEQ ID NO: 260391 - DNA, 20 bp, Artificial
  CRISPR gRNA sequence
gcctaagcctcacaagtagc

SEQ ID NO: 260392 - DNA, 20 bp, Artificial
  CRISPR gRNA sequence
cctaagcctcacaagtagct

SEQ ID NO: 260393 - DNA, 20 bp, Artificial
  CRISPR gRNA sequence
ctcacaagtagctgggatta

SEQ ID NO: 260394 - DNA, 20 bp, Artificial
  CRISPR gRNA sequence
tcacaagtagctgggattac

SEQ ID NO: 260395 - DNA, 20 bp, Artificial
  CRISPR gRNA sequence
tgctaatttttttgtatttt

SEQ ID NO: 260396 - DNA, 20 bp, Artificial
  CRISPR gRNA sequence
taatttttttgtatttttag

SEQ ID NO: 260397 - DNA, 20 bp, Artificial
  CRISPR gRNA sequence
atttttttgtatttttagta

SEQ ID NO: 260398 - DNA, 20 bp, Artificial
  CRISPR gRNA sequence
ttttgtatttttagtagaga

SEQ ID NO: 260399 - DNA, 20 bp, Artificial
  CRISPR gRNA sequence
tttgtatttttagtagagat

SEQ ID NO: 260400 - DNA, 20 bp, Artificial
  CRISPR gRNA sequence
gagatgggatttcaccatgt

SEQ ID NO: 260401 - DNA, 20 bp, Artificial
  CRISPR gRNA sequence
atttcaccatgttagcccga

SEQ ID NO: 260402 - DNA, 20 bp, Artificial
  CRISPR gRNA sequence
tttcaccatgttagcccgac

SEQ ID NO: 260403 - DNA, 20 bp, Artificial
  CRISPR gRNA sequence
ggtctccaactcctgacctc

SEQ ID NO: 260404 - DNA, 20 bp, Artificial
  CRISPR gRNA sequence
ctcaagtgatccacccgcct

SEQ ID NO: 260405 - DNA, 20 bp, Artificial
  CRISPR gRNA sequence
gcctcagcgtcccacgatta

SEQ ID NO: 260406 - DNA, 20 bp, Artificial
  CRISPR gRNA sequence
cctcagcgtcccacgattac

SEQ ID NO: 260407 - DNA, 20 bp, Artificial
  CRISPR gRNA sequence
cgtcccacgattacaggcgt

SEQ ID NO: 260408 - DNA, 20 bp, Artificial
  CRISPR gRNA sequence
acaggcgtgagccaccacac

SEQ ID NO: 260409 - DNA, 20 bp, Artificial
  CRISPR gRNA sequence
caggcgtgagccaccacacc

SEQ ID NO: 260410 - DNA, 20 bp, Artificial
  CRISPR gRNA sequence
caaatcatacattttttatg

SEQ ID NO: 260411 - DNA, 20 bp, Artificial
  CRISPR gRNA sequence
gtcattcttttcttgctcgt

SEQ ID NO: 260412 - DNA, 20 bp, Artificial
  CRISPR gRNA sequence
ttgctcgtaagttttcttac

SEQ ID NO: 260413 - DNA, 20 bp, Artificial
  CRISPR gRNA sequence
cgtaagttttcttactggaa

SEQ ID NO: 260414 - DNA, 20 bp, Artificial
  CRISPR gRNA sequence
cttactggaaaagactgtaa

SEQ ID NO: 260415 - DNA, 20 bp, Artificial
  CRISPR gRNA sequence
ccatctctttccttcttcat

SEQ ID NO: 260416 - DNA, 20 bp, Artificial
  CRISPR gRNA sequence
ctctttccttcttcattaga

SEQ ID NO: 260417 - DNA, 20 bp, Artificial
  CRISPR gRNA sequence
ttcttcattagatagccact

SEQ ID NO: 260418 - DNA, 20 bp, Artificial
  CRISPR gRNA sequence
cactcagtatcaaatgctaa

SEQ ID NO: 260419 - DNA, 20 bp, Artificial
  CRISPR gRNA sequence
tatcaaatgctaaaagttac

SEQ ID NO: 260420 - DNA, 20 bp, Artificial
  CRISPR gRNA sequence
aatgctaaaagttactagaa

SEQ ID NO: 260421 - DNA, 20 bp, Artificial
  CRISPR gRNA sequence
aagttactagaaaagtgaat

SEQ ID NO: 260422 - DNA, 20 bp, Artificial
  CRISPR gRNA sequence
aaagtgaattggcatttgaa

SEQ ID NO: 260423 - DNA, 20 bp, Artificial
  CRISPR gRNA sequence
tgaaaagtaaatatatgtca

SEQ ID NO: 260424 - DNA, 20 bp, Artificial
  CRISPR gRNA sequence
aaagtaaatatatgtcaaag

SEQ ID NO: 260425 - DNA, 20 bp, Artificial
  CRISPR gRNA sequence
atatgtcaaagtagaaaaca

SEQ ID NO: 260426 - DNA, 20 bp, Artificial
  CRISPR gRNA sequence
tatgtcaaagtagaaaacaa

SEQ ID NO: 260427 - DNA, 20 bp, Artificial
  CRISPR gRNA sequence
gaactctccaaccacttatc

SEQ ID NO: 260428 - DNA, 20 bp, Artificial
  CRISPR gRNA sequence
tctccaaccacttatctagc

SEQ ID NO: 260429 - DNA, 20 bp, Artificial
  CRISPR gRNA sequence
cccttttaataaatgttcta

SEQ ID NO: 260430 - DNA, 20 bp, Artificial
  CRISPR gRNA sequence
tgttctaaagaaaacataca

SEQ ID NO: 260431 - DNA, 20 bp, Artificial
  CRISPR gRNA sequence
aagaaaacatacaaagtttt

SEQ ID NO: 260432 - DNA, 20 bp, Artificial
  CRISPR gRNA sequence
tcttaccaaaaactcttcaa

SEQ ID NO: 260433 - DNA, 20 bp, Artificial
  CRISPR gRNA sequence
ttaccaaaaactcttcaaaa

SEQ ID NO: 260434 - DNA, 20 bp, Artificial
  CRISPR gRNA sequence
accaaaaactcttcaaaaga

SEQ ID NO: 260435 - DNA, 20 bp, Artificial
  CRISPR gRNA sequence
ctcttcaaaagagagtgaat

SEQ ID NO: 260436 - DNA, 20 bp, Artificial
  CRISPR gRNA sequence
gagagtgaataagttgatga

SEQ ID NO: 260437 - DNA, 20 bp, Artificial
  CRISPR gRNA sequence
gtgaataagttgatgacaga

SEQ ID NO: 260438 - DNA, 20 bp, Artificial
  CRISPR gRNA sequence
tgaataagttgatgacagat

SEQ ID NO: 260439 - DNA, 20 bp, Artificial
  CRISPR gRNA sequence
atgacagataggtgtccaca

SEQ ID NO: 260440 - DNA, 20 bp, Artificial
  CRISPR gRNA sequence
taggtgtccacaaagcacat

SEQ ID NO: 260441 - DNA, 20 bp, Artificial
  CRISPR gRNA sequence
gtccacaaagcacatcagaa

SEQ ID NO: 260442 - DNA, 20 bp, Artificial
  CRISPR gRNA sequence
aagcacatcagaaaagtatt

SEQ ID NO: 260443 - DNA, 20 bp, Artificial
  CRISPR gRNA sequence
gtacaattaccaattttaaa

SEQ ID NO: 260444 - DNA, 20 bp, Artificial
  CRISPR gRNA sequence
taccaattttaaatagtttt

SEQ ID NO: 260445 - DNA, 20 bp, Artificial
  CRISPR gRNA sequence
aattttaaatagttttcagt

SEQ ID NO: 260446 - DNA, 20 bp, Artificial
  CRISPR gRNA sequence
attttaaatagttttcagtc

SEQ ID NO: 260447 - DNA, 20 bp, Artificial
  CRISPR gRNA sequence
ttttaaatagttttcagtca

SEQ ID NO: 260448 - DNA, 20 bp, Artificial
  CRISPR gRNA sequence
taaatagttttcagtcaggg

SEQ ID NO: 260449 - DNA, 20 bp, Artificial
  CRISPR gRNA sequence
aaatagttttcagtcagggt

SEQ ID NO: 260450 - DNA, 20 bp, Artificial
  CRISPR gRNA sequence
ccttgactgtctaacaaatt

SEQ ID NO: 260451 - DNA, 20 bp, Artificial
  CRISPR gRNA sequence
agtaattttaaatattcttt

SEQ ID NO: 260452 - DNA, 20 bp, Artificial
  CRISPR gRNA sequence
tttaaatattctttaagttt

SEQ ID NO: 260453 - DNA, 20 bp, Artificial
  CRISPR gRNA sequence
taaatattctttaagtttga

SEQ ID NO: 260454 - DNA, 20 bp, Artificial
  CRISPR gRNA sequence
ttgagagatctcttaaaaat

SEQ ID NO: 260455 - DNA, 20 bp, Artificial
  CRISPR gRNA sequence
tgagagatctcttaaaaata

SEQ ID NO: 260456 - DNA, 20 bp, Artificial
  CRISPR gRNA sequence
cctttttaaaataaatgtta

SEQ ID NO: 260457 - DNA, 20 bp, Artificial
  CRISPR gRNA sequence
ataaatgttaaagattcttg

SEQ ID NO: 260458 - DNA, 20 bp, Artificial
  CRISPR gRNA sequence
agattcttgtagaatatatt

SEQ ID NO: 260459 - DNA, 20 bp, Artificial
  CRISPR gRNA sequence
ttcttgtagaatatatttgg

SEQ ID NO: 260460 - DNA, 20 bp, Artificial
  CRISPR gRNA sequence
atttggtagctgtaaacgct

SEQ ID NO: 260461 - DNA, 20 bp, Artificial
  CRISPR gRNA sequence
tagctgtaaacgcttggtac

SEQ ID NO: 260462 - DNA, 20 bp, Artificial
  CRISPR gRNA sequence
tatacacaatttgtgctcac

SEQ ID NO: 260463 - DNA, 20 bp, Artificial
  CRISPR gRNA sequence
atttgtgctcactggtacgt

SEQ ID NO: 260464 - DNA, 20 bp, Artificial
  CRISPR gRNA sequence
acgtcagaccataaaataaa

SEQ ID NO: 260465 - DNA, 20 bp, Artificial
  CRISPR gRNA sequence
cgtcagaccataaaataaac

SEQ ID NO: 260466 - DNA, 20 bp, Artificial
  CRISPR gRNA sequence
atgcaactactgtacctctg

SEQ ID NO: 260467 - DNA, 20 bp, Artificial
  CRISPR gRNA sequence
actactgtacctctgcagat

SEQ ID NO: 260468 - DNA, 20 bp, Artificial
  CRISPR gRNA sequence
ctactgtacctctgcagatt

SEQ ID NO: 260469 - DNA, 20 bp, Artificial
  CRISPR gRNA sequence
gattgggaaattatactctt

SEQ ID NO: 260470 - DNA, 20 bp, Artificial
  CRISPR gRNA sequence
attgggaaattatactcttt

SEQ ID NO: 260471 - DNA, 20 bp, Artificial
  CRISPR gRNA sequence
gctatgtacacttaatgttt

SEQ ID NO: 260472 - DNA, 20 bp, Artificial
  CRISPR gRNA sequence
aagaataacaacaaataatg

SEQ ID NO: 260473 - DNA, 20 bp, Artificial
  CRISPR gRNA sequence
agtctctgtactgccaaaat

SEQ ID NO: 260474 - DNA, 20 bp, Artificial
  CRISPR gRNA sequence
tctgtactgccaaaataaga

SEQ ID NO: 260475 - DNA, 20 bp, Artificial
  CRISPR gRNA sequence
ccaaaataagaaagaaaatt

SEQ ID NO: 260476 - DNA, 20 bp, Artificial
  CRISPR gRNA sequence
caaaataagaaagaaaattg

SEQ ID NO: 260477 - DNA, 20 bp, Artificial
  CRISPR gRNA sequence
agaaagaaaattgaggatac

SEQ ID NO: 260478 - DNA, 20 bp, Artificial
  CRISPR gRNA sequence
tggcttttcaatgtatcttt

SEQ ID NO: 260479 - DNA, 20 bp, Artificial
  CRISPR gRNA sequence
ggcttttcaatgtatctttc

SEQ ID NO: 260480 - DNA, 20 bp, Artificial
  CRISPR gRNA sequence
gcttttcaatgtatctttca

SEQ ID NO: 260481 - DNA, 20 bp, Artificial
  CRISPR gRNA sequence
aaaaataactgtccttattt

SEQ ID NO: 260482 - DNA, 20 bp, Artificial
  CRISPR gRNA sequence
gcatgactgttgacccctat

SEQ ID NO: 260483 - DNA, 20 bp, Artificial
  CRISPR gRNA sequence
actgttgacccctatcagtc

SEQ ID NO: 260484 - DNA, 20 bp, Artificial
  CRISPR gRNA sequence
atcagtccagtttttgaacc

SEQ ID NO: 260485 - DNA, 20 bp, Artificial
  CRISPR gRNA sequence
agtccagtttttgaaccaag

SEQ ID NO: 260486 - DNA, 20 bp, Artificial
  CRISPR gRNA sequence
gtccagtttttgaaccaagc

SEQ ID NO: 260487 - DNA, 20 bp, Artificial
  CRISPR gRNA sequence
tccagtttttgaaccaagcg

SEQ ID NO: 260488 - DNA, 20 bp, Artificial
  CRISPR gRNA sequence
ccagtttttgaaccaagcgg

SEQ ID NO: 260489 - DNA, 20 bp, Artificial
  CRISPR gRNA sequence
gggggcctttttctaactct

SEQ ID NO: 260490 - DNA, 20 bp, Artificial
  CRISPR gRNA sequence
actctgagaacacgttgaat

SEQ ID NO: 260491 - DNA, 20 bp, Artificial
  CRISPR gRNA sequence
gttgaatgagcatcttactc

SEQ ID NO: 260492 - DNA, 20 bp, Artificial
  CRISPR gRNA sequence
catcttactccagcccaccc

SEQ ID NO: 260493 - DNA, 20 bp, Artificial
  CRISPR gRNA sequence
aagtaacaaattctttctgt

SEQ ID NO: 260494 - DNA, 20 bp, Artificial
  CRISPR gRNA sequence
agtaacaaattctttctgtt

SEQ ID NO: 260495 - DNA, 20 bp, Artificial
  CRISPR gRNA sequence
attgtgcttgtgattttccg

SEQ ID NO: 260496 - DNA, 20 bp, Artificial
  CRISPR gRNA sequence
ttccgaagttaatttaaccc

SEQ ID NO: 260497 - DNA, 20 bp, Artificial
  CRISPR gRNA sequence
atttaaccctggatttacct

SEQ ID NO: 260498 - DNA, 20 bp, Artificial
  CRISPR gRNA sequence
aattacaaatcacaccatgt

SEQ ID NO: 260499 - DNA, 20 bp, Artificial
  CRISPR gRNA sequence
acaaatcacaccatgttaga

SEQ ID NO: 260500 - DNA, 20 bp, Artificial
  CRISPR gRNA sequence
tcacaccatgttagatggaa

SEQ ID NO: 260501 - DNA, 20 bp, Artificial
  CRISPR gRNA sequence
agcataataatcaacaacac

SEQ ID NO: 260502 - DNA, 20 bp, Artificial
  CRISPR gRNA sequence
ataatcaacaacaccggcac

SEQ ID NO: 260503 - DNA, 20 bp, Artificial
  CRISPR gRNA sequence
aatcaacaacaccggcactg

SEQ ID NO: 260504 - DNA, 20 bp, Artificial
  CRISPR gRNA sequence
aacaacaccggcactggagt

SEQ ID NO: 260505 - DNA, 20 bp, Artificial
  CRISPR gRNA sequence
accggcactggagtcagact

SEQ ID NO: 260506 - DNA, 20 bp, Artificial
  CRISPR gRNA sequence
ccggcactggagtcagacta

SEQ ID NO: 260507 - DNA, 20 bp, Artificial
  CRISPR gRNA sequence
gcactggagtcagactaagg

SEQ ID NO: 260508 - DNA, 20 bp, Artificial
  CRISPR gRNA sequence
ggagtcagactaaggtggtt

SEQ ID NO: 260509 - DNA, 20 bp, Artificial
  CRISPR gRNA sequence
ggttcagaccctgcctccta

SEQ ID NO: 260510 - DNA, 20 bp, Artificial
  CRISPR gRNA sequence
agctgccacctgtacatcct

SEQ ID NO: 260511 - DNA, 20 bp, Artificial
  CRISPR gRNA sequence
gctgccacctgtacatcctt

SEQ ID NO: 260512 - DNA, 20 bp, Artificial
  CRISPR gRNA sequence
cccttaatgtgcctacccct

SEQ ID NO: 260513 - DNA, 20 bp, Artificial
  CRISPR gRNA sequence
cagtctcttcatctgaaatg

SEQ ID NO: 260514 - DNA, 20 bp, Artificial
  CRISPR gRNA sequence
taactgtaatacctaccttc

SEQ ID NO: 260515 - DNA, 20 bp, Artificial
  CRISPR gRNA sequence
aatacctaccttctagttac

SEQ ID NO: 260516 - DNA, 20 bp, Artificial
  CRISPR gRNA sequence
cgagaactgtgtgctgctca

SEQ ID NO: 260517 - DNA, 20 bp, Artificial
  CRISPR gRNA sequence
ctgtgtgctgctcaaagtgc

SEQ ID NO: 260518 - DNA, 20 bp, Artificial
  CRISPR gRNA sequence
atcctcctcatcatcgtcat

SEQ ID NO: 260519 - DNA, 20 bp, Artificial
  CRISPR gRNA sequence
tcctcctcatcatcgtcatt

SEQ ID NO: 260520 - DNA, 20 bp, Artificial
  CRISPR gRNA sequence
tcatcgtcattgggaactta

SEQ ID NO: 260521 - DNA, 20 bp, Artificial
  CRISPR gRNA sequence
aacttaaagaattttaatct

SEQ ID NO: 260522 - DNA, 20 bp, Artificial
  CRISPR gRNA sequence
taatctaagaaaatacattt

SEQ ID NO: 260523 - DNA, 20 bp, Artificial
  CRISPR gRNA sequence
tacattttggccgattgtaa

SEQ ID NO: 260524 - DNA, 20 bp, Artificial
  CRISPR gRNA sequence
gaaaactaatttattaatat

SEQ ID NO: 260525 - DNA, 20 bp, Artificial
  CRISPR gRNA sequence
atttattaatattggtgttg

SEQ ID NO: 260526 - DNA, 20 bp, Artificial
  CRISPR gRNA sequence
tattaatattggtgttgtag

SEQ ID NO: 260527 - DNA, 20 bp, Artificial
  CRISPR gRNA sequence
tggtgttgtagcagcttctg

SEQ ID NO: 260528 - DNA, 20 bp, Artificial
  CRISPR gRNA sequence
agcagcttctgtggtgactc

SEQ ID NO: 260529 - DNA, 20 bp, Artificial
  CRISPR gRNA sequence
ggtgactccagaattcatgt

SEQ ID NO: 260530 - DNA, 20 bp, Artificial
  CRISPR gRNA sequence
atgttggaactcattcaatt

SEQ ID NO: 260531 - DNA, 20 bp, Artificial
  CRISPR gRNA sequence
tgttggaactcattcaattc

SEQ ID NO: 260532 - DNA, 20 bp, Artificial
  CRISPR gRNA sequence
tggaactcattcaattcagg

SEQ ID NO: 260533 - DNA, 20 bp, Artificial
  CRISPR gRNA sequence
actcattcaattcaggtaga

SEQ ID NO: 260534 - DNA, 20 bp, Artificial
  CRISPR gRNA sequence
tcattcaattcaggtagata

SEQ ID NO: 260535 - DNA, 20 bp, Artificial
  CRISPR gRNA sequence
tcaggtagatagagtaatta

SEQ ID NO: 260536 - DNA, 20 bp, Artificial
  CRISPR gRNA sequence
tacagttcacatttatcttg

SEQ ID NO: 260537 - DNA, 20 bp, Artificial
  CRISPR gRNA sequence
atttatcttgaagcctgact

SEQ ID NO: 260538 - DNA, 20 bp, Artificial
  CRISPR gRNA sequence
tcttgaagcctgactgagct

SEQ ID NO: 260539 - DNA, 20 bp, Artificial
  CRISPR gRNA sequence
actgagctaagcccttcgca

SEQ ID NO: 260540 - DNA, 20 bp, Artificial
  CRISPR gRNA sequence
ttttacctcacaatgacctt

SEQ ID NO: 260541 - DNA, 20 bp, Artificial
  CRISPR gRNA sequence
tttacctcacaatgaccttg

SEQ ID NO: 260542 - DNA, 20 bp, Artificial
  CRISPR gRNA sequence
cctcacaatgaccttgaggt

SEQ ID NO: 260543 - DNA, 20 bp, Artificial
  CRISPR gRNA sequence
ctcacaatgaccttgaggtg

SEQ ID NO: 260544 - DNA, 20 bp, Artificial
  CRISPR gRNA sequence
ttattattattcccacttta

SEQ ID NO: 260545 - DNA, 20 bp, Artificial
  CRISPR gRNA sequence
attattcccactttacagtt

SEQ ID NO: 260546 - DNA, 20 bp, Artificial
  CRISPR gRNA sequence
ttattcccactttacagtta

SEQ ID NO: 260547 - DNA, 20 bp, Artificial
  CRISPR gRNA sequence
actttacagttaaggaaact

SEQ ID NO: 260548 - DNA, 20 bp, Artificial
  CRISPR gRNA sequence
ctttacagttaaggaaactg

SEQ ID NO: 260549 - DNA, 20 bp, Artificial
  CRISPR gRNA sequence
cagttaaggaaactgaggtt

SEQ ID NO: 260550 - DNA, 20 bp, Artificial
  CRISPR gRNA sequence
gttaaggaaactgaggtttg

SEQ ID NO: 260551 - DNA, 20 bp, Artificial
  CRISPR gRNA sequence
taaggaaactgaggtttgga

SEQ ID NO: 260552 - DNA, 20 bp, Artificial
  CRISPR gRNA sequence
ggtttggagagtttaaataa

SEQ ID NO: 260553 - DNA, 20 bp, Artificial
  CRISPR gRNA sequence
ggagagtttaaataatagct

SEQ ID NO: 260554 - DNA, 20 bp, Artificial
  CRISPR gRNA sequence
tttaaataatagctaagcct

SEQ ID NO: 260555 - DNA, 20 bp, Artificial
  CRISPR gRNA sequence
tagctaagcctaagcttacc

SEQ ID NO: 260556 - DNA, 20 bp, Artificial
  CRISPR gRNA sequence
taagcctaagcttacctagt

SEQ ID NO: 260557 - DNA, 20 bp, Artificial
  CRISPR gRNA sequence
taagcttacctagtgagaat

SEQ ID NO: 260558 - DNA, 20 bp, Artificial
  CRISPR gRNA sequence
agtgagaattggacctgtgt

SEQ ID NO: 260559 - DNA, 20 bp, Artificial
  CRISPR gRNA sequence
gtgagaattggacctgtgtt

SEQ ID NO: 260560 - DNA, 20 bp, Artificial
  CRISPR gRNA sequence
ttggacctgtgttaggaaca

SEQ ID NO: 260561 - DNA, 20 bp, Artificial
  CRISPR gRNA sequence
tggacctgtgttaggaacat

SEQ ID NO: 260562 - DNA, 20 bp, Artificial
  CRISPR gRNA sequence
gaacataggcaacctaaatt

SEQ ID NO: 260563 - DNA, 20 bp, Artificial
  CRISPR gRNA sequence
acataggcaacctaaattca

SEQ ID NO: 260564 - DNA, 20 bp, Artificial
  CRISPR gRNA sequence
caacctaaattcagagcttc

SEQ ID NO: 260565 - DNA, 20 bp, Artificial
  CRISPR gRNA sequence
acctaaattcagagcttcca

SEQ ID NO: 260566 - DNA, 20 bp, Artificial
  CRISPR gRNA sequence
ttccagagccaatctactta

SEQ ID NO: 260567 - DNA, 20 bp, Artificial
  CRISPR gRNA sequence
cagagccaatctacttacag

SEQ ID NO: 260568 - DNA, 20 bp, Artificial
  CRISPR gRNA sequence
tttcttaaattaaaaaaaaa

SEQ ID NO: 260569 - DNA, 20 bp, Artificial
  CRISPR gRNA sequence
ttaaattaaaaaaaaaaaga

SEQ ID NO: 260570 - DNA, 20 bp, Artificial
  CRISPR gRNA sequence
attaaaaaaaaaaagaaaga

SEQ ID NO: 260571 - DNA, 20 bp, Artificial
  CRISPR gRNA sequence
aaaaaaaaaagaaagaaaga

SEQ ID NO: 260572 - DNA, 20 bp, Artificial
  CRISPR gRNA sequence
atacataaattaaaaattat

SEQ ID NO: 260573 - DNA, 20 bp, Artificial
  CRISPR gRNA sequence
ataaattaaaaattattggc

SEQ ID NO: 260574 - DNA, 20 bp, Artificial
  CRISPR gRNA sequence
taaattaaaaattattggcc

SEQ ID NO: 260575 - DNA, 20 bp, Artificial
  CRISPR gRNA sequence
taaaaattattggccgggca

SEQ ID NO: 260576 - DNA, 20 bp, Artificial
  CRISPR gRNA sequence
aaattattggccgggcatgg

SEQ ID NO: 260577 - DNA, 20 bp, Artificial
  CRISPR gRNA sequence
gtagctcatgcctgtaaccc

SEQ ID NO: 260578 - DNA, 20 bp, Artificial
  CRISPR gRNA sequence
tgcctgtaaccctagcactt

SEQ ID NO: 260579 - DNA, 20 bp, Artificial
  CRISPR gRNA sequence
gcctgtaaccctagcacttt

SEQ ID NO: 260580 - DNA, 20 bp, Artificial
  CRISPR gRNA sequence
ctgtaaccctagcactttgg

SEQ ID NO: 260581 - DNA, 20 bp, Artificial
  CRISPR gRNA sequence
tgtaaccctagcactttggg

SEQ ID NO: 260582 - DNA, 20 bp, Artificial
  CRISPR gRNA sequence
aaccctagcactttgggagg

SEQ ID NO: 260583 - DNA, 20 bp, Artificial
  CRISPR gRNA sequence
ccctagcactttgggaggca

SEQ ID NO: 260584 - DNA, 20 bp, Artificial
  CRISPR gRNA sequence
cctagcactttgggaggcag

SEQ ID NO: 260585 - DNA, 20 bp, Artificial
  CRISPR gRNA sequence
agcactttgggaggcagagg

SEQ ID NO: 260586 - DNA, 20 bp, Artificial
  CRISPR gRNA sequence
gcactttgggaggcagaggc

SEQ ID NO: 260587 - DNA, 20 bp, Artificial
  CRISPR gRNA sequence
ctttgggaggcagaggcagg

SEQ ID NO: 260588 - DNA, 20 bp, Artificial
  CRISPR gRNA sequence
cagaggcaggtggattgctt

SEQ ID NO: 260589 - DNA, 20 bp, Artificial
  CRISPR gRNA sequence
gcaggtggattgcttgagct

SEQ ID NO: 260590 - DNA, 20 bp, Artificial
  CRISPR gRNA sequence
ggtggattgcttgagctcag

SEQ ID NO: 260591 - DNA, 20 bp, Artificial
  CRISPR gRNA sequence
ttgcttgagctcagaagttt

SEQ ID NO: 260592 - DNA, 20 bp, Artificial
  CRISPR gRNA sequence
tgagctcagaagtttgagac

SEQ ID NO: 260593 - DNA, 20 bp, Artificial
  CRISPR gRNA sequence
tcagaagtttgagaccagcc

SEQ ID NO: 260594 - DNA, 20 bp, Artificial
  CRISPR gRNA sequence
cagaagtttgagaccagcct

SEQ ID NO: 260595 - DNA, 20 bp, Artificial
  CRISPR gRNA sequence
tgagaccagcctgggcaaca

SEQ ID NO: 260596 - DNA, 20 bp, Artificial
  CRISPR gRNA sequence
taataataataataaattct

SEQ ID NO: 260597 - DNA, 20 bp, Artificial
  CRISPR gRNA sequence
aataataataataaattctt

SEQ ID NO: 260598 - DNA, 20 bp, Artificial
  CRISPR gRNA sequence
cttgggacactatcaactaa

SEQ ID NO: 260599 - DNA, 20 bp, Artificial
  CRISPR gRNA sequence
ggacactatcaactaatagc

SEQ ID NO: 260600 - DNA, 20 bp, Artificial
  CRISPR gRNA sequence
acactatcaactaatagcta

SEQ ID NO: 260601 - DNA, 20 bp, Artificial
  CRISPR gRNA sequence
ctaatagctagagaaactaa

SEQ ID NO: 260602 - DNA, 20 bp, Artificial
  CRISPR gRNA sequence
agctagagaaactaatagct

SEQ ID NO: 260603 - DNA, 20 bp, Artificial
  CRISPR gRNA sequence
agcttagaaaatttatttcc

SEQ ID NO: 260604 - DNA, 20 bp, Artificial
  CRISPR gRNA sequence
gcttagaaaatttatttcca

SEQ ID NO: 260605 - DNA, 20 bp, Artificial
  CRISPR gRNA sequence
cttagaaaatttatttccaa

SEQ ID NO: 260606 - DNA, 20 bp, Artificial
  CRISPR gRNA sequence
atttccaagggacttttgtt

SEQ ID NO: 260607 - DNA, 20 bp, Artificial
  CRISPR gRNA sequence
tttgttaagatactatattg

SEQ ID NO: 260608 - DNA, 20 bp, Artificial
  CRISPR gRNA sequence
aagatactatattgtagtct

SEQ ID NO: 260609 - DNA, 20 bp, Artificial
  CRISPR gRNA sequence
aataacacattgccctatta

SEQ ID NO: 260610 - DNA, 20 bp, Artificial
  CRISPR gRNA sequence
gttcaaatttcacacattgt

SEQ ID NO: 260611 - DNA, 20 bp, Artificial
  CRISPR gRNA sequence
ttagaaatttaaaataaact

SEQ ID NO: 260612 - DNA, 20 bp, Artificial
  CRISPR gRNA sequence
ttaaaataaactaagccaat

SEQ ID NO: 260613 - DNA, 20 bp, Artificial
  CRISPR gRNA sequence
aaataaactaagccaattgg

SEQ ID NO: 260614 - DNA, 20 bp, Artificial
  CRISPR gRNA sequence
aagacctcaaaaaatattta

SEQ ID NO: 260615 - DNA, 20 bp, Artificial
  CRISPR gRNA sequence
cctcaaaaaatatttacaga

SEQ ID NO: 260616 - DNA, 20 bp, Artificial
  CRISPR gRNA sequence
aaaaaatatttacagaaaga

SEQ ID NO: 260617 - DNA, 20 bp, Artificial
  CRISPR gRNA sequence
tttacctgttacttgaattg

SEQ ID NO: 260618 - DNA, 20 bp, Artificial
  CRISPR gRNA sequence
ttacctgttacttgaattga

SEQ ID NO: 260619 - DNA, 20 bp, Artificial
  CRISPR gRNA sequence
tacctgttacttgaattgaa

SEQ ID NO: 260620 - DNA, 20 bp, Artificial
  CRISPR gRNA sequence
ttacttgaattgaagggaat

SEQ ID NO: 260621 - DNA, 20 bp, Artificial
  CRISPR gRNA sequence
tgaattgaagggaataagtt

SEQ ID NO: 260622 - DNA, 20 bp, Artificial
  CRISPR gRNA sequence
aattgaagggaataagttga

SEQ ID NO: 260623 - DNA, 20 bp, Artificial
  CRISPR gRNA sequence
aagggaataagttgagagcc

SEQ ID NO: 260624 - DNA, 20 bp, Artificial
  CRISPR gRNA sequence
gggaataagttgagagccaa

SEQ ID NO: 260625 - DNA, 20 bp, Artificial
  CRISPR gRNA sequence
aataagttgagagccaagag

SEQ ID NO: 260626 - DNA, 20 bp, Artificial
  CRISPR gRNA sequence
ttgagagccaagagcagcct

SEQ ID NO: 260627 - DNA, 20 bp, Artificial
  CRISPR gRNA sequence
gagcatctttgtcctgacga

SEQ ID NO: 260628 - DNA, 20 bp, Artificial
  CRISPR gRNA sequence
agcatctttgtcctgacgat

SEQ ID NO: 260629 - DNA, 20 bp, Artificial
  CRISPR gRNA sequence
tctttgtcctgacgatgggc

SEQ ID NO: 260630 - DNA, 20 bp, Artificial
  CRISPR gRNA sequence
ctttgtcctgacgatgggct

SEQ ID NO: 260631 - DNA, 20 bp, Artificial
  CRISPR gRNA sequence
tttgtcctgacgatgggcta

SEQ ID NO: 260632 - DNA, 20 bp, Artificial
  CRISPR gRNA sequence
ctgacgatgggctagggttc

SEQ ID NO: 260633 - DNA, 20 bp, Artificial
  CRISPR gRNA sequence
ggttccagcccctcctcccc

SEQ ID NO: 260634 - DNA, 20 bp, Artificial
  CRISPR gRNA sequence
gttccagcccctcctccccg

SEQ ID NO: 260635 - DNA, 20 bp, Artificial
  CRISPR gRNA sequence
cctcctccccgaggaacccg

SEQ ID NO: 260636 - DNA, 20 bp, Artificial
  CRISPR gRNA sequence
ccccgaggaacccgaagtgt

SEQ ID NO: 260637 - DNA, 20 bp, Artificial
  CRISPR gRNA sequence
cccgaggaacccgaagtgtg

SEQ ID NO: 260638 - DNA, 20 bp, Artificial
  CRISPR gRNA sequence
ccgaggaacccgaagtgtga

SEQ ID NO: 260639 - DNA, 20 bp, Artificial
  CRISPR gRNA sequence
cgaggaacccgaagtgtgag

SEQ ID NO: 260640 - DNA, 20 bp, Artificial
  CRISPR gRNA sequence
cgaagtgtgaggggaactga

SEQ ID NO: 260641 - DNA, 20 bp, Artificial
  CRISPR gRNA sequence
aactgaaagacgcacctgcc

SEQ ID NO: 260642 - DNA, 20 bp, Artificial
  CRISPR gRNA sequence
actgaaagacgcacctgcca

SEQ ID NO: 260643 - DNA, 20 bp, Artificial
  CRISPR gRNA sequence
agacgcacctgccaaggcct

SEQ ID NO: 260644 - DNA, 20 bp, Artificial
  CRISPR gRNA sequence
acgcacctgccaaggcctga

SEQ ID NO: 260645 - DNA, 20 bp, Artificial
  CRISPR gRNA sequence
ctgagagtctccgtcatcca

SEQ ID NO: 260646 - DNA, 20 bp, Artificial
  CRISPR gRNA sequence
caccaccgccaccatccccg

SEQ ID NO: 260647 - DNA, 20 bp, Artificial
  CRISPR gRNA sequence
tccccgtagttttgctgtaa

SEQ ID NO: 260648 - DNA, 20 bp, Artificial
  CRISPR gRNA sequence
ccccgtagttttgctgtaat

SEQ ID NO: 260649 - DNA, 20 bp, Artificial
  CRISPR gRNA sequence
cccgtagttttgctgtaata

SEQ ID NO: 260650 - DNA, 20 bp, Artificial
  CRISPR gRNA sequence
aatagggcaactcaaaccac

SEQ ID NO: 260651 - DNA, 20 bp, Artificial
  CRISPR gRNA sequence
atagggcaactcaaaccaca

SEQ ID NO: 260652 - DNA, 20 bp, Artificial
  CRISPR gRNA sequence
accacaaggcatcctgactg

SEQ ID NO: 260653 - DNA, 20 bp, Artificial
  CRISPR gRNA sequence
cctgactgcagcatttcaca

SEQ ID NO: 260654 - DNA, 20 bp, Artificial
  CRISPR gRNA sequence
ctgactgcagcatttcacac

SEQ ID NO: 260655 - DNA, 20 bp, Artificial
  CRISPR gRNA sequence
taacgttgttttgatgactt

SEQ ID NO: 260656 - DNA, 20 bp, Artificial
  CRISPR gRNA sequence
gacttttacttctattttta

SEQ ID NO: 260657 - DNA, 20 bp, Artificial
  CRISPR gRNA sequence
ttttttttgtcactgaaaaa

SEQ ID NO: 260658 - DNA, 20 bp, Artificial
  CRISPR gRNA sequence
ttttgtcactgaaaaatagt

SEQ ID NO: 260659 - DNA, 20 bp, Artificial
  CRISPR gRNA sequence
aatagtcggtcactacatga

SEQ ID NO: 260660 - DNA, 20 bp, Artificial
  CRISPR gRNA sequence
atagtcggtcactacatgat

SEQ ID NO: 260661 - DNA, 20 bp, Artificial
  CRISPR gRNA sequence
gtcactacatgatgggctta

SEQ ID NO: 260662 - DNA, 20 bp, Artificial
  CRISPR gRNA sequence
tcactacatgatgggcttat

SEQ ID NO: 260663 - DNA, 20 bp, Artificial
  CRISPR gRNA sequence
tgggaattattctttattga

SEQ ID NO: 260664 - DNA, 20 bp, Artificial
  CRISPR gRNA sequence
cctgtgtgaaatgctgcagt

SEQ ID NO: 260665 - DNA, 20 bp, Artificial
  CRISPR gRNA sequence
cagtcaggatgccttgtggt

SEQ ID NO: 260666 - DNA, 20 bp, Artificial
  CRISPR gRNA sequence
ccctattacagcaaaactac

SEQ ID NO: 260667 - DNA, 20 bp, Artificial
  CRISPR gRNA sequence
tggtggcggtggtggtggcc

SEQ ID NO: 260668 - DNA, 20 bp, Artificial
  CRISPR gRNA sequence
ctttcagttcccctcacact

SEQ ID NO: 260669 - DNA, 20 bp, Artificial
  CRISPR gRNA sequence
ctattagttgatagtgtccc

SEQ ID NO: 260670 - DNA, 20 bp, Artificial
  CRISPR gRNA sequence
attattattttaaattgaga

SEQ ID NO: 260671 - DNA, 20 bp, Artificial
  CRISPR gRNA sequence
gcctctgcctcccaaagtgc

SEQ ID NO: 260672 - DNA, 20 bp, Artificial
  CRISPR gRNA sequence
gtagattggctctggaagct

SEQ ID NO: 260673 - DNA, 20 bp, Artificial
  CRISPR gRNA sequence
agtttccttaactgtaaagt

SEQ ID NO: 260674 - DNA, 20 bp, Artificial
  CRISPR gRNA sequence
actgtaattactctatctac

SEQ ID NO: 260675 - DNA, 20 bp, Artificial
  CRISPR gRNA sequence
aattactctatctacctgaa

SEQ ID NO: 260676 - DNA, 20 bp, Artificial
  CRISPR gRNA sequence
actctatctacctgaattga

SEQ ID NO: 260677 - DNA, 20 bp, Artificial
  CRISPR gRNA sequence
tgaattgaatgagttccaac

SEQ ID NO: 260678 - DNA, 20 bp, Artificial
  CRISPR gRNA sequence
atgagttccaacatgaattc

SEQ ID NO: 260679 - DNA, 20 bp, Artificial
  CRISPR gRNA sequence
ttcccaatgacgatgatgag

SEQ ID NO: 260680 - DNA, 20 bp, Artificial
  CRISPR gRNA sequence
catttcagatgaagagactg

SEQ ID NO: 260681 - DNA, 20 bp, Artificial
  CRISPR gRNA sequence
actgaggggtaggcacatta

SEQ ID NO: 260682 - DNA, 20 bp, Artificial
  CRISPR gRNA sequence
gcacattaagggatttgccc

SEQ ID NO: 260683 - DNA, 20 bp, Artificial
  CRISPR gRNA sequence
caggtggcagctataggagg

SEQ ID NO: 260684 - DNA, 20 bp, Artificial
  CRISPR gRNA sequence
ttcatggactcaggtaaatc

SEQ ID NO: 260685 - DNA, 20 bp, Artificial
  CRISPR gRNA sequence
caagcacaattcctaacaga

SEQ ID NO: 260686 - DNA, 20 bp, Artificial
  CRISPR gRNA sequence
taacagaaagaatttgttac

SEQ ID NO: 260687 - DNA, 20 bp, Artificial
  CRISPR gRNA sequence
aatttgttacttgggtgggc

SEQ ID NO: 260688 - DNA, 20 bp, Artificial
  CRISPR gRNA sequence
atgctcattcaacgtgttct

SEQ ID NO: 260689 - DNA, 20 bp, Artificial
  CRISPR gRNA sequence
ggttcaaaaactggactgat

SEQ ID NO: 260690 - DNA, 20 bp, Artificial
  CRISPR gRNA sequence
cattaagtgtacatagccca

SEQ ID NO: 260691 - DNA, 20 bp, Artificial
  CRISPR gRNA sequence
gtgttgatataatgaaagac

SEQ ID NO: 260692 - DNA, 20 bp, Artificial
  CRISPR gRNA sequence
agctaccaaatatattctac

SEQ ID NO: 260693 - DNA, 20 bp, Artificial
  CRISPR gRNA sequence
taagagatctctcaaactta

SEQ ID NO: 260694 - DNA, 20 bp, Artificial
  CRISPR gRNA sequence
aacttattcactctcttttg

SEQ ID NO: 260695 - DNA, 20 bp, Artificial
  CRISPR gRNA sequence
actagctagataagtggttg

SEQ ID NO: 260696 - DNA, 20 bp, Artificial
  CRISPR gRNA sequence
gtaacttttagcatttgata

SEQ ID NO: 260697 - DNA, 20 bp, Artificial
  CRISPR gRNA sequence
taatgaagaaggaaagagat

SEQ ID NO: 260698 - DNA, 20 bp, Artificial
  CRISPR gRNA sequence
agaaaacttacgagcaagaa

SEQ ID NO: 260699 - DNA, 20 bp, Artificial
  CRISPR gRNA sequence
tgtaatcgtgggacgctgag

SEQ ID NO: 260700 - DNA, 20 bp, Artificial
  CRISPR gRNA sequence
atcgtgggacgctgaggcgg

SEQ ID NO: 260701 - DNA, 20 bp, Artificial
  CRISPR gRNA sequence
cgggtggatcacttgaggtc

SEQ ID NO: 260702 - DNA, 20 bp, Artificial
  CRISPR gRNA sequence
taaaaatacaaaaaaattag

SEQ ID NO: 260703 - DNA, 20 bp, Artificial
  CRISPR gRNA sequence
tacttgtgaggcttaggcag

SEQ ID NO: 260704 - DNA, 20 bp, Artificial
  CRISPR gRNA sequence
tgtgtgtatgtatgtatatg

SEQ ID NO: 260705 - DNA, 20 bp, Artificial
  CRISPR gRNA sequence
tgtgtgtatgtatgtatatg

SEQ ID NO: 260706 - DNA, 20 bp, Artificial
  CRISPR gRNA sequence
taagtctaacctgattcctt

SEQ ID NO: 260707 - DNA, 20 bp, Artificial
  CRISPR gRNA sequence
ctaacctgattccttatgag

SEQ ID NO: 260708 - DNA, 20 bp, Artificial
  CRISPR gRNA sequence
ttaaagaagtgtgatttagg

SEQ ID NO: 260709 - DNA, 20 bp, Artificial
  CRISPR gRNA sequence
ttgcatgttttctactagac

SEQ ID NO: 260710 - DNA, 20 bp, Artificial
  CRISPR gRNA sequence
ttgtgcaactgagatccaca

SEQ ID NO: 260711 - DNA, 20 bp, Artificial
  CRISPR gRNA sequence
gagagtattttgctggactt

SEQ ID NO: 260712 - DNA, 20 bp, Artificial
  CRISPR gRNA sequence
attttgctggactttgggat

SEQ ID NO: 260713 - DNA, 20 bp, Artificial
  CRISPR gRNA sequence
gccttaagagggaaatgctc

SEQ ID NO: 260714 - DNA, 20 bp, Artificial
  CRISPR gRNA sequence
tgctctgggattgatgatag

SEQ ID NO: 260715 - DNA, 20 bp, Artificial
  CRISPR gRNA sequence
tgggaaagtaaggtgaaaag

SEQ ID NO: 260716 - DNA, 20 bp, Artificial
  CRISPR gRNA sequence
tttctgttaaaagaaattga

SEQ ID NO: 260717 - DNA, 20 bp, Artificial
  CRISPR gRNA sequence
tgtcatttcaagtaaatttg

SEQ ID NO: 260718 - DNA, 20 bp, Artificial
  CRISPR gRNA sequence
caaaagtataggcattgctt

SEQ ID NO: 260719 - DNA, 20 bp, Artificial
  CRISPR gRNA sequence
aatatatcaataccaggaaa

SEQ ID NO: 260720 - DNA, 20 bp, Artificial
  CRISPR gRNA sequence
tatcaataccaggaaatgga

SEQ ID NO: 260721 - DNA, 20 bp, Artificial
  CRISPR gRNA sequence
cagatagattagaaatagaa

SEQ ID NO: 260722 - DNA, 20 bp, Artificial
  CRISPR gRNA sequence
ctcacattcaaacttttact

SEQ ID NO: 260723 - DNA, 20 bp, Artificial
  CRISPR gRNA sequence
acttttactatgggtgggga

SEQ ID NO: 260724 - DNA, 20 bp, Artificial
  CRISPR gRNA sequence
aacgtcttatgccttttttc

SEQ ID NO: 260725 - DNA, 20 bp, Artificial
  CRISPR gRNA sequence
ccatttggcttttatcttgt

SEQ ID NO: 260726 - DNA, 20 bp, Artificial
  CRISPR gRNA sequence
taactagtgtaggcattgat

SEQ ID NO: 260727 - DNA, 20 bp, Artificial
  CRISPR gRNA sequence
tttcccagcaggtcatggca

SEQ ID NO: 260728 - DNA, 20 bp, Artificial
  CRISPR gRNA sequence
cagcaggtcatggcaaggga

SEQ ID NO: 260729 - DNA, 20 bp, Artificial
  CRISPR gRNA sequence
agcatctggaaaaattacat

SEQ ID NO: 260730 - DNA, 20 bp, Artificial
  CRISPR gRNA sequence
ctgggtggttttgtgactga

SEQ ID NO: 260731 - DNA, 20 bp, Artificial
  CRISPR gRNA sequence
tggccgtttttggccaatga

SEQ ID NO: 260732 - DNA, 20 bp, Artificial
  CRISPR gRNA sequence
gagcctgataattatagcat

SEQ ID NO: 260733 - DNA, 20 bp, Artificial
  CRISPR gRNA sequence
aacactagaagagaagtgca

SEQ ID NO: 260734 - DNA, 20 bp, Artificial
  CRISPR gRNA sequence
tagaagagaagtgcactgga

SEQ ID NO: 260735 - DNA, 20 bp, Artificial
  CRISPR gRNA sequence
tttggtagaggcttggaaaa

SEQ ID NO: 260736 - DNA, 20 bp, Artificial
  CRISPR gRNA sequence
ttgtcatcatcttcattatc

SEQ ID NO: 260737 - DNA, 20 bp, Artificial
  CRISPR gRNA sequence
tggttcctgatggtatcatt

SEQ ID NO: 260738 - DNA, 20 bp, Artificial
  CRISPR gRNA sequence
tgagcccctttctgcaatat

SEQ ID NO: 260739 - DNA, 20 bp, Artificial
  CRISPR gRNA sequence
ccacctcctcgaagaagctt

SEQ ID NO: 260740 - DNA, 20 bp, Artificial
  CRISPR gRNA sequence
ctttattgtggtcttggaag

SEQ ID NO: 260741 - DNA, 20 bp, Artificial
  CRISPR gRNA sequence
tctcatattttaatctccat

SEQ ID NO: 260742 - DNA, 20 bp, Artificial
  CRISPR gRNA sequence
taatctccatcagagtttca

SEQ ID NO: 260743 - DNA, 20 bp, Artificial
  CRISPR gRNA sequence
aatataaaaagaaatatagg

SEQ ID NO: 260744 - DNA, 20 bp, Artificial
  CRISPR gRNA sequence
tactggggaggctgaggtag

SEQ ID NO: 260745 - DNA, 20 bp, Artificial
  CRISPR gRNA sequence
ttgtgtcaatgcactccagc

SEQ ID NO: 260746 - DNA, 20 bp, Artificial
  CRISPR gRNA sequence
acaagtaattaggtagttaa

SEQ ID NO: 260747 - DNA, 20 bp, Artificial
  CRISPR gRNA sequence
ttacagcccctatgatttag

SEQ ID NO: 260748 - DNA, 20 bp, Artificial
  CRISPR gRNA sequence
gagtaggttatatataatag

SEQ ID NO: 260749 - DNA, 20 bp, Artificial
  CRISPR gRNA sequence
gactatgaactccttgaggg

SEQ ID NO: 260750 - DNA, 20 bp, Artificial
  CRISPR gRNA sequence
aatatttgttgaagaaagaa

SEQ ID NO: 260751 - DNA, 20 bp, Artificial
  CRISPR gRNA sequence
tttgttgaagaaagaaatga

SEQ ID NO: 260752 - DNA, 20 bp, Artificial
  CRISPR gRNA sequence
tagaaaggtaagcctttatg

SEQ ID NO: 260753 - DNA, 20 bp, Artificial
  CRISPR gRNA sequence
gtaagcctttatggagagtt

SEQ ID NO: 260754 - DNA, 20 bp, Artificial
  CRISPR gRNA sequence
gactggacagtagacaagat

SEQ ID NO: 260755 - DNA, 20 bp, Artificial
  CRISPR gRNA sequence
tagatggggaaactgaagca

SEQ ID NO: 260756 - DNA, 20 bp, Artificial
  CRISPR gRNA sequence
tggggaaactgaagcacaga

SEQ ID NO: 260757 - DNA, 20 bp, Artificial
  CRISPR gRNA sequence
aaatccagatggtcttgctc

SEQ ID NO: 260758 - DNA, 20 bp, Artificial
  CRISPR gRNA sequence
gttgtctcaggaaggaaaag

SEQ ID NO: 260759 - DNA, 20 bp, Artificial
  CRISPR gRNA sequence
attaataaagaaattaaacc

SEQ ID NO: 260760 - DNA, 20 bp, Artificial
  CRISPR gRNA sequence
tctcagaacagatggcaact

SEQ ID NO: 260761 - DNA, 20 bp, Artificial
  CRISPR gRNA sequence
gaggttatggtgaagcagcg

SEQ ID NO: 260762 - DNA, 20 bp, Artificial
  CRISPR gRNA sequence
gcggagaatccagctaagca

SEQ ID NO: 260763 - DNA, 20 bp, Artificial
  CRISPR gRNA sequence
gaatccagctaagcaaagga

SEQ ID NO: 260764 - DNA, 20 bp, Artificial
  CRISPR gRNA sequence
agtcattttgaagtaatggc

SEQ ID NO: 260765 - DNA, 20 bp, Artificial
  CRISPR gRNA sequence
tgggtaagaagaaaatattt

SEQ ID NO: 260766 - DNA, 20 bp, Artificial
  CRISPR gRNA sequence
tatttcagaatccttatctt

SEQ ID NO: 260767 - DNA, 20 bp, Artificial
  CRISPR gRNA sequence
ccttatctttggaatgaagc

SEQ ID NO: 260768 - DNA, 20 bp, Artificial
  CRISPR gRNA sequence
tggaatgaagctggagttat

SEQ ID NO: 260769 - DNA, 20 bp, Artificial
  CRISPR gRNA sequence
atgaagctggagttatggga

SEQ ID NO: 260770 - DNA, 20 bp, Artificial
  CRISPR gRNA sequence
ggcataactgtagaaaaaca

SEQ ID NO: 260771 - DNA, 20 bp, Artificial
  CRISPR gRNA sequence
tagaaaaacagagagtggag

SEQ ID NO: 260772 - DNA, 20 bp, Artificial
  CRISPR gRNA sequence
ggaaactaactggctctgat

SEQ ID NO: 260773 - DNA, 20 bp, Artificial
  CRISPR gRNA sequence
tctgatgggagtcagctgaa

SEQ ID NO: 260774 - DNA, 20 bp, Artificial
  CRISPR gRNA sequence
gggggacacagtgaggctag

SEQ ID NO: 260775 - DNA, 20 bp, Artificial
  CRISPR gRNA sequence
gccactaagccaatgaggga

SEQ ID NO: 260776 - DNA, 20 bp, Artificial
  CRISPR gRNA sequence
gcattaaacataagagggaa

SEQ ID NO: 260777 - DNA, 20 bp, Artificial
  CRISPR gRNA sequence
taaacataagagggaaagga

SEQ ID NO: 260778 - DNA, 20 bp, Artificial
  CRISPR gRNA sequence
gaaaggagtgaataatggct

SEQ ID NO: 260779 - DNA, 20 bp, Artificial
  CRISPR gRNA sequence
tgaaacgccacctgggactt

SEQ ID NO: 260780 - DNA, 20 bp, Artificial
  CRISPR gRNA sequence
agaaggaagataagacttca

SEQ ID NO: 260781 - DNA, 20 bp, Artificial
  CRISPR gRNA sequence
taataaatgtttgcaaatgg

SEQ ID NO: 260782 - DNA, 20 bp, Artificial
  CRISPR gRNA sequence
gagagagagagacagagaga

SEQ ID NO: 260783 - DNA, 20 bp, Artificial
  CRISPR gRNA sequence
tgtgtagcattgcagggctt

SEQ ID NO: 260784 - DNA, 20 bp, Artificial
  CRISPR gRNA sequence
tgcagggcttgagggtagag

SEQ ID NO: 260785 - DNA, 20 bp, Artificial
  CRISPR gRNA sequence
gaggagggagaggaaaaaaa

SEQ ID NO: 260786 - DNA, 20 bp, Artificial
  CRISPR gRNA sequence
ggagaggaaaaaaagagggt

SEQ ID NO: 260787 - DNA, 20 bp, Artificial
  CRISPR gRNA sequence
ggagatttgttgcataggag

SEQ ID NO: 260788 - DNA, 20 bp, Artificial
  CRISPR gRNA sequence
gaggaagagaagagacttat

SEQ ID NO: 260789 - DNA, 20 bp, Artificial
  CRISPR gRNA sequence
ttataggggtagagataagt

SEQ ID NO: 260790 - DNA, 20 bp, Artificial
  CRISPR gRNA sequence
ttagaatgaagctatggtag

SEQ ID NO: 260791 - DNA, 20 bp, Artificial
  CRISPR gRNA sequence
ttaaaaacaaacaaatctct

SEQ ID NO: 260792 - DNA, 20 bp, Artificial
  CRISPR gRNA sequence
acctatatcaacaagggcta

SEQ ID NO: 260793 - DNA, 20 bp, Artificial
  CRISPR gRNA sequence
tgtgtactttaaattcttgc

SEQ ID NO: 260794 - DNA, 20 bp, Artificial
  CRISPR gRNA sequence
tcagctcacggctgagatca

SEQ ID NO: 260795 - DNA, 20 bp, Artificial
  CRISPR gRNA sequence
cggctgagatcacagggtca

SEQ ID NO: 260796 - DNA, 20 bp, Artificial
  CRISPR gRNA sequence
cgggactctagtttccagtc

SEQ ID NO: 260797 - DNA, 20 bp, Artificial
  CRISPR gRNA sequence
ttccctgtgtgttttggaac

SEQ ID NO: 260798 - DNA, 20 bp, Artificial
  CRISPR gRNA sequence
caaactcaaaagctaatccc

SEQ ID NO: 260799 - DNA, 20 bp, Artificial
  CRISPR gRNA sequence
cccaaggatttctcaaggtg

SEQ ID NO: 260800 - DNA, 20 bp, Artificial
  CRISPR gRNA sequence
tcaaggtgggggatgtgatt

SEQ ID NO: 260801 - DNA, 20 bp, Artificial
  CRISPR gRNA sequence
gtttcttcatctgatacatg

SEQ ID NO: 260802 - DNA, 20 bp, Artificial
  CRISPR gRNA sequence
tacatgaagagtttgggctg

SEQ ID NO: 260803 - DNA, 20 bp, Artificial
  CRISPR gRNA sequence
gcttaaaagtgcttctgaag

SEQ ID NO: 260804 - DNA, 20 bp, Artificial
  CRISPR gRNA sequence
ttttaaaaagctaacttttg

SEQ ID NO: 260805 - DNA, 20 bp, Artificial
  CRISPR gRNA sequence
ctcaactaccccatcccctt

SEQ ID NO: 260806 - DNA, 20 bp, Artificial
  CRISPR gRNA sequence
ccatctctgaaatcccttgc

SEQ ID NO: 260807 - DNA, 20 bp, Artificial
  CRISPR gRNA sequence
cccttgcagggattgctaac

SEQ ID NO: 260808 - DNA, 20 bp, Artificial
  CRISPR gRNA sequence
tcagaggtatgtgatttagg

SEQ ID NO: 260809 - DNA, 20 bp, Artificial
  CRISPR gRNA sequence
atgtactgttgtcttcatca

SEQ ID NO: 260810 - DNA, 20 bp, Artificial
  CRISPR gRNA sequence
gtcttcatcacagagttgtt

SEQ ID NO: 260811 - DNA, 20 bp, Artificial
  CRISPR gRNA sequence
tcacagagttgttttgaatg

SEQ ID NO: 260812 - DNA, 20 bp, Artificial
  CRISPR gRNA sequence
agttgttttgaatgagggat

SEQ ID NO: 260813 - DNA, 20 bp, Artificial
  CRISPR gRNA sequence
gaggaggtctctttatacct

SEQ ID NO: 260814 - DNA, 20 bp, Artificial
  CRISPR gRNA sequence
gttttcttttgatccgttaa

SEQ ID NO: 260815 - DNA, 20 bp, Artificial
  CRISPR gRNA sequence
ttagactacaggcaaccttt

SEQ ID NO: 260816 - DNA, 20 bp, Artificial
  CRISPR gRNA sequence
aatagtgagatttgattttg

SEQ ID NO: 260817 - DNA, 20 bp, Artificial
  CRISPR gRNA sequence
gttgtctggtggctcttggt

SEQ ID NO: 260818 - DNA, 20 bp, Artificial
  CRISPR gRNA sequence
agacctgacctgtgaacggt

SEQ ID NO: 260819 - DNA, 20 bp, Artificial
  CRISPR gRNA sequence
tgacctgtgaacggtaggga

SEQ ID NO: 260820 - DNA, 20 bp, Artificial
  CRISPR gRNA sequence
gggattgggtcacactgcat

SEQ ID NO: 260821 - DNA, 20 bp, Artificial
  CRISPR gRNA sequence
gcatctgagtttatgttgct

SEQ ID NO: 260822 - DNA, 20 bp, Artificial
  CRISPR gRNA sequence
tgcattgctgtgtggtgtct

SEQ ID NO: 260823 - DNA, 20 bp, Artificial
  CRISPR gRNA sequence
gtgtggtgtctctgagtggt

SEQ ID NO: 260824 - DNA, 20 bp, Artificial
  CRISPR gRNA sequence
ggtgtctctgagtggtaggg

SEQ ID NO: 260825 - DNA, 20 bp, Artificial
  CRISPR gRNA sequence
tcctatacttctaactcctt

SEQ ID NO: 260826 - DNA, 20 bp, Artificial
  CRISPR gRNA sequence
ctccttctggatctttcctc

SEQ ID NO: 260827 - DNA, 20 bp, Artificial
  CRISPR gRNA sequence
ccttacccagtgcgtgaact

SEQ ID NO: 260828 - DNA, 20 bp, Artificial
  CRISPR gRNA sequence
ctgtttccatcctacataaa

SEQ ID NO: 260829 - DNA, 20 bp, Artificial
  CRISPR gRNA sequence
gaagtctctacaaaagcctc

SEQ ID NO: 260830 - DNA, 20 bp, Artificial
  CRISPR gRNA sequence
tgcctgtcaatgacccttta

SEQ ID NO: 260831 - DNA, 20 bp, Artificial
  CRISPR gRNA sequence
ctttaaagggttcatgtacc

SEQ ID NO: 260832 - DNA, 20 bp, Artificial
  CRISPR gRNA sequence
atgtaccacggatggcttcg

SEQ ID NO: 260833 - DNA, 20 bp, Artificial
  CRISPR gRNA sequence
agctgattgtgtacctgcct

SEQ ID NO: 260834 - DNA, 20 bp, Artificial
  CRISPR gRNA sequence
acctgccttcggatttctcc

SEQ ID NO: 260835 - DNA, 20 bp, Artificial
  CRISPR gRNA sequence
tttacatcttcccatctcct

SEQ ID NO: 260836 - DNA, 20 bp, Artificial
  CRISPR gRNA sequence
ttaagtcccttatttatttg

SEQ ID NO: 260837 - DNA, 20 bp, Artificial
  CRISPR gRNA sequence
cttatttatttgatgaataa

SEQ ID NO: 260838 - DNA, 20 bp, Artificial
  CRISPR gRNA sequence
tttatttgatgaataaatga

SEQ ID NO: 260839 - DNA, 20 bp, Artificial
  CRISPR gRNA sequence
gacgctgtcacagcagaagt

SEQ ID NO: 260840 - DNA, 20 bp, Artificial
  CRISPR gRNA sequence
ataacttttccctctcaaaa

SEQ ID NO: 260841 - DNA, 20 bp, Artificial
  CRISPR gRNA sequence
aattatttatttatttgaga

SEQ ID NO: 260842 - DNA, 20 bp, Artificial
  CRISPR gRNA sequence
tctcactttgttgctcaggc

SEQ ID NO: 260843 - DNA, 20 bp, Artificial
  CRISPR gRNA sequence
ttttgtattttttgtagaaa

SEQ ID NO: 260844 - DNA, 20 bp, Artificial
  CRISPR gRNA sequence
cccaggctggtttccatctc

SEQ ID NO: 260845 - DNA, 20 bp, Artificial
  CRISPR gRNA sequence
tgtcatcctcccaaagtgct

SEQ ID NO: 260846 - DNA, 20 bp, Artificial
  CRISPR gRNA sequence
cctttagtaaatttattaat

SEQ ID NO: 260847 - DNA, 20 bp, Artificial
  CRISPR gRNA sequence
cccctggtctctttcgacct

SEQ ID NO: 260848 - DNA, 20 bp, Artificial
  CRISPR gRNA sequence
gtgtgccatctgttttcatt

SEQ ID NO: 260849 - DNA, 20 bp, Artificial
  CRISPR gRNA sequence
atctgttttcatttgggatc

SEQ ID NO: 260850 - DNA, 20 bp, Artificial
  CRISPR gRNA sequence
atagttggcccactgtatcc

SEQ ID NO: 260851 - DNA, 20 bp, Artificial
  CRISPR gRNA sequence
tatccacgggttatgcatct

SEQ ID NO: 260852 - DNA, 20 bp, Artificial
  CRISPR gRNA sequence
atctttggattcaatgaacc

SEQ ID NO: 260853 - DNA, 20 bp, Artificial
  CRISPR gRNA sequence
tggatcaaaaacagtatttg

SEQ ID NO: 260854 - DNA, 20 bp, Artificial
  CRISPR gRNA sequence
aaaacagtatttgtgggatg

SEQ ID NO: 260855 - DNA, 20 bp, Artificial
  CRISPR gRNA sequence
atttgtgggatgcagaatct

SEQ ID NO: 260856 - DNA, 20 bp, Artificial
  CRISPR gRNA sequence
attgcatgacttgagcttcc

SEQ ID NO: 260857 - DNA, 20 bp, Artificial
  CRISPR gRNA sequence
ccatggattttggtatctgc

SEQ ID NO: 260858 - DNA, 20 bp, Artificial
  CRISPR gRNA sequence
ggtcctggaaccaacacccc

SEQ ID NO: 260859 - DNA, 20 bp, Artificial
  CRISPR gRNA sequence
aaaactagatgaaatgacca

SEQ ID NO: 260860 - DNA, 20 bp, Artificial
  CRISPR gRNA sequence
taccattttttcattttaac

SEQ ID NO: 260861 - DNA, 20 bp, Artificial
  CRISPR gRNA sequence
gaatttctgggagagagagg

SEQ ID NO: 260862 - DNA, 20 bp, Artificial
  CRISPR gRNA sequence
cattcaaagcatggtaggtc

SEQ ID NO: 260863 - DNA, 20 bp, Artificial
  CRISPR gRNA sequence
tatcttcattgcagctcaga

SEQ ID NO: 260864 - DNA, 20 bp, Artificial
  CRISPR gRNA sequence
gtgaaaggtgctacagtctg

SEQ ID NO: 260865 - DNA, 20 bp, Artificial
  CRISPR gRNA sequence
gttatcagagccatagactg

SEQ ID NO: 260866 - DNA, 20 bp, Artificial
  CRISPR gRNA sequence
cacagtttcctgagcaacca

SEQ ID NO: 260867 - DNA, 20 bp, Artificial
  CRISPR gRNA sequence
catgtgaaattctgttcagt

SEQ ID NO: 260868 - DNA, 20 bp, Artificial
  CRISPR gRNA sequence
ttaaaaggaaacaagataat

SEQ ID NO: 260869 - DNA, 20 bp, Artificial
  CRISPR gRNA sequence
ttcacaaaagccctgaagtt

SEQ ID NO: 260870 - DNA, 20 bp, Artificial
  CRISPR gRNA sequence
gttcaatcccttttgtatac

SEQ ID NO: 260871 - DNA, 20 bp, Artificial
  CRISPR gRNA sequence
ttttgtatacttgggtaagc

SEQ ID NO: 260872 - DNA, 20 bp, Artificial
  CRISPR gRNA sequence
tactgtctgtaagccttatc

SEQ ID NO: 260873 - DNA, 20 bp, Artificial
  CRISPR gRNA sequence
atgaaataaattcagtcttg

SEQ ID NO: 260874 - DNA, 20 bp, Artificial
  CRISPR gRNA sequence
atagcctcttctttaaaata

SEQ ID NO: 260875 - DNA, 20 bp, Artificial
  CRISPR gRNA sequence
atctccaagttcccttccag

SEQ ID NO: 260876 - DNA, 20 bp, Artificial
  CRISPR gRNA sequence
cagttgagtgtggttttttg

SEQ ID NO: 260877 - DNA, 20 bp, Artificial
  CRISPR gRNA sequence
cctatcaagtccaactttga

SEQ ID NO: 260878 - DNA, 20 bp, Artificial
  CRISPR gRNA sequence
aagttatgagcttaaatttc

SEQ ID NO: 260879 - DNA, 20 bp, Artificial
  CRISPR gRNA sequence
cctgcctatttacttcacag

SEQ ID NO: 260880 - DNA, 20 bp, Artificial
  CRISPR gRNA sequence
atttacttcacagttgaata

SEQ ID NO: 260881 - DNA, 20 bp, Artificial
  CRISPR gRNA sequence
agacagcattttatagccct

SEQ ID NO: 260882 - DNA, 20 bp, Artificial
  CRISPR gRNA sequence
agcattaactgagctggtgg

SEQ ID NO: 260883 - DNA, 20 bp, Artificial
  CRISPR gRNA sequence
tgggagggtccttttaaggt

SEQ ID NO: 260884 - DNA, 20 bp, Artificial
  CRISPR gRNA sequence
gttaccaccccacctatgca

SEQ ID NO: 260885 - DNA, 20 bp, Artificial
  CRISPR gRNA sequence
ttataataggtgtaaacggc

SEQ ID NO: 260886 - DNA, 20 bp, Artificial
  CRISPR gRNA sequence
tgataacgtaagcaaagaaa

SEQ ID NO: 260887 - DNA, 20 bp, Artificial
  CRISPR gRNA sequence
aacgtaagcaaagaaaatgg

SEQ ID NO: 260888 - DNA, 20 bp, Artificial
  CRISPR gRNA sequence
aaatattcacagggaaaggg

SEQ ID NO: 260889 - DNA, 20 bp, Artificial
  CRISPR gRNA sequence
tgatacccaagtagcctaag

SEQ ID NO: 260890 - DNA, 20 bp, Artificial
  CRISPR gRNA sequence
aggacgagggagctacatat

SEQ ID NO: 260891 - DNA, 20 bp, Artificial
  CRISPR gRNA sequence
gctacatatttgggtttctt

SEQ ID NO: 260892 - DNA, 20 bp, Artificial
  CRISPR gRNA sequence
cttacattatttgaagtact

SEQ ID NO: 260893 - DNA, 20 bp, Artificial
  CRISPR gRNA sequence
tgtttttacttcatagagca

SEQ ID NO: 260894 - DNA, 20 bp, Artificial
  CRISPR gRNA sequence
taaaagaaaataagagaaat

SEQ ID NO: 260895 - DNA, 20 bp, Artificial
  CRISPR gRNA sequence
cacacatattcagtatcact

SEQ ID NO: 260896 - DNA, 20 bp, Artificial
  CRISPR gRNA sequence
agtttcctatttaggcttct

SEQ ID NO: 260897 - DNA, 20 bp, Artificial
  CRISPR gRNA sequence
aaggtgggaccaaatgctat

SEQ ID NO: 260898 - DNA, 20 bp, Artificial
  CRISPR gRNA sequence
aagtaaacatgagcaataaa

SEQ ID NO: 260899 - DNA, 20 bp, Artificial
  CRISPR gRNA sequence
agagagcccaagctctctaa

SEQ ID NO: 260900 - DNA, 20 bp, Artificial
  CRISPR gRNA sequence
ctgtgtcactatgtttaaag

SEQ ID NO: 260901 - DNA, 20 bp, Artificial
  CRISPR gRNA sequence
atcatgagctgccgtaggac

SEQ ID NO: 260902 - DNA, 20 bp, Artificial
  CRISPR gRNA sequence
gagctgccgtaggacgggaa

SEQ ID NO: 260903 - DNA, 20 bp, Artificial
  CRISPR gRNA sequence
tcttaggaacatgtcacacc

SEQ ID NO: 260904 - DNA, 20 bp, Artificial
  CRISPR gRNA sequence
tcactgtgtgtgctgggaga

SEQ ID NO: 260905 - DNA, 20 bp, Artificial
  CRISPR gRNA sequence
agtcaaactggggagccatc

SEQ ID NO: 260906 - DNA, 20 bp, Artificial
  CRISPR gRNA sequence
gctcacaaaggcagatcagg

SEQ ID NO: 260907 - DNA, 20 bp, Artificial
  CRISPR gRNA sequence
aaaggcagatcaggaagaat

SEQ ID NO: 260908 - DNA, 20 bp, Artificial
  CRISPR gRNA sequence
aatttgaatgtgcattaaaa

SEQ ID NO: 260909 - DNA, 20 bp, Artificial
  CRISPR gRNA sequence
ttcccagggcggtgagcaag

SEQ ID NO: 260910 - DNA, 20 bp, Artificial
  CRISPR gRNA sequence
gagatgcaggcattgcttgc

SEQ ID NO: 260911 - DNA, 20 bp, Artificial
  CRISPR gRNA sequence
atcaaaaacaaaaaaacaaa

SEQ ID NO: 260912 - DNA, 20 bp, Artificial
  CRISPR gRNA sequence
tgttgacacaggtttccaaa

SEQ ID NO: 260913 - DNA, 20 bp, Artificial
  CRISPR gRNA sequence
tgctgataacaacaatacag

SEQ ID NO: 260914 - DNA, 20 bp, Artificial
  CRISPR gRNA sequence
tcactccacaattattttat

SEQ ID NO: 260915 - DNA, 20 bp, Artificial
  CRISPR gRNA sequence
ggggcctaagggaaatgcac

SEQ ID NO: 260916 - DNA, 20 bp, Artificial
  CRISPR gRNA sequence
caaattgaagcatgtgaaac

SEQ ID NO: 260917 - DNA, 20 bp, Artificial
  CRISPR gRNA sequence
atcattttgagacctgagaa

SEQ ID NO: 260918 - DNA, 20 bp, Artificial
  CRISPR gRNA sequence
gggagtggtgctctgtgcca

SEQ ID NO: 260919 - DNA, 20 bp, Artificial
  CRISPR gRNA sequence
agtagacaaggcatggaggt

SEQ ID NO: 260920 - DNA, 20 bp, Artificial
  CRISPR gRNA sequence
gaatgctcacagtctgttct

SEQ ID NO: 260921 - DNA, 20 bp, Artificial
  CRISPR gRNA sequence
aaacctgtggaggccgattt

SEQ ID NO: 260922 - DNA, 20 bp, Artificial
  CRISPR gRNA sequence
tctcaaatttgactgccatc

SEQ ID NO: 260923 - DNA, 20 bp, Artificial
  CRISPR gRNA sequence
actagagaaacttaaaaaat

SEQ ID NO: 260924 - DNA, 20 bp, Artificial
  CRISPR gRNA sequence
gagaaacttaaaaaatatga

SEQ ID NO: 260925 - DNA, 20 bp, Artificial
  CRISPR gRNA sequence
taaaaaatatgaatggatgc

SEQ ID NO: 260926 - DNA, 20 bp, Artificial
  CRISPR gRNA sequence
gattctaaatatgttgtcag

SEQ ID NO: 260927 - DNA, 20 bp, Artificial
  CRISPR gRNA sequence
catagtggctttcaacccaa

SEQ ID NO: 260928 - DNA, 20 bp, Artificial
  CRISPR gRNA sequence
ctttcaacccaattgaatat

SEQ ID NO: 260929 - DNA, 20 bp, Artificial
  CRISPR gRNA sequence
ataatatgaaagacaatcca

SEQ ID NO: 260930 - DNA, 20 bp, Artificial
  CRISPR gRNA sequence
caggcagatcatctgaggtc

SEQ ID NO: 260931 - DNA, 20 bp, Artificial
  CRISPR gRNA sequence
taaaaatataaaaattagct

SEQ ID NO: 260932 - DNA, 20 bp, Artificial
  CRISPR gRNA sequence
tactcgggaggctgaggcag

SEQ ID NO: 260933 - DNA, 20 bp, Artificial
  CRISPR gRNA sequence
ggcaggaggattgcttgatt

SEQ ID NO: 260934 - DNA, 20 bp, Artificial
  CRISPR gRNA sequence
tcatgccactgcactccagc

SEQ ID NO: 260935 - DNA, 20 bp, Artificial
  CRISPR gRNA sequence
ctgcactccagcctgggtga

SEQ ID NO: 260936 - DNA, 20 bp, Artificial
  CRISPR gRNA sequence
ttaataaatgggcaaatgat

SEQ ID NO: 260937 - DNA, 20 bp, Artificial
  CRISPR gRNA sequence
atgggcaaatgatctgaata

SEQ ID NO: 260938 - DNA, 20 bp, Artificial
  CRISPR gRNA sequence
tgaatagagagttctctaaa

SEQ ID NO: 260939 - DNA, 20 bp, Artificial
  CRISPR gRNA sequence
agatatcacttcacgtccac

SEQ ID NO: 260940 - DNA, 20 bp, Artificial
  CRISPR gRNA sequence
gaacaataacaagtgtcggc

SEQ ID NO: 260941 - DNA, 20 bp, Artificial
  CRISPR gRNA sequence
taacaagtgtcggcaagggt

SEQ ID NO: 260942 - DNA, 20 bp, Artificial
  CRISPR gRNA sequence
agccctcattcactgctggt

SEQ ID NO: 260943 - DNA, 20 bp, Artificial
  CRISPR gRNA sequence
attcctcaaaaagttaaaca

SEQ ID NO: 260944 - DNA, 20 bp, Artificial
  CRISPR gRNA sequence
tactgctggcaaatacctaa

SEQ ID NO: 260945 - DNA, 20 bp, Artificial
  CRISPR gRNA sequence
ttcataatagccaaaaagtg

SEQ ID NO: 260946 - DNA, 20 bp, Artificial
  CRISPR gRNA sequence
aatgtagtatagccatacaa

SEQ ID NO: 260947 - DNA, 20 bp, Artificial
  CRISPR gRNA sequence
tggaatattatttggccatg

SEQ ID NO: 260948 - DNA, 20 bp, Artificial
  CRISPR gRNA sequence
gttctggtgcatgcaacaac

SEQ ID NO: 260949 - DNA, 20 bp, Artificial
  CRISPR gRNA sequence
acatggatgaaacttgaaac

SEQ ID NO: 260950 - DNA, 20 bp, Artificial
  CRISPR gRNA sequence
ttctacttataaaaaaagtc

SEQ ID NO: 260951 - DNA, 20 bp, Artificial
  CRISPR gRNA sequence
aaagtagatcagtggtttcc

SEQ ID NO: 260952 - DNA, 20 bp, Artificial
  CRISPR gRNA sequence
gatttaagggagggaggaag

SEQ ID NO: 260953 - DNA, 20 bp, Artificial
  CRISPR gRNA sequence
aggaagcagggtgatggtaa

SEQ ID NO: 260954 - DNA, 20 bp, Artificial
  CRISPR gRNA sequence
atgggtatggtatttcttta

SEQ ID NO: 260955 - DNA, 20 bp, Artificial
  CRISPR gRNA sequence
atggagtaatgaaaatgttc

SEQ ID NO: 260956 - DNA, 20 bp, Artificial
  CRISPR gRNA sequence
ggtgattcattcataacttt

SEQ ID NO: 260957 - DNA, 20 bp, Artificial
  CRISPR gRNA sequence
gtgaatatactaaaaaatct

SEQ ID NO: 260958 - DNA, 20 bp, Artificial
  CRISPR gRNA sequence
aacagcaaactttatagtac

SEQ ID NO: 260959 - DNA, 20 bp, Artificial
  CRISPR gRNA sequence
ccagcctagaccaattaaat

SEQ ID NO: 260960 - DNA, 20 bp, Artificial
  CRISPR gRNA sequence
gccagcaatgattttttaaa

SEQ ID NO: 260961 - DNA, 20 bp, Artificial
  CRISPR gRNA sequence
ttaaaaagaattttgtagag

SEQ ID NO: 260962 - DNA, 20 bp, Artificial
  CRISPR gRNA sequence
gccttggcctcccaaagtgc

SEQ ID NO: 260963 - DNA, 20 bp, Artificial
  CRISPR gRNA sequence
aaaacaaaacacctgtgtat

SEQ ID NO: 260964 - DNA, 20 bp, Artificial
  CRISPR gRNA sequence
attgtaaatttcatttaaaa

SEQ ID NO: 260965 - DNA, 20 bp, Artificial
  CRISPR gRNA sequence
attttatttggctcttcagt

SEQ ID NO: 260966 - DNA, 20 bp, Artificial
  CRISPR gRNA sequence
ggctcttcagtgtgggtata

SEQ ID NO: 260967 - DNA, 20 bp, Artificial
  CRISPR gRNA sequence
gcttttgtttgcattgaaat

SEQ ID NO: 260968 - DNA, 20 bp, Artificial
  CRISPR gRNA sequence
cactttgggaggccgaggcg

SEQ ID NO: 260969 - DNA, 20 bp, Artificial
  CRISPR gRNA sequence
gcggtggatcacctgaggtt

SEQ ID NO: 260970 - DNA, 20 bp, Artificial
  CRISPR gRNA sequence
tactcgggaggctgaggcag

SEQ ID NO: 260971 - DNA, 20 bp, Artificial
  CRISPR gRNA sequence
ctcaggtggtcatagccaac

SEQ ID NO: 260972 - DNA, 20 bp, Artificial
  CRISPR gRNA sequence
tattgtcctgtgccaacaat

SEQ ID NO: 260973 - DNA, 20 bp, Artificial
  CRISPR gRNA sequence
caatgtgttctcttcactta

SEQ ID NO: 260974 - DNA, 20 bp, Artificial
  CRISPR gRNA sequence
cagattctttgatcttttat

SEQ ID NO: 260975 - DNA, 20 bp, Artificial
  CRISPR gRNA sequence
ccagagagataactcccctc

SEQ ID NO: 260976 - DNA, 20 bp, Artificial
  CRISPR gRNA sequence
tttcacctttcatgatataa

SEQ ID NO: 260977 - DNA, 20 bp, Artificial
  CRISPR gRNA sequence
tgatataagggaatagatct

SEQ ID NO: 260978 - DNA, 20 bp, Artificial
  CRISPR gRNA sequence
tttcttggggaggctattct

SEQ ID NO: 260979 - DNA, 20 bp, Artificial
  CRISPR gRNA sequence
aaacacattaaagcaaactc

SEQ ID NO: 260980 - DNA, 20 bp, Artificial
  CRISPR gRNA sequence
tggtcagatcacttgaggcc

SEQ ID NO: 260981 - DNA, 20 bp, Artificial
  CRISPR gRNA sequence
tacttaagagactgaggcag

SEQ ID NO: 260982 - DNA, 20 bp, Artificial
  CRISPR gRNA sequence
aggagaattgtttgaactcg

SEQ ID NO: 260983 - DNA, 20 bp, Artificial
  CRISPR gRNA sequence
atgattaatattaatgtctc

SEQ ID NO: 260984 - DNA, 20 bp, Artificial
  CRISPR gRNA sequence
ggaatatagatttaaaaatt

SEQ ID NO: 260985 - DNA, 20 bp, Artificial
  CRISPR gRNA sequence
agaaagccatgtactgcctt

SEQ ID NO: 260986 - DNA, 20 bp, Artificial
  CRISPR gRNA sequence
ctccattgttccattcaaaa

SEQ ID NO: 260987 - DNA, 20 bp, Artificial
  CRISPR gRNA sequence
ttcctacaatctcttctcaa

SEQ ID NO: 260988 - DNA, 20 bp, Artificial
  CRISPR gRNA sequence
gggcatcccttcacaaagga

SEQ ID NO: 260989 - DNA, 20 bp, Artificial
  CRISPR gRNA sequence
tggaagtctgtgttgtatat

SEQ ID NO: 260990 - DNA, 20 bp, Artificial
  CRISPR gRNA sequence
gcttcaggtttactcaaaaa

SEQ ID NO: 260991 - DNA, 20 bp, Artificial
  CRISPR gRNA sequence
ctgtgatgggaaattgggca

SEQ ID NO: 260992 - DNA, 20 bp, Artificial
  CRISPR gRNA sequence
aatcagtgacattctacctc

SEQ ID NO: 260993 - DNA, 20 bp, Artificial
  CRISPR gRNA sequence
ttcaaatgcagtcctgaaaa

SEQ ID NO: 260994 - DNA, 20 bp, Artificial
  CRISPR gRNA sequence
aactgggttgtggtcagtgg

SEQ ID NO: 260995 - DNA, 20 bp, Artificial
  CRISPR gRNA sequence
ggttgtggtcagtggtgggg

SEQ ID NO: 260996 - DNA, 20 bp, Artificial
  CRISPR gRNA sequence
aggagattcaaggttatatt

SEQ ID NO: 260997 - DNA, 20 bp, Artificial
  CRISPR gRNA sequence
cctttgctgacattgagcgg

SEQ ID NO: 260998 - DNA, 20 bp, Artificial
  CRISPR gRNA sequence
gatcatttttctccattcca

SEQ ID NO: 260999 - DNA, 20 bp, Artificial
  CRISPR gRNA sequence
caggtgccctcaagtaacag

SEQ ID NO: 261000 - DNA, 20 bp, Artificial
  CRISPR gRNA sequence
tcaagtaacagctgggtcta

SEQ ID NO: 261001 - DNA, 20 bp, Artificial
  CRISPR gRNA sequence
tctcgctctgtcgcccaggc

SEQ ID NO: 261002 - DNA, 20 bp, Artificial
  CRISPR gRNA sequence
cccaggctggagtgcagtgg

SEQ ID NO: 261003 - DNA, 20 bp, Artificial
  CRISPR gRNA sequence
ttcactgcaagctctgcctc

SEQ ID NO: 261004 - DNA, 20 bp, Artificial
  CRISPR gRNA sequence
attaatttttttttttgaga

SEQ ID NO: 261005 - DNA, 20 bp, Artificial
  CRISPR gRNA sequence
tcttgctctgtcgcccaggc

SEQ ID NO: 261006 - DNA, 20 bp, Artificial
  CRISPR gRNA sequence
cattctcctgcctcagcctc

SEQ ID NO: 261007 - DNA, 20 bp, Artificial
  CRISPR gRNA sequence
ttttttgtatttttagtaga

SEQ ID NO: 261008 - DNA, 20 bp, Artificial
  CRISPR gRNA sequence
cagggtttcaccttgttagc

SEQ ID NO: 261009 - DNA, 20 bp, Artificial
  CRISPR gRNA sequence
gtgttggcctcccaaagtgc

SEQ ID NO: 261010 - DNA, 20 bp, Artificial
  CRISPR gRNA sequence
ttttgtacttttagtagaga

SEQ ID NO: 261011 - DNA, 20 bp, Artificial
  CRISPR gRNA sequence
cggggtttcaccgtgttagc

SEQ ID NO: 261012 - DNA, 20 bp, Artificial
  CRISPR gRNA sequence
tccattttctaaaatataca

SEQ ID NO: 261013 - DNA, 20 bp, Artificial
  CRISPR gRNA sequence
tattaatcaactgtgtgatc

SEQ ID NO: 261014 - DNA, 20 bp, Artificial
  CRISPR gRNA sequence
acaactgttaagcagtattt

SEQ ID NO: 261015 - DNA, 20 bp, Artificial
  CRISPR gRNA sequence
atcatgattccccaactcag

SEQ ID NO: 261016 - DNA, 20 bp, Artificial
  CRISPR gRNA sequence
ttgattttttggtatacttt

SEQ ID NO: 261017 - DNA, 20 bp, Artificial
  CRISPR gRNA sequence
atcatagcttttcatttttg

SEQ ID NO: 261018 - DNA, 20 bp, Artificial
  CRISPR gRNA sequence
cacatatgttcagttttgta

SEQ ID NO: 261019 - DNA, 20 bp, Artificial
  CRISPR gRNA sequence
tgaatcctagcataatgcca

SEQ ID NO: 261020 - DNA, 20 bp, Artificial
  CRISPR gRNA sequence
agagccatgctgatgaaaaa

SEQ ID NO: 261021 - DNA, 20 bp, Artificial
  CRISPR gRNA sequence
aataggatactaaataagga

SEQ ID NO: 261022 - DNA, 20 bp, Artificial
  CRISPR gRNA sequence
aaaatagagacaattaatgt

SEQ ID NO: 261023 - DNA, 20 bp, Artificial
  CRISPR gRNA sequence
atgtgtgaatattttgtttg

SEQ ID NO: 261024 - DNA, 20 bp, Artificial
  CRISPR gRNA sequence
taatatctgtaatatccaaa

SEQ ID NO: 261025 - DNA, 20 bp, Artificial
  CRISPR gRNA sequence
atgctattttgcttgtagct

SEQ ID NO: 261026 - DNA, 20 bp, Artificial
  CRISPR gRNA sequence
atatgaaaggcatgctactt

SEQ ID NO: 261027 - DNA, 20 bp, Artificial
  CRISPR gRNA sequence
cctatctgtatattataaat

SEQ ID NO: 261028 - DNA, 20 bp, Artificial
  CRISPR gRNA sequence
gagattctgatgtaattgat

SEQ ID NO: 261029 - DNA, 20 bp, Artificial
  CRISPR gRNA sequence
taattgatatgggttgagga

SEQ ID NO: 261030 - DNA, 20 bp, Artificial
  CRISPR gRNA sequence
cagtatattttcaaactttc

SEQ ID NO: 261031 - DNA, 20 bp, Artificial
  CRISPR gRNA sequence
cggataatttattgtgcagc

SEQ ID NO: 261032 - DNA, 20 bp, Artificial
  CRISPR gRNA sequence
gatggaaaatcaatggacta

SEQ ID NO: 261033 - DNA, 20 bp, Artificial
  CRISPR gRNA sequence
agttctaattttctctaatt

SEQ ID NO: 261034 - DNA, 20 bp, Artificial
  CRISPR gRNA sequence
taattttctctaattttgaa

SEQ ID NO: 261035 - DNA, 20 bp, Artificial
  CRISPR gRNA sequence
tcattatataatctatgaga

SEQ ID NO: 261036 - DNA, 20 bp, Artificial
  CRISPR gRNA sequence
catattatttaacttattcc

SEQ ID NO: 261037 - DNA, 20 bp, Artificial
  CRISPR gRNA sequence
cttattccaaggatgcagtt

SEQ ID NO: 261038 - DNA, 20 bp, Artificial
  CRISPR gRNA sequence
actatcttctgatgggagaa

SEQ ID NO: 261039 - DNA, 20 bp, Artificial
  CRISPR gRNA sequence
ggccattggaagtcaccgtt

SEQ ID NO: 261040 - DNA, 20 bp, Artificial
  CRISPR gRNA sequence
caccgttttgaatcacacag

SEQ ID NO: 261041 - DNA, 20 bp, Artificial
  CRISPR gRNA sequence
agtagaatccacaaagtcaa

SEQ ID NO: 261042 - DNA, 20 bp, Artificial
  CRISPR gRNA sequence
gaccagatcatggtcagtgg

SEQ ID NO: 261043 - DNA, 20 bp, Artificial
  CRISPR gRNA sequence
gatcatggtcagtggtgggg

SEQ ID NO: 261044 - DNA, 20 bp, Artificial
  CRISPR gRNA sequence
cccggaccttctaagccctt

SEQ ID NO: 261045 - DNA, 20 bp, Artificial
  CRISPR gRNA sequence
tgggtgctggtggtggttgg

SEQ ID NO: 261046 - DNA, 20 bp, Artificial
  CRISPR gRNA sequence
acagtggcctttattatttt

SEQ ID NO: 261047 - DNA, 20 bp, Artificial
  CRISPR gRNA sequence
catgaaatctgaacacattc

SEQ ID NO: 261048 - DNA, 20 bp, Artificial
  CRISPR gRNA sequence
ggtttattttctgtttaata

SEQ ID NO: 261049 - DNA, 20 bp, Artificial
  CRISPR gRNA sequence
tgattttcttttccccatgc

SEQ ID NO: 261050 - DNA, 20 bp, Artificial
  CRISPR gRNA sequence
atctgagataaaaatctgat

SEQ ID NO: 261051 - DNA, 20 bp, Artificial
  CRISPR gRNA sequence
gttagatttcccagaaggca

SEQ ID NO: 261052 - DNA, 20 bp, Artificial
  CRISPR gRNA sequence
gaggcaaaataagaagctaa

SEQ ID NO: 261053 - DNA, 20 bp, Artificial
  CRISPR gRNA sequence
aagaagctaaatgggtaaat

SEQ ID NO: 261054 - DNA, 20 bp, Artificial
  CRISPR gRNA sequence
aaatgggtaaattagggtgg

SEQ ID NO: 261055 - DNA, 20 bp, Artificial
  CRISPR gRNA sequence
aagaaactagatctgtttat

SEQ ID NO: 261056 - DNA, 20 bp, Artificial
  CRISPR gRNA sequence
ttttttctcctctgaagcag

SEQ ID NO: 261057 - DNA, 20 bp, Artificial
  CRISPR gRNA sequence
tgtcattatgaaactataat

SEQ ID NO: 261058 - DNA, 20 bp, Artificial
  CRISPR gRNA sequence
tatgaaactataatgggagt

SEQ ID NO: 261059 - DNA, 20 bp, Artificial
  CRISPR gRNA sequence
aattttctgagctctcacca

SEQ ID NO: 261060 - DNA, 20 bp, Artificial
  CRISPR gRNA sequence
tttctttaccttcctcaaca

SEQ ID NO: 261061 - DNA, 20 bp, Artificial
  CRISPR gRNA sequence
ctcaacattgaatttttggc

SEQ ID NO: 261062 - DNA, 20 bp, Artificial
  CRISPR gRNA sequence
ctacagttaagaacgtaccc

SEQ ID NO: 261063 - DNA, 20 bp, Artificial
  CRISPR gRNA sequence
cttaggtacatagtatggta

SEQ ID NO: 261064 - DNA, 20 bp, Artificial
  CRISPR gRNA sequence
gtattgactccatgttgtct

SEQ ID NO: 261065 - DNA, 20 bp, Artificial
  CRISPR gRNA sequence
tttttctagaagttacatgc

SEQ ID NO: 261066 - DNA, 20 bp, Artificial
  CRISPR gRNA sequence
tctagaagttacatgcatgg

SEQ ID NO: 261067 - DNA, 20 bp, Artificial
  CRISPR gRNA sequence
ttaagtacatttggtgctta

SEQ ID NO: 261068 - DNA, 20 bp, Artificial
  CRISPR gRNA sequence
tggtgcttaatgaatgctta

SEQ ID NO: 261069 - DNA, 20 bp, Artificial
  CRISPR gRNA sequence
aatgaatgcttattggattg

SEQ ID NO: 261070 - DNA, 20 bp, Artificial
  CRISPR gRNA sequence
acctccagagaggtcaaatt

SEQ ID NO: 261071 - DNA, 20 bp, Artificial
  CRISPR gRNA sequence
aggtcaaattaaggatttaa

SEQ ID NO: 261072 - DNA, 20 bp, Artificial
  CRISPR gRNA sequence
tatatgtacctaattcatag

SEQ ID NO: 261073 - DNA, 20 bp, Artificial
  CRISPR gRNA sequence
ttactgtcagcttggtgact

SEQ ID NO: 261074 - DNA, 20 bp, Artificial
  CRISPR gRNA sequence
tggtgactgcgggtacagac

SEQ ID NO: 261075 - DNA, 20 bp, Artificial
  CRISPR gRNA sequence
tgcttactctgtacttgccg

SEQ ID NO: 261076 - DNA, 20 bp, Artificial
  CRISPR gRNA sequence
tttatactaggtatcatctt

SEQ ID NO: 261077 - DNA, 20 bp, Artificial
  CRISPR gRNA sequence
ttggtattgtaaaatgttgc

SEQ ID NO: 261078 - DNA, 20 bp, Artificial
  CRISPR gRNA sequence
ctggtgtttgctgataattt

SEQ ID NO: 261079 - DNA, 20 bp, Artificial
  CRISPR gRNA sequence
gctgataattttcgagtttt

SEQ ID NO: 261080 - DNA, 20 bp, Artificial
  CRISPR gRNA sequence
ggcttttcaatcctcttatt

SEQ ID NO: 261081 - DNA, 20 bp, Artificial
  CRISPR gRNA sequence
aggccaggtgcagtggccct

SEQ ID NO: 261082 - DNA, 20 bp, Artificial
  CRISPR gRNA sequence
gctctgcagaaagtagtttt

SEQ ID NO: 261083 - DNA, 20 bp, Artificial
  CRISPR gRNA sequence
aacttattataaatattcat

SEQ ID NO: 261084 - DNA, 20 bp, Artificial
  CRISPR gRNA sequence
tataatgagacatcaatttg

SEQ ID NO: 261085 - DNA, 20 bp, Artificial
  CRISPR gRNA sequence
acatcaatttgttgagtgac

SEQ ID NO: 261086 - DNA, 20 bp, Artificial
  CRISPR gRNA sequence
aaagcagcttctcactttca

SEQ ID NO: 261087 - DNA, 20 bp, Artificial
  CRISPR gRNA sequence
tcagacacatcatagacaca

SEQ ID NO: 261088 - DNA, 20 bp, Artificial
  CRISPR gRNA sequence
ctttgtcttacagaccccct

SEQ ID NO: 261089 - DNA, 20 bp, Artificial
  CRISPR gRNA sequence
cacttatctgcatctcaaac

SEQ ID NO: 261090 - DNA, 20 bp, Artificial
  CRISPR gRNA sequence
tctttgtactctcttaccaa

SEQ ID NO: 261091 - DNA, 20 bp, Artificial
  CRISPR gRNA sequence
acaagtttgtctatatttcg

SEQ ID NO: 261092 - DNA, 20 bp, Artificial
  CRISPR gRNA sequence
tttaagcaacaagtaccttg

SEQ ID NO: 261093 - DNA, 20 bp, Artificial
  CRISPR gRNA sequence
agttgggcatctaggccatt

SEQ ID NO: 261094 - DNA, 20 bp, Artificial
  CRISPR gRNA sequence
tctaggccattatggatccc

SEQ ID NO: 261095 - DNA, 20 bp, Artificial
  CRISPR gRNA sequence
ccctggagtttagctgtttc

SEQ ID NO: 261096 - DNA, 20 bp, Artificial
  CRISPR gRNA sequence
atatgctactgtaggcagtt

SEQ ID NO: 261097 - DNA, 20 bp, Artificial
  CRISPR gRNA sequence
ctactgtaggcagttctggg

SEQ ID NO: 261098 - DNA, 20 bp, Artificial
  CRISPR gRNA sequence
tgtaggcagttctgggttga

SEQ ID NO: 261099 - DNA, 20 bp, Artificial
  CRISPR gRNA sequence
tgagtgggtttctaggctga

SEQ ID NO: 261100 - DNA, 20 bp, Artificial
  CRISPR gRNA sequence
tcttgacctgatgttgacat

SEQ ID NO: 261101 - DNA, 20 bp, Artificial
  CRISPR gRNA sequence
ccactgcagatcataatgtg

SEQ ID NO: 261102 - DNA, 20 bp, Artificial
  CRISPR gRNA sequence
ctgctgttcccaggaaacaa

SEQ ID NO: 261103 - DNA, 20 bp, Artificial
  CRISPR gRNA sequence
catggggagaagggcaaagg

SEQ ID NO: 261104 - DNA, 20 bp, Artificial
  CRISPR gRNA sequence
tagctgacattcactgttga

SEQ ID NO: 261105 - DNA, 20 bp, Artificial
  CRISPR gRNA sequence
gtggagatgacacagacaca

SEQ ID NO: 261106 - DNA, 20 bp, Artificial
  CRISPR gRNA sequence
tgcacacatactcaatgcac

SEQ ID NO: 261107 - DNA, 20 bp, Artificial
  CRISPR gRNA sequence
tttcatcccactgctgtgtt

SEQ ID NO: 261108 - DNA, 20 bp, Artificial
  CRISPR gRNA sequence
cccactgctgtgtttagagt

SEQ ID NO: 261109 - DNA, 20 bp, Artificial
  CRISPR gRNA sequence
ctgccatctgacaatcactt

SEQ ID NO: 261110 - DNA, 20 bp, Artificial
  CRISPR gRNA sequence
atgtgcaatgtaaagaacct

SEQ ID NO: 261111 - DNA, 20 bp, Artificial
  CRISPR gRNA sequence
tctaccagctatgatttggt

SEQ ID NO: 261112 - DNA, 20 bp, Artificial
  CRISPR gRNA sequence
acacttggaggtttggcaaa

SEQ ID NO: 261113 - DNA, 20 bp, Artificial
  CRISPR gRNA sequence
ggtttggcaaagggagtcct

SEQ ID NO: 261114 - DNA, 20 bp, Artificial
  CRISPR gRNA sequence
gcaaagggagtcctcagggt

SEQ ID NO: 261115 - DNA, 20 bp, Artificial
  CRISPR gRNA sequence
tctagtctttcatttacaga

SEQ ID NO: 261116 - DNA, 20 bp, Artificial
  CRISPR gRNA sequence
aacaattcttcattgcattg

SEQ ID NO: 261117 - DNA, 20 bp, Artificial
  CRISPR gRNA sequence
cactaaatgtctcctgggac

SEQ ID NO: 261118 - DNA, 20 bp, Artificial
  CRISPR gRNA sequence
ttaagggagcttgaggtgtc

SEQ ID NO: 261119 - DNA, 20 bp, Artificial
  CRISPR gRNA sequence
aacagcatttgggggaaatc

SEQ ID NO: 261120 - DNA, 20 bp, Artificial
  CRISPR gRNA sequence
tgagttttattttagacatg

SEQ ID NO: 261121 - DNA, 20 bp, Artificial
  CRISPR gRNA sequence
tattttagacatgttgagtt

SEQ ID NO: 261122 - DNA, 20 bp, Artificial
  CRISPR gRNA sequence
tttagtccagagatataaat

SEQ ID NO: 261123 - DNA, 20 bp, Artificial
  CRISPR gRNA sequence
gtccagagatataaatttgg

SEQ ID NO: 261124 - DNA, 20 bp, Artificial
  CRISPR gRNA sequence
agtaggtggtaattgaagct

SEQ ID NO: 261125 - DNA, 20 bp, Artificial
  CRISPR gRNA sequence
tggtaattgaagctgtgaat

SEQ ID NO: 261126 - DNA, 20 bp, Artificial
  CRISPR gRNA sequence
gataagattgcctagggaaa

SEQ ID NO: 261127 - DNA, 20 bp, Artificial
  CRISPR gRNA sequence
attctaacggctggttagag

SEQ ID NO: 261128 - DNA, 20 bp, Artificial
  CRISPR gRNA sequence
gcttgcaaaggaggcaggga

SEQ ID NO: 261129 - DNA, 20 bp, Artificial
  CRISPR gRNA sequence
ggaaggagtgacaagacagg

SEQ ID NO: 261130 - DNA, 20 bp, Artificial
  CRISPR gRNA sequence
aagacaggtaggataaaaac

SEQ ID NO: 261131 - DNA, 20 bp, Artificial
  CRISPR gRNA sequence
aaatagtatcacaaaaagaa

SEQ ID NO: 261132 - DNA, 20 bp, Artificial
  CRISPR gRNA sequence
gaagagagttatcaatagta

SEQ ID NO: 261133 - DNA, 20 bp, Artificial
  CRISPR gRNA sequence
caatagtatagaatactgct

SEQ ID NO: 261134 - DNA, 20 bp, Artificial
  CRISPR gRNA sequence
aaggtgtgaagtgctcaggc

SEQ ID NO: 261135 - DNA, 20 bp, Artificial
  CRISPR gRNA sequence
taggcacttttttcataata

SEQ ID NO: 261136 - DNA, 20 bp, Artificial
  CRISPR gRNA sequence
ttttttcataatagagaatt

SEQ ID NO: 261137 - DNA, 20 bp, Artificial
  CRISPR gRNA sequence
tttctgtttttagatgtttt

SEQ ID NO: 261138 - DNA, 20 bp, Artificial
  CRISPR gRNA sequence
gggtcatttgttaagaaatg

SEQ ID NO: 261139 - DNA, 20 bp, Artificial
  CRISPR gRNA sequence
aaattttgctaagattcatg

SEQ ID NO: 261140 - DNA, 20 bp, Artificial
  CRISPR gRNA sequence
gccaagcctatgaaagagag

SEQ ID NO: 261141 - DNA, 20 bp, Artificial
  CRISPR gRNA sequence
atacatacccataaagacat

SEQ ID NO: 261142 - DNA, 20 bp, Artificial
  CRISPR gRNA sequence
gtgattattacagactctgg

SEQ ID NO: 261143 - DNA, 20 bp, Artificial
  CRISPR gRNA sequence
taatgtaagaagatcacaat

SEQ ID NO: 261144 - DNA, 20 bp, Artificial
  CRISPR gRNA sequence
agtgtatttacatatcaaca

SEQ ID NO: 261145 - DNA, 20 bp, Artificial
  CRISPR gRNA sequence
tcaggtcagatgacagcatt

SEQ ID NO: 261146 - DNA, 20 bp, Artificial
  CRISPR gRNA sequence
atgacagcattgagagtaac

SEQ ID NO: 261147 - DNA, 20 bp, Artificial
  CRISPR gRNA sequence
gatttttcaagttcaatgtg

SEQ ID NO: 261148 - DNA, 20 bp, Artificial
  CRISPR gRNA sequence
tcaatgtgaagagtcagtag

SEQ ID NO: 261149 - DNA, 20 bp, Artificial
  CRISPR gRNA sequence
gtcatttgacagttaatatt

SEQ ID NO: 261150 - DNA, 20 bp, Artificial
  CRISPR gRNA sequence
acttctctttcctgcaggtg

SEQ ID NO: 261151 - DNA, 20 bp, Artificial
  CRISPR gRNA sequence
atctgctcaatatcactgct

SEQ ID NO: 261152 - DNA, 20 bp, Artificial
  CRISPR gRNA sequence
gccaccaatgccaatttttc

SEQ ID NO: 261153 - DNA, 20 bp, Artificial
  CRISPR gRNA sequence
tagtgacttgactgagaagt

SEQ ID NO: 261154 - DNA, 20 bp, Artificial
  CRISPR gRNA sequence
gttagggtagaaaacaaaaa

SEQ ID NO: 261155 - DNA, 20 bp, Artificial
  CRISPR gRNA sequence
gggtagaaaacaaaaaggga

SEQ ID NO: 261156 - DNA, 20 bp, Artificial
  CRISPR gRNA sequence
aaatcattccttttggttaa

SEQ ID NO: 261157 - DNA, 20 bp, Artificial
  CRISPR gRNA sequence
ggtgtttaatcttttggtta

SEQ ID NO: 261158 - DNA, 20 bp, Artificial
  CRISPR gRNA sequence
cttttggttagtgggttaaa

SEQ ID NO: 261159 - DNA, 20 bp, Artificial
  CRISPR gRNA sequence
gtgggttaaacggggtaagt

SEQ ID NO: 261160 - DNA, 20 bp, Artificial
  CRISPR gRNA sequence
gggtaagttagagtaggggg

SEQ ID NO: 261161 - DNA, 20 bp, Artificial
  CRISPR gRNA sequence
atacatagacattgtctttt

SEQ ID NO: 261162 - DNA, 20 bp, Artificial
  CRISPR gRNA sequence
ttagtcattttgaccaaatg

SEQ ID NO: 261163 - DNA, 20 bp, Artificial
  CRISPR gRNA sequence
atgagggatttggtcaaatg

SEQ ID NO: 261164 - DNA, 20 bp, Artificial
  CRISPR gRNA sequence
tgttcacaatatactttcga

SEQ ID NO: 261165 - DNA, 20 bp, Artificial
  CRISPR gRNA sequence
atagttctcctacatgaaga

SEQ ID NO: 261166 - DNA, 20 bp, Artificial
  CRISPR gRNA sequence
tcactttatgtcaaaattat

SEQ ID NO: 261167 - DNA, 20 bp, Artificial
  CRISPR gRNA sequence
tgcccaagaggctgaggcat

SEQ ID NO: 261168 - DNA, 20 bp, Artificial
  CRISPR gRNA sequence
cagctctccagcctgggcga

SEQ ID NO: 261169 - DNA, 20 bp, Artificial
  CRISPR gRNA sequence
acaacaaaccacaaaattat

SEQ ID NO: 261170 - DNA, 20 bp, Artificial
  CRISPR gRNA sequence
aaaattatttgagtactgtg

SEQ ID NO: 261171 - DNA, 20 bp, Artificial
  CRISPR gRNA sequence
ctttcctgtttcatatgttt

SEQ ID NO: 261172 - DNA, 20 bp, Artificial
  CRISPR gRNA sequence
tgtcggtgtggagatccaaa

SEQ ID NO: 261173 - DNA, 20 bp, Artificial
  CRISPR gRNA sequence
agagcgtccataggagaagt

SEQ ID NO: 261174 - DNA, 20 bp, Artificial
  CRISPR gRNA sequence
aagtgagaatactgtgaaaa

SEQ ID NO: 261175 - DNA, 20 bp, Artificial
  CRISPR gRNA sequence
aaagggatgttagcattcat

SEQ ID NO: 261176 - DNA, 20 bp, Artificial
  CRISPR gRNA sequence
gttagcattcattagagtat

SEQ ID NO: 261177 - DNA, 20 bp, Artificial
  CRISPR gRNA sequence
gcattcattagagtatgagg

SEQ ID NO: 261178 - DNA, 20 bp, Artificial
  CRISPR gRNA sequence
gaaggttctttggaaggagg

SEQ ID NO: 261179 - DNA, 20 bp, Artificial
  CRISPR gRNA sequence
ttctttggaaggaggacgaa

SEQ ID NO: 261180 - DNA, 20 bp, Artificial
  CRISPR gRNA sequence
tggaaggaggacgaatagaa

SEQ ID NO: 261181 - DNA, 20 bp, Artificial
  CRISPR gRNA sequence
attcacatgggaaagtattt

SEQ ID NO: 261182 - DNA, 20 bp, Artificial
  CRISPR gRNA sequence
gtgtcttttgaagagagcat

SEQ ID NO: 261183 - DNA, 20 bp, Artificial
  CRISPR gRNA sequence
gcatcagagttcttaaggga

SEQ ID NO: 261184 - DNA, 20 bp, Artificial
  CRISPR gRNA sequence
ggcctgaccctgaaatgacc

SEQ ID NO: 261185 - DNA, 20 bp, Artificial
  CRISPR gRNA sequence
gatatttttctacctacagt

SEQ ID NO: 261186 - DNA, 20 bp, Artificial
  CRISPR gRNA sequence
tacctacagtttgagtcaac

SEQ ID NO: 261187 - DNA, 20 bp, Artificial
  CRISPR gRNA sequence
gaatatgcctggggaccttg

SEQ ID NO: 261188 - DNA, 20 bp, Artificial
  CRISPR gRNA sequence
ggttcaagtctcgttagtag

SEQ ID NO: 261189 - DNA, 20 bp, Artificial
  CRISPR gRNA sequence
gggcaatagcctaagaaggg

SEQ ID NO: 261190 - DNA, 20 bp, Artificial
  CRISPR gRNA sequence
caaatttaaacccactacgc

SEQ ID NO: 261191 - DNA, 20 bp, Artificial
  CRISPR gRNA sequence
tttaatgtgagaaggaaggg

SEQ ID NO: 261192 - DNA, 20 bp, Artificial
  CRISPR gRNA sequence
gtgagaaggaagggaggagt

SEQ ID NO: 261193 - DNA, 20 bp, Artificial
  CRISPR gRNA sequence
tttaagtgggcttccattcc

SEQ ID NO: 261194 - DNA, 20 bp, Artificial
  CRISPR gRNA sequence
aagatcaaactcagcagtac

SEQ ID NO: 261195 - DNA, 20 bp, Artificial
  CRISPR gRNA sequence
acttgggtgctgaagaactg

SEQ ID NO: 261196 - DNA, 20 bp, Artificial
  CRISPR gRNA sequence
ttgccagcttcttgggcaca

SEQ ID NO: 261197 - DNA, 20 bp, Artificial
  CRISPR gRNA sequence
atttgaaaatgacagagctg

SEQ ID NO: 261198 - DNA, 20 bp, Artificial
  CRISPR gRNA sequence
gaaaaataggcctactaaag

SEQ ID NO: 261199 - DNA, 20 bp, Artificial
  CRISPR gRNA sequence
tcatttgctgctattattgt

SEQ ID NO: 261200 - DNA, 20 bp, Artificial
  CRISPR gRNA sequence
ttgattgtgagctcacctat

SEQ ID NO: 261201 - DNA, 20 bp, Artificial
  CRISPR gRNA sequence
tattaagaaagatatgcttt

SEQ ID NO: 261202 - DNA, 20 bp, Artificial
  CRISPR gRNA sequence
agatatgcttcgctttggca

SEQ ID NO: 261203 - DNA, 20 bp, Artificial
  CRISPR gRNA sequence
gcttcgctttggcaaggaat

SEQ ID NO: 261204 - DNA, 20 bp, Artificial
  CRISPR gRNA sequence
cttgctatttaaaagaggtg

SEQ ID NO: 261205 - DNA, 20 bp, Artificial
  CRISPR gRNA sequence
aatactaatttcacttcaag

SEQ ID NO: 261206 - DNA, 20 bp, Artificial
  CRISPR gRNA sequence
acctatgtgttctgtgtcat

SEQ ID NO: 261207 - DNA, 20 bp, Artificial
  CRISPR gRNA sequence
gccttgaccccatcagtccc

SEQ ID NO: 261208 - DNA, 20 bp, Artificial
  CRISPR gRNA sequence
gtcctcatggctattttaat

SEQ ID NO: 261209 - DNA, 20 bp, Artificial
  CRISPR gRNA sequence
agctgggaactataccagac

SEQ ID NO: 261210 - DNA, 20 bp, Artificial
  CRISPR gRNA sequence
gccaataaaggacccagaac

SEQ ID NO: 261211 - DNA, 20 bp, Artificial
  CRISPR gRNA sequence
tattaataatccaggtcaaa

SEQ ID NO: 261212 - DNA, 20 bp, Artificial
  CRISPR gRNA sequence
acacacactctctcaagacc

SEQ ID NO: 261213 - DNA, 20 bp, Artificial
  CRISPR gRNA sequence
tctctcaagacctggggtga

SEQ ID NO: 261214 - DNA, 20 bp, Artificial
  CRISPR gRNA sequence
atgcatactttctgacatat

SEQ ID NO: 261215 - DNA, 20 bp, Artificial
  CRISPR gRNA sequence
ctgacatataggaatgtatc

SEQ ID NO: 261216 - DNA, 20 bp, Artificial
  CRISPR gRNA sequence
catgtcctgtttactctgtc

SEQ ID NO: 261217 - DNA, 20 bp, Artificial
  CRISPR gRNA sequence
atataataaatatttattga

SEQ ID NO: 261218 - DNA, 20 bp, Artificial
  CRISPR gRNA sequence
aataaatatttattgactga

SEQ ID NO: 261219 - DNA, 20 bp, Artificial
  CRISPR gRNA sequence
aatatttattgactgagtga

SEQ ID NO: 261220 - DNA, 20 bp, Artificial
  CRISPR gRNA sequence
aatgagttttacatggcctt

SEQ ID NO: 261221 - DNA, 20 bp, Artificial
  CRISPR gRNA sequence
catggccttatgaattaacg

SEQ ID NO: 261222 - DNA, 20 bp, Artificial
  CRISPR gRNA sequence
aaataagcaaggaaagcaga

SEQ ID NO: 261223 - DNA, 20 bp, Artificial
  CRISPR gRNA sequence
caaggaaagcagacagggtg

SEQ ID NO: 261224 - DNA, 20 bp, Artificial
  CRISPR gRNA sequence
gacacttgagcaaggacctg

SEQ ID NO: 261225 - DNA, 20 bp, Artificial
  CRISPR gRNA sequence
ctacagaaggacattctaga

SEQ ID NO: 261226 - DNA, 20 bp, Artificial
  CRISPR gRNA sequence
taggaacatgcctgtgatgg

SEQ ID NO: 261227 - DNA, 20 bp, Artificial
  CRISPR gRNA sequence
tccctcaccccaggtcttga

SEQ ID NO: 261228 - DNA, 20 bp, Artificial
  CRISPR gRNA sequence
tgtgtgtcactctctttgac

SEQ ID NO: 261229 - DNA, 20 bp, Artificial
  CRISPR gRNA sequence
tagcaatcaagatcctggtt

SEQ ID NO: 261230 - DNA, 20 bp, Artificial
  CRISPR gRNA sequence
ctctaatctccagcatgtag

SEQ ID NO: 261231 - DNA, 20 bp, Artificial
  CRISPR gRNA sequence
tgtagttgaatttaacactt

SEQ ID NO: 261232 - DNA, 20 bp, Artificial
  CRISPR gRNA sequence
cagctggcagtgcaaatggc

SEQ ID NO: 261233 - DNA, 20 bp, Artificial
  CRISPR gRNA sequence
cagtgcaaatggctgggata

SEQ ID NO: 261234 - DNA, 20 bp, Artificial
  CRISPR gRNA sequence
tagttaacccgagggactga

SEQ ID NO: 261235 - DNA, 20 bp, Artificial
  CRISPR gRNA sequence
tgatggggtcaaggctgaag

SEQ ID NO: 261236 - DNA, 20 bp, Artificial
  CRISPR gRNA sequence
gctaaactggagatttatac

SEQ ID NO: 261237 - DNA, 20 bp, Artificial
  CRISPR gRNA sequence
gtagtttagtaattttatca

SEQ ID NO: 261238 - DNA, 20 bp, Artificial
  CRISPR gRNA sequence
agctcacaatcaaaaattat

SEQ ID NO: 261239 - DNA, 20 bp, Artificial
  CRISPR gRNA sequence
atttcttctttgtttctgtg

SEQ ID NO: 261240 - DNA, 20 bp, Artificial
  CRISPR gRNA sequence
cttctttgtttctgtgcaga

SEQ ID NO: 261241 - DNA, 20 bp, Artificial
  CRISPR gRNA sequence
ttcaaatacaatctgataac

SEQ ID NO: 261242 - DNA, 20 bp, Artificial
  CRISPR gRNA sequence
ctggcaagtggcacacgtgc

SEQ ID NO: 261243 - DNA, 20 bp, Artificial
  CRISPR gRNA sequence
tcttcagcacccaagtactg

SEQ ID NO: 261244 - DNA, 20 bp, Artificial
  CRISPR gRNA sequence
cttgggactgattaaatcca

SEQ ID NO: 261245 - DNA, 20 bp, Artificial
  CRISPR gRNA sequence
aaagtacagtattttcgatc

SEQ ID NO: 261246 - DNA, 20 bp, Artificial
  CRISPR gRNA sequence
tagcacctcatccctgcgta

SEQ ID NO: 261247 - DNA, 20 bp, Artificial
  CRISPR gRNA sequence
cgggcatgctactaaatgtc

SEQ ID NO: 261248 - DNA, 20 bp, Artificial
  CRISPR gRNA sequence
tactaaatgtcagggatagg

SEQ ID NO: 261249 - DNA, 20 bp, Artificial
  CRISPR gRNA sequence
aacctaagctccttcaacac

SEQ ID NO: 261250 - DNA, 20 bp, Artificial
  CRISPR gRNA sequence
aaaaatatccatggtcattt

SEQ ID NO: 261251 - DNA, 20 bp, Artificial
  CRISPR gRNA sequence
attccaaaatactttcccat

SEQ ID NO: 261252 - DNA, 20 bp, Artificial
  CRISPR gRNA sequence
ggtacaggagcagctgagcc

SEQ ID NO: 261253 - DNA, 20 bp, Artificial
  CRISPR gRNA sequence
ctatctcctcagcacatggc

SEQ ID NO: 261254 - DNA, 20 bp, Artificial
  CRISPR gRNA sequence
ggactcatcctcatactcta

SEQ ID NO: 261255 - DNA, 20 bp, Artificial
  CRISPR gRNA sequence
cgctctttccacaacccact

SEQ ID NO: 261256 - DNA, 20 bp, Artificial
  CRISPR gRNA sequence
aagctcctacctggtctgat

SEQ ID NO: 261257 - DNA, 20 bp, Artificial
  CRISPR gRNA sequence
gttgttgttgttgtttgaga

SEQ ID NO: 261258 - DNA, 20 bp, Artificial
  CRISPR gRNA sequence
gcctcagcctcttgggcagc

SEQ ID NO: 261259 - DNA, 20 bp, Artificial
  CRISPR gRNA sequence
ttttgtatttttagtacaga

SEQ ID NO: 261260 - DNA, 20 bp, Artificial
  CRISPR gRNA sequence
acctcggcctcccaaagtgc

SEQ ID NO: 261261 - DNA, 20 bp, Artificial
  CRISPR gRNA sequence
aacactgaagtctcatgaca

SEQ ID NO: 261262 - DNA, 20 bp, Artificial
  CRISPR gRNA sequence
tttacctgatattgctttga

SEQ ID NO: 261263 - DNA, 20 bp, Artificial
  CRISPR gRNA sequence
tcaaaatgactaaatatgat

SEQ ID NO: 261264 - DNA, 20 bp, Artificial
  CRISPR gRNA sequence
ggaactacgtggctcatttc

SEQ ID NO: 261265 - DNA, 20 bp, Artificial
  CRISPR gRNA sequence
taaacacccatttaaccaaa

SEQ ID NO: 261266 - DNA, 20 bp, Artificial
  CRISPR gRNA sequence
cttctgcaactaaaatgtct

SEQ ID NO: 261267 - DNA, 20 bp, Artificial
  CRISPR gRNA sequence
tgcttgactgagatgtgcag

SEQ ID NO: 261268 - DNA, 20 bp, Artificial
  CRISPR gRNA sequence
tgagaaagggaagaggctcc

SEQ ID NO: 261269 - DNA, 20 bp, Artificial
  CRISPR gRNA sequence
tcactaagtacatggtaagt

SEQ ID NO: 261270 - DNA, 20 bp, Artificial
  CRISPR gRNA sequence
aaatctcttttacttcattt

SEQ ID NO: 261271 - DNA, 20 bp, Artificial
  CRISPR gRNA sequence
ggctgccagccggctggctt

SEQ ID NO: 261272 - DNA, 20 bp, Artificial
  CRISPR gRNA sequence
gcatagggctggtaatgctt

SEQ ID NO: 261273 - DNA, 20 bp, Artificial
  CRISPR gRNA sequence
cgggtgggcccggggcggcg

SEQ ID NO: 261274 - DNA, 20 bp, Artificial
  CRISPR gRNA sequence
tggagggacaatgtcatgga

SEQ ID NO: 261275 - DNA, 20 bp, Artificial
  CRISPR gRNA sequence
cttttttgagcaccttggac

SEQ ID NO: 261276 - DNA, 20 bp, Artificial
  CRISPR gRNA sequence
tctcaatgctgtcatctgac

SEQ ID NO: 261277 - DNA, 20 bp, Artificial
  CRISPR gRNA sequence
aagaggactttcaactcctc

SEQ ID NO: 261278 - DNA, 20 bp, Artificial
  CRISPR gRNA sequence
taatcacaaatttgtaaagg

SEQ ID NO: 261279 - DNA, 20 bp, Artificial
  CRISPR gRNA sequence
tagtacattcctatgtcttt

SEQ ID NO: 261280 - DNA, 20 bp, Artificial
  CRISPR gRNA sequence
tttcataggcttggctccat

SEQ ID NO: 261281 - DNA, 20 bp, Artificial
  CRISPR gRNA sequence
ataggcttggctccatcagg

SEQ ID NO: 261282 - DNA, 20 bp, Artificial
  CRISPR gRNA sequence
gggcaatagtttcacccacc

SEQ ID NO: 261283 - DNA, 20 bp, Artificial
  CRISPR gRNA sequence
tcttagcaaaatttttgact

SEQ ID NO: 261284 - DNA, 20 bp, Artificial
  CRISPR gRNA sequence
aagggttaggaacatcattt

SEQ ID NO: 261285 - DNA, 20 bp, Artificial
  CRISPR gRNA sequence
aacagaaagccatcagattt

SEQ ID NO: 261286 - DNA, 20 bp, Artificial
  CRISPR gRNA sequence
agccatcagatttctggatt

SEQ ID NO: 261287 - DNA, 20 bp, Artificial
  CRISPR gRNA sequence
ctaagtagataatgctgtac

SEQ ID NO: 261288 - DNA, 20 bp, Artificial
  CRISPR gRNA sequence
gtacatgaatgacatgatac

SEQ ID NO: 261289 - DNA, 20 bp, Artificial
  CRISPR gRNA sequence
atgaatgacatgatacctga

SEQ ID NO: 261290 - DNA, 20 bp, Artificial
  CRISPR gRNA sequence
atacctgaatgaataaataa

SEQ ID NO: 261291 - DNA, 20 bp, Artificial
  CRISPR gRNA sequence
accttccttgtcaaaggggc

SEQ ID NO: 261292 - DNA, 20 bp, Artificial
  CRISPR gRNA sequence
atccttctctaaccagccgt

SEQ ID NO: 261293 - DNA, 20 bp, Artificial
  CRISPR gRNA sequence
tttttaccagtgtttctcat

SEQ ID NO: 261294 - DNA, 20 bp, Artificial
  CRISPR gRNA sequence
taccagtgtttctcatctga

SEQ ID NO: 261295 - DNA, 20 bp, Artificial
  CRISPR gRNA sequence
tagtgaagtctaaaaacatt

SEQ ID NO: 261296 - DNA, 20 bp, Artificial
  CRISPR gRNA sequence
tttggatcatcacaacgggg

SEQ ID NO: 261297 - DNA, 20 bp, Artificial
  CRISPR gRNA sequence
agggatgctactggcatcta

SEQ ID NO: 261298 - DNA, 20 bp, Artificial
  CRISPR gRNA sequence
aaacatcctacaatgcaatg

SEQ ID NO: 261299 - DNA, 20 bp, Artificial
  CRISPR gRNA sequence
gcacaagatcacagcagggc

SEQ ID NO: 261300 - DNA, 20 bp, Artificial
  CRISPR gRNA sequence
gaggaaatgtctgtccccag

SEQ ID NO: 261301 - DNA, 20 bp, Artificial
  CRISPR gRNA sequence
cctaactctaaacacagcag

SEQ ID NO: 261302 - DNA, 20 bp, Artificial
  CRISPR gRNA sequence
acctacagcacccatgtgca

SEQ ID NO: 261303 - DNA, 20 bp, Artificial
  CRISPR gRNA sequence
tcatctccaccccttcaaca

SEQ ID NO: 261304 - DNA, 20 bp, Artificial
  CRISPR gRNA sequence
tacttaagtacgtggtcttc

SEQ ID NO: 261305 - DNA, 20 bp, Artificial
  CRISPR gRNA sequence
acgtggtcttcaagaatcta

SEQ ID NO: 261306 - DNA, 20 bp, Artificial
  CRISPR gRNA sequence
agctttaccagcacagctgc

SEQ ID NO: 261307 - DNA, 20 bp, Artificial
  CRISPR gRNA sequence
ccagcacagctgcatgaatg

SEQ ID NO: 261308 - DNA, 20 bp, Artificial
  CRISPR gRNA sequence
catcaggtcaagaactgaga

SEQ ID NO: 261309 - DNA, 20 bp, Artificial
  CRISPR gRNA sequence
cgctgcagaccagccaaaaa

SEQ ID NO: 261310 - DNA, 20 bp, Artificial
  CRISPR gRNA sequence
ccaggaaacagctaaactcc

SEQ ID NO: 261311 - DNA, 20 bp, Artificial
  CRISPR gRNA sequence
acagcaggaaaagatgagcc

SEQ ID NO: 261312 - DNA, 20 bp, Artificial
  CRISPR gRNA sequence
tatttatactcttttggtaa

SEQ ID NO: 261313 - DNA, 20 bp, Artificial
  CRISPR gRNA sequence
cagataagtggtagttttta

SEQ ID NO: 261314 - DNA, 20 bp, Artificial
  CRISPR gRNA sequence
tggtagtttttattgggtaa

SEQ ID NO: 261315 - DNA, 20 bp, Artificial
  CRISPR gRNA sequence
acaggactgcccaattcaca

SEQ ID NO: 261316 - DNA, 20 bp, Artificial
  CRISPR gRNA sequence
tttttttaaaacaaagcaag

SEQ ID NO: 261317 - DNA, 20 bp, Artificial
  CRISPR gRNA sequence
aaagcaagatgaatctcact

SEQ ID NO: 261318 - DNA, 20 bp, Artificial
  CRISPR gRNA sequence
ccagtgtgtctatgatgtgt

SEQ ID NO: 261319 - DNA, 20 bp, Artificial
  CRISPR gRNA sequence
gagaagctgcttttgtccct

SEQ ID NO: 261320 - DNA, 20 bp, Artificial
  CRISPR gRNA sequence
ttatagtaactgacattcta

SEQ ID NO: 261321 - DNA, 20 bp, Artificial
  CRISPR gRNA sequence
cctaggtcagcatatcacag

SEQ ID NO: 261322 - DNA, 20 bp, Artificial
  CRISPR gRNA sequence
caggggaatgcctttcctgg

SEQ ID NO: 261323 - DNA, 20 bp, Artificial
  CRISPR gRNA sequence
aaagttgagattcccaataa

SEQ ID NO: 261324 - DNA, 20 bp, Artificial
  CRISPR gRNA sequence
attaagaagaaacaagaact

SEQ ID NO: 261325 - DNA, 20 bp, Artificial
  CRISPR gRNA sequence
aaaattatcagcaaacacca

SEQ ID NO: 261326 - DNA, 20 bp, Artificial
  CRISPR gRNA sequence
gatcaaagttagaaggtaag

SEQ ID NO: 261327 - DNA, 20 bp, Artificial
  CRISPR gRNA sequence
tagtcaactaacatcagagg

SEQ ID NO: 261328 - DNA, 20 bp, Artificial
  CRISPR gRNA sequence
caataccaaagccccacctt

SEQ ID NO: 261329 - DNA, 20 bp, Artificial
  CRISPR gRNA sequence
ttaagatgatacctagtata

SEQ ID NO: 261330 - DNA, 20 bp, Artificial
  CRISPR gRNA sequence
ttcctaccctgcggcaagta

SEQ ID NO: 261331 - DNA, 20 bp, Artificial
  CRISPR gRNA sequence
acaaatgtccatctgagccc

SEQ ID NO: 261332 - DNA, 20 bp, Artificial
  CRISPR gRNA sequence
agctttggcaataggccaag

SEQ ID NO: 261333 - DNA, 20 bp, Artificial
  CRISPR gRNA sequence
ataggccaagaagagtctaa

SEQ ID NO: 261334 - DNA, 20 bp, Artificial
  CRISPR gRNA sequence
gagtctaaaagaatctaaga

SEQ ID NO: 261335 - DNA, 20 bp, Artificial
  CRISPR gRNA sequence
gataataggaaggcatggct

SEQ ID NO: 261336 - DNA, 20 bp, Artificial
  CRISPR gRNA sequence
gtcaccaagctgacagtaaa

SEQ ID NO: 261337 - DNA, 20 bp, Artificial
  CRISPR gRNA sequence
cagaaatcactgacccatct

SEQ ID NO: 261338 - DNA, 20 bp, Artificial
  CRISPR gRNA sequence
atacagattatgccttaaag

SEQ ID NO: 261339 - DNA, 20 bp, Artificial
  CRISPR gRNA sequence
aatgtacttaatatcaaatg

SEQ ID NO: 261340 - DNA, 20 bp, Artificial
  CRISPR gRNA sequence
agaaatagtcttttatgttt

SEQ ID NO: 261341 - DNA, 20 bp, Artificial
  CRISPR gRNA sequence
aaaaaaattcaaagacaaca

SEQ ID NO: 261342 - DNA, 20 bp, Artificial
  CRISPR gRNA sequence
actatgtacctaagaagttt

SEQ ID NO: 261343 - DNA, 20 bp, Artificial
  CRISPR gRNA sequence
agaagtttctgagtaagaac

SEQ ID NO: 261344 - DNA, 20 bp, Artificial
  CRISPR gRNA sequence
agtaagaacaagggtcactc

SEQ ID NO: 261345 - DNA, 20 bp, Artificial
  CRISPR gRNA sequence
atctagtttctttgctaggt

SEQ ID NO: 261346 - DNA, 20 bp, Artificial
  CRISPR gRNA sequence
tatcagatttttatctcaga

SEQ ID NO: 261347 - DNA, 20 bp, Artificial
  CRISPR gRNA sequence
aaaccacataggcaaaattc

SEQ ID NO: 261348 - DNA, 20 bp, Artificial
  CRISPR gRNA sequence
tgtttccctgaaaaacaaaa

SEQ ID NO: 261349 - DNA, 20 bp, Artificial
  CRISPR gRNA sequence
tccctgaaaaacaaaataga

SEQ ID NO: 261350 - DNA, 20 bp, Artificial
  CRISPR gRNA sequence
tagagtggattaaatgatac

SEQ ID NO: 261351 - DNA, 20 bp, Artificial
  CRISPR gRNA sequence
aaatgatacaggaatagcaa

SEQ ID NO: 261352 - DNA, 20 bp, Artificial
  CRISPR gRNA sequence
tattaaacatatcaccagct

SEQ ID NO: 261353 - DNA, 20 bp, Artificial
  CRISPR gRNA sequence
aaacatatcaccagcttaga

SEQ ID NO: 261354 - DNA, 20 bp, Artificial
  CRISPR gRNA sequence
acagttgaaagccattacgt

SEQ ID NO: 261355 - DNA, 20 bp, Artificial
  CRISPR gRNA sequence
acttgtattcacttgacttt

SEQ ID NO: 261356 - DNA, 20 bp, Artificial
  CRISPR gRNA sequence
tagaccctaaactgcatcct

SEQ ID NO: 261357 - DNA, 20 bp, Artificial
  CRISPR gRNA sequence
gaacactggactgctaatca

SEQ ID NO: 261358 - DNA, 20 bp, Artificial
  CRISPR gRNA sequence
acaaatcactttgtatcttt

SEQ ID NO: 261359 - DNA, 20 bp, Artificial
  CRISPR gRNA sequence
tgtatctttaggaatcaaaa

SEQ ID NO: 261360 - DNA, 20 bp, Artificial
  CRISPR gRNA sequence
aggggatgagaaggaaccta

SEQ ID NO: 261361 - DNA, 20 bp, Artificial
  CRISPR gRNA sequence
tcaacccatatcaattacat

SEQ ID NO: 261362 - DNA, 20 bp, Artificial
  CRISPR gRNA sequence
tcagatttataatatacaga

SEQ ID NO: 261363 - DNA, 20 bp, Artificial
  CRISPR gRNA sequence
ggattgaaaattactaagta

SEQ ID NO: 261364 - DNA, 20 bp, Artificial
  CRISPR gRNA sequence
atacaattaaaatattctgt

SEQ ID NO: 261365 - DNA, 20 bp, Artificial
  CRISPR gRNA sequence
accattcattggcattatgc

SEQ ID NO: 261366 - DNA, 20 bp, Artificial
  CRISPR gRNA sequence
gctaccaatactgtattctt

SEQ ID NO: 261367 - DNA, 20 bp, Artificial
  CRISPR gRNA sequence
tactgtattcttctgagttg

SEQ ID NO: 261368 - DNA, 20 bp, Artificial
  CRISPR gRNA sequence
aatactgcttaacagttgta

SEQ ID NO: 261369 - DNA, 20 bp, Artificial
  CRISPR gRNA sequence
actttgggaggccaacacgg

SEQ ID NO: 261370 - DNA, 20 bp, Artificial
  CRISPR gRNA sequence
tactcaggaggctgaggcag

SEQ ID NO: 261371 - DNA, 20 bp, Artificial
  CRISPR gRNA sequence
tgatcgggaggctgaggcag

SEQ ID NO: 261372 - DNA, 20 bp, Artificial
  CRISPR gRNA sequence
tccagcctgggcgacagagc

SEQ ID NO: 261373 - DNA, 20 bp, Artificial
  CRISPR gRNA sequence
aagattatggagcacaaaaa

SEQ ID NO: 261374 - DNA, 20 bp, Artificial
  CRISPR gRNA sequence
agaattaattagaaatagaa

SEQ ID NO: 261375 - DNA, 20 bp, Artificial
  CRISPR gRNA sequence
agaaatagaagtgagtcttc

SEQ ID NO: 261376 - DNA, 20 bp, Artificial
  CRISPR gRNA sequence
tcttttctgccatgatccac

SEQ ID NO: 261377 - DNA, 20 bp, Artificial
  CRISPR gRNA sequence
aagatattcaaaatataacc

SEQ ID NO: 261378 - DNA, 20 bp, Artificial
  CRISPR gRNA sequence
gcatttgaaaaccattactt

SEQ ID NO: 261379 - DNA, 20 bp, Artificial
  CRISPR gRNA sequence
agttgtatgttacctttcac

SEQ ID NO: 261380 - DNA, 20 bp, Artificial
  CRISPR gRNA sequence
ctcattgtctaggtaaggag

SEQ ID NO: 261381 - DNA, 20 bp, Artificial
  CRISPR gRNA sequence
taacatacaaattctggagg

SEQ ID NO: 261382 - DNA, 20 bp, Artificial
  CRISPR gRNA sequence
atcacagttgaaccccgttt

SEQ ID NO: 261383 - DNA, 20 bp, Artificial
  CRISPR gRNA sequence
tgagtaaacctgaagctgct

SEQ ID NO: 261384 - DNA, 20 bp, Artificial
  CRISPR gRNA sequence
cactatccagtcctttgtga

SEQ ID NO: 261385 - DNA, 20 bp, Artificial
  CRISPR gRNA sequence
ctcccttgagaagagattgt

SEQ ID NO: 261386 - DNA, 20 bp, Artificial
  CRISPR gRNA sequence
aaaaatcatttgcttagaac

SEQ ID NO: 261387 - DNA, 20 bp, Artificial
  CRISPR gRNA sequence
tttgcttagaacaagaatat

SEQ ID NO: 261388 - DNA, 20 bp, Artificial
  CRISPR gRNA sequence
gaagatgtaggacctcttca

SEQ ID NO: 261389 - DNA, 20 bp, Artificial
  CRISPR gRNA sequence
cttcaggggataattatact

SEQ ID NO: 261390 - DNA, 20 bp, Artificial
  CRISPR gRNA sequence
aatattattttcatcctctt

SEQ ID NO: 261391 - DNA, 20 bp, Artificial
  CRISPR gRNA sequence
gcattgggccaatttcctga

SEQ ID NO: 261392 - DNA, 20 bp, Artificial
  CRISPR gRNA sequence
ttgtttgtttgtttttgaga

SEQ ID NO: 261393 - DNA, 20 bp, Artificial
  CRISPR gRNA sequence
ctcactgcaacctccaccca

SEQ ID NO: 261394 - DNA, 20 bp, Artificial
  CRISPR gRNA sequence
gcctcagtctcttaagtagc

SEQ ID NO: 261395 - DNA, 20 bp, Artificial
  CRISPR gRNA sequence
ttctatttttttagtataga

SEQ ID NO: 261396 - DNA, 20 bp, Artificial
  CRISPR gRNA sequence
accttggcctcccaaagtgc

SEQ ID NO: 261397 - DNA, 20 bp, Artificial
  CRISPR gRNA sequence
tgtgatacaggtttttgtaa

SEQ ID NO: 261398 - DNA, 20 bp, Artificial
  CRISPR gRNA sequence
ctttgtttattgcccattgc

SEQ ID NO: 261399 - DNA, 20 bp, Artificial
  CRISPR gRNA sequence
tttattgcccattgcaagag

SEQ ID NO: 261400 - DNA, 20 bp, Artificial
  CRISPR gRNA sequence
gataagaaaaaatataaccc

SEQ ID NO: 261401 - DNA, 20 bp, Artificial
  CRISPR gRNA sequence
tgttttctgcaccaaattca

SEQ ID NO: 261402 - DNA, 20 bp, Artificial
  CRISPR gRNA sequence
aaaggtgaaagactccagag

SEQ ID NO: 261403 - DNA, 20 bp, Artificial
  CRISPR gRNA sequence
gctatcccaataaaagatca

SEQ ID NO: 261404 - DNA, 20 bp, Artificial
  CRISPR gRNA sequence
cactgaagcactgagaaact

SEQ ID NO: 261405 - DNA, 20 bp, Artificial
  CRISPR gRNA sequence
tttttttttttttctggaga

SEQ ID NO: 261406 - DNA, 20 bp, Artificial
  CRISPR gRNA sequence
ttcgctcttgttgcccaggc

SEQ ID NO: 261407 - DNA, 20 bp, Artificial
  CRISPR gRNA sequence
ctgactgcaacctccgccct

SEQ ID NO: 261408 - DNA, 20 bp, Artificial
  CRISPR gRNA sequence
gattctcctgcctcagcctc

SEQ ID NO: 261409 - DNA, 20 bp, Artificial
  CRISPR gRNA sequence
gcctcagcctcccgagtagc

SEQ ID NO: 261410 - DNA, 20 bp, Artificial
  CRISPR gRNA sequence
ttttctatttttagtagaga

SEQ ID NO: 261411 - DNA, 20 bp, Artificial
  CRISPR gRNA sequence
gcctcggcctcccaaagtgc

SEQ ID NO: 261412 - DNA, 20 bp, Artificial
  CRISPR gRNA sequence
agccactgcgcctggccctc

SEQ ID NO: 261413 - DNA, 20 bp, Artificial
  CRISPR gRNA sequence
gcatttttttgctcttgttt

SEQ ID NO: 261414 - DNA, 20 bp, Artificial
  CRISPR gRNA sequence
aaatgaaatttacaatttaa

SEQ ID NO: 261415 - DNA, 20 bp, Artificial
  CRISPR gRNA sequence
aatttacaatttaactgaat

SEQ ID NO: 261416 - DNA, 20 bp, Artificial
  CRISPR gRNA sequence
tataatcaataatgctggct

SEQ ID NO: 261417 - DNA, 20 bp, Artificial
  CRISPR gRNA sequence
agcactttgggaggccaagg

SEQ ID NO: 261418 - DNA, 20 bp, Artificial
  CRISPR gRNA sequence
ctttgggaggccaaggcggg

SEQ ID NO: 261419 - DNA, 20 bp, Artificial
  CRISPR gRNA sequence
cgggatgaatgcttgagccc

SEQ ID NO: 261420 - DNA, 20 bp, Artificial
  CRISPR gRNA sequence
aattggtctaggctgggggg

SEQ ID NO: 261421 - DNA, 20 bp, Artificial
  CRISPR gRNA sequence
tttagtatattcacaaagtt

SEQ ID NO: 261422 - DNA, 20 bp, Artificial
  CRISPR gRNA sequence
gtatattcacaaagttatga

SEQ ID NO: 261423 - DNA, 20 bp, Artificial
  CRISPR gRNA sequence
cactgatctactttggccct

SEQ ID NO: 261424 - DNA, 20 bp, Artificial
  CRISPR gRNA sequence
ttctggactttttttataag

SEQ ID NO: 261425 - DNA, 20 bp, Artificial
  CRISPR gRNA sequence
ttcatcactttttggctatt

SEQ ID NO: 261426 - DNA, 20 bp, Artificial
  CRISPR gRNA sequence
atttgccagcagtaaaattg

SEQ ID NO: 261427 - DNA, 20 bp, Artificial
  CRISPR gRNA sequence
actctatgtttaactttttg

SEQ ID NO: 261428 - DNA, 20 bp, Artificial
  CRISPR gRNA sequence
attgtacattctcaccagca

SEQ ID NO: 261429 - DNA, 20 bp, Artificial
  CRISPR gRNA sequence
ggctatttatctttttatta

SEQ ID NO: 261430 - DNA, 20 bp, Artificial
  CRISPR gRNA sequence
tctttttattattgaattat

SEQ ID NO: 261431 - DNA, 20 bp, Artificial
  CRISPR gRNA sequence
cttttttttttttattttta

SEQ ID NO: 261432 - DNA, 20 bp, Artificial
  CRISPR gRNA sequence
tctcactctgtcacccaggc

SEQ ID NO: 261433 - DNA, 20 bp, Artificial
  CRISPR gRNA sequence
tcactgcagcctctgccacc

SEQ ID NO: 261434 - DNA, 20 bp, Artificial
  CRISPR gRNA sequence
aatcctcctgcctcagcctc

SEQ ID NO: 261435 - DNA, 20 bp, Artificial
  CRISPR gRNA sequence
gcctcagcctcccgagtagc

SEQ ID NO: 261436 - DNA, 20 bp, Artificial
  CRISPR gRNA sequence
ttttatatttttagtagaga

SEQ ID NO: 261437 - DNA, 20 bp, Artificial
  CRISPR gRNA sequence
taaatgttttctctcattct

SEQ ID NO: 261438 - DNA, 20 bp, Artificial
  CRISPR gRNA sequence
cacttgattctaatattcaa

SEQ ID NO: 261439 - DNA, 20 bp, Artificial
  CRISPR gRNA sequence
tgaaagccactatggcctag

SEQ ID NO: 261440 - DNA, 20 bp, Artificial
  CRISPR gRNA sequence
aattcacctgacaacatatt

SEQ ID NO: 261441 - DNA, 20 bp, Artificial
  CRISPR gRNA sequence
ttttccaaggccaattaaat

SEQ ID NO: 261442 - DNA, 20 bp, Artificial
  CRISPR gRNA sequence
ctgtatcgctcacttgacat

SEQ ID NO: 261443 - DNA, 20 bp, Artificial
  CRISPR gRNA sequence
atgcttcaatttgcttagct

SEQ ID NO: 261444 - DNA, 20 bp, Artificial
  CRISPR gRNA sequence
agactctcataaaataattg

SEQ ID NO: 261445 - DNA, 20 bp, Artificial
  CRISPR gRNA sequence
cactgaaaaataaacatgca

SEQ ID NO: 261446 - DNA, 20 bp, Artificial
  CRISPR gRNA sequence
gtttcctttttttacttaga

SEQ ID NO: 261447 - DNA, 20 bp, Artificial
  CRISPR gRNA sequence
tgcatctctcctccttttca

SEQ ID NO: 261448 - DNA, 20 bp, Artificial
  CRISPR gRNA sequence
tctctcctccttttcagaga

SEQ ID NO: 261449 - DNA, 20 bp, Artificial
  CRISPR gRNA sequence
ttctgcttgctcaccgccct

SEQ ID NO: 261450 - DNA, 20 bp, Artificial
  CRISPR gRNA sequence
gtgtttctattgctaattat

SEQ ID NO: 261451 - DNA, 20 bp, Artificial
  CRISPR gRNA sequence
gctgatttaaagaaaaagat

SEQ ID NO: 261452 - DNA, 20 bp, Artificial
  CRISPR gRNA sequence
ttaaagaaaaagatgggaat

SEQ ID NO: 261453 - DNA, 20 bp, Artificial
  CRISPR gRNA sequence
tctttgtggagacaaaaaaa

SEQ ID NO: 261454 - DNA, 20 bp, Artificial
  CRISPR gRNA sequence
tggagacaaaaaaagggagt

SEQ ID NO: 261455 - DNA, 20 bp, Artificial
  CRISPR gRNA sequence
ggaagaaaagctgtggcatc

SEQ ID NO: 261456 - DNA, 20 bp, Artificial
  CRISPR gRNA sequence
atctagagtccagtggtttg

SEQ ID NO: 261457 - DNA, 20 bp, Artificial
  CRISPR gRNA sequence
tgaatatgtcctgtctaact

SEQ ID NO: 261458 - DNA, 20 bp, Artificial
  CRISPR gRNA sequence
ctaagatgcacatgggagag

SEQ ID NO: 261459 - DNA, 20 bp, Artificial
  CRISPR gRNA sequence
gaagaattgatttcccaaaa

SEQ ID NO: 261460 - DNA, 20 bp, Artificial
  CRISPR gRNA sequence
gggcaacagggaaaccagct

SEQ ID NO: 261461 - DNA, 20 bp, Artificial
  CRISPR gRNA sequence
ctcaggagatgacggctgac

SEQ ID NO: 261462 - DNA, 20 bp, Artificial
  CRISPR gRNA sequence
acggctgacctgagtcctga

SEQ ID NO: 261463 - DNA, 20 bp, Artificial
  CRISPR gRNA sequence
tcctgaaggagtatgcatac

SEQ ID NO: 261464 - DNA, 20 bp, Artificial
  CRISPR gRNA sequence
cgtgtctttgtgttggggac

SEQ ID NO: 261465 - DNA, 20 bp, Artificial
  CRISPR gRNA sequence
tggggactggggtgaggtgg

SEQ ID NO: 261466 - DNA, 20 bp, Artificial
  CRISPR gRNA sequence
gggagagtgtgtgtttgggc

SEQ ID NO: 261467 - DNA, 20 bp, Artificial
  CRISPR gRNA sequence
gagtgtgtgtttgggctggg

SEQ ID NO: 261468 - DNA, 20 bp, Artificial
  CRISPR gRNA sequence
gtgagttaggggactgtggg

SEQ ID NO: 261469 - DNA, 20 bp, Artificial
  CRISPR gRNA sequence
ggataagacaaagagagaaa

SEQ ID NO: 261470 - DNA, 20 bp, Artificial
  CRISPR gRNA sequence
gtctgggcaagggagatgag

SEQ ID NO: 261471 - DNA, 20 bp, Artificial
  CRISPR gRNA sequence
gcaagggagatgaggagggt

SEQ ID NO: 261472 - DNA, 20 bp, Artificial
  CRISPR gRNA sequence
gtaagagtgtggccgacttg

SEQ ID NO: 261473 - DNA, 20 bp, Artificial
  CRISPR gRNA sequence
taccttctttttgctgggcc

SEQ ID NO: 261474 - DNA, 20 bp, Artificial
  CRISPR gRNA sequence
tagctaacagcctcctagtt

SEQ ID NO: 261475 - DNA, 20 bp, Artificial
  CRISPR gRNA sequence
ctcctagtttagagttcaag

SEQ ID NO: 261476 - DNA, 20 bp, Artificial
  CRISPR gRNA sequence
accagtgactctaagtgata

SEQ ID NO: 261477 - DNA, 20 bp, Artificial
  CRISPR gRNA sequence
tatgtgtgatcattgtgact

SEQ ID NO: 261478 - DNA, 20 bp, Artificial
  CRISPR gRNA sequence
aaatcaaagtagctgataat

SEQ ID NO: 261479 - DNA, 20 bp, Artificial
  CRISPR gRNA sequence
ttgatatgtattttcggtct

SEQ ID NO: 261480 - DNA, 20 bp, Artificial
  CRISPR gRNA sequence
tttgctttccagttcatgct

SEQ ID NO: 261481 - DNA, 20 bp, Artificial
  CRISPR gRNA sequence
aggcattcttcttaggctac

SEQ ID NO: 261482 - DNA, 20 bp, Artificial
  CRISPR gRNA sequence
ggagacccagccctttccct

SEQ ID NO: 261483 - DNA, 20 bp, Artificial
  CRISPR gRNA sequence
aatatttgattttacttctt

SEQ ID NO: 261484 - DNA, 20 bp, Artificial
  CRISPR gRNA sequence
tctgactgacatttctctaa

SEQ ID NO: 261485 - DNA, 20 bp, Artificial
  CRISPR gRNA sequence
attgacaagttgttttgaag

SEQ ID NO: 261486 - DNA, 20 bp, Artificial
  CRISPR gRNA sequence
gcttaacaacaggcaacatg

SEQ ID NO: 261487 - DNA, 20 bp, Artificial
  CRISPR gRNA sequence
agatttcccacagataatct

SEQ ID NO: 261488 - DNA, 20 bp, Artificial
  CRISPR gRNA sequence
aaagttgcttgaacttccat

SEQ ID NO: 261489 - DNA, 20 bp, Artificial
  CRISPR gRNA sequence
gaacttccatgagaatggca

SEQ ID NO: 261490 - DNA, 20 bp, Artificial
  CRISPR gRNA sequence
gccgtttacacctattataa

SEQ ID NO: 261491 - DNA, 20 bp, Artificial
  CRISPR gRNA sequence
aggtcaaccctctgcatagg

SEQ ID NO: 261492 - DNA, 20 bp, Artificial
  CRISPR gRNA sequence
aactgaggtcaaagaggtag

SEQ ID NO: 261493 - DNA, 20 bp, Artificial
  CRISPR gRNA sequence
tcaaagttggacttgatagg

SEQ ID NO: 261494 - DNA, 20 bp, Artificial
  CRISPR gRNA sequence
ggaggatggtaccagatgtc

SEQ ID NO: 261495 - DNA, 20 bp, Artificial
  CRISPR gRNA sequence
tggtaccagatgtctggagt

SEQ ID NO: 261496 - DNA, 20 bp, Artificial
  CRISPR gRNA sequence
aggagattaccattaagtag

SEQ ID NO: 261497 - DNA, 20 bp, Artificial
  CRISPR gRNA sequence
gattaccattaagtagggga

SEQ ID NO: 261498 - DNA, 20 bp, Artificial
  CRISPR gRNA sequence
ccattaagtaggggagtgaa

SEQ ID NO: 261499 - DNA, 20 bp, Artificial
  CRISPR gRNA sequence
cattttccccactattttat

SEQ ID NO: 261500 - DNA, 20 bp, Artificial
  CRISPR gRNA sequence
atttatttatttagacatct

SEQ ID NO: 261501 - DNA, 20 bp, Artificial
  CRISPR gRNA sequence
actttgttcattcagcaaga

SEQ ID NO: 261502 - DNA, 20 bp, Artificial
  CRISPR gRNA sequence
agatttcctgaaggtcatag

SEQ ID NO: 261503 - DNA, 20 bp, Artificial
  CRISPR gRNA sequence
agcttacccaagtatacaaa

SEQ ID NO: 261504 - DNA, 20 bp, Artificial
  CRISPR gRNA sequence
aaaagggattgaacatagac

SEQ ID NO: 261505 - DNA, 20 bp, Artificial
  CRISPR gRNA sequence
tccttaacttcagggctttt

SEQ ID NO: 261506 - DNA, 20 bp, Artificial
  CRISPR gRNA sequence
taaagaagcagttagagagc

SEQ ID NO: 261507 - DNA, 20 bp, Artificial
  CRISPR gRNA sequence
agcaaaatgtgattttcctc

SEQ ID NO: 261508 - DNA, 20 bp, Artificial
  CRISPR gRNA sequence
ttttaaaaattcggactgaa

SEQ ID NO: 261509 - DNA, 20 bp, Artificial
  CRISPR gRNA sequence
taagttactgtaactttcct

SEQ ID NO: 261510 - DNA, 20 bp, Artificial
  CRISPR gRNA sequence
gtatatttcctgttcaggcc

SEQ ID NO: 261511 - DNA, 20 bp, Artificial
  CRISPR gRNA sequence
gctccttttcaggctctgta

SEQ ID NO: 261512 - DNA, 20 bp, Artificial
  CRISPR gRNA sequence
tattcatgacctaccatgct

SEQ ID NO: 261513 - DNA, 20 bp, Artificial
  CRISPR gRNA sequence
tcacacagaaaaagggggct

SEQ ID NO: 261514 - DNA, 20 bp, Artificial
  CRISPR gRNA sequence
catgcatatacagtggtcct

SEQ ID NO: 261515 - DNA, 20 bp, Artificial
  CRISPR gRNA sequence
acagtggtcctctggatcca

SEQ ID NO: 261516 - DNA, 20 bp, Artificial
  CRISPR gRNA sequence
tgtttttgatccatggttca

SEQ ID NO: 261517 - DNA, 20 bp, Artificial
  CRISPR gRNA sequence
aatccaaagatgcataaccc

SEQ ID NO: 261518 - DNA, 20 bp, Artificial
  CRISPR gRNA sequence
tggcacacacaaaattgggc

SEQ ID NO: 261519 - DNA, 20 bp, Artificial
  CRISPR gRNA sequence
gtggcaagagcagaaccacg

SEQ ID NO: 261520 - DNA, 20 bp, Artificial
  CRISPR gRNA sequence
gagcctgtgacttgcagcag

SEQ ID NO: 261521 - DNA, 20 bp, Artificial
  CRISPR gRNA sequence
ttaccagaaccagaaggcaa

SEQ ID NO: 261522 - DNA, 20 bp, Artificial
  CRISPR gRNA sequence
ggtaacaatataaatagaaa

SEQ ID NO: 261523 - DNA, 20 bp, Artificial
  CRISPR gRNA sequence
tttactaaaggcctggcaca

SEQ ID NO: 261524 - DNA, 20 bp, Artificial
  CRISPR gRNA sequence
ctgtactcctagcactttgg

SEQ ID NO: 261525 - DNA, 20 bp, Artificial
  CRISPR gRNA sequence
actttgggaggatgacacag

SEQ ID NO: 261526 - DNA, 20 bp, Artificial
  CRISPR gRNA sequence
acaaaaaatacaaaaattag

SEQ ID NO: 261527 - DNA, 20 bp, Artificial
  CRISPR gRNA sequence
tacaaaaattagctgggtgt

SEQ ID NO: 261528 - DNA, 20 bp, Artificial
  CRISPR gRNA sequence
tccttgggaggctgaggtgg

SEQ ID NO: 261529 - DNA, 20 bp, Artificial
  CRISPR gRNA sequence
cccaggaggtcaaggctgca

SEQ ID NO: 261530 - DNA, 20 bp, Artificial
  CRISPR gRNA sequence
aaagttatcaaaaacaatca

SEQ ID NO: 261531 - DNA, 20 bp, Artificial
  CRISPR gRNA sequence
gaagaaattttgatgtgtca

SEQ ID NO: 261532 - DNA, 20 bp, Artificial
  CRISPR gRNA sequence
cgtggtacatgaacccttta

SEQ ID NO: 261533 - DNA, 20 bp, Artificial
  CRISPR gRNA sequence
aaagaagccttgtttccaga

SEQ ID NO: 261534 - DNA, 20 bp, Artificial
  CRISPR gRNA sequence
catggaaatgaccttagtgt

SEQ ID NO: 261535 - DNA, 20 bp, Artificial
  CRISPR gRNA sequence
gagagtttattgggaactgg

SEQ ID NO: 261536 - DNA, 20 bp, Artificial
  CRISPR gRNA sequence
ggcagagtattccatttatg

SEQ ID NO: 261537 - DNA, 20 bp, Artificial
  CRISPR gRNA sequence
atgggagatgctgaagatgt

SEQ ID NO: 261538 - DNA, 20 bp, Artificial
  CRISPR gRNA sequence
atgctgaagatgtctgagtt

SEQ ID NO: 261539 - DNA, 20 bp, Artificial
  CRISPR gRNA sequence
ggaaggttagcacagccttg

SEQ ID NO: 261540 - DNA, 20 bp, Artificial
  CRISPR gRNA sequence
gctgatgcaatagcactgat

SEQ ID NO: 261541 - DNA, 20 bp, Artificial
  CRISPR gRNA sequence
ggaggtggcagctggtatga

SEQ ID NO: 261542 - DNA, 20 bp, Artificial
  CRISPR gRNA sequence
tttacagactgatggtgaac

SEQ ID NO: 261543 - DNA, 20 bp, Artificial
  CRISPR gRNA sequence
aacaggaatggaaaccgacc

SEQ ID NO: 261544 - DNA, 20 bp, Artificial
  CRISPR gRNA sequence
accgacccagagttcacgca

SEQ ID NO: 261545 - DNA, 20 bp, Artificial
  CRISPR gRNA sequence
ccagagttcacgcactgggt

SEQ ID NO: 261546 - DNA, 20 bp, Artificial
  CRISPR gRNA sequence
ttcacgcactgggtaagggt

SEQ ID NO: 261547 - DNA, 20 bp, Artificial
  CRISPR gRNA sequence
tcctggaggaaagatccaga

SEQ ID NO: 261548 - DNA, 20 bp, Artificial
  CRISPR gRNA sequence
aggagttagaagtataggac

SEQ ID NO: 261549 - DNA, 20 bp, Artificial
  CRISPR gRNA sequence
agagttcgaggaagccagtt

SEQ ID NO: 261550 - DNA, 20 bp, Artificial
  CRISPR gRNA sequence
attaggaagttcatatgtat

SEQ ID NO: 261551 - DNA, 20 bp, Artificial
  CRISPR gRNA sequence
agagacaccacacagcaatg

SEQ ID NO: 261552 - DNA, 20 bp, Artificial
  CRISPR gRNA sequence
accacacagcaatgcaggat

SEQ ID NO: 261553 - DNA, 20 bp, Artificial
  CRISPR gRNA sequence
gtctaaataggaggtaacca

SEQ ID NO: 261554 - DNA, 20 bp, Artificial
  CRISPR gRNA sequence
ttattatagtaattcagtta

SEQ ID NO: 261555 - DNA, 20 bp, Artificial
  CRISPR gRNA sequence
gcctaaatcacatacctctg

SEQ ID NO: 261556 - DNA, 20 bp, Artificial
  CRISPR gRNA sequence
atacctctgaagaatctgct

SEQ ID NO: 261557 - DNA, 20 bp, Artificial
  CRISPR gRNA sequence
ctaagcacattagcagcatt

SEQ ID NO: 261558 - DNA, 20 bp, Artificial
  CRISPR gRNA sequence
cctggttagcaatccctgca

SEQ ID NO: 261559 - DNA, 20 bp, Artificial
  CRISPR gRNA sequence
ggtcataagagcatccacaa

SEQ ID NO: 261560 - DNA, 20 bp, Artificial
  CRISPR gRNA sequence
taagagcatccacaagggga

SEQ ID NO: 261561 - DNA, 20 bp, Artificial
  CRISPR gRNA sequence
cccccaccttgagaaatcct

SEQ ID NO: 261562 - DNA, 20 bp, Artificial
  CRISPR gRNA sequence
gaaatccttgggattagctt

SEQ ID NO: 261563 - DNA, 20 bp, Artificial
  CRISPR gRNA sequence
tttgaaaaaagagagggcaa

SEQ ID NO: 261564 - DNA, 20 bp, Artificial
  CRISPR gRNA sequence
taacatccctgactggaaac

SEQ ID NO: 261565 - DNA, 20 bp, Artificial
  CRISPR gRNA sequence
gtcccgcccataatgttggg

SEQ ID NO: 261566 - DNA, 20 bp, Artificial
  CRISPR gRNA sequence
gcattgttgaggactcaagc

SEQ ID NO: 261567 - DNA, 20 bp, Artificial
  CRISPR gRNA sequence
taacctcaggttcaccagta

SEQ ID NO: 261568 - DNA, 20 bp, Artificial
  CRISPR gRNA sequence
tccagcttcattccaaagat

SEQ ID NO: 261569 - DNA, 20 bp, Artificial
  CRISPR gRNA sequence
aaatgacttgaaaataaagt

SEQ ID NO: 261570 - DNA, 20 bp, Artificial
  CRISPR gRNA sequence
gtattctatcctttgcttag

SEQ ID NO: 261571 - DNA, 20 bp, Artificial
  CRISPR gRNA sequence
tcaccataacctcacacatt

SEQ ID NO: 261572 - DNA, 20 bp, Artificial
  CRISPR gRNA sequence
gaaccccagagcaagaccat

SEQ ID NO: 261573 - DNA, 20 bp, Artificial
  CRISPR gRNA sequence
tacctttctacattaatctt

SEQ ID NO: 261574 - DNA, 20 bp, Artificial
  CRISPR gRNA sequence
ctttcttcaacaaatattta

SEQ ID NO: 261575 - DNA, 20 bp, Artificial
  CRISPR gRNA sequence
gtgcctaatacagaggttag

SEQ ID NO: 261576 - DNA, 20 bp, Artificial
  CRISPR gRNA sequence
ctaatacagaggttagaagg

SEQ ID NO: 261577 - DNA, 20 bp, Artificial
  CRISPR gRNA sequence
aagacatgattctgccctca

SEQ ID NO: 261578 - DNA, 20 bp, Artificial
  CRISPR gRNA sequence
aagtccctctctttgccatt

SEQ ID NO: 261579 - DNA, 20 bp, Artificial
  CRISPR gRNA sequence
tttttttgttgttgttgaga

SEQ ID NO: 261580 - DNA, 20 bp, Artificial
  CRISPR gRNA sequence
tctcgctctgtcacccaggc

SEQ ID NO: 261581 - DNA, 20 bp, Artificial
  CRISPR gRNA sequence
ttttgtatttttagtagaga

SEQ ID NO: 261582 - DNA, 20 bp, Artificial
  CRISPR gRNA sequence
gccttggtctcccaaagtgc

SEQ ID NO: 261583 - DNA, 20 bp, Artificial
  CRISPR gRNA sequence
ccagaagcttcttcgaggag

SEQ ID NO: 261584 - DNA, 20 bp, Artificial
  CRISPR gRNA sequence
aaagacaagtagattacatg

SEQ ID NO: 261585 - DNA, 20 bp, Artificial
  CRISPR gRNA sequence
atcagaggccaaagtgaact

SEQ ID NO: 261586 - DNA, 20 bp, Artificial
  CRISPR gRNA sequence
gaggccaaagtgaactatga

SEQ ID NO: 261587 - DNA, 20 bp, Artificial
  CRISPR gRNA sequence
tgaactatgagtgagtaatt

SEQ ID NO: 261588 - DNA, 20 bp, Artificial
  CRISPR gRNA sequence
tccaagcctctaccaaatga

SEQ ID NO: 261589 - DNA, 20 bp, Artificial
  CRISPR gRNA sequence
tgcacttctcttctagtgtt

SEQ ID NO: 261590 - DNA, 20 bp, Artificial
  CRISPR gRNA sequence
caaccacctttctgtggggc

SEQ ID NO: 261591 - DNA, 20 bp, Artificial
  CRISPR gRNA sequence
taattatcaggctcaaagct

SEQ ID NO: 261592 - DNA, 20 bp, Artificial
  CRISPR gRNA sequence
tatcaggctcaaagctctga

SEQ ID NO: 261593 - DNA, 20 bp, Artificial
  CRISPR gRNA sequence
ttgtcttggtttttttggtt

SEQ ID NO: 261594 - DNA, 20 bp, Artificial
  CRISPR gRNA sequence
gggaaacaattgtgctttga

SEQ ID NO: 261595 - DNA, 20 bp, Artificial
  CRISPR gRNA sequence
tttagacaaccaagtctgac

SEQ ID NO: 261596 - DNA, 20 bp, Artificial
  CRISPR gRNA sequence
aaccacaacaaattttcttc

SEQ ID NO: 261597 - DNA, 20 bp, Artificial
  CRISPR gRNA sequence
cataagacgttaaaaaggag

SEQ ID NO: 261598 - DNA, 20 bp, Artificial
  CRISPR gRNA sequence
tccccacccatagtaaaagt

SEQ ID NO: 261599 - DNA, 20 bp, Artificial
  CRISPR gRNA sequence
aagtttgaatgtgagagctt

SEQ ID NO: 261600 - DNA, 20 bp, Artificial
  CRISPR gRNA sequence
ccttgctgtaaacgtccttg

SEQ ID NO: 261601 - DNA, 20 bp, Artificial
  CRISPR gRNA sequence
tgttaactagggcacggtag

SEQ ID NO: 261602 - DNA, 20 bp, Artificial
  CRISPR gRNA sequence
tccgtatacaaccagctcag

SEQ ID NO: 261603 - DNA, 20 bp, Artificial
  CRISPR gRNA sequence
gggagtcattggctgaagac

SEQ ID NO: 261604 - DNA, 20 bp, Artificial
  CRISPR gRNA sequence
caagttttggagaagtgaaa

SEQ ID NO: 261605 - DNA, 20 bp, Artificial
  CRISPR gRNA sequence
tgctgatttttctcttcaca

SEQ ID NO: 261606 - DNA, 20 bp, Artificial
  CRISPR gRNA sequence
agtccagcaaaatactctct

SEQ ID NO: 261607 - DNA, 20 bp, Artificial
  CRISPR gRNA sequence
gatctcagttgcacaattat

SEQ ID NO: 261608 - DNA, 20 bp, Artificial
  CRISPR gRNA sequence
acactgtcatccaactcata

SEQ ID NO: 261609 - DNA, 20 bp, Artificial
  CRISPR gRNA sequence
caggttagacttaaccttta

SEQ ID NO: 261610 - DNA, 20 bp, Artificial
  CRISPR gRNA sequence
ggacagttacactttgacca

SEQ ID NO: 261611 - DNA, 20 bp, Artificial
  CRISPR gRNA sequence
gaagctttgcactatttgat

SEQ ID NO: 261612 - DNA, 20 bp, Artificial
  CRISPR gRNA sequence
tttgagactgtttcccaggc

SEQ ID NO: 261613 - DNA, 20 bp, Artificial
  CRISPR gRNA sequence
tgtttcccaggctggagtgc

SEQ ID NO: 261614 - DNA, 20 bp, Artificial
  CRISPR gRNA sequence
ttcacagcaacctccgcgtc

SEQ ID NO: 261615 - DNA, 20 bp, Artificial
  CRISPR gRNA sequence
gcctaagcctcacaagtagc

SEQ ID NO: 261616 - DNA, 20 bp, Artificial
  CRISPR gRNA sequence
ttttgtatttttagtagaga

SEQ ID NO: 261617 - DNA, 20 bp, Artificial
  CRISPR gRNA sequence
gatttcaccatgttagcccg

SEQ ID NO: 261618 - DNA, 20 bp, Artificial
  CRISPR gRNA sequence
tgctaaaagttactagaaaa

SEQ ID NO: 261619 - DNA, 20 bp, Artificial
  CRISPR gRNA sequence
taaagaaaacatacaaagtt

SEQ ID NO: 261620 - DNA, 20 bp, Artificial
  CRISPR gRNA sequence
ttaccaaaaactcttcaaaa

SEQ ID NO: 261621 - DNA, 20 bp, Artificial
  CRISPR gRNA sequence
caaaaactcttcaaaagaga

SEQ ID NO: 261622 - DNA, 20 bp, Artificial
  CRISPR gRNA sequence
aattttaaatagttttcagt

SEQ ID NO: 261623 - DNA, 20 bp, Artificial
  CRISPR gRNA sequence
ataaatgttaaagattcttg

SEQ ID NO: 261624 - DNA, 20 bp, Artificial
  CRISPR gRNA sequence
tacgtcagaccataaaataa

SEQ ID NO: 261625 - DNA, 20 bp, Artificial
  CRISPR gRNA sequence
gctatgtacacttaatgttt

SEQ ID NO: 261626 - DNA, 20 bp, Artificial
  CRISPR gRNA sequence
ccaaaataagaaagaaaatt

SEQ ID NO: 261627 - DNA, 20 bp, Artificial
  CRISPR gRNA sequence
tttctaactctgagaacacg

SEQ ID NO: 261628 - DNA, 20 bp, Artificial
  CRISPR gRNA sequence
agtaacaaattctttctgtt

SEQ ID NO: 261629 - DNA, 20 bp, Artificial
  CRISPR gRNA sequence
tttccgaagttaatttaacc

SEQ ID NO: 261630 - DNA, 20 bp, Artificial
  CRISPR gRNA sequence
taatttaaccctggatttac

SEQ ID NO: 261631 - DNA, 20 bp, Artificial
  CRISPR gRNA sequence
acaaatcacaccatgttaga

SEQ ID NO: 261632 - DNA, 20 bp, Artificial
  CRISPR gRNA sequence
ataatcaacaacaccggcac

SEQ ID NO: 261633 - DNA, 20 bp, Artificial
  CRISPR gRNA sequence
tcatcgtcattgggaactta

SEQ ID NO: 261634 - DNA, 20 bp, Artificial
  CRISPR gRNA sequence
agcagcttctgtggtgactc

SEQ ID NO: 261635 - DNA, 20 bp, Artificial
  CRISPR gRNA sequence
actcattcaattcaggtaga

SEQ ID NO: 261636 - DNA, 20 bp, Artificial
  CRISPR gRNA sequence
gactgagctaagcccttcgc

SEQ ID NO: 261637 - DNA, 20 bp, Artificial
  CRISPR gRNA sequence
gttaaggaaactgaggtttg

SEQ ID NO: 261638 - DNA, 20 bp, Artificial
  CRISPR gRNA sequence
taagcctaagcttacctagt

SEQ ID NO: 261639 - DNA, 20 bp, Artificial
  CRISPR gRNA sequence
actttgggaggcagaggcag

SEQ ID NO: 261640 - DNA, 20 bp, Artificial
  CRISPR gRNA sequence
aagatactatattgtagtct

SEQ ID NO: 261641 - DNA, 20 bp, Artificial
  CRISPR gRNA sequence
taacattgtttacctgttac

SEQ ID NO: 261642 - DNA, 20 bp, Artificial
  CRISPR gRNA sequence
tacctgttacttgaattgaa

SEQ ID NO: 261643 - DNA, 20 bp, Artificial
  CRISPR gRNA sequence
tctttgtcctgacgatgggc

SEQ ID NO: 261644 - DNA, 20 bp, Artificial
  CRISPR gRNA sequence
agacgcacctgccaaggcct

SEQ ID NO: 261645 - DNA, 20 bp, Artificial
  CRISPR gRNA sequence
cctgactgcagcatttcaca

SEQ ID NO: 261646 - DNA, 20 bp, Artificial
  CRISPR gRNA sequence
tcactacatgatgggcttat

SEQ ID NO: 261647 - DNA, 20 bp, Artificial
  CRISPR gRNA sequence
atgggaattattctttattg

SEQ ID NO: 261648 - DNA, 20 bp, Artificial
  CRISPR gRNA sequence
atgctgcagtcaggatgcct

SEQ ID NO: 261649 - DNA, 20 bp, Artificial
  CRISPR gRNA sequence
atattttttgaggtcttcca

SEQ ID NO: 261650 - DNA, 20 bp, Artificial
  CRISPR gRNA sequence
ttttgaggtcttccaattgg

SEQ ID NO: 261651 - DNA, 20 bp, Artificial
  CRISPR gRNA sequence
tgaaatttgaacatttgaag

SEQ ID NO: 261652 - DNA, 20 bp, Artificial
  CRISPR gRNA sequence
caatgtgttattttgaaaat

SEQ ID NO: 261653 - DNA, 20 bp, Artificial
  CRISPR gRNA sequence
ggaaataaattttctaagct

SEQ ID NO: 261654 - DNA, 20 bp, Artificial
  CRISPR gRNA sequence
attattattttaaattgaga

SEQ ID NO: 261655 - DNA, 20 bp, Artificial
  CRISPR gRNA sequence
ccaataatttttaatttatg

SEQ ID NO: 261656 - DNA, 20 bp, Artificial
  CRISPR gRNA sequence
aatttaagaaagctgctgta

SEQ ID NO: 261657 - DNA, 20 bp, Artificial
  CRISPR gRNA sequence
acaggtccaattctcactag

SEQ ID NO: 261658 - DNA, 20 bp, Artificial
  CRISPR gRNA sequence
ccaattctcactaggtaagc

SEQ ID NO: 261659 - DNA, 20 bp, Artificial
  CRISPR gRNA sequence
attatttaaactctccaaac

SEQ ID NO: 261660 - DNA, 20 bp, Artificial
  CRISPR gRNA sequence
aaaatgaaataatccatgcg

SEQ ID NO: 261661 - DNA, 20 bp, Artificial
  CRISPR gRNA sequence
atgcgaagggcttagctcag

SEQ ID NO: 261662 - DNA, 20 bp, Artificial
  CRISPR gRNA sequence
tacaacaccaatattaataa

SEQ ID NO: 261663 - DNA, 20 bp, Artificial
  CRISPR gRNA sequence
aatcggccaaaatgtatttt

SEQ ID NO: 261664 - DNA, 20 bp, Artificial
  CRISPR gRNA sequence
gactgaggggtaggcacatt

SEQ ID NO: 261665 - DNA, 20 bp, Artificial
  CRISPR gRNA sequence
tctgactccagtgccggtgt

SEQ ID NO: 261666 - DNA, 20 bp, Artificial
  CRISPR gRNA sequence
atgctattccatctaacatg

SEQ ID NO: 261667 - DNA, 20 bp, Artificial
  CRISPR gRNA sequence
tctcagagttagaaaaaggc

SEQ ID NO: 261668 - DNA, 20 bp, Artificial
  CRISPR gRNA sequence
ggactgataggggtcaacag

SEQ ID NO: 261669 - DNA, 20 bp, Artificial
  CRISPR gRNA sequence
ggtacagtagttgcatatat

SEQ ID NO: 261670 - DNA, 20 bp, Artificial
  CRISPR gRNA sequence
tggcaatgagatctggtacc

SEQ ID NO: 261671 - DNA, 20 bp, Artificial
  CRISPR gRNA sequence
gtacactaaatacttttctg

SEQ ID NO: 261672 - DNA, 20 bp, Artificial
  CRISPR gRNA sequence
aacttattcactctcttttg

SEQ ID NO: 261673 - DNA, 20 bp, Artificial
  CRISPR gRNA sequence
ttggtaagactcaaaacttt

SEQ ID NO: 261674 - DNA, 20 bp, Artificial
  CRISPR gRNA sequence
agagttcacacacatagggc

SEQ ID NO: 261675 - DNA, 20 bp, Artificial
  CRISPR gRNA sequence
agaatgaccacataaaaaat

SEQ ID NO: 261676 - DNA, 20 bp, Artificial
  CRISPR gRNA sequence
cctgtaatcccagctacttg

SEQ ID NO: 261677 - DNA, 20 bp, Artificial
  CRISPR gRNA sequence
ttgtgaggcttaggcaggag

SEQ ID NO: 261678 - DNA, 20 bp, Artificial
  CRISPR gRNA sequence
gacgcggaggttgctgtgaa

SEQ ID NO: 261679 - DNA, 20 bp, Artificial
  CRISPR gRNA sequence
tgcattctaatcaaatagtg

SEQ ID NO: 261680 - DNA, 20 bp, Artificial
  CRISPR gRNA sequence
caaatagtgcaaagcttctt

SEQ ID NO: 261681 - DNA, 20 bp, Artificial
  CRISPR gRNA sequence
ttaatttaataatgtaactt

SEQ ID NO: 261682 - DNA, 20 bp, Artificial
  CRISPR gRNA sequence
tgtaacttatttgtttacag

SEQ ID NO: 261683 - DNA, 20 bp, Artificial
  CRISPR gRNA sequence
ttctataaaggttaagtcta

SEQ ID NO: 261684 - DNA, 20 bp, Artificial
  CRISPR gRNA sequence
tttatggctaagttaaagaa

SEQ ID NO: 261685 - DNA, 20 bp, Artificial
  CRISPR gRNA sequence
ttaacttagataagcccttt

SEQ ID NO: 261686 - DNA, 20 bp, Artificial
  CRISPR gRNA sequence
agccttaagagggaaatgct

SEQ ID NO: 261687 - DNA, 20 bp, Artificial
  CRISPR gRNA sequence
caaaatacttgacattggtc

SEQ ID NO: 261688 - DNA, 20 bp, Artificial
  CRISPR gRNA sequence
ggcaaaaaactgtcaaaatg

SEQ ID NO: 261689 - DNA, 20 bp, Artificial
  CRISPR gRNA sequence
atttctccagcgccttccct

SEQ ID NO: 261690 - DNA, 20 bp, Artificial
  CRISPR gRNA sequence
gttgtatacggaaagaagta

SEQ ID NO: 261691 - DNA, 20 bp, Artificial
  CRISPR gRNA sequence
agttaagtgttgctctgaga

SEQ ID NO: 261692 - DNA, 20 bp, Artificial
  CRISPR gRNA sequence
aagatgaatgtcaaaaaatc

SEQ ID NO: 261693 - DNA, 20 bp, Artificial
  CRISPR gRNA sequence
atgacttccaatatgctgtg

SEQ ID NO: 261694 - DNA, 20 bp, Artificial
  CRISPR gRNA sequence
tctgttaaaagaaattgact

SEQ ID NO: 261695 - DNA, 20 bp, Artificial
  CRISPR gRNA sequence
ggatatttcaaaagtatagg

SEQ ID NO: 261696 - DNA, 20 bp, Artificial
  CRISPR gRNA sequence
tcaaaagtataggcattgct

SEQ ID NO: 261697 - DNA, 20 bp, Artificial
  CRISPR gRNA sequence
agtataggcattgcttaagg

SEQ ID NO: 261698 - DNA, 20 bp, Artificial
  CRISPR gRNA sequence
accgtgccctagttaacaca

SEQ ID NO: 261699 - DNA, 20 bp, Artificial
  CRISPR gRNA sequence
ttaaggcaaccatccagcaa

SEQ ID NO: 261700 - DNA, 20 bp, Artificial
  CRISPR gRNA sequence
tggaatgagtcattgccaca

SEQ ID NO: 261701 - DNA, 20 bp, Artificial
  CRISPR gRNA sequence
gattagaaatagaaatgaat

SEQ ID NO: 261702 - DNA, 20 bp, Artificial
  CRISPR gRNA sequence
ttcaagggtggagaaatgcc

SEQ ID NO: 261703 - DNA, 20 bp, Artificial
  CRISPR gRNA sequence
gaaatgccatatgattacca

SEQ ID NO: 261704 - DNA, 20 bp, Artificial
  CRISPR gRNA sequence
catcccagaagaaaatttgt

SEQ ID NO: 261705 - DNA, 20 bp, Artificial
  CRISPR gRNA sequence
cggacactccttcaaagcac

SEQ ID NO: 261706 - DNA, 20 bp, Artificial
  CRISPR gRNA sequence
ctttctcatgttggttaaat

SEQ ID NO: 261707 - DNA, 20 bp, Artificial
  CRISPR gRNA sequence
atctggaaaaattacatctg

SEQ ID NO: 261708 - DNA, 20 bp, Artificial
  CRISPR gRNA sequence
agatatctgtgtctctttta

SEQ ID NO: 261709 - DNA, 20 bp, Artificial
  CRISPR gRNA sequence
tcttttacggtgatttattt

SEQ ID NO: 261710 - DNA, 20 bp, Artificial
  CRISPR gRNA sequence
aaaaaccaagacaattcact

SEQ ID NO: 261711 - DNA, 20 bp, Artificial
  CRISPR gRNA sequence
gaactactcagtcatttggt

SEQ ID NO: 261712 - DNA, 20 bp, Artificial
  CRISPR gRNA sequence
tttggtagaggcttggaaaa

SEQ ID NO: 261713 - DNA, 20 bp, Artificial
  CRISPR gRNA sequence
tttcaatgttaatttcaaag

SEQ ID NO: 261714 - DNA, 20 bp, Artificial
  CRISPR gRNA sequence
cgtgtcaccatgcaggttat

SEQ ID NO: 261715 - DNA, 20 bp, Artificial
  CRISPR gRNA sequence
accatgcaggttatatgtgc

SEQ ID NO: 261716 - DNA, 20 bp, Artificial
  CRISPR gRNA sequence
tgaaagatccacctcctcga

SEQ ID NO: 261717 - DNA, 20 bp, Artificial
  CRISPR gRNA sequence
tctcatattttaatctccat

SEQ ID NO: 261718 - DNA, 20 bp, Artificial
  CRISPR gRNA sequence
caggcagatcacctgaggtc

SEQ ID NO: 261719 - DNA, 20 bp, Artificial
  CRISPR gRNA sequence
tggggaggctgaggtaggag

SEQ ID NO: 261720 - DNA, 20 bp, Artificial
  CRISPR gRNA sequence
gaggcagaggttgcagtgag

SEQ ID NO: 261721 - DNA, 20 bp, Artificial
  CRISPR gRNA sequence
actccagcctgggtgacaga

SEQ ID NO: 261722 - DNA, 20 bp, Artificial
  CRISPR gRNA sequence
taggtagttaactgagttct

SEQ ID NO: 261723 - DNA, 20 bp, Artificial
  CRISPR gRNA sequence
tctctctgcttttacagccc

SEQ ID NO: 261724 - DNA, 20 bp, Artificial
  CRISPR gRNA sequence
ctatttgatgactaaaggac

SEQ ID NO: 261725 - DNA, 20 bp, Artificial
  CRISPR gRNA sequence
gagagggacttccttccctc

SEQ ID NO: 261726 - DNA, 20 bp, Artificial
  CRISPR gRNA sequence
gaagcataaaataaatactc

SEQ ID NO: 261727 - DNA, 20 bp, Artificial
  CRISPR gRNA sequence
ggaattagactggacagtag

SEQ ID NO: 261728 - DNA, 20 bp, Artificial
  CRISPR gRNA sequence
atgtgccaggtagtgttctg

SEQ ID NO: 261729 - DNA, 20 bp, Artificial
  CRISPR gRNA sequence
caagtcctatgaggtagtta

SEQ ID NO: 261730 - DNA, 20 bp, Artificial
  CRISPR gRNA sequence
tgaggtagttactatgattg

SEQ ID NO: 261731 - DNA, 20 bp, Artificial
  CRISPR gRNA sequence
agcacagagtgggtagagca

SEQ ID NO: 261732 - DNA, 20 bp, Artificial
  CRISPR gRNA sequence
tgttgtctcaggaaggaaaa

SEQ ID NO: 261733 - DNA, 20 bp, Artificial
  CRISPR gRNA sequence
taaagaaattaaaccaggaa

SEQ ID NO: 261734 - DNA, 20 bp, Artificial
  CRISPR gRNA sequence
gccactaagccaatgaggga

SEQ ID NO: 261735 - DNA, 20 bp, Artificial
  CRISPR gRNA sequence
taagagggaaaggagtgaat

SEQ ID NO: 261736 - DNA, 20 bp, Artificial
  CRISPR gRNA sequence
ggaaaggagtgaataatggc

SEQ ID NO: 261737 - DNA, 20 bp, Artificial
  CRISPR gRNA sequence
tgaaacgccacctgggactt

SEQ ID NO: 261738 - DNA, 20 bp, Artificial
  CRISPR gRNA sequence
gagaaggaagataagacttc

SEQ ID NO: 261739 - DNA, 20 bp, Artificial
  CRISPR gRNA sequence
tattttgtgcatgtaataat

SEQ ID NO: 261740 - DNA, 20 bp, Artificial
  CRISPR gRNA sequence
caaatggctgagtgacttaa

SEQ ID NO: 261741 - DNA, 20 bp, Artificial
  CRISPR gRNA sequence
tgtgtgtgtgtgtagcattg

SEQ ID NO: 261742 - DNA, 20 bp, Artificial
  CRISPR gRNA sequence
gaggaaaaaaagagggtggg

SEQ ID NO: 261743 - DNA, 20 bp, Artificial
  CRISPR gRNA sequence
ttttctcaaggagataggga

SEQ ID NO: 261744 - DNA, 20 bp, Artificial
  CRISPR gRNA sequence
agaatgaagctatggtagat

SEQ ID NO: 261745 - DNA, 20 bp, Artificial
  CRISPR gRNA sequence
tgcccatgtgtactttaaat

SEQ ID NO: 261746 - DNA, 20 bp, Artificial
  CRISPR gRNA sequence
ctcaacaatgcacactatgg

SEQ ID NO: 261747 - DNA, 20 bp, Artificial
  CRISPR gRNA sequence
cccaacattatgggcgggac

SEQ ID NO: 261748 - DNA, 20 bp, Artificial
  CRISPR gRNA sequence
gttaatcttagcatttccct

SEQ ID NO: 261749 - DNA, 20 bp, Artificial
  CRISPR gRNA sequence
gtgttttggaacaaggatat

SEQ ID NO: 261750 - DNA, 20 bp, Artificial
  CRISPR gRNA sequence
caaggatatggttgcttgac

SEQ ID NO: 261751 - DNA, 20 bp, Artificial
  CRISPR gRNA sequence
tcaaactcaaaagctaatcc

SEQ ID NO: 261752 - DNA, 20 bp, Artificial
  CRISPR gRNA sequence
aggatttctcaaggtggggg

SEQ ID NO: 261753 - DNA, 20 bp, Artificial
  CRISPR gRNA sequence
gtgacagaacttttctaggc

SEQ ID NO: 261754 - DNA, 20 bp, Artificial
  CRISPR gRNA sequence
gtttcttcatctgatacatg

SEQ ID NO: 261755 - DNA, 20 bp, Artificial
  CRISPR gRNA sequence
aggatatctcaggtctactt

SEQ ID NO: 261756 - DNA, 20 bp, Artificial
  CRISPR gRNA sequence
aggtctactttctggcttaa

SEQ ID NO: 261757 - DNA, 20 bp, Artificial
  CRISPR gRNA sequence
gccatctctgaaatcccttg

SEQ ID NO: 261758 - DNA, 20 bp, Artificial
  CRISPR gRNA sequence
caggatcctaaatgctgcta

SEQ ID NO: 261759 - DNA, 20 bp, Artificial
  CRISPR gRNA sequence
gcaatgctgcctttgctatc

SEQ ID NO: 261760 - DNA, 20 bp, Artificial
  CRISPR gRNA sequence
tatatgacaaggtgatcctg

SEQ ID NO: 261761 - DNA, 20 bp, Artificial
  CRISPR gRNA sequence
tgagcagattcttcagaggt

SEQ ID NO: 261762 - DNA, 20 bp, Artificial
  CRISPR gRNA sequence
tactgttgtcttcatcacag

SEQ ID NO: 261763 - DNA, 20 bp, Artificial
  CRISPR gRNA sequence
tatggctctcaaatttggtt

SEQ ID NO: 261764 - DNA, 20 bp, Artificial
  CRISPR gRNA sequence
gaggaggtctctttatacct

SEQ ID NO: 261765 - DNA, 20 bp, Artificial
  CRISPR gRNA sequence
acaggcaaccttttagaata

SEQ ID NO: 261766 - DNA, 20 bp, Artificial
  CRISPR gRNA sequence
caaccttttagaatagtgag

SEQ ID NO: 261767 - DNA, 20 bp, Artificial
  CRISPR gRNA sequence
tgctcttgctatgttgtccc

SEQ ID NO: 261768 - DNA, 20 bp, Artificial
  CRISPR gRNA sequence
cagacctgacctgtgaacgg

SEQ ID NO: 261769 - DNA, 20 bp, Artificial
  CRISPR gRNA sequence
gggattgggtcacactgcat

SEQ ID NO: 261770 - DNA, 20 bp, Artificial
  CRISPR gRNA sequence
tcacactgcatctgagttta

SEQ ID NO: 261771 - DNA, 20 bp, Artificial
  CRISPR gRNA sequence
gtttatgttgctttgggtta

SEQ ID NO: 261772 - DNA, 20 bp, Artificial
  CRISPR gRNA sequence
ggatgggttacagcacaggt

SEQ ID NO: 261773 - DNA, 20 bp, Artificial
  CRISPR gRNA sequence
aatgtacatttctatcccca

SEQ ID NO: 261774 - DNA, 20 bp, Artificial
  CRISPR gRNA sequence
acccagtgcgtgaactctgg

SEQ ID NO: 261775 - DNA, 20 bp, Artificial
  CRISPR gRNA sequence
tgtaaaactgagcaccaatg

SEQ ID NO: 261776 - DNA, 20 bp, Artificial
  CRISPR gRNA sequence
tcagtgctattgcatcagcc

SEQ ID NO: 261777 - DNA, 20 bp, Artificial
  CRISPR gRNA sequence
ttgctccaagccaagggcag

SEQ ID NO: 261778 - DNA, 20 bp, Artificial
  CRISPR gRNA sequence
tccaagccaagggcagtcaa

SEQ ID NO: 261779 - DNA, 20 bp, Artificial
  CRISPR gRNA sequence
gactggtattggccatcttc

SEQ ID NO: 261780 - DNA, 20 bp, Artificial
  CRISPR gRNA sequence
agaatcatcctgtctggaaa

SEQ ID NO: 261781 - DNA, 20 bp, Artificial
  CRISPR gRNA sequence
taaagggttcatgtaccacg

SEQ ID NO: 261782 - DNA, 20 bp, Artificial
  CRISPR gRNA sequence
cacggatggcttcggagagt

SEQ ID NO: 261783 - DNA, 20 bp, Artificial
  CRISPR gRNA sequence
tagctgattgtgtacctgcc

SEQ ID NO: 261784 - DNA, 20 bp, Artificial
  CRISPR gRNA sequence
gcagaagtcagaataccaaa

SEQ ID NO: 261785 - DNA, 20 bp, Artificial
  CRISPR gRNA sequence
atttcttctcagaaagtact

SEQ ID NO: 261786 - DNA, 20 bp, Artificial
  CRISPR gRNA sequence
cttctcagaaagtactcatt

SEQ ID NO: 261787 - DNA, 20 bp, Artificial
  CRISPR gRNA sequence
acacaaataaaggttaaagg

SEQ ID NO: 261788 - DNA, 20 bp, Artificial
  CRISPR gRNA sequence
aataaaggttaaaggtgggg

SEQ ID NO: 261789 - DNA, 20 bp, Artificial
  CRISPR gRNA sequence
ggtctcgccatgttgcccag

SEQ ID NO: 261790 - DNA, 20 bp, Artificial
  CRISPR gRNA sequence
gcctttagtaaatttattaa

SEQ ID NO: 261791 - DNA, 20 bp, Artificial
  CRISPR gRNA sequence
cttgttcaaactaaaacctc

SEQ ID NO: 261792 - DNA, 20 bp, Artificial
  CRISPR gRNA sequence
caaactaaaacctctttaga

SEQ ID NO: 261793 - DNA, 20 bp, Artificial
  CRISPR gRNA sequence
ctttctgtcaagaacagtta

SEQ ID NO: 261794 - DNA, 20 bp, Artificial
  CRISPR gRNA sequence
acacaatcttggccaaagct

SEQ ID NO: 261795 - DNA, 20 bp, Artificial
  CRISPR gRNA sequence
tggccaaagctggttgcttg

SEQ ID NO: 261796 - DNA, 20 bp, Artificial
  CRISPR gRNA sequence
ctgcttctcttgatggaagt

SEQ ID NO: 261797 - DNA, 20 bp, Artificial
  CRISPR gRNA sequence
tgcccaattttgtgtgtgcc

SEQ ID NO: 261798 - DNA, 20 bp, Artificial
  CRISPR gRNA sequence
gtatccacgggttatgcatc

SEQ ID NO: 261799 - DNA, 20 bp, Artificial
  CRISPR gRNA sequence
aggaccaacaattgcatgac

SEQ ID NO: 261800 - DNA, 20 bp, Artificial
  CRISPR gRNA sequence
aattgcatgacttgagcttc

SEQ ID NO: 261801 - DNA, 20 bp, Artificial
  CRISPR gRNA sequence
tccagaggaccactgtatat

SEQ ID NO: 261802 - DNA, 20 bp, Artificial
  CRISPR gRNA sequence
ccactgtatatgcatgttta

SEQ ID NO: 261803 - DNA, 20 bp, Artificial
  CRISPR gRNA sequence
aagccccctttttctgtgtg

SEQ ID NO: 261804 - DNA, 20 bp, Artificial
  CRISPR gRNA sequence
tcaaagcatggtaggtcatg

SEQ ID NO: 261805 - DNA, 20 bp, Artificial
  CRISPR gRNA sequence
gcatggtaggtcatgaatag

SEQ ID NO: 261806 - DNA, 20 bp, Artificial
  CRISPR gRNA sequence
gaaaggtgctacagtctggt

SEQ ID NO: 261807 - DNA, 20 bp, Artificial
  CRISPR gRNA sequence
ccccctttcttctcagggag

SEQ ID NO: 261808 - DNA, 20 bp, Artificial
  CRISPR gRNA sequence
tcagggagcacggtttgtct

SEQ ID NO: 261809 - DNA, 20 bp, Artificial
  CRISPR gRNA sequence
agggcaaaatggctgaaagt

SEQ ID NO: 261810 - DNA, 20 bp, Artificial
  CRISPR gRNA sequence
tggctgaaagtagaagcttt

SEQ ID NO: 261811 - DNA, 20 bp, Artificial
  CRISPR gRNA sequence
aagataattagaatcttaca

SEQ ID NO: 261812 - DNA, 20 bp, Artificial
  CRISPR gRNA sequence
atggaacctgataaagttct

SEQ ID NO: 261813 - DNA, 20 bp, Artificial
  CRISPR gRNA sequence
atcatgtattccagctctct

SEQ ID NO: 261814 - DNA, 20 bp, Artificial
  CRISPR gRNA sequence
tccagctctctaactgcttc

SEQ ID NO: 261815 - DNA, 20 bp, Artificial
  CRISPR gRNA sequence
actgcttctttagcttccca

SEQ ID NO: 261816 - DNA, 20 bp, Artificial
  CRISPR gRNA sequence
attcacaaaagccctgaagt

SEQ ID NO: 261817 - DNA, 20 bp, Artificial
  CRISPR gRNA sequence
ctagtgaagttcagactgaa

SEQ ID NO: 261818 - DNA, 20 bp, Artificial
  CRISPR gRNA sequence
ttgtgcatcagaaataattt

SEQ ID NO: 261819 - DNA, 20 bp, Artificial
  CRISPR gRNA sequence
aatcttcaaaattgtaagca

SEQ ID NO: 261820 - DNA, 20 bp, Artificial
  CRISPR gRNA sequence
cagtcttgctgaatgaacaa

SEQ ID NO: 261821 - DNA, 20 bp, Artificial
  CRISPR gRNA sequence
aaagttgtttttctgtccat

SEQ ID NO: 261822 - DNA, 20 bp, Artificial
  CRISPR gRNA sequence
ctcttccattatttgtgtga

SEQ ID NO: 261823 - DNA, 20 bp, Artificial
  CRISPR gRNA sequence
caagttcccttccagttgag

SEQ ID NO: 261824 - DNA, 20 bp, Artificial
  CRISPR gRNA sequence
catggcagaaggaaatgaac

SEQ ID NO: 261825 - DNA, 20 bp, Artificial
  CRISPR gRNA sequence
tagattagaagtcataagtt

SEQ ID NO: 261826 - DNA, 20 bp, Artificial
  CRISPR gRNA sequence
gcttaaatttcaaggatcac

SEQ ID NO: 261827 - DNA, 20 bp, Artificial
  CRISPR gRNA sequence
aactcatctacctctttgac

SEQ ID NO: 261828 - DNA, 20 bp, Artificial
  CRISPR gRNA sequence
atagatactaaattaagcca

SEQ ID NO: 261829 - DNA, 20 bp, Artificial
  CRISPR gRNA sequence
tgtgtttcccatattgcatt

SEQ ID NO: 261830 - DNA, 20 bp, Artificial
  CRISPR gRNA sequence
attactaaatatggtaattg

SEQ ID NO: 261831 - DNA, 20 bp, Artificial
  CRISPR gRNA sequence
taataggtgtaaacggcaag

SEQ ID NO: 261832 - DNA, 20 bp, Artificial
  CRISPR gRNA sequence
agagttgtttttttttgtaa

SEQ ID NO: 261833 - DNA, 20 bp, Artificial
  CRISPR gRNA sequence
ctttcaattttcctgaagtc

SEQ ID NO: 261834 - DNA, 20 bp, Artificial
  CRISPR gRNA sequence
ttcctgaagtcggctgtttc

SEQ ID NO: 261835 - DNA, 20 bp, Artificial
  CRISPR gRNA sequence
gtcggctgtttcacaagatt

SEQ ID NO: 261836 - DNA, 20 bp, Artificial
  CRISPR gRNA sequence
aagcaggagctgtgagggaa

SEQ ID NO: 261837 - DNA, 20 bp, Artificial
  CRISPR gRNA sequence
gagggaaagaggtttgaggt

SEQ ID NO: 261838 - DNA, 20 bp, Artificial
  CRISPR gRNA sequence
ttcctgtctccacaccttta

SEQ ID NO: 261839 - DNA, 20 bp, Artificial
  CRISPR gRNA sequence
tagctggtttagctgctagg

SEQ ID NO: 261840 - DNA, 20 bp, Artificial
  CRISPR gRNA sequence
aaagaaaatggatgggttga

SEQ ID NO: 261841 - DNA, 20 bp, Artificial
  CRISPR gRNA sequence
acaatgtttcttttaaccta

SEQ ID NO: 261842 - DNA, 20 bp, Artificial
  CRISPR gRNA sequence
aggacgagggagctacatat

SEQ ID NO: 261843 - DNA, 20 bp, Artificial
  CRISPR gRNA sequence
ccttacattatttgaagtac

SEQ ID NO: 261844 - DNA, 20 bp, Artificial
  CRISPR gRNA sequence
aagccaaatgtcatctgata

SEQ ID NO: 261845 - DNA, 20 bp, Artificial
  CRISPR gRNA sequence
gatattctgattatcagcta

SEQ ID NO: 261846 - DNA, 20 bp, Artificial
  CRISPR gRNA sequence
tatcagctactttgatttct

SEQ ID NO: 261847 - DNA, 20 bp, Artificial
  CRISPR gRNA sequence
aataagagaaatcagaatta

SEQ ID NO: 261848 - DNA, 20 bp, Artificial
  CRISPR gRNA sequence
ttactgtcttgcaaagcata

SEQ ID NO: 261849 - DNA, 20 bp, Artificial
  CRISPR gRNA sequence
gagattttgaggtcctgtga

SEQ ID NO: 261850 - DNA, 20 bp, Artificial
  CRISPR gRNA sequence
cctgtgagatagtttcctat

SEQ ID NO: 261851 - DNA, 20 bp, Artificial
  CRISPR gRNA sequence
gaggatataaatattgagaa

SEQ ID NO: 261852 - DNA, 20 bp, Artificial
  CRISPR gRNA sequence
ttttatcagccaaccttgaa

SEQ ID NO: 261853 - DNA, 20 bp, Artificial
  CRISPR gRNA sequence
catgttaacacatagtaagc

SEQ ID NO: 261854 - DNA, 20 bp, Artificial
  CRISPR gRNA sequence
aacgatttcaagcacagtat

SEQ ID NO: 261855 - DNA, 20 bp, Artificial
  CRISPR gRNA sequence
taaacatgagcaataaattg

SEQ ID NO: 261856 - DNA, 20 bp, Artificial
  CRISPR gRNA sequence
aaatggccttatcgaaaaca

SEQ ID NO: 261857 - DNA, 20 bp, Artificial
  CRISPR gRNA sequence
aagctctctaatggagtgaa

SEQ ID NO: 261858 - DNA, 20 bp, Artificial
  CRISPR gRNA sequence
gtcatctcctgagatcctta

SEQ ID NO: 261859 - DNA, 20 bp, Artificial
  CRISPR gRNA sequence
ctggtttccctgttgccccc

SEQ ID NO: 261860 - DNA, 20 bp, Artificial
  CRISPR gRNA sequence
ttgtgcagatcactgtgtca

SEQ ID NO: 261861 - DNA, 20 bp, Artificial
  CRISPR gRNA sequence
aaccactggactctagatgc

SEQ ID NO: 261862 - DNA, 20 bp, Artificial
  CRISPR gRNA sequence
agtcaaactggggagccatc

SEQ ID NO: 261863 - DNA, 20 bp, Artificial
  CRISPR gRNA sequence
aaaaggaggagagatgcagg

SEQ ID NO: 261864 - DNA, 20 bp, Artificial
  CRISPR gRNA sequence
caaaaacaaaaaaacaaatt

SEQ ID NO: 261865 - DNA, 20 bp, Artificial
  CRISPR gRNA sequence
gtattaagacaggtcgaact

SEQ ID NO: 261866 - DNA, 20 bp, Artificial
  CRISPR gRNA sequence
gtcgaactttttgattcttt

SEQ ID NO: 261867 - DNA, 20 bp, Artificial
  CRISPR gRNA sequence
ttctttgcatgtttattttt

SEQ ID NO: 261868 - DNA, 20 bp, Artificial
  CRISPR gRNA sequence
gtgaagttaaagttgttgac

SEQ ID NO: 261869 - DNA, 20 bp, Artificial
  CRISPR gRNA sequence
ttgttgacacaggtttccaa

SEQ ID NO: 261870 - DNA, 20 bp, Artificial
  CRISPR gRNA sequence
attgaagcatgtgaaacaag

SEQ ID NO: 261871 - DNA, 20 bp, Artificial
  CRISPR gRNA sequence
tcacagtctgttcttgggat

SEQ ID NO: 261872 - DNA, 20 bp, Artificial
  CRISPR gRNA sequence
ggcttaaatggtctaattag

SEQ ID NO: 261873 - DNA, 20 bp, Artificial
  CRISPR gRNA sequence
aatggtctaattaggagggc

SEQ ID NO: 261874 - DNA, 20 bp, Artificial
  CRISPR gRNA sequence
aggttggaaaaacctgtgga

SEQ ID NO: 261875 - DNA, 20 bp, Artificial
  CRISPR gRNA sequence
ggccgatttgaggataagaa

SEQ ID NO: 261876 - DNA, 20 bp, Artificial
  CRISPR gRNA sequence
ggatgcctgggtcctatacc

SEQ ID NO: 261877 - DNA, 20 bp, Artificial
  CRISPR gRNA sequence
ctgggtcctatacctagaga

SEQ ID NO: 261878 - DNA, 20 bp, Artificial
  CRISPR gRNA sequence
ttaattggccttggaaaacc

SEQ ID NO: 261879 - DNA, 20 bp, Artificial
  CRISPR gRNA sequence
gccttggaaaaccaaaggct

SEQ ID NO: 261880 - DNA, 20 bp, Artificial
  CRISPR gRNA sequence
aaaggcttttagatttttcc

SEQ ID NO: 261881 - DNA, 20 bp, Artificial
  CRISPR gRNA sequence
ggtgaattccactaggccat

SEQ ID NO: 261882 - DNA, 20 bp, Artificial
  CRISPR gRNA sequence
caggcagatcatctgaggtc

SEQ ID NO: 261883 - DNA, 20 bp, Artificial
  CRISPR gRNA sequence
ctactcgggaggctgaggca

SEQ ID NO: 261884 - DNA, 20 bp, Artificial
  CRISPR gRNA sequence
tcgggaggctgaggcaggag

SEQ ID NO: 261885 - DNA, 20 bp, Artificial
  CRISPR gRNA sequence
gaggctgaggcaggaggatt

SEQ ID NO: 261886 - DNA, 20 bp, Artificial
  CRISPR gRNA sequence
tggctaataagcacatgaaa

SEQ ID NO: 261887 - DNA, 20 bp, Artificial
  CRISPR gRNA sequence
gtgagaatgtacaatggtgc

SEQ ID NO: 261888 - DNA, 20 bp, Artificial
  CRISPR gRNA sequence
aatggtgcagttgctttggc

SEQ ID NO: 261889 - DNA, 20 bp, Artificial
  CRISPR gRNA sequence
cagttgctttggcaacagtt

SEQ ID NO: 261890 - DNA, 20 bp, Artificial
  CRISPR gRNA sequence
gacacaaaaagccacatatc

SEQ ID NO: 261891 - DNA, 20 bp, Artificial
  CRISPR gRNA sequence
tcatagggccaaagtagatc

SEQ ID NO: 261892 - DNA, 20 bp, Artificial
  CRISPR gRNA sequence
caaagtagatcagtggtttc

SEQ ID NO: 261893 - DNA, 20 bp, Artificial
  CRISPR gRNA sequence
aatgttctggaatcagatag

SEQ ID NO: 261894 - DNA, 20 bp, Artificial
  CRISPR gRNA sequence
agttcttgatataaagccag

SEQ ID NO: 261895 - DNA, 20 bp, Artificial
  CRISPR gRNA sequence
ccatcatccccagccagcat

SEQ ID NO: 261896 - DNA, 20 bp, Artificial
  CRISPR gRNA sequence
taaatttcatttaaaaatga

SEQ ID NO: 261897 - DNA, 20 bp, Artificial
  CRISPR gRNA sequence
ttcagtgtgggtatacggga

SEQ ID NO: 261898 - DNA, 20 bp, Artificial
  CRISPR gRNA sequence
accccaaaacaagagcaaaa

SEQ ID NO: 261899 - DNA, 20 bp, Artificial
  CRISPR gRNA sequence
aaacaagagcaaaaaaatgc

SEQ ID NO: 261900 - DNA, 20 bp, Artificial
  CRISPR gRNA sequence
aatttgaatcaaagacacaa

SEQ ID NO: 261901 - DNA, 20 bp, Artificial
  CRISPR gRNA sequence
atcaaagacacaaagtggtt

SEQ ID NO: 261902 - DNA, 20 bp, Artificial
  CRISPR gRNA sequence
ggaaggtgtcttggttgcaa

SEQ ID NO: 261903 - DNA, 20 bp, Artificial
  CRISPR gRNA sequence
tcttggttgcaaagttgatt

SEQ ID NO: 261904 - DNA, 20 bp, Artificial
  CRISPR gRNA sequence
aaagttgattcccagtttct

SEQ ID NO: 261905 - DNA, 20 bp, Artificial
  CRISPR gRNA sequence
ctcaggtggtcatagccaac

SEQ ID NO: 261906 - DNA, 20 bp, Artificial
  CRISPR gRNA sequence
tagccaacttgggttttagt

SEQ ID NO: 261907 - DNA, 20 bp, Artificial
  CRISPR gRNA sequence
tagttctggctttgctcacc

SEQ ID NO: 261908 - DNA, 20 bp, Artificial
  CRISPR gRNA sequence
gtgacttcagacaaaccagc

SEQ ID NO: 261909 - DNA, 20 bp, Artificial
  CRISPR gRNA sequence
ttcacttatggagttgataa

SEQ ID NO: 261910 - DNA, 20 bp, Artificial
  CRISPR gRNA sequence
tgataaactagtttcaggtt

SEQ ID NO: 261911 - DNA, 20 bp, Artificial
  CRISPR gRNA sequence
agtttcaggttctttgcttt

SEQ ID NO: 261912 - DNA, 20 bp, Artificial
  CRISPR gRNA sequence
aaagattgaactaaatgctc

SEQ ID NO: 261913 - DNA, 20 bp, Artificial
  CRISPR gRNA sequence
atgggcaataaacaaagtaa

SEQ ID NO: 261914 - DNA, 20 bp, Artificial
  CRISPR gRNA sequence
tgtaggttgggcatggtggc

SEQ ID NO: 261915 - DNA, 20 bp, Artificial
  CRISPR gRNA sequence
tggtcagatcacttgaggcc

SEQ ID NO: 261916 - DNA, 20 bp, Artificial
  CRISPR gRNA sequence
ttaagagactgaggcaggag

SEQ ID NO: 261917 - DNA, 20 bp, Artificial
  CRISPR gRNA sequence
tgggtggaggttgcagtgag

SEQ ID NO: 261918 - DNA, 20 bp, Artificial
  CRISPR gRNA sequence
agtcaggaaattggcccaat

SEQ ID NO: 261919 - DNA, 20 bp, Artificial
  CRISPR gRNA sequence
taatattaatgtctcaggaa

SEQ ID NO: 261920 - DNA, 20 bp, Artificial
  CRISPR gRNA sequence
cttatattcttgttctaagc

SEQ ID NO: 261921 - DNA, 20 bp, Artificial
  CRISPR gRNA sequence
atttttttttcccccaggaa

SEQ ID NO: 261922 - DNA, 20 bp, Artificial
  CRISPR gRNA sequence
gattttggtgaagcagtcgc

SEQ ID NO: 261923 - DNA, 20 bp, Artificial
  CRISPR gRNA sequence
tgtatatgggaattactccc

SEQ ID NO: 261924 - DNA, 20 bp, Artificial
  CRISPR gRNA sequence
gggaattactcccagcagct

SEQ ID NO: 261925 - DNA, 20 bp, Artificial
  CRISPR gRNA sequence
ccagtgtaccaccctaaagt

SEQ ID NO: 261926 - DNA, 20 bp, Artificial
  CRISPR gRNA sequence
ggtggggttgaataaggcct

SEQ ID NO: 261927 - DNA, 20 bp, Artificial
  CRISPR gRNA sequence
ttgatactaacaaagacaaa

SEQ ID NO: 261928 - DNA, 20 bp, Artificial
  CRISPR gRNA sequence
aatttttccctttactgtag

SEQ ID NO: 261929 - DNA, 20 bp, Artificial
  CRISPR gRNA sequence
ctacagggcccgccaccacg

SEQ ID NO: 261930 - DNA, 20 bp, Artificial
  CRISPR gRNA sequence
ttttttgtatttttagtaga

SEQ ID NO: 261931 - DNA, 20 bp, Artificial
  CRISPR gRNA sequence
caccttgttagccaggatgg

SEQ ID NO: 261932 - DNA, 20 bp, Artificial
  CRISPR gRNA sequence
cgtgttggcctcccaaagtg

SEQ ID NO: 261933 - DNA, 20 bp, Artificial
  CRISPR gRNA sequence
ttttgtacttttagtagaga

SEQ ID NO: 261934 - DNA, 20 bp, Artificial
  CRISPR gRNA sequence
cacctgggcctcccaaagtg

SEQ ID NO: 261935 - DNA, 20 bp, Artificial
  CRISPR gRNA sequence
ctaaatgttagggagaaaaa

SEQ ID NO: 261936 - DNA, 20 bp, Artificial
  CRISPR gRNA sequence
acagtattggtagcaacaag

SEQ ID NO: 261937 - DNA, 20 bp, Artificial
  CRISPR gRNA sequence
tattggtagcaacaagtaaa

SEQ ID NO: 261938 - DNA, 20 bp, Artificial
  CRISPR gRNA sequence
ggtatactttgtggatatat

SEQ ID NO: 261939 - DNA, 20 bp, Artificial
  CRISPR gRNA sequence
gataataagaaacacatatg

SEQ ID NO: 261940 - DNA, 20 bp, Artificial
  CRISPR gRNA sequence
atcctagcataatgccaatg

SEQ ID NO: 261941 - DNA, 20 bp, Artificial
  CRISPR gRNA sequence
aagaattgttaatgtggcag

SEQ ID NO: 261942 - DNA, 20 bp, Artificial
  CRISPR gRNA sequence
agacaattaatgtgtgaata

SEQ ID NO: 261943 - DNA, 20 bp, Artificial
  CRISPR gRNA sequence
attttgtttgctgagtccta

SEQ ID NO: 261944 - DNA, 20 bp, Artificial
  CRISPR gRNA sequence
aaggttaaaaaattatgcta

SEQ ID NO: 261945 - DNA, 20 bp, Artificial
  CRISPR gRNA sequence
tctgtatattataaatctga

SEQ ID NO: 261946 - DNA, 20 bp, Artificial
  CRISPR gRNA sequence
accaatgcctagttccagcc

SEQ ID NO: 261947 - DNA, 20 bp, Artificial
  CRISPR gRNA sequence
ggatggaaaatcaatggact

SEQ ID NO: 261948 - DNA, 20 bp, Artificial
  CRISPR gRNA sequence
aatggactagaggatttttg

SEQ ID NO: 261949 - DNA, 20 bp, Artificial
  CRISPR gRNA sequence
ataggttccttctcatcccc

SEQ ID NO: 261950 - DNA, 20 bp, Artificial
  CRISPR gRNA sequence
ttttgattcctaaagataca

SEQ ID NO: 261951 - DNA, 20 bp, Artificial
  CRISPR gRNA sequence
attcctaaagatacaaagtg

SEQ ID NO: 261952 - DNA, 20 bp, Artificial
  CRISPR gRNA sequence
gttggaactagaaatttatc

SEQ ID NO: 261953 - DNA, 20 bp, Artificial
  CRISPR gRNA sequence
ttctgactgccatattaggc

SEQ ID NO: 261954 - DNA, 20 bp, Artificial
  CRISPR gRNA sequence
tattaggctgatgattttct

SEQ ID NO: 261955 - DNA, 20 bp, Artificial
  CRISPR gRNA sequence
tatttaacttattccaagga

SEQ ID NO: 261956 - DNA, 20 bp, Artificial
  CRISPR gRNA sequence
tccaaggatgcagtttaggg

SEQ ID NO: 261957 - DNA, 20 bp, Artificial
  CRISPR gRNA sequence
aggttaaggccattggaagt

SEQ ID NO: 261958 - DNA, 20 bp, Artificial
  CRISPR gRNA sequence
ccagtgtaccatcctaacgt

SEQ ID NO: 261959 - DNA, 20 bp, Artificial
  CRISPR gRNA sequence
ctattcactctaagctggtg

SEQ ID NO: 261960 - DNA, 20 bp, Artificial
  CRISPR gRNA sequence
gtatcatttaatccactcta

SEQ ID NO: 261961 - DNA, 20 bp, Artificial
  CRISPR gRNA sequence
ctggtggtggttggtggagt

SEQ ID NO: 261962 - DNA, 20 bp, Artificial
  CRISPR gRNA sequence
ttggtggagtcctggcttgc

SEQ ID NO: 261963 - DNA, 20 bp, Artificial
  CRISPR gRNA sequence
tttctgggtaagagaagcag

SEQ ID NO: 261964 - DNA, 20 bp, Artificial
  CRISPR gRNA sequence
acattcaagaattttgccta

SEQ ID NO: 261965 - DNA, 20 bp, Artificial
  CRISPR gRNA sequence
ttttgcctatgtggtttatt

SEQ ID NO: 261966 - DNA, 20 bp, Artificial
  CRISPR gRNA sequence
attttctgtttaatatagga

SEQ ID NO: 261967 - DNA, 20 bp, Artificial
  CRISPR gRNA sequence
ggatgatgattttcttttcc

SEQ ID NO: 261968 - DNA, 20 bp, Artificial
  CRISPR gRNA sequence
catgcttgagtaggttctct

SEQ ID NO: 261969 - DNA, 20 bp, Artificial
  CRISPR gRNA sequence
gagataaaaatctgatatga

SEQ ID NO: 261970 - DNA, 20 bp, Artificial
  CRISPR gRNA sequence
taaatgggtaaattagggtg

SEQ ID NO: 261971 - DNA, 20 bp, Artificial
  CRISPR gRNA sequence
aatataattatgacacataa

SEQ ID NO: 261972 - DNA, 20 bp, Artificial
  CRISPR gRNA sequence
aactgaagccaatggacaat

SEQ ID NO: 261973 - DNA, 20 bp, Artificial
  CRISPR gRNA sequence
aaacctagcaaagaaactag

SEQ ID NO: 261974 - DNA, 20 bp, Artificial
  CRISPR gRNA sequence
attgaagtactaacttttgc

SEQ ID NO: 261975 - DNA, 20 bp, Artificial
  CRISPR gRNA sequence
ctcaacattgaatttttggc

SEQ ID NO: 261976 - DNA, 20 bp, Artificial
  CRISPR gRNA sequence
catttgatattaagtacatt

SEQ ID NO: 261977 - DNA, 20 bp, Artificial
  CRISPR gRNA sequence
aagtacatttggtgcttaat

SEQ ID NO: 261978 - DNA, 20 bp, Artificial
  CRISPR gRNA sequence
ttggtgcttaatgaatgctt

SEQ ID NO: 261979 - DNA, 20 bp, Artificial
  CRISPR gRNA sequence
aacctccagagaggtcaaat

SEQ ID NO: 261980 - DNA, 20 bp, Artificial
  CRISPR gRNA sequence
tacctaattcatagatgggt

SEQ ID NO: 261981 - DNA, 20 bp, Artificial
  CRISPR gRNA sequence
agccatatcatatgaagtca

SEQ ID NO: 261982 - DNA, 20 bp, Artificial
  CRISPR gRNA sequence
atgaagtcattctgtttact

SEQ ID NO: 261983 - DNA, 20 bp, Artificial
  CRISPR gRNA sequence
atgccttcctattatccagt

SEQ ID NO: 261984 - DNA, 20 bp, Artificial
  CRISPR gRNA sequence
gactcttcttggcctattgc

SEQ ID NO: 261985 - DNA, 20 bp, Artificial
  CRISPR gRNA sequence
tggacatttgtcaggctgcc

SEQ ID NO: 261986 - DNA, 20 bp, Artificial
  CRISPR gRNA sequence
cgcagggtaggaaacaaagt

SEQ ID NO: 261987 - DNA, 20 bp, Artificial
  CRISPR gRNA sequence
ggtatcatcttaagaatttg

SEQ ID NO: 261988 - DNA, 20 bp, Artificial
  CRISPR gRNA sequence
aagttgcccaaccctgaagg

SEQ ID NO: 261989 - DNA, 20 bp, Artificial
  CRISPR gRNA sequence
accttctaactttgatcctc

SEQ ID NO: 261990 - DNA, 20 bp, Artificial
  CRISPR gRNA sequence
ctggtgtttgctgataattt

SEQ ID NO: 261991 - DNA, 20 bp, Artificial
  CRISPR gRNA sequence
gagtttttagaattcttagt

SEQ ID NO: 261992 - DNA, 20 bp, Artificial
  CRISPR gRNA sequence
tttcttcttaatctctggcc

SEQ ID NO: 261993 - DNA, 20 bp, Artificial
  CRISPR gRNA sequence
attggcttttatgcctacca

SEQ ID NO: 261994 - DNA, 20 bp, Artificial
  CRISPR gRNA sequence
aatttactagctctgcagaa

SEQ ID NO: 261995 - DNA, 20 bp, Artificial
  CRISPR gRNA sequence
gagtcacccaaagggacaaa

SEQ ID NO: 261996 - DNA, 20 bp, Artificial
  CRISPR gRNA sequence
tcagacacatcatagacaca

SEQ ID NO: 261997 - DNA, 20 bp, Artificial
  CRISPR gRNA sequence
ggcagtactactaattccta

SEQ ID NO: 261998 - DNA, 20 bp, Artificial
  CRISPR gRNA sequence
ctaattcctagtgagattca

SEQ ID NO: 261999 - DNA, 20 bp, Artificial
  CRISPR gRNA sequence
tcctagtgagattcatcttg

SEQ ID NO: 262000 - DNA, 20 bp, Artificial
  CRISPR gRNA sequence
ttgttttaaaaaaattttat

SEQ ID NO: 262001 - DNA, 20 bp, Artificial
  CRISPR gRNA sequence
cttaccaaaagagtataaat

SEQ ID NO: 262002 - DNA, 20 bp, Artificial
  CRISPR gRNA sequence
tctaggccattatggatccc

SEQ ID NO: 262003 - DNA, 20 bp, Artificial
  CRISPR gRNA sequence
attatggatccctggagttt

SEQ ID NO: 262004 - DNA, 20 bp, Artificial
  CRISPR gRNA sequence
cagcgtgccttgatgtaagt

SEQ ID NO: 262005 - DNA, 20 bp, Artificial
  CRISPR gRNA sequence
tgtaggcagttctgggttga

SEQ ID NO: 262006 - DNA, 20 bp, Artificial
  CRISPR gRNA sequence
tgagtgggtttctaggctga

SEQ ID NO: 262007 - DNA, 20 bp, Artificial
  CRISPR gRNA sequence
agcgggtttctgggagcagc

SEQ ID NO: 262008 - DNA, 20 bp, Artificial
  CRISPR gRNA sequence
gcagctgtgctggtaaagct

SEQ ID NO: 262009 - DNA, 20 bp, Artificial
  CRISPR gRNA sequence
atagtgtgtgtacaggtagt

SEQ ID NO: 262010 - DNA, 20 bp, Artificial
  CRISPR gRNA sequence
tctgctttttataataatcc

SEQ ID NO: 262011 - DNA, 20 bp, Artificial
  CRISPR gRNA sequence
tcttgaagaccacgtactta

SEQ ID NO: 262012 - DNA, 20 bp, Artificial
  CRISPR gRNA sequence
tgggtgctgtaggttctgcg

SEQ ID NO: 262013 - DNA, 20 bp, Artificial
  CRISPR gRNA sequence
ctgtcattttcatcccactg

SEQ ID NO: 262014 - DNA, 20 bp, Artificial
  CRISPR gRNA sequence
tgctgtggcctctctaccag

SEQ ID NO: 262015 - DNA, 20 bp, Artificial
  CRISPR gRNA sequence
ggcctctctaccagctatga

SEQ ID NO: 262016 - DNA, 20 bp, Artificial
  CRISPR gRNA sequence
ggaggcagaggctgacactt

SEQ ID NO: 262017 - DNA, 20 bp, Artificial
  CRISPR gRNA sequence
agggttggagtaagtactaa

SEQ ID NO: 262018 - DNA, 20 bp, Artificial
  CRISPR gRNA sequence
aaaatgcttcccaggttatc

SEQ ID NO: 262019 - DNA, 20 bp, Artificial
  CRISPR gRNA sequence
caattcttcattgcattgta

SEQ ID NO: 262020 - DNA, 20 bp, Artificial
  CRISPR gRNA sequence
ctccccgttgtgatgatcca

SEQ ID NO: 262021 - DNA, 20 bp, Artificial
  CRISPR gRNA sequence
tcactaaatgtctcctggga

SEQ ID NO: 262022 - DNA, 20 bp, Artificial
  CRISPR gRNA sequence
tctcctgggacagggattaa

SEQ ID NO: 262023 - DNA, 20 bp, Artificial
  CRISPR gRNA sequence
aacagcatttgggggaaatc

SEQ ID NO: 262024 - DNA, 20 bp, Artificial
  CRISPR gRNA sequence
tgagttttattttagacatg

SEQ ID NO: 262025 - DNA, 20 bp, Artificial
  CRISPR gRNA sequence
tttagacatgttgagtttag

SEQ ID NO: 262026 - DNA, 20 bp, Artificial
  CRISPR gRNA sequence
tgttgagtttagagtggctt

SEQ ID NO: 262027 - DNA, 20 bp, Artificial
  CRISPR gRNA sequence
aattgaagctgtgaatgtgg

SEQ ID NO: 262028 - DNA, 20 bp, Artificial
  CRISPR gRNA sequence
taacggctggttagagaagg

SEQ ID NO: 262029 - DNA, 20 bp, Artificial
  CRISPR gRNA sequence
gaggacttaaaacatgttag

SEQ ID NO: 262030 - DNA, 20 bp, Artificial
  CRISPR gRNA sequence
gtgtttagtaacatggaagt

SEQ ID NO: 262031 - DNA, 20 bp, Artificial
  CRISPR gRNA sequence
aattctgaatccagaaatct

SEQ ID NO: 262032 - DNA, 20 bp, Artificial
  CRISPR gRNA sequence
aatccagaaatctgatggct

SEQ ID NO: 262033 - DNA, 20 bp, Artificial
  CRISPR gRNA sequence
tctgatggctttctgttttt

SEQ ID NO: 262034 - DNA, 20 bp, Artificial
  CRISPR gRNA sequence
aatgtagaattttactatca

SEQ ID NO: 262035 - DNA, 20 bp, Artificial
  CRISPR gRNA sequence
acccttagtcaaaaattttg

SEQ ID NO: 262036 - DNA, 20 bp, Artificial
  CRISPR gRNA sequence
gtctagaactgtaaattgcc

SEQ ID NO: 262037 - DNA, 20 bp, Artificial
  CRISPR gRNA sequence
tggactccacctttacaaat

SEQ ID NO: 262038 - DNA, 20 bp, Artificial
  CRISPR gRNA sequence
tcttcggttaattatggaaa

SEQ ID NO: 262039 - DNA, 20 bp, Artificial
  CRISPR gRNA sequence
gtaagaagatcacaatgtgg

SEQ ID NO: 262040 - DNA, 20 bp, Artificial
  CRISPR gRNA sequence
atttctctaaaatactttct

SEQ ID NO: 262041 - DNA, 20 bp, Artificial
  CRISPR gRNA sequence
tgtgaagagtcagtagttgg

SEQ ID NO: 262042 - DNA, 20 bp, Artificial
  CRISPR gRNA sequence
ccaaggtgctcaaaaaaggt

SEQ ID NO: 262043 - DNA, 20 bp, Artificial
  CRISPR gRNA sequence
gagactctgaaatgaagtaa

SEQ ID NO: 262044 - DNA, 20 bp, Artificial
  CRISPR gRNA sequence
agggtagaaaacaaaaaggg

SEQ ID NO: 262045 - DNA, 20 bp, Artificial
  CRISPR gRNA sequence
atcattccttttggttaaat

SEQ ID NO: 262046 - DNA, 20 bp, Artificial
  CRISPR gRNA sequence
gccacgtagttcctatttaa

SEQ ID NO: 262047 - DNA, 20 bp, Artificial
  CRISPR gRNA sequence
cctatttaatgctgttttcc

SEQ ID NO: 262048 - DNA, 20 bp, Artificial
  CRISPR gRNA sequence
tttagtcattttgaccaaat

SEQ ID NO: 262049 - DNA, 20 bp, Artificial
  CRISPR gRNA sequence
aatgagggatttggtcaaat

SEQ ID NO: 262050 - DNA, 20 bp, Artificial
  CRISPR gRNA sequence
aagcaatatcaggtaaacca

SEQ ID NO: 262051 - DNA, 20 bp, Artificial
  CRISPR gRNA sequence
atgggacctggcgcagtggc

SEQ ID NO: 262052 - DNA, 20 bp, Artificial
  CRISPR gRNA sequence
tctgtactaaaaatacaaaa

SEQ ID NO: 262053 - DNA, 20 bp, Artificial
  CRISPR gRNA sequence
ccaagaggctgaggcatgag

SEQ ID NO: 262054 - DNA, 20 bp, Artificial
  CRISPR gRNA sequence
caaaattatttgagtactgt

SEQ ID NO: 262055 - DNA, 20 bp, Artificial
  CRISPR gRNA sequence
tcattccaatcagaccaggt

SEQ ID NO: 262056 - DNA, 20 bp, Artificial
  CRISPR gRNA sequence
atcagaccaggtaggagctt

SEQ ID NO: 262057 - DNA, 20 bp, Artificial
  CRISPR gRNA sequence
ggtaggagctttcctgtttc

SEQ ID NO: 262058 - DNA, 20 bp, Artificial
  CRISPR gRNA sequence
gctcctttacagggacttta

SEQ ID NO: 262059 - DNA, 20 bp, Artificial
  CRISPR gRNA sequence
accatggatatttttctacc

SEQ ID NO: 262060 - DNA, 20 bp, Artificial
  CRISPR gRNA sequence
cagtggccctcaccatttgt

SEQ ID NO: 262061 - DNA, 20 bp, Artificial
  CRISPR gRNA sequence
tcagttaattcaggtgttga

SEQ ID NO: 262062 - DNA, 20 bp, Artificial
  CRISPR gRNA sequence
aattcaggtgttgaaggagc

SEQ ID NO: 262063 - DNA, 20 bp, Artificial
  CRISPR gRNA sequence
ccttttaacttccatcattt

SEQ ID NO: 262064 - DNA, 20 bp, Artificial
  CRISPR gRNA sequence
atcattttcctgtttcttga

SEQ ID NO: 262065 - DNA, 20 bp, Artificial
  CRISPR gRNA sequence
ggaagggaggagtaggaatc

SEQ ID NO: 262066 - DNA, 20 bp, Artificial
  CRISPR gRNA sequence
gatcgaaaatactgtacttt

SEQ ID NO: 262067 - DNA, 20 bp, Artificial
  CRISPR gRNA sequence
gtactttggttgatttttaa

SEQ ID NO: 262068 - DNA, 20 bp, Artificial
  CRISPR gRNA sequence
ttttaagtgggcttccattc

SEQ ID NO: 262069 - DNA, 20 bp, Artificial
  CRISPR gRNA sequence
tacttgggtgctgaagaact

SEQ ID NO: 262070 - DNA, 20 bp, Artificial
  CRISPR gRNA sequence
ccctggcacgtgtgccactt

SEQ ID NO: 262071 - DNA, 20 bp, Artificial
  CRISPR gRNA sequence
agagttcttcaatccaagtt

SEQ ID NO: 262072 - DNA, 20 bp, Artificial
  CRISPR gRNA sequence
atttgaaaatgacagagctg

SEQ ID NO: 262073 - DNA, 20 bp, Artificial
  CRISPR gRNA sequence
aagacttgatctatggtaat

SEQ ID NO: 262074 - DNA, 20 bp, Artificial
  CRISPR gRNA sequence
tgatctatggtaataaatga

SEQ ID NO: 262075 - DNA, 20 bp, Artificial
  CRISPR gRNA sequence
ctaaagatgaatcacacttg

SEQ ID NO: 262076 - DNA, 20 bp, Artificial
  CRISPR gRNA sequence
aagaaatgttatacagggaa

SEQ ID NO: 262077 - DNA, 20 bp, Artificial
  CRISPR gRNA sequence
ttcaaaaacagtggtaggag

SEQ ID NO: 262078 - DNA, 20 bp, Artificial
  CRISPR gRNA sequence
agtggtaggagcaatgcttt

SEQ ID NO: 262079 - DNA, 20 bp, Artificial
  CRISPR gRNA sequence
attaatggtactcctataat

SEQ ID NO: 262080 - DNA, 20 bp, Artificial
  CRISPR gRNA sequence
aaattactaaactactatat

SEQ ID NO: 262081 - DNA, 20 bp, Artificial
  CRISPR gRNA sequence
gtcttttggtattaagaaag

SEQ ID NO: 262082 - DNA, 20 bp, Artificial
  CRISPR gRNA sequence
aagatatgctttcagaatag

SEQ ID NO: 262083 - DNA, 20 bp, Artificial
  CRISPR gRNA sequence
atgctttcagaatagatatg

SEQ ID NO: 262084 - DNA, 20 bp, Artificial
  CRISPR gRNA sequence
ggtaaatccttgtataaatc

SEQ ID NO: 262085 - DNA, 20 bp, Artificial
  CRISPR gRNA sequence
ctaatttcacttcaagcagg

SEQ ID NO: 262086 - DNA, 20 bp, Artificial
  CRISPR gRNA sequence
cacttcaagcagggtacgtt

SEQ ID NO: 262087 - DNA, 20 bp, Artificial
  CRISPR gRNA sequence
tcaagcagggtacgtttctg

SEQ ID NO: 262088 - DNA, 20 bp, Artificial
  CRISPR gRNA sequence
gcagggtacgtttctggttt

SEQ ID NO: 262089 - DNA, 20 bp, Artificial
  CRISPR gRNA sequence
gacctctttgagatgtcagg

SEQ ID NO: 262090 - DNA, 20 bp, Artificial
  CRISPR gRNA sequence
tctgtgtcatgtgaatgctg

SEQ ID NO: 262091 - DNA, 20 bp, Artificial
  CRISPR gRNA sequence
tgttaaattcaactacatgc

SEQ ID NO: 262092 - DNA, 20 bp, Artificial
  CRISPR gRNA sequence
taaaggacccagaaccagga

SEQ ID NO: 262093 - DNA, 20 bp, Artificial
  CRISPR gRNA sequence
tacctcagggcctttacatg

SEQ ID NO: 262094 - DNA, 20 bp, Artificial
  CRISPR gRNA sequence
gaatgtccttctgtagatga

SEQ ID NO: 262095 - DNA, 20 bp, Artificial
  CRISPR gRNA sequence
gttaaactaccccacaccct

SEQ ID NO: 262096 - DNA, 20 bp, Artificial
  CRISPR gRNA sequence
ccccacaccctgtctgcttt

SEQ ID NO: 262097 - DNA, 20 bp, Artificial
  CRISPR gRNA sequence
agacatttttcttatttatt

SEQ ID NO: 262098 - DNA, 20 bp, Artificial
  CRISPR gRNA sequence
ttcttatttatttgtagttt

SEQ ID NO: 262099 - DNA, 20 bp, Artificial
  CRISPR gRNA sequence
aagcttcatgaggcaagtaa

SEQ ID NO: 262100 - DNA, 20 bp, Artificial
  CRISPR gRNA sequence
tcatgaggcaagtaactttg

SEQ ID NO: 262101 - DNA, 20 bp, Artificial
  CRISPR gRNA sequence
aatatttattgactgagtga

SEQ ID NO: 262102 - DNA, 20 bp, Artificial
  CRISPR gRNA sequence
agaggaaagtagaaaataga

SEQ ID NO: 262103 - DNA, 20 bp, Artificial
  CRISPR gRNA sequence
ctggctttctccctctcaaa

SEQ ID NO: 262104 - DNA, 20 bp, Artificial
  CRISPR gRNA sequence
aagcaaagttacttgcctca

SEQ ID NO: 262105 - DNA, 20 bp, Artificial
  CRISPR gRNA sequence
ggaaagcagacagggtgtgg

SEQ ID NO: 262106 - DNA, 20 bp, Artificial
  CRISPR gRNA sequence
gtgtgtgtcactctctttga

SEQ ID NO: 262107 - DNA, 20 bp, Artificial
  CRISPR gRNA sequence
gcaaacaaaccagaaacgta

SEQ ID NO: 262108 - DNA, 20 bp, Artificial
  CRISPR gRNA sequence
gtgaaattagtatttgaaag

SEQ ID NO: 262109 - DNA, 20 bp, Artificial
  CRISPR gRNA sequence
tttttcaaaaaaggctaaac

SEQ ID NO: 262110 - DNA, 20 bp, Artificial
  CRISPR gRNA sequence
ggctaaactggagatttata

SEQ ID NO: 262111 - DNA, 20 bp, Artificial
  CRISPR gRNA sequence
caaatttaaagcagacatat

SEQ ID NO: 262112 - DNA, 20 bp, Artificial
  CRISPR gRNA sequence
cacttggtctctttaaattg

SEQ ID NO: 262113 - DNA, 20 bp, Artificial
  CRISPR gRNA sequence
acaataatagcagcaaatga

SEQ ID NO: 262114 - DNA, 20 bp, Artificial
  CRISPR gRNA sequence
tatgaaagcattgctcctac

SEQ ID NO: 262115 - DNA, 20 bp, Artificial
  CRISPR gRNA sequence
ttccctgtataacatttctt

SEQ ID NO: 262116 - DNA, 20 bp, Artificial
  CRISPR gRNA sequence
gtgagtaagaaacatctcaa

SEQ ID NO: 262117 - DNA, 20 bp, Artificial
  CRISPR gRNA sequence
tttcaaatacaatctgataa

SEQ ID NO: 262118 - DNA, 20 bp, Artificial
  CRISPR gRNA sequence
tcttcagcacccaagtactg

SEQ ID NO: 262119 - DNA, 20 bp, Artificial
  CRISPR gRNA sequence
gctgagtttgatcttcttgg

SEQ ID NO: 262120 - DNA, 20 bp, Artificial
  CRISPR gRNA sequence
agtattttcgatctggaatc

SEQ ID NO: 262121 - DNA, 20 bp, Artificial
  CRISPR gRNA sequence
tagcacctcatccctgcgta

SEQ ID NO: 262122 - DNA, 20 bp, Artificial
  CRISPR gRNA sequence
ccccccttcttaggctattg

SEQ ID NO: 262123 - DNA, 20 bp, Artificial
  CRISPR gRNA sequence
agacttgggccatgccctta

SEQ ID NO: 262124 - DNA, 20 bp, Artificial
  CRISPR gRNA sequence
ggtacaggagcagctgagcc

SEQ ID NO: 262125 - DNA, 20 bp, Artificial
  CRISPR gRNA sequence
ccttctgcctgaccacttct

SEQ ID NO: 262126 - DNA, 20 bp, Artificial
  CRISPR gRNA sequence
aacaggaaagctcctacctg

SEQ ID NO: 262127 - DNA, 20 bp, Artificial
  CRISPR gRNA sequence
tcacagtactcaaataattt

SEQ ID NO: 262128 - DNA, 20 bp, Artificial
  CRISPR gRNA sequence
gttgttgttgttgttgttgt

SEQ ID NO: 262129 - DNA, 20 bp, Artificial
  CRISPR gRNA sequence
aacctccgcctgccaggttc

SEQ ID NO: 262130 - DNA, 20 bp, Artificial
  CRISPR gRNA sequence
tgcctcagcctcttgggcag

SEQ ID NO: 262131 - DNA, 20 bp, Artificial
  CRISPR gRNA sequence
ttttgtatttttagtacaga

SEQ ID NO: 262132 - DNA, 20 bp, Artificial
  CRISPR gRNA sequence
cacctcggcctcccaaagtg

SEQ ID NO: 262133 - DNA, 20 bp, Artificial
  CRISPR gRNA sequence
acagggagtgaggaaagcaa

SEQ ID NO: 262134 - DNA, 20 bp, Artificial
  CRISPR gRNA sequence
aagcaacttggtttacctga

SEQ ID NO: 262135 - DNA, 20 bp, Artificial
  CRISPR gRNA sequence
ctcatttcatgagtgggaga

SEQ ID NO: 262136 - DNA, 20 bp, Artificial
  CRISPR gRNA sequence
tgagtgggagacagtgtttt

SEQ ID NO: 262137 - DNA, 20 bp, Artificial
  CRISPR gRNA sequence
cctccccctactctaactta

SEQ ID NO: 262138 - DNA, 20 bp, Artificial
  CRISPR gRNA sequence
ccccgtttaacccactaacc

SEQ ID NO: 262139 - DNA, 20 bp, Artificial
  CRISPR gRNA sequence
aacacccatttaaccaaaag

SEQ ID NO: 262140 - DNA, 20 bp, Artificial
  CRISPR gRNA sequence
aaatgtctgtggataccaca

SEQ ID NO: 262141 - DNA, 20 bp, Artificial
  CRISPR gRNA sequence
gctcccagaatccactccct

SEQ ID NO: 262142 - DNA, 20 bp, Artificial
  CRISPR gRNA sequence
cagatgggggctgccagccg

SEQ ID NO: 262143 - DNA, 20 bp, Artificial
  CRISPR gRNA sequence
gtggtggggcatagggctgg

SEQ ID NO: 262144 - DNA, 20 bp, Artificial
  CRISPR gRNA sequence
tgtgatcttcttacattagc

SEQ ID NO: 262145 - DNA, 20 bp, Artificial
  CRISPR gRNA sequence
acattagcatttgcttaaca

SEQ ID NO: 262146 - DNA, 20 bp, Artificial
  CRISPR gRNA sequence
tctacactcatctctctttc

SEQ ID NO: 262147 - DNA, 20 bp, Artificial
  CRISPR gRNA sequence
gaagtgagggaagtaagggc

SEQ ID NO: 262148 - DNA, 20 bp, Artificial
  CRISPR gRNA sequence
acatctaaaaacagaaagcc

SEQ ID NO: 262149 - DNA, 20 bp, Artificial
  CRISPR gRNA sequence
aaacagaaagccatcagatt

SEQ ID NO: 262150 - DNA, 20 bp, Artificial
  CRISPR gRNA sequence
acctgaatgaataaataagt

SEQ ID NO: 262151 - DNA, 20 bp, Artificial
  CRISPR gRNA sequence
aataagtgaatgatttcagc

SEQ ID NO: 262152 - DNA, 20 bp, Artificial
  CRISPR gRNA sequence
gtgaatgatttcagccctgg

SEQ ID NO: 262153 - DNA, 20 bp, Artificial
  CRISPR gRNA sequence
ggcatgagtaagtgctaaag

SEQ ID NO: 262154 - DNA, 20 bp, Artificial
  CRISPR gRNA sequence
catgttactaaacacagcta

SEQ ID NO: 262155 - DNA, 20 bp, Artificial
  CRISPR gRNA sequence
ctctttgccatctatgacat

SEQ ID NO: 262156 - DNA, 20 bp, Artificial
  CRISPR gRNA sequence
aaccagccgttagaatttct

SEQ ID NO: 262157 - DNA, 20 bp, Artificial
  CRISPR gRNA sequence
taggcaatcttatccacatt

SEQ ID NO: 262158 - DNA, 20 bp, Artificial
  CRISPR gRNA sequence
caacatgtctaaaataaaac

SEQ ID NO: 262159 - DNA, 20 bp, Artificial
  CRISPR gRNA sequence
aactcaagatttcccccaaa

SEQ ID NO: 262160 - DNA, 20 bp, Artificial
  CRISPR gRNA sequence
aaatgctgttttttttttac

SEQ ID NO: 262161 - DNA, 20 bp, Artificial
  CRISPR gRNA sequence
catcctacaatgcaatgaag

SEQ ID NO: 262162 - DNA, 20 bp, Artificial
  CRISPR gRNA sequence
aggccacagcaataaaggtg

SEQ ID NO: 262163 - DNA, 20 bp, Artificial
  CRISPR gRNA sequence
aggtctgttgcagtcagctc

SEQ ID NO: 262164 - DNA, 20 bp, Artificial
  CRISPR gRNA sequence
cagctcccatgcttatcctc

SEQ ID NO: 262165 - DNA, 20 bp, Artificial
  CRISPR gRNA sequence
tccccatgccagccttaccc

SEQ ID NO: 262166 - DNA, 20 bp, Artificial
  CRISPR gRNA sequence
tacgtggtcttcaagaatct

SEQ ID NO: 262167 - DNA, 20 bp, Artificial
  CRISPR gRNA sequence
atgatctgcagtggggaaca

SEQ ID NO: 262168 - DNA, 20 bp, Artificial
  CRISPR gRNA sequence
ggggaacataatgtttttta

SEQ ID NO: 262169 - DNA, 20 bp, Artificial
  CRISPR gRNA sequence
aagatttctttaggaaaacg

SEQ ID NO: 262170 - DNA, 20 bp, Artificial
  CRISPR gRNA sequence
agtgacaggtgctggcctgt

SEQ ID NO: 262171 - DNA, 20 bp, Artificial
  CRISPR gRNA sequence
gcccaactcagcaaggtact

SEQ ID NO: 262172 - DNA, 20 bp, Artificial
  CRISPR gRNA sequence
tggtaagagagtacaaagac

SEQ ID NO: 262173 - DNA, 20 bp, Artificial
  CRISPR gRNA sequence
ggtttgagatgcagataagt

SEQ ID NO: 262174 - DNA, 20 bp, Artificial
  CRISPR gRNA sequence
atgtgtctgagttgaaagtg

SEQ ID NO: 262175 - DNA, 20 bp, Artificial
  CRISPR gRNA sequence
taaattcattgaaagtgaga

SEQ ID NO: 262176 - DNA, 20 bp, Artificial
  CRISPR gRNA sequence
cattctaatgaatatttata

SEQ ID NO: 262177 - DNA, 20 bp, Artificial
  CRISPR gRNA sequence
ctggcctttaagttagaaag

SEQ ID NO: 262178 - DNA, 20 bp, Artificial
  CRISPR gRNA sequence
gaaagttgagattcccaata

SEQ ID NO: 262179 - DNA, 20 bp, Artificial
  CRISPR gRNA sequence
taggcataaaagccaatggc

SEQ ID NO: 262180 - DNA, 20 bp, Artificial
  CRISPR gRNA sequence
tttccaggaacaagcaacca

SEQ ID NO: 262181 - DNA, 20 bp, Artificial
  CRISPR gRNA sequence
atgtggggaacaactgaaag

SEQ ID NO: 262182 - DNA, 20 bp, Artificial
  CRISPR gRNA sequence
aacagaatgacttcatatga

SEQ ID NO: 262183 - DNA, 20 bp, Artificial
  CRISPR gRNA sequence
atctatgaattaggtacata

SEQ ID NO: 262184 - DNA, 20 bp, Artificial
  CRISPR gRNA sequence
ctatcaagagaaatagtctt

SEQ ID NO: 262185 - DNA, 20 bp, Artificial
  CRISPR gRNA sequence
tgtaccatactatgtaccta

SEQ ID NO: 262186 - DNA, 20 bp, Artificial
  CRISPR gRNA sequence
cagaaaattctaactcccat

SEQ ID NO: 262187 - DNA, 20 bp, Artificial
  CRISPR gRNA sequence
tacttggcctcacacaattc

SEQ ID NO: 262188 - DNA, 20 bp, Artificial
  CRISPR gRNA sequence
atatgactcagataaacaga

SEQ ID NO: 262189 - DNA, 20 bp, Artificial
  CRISPR gRNA sequence
aaacagatctagtttctttg

SEQ ID NO: 262190 - DNA, 20 bp, Artificial
  CRISPR gRNA sequence
tgaatacacaatttcagtag

SEQ ID NO: 262191 - DNA, 20 bp, Artificial
  CRISPR gRNA sequence
aatttcagtagccaagtttc

SEQ ID NO: 262192 - DNA, 20 bp, Artificial
  CRISPR gRNA sequence
tgatcaagccaacattgtcc

SEQ ID NO: 262193 - DNA, 20 bp, Artificial
  CRISPR gRNA sequence
ttgtccattggcttcagttg

SEQ ID NO: 262194 - DNA, 20 bp, Artificial
  CRISPR gRNA sequence
cctagcttcccaagttgcct

SEQ ID NO: 262195 - DNA, 20 bp, Artificial
  CRISPR gRNA sequence
tatacatatatacgcattaa

SEQ ID NO: 262196 - DNA, 20 bp, Artificial
  CRISPR gRNA sequence
cctccaccctaatttaccca

SEQ ID NO: 262197 - DNA, 20 bp, Artificial
  CRISPR gRNA sequence
ttctgggaaatctaactcat

SEQ ID NO: 262198 - DNA, 20 bp, Artificial
  CRISPR gRNA sequence
aggcaaaattcttgaatgtg

SEQ ID NO: 262199 - DNA, 20 bp, Artificial
  CRISPR gRNA sequence
gaaaagttacataaaagcag

SEQ ID NO: 262200 - DNA, 20 bp, Artificial
  CRISPR gRNA sequence
caaccaccaccagcacccaa

SEQ ID NO: 262201 - DNA, 20 bp, Artificial
  CRISPR gRNA sequence
gaaataggggacttggacaa

SEQ ID NO: 262202 - DNA, 20 bp, Artificial
  CRISPR gRNA sequence
ttccctgaaaaacaaaatag

SEQ ID NO: 262203 - DNA, 20 bp, Artificial
  CRISPR gRNA sequence
ataaaaatattaaacatatc

SEQ ID NO: 262204 - DNA, 20 bp, Artificial
  CRISPR gRNA sequence
catatcaccagcttagagtg

SEQ ID NO: 262205 - DNA, 20 bp, Artificial
  CRISPR gRNA sequence
ccaccactgaccatgatctg

SEQ ID NO: 262206 - DNA, 20 bp, Artificial
  CRISPR gRNA sequence
gacttgtattcacttgactt

SEQ ID NO: 262207 - DNA, 20 bp, Artificial
  CRISPR gRNA sequence
ttgactttgtggattctact

SEQ ID NO: 262208 - DNA, 20 bp, Artificial
  CRISPR gRNA sequence
aatggccttaacctaacttt

SEQ ID NO: 262209 - DNA, 20 bp, Artificial
  CRISPR gRNA sequence
tggaataagttaaataatat

SEQ ID NO: 262210 - DNA, 20 bp, Artificial
  CRISPR gRNA sequence
ttctagttccaaccctgtct

SEQ ID NO: 262211 - DNA, 20 bp, Artificial
  CRISPR gRNA sequence
ataccaaaaatcctctagtc

SEQ ID NO: 262212 - DNA, 20 bp, Artificial
  CRISPR gRNA sequence
ctgcacaataaattatccga

SEQ ID NO: 262213 - DNA, 20 bp, Artificial
  CRISPR gRNA sequence
ggtatttcttttaaaaccta

SEQ ID NO: 262214 - DNA, 20 bp, Artificial
  CRISPR gRNA sequence
ctcagatttataatatacag

SEQ ID NO: 262215 - DNA, 20 bp, Artificial
  CRISPR gRNA sequence
gacttgatacaattaaaata

SEQ ID NO: 262216 - DNA, 20 bp, Artificial
  CRISPR gRNA sequence
tctctattttgccagaacac

SEQ ID NO: 262217 - DNA, 20 bp, Artificial
  CRISPR gRNA sequence
aaccattcattggcattatg

SEQ ID NO: 262218 - DNA, 20 bp, Artificial
  CRISPR gRNA sequence
ttcagtacaaaactgaacat

SEQ ID NO: 262219 - DNA, 20 bp, Artificial
  CRISPR gRNA sequence
tattcttctgagttggggaa

SEQ ID NO: 262220 - DNA, 20 bp, Artificial
  CRISPR gRNA sequence
tattttcactaattcacaaa

SEQ ID NO: 262221 - DNA, 20 bp, Artificial
  CRISPR gRNA sequence
aatactgcttaacagttgta

SEQ ID NO: 262222 - DNA, 20 bp, Artificial
  CRISPR gRNA sequence
tgacttatccaagatcacac

SEQ ID NO: 262223 - DNA, 20 bp, Artificial
  CRISPR gRNA sequence
taatagcaaattttatgtcc

SEQ ID NO: 262224 - DNA, 20 bp, Artificial
  CRISPR gRNA sequence
gaaaggtacgggctgggcgc

SEQ ID NO: 262225 - DNA, 20 bp, Artificial
  CRISPR gRNA sequence
ggtgggcagatcacgaggtc

SEQ ID NO: 262226 - DNA, 20 bp, Artificial
  CRISPR gRNA sequence
aatggcatgaacctgggagg

SEQ ID NO: 262227 - DNA, 20 bp, Artificial
  CRISPR gRNA sequence
aatgacgtgaacccgggagg

SEQ ID NO: 262228 - DNA, 20 bp, Artificial
  CRISPR gRNA sequence
tggaaaggtacttttacaga

SEQ ID NO: 262229 - DNA, 20 bp, Artificial
  CRISPR gRNA sequence
cagctgttacttgagggcac

SEQ ID NO: 262230 - DNA, 20 bp, Artificial
  CRISPR gRNA sequence
aaccccaccactgaccacaa

SEQ ID NO: 262231 - DNA, 20 bp, Artificial
  CRISPR gRNA sequence
tcaattttgcagaagtaaat

SEQ ID NO: 262232 - DNA, 20 bp, Artificial
  CRISPR gRNA sequence
aaattctggaggtagaatgt

SEQ ID NO: 262233 - DNA, 20 bp, Artificial
  CRISPR gRNA sequence
aatttcccatcacagttgaa

SEQ ID NO: 262234 - DNA, 20 bp, Artificial
  CRISPR gRNA sequence
atgcccggaactcccttgag

SEQ ID NO: 262235 - DNA, 20 bp, Artificial
  CRISPR gRNA sequence
cgtacgctacaagcatgggc

SEQ ID NO: 262236 - DNA, 20 bp, Artificial
  CRISPR gRNA sequence
gggcgactgcttcaccaaaa

SEQ ID NO: 262237 - DNA, 20 bp, Artificial
  CRISPR gRNA sequence
tcctgggggaaaaaaaaatc

SEQ ID NO: 262238 - DNA, 20 bp, Artificial
  CRISPR gRNA sequence
taaatgaacagatctccagc

SEQ ID NO: 262239 - DNA, 20 bp, Artificial
  CRISPR gRNA sequence
cttttgaatggaacaatgga

SEQ ID NO: 262240 - DNA, 20 bp, Artificial
  CRISPR gRNA sequence
ttttcacccagaaggcagta

SEQ ID NO: 262241 - DNA, 20 bp, Artificial
  CRISPR gRNA sequence
gactgagtgatatatttgga

SEQ ID NO: 262242 - DNA, 20 bp, Artificial
  CRISPR gRNA sequence
tgacacagacacaaaaatag

SEQ ID NO: 262243 - DNA, 20 bp, Artificial
  CRISPR gRNA sequence
acacaaaaatagatctgttt

SEQ ID NO: 262244 - DNA, 20 bp, Artificial
  CRISPR gRNA sequence
aaaaatagatctgtttcttt

SEQ ID NO: 262245 - DNA, 20 bp, Artificial
  CRISPR gRNA sequence
atagatctgtttctttgttt

SEQ ID NO: 262246 - DNA, 20 bp, Artificial
  CRISPR gRNA sequence
tgcctcagtctcttaagtag

SEQ ID NO: 262247 - DNA, 20 bp, Artificial
  CRISPR gRNA sequence
ttctatttttttagtataga

SEQ ID NO: 262248 - DNA, 20 bp, Artificial
  CRISPR gRNA sequence
caccttggcctcccaaagtg

SEQ ID NO: 262249 - DNA, 20 bp, Artificial
  CRISPR gRNA sequence
gccaccatgcccaacctaca

SEQ ID NO: 262250 - DNA, 20 bp, Artificial
  CRISPR gRNA sequence
catgcccaacctacaaatag

SEQ ID NO: 262251 - DNA, 20 bp, Artificial
  CRISPR gRNA sequence
atttgtttttaagttgtgat

SEQ ID NO: 262252 - DNA, 20 bp, Artificial
  CRISPR gRNA sequence
aatattttgaaacattttta

SEQ ID NO: 262253 - DNA, 20 bp, Artificial
  CRISPR gRNA sequence
gataagaaaaaatataaccc

SEQ ID NO: 262254 - DNA, 20 bp, Artificial
  CRISPR gRNA sequence
agaaaaaatataacccaaga

SEQ ID NO: 262255 - DNA, 20 bp, Artificial
  CRISPR gRNA sequence
taacccaagagtttgcttta

SEQ ID NO: 262256 - DNA, 20 bp, Artificial
  CRISPR gRNA sequence
ttaaaagcaaagaacctgaa

SEQ ID NO: 262257 - DNA, 20 bp, Artificial
  CRISPR gRNA sequence
ttctttttttttttcttttc

SEQ ID NO: 262258 - DNA, 20 bp, Artificial
  CRISPR gRNA sequence
tataaggcctagaaacatta

SEQ ID NO: 262259 - DNA, 20 bp, Artificial
  CRISPR gRNA sequence
tttttttttttttctggaga

SEQ ID NO: 262260 - DNA, 20 bp, Artificial
  CRISPR gRNA sequence
aacctccgccctctgggttc

SEQ ID NO: 262261 - DNA, 20 bp, Artificial
  CRISPR gRNA sequence
tgcctcagcctcccgagtag

SEQ ID NO: 262262 - DNA, 20 bp, Artificial
  CRISPR gRNA sequence
ttttctatttttagtagaga

SEQ ID NO: 262263 - DNA, 20 bp, Artificial
  CRISPR gRNA sequence
acggggtttctccatgttgg

SEQ ID NO: 262264 - DNA, 20 bp, Artificial
  CRISPR gRNA sequence
cgcctcggcctcccaaagtg

SEQ ID NO: 262265 - DNA, 20 bp, Artificial
  CRISPR gRNA sequence
aacaacaaaccactttgtgt

SEQ ID NO: 262266 - DNA, 20 bp, Artificial
  CRISPR gRNA sequence
aaacaaaagcatttttttgc

SEQ ID NO: 262267 - DNA, 20 bp, Artificial
  CRISPR gRNA sequence
tttacctacttgcatttctt

SEQ ID NO: 262268 - DNA, 20 bp, Artificial
  CRISPR gRNA sequence
acactgaagagccaaataaa

SEQ ID NO: 262269 - DNA, 20 bp, Artificial
  CRISPR gRNA sequence
gaatttgaattcatatacac

SEQ ID NO: 262270 - DNA, 20 bp, Artificial
  CRISPR gRNA sequence
tgaattcatatacacaggtg

SEQ ID NO: 262271 - DNA, 20 bp, Artificial
  CRISPR gRNA sequence
catatacacaggtgttttgt

SEQ ID NO: 262272 - DNA, 20 bp, Artificial
  CRISPR gRNA sequence
tggcatagaactaaattaat

SEQ ID NO: 262273 - DNA, 20 bp, Artificial
  CRISPR gRNA sequence
ttgggaggccaaggcgggat

SEQ ID NO: 262274 - DNA, 20 bp, Artificial
  CRISPR gRNA sequence
attctttttaaaaaatcatt

SEQ ID NO: 262275 - DNA, 20 bp, Artificial
  CRISPR gRNA sequence
agtcctcccacttccggaaa

SEQ ID NO: 262276 - DNA, 20 bp, Artificial
  CRISPR gRNA sequence
taattggtctaggctggggg

SEQ ID NO: 262277 - DNA, 20 bp, Artificial
  CRISPR gRNA sequence
gctggggggaaggattgata

SEQ ID NO: 262278 - DNA, 20 bp, Artificial
  CRISPR gRNA sequence
gagatataattcaggtacta

SEQ ID NO: 262279 - DNA, 20 bp, Artificial
  CRISPR gRNA sequence
aattcaggtactataaagtt

SEQ ID NO: 262280 - DNA, 20 bp, Artificial
  CRISPR gRNA sequence
ctgttttaaagtgtaaaatt

SEQ ID NO: 262281 - DNA, 20 bp, Artificial
  CRISPR gRNA sequence
gttatgaatgaatcaccact

SEQ ID NO: 262282 - DNA, 20 bp, Artificial
  CRISPR gRNA sequence
accatacccatttaccatca

SEQ ID NO: 262283 - DNA, 20 bp, Artificial
  CRISPR gRNA sequence
ataagtagaatcatacgata

SEQ ID NO: 262284 - DNA, 20 bp, Artificial
  CRISPR gRNA sequence
acgatatgtggctttttgtg

SEQ ID NO: 262285 - DNA, 20 bp, Artificial
  CRISPR gRNA sequence
ctcgtttctttcacttagca

SEQ ID NO: 262286 - DNA, 20 bp, Artificial
  CRISPR gRNA sequence
tttcacttagcataatgttt

SEQ ID NO: 262287 - DNA, 20 bp, Artificial
  CRISPR gRNA sequence
ataatgttttcaagtttcat

SEQ ID NO: 262288 - DNA, 20 bp, Artificial
  CRISPR gRNA sequence
tttcaagtttcatccatgtt

SEQ ID NO: 262289 - DNA, 20 bp, Artificial
  CRISPR gRNA sequence
cattgtatggctatactaca

SEQ ID NO: 262290 - DNA, 20 bp, Artificial
  CRISPR gRNA sequence
tgctactatgagcatttgca

SEQ ID NO: 262291 - DNA, 20 bp, Artificial
  CRISPR gRNA sequence
atacagatttttgtgtggac

SEQ ID NO: 262292 - DNA, 20 bp, Artificial
  CRISPR gRNA sequence
tgctgggtcatatggtaact

SEQ ID NO: 262293 - DNA, 20 bp, Artificial
  CRISPR gRNA sequence
gacgtgaagtgatatctcat

SEQ ID NO: 262294 - DNA, 20 bp, Artificial
  CRISPR gRNA sequence
tgaagtgatatctcatcatg

SEQ ID NO: 262295 - DNA, 20 bp, Artificial
  CRISPR gRNA sequence
atgatgctaagcatcttttc

SEQ ID NO: 262296 - DNA, 20 bp, Artificial
  CRISPR gRNA sequence
ttttatatttttagtagaga

SEQ ID NO: 262297 - DNA, 20 bp, Artificial
  CRISPR gRNA sequence
ctgcctgcctcagccttgat

SEQ ID NO: 262298 - DNA, 20 bp, Artificial
  CRISPR gRNA sequence
atacaagtttcttatcagat

SEQ ID NO: 262299 - DNA, 20 bp, Artificial
  CRISPR gRNA sequence
ttatcagatatgtgatttgt

SEQ ID NO: 262300 - DNA, 20 bp, Artificial
  CRISPR gRNA sequence
gtaaatgttttctctcattc

SEQ ID NO: 262301 - DNA, 20 bp, Artificial
  CRISPR gRNA sequence
attatcttaaaagttccccc

SEQ ID NO: 262302 - DNA, 20 bp, Artificial
  CRISPR gRNA sequence
cctggaaaaatctaaaagcc

SEQ ID NO: 262303 - DNA, 20 bp, Artificial
  CRISPR gRNA sequence
caggcatccattcatatttt

SEQ ID NO: 262304 - DNA, 20 bp, Artificial
  CRISPR gRNA sequence
ttatcctcaaatcggcctcc

SEQ ID NO: 262305 - DNA, 20 bp, Artificial
  CRISPR gRNA sequence
cactcccttctcaggtctca

SEQ ID NO: 262306 - DNA, 20 bp, Artificial
  CRISPR gRNA sequence
agttctaccttttaaacaac

SEQ ID NO: 262307 - DNA, 20 bp, Artificial
  CRISPR gRNA sequence
ttttaaacaactcttgtttc

SEQ ID NO: 262308 - DNA, 20 bp, Artificial
  CRISPR gRNA sequence
ctcttgtttcacatgcttca

SEQ ID NO: 262309 - DNA, 20 bp, Artificial
  CRISPR gRNA sequence
gtttcacatgcttcaatttg

SEQ ID NO: 262310 - DNA, 20 bp, Artificial
  CRISPR gRNA sequence
catgcttcaatttgcttagc

SEQ ID NO: 262311 - DNA, 20 bp, Artificial
  CRISPR gRNA sequence
atgtgcatttcccttaggcc

SEQ ID NO: 262312 - DNA, 20 bp, Artificial
  CRISPR gRNA sequence
ttgacagaaaggaccacatg

SEQ ID NO: 262313 - DNA, 20 bp, Artificial
  CRISPR gRNA sequence
aataattgtggagtgaaaga

SEQ ID NO: 262314 - DNA, 20 bp, Artificial
  CRISPR gRNA sequence
tgtattgttgttatcagcag

SEQ ID NO: 262315 - DNA, 20 bp, Artificial
  CRISPR gRNA sequence
tgtcttaatacaaacatcca

SEQ ID NO: 262316 - DNA, 20 bp, Artificial
  CRISPR gRNA sequence
tacaaacatccaatttgttt

SEQ ID NO: 262317 - DNA, 20 bp, Artificial
  CRISPR gRNA sequence
catccaatttgtttttttgt

SEQ ID NO: 262318 - DNA, 20 bp, Artificial
  CRISPR gRNA sequence
gtttttttgtttttgattta

SEQ ID NO: 262319 - DNA, 20 bp, Artificial
  CRISPR gRNA sequence
ttttgtttttgatttatttt

SEQ ID NO: 262320 - DNA, 20 bp, Artificial
  CRISPR gRNA sequence
gtgcaggttaggcatttgta

SEQ ID NO: 262321 - DNA, 20 bp, Artificial
  CRISPR gRNA sequence
cttgctcaccgccctgggaa

SEQ ID NO: 262322 - DNA, 20 bp, Artificial
  CRISPR gRNA sequence
tgtgtttctattgctaatta

SEQ ID NO: 262323 - DNA, 20 bp, Artificial
  CRISPR gRNA sequence
tctattgctaattatttgga

SEQ ID NO: 262324 - DNA, 20 bp, Artificial
  CRISPR gRNA sequence
cttcctgatctgcctttgtg

SEQ ID NO: 262325 - DNA, 20 bp, Artificial
  CRISPR gRNA sequence
agagaaaccccagatggctc

SEQ ID NO: 262326 - DNA, 20 bp, Artificial
  CRISPR gRNA sequence
agctgtggcatctagagtcc

SEQ ID NO: 262327 - DNA, 20 bp, Artificial
  CRISPR gRNA sequence
agatgcacatgggagagaag

SEQ ID NO: 262328 - DNA, 20 bp, Artificial
  CRISPR gRNA sequence
gtcctgaaggagtatgcata

SEQ ID NO: 262329 - DNA, 20 bp, Artificial
  CRISPR gRNA sequence
ctggggtgaggtgggagagt

SEQ ID NO: 262330 - DNA, 20 bp, Artificial
  CRISPR gRNA sequence
tgggccatgagttacaaaag

SEQ ID NO: 262331 - DNA, 20 bp, Artificial
  CRISPR gRNA sequence
aagcatagttcactccatta

SEQ ID NO: 262332 - DNA, 20 bp, Artificial
  CRISPR gRNA sequence
gaaggtgatgaagatctact

SEQ ID NO: 262333 - DNA, 20 bp, Artificial
  CRISPR gRNA sequence
ggcttttatgcagaaaagtg

SEQ ID NO: 262334 - DNA, 20 bp, Artificial
  CRISPR gRNA sequence
gtgctaagattttgctggaa

SEQ ID NO: 262335 - DNA, 20 bp, Artificial
  CRISPR gRNA sequence
tggaaaagagcttgaaaact

SEQ ID NO: 262336 - DNA, 20 bp, Artificial
  CRISPR gRNA sequence
aaagccatccaatttattgc

SEQ ID NO: 262337 - DNA, 20 bp, Artificial
  CRISPR gRNA sequence
ctggctctcaaacacagata

SEQ ID NO: 262338 - DNA, 20 bp, Artificial
  CRISPR gRNA sequence
aacacagatactgtgcttga

SEQ ID NO: 262339 - DNA, 20 bp, Artificial
  CRISPR gRNA sequence
cagatactgtgcttgaaatc

SEQ ID NO: 262340 - DNA, 20 bp, Artificial
  CRISPR gRNA sequence
taacatgtagctaacagcct

SEQ ID NO: 262341 - DNA, 20 bp, Artificial
  CRISPR gRNA sequence
ttcaaggttggctgataaaa

SEQ ID NO: 262342 - DNA, 20 bp, Artificial
  CRISPR gRNA sequence
cacaggacctcaaaatctct

SEQ ID NO: 262343 - DNA, 20 bp, Artificial
  CRISPR gRNA sequence
actttgagtaaacacaataa

SEQ ID NO: 262344 - DNA, 20 bp, Artificial
  CRISPR gRNA sequence
aatcagaatatcagatgaca

SEQ ID NO: 262345 - DNA, 20 bp, Artificial
  CRISPR gRNA sequence
ttgatatgtattttcggtct

SEQ ID NO: 262346 - DNA, 20 bp, Artificial
  CRISPR gRNA sequence
tgtagctccctcgtcctaac

SEQ ID NO: 262347 - DNA, 20 bp, Artificial
  CRISPR gRNA sequence
gctccctcgtcctaacttgt

SEQ ID NO: 262348 - DNA, 20 bp, Artificial
  CRISPR gRNA sequence
ctaacttgtgtttgatttct

SEQ ID NO: 262349 - DNA, 20 bp, Artificial
  CRISPR gRNA sequence
ccagccctttccctgtgaat

SEQ ID NO: 262350 - DNA, 20 bp, Artificial
  CRISPR gRNA sequence
attgtcaacccatccatttt

SEQ ID NO: 262351 - DNA, 20 bp, Artificial
  CRISPR gRNA sequence
ttttctttgcttacgttatc

SEQ ID NO: 262352 - DNA, 20 bp, Artificial
  CRISPR gRNA sequence
tttctctaactgaattgaca

SEQ ID NO: 262353 - DNA, 20 bp, Artificial
  CRISPR gRNA sequence
agttgttttgaaggtgaatt

SEQ ID NO: 262354 - DNA, 20 bp, Artificial
  CRISPR gRNA sequence
ttttgaaggtgaatttagtg

SEQ ID NO: 262355 - DNA, 20 bp, Artificial
  CRISPR gRNA sequence
aaacctctttccctcacagc

SEQ ID NO: 262356 - DNA, 20 bp, Artificial
  CRISPR gRNA sequence
aacaacaggcaacatgaaga

SEQ ID NO: 262357 - DNA, 20 bp, Artificial
  CRISPR gRNA sequence
gaggtgagaaggtacttatc

SEQ ID NO: 262358 - DNA, 20 bp, Artificial
  CRISPR gRNA sequence
tgagcaaggtactgagagct

SEQ ID NO: 262359 - DNA, 20 bp, Artificial
  CRISPR gRNA sequence
ccgacttcaggaaaattgaa

SEQ ID NO: 262360 - DNA, 20 bp, Artificial
  CRISPR gRNA sequence
agaatggcagtgggtggtgg

SEQ ID NO: 262361 - DNA, 20 bp, Artificial
  CRISPR gRNA sequence
ttacaaaaaaaaacaactct

SEQ ID NO: 262362 - DNA, 20 bp, Artificial
  CRISPR gRNA sequence
gaccctcccaccagctcagt

SEQ ID NO: 262363 - DNA, 20 bp, Artificial
  CRISPR gRNA sequence
tcccaccagctcagttaatg

SEQ ID NO: 262364 - DNA, 20 bp, Artificial
  CRISPR gRNA sequence
aaatgcaatatgggaaacac

SEQ ID NO: 262365 - DNA, 20 bp, Artificial
  CRISPR gRNA sequence
cattggcttaatttagtatc

SEQ ID NO: 262366 - DNA, 20 bp, Artificial
  CRISPR gRNA sequence
tcaaaatttcaacacaattg

SEQ ID NO: 262367 - DNA, 20 bp, Artificial
  CRISPR gRNA sequence
gtctggagtgagggttaggg

SEQ ID NO: 262368 - DNA, 20 bp, Artificial
  CRISPR gRNA sequence
tttatttagacatctaggag

SEQ ID NO: 262369 - DNA, 20 bp, Artificial
  CRISPR gRNA sequence
taatgcacatatacaaaaca

SEQ ID NO: 262370 - DNA, 20 bp, Artificial
  CRISPR gRNA sequence
aaacattttgcttacaattt

SEQ ID NO: 262371 - DNA, 20 bp, Artificial
  CRISPR gRNA sequence
ggtcatagatggatcccaga

SEQ ID NO: 262372 - DNA, 20 bp, Artificial
  CRISPR gRNA sequence
ataccattgagatcttccat

SEQ ID NO: 262373 - DNA, 20 bp, Artificial
  CRISPR gRNA sequence
tagcttacccaagtatacaa

SEQ ID NO: 262374 - DNA, 20 bp, Artificial
  CRISPR gRNA sequence
actaggaaaatccttaactt

SEQ ID NO: 262375 - DNA, 20 bp, Artificial
  CRISPR gRNA sequence
tcagggcttttgtgaattac

SEQ ID NO: 262376 - DNA, 20 bp, Artificial
  CRISPR gRNA sequence
tgtgaattacatttgtttgt

SEQ ID NO: 262377 - DNA, 20 bp, Artificial
  CRISPR gRNA sequence
agcagttagagagctggaat

SEQ ID NO: 262378 - DNA, 20 bp, Artificial
  CRISPR gRNA sequence
atacatgattaattagcaaa

SEQ ID NO: 262379 - DNA, 20 bp, Artificial
  CRISPR gRNA sequence
tgcagttgaaaaatcaggtt

SEQ ID NO: 262380 - DNA, 20 bp, Artificial
  CRISPR gRNA sequence
aggttgtaagattctaatta

SEQ ID NO: 262381 - DNA, 20 bp, Artificial
  CRISPR gRNA sequence
aggtaggaaccaaaaacaat

SEQ ID NO: 262382 - DNA, 20 bp, Artificial
  CRISPR gRNA sequence
tgagcacactgtgaaggtga

SEQ ID NO: 262383 - DNA, 20 bp, Artificial
  CRISPR gRNA sequence
ctgataaccttagctggtgg

SEQ ID NO: 262384 - DNA, 20 bp, Artificial
  CRISPR gRNA sequence
acaaagctattcatgaccta

SEQ ID NO: 262385 - DNA, 20 bp, Artificial
  CRISPR gRNA sequence
ataatgataataatgcaagt

SEQ ID NO: 262386 - DNA, 20 bp, Artificial
  CRISPR gRNA sequence
ataattctgtggtcatttca

SEQ ID NO: 262387 - DNA, 20 bp, Artificial
  CRISPR gRNA sequence
cttcccattttcacaagaaa

SEQ ID NO: 262388 - DNA, 20 bp, Artificial
  CRISPR gRNA sequence
aatctcttcacacagaaaaa

SEQ ID NO: 262389 - DNA, 20 bp, Artificial
  CRISPR gRNA sequence
acagaaaaagggggctttga

SEQ ID NO: 262390 - DNA, 20 bp, Artificial
  CRISPR gRNA sequence
aattgttggtcctctgtatc

SEQ ID NO: 262391 - DNA, 20 bp, Artificial
  CRISPR gRNA sequence
tagattctgcatcccacaaa

SEQ ID NO: 262392 - DNA, 20 bp, Artificial
  CRISPR gRNA sequence
caagagaagcagaccaagca

SEQ ID NO: 262393 - DNA, 20 bp, Artificial
  CRISPR gRNA sequence
gaccaagcaaccagctttgg

SEQ ID NO: 262394 - DNA, 20 bp, Artificial
  CRISPR gRNA sequence
taactgttcttgacagaaag

SEQ ID NO: 262395 - DNA, 20 bp, Artificial
  CRISPR gRNA sequence
ggttttaaaacaaaatctaa

SEQ ID NO: 262396 - DNA, 20 bp, Artificial
  CRISPR gRNA sequence
aaaacaaaatctaaagaggt

SEQ ID NO: 262397 - DNA, 20 bp, Artificial
  CRISPR gRNA sequence
gttttagtttgaacaaggac

SEQ ID NO: 262398 - DNA, 20 bp, Artificial
  CRISPR gRNA sequence
caatataaatagaaatagaa

SEQ ID NO: 262399 - DNA, 20 bp, Artificial
  CRISPR gRNA sequence
atttactaaaggcctggcac

SEQ ID NO: 262400 - DNA, 20 bp, Artificial
  CRISPR gRNA sequence
ttgggaggatgacacaggtg

SEQ ID NO: 262401 - DNA, 20 bp, Artificial
  CRISPR gRNA sequence
gaggtcaaggctgcagtgag

SEQ ID NO: 262402 - DNA, 20 bp, Artificial
  CRISPR gRNA sequence
aataaataatttagtaaaga

SEQ ID NO: 262403 - DNA, 20 bp, Artificial
  CRISPR gRNA sequence
ataaataagggacttaatgt

SEQ ID NO: 262404 - DNA, 20 bp, Artificial
  CRISPR gRNA sequence
tgggaagatgtaaaagacag

SEQ ID NO: 262405 - DNA, 20 bp, Artificial
  CRISPR gRNA sequence
tgacaggcacgcgaaagaag

SEQ ID NO: 262406 - DNA, 20 bp, Artificial
  CRISPR gRNA sequence
agaagccttgtttccagaca

SEQ ID NO: 262407 - DNA, 20 bp, Artificial
  CRISPR gRNA sequence
tttccagacaggatgattct

SEQ ID NO: 262408 - DNA, 20 bp, Artificial
  CRISPR gRNA sequence
catggaaatgaccttagtgt

SEQ ID NO: 262409 - DNA, 20 bp, Artificial
  CRISPR gRNA sequence
tggggagccaagaaaaggca

SEQ ID NO: 262410 - DNA, 20 bp, Artificial
  CRISPR gRNA sequence
gttgagaatgttgtggtaca

SEQ ID NO: 262411 - DNA, 20 bp, Artificial
  CRISPR gRNA sequence
agcaagcaatcttgactgcc

SEQ ID NO: 262412 - DNA, 20 bp, Artificial
  CRISPR gRNA sequence
ggtcaaacaaggcattggtg

SEQ ID NO: 262413 - DNA, 20 bp, Artificial
  CRISPR gRNA sequence
ataggaggtaaccagggaat

SEQ ID NO: 262414 - DNA, 20 bp, Artificial
  CRISPR gRNA sequence
taatttattattttctaaat

SEQ ID NO: 262415 - DNA, 20 bp, Artificial
  CRISPR gRNA sequence
ccaggtaaatgtcatggccc

SEQ ID NO: 262416 - DNA, 20 bp, Artificial
  CRISPR gRNA sequence
tcctggttagcaatccctgc

SEQ ID NO: 262417 - DNA, 20 bp, Artificial
  CRISPR gRNA sequence
tgcaagggatttcagagatg

SEQ ID NO: 262418 - DNA, 20 bp, Artificial
  CRISPR gRNA sequence
ccttgttagacccgacaaaa

SEQ ID NO: 262419 - DNA, 20 bp, Artificial
  CRISPR gRNA sequence
tcccccaccttgagaaatcc

SEQ ID NO: 262420 - DNA, 20 bp, Artificial
  CRISPR gRNA sequence
caccttgagaaatccttggg

SEQ ID NO: 262421 - DNA, 20 bp, Artificial
  CRISPR gRNA sequence
gaaatccttgggattagctt

SEQ ID NO: 262422 - DNA, 20 bp, Artificial
  CRISPR gRNA sequence
ccaaaacacacagggaaatg

SEQ ID NO: 262423 - DNA, 20 bp, Artificial
  CRISPR gRNA sequence
cgcccataatgttgggcagg

SEQ ID NO: 262424 - DNA, 20 bp, Artificial
  CRISPR gRNA sequence
acccagtagcccttgttgat

SEQ ID NO: 262425 - DNA, 20 bp, Artificial
  CRISPR gRNA sequence
ttaacatcatgacctactct

SEQ ID NO: 262426 - DNA, 20 bp, Artificial
  CRISPR gRNA sequence
atcatgacctactctgagag

SEQ ID NO: 262427 - DNA, 20 bp, Artificial
  CRISPR gRNA sequence
tgacctactctgagagattt

SEQ ID NO: 262428 - DNA, 20 bp, Artificial
  CRISPR gRNA sequence
gtatagaatcactcatctac

SEQ ID NO: 262429 - DNA, 20 bp, Artificial
  CRISPR gRNA sequence
tctcttcctccctatcttct

SEQ ID NO: 262430 - DNA, 20 bp, Artificial
  CRISPR gRNA sequence
tttcctctccttttcactgt

SEQ ID NO: 262431 - DNA, 20 bp, Artificial
  CRISPR gRNA sequence
ctaaactcaaaagtcccagg

SEQ ID NO: 262432 - DNA, 20 bp, Artificial
  CRISPR gRNA sequence
attattcactcctttccctc

SEQ ID NO: 262433 - DNA, 20 bp, Artificial
  CRISPR gRNA sequence
tttttgaaactctttccctc

SEQ ID NO: 262434 - DNA, 20 bp, Artificial
  CRISPR gRNA sequence
gctgactcccatcagagcca

SEQ ID NO: 262435 - DNA, 20 bp, Artificial
  CRISPR gRNA sequence
cccatcagagccagttagtt

SEQ ID NO: 262436 - DNA, 20 bp, Artificial
  CRISPR gRNA sequence
tttccagattcagctccact

SEQ ID NO: 262437 - DNA, 20 bp, Artificial
  CRISPR gRNA sequence
tagccatccattcccataac

SEQ ID NO: 262438 - DNA, 20 bp, Artificial
  CRISPR gRNA sequence
ctccagcttcattccaaaga

SEQ ID NO: 262439 - DNA, 20 bp, Artificial
  CRISPR gRNA sequence
acttcaaaatgacttgaaaa

SEQ ID NO: 262440 - DNA, 20 bp, Artificial
  CRISPR gRNA sequence
tctgttaccagtattctatc

SEQ ID NO: 262441 - DNA, 20 bp, Artificial
  CRISPR gRNA sequence
agtattctatcctttgctta

SEQ ID NO: 262442 - DNA, 20 bp, Artificial
  CRISPR gRNA sequence
ctttgcttagctggattctc

SEQ ID NO: 262443 - DNA, 20 bp, Artificial
  CRISPR gRNA sequence
tgagaacatgaaacagtatt

SEQ ID NO: 262444 - DNA, 20 bp, Artificial
  CRISPR gRNA sequence
tgaaccccagagcaagacca

SEQ ID NO: 262445 - DNA, 20 bp, Artificial
  CRISPR gRNA sequence
ccatctggatttacatactt

SEQ ID NO: 262446 - DNA, 20 bp, Artificial
  CRISPR gRNA sequence
agcaagatgctctacccact

SEQ ID NO: 262447 - DNA, 20 bp, Artificial
  CRISPR gRNA sequence
atgctctacccactctgtgc

SEQ ID NO: 262448 - DNA, 20 bp, Artificial
  CRISPR gRNA sequence
agtaactacctcataggact

SEQ ID NO: 262449 - DNA, 20 bp, Artificial
  CRISPR gRNA sequence
tctaattcccaactctccat

SEQ ID NO: 262450 - DNA, 20 bp, Artificial
  CRISPR gRNA sequence
taatcttacgagtatttatt

SEQ ID NO: 262451 - DNA, 20 bp, Artificial
  CRISPR gRNA sequence
caaatatttattgagtaact

SEQ ID NO: 262452 - DNA, 20 bp, Artificial
  CRISPR gRNA sequence
aggttagaaggatgaataag

SEQ ID NO: 262453 - DNA, 20 bp, Artificial
  CRISPR gRNA sequence
ttgccatttggggtctcaga

SEQ ID NO: 262454 - DNA, 20 bp, Artificial
  CRISPR gRNA sequence
gtgagaggtgtagaggacat

SEQ ID NO: 262455 - DNA, 20 bp, Artificial
  CRISPR gRNA sequence
gtgactgccaagtgttattt

SEQ ID NO: 262456 - DNA, 20 bp, Artificial
  CRISPR gRNA sequence
tgtactacacaatacttgtg

SEQ ID NO: 262457 - DNA, 20 bp, Artificial
  CRISPR gRNA sequence
ttttgtatttttagtagaga

SEQ ID NO: 262458 - DNA, 20 bp, Artificial
  CRISPR gRNA sequence
tatattctctgaaactctga

SEQ ID NO: 262459 - DNA, 20 bp, Artificial
  CRISPR gRNA sequence
ctgatggagattaaaatatg

SEQ ID NO: 262460 - DNA, 20 bp, Artificial
  CRISPR gRNA sequence
caataaaggctgaagtatcc

SEQ ID NO: 262461 - DNA, 20 bp, Artificial
  CRISPR gRNA sequence
aaagtctaacatgaaagaca

SEQ ID NO: 262462 - DNA, 20 bp, Artificial
  CRISPR gRNA sequence
gaaagacaagtagattacat

SEQ ID NO: 262463 - DNA, 20 bp, Artificial
  CRISPR gRNA sequence
tggtggattgtgagccaatg

SEQ ID NO: 262464 - DNA, 20 bp, Artificial
  CRISPR gRNA sequence
tatccagtgcacttctcttc

SEQ ID NO: 262465 - DNA, 20 bp, Artificial
  CRISPR gRNA sequence
tagtgtttggagtcctcaaa

SEQ ID NO: 262466 - DNA, 20 bp, Artificial
  CRISPR gRNA sequence
ggggcctgggttaccttccc

SEQ ID NO: 262467 - DNA, 20 bp, Artificial
  CRISPR gRNA sequence
caaagctctgagtgaattgt

SEQ ID NO: 262468 - DNA, 20 bp, Artificial
  CRISPR gRNA sequence
gagtgaattgtcttggtttt

SEQ ID NO: 262469 - DNA, 20 bp, Artificial
  CRISPR gRNA sequence
ttgtcttggtttttttggtt

SEQ ID NO: 262470 - DNA, 20 bp, Artificial
  CRISPR gRNA sequence
aagagacacagatatcttaa

SEQ ID NO: 262471 - DNA, 20 bp, Artificial
  CRISPR gRNA sequence
taaccaacatgagaaagaga

SEQ ID NO: 262472 - DNA, 20 bp, Artificial
  CRISPR gRNA sequence
catgacctgctgggaaacaa

SEQ ID NO: 262473 - DNA, 20 bp, Artificial
  CRISPR gRNA sequence
gctttgaaggagtgtccgtc

SEQ ID NO: 262474 - DNA, 20 bp, Artificial
  CRISPR gRNA sequence
aatgcctacactagttaata

SEQ ID NO: 262475 - DNA, 20 bp, Artificial
  CRISPR gRNA sequence
tccttttgtaaatgtcagca

SEQ ID NO: 262476 - DNA, 20 bp, Artificial
  CRISPR gRNA sequence
atcctctccccacccatagt

SEQ ID NO: 262477 - DNA, 20 bp, Artificial
  CRISPR gRNA sequence
catagtaaaagtttgaatgt

SEQ ID NO: 262478 - DNA, 20 bp, Artificial
  CRISPR gRNA sequence
gagagctttggagttacaat

SEQ ID NO: 262479 - DNA, 20 bp, Artificial
  CRISPR gRNA sequence
gtcatgtaaatacggcaatc

SEQ ID NO: 262480 - DNA, 20 bp, Artificial
  CRISPR gRNA sequence
agagtacaaataaaattttt

SEQ ID NO: 262481 - DNA, 20 bp, Artificial
  CRISPR gRNA sequence
ttattaaatgtcagttattt

SEQ ID NO: 262482 - DNA, 20 bp, Artificial
  CRISPR gRNA sequence
taagggaaggcgctggagaa

SEQ ID NO: 262483 - DNA, 20 bp, Artificial
  CRISPR gRNA sequence
ttgtccaaactggccatttt

SEQ ID NO: 262484 - DNA, 20 bp, Artificial
  CRISPR gRNA sequence
ccattttgacagttttttgc

SEQ ID NO: 262485 - DNA, 20 bp, Artificial
  CRISPR gRNA sequence
tggaaaaataagtggtaata

SEQ ID NO: 262486 - DNA, 20 bp, Artificial
  CRISPR gRNA sequence
ctgatttttctcttcacact

SEQ ID NO: 262487 - DNA, 20 bp, Artificial
  CRISPR gRNA sequence
tttctcttcacactggatga

SEQ ID NO: 262488 - DNA, 20 bp, Artificial
  CRISPR gRNA sequence
agtctagtagaaaacatgca

SEQ ID NO: 262489 - DNA, 20 bp, Artificial
  CRISPR gRNA sequence
tgcaaagggcttatctaagt

SEQ ID NO: 262490 - DNA, 20 bp, Artificial
  CRISPR gRNA sequence
catctcaacacaggcataac

SEQ ID NO: 262491 - DNA, 20 bp, Artificial
  CRISPR gRNA sequence
agagaaaggcaaagcacaca

SEQ ID NO: 262492 - DNA, 20 bp, Artificial
  CRISPR gRNA sequence
cacacaagaagctttgcact

SEQ ID NO: 262493 - DNA, 20 bp, Artificial
  CRISPR gRNA sequence
taatttttttttttttttga

SEQ ID NO: 262494 - DNA, 20 bp, Artificial
  CRISPR gRNA sequence
ttcacagcaacctccgcgtc

SEQ ID NO: 262495 - DNA, 20 bp, Artificial
  CRISPR gRNA sequence
tgcctaagcctcacaagtag

SEQ ID NO: 262496 - DNA, 20 bp, Artificial
  CRISPR gRNA sequence
tttttgtatttttagtagag

SEQ ID NO: 262497 - DNA, 20 bp, Artificial
  CRISPR gRNA sequence
gatccacccgcctcagcgtc

SEQ ID NO: 262498 - DNA, 20 bp, Artificial
  CRISPR gRNA sequence
tggtcattcttttcttgctc

SEQ ID NO: 262499 - DNA, 20 bp, Artificial
  CRISPR gRNA sequence
aatgttctaaagaaaacata

SEQ ID NO: 262500 - DNA, 20 bp, Artificial
  CRISPR gRNA sequence
gtgtacaattaccaatttta

SEQ ID NO: 262501 - DNA, 20 bp, Artificial
  CRISPR gRNA sequence
ttaaatagttttcagtcagg

SEQ ID NO: 262502 - DNA, 20 bp, Artificial
  CRISPR gRNA sequence
taagtaattttaaatattct

SEQ ID NO: 262503 - DNA, 20 bp, Artificial
  CRISPR gRNA sequence
tttgagagatctcttaaaaa

SEQ ID NO: 262504 - DNA, 20 bp, Artificial
  CRISPR gRNA sequence
gacctttttaaaataaatgt

SEQ ID NO: 262505 - DNA, 20 bp, Artificial
  CRISPR gRNA sequence
agaatatatttggtagctgt

SEQ ID NO: 262506 - DNA, 20 bp, Artificial
  CRISPR gRNA sequence
tcatgtctttcattatatca

SEQ ID NO: 262507 - DNA, 20 bp, Artificial
  CRISPR gRNA sequence
atatgcaactactgtacctc

SEQ ID NO: 262508 - DNA, 20 bp, Artificial
  CRISPR gRNA sequence
ctctttgggctatgtacact

SEQ ID NO: 262509 - DNA, 20 bp, Artificial
  CRISPR gRNA sequence
taagaaagaaaattgaggat

SEQ ID NO: 262510 - DNA, 20 bp, Artificial
  CRISPR gRNA sequence
tgactgttgacccctatcag

SEQ ID NO: 262511 - DNA, 20 bp, Artificial
  CRISPR gRNA sequence
caaattctttctgttaggaa

SEQ ID NO: 262512 - DNA, 20 bp, Artificial
  CRISPR gRNA sequence
ctttctgttaggaattgtgc

SEQ ID NO: 262513 - DNA, 20 bp, Artificial
  CRISPR gRNA sequence
ttttccgaagttaatttaac

SEQ ID NO: 262514 - DNA, 20 bp, Artificial
  CRISPR gRNA sequence
aatctaagaaaatacatttt

SEQ ID NO: 262515 - DNA, 20 bp, Artificial
  CRISPR gRNA sequence
tttattaatattggtgttgt

SEQ ID NO: 262516 - DNA, 20 bp, Artificial
  CRISPR gRNA sequence
tgactgagctaagcccttcg

SEQ ID NO: 262517 - DNA, 20 bp, Artificial
  CRISPR gRNA sequence
acctcacaatgaccttgagg

SEQ ID NO: 262518 - DNA, 20 bp, Artificial
  CRISPR gRNA sequence
cactttacagttaaggaaac

SEQ ID NO: 262519 - DNA, 20 bp, Artificial
  CRISPR gRNA sequence
gttaaggaaactgaggtttg

SEQ ID NO: 262520 - DNA, 20 bp, Artificial
  CRISPR gRNA sequence
agtttaaataatagctaagc

SEQ ID NO: 262521 - DNA, 20 bp, Artificial
  CRISPR gRNA sequence
gaacataggcaacctaaatt

SEQ ID NO: 262522 - DNA, 20 bp, Artificial
  CRISPR gRNA sequence
tccagagccaatctacttac

SEQ ID NO: 262523 - DNA, 20 bp, Artificial
  CRISPR gRNA sequence
cactttgggaggcagaggca

SEQ ID NO: 262524 - DNA, 20 bp, Artificial
  CRISPR gRNA sequence
ttgggaggcagaggcaggtg

SEQ ID NO: 262525 - DNA, 20 bp, Artificial
  CRISPR gRNA sequence
caggtggattgcttgagctc

SEQ ID NO: 262526 - DNA, 20 bp, Artificial
  CRISPR gRNA sequence
aactaatagctagagaaact

SEQ ID NO: 262527 - DNA, 20 bp, Artificial
  CRISPR gRNA sequence
ctatattgtagtctgagaat

SEQ ID NO: 262528 - DNA, 20 bp, Artificial
  CRISPR gRNA sequence
tacagaaagaaagacattaa

SEQ ID NO: 262529 - DNA, 20 bp, Artificial
  CRISPR gRNA sequence
accaccaccgccaccatccc

SEQ ID NO: 262530 - DNA, 20 bp, Artificial
  CRISPR gRNA sequence
gcatttcacacaggatataa

SEQ ID NO: 262531 - DNA, 20 bp, Artificial
  CRISPR gRNA sequence
aaatagtcggtcactacatg

SEQ ID NO: 262532 - DNA, 20 bp, Artificial
  CRISPR gRNA sequence
gctattagttgatagtgtcc

SEQ ID NO: 262533 - DNA, 20 bp, Artificial
  CRISPR gRNA sequence
ctttctttttttttttaatt

SEQ ID NO: 262534 - DNA, 20 bp, Artificial
  CRISPR gRNA sequence
aatcacaagcacaattccta

SEQ ID NO: 262535 - DNA, 20 bp, Artificial
  CRISPR gRNA sequence
acaagcacaattcctaacag

SEQ ID NO: 262536 - DNA, 20 bp, Artificial
  CRISPR gRNA sequence
cattcaacgtgttctcagag

SEQ ID NO: 262537 - DNA, 20 bp, Artificial
  CRISPR gRNA sequence
cagctaccaaatatattcta

SEQ ID NO: 262538 - DNA, 20 bp, Artificial
  CRISPR gRNA sequence
ttaagagatctctcaaactt

SEQ ID NO: 262539 - DNA, 20 bp, Artificial
  CRISPR gRNA sequence
acttttacagtcttttccag

SEQ ID NO: 262540 - DNA, 20 bp, Artificial
  CRISPR gRNA sequence
ccagtaagaaaacttacgag

SEQ ID NO: 262541 - DNA, 20 bp, Artificial
  CRISPR gRNA sequence
aagaaaacttacgagcaaga

SEQ ID NO: 262542 - DNA, 20 bp, Artificial
  CRISPR gRNA sequence
ctacttgtgaggcttaggca

SEQ ID NO: 262543 - DNA, 20 bp, Artificial
  CRISPR gRNA sequence
tctctgtacacaccttccat

SEQ ID NO: 262544 - DNA, 20 bp, Artificial
  CRISPR gRNA sequence
gtaactgtccttcctaggtc

SEQ ID NO: 262545 - DNA, 20 bp, Artificial
  CRISPR gRNA sequence
gtgtgtgtatgtatgtatat

SEQ ID NO: 262546 - DNA, 20 bp, Artificial
  CRISPR gRNA sequence
gtgtgtgtatgtatgtatat

SEQ ID NO: 262547 - DNA, 20 bp, Artificial
  CRISPR gRNA sequence
agcctaatcatccagtgtga

SEQ ID NO: 262548 - DNA, 20 bp, Artificial
  CRISPR gRNA sequence
tgtggccagtttttctgtta

SEQ ID NO: 262549 - DNA, 20 bp, Artificial
  CRISPR gRNA sequence
gagtcattgccacagataga

SEQ ID NO: 262550 - DNA, 20 bp, Artificial
  CRISPR gRNA sequence
ttgccacagatagattagaa

SEQ ID NO: 262551 - DNA, 20 bp, Artificial
  CRISPR gRNA sequence
ttatgccttttttcaagggt

SEQ ID NO: 262552 - DNA, 20 bp, Artificial
  CRISPR gRNA sequence
tttatgccaccaacatccca

SEQ ID NO: 262553 - DNA, 20 bp, Artificial
  CRISPR gRNA sequence
ccagcaggtcatggcaaggg

SEQ ID NO: 262554 - DNA, 20 bp, Artificial
  CRISPR gRNA sequence
tttttgtttgcctttttctt

SEQ ID NO: 262555 - DNA, 20 bp, Artificial
  CRISPR gRNA sequence
tgagcctgataattatagca

SEQ ID NO: 262556 - DNA, 20 bp, Artificial
  CRISPR gRNA sequence
gggaaggtaacccaggcccc

SEQ ID NO: 262557 - DNA, 20 bp, Artificial
  CRISPR gRNA sequence
atggttcctgatggtatcat

SEQ ID NO: 262558 - DNA, 20 bp, Artificial
  CRISPR gRNA sequence
ttaatctccatcagagtttc

SEQ ID NO: 262559 - DNA, 20 bp, Artificial
  CRISPR gRNA sequence
cagagtttcagagaatataa

SEQ ID NO: 262560 - DNA, 20 bp, Artificial
  CRISPR gRNA sequence
ctactggggaggctgaggta

SEQ ID NO: 262561 - DNA, 20 bp, Artificial
  CRISPR gRNA sequence
cgtctcaacaacaacaaaaa

SEQ ID NO: 262562 - DNA, 20 bp, Artificial
  CRISPR gRNA sequence
agactatgaactccttgagg

SEQ ID NO: 262563 - DNA, 20 bp, Artificial
  CRISPR gRNA sequence
ttactcaataaatatttgtt

SEQ ID NO: 262564 - DNA, 20 bp, Artificial
  CRISPR gRNA sequence
tcaataaatatttgttgaag

SEQ ID NO: 262565 - DNA, 20 bp, Artificial
  CRISPR gRNA sequence
taaatactcgtaagattaat

SEQ ID NO: 262566 - DNA, 20 bp, Artificial
  CRISPR gRNA sequence
gaaggaaaaggtggattaat

SEQ ID NO: 262567 - DNA, 20 bp, Artificial
  CRISPR gRNA sequence
tgaggttatggtgaagcagc

SEQ ID NO: 262568 - DNA, 20 bp, Artificial
  CRISPR gRNA sequence
agaatccagctaagcaaagg

SEQ ID NO: 262569 - DNA, 20 bp, Artificial
  CRISPR gRNA sequence
caaaggatagaatactggta

SEQ ID NO: 262570 - DNA, 20 bp, Artificial
  CRISPR gRNA sequence
tgaagtaatggcctgggtaa

SEQ ID NO: 262571 - DNA, 20 bp, Artificial
  CRISPR gRNA sequence
ctgggtaagaagaaaatatt

SEQ ID NO: 262572 - DNA, 20 bp, Artificial
  CRISPR gRNA sequence
cgaaaggagagggcataact

SEQ ID NO: 262573 - DNA, 20 bp, Artificial
  CRISPR gRNA sequence
ggttagctagtgaaggagac

SEQ ID NO: 262574 - DNA, 20 bp, Artificial
  CRISPR gRNA sequence
aagataagacttcacaggat

SEQ ID NO: 262575 - DNA, 20 bp, Artificial
  CRISPR gRNA sequence
tagagaagggtattattagg

SEQ ID NO: 262576 - DNA, 20 bp, Artificial
  CRISPR gRNA sequence
cttataggggtagagataag

SEQ ID NO: 262577 - DNA, 20 bp, Artificial
  CRISPR gRNA sequence
atgacctgatagagcaaata

SEQ ID NO: 262578 - DNA, 20 bp, Artificial
  CRISPR gRNA sequence
gatagagcaaatacaagaaa

SEQ ID NO: 262579 - DNA, 20 bp, Artificial
  CRISPR gRNA sequence
cctaaatgctgctaatgtgc

SEQ ID NO: 262580 - DNA, 20 bp, Artificial
  CRISPR gRNA sequence
ttcagaggtatgtgatttag

SEQ ID NO: 262581 - DNA, 20 bp, Artificial
  CRISPR gRNA sequence
tactagattaaaacatatat

SEQ ID NO: 262582 - DNA, 20 bp, Artificial
  CRISPR gRNA sequence
tactataataatatatatgt

SEQ ID NO: 262583 - DNA, 20 bp, Artificial
  CRISPR gRNA sequence
tttagactacaggcaacctt

SEQ ID NO: 262584 - DNA, 20 bp, Artificial
  CRISPR gRNA sequence
tgaagtctctacaaaagcct

SEQ ID NO: 262585 - DNA, 20 bp, Artificial
  CRISPR gRNA sequence
tacctgccttcggatttctc

SEQ ID NO: 262586 - DNA, 20 bp, Artificial
  CRISPR gRNA sequence
ttttacatcttcccatctcc

SEQ ID NO: 262587 - DNA, 20 bp, Artificial
  CRISPR gRNA sequence
tgacgctgtcacagcagaag

SEQ ID NO: 262588 - DNA, 20 bp, Artificial
  CRISPR gRNA sequence
tgacacatcaaaatttcttc

SEQ ID NO: 262589 - DNA, 20 bp, Artificial
  CRISPR gRNA sequence
agctaatttttgtatttttt

SEQ ID NO: 262590 - DNA, 20 bp, Artificial
  CRISPR gRNA sequence
aaaaacagtatttgtgggat

SEQ ID NO: 262591 - DNA, 20 bp, Artificial
  CRISPR gRNA sequence
gactttcaagataacagtca

SEQ ID NO: 262592 - DNA, 20 bp, Artificial
  CRISPR gRNA sequence
gaaaactagatgaaatgacc

SEQ ID NO: 262593 - DNA, 20 bp, Artificial
  CRISPR gRNA sequence
tttaaaaggaaacaagataa

SEQ ID NO: 262594 - DNA, 20 bp, Artificial
  CRISPR gRNA sequence
aacctgatttttcaactgca

SEQ ID NO: 262595 - DNA, 20 bp, Artificial
  CRISPR gRNA sequence
tttctctatggtgctacgat

SEQ ID NO: 262596 - DNA, 20 bp, Artificial
  CRISPR gRNA sequence
cttttgtatacttgggtaag

SEQ ID NO: 262597 - DNA, 20 bp, Artificial
  CRISPR gRNA sequence
gtataattattacttgtgca

SEQ ID NO: 262598 - DNA, 20 bp, Artificial
  CRISPR gRNA sequence
aacaacttgtcaattcagtt

SEQ ID NO: 262599 - DNA, 20 bp, Artificial
  CRISPR gRNA sequence
aatcttttgataacgtaagc

SEQ ID NO: 262600 - DNA, 20 bp, Artificial
  CRISPR gRNA sequence
ctgatacccaagtagcctaa

SEQ ID NO: 262601 - DNA, 20 bp, Artificial
  CRISPR gRNA sequence
tagcatgaactggaaagcaa

SEQ ID NO: 262602 - DNA, 20 bp, Artificial
  CRISPR gRNA sequence
atttgaagtactgtggattt

SEQ ID NO: 262603 - DNA, 20 bp, Artificial
  CRISPR gRNA sequence
tttacacatgccccatttta

SEQ ID NO: 262604 - DNA, 20 bp, Artificial
  CRISPR gRNA sequence
ccccattttaaaagaaaata

SEQ ID NO: 262605 - DNA, 20 bp, Artificial
  CRISPR gRNA sequence
ttaaaagaaaataagagaaa

SEQ ID NO: 262606 - DNA, 20 bp, Artificial
  CRISPR gRNA sequence
tgctatgaggatataaatat

SEQ ID NO: 262607 - DNA, 20 bp, Artificial
  CRISPR gRNA sequence
agctcacaaaggcagatcag

SEQ ID NO: 262608 - DNA, 20 bp, Artificial
  CRISPR gRNA sequence
gaatttgaatgtgcattaaa

SEQ ID NO: 262609 - DNA, 20 bp, Artificial
  CRISPR gRNA sequence
cagaatccaaataattagca

SEQ ID NO: 262610 - DNA, 20 bp, Artificial
  CRISPR gRNA sequence
attcccagggcggtgagcaa

SEQ ID NO: 262611 - DNA, 20 bp, Artificial
  CRISPR gRNA sequence
ttctcaaatttgactgccat

SEQ ID NO: 262612 - DNA, 20 bp, Artificial
  CRISPR gRNA sequence
gactgccatctagaattact

SEQ ID NO: 262613 - DNA, 20 bp, Artificial
  CRISPR gRNA sequence
gctttcaacccaattgaata

SEQ ID NO: 262614 - DNA, 20 bp, Artificial
  CRISPR gRNA sequence
gataatatgaaagacaatcc

SEQ ID NO: 262615 - DNA, 20 bp, Artificial
  CRISPR gRNA sequence
gaaagacaatccacagaatg

SEQ ID NO: 262616 - DNA, 20 bp, Artificial
  CRISPR gRNA sequence
tttacaaatcacatatctga

SEQ ID NO: 262617 - DNA, 20 bp, Artificial
  CRISPR gRNA sequence
gagaccagcctggcccacat

SEQ ID NO: 262618 - DNA, 20 bp, Artificial
  CRISPR gRNA sequence
ctgaatagagagttctctaa

SEQ ID NO: 262619 - DNA, 20 bp, Artificial
  CRISPR gRNA sequence
gcttagcatcattagttatt

SEQ ID NO: 262620 - DNA, 20 bp, Artificial
  CRISPR gRNA sequence
cgtccaccaggatggctata

SEQ ID NO: 262621 - DNA, 20 bp, Artificial
  CRISPR gRNA sequence
gagccctcattcactgctgg

SEQ ID NO: 262622 - DNA, 20 bp, Artificial
  CRISPR gRNA sequence
taatagccaaaaagtgatga

SEQ ID NO: 262623 - DNA, 20 bp, Artificial
  CRISPR gRNA sequence
tgaaaacattatgctaagtg

SEQ ID NO: 262624 - DNA, 20 bp, Artificial
  CRISPR gRNA sequence
attctacttataaaaaaagt

SEQ ID NO: 262625 - DNA, 20 bp, Artificial
  CRISPR gRNA sequence
ataaagttattatctaaaat

SEQ ID NO: 262626 - DNA, 20 bp, Artificial
  CRISPR gRNA sequence
cccagcctagaccaattaaa

SEQ ID NO: 262627 - DNA, 20 bp, Artificial
  CRISPR gRNA sequence
agccagcaatgattttttaa

SEQ ID NO: 262628 - DNA, 20 bp, Artificial
  CRISPR gRNA sequence
tgttgcttcaaataaactta

SEQ ID NO: 262629 - DNA, 20 bp, Artificial
  CRISPR gRNA sequence
acacaaagtggtttgttgtt

SEQ ID NO: 262630 - DNA, 20 bp, Artificial
  CRISPR gRNA sequence
gagacaagcctgaccaacat

SEQ ID NO: 262631 - DNA, 20 bp, Artificial
  CRISPR gRNA sequence
aaaccccgtctctactaaaa

SEQ ID NO: 262632 - DNA, 20 bp, Artificial
  CRISPR gRNA sequence
ctactcgggaggctgaggca

SEQ ID NO: 262633 - DNA, 20 bp, Artificial
  CRISPR gRNA sequence
acaagagcgaaactccgtct

SEQ ID NO: 262634 - DNA, 20 bp, Artificial
  CRISPR gRNA sequence
gtctccagaaaaaaaaaaaa

SEQ ID NO: 262635 - DNA, 20 bp, Artificial
  CRISPR gRNA sequence
ttctaggccttatacaatca

SEQ ID NO: 262636 - DNA, 20 bp, Artificial
  CRISPR gRNA sequence
ggccttatacaatcattaga

SEQ ID NO: 262637 - DNA, 20 bp, Artificial
  CRISPR gRNA sequence
tcattagaaaagaaaaaaaa

SEQ ID NO: 262638 - DNA, 20 bp, Artificial
  CRISPR gRNA sequence
ggctattctctgaatttggt

SEQ ID NO: 262639 - DNA, 20 bp, Artificial
  CRISPR gRNA sequence
accccgtctatactaaaaaa

SEQ ID NO: 262640 - DNA, 20 bp, Artificial
  CRISPR gRNA sequence
ctacttaagagactgaggca

SEQ ID NO: 262641 - DNA, 20 bp, Artificial
  CRISPR gRNA sequence
tgtctcaaaaacaaacaaac

SEQ ID NO: 262642 - DNA, 20 bp, Artificial
  CRISPR gRNA sequence
agctgtggtgctcaatgcta

SEQ ID NO: 262643 - DNA, 20 bp, Artificial
  CRISPR gRNA sequence
aggtcctacatcttctgcca

SEQ ID NO: 262644 - DNA, 20 bp, Artificial
  CRISPR gRNA sequence
ttaatatattttgctctcag

SEQ ID NO: 262645 - DNA, 20 bp, Artificial
  CRISPR gRNA sequence
gaatcagtgacattctacct

SEQ ID NO: 262646 - DNA, 20 bp, Artificial
  CRISPR gRNA sequence
aacaaagacaaataatgttt

SEQ ID NO: 262647 - DNA, 20 bp, Artificial
  CRISPR gRNA sequence
ctccattccagtggatcatg

SEQ ID NO: 262648 - DNA, 20 bp, Artificial
  CRISPR gRNA sequence
ttccattttctaaaatatac

SEQ ID NO: 262649 - DNA, 20 bp, Artificial
  CRISPR gRNA sequence
aatatacaaagaatgctgga

SEQ ID NO: 262650 - DNA, 20 bp, Artificial
  CRISPR gRNA sequence
atgttctgcctaaatgttag

SEQ ID NO: 262651 - DNA, 20 bp, Artificial
  CRISPR gRNA sequence
aatcatgattccccaactca

SEQ ID NO: 262652 - DNA, 20 bp, Artificial
  CRISPR gRNA sequence
tcatttttgtggaatgataa

SEQ ID NO: 262653 - DNA, 20 bp, Artificial
  CRISPR gRNA sequence
aaataggatactaaataagg

SEQ ID NO: 262654 - DNA, 20 bp, Artificial
  CRISPR gRNA sequence
ctaatatctgtaatatccaa

SEQ ID NO: 262655 - DNA, 20 bp, Artificial
  CRISPR gRNA sequence
ataaatctgagtaggtttta

SEQ ID NO: 262656 - DNA, 20 bp, Artificial
  CRISPR gRNA sequence
ctaattttctctaattttga

SEQ ID NO: 262657 - DNA, 20 bp, Artificial
  CRISPR gRNA sequence
tctatgagacagggttggaa

SEQ ID NO: 262658 - DNA, 20 bp, Artificial
  CRISPR gRNA sequence
agattaactatcttctgatg

SEQ ID NO: 262659 - DNA, 20 bp, Artificial
  CRISPR gRNA sequence
tcaccgttttgaatcacaca

SEQ ID NO: 262660 - DNA, 20 bp, Artificial
  CRISPR gRNA sequence
acatgaaatctgaacacatt

SEQ ID NO: 262661 - DNA, 20 bp, Artificial
  CRISPR gRNA sequence
gttggcttgatcaaaaatca

SEQ ID NO: 262662 - DNA, 20 bp, Artificial
  CRISPR gRNA sequence
attgtgtattcaaacctagc

SEQ ID NO: 262663 - DNA, 20 bp, Artificial
  CRISPR gRNA sequence
ttatgaaactataatgggag

SEQ ID NO: 262664 - DNA, 20 bp, Artificial
  CRISPR gRNA sequence
tgagtgacccttgttcttac

SEQ ID NO: 262665 - DNA, 20 bp, Artificial
  CRISPR gRNA sequence
tcttaggtacatagtatggt

SEQ ID NO: 262666 - DNA, 20 bp, Artificial
  CRISPR gRNA sequence
tggatgagtcatttcttcaa

SEQ ID NO: 262667 - DNA, 20 bp, Artificial
  CRISPR gRNA sequence
ctttatactaggtatcatct

SEQ ID NO: 262668 - DNA, 20 bp, Artificial
  CRISPR gRNA sequence
tgctgataattttcgagttt

SEQ ID NO: 262669 - DNA, 20 bp, Artificial
  CRISPR gRNA sequence
caaagtaatttactagctct

SEQ ID NO: 262670 - DNA, 20 bp, Artificial
  CRISPR gRNA sequence
aaacttattataaatattca

SEQ ID NO: 262671 - DNA, 20 bp, Artificial
  CRISPR gRNA sequence
tacaagtttgtctatatttc

SEQ ID NO: 262672 - DNA, 20 bp, Artificial
  CRISPR gRNA sequence
gtaaagctgcccgttttcct

SEQ ID NO: 262673 - DNA, 20 bp, Artificial
  CRISPR gRNA sequence
aagggcaaaggaggaatggt

SEQ ID NO: 262674 - DNA, 20 bp, Artificial
  CRISPR gRNA sequence
tatgtgcaatgtaaagaacc

SEQ ID NO: 262675 - DNA, 20 bp, Artificial
  CRISPR gRNA sequence
acagctctagtctttcattt

SEQ ID NO: 262676 - DNA, 20 bp, Artificial
  CRISPR gRNA sequence
ggtagtgtcattcactcaga

SEQ ID NO: 262677 - DNA, 20 bp, Artificial
  CRISPR gRNA sequence
gaaggcctaggaccaagcag

SEQ ID NO: 262678 - DNA, 20 bp, Artificial
  CRISPR gRNA sequence
tgggatgtcatagatggcaa

SEQ ID NO: 262679 - DNA, 20 bp, Artificial
  CRISPR gRNA sequence
agaagagagttatcaatagt

SEQ ID NO: 262680 - DNA, 20 bp, Artificial
  CRISPR gRNA sequence
ctaggcacttttttcataat

SEQ ID NO: 262681 - DNA, 20 bp, Artificial
  CRISPR gRNA sequence
cataatagagaattctgaat

SEQ ID NO: 262682 - DNA, 20 bp, Artificial
  CRISPR gRNA sequence
atgttttctgggtcatttgt

SEQ ID NO: 262683 - DNA, 20 bp, Artificial
  CRISPR gRNA sequence
tgggtcatttgttaagaaat

SEQ ID NO: 262684 - DNA, 20 bp, Artificial
  CRISPR gRNA sequence
aattttactatcacattgat

SEQ ID NO: 262685 - DNA, 20 bp, Artificial
  CRISPR gRNA sequence
cctatgaaagagagatgagt

SEQ ID NO: 262686 - DNA, 20 bp, Artificial
  CRISPR gRNA sequence
gacttgactgagaagttagg

SEQ ID NO: 262687 - DNA, 20 bp, Artificial
  CRISPR gRNA sequence
ccacagacattttagttgca

SEQ ID NO: 262688 - DNA, 20 bp, Artificial
  CRISPR gRNA sequence
taatgctgttttcctttagt

SEQ ID NO: 262689 - DNA, 20 bp, Artificial
  CRISPR gRNA sequence
atgttcacaatatactttcg

SEQ ID NO: 262690 - DNA, 20 bp, Artificial
  CRISPR gRNA sequence
ataaaatagttctcctacat

SEQ ID NO: 262691 - DNA, 20 bp, Artificial
  CRISPR gRNA sequence
aatagttctcctacatgaag

SEQ ID NO: 262692 - DNA, 20 bp, Artificial
  CRISPR gRNA sequence
ctgcccaagaggctgaggca

SEQ ID NO: 262693 - DNA, 20 bp, Artificial
  CRISPR gRNA sequence
aagagcgtccataggagaag

SEQ ID NO: 262694 - DNA, 20 bp, Artificial
  CRISPR gRNA sequence
gttctttggaaggaggacga

SEQ ID NO: 262695 - DNA, 20 bp, Artificial
  CRISPR gRNA sequence
ctacctacagtttgagtcaa

SEQ ID NO: 262696 - DNA, 20 bp, Artificial
  CRISPR gRNA sequence
agaatatgcctggggacctt

SEQ ID NO: 262697 - DNA, 20 bp, Artificial
  CRISPR gRNA sequence
ggcacctcccacttttatgt

SEQ ID NO: 262698 - DNA, 20 bp, Artificial
  CRISPR gRNA sequence
atgtttcttactcactctgc

SEQ ID NO: 262699 - DNA, 20 bp, Artificial
  CRISPR gRNA sequence
tcactctgcacagaaacaaa

SEQ ID NO: 262700 - DNA, 20 bp, Artificial
  CRISPR gRNA sequence
ttttcactattagtatgaac

SEQ ID NO: 262701 - DNA, 20 bp, Artificial
  CRISPR gRNA sequence
gtttcagatatggtagttat

SEQ ID NO: 262702 - DNA, 20 bp, Artificial
  CRISPR gRNA sequence
ttaatattgtcttttggtat

SEQ ID NO: 262703 - DNA, 20 bp, Artificial
  CRISPR gRNA sequence
gtattaagaaagatatgctt

SEQ ID NO: 262704 - DNA, 20 bp, Artificial
  CRISPR gRNA sequence
tctgcaaggccatttgaggc

SEQ ID NO: 262705 - DNA, 20 bp, Artificial
  CRISPR gRNA sequence
acatgtcctgtttactctgt

SEQ ID NO: 262706 - DNA, 20 bp, Artificial
  CRISPR gRNA sequence
ttataatcatactttgagag

SEQ ID NO: 262707 - DNA, 20 bp, Artificial
  CRISPR gRNA sequence
tctgggcactggagatacag

SEQ ID NO: 262708 - DNA, 20 bp, Artificial
  CRISPR gRNA sequence
gcttataaactacaaataaa

SEQ ID NO: 262709 - DNA, 20 bp, Artificial
  CRISPR gRNA sequence
aagagatggtaaaatgctat

SEQ ID NO: 262710 - DNA, 20 bp, Artificial
  CRISPR gRNA sequence
tcctgatacattcctatatg

SEQ ID NO: 262711 - DNA, 20 bp, Artificial
  CRISPR gRNA sequence
gaggtcagccattggtctga

SEQ ID NO: 262712 - DNA, 20 bp, Artificial
  CRISPR gRNA sequence
actgaagtcaagcaaacaaa

SEQ ID NO: 262713 - DNA, 20 bp, Artificial
  CRISPR gRNA sequence
ttgtttctgtgcagagtgag

SEQ ID NO: 262714 - DNA, 20 bp, Artificial
  CRISPR gRNA sequence
tagtaggcctatttttccag

SEQ ID NO: 262715 - DNA, 20 bp, Artificial
  CRISPR gRNA sequence
cattacaagataaactattt

SEQ ID NO: 262716 - DNA, 20 bp, Artificial
  CRISPR gRNA sequence
ctagttgactcaaactgtag

SEQ ID NO: 262717 - DNA, 20 bp, Artificial
  CRISPR gRNA sequence
gctatctcctcagcacatgg

SEQ ID NO: 262718 - DNA, 20 bp, Artificial
  CRISPR gRNA sequence
gtcaaaatgactaaatatga

SEQ ID NO: 262719 - DNA, 20 bp, Artificial
  CRISPR gRNA sequence
gactgagatgtgcaggtgag

SEQ ID NO: 262720 - DNA, 20 bp, Artificial
  CRISPR gRNA sequence
gtgagaaagggaagaggctc

SEQ ID NO: 262721 - DNA, 20 bp, Artificial
  CRISPR gRNA sequence
tgatatttggtctagtcact

SEQ ID NO: 262722 - DNA, 20 bp, Artificial
  CRISPR gRNA sequence
cattgaacttgaaaaatctc

SEQ ID NO: 262723 - DNA, 20 bp, Artificial
  CRISPR gRNA sequence
aatctcaaagaaagtatttt

SEQ ID NO: 262724 - DNA, 20 bp, Artificial
  CRISPR gRNA sequence
tacatttcttaacaaatgac

SEQ ID NO: 262725 - DNA, 20 bp, Artificial
  CRISPR gRNA sequence
gacccagaaaacatctaaaa

SEQ ID NO: 262726 - DNA, 20 bp, Artificial
  CRISPR gRNA sequence
aagccatcagatttctggat

SEQ ID NO: 262727 - DNA, 20 bp, Artificial
  CRISPR gRNA sequence
aaggggcatgagtaagtgct

SEQ ID NO: 262728 - DNA, 20 bp, Artificial
  CRISPR gRNA sequence
catccttctctaaccagccg

SEQ ID NO: 262729 - DNA, 20 bp, Artificial
  CRISPR gRNA sequence
taaacatcctacaatgcaat

SEQ ID NO: 262730 - DNA, 20 bp, Artificial
  CRISPR gRNA sequence
atgtctgtccccagatgagt

SEQ ID NO: 262731 - DNA, 20 bp, Artificial
  CRISPR gRNA sequence
ctacttaagtacgtggtctt

SEQ ID NO: 262732 - DNA, 20 bp, Artificial
  CRISPR gRNA sequence
accagcacagctgcatgaat

SEQ ID NO: 262733 - DNA, 20 bp, Artificial
  CRISPR gRNA sequence
acatcaggtcaagaactgag

SEQ ID NO: 262734 - DNA, 20 bp, Artificial
  CRISPR gRNA sequence
gatagaatctgcagctgctc

SEQ ID NO: 262735 - DNA, 20 bp, Artificial
  CRISPR gRNA sequence
ctcccagaaacccgctcagc

SEQ ID NO: 262736 - DNA, 20 bp, Artificial
  CRISPR gRNA sequence
gaccagccaaaaataggatc

SEQ ID NO: 262737 - DNA, 20 bp, Artificial
  CRISPR gRNA sequence
cactgcacctggcctttaag

SEQ ID NO: 262738 - DNA, 20 bp, Artificial
  CRISPR gRNA sequence
agccaatggccagagattaa

SEQ ID NO: 262739 - DNA, 20 bp, Artificial
  CRISPR gRNA sequence
gattaagaagaaacaagaac

SEQ ID NO: 262740 - DNA, 20 bp, Artificial
  CRISPR gRNA sequence
gtagtcaactaacatcagag

SEQ ID NO: 262741 - DNA, 20 bp, Artificial
  CRISPR gRNA sequence
cttaagatgatacctagtat

SEQ ID NO: 262742 - DNA, 20 bp, Artificial
  CRISPR gRNA sequence
aataggccaagaagagtcta

SEQ ID NO: 262743 - DNA, 20 bp, Artificial
  CRISPR gRNA sequence
agtcaccaagctgacagtaa

SEQ ID NO: 262744 - DNA, 20 bp, Artificial
  CRISPR gRNA sequence
gacttcatatgatatggctt

SEQ ID NO: 262745 - DNA, 20 bp, Artificial
  CRISPR gRNA sequence
aaatgtacttaatatcaaat

SEQ ID NO: 262746 - DNA, 20 bp, Artificial
  CRISPR gRNA sequence
atatcaaatggagaatatca

SEQ ID NO: 262747 - DNA, 20 bp, Artificial
  CRISPR gRNA sequence
tagtcttttggagactatca

SEQ ID NO: 262748 - DNA, 20 bp, Artificial
  CRISPR gRNA sequence
gagaaatagtcttttatgtt

SEQ ID NO: 262749 - DNA, 20 bp, Artificial
  CRISPR gRNA sequence
ttgagaatacatttctcatt

SEQ ID NO: 262750 - DNA, 20 bp, Artificial
  CRISPR gRNA sequence
ctcatccatgcatgtaactt

SEQ ID NO: 262751 - DNA, 20 bp, Artificial
  CRISPR gRNA sequence
aattcaatgttgaggaaggt

SEQ ID NO: 262752 - DNA, 20 bp, Artificial
  CRISPR gRNA sequence
ttcaattcagtggtgagagc

SEQ ID NO: 262753 - DNA, 20 bp, Artificial
  CRISPR gRNA sequence
cacaattcaactgcttcaga

SEQ ID NO: 262754 - DNA, 20 bp, Artificial
  CRISPR gRNA sequence
attatattgcaaaatgggga

SEQ ID NO: 262755 - DNA, 20 bp, Artificial
  CRISPR gRNA sequence
aacctactcaagcatgggga

SEQ ID NO: 262756 - DNA, 20 bp, Artificial
  CRISPR gRNA sequence
aaatcatcatcctatattaa

SEQ ID NO: 262757 - DNA, 20 bp, Artificial
  CRISPR gRNA sequence
agcagtgctgcttctcttac

SEQ ID NO: 262758 - DNA, 20 bp, Artificial
  CRISPR gRNA sequence
tttccttccttgtgaacatc

SEQ ID NO: 262759 - DNA, 20 bp, Artificial
  CRISPR gRNA sequence
gaacatcagagaaaaatgtg

SEQ ID NO: 262760 - DNA, 20 bp, Artificial
  CRISPR gRNA sequence
atatgcatgttttcaagcct

SEQ ID NO: 262761 - DNA, 20 bp, Artificial
  CRISPR gRNA sequence
aaggggatgagaaggaacct

SEQ ID NO: 262762 - DNA, 20 bp, Artificial
  CRISPR gRNA sequence
atagaattctattcaaaatt

SEQ ID NO: 262763 - DNA, 20 bp, Artificial
  CRISPR gRNA sequence
aaaattagagaaaattagaa

SEQ ID NO: 262764 - DNA, 20 bp, Artificial
  CRISPR gRNA sequence
tagctgcacaataaattatc

SEQ ID NO: 262765 - DNA, 20 bp, Artificial
  CRISPR gRNA sequence
ctcaacccatatcaattaca

SEQ ID NO: 262766 - DNA, 20 bp, Artificial
  CRISPR gRNA sequence
ctgtttggatattacagata

SEQ ID NO: 262767 - DNA, 20 bp, Artificial
  CRISPR gRNA sequence
catggctctgttccagcatt

SEQ ID NO: 262768 - DNA, 20 bp, Artificial
  CRISPR gRNA sequence
tccagcattctttgtatatt

SEQ ID NO: 262769 - DNA, 20 bp, Artificial
  CRISPR gRNA sequence
ctactcaggaggctgaggca

SEQ ID NO: 262770 - DNA, 20 bp, Artificial
  CRISPR gRNA sequence
ctgatcgggaggctgaggca

SEQ ID NO: 262771 - DNA, 20 bp, Artificial
  CRISPR gRNA sequence
cgagagtccgtctcaaaaaa

SEQ ID NO: 262772 - DNA, 20 bp, Artificial
  CRISPR gRNA sequence
tccgtctcaaaaaaaaagaa

SEQ ID NO: 262773 - DNA, 20 bp, Artificial
  CRISPR gRNA sequence
tcaaaaaaaaagaaaaagaa

SEQ ID NO: 262774 - DNA, 20 bp, Artificial
  CRISPR gRNA sequence
aaaaaagaaaaagaaaaaga

SEQ ID NO: 262775 - DNA, 20 bp, Artificial
  CRISPR gRNA sequence
ggaaggaaggaaggaaggaa

SEQ ID NO: 262776 - DNA, 20 bp, Artificial
  CRISPR gRNA sequence
gaagattatggagcacaaaa

SEQ ID NO: 262777 - DNA, 20 bp, Artificial
  CRISPR gRNA sequence
gagcacaaaaaaagaattaa

SEQ ID NO: 262778 - DNA, 20 bp, Artificial
  CRISPR gRNA sequence
ctgccatgatccactggaat

SEQ ID NO: 262779 - DNA, 20 bp, Artificial
  CRISPR gRNA sequence
ttaacatacaaattctggag

SEQ ID NO: 262780 - DNA, 20 bp, Artificial
  CRISPR gRNA sequence
aaaaaatcatttgcttagaa

SEQ ID NO: 262781 - DNA, 20 bp, Artificial
  CRISPR gRNA sequence
gcaagagtgggatgaagaga

SEQ ID NO: 262782 - DNA, 20 bp, Artificial
  CRISPR gRNA sequence
gtgttttctgcaccaaattc

SEQ ID NO: 262783 - DNA, 20 bp, Artificial
  CRISPR gRNA sequence
aattcagagaatagcctccc

SEQ ID NO: 262784 - DNA, 20 bp, Artificial
  CRISPR gRNA sequence
tgctatcccaataaaagatc

SEQ ID NO: 262785 - DNA, 20 bp, Artificial
  CRISPR gRNA sequence
ttctaatgattgtataaggc

SEQ ID NO: 262786 - DNA, 20 bp, Artificial
  CRISPR gRNA sequence
ccaagttggctatgaccacc

SEQ ID NO: 262787 - DNA, 20 bp, Artificial
  CRISPR gRNA sequence
gaaatagaccactgaagcac

SEQ ID NO: 262788 - DNA, 20 bp, Artificial
  CRISPR gRNA sequence
gagccactgcgcctggccct

SEQ ID NO: 262789 - DNA, 20 bp, Artificial
  CRISPR gRNA sequence
tcaagaccagcctgggcaac

SEQ ID NO: 262790 - DNA, 20 bp, Artificial
  CRISPR gRNA sequence
gaacattttcattactccat

SEQ ID NO: 262791 - DNA, 20 bp, Artificial
  CRISPR gRNA sequence
attctggactttttttataa

SEQ ID NO: 262792 - DNA, 20 bp, Artificial
  CRISPR gRNA sequence
ctcactgcagcctctgccac

SEQ ID NO: 262793 - DNA, 20 bp, Artificial
  CRISPR gRNA sequence
gaattcacctgacaacatat

SEQ ID NO: 262794 - DNA, 20 bp, Artificial
  CRISPR gRNA sequence
gttttccaaggccaattaaa

SEQ ID NO: 262795 - DNA, 20 bp, Artificial
  CRISPR gRNA sequence
cctggtttccaagtctcttg

SEQ ID NO: 262796 - DNA, 20 bp, Artificial
  CRISPR gRNA sequence
gcactgaaaaataaacatgc

SEQ ID NO: 262797 - DNA, 20 bp, Artificial
  CRISPR gRNA sequence
ctgcctttgtgagctgattt

SEQ ID NO: 262798 - DNA, 20 bp, Artificial
  CRISPR gRNA sequence
tttaaagaaaaagatgggaa

SEQ ID NO: 262799 - DNA, 20 bp, Artificial
  CRISPR gRNA sequence
agggagtgtgggtgggctgg

SEQ ID NO: 262800 - DNA, 20 bp, Artificial
  CRISPR gRNA sequence
gggaagggagagagaggaag

SEQ ID NO: 262801 - DNA, 20 bp, Artificial
  CRISPR gRNA sequence
cctaagatgcacatgggaga

SEQ ID NO: 262802 - DNA, 20 bp, Artificial
  CRISPR gRNA sequence
gcagctcatgatctgatggg

SEQ ID NO: 262803 - DNA, 20 bp, Artificial
  CRISPR gRNA sequence
gtggggaggataagacaaag

SEQ ID NO: 262804 - DNA, 20 bp, Artificial
  CRISPR gRNA sequence
gatctactgaaggcttttat

SEQ ID NO: 262805 - DNA, 20 bp, Artificial
  CRISPR gRNA sequence
gctttgcaagacagtaaatg

SEQ ID NO: 262806 - DNA, 20 bp, Artificial
  CRISPR gRNA sequence
agagaaatttacttttggtg

SEQ ID NO: 262807 - DNA, 20 bp, Artificial
  CRISPR gRNA sequence
gctctatgaagtaaaaacat

SEQ ID NO: 262808 - DNA, 20 bp, Artificial
  CRISPR gRNA sequence
gaaatcaaagtagctgataa

SEQ ID NO: 262809 - DNA, 20 bp, Artificial
  CRISPR gRNA sequence
taaggacatatctagactca

SEQ ID NO: 262810 - DNA, 20 bp, Artificial
  CRISPR gRNA sequence
aggtcaaacctactaggtta

SEQ ID NO: 262811 - DNA, 20 bp, Artificial
  CRISPR gRNA sequence
gaaagttgcttgaacttcca

SEQ ID NO: 262812 - DNA, 20 bp, Artificial
  CRISPR gRNA sequence
cagttaatgcttagatttcc

SEQ ID NO: 262813 - DNA, 20 bp, Artificial
  CRISPR gRNA sequence
atgttttaaatcataaatgg

SEQ ID NO: 262814 - DNA, 20 bp, Artificial
  CRISPR gRNA sequence
aatttatttcatgctcatat

SEQ ID NO: 262815 - DNA, 20 bp, Artificial
  CRISPR gRNA sequence
tttctttatcgtagcaccat

SEQ ID NO: 262816 - DNA, 20 bp, Artificial
  CRISPR gRNA sequence
tagcaaaatgtgattttcct

SEQ ID NO: 262817 - DNA, 20 bp, Artificial
  CRISPR gRNA sequence
cttttaaaaattcggactga

SEQ ID NO: 262818 - DNA, 20 bp, Artificial
  CRISPR gRNA sequence
agacaaaccgtgctccctga

SEQ ID NO: 262819 - DNA, 20 bp, Artificial
  CRISPR gRNA sequence
ggcctggcttccttctgata

SEQ ID NO: 262820 - DNA, 20 bp, Artificial
  CRISPR gRNA sequence
atggacccagcctctctctc

SEQ ID NO: 262821 - DNA, 20 bp, Artificial
  CRISPR gRNA sequence
tgaaagtcttcccattttca

SEQ ID NO: 262822 - DNA, 20 bp, Artificial
  CRISPR gRNA sequence
tttaaggaaaatctcttcac

SEQ ID NO: 262823 - DNA, 20 bp, Artificial
  CRISPR gRNA sequence
agagcctgtgacttgcagca

SEQ ID NO: 262824 - DNA, 20 bp, Artificial
  CRISPR gRNA sequence
aagcacattaactgttcttg

SEQ ID NO: 262825 - DNA, 20 bp, Artificial
  CRISPR gRNA sequence
gattataggtaacaatataa

SEQ ID NO: 262826 - DNA, 20 bp, Artificial
  CRISPR gRNA sequence
aggtaacaatataaatagaa

SEQ ID NO: 262827 - DNA, 20 bp, Artificial
  CRISPR gRNA sequence
tattgtgctacatgtaactg

SEQ ID NO: 262828 - DNA, 20 bp, Artificial
  CRISPR gRNA sequence
aatcaatgagtactttctga

SEQ ID NO: 262829 - DNA, 20 bp, Artificial
  CRISPR gRNA sequence
agaagaaattttgatgtgtc

SEQ ID NO: 262830 - DNA, 20 bp, Artificial
  CRISPR gRNA sequence
gacagagctgtttcattcta

SEQ ID NO: 262831 - DNA, 20 bp, Artificial
  CRISPR gRNA sequence
caataccagtcatggggagc

SEQ ID NO: 262832 - DNA, 20 bp, Artificial
  CRISPR gRNA sequence
gaaaaggcacatagatttta

SEQ ID NO: 262833 - DNA, 20 bp, Artificial
  CRISPR gRNA sequence
gatgctgaagatgtctgagt

SEQ ID NO: 262834 - DNA, 20 bp, Artificial
  CRISPR gRNA sequence
ttcgaggaagccagttgggg

SEQ ID NO: 262835 - DNA, 20 bp, Artificial
  CRISPR gRNA sequence
tttcctctgatctcctaatg

SEQ ID NO: 262836 - DNA, 20 bp, Artificial
  CRISPR gRNA sequence
gtaattcagttaacggatca

SEQ ID NO: 262837 - DNA, 20 bp, Artificial
  CRISPR gRNA sequence
tgcctaaatcacatacctct

SEQ ID NO: 262838 - DNA, 20 bp, Artificial
  CRISPR gRNA sequence
acttcagaagcacttttaag

SEQ ID NO: 262839 - DNA, 20 bp, Artificial
  CRISPR gRNA sequence
aaactcttcatgtatcagat

SEQ ID NO: 262840 - DNA, 20 bp, Artificial
  CRISPR gRNA sequence
tcagatgaagaaaccgaggc

SEQ ID NO: 262841 - DNA, 20 bp, Artificial
  CRISPR gRNA sequence
cctaatcacatcccccacct

SEQ ID NO: 262842 - DNA, 20 bp, Artificial
  CRISPR gRNA sequence
gtttgaaaaaagagagggca

SEQ ID NO: 262843 - DNA, 20 bp, Artificial
  CRISPR gRNA sequence
tgcattgttgaggactcaag

SEQ ID NO: 262844 - DNA, 20 bp, Artificial
  CRISPR gRNA sequence
ttaacctcaggttcaccagt

SEQ ID NO: 262845 - DNA, 20 bp, Artificial
  CRISPR gRNA sequence
aatctccctccctatctcct

SEQ ID NO: 262846 - DNA, 20 bp, Artificial
  CRISPR gRNA sequence
ggagttcatagtctagtgga

SEQ ID NO: 262847 - DNA, 20 bp, Artificial
  CRISPR gRNA sequence
tcaatacacagtaataattt

SEQ ID NO: 262848 - DNA, 20 bp, Artificial
  CRISPR gRNA sequence
aatgaggtgattcagatatt

SEQ ID NO: 262849 - DNA, 20 bp, Artificial
  CRISPR gRNA sequence
aagataatgaagatgatgac

SEQ ID NO: 262850 - DNA, 20 bp, Artificial
  CRISPR gRNA sequence
tcagctcaactatgtactga

SEQ ID NO: 262851 - DNA, 20 bp, Artificial
  CRISPR gRNA sequence
ccataaataataaatttctt

SEQ ID NO: 262852 - DNA, 20 bp, Artificial
  CRISPR gRNA sequence
aaacaaaaatttaaccaaca

SEQ ID NO: 262853 - DNA, 20 bp, Artificial
  CRISPR gRNA sequence
catccagtcaatttctttta

SEQ ID NO: 262854 - DNA, 20 bp, Artificial
  CRISPR gRNA sequence
ctcagagcaacacttaactg

SEQ ID NO: 262855 - DNA, 20 bp, Artificial
  CRISPR gRNA sequence
tcctgctttccatgcctctc

SEQ ID NO: 262856 - DNA, 20 bp, Artificial
  CRISPR gRNA sequence
aagcgctaagggaaggcgct

SEQ ID NO: 262857 - DNA, 20 bp, Artificial
  CRISPR gRNA sequence
tgcacaattatccgagtcta

SEQ ID NO: 262858 - DNA, 20 bp, Artificial
  CRISPR gRNA sequence
tcaggttagacttaaccttt

SEQ ID NO: 262859 - DNA, 20 bp, Artificial
  CRISPR gRNA sequence
aggacagttacactttgacc

SEQ ID NO: 262860 - DNA, 20 bp, Artificial
  CRISPR gRNA sequence
tcttaatggaaggtgtgtac

SEQ ID NO: 262861 - DNA, 20 bp, Artificial
  CRISPR gRNA sequence
agaagctttgcactatttga

SEQ ID NO: 262862 - DNA, 20 bp, Artificial
  CRISPR gRNA sequence
gtatcaaatgctaaaagtta

SEQ ID NO: 262863 - DNA, 20 bp, Artificial
  CRISPR gRNA sequence
aaaagtaaatatatgtcaaa

SEQ ID NO: 262864 - DNA, 20 bp, Artificial
  CRISPR gRNA sequence
ccccttttaataaatgttct

SEQ ID NO: 262865 - DNA, 20 bp, Artificial
  CRISPR gRNA sequence
ataggtgtccacaaagcaca

SEQ ID NO: 262866 - DNA, 20 bp, Artificial
  CRISPR gRNA sequence
aataaatgttaaagattctt

SEQ ID NO: 262867 - DNA, 20 bp, Artificial
  CRISPR gRNA sequence
ggctatgtacacttaatgtt

SEQ ID NO: 262868 - DNA, 20 bp, Artificial
  CRISPR gRNA sequence
cagtctctgtactgccaaaa

SEQ ID NO: 262869 - DNA, 20 bp, Artificial
  CRISPR gRNA sequence
ctctgtactgccaaaataag

SEQ ID NO: 262870 - DNA, 20 bp, Artificial
  CRISPR gRNA sequence
atcatcgtcattgggaactt

SEQ ID NO: 262871 - DNA, 20 bp, Artificial
  CRISPR gRNA sequence
gaacttaaagaattttaatc

SEQ ID NO: 262872 - DNA, 20 bp, Artificial
  CRISPR gRNA sequence
atacattttggccgattgta

SEQ ID NO: 262873 - DNA, 20 bp, Artificial
  CRISPR gRNA sequence
tagcagcttctgtggtgact

SEQ ID NO: 262874 - DNA, 20 bp, Artificial
  CRISPR gRNA sequence
ctaagcctaagcttacctag

SEQ ID NO: 262875 - DNA, 20 bp, Artificial
  CRISPR gRNA sequence
ctttcttaaattaaaaaaaa

SEQ ID NO: 262876 - DNA, 20 bp, Artificial
  CRISPR gRNA sequence
cttaaattaaaaaaaaaaag

SEQ ID NO: 262877 - DNA, 20 bp, Artificial
  CRISPR gRNA sequence
aattaaaaaaaaaaagaaag

SEQ ID NO: 262878 - DNA, 20 bp, Artificial
  CRISPR gRNA sequence
aaaaaaaaaaagaaagaaag

SEQ ID NO: 262879 - DNA, 20 bp, Artificial
  CRISPR gRNA sequence
gacactatcaactaatagct

SEQ ID NO: 262880 - DNA, 20 bp, Artificial
  CRISPR gRNA sequence
tagctagagaaactaatagc

SEQ ID NO: 262881 - DNA, 20 bp, Artificial
  CRISPR gRNA sequence
taagatactatattgtagtc

SEQ ID NO: 262882 - DNA, 20 bp, Artificial
  CRISPR gRNA sequence
tgttcaaatttcacacattg

SEQ ID NO: 262883 - DNA, 20 bp, Artificial
  CRISPR gRNA sequence
gaagacctcaaaaaatattt

SEQ ID NO: 262884 - DNA, 20 bp, Artificial
  CRISPR gRNA sequence
acctcaaaaaatatttacag

SEQ ID NO: 262885 - DNA, 20 bp, Artificial
  CRISPR gRNA sequence
aagtaaaagtctaaagtcat

SEQ ID NO: 262886 - DNA, 20 bp, Artificial
  CRISPR gRNA sequence
tttgagttgccctattacag

SEQ ID NO: 262887 - DNA, 20 bp, Artificial
  CRISPR gRNA sequence
aaaaggcccccgcttggttc

SEQ ID NO: 262888 - DNA, 20 bp, Artificial
  CRISPR gRNA sequence
gcacaaattgtgtatattta

SEQ ID NO: 262889 - DNA, 20 bp, Artificial
  CRISPR gRNA sequence
aagggaagcctaccctgact

SEQ ID NO: 262890 - DNA, 20 bp, Artificial
  CRISPR gRNA sequence
gaagagtttttggtaagact

SEQ ID NO: 262891 - DNA, 20 bp, Artificial
  CRISPR gRNA sequence
tttacagtcttttccagtaa

SEQ ID NO: 262892 - DNA, 20 bp, Artificial
  CRISPR gRNA sequence
atcattccttttcacttctc

SEQ ID NO: 262893 - DNA, 20 bp, Artificial
  CRISPR gRNA sequence
acttctccaaaacttgggca

SEQ ID NO: 262894 - DNA, 20 bp, Artificial
  CRISPR gRNA sequence
aatgacagggtgttagcacc

SEQ ID NO: 262895 - DNA, 20 bp, Artificial
  CRISPR gRNA sequence
gggtgttagcaccaaaaacc

SEQ ID NO: 262896 - DNA, 20 bp, Artificial
  CRISPR gRNA sequence
caccaaaaacccaaaaccaa

SEQ ID NO: 262897 - DNA, 20 bp, Artificial
  CRISPR gRNA sequence
aggagagggcataactgtag

SEQ ID NO: 262898 - DNA, 20 bp, Artificial
  CRISPR gRNA sequence
taagaaaaagtggaggggga

SEQ ID NO: 262899 - DNA, 20 bp, Artificial
  CRISPR gRNA sequence
atactggtgaacctgaggtt

SEQ ID NO: 262900 - DNA, 20 bp, Artificial
  CRISPR gRNA sequence
ctcaaatttggttactagat

SEQ ID NO: 262901 - DNA, 20 bp, Artificial
  CRISPR gRNA sequence
tcctgttcaccatcagtctg

SEQ ID NO: 262902 - DNA, 20 bp, Artificial
  CRISPR gRNA sequence
tcatttgtccttgttcaaac

SEQ ID NO: 262903 - DNA, 20 bp, Artificial
  CRISPR gRNA sequence
aacctctttagattttgttt

SEQ ID NO: 262904 - DNA, 20 bp, Artificial
  CRISPR gRNA sequence
gattcaatgaaccatggatc

SEQ ID NO: 262905 - DNA, 20 bp, Artificial
  CRISPR gRNA sequence
tttcaagataacagtcaaca

SEQ ID NO: 262906 - DNA, 20 bp, Artificial
  CRISPR gRNA sequence
gtgctacgataaagaaaagg

SEQ ID NO: 262907 - DNA, 20 bp, Artificial
  CRISPR gRNA sequence
ttttctgtccatttatgatt

SEQ ID NO: 262908 - DNA, 20 bp, Artificial
  CRISPR gRNA sequence
caaagcactaaattcacctt

SEQ ID NO: 262909 - DNA, 20 bp, Artificial
  CRISPR gRNA sequence
tttcctcaaatggccttatc

SEQ ID NO: 262910 - DNA, 20 bp, Artificial
  CRISPR gRNA sequence
ggaagaatttgaatgtgcat

SEQ ID NO: 262911 - DNA, 20 bp, Artificial
  CRISPR gRNA sequence
ggaaacaaacaaaataaatc

SEQ ID NO: 262912 - DNA, 20 bp, Artificial
  CRISPR gRNA sequence
acaaaataaatcaaaaacaa

SEQ ID NO: 262913 - DNA, 20 bp, Artificial
  CRISPR gRNA sequence
gtttgaggaaatgaggttgg

SEQ ID NO: 262914 - DNA, 20 bp, Artificial
  CRISPR gRNA sequence
ttctgatttaattggccttg

SEQ ID NO: 262915 - DNA, 20 bp, Artificial
  CRISPR gRNA sequence
agacaatccacagaatgaga

SEQ ID NO: 262916 - DNA, 20 bp, Artificial
  CRISPR gRNA sequence
ggcaaatacctaagagagtt

SEQ ID NO: 262917 - DNA, 20 bp, Artificial
  CRISPR gRNA sequence
agccaaaaagtgatgaatag

SEQ ID NO: 262918 - DNA, 20 bp, Artificial
  CRISPR gRNA sequence
ttgaaacatggatgaaactt

SEQ ID NO: 262919 - DNA, 20 bp, Artificial
  CRISPR gRNA sequence
aatctctgaattttacactt

SEQ ID NO: 262920 - DNA, 20 bp, Artificial
  CRISPR gRNA sequence
tattatctaaaataaagaaa

SEQ ID NO: 262921 - DNA, 20 bp, Artificial
  CRISPR gRNA sequence
ctatgccatttccttcttac

SEQ ID NO: 262922 - DNA, 20 bp, Artificial
  CRISPR gRNA sequence
catttccttcttaccaaaac

SEQ ID NO: 262923 - DNA, 20 bp, Artificial
  CRISPR gRNA sequence
ccttcttaccaaaaccaaaa

SEQ ID NO: 262924 - DNA, 20 bp, Artificial
  CRISPR gRNA sequence
aaataattattaacataccc

SEQ ID NO: 262925 - DNA, 20 bp, Artificial
  CRISPR gRNA sequence
tattctctgaatttggtgca

SEQ ID NO: 262926 - DNA, 20 bp, Artificial
  CRISPR gRNA sequence
aaatattttaattcctttac

SEQ ID NO: 262927 - DNA, 20 bp, Artificial
  CRISPR gRNA sequence
aaaaacctgtatcacaactt

SEQ ID NO: 262928 - DNA, 20 bp, Artificial
  CRISPR gRNA sequence
acagagcaagactctgtctc

SEQ ID NO: 262929 - DNA, 20 bp, Artificial
  CRISPR gRNA sequence
ccatgtactgccttctgggt

SEQ ID NO: 262930 - DNA, 20 bp, Artificial
  CRISPR gRNA sequence
tcctacatcttctgccaaga

SEQ ID NO: 262931 - DNA, 20 bp, Artificial
  CRISPR gRNA sequence
cagcagcttcaggtttactc

SEQ ID NO: 262932 - DNA, 20 bp, Artificial
  CRISPR gRNA sequence
tggttttcaaatgcagtcct

SEQ ID NO: 262933 - DNA, 20 bp, Artificial
  CRISPR gRNA sequence
cacctaactttttcatagtc

SEQ ID NO: 262934 - DNA, 20 bp, Artificial
  CRISPR gRNA sequence
tgatgattttcttaaggctt

SEQ ID NO: 262935 - DNA, 20 bp, Artificial
  CRISPR gRNA sequence
tggctttcaactgtggtcgt

SEQ ID NO: 262936 - DNA, 20 bp, Artificial
  CRISPR gRNA sequence
tgcaatataattatgacaca

SEQ ID NO: 262937 - DNA, 20 bp, Artificial
  CRISPR gRNA sequence
agaggacactgctcattatt

SEQ ID NO: 262938 - DNA, 20 bp, Artificial
  CRISPR gRNA sequence
agtcaattcggttacccaat

SEQ ID NO: 262939 - DNA, 20 bp, Artificial
  CRISPR gRNA sequence
ttcctaaagaaatcttttta

SEQ ID NO: 262940 - DNA, 20 bp, Artificial
  CRISPR gRNA sequence
ttacagaaaggatgtagaac

SEQ ID NO: 262941 - DNA, 20 bp, Artificial
  CRISPR gRNA sequence
atgagaaacactggtaaaaa

SEQ ID NO: 262942 - DNA, 20 bp, Artificial
  CRISPR gRNA sequence
agtgacaagacaggtaggat

SEQ ID NO: 262943 - DNA, 20 bp, Artificial
  CRISPR gRNA sequence
agttgaagaagatgaggact

SEQ ID NO: 262944 - DNA, 20 bp, Artificial
  CRISPR gRNA sequence
caggcaggagtgtatggaaa

SEQ ID NO: 262945 - DNA, 20 bp, Artificial
  CRISPR gRNA sequence
tcctcttcggttaattatgg

SEQ ID NO: 262946 - DNA, 20 bp, Artificial
  CRISPR gRNA sequence
ttgactgagaagttagggta

SEQ ID NO: 262947 - DNA, 20 bp, Artificial
  CRISPR gRNA sequence
agggataggaagacatattt

SEQ ID NO: 262948 - DNA, 20 bp, Artificial
  CRISPR gRNA sequence
aagacatatttaaaaaccat

SEQ ID NO: 262949 - DNA, 20 bp, Artificial
  CRISPR gRNA sequence
tggtttagggctcagagctc

SEQ ID NO: 262950 - DNA, 20 bp, Artificial
  CRISPR gRNA sequence
tatgaaccaagaaatggttc

SEQ ID NO: 262951 - DNA, 20 bp, Artificial
  CRISPR gRNA sequence
tcagatatggtagttatgaa

SEQ ID NO: 262952 - DNA, 20 bp, Artificial
  CRISPR gRNA sequence
cgttaattcataaggccatg

SEQ ID NO: 262953 - DNA, 20 bp, Artificial
  CRISPR gRNA sequence
tcttggttcatactaatagt

SEQ ID NO: 262954 - DNA, 20 bp, Artificial
  CRISPR gRNA sequence
taggcctatttttccagtca

SEQ ID NO: 262955 - DNA, 20 bp, Artificial
  CRISPR gRNA sequence
tatttgccactgccatttca

SEQ ID NO: 262956 - DNA, 20 bp, Artificial
  CRISPR gRNA sequence
gaaccaagtctacgtgcctc

SEQ ID NO: 262957 - DNA, 20 bp, Artificial
  CRISPR gRNA sequence
tatgtatttctaaactaaag

SEQ ID NO: 262958 - DNA, 20 bp, Artificial
  CRISPR gRNA sequence
ctgtcaaatgacagagacac

SEQ ID NO: 262959 - DNA, 20 bp, Artificial
  CRISPR gRNA sequence
atttcttaacaaatgaccca

SEQ ID NO: 262960 - DNA, 20 bp, Artificial
  CRISPR gRNA sequence
aaatgacccagaaaacatct

SEQ ID NO: 262961 - DNA, 20 bp, Artificial
  CRISPR gRNA sequence
aagtgctaaagaaaggtttg

SEQ ID NO: 262962 - DNA, 20 bp, Artificial
  CRISPR gRNA sequence
taaactcaacatgtctaaaa

SEQ ID NO: 262963 - DNA, 20 bp, Artificial
  CRISPR gRNA sequence
ggagacatttagtgaagtct

SEQ ID NO: 262964 - DNA, 20 bp, Artificial
  CRISPR gRNA sequence
tctgtccccagatgagtgta

SEQ ID NO: 262965 - DNA, 20 bp, Artificial
  CRISPR gRNA sequence
ttttaaaaagatttctttag

SEQ ID NO: 262966 - DNA, 20 bp, Artificial
  CRISPR gRNA sequence
caggccctcaggaagttccg

SEQ ID NO: 262967 - DNA, 20 bp, Artificial
  CRISPR gRNA sequence
agggggtctgtaagacaaag

SEQ ID NO: 262968 - DNA, 20 bp, Artificial
  CRISPR gRNA sequence
aaacaaaaataaaatttttt

SEQ ID NO: 262969 - DNA, 20 bp, Artificial
  CRISPR gRNA sequence
aattagtagtactgccaagg

SEQ ID NO: 262970 - DNA, 20 bp, Artificial
  CRISPR gRNA sequence
ttgaaggttaaagtaattcc

SEQ ID NO: 262971 - DNA, 20 bp, Artificial
  CRISPR gRNA sequence
aaacaagaactaagaattct

SEQ ID NO: 262972 - DNA, 20 bp, Artificial
  CRISPR gRNA sequence
gtttatacatatatacgcat

SEQ ID NO: 262973 - DNA, 20 bp, Artificial
  CRISPR gRNA sequence
tggacaaaggtgtttccctg

SEQ ID NO: 262974 - DNA, 20 bp, Artificial
  CRISPR gRNA sequence
gtggattctactgtgtgatt

SEQ ID NO: 262975 - DNA, 20 bp, Artificial
  CRISPR gRNA sequence
ctaggcattggtatttcttt

SEQ ID NO: 262976 - DNA, 20 bp, Artificial
  CRISPR gRNA sequence
gctctgttccagcattgaag

SEQ ID NO: 262977 - DNA, 20 bp, Artificial
  CRISPR gRNA sequence
cattatgctaggattcagta

SEQ ID NO: 262978 - DNA, 20 bp, Artificial
  CRISPR gRNA sequence
gtaaagggaaaaatttttct

SEQ ID NO: 262979 - DNA, 20 bp, Artificial
  CRISPR gRNA sequence
cagttttcaggactgcattt

SEQ ID NO: 262980 - DNA, 20 bp, Artificial
  CRISPR gRNA sequence
atggtgagcaaagccagaac

SEQ ID NO: 262981 - DNA, 20 bp, Artificial
  CRISPR gRNA sequence
ctggccctcaagaatttttc

SEQ ID NO: 262982 - DNA, 20 bp, Artificial
  CRISPR gRNA sequence
gaaccagtggcctaacagag

SEQ ID NO: 262983 - DNA, 20 bp, Artificial
  CRISPR gRNA sequence
tagtgacacagtgatctgca

SEQ ID NO: 262984 - DNA, 20 bp, Artificial
  CRISPR gRNA sequence
attttgctggaaaagagctt

SEQ ID NO: 262985 - DNA, 20 bp, Artificial
  CRISPR gRNA sequence
caccccttgctctatgaagt

SEQ ID NO: 262986 - DNA, 20 bp, Artificial
  CRISPR gRNA sequence
ggggaagcttggttacaaaa

SEQ ID NO: 262987 - DNA, 20 bp, Artificial
  CRISPR gRNA sequence
tattagagtcttatcctgca

SEQ ID NO: 262988 - DNA, 20 bp, Artificial
  CRISPR gRNA sequence
tttaaatcataaatggacag

SEQ ID NO: 262989 - DNA, 20 bp, Artificial
  CRISPR gRNA sequence
ttgcctctaatgcacatata

SEQ ID NO: 262990 - DNA, 20 bp, Artificial
  CRISPR gRNA sequence
atcgtagcaccatagagaaa

SEQ ID NO: 262991 - DNA, 20 bp, Artificial
  CRISPR gRNA sequence
tcacatgttaggtaggaacc

SEQ ID NO: 262992 - DNA, 20 bp, Artificial
  CRISPR gRNA sequence
tgataagagaaagagaagta

SEQ ID NO: 262993 - DNA, 20 bp, Artificial
  CRISPR gRNA sequence
ctctgagctgcaatgaagat

SEQ ID NO: 262994 - DNA, 20 bp, Artificial
  CRISPR gRNA sequence
tctcattccagatcccaaat

SEQ ID NO: 262995 - DNA, 20 bp, Artificial
  CRISPR gRNA sequence
cttgacagaaagtatggttt

SEQ ID NO: 262996 - DNA, 20 bp, Artificial
  CRISPR gRNA sequence
tttgagagggaaaagttatc

SEQ ID NO: 262997 - DNA, 20 bp, Artificial
  CRISPR gRNA sequence
cagttaatattaaaattgct

SEQ ID NO: 262998 - DNA, 20 bp, Artificial
  CRISPR gRNA sequence
ggatgtgagtgctctgggac

SEQ ID NO: 262999 - DNA, 20 bp, Artificial
  CRISPR gRNA sequence
attcagttaacggatcaaaa

SEQ ID NO: 263000 - DNA, 20 bp, Artificial
  CRISPR gRNA sequence
aattatcctgatccctcatt

SEQ ID NO: 263001 - DNA, 20 bp, Artificial
  CRISPR gRNA sequence
tggaccttaacattgcatag

SEQ ID NO: 263002 - DNA, 20 bp, Artificial
  CRISPR gRNA sequence
aagcaaccatatccttgttc

SEQ ID NO: 263003 - DNA, 20 bp, Artificial
  CRISPR gRNA sequence
ctccctccctatctccttga

SEQ ID NO: 263004 - DNA, 20 bp, Artificial
  CRISPR gRNA sequence
gcaggttctcttccagcaat

SEQ ID NO: 263005 - DNA, 20 bp, Artificial
  CRISPR gRNA sequence
ctaacaccctgtcattggcc

SEQ ID NO: 263006 - DNA, 20 bp, Artificial
  CRISPR gRNA sequence
gagagccattcagtcagtca

SEQ ID NO: 263007 - DNA, 20 bp, Artificial
  CRISPR gRNA sequence
cttgctggatggttgcctta

SEQ ID NO: 263008 - DNA, 20 bp, Artificial
  CRISPR gRNA sequence
actagggcacggtagtagag

SEQ ID NO: 263009 - DNA, 20 bp, Artificial
  CRISPR gRNA sequence
tcaaatttacttgaaatgac

SEQ ID NO: 263010 - DNA, 20 bp, Artificial
  CRISPR gRNA sequence
cagtcaatttcttttaacag

SEQ ID NO: 263011 - DNA, 20 bp, Artificial
  CRISPR gRNA sequence
acaattatccgagtctagta

SEQ ID NO: 263012 - DNA, 20 bp, Artificial
  CRISPR gRNA sequence
agtaaatatatgtcaaagta

SEQ ID NO: 263013 - DNA, 20 bp, Artificial
  CRISPR gRNA sequence
cttttaataaatgttctaaa

SEQ ID NO: 263014 - DNA, 20 bp, Artificial
  CRISPR gRNA sequence
acaaagttttgagtcttacc

SEQ ID NO: 263015 - DNA, 20 bp, Artificial
  CRISPR gRNA sequence
cattttggccgattgtaaaa

SEQ ID NO: 263016 - DNA, 20 bp, Artificial
  CRISPR gRNA sequence
aacacattgccctattacag

SEQ ID NO: 263017 - DNA, 20 bp, Artificial
  CRISPR gRNA sequence
ccataagcccatcatgtagt

SEQ ID NO: 263018 - DNA, 20 bp, Artificial
  CRISPR gRNA sequence
tttttcagtgacaaaaaaaa

SEQ ID NO: 263019 - DNA, 20 bp, Artificial
  CRISPR gRNA sequence
ttcagtgacaaaaaaaaagt

SEQ ID NO: 263020 - DNA, 20 bp, Artificial
  CRISPR gRNA sequence
tcagtgacaaaaaaaaagtc

SEQ ID NO: 263021 - DNA, 20 bp, Artificial
  CRISPR gRNA sequence
cagtgacaaaaaaaaagtct

SEQ ID NO: 263022 - DNA, 20 bp, Artificial
  CRISPR gRNA sequence
agtgacaaaaaaaaagtctt

SEQ ID NO: 263023 - DNA, 20 bp, Artificial
  CRISPR gRNA sequence
taaaaatagaagtaaaagtc

SEQ ID NO: 263024 - DNA, 20 bp, Artificial
  CRISPR gRNA sequence
aaaaatagaagtaaaagtct

SEQ ID NO: 263025 - DNA, 20 bp, Artificial
  CRISPR gRNA sequence
aaaatagaagtaaaagtcta

SEQ ID NO: 263026 - DNA, 20 bp, Artificial
  CRISPR gRNA sequence
aagtcatcaaaacaacgtta

SEQ ID NO: 263027 - DNA, 20 bp, Artificial
  CRISPR gRNA sequence
tatcctgtgtgaaatgctgc

SEQ ID NO: 263028 - DNA, 20 bp, Artificial
  CRISPR gRNA sequence
tgtgaaatgctgcagtcagg

SEQ ID NO: 263029 - DNA, 20 bp, Artificial
  CRISPR gRNA sequence
cagtcaggatgccttgtggt

SEQ ID NO: 263030 - DNA, 20 bp, Artificial
  CRISPR gRNA sequence
gtggtttgagttgccctatt

SEQ ID NO: 263031 - DNA, 20 bp, Artificial
  CRISPR gRNA sequence
tggtttgagttgccctatta

SEQ ID NO: 263032 - DNA, 20 bp, Artificial
  CRISPR gRNA sequence
gagttgccctattacagcaa

SEQ ID NO: 263033 - DNA, 20 bp, Artificial
  CRISPR gRNA sequence
agttgccctattacagcaaa

SEQ ID NO: 263034 - DNA, 20 bp, Artificial
  CRISPR gRNA sequence
ccctattacagcaaaactac

SEQ ID NO: 263035 - DNA, 20 bp, Artificial
  CRISPR gRNA sequence
ttacagcaaaactacgggga

SEQ ID NO: 263036 - DNA, 20 bp, Artificial
  CRISPR gRNA sequence
cagcaaaactacggggatgg

SEQ ID NO: 263037 - DNA, 20 bp, Artificial
  CRISPR gRNA sequence
cggggatggtggcggtggtg

SEQ ID NO: 263038 - DNA, 20 bp, Artificial
  CRISPR gRNA sequence
tcaggccttggcaggtgcgt

SEQ ID NO: 263039 - DNA, 20 bp, Artificial
  CRISPR gRNA sequence
aggccttggcaggtgcgtct

SEQ ID NO: 263040 - DNA, 20 bp, Artificial
  CRISPR gRNA sequence
ggcaggtgcgtctttcagtt

SEQ ID NO: 263041 - DNA, 20 bp, Artificial
  CRISPR gRNA sequence
gcaggtgcgtctttcagttc

SEQ ID NO: 263042 - DNA, 20 bp, Artificial
  CRISPR gRNA sequence
tcagttcccctcacacttcg

SEQ ID NO: 263043 - DNA, 20 bp, Artificial
  CRISPR gRNA sequence
cagttcccctcacacttcgg

SEQ ID NO: 263044 - DNA, 20 bp, Artificial
  CRISPR gRNA sequence
agttcccctcacacttcggg

SEQ ID NO: 263045 - DNA, 20 bp, Artificial
  CRISPR gRNA sequence
ccctcacacttcgggttcct

SEQ ID NO: 263046 - DNA, 20 bp, Artificial
  CRISPR gRNA sequence
acacttcgggttcctcgggg

SEQ ID NO: 263047 - DNA, 20 bp, Artificial
  CRISPR gRNA sequence
cgggttcctcggggaggagg

SEQ ID NO: 263048 - DNA, 20 bp, Artificial
  CRISPR gRNA sequence
gggttcctcggggaggaggg

SEQ ID NO: 263049 - DNA, 20 bp, Artificial
  CRISPR gRNA sequence
ctcggggaggaggggctgga

SEQ ID NO: 263050 - DNA, 20 bp, Artificial
  CRISPR gRNA sequence
ggggaggaggggctggaacc

SEQ ID NO: 263051 - DNA, 20 bp, Artificial
  CRISPR gRNA sequence
gaaccctagcccatcgtcag

SEQ ID NO: 263052 - DNA, 20 bp, Artificial
  CRISPR gRNA sequence
gcccatcgtcaggacaaaga

SEQ ID NO: 263053 - DNA, 20 bp, Artificial
  CRISPR gRNA sequence
aggctgctcttggctctcaa

SEQ ID NO: 263054 - DNA, 20 bp, Artificial
  CRISPR gRNA sequence
ctcttggctctcaacttatt

SEQ ID NO: 263055 - DNA, 20 bp, Artificial
  CRISPR gRNA sequence
ttggctctcaacttattccc

SEQ ID NO: 263056 - DNA, 20 bp, Artificial
  CRISPR gRNA sequence
ggctctcaacttattccctt

SEQ ID NO: 263057 - DNA, 20 bp, Artificial
  CRISPR gRNA sequence
gctctcaacttattcccttc

SEQ ID NO: 263058 - DNA, 20 bp, Artificial
  CRISPR gRNA sequence
tcaacttattcccttcaatt

SEQ ID NO: 263059 - DNA, 20 bp, Artificial
  CRISPR gRNA sequence
aacttattcccttcaattca

SEQ ID NO: 263060 - DNA, 20 bp, Artificial
  CRISPR gRNA sequence
attcccttcaattcaagtaa

SEQ ID NO: 263061 - DNA, 20 bp, Artificial
  CRISPR gRNA sequence
ttcccttcaattcaagtaac

SEQ ID NO: 263062 - DNA, 20 bp, Artificial
  CRISPR gRNA sequence
ccttcaattcaagtaacagg

SEQ ID NO: 263063 - DNA, 20 bp, Artificial
  CRISPR gRNA sequence
caattcaagtaacaggtaaa

SEQ ID NO: 263064 - DNA, 20 bp, Artificial
  CRISPR gRNA sequence
aattcaagtaacaggtaaac

SEQ ID NO: 263065 - DNA, 20 bp, Artificial
  CRISPR gRNA sequence
aagtaacaggtaaacaatgt

SEQ ID NO: 263066 - DNA, 20 bp, Artificial
  CRISPR gRNA sequence
atgtctttctttctgtaaat

SEQ ID NO: 263067 - DNA, 20 bp, Artificial
  CRISPR gRNA sequence
tctttctgtaaatatttttt

SEQ ID NO: 263068 - DNA, 20 bp, Artificial
  CRISPR gRNA sequence
ctttctgtaaatattttttg

SEQ ID NO: 263069 - DNA, 20 bp, Artificial
  CRISPR gRNA sequence
tttctgtaaatattttttga

SEQ ID NO: 263070 - DNA, 20 bp, Artificial
  CRISPR gRNA sequence
tctgtaaatattttttgagg

SEQ ID NO: 263071 - DNA, 20 bp, Artificial
  CRISPR gRNA sequence
ctgtaaatattttttgaggt

SEQ ID NO: 263072 - DNA, 20 bp, Artificial
  CRISPR gRNA sequence
tgtaaatattttttgaggtc

SEQ ID NO: 263073 - DNA, 20 bp, Artificial
  CRISPR gRNA sequence
taaatattttttgaggtctt

SEQ ID NO: 263074 - DNA, 20 bp, Artificial
  CRISPR gRNA sequence
tttgaggtcttccaattggc

SEQ ID NO: 263075 - DNA, 20 bp, Artificial
  CRISPR gRNA sequence
ttgaggtcttccaattggct

SEQ ID NO: 263076 - DNA, 20 bp, Artificial
  CRISPR gRNA sequence
tgaggtcttccaattggctt

SEQ ID NO: 263077 - DNA, 20 bp, Artificial
  CRISPR gRNA sequence
gaggtcttccaattggctta

SEQ ID NO: 263078 - DNA, 20 bp, Artificial
  CRISPR gRNA sequence
aggtcttccaattggcttag

SEQ ID NO: 263079 - DNA, 20 bp, Artificial
  CRISPR gRNA sequence
ccaattggcttagtttattt

SEQ ID NO: 263080 - DNA, 20 bp, Artificial
  CRISPR gRNA sequence
caattggcttagtttatttt

SEQ ID NO: 263081 - DNA, 20 bp, Artificial
  CRISPR gRNA sequence
gcttagtttattttaaattt

SEQ ID NO: 263082 - DNA, 20 bp, Artificial
  CRISPR gRNA sequence
agtttattttaaatttctaa

SEQ ID NO: 263083 - DNA, 20 bp, Artificial
  CRISPR gRNA sequence
gtttattttaaatttctaac

SEQ ID NO: 263084 - DNA, 20 bp, Artificial
  CRISPR gRNA sequence
attttaaatttctaacaatg

SEQ ID NO: 263085 - DNA, 20 bp, Artificial
  CRISPR gRNA sequence
ttttaaatttctaacaatgt

SEQ ID NO: 263086 - DNA, 20 bp, Artificial
  CRISPR gRNA sequence
taaatttctaacaatgtgtg

SEQ ID NO: 263087 - DNA, 20 bp, Artificial
  CRISPR gRNA sequence
aaatttctaacaatgtgtga

SEQ ID NO: 263088 - DNA, 20 bp, Artificial
  CRISPR gRNA sequence
aatttctaacaatgtgtgaa

SEQ ID NO: 263089 - DNA, 20 bp, Artificial
  CRISPR gRNA sequence
ctaacaatgtgtgaaatttg

SEQ ID NO: 263090 - DNA, 20 bp, Artificial
  CRISPR gRNA sequence
taacaatgtgtgaaatttga

SEQ ID NO: 263091 - DNA, 20 bp, Artificial
  CRISPR gRNA sequence
acaatgtgtgaaatttgaac

SEQ ID NO: 263092 - DNA, 20 bp, Artificial
  CRISPR gRNA sequence
gaacatttgaagtgtagttt

SEQ ID NO: 263093 - DNA, 20 bp, Artificial
  CRISPR gRNA sequence
aacatttgaagtgtagtttt

SEQ ID NO: 263094 - DNA, 20 bp, Artificial
  CRISPR gRNA sequence
gaagtgtagttttgctgtaa

SEQ ID NO: 263095 - DNA, 20 bp, Artificial
  CRISPR gRNA sequence
aagtgtagttttgctgtaat

SEQ ID NO: 263096 - DNA, 20 bp, Artificial
  CRISPR gRNA sequence
tgctgtaatagggcaatgtg

SEQ ID NO: 263097 - DNA, 20 bp, Artificial
  CRISPR gRNA sequence
gctgtaatagggcaatgtgt

SEQ ID NO: 263098 - DNA, 20 bp, Artificial
  CRISPR gRNA sequence
ctgtaatagggcaatgtgtt

SEQ ID NO: 263099 - DNA, 20 bp, Artificial
  CRISPR gRNA sequence
taatagggcaatgtgttatt

SEQ ID NO: 263100 - DNA, 20 bp, Artificial
  CRISPR gRNA sequence
ttttgaaaatcattgattct

SEQ ID NO: 263101 - DNA, 20 bp, Artificial
  CRISPR gRNA sequence
tgaaaatcattgattctcag

SEQ ID NO: 263102 - DNA, 20 bp, Artificial
  CRISPR gRNA sequence
gaaaatcattgattctcaga

SEQ ID NO: 263103 - DNA, 20 bp, Artificial
  CRISPR gRNA sequence
aaaatcattgattctcagac

SEQ ID NO: 263104 - DNA, 20 bp, Artificial
  CRISPR gRNA sequence
attctcagactacaatatag

SEQ ID NO: 263105 - DNA, 20 bp, Artificial
  CRISPR gRNA sequence
tcagactacaatatagtatc

SEQ ID NO: 263106 - DNA, 20 bp, Artificial
  CRISPR gRNA sequence
agactacaatatagtatctt

SEQ ID NO: 263107 - DNA, 20 bp, Artificial
  CRISPR gRNA sequence
caatatagtatcttaacaaa

SEQ ID NO: 263108 - DNA, 20 bp, Artificial
  CRISPR gRNA sequence
aacaaaagtcccttggaaat

SEQ ID NO: 263109 - DNA, 20 bp, Artificial
  CRISPR gRNA sequence
acaaaagtcccttggaaata

SEQ ID NO: 263110 - DNA, 20 bp, Artificial
  CRISPR gRNA sequence
ggaaataaattttctaagct

SEQ ID NO: 263111 - DNA, 20 bp, Artificial
  CRISPR gRNA sequence
gaaataaattttctaagcta

SEQ ID NO: 263112 - DNA, 20 bp, Artificial
  CRISPR gRNA sequence
tctaagctattagtttctct

SEQ ID NO: 263113 - DNA, 20 bp, Artificial
  CRISPR gRNA sequence
ctaagctattagtttctcta

SEQ ID NO: 263114 - DNA, 20 bp, Artificial
  CRISPR gRNA sequence
taagctattagtttctctag

SEQ ID NO: 263115 - DNA, 20 bp, Artificial
  CRISPR gRNA sequence
agctattagtttctctagct

SEQ ID NO: 263116 - DNA, 20 bp, Artificial
  CRISPR gRNA sequence
ttagtttctctagctattag

SEQ ID NO: 263117 - DNA, 20 bp, Artificial
  CRISPR gRNA sequence
gtttctctagctattagttg

SEQ ID NO: 263118 - DNA, 20 bp, Artificial
  CRISPR gRNA sequence
ctctagctattagttgatag

SEQ ID NO: 263119 - DNA, 20 bp, Artificial
  CRISPR gRNA sequence
tctagctattagttgatagt

SEQ ID NO: 263120 - DNA, 20 bp, Artificial
  CRISPR gRNA sequence
tagctattagttgatagtgt

SEQ ID NO: 263121 - DNA, 20 bp, Artificial
  CRISPR gRNA sequence
gctattagttgatagtgtcc

SEQ ID NO: 263122 - DNA, 20 bp, Artificial
  CRISPR gRNA sequence
ttagttgatagtgtcccaag

SEQ ID NO: 263123 - DNA, 20 bp, Artificial
  CRISPR gRNA sequence
gttgatagtgtcccaagaat

SEQ ID NO: 263124 - DNA, 20 bp, Artificial
  CRISPR gRNA sequence
atagtgtcccaagaatttat

SEQ ID NO: 263125 - DNA, 20 bp, Artificial
  CRISPR gRNA sequence
attattattattattatttt

SEQ ID NO: 263126 - DNA, 20 bp, Artificial
  CRISPR gRNA sequence
ttattattattattatttta

SEQ ID NO: 263127 - DNA, 20 bp, Artificial
  CRISPR gRNA sequence
ttattattattattttaaat

SEQ ID NO: 263128 - DNA, 20 bp, Artificial
  CRISPR gRNA sequence
ttattattattttaaattga

SEQ ID NO: 263129 - DNA, 20 bp, Artificial
  CRISPR gRNA sequence
ttattattttaaattgagat

SEQ ID NO: 263130 - DNA, 20 bp, Artificial
  CRISPR gRNA sequence
ttattttaaattgagatggg

SEQ ID NO: 263131 - DNA, 20 bp, Artificial
  CRISPR gRNA sequence
ttttaaattgagatggggtt

SEQ ID NO: 263132 - DNA, 20 bp, Artificial
  CRISPR gRNA sequence
taaattgagatggggtttca

SEQ ID NO: 263133 - DNA, 20 bp, Artificial
  CRISPR gRNA sequence
aaattgagatggggtttcac

SEQ ID NO: 263134 - DNA, 20 bp, Artificial
  CRISPR gRNA sequence
aattgagatggggtttcact

SEQ ID NO: 263135 - DNA, 20 bp, Artificial
  CRISPR gRNA sequence
agatggggtttcactatgtt

SEQ ID NO: 263136 - DNA, 20 bp, Artificial
  CRISPR gRNA sequence
cactatgttgcccaggctgg

SEQ ID NO: 263137 - DNA, 20 bp, Artificial
  CRISPR gRNA sequence
actatgttgcccaggctggt

SEQ ID NO: 263138 - DNA, 20 bp, Artificial
  CRISPR gRNA sequence
tgttgcccaggctggtctca

SEQ ID NO: 263139 - DNA, 20 bp, Artificial
  CRISPR gRNA sequence
cccaggctggtctcaaactt

SEQ ID NO: 263140 - DNA, 20 bp, Artificial
  CRISPR gRNA sequence
gtctcaaacttctgagctca

SEQ ID NO: 263141 - DNA, 20 bp, Artificial
  CRISPR gRNA sequence
aaacttctgagctcaagcaa

SEQ ID NO: 263142 - DNA, 20 bp, Artificial
  CRISPR gRNA sequence
ctgagctcaagcaatccacc

SEQ ID NO: 263143 - DNA, 20 bp, Artificial
  CRISPR gRNA sequence
tgagctcaagcaatccacct

SEQ ID NO: 263144 - DNA, 20 bp, Artificial
  CRISPR gRNA sequence
agctcaagcaatccacctgc

SEQ ID NO: 263145 - DNA, 20 bp, Artificial
  CRISPR gRNA sequence
aagcaatccacctgcctctg

SEQ ID NO: 263146 - DNA, 20 bp, Artificial
  CRISPR gRNA sequence
cctctgcctcccaaagtgct

SEQ ID NO: 263147 - DNA, 20 bp, Artificial
  CRISPR gRNA sequence
tgcctcccaaagtgctaggg

SEQ ID NO: 263148 - DNA, 20 bp, Artificial
  CRISPR gRNA sequence
cctcccaaagtgctagggtt

SEQ ID NO: 263149 - DNA, 20 bp, Artificial
  CRISPR gRNA sequence
ccaaagtgctagggttacag

SEQ ID NO: 263150 - DNA, 20 bp, Artificial
  CRISPR gRNA sequence
gggttacaggcatgagctac

SEQ ID NO: 263151 - DNA, 20 bp, Artificial
  CRISPR gRNA sequence
caggcatgagctaccatgcc

SEQ ID NO: 263152 - DNA, 20 bp, Artificial
  CRISPR gRNA sequence
ccatgcccggccaataattt

SEQ ID NO: 263153 - DNA, 20 bp, Artificial
  CRISPR gRNA sequence
ttaatttatgtatcgtttct

SEQ ID NO: 263154 - DNA, 20 bp, Artificial
  CRISPR gRNA sequence
taatttatgtatcgtttctt

SEQ ID NO: 263155 - DNA, 20 bp, Artificial
  CRISPR gRNA sequence
aatttatgtatcgtttcttt

SEQ ID NO: 263156 - DNA, 20 bp, Artificial
  CRISPR gRNA sequence
atttatgtatcgtttctttc

SEQ ID NO: 263157 - DNA, 20 bp, Artificial
  CRISPR gRNA sequence
atgtatcgtttctttctttc

SEQ ID NO: 263158 - DNA, 20 bp, Artificial
  CRISPR gRNA sequence
tgtatcgtttctttctttct

SEQ ID NO: 263159 - DNA, 20 bp, Artificial
  CRISPR gRNA sequence
ctttctttctttcttttttt

SEQ ID NO: 263160 - DNA, 20 bp, Artificial
  CRISPR gRNA sequence
tttctttctttctttttttt

SEQ ID NO: 263161 - DNA, 20 bp, Artificial
  CRISPR gRNA sequence
tctttctttctttttttttt

SEQ ID NO: 263162 - DNA, 20 bp, Artificial
  CRISPR gRNA sequence
ctttctttcttttttttttt

SEQ ID NO: 263163 - DNA, 20 bp, Artificial
  CRISPR gRNA sequence
tttctttcttttttttttta

SEQ ID NO: 263164 - DNA, 20 bp, Artificial
  CRISPR gRNA sequence
tctttctttttttttttaat

SEQ ID NO: 263165 - DNA, 20 bp, Artificial
  CRISPR gRNA sequence
ctttctttttttttttaatt

SEQ ID NO: 263166 - DNA, 20 bp, Artificial
  CRISPR gRNA sequence
tttctttttttttttaattt

SEQ ID NO: 263167 - DNA, 20 bp, Artificial
  CRISPR gRNA sequence
tctttttttttttaatttaa

SEQ ID NO: 263168 - DNA, 20 bp, Artificial
  CRISPR gRNA sequence
ctttttttttttaatttaag

SEQ ID NO: 263169 - DNA, 20 bp, Artificial
  CRISPR gRNA sequence
tttttttttttaatttaaga

SEQ ID NO: 263170 - DNA, 20 bp, Artificial
  CRISPR gRNA sequence
tttttttttaatttaagaaa

SEQ ID NO: 263171 - DNA, 20 bp, Artificial
  CRISPR gRNA sequence
ttttttttaatttaagaaag

SEQ ID NO: 263172 - DNA, 20 bp, Artificial
  CRISPR gRNA sequence
tttttttaatttaagaaagc

SEQ ID NO: 263173 - DNA, 20 bp, Artificial
  CRISPR gRNA sequence
ttttttaatttaagaaagct

SEQ ID NO: 263174 - DNA, 20 bp, Artificial
  CRISPR gRNA sequence
tttttaatttaagaaagctg

SEQ ID NO: 263175 - DNA, 20 bp, Artificial
  CRISPR gRNA sequence
ttttaatttaagaaagctgc

SEQ ID NO: 263176 - DNA, 20 bp, Artificial
  CRISPR gRNA sequence
tttaatttaagaaagctgct

SEQ ID NO: 263177 - DNA, 20 bp, Artificial
  CRISPR gRNA sequence
ttaatttaagaaagctgctg

SEQ ID NO: 263178 - DNA, 20 bp, Artificial
  CRISPR gRNA sequence
taatttaagaaagctgctgt

SEQ ID NO: 263179 - DNA, 20 bp, Artificial
  CRISPR gRNA sequence
aatttaagaaagctgctgta

SEQ ID NO: 263180 - DNA, 20 bp, Artificial
  CRISPR gRNA sequence
atttaagaaagctgctgtaa

SEQ ID NO: 263181 - DNA, 20 bp, Artificial
  CRISPR gRNA sequence
aagaaagctgctgtaagtag

SEQ ID NO: 263182 - DNA, 20 bp, Artificial
  CRISPR gRNA sequence
agaaagctgctgtaagtaga

SEQ ID NO: 263183 - DNA, 20 bp, Artificial
  CRISPR gRNA sequence
ctgtaagtagattggctctg

SEQ ID NO: 263184 - DNA, 20 bp, Artificial
  CRISPR gRNA sequence
taagtagattggctctggaa

SEQ ID NO: 263185 - DNA, 20 bp, Artificial
  CRISPR gRNA sequence
gctctggaagctctgaattt

SEQ ID NO: 263186 - DNA, 20 bp, Artificial
  CRISPR gRNA sequence
tggaagctctgaatttaggt

SEQ ID NO: 263187 - DNA, 20 bp, Artificial
  CRISPR gRNA sequence
gaagctctgaatttaggttg

SEQ ID NO: 263188 - DNA, 20 bp, Artificial
  CRISPR gRNA sequence
tgaatttaggttgcctatgt

SEQ ID NO: 263189 - DNA, 20 bp, Artificial
  CRISPR gRNA sequence
aatttaggttgcctatgttc

SEQ ID NO: 263190 - DNA, 20 bp, Artificial
  CRISPR gRNA sequence
aggttgcctatgttcctaac

SEQ ID NO: 263191 - DNA, 20 bp, Artificial
  CRISPR gRNA sequence
ggttgcctatgttcctaaca

SEQ ID NO: 263192 - DNA, 20 bp, Artificial
  CRISPR gRNA sequence
cctatgttcctaacacaggt

SEQ ID NO: 263193 - DNA, 20 bp, Artificial
  CRISPR gRNA sequence
tgttcctaacacaggtccaa

SEQ ID NO: 263194 - DNA, 20 bp, Artificial
  CRISPR gRNA sequence
ctaacacaggtccaattctc

SEQ ID NO: 263195 - DNA, 20 bp, Artificial
  CRISPR gRNA sequence
acacaggtccaattctcact

SEQ ID NO: 263196 - DNA, 20 bp, Artificial
  CRISPR gRNA sequence
tcactaggtaagcttaggct

SEQ ID NO: 263197 - DNA, 20 bp, Artificial
  CRISPR gRNA sequence
actaggtaagcttaggctta

SEQ ID NO: 263198 - DNA, 20 bp, Artificial
  CRISPR gRNA sequence
ggtaagcttaggcttagcta

SEQ ID NO: 263199 - DNA, 20 bp, Artificial
  CRISPR gRNA sequence
aggcttagctattatttaaa

SEQ ID NO: 263200 - DNA, 20 bp, Artificial
  CRISPR gRNA sequence
ggcttagctattatttaaac

SEQ ID NO: 263201 - DNA, 20 bp, Artificial
  CRISPR gRNA sequence
agctattatttaaactctcc

SEQ ID NO: 263202 - DNA, 20 bp, Artificial
  CRISPR gRNA sequence
gctattatttaaactctcca

SEQ ID NO: 263203 - DNA, 20 bp, Artificial
  CRISPR gRNA sequence
ttatttaaactctccaaacc

SEQ ID NO: 263204 - DNA, 20 bp, Artificial
  CRISPR gRNA sequence
tttaaactctccaaacctca

SEQ ID NO: 263205 - DNA, 20 bp, Artificial
  CRISPR gRNA sequence
aaactctccaaacctcagtt

SEQ ID NO: 263206 - DNA, 20 bp, Artificial
  CRISPR gRNA sequence
aactctccaaacctcagttt

SEQ ID NO: 263207 - DNA, 20 bp, Artificial
  CRISPR gRNA sequence
tccaaacctcagtttcctta

SEQ ID NO: 263208 - DNA, 20 bp, Artificial
  CRISPR gRNA sequence
caaacctcagtttccttaac

SEQ ID NO: 263209 - DNA, 20 bp, Artificial
  CRISPR gRNA sequence
agtttccttaactgtaaagt

SEQ ID NO: 263210 - DNA, 20 bp, Artificial
  CRISPR gRNA sequence
ccttaactgtaaagtgggaa

SEQ ID NO: 263211 - DNA, 20 bp, Artificial
  CRISPR gRNA sequence
cttaactgtaaagtgggaat

SEQ ID NO: 263212 - DNA, 20 bp, Artificial
  CRISPR gRNA sequence
aactgtaaagtgggaataat

SEQ ID NO: 263213 - DNA, 20 bp, Artificial
  CRISPR gRNA sequence
actgtaaagtgggaataata

SEQ ID NO: 263214 - DNA, 20 bp, Artificial
  CRISPR gRNA sequence
taaagtgggaataataataa

SEQ ID NO: 263215 - DNA, 20 bp, Artificial
  CRISPR gRNA sequence
acctcaaggtcattgtgagg

SEQ ID NO: 263216 - DNA, 20 bp, Artificial
  CRISPR gRNA sequence
aaggtcattgtgaggtaaaa

SEQ ID NO: 263217 - DNA, 20 bp, Artificial
  CRISPR gRNA sequence
tgaggtaaaatgaaataatc

SEQ ID NO: 263218 - DNA, 20 bp, Artificial
  CRISPR gRNA sequence
agctcagtcaggcttcaaga

SEQ ID NO: 263219 - DNA, 20 bp, Artificial
  CRISPR gRNA sequence
gctcagtcaggcttcaagat

SEQ ID NO: 263220 - DNA, 20 bp, Artificial
  CRISPR gRNA sequence
agtcaggcttcaagataaat

SEQ ID NO: 263221 - DNA, 20 bp, Artificial
  CRISPR gRNA sequence
caagataaatgtgaactgta

SEQ ID NO: 263222 - DNA, 20 bp, Artificial
  CRISPR gRNA sequence
aagataaatgtgaactgtaa

SEQ ID NO: 263223 - DNA, 20 bp, Artificial
  CRISPR gRNA sequence
taattactctatctacctga

SEQ ID NO: 263224 - DNA, 20 bp, Artificial
  CRISPR gRNA sequence
ctctatctacctgaattgaa

SEQ ID NO: 263225 - DNA, 20 bp, Artificial
  CRISPR gRNA sequence
tatctacctgaattgaatga

SEQ ID NO: 263226 - DNA, 20 bp, Artificial
  CRISPR gRNA sequence
tctacctgaattgaatgagt

SEQ ID NO: 263227 - DNA, 20 bp, Artificial
  CRISPR gRNA sequence
cctgaattgaatgagttcca

SEQ ID NO: 263228 - DNA, 20 bp, Artificial
  CRISPR gRNA sequence
aattgaatgagttccaacat

SEQ ID NO: 263229 - DNA, 20 bp, Artificial
  CRISPR gRNA sequence
aatgagttccaacatgaatt

SEQ ID NO: 263230 - DNA, 20 bp, Artificial
  CRISPR gRNA sequence
caacatgaattctggagtca

SEQ ID NO: 263231 - DNA, 20 bp, Artificial
  CRISPR gRNA sequence
tggagtcaccacagaagctg

SEQ ID NO: 263232 - DNA, 20 bp, Artificial
  CRISPR gRNA sequence
gagtcaccacagaagctgct

SEQ ID NO: 263233 - DNA, 20 bp, Artificial
  CRISPR gRNA sequence
ctacaacaccaatattaata

SEQ ID NO: 263234 - DNA, 20 bp, Artificial
  CRISPR gRNA sequence
caacaccaatattaataaat

SEQ ID NO: 263235 - DNA, 20 bp, Artificial
  CRISPR gRNA sequence
ataaattagttttcttttac

SEQ ID NO: 263236 - DNA, 20 bp, Artificial
  CRISPR gRNA sequence
gttttcttttacaatcggcc

SEQ ID NO: 263237 - DNA, 20 bp, Artificial
  CRISPR gRNA sequence
tcttttacaatcggccaaaa

SEQ ID NO: 263238 - DNA, 20 bp, Artificial
  CRISPR gRNA sequence
cttttacaatcggccaaaat

SEQ ID NO: 263239 - DNA, 20 bp, Artificial
  CRISPR gRNA sequence
ttttacaatcggccaaaatg

SEQ ID NO: 263240 - DNA, 20 bp, Artificial
  CRISPR gRNA sequence
ttacaatcggccaaaatgta

SEQ ID NO: 263241 - DNA, 20 bp, Artificial
  CRISPR gRNA sequence
tacaatcggccaaaatgtat

SEQ ID NO: 263242 - DNA, 20 bp, Artificial
  CRISPR gRNA sequence
acaatcggccaaaatgtatt

SEQ ID NO: 263243 - DNA, 20 bp, Artificial
  CRISPR gRNA sequence
caatcggccaaaatgtattt

SEQ ID NO: 263244 - DNA, 20 bp, Artificial
  CRISPR gRNA sequence
tcttagattaaaattcttta

SEQ ID NO: 263245 - DNA, 20 bp, Artificial
  CRISPR gRNA sequence
cttagattaaaattctttaa

SEQ ID NO: 263246 - DNA, 20 bp, Artificial
  CRISPR gRNA sequence
ttagattaaaattctttaag

SEQ ID NO: 263247 - DNA, 20 bp, Artificial
  CRISPR gRNA sequence
agattaaaattctttaagtt

SEQ ID NO: 263248 - DNA, 20 bp, Artificial
  CRISPR gRNA sequence
gattaaaattctttaagttc

SEQ ID NO: 263249 - DNA, 20 bp, Artificial
  CRISPR gRNA sequence
aaattctttaagttcccaat

SEQ ID NO: 263250 - DNA, 20 bp, Artificial
  CRISPR gRNA sequence
tttaagttcccaatgacgat

SEQ ID NO: 263251 - DNA, 20 bp, Artificial
  CRISPR gRNA sequence
taagttcccaatgacgatga

SEQ ID NO: 263252 - DNA, 20 bp, Artificial
  CRISPR gRNA sequence
aagttcccaatgacgatgat

SEQ ID NO: 263253 - DNA, 20 bp, Artificial
  CRISPR gRNA sequence
agttcccaatgacgatgatg

SEQ ID NO: 263254 - DNA, 20 bp, Artificial
  CRISPR gRNA sequence
ccaatgacgatgatgaggag

SEQ ID NO: 263255 - DNA, 20 bp, Artificial
  CRISPR gRNA sequence
gcactttgagcagcacacag

SEQ ID NO: 263256 - DNA, 20 bp, Artificial
  CRISPR gRNA sequence
tgagcagcacacagttctcg

SEQ ID NO: 263257 - DNA, 20 bp, Artificial
  CRISPR gRNA sequence
gagcagcacacagttctcgt

SEQ ID NO: 263258 - DNA, 20 bp, Artificial
  CRISPR gRNA sequence
agcagcacacagttctcgta

SEQ ID NO: 263259 - DNA, 20 bp, Artificial
  CRISPR gRNA sequence
tcgtaactagaaggtaggta

SEQ ID NO: 263260 - DNA, 20 bp, Artificial
  CRISPR gRNA sequence
gtaactagaaggtaggtatt

SEQ ID NO: 263261 - DNA, 20 bp, Artificial
  CRISPR gRNA sequence
gaaggtaggtattacagtta

SEQ ID NO: 263262 - DNA, 20 bp, Artificial
  CRISPR gRNA sequence
cagttaacttcatttcagat

SEQ ID NO: 263263 - DNA, 20 bp, Artificial
  CRISPR gRNA sequence
acttcatttcagatgaagag

SEQ ID NO: 263264 - DNA, 20 bp, Artificial
  CRISPR gRNA sequence
catttcagatgaagagactg

SEQ ID NO: 263265 - DNA, 20 bp, Artificial
  CRISPR gRNA sequence
atttcagatgaagagactga

SEQ ID NO: 263266 - DNA, 20 bp, Artificial
  CRISPR gRNA sequence
cagatgaagagactgagggg

SEQ ID NO: 263267 - DNA, 20 bp, Artificial
  CRISPR gRNA sequence
agatgaagagactgaggggt

SEQ ID NO: 263268 - DNA, 20 bp, Artificial
  CRISPR gRNA sequence
aggggtaggcacattaaggg

SEQ ID NO: 263269 - DNA, 20 bp, Artificial
  CRISPR gRNA sequence
agggatttgcccaaggatgt

SEQ ID NO: 263270 - DNA, 20 bp, Artificial
  CRISPR gRNA sequence
gcccaaggatgtacaggtgg

SEQ ID NO: 263271 - DNA, 20 bp, Artificial
  CRISPR gRNA sequence
cccaaggatgtacaggtggc

SEQ ID NO: 263272 - DNA, 20 bp, Artificial
  CRISPR gRNA sequence
taggaggcagggtctgaacc

SEQ ID NO: 263273 - DNA, 20 bp, Artificial
  CRISPR gRNA sequence
aaccaccttagtctgactcc

SEQ ID NO: 263274 - DNA, 20 bp, Artificial
  CRISPR gRNA sequence
agtctgactccagtgccggt

SEQ ID NO: 263275 - DNA, 20 bp, Artificial
  CRISPR gRNA sequence
gtctgactccagtgccggtg

SEQ ID NO: 263276 - DNA, 20 bp, Artificial
  CRISPR gRNA sequence
actccagtgccggtgttgtt

SEQ ID NO: 263277 - DNA, 20 bp, Artificial
  CRISPR gRNA sequence
cagtgccggtgttgttgatt

SEQ ID NO: 263278 - DNA, 20 bp, Artificial
  CRISPR gRNA sequence
ttgattattatgctattcca

SEQ ID NO: 263279 - DNA, 20 bp, Artificial
  CRISPR gRNA sequence
attattatgctattccatct

SEQ ID NO: 263280 - DNA, 20 bp, Artificial
  CRISPR gRNA sequence
ttatgctattccatctaaca

SEQ ID NO: 263281 - DNA, 20 bp, Artificial
  CRISPR gRNA sequence
tgctattccatctaacatgg

SEQ ID NO: 263282 - DNA, 20 bp, Artificial
  CRISPR gRNA sequence
ttccatctaacatggtgtga

SEQ ID NO: 263283 - DNA, 20 bp, Artificial
  CRISPR gRNA sequence
catctaacatggtgtgattt

SEQ ID NO: 263284 - DNA, 20 bp, Artificial
  CRISPR gRNA sequence
acatggtgtgatttgtaatt

SEQ ID NO: 263285 - DNA, 20 bp, Artificial
  CRISPR gRNA sequence
gtaatttcatggactcaggt

SEQ ID NO: 263286 - DNA, 20 bp, Artificial
  CRISPR gRNA sequence
taatttcatggactcaggta

SEQ ID NO: 263287 - DNA, 20 bp, Artificial
  CRISPR gRNA sequence
catggactcaggtaaatcca

SEQ ID NO: 263288 - DNA, 20 bp, Artificial
  CRISPR gRNA sequence
atggactcaggtaaatccag

SEQ ID NO: 263289 - DNA, 20 bp, Artificial
  CRISPR gRNA sequence
aggtaaatccagggttaaat

SEQ ID NO: 263290 - DNA, 20 bp, Artificial
  CRISPR gRNA sequence
aattaacttcggaaaatcac

SEQ ID NO: 263291 - DNA, 20 bp, Artificial
  CRISPR gRNA sequence
acttcggaaaatcacaagca

SEQ ID NO: 263292 - DNA, 20 bp, Artificial
  CRISPR gRNA sequence
cggaaaatcacaagcacaat

SEQ ID NO: 263293 - DNA, 20 bp, Artificial
  CRISPR gRNA sequence
ggaaaatcacaagcacaatt

SEQ ID NO: 263294 - DNA, 20 bp, Artificial
  CRISPR gRNA sequence
ctaacagaaagaatttgtta

SEQ ID NO: 263295 - DNA, 20 bp, Artificial
  CRISPR gRNA sequence
acagaaagaatttgttactt

SEQ ID NO: 263296 - DNA, 20 bp, Artificial
  CRISPR gRNA sequence
gttacttgggtgggctggag

SEQ ID NO: 263297 - DNA, 20 bp, Artificial
  CRISPR gRNA sequence
ttacttgggtgggctggagt

SEQ ID NO: 263298 - DNA, 20 bp, Artificial
  CRISPR gRNA sequence
cttgggtgggctggagtaag

SEQ ID NO: 263299 - DNA, 20 bp, Artificial
  CRISPR gRNA sequence
gggtgggctggagtaagatg

SEQ ID NO: 263300 - DNA, 20 bp, Artificial
  CRISPR gRNA sequence
ggtgggctggagtaagatgc

SEQ ID NO: 263301 - DNA, 20 bp, Artificial
  CRISPR gRNA sequence
gagtaagatgctcattcaac

SEQ ID NO: 263302 - DNA, 20 bp, Artificial
  CRISPR gRNA sequence
attcaacgtgttctcagagt

SEQ ID NO: 263303 - DNA, 20 bp, Artificial
  CRISPR gRNA sequence
aacgtgttctcagagttaga

SEQ ID NO: 263304 - DNA, 20 bp, Artificial
  CRISPR gRNA sequence
tcagagttagaaaaaggccc

SEQ ID NO: 263305 - DNA, 20 bp, Artificial
  CRISPR gRNA sequence
agagttagaaaaaggccccc

SEQ ID NO: 263306 - DNA, 20 bp, Artificial
  CRISPR gRNA sequence
gaaaaaggcccccgcttggt

SEQ ID NO: 263307 - DNA, 20 bp, Artificial
  CRISPR gRNA sequence
ggttcaaaaactggactgat

SEQ ID NO: 263308 - DNA, 20 bp, Artificial
  CRISPR gRNA sequence
gttcaaaaactggactgata

SEQ ID NO: 263309 - DNA, 20 bp, Artificial
  CRISPR gRNA sequence
aaaaactggactgatagggg

SEQ ID NO: 263310 - DNA, 20 bp, Artificial
  CRISPR gRNA sequence
gactgataggggtcaacagt

SEQ ID NO: 263311 - DNA, 20 bp, Artificial
  CRISPR gRNA sequence
ataggggtcaacagtcatgc

SEQ ID NO: 263312 - DNA, 20 bp, Artificial
  CRISPR gRNA sequence
aaataaggacagttattttt

SEQ ID NO: 263313 - DNA, 20 bp, Artificial
  CRISPR gRNA sequence
aataaggacagttatttttc

SEQ ID NO: 263314 - DNA, 20 bp, Artificial
  CRISPR gRNA sequence
tttttccctgaaagatacat

SEQ ID NO: 263315 - DNA, 20 bp, Artificial
  CRISPR gRNA sequence
ttccctgaaagatacattga

SEQ ID NO: 263316 - DNA, 20 bp, Artificial
  CRISPR gRNA sequence
tccctgaaagatacattgaa

SEQ ID NO: 263317 - DNA, 20 bp, Artificial
  CRISPR gRNA sequence
ccctgaaagatacattgaaa

SEQ ID NO: 263318 - DNA, 20 bp, Artificial
  CRISPR gRNA sequence
cctgaaagatacattgaaaa

SEQ ID NO: 263319 - DNA, 20 bp, Artificial
  CRISPR gRNA sequence
aaagatacattgaaaagcca

SEQ ID NO: 263320 - DNA, 20 bp, Artificial
  CRISPR gRNA sequence
aaaagccagtatcctcaatt

SEQ ID NO: 263321 - DNA, 20 bp, Artificial
  CRISPR gRNA sequence
aattttctttcttattttgg

SEQ ID NO: 263322 - DNA, 20 bp, Artificial
  CRISPR gRNA sequence
tctttcttattttggcagta

SEQ ID NO: 263323 - DNA, 20 bp, Artificial
  CRISPR gRNA sequence
ctttcttattttggcagtac

SEQ ID NO: 263324 - DNA, 20 bp, Artificial
  CRISPR gRNA sequence
tttcttattttggcagtaca

SEQ ID NO: 263325 - DNA, 20 bp, Artificial
  CRISPR gRNA sequence
tcttattttggcagtacaga

SEQ ID NO: 263326 - DNA, 20 bp, Artificial
  CRISPR gRNA sequence
cttattttggcagtacagag

SEQ ID NO: 263327 - DNA, 20 bp, Artificial
  CRISPR gRNA sequence
ttattttggcagtacagaga

SEQ ID NO: 263328 - DNA, 20 bp, Artificial
  CRISPR gRNA sequence
attttggcagtacagagact

SEQ ID NO: 263329 - DNA, 20 bp, Artificial
  CRISPR gRNA sequence
ttttggcagtacagagactg

SEQ ID NO: 263330 - DNA, 20 bp, Artificial
  CRISPR gRNA sequence
tggcagtacagagactgcat

SEQ ID NO: 263331 - DNA, 20 bp, Artificial
  CRISPR gRNA sequence
ggcagtacagagactgcatt

SEQ ID NO: 263332 - DNA, 20 bp, Artificial
  CRISPR gRNA sequence
gcagtacagagactgcatta

SEQ ID NO: 263333 - DNA, 20 bp, Artificial
  CRISPR gRNA sequence
cattatttgttgttattctt

SEQ ID NO: 263334 - DNA, 20 bp, Artificial
  CRISPR gRNA sequence
tttgttgttattcttaaaca

SEQ ID NO: 263335 - DNA, 20 bp, Artificial
  CRISPR gRNA sequence
gttgttattcttaaacatta

SEQ ID NO: 263336 - DNA, 20 bp, Artificial
  CRISPR gRNA sequence
ttgttattcttaaacattaa

SEQ ID NO: 263337 - DNA, 20 bp, Artificial
  CRISPR gRNA sequence
ttattcttaaacattaagtg

SEQ ID NO: 263338 - DNA, 20 bp, Artificial
  CRISPR gRNA sequence
ttcttaaacattaagtgtac

SEQ ID NO: 263339 - DNA, 20 bp, Artificial
  CRISPR gRNA sequence
ttaaacattaagtgtacata

SEQ ID NO: 263340 - DNA, 20 bp, Artificial
  CRISPR gRNA sequence
aaacattaagtgtacatagc

SEQ ID NO: 263341 - DNA, 20 bp, Artificial
  CRISPR gRNA sequence
aacattaagtgtacatagcc

SEQ ID NO: 263342 - DNA, 20 bp, Artificial
  CRISPR gRNA sequence
agtgtacatagcccaaagag

SEQ ID NO: 263343 - DNA, 20 bp, Artificial
  CRISPR gRNA sequence
cccaatctgcagaggtacag

SEQ ID NO: 263344 - DNA, 20 bp, Artificial
  CRISPR gRNA sequence
ccaatctgcagaggtacagt

SEQ ID NO: 263345 - DNA, 20 bp, Artificial
  CRISPR gRNA sequence
cagaggtacagtagttgcat

SEQ ID NO: 263346 - DNA, 20 bp, Artificial
  CRISPR gRNA sequence
catatatacccgtttatttt

SEQ ID NO: 263347 - DNA, 20 bp, Artificial
  CRISPR gRNA sequence
attttatggtctgacgtacc

SEQ ID NO: 263348 - DNA, 20 bp, Artificial
  CRISPR gRNA sequence
ttttatggtctgacgtacca

SEQ ID NO: 263349 - DNA, 20 bp, Artificial
  CRISPR gRNA sequence
tatggtctgacgtaccagtg

SEQ ID NO: 263350 - DNA, 20 bp, Artificial
  CRISPR gRNA sequence
atggtctgacgtaccagtga

SEQ ID NO: 263351 - DNA, 20 bp, Artificial
  CRISPR gRNA sequence
tggtctgacgtaccagtgag

SEQ ID NO: 263352 - DNA, 20 bp, Artificial
  CRISPR gRNA sequence
acgtaccagtgagcacaaat

SEQ ID NO: 263353 - DNA, 20 bp, Artificial
  CRISPR gRNA sequence
tgtatatttataaaacgtgt

SEQ ID NO: 263354 - DNA, 20 bp, Artificial
  CRISPR gRNA sequence
ataaaacgtgttgatataat

SEQ ID NO: 263355 - DNA, 20 bp, Artificial
  CRISPR gRNA sequence
taaaacgtgttgatataatg

SEQ ID NO: 263356 - DNA, 20 bp, Artificial
  CRISPR gRNA sequence
atataatgaaagacatgagt

SEQ ID NO: 263357 - DNA, 20 bp, Artificial
  CRISPR gRNA sequence
gcaatgagatctggtaccaa

SEQ ID NO: 263358 - DNA, 20 bp, Artificial
  CRISPR gRNA sequence
gtaccaagcgtttacagcta

SEQ ID NO: 263359 - DNA, 20 bp, Artificial
  CRISPR gRNA sequence
acagctaccaaatatattct

SEQ ID NO: 263360 - DNA, 20 bp, Artificial
  CRISPR gRNA sequence
cagctaccaaatatattcta

SEQ ID NO: 263361 - DNA, 20 bp, Artificial
  CRISPR gRNA sequence
ccaaatatattctacaagaa

SEQ ID NO: 263362 - DNA, 20 bp, Artificial
  CRISPR gRNA sequence
tacaagaatctttaacattt

SEQ ID NO: 263363 - DNA, 20 bp, Artificial
  CRISPR gRNA sequence
caagaatctttaacatttat

SEQ ID NO: 263364 - DNA, 20 bp, Artificial
  CRISPR gRNA sequence
taacatttattttaaaaagg

SEQ ID NO: 263365 - DNA, 20 bp, Artificial
  CRISPR gRNA sequence
aacatttattttaaaaaggt

SEQ ID NO: 263366 - DNA, 20 bp, Artificial
  CRISPR gRNA sequence
acatttattttaaaaaggtc

SEQ ID NO: 263367 - DNA, 20 bp, Artificial
  CRISPR gRNA sequence
attttaaaaaggtcaaacct

SEQ ID NO: 263368 - DNA, 20 bp, Artificial
  CRISPR gRNA sequence
ttttaaaaaggtcaaacctt

SEQ ID NO: 263369 - DNA, 20 bp, Artificial
  CRISPR gRNA sequence
taaaaaggtcaaaccttatt

SEQ ID NO: 263370 - DNA, 20 bp, Artificial
  CRISPR gRNA sequence
aaaaaggtcaaaccttattt

SEQ ID NO: 263371 - DNA, 20 bp, Artificial
  CRISPR gRNA sequence
aaaaggtcaaaccttatttt

SEQ ID NO: 263372 - DNA, 20 bp, Artificial
  CRISPR gRNA sequence
atttttaagagatctctcaa

SEQ ID NO: 263373 - DNA, 20 bp, Artificial
  CRISPR gRNA sequence
tttttaagagatctctcaaa

SEQ ID NO: 263374 - DNA, 20 bp, Artificial
  CRISPR gRNA sequence
ttaagagatctctcaaactt

SEQ ID NO: 263375 - DNA, 20 bp, Artificial
  CRISPR gRNA sequence
taagagatctctcaaactta

SEQ ID NO: 263376 - DNA, 20 bp, Artificial
  CRISPR gRNA sequence
aagagatctctcaaacttaa

SEQ ID NO: 263377 - DNA, 20 bp, Artificial
  CRISPR gRNA sequence
agagatctctcaaacttaaa

SEQ ID NO: 263378 - DNA, 20 bp, Artificial
  CRISPR gRNA sequence
tcaaacttaaagaatattta

SEQ ID NO: 263379 - DNA, 20 bp, Artificial
  CRISPR gRNA sequence
aaacttaaagaatatttaaa

SEQ ID NO: 263380 - DNA, 20 bp, Artificial
  CRISPR gRNA sequence
aaagaatatttaaaattact

SEQ ID NO: 263381 - DNA, 20 bp, Artificial
  CRISPR gRNA sequence
aagaatatttaaaattactt

SEQ ID NO: 263382 - DNA, 20 bp, Artificial
  CRISPR gRNA sequence
aaaattacttaatttgttag

SEQ ID NO: 263383 - DNA, 20 bp, Artificial
  CRISPR gRNA sequence
aaattacttaatttgttaga

SEQ ID NO: 263384 - DNA, 20 bp, Artificial
  CRISPR gRNA sequence
cttaatttgttagacagtca

SEQ ID NO: 263385 - DNA, 20 bp, Artificial
  CRISPR gRNA sequence
aatttgttagacagtcaagg

SEQ ID NO: 263386 - DNA, 20 bp, Artificial
  CRISPR gRNA sequence
atttgttagacagtcaaggg

SEQ ID NO: 263387 - DNA, 20 bp, Artificial
  CRISPR gRNA sequence
gttagacagtcaagggaagc

SEQ ID NO: 263388 - DNA, 20 bp, Artificial
  CRISPR gRNA sequence
ttagacagtcaagggaagcc

SEQ ID NO: 263389 - DNA, 20 bp, Artificial
  CRISPR gRNA sequence
gacagtcaagggaagcctac

SEQ ID NO: 263390 - DNA, 20 bp, Artificial
  CRISPR gRNA sequence
ccctgactgaaaactattta

SEQ ID NO: 263391 - DNA, 20 bp, Artificial
  CRISPR gRNA sequence
actgaaaactatttaaaatt

SEQ ID NO: 263392 - DNA, 20 bp, Artificial
  CRISPR gRNA sequence
aaaactatttaaaattggta

SEQ ID NO: 263393 - DNA, 20 bp, Artificial
  CRISPR gRNA sequence
tttaaaattggtaattgtac

SEQ ID NO: 263394 - DNA, 20 bp, Artificial
  CRISPR gRNA sequence
aaaattggtaattgtacact

SEQ ID NO: 263395 - DNA, 20 bp, Artificial
  CRISPR gRNA sequence
aaattggtaattgtacacta

SEQ ID NO: 263396 - DNA, 20 bp, Artificial
  CRISPR gRNA sequence
gtaattgtacactaaatact

SEQ ID NO: 263397 - DNA, 20 bp, Artificial
  CRISPR gRNA sequence
tacactaaatacttttctga

SEQ ID NO: 263398 - DNA, 20 bp, Artificial
  CRISPR gRNA sequence
aatacttttctgatgtgctt

SEQ ID NO: 263399 - DNA, 20 bp, Artificial
  CRISPR gRNA sequence
ttctgatgtgctttgtggac

SEQ ID NO: 263400 - DNA, 20 bp, Artificial
  CRISPR gRNA sequence
tctgatgtgctttgtggaca

SEQ ID NO: 263401 - DNA, 20 bp, Artificial
  CRISPR gRNA sequence
ctgatgtgctttgtggacac

SEQ ID NO: 263402 - DNA, 20 bp, Artificial
  CRISPR gRNA sequence
tgatgtgctttgtggacacc

SEQ ID NO: 263403 - DNA, 20 bp, Artificial
  CRISPR gRNA sequence
atgtgctttgtggacaccta

SEQ ID NO: 263404 - DNA, 20 bp, Artificial
  CRISPR gRNA sequence
tgtggacacctatctgtcat

SEQ ID NO: 263405 - DNA, 20 bp, Artificial
  CRISPR gRNA sequence
gtggacacctatctgtcatc

SEQ ID NO: 263406 - DNA, 20 bp, Artificial
  CRISPR gRNA sequence
tggacacctatctgtcatca

SEQ ID NO: 263407 - DNA, 20 bp, Artificial
  CRISPR gRNA sequence
tctgtcatcaacttattcac

SEQ ID NO: 263408 - DNA, 20 bp, Artificial
  CRISPR gRNA sequence
tcatcaacttattcactctc

SEQ ID NO: 263409 - DNA, 20 bp, Artificial
  CRISPR gRNA sequence
attcactctcttttgaagag

SEQ ID NO: 263410 - DNA, 20 bp, Artificial
  CRISPR gRNA sequence
ttcactctcttttgaagagt

SEQ ID NO: 263411 - DNA, 20 bp, Artificial
  CRISPR gRNA sequence
actctcttttgaagagtttt

SEQ ID NO: 263412 - DNA, 20 bp, Artificial
  CRISPR gRNA sequence
tcttttgaagagtttttggt

SEQ ID NO: 263413 - DNA, 20 bp, Artificial
  CRISPR gRNA sequence
ttttgaagagtttttggtaa

SEQ ID NO: 263414 - DNA, 20 bp, Artificial
  CRISPR gRNA sequence
ttgaagagtttttggtaaga

SEQ ID NO: 263415 - DNA, 20 bp, Artificial
  CRISPR gRNA sequence
tgaagagtttttggtaagac

SEQ ID NO: 263416 - DNA, 20 bp, Artificial
  CRISPR gRNA sequence
gaagagtttttggtaagact

SEQ ID NO: 263417 - DNA, 20 bp, Artificial
  CRISPR gRNA sequence
aagagtttttggtaagactc

SEQ ID NO: 263418 - DNA, 20 bp, Artificial
  CRISPR gRNA sequence
ttggtaagactcaaaacttt

SEQ ID NO: 263419 - DNA, 20 bp, Artificial
  CRISPR gRNA sequence
tggtaagactcaaaactttg

SEQ ID NO: 263420 - DNA, 20 bp, Artificial
  CRISPR gRNA sequence
ggtaagactcaaaactttgt

SEQ ID NO: 263421 - DNA, 20 bp, Artificial
  CRISPR gRNA sequence
gtaagactcaaaactttgta

SEQ ID NO: 263422 - DNA, 20 bp, Artificial
  CRISPR gRNA sequence
aaaactttgtatgttttctt

SEQ ID NO: 263423 - DNA, 20 bp, Artificial
  CRISPR gRNA sequence
tgtatgttttctttagaaca

SEQ ID NO: 263424 - DNA, 20 bp, Artificial
  CRISPR gRNA sequence
gtatgttttctttagaacat

SEQ ID NO: 263425 - DNA, 20 bp, Artificial
  CRISPR gRNA sequence
tatgttttctttagaacatt

SEQ ID NO: 263426 - DNA, 20 bp, Artificial
  CRISPR gRNA sequence
tctttagaacatttattaaa

SEQ ID NO: 263427 - DNA, 20 bp, Artificial
  CRISPR gRNA sequence
ctttagaacatttattaaaa

SEQ ID NO: 263428 - DNA, 20 bp, Artificial
  CRISPR gRNA sequence
tttagaacatttattaaaag

SEQ ID NO: 263429 - DNA, 20 bp, Artificial
  CRISPR gRNA sequence
tagaacatttattaaaaggg

SEQ ID NO: 263430 - DNA, 20 bp, Artificial
  CRISPR gRNA sequence
agaacatttattaaaagggg

SEQ ID NO: 263431 - DNA, 20 bp, Artificial
  CRISPR gRNA sequence
gaacatttattaaaagggga

SEQ ID NO: 263432 - DNA, 20 bp, Artificial
  CRISPR gRNA sequence
attaaaaggggactagctag

SEQ ID NO: 263433 - DNA, 20 bp, Artificial
  CRISPR gRNA sequence
ttaaaaggggactagctaga

SEQ ID NO: 263434 - DNA, 20 bp, Artificial
  CRISPR gRNA sequence
aaaggggactagctagataa

SEQ ID NO: 263435 - DNA, 20 bp, Artificial
  CRISPR gRNA sequence
gctagataagtggttggaga

SEQ ID NO: 263436 - DNA, 20 bp, Artificial
  CRISPR gRNA sequence
gataagtggttggagagttc

SEQ ID NO: 263437 - DNA, 20 bp, Artificial
  CRISPR gRNA sequence
gagagttcacacacataggg

SEQ ID NO: 263438 - DNA, 20 bp, Artificial
  CRISPR gRNA sequence
acacacatagggcctttgtt

SEQ ID NO: 263439 - DNA, 20 bp, Artificial
  CRISPR gRNA sequence
tgttttctactttgacatat

SEQ ID NO: 263440 - DNA, 20 bp, Artificial
  CRISPR gRNA sequence
gttttctactttgacatata

SEQ ID NO: 263441 - DNA, 20 bp, Artificial
  CRISPR gRNA sequence
ttttctactttgacatatat

SEQ ID NO: 263442 - DNA, 20 bp, Artificial
  CRISPR gRNA sequence
tctactttgacatatattta

SEQ ID NO: 263443 - DNA, 20 bp, Artificial
  CRISPR gRNA sequence
ctactttgacatatatttac

SEQ ID NO: 263444 - DNA, 20 bp, Artificial
  CRISPR gRNA sequence
tactttgacatatatttact

SEQ ID NO: 263445 - DNA, 20 bp, Artificial
  CRISPR gRNA sequence
ctttgacatatatttacttt

SEQ ID NO: 263446 - DNA, 20 bp, Artificial
  CRISPR gRNA sequence
tgacatatatttacttttca

SEQ ID NO: 263447 - DNA, 20 bp, Artificial
  CRISPR gRNA sequence
gacatatatttacttttcaa

SEQ ID NO: 263448 - DNA, 20 bp, Artificial
  CRISPR gRNA sequence
acatatatttacttttcaaa

SEQ ID NO: 263449 - DNA, 20 bp, Artificial
  CRISPR gRNA sequence
acttttcaaatgccaattca

SEQ ID NO: 263450 - DNA, 20 bp, Artificial
  CRISPR gRNA sequence
cttttcaaatgccaattcac

SEQ ID NO: 263451 - DNA, 20 bp, Artificial
  CRISPR gRNA sequence
ttcaaatgccaattcacttt

SEQ ID NO: 263452 - DNA, 20 bp, Artificial
  CRISPR gRNA sequence
tcaaatgccaattcactttt

SEQ ID NO: 263453 - DNA, 20 bp, Artificial
  CRISPR gRNA sequence
caaatgccaattcacttttc

SEQ ID NO: 263454 - DNA, 20 bp, Artificial
  CRISPR gRNA sequence
aaatgccaattcacttttct

SEQ ID NO: 263455 - DNA, 20 bp, Artificial
  CRISPR gRNA sequence
acttttctagtaacttttag

SEQ ID NO: 263456 - DNA, 20 bp, Artificial
  CRISPR gRNA sequence
ttctagtaacttttagcatt

SEQ ID NO: 263457 - DNA, 20 bp, Artificial
  CRISPR gRNA sequence
tctagtaacttttagcattt

SEQ ID NO: 263458 - DNA, 20 bp, Artificial
  CRISPR gRNA sequence
ctagtaacttttagcatttg

SEQ ID NO: 263459 - DNA, 20 bp, Artificial
  CRISPR gRNA sequence
tagtaacttttagcatttga

SEQ ID NO: 263460 - DNA, 20 bp, Artificial
  CRISPR gRNA sequence
gtaacttttagcatttgata

SEQ ID NO: 263461 - DNA, 20 bp, Artificial
  CRISPR gRNA sequence
ttagcatttgatactgagtg

SEQ ID NO: 263462 - DNA, 20 bp, Artificial
  CRISPR gRNA sequence
tagcatttgatactgagtgg

SEQ ID NO: 263463 - DNA, 20 bp, Artificial
  CRISPR gRNA sequence
agcatttgatactgagtggc

SEQ ID NO: 263464 - DNA, 20 bp, Artificial
  CRISPR gRNA sequence
gcatttgatactgagtggct

SEQ ID NO: 263465 - DNA, 20 bp, Artificial
  CRISPR gRNA sequence
gatactgagtggctatctaa

SEQ ID NO: 263466 - DNA, 20 bp, Artificial
  CRISPR gRNA sequence
atactgagtggctatctaat

SEQ ID NO: 263467 - DNA, 20 bp, Artificial
  CRISPR gRNA sequence
agtggctatctaatgaagaa

SEQ ID NO: 263468 - DNA, 20 bp, Artificial
  CRISPR gRNA sequence
tctaatgaagaaggaaagag

SEQ ID NO: 263469 - DNA, 20 bp, Artificial
  CRISPR gRNA sequence
atgaagaaggaaagagatgg

SEQ ID NO: 263470 - DNA, 20 bp, Artificial
  CRISPR gRNA sequence
ttacagtcttttccagtaag

SEQ ID NO: 263471 - DNA, 20 bp, Artificial
  CRISPR gRNA sequence
tacagtcttttccagtaaga

SEQ ID NO: 263472 - DNA, 20 bp, Artificial
  CRISPR gRNA sequence
acagtcttttccagtaagaa

SEQ ID NO: 263473 - DNA, 20 bp, Artificial
  CRISPR gRNA sequence
cagtcttttccagtaagaaa

SEQ ID NO: 263474 - DNA, 20 bp, Artificial
  CRISPR gRNA sequence
ttccagtaagaaaacttacg

SEQ ID NO: 263475 - DNA, 20 bp, Artificial
  CRISPR gRNA sequence
tccagtaagaaaacttacga

SEQ ID NO: 263476 - DNA, 20 bp, Artificial
  CRISPR gRNA sequence
ccagtaagaaaacttacgag

SEQ ID NO: 263477 - DNA, 20 bp, Artificial
  CRISPR gRNA sequence
cagtaagaaaacttacgagc

SEQ ID NO: 263478 - DNA, 20 bp, Artificial
  CRISPR gRNA sequence
acgagcaagaaaagaatgac

SEQ ID NO: 263479 - DNA, 20 bp, Artificial
  CRISPR gRNA sequence
cgagcaagaaaagaatgacc

SEQ ID NO: 263480 - DNA, 20 bp, Artificial
  CRISPR gRNA sequence
ggcctggtgtggtggctcac

SEQ ID NO: 263481 - DNA, 20 bp, Artificial
  CRISPR gRNA sequence
gcctggtgtggtggctcacg

SEQ ID NO: 263482 - DNA, 20 bp, Artificial
  CRISPR gRNA sequence
gtgtggtggctcacgcctgt

SEQ ID NO: 263483 - DNA, 20 bp, Artificial
  CRISPR gRNA sequence
acgcctgtaatcgtgggacg

SEQ ID NO: 263484 - DNA, 20 bp, Artificial
  CRISPR gRNA sequence
taatcgtgggacgctgaggc

SEQ ID NO: 263485 - DNA, 20 bp, Artificial
  CRISPR gRNA sequence
aggcgggtggatcacttgag

SEQ ID NO: 263486 - DNA, 20 bp, Artificial
  CRISPR gRNA sequence
gaggtcaggagttggagacc

SEQ ID NO: 263487 - DNA, 20 bp, Artificial
  CRISPR gRNA sequence
aggtcaggagttggagaccc

SEQ ID NO: 263488 - DNA, 20 bp, Artificial
  CRISPR gRNA sequence
gagacccgtcgggctaacat

SEQ ID NO: 263489 - DNA, 20 bp, Artificial
  CRISPR gRNA sequence
acatggtgaaatcccatctc

SEQ ID NO: 263490 - DNA, 20 bp, Artificial
  CRISPR gRNA sequence
tactaaaaatacaaaaaaat

SEQ ID NO: 263491 - DNA, 20 bp, Artificial
  CRISPR gRNA sequence
ctaaaaatacaaaaaaatta

SEQ ID NO: 263492 - DNA, 20 bp, Artificial
  CRISPR gRNA sequence
aaaatacaaaaaaattagca

SEQ ID NO: 263493 - DNA, 20 bp, Artificial
  CRISPR gRNA sequence
gcagggtgtggtggcatgcg

SEQ ID NO: 263494 - DNA, 20 bp, Artificial
  CRISPR gRNA sequence
taatcccagctacttgtgag

SEQ ID NO: 263495 - DNA, 20 bp, Artificial
  CRISPR gRNA sequence
cttgtgaggcttaggcagga

SEQ ID NO: 263496 - DNA, 20 bp, Artificial
  CRISPR gRNA sequence
gtgaggcttaggcaggagaa

SEQ ID NO: 263497 - DNA, 20 bp, Artificial
  CRISPR gRNA sequence
tgaggcttaggcaggagaat

SEQ ID NO: 263498 - DNA, 20 bp, Artificial
  CRISPR gRNA sequence
aggcaggagaattgcttaaa

SEQ ID NO: 263499 - DNA, 20 bp, Artificial
  CRISPR gRNA sequence
ggcaggagaattgcttaaac

SEQ ID NO: 263500 - DNA, 20 bp, Artificial
  CRISPR gRNA sequence
cttaaacccgggacgcggag

SEQ ID NO: 263501 - DNA, 20 bp, Artificial
  CRISPR gRNA sequence
aaacccgggacgcggaggtt

SEQ ID NO: 263502 - DNA, 20 bp, Artificial
  CRISPR gRNA sequence
aacccgggacgcggaggttg

SEQ ID NO: 263503 - DNA, 20 bp, Artificial
  CRISPR gRNA sequence
ctgtgaacttagattgcacc

SEQ ID NO: 263504 - DNA, 20 bp, Artificial
  CRISPR gRNA sequence
tgaacttagattgcacccct

SEQ ID NO: 263505 - DNA, 20 bp, Artificial
  CRISPR gRNA sequence
agattgcacccctgcactcc

SEQ ID NO: 263506 - DNA, 20 bp, Artificial
  CRISPR gRNA sequence
gattgcacccctgcactcca

SEQ ID NO: 263507 - DNA, 20 bp, Artificial
  CRISPR gRNA sequence
cacccctgcactccagcctg

SEQ ID NO: 263508 - DNA, 20 bp, Artificial
  CRISPR gRNA sequence
cactccagcctgggaaacag

SEQ ID NO: 263509 - DNA, 20 bp, Artificial
  CRISPR gRNA sequence
cagcctgggaaacagtctca

SEQ ID NO: 263510 - DNA, 20 bp, Artificial
  CRISPR gRNA sequence
ggaaacagtctcaaaaaaaa

SEQ ID NO: 263511 - DNA, 20 bp, Artificial
  CRISPR gRNA sequence
aaaaaaaaaaaaaaattatg

SEQ ID NO: 263512 - DNA, 20 bp, Artificial
  CRISPR gRNA sequence
tgctgcattctaatcaaata

SEQ ID NO: 263513 - DNA, 20 bp, Artificial
  CRISPR gRNA sequence
cattctaatcaaatagtgca

SEQ ID NO: 263514 - DNA, 20 bp, Artificial
  CRISPR gRNA sequence
taatcaaatagtgcaaagct

SEQ ID NO: 263515 - DNA, 20 bp, Artificial
  CRISPR gRNA sequence
atcaaatagtgcaaagcttc

SEQ ID NO: 263516 - DNA, 20 bp, Artificial
  CRISPR gRNA sequence
cttgtgtgctttgcctttct

SEQ ID NO: 263517 - DNA, 20 bp, Artificial
  CRISPR gRNA sequence
ttgtgtgctttgcctttctc

SEQ ID NO: 263518 - DNA, 20 bp, Artificial
  CRISPR gRNA sequence
gtgtgctttgcctttctctg

SEQ ID NO: 263519 - DNA, 20 bp, Artificial
  CRISPR gRNA sequence
tgtgctttgcctttctctgt

SEQ ID NO: 263520 - DNA, 20 bp, Artificial
  CRISPR gRNA sequence
tgcctttctctgtacacacc

SEQ ID NO: 263521 - DNA, 20 bp, Artificial
  CRISPR gRNA sequence
gcctttctctgtacacacct

SEQ ID NO: 263522 - DNA, 20 bp, Artificial
  CRISPR gRNA sequence
cctttctctgtacacacctt

SEQ ID NO: 263523 - DNA, 20 bp, Artificial
  CRISPR gRNA sequence
tctctgtacacaccttccat

SEQ ID NO: 263524 - DNA, 20 bp, Artificial
  CRISPR gRNA sequence
ctctgtacacaccttccatt

SEQ ID NO: 263525 - DNA, 20 bp, Artificial
  CRISPR gRNA sequence
tctgtacacaccttccatta

SEQ ID NO: 263526 - DNA, 20 bp, Artificial
  CRISPR gRNA sequence
tgtacacaccttccattaag

SEQ ID NO: 263527 - DNA, 20 bp, Artificial
  CRISPR gRNA sequence
tacacaccttccattaagaa

SEQ ID NO: 263528 - DNA, 20 bp, Artificial
  CRISPR gRNA sequence
ccattaagaaattatagata

SEQ ID NO: 263529 - DNA, 20 bp, Artificial
  CRISPR gRNA sequence
cattaagaaattatagatag

SEQ ID NO: 263530 - DNA, 20 bp, Artificial
  CRISPR gRNA sequence
agaaattatagatagggaaa

SEQ ID NO: 263531 - DNA, 20 bp, Artificial
  CRISPR gRNA sequence
tagatagggaaattctctgg

SEQ ID NO: 263532 - DNA, 20 bp, Artificial
  CRISPR gRNA sequence
tctggtcaaagtgtaactgt

SEQ ID NO: 263533 - DNA, 20 bp, Artificial
  CRISPR gRNA sequence
tggtcaaagtgtaactgtcc

SEQ ID NO: 263534 - DNA, 20 bp, Artificial
  CRISPR gRNA sequence
gtcaaagtgtaactgtcctt

SEQ ID NO: 263535 - DNA, 20 bp, Artificial
  CRISPR gRNA sequence
tccttcctaggtctgagaaa

SEQ ID NO: 263536 - DNA, 20 bp, Artificial
  CRISPR gRNA sequence
cctaggtctgagaaaccact

SEQ ID NO: 263537 - DNA, 20 bp, Artificial
  CRISPR gRNA sequence
ctaggtctgagaaaccactg

SEQ ID NO: 263538 - DNA, 20 bp, Artificial
  CRISPR gRNA sequence
ggtctgagaaaccactgtta

SEQ ID NO: 263539 - DNA, 20 bp, Artificial
  CRISPR gRNA sequence
agaaaccactgttatgcctg

SEQ ID NO: 263540 - DNA, 20 bp, Artificial
  CRISPR gRNA sequence
ttatgcctgtgttgagatgt

SEQ ID NO: 263541 - DNA, 20 bp, Artificial
  CRISPR gRNA sequence
tgcctgtgttgagatgtgta

SEQ ID NO: 263542 - DNA, 20 bp, Artificial
  CRISPR gRNA sequence
tgttgagatgtgtatctgtg

SEQ ID NO: 263543 - DNA, 20 bp, Artificial
  CRISPR gRNA sequence
agatgtgtatctgtgtgcgt

SEQ ID NO: 263544 - DNA, 20 bp, Artificial
  CRISPR gRNA sequence
tgtgcgtgcatgtgtgtgta

SEQ ID NO: 263545 - DNA, 20 bp, Artificial
  CRISPR gRNA sequence
ttttttccattaatttaata

SEQ ID NO: 263546 - DNA, 20 bp, Artificial
  CRISPR gRNA sequence
ttttccattaatttaataat

SEQ ID NO: 263547 - DNA, 20 bp, Artificial
  CRISPR gRNA sequence
tttccattaatttaataatg

SEQ ID NO: 263548 - DNA, 20 bp, Artificial
  CRISPR gRNA sequence
ttccattaatttaataatgt

SEQ ID NO: 263549 - DNA, 20 bp, Artificial
  CRISPR gRNA sequence
tccattaatttaataatgtg

SEQ ID NO: 263550 - DNA, 20 bp, Artificial
  CRISPR gRNA sequence
ccattaatttaataatgtgt

SEQ ID NO: 263551 - DNA, 20 bp, Artificial
  CRISPR gRNA sequence
cattaatttaataatgtgtg

SEQ ID NO: 263552 - DNA, 20 bp, Artificial
  CRISPR gRNA sequence
atttaataatgtgtgtgtat

SEQ ID NO: 263553 - DNA, 20 bp, Artificial
  CRISPR gRNA sequence
aataatgtgtgtgtatgtat

SEQ ID NO: 263554 - DNA, 20 bp, Artificial
  CRISPR gRNA sequence
ataatgtgtgtgtatgtatg

SEQ ID NO: 263555 - DNA, 20 bp, Artificial
  CRISPR gRNA sequence
ttttttccattaatttaata

SEQ ID NO: 263556 - DNA, 20 bp, Artificial
  CRISPR gRNA sequence
ttttccattaatttaataat

SEQ ID NO: 263557 - DNA, 20 bp, Artificial
  CRISPR gRNA sequence
tttccattaatttaataatg

SEQ ID NO: 263558 - DNA, 20 bp, Artificial
  CRISPR gRNA sequence
ttccattaatttaataatgt

SEQ ID NO: 263559 - DNA, 20 bp, Artificial
  CRISPR gRNA sequence
tccattaatttaataatgta

SEQ ID NO: 263560 - DNA, 20 bp, Artificial
  CRISPR gRNA sequence
ccattaatttaataatgtaa

SEQ ID NO: 263561 - DNA, 20 bp, Artificial
  CRISPR gRNA sequence
cattaatttaataatgtaac

SEQ ID NO: 263562 - DNA, 20 bp, Artificial
  CRISPR gRNA sequence
atttaataatgtaacttatt

SEQ ID NO: 263563 - DNA, 20 bp, Artificial
  CRISPR gRNA sequence
aataatgtaacttatttgtt

SEQ ID NO: 263564 - DNA, 20 bp, Artificial
  CRISPR gRNA sequence
ataatgtaacttatttgttt

SEQ ID NO: 263565 - DNA, 20 bp, Artificial
  CRISPR gRNA sequence
atttgtttacagcatagctt

SEQ ID NO: 263566 - DNA, 20 bp, Artificial
  CRISPR gRNA sequence
tttgtttacagcatagctta

SEQ ID NO: 263567 - DNA, 20 bp, Artificial
  CRISPR gRNA sequence
gtttacagcatagcttaaaa

SEQ ID NO: 263568 - DNA, 20 bp, Artificial
  CRISPR gRNA sequence
tttacagcatagcttaaaat

SEQ ID NO: 263569 - DNA, 20 bp, Artificial
  CRISPR gRNA sequence
acagcatagcttaaaatatt

SEQ ID NO: 263570 - DNA, 20 bp, Artificial
  CRISPR gRNA sequence
cagcatagcttaaaatattt

SEQ ID NO: 263571 - DNA, 20 bp, Artificial
  CRISPR gRNA sequence
aaaatatttattctataaag

SEQ ID NO: 263572 - DNA, 20 bp, Artificial
  CRISPR gRNA sequence
aaatatttattctataaagg

SEQ ID NO: 263573 - DNA, 20 bp, Artificial
  CRISPR gRNA sequence
attctataaaggttaagtct

SEQ ID NO: 263574 - DNA, 20 bp, Artificial
  CRISPR gRNA sequence
ttctataaaggttaagtcta

SEQ ID NO: 263575 - DNA, 20 bp, Artificial
  CRISPR gRNA sequence
tataaaggttaagtctaacc

SEQ ID NO: 263576 - DNA, 20 bp, Artificial
  CRISPR gRNA sequence
taaaggttaagtctaacctg

SEQ ID NO: 263577 - DNA, 20 bp, Artificial
  CRISPR gRNA sequence
agtctaacctgattccttat

SEQ ID NO: 263578 - DNA, 20 bp, Artificial
  CRISPR gRNA sequence
acctgattccttatgagttg

SEQ ID NO: 263579 - DNA, 20 bp, Artificial
  CRISPR gRNA sequence
attccttatgagttggatga

SEQ ID NO: 263580 - DNA, 20 bp, Artificial
  CRISPR gRNA sequence
cttatgagttggatgacagt

SEQ ID NO: 263581 - DNA, 20 bp, Artificial
  CRISPR gRNA sequence
atgagttggatgacagtgta

SEQ ID NO: 263582 - DNA, 20 bp, Artificial
  CRISPR gRNA sequence
tgagttggatgacagtgtag

SEQ ID NO: 263583 - DNA, 20 bp, Artificial
  CRISPR gRNA sequence
gatgacagtgtagagagata

SEQ ID NO: 263584 - DNA, 20 bp, Artificial
  CRISPR gRNA sequence
atggctaagttaaagaagtg

SEQ ID NO: 263585 - DNA, 20 bp, Artificial
  CRISPR gRNA sequence
tggctaagttaaagaagtgt

SEQ ID NO: 263586 - DNA, 20 bp, Artificial
  CRISPR gRNA sequence
agttaaagaagtgtgattta

SEQ ID NO: 263587 - DNA, 20 bp, Artificial
  CRISPR gRNA sequence
aagaagtgtgatttaggaag

SEQ ID NO: 263588 - DNA, 20 bp, Artificial
  CRISPR gRNA sequence
aggaagagtgaggaaacctt

SEQ ID NO: 263589 - DNA, 20 bp, Artificial
  CRISPR gRNA sequence
ggaagagtgaggaaacctta

SEQ ID NO: 263590 - DNA, 20 bp, Artificial
  CRISPR gRNA sequence
aacttagataagccctttgc

SEQ ID NO: 263591 - DNA, 20 bp, Artificial
  CRISPR gRNA sequence
acttagataagccctttgca

SEQ ID NO: 263592 - DNA, 20 bp, Artificial
  CRISPR gRNA sequence
agataagccctttgcatgtt

SEQ ID NO: 263593 - DNA, 20 bp, Artificial
  CRISPR gRNA sequence
gataagccctttgcatgttt

SEQ ID NO: 263594 - DNA, 20 bp, Artificial
  CRISPR gRNA sequence
tgcatgttttctactagact

SEQ ID NO: 263595 - DNA, 20 bp, Artificial
  CRISPR gRNA sequence
gcatgttttctactagactc

SEQ ID NO: 263596 - DNA, 20 bp, Artificial
  CRISPR gRNA sequence
catgttttctactagactcg

SEQ ID NO: 263597 - DNA, 20 bp, Artificial
  CRISPR gRNA sequence
tctactagactcggataatt

SEQ ID NO: 263598 - DNA, 20 bp, Artificial
  CRISPR gRNA sequence
ctactagactcggataattg

SEQ ID NO: 263599 - DNA, 20 bp, Artificial
  CRISPR gRNA sequence
tactagactcggataattgt

SEQ ID NO: 263600 - DNA, 20 bp, Artificial
  CRISPR gRNA sequence
ctagactcggataattgtgc

SEQ ID NO: 263601 - DNA, 20 bp, Artificial
  CRISPR gRNA sequence
gactcggataattgtgcaac

SEQ ID NO: 263602 - DNA, 20 bp, Artificial
  CRISPR gRNA sequence
ggataattgtgcaactgaga

SEQ ID NO: 263603 - DNA, 20 bp, Artificial
  CRISPR gRNA sequence
tgcaactgagatccacagag

SEQ ID NO: 263604 - DNA, 20 bp, Artificial
  CRISPR gRNA sequence
agatccacagagagtatttt

SEQ ID NO: 263605 - DNA, 20 bp, Artificial
  CRISPR gRNA sequence
tgctggactttgggatagga

SEQ ID NO: 263606 - DNA, 20 bp, Artificial
  CRISPR gRNA sequence
gctggactttgggataggag

SEQ ID NO: 263607 - DNA, 20 bp, Artificial
  CRISPR gRNA sequence
ctggactttgggataggagt

SEQ ID NO: 263608 - DNA, 20 bp, Artificial
  CRISPR gRNA sequence
gactttgggataggagtcca

SEQ ID NO: 263609 - DNA, 20 bp, Artificial
  CRISPR gRNA sequence
tgggataggagtccagccca

SEQ ID NO: 263610 - DNA, 20 bp, Artificial
  CRISPR gRNA sequence
gggataggagtccagcccag

SEQ ID NO: 263611 - DNA, 20 bp, Artificial
  CRISPR gRNA sequence
ggataggagtccagcccaga

SEQ ID NO: 263612 - DNA, 20 bp, Artificial
  CRISPR gRNA sequence
cagagccttaagagggaaat

SEQ ID NO: 263613 - DNA, 20 bp, Artificial
  CRISPR gRNA sequence
aagagggaaatgctctggga

SEQ ID NO: 263614 - DNA, 20 bp, Artificial
  CRISPR gRNA sequence
agagggaaatgctctgggat

SEQ ID NO: 263615 - DNA, 20 bp, Artificial
  CRISPR gRNA sequence
tgggattgatgatagaagga

SEQ ID NO: 263616 - DNA, 20 bp, Artificial
  CRISPR gRNA sequence
ggattgatgatagaaggatg

SEQ ID NO: 263617 - DNA, 20 bp, Artificial
  CRISPR gRNA sequence
atgatagaaggatggtatgc

SEQ ID NO: 263618 - DNA, 20 bp, Artificial
  CRISPR gRNA sequence
gacattggtcacatgtttca

SEQ ID NO: 263619 - DNA, 20 bp, Artificial
  CRISPR gRNA sequence
acattggtcacatgtttcag

SEQ ID NO: 263620 - DNA, 20 bp, Artificial
  CRISPR gRNA sequence
gtcacatgtttcaggccata

SEQ ID NO: 263621 - DNA, 20 bp, Artificial
  CRISPR gRNA sequence
caggccatatttgctatttt

SEQ ID NO: 263622 - DNA, 20 bp, Artificial
  CRISPR gRNA sequence
aggccatatttgctattttt

SEQ ID NO: 263623 - DNA, 20 bp, Artificial
  CRISPR gRNA sequence
gctattttttagcaagccta

SEQ ID NO: 263624 - DNA, 20 bp, Artificial
  CRISPR gRNA sequence
ctattttttagcaagcctaa

SEQ ID NO: 263625 - DNA, 20 bp, Artificial
  CRISPR gRNA sequence
ttttttagcaagcctaatca

SEQ ID NO: 263626 - DNA, 20 bp, Artificial
  CRISPR gRNA sequence
tttagcaagcctaatcatcc

SEQ ID NO: 263627 - DNA, 20 bp, Artificial
  CRISPR gRNA sequence
ttagcaagcctaatcatcca

SEQ ID NO: 263628 - DNA, 20 bp, Artificial
  CRISPR gRNA sequence
tagcaagcctaatcatccag

SEQ ID NO: 263629 - DNA, 20 bp, Artificial
  CRISPR gRNA sequence
agcaagcctaatcatccagt

SEQ ID NO: 263630 - DNA, 20 bp, Artificial
  CRISPR gRNA sequence
gcaagcctaatcatccagtg

SEQ ID NO: 263631 - DNA, 20 bp, Artificial
  CRISPR gRNA sequence
atcatccagtgtgaagagaa

SEQ ID NO: 263632 - DNA, 20 bp, Artificial
  CRISPR gRNA sequence
ccacttatttttccatgaga

SEQ ID NO: 263633 - DNA, 20 bp, Artificial
  CRISPR gRNA sequence
atttttccatgagatcattc

SEQ ID NO: 263634 - DNA, 20 bp, Artificial
  CRISPR gRNA sequence
tttttccatgagatcattcc

SEQ ID NO: 263635 - DNA, 20 bp, Artificial
  CRISPR gRNA sequence
ttccatgagatcattccttt

SEQ ID NO: 263636 - DNA, 20 bp, Artificial
  CRISPR gRNA sequence
tccatgagatcattcctttt

SEQ ID NO: 263637 - DNA, 20 bp, Artificial
  CRISPR gRNA sequence
ccatgagatcattccttttc

SEQ ID NO: 263638 - DNA, 20 bp, Artificial
  CRISPR gRNA sequence
catgagatcattccttttca

SEQ ID NO: 263639 - DNA, 20 bp, Artificial
  CRISPR gRNA sequence
cttttcacttctccaaaact

SEQ ID NO: 263640 - DNA, 20 bp, Artificial
  CRISPR gRNA sequence
ttcacttctccaaaacttgg

SEQ ID NO: 263641 - DNA, 20 bp, Artificial
  CRISPR gRNA sequence
tcacttctccaaaacttggg

SEQ ID NO: 263642 - DNA, 20 bp, Artificial
  CRISPR gRNA sequence
cacttctccaaaacttgggc

SEQ ID NO: 263643 - DNA, 20 bp, Artificial
  CRISPR gRNA sequence
acttctccaaaacttgggca

SEQ ID NO: 263644 - DNA, 20 bp, Artificial
  CRISPR gRNA sequence
ctccaaaacttgggcaaaaa

SEQ ID NO: 263645 - DNA, 20 bp, Artificial
  CRISPR gRNA sequence
tccaaaacttgggcaaaaaa

SEQ ID NO: 263646 - DNA, 20 bp, Artificial
  CRISPR gRNA sequence
caaaacttgggcaaaaaact

SEQ ID NO: 263647 - DNA, 20 bp, Artificial
  CRISPR gRNA sequence
gggcaaaaaactgtcaaaat

SEQ ID NO: 263648 - DNA, 20 bp, Artificial
  CRISPR gRNA sequence
ggcaaaaaactgtcaaaatg

SEQ ID NO: 263649 - DNA, 20 bp, Artificial
  CRISPR gRNA sequence
tcaaaatggccagtttggac

SEQ ID NO: 263650 - DNA, 20 bp, Artificial
  CRISPR gRNA sequence
ggacaaagctaatttctcca

SEQ ID NO: 263651 - DNA, 20 bp, Artificial
  CRISPR gRNA sequence
gacaaagctaatttctccag

SEQ ID NO: 263652 - DNA, 20 bp, Artificial
  CRISPR gRNA sequence
atttctccagcgccttccct

SEQ ID NO: 263653 - DNA, 20 bp, Artificial
  CRISPR gRNA sequence
ctccagcgccttcccttagc

SEQ ID NO: 263654 - DNA, 20 bp, Artificial
  CRISPR gRNA sequence
tccagcgccttcccttagcg

SEQ ID NO: 263655 - DNA, 20 bp, Artificial
  CRISPR gRNA sequence
cagcgccttcccttagcgct

SEQ ID NO: 263656 - DNA, 20 bp, Artificial
  CRISPR gRNA sequence
cccttagcgcttatttttct

SEQ ID NO: 263657 - DNA, 20 bp, Artificial
  CRISPR gRNA sequence
ccttagcgcttatttttctg

SEQ ID NO: 263658 - DNA, 20 bp, Artificial
  CRISPR gRNA sequence
agcgcttatttttctgagag

SEQ ID NO: 263659 - DNA, 20 bp, Artificial
  CRISPR gRNA sequence
gcgcttatttttctgagaga

SEQ ID NO: 263660 - DNA, 20 bp, Artificial
  CRISPR gRNA sequence
atttttctgagagaggcatg

SEQ ID NO: 263661 - DNA, 20 bp, Artificial
  CRISPR gRNA sequence
tttttctgagagaggcatgg

SEQ ID NO: 263662 - DNA, 20 bp, Artificial
  CRISPR gRNA sequence
ttctgagagaggcatggaaa

SEQ ID NO: 263663 - DNA, 20 bp, Artificial
  CRISPR gRNA sequence
tctgagagaggcatggaaag

SEQ ID NO: 263664 - DNA, 20 bp, Artificial
  CRISPR gRNA sequence
ctgagagaggcatggaaagc

SEQ ID NO: 263665 - DNA, 20 bp, Artificial
  CRISPR gRNA sequence
tgagagaggcatggaaagca

SEQ ID NO: 263666 - DNA, 20 bp, Artificial
  CRISPR gRNA sequence
agagaggcatggaaagcagg

SEQ ID NO: 263667 - DNA, 20 bp, Artificial
  CRISPR gRNA sequence
acatttaataaaaagtcatc

SEQ ID NO: 263668 - DNA, 20 bp, Artificial
  CRISPR gRNA sequence
aataaaaagtcatcagcaaa

SEQ ID NO: 263669 - DNA, 20 bp, Artificial
  CRISPR gRNA sequence
ataaaaagtcatcagcaaag

SEQ ID NO: 263670 - DNA, 20 bp, Artificial
  CRISPR gRNA sequence
aaaattttatttgtactcta

SEQ ID NO: 263671 - DNA, 20 bp, Artificial
  CRISPR gRNA sequence
tatttgtactctagtcttca

SEQ ID NO: 263672 - DNA, 20 bp, Artificial
  CRISPR gRNA sequence
atttgtactctagtcttcag

SEQ ID NO: 263673 - DNA, 20 bp, Artificial
  CRISPR gRNA sequence
tttgtactctagtcttcagc

SEQ ID NO: 263674 - DNA, 20 bp, Artificial
  CRISPR gRNA sequence
gtactctagtcttcagccaa

SEQ ID NO: 263675 - DNA, 20 bp, Artificial
  CRISPR gRNA sequence
tactctagtcttcagccaat

SEQ ID NO: 263676 - DNA, 20 bp, Artificial
  CRISPR gRNA sequence
tagtcttcagccaatgactc

SEQ ID NO: 263677 - DNA, 20 bp, Artificial
  CRISPR gRNA sequence
gtcttcagccaatgactccc

SEQ ID NO: 263678 - DNA, 20 bp, Artificial
  CRISPR gRNA sequence
cagccaatgactcccctgag

SEQ ID NO: 263679 - DNA, 20 bp, Artificial
  CRISPR gRNA sequence
agccaatgactcccctgagc

SEQ ID NO: 263680 - DNA, 20 bp, Artificial
  CRISPR gRNA sequence
ccctgagctggttgtatacg

SEQ ID NO: 263681 - DNA, 20 bp, Artificial
  CRISPR gRNA sequence
agctggttgtatacggaaag

SEQ ID NO: 263682 - DNA, 20 bp, Artificial
  CRISPR gRNA sequence
gttgtatacggaaagaagta

SEQ ID NO: 263683 - DNA, 20 bp, Artificial
  CRISPR gRNA sequence
tatacggaaagaagtaattt

SEQ ID NO: 263684 - DNA, 20 bp, Artificial
  CRISPR gRNA sequence
gtttctcacagttaagtgtt

SEQ ID NO: 263685 - DNA, 20 bp, Artificial
  CRISPR gRNA sequence
tttctcacagttaagtgttg

SEQ ID NO: 263686 - DNA, 20 bp, Artificial
  CRISPR gRNA sequence
ctcacagttaagtgttgctc

SEQ ID NO: 263687 - DNA, 20 bp, Artificial
  CRISPR gRNA sequence
tcacagttaagtgttgctct

SEQ ID NO: 263688 - DNA, 20 bp, Artificial
  CRISPR gRNA sequence
acagttaagtgttgctctga

SEQ ID NO: 263689 - DNA, 20 bp, Artificial
  CRISPR gRNA sequence
agtgttgctctgagactggg

SEQ ID NO: 263690 - DNA, 20 bp, Artificial
  CRISPR gRNA sequence
ctctgagactgggcttggga

SEQ ID NO: 263691 - DNA, 20 bp, Artificial
  CRISPR gRNA sequence
tgagactgggcttgggaaag

SEQ ID NO: 263692 - DNA, 20 bp, Artificial
  CRISPR gRNA sequence
agactgggcttgggaaagta

SEQ ID NO: 263693 - DNA, 20 bp, Artificial
  CRISPR gRNA sequence
ggcttgggaaagtaaggtga

SEQ ID NO: 263694 - DNA, 20 bp, Artificial
  CRISPR gRNA sequence
gggaaagtaaggtgaaaaga

SEQ ID NO: 263695 - DNA, 20 bp, Artificial
  CRISPR gRNA sequence
ggaaagtaaggtgaaaagat

SEQ ID NO: 263696 - DNA, 20 bp, Artificial
  CRISPR gRNA sequence
ccgtatttacatgacttcca

SEQ ID NO: 263697 - DNA, 20 bp, Artificial
  CRISPR gRNA sequence
acatgacttccaatatgctg

SEQ ID NO: 263698 - DNA, 20 bp, Artificial
  CRISPR gRNA sequence
catgacttccaatatgctgt

SEQ ID NO: 263699 - DNA, 20 bp, Artificial
  CRISPR gRNA sequence
ccaatatgctgtggccagtt

SEQ ID NO: 263700 - DNA, 20 bp, Artificial
  CRISPR gRNA sequence
caatatgctgtggccagttt

SEQ ID NO: 263701 - DNA, 20 bp, Artificial
  CRISPR gRNA sequence
tggccagtttttctgttaaa

SEQ ID NO: 263702 - DNA, 20 bp, Artificial
  CRISPR gRNA sequence
ttctgttaaaagaaattgac

SEQ ID NO: 263703 - DNA, 20 bp, Artificial
  CRISPR gRNA sequence
tctgttaaaagaaattgact

SEQ ID NO: 263704 - DNA, 20 bp, Artificial
  CRISPR gRNA sequence
ctgttaaaagaaattgactg

SEQ ID NO: 263705 - DNA, 20 bp, Artificial
  CRISPR gRNA sequence
tgttaaaagaaattgactgg

SEQ ID NO: 263706 - DNA, 20 bp, Artificial
  CRISPR gRNA sequence
ttaaaagaaattgactggat

SEQ ID NO: 263707 - DNA, 20 bp, Artificial
  CRISPR gRNA sequence
aaagaaattgactggatgtt

SEQ ID NO: 263708 - DNA, 20 bp, Artificial
  CRISPR gRNA sequence
actggatgtttttgtcattt

SEQ ID NO: 263709 - DNA, 20 bp, Artificial
  CRISPR gRNA sequence
gatgtttttgtcatttcaag

SEQ ID NO: 263710 - DNA, 20 bp, Artificial
  CRISPR gRNA sequence
ttgtcatttcaagtaaattt

SEQ ID NO: 263711 - DNA, 20 bp, Artificial
  CRISPR gRNA sequence
tgtcatttcaagtaaatttg

SEQ ID NO: 263712 - DNA, 20 bp, Artificial
  CRISPR gRNA sequence
gtcatttcaagtaaatttga

SEQ ID NO: 263713 - DNA, 20 bp, Artificial
  CRISPR gRNA sequence
tcatttcaagtaaatttgat

SEQ ID NO: 263714 - DNA, 20 bp, Artificial
  CRISPR gRNA sequence
caagtaaatttgatggatat

SEQ ID NO: 263715 - DNA, 20 bp, Artificial
  CRISPR gRNA sequence
aagtaaatttgatggatatt

SEQ ID NO: 263716 - DNA, 20 bp, Artificial
  CRISPR gRNA sequence
gatggatatttcaaaagtat

SEQ ID NO: 263717 - DNA, 20 bp, Artificial
  CRISPR gRNA sequence
atggatatttcaaaagtata

SEQ ID NO: 263718 - DNA, 20 bp, Artificial
  CRISPR gRNA sequence
caaaagtataggcattgctt

SEQ ID NO: 263719 - DNA, 20 bp, Artificial
  CRISPR gRNA sequence
aaaagtataggcattgctta

SEQ ID NO: 263720 - DNA, 20 bp, Artificial
  CRISPR gRNA sequence
cttaaggatttgttttactc

SEQ ID NO: 263721 - DNA, 20 bp, Artificial
  CRISPR gRNA sequence
aaggatttgttttactctac

SEQ ID NO: 263722 - DNA, 20 bp, Artificial
  CRISPR gRNA sequence
aggatttgttttactctact

SEQ ID NO: 263723 - DNA, 20 bp, Artificial
  CRISPR gRNA sequence
gttttactctactaccgtgc

SEQ ID NO: 263724 - DNA, 20 bp, Artificial
  CRISPR gRNA sequence
ttttactctactaccgtgcc

SEQ ID NO: 263725 - DNA, 20 bp, Artificial
  CRISPR gRNA sequence
tactctactaccgtgcccta

SEQ ID NO: 263726 - DNA, 20 bp, Artificial
  CRISPR gRNA sequence
actctactaccgtgccctag

SEQ ID NO: 263727 - DNA, 20 bp, Artificial
  CRISPR gRNA sequence
ctctactaccgtgccctagt

SEQ ID NO: 263728 - DNA, 20 bp, Artificial
  CRISPR gRNA sequence
tactaccgtgccctagttaa

SEQ ID NO: 263729 - DNA, 20 bp, Artificial
  CRISPR gRNA sequence
ctaccgtgccctagttaaca

SEQ ID NO: 263730 - DNA, 20 bp, Artificial
  CRISPR gRNA sequence
ccgtgccctagttaacacat

SEQ ID NO: 263731 - DNA, 20 bp, Artificial
  CRISPR gRNA sequence
gttaacacattgtgtttttt

SEQ ID NO: 263732 - DNA, 20 bp, Artificial
  CRISPR gRNA sequence
acacattgtgttttttaagg

SEQ ID NO: 263733 - DNA, 20 bp, Artificial
  CRISPR gRNA sequence
tgttttttaaggcaaccatc

SEQ ID NO: 263734 - DNA, 20 bp, Artificial
  CRISPR gRNA sequence
tttaaggcaaccatccagca

SEQ ID NO: 263735 - DNA, 20 bp, Artificial
  CRISPR gRNA sequence
ttaaggcaaccatccagcaa

SEQ ID NO: 263736 - DNA, 20 bp, Artificial
  CRISPR gRNA sequence
taaggcaaccatccagcaag

SEQ ID NO: 263737 - DNA, 20 bp, Artificial
  CRISPR gRNA sequence
aaggcaaccatccagcaagg

SEQ ID NO: 263738 - DNA, 20 bp, Artificial
  CRISPR gRNA sequence
aggcaaccatccagcaagga

SEQ ID NO: 263739 - DNA, 20 bp, Artificial
  CRISPR gRNA sequence
acagcaaggactgcaaaatt

SEQ ID NO: 263740 - DNA, 20 bp, Artificial
  CRISPR gRNA sequence
cagcaaggactgcaaaatta

SEQ ID NO: 263741 - DNA, 20 bp, Artificial
  CRISPR gRNA sequence
caaaattaatatcaatatat

SEQ ID NO: 263742 - DNA, 20 bp, Artificial
  CRISPR gRNA sequence
atatcaatatatcaatacca

SEQ ID NO: 263743 - DNA, 20 bp, Artificial
  CRISPR gRNA sequence
ccacagatagattagaaata

SEQ ID NO: 263744 - DNA, 20 bp, Artificial
  CRISPR gRNA sequence
gaaatagaaatgaatctgtg

SEQ ID NO: 263745 - DNA, 20 bp, Artificial
  CRISPR gRNA sequence
tgattgtaactccaaagctc

SEQ ID NO: 263746 - DNA, 20 bp, Artificial
  CRISPR gRNA sequence
taactccaaagctctcacat

SEQ ID NO: 263747 - DNA, 20 bp, Artificial
  CRISPR gRNA sequence
caaagctctcacattcaaac

SEQ ID NO: 263748 - DNA, 20 bp, Artificial
  CRISPR gRNA sequence
tcacattcaaacttttacta

SEQ ID NO: 263749 - DNA, 20 bp, Artificial
  CRISPR gRNA sequence
acattcaaacttttactatg

SEQ ID NO: 263750 - DNA, 20 bp, Artificial
  CRISPR gRNA sequence
aaacttttactatgggtggg

SEQ ID NO: 263751 - DNA, 20 bp, Artificial
  CRISPR gRNA sequence
ttactatgggtggggagagg

SEQ ID NO: 263752 - DNA, 20 bp, Artificial
  CRISPR gRNA sequence
tactatgggtggggagagga

SEQ ID NO: 263753 - DNA, 20 bp, Artificial
  CRISPR gRNA sequence
actatgggtggggagaggat

SEQ ID NO: 263754 - DNA, 20 bp, Artificial
  CRISPR gRNA sequence
ctatgggtggggagaggatc

SEQ ID NO: 263755 - DNA, 20 bp, Artificial
  CRISPR gRNA sequence
tgggtggggagaggatctcg

SEQ ID NO: 263756 - DNA, 20 bp, Artificial
  CRISPR gRNA sequence
gctgcctccccttctttaag

SEQ ID NO: 263757 - DNA, 20 bp, Artificial
  CRISPR gRNA sequence
cctccccttctttaagacat

SEQ ID NO: 263758 - DNA, 20 bp, Artificial
  CRISPR gRNA sequence
cccttctttaagacatagac

SEQ ID NO: 263759 - DNA, 20 bp, Artificial
  CRISPR gRNA sequence
ctttaagacatagaccctcc

SEQ ID NO: 263760 - DNA, 20 bp, Artificial
  CRISPR gRNA sequence
tttaagacatagaccctcct

SEQ ID NO: 263761 - DNA, 20 bp, Artificial
  CRISPR gRNA sequence
taagacatagaccctcctcc

SEQ ID NO: 263762 - DNA, 20 bp, Artificial
  CRISPR gRNA sequence
aagacatagaccctcctcct

SEQ ID NO: 263763 - DNA, 20 bp, Artificial
  CRISPR gRNA sequence
agacatagaccctcctcctt

SEQ ID NO: 263764 - DNA, 20 bp, Artificial
  CRISPR gRNA sequence
ctcctttttaacgtcttatg

SEQ ID NO: 263765 - DNA, 20 bp, Artificial
  CRISPR gRNA sequence
ctttttaacgtcttatgcct

SEQ ID NO: 263766 - DNA, 20 bp, Artificial
  CRISPR gRNA sequence
tttaacgtcttatgcctttt

SEQ ID NO: 263767 - DNA, 20 bp, Artificial
  CRISPR gRNA sequence
ttaacgtcttatgccttttt

SEQ ID NO: 263768 - DNA, 20 bp, Artificial
  CRISPR gRNA sequence
taacgtcttatgcctttttt

SEQ ID NO: 263769 - DNA, 20 bp, Artificial
  CRISPR gRNA sequence
aacgtcttatgccttttttc

SEQ ID NO: 263770 - DNA, 20 bp, Artificial
  CRISPR gRNA sequence
acgtcttatgccttttttca

SEQ ID NO: 263771 - DNA, 20 bp, Artificial
  CRISPR gRNA sequence
atgccttttttcaagggtgg

SEQ ID NO: 263772 - DNA, 20 bp, Artificial
  CRISPR gRNA sequence
tgccttttttcaagggtgga

SEQ ID NO: 263773 - DNA, 20 bp, Artificial
  CRISPR gRNA sequence
ttttcaagggtggagaaatg

SEQ ID NO: 263774 - DNA, 20 bp, Artificial
  CRISPR gRNA sequence
tttcaagggtggagaaatgc

SEQ ID NO: 263775 - DNA, 20 bp, Artificial
  CRISPR gRNA sequence
ttcaagggtggagaaatgcc

SEQ ID NO: 263776 - DNA, 20 bp, Artificial
  CRISPR gRNA sequence
tcaagggtggagaaatgcca

SEQ ID NO: 263777 - DNA, 20 bp, Artificial
  CRISPR gRNA sequence
caagggtggagaaatgccat

SEQ ID NO: 263778 - DNA, 20 bp, Artificial
  CRISPR gRNA sequence
aagggtggagaaatgccata

SEQ ID NO: 263779 - DNA, 20 bp, Artificial
  CRISPR gRNA sequence
ccatttggcttttatcttgt

SEQ ID NO: 263780 - DNA, 20 bp, Artificial
  CRISPR gRNA sequence
ggcttttatcttgtgtggat

SEQ ID NO: 263781 - DNA, 20 bp, Artificial
  CRISPR gRNA sequence
gcttttatcttgtgtggata

SEQ ID NO: 263782 - DNA, 20 bp, Artificial
  CRISPR gRNA sequence
ttatcttgtgtggatatctt

SEQ ID NO: 263783 - DNA, 20 bp, Artificial
  CRISPR gRNA sequence
tatcttgtgtggatatcttc

SEQ ID NO: 263784 - DNA, 20 bp, Artificial
  CRISPR gRNA sequence
atcttgtgtggatatcttcc

SEQ ID NO: 263785 - DNA, 20 bp, Artificial
  CRISPR gRNA sequence
tcttgtgtggatatcttcct

SEQ ID NO: 263786 - DNA, 20 bp, Artificial
  CRISPR gRNA sequence
gtgtggatatcttcctccaa

SEQ ID NO: 263787 - DNA, 20 bp, Artificial
  CRISPR gRNA sequence
tgtggatatcttcctccaag

SEQ ID NO: 263788 - DNA, 20 bp, Artificial
  CRISPR gRNA sequence
cctccaagtatttcctgcaa

SEQ ID NO: 263789 - DNA, 20 bp, Artificial
  CRISPR gRNA sequence
ctccaagtatttcctgcaag

SEQ ID NO: 263790 - DNA, 20 bp, Artificial
  CRISPR gRNA sequence
caagtatttcctgcaagcag

SEQ ID NO: 263791 - DNA, 20 bp, Artificial
  CRISPR gRNA sequence
cctgcaagcagtgtgctgac

SEQ ID NO: 263792 - DNA, 20 bp, Artificial
  CRISPR gRNA sequence
ctgcaagcagtgtgctgaca

SEQ ID NO: 263793 - DNA, 20 bp, Artificial
  CRISPR gRNA sequence
caagcagtgtgctgacattt

SEQ ID NO: 263794 - DNA, 20 bp, Artificial
  CRISPR gRNA sequence
acatttacaaaaggaaaatt

SEQ ID NO: 263795 - DNA, 20 bp, Artificial
  CRISPR gRNA sequence
acaaaaggaaaatttttatg

SEQ ID NO: 263796 - DNA, 20 bp, Artificial
  CRISPR gRNA sequence
caaaaggaaaatttttatgc

SEQ ID NO: 263797 - DNA, 20 bp, Artificial
  CRISPR gRNA sequence
ttatgccaccaacatcccag

SEQ ID NO: 263798 - DNA, 20 bp, Artificial
  CRISPR gRNA sequence
tatgccaccaacatcccaga

SEQ ID NO: 263799 - DNA, 20 bp, Artificial
  CRISPR gRNA sequence
atgccaccaacatcccagaa

SEQ ID NO: 263800 - DNA, 20 bp, Artificial
  CRISPR gRNA sequence
tgccaccaacatcccagaag

SEQ ID NO: 263801 - DNA, 20 bp, Artificial
  CRISPR gRNA sequence
gttgtggtttatcatctcta

SEQ ID NO: 263802 - DNA, 20 bp, Artificial
  CRISPR gRNA sequence
ttgtggtttatcatctctaa

SEQ ID NO: 263803 - DNA, 20 bp, Artificial
  CRISPR gRNA sequence
tggtttatcatctctaacac

SEQ ID NO: 263804 - DNA, 20 bp, Artificial
  CRISPR gRNA sequence
atcatctctaacacaaaagc

SEQ ID NO: 263805 - DNA, 20 bp, Artificial
  CRISPR gRNA sequence
tcatctctaacacaaaagcc

SEQ ID NO: 263806 - DNA, 20 bp, Artificial
  CRISPR gRNA sequence
taacacaaaagccctttatt

SEQ ID NO: 263807 - DNA, 20 bp, Artificial
  CRISPR gRNA sequence
acacaaaagccctttattaa

SEQ ID NO: 263808 - DNA, 20 bp, Artificial
  CRISPR gRNA sequence
tattaactagtgtaggcatt

SEQ ID NO: 263809 - DNA, 20 bp, Artificial
  CRISPR gRNA sequence
attaactagtgtaggcattg

SEQ ID NO: 263810 - DNA, 20 bp, Artificial
  CRISPR gRNA sequence
ttaactagtgtaggcattga

SEQ ID NO: 263811 - DNA, 20 bp, Artificial
  CRISPR gRNA sequence
actagtgtaggcattgatga

SEQ ID NO: 263812 - DNA, 20 bp, Artificial
  CRISPR gRNA sequence
gtgtaggcattgatgaggat

SEQ ID NO: 263813 - DNA, 20 bp, Artificial
  CRISPR gRNA sequence
atgaggatacgcaattcatg

SEQ ID NO: 263814 - DNA, 20 bp, Artificial
  CRISPR gRNA sequence
atgtcagacttggttgtcta

SEQ ID NO: 263815 - DNA, 20 bp, Artificial
  CRISPR gRNA sequence
ggttgtctaaaaatcagagg

SEQ ID NO: 263816 - DNA, 20 bp, Artificial
  CRISPR gRNA sequence
gttgtctaaaaatcagagga

SEQ ID NO: 263817 - DNA, 20 bp, Artificial
  CRISPR gRNA sequence
tctaaaaatcagaggacgga

SEQ ID NO: 263818 - DNA, 20 bp, Artificial
  CRISPR gRNA sequence
aaaatcagaggacggacact

SEQ ID NO: 263819 - DNA, 20 bp, Artificial
  CRISPR gRNA sequence
cttcaaagcacaattgtttc

SEQ ID NO: 263820 - DNA, 20 bp, Artificial
  CRISPR gRNA sequence
caaagcacaattgtttccca

SEQ ID NO: 263821 - DNA, 20 bp, Artificial
  CRISPR gRNA sequence
aaagcacaattgtttcccag

SEQ ID NO: 263822 - DNA, 20 bp, Artificial
  CRISPR gRNA sequence
tttcccagcaggtcatggca

SEQ ID NO: 263823 - DNA, 20 bp, Artificial
  CRISPR gRNA sequence
cccagcaggtcatggcaagg

SEQ ID NO: 263824 - DNA, 20 bp, Artificial
  CRISPR gRNA sequence
ccagcaggtcatggcaaggg

SEQ ID NO: 263825 - DNA, 20 bp, Artificial
  CRISPR gRNA sequence
cttctctttctcatgttggt

SEQ ID NO: 263826 - DNA, 20 bp, Artificial
  CRISPR gRNA sequence
ttctctttctcatgttggtt

SEQ ID NO: 263827 - DNA, 20 bp, Artificial
  CRISPR gRNA sequence
ctctttctcatgttggttaa

SEQ ID NO: 263828 - DNA, 20 bp, Artificial
  CRISPR gRNA sequence
tctttctcatgttggttaaa

SEQ ID NO: 263829 - DNA, 20 bp, Artificial
  CRISPR gRNA sequence
tttctcatgttggttaaatt

SEQ ID NO: 263830 - DNA, 20 bp, Artificial
  CRISPR gRNA sequence
tctcatgttggttaaatttt

SEQ ID NO: 263831 - DNA, 20 bp, Artificial
  CRISPR gRNA sequence
ctcatgttggttaaattttt

SEQ ID NO: 263832 - DNA, 20 bp, Artificial
  CRISPR gRNA sequence
tcatgttggttaaatttttg

SEQ ID NO: 263833 - DNA, 20 bp, Artificial
  CRISPR gRNA sequence
atgttggttaaatttttgtt

SEQ ID NO: 263834 - DNA, 20 bp, Artificial
  CRISPR gRNA sequence
gttaaatttttgtttgcctt

SEQ ID NO: 263835 - DNA, 20 bp, Artificial
  CRISPR gRNA sequence
aatttttgtttgcctttttc

SEQ ID NO: 263836 - DNA, 20 bp, Artificial
  CRISPR gRNA sequence
ttgtttgcctttttcttcaa

SEQ ID NO: 263837 - DNA, 20 bp, Artificial
  CRISPR gRNA sequence
tgtttgcctttttcttcaag

SEQ ID NO: 263838 - DNA, 20 bp, Artificial
  CRISPR gRNA sequence
gtttgcctttttcttcaaga

SEQ ID NO: 263839 - DNA, 20 bp, Artificial
  CRISPR gRNA sequence
tttgcctttttcttcaagaa

SEQ ID NO: 263840 - DNA, 20 bp, Artificial
  CRISPR gRNA sequence
gcctttttcttcaagaaatt

SEQ ID NO: 263841 - DNA, 20 bp, Artificial
  CRISPR gRNA sequence
cctttttcttcaagaaattt

SEQ ID NO: 263842 - DNA, 20 bp, Artificial
  CRISPR gRNA sequence
tttcttcaagaaatttatta

SEQ ID NO: 263843 - DNA, 20 bp, Artificial
  CRISPR gRNA sequence
ttcttcaagaaatttattat

SEQ ID NO: 263844 - DNA, 20 bp, Artificial
  CRISPR gRNA sequence
tcttcaagaaatttattatt

SEQ ID NO: 263845 - DNA, 20 bp, Artificial
  CRISPR gRNA sequence
cttcaagaaatttattattt

SEQ ID NO: 263846 - DNA, 20 bp, Artificial
  CRISPR gRNA sequence
ttcaagaaatttattattta

SEQ ID NO: 263847 - DNA, 20 bp, Artificial
  CRISPR gRNA sequence
caagaaatttattatttatg

SEQ ID NO: 263848 - DNA, 20 bp, Artificial
  CRISPR gRNA sequence
aagaaatttattatttatgg

SEQ ID NO: 263849 - DNA, 20 bp, Artificial
  CRISPR gRNA sequence
attatttatggaacttcaca

SEQ ID NO: 263850 - DNA, 20 bp, Artificial
  CRISPR gRNA sequence
ttatttatggaacttcacag

SEQ ID NO: 263851 - DNA, 20 bp, Artificial
  CRISPR gRNA sequence
tttatggaacttcacagagg

SEQ ID NO: 263852 - DNA, 20 bp, Artificial
  CRISPR gRNA sequence
atggaacttcacagaggctg

SEQ ID NO: 263853 - DNA, 20 bp, Artificial
  CRISPR gRNA sequence
tggaacttcacagaggctgg

SEQ ID NO: 263854 - DNA, 20 bp, Artificial
  CRISPR gRNA sequence
cacagaggctggaacttttc

SEQ ID NO: 263855 - DNA, 20 bp, Artificial
  CRISPR gRNA sequence
acagaggctggaacttttct

SEQ ID NO: 263856 - DNA, 20 bp, Artificial
  CRISPR gRNA sequence
gaacttttcttctcagtaca

SEQ ID NO: 263857 - DNA, 20 bp, Artificial
  CRISPR gRNA sequence
ttcttctcagtacatagttg

SEQ ID NO: 263858 - DNA, 20 bp, Artificial
  CRISPR gRNA sequence
tcttctcagtacatagttga

SEQ ID NO: 263859 - DNA, 20 bp, Artificial
  CRISPR gRNA sequence
cttctcagtacatagttgag

SEQ ID NO: 263860 - DNA, 20 bp, Artificial
  CRISPR gRNA sequence
ttctcagtacatagttgagc

SEQ ID NO: 263861 - DNA, 20 bp, Artificial
  CRISPR gRNA sequence
ctcagtacatagttgagctg

SEQ ID NO: 263862 - DNA, 20 bp, Artificial
  CRISPR gRNA sequence
tcagtacatagttgagctga

SEQ ID NO: 263863 - DNA, 20 bp, Artificial
  CRISPR gRNA sequence
agtacatagttgagctgagc

SEQ ID NO: 263864 - DNA, 20 bp, Artificial
  CRISPR gRNA sequence
agctgagcatctggaaaaat

SEQ ID NO: 263865 - DNA, 20 bp, Artificial
  CRISPR gRNA sequence
agcatctggaaaaattacat

SEQ ID NO: 263866 - DNA, 20 bp, Artificial
  CRISPR gRNA sequence
gaaaaattacatctgggtgg

SEQ ID NO: 263867 - DNA, 20 bp, Artificial
  CRISPR gRNA sequence
catctgggtggttttgtgac

SEQ ID NO: 263868 - DNA, 20 bp, Artificial
  CRISPR gRNA sequence
ggtggttttgtgactgactg

SEQ ID NO: 263869 - DNA, 20 bp, Artificial
  CRISPR gRNA sequence
tgtgactgactgaatggctc

SEQ ID NO: 263870 - DNA, 20 bp, Artificial
  CRISPR gRNA sequence
gtgactgactgaatggctct

SEQ ID NO: 263871 - DNA, 20 bp, Artificial
  CRISPR gRNA sequence
tgactgactgaatggctctc

SEQ ID NO: 263872 - DNA, 20 bp, Artificial
  CRISPR gRNA sequence
actgaatggctctctggtta

SEQ ID NO: 263873 - DNA, 20 bp, Artificial
  CRISPR gRNA sequence
aatggctctctggttaagct

SEQ ID NO: 263874 - DNA, 20 bp, Artificial
  CRISPR gRNA sequence
tctggttaagctgtgttaag

SEQ ID NO: 263875 - DNA, 20 bp, Artificial
  CRISPR gRNA sequence
tggttaagctgtgttaagat

SEQ ID NO: 263876 - DNA, 20 bp, Artificial
  CRISPR gRNA sequence
gttaagctgtgttaagatat

SEQ ID NO: 263877 - DNA, 20 bp, Artificial
  CRISPR gRNA sequence
agctgtgttaagatatctgt

SEQ ID NO: 263878 - DNA, 20 bp, Artificial
  CRISPR gRNA sequence
tgttaagatatctgtgtctc

SEQ ID NO: 263879 - DNA, 20 bp, Artificial
  CRISPR gRNA sequence
agatatctgtgtctctttta

SEQ ID NO: 263880 - DNA, 20 bp, Artificial
  CRISPR gRNA sequence
tgtctcttttacggtgattt

SEQ ID NO: 263881 - DNA, 20 bp, Artificial
  CRISPR gRNA sequence
ttttacggtgatttatttgg

SEQ ID NO: 263882 - DNA, 20 bp, Artificial
  CRISPR gRNA sequence
ttacggtgatttatttggcc

SEQ ID NO: 263883 - DNA, 20 bp, Artificial
  CRISPR gRNA sequence
tacggtgatttatttggccg

SEQ ID NO: 263884 - DNA, 20 bp, Artificial
  CRISPR gRNA sequence
acggtgatttatttggccgt

SEQ ID NO: 263885 - DNA, 20 bp, Artificial
  CRISPR gRNA sequence
cggtgatttatttggccgtt

SEQ ID NO: 263886 - DNA, 20 bp, Artificial
  CRISPR gRNA sequence
atttggccgtttttggccaa

SEQ ID NO: 263887 - DNA, 20 bp, Artificial
  CRISPR gRNA sequence
tttggccgtttttggccaat

SEQ ID NO: 263888 - DNA, 20 bp, Artificial
  CRISPR gRNA sequence
ggccgtttttggccaatgac

SEQ ID NO: 263889 - DNA, 20 bp, Artificial
  CRISPR gRNA sequence
gccgtttttggccaatgaca

SEQ ID NO: 263890 - DNA, 20 bp, Artificial
  CRISPR gRNA sequence
ttggccaatgacagggtgtt

SEQ ID NO: 263891 - DNA, 20 bp, Artificial
  CRISPR gRNA sequence
tggccaatgacagggtgtta

SEQ ID NO: 263892 - DNA, 20 bp, Artificial
  CRISPR gRNA sequence
ggccaatgacagggtgttag

SEQ ID NO: 263893 - DNA, 20 bp, Artificial
  CRISPR gRNA sequence
gccaatgacagggtgttagc

SEQ ID NO: 263894 - DNA, 20 bp, Artificial
  CRISPR gRNA sequence
gcaccaaaaacccaaaacca

SEQ ID NO: 263895 - DNA, 20 bp, Artificial
  CRISPR gRNA sequence
actcagagctttgagcctga

SEQ ID NO: 263896 - DNA, 20 bp, Artificial
  CRISPR gRNA sequence
agagctttgagcctgataat

SEQ ID NO: 263897 - DNA, 20 bp, Artificial
  CRISPR gRNA sequence
tgagcctgataattatagca

SEQ ID NO: 263898 - DNA, 20 bp, Artificial
  CRISPR gRNA sequence
gagcctgataattatagcat

SEQ ID NO: 263899 - DNA, 20 bp, Artificial
  CRISPR gRNA sequence
agcctgataattatagcatg

SEQ ID NO: 263900 - DNA, 20 bp, Artificial
  CRISPR gRNA sequence
ataattatagcatgagaatt

SEQ ID NO: 263901 - DNA, 20 bp, Artificial
  CRISPR gRNA sequence
tagcatgagaattggtgcct

SEQ ID NO: 263902 - DNA, 20 bp, Artificial
  CRISPR gRNA sequence
gtgcctgaagctggggggaa

SEQ ID NO: 263903 - DNA, 20 bp, Artificial
  CRISPR gRNA sequence
aagctggggggaaggtaacc

SEQ ID NO: 263904 - DNA, 20 bp, Artificial
  CRISPR gRNA sequence
gggggaaggtaacccaggcc

SEQ ID NO: 263905 - DNA, 20 bp, Artificial
  CRISPR gRNA sequence
catgcaagtgtctaactttt

SEQ ID NO: 263906 - DNA, 20 bp, Artificial
  CRISPR gRNA sequence
actttttccttgttaatctc

SEQ ID NO: 263907 - DNA, 20 bp, Artificial
  CRISPR gRNA sequence
tttccttgttaatctcattt

SEQ ID NO: 263908 - DNA, 20 bp, Artificial
  CRISPR gRNA sequence
ttccttgttaatctcatttt

SEQ ID NO: 263909 - DNA, 20 bp, Artificial
  CRISPR gRNA sequence
tccttgttaatctcattttg

SEQ ID NO: 263910 - DNA, 20 bp, Artificial
  CRISPR gRNA sequence
ccttgttaatctcattttga

SEQ ID NO: 263911 - DNA, 20 bp, Artificial
  CRISPR gRNA sequence
cttgttaatctcattttgag

SEQ ID NO: 263912 - DNA, 20 bp, Artificial
  CRISPR gRNA sequence
gttaatctcattttgaggac

SEQ ID NO: 263913 - DNA, 20 bp, Artificial
  CRISPR gRNA sequence
ttaatctcattttgaggact

SEQ ID NO: 263914 - DNA, 20 bp, Artificial
  CRISPR gRNA sequence
atctcattttgaggactcca

SEQ ID NO: 263915 - DNA, 20 bp, Artificial
  CRISPR gRNA sequence
attttgaggactccaaacac

SEQ ID NO: 263916 - DNA, 20 bp, Artificial
  CRISPR gRNA sequence
tgaggactccaaacactaga

SEQ ID NO: 263917 - DNA, 20 bp, Artificial
  CRISPR gRNA sequence
gaggactccaaacactagaa

SEQ ID NO: 263918 - DNA, 20 bp, Artificial
  CRISPR gRNA sequence
aggactccaaacactagaag

SEQ ID NO: 263919 - DNA, 20 bp, Artificial
  CRISPR gRNA sequence
caaacactagaagagaagtg

SEQ ID NO: 263920 - DNA, 20 bp, Artificial
  CRISPR gRNA sequence
gaagagaagtgcactggata

SEQ ID NO: 263921 - DNA, 20 bp, Artificial
  CRISPR gRNA sequence
gataggatcaagaactactc

SEQ ID NO: 263922 - DNA, 20 bp, Artificial
  CRISPR gRNA sequence
ctcagtcatttggtagaggc

SEQ ID NO: 263923 - DNA, 20 bp, Artificial
  CRISPR gRNA sequence
agtcatttggtagaggcttg

SEQ ID NO: 263924 - DNA, 20 bp, Artificial
  CRISPR gRNA sequence
ggtagaggcttggaaaaaag

SEQ ID NO: 263925 - DNA, 20 bp, Artificial
  CRISPR gRNA sequence
gtagaggcttggaaaaaaga

SEQ ID NO: 263926 - DNA, 20 bp, Artificial
  CRISPR gRNA sequence
ggaaaaaagagtttagactt

SEQ ID NO: 263927 - DNA, 20 bp, Artificial
  CRISPR gRNA sequence
gaaaaaagagtttagacttc

SEQ ID NO: 263928 - DNA, 20 bp, Artificial
  CRISPR gRNA sequence
agacttctcactatttcaat

SEQ ID NO: 263929 - DNA, 20 bp, Artificial
  CRISPR gRNA sequence
gacttctcactatttcaatg

SEQ ID NO: 263930 - DNA, 20 bp, Artificial
  CRISPR gRNA sequence
ctcactatttcaatgttaat

SEQ ID NO: 263931 - DNA, 20 bp, Artificial
  CRISPR gRNA sequence
tcactatttcaatgttaatt

SEQ ID NO: 263932 - DNA, 20 bp, Artificial
  CRISPR gRNA sequence
actatttcaatgttaatttc

SEQ ID NO: 263933 - DNA, 20 bp, Artificial
  CRISPR gRNA sequence
tttcaatgttaatttcaaag

SEQ ID NO: 263934 - DNA, 20 bp, Artificial
  CRISPR gRNA sequence
caatgttaatttcaaaggca

SEQ ID NO: 263935 - DNA, 20 bp, Artificial
  CRISPR gRNA sequence
aatgttaatttcaaaggcat

SEQ ID NO: 263936 - DNA, 20 bp, Artificial
  CRISPR gRNA sequence
atttcaaaggcatgtttatt

SEQ ID NO: 263937 - DNA, 20 bp, Artificial
  CRISPR gRNA sequence
caaaggcatgtttatttagt

SEQ ID NO: 263938 - DNA, 20 bp, Artificial
  CRISPR gRNA sequence
aaaggcatgtttatttagtc

SEQ ID NO: 263939 - DNA, 20 bp, Artificial
  CRISPR gRNA sequence
atttagtctcgtgtcaccat

SEQ ID NO: 263940 - DNA, 20 bp, Artificial
  CRISPR gRNA sequence
tttagtctcgtgtcaccatg

SEQ ID NO: 263941 - DNA, 20 bp, Artificial
  CRISPR gRNA sequence
agtctcgtgtcaccatgcag

SEQ ID NO: 263942 - DNA, 20 bp, Artificial
  CRISPR gRNA sequence
gtctcgtgtcaccatgcagg

SEQ ID NO: 263943 - DNA, 20 bp, Artificial
  CRISPR gRNA sequence
gtgtcaccatgcaggttata

SEQ ID NO: 263944 - DNA, 20 bp, Artificial
  CRISPR gRNA sequence
tatgtgcttctgttttcatt

SEQ ID NO: 263945 - DNA, 20 bp, Artificial
  CRISPR gRNA sequence
ctgttttcattgctggaaga

SEQ ID NO: 263946 - DNA, 20 bp, Artificial
  CRISPR gRNA sequence
tgttttcattgctggaagag

SEQ ID NO: 263947 - DNA, 20 bp, Artificial
  CRISPR gRNA sequence
ttttcattgctggaagagaa

SEQ ID NO: 263948 - DNA, 20 bp, Artificial
  CRISPR gRNA sequence
tcattgctggaagagaacct

SEQ ID NO: 263949 - DNA, 20 bp, Artificial
  CRISPR gRNA sequence
cattgctggaagagaacctg

SEQ ID NO: 263950 - DNA, 20 bp, Artificial
  CRISPR gRNA sequence
attgctggaagagaacctgc

SEQ ID NO: 263951 - DNA, 20 bp, Artificial
  CRISPR gRNA sequence
ctggaagagaacctgcaagg

SEQ ID NO: 263952 - DNA, 20 bp, Artificial
  CRISPR gRNA sequence
gaagagaacctgcaaggtgg

SEQ ID NO: 263953 - DNA, 20 bp, Artificial
  CRISPR gRNA sequence
caaggtggtggagaagttct

SEQ ID NO: 263954 - DNA, 20 bp, Artificial
  CRISPR gRNA sequence
ttacttaactttgagctgct

SEQ ID NO: 263955 - DNA, 20 bp, Artificial
  CRISPR gRNA sequence
acttaactttgagctgctcc

SEQ ID NO: 263956 - DNA, 20 bp, Artificial
  CRISPR gRNA sequence
cttaactttgagctgctccc

SEQ ID NO: 263957 - DNA, 20 bp, Artificial
  CRISPR gRNA sequence
aactttgagctgctccctta

SEQ ID NO: 263958 - DNA, 20 bp, Artificial
  CRISPR gRNA sequence
actttgagctgctcccttat

SEQ ID NO: 263959 - DNA, 20 bp, Artificial
  CRISPR gRNA sequence
tgagctgctcccttatctct

SEQ ID NO: 263960 - DNA, 20 bp, Artificial
  CRISPR gRNA sequence
gagctgctcccttatctctg

SEQ ID NO: 263961 - DNA, 20 bp, Artificial
  CRISPR gRNA sequence
agctgctcccttatctctgc

SEQ ID NO: 263962 - DNA, 20 bp, Artificial
  CRISPR gRNA sequence
ctcccttatctctgcattac

SEQ ID NO: 263963 - DNA, 20 bp, Artificial
  CRISPR gRNA sequence
ccttatctctgcattaccat

SEQ ID NO: 263964 - DNA, 20 bp, Artificial
  CRISPR gRNA sequence
atctctgcattaccattact

SEQ ID NO: 263965 - DNA, 20 bp, Artificial
  CRISPR gRNA sequence
tctctgcattaccattactg

SEQ ID NO: 263966 - DNA, 20 bp, Artificial
  CRISPR gRNA sequence
tgcattaccattactgtcat

SEQ ID NO: 263967 - DNA, 20 bp, Artificial
  CRISPR gRNA sequence
cattaccattactgtcatct

SEQ ID NO: 263968 - DNA, 20 bp, Artificial
  CRISPR gRNA sequence
ccattactgtcatctttttc

SEQ ID NO: 263969 - DNA, 20 bp, Artificial
  CRISPR gRNA sequence
ctgtcatctttttctttgtc

SEQ ID NO: 263970 - DNA, 20 bp, Artificial
  CRISPR gRNA sequence
tcatctttttctttgtcatc

SEQ ID NO: 263971 - DNA, 20 bp, Artificial
  CRISPR gRNA sequence
tttctttgtcatcatcttca

SEQ ID NO: 263972 - DNA, 20 bp, Artificial
  CRISPR gRNA sequence
ttctttgtcatcatcttcat

SEQ ID NO: 263973 - DNA, 20 bp, Artificial
  CRISPR gRNA sequence
tctttgtcatcatcttcatt

SEQ ID NO: 263974 - DNA, 20 bp, Artificial
  CRISPR gRNA sequence
ctttgtcatcatcttcatta

SEQ ID NO: 263975 - DNA, 20 bp, Artificial
  CRISPR gRNA sequence
tttgtcatcatcttcattat

SEQ ID NO: 263976 - DNA, 20 bp, Artificial
  CRISPR gRNA sequence
tgtcatcatcttcattatct

SEQ ID NO: 263977 - DNA, 20 bp, Artificial
  CRISPR gRNA sequence
gtcatcatcttcattatctt

SEQ ID NO: 263978 - DNA, 20 bp, Artificial
  CRISPR gRNA sequence
tcatcatcttcattatcttg

SEQ ID NO: 263979 - DNA, 20 bp, Artificial
  CRISPR gRNA sequence
cattatcttgggtattgtgg

SEQ ID NO: 263980 - DNA, 20 bp, Artificial
  CRISPR gRNA sequence
attatcttgggtattgtggc

SEQ ID NO: 263981 - DNA, 20 bp, Artificial
  CRISPR gRNA sequence
tcttgggtattgtggctgac

SEQ ID NO: 263982 - DNA, 20 bp, Artificial
  CRISPR gRNA sequence
gggtattgtggctgacaata

SEQ ID NO: 263983 - DNA, 20 bp, Artificial
  CRISPR gRNA sequence
ggtattgtggctgacaatat

SEQ ID NO: 263984 - DNA, 20 bp, Artificial
  CRISPR gRNA sequence
tggctgacaatataaccagg

SEQ ID NO: 263985 - DNA, 20 bp, Artificial
  CRISPR gRNA sequence
acaatataaccaggttaatg

SEQ ID NO: 263986 - DNA, 20 bp, Artificial
  CRISPR gRNA sequence
atggttcctgatggtatcat

SEQ ID NO: 263987 - DNA, 20 bp, Artificial
  CRISPR gRNA sequence
ctgatggtatcattcagaat

SEQ ID NO: 263988 - DNA, 20 bp, Artificial
  CRISPR gRNA sequence
atggtatcattcagaattac

SEQ ID NO: 263989 - DNA, 20 bp, Artificial
  CRISPR gRNA sequence
agaattactcactcatagtt

SEQ ID NO: 263990 - DNA, 20 bp, Artificial
  CRISPR gRNA sequence
ctcactcatagttcactttg

SEQ ID NO: 263991 - DNA, 20 bp, Artificial
  CRISPR gRNA sequence
actcatagttcactttggcc

SEQ ID NO: 263992 - DNA, 20 bp, Artificial
  CRISPR gRNA sequence
atagttcactttggcctctg

SEQ ID NO: 263993 - DNA, 20 bp, Artificial
  CRISPR gRNA sequence
actttggcctctgatctaat

SEQ ID NO: 263994 - DNA, 20 bp, Artificial
  CRISPR gRNA sequence
tggcctctgatctaattgtg

SEQ ID NO: 263995 - DNA, 20 bp, Artificial
  CRISPR gRNA sequence
ggcctctgatctaattgtga

SEQ ID NO: 263996 - DNA, 20 bp, Artificial
  CRISPR gRNA sequence
gcctctgatctaattgtgag

SEQ ID NO: 263997 - DNA, 20 bp, Artificial
  CRISPR gRNA sequence
tgatctaattgtgagcccct

SEQ ID NO: 263998 - DNA, 20 bp, Artificial
  CRISPR gRNA sequence
atctaattgtgagccccttt

SEQ ID NO: 263999 - DNA, 20 bp, Artificial
  CRISPR gRNA sequence
attgtgagcccctttctgca

SEQ ID NO: 264000 - DNA, 20 bp, Artificial
  CRISPR gRNA sequence
tgagcccctttctgcaatat

SEQ ID NO: 264001 - DNA, 20 bp, Artificial
  CRISPR gRNA sequence
tctgcaatatctgaatcacc

SEQ ID NO: 264002 - DNA, 20 bp, Artificial
  CRISPR gRNA sequence
ctgcaatatctgaatcacct

SEQ ID NO: 264003 - DNA, 20 bp, Artificial
  CRISPR gRNA sequence
tgcaatatctgaatcacctc

SEQ ID NO: 264004 - DNA, 20 bp, Artificial
  CRISPR gRNA sequence
caatatctgaatcacctcat

SEQ ID NO: 264005 - DNA, 20 bp, Artificial
  CRISPR gRNA sequence
aatcacctcattggctcaca

SEQ ID NO: 264006 - DNA, 20 bp, Artificial
  CRISPR gRNA sequence
attggctcacaatccaccat

SEQ ID NO: 264007 - DNA, 20 bp, Artificial
  CRISPR gRNA sequence
gctcacaatccaccatgtaa

SEQ ID NO: 264008 - DNA, 20 bp, Artificial
  CRISPR gRNA sequence
acaatccaccatgtaatcta

SEQ ID NO: 264009 - DNA, 20 bp, Artificial
  CRISPR gRNA sequence
cttgtctttcatgttagact

SEQ ID NO: 264010 - DNA, 20 bp, Artificial
  CRISPR gRNA sequence
gtctttcatgttagactttt

SEQ ID NO: 264011 - DNA, 20 bp, Artificial
  CRISPR gRNA sequence
tctttcatgttagacttttc

SEQ ID NO: 264012 - DNA, 20 bp, Artificial
  CRISPR gRNA sequence
tcatgttagacttttcgtga

SEQ ID NO: 264013 - DNA, 20 bp, Artificial
  CRISPR gRNA sequence
catgttagacttttcgtgaa

SEQ ID NO: 264014 - DNA, 20 bp, Artificial
  CRISPR gRNA sequence
atgttagacttttcgtgaaa

SEQ ID NO: 264015 - DNA, 20 bp, Artificial
  CRISPR gRNA sequence
gacttttcgtgaaagatcca

SEQ ID NO: 264016 - DNA, 20 bp, Artificial
  CRISPR gRNA sequence
ttcgtgaaagatccacctcc

SEQ ID NO: 264017 - DNA, 20 bp, Artificial
  CRISPR gRNA sequence
tcgtgaaagatccacctcct

SEQ ID NO: 264018 - DNA, 20 bp, Artificial
  CRISPR gRNA sequence
cgtgaaagatccacctcctc

SEQ ID NO: 264019 - DNA, 20 bp, Artificial
  CRISPR gRNA sequence
gtgaaagatccacctcctcg

SEQ ID NO: 264020 - DNA, 20 bp, Artificial
  CRISPR gRNA sequence
ctcgaagaagcttctggata

SEQ ID NO: 264021 - DNA, 20 bp, Artificial
  CRISPR gRNA sequence
gaagaagcttctggatactt

SEQ ID NO: 264022 - DNA, 20 bp, Artificial
  CRISPR gRNA sequence
ctggatacttcagcctttat

SEQ ID NO: 264023 - DNA, 20 bp, Artificial
  CRISPR gRNA sequence
tggatacttcagcctttatt

SEQ ID NO: 264024 - DNA, 20 bp, Artificial
  CRISPR gRNA sequence
gatacttcagcctttattgt

SEQ ID NO: 264025 - DNA, 20 bp, Artificial
  CRISPR gRNA sequence
cagcctttattgtggtcttg

SEQ ID NO: 264026 - DNA, 20 bp, Artificial
  CRISPR gRNA sequence
agcctttattgtggtcttgg

SEQ ID NO: 264027 - DNA, 20 bp, Artificial
  CRISPR gRNA sequence
tattgtggtcttggaagagg

SEQ ID NO: 264028 - DNA, 20 bp, Artificial
  CRISPR gRNA sequence
attgtggtcttggaagagga

SEQ ID NO: 264029 - DNA, 20 bp, Artificial
  CRISPR gRNA sequence
ttgtggtcttggaagaggag

SEQ ID NO: 264030 - DNA, 20 bp, Artificial
  CRISPR gRNA sequence
tggtcttggaagaggagttc

SEQ ID NO: 264031 - DNA, 20 bp, Artificial
  CRISPR gRNA sequence
ggaagaggagttctgatgga

SEQ ID NO: 264032 - DNA, 20 bp, Artificial
  CRISPR gRNA sequence
gaagaggagttctgatggaa

SEQ ID NO: 264033 - DNA, 20 bp, Artificial
  CRISPR gRNA sequence
tgatggaagtgtatctcaac

SEQ ID NO: 264034 - DNA, 20 bp, Artificial
  CRISPR gRNA sequence
atggaagtgtatctcaactt

SEQ ID NO: 264035 - DNA, 20 bp, Artificial
  CRISPR gRNA sequence
aacttaacaaatatttatta

SEQ ID NO: 264036 - DNA, 20 bp, Artificial
  CRISPR gRNA sequence
aacaaatatttattaaacct

SEQ ID NO: 264037 - DNA, 20 bp, Artificial
  CRISPR gRNA sequence
acaaatatttattaaacctc

SEQ ID NO: 264038 - DNA, 20 bp, Artificial
  CRISPR gRNA sequence
attaaacctctcatatttta

SEQ ID NO: 264039 - DNA, 20 bp, Artificial
  CRISPR gRNA sequence
ttaaacctctcatattttaa

SEQ ID NO: 264040 - DNA, 20 bp, Artificial
  CRISPR gRNA sequence
aacctctcatattttaatct

SEQ ID NO: 264041 - DNA, 20 bp, Artificial
  CRISPR gRNA sequence
tcatattttaatctccatca

SEQ ID NO: 264042 - DNA, 20 bp, Artificial
  CRISPR gRNA sequence
atattttaatctccatcaga

SEQ ID NO: 264043 - DNA, 20 bp, Artificial
  CRISPR gRNA sequence
taatctccatcagagtttca

SEQ ID NO: 264044 - DNA, 20 bp, Artificial
  CRISPR gRNA sequence
aatctccatcagagtttcag

SEQ ID NO: 264045 - DNA, 20 bp, Artificial
  CRISPR gRNA sequence
atctccatcagagtttcaga

SEQ ID NO: 264046 - DNA, 20 bp, Artificial
  CRISPR gRNA sequence
catcagagtttcagagaata

SEQ ID NO: 264047 - DNA, 20 bp, Artificial
  CRISPR gRNA sequence
cagagaatataaaaagaaat

SEQ ID NO: 264048 - DNA, 20 bp, Artificial
  CRISPR gRNA sequence
agagaatataaaaagaaata

SEQ ID NO: 264049 - DNA, 20 bp, Artificial
  CRISPR gRNA sequence
acacctgtaaccccagcact

SEQ ID NO: 264050 - DNA, 20 bp, Artificial
  CRISPR gRNA sequence
taaccccagcactttgggag

SEQ ID NO: 264051 - DNA, 20 bp, Artificial
  CRISPR gRNA sequence
tgggagaccaaggcaggcag

SEQ ID NO: 264052 - DNA, 20 bp, Artificial
  CRISPR gRNA sequence
gggagaccaaggcaggcaga

SEQ ID NO: 264053 - DNA, 20 bp, Artificial
  CRISPR gRNA sequence
ggagaccaaggcaggcagat

SEQ ID NO: 264054 - DNA, 20 bp, Artificial
  CRISPR gRNA sequence
aggtcagaagtttgagacca

SEQ ID NO: 264055 - DNA, 20 bp, Artificial
  CRISPR gRNA sequence
gagaccagtctggccaatat

SEQ ID NO: 264056 - DNA, 20 bp, Artificial
  CRISPR gRNA sequence
agaccagtctggccaatatg

SEQ ID NO: 264057 - DNA, 20 bp, Artificial
  CRISPR gRNA sequence
gccaatatggtgaaacccca

SEQ ID NO: 264058 - DNA, 20 bp, Artificial
  CRISPR gRNA sequence
tactaaaaatacaaaaatta

SEQ ID NO: 264059 - DNA, 20 bp, Artificial
  CRISPR gRNA sequence
ctaaaaatacaaaaattagc

SEQ ID NO: 264060 - DNA, 20 bp, Artificial
  CRISPR gRNA sequence
aaaatacaaaaattagccag

SEQ ID NO: 264061 - DNA, 20 bp, Artificial
  CRISPR gRNA sequence
gccaggcgtggtggtacaca

SEQ ID NO: 264062 - DNA, 20 bp, Artificial
  CRISPR gRNA sequence
tagtcccagctactggggag

SEQ ID NO: 264063 - DNA, 20 bp, Artificial
  CRISPR gRNA sequence
ctggggaggctgaggtagga

SEQ ID NO: 264064 - DNA, 20 bp, Artificial
  CRISPR gRNA sequence
gggaggctgaggtaggagaa

SEQ ID NO: 264065 - DNA, 20 bp, Artificial
  CRISPR gRNA sequence
aggtaggagaattgcttgaa

SEQ ID NO: 264066 - DNA, 20 bp, Artificial
  CRISPR gRNA sequence
cttgaacctaggaggcagag

SEQ ID NO: 264067 - DNA, 20 bp, Artificial
  CRISPR gRNA sequence
gaacctaggaggcagaggtt

SEQ ID NO: 264068 - DNA, 20 bp, Artificial
  CRISPR gRNA sequence
aacctaggaggcagaggttg

SEQ ID NO: 264069 - DNA, 20 bp, Artificial
  CRISPR gRNA sequence
ggaggcagaggttgcagtga

SEQ ID NO: 264070 - DNA, 20 bp, Artificial
  CRISPR gRNA sequence
cagtgagcagagattgtgtc

SEQ ID NO: 264071 - DNA, 20 bp, Artificial
  CRISPR gRNA sequence
tgtcaatgcactccagcctg

SEQ ID NO: 264072 - DNA, 20 bp, Artificial
  CRISPR gRNA sequence
cagcctgggtgacagagcga

SEQ ID NO: 264073 - DNA, 20 bp, Artificial
  CRISPR gRNA sequence
ggtgacagagcgagattccg

SEQ ID NO: 264074 - DNA, 20 bp, Artificial
  CRISPR gRNA sequence
cgtctcaacaacaacaaaaa

SEQ ID NO: 264075 - DNA, 20 bp, Artificial
  CRISPR gRNA sequence
aacaacaacaaaaaaaagaa

SEQ ID NO: 264076 - DNA, 20 bp, Artificial
  CRISPR gRNA sequence
tgtagtacaagtaattaggt

SEQ ID NO: 264077 - DNA, 20 bp, Artificial
  CRISPR gRNA sequence
ggtagttaactgagttctct

SEQ ID NO: 264078 - DNA, 20 bp, Artificial
  CRISPR gRNA sequence
actgagttctctctgctttt

SEQ ID NO: 264079 - DNA, 20 bp, Artificial
  CRISPR gRNA sequence
agttctctctgcttttacag

SEQ ID NO: 264080 - DNA, 20 bp, Artificial
  CRISPR gRNA sequence
tctctgcttttacagcccct

SEQ ID NO: 264081 - DNA, 20 bp, Artificial
  CRISPR gRNA sequence
tctgcttttacagcccctat

SEQ ID NO: 264082 - DNA, 20 bp, Artificial
  CRISPR gRNA sequence
tgcttttacagcccctatga

SEQ ID NO: 264083 - DNA, 20 bp, Artificial
  CRISPR gRNA sequence
cttttacagcccctatgatt

SEQ ID NO: 264084 - DNA, 20 bp, Artificial
  CRISPR gRNA sequence
ttacagcccctatgatttag

SEQ ID NO: 264085 - DNA, 20 bp, Artificial
  CRISPR gRNA sequence
tacagcccctatgatttagt

SEQ ID NO: 264086 - DNA, 20 bp, Artificial
  CRISPR gRNA sequence
acagcccctatgatttagtt

SEQ ID NO: 264087 - DNA, 20 bp, Artificial
  CRISPR gRNA sequence
cagcccctatgatttagttg

SEQ ID NO: 264088 - DNA, 20 bp, Artificial
  CRISPR gRNA sequence
tgatttagttgagtaggtta

SEQ ID NO: 264089 - DNA, 20 bp, Artificial
  CRISPR gRNA sequence
agttgagtaggttatatata

SEQ ID NO: 264090 - DNA, 20 bp, Artificial
  CRISPR gRNA sequence
gttgagtaggttatatataa

SEQ ID NO: 264091 - DNA, 20 bp, Artificial
  CRISPR gRNA sequence
agtaggttatatataatagg

SEQ ID NO: 264092 - DNA, 20 bp, Artificial
  CRISPR gRNA sequence
tatataataggaggatgtaa

SEQ ID NO: 264093 - DNA, 20 bp, Artificial
  CRISPR gRNA sequence
gaaacagataaataacactt

SEQ ID NO: 264094 - DNA, 20 bp, Artificial
  CRISPR gRNA sequence
ggcagtcactacctcaccat

SEQ ID NO: 264095 - DNA, 20 bp, Artificial
  CRISPR gRNA sequence
gcagtcactacctcaccatg

SEQ ID NO: 264096 - DNA, 20 bp, Artificial
  CRISPR gRNA sequence
cctcaccatgctatttgatg

SEQ ID NO: 264097 - DNA, 20 bp, Artificial
  CRISPR gRNA sequence
accatgctatttgatgacta

SEQ ID NO: 264098 - DNA, 20 bp, Artificial
  CRISPR gRNA sequence
tttgatgactaaaggacttt

SEQ ID NO: 264099 - DNA, 20 bp, Artificial
  CRISPR gRNA sequence
gatgactaaaggactttggt

SEQ ID NO: 264100 - DNA, 20 bp, Artificial
  CRISPR gRNA sequence
atgactaaaggactttggtt

SEQ ID NO: 264101 - DNA, 20 bp, Artificial
  CRISPR gRNA sequence
aaggactttggtttgcctac

SEQ ID NO: 264102 - DNA, 20 bp, Artificial
  CRISPR gRNA sequence
tggtttgcctacattatttt

SEQ ID NO: 264103 - DNA, 20 bp, Artificial
  CRISPR gRNA sequence
ggtttgcctacattattttt

SEQ ID NO: 264104 - DNA, 20 bp, Artificial
  CRISPR gRNA sequence
gtttgcctacattattttta

SEQ ID NO: 264105 - DNA, 20 bp, Artificial
  CRISPR gRNA sequence
gcctacattatttttataat

SEQ ID NO: 264106 - DNA, 20 bp, Artificial
  CRISPR gRNA sequence
cctacattatttttataatc

SEQ ID NO: 264107 - DNA, 20 bp, Artificial
  CRISPR gRNA sequence
cattatttttataatctgaa

SEQ ID NO: 264108 - DNA, 20 bp, Artificial
  CRISPR gRNA sequence
tttttataatctgaaatgtc

SEQ ID NO: 264109 - DNA, 20 bp, Artificial
  CRISPR gRNA sequence
ttataatctgaaatgtcctc

SEQ ID NO: 264110 - DNA, 20 bp, Artificial
  CRISPR gRNA sequence
tataatctgaaatgtcctct

SEQ ID NO: 264111 - DNA, 20 bp, Artificial
  CRISPR gRNA sequence
ataatctgaaatgtcctcta

SEQ ID NO: 264112 - DNA, 20 bp, Artificial
  CRISPR gRNA sequence
taatctgaaatgtcctctac

SEQ ID NO: 264113 - DNA, 20 bp, Artificial
  CRISPR gRNA sequence
aaatgtcctctacacctctc

SEQ ID NO: 264114 - DNA, 20 bp, Artificial
  CRISPR gRNA sequence
tacacctctcacctgaagaa

SEQ ID NO: 264115 - DNA, 20 bp, Artificial
  CRISPR gRNA sequence
cacctctcacctgaagaagc

SEQ ID NO: 264116 - DNA, 20 bp, Artificial
  CRISPR gRNA sequence
tcacctgaagaagccttctc

SEQ ID NO: 264117 - DNA, 20 bp, Artificial
  CRISPR gRNA sequence
acctgaagaagccttctctg

SEQ ID NO: 264118 - DNA, 20 bp, Artificial
  CRISPR gRNA sequence
aagaagccttctctgagacc

SEQ ID NO: 264119 - DNA, 20 bp, Artificial
  CRISPR gRNA sequence
ctctgagaccccaaatggca

SEQ ID NO: 264120 - DNA, 20 bp, Artificial
  CRISPR gRNA sequence
tctgagaccccaaatggcaa

SEQ ID NO: 264121 - DNA, 20 bp, Artificial
  CRISPR gRNA sequence
tgagaccccaaatggcaaag

SEQ ID NO: 264122 - DNA, 20 bp, Artificial
  CRISPR gRNA sequence
agaccccaaatggcaaagag

SEQ ID NO: 264123 - DNA, 20 bp, Artificial
  CRISPR gRNA sequence
ccttccctctcaagtttctc

SEQ ID NO: 264124 - DNA, 20 bp, Artificial
  CRISPR gRNA sequence
cttccctctcaagtttctcc

SEQ ID NO: 264125 - DNA, 20 bp, Artificial
  CRISPR gRNA sequence
ccctctcaagtttctccaaa

SEQ ID NO: 264126 - DNA, 20 bp, Artificial
  CRISPR gRNA sequence
cctctcaagtttctccaaat

SEQ ID NO: 264127 - DNA, 20 bp, Artificial
  CRISPR gRNA sequence
tcaagtttctccaaattatt

SEQ ID NO: 264128 - DNA, 20 bp, Artificial
  CRISPR gRNA sequence
aagtttctccaaattattac

SEQ ID NO: 264129 - DNA, 20 bp, Artificial
  CRISPR gRNA sequence
ctccaaattattactgtgta

SEQ ID NO: 264130 - DNA, 20 bp, Artificial
  CRISPR gRNA sequence
tccaaattattactgtgtat

SEQ ID NO: 264131 - DNA, 20 bp, Artificial
  CRISPR gRNA sequence
caaattattactgtgtattg

SEQ ID NO: 264132 - DNA, 20 bp, Artificial
  CRISPR gRNA sequence
ttactgtgtattgacacatt

SEQ ID NO: 264133 - DNA, 20 bp, Artificial
  CRISPR gRNA sequence
ctgtgtattgacacatttat

SEQ ID NO: 264134 - DNA, 20 bp, Artificial
  CRISPR gRNA sequence
tgtattgacacatttatttt

SEQ ID NO: 264135 - DNA, 20 bp, Artificial
  CRISPR gRNA sequence
acacatttattttcttttcc

SEQ ID NO: 264136 - DNA, 20 bp, Artificial
  CRISPR gRNA sequence
attttcttttccactagact

SEQ ID NO: 264137 - DNA, 20 bp, Artificial
  CRISPR gRNA sequence
ttttcttttccactagacta

SEQ ID NO: 264138 - DNA, 20 bp, Artificial
  CRISPR gRNA sequence
tcttttccactagactatga

SEQ ID NO: 264139 - DNA, 20 bp, Artificial
  CRISPR gRNA sequence
cttttccactagactatgaa

SEQ ID NO: 264140 - DNA, 20 bp, Artificial
  CRISPR gRNA sequence
ttttccactagactatgaac

SEQ ID NO: 264141 - DNA, 20 bp, Artificial
  CRISPR gRNA sequence
ttccactagactatgaactc

SEQ ID NO: 264142 - DNA, 20 bp, Artificial
  CRISPR gRNA sequence
tccactagactatgaactcc

SEQ ID NO: 264143 - DNA, 20 bp, Artificial
  CRISPR gRNA sequence
ccactagactatgaactcct

SEQ ID NO: 264144 - DNA, 20 bp, Artificial
  CRISPR gRNA sequence
cactagactatgaactcctt

SEQ ID NO: 264145 - DNA, 20 bp, Artificial
  CRISPR gRNA sequence
gactatgaactccttgaggg

SEQ ID NO: 264146 - DNA, 20 bp, Artificial
  CRISPR gRNA sequence
tgaactccttgagggcagaa

SEQ ID NO: 264147 - DNA, 20 bp, Artificial
  CRISPR gRNA sequence
cttgagggcagaatcatgtc

SEQ ID NO: 264148 - DNA, 20 bp, Artificial
  CRISPR gRNA sequence
gagggcagaatcatgtctta

SEQ ID NO: 264149 - DNA, 20 bp, Artificial
  CRISPR gRNA sequence
agggcagaatcatgtcttat

SEQ ID NO: 264150 - DNA, 20 bp, Artificial
  CRISPR gRNA sequence
attcatccttctaacctctg

SEQ ID NO: 264151 - DNA, 20 bp, Artificial
  CRISPR gRNA sequence
ttcatccttctaacctctgt

SEQ ID NO: 264152 - DNA, 20 bp, Artificial
  CRISPR gRNA sequence
atccttctaacctctgtatt

SEQ ID NO: 264153 - DNA, 20 bp, Artificial
  CRISPR gRNA sequence
ctaacctctgtattaggcac

SEQ ID NO: 264154 - DNA, 20 bp, Artificial
  CRISPR gRNA sequence
taacctctgtattaggcaca

SEQ ID NO: 264155 - DNA, 20 bp, Artificial
  CRISPR gRNA sequence
acctctgtattaggcacaat

SEQ ID NO: 264156 - DNA, 20 bp, Artificial
  CRISPR gRNA sequence
tgtattaggcacaatgctgt

SEQ ID NO: 264157 - DNA, 20 bp, Artificial
  CRISPR gRNA sequence
tattaggcacaatgctgtaa

SEQ ID NO: 264158 - DNA, 20 bp, Artificial
  CRISPR gRNA sequence
ggcacaatgctgtaagcata

SEQ ID NO: 264159 - DNA, 20 bp, Artificial
  CRISPR gRNA sequence
taagcatatagttactcaat

SEQ ID NO: 264160 - DNA, 20 bp, Artificial
  CRISPR gRNA sequence
ctcaataaatatttgttgaa

SEQ ID NO: 264161 - DNA, 20 bp, Artificial
  CRISPR gRNA sequence
aataaatatttgttgaagaa

SEQ ID NO: 264162 - DNA, 20 bp, Artificial
  CRISPR gRNA sequence
gttgaagaaagaaatgaatg

SEQ ID NO: 264163 - DNA, 20 bp, Artificial
  CRISPR gRNA sequence
ttgaagaaagaaatgaatga

SEQ ID NO: 264164 - DNA, 20 bp, Artificial
  CRISPR gRNA sequence
aagaaagaaatgaatgaatt

SEQ ID NO: 264165 - DNA, 20 bp, Artificial
  CRISPR gRNA sequence
gtaacaaaatgaggaagcat

SEQ ID NO: 264166 - DNA, 20 bp, Artificial
  CRISPR gRNA sequence
gtaagattaatgtagaaagg

SEQ ID NO: 264167 - DNA, 20 bp, Artificial
  CRISPR gRNA sequence
atgtagaaaggtaagccttt

SEQ ID NO: 264168 - DNA, 20 bp, Artificial
  CRISPR gRNA sequence
tatggagagttgggaattag

SEQ ID NO: 264169 - DNA, 20 bp, Artificial
  CRISPR gRNA sequence
atggagagttgggaattaga

SEQ ID NO: 264170 - DNA, 20 bp, Artificial
  CRISPR gRNA sequence
tggagagttgggaattagac

SEQ ID NO: 264171 - DNA, 20 bp, Artificial
  CRISPR gRNA sequence
ggaattagactggacagtag

SEQ ID NO: 264172 - DNA, 20 bp, Artificial
  CRISPR gRNA sequence
gactggacagtagacaagat

SEQ ID NO: 264173 - DNA, 20 bp, Artificial
  CRISPR gRNA sequence
gacagtagacaagatttgaa

SEQ ID NO: 264174 - DNA, 20 bp, Artificial
  CRISPR gRNA sequence
gaatgaacgttgttattaat

SEQ ID NO: 264175 - DNA, 20 bp, Artificial
  CRISPR gRNA sequence
aatgaacgttgttattaata

SEQ ID NO: 264176 - DNA, 20 bp, Artificial
  CRISPR gRNA sequence
ttattaataataattgctag

SEQ ID NO: 264177 - DNA, 20 bp, Artificial
  CRISPR gRNA sequence
ttaataataattgctagcta

SEQ ID NO: 264178 - DNA, 20 bp, Artificial
  CRISPR gRNA sequence
ataataattgctagctaaca

SEQ ID NO: 264179 - DNA, 20 bp, Artificial
  CRISPR gRNA sequence
ctagctaacatttattttgc

SEQ ID NO: 264180 - DNA, 20 bp, Artificial
  CRISPR gRNA sequence
gctaacatttattttgcact

SEQ ID NO: 264181 - DNA, 20 bp, Artificial
  CRISPR gRNA sequence
acatttattttgcacttata

SEQ ID NO: 264182 - DNA, 20 bp, Artificial
  CRISPR gRNA sequence
attttgcacttataatgtgc

SEQ ID NO: 264183 - DNA, 20 bp, Artificial
  CRISPR gRNA sequence
ttttgcacttataatgtgcc

SEQ ID NO: 264184 - DNA, 20 bp, Artificial
  CRISPR gRNA sequence
tgcacttataatgtgccagg

SEQ ID NO: 264185 - DNA, 20 bp, Artificial
  CRISPR gRNA sequence
gcacttataatgtgccaggt

SEQ ID NO: 264186 - DNA, 20 bp, Artificial
  CRISPR gRNA sequence
cacttataatgtgccaggta

SEQ ID NO: 264187 - DNA, 20 bp, Artificial
  CRISPR gRNA sequence
ataatgtgccaggtagtgtt

SEQ ID NO: 264188 - DNA, 20 bp, Artificial
  CRISPR gRNA sequence
taatgtgccaggtagtgttc

SEQ ID NO: 264189 - DNA, 20 bp, Artificial
  CRISPR gRNA sequence
tgcctggctttccctgtatt

SEQ ID NO: 264190 - DNA, 20 bp, Artificial
  CRISPR gRNA sequence
cctggctttccctgtattaa

SEQ ID NO: 264191 - DNA, 20 bp, Artificial
  CRISPR gRNA sequence
gctttccctgtattaagtca

SEQ ID NO: 264192 - DNA, 20 bp, Artificial
  CRISPR gRNA sequence
tccctgtattaagtcatcta

SEQ ID NO: 264193 - DNA, 20 bp, Artificial
  CRISPR gRNA sequence
ccctgtattaagtcatctaa

SEQ ID NO: 264194 - DNA, 20 bp, Artificial
  CRISPR gRNA sequence
cctgtattaagtcatctaat

SEQ ID NO: 264195 - DNA, 20 bp, Artificial
  CRISPR gRNA sequence
tattaagtcatctaatctcc

SEQ ID NO: 264196 - DNA, 20 bp, Artificial
  CRISPR gRNA sequence
agtcatctaatctccaagtc

SEQ ID NO: 264197 - DNA, 20 bp, Artificial
  CRISPR gRNA sequence
atctccaagtcctatgaggt

SEQ ID NO: 264198 - DNA, 20 bp, Artificial
  CRISPR gRNA sequence
caagtcctatgaggtagtta

SEQ ID NO: 264199 - DNA, 20 bp, Artificial
  CRISPR gRNA sequence
tgaggtagttactatgattg

SEQ ID NO: 264200 - DNA, 20 bp, Artificial
  CRISPR gRNA sequence
ctatgattgctatgattata

SEQ ID NO: 264201 - DNA, 20 bp, Artificial
  CRISPR gRNA sequence
tgattgctatgattatacta

SEQ ID NO: 264202 - DNA, 20 bp, Artificial
  CRISPR gRNA sequence
ctatgattatactatttcat

SEQ ID NO: 264203 - DNA, 20 bp, Artificial
  CRISPR gRNA sequence
tgattatactatttcataga

SEQ ID NO: 264204 - DNA, 20 bp, Artificial
  CRISPR gRNA sequence
tactatttcatagatgggga

SEQ ID NO: 264205 - DNA, 20 bp, Artificial
  CRISPR gRNA sequence
tttcatagatggggaaactg

SEQ ID NO: 264206 - DNA, 20 bp, Artificial
  CRISPR gRNA sequence
catagatggggaaactgaag

SEQ ID NO: 264207 - DNA, 20 bp, Artificial
  CRISPR gRNA sequence
atagatggggaaactgaagc

SEQ ID NO: 264208 - DNA, 20 bp, Artificial
  CRISPR gRNA sequence
aagcacagagtgggtagagc

SEQ ID NO: 264209 - DNA, 20 bp, Artificial
  CRISPR gRNA sequence
gcttatggtcacaaagctac

SEQ ID NO: 264210 - DNA, 20 bp, Artificial
  CRISPR gRNA sequence
cttatggtcacaaagctact

SEQ ID NO: 264211 - DNA, 20 bp, Artificial
  CRISPR gRNA sequence
atggtcacaaagctactaag

SEQ ID NO: 264212 - DNA, 20 bp, Artificial
  CRISPR gRNA sequence
tggtcacaaagctactaagt

SEQ ID NO: 264213 - DNA, 20 bp, Artificial
  CRISPR gRNA sequence
ctaagtatgtaaatccagat

SEQ ID NO: 264214 - DNA, 20 bp, Artificial
  CRISPR gRNA sequence
agtatgtaaatccagatggt

SEQ ID NO: 264215 - DNA, 20 bp, Artificial
  CRISPR gRNA sequence
gctctggggttcatgttctt

SEQ ID NO: 264216 - DNA, 20 bp, Artificial
  CRISPR gRNA sequence
ctctggggttcatgttctta

SEQ ID NO: 264217 - DNA, 20 bp, Artificial
  CRISPR gRNA sequence
tggggttcatgttcttacca

SEQ ID NO: 264218 - DNA, 20 bp, Artificial
  CRISPR gRNA sequence
gggttcatgttcttaccaat

SEQ ID NO: 264219 - DNA, 20 bp, Artificial
  CRISPR gRNA sequence
atgttcttaccaatgctgtg

SEQ ID NO: 264220 - DNA, 20 bp, Artificial
  CRISPR gRNA sequence
ttaccaatgctgtgttgtct

SEQ ID NO: 264221 - DNA, 20 bp, Artificial
  CRISPR gRNA sequence
accaatgctgtgttgtctca

SEQ ID NO: 264222 - DNA, 20 bp, Artificial
  CRISPR gRNA sequence
ccaatgctgtgttgtctcag

SEQ ID NO: 264223 - DNA, 20 bp, Artificial
  CRISPR gRNA sequence
tgttgtctcaggaaggaaaa

SEQ ID NO: 264224 - DNA, 20 bp, Artificial
  CRISPR gRNA sequence
tctcaggaaggaaaaggtgg

SEQ ID NO: 264225 - DNA, 20 bp, Artificial
  CRISPR gRNA sequence
aggaaggaaaaggtggatta

SEQ ID NO: 264226 - DNA, 20 bp, Artificial
  CRISPR gRNA sequence
ataaagaaattaaaccagga

SEQ ID NO: 264227 - DNA, 20 bp, Artificial
  CRISPR gRNA sequence
aaccaggaatactgtttcat

SEQ ID NO: 264228 - DNA, 20 bp, Artificial
  CRISPR gRNA sequence
tttcatgttctcagaacaga

SEQ ID NO: 264229 - DNA, 20 bp, Artificial
  CRISPR gRNA sequence
catgttctcagaacagatgg

SEQ ID NO: 264230 - DNA, 20 bp, Artificial
  CRISPR gRNA sequence
atgttctcagaacagatggc

SEQ ID NO: 264231 - DNA, 20 bp, Artificial
  CRISPR gRNA sequence
tcagaacagatggcaactct

SEQ ID NO: 264232 - DNA, 20 bp, Artificial
  CRISPR gRNA sequence
agaacagatggcaactctga

SEQ ID NO: 264233 - DNA, 20 bp, Artificial
  CRISPR gRNA sequence
tgaatgtgtgaggttatggt

SEQ ID NO: 264234 - DNA, 20 bp, Artificial
  CRISPR gRNA sequence
aatgtgtgaggttatggtga

SEQ ID NO: 264235 - DNA, 20 bp, Artificial
  CRISPR gRNA sequence
tggtgaagcagcggagaatc

SEQ ID NO: 264236 - DNA, 20 bp, Artificial
  CRISPR gRNA sequence
agcaaaggatagaatactgg

SEQ ID NO: 264237 - DNA, 20 bp, Artificial
  CRISPR gRNA sequence
gtaacagaaattcaaacttt

SEQ ID NO: 264238 - DNA, 20 bp, Artificial
  CRISPR gRNA sequence
aaactttattttcaagtcat

SEQ ID NO: 264239 - DNA, 20 bp, Artificial
  CRISPR gRNA sequence
tattttcaagtcattttgaa

SEQ ID NO: 264240 - DNA, 20 bp, Artificial
  CRISPR gRNA sequence
attttcaagtcattttgaag

SEQ ID NO: 264241 - DNA, 20 bp, Artificial
  CRISPR gRNA sequence
ttttcaagtcattttgaagt

SEQ ID NO: 264242 - DNA, 20 bp, Artificial
  CRISPR gRNA sequence
tcaagtcattttgaagtaat

SEQ ID NO: 264243 - DNA, 20 bp, Artificial
  CRISPR gRNA sequence
caagtcattttgaagtaatg

SEQ ID NO: 264244 - DNA, 20 bp, Artificial
  CRISPR gRNA sequence
aagtcattttgaagtaatgg

SEQ ID NO: 264245 - DNA, 20 bp, Artificial
  CRISPR gRNA sequence
tgaagtaatggcctgggtaa

SEQ ID NO: 264246 - DNA, 20 bp, Artificial
  CRISPR gRNA sequence
gaagtaatggcctgggtaag

SEQ ID NO: 264247 - DNA, 20 bp, Artificial
  CRISPR gRNA sequence
aagtaatggcctgggtaaga

SEQ ID NO: 264248 - DNA, 20 bp, Artificial
  CRISPR gRNA sequence
ggtaagaagaaaatatttca

SEQ ID NO: 264249 - DNA, 20 bp, Artificial
  CRISPR gRNA sequence
cagaatccttatctttggaa

SEQ ID NO: 264250 - DNA, 20 bp, Artificial
  CRISPR gRNA sequence
agaatccttatctttggaat

SEQ ID NO: 264251 - DNA, 20 bp, Artificial
  CRISPR gRNA sequence
atctttggaatgaagctgga

SEQ ID NO: 264252 - DNA, 20 bp, Artificial
  CRISPR gRNA sequence
tctttggaatgaagctggag

SEQ ID NO: 264253 - DNA, 20 bp, Artificial
  CRISPR gRNA sequence
tggaatgaagctggagttat

SEQ ID NO: 264254 - DNA, 20 bp, Artificial
  CRISPR gRNA sequence
ggaatgaagctggagttatg

SEQ ID NO: 264255 - DNA, 20 bp, Artificial
  CRISPR gRNA sequence
gaatgaagctggagttatgg

SEQ ID NO: 264256 - DNA, 20 bp, Artificial
  CRISPR gRNA sequence
gagttatgggaatggatggc

SEQ ID NO: 264257 - DNA, 20 bp, Artificial
  CRISPR gRNA sequence
tgggaatggatggctagtcg

SEQ ID NO: 264258 - DNA, 20 bp, Artificial
  CRISPR gRNA sequence
gtcgaaaggagagggcataa

SEQ ID NO: 264259 - DNA, 20 bp, Artificial
  CRISPR gRNA sequence
tagaaaaacagagagtggag

SEQ ID NO: 264260 - DNA, 20 bp, Artificial
  CRISPR gRNA sequence
aatctggaaactaactggct

SEQ ID NO: 264261 - DNA, 20 bp, Artificial
  CRISPR gRNA sequence
gaaactaactggctctgatg

SEQ ID NO: 264262 - DNA, 20 bp, Artificial
  CRISPR gRNA sequence
actggctctgatgggagtca

SEQ ID NO: 264263 - DNA, 20 bp, Artificial
  CRISPR gRNA sequence
gctctgatgggagtcagctg

SEQ ID NO: 264264 - DNA, 20 bp, Artificial
  CRISPR gRNA sequence
tgatgggagtcagctgaaaa

SEQ ID NO: 264265 - DNA, 20 bp, Artificial
  CRISPR gRNA sequence
atgggagtcagctgaaaagg

SEQ ID NO: 264266 - DNA, 20 bp, Artificial
  CRISPR gRNA sequence
aaaaggatggttagctagtg

SEQ ID NO: 264267 - DNA, 20 bp, Artificial
  CRISPR gRNA sequence
gctagtgaaggagacaaaga

SEQ ID NO: 264268 - DNA, 20 bp, Artificial
  CRISPR gRNA sequence
gtgaaggagacaaagaaagt

SEQ ID NO: 264269 - DNA, 20 bp, Artificial
  CRISPR gRNA sequence
gtggaatgccactaagccaa

SEQ ID NO: 264270 - DNA, 20 bp, Artificial
  CRISPR gRNA sequence
agccaatgagggaaagagtt

SEQ ID NO: 264271 - DNA, 20 bp, Artificial
  CRISPR gRNA sequence
caaaaagatagtggttaata

SEQ ID NO: 264272 - DNA, 20 bp, Artificial
  CRISPR gRNA sequence
aaaaagatagtggttaatag

SEQ ID NO: 264273 - DNA, 20 bp, Artificial
  CRISPR gRNA sequence
atagcattaaacataagagg

SEQ ID NO: 264274 - DNA, 20 bp, Artificial
  CRISPR gRNA sequence
aacataagagggaaaggagt

SEQ ID NO: 264275 - DNA, 20 bp, Artificial
  CRISPR gRNA sequence
gggatttggctgaaacgcca

SEQ ID NO: 264276 - DNA, 20 bp, Artificial
  CRISPR gRNA sequence
ggatttggctgaaacgccac

SEQ ID NO: 264277 - DNA, 20 bp, Artificial
  CRISPR gRNA sequence
ggctgaaacgccacctggga

SEQ ID NO: 264278 - DNA, 20 bp, Artificial
  CRISPR gRNA sequence
gctgaaacgccacctgggac

SEQ ID NO: 264279 - DNA, 20 bp, Artificial
  CRISPR gRNA sequence
aaacgccacctgggactttt

SEQ ID NO: 264280 - DNA, 20 bp, Artificial
  CRISPR gRNA sequence
ggacttttgagtttaggcag

SEQ ID NO: 264281 - DNA, 20 bp, Artificial
  CRISPR gRNA sequence
ttgagtttaggcagagacat

SEQ ID NO: 264282 - DNA, 20 bp, Artificial
  CRISPR gRNA sequence
tgagtttaggcagagacatg

SEQ ID NO: 264283 - DNA, 20 bp, Artificial
  CRISPR gRNA sequence
gagtttaggcagagacatgg

SEQ ID NO: 264284 - DNA, 20 bp, Artificial
  CRISPR gRNA sequence
agtttaggcagagacatgga

SEQ ID NO: 264285 - DNA, 20 bp, Artificial
  CRISPR gRNA sequence
aggcagagacatggagaagg

SEQ ID NO: 264286 - DNA, 20 bp, Artificial
  CRISPR gRNA sequence
ggcagagacatggagaagga

SEQ ID NO: 264287 - DNA, 20 bp, Artificial
  CRISPR gRNA sequence
cacaggattaagaaaaagtg

SEQ ID NO: 264288 - DNA, 20 bp, Artificial
  CRISPR gRNA sequence
acaggattaagaaaaagtgg

SEQ ID NO: 264289 - DNA, 20 bp, Artificial
  CRISPR gRNA sequence
agaaaaagtggagggggaca

SEQ ID NO: 264290 - DNA, 20 bp, Artificial
  CRISPR gRNA sequence
ggaacttatatcacctaaaa

SEQ ID NO: 264291 - DNA, 20 bp, Artificial
  CRISPR gRNA sequence
atatcacctaaaatgtctac

SEQ ID NO: 264292 - DNA, 20 bp, Artificial
  CRISPR gRNA sequence
tatcacctaaaatgtctacc

SEQ ID NO: 264293 - DNA, 20 bp, Artificial
  CRISPR gRNA sequence
aaatgtctaccatggtattt

SEQ ID NO: 264294 - DNA, 20 bp, Artificial
  CRISPR gRNA sequence
ccatggtattttgtgcatgt

SEQ ID NO: 264295 - DNA, 20 bp, Artificial
  CRISPR gRNA sequence
tgtgcatgtaataataaatg

SEQ ID NO: 264296 - DNA, 20 bp, Artificial
  CRISPR gRNA sequence
gtgcatgtaataataaatgt

SEQ ID NO: 264297 - DNA, 20 bp, Artificial
  CRISPR gRNA sequence
tgcatgtaataataaatgtt

SEQ ID NO: 264298 - DNA, 20 bp, Artificial
  CRISPR gRNA sequence
gcaaatggctgagtgactta

SEQ ID NO: 264299 - DNA, 20 bp, Artificial
  CRISPR gRNA sequence
caaatggctgagtgacttaa

SEQ ID NO: 264300 - DNA, 20 bp, Artificial
  CRISPR gRNA sequence
agtgacttaagtatgtttga

SEQ ID NO: 264301 - DNA, 20 bp, Artificial
  CRISPR gRNA sequence
aagtatgtttgacatgtgga

SEQ ID NO: 264302 - DNA, 20 bp, Artificial
  CRISPR gRNA sequence
agtatgtttgacatgtggaa

SEQ ID NO: 264303 - DNA, 20 bp, Artificial
  CRISPR gRNA sequence
gacatgtggaaggagccaag

SEQ ID NO: 264304 - DNA, 20 bp, Artificial
  CRISPR gRNA sequence
acatgtggaaggagccaagt

SEQ ID NO: 264305 - DNA, 20 bp, Artificial
  CRISPR gRNA sequence
gacctgagagagagagagag

SEQ ID NO: 264306 - DNA, 20 bp, Artificial
  CRISPR gRNA sequence
agagagagagagagagggag

SEQ ID NO: 264307 - DNA, 20 bp, Artificial
  CRISPR gRNA sequence
cagggcttgagggtagagaa

SEQ ID NO: 264308 - DNA, 20 bp, Artificial
  CRISPR gRNA sequence
gagggtagagaagggtatta

SEQ ID NO: 264309 - DNA, 20 bp, Artificial
  CRISPR gRNA sequence
agggtagagaagggtattat

SEQ ID NO: 264310 - DNA, 20 bp, Artificial
  CRISPR gRNA sequence
ttaggaaagaaaggaggagg

SEQ ID NO: 264311 - DNA, 20 bp, Artificial
  CRISPR gRNA sequence
ggaaagaaaggaggaggagg

SEQ ID NO: 264312 - DNA, 20 bp, Artificial
  CRISPR gRNA sequence
tctcaaggagatagggaggg

SEQ ID NO: 264313 - DNA, 20 bp, Artificial
  CRISPR gRNA sequence
ctcaaggagatagggaggga

SEQ ID NO: 264314 - DNA, 20 bp, Artificial
  CRISPR gRNA sequence
tcaaggagatagggagggag

SEQ ID NO: 264315 - DNA, 20 bp, Artificial
  CRISPR gRNA sequence
aaggagatagggagggagat

SEQ ID NO: 264316 - DNA, 20 bp, Artificial
  CRISPR gRNA sequence
gttgcataggagatgagtgt

SEQ ID NO: 264317 - DNA, 20 bp, Artificial
  CRISPR gRNA sequence
ttgcataggagatgagtgta

SEQ ID NO: 264318 - DNA, 20 bp, Artificial
  CRISPR gRNA sequence
cataggagatgagtgtatta

SEQ ID NO: 264319 - DNA, 20 bp, Artificial
  CRISPR gRNA sequence
gagagaggaggacaaatctc

SEQ ID NO: 264320 - DNA, 20 bp, Artificial
  CRISPR gRNA sequence
taagaagatagggaggaaga

SEQ ID NO: 264321 - DNA, 20 bp, Artificial
  CRISPR gRNA sequence
agaagatagggaggaagaga

SEQ ID NO: 264322 - DNA, 20 bp, Artificial
  CRISPR gRNA sequence
ataggggtagagataagtta

SEQ ID NO: 264323 - DNA, 20 bp, Artificial
  CRISPR gRNA sequence
taggggtagagataagttag

SEQ ID NO: 264324 - DNA, 20 bp, Artificial
  CRISPR gRNA sequence
gaatgaagctatggtagatg

SEQ ID NO: 264325 - DNA, 20 bp, Artificial
  CRISPR gRNA sequence
tggtagatgagtgattctat

SEQ ID NO: 264326 - DNA, 20 bp, Artificial
  CRISPR gRNA sequence
tatactggtgaacctgaggt

SEQ ID NO: 264327 - DNA, 20 bp, Artificial
  CRISPR gRNA sequence
tactggtgaacctgaggtta

SEQ ID NO: 264328 - DNA, 20 bp, Artificial
  CRISPR gRNA sequence
gtgaacctgaggttaaaaac

SEQ ID NO: 264329 - DNA, 20 bp, Artificial
  CRISPR gRNA sequence
aggttaaaaacaaacaaatc

SEQ ID NO: 264330 - DNA, 20 bp, Artificial
  CRISPR gRNA sequence
aaaacaaacaaatctctcag

SEQ ID NO: 264331 - DNA, 20 bp, Artificial
  CRISPR gRNA sequence
tcagagtaggtcatgatgtt

SEQ ID NO: 264332 - DNA, 20 bp, Artificial
  CRISPR gRNA sequence
agagtaggtcatgatgttaa

SEQ ID NO: 264333 - DNA, 20 bp, Artificial
  CRISPR gRNA sequence
aacctatatcaacaagggct

SEQ ID NO: 264334 - DNA, 20 bp, Artificial
  CRISPR gRNA sequence
tatcaacaagggctactggg

SEQ ID NO: 264335 - DNA, 20 bp, Artificial
  CRISPR gRNA sequence
ctgggtaatacatgccttct

SEQ ID NO: 264336 - DNA, 20 bp, Artificial
  CRISPR gRNA sequence
ggtaatacatgccttctctc

SEQ ID NO: 264337 - DNA, 20 bp, Artificial
  CRISPR gRNA sequence
ctctctgaagactttgccca

SEQ ID NO: 264338 - DNA, 20 bp, Artificial
  CRISPR gRNA sequence
tctctgaagactttgcccat

SEQ ID NO: 264339 - DNA, 20 bp, Artificial
  CRISPR gRNA sequence
tctgaagactttgcccatgt

SEQ ID NO: 264340 - DNA, 20 bp, Artificial
  CRISPR gRNA sequence
tgaagactttgcccatgtgt

SEQ ID NO: 264341 - DNA, 20 bp, Artificial
  CRISPR gRNA sequence
aagactttgcccatgtgtac

SEQ ID NO: 264342 - DNA, 20 bp, Artificial
  CRISPR gRNA sequence
tgcccatgtgtactttaaat

SEQ ID NO: 264343 - DNA, 20 bp, Artificial
  CRISPR gRNA sequence
gcccatgtgtactttaaatt

SEQ ID NO: 264344 - DNA, 20 bp, Artificial
  CRISPR gRNA sequence
cccatgtgtactttaaattc

SEQ ID NO: 264345 - DNA, 20 bp, Artificial
  CRISPR gRNA sequence
taaattcttgcttgagtcct

SEQ ID NO: 264346 - DNA, 20 bp, Artificial
  CRISPR gRNA sequence
aaattcttgcttgagtcctc

SEQ ID NO: 264347 - DNA, 20 bp, Artificial
  CRISPR gRNA sequence
aattcttgcttgagtcctca

SEQ ID NO: 264348 - DNA, 20 bp, Artificial
  CRISPR gRNA sequence
ttgcttgagtcctcaacaat

SEQ ID NO: 264349 - DNA, 20 bp, Artificial
  CRISPR gRNA sequence
gcttgagtcctcaacaatgc

SEQ ID NO: 264350 - DNA, 20 bp, Artificial
  CRISPR gRNA sequence
cttgagtcctcaacaatgca

SEQ ID NO: 264351 - DNA, 20 bp, Artificial
  CRISPR gRNA sequence
gagtcctcaacaatgcacac

SEQ ID NO: 264352 - DNA, 20 bp, Artificial
  CRISPR gRNA sequence
agtcctcaacaatgcacact

SEQ ID NO: 264353 - DNA, 20 bp, Artificial
  CRISPR gRNA sequence
aacaatgcacactatggcta

SEQ ID NO: 264354 - DNA, 20 bp, Artificial
  CRISPR gRNA sequence
tggctaggcttgacctcagc

SEQ ID NO: 264355 - DNA, 20 bp, Artificial
  CRISPR gRNA sequence
ggcttgacctcagctcacgg

SEQ ID NO: 264356 - DNA, 20 bp, Artificial
  CRISPR gRNA sequence
gacctcagctcacggctgag

SEQ ID NO: 264357 - DNA, 20 bp, Artificial
  CRISPR gRNA sequence
acctcagctcacggctgaga

SEQ ID NO: 264358 - DNA, 20 bp, Artificial
  CRISPR gRNA sequence
agctcacggctgagatcaca

SEQ ID NO: 264359 - DNA, 20 bp, Artificial
  CRISPR gRNA sequence
acggctgagatcacagggtc

SEQ ID NO: 264360 - DNA, 20 bp, Artificial
  CRISPR gRNA sequence
agatcacagggtcacagggt

SEQ ID NO: 264361 - DNA, 20 bp, Artificial
  CRISPR gRNA sequence
aaaccaaccctgcccaacat

SEQ ID NO: 264362 - DNA, 20 bp, Artificial
  CRISPR gRNA sequence
cccaacattatgggcgggac

SEQ ID NO: 264363 - DNA, 20 bp, Artificial
  CRISPR gRNA sequence
tgggcgggactctagtttcc

SEQ ID NO: 264364 - DNA, 20 bp, Artificial
  CRISPR gRNA sequence
tagtttccagtcagggatgt

SEQ ID NO: 264365 - DNA, 20 bp, Artificial
  CRISPR gRNA sequence
gtttccagtcagggatgtta

SEQ ID NO: 264366 - DNA, 20 bp, Artificial
  CRISPR gRNA sequence
ccagtcagggatgttaatct

SEQ ID NO: 264367 - DNA, 20 bp, Artificial
  CRISPR gRNA sequence
cagtcagggatgttaatctt

SEQ ID NO: 264368 - DNA, 20 bp, Artificial
  CRISPR gRNA sequence
atcttagcatttccctgtgt

SEQ ID NO: 264369 - DNA, 20 bp, Artificial
  CRISPR gRNA sequence
agcatttccctgtgtgtttt

SEQ ID NO: 264370 - DNA, 20 bp, Artificial
  CRISPR gRNA sequence
gcatttccctgtgtgttttg

SEQ ID NO: 264371 - DNA, 20 bp, Artificial
  CRISPR gRNA sequence
ccctgtgtgttttggaacaa

SEQ ID NO: 264372 - DNA, 20 bp, Artificial
  CRISPR gRNA sequence
cctgtgtgttttggaacaag

SEQ ID NO: 264373 - DNA, 20 bp, Artificial
  CRISPR gRNA sequence
tgtgttttggaacaaggata

SEQ ID NO: 264374 - DNA, 20 bp, Artificial
  CRISPR gRNA sequence
tggaacaaggatatggttgc

SEQ ID NO: 264375 - DNA, 20 bp, Artificial
  CRISPR gRNA sequence
ggaacaaggatatggttgct

SEQ ID NO: 264376 - DNA, 20 bp, Artificial
  CRISPR gRNA sequence
gaacaaggatatggttgctt

SEQ ID NO: 264377 - DNA, 20 bp, Artificial
  CRISPR gRNA sequence
cttgaccttggcttggggag

SEQ ID NO: 264378 - DNA, 20 bp, Artificial
  CRISPR gRNA sequence
gaccttggcttggggaggcc

SEQ ID NO: 264379 - DNA, 20 bp, Artificial
  CRISPR gRNA sequence
accttggcttggggaggcca

SEQ ID NO: 264380 - DNA, 20 bp, Artificial
  CRISPR gRNA sequence
ggcttggggaggccagtccg

SEQ ID NO: 264381 - DNA, 20 bp, Artificial
  CRISPR gRNA sequence
gcttggggaggccagtccgc

SEQ ID NO: 264382 - DNA, 20 bp, Artificial
  CRISPR gRNA sequence
ggggaggccagtccgctatt

SEQ ID NO: 264383 - DNA, 20 bp, Artificial
  CRISPR gRNA sequence
gggaggccagtccgctattc

SEQ ID NO: 264384 - DNA, 20 bp, Artificial
  CRISPR gRNA sequence
ttcttttgccctctcttttt

SEQ ID NO: 264385 - DNA, 20 bp, Artificial
  CRISPR gRNA sequence
ttttgccctctcttttttca

SEQ ID NO: 264386 - DNA, 20 bp, Artificial
  CRISPR gRNA sequence
ttgccctctcttttttcaaa

SEQ ID NO: 264387 - DNA, 20 bp, Artificial
  CRISPR gRNA sequence
tgccctctcttttttcaaac

SEQ ID NO: 264388 - DNA, 20 bp, Artificial
  CRISPR gRNA sequence
gccctctcttttttcaaact

SEQ ID NO: 264389 - DNA, 20 bp, Artificial
  CRISPR gRNA sequence
ccctctcttttttcaaactc

SEQ ID NO: 264390 - DNA, 20 bp, Artificial
  CRISPR gRNA sequence
tcttttttcaaactcaaaag

SEQ ID NO: 264391 - DNA, 20 bp, Artificial
  CRISPR gRNA sequence
ttttttcaaactcaaaagct

SEQ ID NO: 264392 - DNA, 20 bp, Artificial
  CRISPR gRNA sequence
ttttcaaactcaaaagctaa

SEQ ID NO: 264393 - DNA, 20 bp, Artificial
  CRISPR gRNA sequence
tttcaaactcaaaagctaat

SEQ ID NO: 264394 - DNA, 20 bp, Artificial
  CRISPR gRNA sequence
ttcaaactcaaaagctaatc

SEQ ID NO: 264395 - DNA, 20 bp, Artificial
  CRISPR gRNA sequence
tcaaactcaaaagctaatcc

SEQ ID NO: 264396 - DNA, 20 bp, Artificial
  CRISPR gRNA sequence
caaactcaaaagctaatccc

SEQ ID NO: 264397 - DNA, 20 bp, Artificial
  CRISPR gRNA sequence
aaactcaaaagctaatccca

SEQ ID NO: 264398 - DNA, 20 bp, Artificial
  CRISPR gRNA sequence
aaaagctaatcccaaggatt

SEQ ID NO: 264399 - DNA, 20 bp, Artificial
  CRISPR gRNA sequence
atcccaaggatttctcaagg

SEQ ID NO: 264400 - DNA, 20 bp, Artificial
  CRISPR gRNA sequence
ctcaaggtgggggatgtgat

SEQ ID NO: 264401 - DNA, 20 bp, Artificial
  CRISPR gRNA sequence
tcaaggtgggggatgtgatt

SEQ ID NO: 264402 - DNA, 20 bp, Artificial
  CRISPR gRNA sequence
aaggtgggggatgtgattag

SEQ ID NO: 264403 - DNA, 20 bp, Artificial
  CRISPR gRNA sequence
ggagtattagtctatcatac

SEQ ID NO: 264404 - DNA, 20 bp, Artificial
  CRISPR gRNA sequence
gtctatcatactgtgacaga

SEQ ID NO: 264405 - DNA, 20 bp, Artificial
  CRISPR gRNA sequence
tcatactgtgacagaacttt

SEQ ID NO: 264406 - DNA, 20 bp, Artificial
  CRISPR gRNA sequence
tgacagaacttttctaggcc

SEQ ID NO: 264407 - DNA, 20 bp, Artificial
  CRISPR gRNA sequence
ttctaggcctcggtttcttc

SEQ ID NO: 264408 - DNA, 20 bp, Artificial
  CRISPR gRNA sequence
tctaggcctcggtttcttca

SEQ ID NO: 264409 - DNA, 20 bp, Artificial
  CRISPR gRNA sequence
ctaggcctcggtttcttcat

SEQ ID NO: 264410 - DNA, 20 bp, Artificial
  CRISPR gRNA sequence
taggcctcggtttcttcatc

SEQ ID NO: 264411 - DNA, 20 bp, Artificial
  CRISPR gRNA sequence
ggcctcggtttcttcatctg

SEQ ID NO: 264412 - DNA, 20 bp, Artificial
  CRISPR gRNA sequence
ggtttcttcatctgatacat

SEQ ID NO: 264413 - DNA, 20 bp, Artificial
  CRISPR gRNA sequence
cttcatctgatacatgaaga

SEQ ID NO: 264414 - DNA, 20 bp, Artificial
  CRISPR gRNA sequence
ttcatctgatacatgaagag

SEQ ID NO: 264415 - DNA, 20 bp, Artificial
  CRISPR gRNA sequence
catctgatacatgaagagtt

SEQ ID NO: 264416 - DNA, 20 bp, Artificial
  CRISPR gRNA sequence
atctgatacatgaagagttt

SEQ ID NO: 264417 - DNA, 20 bp, Artificial
  CRISPR gRNA sequence
atacatgaagagtttgggct

SEQ ID NO: 264418 - DNA, 20 bp, Artificial
  CRISPR gRNA sequence
gggctggaggatatctcagg

SEQ ID NO: 264419 - DNA, 20 bp, Artificial
  CRISPR gRNA sequence
ggctggaggatatctcaggt

SEQ ID NO: 264420 - DNA, 20 bp, Artificial
  CRISPR gRNA sequence
gaggatatctcaggtctact

SEQ ID NO: 264421 - DNA, 20 bp, Artificial
  CRISPR gRNA sequence
aggtctactttctggcttaa

SEQ ID NO: 264422 - DNA, 20 bp, Artificial
  CRISPR gRNA sequence
ctttctggcttaaaagtgct

SEQ ID NO: 264423 - DNA, 20 bp, Artificial
  CRISPR gRNA sequence
tctggcttaaaagtgcttct

SEQ ID NO: 264424 - DNA, 20 bp, Artificial
  CRISPR gRNA sequence
ctggcttaaaagtgcttctg

SEQ ID NO: 264425 - DNA, 20 bp, Artificial
  CRISPR gRNA sequence
tggcttaaaagtgcttctga

SEQ ID NO: 264426 - DNA, 20 bp, Artificial
  CRISPR gRNA sequence
gcttaaaagtgcttctgaag

SEQ ID NO: 264427 - DNA, 20 bp, Artificial
  CRISPR gRNA sequence
aaaagtgcttctgaagtgga

SEQ ID NO: 264428 - DNA, 20 bp, Artificial
  CRISPR gRNA sequence
aaagtgcttctgaagtggaa

SEQ ID NO: 264429 - DNA, 20 bp, Artificial
  CRISPR gRNA sequence
ctgaagtggaattttttaaa

SEQ ID NO: 264430 - DNA, 20 bp, Artificial
  CRISPR gRNA sequence
tgaagtggaattttttaaaa

SEQ ID NO: 264431 - DNA, 20 bp, Artificial
  CRISPR gRNA sequence
aagtggaattttttaaaaag

SEQ ID NO: 264432 - DNA, 20 bp, Artificial
  CRISPR gRNA sequence
tttaaaaagctaacttttgt

SEQ ID NO: 264433 - DNA, 20 bp, Artificial
  CRISPR gRNA sequence
ttaaaaagctaacttttgtc

SEQ ID NO: 264434 - DNA, 20 bp, Artificial
  CRISPR gRNA sequence
taaaaagctaacttttgtcg

SEQ ID NO: 264435 - DNA, 20 bp, Artificial
  CRISPR gRNA sequence
aaaaagctaacttttgtcgg

SEQ ID NO: 264436 - DNA, 20 bp, Artificial
  CRISPR gRNA sequence
aaaagctaacttttgtcggg

SEQ ID NO: 264437 - DNA, 20 bp, Artificial
  CRISPR gRNA sequence
acttttgtcgggtctaacaa

SEQ ID NO: 264438 - DNA, 20 bp, Artificial
  CRISPR gRNA sequence
ttgtcgggtctaacaaggca

SEQ ID NO: 264439 - DNA, 20 bp, Artificial
  CRISPR gRNA sequence
tgtcgggtctaacaaggcag

SEQ ID NO: 264440 - DNA, 20 bp, Artificial
  CRISPR gRNA sequence
gtcgggtctaacaaggcagc

SEQ ID NO: 264441 - DNA, 20 bp, Artificial
  CRISPR gRNA sequence
tcgggtctaacaaggcagct

SEQ ID NO: 264442 - DNA, 20 bp, Artificial
  CRISPR gRNA sequence
acaaggcagctcaactaccc

SEQ ID NO: 264443 - DNA, 20 bp, Artificial
  CRISPR gRNA sequence
aactaccccatccccttgtg

SEQ ID NO: 264444 - DNA, 20 bp, Artificial
  CRISPR gRNA sequence
ccccatccccttgtggatgc

SEQ ID NO: 264445 - DNA, 20 bp, Artificial
  CRISPR gRNA sequence
gtggatgctcttatgacctg

SEQ ID NO: 264446 - DNA, 20 bp, Artificial
  CRISPR gRNA sequence
tggatgctcttatgacctga

SEQ ID NO: 264447 - DNA, 20 bp, Artificial
  CRISPR gRNA sequence
ttatgacctgatagagcaaa

SEQ ID NO: 264448 - DNA, 20 bp, Artificial
  CRISPR gRNA sequence
atgacctgatagagcaaata

SEQ ID NO: 264449 - DNA, 20 bp, Artificial
  CRISPR gRNA sequence
tgacctgatagagcaaatac

SEQ ID NO: 264450 - DNA, 20 bp, Artificial
  CRISPR gRNA sequence
atagagcaaatacaagaaat

SEQ ID NO: 264451 - DNA, 20 bp, Artificial
  CRISPR gRNA sequence
gaaaccagccatctctgaaa

SEQ ID NO: 264452 - DNA, 20 bp, Artificial
  CRISPR gRNA sequence
tgaaatcccttgcagggatt

SEQ ID NO: 264453 - DNA, 20 bp, Artificial
  CRISPR gRNA sequence
aaatcccttgcagggattgc

SEQ ID NO: 264454 - DNA, 20 bp, Artificial
  CRISPR gRNA sequence
gcagggattgctaaccagga

SEQ ID NO: 264455 - DNA, 20 bp, Artificial
  CRISPR gRNA sequence
cagggattgctaaccaggat

SEQ ID NO: 264456 - DNA, 20 bp, Artificial
  CRISPR gRNA sequence
ctaaccaggatcctaaatgc

SEQ ID NO: 264457 - DNA, 20 bp, Artificial
  CRISPR gRNA sequence
accaggatcctaaatgctgc

SEQ ID NO: 264458 - DNA, 20 bp, Artificial
  CRISPR gRNA sequence
aatgctgctaatgtgcttag

SEQ ID NO: 264459 - DNA, 20 bp, Artificial
  CRISPR gRNA sequence
ctaatgtgcttagaaatgac

SEQ ID NO: 264460 - DNA, 20 bp, Artificial
  CRISPR gRNA sequence
atgtgcttagaaatgactgc

SEQ ID NO: 264461 - DNA, 20 bp, Artificial
  CRISPR gRNA sequence
agaaatgactgctggacttt

SEQ ID NO: 264462 - DNA, 20 bp, Artificial
  CRISPR gRNA sequence
gaaatgactgctggactttg

SEQ ID NO: 264463 - DNA, 20 bp, Artificial
  CRISPR gRNA sequence
ctggactttgagggggcaat

SEQ ID NO: 264464 - DNA, 20 bp, Artificial
  CRISPR gRNA sequence
gactttgagggggcaatgct

SEQ ID NO: 264465 - DNA, 20 bp, Artificial
  CRISPR gRNA sequence
tgagggggcaatgctgcctt

SEQ ID NO: 264466 - DNA, 20 bp, Artificial
  CRISPR gRNA sequence
gagggggcaatgctgccttt

SEQ ID NO: 264467 - DNA, 20 bp, Artificial
  CRISPR gRNA sequence
agggggcaatgctgcctttg

SEQ ID NO: 264468 - DNA, 20 bp, Artificial
  CRISPR gRNA sequence
cctttgctatctcctgtttt

SEQ ID NO: 264469 - DNA, 20 bp, Artificial
  CRISPR gRNA sequence
tgctatctcctgttttccta

SEQ ID NO: 264470 - DNA, 20 bp, Artificial
  CRISPR gRNA sequence
gctatctcctgttttcctat

SEQ ID NO: 264471 - DNA, 20 bp, Artificial
  CRISPR gRNA sequence
ctatctcctgttttcctatg

SEQ ID NO: 264472 - DNA, 20 bp, Artificial
  CRISPR gRNA sequence
tctcctgttttcctatgcaa

SEQ ID NO: 264473 - DNA, 20 bp, Artificial
  CRISPR gRNA sequence
ctgttttcctatgcaatgtt

SEQ ID NO: 264474 - DNA, 20 bp, Artificial
  CRISPR gRNA sequence
ttttcctatgcaatgttaag

SEQ ID NO: 264475 - DNA, 20 bp, Artificial
  CRISPR gRNA sequence
tcctatgcaatgttaaggtc

SEQ ID NO: 264476 - DNA, 20 bp, Artificial
  CRISPR gRNA sequence
cctatgcaatgttaaggtcc

SEQ ID NO: 264477 - DNA, 20 bp, Artificial
  CRISPR gRNA sequence
ctatgcaatgttaaggtcca

SEQ ID NO: 264478 - DNA, 20 bp, Artificial
  CRISPR gRNA sequence
tgcaatgttaaggtccaaca

SEQ ID NO: 264479 - DNA, 20 bp, Artificial
  CRISPR gRNA sequence
aggtccaacacagtaattat

SEQ ID NO: 264480 - DNA, 20 bp, Artificial
  CRISPR gRNA sequence
tttaaacttctgggccatga

SEQ ID NO: 264481 - DNA, 20 bp, Artificial
  CRISPR gRNA sequence
aaacttctgggccatgacat

SEQ ID NO: 264482 - DNA, 20 bp, Artificial
  CRISPR gRNA sequence
aacttctgggccatgacatt

SEQ ID NO: 264483 - DNA, 20 bp, Artificial
  CRISPR gRNA sequence
ctgggccatgacatttacct

SEQ ID NO: 264484 - DNA, 20 bp, Artificial
  CRISPR gRNA sequence
tgggccatgacatttacctg

SEQ ID NO: 264485 - DNA, 20 bp, Artificial
  CRISPR gRNA sequence
ggccatgacatttacctgga

SEQ ID NO: 264486 - DNA, 20 bp, Artificial
  CRISPR gRNA sequence
acctggaggttctgtatatg

SEQ ID NO: 264487 - DNA, 20 bp, Artificial
  CRISPR gRNA sequence
cctggaggttctgtatatga

SEQ ID NO: 264488 - DNA, 20 bp, Artificial
  CRISPR gRNA sequence
gaggttctgtatatgacaag

SEQ ID NO: 264489 - DNA, 20 bp, Artificial
  CRISPR gRNA sequence
tgtatatgacaaggtgatcc

SEQ ID NO: 264490 - DNA, 20 bp, Artificial
  CRISPR gRNA sequence
tatatgacaaggtgatcctg

SEQ ID NO: 264491 - DNA, 20 bp, Artificial
  CRISPR gRNA sequence
agcagattcttcagaggtat

SEQ ID NO: 264492 - DNA, 20 bp, Artificial
  CRISPR gRNA sequence
ttcagaggtatgtgatttag

SEQ ID NO: 264493 - DNA, 20 bp, Artificial
  CRISPR gRNA sequence
cagaggtatgtgatttaggc

SEQ ID NO: 264494 - DNA, 20 bp, Artificial
  CRISPR gRNA sequence
agaggtatgtgatttaggca

SEQ ID NO: 264495 - DNA, 20 bp, Artificial
  CRISPR gRNA sequence
aggcagaatggaacagacag

SEQ ID NO: 264496 - DNA, 20 bp, Artificial
  CRISPR gRNA sequence
ggcagaatggaacagacagg

SEQ ID NO: 264497 - DNA, 20 bp, Artificial
  CRISPR gRNA sequence
ttgtcttcatcacagagttg

SEQ ID NO: 264498 - DNA, 20 bp, Artificial
  CRISPR gRNA sequence
tcttcatcacagagttgttt

SEQ ID NO: 264499 - DNA, 20 bp, Artificial
  CRISPR gRNA sequence
catcacagagttgttttgaa

SEQ ID NO: 264500 - DNA, 20 bp, Artificial
  CRISPR gRNA sequence
atcacagagttgttttgaat

SEQ ID NO: 264501 - DNA, 20 bp, Artificial
  CRISPR gRNA sequence
ttttgaatgagggatcagga

SEQ ID NO: 264502 - DNA, 20 bp, Artificial
  CRISPR gRNA sequence
tgaatgagggatcaggataa

SEQ ID NO: 264503 - DNA, 20 bp, Artificial
  CRISPR gRNA sequence
gaatgagggatcaggataat

SEQ ID NO: 264504 - DNA, 20 bp, Artificial
  CRISPR gRNA sequence
aatgagggatcaggataatt

SEQ ID NO: 264505 - DNA, 20 bp, Artificial
  CRISPR gRNA sequence
tggctcaggaggaaaatatg

SEQ ID NO: 264506 - DNA, 20 bp, Artificial
  CRISPR gRNA sequence
aggaggaaaatatggctctc

SEQ ID NO: 264507 - DNA, 20 bp, Artificial
  CRISPR gRNA sequence
tcaaatttggttactagatt

SEQ ID NO: 264508 - DNA, 20 bp, Artificial
  CRISPR gRNA sequence
aaatttggttactagattaa

SEQ ID NO: 264509 - DNA, 20 bp, Artificial
  CRISPR gRNA sequence
ggttactagattaaaacata

SEQ ID NO: 264510 - DNA, 20 bp, Artificial
  CRISPR gRNA sequence
gttactagattaaaacatat

SEQ ID NO: 264511 - DNA, 20 bp, Artificial
  CRISPR gRNA sequence
ctagattaaaacatatattt

SEQ ID NO: 264512 - DNA, 20 bp, Artificial
  CRISPR gRNA sequence
gattaaaacatatatttaga

SEQ ID NO: 264513 - DNA, 20 bp, Artificial
  CRISPR gRNA sequence
aaacatatatttagaaaata

SEQ ID NO: 264514 - DNA, 20 bp, Artificial
  CRISPR gRNA sequence
agaaaataataaattaatag

SEQ ID NO: 264515 - DNA, 20 bp, Artificial
  CRISPR gRNA sequence
gaaaataataaattaataga

SEQ ID NO: 264516 - DNA, 20 bp, Artificial
  CRISPR gRNA sequence
atagaggaggtctctttata

SEQ ID NO: 264517 - DNA, 20 bp, Artificial
  CRISPR gRNA sequence
tttatacctgtgggttttct

SEQ ID NO: 264518 - DNA, 20 bp, Artificial
  CRISPR gRNA sequence
tatacctgtgggttttcttt

SEQ ID NO: 264519 - DNA, 20 bp, Artificial
  CRISPR gRNA sequence
atacctgtgggttttctttt

SEQ ID NO: 264520 - DNA, 20 bp, Artificial
  CRISPR gRNA sequence
tacctgtgggttttcttttg

SEQ ID NO: 264521 - DNA, 20 bp, Artificial
  CRISPR gRNA sequence
tgggttttcttttgatccgt

SEQ ID NO: 264522 - DNA, 20 bp, Artificial
  CRISPR gRNA sequence
tcttttgatccgttaactga

SEQ ID NO: 264523 - DNA, 20 bp, Artificial
  CRISPR gRNA sequence
cttttgatccgttaactgaa

SEQ ID NO: 264524 - DNA, 20 bp, Artificial
  CRISPR gRNA sequence
ttttgatccgttaactgaat

SEQ ID NO: 264525 - DNA, 20 bp, Artificial
  CRISPR gRNA sequence
ttgatccgttaactgaatta

SEQ ID NO: 264526 - DNA, 20 bp, Artificial
  CRISPR gRNA sequence
tgatccgttaactgaattac

SEQ ID NO: 264527 - DNA, 20 bp, Artificial
  CRISPR gRNA sequence
gatccgttaactgaattact

SEQ ID NO: 264528 - DNA, 20 bp, Artificial
  CRISPR gRNA sequence
atccgttaactgaattacta

SEQ ID NO: 264529 - DNA, 20 bp, Artificial
  CRISPR gRNA sequence
actgaattactataataata

SEQ ID NO: 264530 - DNA, 20 bp, Artificial
  CRISPR gRNA sequence
aattactataataatatata

SEQ ID NO: 264531 - DNA, 20 bp, Artificial
  CRISPR gRNA sequence
ctataataatatatatgtac

SEQ ID NO: 264532 - DNA, 20 bp, Artificial
  CRISPR gRNA sequence
taataatatatatgtacaga

SEQ ID NO: 264533 - DNA, 20 bp, Artificial
  CRISPR gRNA sequence
taattccctggttacctcct

SEQ ID NO: 264534 - DNA, 20 bp, Artificial
  CRISPR gRNA sequence
cctggttacctcctatttag

SEQ ID NO: 264535 - DNA, 20 bp, Artificial
  CRISPR gRNA sequence
gttacctcctatttagacta

SEQ ID NO: 264536 - DNA, 20 bp, Artificial
  CRISPR gRNA sequence
cctcctatttagactacagg

SEQ ID NO: 264537 - DNA, 20 bp, Artificial
  CRISPR gRNA sequence
ctatttagactacaggcaac

SEQ ID NO: 264538 - DNA, 20 bp, Artificial
  CRISPR gRNA sequence
tttagactacaggcaacctt

SEQ ID NO: 264539 - DNA, 20 bp, Artificial
  CRISPR gRNA sequence
agactacaggcaacctttta

SEQ ID NO: 264540 - DNA, 20 bp, Artificial
  CRISPR gRNA sequence
gactacaggcaaccttttag

SEQ ID NO: 264541 - DNA, 20 bp, Artificial
  CRISPR gRNA sequence
caggcaaccttttagaatag

SEQ ID NO: 264542 - DNA, 20 bp, Artificial
  CRISPR gRNA sequence
ttagaatagtgagatttgat

SEQ ID NO: 264543 - DNA, 20 bp, Artificial
  CRISPR gRNA sequence
tagaatagtgagatttgatt

SEQ ID NO: 264544 - DNA, 20 bp, Artificial
  CRISPR gRNA sequence
agaatagtgagatttgattt

SEQ ID NO: 264545 - DNA, 20 bp, Artificial
  CRISPR gRNA sequence
gaatagtgagatttgatttt

SEQ ID NO: 264546 - DNA, 20 bp, Artificial
  CRISPR gRNA sequence
gattttggggagttgtctgg

SEQ ID NO: 264547 - DNA, 20 bp, Artificial
  CRISPR gRNA sequence
attttggggagttgtctggt

SEQ ID NO: 264548 - DNA, 20 bp, Artificial
  CRISPR gRNA sequence
tggggagttgtctggtggct

SEQ ID NO: 264549 - DNA, 20 bp, Artificial
  CRISPR gRNA sequence
ggggagttgtctggtggctc

SEQ ID NO: 264550 - DNA, 20 bp, Artificial
  CRISPR gRNA sequence
gggagttgtctggtggctct

SEQ ID NO: 264551 - DNA, 20 bp, Artificial
  CRISPR gRNA sequence
tctggtggctcttggtatgg

SEQ ID NO: 264552 - DNA, 20 bp, Artificial
  CRISPR gRNA sequence
gtggctcttggtatgggttc

SEQ ID NO: 264553 - DNA, 20 bp, Artificial
  CRISPR gRNA sequence
ttggtatgggttccactttc

SEQ ID NO: 264554 - DNA, 20 bp, Artificial
  CRISPR gRNA sequence
ggtatgggttccactttcat

SEQ ID NO: 264555 - DNA, 20 bp, Artificial
  CRISPR gRNA sequence
gtatgggttccactttcatg

SEQ ID NO: 264556 - DNA, 20 bp, Artificial
  CRISPR gRNA sequence
cactttcatgtaagttaagg

SEQ ID NO: 264557 - DNA, 20 bp, Artificial
  CRISPR gRNA sequence
tcatgtaagttaaggtgctc

SEQ ID NO: 264558 - DNA, 20 bp, Artificial
  CRISPR gRNA sequence
catgtaagttaaggtgctct

SEQ ID NO: 264559 - DNA, 20 bp, Artificial
  CRISPR gRNA sequence
atgtaagttaaggtgctctt

SEQ ID NO: 264560 - DNA, 20 bp, Artificial
  CRISPR gRNA sequence
aggtgctcttgctatgttgt

SEQ ID NO: 264561 - DNA, 20 bp, Artificial
  CRISPR gRNA sequence
ttgctatgttgtccccttag

SEQ ID NO: 264562 - DNA, 20 bp, Artificial
  CRISPR gRNA sequence
gctatgttgtccccttagat

SEQ ID NO: 264563 - DNA, 20 bp, Artificial
  CRISPR gRNA sequence
ctatgttgtccccttagatt

SEQ ID NO: 264564 - DNA, 20 bp, Artificial
  CRISPR gRNA sequence
tgttgtccccttagattgtc

SEQ ID NO: 264565 - DNA, 20 bp, Artificial
  CRISPR gRNA sequence
tccccttagattgtctttct

SEQ ID NO: 264566 - DNA, 20 bp, Artificial
  CRISPR gRNA sequence
agattgtctttctaacatta

SEQ ID NO: 264567 - DNA, 20 bp, Artificial
  CRISPR gRNA sequence
gattgtctttctaacattag

SEQ ID NO: 264568 - DNA, 20 bp, Artificial
  CRISPR gRNA sequence
tctttctaacattaggagat

SEQ ID NO: 264569 - DNA, 20 bp, Artificial
  CRISPR gRNA sequence
tctaacattaggagatcaga

SEQ ID NO: 264570 - DNA, 20 bp, Artificial
  CRISPR gRNA sequence
ctaacattaggagatcagag

SEQ ID NO: 264571 - DNA, 20 bp, Artificial
  CRISPR gRNA sequence
taacattaggagatcagagg

SEQ ID NO: 264572 - DNA, 20 bp, Artificial
  CRISPR gRNA sequence
acattaggagatcagaggaa

SEQ ID NO: 264573 - DNA, 20 bp, Artificial
  CRISPR gRNA sequence
ggagatcagaggaaaattgc

SEQ ID NO: 264574 - DNA, 20 bp, Artificial
  CRISPR gRNA sequence
cagacctgacctgtgaacgg

SEQ ID NO: 264575 - DNA, 20 bp, Artificial
  CRISPR gRNA sequence
acctgtgaacggtagggatt

SEQ ID NO: 264576 - DNA, 20 bp, Artificial
  CRISPR gRNA sequence
tgaacggtagggattgggtc

SEQ ID NO: 264577 - DNA, 20 bp, Artificial
  CRISPR gRNA sequence
ggtcacactgcatctgagtt

SEQ ID NO: 264578 - DNA, 20 bp, Artificial
  CRISPR gRNA sequence
catctgagtttatgttgctt

SEQ ID NO: 264579 - DNA, 20 bp, Artificial
  CRISPR gRNA sequence
agtttatgttgctttgggtt

SEQ ID NO: 264580 - DNA, 20 bp, Artificial
  CRISPR gRNA sequence
atgttgctttgggttaggaa

SEQ ID NO: 264581 - DNA, 20 bp, Artificial
  CRISPR gRNA sequence
tgttgctttgggttaggaag

SEQ ID NO: 264582 - DNA, 20 bp, Artificial
  CRISPR gRNA sequence
ctttgggttaggaagttttg

SEQ ID NO: 264583 - DNA, 20 bp, Artificial
  CRISPR gRNA sequence
tgggttaggaagttttggtc

SEQ ID NO: 264584 - DNA, 20 bp, Artificial
  CRISPR gRNA sequence
gggttaggaagttttggtcc

SEQ ID NO: 264585 - DNA, 20 bp, Artificial
  CRISPR gRNA sequence
ggttaggaagttttggtccc

SEQ ID NO: 264586 - DNA, 20 bp, Artificial
  CRISPR gRNA sequence
ggaagttttggtcccagagc

SEQ ID NO: 264587 - DNA, 20 bp, Artificial
  CRISPR gRNA sequence
tggtcccagagcactcacat

SEQ ID NO: 264588 - DNA, 20 bp, Artificial
  CRISPR gRNA sequence
ggtcccagagcactcacatc

SEQ ID NO: 264589 - DNA, 20 bp, Artificial
  CRISPR gRNA sequence
gtcccagagcactcacatcc

SEQ ID NO: 264590 - DNA, 20 bp, Artificial
  CRISPR gRNA sequence
acatcctgcattgctgtgtg

SEQ ID NO: 264591 - DNA, 20 bp, Artificial
  CRISPR gRNA sequence
cattgctgtgtggtgtctct

SEQ ID NO: 264592 - DNA, 20 bp, Artificial
  CRISPR gRNA sequence
ctgtgtggtgtctctgagtg

SEQ ID NO: 264593 - DNA, 20 bp, Artificial
  CRISPR gRNA sequence
tgtggtgtctctgagtggta

SEQ ID NO: 264594 - DNA, 20 bp, Artificial
  CRISPR gRNA sequence
tgagtggtagggatgggtta

SEQ ID NO: 264595 - DNA, 20 bp, Artificial
  CRISPR gRNA sequence
agtggtagggatgggttaca

SEQ ID NO: 264596 - DNA, 20 bp, Artificial
  CRISPR gRNA sequence
cagcacaggtgatggttttt

SEQ ID NO: 264597 - DNA, 20 bp, Artificial
  CRISPR gRNA sequence
ttagcaattttaatattaac

SEQ ID NO: 264598 - DNA, 20 bp, Artificial
  CRISPR gRNA sequence
tagcaattttaatattaact

SEQ ID NO: 264599 - DNA, 20 bp, Artificial
  CRISPR gRNA sequence
agcaattttaatattaactg

SEQ ID NO: 264600 - DNA, 20 bp, Artificial
  CRISPR gRNA sequence
gcaattttaatattaactgt

SEQ ID NO: 264601 - DNA, 20 bp, Artificial
  CRISPR gRNA sequence
taatattaactgtcatccta

SEQ ID NO: 264602 - DNA, 20 bp, Artificial
  CRISPR gRNA sequence
aatattaactgtcatcctaa

SEQ ID NO: 264603 - DNA, 20 bp, Artificial
  CRISPR gRNA sequence
atattaactgtcatcctaat

SEQ ID NO: 264604 - DNA, 20 bp, Artificial
  CRISPR gRNA sequence
actgtcatcctaatacatat

SEQ ID NO: 264605 - DNA, 20 bp, Artificial
  CRISPR gRNA sequence
tcatcctaatacatatgaac

SEQ ID NO: 264606 - DNA, 20 bp, Artificial
  CRISPR gRNA sequence
atacatatgaacttcctaat

SEQ ID NO: 264607 - DNA, 20 bp, Artificial
  CRISPR gRNA sequence
cctaatgtacatttctatcc

SEQ ID NO: 264608 - DNA, 20 bp, Artificial
  CRISPR gRNA sequence
ctaatgtacatttctatccc

SEQ ID NO: 264609 - DNA, 20 bp, Artificial
  CRISPR gRNA sequence
atgtacatttctatccccaa

SEQ ID NO: 264610 - DNA, 20 bp, Artificial
  CRISPR gRNA sequence
ctatccccaactggcttcct

SEQ ID NO: 264611 - DNA, 20 bp, Artificial
  CRISPR gRNA sequence
tatccccaactggcttcctc

SEQ ID NO: 264612 - DNA, 20 bp, Artificial
  CRISPR gRNA sequence
tccccaactggcttcctcga

SEQ ID NO: 264613 - DNA, 20 bp, Artificial
  CRISPR gRNA sequence
gcttcctcgaactctagtcc

SEQ ID NO: 264614 - DNA, 20 bp, Artificial
  CRISPR gRNA sequence
cctcgaactctagtcctata

SEQ ID NO: 264615 - DNA, 20 bp, Artificial
  CRISPR gRNA sequence
ctcgaactctagtcctatac

SEQ ID NO: 264616 - DNA, 20 bp, Artificial
  CRISPR gRNA sequence
gaactctagtcctatacttc

SEQ ID NO: 264617 - DNA, 20 bp, Artificial
  CRISPR gRNA sequence
tagtcctatacttctaactc

SEQ ID NO: 264618 - DNA, 20 bp, Artificial
  CRISPR gRNA sequence
gtcctatacttctaactcct

SEQ ID NO: 264619 - DNA, 20 bp, Artificial
  CRISPR gRNA sequence
tacttctaactccttctgga

SEQ ID NO: 264620 - DNA, 20 bp, Artificial
  CRISPR gRNA sequence
ctaactccttctggatcttt

SEQ ID NO: 264621 - DNA, 20 bp, Artificial
  CRISPR gRNA sequence
taactccttctggatctttc

SEQ ID NO: 264622 - DNA, 20 bp, Artificial
  CRISPR gRNA sequence
actccttctggatctttcct

SEQ ID NO: 264623 - DNA, 20 bp, Artificial
  CRISPR gRNA sequence
cttctggatctttcctccag

SEQ ID NO: 264624 - DNA, 20 bp, Artificial
  CRISPR gRNA sequence
ctggatctttcctccaggat

SEQ ID NO: 264625 - DNA, 20 bp, Artificial
  CRISPR gRNA sequence
tggatctttcctccaggatg

SEQ ID NO: 264626 - DNA, 20 bp, Artificial
  CRISPR gRNA sequence
gatctttcctccaggatgaa

SEQ ID NO: 264627 - DNA, 20 bp, Artificial
  CRISPR gRNA sequence
tcctccaggatgaacaaatt

SEQ ID NO: 264628 - DNA, 20 bp, Artificial
  CRISPR gRNA sequence
cctccaggatgaacaaattt

SEQ ID NO: 264629 - DNA, 20 bp, Artificial
  CRISPR gRNA sequence
ctccaggatgaacaaatttc

SEQ ID NO: 264630 - DNA, 20 bp, Artificial
  CRISPR gRNA sequence
caggatgaacaaatttcctc

SEQ ID NO: 264631 - DNA, 20 bp, Artificial
  CRISPR gRNA sequence
cctcttaacttacctcattt

SEQ ID NO: 264632 - DNA, 20 bp, Artificial
  CRISPR gRNA sequence
ctcttaacttacctcatttt

SEQ ID NO: 264633 - DNA, 20 bp, Artificial
  CRISPR gRNA sequence
ttaacttacctcattttgtc

SEQ ID NO: 264634 - DNA, 20 bp, Artificial
  CRISPR gRNA sequence
aacttacctcattttgtcaa

SEQ ID NO: 264635 - DNA, 20 bp, Artificial
  CRISPR gRNA sequence
acttacctcattttgtcaat

SEQ ID NO: 264636 - DNA, 20 bp, Artificial
  CRISPR gRNA sequence
acctcattttgtcaatggtg

SEQ ID NO: 264637 - DNA, 20 bp, Artificial
  CRISPR gRNA sequence
cctcattttgtcaatggtgc

SEQ ID NO: 264638 - DNA, 20 bp, Artificial
  CRISPR gRNA sequence
attttgtcaatggtgcctcc

SEQ ID NO: 264639 - DNA, 20 bp, Artificial
  CRISPR gRNA sequence
tgtcaatggtgcctccactc

SEQ ID NO: 264640 - DNA, 20 bp, Artificial
  CRISPR gRNA sequence
gtcaatggtgcctccactca

SEQ ID NO: 264641 - DNA, 20 bp, Artificial
  CRISPR gRNA sequence
tcaatggtgcctccactcat

SEQ ID NO: 264642 - DNA, 20 bp, Artificial
  CRISPR gRNA sequence
cactcatacccttacccagt

SEQ ID NO: 264643 - DNA, 20 bp, Artificial
  CRISPR gRNA sequence
atacccttacccagtgcgtg

SEQ ID NO: 264644 - DNA, 20 bp, Artificial
  CRISPR gRNA sequence
acccagtgcgtgaactctgg

SEQ ID NO: 264645 - DNA, 20 bp, Artificial
  CRISPR gRNA sequence
cccagtgcgtgaactctggg

SEQ ID NO: 264646 - DNA, 20 bp, Artificial
  CRISPR gRNA sequence
tgggtcggtttccattcctg

SEQ ID NO: 264647 - DNA, 20 bp, Artificial
  CRISPR gRNA sequence
ggtcggtttccattcctgtt

SEQ ID NO: 264648 - DNA, 20 bp, Artificial
  CRISPR gRNA sequence
ccattcctgttcaccatcag

SEQ ID NO: 264649 - DNA, 20 bp, Artificial
  CRISPR gRNA sequence
cattcctgttcaccatcagt

SEQ ID NO: 264650 - DNA, 20 bp, Artificial
  CRISPR gRNA sequence
ctgttcaccatcagtctgta

SEQ ID NO: 264651 - DNA, 20 bp, Artificial
  CRISPR gRNA sequence
ttcaccatcagtctgtaaaa

SEQ ID NO: 264652 - DNA, 20 bp, Artificial
  CRISPR gRNA sequence
accatcagtctgtaaaactg

SEQ ID NO: 264653 - DNA, 20 bp, Artificial
  CRISPR gRNA sequence
taaaactgagcaccaatgcc

SEQ ID NO: 264654 - DNA, 20 bp, Artificial
  CRISPR gRNA sequence
agcaccaatgccttgtttga

SEQ ID NO: 264655 - DNA, 20 bp, Artificial
  CRISPR gRNA sequence
gtttgaccctttcataccag

SEQ ID NO: 264656 - DNA, 20 bp, Artificial
  CRISPR gRNA sequence
tttgaccctttcataccagc

SEQ ID NO: 264657 - DNA, 20 bp, Artificial
  CRISPR gRNA sequence
gaccctttcataccagctgc

SEQ ID NO: 264658 - DNA, 20 bp, Artificial
  CRISPR gRNA sequence
accctttcataccagctgcc

SEQ ID NO: 264659 - DNA, 20 bp, Artificial
  CRISPR gRNA sequence
tcataccagctgccacctcc

SEQ ID NO: 264660 - DNA, 20 bp, Artificial
  CRISPR gRNA sequence
cataccagctgccacctcca

SEQ ID NO: 264661 - DNA, 20 bp, Artificial
  CRISPR gRNA sequence
ataccagctgccacctccac

SEQ ID NO: 264662 - DNA, 20 bp, Artificial
  CRISPR gRNA sequence
ccacctccacagctcaggcc

SEQ ID NO: 264663 - DNA, 20 bp, Artificial
  CRISPR gRNA sequence
cacagctcaggccttatgaa

SEQ ID NO: 264664 - DNA, 20 bp, Artificial
  CRISPR gRNA sequence
aggccttatgaactcacatc

SEQ ID NO: 264665 - DNA, 20 bp, Artificial
  CRISPR gRNA sequence
atgaactcacatcagtgcta

SEQ ID NO: 264666 - DNA, 20 bp, Artificial
  CRISPR gRNA sequence
tgaactcacatcagtgctat

SEQ ID NO: 264667 - DNA, 20 bp, Artificial
  CRISPR gRNA sequence
acatcagtgctattgcatca

SEQ ID NO: 264668 - DNA, 20 bp, Artificial
  CRISPR gRNA sequence
ttgcatcagcctcctgattg

SEQ ID NO: 264669 - DNA, 20 bp, Artificial
  CRISPR gRNA sequence
catcagcctcctgattggtc

SEQ ID NO: 264670 - DNA, 20 bp, Artificial
  CRISPR gRNA sequence
ctgattggtctctgcctcag

SEQ ID NO: 264671 - DNA, 20 bp, Artificial
  CRISPR gRNA sequence
attggtctctgcctcagttc

SEQ ID NO: 264672 - DNA, 20 bp, Artificial
  CRISPR gRNA sequence
gtctctgcctcagttcttcc

SEQ ID NO: 264673 - DNA, 20 bp, Artificial
  CRISPR gRNA sequence
tgcctcagttcttcccttgc

SEQ ID NO: 264674 - DNA, 20 bp, Artificial
  CRISPR gRNA sequence
cctcagttcttcccttgctc

SEQ ID NO: 264675 - DNA, 20 bp, Artificial
  CRISPR gRNA sequence
agttcttcccttgctccaag

SEQ ID NO: 264676 - DNA, 20 bp, Artificial
  CRISPR gRNA sequence
ttcccttgctccaagccaag

SEQ ID NO: 264677 - DNA, 20 bp, Artificial
  CRISPR gRNA sequence
cccttgctccaagccaaggg

SEQ ID NO: 264678 - DNA, 20 bp, Artificial
  CRISPR gRNA sequence
ccttgctccaagccaagggc

SEQ ID NO: 264679 - DNA, 20 bp, Artificial
  CRISPR gRNA sequence
gctccaagccaagggcagtc

SEQ ID NO: 264680 - DNA, 20 bp, Artificial
  CRISPR gRNA sequence
ctccaagccaagggcagtca

SEQ ID NO: 264681 - DNA, 20 bp, Artificial
  CRISPR gRNA sequence
caagccaagggcagtcaaga

SEQ ID NO: 264682 - DNA, 20 bp, Artificial
  CRISPR gRNA sequence
cttgctgcactcctcaaggc

SEQ ID NO: 264683 - DNA, 20 bp, Artificial
  CRISPR gRNA sequence
gctgcactcctcaaggctgt

SEQ ID NO: 264684 - DNA, 20 bp, Artificial
  CRISPR gRNA sequence
ctgcactcctcaaggctgtg

SEQ ID NO: 264685 - DNA, 20 bp, Artificial
  CRISPR gRNA sequence
cactcctcaaggctgtgcta

SEQ ID NO: 264686 - DNA, 20 bp, Artificial
  CRISPR gRNA sequence
ctcaaggctgtgctaacctt

SEQ ID NO: 264687 - DNA, 20 bp, Artificial
  CRISPR gRNA sequence
aaggctgtgctaaccttccc

SEQ ID NO: 264688 - DNA, 20 bp, Artificial
  CRISPR gRNA sequence
tgctaaccttcccaaagcag

SEQ ID NO: 264689 - DNA, 20 bp, Artificial
  CRISPR gRNA sequence
accttcccaaagcagcatgt

SEQ ID NO: 264690 - DNA, 20 bp, Artificial
  CRISPR gRNA sequence
cccaaagcagcatgtaccac

SEQ ID NO: 264691 - DNA, 20 bp, Artificial
  CRISPR gRNA sequence
ccaaagcagcatgtaccaca

SEQ ID NO: 264692 - DNA, 20 bp, Artificial
  CRISPR gRNA sequence
tcaactcagacatcttcagc

SEQ ID NO: 264693 - DNA, 20 bp, Artificial
  CRISPR gRNA sequence
aactcagacatcttcagcat

SEQ ID NO: 264694 - DNA, 20 bp, Artificial
  CRISPR gRNA sequence
agacatcttcagcatctccc

SEQ ID NO: 264695 - DNA, 20 bp, Artificial
  CRISPR gRNA sequence
cagcatctcccatggccttt

SEQ ID NO: 264696 - DNA, 20 bp, Artificial
  CRISPR gRNA sequence
agcatctcccatggcctttc

SEQ ID NO: 264697 - DNA, 20 bp, Artificial
  CRISPR gRNA sequence
ccatggcctttctggtaaaa

SEQ ID NO: 264698 - DNA, 20 bp, Artificial
  CRISPR gRNA sequence
tctggtaaaatctatgtgcc

SEQ ID NO: 264699 - DNA, 20 bp, Artificial
  CRISPR gRNA sequence
ctggtaaaatctatgtgcct

SEQ ID NO: 264700 - DNA, 20 bp, Artificial
  CRISPR gRNA sequence
tggtaaaatctatgtgcctt

SEQ ID NO: 264701 - DNA, 20 bp, Artificial
  CRISPR gRNA sequence
gtaaaatctatgtgcctttt

SEQ ID NO: 264702 - DNA, 20 bp, Artificial
  CRISPR gRNA sequence
tgtgccttttcttggctccc

SEQ ID NO: 264703 - DNA, 20 bp, Artificial
  CRISPR gRNA sequence
ttcttggctccccatgactg

SEQ ID NO: 264704 - DNA, 20 bp, Artificial
  CRISPR gRNA sequence
tcttggctccccatgactgg

SEQ ID NO: 264705 - DNA, 20 bp, Artificial
  CRISPR gRNA sequence
cttggctccccatgactggt

SEQ ID NO: 264706 - DNA, 20 bp, Artificial
  CRISPR gRNA sequence
ttggctccccatgactggta

SEQ ID NO: 264707 - DNA, 20 bp, Artificial
  CRISPR gRNA sequence
ggctccccatgactggtatt

SEQ ID NO: 264708 - DNA, 20 bp, Artificial
  CRISPR gRNA sequence
gctccccatgactggtattg

SEQ ID NO: 264709 - DNA, 20 bp, Artificial
  CRISPR gRNA sequence
cccatgactggtattggcca

SEQ ID NO: 264710 - DNA, 20 bp, Artificial
  CRISPR gRNA sequence
gtattggccatcttcacctg

SEQ ID NO: 264711 - DNA, 20 bp, Artificial
  CRISPR gRNA sequence
gccatcttcacctgtttcca

SEQ ID NO: 264712 - DNA, 20 bp, Artificial
  CRISPR gRNA sequence
cacctgtttccatcctacat

SEQ ID NO: 264713 - DNA, 20 bp, Artificial
  CRISPR gRNA sequence
acctgtttccatcctacata

SEQ ID NO: 264714 - DNA, 20 bp, Artificial
  CRISPR gRNA sequence
tttccatcctacataaatgg

SEQ ID NO: 264715 - DNA, 20 bp, Artificial
  CRISPR gRNA sequence
ccatcctacataaatggaat

SEQ ID NO: 264716 - DNA, 20 bp, Artificial
  CRISPR gRNA sequence
catcctacataaatggaata

SEQ ID NO: 264717 - DNA, 20 bp, Artificial
  CRISPR gRNA sequence
cataaatggaatactctgcc

SEQ ID NO: 264718 - DNA, 20 bp, Artificial
  CRISPR gRNA sequence
tgccagttcccaataaactc

SEQ ID NO: 264719 - DNA, 20 bp, Artificial
  CRISPR gRNA sequence
ccagttcccaataaactctc

SEQ ID NO: 264720 - DNA, 20 bp, Artificial
  CRISPR gRNA sequence
ccaataaactctcacactaa

SEQ ID NO: 264721 - DNA, 20 bp, Artificial
  CRISPR gRNA sequence
tcacactaaggtcatttcca

SEQ ID NO: 264722 - DNA, 20 bp, Artificial
  CRISPR gRNA sequence
acactaaggtcatttccatg

SEQ ID NO: 264723 - DNA, 20 bp, Artificial
  CRISPR gRNA sequence
aggtcatttccatgatctta

SEQ ID NO: 264724 - DNA, 20 bp, Artificial
  CRISPR gRNA sequence
ccatgatcttagcctgtcta

SEQ ID NO: 264725 - DNA, 20 bp, Artificial
  CRISPR gRNA sequence
catgatcttagcctgtctaa

SEQ ID NO: 264726 - DNA, 20 bp, Artificial
  CRISPR gRNA sequence
agcctgtctaaatttgcccc

SEQ ID NO: 264727 - DNA, 20 bp, Artificial
  CRISPR gRNA sequence
gcctgtctaaatttgcccca

SEQ ID NO: 264728 - DNA, 20 bp, Artificial
  CRISPR gRNA sequence
tctaaatttgccccagacct

SEQ ID NO: 264729 - DNA, 20 bp, Artificial
  CRISPR gRNA sequence
aatttgccccagaccttatg

SEQ ID NO: 264730 - DNA, 20 bp, Artificial
  CRISPR gRNA sequence
gccccagaccttatggccca

SEQ ID NO: 264731 - DNA, 20 bp, Artificial
  CRISPR gRNA sequence
ccccagaccttatggcccag

SEQ ID NO: 264732 - DNA, 20 bp, Artificial
  CRISPR gRNA sequence
atggcccagctaaatgtgaa

SEQ ID NO: 264733 - DNA, 20 bp, Artificial
  CRISPR gRNA sequence
tggcccagctaaatgtgaag

SEQ ID NO: 264734 - DNA, 20 bp, Artificial
  CRISPR gRNA sequence
aatgtgaagtctctacaaaa

SEQ ID NO: 264735 - DNA, 20 bp, Artificial
  CRISPR gRNA sequence
tacaaaagcctccagaatca

SEQ ID NO: 264736 - DNA, 20 bp, Artificial
  CRISPR gRNA sequence
caaaagcctccagaatcatc

SEQ ID NO: 264737 - DNA, 20 bp, Artificial
  CRISPR gRNA sequence
cagaatcatcctgtctggaa

SEQ ID NO: 264738 - DNA, 20 bp, Artificial
  CRISPR gRNA sequence
tctggaaacaaggcttcttt

SEQ ID NO: 264739 - DNA, 20 bp, Artificial
  CRISPR gRNA sequence
gaaacaaggcttctttcgcg

SEQ ID NO: 264740 - DNA, 20 bp, Artificial
  CRISPR gRNA sequence
ctttcgcgtgcctgtcaatg

SEQ ID NO: 264741 - DNA, 20 bp, Artificial
  CRISPR gRNA sequence
tttcgcgtgcctgtcaatga

SEQ ID NO: 264742 - DNA, 20 bp, Artificial
  CRISPR gRNA sequence
tcgcgtgcctgtcaatgacc

SEQ ID NO: 264743 - DNA, 20 bp, Artificial
  CRISPR gRNA sequence
cgcgtgcctgtcaatgaccc

SEQ ID NO: 264744 - DNA, 20 bp, Artificial
  CRISPR gRNA sequence
gcgtgcctgtcaatgaccct

SEQ ID NO: 264745 - DNA, 20 bp, Artificial
  CRISPR gRNA sequence
tcaatgaccctttaaagggt

SEQ ID NO: 264746 - DNA, 20 bp, Artificial
  CRISPR gRNA sequence
taaagggttcatgtaccacg

SEQ ID NO: 264747 - DNA, 20 bp, Artificial
  CRISPR gRNA sequence
aaagggttcatgtaccacgg

SEQ ID NO: 264748 - DNA, 20 bp, Artificial
  CRISPR gRNA sequence
aagggttcatgtaccacgga

SEQ ID NO: 264749 - DNA, 20 bp, Artificial
  CRISPR gRNA sequence
atgtaccacggatggcttcg

SEQ ID NO: 264750 - DNA, 20 bp, Artificial
  CRISPR gRNA sequence
cggagagtagctgattgtgt

SEQ ID NO: 264751 - DNA, 20 bp, Artificial
  CRISPR gRNA sequence
ggagagtagctgattgtgta

SEQ ID NO: 264752 - DNA, 20 bp, Artificial
  CRISPR gRNA sequence
attgtgtacctgccttcgga

SEQ ID NO: 264753 - DNA, 20 bp, Artificial
  CRISPR gRNA sequence
tgtacctgccttcggatttc

SEQ ID NO: 264754 - DNA, 20 bp, Artificial
  CRISPR gRNA sequence
ccttcggatttctcctagaa

SEQ ID NO: 264755 - DNA, 20 bp, Artificial
  CRISPR gRNA sequence
cggatttctcctagaatgaa

SEQ ID NO: 264756 - DNA, 20 bp, Artificial
  CRISPR gRNA sequence
ggatttctcctagaatgaaa

SEQ ID NO: 264757 - DNA, 20 bp, Artificial
  CRISPR gRNA sequence
ctcctagaatgaaacagctc

SEQ ID NO: 264758 - DNA, 20 bp, Artificial
  CRISPR gRNA sequence
tcctagaatgaaacagctct

SEQ ID NO: 264759 - DNA, 20 bp, Artificial
  CRISPR gRNA sequence
ctagaatgaaacagctctgt

SEQ ID NO: 264760 - DNA, 20 bp, Artificial
  CRISPR gRNA sequence
gaatgaaacagctctgtctt

SEQ ID NO: 264761 - DNA, 20 bp, Artificial
  CRISPR gRNA sequence
tgtcttttacatcttcccat

SEQ ID NO: 264762 - DNA, 20 bp, Artificial
  CRISPR gRNA sequence
tcttttacatcttcccatct

SEQ ID NO: 264763 - DNA, 20 bp, Artificial
  CRISPR gRNA sequence
ttacatcttcccatctccta

SEQ ID NO: 264764 - DNA, 20 bp, Artificial
  CRISPR gRNA sequence
tacatcttcccatctcctaa

SEQ ID NO: 264765 - DNA, 20 bp, Artificial
  CRISPR gRNA sequence
acatcttcccatctcctaag

SEQ ID NO: 264766 - DNA, 20 bp, Artificial
  CRISPR gRNA sequence
catcttcccatctcctaaga

SEQ ID NO: 264767 - DNA, 20 bp, Artificial
  CRISPR gRNA sequence
cccatctcctaagaatcaag

SEQ ID NO: 264768 - DNA, 20 bp, Artificial
  CRISPR gRNA sequence
ccatctcctaagaatcaagt

SEQ ID NO: 264769 - DNA, 20 bp, Artificial
  CRISPR gRNA sequence
ctaagaatcaagtacattaa

SEQ ID NO: 264770 - DNA, 20 bp, Artificial
  CRISPR gRNA sequence
agaatcaagtacattaagtc

SEQ ID NO: 264771 - DNA, 20 bp, Artificial
  CRISPR gRNA sequence
agtcccttatttatttgatg

SEQ ID NO: 264772 - DNA, 20 bp, Artificial
  CRISPR gRNA sequence
atttatttgatgaataaatg

SEQ ID NO: 264773 - DNA, 20 bp, Artificial
  CRISPR gRNA sequence
tttatttgatgaataaatga

SEQ ID NO: 264774 - DNA, 20 bp, Artificial
  CRISPR gRNA sequence
atttgatgaataaatgaatg

SEQ ID NO: 264775 - DNA, 20 bp, Artificial
  CRISPR gRNA sequence
tttgatgaataaatgaatga

SEQ ID NO: 264776 - DNA, 20 bp, Artificial
  CRISPR gRNA sequence
gatgaataaatgaatgaatg

SEQ ID NO: 264777 - DNA, 20 bp, Artificial
  CRISPR gRNA sequence
atgaataaatgaatgaatga

SEQ ID NO: 264778 - DNA, 20 bp, Artificial
  CRISPR gRNA sequence
tcacagcagaagtcagaata

SEQ ID NO: 264779 - DNA, 20 bp, Artificial
  CRISPR gRNA sequence
tgtgacacatcaaaatttct

SEQ ID NO: 264780 - DNA, 20 bp, Artificial
  CRISPR gRNA sequence
tgacacatcaaaatttcttc

SEQ ID NO: 264781 - DNA, 20 bp, Artificial
  CRISPR gRNA sequence
cttctcagaaagtactcatt

SEQ ID NO: 264782 - DNA, 20 bp, Artificial
  CRISPR gRNA sequence
ttctcagaaagtactcattg

SEQ ID NO: 264783 - DNA, 20 bp, Artificial
  CRISPR gRNA sequence
ctcagaaagtactcattgat

SEQ ID NO: 264784 - DNA, 20 bp, Artificial
  CRISPR gRNA sequence
tcagaaagtactcattgatt

SEQ ID NO: 264785 - DNA, 20 bp, Artificial
  CRISPR gRNA sequence
agaaagtactcattgattgt

SEQ ID NO: 264786 - DNA, 20 bp, Artificial
  CRISPR gRNA sequence
attgattgtttttgataact

SEQ ID NO: 264787 - DNA, 20 bp, Artificial
  CRISPR gRNA sequence
attgtttttgataacttttc

SEQ ID NO: 264788 - DNA, 20 bp, Artificial
  CRISPR gRNA sequence
tttttgataacttttccctc

SEQ ID NO: 264789 - DNA, 20 bp, Artificial
  CRISPR gRNA sequence
ttgataacttttccctctca

SEQ ID NO: 264790 - DNA, 20 bp, Artificial
  CRISPR gRNA sequence
tgataacttttccctctcaa

SEQ ID NO: 264791 - DNA, 20 bp, Artificial
  CRISPR gRNA sequence
gataacttttccctctcaaa

SEQ ID NO: 264792 - DNA, 20 bp, Artificial
  CRISPR gRNA sequence
ataacttttccctctcaaaa

SEQ ID NO: 264793 - DNA, 20 bp, Artificial
  CRISPR gRNA sequence
ttccctctcaaaaatgaatg

SEQ ID NO: 264794 - DNA, 20 bp, Artificial
  CRISPR gRNA sequence
tccctctcaaaaatgaatgc

SEQ ID NO: 264795 - DNA, 20 bp, Artificial
  CRISPR gRNA sequence
ccctctcaaaaatgaatgcc

SEQ ID NO: 264796 - DNA, 20 bp, Artificial
  CRISPR gRNA sequence
cctctcaaaaatgaatgcct

SEQ ID NO: 264797 - DNA, 20 bp, Artificial
  CRISPR gRNA sequence
tcaaaaatgaatgccttagg

SEQ ID NO: 264798 - DNA, 20 bp, Artificial
  CRISPR gRNA sequence
aaaaatgaatgccttaggtc

SEQ ID NO: 264799 - DNA, 20 bp, Artificial
  CRISPR gRNA sequence
aggtcttggtgctcatatgg

SEQ ID NO: 264800 - DNA, 20 bp, Artificial
  CRISPR gRNA sequence
ggtcttggtgctcatatggg

SEQ ID NO: 264801 - DNA, 20 bp, Artificial
  CRISPR gRNA sequence
ggtgctcatatgggactttt

SEQ ID NO: 264802 - DNA, 20 bp, Artificial
  CRISPR gRNA sequence
gtgctcatatgggacttttt

SEQ ID NO: 264803 - DNA, 20 bp, Artificial
  CRISPR gRNA sequence
atatgggactttttgctact

SEQ ID NO: 264804 - DNA, 20 bp, Artificial
  CRISPR gRNA sequence
tttgctactgaactatctga

SEQ ID NO: 264805 - DNA, 20 bp, Artificial
  CRISPR gRNA sequence
ttgctactgaactatctgac

SEQ ID NO: 264806 - DNA, 20 bp, Artificial
  CRISPR gRNA sequence
tgctactgaactatctgacc

SEQ ID NO: 264807 - DNA, 20 bp, Artificial
  CRISPR gRNA sequence
gctactgaactatctgacct

SEQ ID NO: 264808 - DNA, 20 bp, Artificial
  CRISPR gRNA sequence
ctactgaactatctgacctt

SEQ ID NO: 264809 - DNA, 20 bp, Artificial
  CRISPR gRNA sequence
ctgaactatctgacctttga

SEQ ID NO: 264810 - DNA, 20 bp, Artificial
  CRISPR gRNA sequence
aactatctgacctttgactt

SEQ ID NO: 264811 - DNA, 20 bp, Artificial
  CRISPR gRNA sequence
tctgacctttgacttacttt

SEQ ID NO: 264812 - DNA, 20 bp, Artificial
  CRISPR gRNA sequence
acctttgacttactttctga

SEQ ID NO: 264813 - DNA, 20 bp, Artificial
  CRISPR gRNA sequence
tgacttactttctgacagtt

SEQ ID NO: 264814 - DNA, 20 bp, Artificial
  CRISPR gRNA sequence
gacttactttctgacagtta

SEQ ID NO: 264815 - DNA, 20 bp, Artificial
  CRISPR gRNA sequence
acttactttctgacagttac

SEQ ID NO: 264816 - DNA, 20 bp, Artificial
  CRISPR gRNA sequence
actttctgacagttacatgt

SEQ ID NO: 264817 - DNA, 20 bp, Artificial
  CRISPR gRNA sequence
ctttctgacagttacatgta

SEQ ID NO: 264818 - DNA, 20 bp, Artificial
  CRISPR gRNA sequence
tctgacagttacatgtagca

SEQ ID NO: 264819 - DNA, 20 bp, Artificial
  CRISPR gRNA sequence
ctgacagttacatgtagcac

SEQ ID NO: 264820 - DNA, 20 bp, Artificial
  CRISPR gRNA sequence
tgacagttacatgtagcaca

SEQ ID NO: 264821 - DNA, 20 bp, Artificial
  CRISPR gRNA sequence
acagttacatgtagcacaat

SEQ ID NO: 264822 - DNA, 20 bp, Artificial
  CRISPR gRNA sequence
catgtagcacaataattttt

SEQ ID NO: 264823 - DNA, 20 bp, Artificial
  CRISPR gRNA sequence
ttttaagaggacaagaacaa

SEQ ID NO: 264824 - DNA, 20 bp, Artificial
  CRISPR gRNA sequence
tttaagaggacaagaacaag

SEQ ID NO: 264825 - DNA, 20 bp, Artificial
  CRISPR gRNA sequence
ttaagaggacaagaacaagt

SEQ ID NO: 264826 - DNA, 20 bp, Artificial
  CRISPR gRNA sequence
taagaggacaagaacaagtg

SEQ ID NO: 264827 - DNA, 20 bp, Artificial
  CRISPR gRNA sequence
aagaggacaagaacaagtgt

SEQ ID NO: 264828 - DNA, 20 bp, Artificial
  CRISPR gRNA sequence
agaggacaagaacaagtgtc

SEQ ID NO: 264829 - DNA, 20 bp, Artificial
  CRISPR gRNA sequence
tacattatagtgtctgcctg

SEQ ID NO: 264830 - DNA, 20 bp, Artificial
  CRISPR gRNA sequence
cattatagtgtctgcctgtg

SEQ ID NO: 264831 - DNA, 20 bp, Artificial
  CRISPR gRNA sequence
tagtgtctgcctgtgtagga

SEQ ID NO: 264832 - DNA, 20 bp, Artificial
  CRISPR gRNA sequence
cctgtgtaggaacacaaata

SEQ ID NO: 264833 - DNA, 20 bp, Artificial
  CRISPR gRNA sequence
tgtaggaacacaaataaagg

SEQ ID NO: 264834 - DNA, 20 bp, Artificial
  CRISPR gRNA sequence
aaggtggggcttagattagt

SEQ ID NO: 264835 - DNA, 20 bp, Artificial
  CRISPR gRNA sequence
agattagtgctgaccaaaag

SEQ ID NO: 264836 - DNA, 20 bp, Artificial
  CRISPR gRNA sequence
gattagtgctgaccaaaagc

SEQ ID NO: 264837 - DNA, 20 bp, Artificial
  CRISPR gRNA sequence
gtgctgaccaaaagcaactt

SEQ ID NO: 264838 - DNA, 20 bp, Artificial
  CRISPR gRNA sequence
accaaaagcaacttctttac

SEQ ID NO: 264839 - DNA, 20 bp, Artificial
  CRISPR gRNA sequence
ctttactaaattatttattt

SEQ ID NO: 264840 - DNA, 20 bp, Artificial
  CRISPR gRNA sequence
tttactaaattatttattta

SEQ ID NO: 264841 - DNA, 20 bp, Artificial
  CRISPR gRNA sequence
tactaaattatttatttatt

SEQ ID NO: 264842 - DNA, 20 bp, Artificial
  CRISPR gRNA sequence
actaaattatttatttattt

SEQ ID NO: 264843 - DNA, 20 bp, Artificial
  CRISPR gRNA sequence
ctaaattatttatttatttg

SEQ ID NO: 264844 - DNA, 20 bp, Artificial
  CRISPR gRNA sequence
aattatttatttatttgaga

SEQ ID NO: 264845 - DNA, 20 bp, Artificial
  CRISPR gRNA sequence
tttatttatttgagatgggg

SEQ ID NO: 264846 - DNA, 20 bp, Artificial
  CRISPR gRNA sequence
atttatttgagatggggtct

SEQ ID NO: 264847 - DNA, 20 bp, Artificial
  CRISPR gRNA sequence
tttatttgagatggggtctc

SEQ ID NO: 264848 - DNA, 20 bp, Artificial
  CRISPR gRNA sequence
atttgagatggggtctcact

SEQ ID NO: 264849 - DNA, 20 bp, Artificial
  CRISPR gRNA sequence
tttgagatggggtctcactt

SEQ ID NO: 264850 - DNA, 20 bp, Artificial
  CRISPR gRNA sequence
gagatggggtctcactttgt

SEQ ID NO: 264851 - DNA, 20 bp, Artificial
  CRISPR gRNA sequence
agatggggtctcactttgtt

SEQ ID NO: 264852 - DNA, 20 bp, Artificial
  CRISPR gRNA sequence
actttgttgctcaggctgga

SEQ ID NO: 264853 - DNA, 20 bp, Artificial
  CRISPR gRNA sequence
tgttgctcaggctggagtgc

SEQ ID NO: 264854 - DNA, 20 bp, Artificial
  CRISPR gRNA sequence
gttgctcaggctggagtgca

SEQ ID NO: 264855 - DNA, 20 bp, Artificial
  CRISPR gRNA sequence
ttgctcaggctggagtgcag

SEQ ID NO: 264856 - DNA, 20 bp, Artificial
  CRISPR gRNA sequence
ctcaggctggagtgcagtgg

SEQ ID NO: 264857 - DNA, 20 bp, Artificial
  CRISPR gRNA sequence
aggctggagtgcagtggtac

SEQ ID NO: 264858 - DNA, 20 bp, Artificial
  CRISPR gRNA sequence
gagtgcagtggtacaatcac

SEQ ID NO: 264859 - DNA, 20 bp, Artificial
  CRISPR gRNA sequence
actgcagccttgacctcctg

SEQ ID NO: 264860 - DNA, 20 bp, Artificial
  CRISPR gRNA sequence
cagccttgacctcctgggct

SEQ ID NO: 264861 - DNA, 20 bp, Artificial
  CRISPR gRNA sequence
gacctcctgggctcaagtga

SEQ ID NO: 264862 - DNA, 20 bp, Artificial
  CRISPR gRNA sequence
acctcctgggctcaagtgat

SEQ ID NO: 264863 - DNA, 20 bp, Artificial
  CRISPR gRNA sequence
ctgggctcaagtgatcctcc

SEQ ID NO: 264864 - DNA, 20 bp, Artificial
  CRISPR gRNA sequence
ggctcaagtgatcctcccac

SEQ ID NO: 264865 - DNA, 20 bp, Artificial
  CRISPR gRNA sequence
aagtgatcctcccacctcag

SEQ ID NO: 264866 - DNA, 20 bp, Artificial
  CRISPR gRNA sequence
ccacctcagcctcccaagga

SEQ ID NO: 264867 - DNA, 20 bp, Artificial
  CRISPR gRNA sequence
agcctcccaaggagctggga

SEQ ID NO: 264868 - DNA, 20 bp, Artificial
  CRISPR gRNA sequence
ccaaggagctgggactacag

SEQ ID NO: 264869 - DNA, 20 bp, Artificial
  CRISPR gRNA sequence
ggactacaggcacatgccac

SEQ ID NO: 264870 - DNA, 20 bp, Artificial
  CRISPR gRNA sequence
caggcacatgccaccacagc

SEQ ID NO: 264871 - DNA, 20 bp, Artificial
  CRISPR gRNA sequence
atttttgtattttttgtaga

SEQ ID NO: 264872 - DNA, 20 bp, Artificial
  CRISPR gRNA sequence
ttgtattttttgtagaaatg

SEQ ID NO: 264873 - DNA, 20 bp, Artificial
  CRISPR gRNA sequence
tgtattttttgtagaaatgg

SEQ ID NO: 264874 - DNA, 20 bp, Artificial
  CRISPR gRNA sequence
gtattttttgtagaaatggg

SEQ ID NO: 264875 - DNA, 20 bp, Artificial
  CRISPR gRNA sequence
tattttttgtagaaatgggg

SEQ ID NO: 264876 - DNA, 20 bp, Artificial
  CRISPR gRNA sequence
tttgtagaaatggggtctcg

SEQ ID NO: 264877 - DNA, 20 bp, Artificial
  CRISPR gRNA sequence
ttgtagaaatggggtctcgc

SEQ ID NO: 264878 - DNA, 20 bp, Artificial
  CRISPR gRNA sequence
tgtagaaatggggtctcgcc

SEQ ID NO: 264879 - DNA, 20 bp, Artificial
  CRISPR gRNA sequence
gtagaaatggggtctcgcca

SEQ ID NO: 264880 - DNA, 20 bp, Artificial
  CRISPR gRNA sequence
tagaaatggggtctcgccat

SEQ ID NO: 264881 - DNA, 20 bp, Artificial
  CRISPR gRNA sequence
gccatgttgcccaggctggt

SEQ ID NO: 264882 - DNA, 20 bp, Artificial
  CRISPR gRNA sequence
cccaggctggtttccatctc

SEQ ID NO: 264883 - DNA, 20 bp, Artificial
  CRISPR gRNA sequence
gtttccatctcctgggttca

SEQ ID NO: 264884 - DNA, 20 bp, Artificial
  CRISPR gRNA sequence
ccatctcctgggttcaagcg

SEQ ID NO: 264885 - DNA, 20 bp, Artificial
  CRISPR gRNA sequence
catctcctgggttcaagcga

SEQ ID NO: 264886 - DNA, 20 bp, Artificial
  CRISPR gRNA sequence
ctgggttcaagcgatccacc

SEQ ID NO: 264887 - DNA, 20 bp, Artificial
  CRISPR gRNA sequence
ggttcaagcgatccacctgt

SEQ ID NO: 264888 - DNA, 20 bp, Artificial
  CRISPR gRNA sequence
aagcgatccacctgtgtcat

SEQ ID NO: 264889 - DNA, 20 bp, Artificial
  CRISPR gRNA sequence
tgtcatcctcccaaagtgct

SEQ ID NO: 264890 - DNA, 20 bp, Artificial
  CRISPR gRNA sequence
ccaaagtgctaggagtacag

SEQ ID NO: 264891 - DNA, 20 bp, Artificial
  CRISPR gRNA sequence
ggagtacaggtgtaatccac

SEQ ID NO: 264892 - DNA, 20 bp, Artificial
  CRISPR gRNA sequence
tgccaggcctttagtaaatt

SEQ ID NO: 264893 - DNA, 20 bp, Artificial
  CRISPR gRNA sequence
tagtaaatttattaatcagg

SEQ ID NO: 264894 - DNA, 20 bp, Artificial
  CRISPR gRNA sequence
agtaaatttattaatcagga

SEQ ID NO: 264895 - DNA, 20 bp, Artificial
  CRISPR gRNA sequence
gtaaatttattaatcaggat

SEQ ID NO: 264896 - DNA, 20 bp, Artificial
  CRISPR gRNA sequence
attaatcaggattctatttc

SEQ ID NO: 264897 - DNA, 20 bp, Artificial
  CRISPR gRNA sequence
ttaatcaggattctatttct

SEQ ID NO: 264898 - DNA, 20 bp, Artificial
  CRISPR gRNA sequence
atcaggattctatttctatt

SEQ ID NO: 264899 - DNA, 20 bp, Artificial
  CRISPR gRNA sequence
tatttctatttatattgtta

SEQ ID NO: 264900 - DNA, 20 bp, Artificial
  CRISPR gRNA sequence
tttctatttatattgttacc

SEQ ID NO: 264901 - DNA, 20 bp, Artificial
  CRISPR gRNA sequence
ctatttatattgttacctat

SEQ ID NO: 264902 - DNA, 20 bp, Artificial
  CRISPR gRNA sequence
tatttatattgttacctata

SEQ ID NO: 264903 - DNA, 20 bp, Artificial
  CRISPR gRNA sequence
tttatattgttacctataat

SEQ ID NO: 264904 - DNA, 20 bp, Artificial
  CRISPR gRNA sequence
atattgttacctataatcat

SEQ ID NO: 264905 - DNA, 20 bp, Artificial
  CRISPR gRNA sequence
tattgttacctataatcatt

SEQ ID NO: 264906 - DNA, 20 bp, Artificial
  CRISPR gRNA sequence
ttacctataatcatttgtcc

SEQ ID NO: 264907 - DNA, 20 bp, Artificial
  CRISPR gRNA sequence
cctataatcatttgtccttg

SEQ ID NO: 264908 - DNA, 20 bp, Artificial
  CRISPR gRNA sequence
taatcatttgtccttgttca

SEQ ID NO: 264909 - DNA, 20 bp, Artificial
  CRISPR gRNA sequence
gtccttgttcaaactaaaac

SEQ ID NO: 264910 - DNA, 20 bp, Artificial
  CRISPR gRNA sequence
tccttgttcaaactaaaacc

SEQ ID NO: 264911 - DNA, 20 bp, Artificial
  CRISPR gRNA sequence
gttcaaactaaaacctcttt

SEQ ID NO: 264912 - DNA, 20 bp, Artificial
  CRISPR gRNA sequence
ttcaaactaaaacctcttta

SEQ ID NO: 264913 - DNA, 20 bp, Artificial
  CRISPR gRNA sequence
aaactaaaacctctttagat

SEQ ID NO: 264914 - DNA, 20 bp, Artificial
  CRISPR gRNA sequence
aaacctctttagattttgtt

SEQ ID NO: 264915 - DNA, 20 bp, Artificial
  CRISPR gRNA sequence
tttagattttgttttaaaac

SEQ ID NO: 264916 - DNA, 20 bp, Artificial
  CRISPR gRNA sequence
tagattttgttttaaaacca

SEQ ID NO: 264917 - DNA, 20 bp, Artificial
  CRISPR gRNA sequence
agattttgttttaaaaccat

SEQ ID NO: 264918 - DNA, 20 bp, Artificial
  CRISPR gRNA sequence
gattttgttttaaaaccata

SEQ ID NO: 264919 - DNA, 20 bp, Artificial
  CRISPR gRNA sequence
tgttttaaaaccatactttc

SEQ ID NO: 264920 - DNA, 20 bp, Artificial
  CRISPR gRNA sequence
gttttaaaaccatactttct

SEQ ID NO: 264921 - DNA, 20 bp, Artificial
  CRISPR gRNA sequence
ttttaaaaccatactttctg

SEQ ID NO: 264922 - DNA, 20 bp, Artificial
  CRISPR gRNA sequence
taaaaccatactttctgtca

SEQ ID NO: 264923 - DNA, 20 bp, Artificial
  CRISPR gRNA sequence
aaaaccatactttctgtcaa

SEQ ID NO: 264924 - DNA, 20 bp, Artificial
  CRISPR gRNA sequence
aaaccatactttctgtcaag

SEQ ID NO: 264925 - DNA, 20 bp, Artificial
  CRISPR gRNA sequence
tctgtcaagaacagttaatg

SEQ ID NO: 264926 - DNA, 20 bp, Artificial
  CRISPR gRNA sequence
ctgtcaagaacagttaatgt

SEQ ID NO: 264927 - DNA, 20 bp, Artificial
  CRISPR gRNA sequence
tgtcaagaacagttaatgtg

SEQ ID NO: 264928 - DNA, 20 bp, Artificial
  CRISPR gRNA sequence
tcaagaacagttaatgtgct

SEQ ID NO: 264929 - DNA, 20 bp, Artificial
  CRISPR gRNA sequence
atgtgcttggtataactgat

SEQ ID NO: 264930 - DNA, 20 bp, Artificial
  CRISPR gRNA sequence
ggtataactgatagttgtga

SEQ ID NO: 264931 - DNA, 20 bp, Artificial
  CRISPR gRNA sequence
gtataactgatagttgtgat

SEQ ID NO: 264932 - DNA, 20 bp, Artificial
  CRISPR gRNA sequence
atagttgtgatatacacaat

SEQ ID NO: 264933 - DNA, 20 bp, Artificial
  CRISPR gRNA sequence
tgatatacacaatcttggcc

SEQ ID NO: 264934 - DNA, 20 bp, Artificial
  CRISPR gRNA sequence
ggccaaagctggttgcttgg

SEQ ID NO: 264935 - DNA, 20 bp, Artificial
  CRISPR gRNA sequence
gccaaagctggttgcttggt

SEQ ID NO: 264936 - DNA, 20 bp, Artificial
  CRISPR gRNA sequence
gttgcttggtctgcttctct

SEQ ID NO: 264937 - DNA, 20 bp, Artificial
  CRISPR gRNA sequence
cttggtctgcttctcttgat

SEQ ID NO: 264938 - DNA, 20 bp, Artificial
  CRISPR gRNA sequence
ggtctgcttctcttgatgga

SEQ ID NO: 264939 - DNA, 20 bp, Artificial
  CRISPR gRNA sequence
gtctgcttctcttgatggaa

SEQ ID NO: 264940 - DNA, 20 bp, Artificial
  CRISPR gRNA sequence
cttctcttgatggaagtcat

SEQ ID NO: 264941 - DNA, 20 bp, Artificial
  CRISPR gRNA sequence
ctcttgatggaagtcattgc

SEQ ID NO: 264942 - DNA, 20 bp, Artificial
  CRISPR gRNA sequence
tcttgatggaagtcattgct

SEQ ID NO: 264943 - DNA, 20 bp, Artificial
  CRISPR gRNA sequence
ttgatggaagtcattgcttc

SEQ ID NO: 264944 - DNA, 20 bp, Artificial
  CRISPR gRNA sequence
gatggaagtcattgcttctg

SEQ ID NO: 264945 - DNA, 20 bp, Artificial
  CRISPR gRNA sequence
atggaagtcattgcttctgt

SEQ ID NO: 264946 - DNA, 20 bp, Artificial
  CRISPR gRNA sequence
cttctgtcatggtggcctcc

SEQ ID NO: 264947 - DNA, 20 bp, Artificial
  CRISPR gRNA sequence
ctgtcatggtggcctccact

SEQ ID NO: 264948 - DNA, 20 bp, Artificial
  CRISPR gRNA sequence
tgtcatggtggcctccacta

SEQ ID NO: 264949 - DNA, 20 bp, Artificial
  CRISPR gRNA sequence
tcatggtggcctccactaca

SEQ ID NO: 264950 - DNA, 20 bp, Artificial
  CRISPR gRNA sequence
cactacacaactctcttgcc

SEQ ID NO: 264951 - DNA, 20 bp, Artificial
  CRISPR gRNA sequence
cacaactctcttgccttctg

SEQ ID NO: 264952 - DNA, 20 bp, Artificial
  CRISPR gRNA sequence
tcttgccttctggttctggt

SEQ ID NO: 264953 - DNA, 20 bp, Artificial
  CRISPR gRNA sequence
ttgccttctggttctggtaa

SEQ ID NO: 264954 - DNA, 20 bp, Artificial
  CRISPR gRNA sequence
gccttctggttctggtaact

SEQ ID NO: 264955 - DNA, 20 bp, Artificial
  CRISPR gRNA sequence
ccttctggttctggtaactt

SEQ ID NO: 264956 - DNA, 20 bp, Artificial
  CRISPR gRNA sequence
ctggttctggtaacttcgct

SEQ ID NO: 264957 - DNA, 20 bp, Artificial
  CRISPR gRNA sequence
tggttctggtaacttcgctg

SEQ ID NO: 264958 - DNA, 20 bp, Artificial
  CRISPR gRNA sequence
gttctggtaacttcgctgtc

SEQ ID NO: 264959 - DNA, 20 bp, Artificial
  CRISPR gRNA sequence
tggtaacttcgctgtcccct

SEQ ID NO: 264960 - DNA, 20 bp, Artificial
  CRISPR gRNA sequence
gtaacttcgctgtcccctgg

SEQ ID NO: 264961 - DNA, 20 bp, Artificial
  CRISPR gRNA sequence
cgctgtcccctggtctcttt

SEQ ID NO: 264962 - DNA, 20 bp, Artificial
  CRISPR gRNA sequence
gctgtcccctggtctctttc

SEQ ID NO: 264963 - DNA, 20 bp, Artificial
  CRISPR gRNA sequence
tcccctggtctctttcgacc

SEQ ID NO: 264964 - DNA, 20 bp, Artificial
  CRISPR gRNA sequence
gtctctttcgacctaagggt

SEQ ID NO: 264965 - DNA, 20 bp, Artificial
  CRISPR gRNA sequence
tttcgacctaagggtggtca

SEQ ID NO: 264966 - DNA, 20 bp, Artificial
  CRISPR gRNA sequence
tcgacctaagggtggtcata

SEQ ID NO: 264967 - DNA, 20 bp, Artificial
  CRISPR gRNA sequence
cgacctaagggtggtcataa

SEQ ID NO: 264968 - DNA, 20 bp, Artificial
  CRISPR gRNA sequence
gacctaagggtggtcataat

SEQ ID NO: 264969 - DNA, 20 bp, Artificial
  CRISPR gRNA sequence
agggtggtcataattctgct

SEQ ID NO: 264970 - DNA, 20 bp, Artificial
  CRISPR gRNA sequence
tgctgctgcaagtcacaggc

SEQ ID NO: 264971 - DNA, 20 bp, Artificial
  CRISPR gRNA sequence
ctgctgcaagtcacaggctc

SEQ ID NO: 264972 - DNA, 20 bp, Artificial
  CRISPR gRNA sequence
ctgcaagtcacaggctctgg

SEQ ID NO: 264973 - DNA, 20 bp, Artificial
  CRISPR gRNA sequence
caagtcacaggctctggcac

SEQ ID NO: 264974 - DNA, 20 bp, Artificial
  CRISPR gRNA sequence
tggcactacccctcgtggtt

SEQ ID NO: 264975 - DNA, 20 bp, Artificial
  CRISPR gRNA sequence
gcactacccctcgtggttct

SEQ ID NO: 264976 - DNA, 20 bp, Artificial
  CRISPR gRNA sequence
cccctcgtggttctgctctt

SEQ ID NO: 264977 - DNA, 20 bp, Artificial
  CRISPR gRNA sequence
gtggttctgctcttgccaca

SEQ ID NO: 264978 - DNA, 20 bp, Artificial
  CRISPR gRNA sequence
tgctcttgccacacctttgc

SEQ ID NO: 264979 - DNA, 20 bp, Artificial
  CRISPR gRNA sequence
ctcttgccacacctttgcca

SEQ ID NO: 264980 - DNA, 20 bp, Artificial
  CRISPR gRNA sequence
ttgccacacctttgccaaca

SEQ ID NO: 264981 - DNA, 20 bp, Artificial
  CRISPR gRNA sequence
gccacacctttgccaacagt

SEQ ID NO: 264982 - DNA, 20 bp, Artificial
  CRISPR gRNA sequence
ccacacctttgccaacagtc

SEQ ID NO: 264983 - DNA, 20 bp, Artificial
  CRISPR gRNA sequence
tgccaacagtcctttcataa

SEQ ID NO: 264984 - DNA, 20 bp, Artificial
  CRISPR gRNA sequence
gccaacagtcctttcataaa

SEQ ID NO: 264985 - DNA, 20 bp, Artificial
  CRISPR gRNA sequence
ccaacagtcctttcataaat

SEQ ID NO: 264986 - DNA, 20 bp, Artificial
  CRISPR gRNA sequence
tcataaataaccttcctact

SEQ ID NO: 264987 - DNA, 20 bp, Artificial
  CRISPR gRNA sequence
cataaataaccttcctactc

SEQ ID NO: 264988 - DNA, 20 bp, Artificial
  CRISPR gRNA sequence
ataaataaccttcctactct

SEQ ID NO: 264989 - DNA, 20 bp, Artificial
  CRISPR gRNA sequence
cctactcttgcccaattttg

SEQ ID NO: 264990 - DNA, 20 bp, Artificial
  CRISPR gRNA sequence
ctactcttgcccaattttgt

SEQ ID NO: 264991 - DNA, 20 bp, Artificial
  CRISPR gRNA sequence
ctcttgcccaattttgtgtg

SEQ ID NO: 264992 - DNA, 20 bp, Artificial
  CRISPR gRNA sequence
ttgcccaattttgtgtgtgc

SEQ ID NO: 264993 - DNA, 20 bp, Artificial
  CRISPR gRNA sequence
gcccaattttgtgtgtgcca

SEQ ID NO: 264994 - DNA, 20 bp, Artificial
  CRISPR gRNA sequence
cccaattttgtgtgtgccat

SEQ ID NO: 264995 - DNA, 20 bp, Artificial
  CRISPR gRNA sequence
tgtgtgtgccatctgttttc

SEQ ID NO: 264996 - DNA, 20 bp, Artificial
  CRISPR gRNA sequence
gtgtgtgccatctgttttca

SEQ ID NO: 264997 - DNA, 20 bp, Artificial
  CRISPR gRNA sequence
tgtgtgccatctgttttcat

SEQ ID NO: 264998 - DNA, 20 bp, Artificial
  CRISPR gRNA sequence
ttttcatttgggatctggaa

SEQ ID NO: 264999 - DNA, 20 bp, Artificial
  CRISPR gRNA sequence
tcatttgggatctggaatga

SEQ ID NO: 265000 - DNA, 20 bp, Artificial
  CRISPR gRNA sequence
catttgggatctggaatgag

SEQ ID NO: 265001 - DNA, 20 bp, Artificial
  CRISPR gRNA sequence
atttgggatctggaatgaga

SEQ ID NO: 265002 - DNA, 20 bp, Artificial
  CRISPR gRNA sequence
gggatctggaatgagacaac

SEQ ID NO: 265003 - DNA, 20 bp, Artificial
  CRISPR gRNA sequence
ggatctggaatgagacaaca

SEQ ID NO: 265004 - DNA, 20 bp, Artificial
  CRISPR gRNA sequence
gaatgagacaacatatagtt

SEQ ID NO: 265005 - DNA, 20 bp, Artificial
  CRISPR gRNA sequence
gcccactgtatccacgggtt

SEQ ID NO: 265006 - DNA, 20 bp, Artificial
  CRISPR gRNA sequence
tatccacgggttatgcatct

SEQ ID NO: 265007 - DNA, 20 bp, Artificial
  CRISPR gRNA sequence
tgcatctttggattcaatga

SEQ ID NO: 265008 - DNA, 20 bp, Artificial
  CRISPR gRNA sequence
tggattcaatgaaccatgga

SEQ ID NO: 265009 - DNA, 20 bp, Artificial
  CRISPR gRNA sequence
ggattcaatgaaccatggat

SEQ ID NO: 265010 - DNA, 20 bp, Artificial
  CRISPR gRNA sequence
gattcaatgaaccatggatc

SEQ ID NO: 265011 - DNA, 20 bp, Artificial
  CRISPR gRNA sequence
aatgaaccatggatcaaaaa

SEQ ID NO: 265012 - DNA, 20 bp, Artificial
  CRISPR gRNA sequence
gtgggatgcagaatctatgg

SEQ ID NO: 265013 - DNA, 20 bp, Artificial
  CRISPR gRNA sequence
tgggatgcagaatctatgga

SEQ ID NO: 265014 - DNA, 20 bp, Artificial
  CRISPR gRNA sequence
tggatacagaggaccaacaa

SEQ ID NO: 265015 - DNA, 20 bp, Artificial
  CRISPR gRNA sequence
catgacttgagcttccatgg

SEQ ID NO: 265016 - DNA, 20 bp, Artificial
  CRISPR gRNA sequence
gagcttccatggattttggt

SEQ ID NO: 265017 - DNA, 20 bp, Artificial
  CRISPR gRNA sequence
agcttccatggattttggta

SEQ ID NO: 265018 - DNA, 20 bp, Artificial
  CRISPR gRNA sequence
ccatggattttggtatctgc

SEQ ID NO: 265019 - DNA, 20 bp, Artificial
  CRISPR gRNA sequence
catggattttggtatctgca

SEQ ID NO: 265020 - DNA, 20 bp, Artificial
  CRISPR gRNA sequence
tggtatctgcaggggtcctg

SEQ ID NO: 265021 - DNA, 20 bp, Artificial
  CRISPR gRNA sequence
ggtatctgcaggggtcctgg

SEQ ID NO: 265022 - DNA, 20 bp, Artificial
  CRISPR gRNA sequence
gtatctgcaggggtcctgga

SEQ ID NO: 265023 - DNA, 20 bp, Artificial
  CRISPR gRNA sequence
caggggtcctggaaccaaca

SEQ ID NO: 265024 - DNA, 20 bp, Artificial
  CRISPR gRNA sequence
gaaccaacaccccatggatc

SEQ ID NO: 265025 - DNA, 20 bp, Artificial
  CRISPR gRNA sequence
tatatgcatgtttatcaagc

SEQ ID NO: 265026 - DNA, 20 bp, Artificial
  CRISPR gRNA sequence
atcaagcttattcaaagccc

SEQ ID NO: 265027 - DNA, 20 bp, Artificial
  CRISPR gRNA sequence
tcaagcttattcaaagcccc

SEQ ID NO: 265028 - DNA, 20 bp, Artificial
  CRISPR gRNA sequence
attcaaagccccctttttct

SEQ ID NO: 265029 - DNA, 20 bp, Artificial
  CRISPR gRNA sequence
ttcaaagccccctttttctg

SEQ ID NO: 265030 - DNA, 20 bp, Artificial
  CRISPR gRNA sequence
aaagccccctttttctgtgt

SEQ ID NO: 265031 - DNA, 20 bp, Artificial
  CRISPR gRNA sequence
tttctgtgtgaagagatttt

SEQ ID NO: 265032 - DNA, 20 bp, Artificial
  CRISPR gRNA sequence
ttctgtgtgaagagattttc

SEQ ID NO: 265033 - DNA, 20 bp, Artificial
  CRISPR gRNA sequence
tctgtgtgaagagattttcc

SEQ ID NO: 265034 - DNA, 20 bp, Artificial
  CRISPR gRNA sequence
ctgtgtgaagagattttcct

SEQ ID NO: 265035 - DNA, 20 bp, Artificial
  CRISPR gRNA sequence
tgtgtgaagagattttcctt

SEQ ID NO: 265036 - DNA, 20 bp, Artificial
  CRISPR gRNA sequence
tgtgaagagattttccttaa

SEQ ID NO: 265037 - DNA, 20 bp, Artificial
  CRISPR gRNA sequence
tccttaaatcttcatttctt

SEQ ID NO: 265038 - DNA, 20 bp, Artificial
  CRISPR gRNA sequence
ccttaaatcttcatttcttg

SEQ ID NO: 265039 - DNA, 20 bp, Artificial
  CRISPR gRNA sequence
cttaaatcttcatttcttgt

SEQ ID NO: 265040 - DNA, 20 bp, Artificial
  CRISPR gRNA sequence
aaatcttcatttcttgtgaa

SEQ ID NO: 265041 - DNA, 20 bp, Artificial
  CRISPR gRNA sequence
aatcttcatttcttgtgaaa

SEQ ID NO: 265042 - DNA, 20 bp, Artificial
  CRISPR gRNA sequence
catttcttgtgaaaatggga

SEQ ID NO: 265043 - DNA, 20 bp, Artificial
  CRISPR gRNA sequence
atttcttgtgaaaatgggaa

SEQ ID NO: 265044 - DNA, 20 bp, Artificial
  CRISPR gRNA sequence
cttgtgaaaatgggaagact

SEQ ID NO: 265045 - DNA, 20 bp, Artificial
  CRISPR gRNA sequence
ttgtgaaaatgggaagactt

SEQ ID NO: 265046 - DNA, 20 bp, Artificial
  CRISPR gRNA sequence
gtgaaaatgggaagactttc

SEQ ID NO: 265047 - DNA, 20 bp, Artificial
  CRISPR gRNA sequence
tgaaaatgggaagactttca

SEQ ID NO: 265048 - DNA, 20 bp, Artificial
  CRISPR gRNA sequence
tcaagataacagtcaacaga

SEQ ID NO: 265049 - DNA, 20 bp, Artificial
  CRISPR gRNA sequence
caagataacagtcaacagaa

SEQ ID NO: 265050 - DNA, 20 bp, Artificial
  CRISPR gRNA sequence
aagataacagtcaacagaaa

SEQ ID NO: 265051 - DNA, 20 bp, Artificial
  CRISPR gRNA sequence
gatgaaatgaccacagaatt

SEQ ID NO: 265052 - DNA, 20 bp, Artificial
  CRISPR gRNA sequence
tttttaaaccataacttgca

SEQ ID NO: 265053 - DNA, 20 bp, Artificial
  CRISPR gRNA sequence
ttaaaccataacttgcatta

SEQ ID NO: 265054 - DNA, 20 bp, Artificial
  CRISPR gRNA sequence
taaaccataacttgcattat

SEQ ID NO: 265055 - DNA, 20 bp, Artificial
  CRISPR gRNA sequence
aaaccataacttgcattatt

SEQ ID NO: 265056 - DNA, 20 bp, Artificial
  CRISPR gRNA sequence
aaccataacttgcattatta

SEQ ID NO: 265057 - DNA, 20 bp, Artificial
  CRISPR gRNA sequence
gcattattatcattattatt

SEQ ID NO: 265058 - DNA, 20 bp, Artificial
  CRISPR gRNA sequence
cattattatcattattatta

SEQ ID NO: 265059 - DNA, 20 bp, Artificial
  CRISPR gRNA sequence
ttatcattattattaccatt

SEQ ID NO: 265060 - DNA, 20 bp, Artificial
  CRISPR gRNA sequence
tcattattattaccattttt

SEQ ID NO: 265061 - DNA, 20 bp, Artificial
  CRISPR gRNA sequence
ttattaccattttttcattt

SEQ ID NO: 265062 - DNA, 20 bp, Artificial
  CRISPR gRNA sequence
ttaccattttttcattttaa

SEQ ID NO: 265063 - DNA, 20 bp, Artificial
  CRISPR gRNA sequence
ccattttttcattttaacat

SEQ ID NO: 265064 - DNA, 20 bp, Artificial
  CRISPR gRNA sequence
tttcattttaacatgaattt

SEQ ID NO: 265065 - DNA, 20 bp, Artificial
  CRISPR gRNA sequence
ttcattttaacatgaatttc

SEQ ID NO: 265066 - DNA, 20 bp, Artificial
  CRISPR gRNA sequence
tcattttaacatgaatttct

SEQ ID NO: 265067 - DNA, 20 bp, Artificial
  CRISPR gRNA sequence
cattttaacatgaatttctg

SEQ ID NO: 265068 - DNA, 20 bp, Artificial
  CRISPR gRNA sequence
attttaacatgaatttctgg

SEQ ID NO: 265069 - DNA, 20 bp, Artificial
  CRISPR gRNA sequence
taacatgaatttctgggaga

SEQ ID NO: 265070 - DNA, 20 bp, Artificial
  CRISPR gRNA sequence
aacatgaatttctgggagag

SEQ ID NO: 265071 - DNA, 20 bp, Artificial
  CRISPR gRNA sequence
acatgaatttctgggagaga

SEQ ID NO: 265072 - DNA, 20 bp, Artificial
  CRISPR gRNA sequence
ctgggagagagaggctgggt

SEQ ID NO: 265073 - DNA, 20 bp, Artificial
  CRISPR gRNA sequence
tgggagagagaggctgggtc

SEQ ID NO: 265074 - DNA, 20 bp, Artificial
  CRISPR gRNA sequence
ggagagagaggctgggtcca

SEQ ID NO: 265075 - DNA, 20 bp, Artificial
  CRISPR gRNA sequence
ggtccattcaaagcatggta

SEQ ID NO: 265076 - DNA, 20 bp, Artificial
  CRISPR gRNA sequence
aaagcatggtaggtcatgaa

SEQ ID NO: 265077 - DNA, 20 bp, Artificial
  CRISPR gRNA sequence
tgtttttatcttcattgcag

SEQ ID NO: 265078 - DNA, 20 bp, Artificial
  CRISPR gRNA sequence
gtttttatcttcattgcagc

SEQ ID NO: 265079 - DNA, 20 bp, Artificial
  CRISPR gRNA sequence
tttttatcttcattgcagct

SEQ ID NO: 265080 - DNA, 20 bp, Artificial
  CRISPR gRNA sequence
ttatcttcattgcagctcag

SEQ ID NO: 265081 - DNA, 20 bp, Artificial
  CRISPR gRNA sequence
tatcttcattgcagctcaga

SEQ ID NO: 265082 - DNA, 20 bp, Artificial
  CRISPR gRNA sequence
atcttcattgcagctcagag

SEQ ID NO: 265083 - DNA, 20 bp, Artificial
  CRISPR gRNA sequence
tcttcattgcagctcagaga

SEQ ID NO: 265084 - DNA, 20 bp, Artificial
  CRISPR gRNA sequence
cattgcagctcagagaggat

SEQ ID NO: 265085 - DNA, 20 bp, Artificial
  CRISPR gRNA sequence
attgcagctcagagaggatg

SEQ ID NO: 265086 - DNA, 20 bp, Artificial
  CRISPR gRNA sequence
cagctcagagaggatggtga

SEQ ID NO: 265087 - DNA, 20 bp, Artificial
  CRISPR gRNA sequence
agagaggatggtgaaaggtg

SEQ ID NO: 265088 - DNA, 20 bp, Artificial
  CRISPR gRNA sequence
cagtctggtgaatgttttgt

SEQ ID NO: 265089 - DNA, 20 bp, Artificial
  CRISPR gRNA sequence
gtgaatgttttgtacttctc

SEQ ID NO: 265090 - DNA, 20 bp, Artificial
  CRISPR gRNA sequence
tgtacttctctttctcttat

SEQ ID NO: 265091 - DNA, 20 bp, Artificial
  CRISPR gRNA sequence
gtacttctctttctcttatc

SEQ ID NO: 265092 - DNA, 20 bp, Artificial
  CRISPR gRNA sequence
tacttctctttctcttatca

SEQ ID NO: 265093 - DNA, 20 bp, Artificial
  CRISPR gRNA sequence
ctctttctcttatcagaagg

SEQ ID NO: 265094 - DNA, 20 bp, Artificial
  CRISPR gRNA sequence
tctttctcttatcagaagga

SEQ ID NO: 265095 - DNA, 20 bp, Artificial
  CRISPR gRNA sequence
tttctcttatcagaaggaag

SEQ ID NO: 265096 - DNA, 20 bp, Artificial
  CRISPR gRNA sequence
tctcttatcagaaggaagcc

SEQ ID NO: 265097 - DNA, 20 bp, Artificial
  CRISPR gRNA sequence
ctcttatcagaaggaagcca

SEQ ID NO: 265098 - DNA, 20 bp, Artificial
  CRISPR gRNA sequence
tcttatcagaaggaagccag

SEQ ID NO: 265099 - DNA, 20 bp, Artificial
  CRISPR gRNA sequence
ttatcagaaggaagccaggc

SEQ ID NO: 265100 - DNA, 20 bp, Artificial
  CRISPR gRNA sequence
atcagaaggaagccaggcca

SEQ ID NO: 265101 - DNA, 20 bp, Artificial
  CRISPR gRNA sequence
tcagaaggaagccaggccac

SEQ ID NO: 265102 - DNA, 20 bp, Artificial
  CRISPR gRNA sequence
aggttatcagagccatagac

SEQ ID NO: 265103 - DNA, 20 bp, Artificial
  CRISPR gRNA sequence
tcagagccatagactgttga

SEQ ID NO: 265104 - DNA, 20 bp, Artificial
  CRISPR gRNA sequence
ttgagtccccctttcttctc

SEQ ID NO: 265105 - DNA, 20 bp, Artificial
  CRISPR gRNA sequence
agtccccctttcttctcagg

SEQ ID NO: 265106 - DNA, 20 bp, Artificial
  CRISPR gRNA sequence
tcttctcagggagcacggtt

SEQ ID NO: 265107 - DNA, 20 bp, Artificial
  CRISPR gRNA sequence
cttctcagggagcacggttt

SEQ ID NO: 265108 - DNA, 20 bp, Artificial
  CRISPR gRNA sequence
ttctcagggagcacggtttg

SEQ ID NO: 265109 - DNA, 20 bp, Artificial
  CRISPR gRNA sequence
ctcagggagcacggtttgtc

SEQ ID NO: 265110 - DNA, 20 bp, Artificial
  CRISPR gRNA sequence
tcagggagcacggtttgtct

SEQ ID NO: 265111 - DNA, 20 bp, Artificial
  CRISPR gRNA sequence
agggagcacggtttgtctca

SEQ ID NO: 265112 - DNA, 20 bp, Artificial
  CRISPR gRNA sequence
gtctcacagtttcctgagca

SEQ ID NO: 265113 - DNA, 20 bp, Artificial
  CRISPR gRNA sequence
tctcacagtttcctgagcaa

SEQ ID NO: 265114 - DNA, 20 bp, Artificial
  CRISPR gRNA sequence
acagtttcctgagcaaccac

SEQ ID NO: 265115 - DNA, 20 bp, Artificial
  CRISPR gRNA sequence
cctgagcaaccaccgggttg

SEQ ID NO: 265116 - DNA, 20 bp, Artificial
  CRISPR gRNA sequence
ctgagcaaccaccgggttgt

SEQ ID NO: 265117 - DNA, 20 bp, Artificial
  CRISPR gRNA sequence
agcaaccaccgggttgtctt

SEQ ID NO: 265118 - DNA, 20 bp, Artificial
  CRISPR gRNA sequence
tcttgtgggggagcctaccc

SEQ ID NO: 265119 - DNA, 20 bp, Artificial
  CRISPR gRNA sequence
gtgggggagcctacccctta

SEQ ID NO: 265120 - DNA, 20 bp, Artificial
  CRISPR gRNA sequence
tgggggagcctaccccttac

SEQ ID NO: 265121 - DNA, 20 bp, Artificial
  CRISPR gRNA sequence
ccccttacagagcctgaaaa

SEQ ID NO: 265122 - DNA, 20 bp, Artificial
  CRISPR gRNA sequence
acagagcctgaaaaggagcc

SEQ ID NO: 265123 - DNA, 20 bp, Artificial
  CRISPR gRNA sequence
cagagcctgaaaaggagcca

SEQ ID NO: 265124 - DNA, 20 bp, Artificial
  CRISPR gRNA sequence
aaaaggagccagtggtcaga

SEQ ID NO: 265125 - DNA, 20 bp, Artificial
  CRISPR gRNA sequence
aagggcatcctgggcctgaa

SEQ ID NO: 265126 - DNA, 20 bp, Artificial
  CRISPR gRNA sequence
ggcctgaacaggaaatatac

SEQ ID NO: 265127 - DNA, 20 bp, Artificial
  CRISPR gRNA sequence
aacaggaaatatactcagag

SEQ ID NO: 265128 - DNA, 20 bp, Artificial
  CRISPR gRNA sequence
agaggaaagttacagtaact

SEQ ID NO: 265129 - DNA, 20 bp, Artificial
  CRISPR gRNA sequence
cagtaacttaactagctctg

SEQ ID NO: 265130 - DNA, 20 bp, Artificial
  CRISPR gRNA sequence
aactagctctgtggtcagga

SEQ ID NO: 265131 - DNA, 20 bp, Artificial
  CRISPR gRNA sequence
actagctctgtggtcaggag

SEQ ID NO: 265132 - DNA, 20 bp, Artificial
  CRISPR gRNA sequence
gctctgtggtcaggagggag

SEQ ID NO: 265133 - DNA, 20 bp, Artificial
  CRISPR gRNA sequence
tgtggtcaggagggaggtgc

SEQ ID NO: 265134 - DNA, 20 bp, Artificial
  CRISPR gRNA sequence
tggtcaggagggaggtgctc

SEQ ID NO: 265135 - DNA, 20 bp, Artificial
  CRISPR gRNA sequence
ttctatgccagggaaatcag

SEQ ID NO: 265136 - DNA, 20 bp, Artificial
  CRISPR gRNA sequence
ctatgccagggaaatcagca

SEQ ID NO: 265137 - DNA, 20 bp, Artificial
  CRISPR gRNA sequence
tatgccagggaaatcagcat

SEQ ID NO: 265138 - DNA, 20 bp, Artificial
  CRISPR gRNA sequence
tgccagggaaatcagcatca

SEQ ID NO: 265139 - DNA, 20 bp, Artificial
  CRISPR gRNA sequence
cacagtgtgctcacaaatat

SEQ ID NO: 265140 - DNA, 20 bp, Artificial
  CRISPR gRNA sequence
acagtgtgctcacaaatatc

SEQ ID NO: 265141 - DNA, 20 bp, Artificial
  CRISPR gRNA sequence
acaaatatcacagggcaaaa

SEQ ID NO: 265142 - DNA, 20 bp, Artificial
  CRISPR gRNA sequence
aaagtagaagctttcattgt

SEQ ID NO: 265143 - DNA, 20 bp, Artificial
  CRISPR gRNA sequence
tcattgtttttggttcctac

SEQ ID NO: 265144 - DNA, 20 bp, Artificial
  CRISPR gRNA sequence
cattgtttttggttcctacc

SEQ ID NO: 265145 - DNA, 20 bp, Artificial
  CRISPR gRNA sequence
attgtttttggttcctacct

SEQ ID NO: 265146 - DNA, 20 bp, Artificial
  CRISPR gRNA sequence
tttttggttcctacctaaca

SEQ ID NO: 265147 - DNA, 20 bp, Artificial
  CRISPR gRNA sequence
ttggttcctacctaacatgt

SEQ ID NO: 265148 - DNA, 20 bp, Artificial
  CRISPR gRNA sequence
tggttcctacctaacatgtg

SEQ ID NO: 265149 - DNA, 20 bp, Artificial
  CRISPR gRNA sequence
ggttcctacctaacatgtga

SEQ ID NO: 265150 - DNA, 20 bp, Artificial
  CRISPR gRNA sequence
gttcctacctaacatgtgaa

SEQ ID NO: 265151 - DNA, 20 bp, Artificial
  CRISPR gRNA sequence
ctacctaacatgtgaaattc

SEQ ID NO: 265152 - DNA, 20 bp, Artificial
  CRISPR gRNA sequence
cctaacatgtgaaattctgt

SEQ ID NO: 265153 - DNA, 20 bp, Artificial
  CRISPR gRNA sequence
acatgtgaaattctgttcag

SEQ ID NO: 265154 - DNA, 20 bp, Artificial
  CRISPR gRNA sequence
tgttcagtccgaatttttaa

SEQ ID NO: 265155 - DNA, 20 bp, Artificial
  CRISPR gRNA sequence
ttcagtccgaatttttaaaa

SEQ ID NO: 265156 - DNA, 20 bp, Artificial
  CRISPR gRNA sequence
agtccgaatttttaaaagga

SEQ ID NO: 265157 - DNA, 20 bp, Artificial
  CRISPR gRNA sequence
ttaaaaggaaacaagataat

SEQ ID NO: 265158 - DNA, 20 bp, Artificial
  CRISPR gRNA sequence
taaaaggaaacaagataatt

SEQ ID NO: 265159 - DNA, 20 bp, Artificial
  CRISPR gRNA sequence
aaaaggaaacaagataatta

SEQ ID NO: 265160 - DNA, 20 bp, Artificial
  CRISPR gRNA sequence
aaaggaaacaagataattag

SEQ ID NO: 265161 - DNA, 20 bp, Artificial
  CRISPR gRNA sequence
gaatcttacaacctgatttt

SEQ ID NO: 265162 - DNA, 20 bp, Artificial
  CRISPR gRNA sequence
acaacctgatttttcaactg

SEQ ID NO: 265163 - DNA, 20 bp, Artificial
  CRISPR gRNA sequence
caacctgatttttcaactgc

SEQ ID NO: 265164 - DNA, 20 bp, Artificial
  CRISPR gRNA sequence
atttttcaactgcaaaagaa

SEQ ID NO: 265165 - DNA, 20 bp, Artificial
  CRISPR gRNA sequence
ttcaactgcaaaagaaagtc

SEQ ID NO: 265166 - DNA, 20 bp, Artificial
  CRISPR gRNA sequence
tcaactgcaaaagaaagtca

SEQ ID NO: 265167 - DNA, 20 bp, Artificial
  CRISPR gRNA sequence
caactgcaaaagaaagtcag

SEQ ID NO: 265168 - DNA, 20 bp, Artificial
  CRISPR gRNA sequence
aactgcaaaagaaagtcaga

SEQ ID NO: 265169 - DNA, 20 bp, Artificial
  CRISPR gRNA sequence
caaaagaaagtcagactatg

SEQ ID NO: 265170 - DNA, 20 bp, Artificial
  CRISPR gRNA sequence
tgatgtgcataaatggaacc

SEQ ID NO: 265171 - DNA, 20 bp, Artificial
  CRISPR gRNA sequence
ataaagttcttaaagattct

SEQ ID NO: 265172 - DNA, 20 bp, Artificial
  CRISPR gRNA sequence
ttaaagattctggaggaaaa

SEQ ID NO: 265173 - DNA, 20 bp, Artificial
  CRISPR gRNA sequence
aaagattctggaggaaaatc

SEQ ID NO: 265174 - DNA, 20 bp, Artificial
  CRISPR gRNA sequence
aagattctggaggaaaatca

SEQ ID NO: 265175 - DNA, 20 bp, Artificial
  CRISPR gRNA sequence
tggaggaaaatcacattttg

SEQ ID NO: 265176 - DNA, 20 bp, Artificial
  CRISPR gRNA sequence
gaggaaaatcacattttgct

SEQ ID NO: 265177 - DNA, 20 bp, Artificial
  CRISPR gRNA sequence
tgctaattaatcatgtattc

SEQ ID NO: 265178 - DNA, 20 bp, Artificial
  CRISPR gRNA sequence
gctaattaatcatgtattcc

SEQ ID NO: 265179 - DNA, 20 bp, Artificial
  CRISPR gRNA sequence
ctaattaatcatgtattcca

SEQ ID NO: 265180 - DNA, 20 bp, Artificial
  CRISPR gRNA sequence
attaatcatgtattccagct

SEQ ID NO: 265181 - DNA, 20 bp, Artificial
  CRISPR gRNA sequence
atcatgtattccagctctct

SEQ ID NO: 265182 - DNA, 20 bp, Artificial
  CRISPR gRNA sequence
cagctctctaactgcttctt

SEQ ID NO: 265183 - DNA, 20 bp, Artificial
  CRISPR gRNA sequence
tctaactgcttctttagctt

SEQ ID NO: 265184 - DNA, 20 bp, Artificial
  CRISPR gRNA sequence
taactgcttctttagcttcc

SEQ ID NO: 265185 - DNA, 20 bp, Artificial
  CRISPR gRNA sequence
actgcttctttagcttccca

SEQ ID NO: 265186 - DNA, 20 bp, Artificial
  CRISPR gRNA sequence
cttctttagcttcccagtac

SEQ ID NO: 265187 - DNA, 20 bp, Artificial
  CRISPR gRNA sequence
ctttagcttcccagtacgtt

SEQ ID NO: 265188 - DNA, 20 bp, Artificial
  CRISPR gRNA sequence
tttagcttcccagtacgttt

SEQ ID NO: 265189 - DNA, 20 bp, Artificial
  CRISPR gRNA sequence
tagcttcccagtacgtttta

SEQ ID NO: 265190 - DNA, 20 bp, Artificial
  CRISPR gRNA sequence
agcttcccagtacgttttat

SEQ ID NO: 265191 - DNA, 20 bp, Artificial
  CRISPR gRNA sequence
gcttcccagtacgttttatt

SEQ ID NO: 265192 - DNA, 20 bp, Artificial
  CRISPR gRNA sequence
cccagtacgttttatttctc

SEQ ID NO: 265193 - DNA, 20 bp, Artificial
  CRISPR gRNA sequence
ccagtacgttttatttctct

SEQ ID NO: 265194 - DNA, 20 bp, Artificial
  CRISPR gRNA sequence
tatttctctatggtgctacg

SEQ ID NO: 265195 - DNA, 20 bp, Artificial
  CRISPR gRNA sequence
atttctctatggtgctacga

SEQ ID NO: 265196 - DNA, 20 bp, Artificial
  CRISPR gRNA sequence
tttctctatggtgctacgat

SEQ ID NO: 265197 - DNA, 20 bp, Artificial
  CRISPR gRNA sequence
ctctatggtgctacgataaa

SEQ ID NO: 265198 - DNA, 20 bp, Artificial
  CRISPR gRNA sequence
tctatggtgctacgataaag

SEQ ID NO: 265199 - DNA, 20 bp, Artificial
  CRISPR gRNA sequence
tatggtgctacgataaagaa

SEQ ID NO: 265200 - DNA, 20 bp, Artificial
  CRISPR gRNA sequence
tggtgctacgataaagaaaa

SEQ ID NO: 265201 - DNA, 20 bp, Artificial
  CRISPR gRNA sequence
cgataaagaaaaggaaaaac

SEQ ID NO: 265202 - DNA, 20 bp, Artificial
  CRISPR gRNA sequence
tgacaaacaaatgtaattca

SEQ ID NO: 265203 - DNA, 20 bp, Artificial
  CRISPR gRNA sequence
acaaaagccctgaagttaag

SEQ ID NO: 265204 - DNA, 20 bp, Artificial
  CRISPR gRNA sequence
aagttaaggattttcctagt

SEQ ID NO: 265205 - DNA, 20 bp, Artificial
  CRISPR gRNA sequence
aggattttcctagtgaagtt

SEQ ID NO: 265206 - DNA, 20 bp, Artificial
  CRISPR gRNA sequence
tcctagtgaagttcagactg

SEQ ID NO: 265207 - DNA, 20 bp, Artificial
  CRISPR gRNA sequence
cctagtgaagttcagactga

SEQ ID NO: 265208 - DNA, 20 bp, Artificial
  CRISPR gRNA sequence
ctagtgaagttcagactgaa

SEQ ID NO: 265209 - DNA, 20 bp, Artificial
  CRISPR gRNA sequence
gtgaagttcagactgaaatg

SEQ ID NO: 265210 - DNA, 20 bp, Artificial
  CRISPR gRNA sequence
agactgaaatgtgatttcat

SEQ ID NO: 265211 - DNA, 20 bp, Artificial
  CRISPR gRNA sequence
aaatgtgatttcatgtgttg

SEQ ID NO: 265212 - DNA, 20 bp, Artificial
  CRISPR gRNA sequence
catgtgttgactcatgtcta

SEQ ID NO: 265213 - DNA, 20 bp, Artificial
  CRISPR gRNA sequence
atgtgttgactcatgtctat

SEQ ID NO: 265214 - DNA, 20 bp, Artificial
  CRISPR gRNA sequence
actcatgtctatgttcaatc

SEQ ID NO: 265215 - DNA, 20 bp, Artificial
  CRISPR gRNA sequence
atgtctatgttcaatccctt

SEQ ID NO: 265216 - DNA, 20 bp, Artificial
  CRISPR gRNA sequence
tgttcaatcccttttgtata

SEQ ID NO: 265217 - DNA, 20 bp, Artificial
  CRISPR gRNA sequence
aatcccttttgtatacttgg

SEQ ID NO: 265218 - DNA, 20 bp, Artificial
  CRISPR gRNA sequence
ttgtatacttgggtaagcta

SEQ ID NO: 265219 - DNA, 20 bp, Artificial
  CRISPR gRNA sequence
tgtatacttgggtaagctag

SEQ ID NO: 265220 - DNA, 20 bp, Artificial
  CRISPR gRNA sequence
gtatacttgggtaagctaga

SEQ ID NO: 265221 - DNA, 20 bp, Artificial
  CRISPR gRNA sequence
tatacttgggtaagctagaa

SEQ ID NO: 265222 - DNA, 20 bp, Artificial
  CRISPR gRNA sequence
gggtaagctagaatggaaga

SEQ ID NO: 265223 - DNA, 20 bp, Artificial
  CRISPR gRNA sequence
ggtaagctagaatggaagat

SEQ ID NO: 265224 - DNA, 20 bp, Artificial
  CRISPR gRNA sequence
gaatggaagatctcaatggt

SEQ ID NO: 265225 - DNA, 20 bp, Artificial
  CRISPR gRNA sequence
aatggtataattattacttg

SEQ ID NO: 265226 - DNA, 20 bp, Artificial
  CRISPR gRNA sequence
ttacttgtgcatcagaaata

SEQ ID NO: 265227 - DNA, 20 bp, Artificial
  CRISPR gRNA sequence
cttgtgcatcagaaataatt

SEQ ID NO: 265228 - DNA, 20 bp, Artificial
  CRISPR gRNA sequence
gtgcatcagaaataatttat

SEQ ID NO: 265229 - DNA, 20 bp, Artificial
  CRISPR gRNA sequence
tgcatcagaaataatttata

SEQ ID NO: 265230 - DNA, 20 bp, Artificial
  CRISPR gRNA sequence
ataagattatttgatgtgat

SEQ ID NO: 265231 - DNA, 20 bp, Artificial
  CRISPR gRNA sequence
taagattatttgatgtgatc

SEQ ID NO: 265232 - DNA, 20 bp, Artificial
  CRISPR gRNA sequence
tttgatgtgatcatactgtc

SEQ ID NO: 265233 - DNA, 20 bp, Artificial
  CRISPR gRNA sequence
gatgtgatcatactgtctgt

SEQ ID NO: 265234 - DNA, 20 bp, Artificial
  CRISPR gRNA sequence
atgtgatcatactgtctgta

SEQ ID NO: 265235 - DNA, 20 bp, Artificial
  CRISPR gRNA sequence
tctgtaagccttatctggga

SEQ ID NO: 265236 - DNA, 20 bp, Artificial
  CRISPR gRNA sequence
taagccttatctgggatcca

SEQ ID NO: 265237 - DNA, 20 bp, Artificial
  CRISPR gRNA sequence
atctgggatccatctatgac

SEQ ID NO: 265238 - DNA, 20 bp, Artificial
  CRISPR gRNA sequence
tctgggatccatctatgacc

SEQ ID NO: 265239 - DNA, 20 bp, Artificial
  CRISPR gRNA sequence
ggatccatctatgaccttca

SEQ ID NO: 265240 - DNA, 20 bp, Artificial
  CRISPR gRNA sequence
tgaccttcaggaaatcttca

SEQ ID NO: 265241 - DNA, 20 bp, Artificial
  CRISPR gRNA sequence
caggaaatcttcaaaattgt

SEQ ID NO: 265242 - DNA, 20 bp, Artificial
  CRISPR gRNA sequence
aggaaatcttcaaaattgta

SEQ ID NO: 265243 - DNA, 20 bp, Artificial
  CRISPR gRNA sequence
caaaattgtaagcaaaatgt

SEQ ID NO: 265244 - DNA, 20 bp, Artificial
  CRISPR gRNA sequence
aaaattgtaagcaaaatgtt

SEQ ID NO: 265245 - DNA, 20 bp, Artificial
  CRISPR gRNA sequence
taagcaaaatgttttgtata

SEQ ID NO: 265246 - DNA, 20 bp, Artificial
  CRISPR gRNA sequence
tgtatatgtgcattagaggc

SEQ ID NO: 265247 - DNA, 20 bp, Artificial
  CRISPR gRNA sequence
gtatatgtgcattagaggca

SEQ ID NO: 265248 - DNA, 20 bp, Artificial
  CRISPR gRNA sequence
tatatgtgcattagaggcaa

SEQ ID NO: 265249 - DNA, 20 bp, Artificial
  CRISPR gRNA sequence
gaggcaaaaaatttggaaat

SEQ ID NO: 265250 - DNA, 20 bp, Artificial
  CRISPR gRNA sequence
ggaaatgtatttttttctag

SEQ ID NO: 265251 - DNA, 20 bp, Artificial
  CRISPR gRNA sequence
gaaatgtatttttttctaga

SEQ ID NO: 265252 - DNA, 20 bp, Artificial
  CRISPR gRNA sequence
ttttctagatatgagcatga

SEQ ID NO: 265253 - DNA, 20 bp, Artificial
  CRISPR gRNA sequence
tttctagatatgagcatgaa

SEQ ID NO: 265254 - DNA, 20 bp, Artificial
  CRISPR gRNA sequence
ttctagatatgagcatgaaa

SEQ ID NO: 265255 - DNA, 20 bp, Artificial
  CRISPR gRNA sequence
tctagatatgagcatgaaat

SEQ ID NO: 265256 - DNA, 20 bp, Artificial
  CRISPR gRNA sequence
ctagatatgagcatgaaata

SEQ ID NO: 265257 - DNA, 20 bp, Artificial
  CRISPR gRNA sequence
tagatatgagcatgaaataa

SEQ ID NO: 265258 - DNA, 20 bp, Artificial
  CRISPR gRNA sequence
gatatgagcatgaaataaat

SEQ ID NO: 265259 - DNA, 20 bp, Artificial
  CRISPR gRNA sequence
agtcttgctgaatgaacaaa

SEQ ID NO: 265260 - DNA, 20 bp, Artificial
  CRISPR gRNA sequence
gctgaatgaacaaagttgtt

SEQ ID NO: 265261 - DNA, 20 bp, Artificial
  CRISPR gRNA sequence
ctgaatgaacaaagttgttt

SEQ ID NO: 265262 - DNA, 20 bp, Artificial
  CRISPR gRNA sequence
aatgaacaaagttgtttttc

SEQ ID NO: 265263 - DNA, 20 bp, Artificial
  CRISPR gRNA sequence
tttttctgtccatttatgat

SEQ ID NO: 265264 - DNA, 20 bp, Artificial
  CRISPR gRNA sequence
ttctgtccatttatgattta

SEQ ID NO: 265265 - DNA, 20 bp, Artificial
  CRISPR gRNA sequence
tctgtccatttatgatttaa

SEQ ID NO: 265266 - DNA, 20 bp, Artificial
  CRISPR gRNA sequence
ctgtccatttatgatttaaa

SEQ ID NO: 265267 - DNA, 20 bp, Artificial
  CRISPR gRNA sequence
tgtccatttatgatttaaaa

SEQ ID NO: 265268 - DNA, 20 bp, Artificial
  CRISPR gRNA sequence
tccatttatgatttaaaaca

SEQ ID NO: 265269 - DNA, 20 bp, Artificial
  CRISPR gRNA sequence
atgatttaaaacattactcc

SEQ ID NO: 265270 - DNA, 20 bp, Artificial
  CRISPR gRNA sequence
tgatttaaaacattactcct

SEQ ID NO: 265271 - DNA, 20 bp, Artificial
  CRISPR gRNA sequence
aaaacattactcctagatgt

SEQ ID NO: 265272 - DNA, 20 bp, Artificial
  CRISPR gRNA sequence
aaacattactcctagatgtc

SEQ ID NO: 265273 - DNA, 20 bp, Artificial
  CRISPR gRNA sequence
ctcctagatgtctaaataaa

SEQ ID NO: 265274 - DNA, 20 bp, Artificial
  CRISPR gRNA sequence
ctagatgtctaaataaataa

SEQ ID NO: 265275 - DNA, 20 bp, Artificial
  CRISPR gRNA sequence
gatgtctaaataaataaatt

SEQ ID NO: 265276 - DNA, 20 bp, Artificial
  CRISPR gRNA sequence
aataaataaattacatctta

SEQ ID NO: 265277 - DNA, 20 bp, Artificial
  CRISPR gRNA sequence
catcttagctcttccattat

SEQ ID NO: 265278 - DNA, 20 bp, Artificial
  CRISPR gRNA sequence
agctcttccattatttgtgt

SEQ ID NO: 265279 - DNA, 20 bp, Artificial
  CRISPR gRNA sequence
gctcttccattatttgtgtg

SEQ ID NO: 265280 - DNA, 20 bp, Artificial
  CRISPR gRNA sequence
ttccattatttgtgtgacct

SEQ ID NO: 265281 - DNA, 20 bp, Artificial
  CRISPR gRNA sequence
ccattatttgtgtgaccttg

SEQ ID NO: 265282 - DNA, 20 bp, Artificial
  CRISPR gRNA sequence
cattatttgtgtgaccttgt

SEQ ID NO: 265283 - DNA, 20 bp, Artificial
  CRISPR gRNA sequence
tttgtgtgaccttgtttgaa

SEQ ID NO: 265284 - DNA, 20 bp, Artificial
  CRISPR gRNA sequence
gtgtgaccttgtttgaaaag

SEQ ID NO: 265285 - DNA, 20 bp, Artificial
  CRISPR gRNA sequence
tgtgaccttgtttgaaaagt

SEQ ID NO: 265286 - DNA, 20 bp, Artificial
  CRISPR gRNA sequence
gtttgaaaagtcatttactt

SEQ ID NO: 265287 - DNA, 20 bp, Artificial
  CRISPR gRNA sequence
tttgaaaagtcatttacttc

SEQ ID NO: 265288 - DNA, 20 bp, Artificial
  CRISPR gRNA sequence
gaaaagtcatttacttcttc

SEQ ID NO: 265289 - DNA, 20 bp, Artificial
  CRISPR gRNA sequence
aaaagtcatttacttcttct

SEQ ID NO: 265290 - DNA, 20 bp, Artificial
  CRISPR gRNA sequence
acttcttctctttttttccc

SEQ ID NO: 265291 - DNA, 20 bp, Artificial
  CRISPR gRNA sequence
cttcttctctttttttcccc

SEQ ID NO: 265292 - DNA, 20 bp, Artificial
  CRISPR gRNA sequence
cttctctttttttcccccca

SEQ ID NO: 265293 - DNA, 20 bp, Artificial
  CRISPR gRNA sequence
ttctctttttttccccccaa

SEQ ID NO: 265294 - DNA, 20 bp, Artificial
  CRISPR gRNA sequence
ctctttttttccccccaata

SEQ ID NO: 265295 - DNA, 20 bp, Artificial
  CRISPR gRNA sequence
tctttttttccccccaatag

SEQ ID NO: 265296 - DNA, 20 bp, Artificial
  CRISPR gRNA sequence
tttttttccccccaatagcc

SEQ ID NO: 265297 - DNA, 20 bp, Artificial
  CRISPR gRNA sequence
tttttccccccaatagcctc

SEQ ID NO: 265298 - DNA, 20 bp, Artificial
  CRISPR gRNA sequence
ttttccccccaatagcctct

SEQ ID NO: 265299 - DNA, 20 bp, Artificial
  CRISPR gRNA sequence
tttccccccaatagcctctt

SEQ ID NO: 265300 - DNA, 20 bp, Artificial
  CRISPR gRNA sequence
ttccccccaatagcctcttc

SEQ ID NO: 265301 - DNA, 20 bp, Artificial
  CRISPR gRNA sequence
tccccccaatagcctcttct

SEQ ID NO: 265302 - DNA, 20 bp, Artificial
  CRISPR gRNA sequence
ccccccaatagcctcttctt

SEQ ID NO: 265303 - DNA, 20 bp, Artificial
  CRISPR gRNA sequence
cccccaatagcctcttcttt

SEQ ID NO: 265304 - DNA, 20 bp, Artificial
  CRISPR gRNA sequence
ttctttaaaataaggaattg

SEQ ID NO: 265305 - DNA, 20 bp, Artificial
  CRISPR gRNA sequence
ctttaaaataaggaattggc

SEQ ID NO: 265306 - DNA, 20 bp, Artificial
  CRISPR gRNA sequence
tttaaaataaggaattggca

SEQ ID NO: 265307 - DNA, 20 bp, Artificial
  CRISPR gRNA sequence
taaaataaggaattggcata

SEQ ID NO: 265308 - DNA, 20 bp, Artificial
  CRISPR gRNA sequence
aaaataaggaattggcatag

SEQ ID NO: 265309 - DNA, 20 bp, Artificial
  CRISPR gRNA sequence
aaataaggaattggcataga

SEQ ID NO: 265310 - DNA, 20 bp, Artificial
  CRISPR gRNA sequence
gcatagatcatctccaagtt

SEQ ID NO: 265311 - DNA, 20 bp, Artificial
  CRISPR gRNA sequence
caagttcccttccagttgag

SEQ ID NO: 265312 - DNA, 20 bp, Artificial
  CRISPR gRNA sequence
ccttccagttgagtgtggtt

SEQ ID NO: 265313 - DNA, 20 bp, Artificial
  CRISPR gRNA sequence
ccagttgagtgtggtttttt

SEQ ID NO: 265314 - DNA, 20 bp, Artificial
  CRISPR gRNA sequence
cagttgagtgtggttttttg

SEQ ID NO: 265315 - DNA, 20 bp, Artificial
  CRISPR gRNA sequence
agtgtggttttttgcaggat

SEQ ID NO: 265316 - DNA, 20 bp, Artificial
  CRISPR gRNA sequence
tttgcaggataagactctaa

SEQ ID NO: 265317 - DNA, 20 bp, Artificial
  CRISPR gRNA sequence
ttgcaggataagactctaat

SEQ ID NO: 265318 - DNA, 20 bp, Artificial
  CRISPR gRNA sequence
tgcaggataagactctaata

SEQ ID NO: 265319 - DNA, 20 bp, Artificial
  CRISPR gRNA sequence
gcaggataagactctaataa

SEQ ID NO: 265320 - DNA, 20 bp, Artificial
  CRISPR gRNA sequence
caggataagactctaataaa

SEQ ID NO: 265321 - DNA, 20 bp, Artificial
  CRISPR gRNA sequence
taataaaatagtggggaaaa

SEQ ID NO: 265322 - DNA, 20 bp, Artificial
  CRISPR gRNA sequence
ataaaatagtggggaaaatg

SEQ ID NO: 265323 - DNA, 20 bp, Artificial
  CRISPR gRNA sequence
tgttctggtcctcttcccat

SEQ ID NO: 265324 - DNA, 20 bp, Artificial
  CRISPR gRNA sequence
gttctggtcctcttcccatt

SEQ ID NO: 265325 - DNA, 20 bp, Artificial
  CRISPR gRNA sequence
ttctggtcctcttcccattc

SEQ ID NO: 265326 - DNA, 20 bp, Artificial
  CRISPR gRNA sequence
tggtcctcttcccattccat

SEQ ID NO: 265327 - DNA, 20 bp, Artificial
  CRISPR gRNA sequence
gtcctcttcccattccattc

SEQ ID NO: 265328 - DNA, 20 bp, Artificial
  CRISPR gRNA sequence
ttcccattccattcactccc

SEQ ID NO: 265329 - DNA, 20 bp, Artificial
  CRISPR gRNA sequence
cccattccattcactcccct

SEQ ID NO: 265330 - DNA, 20 bp, Artificial
  CRISPR gRNA sequence
ccattccattcactccccta

SEQ ID NO: 265331 - DNA, 20 bp, Artificial
  CRISPR gRNA sequence
cattcactcccctacttaat

SEQ ID NO: 265332 - DNA, 20 bp, Artificial
  CRISPR gRNA sequence
actcccctacttaatggtaa

SEQ ID NO: 265333 - DNA, 20 bp, Artificial
  CRISPR gRNA sequence
ccctacttaatggtaatctc

SEQ ID NO: 265334 - DNA, 20 bp, Artificial
  CRISPR gRNA sequence
cttaatggtaatctcctccc

SEQ ID NO: 265335 - DNA, 20 bp, Artificial
  CRISPR gRNA sequence
aatggtaatctcctccctaa

SEQ ID NO: 265336 - DNA, 20 bp, Artificial
  CRISPR gRNA sequence
atggtaatctcctccctaac

SEQ ID NO: 265337 - DNA, 20 bp, Artificial
  CRISPR gRNA sequence
ctccctaaccctcactccag

SEQ ID NO: 265338 - DNA, 20 bp, Artificial
  CRISPR gRNA sequence
cctaaccctcactccagaca

SEQ ID NO: 265339 - DNA, 20 bp, Artificial
  CRISPR gRNA sequence
accctcactccagacatctg

SEQ ID NO: 265340 - DNA, 20 bp, Artificial
  CRISPR gRNA sequence
actccagacatctggtacca

SEQ ID NO: 265341 - DNA, 20 bp, Artificial
  CRISPR gRNA sequence
cagacatctggtaccatcct

SEQ ID NO: 265342 - DNA, 20 bp, Artificial
  CRISPR gRNA sequence
gtaccatcctccctatcaag

SEQ ID NO: 265343 - DNA, 20 bp, Artificial
  CRISPR gRNA sequence
cctatcaagtccaactttga

SEQ ID NO: 265344 - DNA, 20 bp, Artificial
  CRISPR gRNA sequence
tcaagtccaactttgagagg

SEQ ID NO: 265345 - DNA, 20 bp, Artificial
  CRISPR gRNA sequence
tgagaggatctagaaccaat

SEQ ID NO: 265346 - DNA, 20 bp, Artificial
  CRISPR gRNA sequence
gagaggatctagaaccaatc

SEQ ID NO: 265347 - DNA, 20 bp, Artificial
  CRISPR gRNA sequence
agaggatctagaaccaatca

SEQ ID NO: 265348 - DNA, 20 bp, Artificial
  CRISPR gRNA sequence
gaaccaatcactgcaattgt

SEQ ID NO: 265349 - DNA, 20 bp, Artificial
  CRISPR gRNA sequence
caattgtgttgaaattttga

SEQ ID NO: 265350 - DNA, 20 bp, Artificial
  CRISPR gRNA sequence
tgttgaaattttgatgcaac

SEQ ID NO: 265351 - DNA, 20 bp, Artificial
  CRISPR gRNA sequence
aaattttgatgcaacatggc

SEQ ID NO: 265352 - DNA, 20 bp, Artificial
  CRISPR gRNA sequence
tgatgcaacatggcagaagg

SEQ ID NO: 265353 - DNA, 20 bp, Artificial
  CRISPR gRNA sequence
gatgcaacatggcagaagga

SEQ ID NO: 265354 - DNA, 20 bp, Artificial
  CRISPR gRNA sequence
atgcaacatggcagaaggaa

SEQ ID NO: 265355 - DNA, 20 bp, Artificial
  CRISPR gRNA sequence
gaagtcataagttatgagct

SEQ ID NO: 265356 - DNA, 20 bp, Artificial
  CRISPR gRNA sequence
tgagcttaaatttcaaggat

SEQ ID NO: 265357 - DNA, 20 bp, Artificial
  CRISPR gRNA sequence
aaatttcaaggatcacttat

SEQ ID NO: 265358 - DNA, 20 bp, Artificial
  CRISPR gRNA sequence
aatttcaaggatcacttatg

SEQ ID NO: 265359 - DNA, 20 bp, Artificial
  CRISPR gRNA sequence
caaggatcacttatgtttcc

SEQ ID NO: 265360 - DNA, 20 bp, Artificial
  CRISPR gRNA sequence
aaggatcacttatgtttcct

SEQ ID NO: 265361 - DNA, 20 bp, Artificial
  CRISPR gRNA sequence
atgtttcctgtaaccttgga

SEQ ID NO: 265362 - DNA, 20 bp, Artificial
  CRISPR gRNA sequence
tgtttcctgtaaccttggac

SEQ ID NO: 265363 - DNA, 20 bp, Artificial
  CRISPR gRNA sequence
cctgtaaccttggacaactc

SEQ ID NO: 265364 - DNA, 20 bp, Artificial
  CRISPR gRNA sequence
ctgtaaccttggacaactca

SEQ ID NO: 265365 - DNA, 20 bp, Artificial
  CRISPR gRNA sequence
taaccttggacaactcatct

SEQ ID NO: 265366 - DNA, 20 bp, Artificial
  CRISPR gRNA sequence
ggacaactcatctacctctt

SEQ ID NO: 265367 - DNA, 20 bp, Artificial
  CRISPR gRNA sequence
gacaactcatctacctcttt

SEQ ID NO: 265368 - DNA, 20 bp, Artificial
  CRISPR gRNA sequence
atctacctctttgacctcag

SEQ ID NO: 265369 - DNA, 20 bp, Artificial
  CRISPR gRNA sequence
cctctttgacctcagtttcc

SEQ ID NO: 265370 - DNA, 20 bp, Artificial
  CRISPR gRNA sequence
tttgacctcagtttccccat

SEQ ID NO: 265371 - DNA, 20 bp, Artificial
  CRISPR gRNA sequence
tgacctcagtttccccatgt

SEQ ID NO: 265372 - DNA, 20 bp, Artificial
  CRISPR gRNA sequence
gacctcagtttccccatgtg

SEQ ID NO: 265373 - DNA, 20 bp, Artificial
  CRISPR gRNA sequence
acctcagtttccccatgtgt

SEQ ID NO: 265374 - DNA, 20 bp, Artificial
  CRISPR gRNA sequence
agtttccccatgtgtaagat

SEQ ID NO: 265375 - DNA, 20 bp, Artificial
  CRISPR gRNA sequence
ccccatgtgtaagatgggca

SEQ ID NO: 265376 - DNA, 20 bp, Artificial
  CRISPR gRNA sequence
cccatgtgtaagatgggcat

SEQ ID NO: 265377 - DNA, 20 bp, Artificial
  CRISPR gRNA sequence
tcctgcctatttacttcaca

SEQ ID NO: 265378 - DNA, 20 bp, Artificial
  CRISPR gRNA sequence
cctatttacttcacagttga

SEQ ID NO: 265379 - DNA, 20 bp, Artificial
  CRISPR gRNA sequence
tttacttcacagttgaatat

SEQ ID NO: 265380 - DNA, 20 bp, Artificial
  CRISPR gRNA sequence
acttcacagttgaatataga

SEQ ID NO: 265381 - DNA, 20 bp, Artificial
  CRISPR gRNA sequence
cttcacagttgaatatagag

SEQ ID NO: 265382 - DNA, 20 bp, Artificial
  CRISPR gRNA sequence
cacagttgaatatagagttc

SEQ ID NO: 265383 - DNA, 20 bp, Artificial
  CRISPR gRNA sequence
acagttgaatatagagttca

SEQ ID NO: 265384 - DNA, 20 bp, Artificial
  CRISPR gRNA sequence
aatatagagttcagatgaga

SEQ ID NO: 265385 - DNA, 20 bp, Artificial
  CRISPR gRNA sequence
agatgagataagagacagca

SEQ ID NO: 265386 - DNA, 20 bp, Artificial
  CRISPR gRNA sequence
tatagccctgtgaatgtaag

SEQ ID NO: 265387 - DNA, 20 bp, Artificial
  CRISPR gRNA sequence
atagccctgtgaatgtaagc

SEQ ID NO: 265388 - DNA, 20 bp, Artificial
  CRISPR gRNA sequence
tagccctgtgaatgtaagcc

SEQ ID NO: 265389 - DNA, 20 bp, Artificial
  CRISPR gRNA sequence
tgaatgtaagccatagatac

SEQ ID NO: 265390 - DNA, 20 bp, Artificial
  CRISPR gRNA sequence
aattaagccaatgtgtttcc

SEQ ID NO: 265391 - DNA, 20 bp, Artificial
  CRISPR gRNA sequence
agccaatgtgtttcccatat

SEQ ID NO: 265392 - DNA, 20 bp, Artificial
  CRISPR gRNA sequence
cccatattgcattttgggct

SEQ ID NO: 265393 - DNA, 20 bp, Artificial
  CRISPR gRNA sequence
ccatattgcattttgggctt

SEQ ID NO: 265394 - DNA, 20 bp, Artificial
  CRISPR gRNA sequence
cattttgggcttcattttct

SEQ ID NO: 265395 - DNA, 20 bp, Artificial
  CRISPR gRNA sequence
tgggcttcattttctttgga

SEQ ID NO: 265396 - DNA, 20 bp, Artificial
  CRISPR gRNA sequence
gggcttcattttctttggaa

SEQ ID NO: 265397 - DNA, 20 bp, Artificial
  CRISPR gRNA sequence
ggcttcattttctttggaaa

SEQ ID NO: 265398 - DNA, 20 bp, Artificial
  CRISPR gRNA sequence
cattttctttggaaatctaa

SEQ ID NO: 265399 - DNA, 20 bp, Artificial
  CRISPR gRNA sequence
attttctttggaaatctaag

SEQ ID NO: 265400 - DNA, 20 bp, Artificial
  CRISPR gRNA sequence
tctttggaaatctaagcatt

SEQ ID NO: 265401 - DNA, 20 bp, Artificial
  CRISPR gRNA sequence
ctttggaaatctaagcatta

SEQ ID NO: 265402 - DNA, 20 bp, Artificial
  CRISPR gRNA sequence
tttggaaatctaagcattaa

SEQ ID NO: 265403 - DNA, 20 bp, Artificial
  CRISPR gRNA sequence
tggaaatctaagcattaact

SEQ ID NO: 265404 - DNA, 20 bp, Artificial
  CRISPR gRNA sequence
ggaaatctaagcattaactg

SEQ ID NO: 265405 - DNA, 20 bp, Artificial
  CRISPR gRNA sequence
gaaatctaagcattaactga

SEQ ID NO: 265406 - DNA, 20 bp, Artificial
  CRISPR gRNA sequence
agcattaactgagctggtgg

SEQ ID NO: 265407 - DNA, 20 bp, Artificial
  CRISPR gRNA sequence
actgagctggtgggagggtc

SEQ ID NO: 265408 - DNA, 20 bp, Artificial
  CRISPR gRNA sequence
agctggtgggagggtccttt

SEQ ID NO: 265409 - DNA, 20 bp, Artificial
  CRISPR gRNA sequence
gtgggagggtccttttaagg

SEQ ID NO: 265410 - DNA, 20 bp, Artificial
  CRISPR gRNA sequence
ttaaggtcagggttctttga

SEQ ID NO: 265411 - DNA, 20 bp, Artificial
  CRISPR gRNA sequence
taaggtcagggttctttgat

SEQ ID NO: 265412 - DNA, 20 bp, Artificial
  CRISPR gRNA sequence
aaggtcagggttctttgatg

SEQ ID NO: 265413 - DNA, 20 bp, Artificial
  CRISPR gRNA sequence
aggtcagggttctttgatgc

SEQ ID NO: 265414 - DNA, 20 bp, Artificial
  CRISPR gRNA sequence
tttgatgctgggagccacac

SEQ ID NO: 265415 - DNA, 20 bp, Artificial
  CRISPR gRNA sequence
tgatgctgggagccacacct

SEQ ID NO: 265416 - DNA, 20 bp, Artificial
  CRISPR gRNA sequence
gatgctgggagccacacctt

SEQ ID NO: 265417 - DNA, 20 bp, Artificial
  CRISPR gRNA sequence
atgctgggagccacacctta

SEQ ID NO: 265418 - DNA, 20 bp, Artificial
  CRISPR gRNA sequence
ggagccacaccttagaggtg

SEQ ID NO: 265419 - DNA, 20 bp, Artificial
  CRISPR gRNA sequence
agaggtggttaccaccccac

SEQ ID NO: 265420 - DNA, 20 bp, Artificial
  CRISPR gRNA sequence
gaggtggttaccaccccacc

SEQ ID NO: 265421 - DNA, 20 bp, Artificial
  CRISPR gRNA sequence
ccaccccacctatgcagagg

SEQ ID NO: 265422 - DNA, 20 bp, Artificial
  CRISPR gRNA sequence
tgcagagggttgacctcatt

SEQ ID NO: 265423 - DNA, 20 bp, Artificial
  CRISPR gRNA sequence
acctcattactaaatatggt

SEQ ID NO: 265424 - DNA, 20 bp, Artificial
  CRISPR gRNA sequence
attactaaatatggtaattg

SEQ ID NO: 265425 - DNA, 20 bp, Artificial
  CRISPR gRNA sequence
ctaaatatggtaattgaccc

SEQ ID NO: 265426 - DNA, 20 bp, Artificial
  CRISPR gRNA sequence
aatatggtaattgacccgtt

SEQ ID NO: 265427 - DNA, 20 bp, Artificial
  CRISPR gRNA sequence
acccgtttataataggtgta

SEQ ID NO: 265428 - DNA, 20 bp, Artificial
  CRISPR gRNA sequence
ataataggtgtaaacggcaa

SEQ ID NO: 265429 - DNA, 20 bp, Artificial
  CRISPR gRNA sequence
taataggtgtaaacggcaag

SEQ ID NO: 265430 - DNA, 20 bp, Artificial
  CRISPR gRNA sequence
tttttttttgtaaccaagct

SEQ ID NO: 265431 - DNA, 20 bp, Artificial
  CRISPR gRNA sequence
ttttttgtaaccaagcttcc

SEQ ID NO: 265432 - DNA, 20 bp, Artificial
  CRISPR gRNA sequence
tttttgtaaccaagcttccc

SEQ ID NO: 265433 - DNA, 20 bp, Artificial
  CRISPR gRNA sequence
ttttgtaaccaagcttcccc

SEQ ID NO: 265434 - DNA, 20 bp, Artificial
  CRISPR gRNA sequence
tttgtaaccaagcttcccca

SEQ ID NO: 265435 - DNA, 20 bp, Artificial
  CRISPR gRNA sequence
ttgtaaccaagcttccccac

SEQ ID NO: 265436 - DNA, 20 bp, Artificial
  CRISPR gRNA sequence
tgtaaccaagcttccccacc

SEQ ID NO: 265437 - DNA, 20 bp, Artificial
  CRISPR gRNA sequence
gtaaccaagcttccccacca

SEQ ID NO: 265438 - DNA, 20 bp, Artificial
  CRISPR gRNA sequence
taaccaagcttccccaccac

SEQ ID NO: 265439 - DNA, 20 bp, Artificial
  CRISPR gRNA sequence
ccccaccacccactgccatt

SEQ ID NO: 265440 - DNA, 20 bp, Artificial
  CRISPR gRNA sequence
cccaccacccactgccattc

SEQ ID NO: 265441 - DNA, 20 bp, Artificial
  CRISPR gRNA sequence
ccattctcatggaagttcaa

SEQ ID NO: 265442 - DNA, 20 bp, Artificial
  CRISPR gRNA sequence
tcatggaagttcaagcaact

SEQ ID NO: 265443 - DNA, 20 bp, Artificial
  CRISPR gRNA sequence
atggaagttcaagcaacttt

SEQ ID NO: 265444 - DNA, 20 bp, Artificial
  CRISPR gRNA sequence
aagcaactttcaattttcct

SEQ ID NO: 265445 - DNA, 20 bp, Artificial
  CRISPR gRNA sequence
tcaattttcctgaagtcggc

SEQ ID NO: 265446 - DNA, 20 bp, Artificial
  CRISPR gRNA sequence
caattttcctgaagtcggct

SEQ ID NO: 265447 - DNA, 20 bp, Artificial
  CRISPR gRNA sequence
aattttcctgaagtcggctg

SEQ ID NO: 265448 - DNA, 20 bp, Artificial
  CRISPR gRNA sequence
tcctgaagtcggctgtttca

SEQ ID NO: 265449 - DNA, 20 bp, Artificial
  CRISPR gRNA sequence
cctgaagtcggctgtttcac

SEQ ID NO: 265450 - DNA, 20 bp, Artificial
  CRISPR gRNA sequence
ctgaagtcggctgtttcaca

SEQ ID NO: 265451 - DNA, 20 bp, Artificial
  CRISPR gRNA sequence
aagtcggctgtttcacaaga

SEQ ID NO: 265452 - DNA, 20 bp, Artificial
  CRISPR gRNA sequence
tttcacaagattcacagatt

SEQ ID NO: 265453 - DNA, 20 bp, Artificial
  CRISPR gRNA sequence
cacaagattcacagattatc

SEQ ID NO: 265454 - DNA, 20 bp, Artificial
  CRISPR gRNA sequence
acaagattcacagattatct

SEQ ID NO: 265455 - DNA, 20 bp, Artificial
  CRISPR gRNA sequence
acagattatctgtgggaaat

SEQ ID NO: 265456 - DNA, 20 bp, Artificial
  CRISPR gRNA sequence
tctgtgggaaatcttttagc

SEQ ID NO: 265457 - DNA, 20 bp, Artificial
  CRISPR gRNA sequence
tgggaaatcttttagctctc

SEQ ID NO: 265458 - DNA, 20 bp, Artificial
  CRISPR gRNA sequence
ttagctctcagtaccttgct

SEQ ID NO: 265459 - DNA, 20 bp, Artificial
  CRISPR gRNA sequence
tagctctcagtaccttgctc

SEQ ID NO: 265460 - DNA, 20 bp, Artificial
  CRISPR gRNA sequence
agctctcagtaccttgctca

SEQ ID NO: 265461 - DNA, 20 bp, Artificial
  CRISPR gRNA sequence
gctctcagtaccttgctcac

SEQ ID NO: 265462 - DNA, 20 bp, Artificial
  CRISPR gRNA sequence
tcagtaccttgctcacaagc

SEQ ID NO: 265463 - DNA, 20 bp, Artificial
  CRISPR gRNA sequence
agtaccttgctcacaagcag

SEQ ID NO: 265464 - DNA, 20 bp, Artificial
  CRISPR gRNA sequence
gctcacaagcagcagataag

SEQ ID NO: 265465 - DNA, 20 bp, Artificial
  CRISPR gRNA sequence
ctcacaagcagcagataagt

SEQ ID NO: 265466 - DNA, 20 bp, Artificial
  CRISPR gRNA sequence
acaagcagcagataagtacc

SEQ ID NO: 265467 - DNA, 20 bp, Artificial
  CRISPR gRNA sequence
ctcacctccaatctcactct

SEQ ID NO: 265468 - DNA, 20 bp, Artificial
  CRISPR gRNA sequence
tcacctccaatctcactctt

SEQ ID NO: 265469 - DNA, 20 bp, Artificial
  CRISPR gRNA sequence
acctccaatctcactcttca

SEQ ID NO: 265470 - DNA, 20 bp, Artificial
  CRISPR gRNA sequence
caatctcactcttcatgttg

SEQ ID NO: 265471 - DNA, 20 bp, Artificial
  CRISPR gRNA sequence
actcttcatgttgcctgttg

SEQ ID NO: 265472 - DNA, 20 bp, Artificial
  CRISPR gRNA sequence
ttcatgttgcctgttgttaa

SEQ ID NO: 265473 - DNA, 20 bp, Artificial
  CRISPR gRNA sequence
catgttgcctgttgttaagc

SEQ ID NO: 265474 - DNA, 20 bp, Artificial
  CRISPR gRNA sequence
atgttgcctgttgttaagca

SEQ ID NO: 265475 - DNA, 20 bp, Artificial
  CRISPR gRNA sequence
cctgttgttaagcaggagct

SEQ ID NO: 265476 - DNA, 20 bp, Artificial
  CRISPR gRNA sequence
ttgttaagcaggagctgtga

SEQ ID NO: 265477 - DNA, 20 bp, Artificial
  CRISPR gRNA sequence
ttaagcaggagctgtgaggg

SEQ ID NO: 265478 - DNA, 20 bp, Artificial
  CRISPR gRNA sequence
agcaggagctgtgagggaaa

SEQ ID NO: 265479 - DNA, 20 bp, Artificial
  CRISPR gRNA sequence
tgagggaaagaggtttgagg

SEQ ID NO: 265480 - DNA, 20 bp, Artificial
  CRISPR gRNA sequence
gaggttagtgcttcctgtct

SEQ ID NO: 265481 - DNA, 20 bp, Artificial
  CRISPR gRNA sequence
aggttagtgcttcctgtctc

SEQ ID NO: 265482 - DNA, 20 bp, Artificial
  CRISPR gRNA sequence
gtgcttcctgtctccacacc

SEQ ID NO: 265483 - DNA, 20 bp, Artificial
  CRISPR gRNA sequence
cctgtctccacacctttagc

SEQ ID NO: 265484 - DNA, 20 bp, Artificial
  CRISPR gRNA sequence
ctgtctccacacctttagct

SEQ ID NO: 265485 - DNA, 20 bp, Artificial
  CRISPR gRNA sequence
tctccacacctttagctggt

SEQ ID NO: 265486 - DNA, 20 bp, Artificial
  CRISPR gRNA sequence
cacacctttagctggtttag

SEQ ID NO: 265487 - DNA, 20 bp, Artificial
  CRISPR gRNA sequence
tagctggtttagctgctagg

SEQ ID NO: 265488 - DNA, 20 bp, Artificial
  CRISPR gRNA sequence
agctggtttagctgctagga

SEQ ID NO: 265489 - DNA, 20 bp, Artificial
  CRISPR gRNA sequence
gctggtttagctgctaggaa

SEQ ID NO: 265490 - DNA, 20 bp, Artificial
  CRISPR gRNA sequence
gtttagctgctaggaaaggc

SEQ ID NO: 265491 - DNA, 20 bp, Artificial
  CRISPR gRNA sequence
agctgctaggaaaggctttg

SEQ ID NO: 265492 - DNA, 20 bp, Artificial
  CRISPR gRNA sequence
gctgctaggaaaggctttga

SEQ ID NO: 265493 - DNA, 20 bp, Artificial
  CRISPR gRNA sequence
ctaggaaaggctttgaaaag

SEQ ID NO: 265494 - DNA, 20 bp, Artificial
  CRISPR gRNA sequence
ggaaaggctttgaaaagcaa

SEQ ID NO: 265495 - DNA, 20 bp, Artificial
  CRISPR gRNA sequence
tgaaaagcaaagcactaaat

SEQ ID NO: 265496 - DNA, 20 bp, Artificial
  CRISPR gRNA sequence
gaaaagcaaagcactaaatt

SEQ ID NO: 265497 - DNA, 20 bp, Artificial
  CRISPR gRNA sequence
aaaagcaaagcactaaattc

SEQ ID NO: 265498 - DNA, 20 bp, Artificial
  CRISPR gRNA sequence
aattcaccttcaaaacaact

SEQ ID NO: 265499 - DNA, 20 bp, Artificial
  CRISPR gRNA sequence
accttcaaaacaacttgtca

SEQ ID NO: 265500 - DNA, 20 bp, Artificial
  CRISPR gRNA sequence
caaaacaacttgtcaattca

SEQ ID NO: 265501 - DNA, 20 bp, Artificial
  CRISPR gRNA sequence
aaaacaacttgtcaattcag

SEQ ID NO: 265502 - DNA, 20 bp, Artificial
  CRISPR gRNA sequence
gtcaattcagttagagaaat

SEQ ID NO: 265503 - DNA, 20 bp, Artificial
  CRISPR gRNA sequence
tcaattcagttagagaaatg

SEQ ID NO: 265504 - DNA, 20 bp, Artificial
  CRISPR gRNA sequence
agttagagaaatgtcagtca

SEQ ID NO: 265505 - DNA, 20 bp, Artificial
  CRISPR gRNA sequence
gagaaatgtcagtcagacca

SEQ ID NO: 265506 - DNA, 20 bp, Artificial
  CRISPR gRNA sequence
ttgataacgtaagcaaagaa

SEQ ID NO: 265507 - DNA, 20 bp, Artificial
  CRISPR gRNA sequence
tgataacgtaagcaaagaaa

SEQ ID NO: 265508 - DNA, 20 bp, Artificial
  CRISPR gRNA sequence
gataacgtaagcaaagaaaa

SEQ ID NO: 265509 - DNA, 20 bp, Artificial
  CRISPR gRNA sequence
ataacgtaagcaaagaaaat

SEQ ID NO: 265510 - DNA, 20 bp, Artificial
  CRISPR gRNA sequence
acaatgtttcttttaaccta

SEQ ID NO: 265511 - DNA, 20 bp, Artificial
  CRISPR gRNA sequence
cttttaacctagtaggtttg

SEQ ID NO: 265512 - DNA, 20 bp, Artificial
  CRISPR gRNA sequence
ttttaacctagtaggtttga

SEQ ID NO: 265513 - DNA, 20 bp, Artificial
  CRISPR gRNA sequence
ttaacctagtaggtttgacc

SEQ ID NO: 265514 - DNA, 20 bp, Artificial
  CRISPR gRNA sequence
taacctagtaggtttgacct

SEQ ID NO: 265515 - DNA, 20 bp, Artificial
  CRISPR gRNA sequence
aacctagtaggtttgaccta

SEQ ID NO: 265516 - DNA, 20 bp, Artificial
  CRISPR gRNA sequence
acctagtaggtttgacctag

SEQ ID NO: 265517 - DNA, 20 bp, Artificial
  CRISPR gRNA sequence
gtaggtttgacctaggtaga

SEQ ID NO: 265518 - DNA, 20 bp, Artificial
  CRISPR gRNA sequence
gacctaggtagaccttacct

SEQ ID NO: 265519 - DNA, 20 bp, Artificial
  CRISPR gRNA sequence
acctaggtagaccttacctg

SEQ ID NO: 265520 - DNA, 20 bp, Artificial
  CRISPR gRNA sequence
ggtagaccttacctgaacac

SEQ ID NO: 265521 - DNA, 20 bp, Artificial
  CRISPR gRNA sequence
acctgaacactcacaagaag

SEQ ID NO: 265522 - DNA, 20 bp, Artificial
  CRISPR gRNA sequence
cctgaacactcacaagaagt

SEQ ID NO: 265523 - DNA, 20 bp, Artificial
  CRISPR gRNA sequence
aacactcacaagaagtaaaa

SEQ ID NO: 265524 - DNA, 20 bp, Artificial
  CRISPR gRNA sequence
acaagaagtaaaatcaaata

SEQ ID NO: 265525 - DNA, 20 bp, Artificial
  CRISPR gRNA sequence
acagggaaagggctgggtct

SEQ ID NO: 265526 - DNA, 20 bp, Artificial
  CRISPR gRNA sequence
ggtctcctgatacccaagta

SEQ ID NO: 265527 - DNA, 20 bp, Artificial
  CRISPR gRNA sequence
ctgatacccaagtagcctaa

SEQ ID NO: 265528 - DNA, 20 bp, Artificial
  CRISPR gRNA sequence
atacccaagtagcctaagaa

SEQ ID NO: 265529 - DNA, 20 bp, Artificial
  CRISPR gRNA sequence
agaagaatgccttccactcc

SEQ ID NO: 265530 - DNA, 20 bp, Artificial
  CRISPR gRNA sequence
ccactcctagcatgaactgg

SEQ ID NO: 265531 - DNA, 20 bp, Artificial
  CRISPR gRNA sequence
cactcctagcatgaactgga

SEQ ID NO: 265532 - DNA, 20 bp, Artificial
  CRISPR gRNA sequence
ctagcatgaactggaaagca

SEQ ID NO: 265533 - DNA, 20 bp, Artificial
  CRISPR gRNA sequence
gcatgaactggaaagcaaaa

SEQ ID NO: 265534 - DNA, 20 bp, Artificial
  CRISPR gRNA sequence
gaaagcaaaaagaaatcaaa

SEQ ID NO: 265535 - DNA, 20 bp, Artificial
  CRISPR gRNA sequence
ggacgagggagctacatatt

SEQ ID NO: 265536 - DNA, 20 bp, Artificial
  CRISPR gRNA sequence
catatttgggtttcttctga

SEQ ID NO: 265537 - DNA, 20 bp, Artificial
  CRISPR gRNA sequence
gggtttcttctgagtctaga

SEQ ID NO: 265538 - DNA, 20 bp, Artificial
  CRISPR gRNA sequence
ggtttcttctgagtctagat

SEQ ID NO: 265539 - DNA, 20 bp, Artificial
  CRISPR gRNA sequence
cttctgagtctagatatgtc

SEQ ID NO: 265540 - DNA, 20 bp, Artificial
  CRISPR gRNA sequence
ttctgagtctagatatgtcc

SEQ ID NO: 265541 - DNA, 20 bp, Artificial
  CRISPR gRNA sequence
ctgagtctagatatgtcctt

SEQ ID NO: 265542 - DNA, 20 bp, Artificial
  CRISPR gRNA sequence
tgagtctagatatgtcctta

SEQ ID NO: 265543 - DNA, 20 bp, Artificial
  CRISPR gRNA sequence
agtctagatatgtccttaca

SEQ ID NO: 265544 - DNA, 20 bp, Artificial
  CRISPR gRNA sequence
gatatgtccttacatttgta

SEQ ID NO: 265545 - DNA, 20 bp, Artificial
  CRISPR gRNA sequence
acatttgtaatatgtcctta

SEQ ID NO: 265546 - DNA, 20 bp, Artificial
  CRISPR gRNA sequence
catttgtaatatgtccttac

SEQ ID NO: 265547 - DNA, 20 bp, Artificial
  CRISPR gRNA sequence
gtaatatgtccttacattat

SEQ ID NO: 265548 - DNA, 20 bp, Artificial
  CRISPR gRNA sequence
taatatgtccttacattatt

SEQ ID NO: 265549 - DNA, 20 bp, Artificial
  CRISPR gRNA sequence
acattatttgaagtactgtg

SEQ ID NO: 265550 - DNA, 20 bp, Artificial
  CRISPR gRNA sequence
cattatttgaagtactgtgg

SEQ ID NO: 265551 - DNA, 20 bp, Artificial
  CRISPR gRNA sequence
tttgaagtactgtggatttt

SEQ ID NO: 265552 - DNA, 20 bp, Artificial
  CRISPR gRNA sequence
gaagtactgtggattttcag

SEQ ID NO: 265553 - DNA, 20 bp, Artificial
  CRISPR gRNA sequence
aagtactgtggattttcaga

SEQ ID NO: 265554 - DNA, 20 bp, Artificial
  CRISPR gRNA sequence
tggattttcagaaactcaga

SEQ ID NO: 265555 - DNA, 20 bp, Artificial
  CRISPR gRNA sequence
tcagaaactcagagaccgaa

SEQ ID NO: 265556 - DNA, 20 bp, Artificial
  CRISPR gRNA sequence
cagaaactcagagaccgaaa

SEQ ID NO: 265557 - DNA, 20 bp, Artificial
  CRISPR gRNA sequence
agaaactcagagaccgaaaa

SEQ ID NO: 265558 - DNA, 20 bp, Artificial
  CRISPR gRNA sequence
agagaccgaaaatacatatc

SEQ ID NO: 265559 - DNA, 20 bp, Artificial
  CRISPR gRNA sequence
atattctgattatcagctac

SEQ ID NO: 265560 - DNA, 20 bp, Artificial
  CRISPR gRNA sequence
tgattatcagctactttgat

SEQ ID NO: 265561 - DNA, 20 bp, Artificial
  CRISPR gRNA sequence
attatcagctactttgattt

SEQ ID NO: 265562 - DNA, 20 bp, Artificial
  CRISPR gRNA sequence
tcagctactttgatttctcc

SEQ ID NO: 265563 - DNA, 20 bp, Artificial
  CRISPR gRNA sequence
ctttgatttctccatgtttt

SEQ ID NO: 265564 - DNA, 20 bp, Artificial
  CRISPR gRNA sequence
tgatttctccatgtttttac

SEQ ID NO: 265565 - DNA, 20 bp, Artificial
  CRISPR gRNA sequence
gatttctccatgtttttact

SEQ ID NO: 265566 - DNA, 20 bp, Artificial
  CRISPR gRNA sequence
atttctccatgtttttactt

SEQ ID NO: 265567 - DNA, 20 bp, Artificial
  CRISPR gRNA sequence
ctccatgtttttacttcata

SEQ ID NO: 265568 - DNA, 20 bp, Artificial
  CRISPR gRNA sequence
tccatgtttttacttcatag

SEQ ID NO: 265569 - DNA, 20 bp, Artificial
  CRISPR gRNA sequence
catgtttttacttcatagag

SEQ ID NO: 265570 - DNA, 20 bp, Artificial
  CRISPR gRNA sequence
ttacttcatagagcaagggg

SEQ ID NO: 265571 - DNA, 20 bp, Artificial
  CRISPR gRNA sequence
tacttcatagagcaaggggt

SEQ ID NO: 265572 - DNA, 20 bp, Artificial
  CRISPR gRNA sequence
acttcatagagcaaggggtg

SEQ ID NO: 265573 - DNA, 20 bp, Artificial
  CRISPR gRNA sequence
cttcatagagcaaggggtgt

SEQ ID NO: 265574 - DNA, 20 bp, Artificial
  CRISPR gRNA sequence
catagagcaaggggtgtgca

SEQ ID NO: 265575 - DNA, 20 bp, Artificial
  CRISPR gRNA sequence
atagagcaaggggtgtgcat

SEQ ID NO: 265576 - DNA, 20 bp, Artificial
  CRISPR gRNA sequence
ttacacatgccccattttaa

SEQ ID NO: 265577 - DNA, 20 bp, Artificial
  CRISPR gRNA sequence
tacacatgccccattttaaa

SEQ ID NO: 265578 - DNA, 20 bp, Artificial
  CRISPR gRNA sequence
acacatgccccattttaaaa

SEQ ID NO: 265579 - DNA, 20 bp, Artificial
  CRISPR gRNA sequence
cacatgccccattttaaaag

SEQ ID NO: 265580 - DNA, 20 bp, Artificial
  CRISPR gRNA sequence
taaaagaaaataagagaaat

SEQ ID NO: 265581 - DNA, 20 bp, Artificial
  CRISPR gRNA sequence
aaaagaaaataagagaaatc

SEQ ID NO: 265582 - DNA, 20 bp, Artificial
  CRISPR gRNA sequence
aaagaaaataagagaaatca

SEQ ID NO: 265583 - DNA, 20 bp, Artificial
  CRISPR gRNA sequence
ttgtgtttactcaaagtcac

SEQ ID NO: 265584 - DNA, 20 bp, Artificial
  CRISPR gRNA sequence
tgtttactcaaagtcacaat

SEQ ID NO: 265585 - DNA, 20 bp, Artificial
  CRISPR gRNA sequence
actcaaagtcacaatgatca

SEQ ID NO: 265586 - DNA, 20 bp, Artificial
  CRISPR gRNA sequence
ctcaaagtcacaatgatcac

SEQ ID NO: 265587 - DNA, 20 bp, Artificial
  CRISPR gRNA sequence
aaagtcacaatgatcacaca

SEQ ID NO: 265588 - DNA, 20 bp, Artificial
  CRISPR gRNA sequence
agtatcacttagagtcactg

SEQ ID NO: 265589 - DNA, 20 bp, Artificial
  CRISPR gRNA sequence
agagtcactggttatctttt

SEQ ID NO: 265590 - DNA, 20 bp, Artificial
  CRISPR gRNA sequence
gagtcactggttatcttttt

SEQ ID NO: 265591 - DNA, 20 bp, Artificial
  CRISPR gRNA sequence
gttatctttttctagcacca

SEQ ID NO: 265592 - DNA, 20 bp, Artificial
  CRISPR gRNA sequence
tctttttctagcaccaaaag

SEQ ID NO: 265593 - DNA, 20 bp, Artificial
  CRISPR gRNA sequence
tttctagcaccaaaagtaaa

SEQ ID NO: 265594 - DNA, 20 bp, Artificial
  CRISPR gRNA sequence
ttctagcaccaaaagtaaat

SEQ ID NO: 265595 - DNA, 20 bp, Artificial
  CRISPR gRNA sequence
tctagcaccaaaagtaaatt

SEQ ID NO: 265596 - DNA, 20 bp, Artificial
  CRISPR gRNA sequence
ctagcaccaaaagtaaattt

SEQ ID NO: 265597 - DNA, 20 bp, Artificial
  CRISPR gRNA sequence
tagcaccaaaagtaaatttc

SEQ ID NO: 265598 - DNA, 20 bp, Artificial
  CRISPR gRNA sequence
gcaccaaaagtaaatttctc

SEQ ID NO: 265599 - DNA, 20 bp, Artificial
  CRISPR gRNA sequence
ctctcatttactgtcttgca

SEQ ID NO: 265600 - DNA, 20 bp, Artificial
  CRISPR gRNA sequence
tctcatttactgtcttgcaa

SEQ ID NO: 265601 - DNA, 20 bp, Artificial
  CRISPR gRNA sequence
tcatttactgtcttgcaaag

SEQ ID NO: 265602 - DNA, 20 bp, Artificial
  CRISPR gRNA sequence
atttactgtcttgcaaagca

SEQ ID NO: 265603 - DNA, 20 bp, Artificial
  CRISPR gRNA sequence
actgtcttgcaaagcatata

SEQ ID NO: 265604 - DNA, 20 bp, Artificial
  CRISPR gRNA sequence
ctgtcttgcaaagcatatag

SEQ ID NO: 265605 - DNA, 20 bp, Artificial
  CRISPR gRNA sequence
tcttgcaaagcatatagaga

SEQ ID NO: 265606 - DNA, 20 bp, Artificial
  CRISPR gRNA sequence
gcaaagcatatagagatttt

SEQ ID NO: 265607 - DNA, 20 bp, Artificial
  CRISPR gRNA sequence
caaagcatatagagattttg

SEQ ID NO: 265608 - DNA, 20 bp, Artificial
  CRISPR gRNA sequence
tgaggtcctgtgagatagtt

SEQ ID NO: 265609 - DNA, 20 bp, Artificial
  CRISPR gRNA sequence
gaggtcctgtgagatagttt

SEQ ID NO: 265610 - DNA, 20 bp, Artificial
  CRISPR gRNA sequence
aggtcctgtgagatagtttc

SEQ ID NO: 265611 - DNA, 20 bp, Artificial
  CRISPR gRNA sequence
tgagatagtttcctatttag

SEQ ID NO: 265612 - DNA, 20 bp, Artificial
  CRISPR gRNA sequence
cctatttaggcttctctgaa

SEQ ID NO: 265613 - DNA, 20 bp, Artificial
  CRISPR gRNA sequence
ctatttaggcttctctgaat

SEQ ID NO: 265614 - DNA, 20 bp, Artificial
  CRISPR gRNA sequence
tttaggcttctctgaattat

SEQ ID NO: 265615 - DNA, 20 bp, Artificial
  CRISPR gRNA sequence
aggcttctctgaattattga

SEQ ID NO: 265616 - DNA, 20 bp, Artificial
  CRISPR gRNA sequence
ggcttctctgaattattgac

SEQ ID NO: 265617 - DNA, 20 bp, Artificial
  CRISPR gRNA sequence
ctctgaattattgacatgaa

SEQ ID NO: 265618 - DNA, 20 bp, Artificial
  CRISPR gRNA sequence
tctgaattattgacatgaac

SEQ ID NO: 265619 - DNA, 20 bp, Artificial
  CRISPR gRNA sequence
tgaattattgacatgaacca

SEQ ID NO: 265620 - DNA, 20 bp, Artificial
  CRISPR gRNA sequence
aattattgacatgaaccaag

SEQ ID NO: 265621 - DNA, 20 bp, Artificial
  CRISPR gRNA sequence
ttgacatgaaccaaggtggg

SEQ ID NO: 265622 - DNA, 20 bp, Artificial
  CRISPR gRNA sequence
acatgaaccaaggtgggacc

SEQ ID NO: 265623 - DNA, 20 bp, Artificial
  CRISPR gRNA sequence
tgaggatataaatattgaga

SEQ ID NO: 265624 - DNA, 20 bp, Artificial
  CRISPR gRNA sequence
agaaacgagattttatcagc

SEQ ID NO: 265625 - DNA, 20 bp, Artificial
  CRISPR gRNA sequence
tatcagccaaccttgaactc

SEQ ID NO: 265626 - DNA, 20 bp, Artificial
  CRISPR gRNA sequence
atcagccaaccttgaactca

SEQ ID NO: 265627 - DNA, 20 bp, Artificial
  CRISPR gRNA sequence
tcagccaaccttgaactcag

SEQ ID NO: 265628 - DNA, 20 bp, Artificial
  CRISPR gRNA sequence
gaactcagcttgaactctaa

SEQ ID NO: 265629 - DNA, 20 bp, Artificial
  CRISPR gRNA sequence
aactcagcttgaactctaaa

SEQ ID NO: 265630 - DNA, 20 bp, Artificial
  CRISPR gRNA sequence
agcttgaactctaaactagg

SEQ ID NO: 265631 - DNA, 20 bp, Artificial
  CRISPR gRNA sequence
gaactctaaactaggaggct

SEQ ID NO: 265632 - DNA, 20 bp, Artificial
  CRISPR gRNA sequence
aactctaaactaggaggctg

SEQ ID NO: 265633 - DNA, 20 bp, Artificial
  CRISPR gRNA sequence
taaactaggaggctgttagc

SEQ ID NO: 265634 - DNA, 20 bp, Artificial
  CRISPR gRNA sequence
aactaggaggctgttagcta

SEQ ID NO: 265635 - DNA, 20 bp, Artificial
  CRISPR gRNA sequence
ggaggctgttagctacatgt

SEQ ID NO: 265636 - DNA, 20 bp, Artificial
  CRISPR gRNA sequence
ttagctacatgttaacacat

SEQ ID NO: 265637 - DNA, 20 bp, Artificial
  CRISPR gRNA sequence
gctacatgttaacacatagt

SEQ ID NO: 265638 - DNA, 20 bp, Artificial
  CRISPR gRNA sequence
catgttaacacatagtaagc

SEQ ID NO: 265639 - DNA, 20 bp, Artificial
  CRISPR gRNA sequence
acacatagtaagcaaacgat

SEQ ID NO: 265640 - DNA, 20 bp, Artificial
  CRISPR gRNA sequence
caagcacagtatctgtgttt

SEQ ID NO: 265641 - DNA, 20 bp, Artificial
  CRISPR gRNA sequence
aagcacagtatctgtgtttg

SEQ ID NO: 265642 - DNA, 20 bp, Artificial
  CRISPR gRNA sequence
tgtttgagagccagctaatt

SEQ ID NO: 265643 - DNA, 20 bp, Artificial
  CRISPR gRNA sequence
gagagccagctaatttaaaa

SEQ ID NO: 265644 - DNA, 20 bp, Artificial
  CRISPR gRNA sequence
agagccagctaatttaaaaa

SEQ ID NO: 265645 - DNA, 20 bp, Artificial
  CRISPR gRNA sequence
atttaaaaatgatctatgtt

SEQ ID NO: 265646 - DNA, 20 bp, Artificial
  CRISPR gRNA sequence
aaaaatgatctatgttgaca

SEQ ID NO: 265647 - DNA, 20 bp, Artificial
  CRISPR gRNA sequence
aaaatgatctatgttgacaa

SEQ ID NO: 265648 - DNA, 20 bp, Artificial
  CRISPR gRNA sequence
tgttgacaaagaagagggag

SEQ ID NO: 265649 - DNA, 20 bp, Artificial
  CRISPR gRNA sequence
acaaagaagagggaggaaag

SEQ ID NO: 265650 - DNA, 20 bp, Artificial
  CRISPR gRNA sequence
gatggcttttcctcaaatgg

SEQ ID NO: 265651 - DNA, 20 bp, Artificial
  CRISPR gRNA sequence
ttcctcaaatggccttatcg

SEQ ID NO: 265652 - DNA, 20 bp, Artificial
  CRISPR gRNA sequence
tcctcaaatggccttatcga

SEQ ID NO: 265653 - DNA, 20 bp, Artificial
  CRISPR gRNA sequence
cctcaaatggccttatcgaa

SEQ ID NO: 265654 - DNA, 20 bp, Artificial
  CRISPR gRNA sequence
ctcaaatggccttatcgaaa

SEQ ID NO: 265655 - DNA, 20 bp, Artificial
  CRISPR gRNA sequence
aaatggccttatcgaaaaca

SEQ ID NO: 265656 - DNA, 20 bp, Artificial
  CRISPR gRNA sequence
atcgaaaacaaatagttttc

SEQ ID NO: 265657 - DNA, 20 bp, Artificial
  CRISPR gRNA sequence
tcgaaaacaaatagttttca

SEQ ID NO: 265658 - DNA, 20 bp, Artificial
  CRISPR gRNA sequence
tcaagctcttttccagcaaa

SEQ ID NO: 265659 - DNA, 20 bp, Artificial
  CRISPR gRNA sequence
caagctcttttccagcaaaa

SEQ ID NO: 265660 - DNA, 20 bp, Artificial
  CRISPR gRNA sequence
aagctcttttccagcaaaat

SEQ ID NO: 265661 - DNA, 20 bp, Artificial
  CRISPR gRNA sequence
ttttccagcaaaatcttagc

SEQ ID NO: 265662 - DNA, 20 bp, Artificial
  CRISPR gRNA sequence
ttccagcaaaatcttagcac

SEQ ID NO: 265663 - DNA, 20 bp, Artificial
  CRISPR gRNA sequence
tccagcaaaatcttagcact

SEQ ID NO: 265664 - DNA, 20 bp, Artificial
  CRISPR gRNA sequence
ccagcaaaatcttagcactt

SEQ ID NO: 265665 - DNA, 20 bp, Artificial
  CRISPR gRNA sequence
cagcaaaatcttagcacttt

SEQ ID NO: 265666 - DNA, 20 bp, Artificial
  CRISPR gRNA sequence
agcacttttctgcataaaag

SEQ ID NO: 265667 - DNA, 20 bp, Artificial
  CRISPR gRNA sequence
gcacttttctgcataaaagc

SEQ ID NO: 265668 - DNA, 20 bp, Artificial
  CRISPR gRNA sequence
ttctgcataaaagccttcag

SEQ ID NO: 265669 - DNA, 20 bp, Artificial
  CRISPR gRNA sequence
tctgcataaaagccttcagt

SEQ ID NO: 265670 - DNA, 20 bp, Artificial
  CRISPR gRNA sequence
ctgcataaaagccttcagta

SEQ ID NO: 265671 - DNA, 20 bp, Artificial
  CRISPR gRNA sequence
tgcataaaagccttcagtag

SEQ ID NO: 265672 - DNA, 20 bp, Artificial
  CRISPR gRNA sequence
cataaaagccttcagtagat

SEQ ID NO: 265673 - DNA, 20 bp, Artificial
  CRISPR gRNA sequence
cagtagatcttcatcacctt

SEQ ID NO: 265674 - DNA, 20 bp, Artificial
  CRISPR gRNA sequence
agtagatcttcatcaccttc

SEQ ID NO: 265675 - DNA, 20 bp, Artificial
  CRISPR gRNA sequence
catcaccttcagaagagagc

SEQ ID NO: 265676 - DNA, 20 bp, Artificial
  CRISPR gRNA sequence
atcaccttcagaagagagcc

SEQ ID NO: 265677 - DNA, 20 bp, Artificial
  CRISPR gRNA sequence
cagaagagagcccaagctct

SEQ ID NO: 265678 - DNA, 20 bp, Artificial
  CRISPR gRNA sequence
agaagagagcccaagctctc

SEQ ID NO: 265679 - DNA, 20 bp, Artificial
  CRISPR gRNA sequence
tctaatggagtgaactatgc

SEQ ID NO: 265680 - DNA, 20 bp, Artificial
  CRISPR gRNA sequence
taatggagtgaactatgctt

SEQ ID NO: 265681 - DNA, 20 bp, Artificial
  CRISPR gRNA sequence
atggagtgaactatgcttgc

SEQ ID NO: 265682 - DNA, 20 bp, Artificial
  CRISPR gRNA sequence
tgcttgctctgacaatcttg

SEQ ID NO: 265683 - DNA, 20 bp, Artificial
  CRISPR gRNA sequence
gctctgacaatcttgtcttt

SEQ ID NO: 265684 - DNA, 20 bp, Artificial
  CRISPR gRNA sequence
ctctgacaatcttgtctttt

SEQ ID NO: 265685 - DNA, 20 bp, Artificial
  CRISPR gRNA sequence
tgacaatcttgtcttttgta

SEQ ID NO: 265686 - DNA, 20 bp, Artificial
  CRISPR gRNA sequence
acaatcttgtcttttgtaac

SEQ ID NO: 265687 - DNA, 20 bp, Artificial
  CRISPR gRNA sequence
gtcttttgtaactcatggcc

SEQ ID NO: 265688 - DNA, 20 bp, Artificial
  CRISPR gRNA sequence
tcttttgtaactcatggccc

SEQ ID NO: 265689 - DNA, 20 bp, Artificial
  CRISPR gRNA sequence
ttgtaactcatggcccagca

SEQ ID NO: 265690 - DNA, 20 bp, Artificial
  CRISPR gRNA sequence
tgtaactcatggcccagcaa

SEQ ID NO: 265691 - DNA, 20 bp, Artificial
  CRISPR gRNA sequence
gtaactcatggcccagcaaa

SEQ ID NO: 265692 - DNA, 20 bp, Artificial
  CRISPR gRNA sequence
taactcatggcccagcaaaa

SEQ ID NO: 265693 - DNA, 20 bp, Artificial
  CRISPR gRNA sequence
atggcccagcaaaaagaagg

SEQ ID NO: 265694 - DNA, 20 bp, Artificial
  CRISPR gRNA sequence
taattccccaagtcggccac

SEQ ID NO: 265695 - DNA, 20 bp, Artificial
  CRISPR gRNA sequence
cccaagtcggccacactctt

SEQ ID NO: 265696 - DNA, 20 bp, Artificial
  CRISPR gRNA sequence
ttaccctcctcatctccctt

SEQ ID NO: 265697 - DNA, 20 bp, Artificial
  CRISPR gRNA sequence
accctcctcatctcccttgc

SEQ ID NO: 265698 - DNA, 20 bp, Artificial
  CRISPR gRNA sequence
ccctcctcatctcccttgcc

SEQ ID NO: 265699 - DNA, 20 bp, Artificial
  CRISPR gRNA sequence
ctcatctcccttgcccagac

SEQ ID NO: 265700 - DNA, 20 bp, Artificial
  CRISPR gRNA sequence
atctcccttgcccagactac

SEQ ID NO: 265701 - DNA, 20 bp, Artificial
  CRISPR gRNA sequence
ccttgcccagactactcttt

SEQ ID NO: 265702 - DNA, 20 bp, Artificial
  CRISPR gRNA sequence
gcccagactactctttttct

SEQ ID NO: 265703 - DNA, 20 bp, Artificial
  CRISPR gRNA sequence
cccagactactctttttctc

SEQ ID NO: 265704 - DNA, 20 bp, Artificial
  CRISPR gRNA sequence
ctctttttctctctttgtct

SEQ ID NO: 265705 - DNA, 20 bp, Artificial
  CRISPR gRNA sequence
tttttctctctttgtcttat

SEQ ID NO: 265706 - DNA, 20 bp, Artificial
  CRISPR gRNA sequence
tttctctctttgtcttatcc

SEQ ID NO: 265707 - DNA, 20 bp, Artificial
  CRISPR gRNA sequence
ttctctctttgtcttatcct

SEQ ID NO: 265708 - DNA, 20 bp, Artificial
  CRISPR gRNA sequence
tctctctttgtcttatcctc

SEQ ID NO: 265709 - DNA, 20 bp, Artificial
  CRISPR gRNA sequence
ctctctttgtcttatcctcc

SEQ ID NO: 265710 - DNA, 20 bp, Artificial
  CRISPR gRNA sequence
tctctttgtcttatcctccc

SEQ ID NO: 265711 - DNA, 20 bp, Artificial
  CRISPR gRNA sequence
tctttgtcttatcctcccca

SEQ ID NO: 265712 - DNA, 20 bp, Artificial
  CRISPR gRNA sequence
tttgtcttatcctccccaca

SEQ ID NO: 265713 - DNA, 20 bp, Artificial
  CRISPR gRNA sequence
tgtcttatcctccccacagt

SEQ ID NO: 265714 - DNA, 20 bp, Artificial
  CRISPR gRNA sequence
gtcttatcctccccacagtc

SEQ ID NO: 265715 - DNA, 20 bp, Artificial
  CRISPR gRNA sequence
tcttatcctccccacagtcc

SEQ ID NO: 265716 - DNA, 20 bp, Artificial
  CRISPR gRNA sequence
atcctccccacagtccccta

SEQ ID NO: 265717 - DNA, 20 bp, Artificial
  CRISPR gRNA sequence
tcctccccacagtcccctaa

SEQ ID NO: 265718 - DNA, 20 bp, Artificial
  CRISPR gRNA sequence
cccacagtcccctaactcac

SEQ ID NO: 265719 - DNA, 20 bp, Artificial
  CRISPR gRNA sequence
actcaccccagcccaaacac

SEQ ID NO: 265720 - DNA, 20 bp, Artificial
  CRISPR gRNA sequence
accccagcccaaacacacac

SEQ ID NO: 265721 - DNA, 20 bp, Artificial
  CRISPR gRNA sequence
tcccacctcaccccagtccc

SEQ ID NO: 265722 - DNA, 20 bp, Artificial
  CRISPR gRNA sequence
ccacctcaccccagtcccca

SEQ ID NO: 265723 - DNA, 20 bp, Artificial
  CRISPR gRNA sequence
accccagtccccaacacaaa

SEQ ID NO: 265724 - DNA, 20 bp, Artificial
  CRISPR gRNA sequence
agccaggctaacttttactt

SEQ ID NO: 265725 - DNA, 20 bp, Artificial
  CRISPR gRNA sequence
gccaggctaacttttactta

SEQ ID NO: 265726 - DNA, 20 bp, Artificial
  CRISPR gRNA sequence
acttttacttagtaaaagtt

SEQ ID NO: 265727 - DNA, 20 bp, Artificial
  CRISPR gRNA sequence
ttacttagtaaaagttggtc

SEQ ID NO: 265728 - DNA, 20 bp, Artificial
  CRISPR gRNA sequence
tacttagtaaaagttggtca

SEQ ID NO: 265729 - DNA, 20 bp, Artificial
  CRISPR gRNA sequence
acttagtaaaagttggtcaa

SEQ ID NO: 265730 - DNA, 20 bp, Artificial
  CRISPR gRNA sequence
cttagtaaaagttggtcaaa

SEQ ID NO: 265731 - DNA, 20 bp, Artificial
  CRISPR gRNA sequence
agtaaaagttggtcaaatcc

SEQ ID NO: 265732 - DNA, 20 bp, Artificial
  CRISPR gRNA sequence
gtaaaagttggtcaaatcca

SEQ ID NO: 265733 - DNA, 20 bp, Artificial
  CRISPR gRNA sequence
gtcaaatccatgtatgcata

SEQ ID NO: 265734 - DNA, 20 bp, Artificial
  CRISPR gRNA sequence
cttcaggactcaggtcagcc

SEQ ID NO: 265735 - DNA, 20 bp, Artificial
  CRISPR gRNA sequence
caggactcaggtcagccgtc

SEQ ID NO: 265736 - DNA, 20 bp, Artificial
  CRISPR gRNA sequence
aggactcaggtcagccgtca

SEQ ID NO: 265737 - DNA, 20 bp, Artificial
  CRISPR gRNA sequence
aggtcagccgtcatctcctg

SEQ ID NO: 265738 - DNA, 20 bp, Artificial
  CRISPR gRNA sequence
ctgagatccttagctggttt

SEQ ID NO: 265739 - DNA, 20 bp, Artificial
  CRISPR gRNA sequence
agatccttagctggtttccc

SEQ ID NO: 265740 - DNA, 20 bp, Artificial
  CRISPR gRNA sequence
agctggtttccctgttgccc

SEQ ID NO: 265741 - DNA, 20 bp, Artificial
  CRISPR gRNA sequence
gctggtttccctgttgcccc

SEQ ID NO: 265742 - DNA, 20 bp, Artificial
  CRISPR gRNA sequence
gtttccctgttgcccccgga

SEQ ID NO: 265743 - DNA, 20 bp, Artificial
  CRISPR gRNA sequence
ccctgttgcccccggaagtt

SEQ ID NO: 265744 - DNA, 20 bp, Artificial
  CRISPR gRNA sequence
cctgttgcccccggaagttt

SEQ ID NO: 265745 - DNA, 20 bp, Artificial
  CRISPR gRNA sequence
ttgcccccggaagttttgtg

SEQ ID NO: 265746 - DNA, 20 bp, Artificial
  CRISPR gRNA sequence
cccccggaagttttgtgcag

SEQ ID NO: 265747 - DNA, 20 bp, Artificial
  CRISPR gRNA sequence
tgtgcagatcactgtgtcac

SEQ ID NO: 265748 - DNA, 20 bp, Artificial
  CRISPR gRNA sequence
gtgcagatcactgtgtcact

SEQ ID NO: 265749 - DNA, 20 bp, Artificial
  CRISPR gRNA sequence
tgcagatcactgtgtcacta

SEQ ID NO: 265750 - DNA, 20 bp, Artificial
  CRISPR gRNA sequence
tgtcactatgtttaaagtag

SEQ ID NO: 265751 - DNA, 20 bp, Artificial
  CRISPR gRNA sequence
tgtttaaagtagggtctatt

SEQ ID NO: 265752 - DNA, 20 bp, Artificial
  CRISPR gRNA sequence
aaagtagggtctatttatat

SEQ ID NO: 265753 - DNA, 20 bp, Artificial
  CRISPR gRNA sequence
aagtagggtctatttatatc

SEQ ID NO: 265754 - DNA, 20 bp, Artificial
  CRISPR gRNA sequence
tttatatctttcttccccat

SEQ ID NO: 265755 - DNA, 20 bp, Artificial
  CRISPR gRNA sequence
atatctttcttccccatcag

SEQ ID NO: 265756 - DNA, 20 bp, Artificial
  CRISPR gRNA sequence
tatctttcttccccatcaga

SEQ ID NO: 265757 - DNA, 20 bp, Artificial
  CRISPR gRNA sequence
tcttccccatcagatcatga

SEQ ID NO: 265758 - DNA, 20 bp, Artificial
  CRISPR gRNA sequence
cttccccatcagatcatgag

SEQ ID NO: 265759 - DNA, 20 bp, Artificial
  CRISPR gRNA sequence
ttccccatcagatcatgagc

SEQ ID NO: 265760 - DNA, 20 bp, Artificial
  CRISPR gRNA sequence
ccccatcagatcatgagctg

SEQ ID NO: 265761 - DNA, 20 bp, Artificial
  CRISPR gRNA sequence
cccatcagatcatgagctgc

SEQ ID NO: 265762 - DNA, 20 bp, Artificial
  CRISPR gRNA sequence
ccgtaggacgggaattgagt

SEQ ID NO: 265763 - DNA, 20 bp, Artificial
  CRISPR gRNA sequence
agtggcattcatttttggga

SEQ ID NO: 265764 - DNA, 20 bp, Artificial
  CRISPR gRNA sequence
atttttgggaaatcaattct

SEQ ID NO: 265765 - DNA, 20 bp, Artificial
  CRISPR gRNA sequence
ttgggaaatcaattcttctc

SEQ ID NO: 265766 - DNA, 20 bp, Artificial
  CRISPR gRNA sequence
tgggaaatcaattcttctct

SEQ ID NO: 265767 - DNA, 20 bp, Artificial
  CRISPR gRNA sequence
gggaaatcaattcttctctc

SEQ ID NO: 265768 - DNA, 20 bp, Artificial
  CRISPR gRNA sequence
ggaaatcaattcttctctcc

SEQ ID NO: 265769 - DNA, 20 bp, Artificial
  CRISPR gRNA sequence
ttctctcccatgtgcatctt

SEQ ID NO: 265770 - DNA, 20 bp, Artificial
  CRISPR gRNA sequence
ctctcccatgtgcatcttag

SEQ ID NO: 265771 - DNA, 20 bp, Artificial
  CRISPR gRNA sequence
tctcccatgtgcatcttagg

SEQ ID NO: 265772 - DNA, 20 bp, Artificial
  CRISPR gRNA sequence
tcccatgtgcatcttaggaa

SEQ ID NO: 265773 - DNA, 20 bp, Artificial
  CRISPR gRNA sequence
ccatgtgcatcttaggaaca

SEQ ID NO: 265774 - DNA, 20 bp, Artificial
  CRISPR gRNA sequence
aggaacatgtcacaccctga

SEQ ID NO: 265775 - DNA, 20 bp, Artificial
  CRISPR gRNA sequence
ggaacatgtcacaccctgag
